United States Patent 11,421,016 (CANCER NEOEPITOPES) - sequence listing, part 2

SEQ ID NO: 45650 - protein, 9 aa, Homo Sapiens
AESGNMDVP

SEQ ID NO: 45651 - protein, 9 aa, Homo Sapiens
LELHRGTDG

SEQ ID NO: 45652 - protein, 9 aa, Homo Sapiens
TGDARSAFR

SEQ ID NO: 45653 - protein, 9 aa, Homo Sapiens
GRSCDVSSV

SEQ ID NO: 45654 - protein, 9 aa, Homo Sapiens
QAESGNMDV

SEQ ID NO: 45655 - protein, 9 aa, Homo Sapiens
SCDVSSVGC

SEQ ID NO: 45656 - protein, 9 aa, Homo Sapiens
YGRSCDVSS

SEQ ID NO: 45657 - protein, 9 aa, Homo Sapiens
APIATFHDS

SEQ ID NO: 45658 - protein, 9 aa, Homo Sapiens
DARSAFRPL

SEQ ID NO: 45659 - protein, 9 aa, Homo Sapiens
EERAPIATF

SEQ ID NO: 45660 - protein, 9 aa, Homo Sapiens
TLVPMPMRV

SEQ ID NO: 45661 - protein, 9 aa, Homo Sapiens
AACPFYGAW

SEQ ID NO: 45662 - protein, 9 aa, Homo Sapiens
MPMRVNGAS

SEQ ID NO: 45663 - protein, 9 aa, Homo Sapiens
PTSLELHRG

SEQ ID NO: 45664 - protein, 9 aa, Homo Sapiens
SEQAESGNM

SEQ ID NO: 45665 - protein, 9 aa, Homo Sapiens
ILKFIPMSV

SEQ ID NO: 45666 - protein, 9 aa, Homo Sapiens
MSVLYGVFL

SEQ ID NO: 45667 - protein, 9 aa, Homo Sapiens
PGAALPSLM

SEQ ID NO: 45668 - protein, 9 aa, Homo Sapiens
YRKAGEVFI

SEQ ID NO: 45669 - protein, 9 aa, Homo Sapiens
SLELHRGTD

SEQ ID NO: 45670 - protein, 9 aa, Homo Sapiens
YTHMHTYMS

SEQ ID NO: 45671 - protein, 9 aa, Homo Sapiens
MSIHIHAYA

SEQ ID NO: 45672 - protein, 9 aa, Homo Sapiens
RSCDVSSVG

SEQ ID NO: 45673 - protein, 9 aa, Homo Sapiens
SIHIHAYAY

SEQ ID NO: 45674 - protein, 9 aa, Homo Sapiens
SSVGCAIIE

SEQ ID NO: 45675 - protein, 9 aa, Homo Sapiens
ACPFYGAWL

SEQ ID NO: 45676 - protein, 9 aa, Homo Sapiens
PIGKNNPPL

SEQ ID NO: 45677 - protein, 9 aa, Homo Sapiens
RSAFRPLRD

SEQ ID NO: 45678 - protein, 9 aa, Homo Sapiens
FGIGTIGDS

SEQ ID NO: 45679 - protein, 9 aa, Homo Sapiens
WTLVPMPMR

SEQ ID NO: 45680 - protein, 9 aa, Homo Sapiens
MRVNGASKS

SEQ ID NO: 45681 - protein, 9 aa, Homo Sapiens
TQHHTEPIG

SEQ ID NO: 45682 - protein, 9 aa, Homo Sapiens
SSVASAKGF

SEQ ID NO: 45683 - protein, 9 aa, Homo Sapiens
IVKHAFKII

SEQ ID NO: 45684 - protein, 9 aa, Homo Sapiens
SFPHRPPGA

SEQ ID NO: 45685 - protein, 9 aa, Homo Sapiens
LHRGTDGGT

SEQ ID NO: 45686 - protein, 9 aa, Homo Sapiens
QYGRSCDVS

SEQ ID NO: 45687 - protein, 9 aa, Homo Sapiens
PSHPPKDVY

SEQ ID NO: 45688 - protein, 9 aa, Homo Sapiens
PCISPAPPY

SEQ ID NO: 45689 - protein, 9 aa, Homo Sapiens
HMHTYMSIH

SEQ ID NO: 45690 - protein, 9 aa, Homo Sapiens
SLVKKTDLK

SEQ ID NO: 45691 - protein, 9 aa, Homo Sapiens
PMSVLYGVF

SEQ ID NO: 45692 - protein, 9 aa, Homo Sapiens
SPLQPSLAT

SEQ ID NO: 45693 - protein, 9 aa, Homo Sapiens
SSEQAESGN

SEQ ID NO: 45694 - protein, 9 aa, Homo Sapiens
LVKKTDLKD

SEQ ID NO: 45695 - protein, 9 aa, Homo Sapiens
VSSVGCAII

SEQ ID NO: 45696 - protein, 9 aa, Homo Sapiens
IGDSQNLAW

SEQ ID NO: 45697 - protein, 9 aa, Homo Sapiens
LVPMPMRVN

SEQ ID NO: 45698 - protein, 9 aa, Homo Sapiens
EIIRGLLAK

SEQ ID NO: 45699 - protein, 9 aa, Homo Sapiens
PPGAALPSL

SEQ ID NO: 45700 - protein, 9 aa, Homo Sapiens
ESGNMDVPP

SEQ ID NO: 45701 - protein, 9 aa, Homo Sapiens
ICTQHHTEP

SEQ ID NO: 45702 - protein, 9 aa, Homo Sapiens
PIATFHDSK

SEQ ID NO: 45703 - protein, 9 aa, Homo Sapiens
LWTTPPLQH

SEQ ID NO: 45704 - protein, 9 aa, Homo Sapiens
LPLWLSFSD

SEQ ID NO: 45705 - protein, 9 aa, Homo Sapiens
LSERWQILT

SEQ ID NO: 45706 - protein, 9 aa, Homo Sapiens
GLEASASPL

SEQ ID NO: 45707 - protein, 9 aa, Homo Sapiens
EPLGRQPWA

SEQ ID NO: 45708 - protein, 9 aa, Homo Sapiens
NLGAAFLRI

SEQ ID NO: 45709 - protein, 9 aa, Homo Sapiens
IVKKPSLQF

SEQ ID NO: 45710 - protein, 9 aa, Homo Sapiens
GSCRQTGDF

SEQ ID NO: 45711 - protein, 9 aa, Homo Sapiens
RQPWAAVQA

SEQ ID NO: 45712 - protein, 9 aa, Homo Sapiens
WTTPPLQHG

SEQ ID NO: 45713 - protein, 9 aa, Homo Sapiens
ALANRAPAL

SEQ ID NO: 45714 - protein, 9 aa, Homo Sapiens
ERVPVEELL

SEQ ID NO: 45715 - protein, 9 aa, Homo Sapiens
RREEQTKLR

SEQ ID NO: 45716 - protein, 9 aa, Homo Sapiens
KRQIAMKAI

SEQ ID NO: 45717 - protein, 9 aa, Homo Sapiens
GLTKEYGNS

SEQ ID NO: 45718 - protein, 9 aa, Homo Sapiens
PWGRLHSHC

SEQ ID NO: 45719 - protein, 9 aa, Homo Sapiens
RLFHLGRRC

SEQ ID NO: 45720 - protein, 9 aa, Homo Sapiens
GRRCALANR

SEQ ID NO: 45721 - protein, 9 aa, Homo Sapiens
ARGEAEARQ

SEQ ID NO: 45722 - protein, 9 aa, Homo Sapiens
TLVFNSYSE

SEQ ID NO: 45723 - protein, 9 aa, Homo Sapiens
PLGRQPWAA

SEQ ID NO: 45724 - protein, 9 aa, Homo Sapiens
RNNFSVAQC

SEQ ID NO: 45725 - protein, 9 aa, Homo Sapiens
PQVPNDNLG

SEQ ID NO: 45726 - protein, 9 aa, Homo Sapiens
WACTAAHGW

SEQ ID NO: 45727 - protein, 9 aa, Homo Sapiens
PKQEVALPL

SEQ ID NO: 45728 - protein, 9 aa, Homo Sapiens
TTVPCDDKI

SEQ ID NO: 45729 - protein, 9 aa, Homo Sapiens
REAPRNNFS

SEQ ID NO: 45730 - protein, 9 aa, Homo Sapiens
LGAASVPSQ

SEQ ID NO: 45731 - protein, 9 aa, Homo Sapiens
LDKIVKKPS

SEQ ID NO: 45732 - protein, 9 aa, Homo Sapiens
VTTVPCDDK

SEQ ID NO: 45733 - protein, 9 aa, Homo Sapiens
LARQARGEA

SEQ ID NO: 45734 - protein, 9 aa, Homo Sapiens
QVPNDNLGP

SEQ ID NO: 45735 - protein, 9 aa, Homo Sapiens
SASPLSTPT

SEQ ID NO: 45736 - protein, 9 aa, Homo Sapiens
VRSPTAECL

SEQ ID NO: 45737 - protein, 9 aa, Homo Sapiens
RHAGEGAPH

SEQ ID NO: 45738 - protein, 9 aa, Homo Sapiens
GALGQVRGG

SEQ ID NO: 45739 - protein, 9 aa, Homo Sapiens
APAIQPVLW

SEQ ID NO: 45740 - protein, 9 aa, Homo Sapiens
ASAGRDGGG

SEQ ID NO: 45741 - protein, 9 aa, Homo Sapiens
EVLLQGLLG

SEQ ID NO: 45742 - protein, 9 aa, Homo Sapiens
VALPLWLSF

SEQ ID NO: 45743 - protein, 9 aa, Homo Sapiens
QREAPRNNF

SEQ ID NO: 45744 - protein, 9 aa, Homo Sapiens
NLRKELYEL

SEQ ID NO: 45745 - protein, 9 aa, Homo Sapiens
LENNLGAAF

SEQ ID NO: 45746 - protein, 9 aa, Homo Sapiens
SPCVNGGSC

SEQ ID NO: 45747 - protein, 9 aa, Homo Sapiens
EYGNSPLHR

SEQ ID NO: 45748 - protein, 9 aa, Homo Sapiens
SPTAECLAA

SEQ ID NO: 45749 - protein, 9 aa, Homo Sapiens
LIHVDSRLH

SEQ ID NO: 45750 - protein, 9 aa, Homo Sapiens
PWAAVQAQD

SEQ ID NO: 45751 - protein, 9 aa, Homo Sapiens
CLAAEKALM

SEQ ID NO: 45752 - protein, 9 aa, Homo Sapiens
LHSHCPRHC

SEQ ID NO: 45753 - protein, 9 aa, Homo Sapiens
AASAGRDGG

SEQ ID NO: 45754 - protein, 9 aa, Homo Sapiens
ERARREEQT

SEQ ID NO: 45755 - protein, 9 aa, Homo Sapiens
LPENLRKEL

SEQ ID NO: 45756 - protein, 9 aa, Homo Sapiens
APKQEVALP

SEQ ID NO: 45757 - protein, 9 aa, Homo Sapiens
TQLLPENLR

SEQ ID NO: 45758 - protein, 9 aa, Homo Sapiens
PPWGRLHSH

SEQ ID NO: 45759 - protein, 9 aa, Homo Sapiens
QFSMLWPYY

SEQ ID NO: 45760 - protein, 9 aa, Homo Sapiens
RERARLFHL

SEQ ID NO: 45761 - protein, 9 aa, Homo Sapiens
HAGEGAPHG

SEQ ID NO: 45762 - protein, 9 aa, Homo Sapiens
NDAEPSAPP

SEQ ID NO: 45763 - protein, 9 aa, Homo Sapiens
ADHAHADAP

SEQ ID NO: 45764 - protein, 9 aa, Homo Sapiens
GSQLSQKHI

SEQ ID NO: 45765 - protein, 9 aa, Homo Sapiens
KAAEIAPGQ

SEQ ID NO: 45766 - protein, 9 aa, Homo Sapiens
QLLPENLRK

SEQ ID NO: 45767 - protein, 9 aa, Homo Sapiens
FIVYVMGGV

SEQ ID NO: 45768 - protein, 9 aa, Homo Sapiens
PSNMVNDHQ

SEQ ID NO: 45769 - protein, 9 aa, Homo Sapiens
QEERVPVEE

SEQ ID NO: 45770 - protein, 9 aa, Homo Sapiens
AAQRPEGTY

SEQ ID NO: 45771 - protein, 9 aa, Homo Sapiens
HTQCEKAAE

SEQ ID NO: 45772 - protein, 9 aa, Homo Sapiens
CSVLWCTLQ

SEQ ID NO: 45773 - protein, 9 aa, Homo Sapiens
RARLFHLGR

SEQ ID NO: 45774 - protein, 9 aa, Homo Sapiens
PLQDETLGA

SEQ ID NO: 45775 - protein, 9 aa, Homo Sapiens
AEIAPGQTL

SEQ ID NO: 45776 - protein, 9 aa, Homo Sapiens
SKACFVAEN

SEQ ID NO: 45777 - protein, 9 aa, Homo Sapiens
PAAAAQRPE

SEQ ID NO: 45778 - protein, 9 aa, Homo Sapiens
VEELLARQA

SEQ ID NO: 45779 - protein, 9 aa, Homo Sapiens
TPAAAAQRP

SEQ ID NO: 45780 - protein, 9 aa, Homo Sapiens
HADHAHADA

SEQ ID NO: 45781 - protein, 9 aa, Homo Sapiens
PAIQPVLWT

SEQ ID NO: 45782 - protein, 9 aa, Homo Sapiens
CPIHCSVLW

SEQ ID NO: 45783 - protein, 9 aa, Homo Sapiens
ADAPAIQPV

SEQ ID NO: 45784 - protein, 9 aa, Homo Sapiens
LGPLQFSML

SEQ ID NO: 45785 - protein, 9 aa, Homo Sapiens
AAAQRPEGT

SEQ ID NO: 45786 - protein, 9 aa, Homo Sapiens
EPQEVLLQG

SEQ ID NO: 45787 - protein, 9 aa, Homo Sapiens
LSQKHISSP

SEQ ID NO: 45788 - protein, 9 aa, Homo Sapiens
AEARQGALG

SEQ ID NO: 45789 - protein, 9 aa, Homo Sapiens
GLLARERAR

SEQ ID NO: 45790 - protein, 9 aa, Homo Sapiens
RLHRERREG

SEQ ID NO: 45791 - protein, 9 aa, Homo Sapiens
QKHISSPLA

SEQ ID NO: 45792 - protein, 9 aa, Homo Sapiens
LFLIHVDSR

SEQ ID NO: 45793 - protein, 9 aa, Homo Sapiens
RRCALANRA

SEQ ID NO: 45794 - protein, 9 aa, Homo Sapiens
NQEDVRNNR

SEQ ID NO: 45795 - protein, 9 aa, Homo Sapiens
LGQVRGGRV

SEQ ID NO: 45796 - protein, 9 aa, Homo Sapiens
PCVNGGSCR

SEQ ID NO: 45797 - protein, 9 aa, Homo Sapiens
KLAGVQEER

SEQ ID NO: 45798 - protein, 9 aa, Homo Sapiens
SERWQILTF

SEQ ID NO: 45799 - protein, 9 aa, Homo Sapiens
VLHLDETKD

SEQ ID NO: 45800 - protein, 9 aa, Homo Sapiens
IQPVLWTTP

SEQ ID NO: 45801 - protein, 9 aa, Homo Sapiens
LLKSKACFV

SEQ ID NO: 45802 - protein, 9 aa, Homo Sapiens
PARSGDAQL

SEQ ID NO: 45803 - protein, 9 aa, Homo Sapiens
VLWCTLQRG

SEQ ID NO: 45804 - protein, 9 aa, Homo Sapiens
YTLVFNSYS

SEQ ID NO: 45805 - protein, 9 aa, Homo Sapiens
PVTTVPCDD

SEQ ID NO: 45806 - protein, 9 aa, Homo Sapiens
APLAAARAL

SEQ ID NO: 45807 - protein, 9 aa, Homo Sapiens
DQGLTKEYG

SEQ ID NO: 45808 - protein, 9 aa, Homo Sapiens
KLGPLQFSM

SEQ ID NO: 45809 - protein, 9 aa, Homo Sapiens
RLCALVWEV

SEQ ID NO: 45810 - protein, 9 aa, Homo Sapiens
GWRPSGSSE

SEQ ID NO: 45811 - protein, 9 aa, Homo Sapiens
PNDNLGPDQ

SEQ ID NO: 45812 - protein, 9 aa, Homo Sapiens
QGALGQVRG

SEQ ID NO: 45813 - protein, 9 aa, Homo Sapiens
TAECLAAEK

SEQ ID NO: 45814 - protein, 9 aa, Homo Sapiens
GEGAPHGKL

SEQ ID NO: 45815 - protein, 9 aa, Homo Sapiens
LEASASPLS

SEQ ID NO: 45816 - protein, 9 aa, Homo Sapiens
TGLVINQED

SEQ ID NO: 45817 - protein, 9 aa, Homo Sapiens
RAPALLRAQ

SEQ ID NO: 45818 - protein, 9 aa, Homo Sapiens
APHGKLAGV

SEQ ID NO: 45819 - protein, 9 aa, Homo Sapiens
NNLGAAFLR

SEQ ID NO: 45820 - protein, 9 aa, Homo Sapiens
PSPCVNGGS

SEQ ID NO: 45821 - protein, 9 aa, Homo Sapiens
EIAPGQTLT

SEQ ID NO: 45822 - protein, 9 aa, Homo Sapiens
SMLWPYYVL

SEQ ID NO: 45823 - protein, 9 aa, Homo Sapiens
RREGLLARE

SEQ ID NO: 45824 - protein, 9 aa, Homo Sapiens
EELLARQAR

SEQ ID NO: 45825 - protein, 9 aa, Homo Sapiens
EEPQEVLLQ

SEQ ID NO: 45826 - protein, 9 aa, Homo Sapiens
MSSLSHISA

SEQ ID NO: 45827 - protein, 9 aa, Homo Sapiens
GSQRNPGRK

SEQ ID NO: 45828 - protein, 9 aa, Homo Sapiens
CVNGGSCRQ

SEQ ID NO: 45829 - protein, 9 aa, Homo Sapiens
ALQPLQPHA

SEQ ID NO: 45830 - protein, 9 aa, Homo Sapiens
LGLEASASP

SEQ ID NO: 45831 - protein, 9 aa, Homo Sapiens
CTAAHGWRP

SEQ ID NO: 45832 - protein, 9 aa, Homo Sapiens
NVPRGQPSN

SEQ ID NO: 45833 - protein, 9 aa, Homo Sapiens
TVLLFLIHV

SEQ ID NO: 45834 - protein, 9 aa, Homo Sapiens
ARAGPRFIV

SEQ ID NO: 45835 - protein, 9 aa, Homo Sapiens
AAEIAPGQT

SEQ ID NO: 45836 - protein, 9 aa, Homo Sapiens
GRVRLHRER

SEQ ID NO: 45837 - protein, 9 aa, Homo Sapiens
EPSAPPYDS

SEQ ID NO: 45838 - protein, 9 aa, Homo Sapiens
ISSPLASYF

SEQ ID NO: 45839 - protein, 9 aa, Homo Sapiens
VDQREAPRN

SEQ ID NO: 45840 - protein, 9 aa, Homo Sapiens
RERREGLLA

SEQ ID NO: 45841 - protein, 9 aa, Homo Sapiens
HRERREGLL

SEQ ID NO: 45842 - protein, 9 aa, Homo Sapiens
QTKLRRIAS

SEQ ID NO: 45843 - protein, 9 aa, Homo Sapiens
VPVEELLAR

SEQ ID NO: 45844 - protein, 9 aa, Homo Sapiens
SNMVNDHQP

SEQ ID NO: 45845 - protein, 9 aa, Homo Sapiens
AFLRIPILY

SEQ ID NO: 45846 - protein, 9 aa, Homo Sapiens
ECLAAEKAL

SEQ ID NO: 45847 - protein, 9 aa, Homo Sapiens
LTKEYGNSP

SEQ ID NO: 45848 - protein, 9 aa, Homo Sapiens
NTVLLFLIH

SEQ ID NO: 45849 - protein, 9 aa, Homo Sapiens
QEEPQEVLL

SEQ ID NO: 45850 - protein, 9 aa, Homo Sapiens
YPCRSLSER

SEQ ID NO: 45851 - protein, 9 aa, Homo Sapiens
GQPSNMVND

SEQ ID NO: 45852 - protein, 9 aa, Homo Sapiens
AQLTIIVVD

SEQ ID NO: 45853 - protein, 9 aa, Homo Sapiens
LQPLQPHAD

SEQ ID NO: 45854 - protein, 9 aa, Homo Sapiens
NSYSERNVS

SEQ ID NO: 45855 - protein, 9 aa, Homo Sapiens
HAHADAPAI

SEQ ID NO: 45856 - protein, 9 aa, Homo Sapiens
SGDAQLTII

SEQ ID NO: 45857 - protein, 9 aa, Homo Sapiens
EDQGLTKEY

SEQ ID NO: 45858 - protein, 9 aa, Homo Sapiens
GLGGEAVGT

SEQ ID NO: 45859 - protein, 9 aa, Homo Sapiens
KVRSPTAEC

SEQ ID NO: 45860 - protein, 9 aa, Homo Sapiens
LHLDETKDH

SEQ ID NO: 45861 - protein, 9 aa, Homo Sapiens
LFHLGRRCA

SEQ ID NO: 45862 - protein, 9 aa, Homo Sapiens
LLDKIVKKP

SEQ ID NO: 45863 - protein, 9 aa, Homo Sapiens
FLIHVDSRL

SEQ ID NO: 45864 - protein, 9 aa, Homo Sapiens
ELLARQARG

SEQ ID NO: 45865 - protein, 9 aa, Homo Sapiens
DAQLTIIVV

SEQ ID NO: 45866 - protein, 9 aa, Homo Sapiens
PQEVLLQGL

SEQ ID NO: 45867 - protein, 9 aa, Homo Sapiens
RQGALGQVR

SEQ ID NO: 45868 - protein, 9 aa, Homo Sapiens
VLLQGLLGL

SEQ ID NO: 45869 - protein, 9 aa, Homo Sapiens
GLVINQEDV

SEQ ID NO: 45870 - protein, 9 aa, Homo Sapiens
NRFYRRLCA

SEQ ID NO: 45871 - protein, 9 aa, Homo Sapiens
VKKPSLQFL

SEQ ID NO: 45872 - protein, 9 aa, Homo Sapiens
IAMKAIGQT

SEQ ID NO: 45873 - protein, 9 aa, Homo Sapiens
GGEAVGTGE

SEQ ID NO: 45874 - protein, 9 aa, Homo Sapiens
VFNSYSERN

SEQ ID NO: 45875 - protein, 9 aa, Homo Sapiens
CFVAENLMR

SEQ ID NO: 45876 - protein, 9 aa, Homo Sapiens
RGEAEARQG

SEQ ID NO: 45877 - protein, 9 aa, Homo Sapiens
GDAQLTIIV

SEQ ID NO: 45878 - protein, 9 aa, Homo Sapiens
SAGRDGGGA

SEQ ID NO: 45879 - protein, 9 aa, Homo Sapiens
LKENDAEPS

SEQ ID NO: 45880 - protein, 9 aa, Homo Sapiens
LQGPQGSQR

SEQ ID NO: 45881 - protein, 9 aa, Homo Sapiens
EAEARQGAL

SEQ ID NO: 45882 - protein, 9 aa, Homo Sapiens
PAGPVTTVP

SEQ ID NO: 45883 - protein, 9 aa, Homo Sapiens
VQEERVPVE

SEQ ID NO: 45884 - protein, 9 aa, Homo Sapiens
FYRRLCALV

SEQ ID NO: 45885 - protein, 9 aa, Homo Sapiens
GPLQFSMLW

SEQ ID NO: 45886 - protein, 9 aa, Homo Sapiens
VINQEDVRN

SEQ ID NO: 45887 - protein, 9 aa, Homo Sapiens
HPGLGGEAV

SEQ ID NO: 45888 - protein, 9 aa, Homo Sapiens
AQRPEGTYA

SEQ ID NO: 45889 - protein, 9 aa, Homo Sapiens
LGRRCALAN

SEQ ID NO: 45890 - protein, 9 aa, Homo Sapiens
EARQGALGQ

SEQ ID NO: 45891 - protein, 9 aa, Homo Sapiens
QLTIIVVDT

SEQ ID NO: 45892 - protein, 9 aa, Homo Sapiens
SALQPLQPH

SEQ ID NO: 45893 - protein, 9 aa, Homo Sapiens
HLDETKDHN

SEQ ID NO: 45894 - protein, 9 aa, Homo Sapiens
AGPVTTVPC

SEQ ID NO: 45895 - protein, 9 aa, Homo Sapiens
IEARAGPRF

SEQ ID NO: 45896 - protein, 9 aa, Homo Sapiens
GTGLVINQE

SEQ ID NO: 45897 - protein, 9 aa, Homo Sapiens
KHISSPLAS

SEQ ID NO: 45898 - protein, 9 aa, Homo Sapiens
MLWPYYVLG

SEQ ID NO: 45899 - protein, 9 aa, Homo Sapiens
RNPGRKGEK

SEQ ID NO: 45900 - protein, 9 aa, Homo Sapiens
GEAEARQGA

SEQ ID NO: 45901 - protein, 9 aa, Homo Sapiens
KIVKKPSLQ

SEQ ID NO: 45902 - protein, 9 aa, Homo Sapiens
EEQTKLRRI

SEQ ID NO: 45903 - protein, 9 aa, Homo Sapiens
KENDAEPSA

SEQ ID NO: 45904 - protein, 9 aa, Homo Sapiens
GAAFLRIPI

SEQ ID NO: 45905 - protein, 9 aa, Homo Sapiens
CEKAAEIAP

SEQ ID NO: 45906 - protein, 9 aa, Homo Sapiens
ARSGDAQLT

SEQ ID NO: 45907 - protein, 9 aa, Homo Sapiens
PVLWTTPPL

SEQ ID NO: 45908 - protein, 9 aa, Homo Sapiens
TAAHGWRPS

SEQ ID NO: 45909 - protein, 9 aa, Homo Sapiens
ERWQILTFD

SEQ ID NO: 45910 - protein, 9 aa, Homo Sapiens
PLWLSFSDH

SEQ ID NO: 45911 - protein, 9 aa, Homo Sapiens
RVRLHRERR

SEQ ID NO: 45912 - protein, 9 aa, Homo Sapiens
HISSPLASY

SEQ ID NO: 45913 - protein, 9 aa, Homo Sapiens
RSLSERWQI

SEQ ID NO: 45914 - protein, 9 aa, Homo Sapiens
INQEDVRNN

SEQ ID NO: 45915 - protein, 9 aa, Homo Sapiens
LQFSMLWPY

SEQ ID NO: 45916 - protein, 9 aa, Homo Sapiens
LNNSASYYL

SEQ ID NO: 45917 - protein, 9 aa, Homo Sapiens
RWQILTFDF

SEQ ID NO: 45918 - protein, 9 aa, Homo Sapiens
AGPRFIVYV

SEQ ID NO: 45919 - protein, 9 aa, Homo Sapiens
EGLLARERA

SEQ ID NO: 45920 - protein, 9 aa, Homo Sapiens
GLGLEASAS

SEQ ID NO: 45921 - protein, 9 aa, Homo Sapiens
PHADHAHAD

SEQ ID NO: 45922 - protein, 9 aa, Homo Sapiens
PCRSLSERW

SEQ ID NO: 45923 - protein, 9 aa, Homo Sapiens
SSLSHISAL

SEQ ID NO: 45924 - protein, 9 aa, Homo Sapiens
EHPGLGGEA

SEQ ID NO: 45925 - protein, 9 aa, Homo Sapiens
LPATQDVHV

SEQ ID NO: 45926 - protein, 9 aa, Homo Sapiens
DETKDHNSL

SEQ ID NO: 45927 - protein, 9 aa, Homo Sapiens
EKAAEIAPG

SEQ ID NO: 45928 - protein, 9 aa, Homo Sapiens
TVPCDDKIF

SEQ ID NO: 45929 - protein, 9 aa, Homo Sapiens
LVFNSYSER

SEQ ID NO: 45930 - protein, 9 aa, Homo Sapiens
HADAPAIQP

SEQ ID NO: 45931 - protein, 9 aa, Homo Sapiens
GPQGSQRNP

SEQ ID NO: 45932 - protein, 9 aa, Homo Sapiens
LHRERREGL

SEQ ID NO: 45933 - protein, 9 aa, Homo Sapiens
PALLRAQAA

SEQ ID NO: 45934 - protein, 9 aa, Homo Sapiens
AAFLRIPIL

SEQ ID NO: 45935 - protein, 9 aa, Homo Sapiens
LRAQAASAG

SEQ ID NO: 45936 - protein, 9 aa, Homo Sapiens
DKRQIAMKA

SEQ ID NO: 45937 - protein, 9 aa, Homo Sapiens
RAGPRFIVY

SEQ ID NO: 45938 - protein, 9 aa, Homo Sapiens
DAEPSAPPY

SEQ ID NO: 45939 - protein, 9 aa, Homo Sapiens
EARAGPRFI

SEQ ID NO: 45940 - protein, 9 aa, Homo Sapiens
PLQHGHRHG

SEQ ID NO: 45941 - protein, 9 aa, Homo Sapiens
EEPLGRQPW

SEQ ID NO: 45942 - protein, 9 aa, Homo Sapiens
RAAEYQLNN

SEQ ID NO: 45943 - protein, 9 aa, Homo Sapiens
REEQTKLRR

SEQ ID NO: 45944 - protein, 9 aa, Homo Sapiens
AQAASAGRD

SEQ ID NO: 45945 - protein, 9 aa, Homo Sapiens
VNGGSCRQT

SEQ ID NO: 45946 - protein, 9 aa, Homo Sapiens
GAPHGKLAG

SEQ ID NO: 45947 - protein, 9 aa, Homo Sapiens
APALLRAQA

SEQ ID NO: 45948 - protein, 9 aa, Homo Sapiens
LANRAPALL

SEQ ID NO: 45949 - protein, 9 aa, Homo Sapiens
LGPDQHTLS

SEQ ID NO: 45950 - protein, 9 aa, Homo Sapiens
WGRLHSHCP

SEQ ID NO: 45951 - protein, 9 aa, Homo Sapiens
CALANRAPA

SEQ ID NO: 45952 - protein, 9 aa, Homo Sapiens
PEVLHLDET

SEQ ID NO: 45953 - protein, 9 aa, Homo Sapiens
ERREGLLAR

SEQ ID NO: 45954 - protein, 9 aa, Homo Sapiens
SVLWCTLQR

SEQ ID NO: 45955 - protein, 9 aa, Homo Sapiens
PPLQHGHRH

SEQ ID NO: 45956 - protein, 9 aa, Homo Sapiens
SQLSQKHIS

SEQ ID NO: 45957 - protein, 9 aa, Homo Sapiens
QGSQRNPGR

SEQ ID NO: 45958 - protein, 9 aa, Homo Sapiens
LDETKDHNS

SEQ ID NO: 45959 - protein, 9 aa, Homo Sapiens
ARERARLFH

SEQ ID NO: 45960 - protein, 9 aa, Homo Sapiens
LTIIVVDTN

SEQ ID NO: 45961 - protein, 9 aa, Homo Sapiens
SHISALQPL

SEQ ID NO: 45962 - protein, 9 aa, Homo Sapiens
AGRDGGGAM

SEQ ID NO: 45963 - protein, 9 aa, Homo Sapiens
VRLHRERRE

SEQ ID NO: 45964 - protein, 9 aa, Homo Sapiens
NMVNDHQPS

SEQ ID NO: 45965 - protein, 9 aa, Homo Sapiens
REGLLARER

SEQ ID NO: 45966 - protein, 9 aa, Homo Sapiens
LAGVQEERV

SEQ ID NO: 45967 - protein, 9 aa, Homo Sapiens
GVQEERVPV

SEQ ID NO: 45968 - protein, 9 aa, Homo Sapiens
EGAPHGKLA

SEQ ID NO: 45969 - protein, 9 aa, Homo Sapiens
AHGWRPSGS

SEQ ID NO: 45970 - protein, 9 aa, Homo Sapiens
IKPAGPVTT

SEQ ID NO: 45971 - protein, 9 aa, Homo Sapiens
RLKENDAEP

SEQ ID NO: 45972 - protein, 9 aa, Homo Sapiens
KSKACFVAE

SEQ ID NO: 45973 - protein, 9 aa, Homo Sapiens
AIQPVLWTT

SEQ ID NO: 45974 - protein, 9 aa, Homo Sapiens
SQRNPGRKG

SEQ ID NO: 45975 - protein, 9 aa, Homo Sapiens
YRRLCALVW

SEQ ID NO: 45976 - protein, 9 aa, Homo Sapiens
AHADAPAIQ

SEQ ID NO: 45977 - protein, 9 aa, Homo Sapiens
ACFVAENLM

SEQ ID NO: 45978 - protein, 9 aa, Homo Sapiens
QEVLLQGLL

SEQ ID NO: 45979 - protein, 9 aa, Homo Sapiens
RQIAMKAIG

SEQ ID NO: 45980 - protein, 9 aa, Homo Sapiens
LAAARALPA

SEQ ID NO: 45981 - protein, 9 aa, Homo Sapiens
AAHGWRPSG

SEQ ID NO: 45982 - protein, 9 aa, Homo Sapiens
PRGQPSNMV

SEQ ID NO: 45983 - protein, 9 aa, Homo Sapiens
RCALANRAP

SEQ ID NO: 45984 - protein, 9 aa, Homo Sapiens
RFIVYVMGG

SEQ ID NO: 45985 - protein, 9 aa, Homo Sapiens
QIAMKAIGQ

SEQ ID NO: 45986 - protein, 9 aa, Homo Sapiens
QEDVRNNRS

SEQ ID NO: 45987 - protein, 9 aa, Homo Sapiens
PLQPHADHA

SEQ ID NO: 45988 - protein, 9 aa, Homo Sapiens
QAASAGRDG

SEQ ID NO: 45989 - protein, 9 aa, Homo Sapiens
ARLFHLGRR

SEQ ID NO: 45990 - protein, 9 aa, Homo Sapiens
LSHISALQP

SEQ ID NO: 45991 - protein, 9 aa, Homo Sapiens
QTPAAAAQR

SEQ ID NO: 45992 - protein, 9 aa, Homo Sapiens
NDNLGPDQH

SEQ ID NO: 45993 - protein, 9 aa, Homo Sapiens
CALVWEVRY

SEQ ID NO: 45994 - protein, 9 aa, Homo Sapiens
QLSQKHISS

SEQ ID NO: 45995 - protein, 9 aa, Homo Sapiens
AMKAIGQTE

SEQ ID NO: 45996 - protein, 9 aa, Homo Sapiens
QEVALPLWL

SEQ ID NO: 45997 - protein, 9 aa, Homo Sapiens
EVLHLDETK

SEQ ID NO: 45998 - protein, 9 aa, Homo Sapiens
TPPLQHGHR

SEQ ID NO: 45999 - protein, 9 aa, Homo Sapiens
MRSSDCPIH

SEQ ID NO: 46000 - protein, 9 aa, Homo Sapiens
AARALPATQ

SEQ ID NO: 46001 - protein, 9 aa, Homo Sapiens
ITQLLPENL

SEQ ID NO: 46002 - protein, 9 aa, Homo Sapiens
GLGLGLEAS

SEQ ID NO: 46003 - protein, 9 aa, Homo Sapiens
QLNNSASYY

SEQ ID NO: 46004 - protein, 9 aa, Homo Sapiens
ARALPATQD

SEQ ID NO: 46005 - protein, 9 aa, Homo Sapiens
AAARALPAT

SEQ ID NO: 46006 - protein, 9 aa, Homo Sapiens
YQLNNSASY

SEQ ID NO: 46007 - protein, 9 aa, Homo Sapiens
FHLGRRCAL

SEQ ID NO: 46008 - protein, 9 aa, Homo Sapiens
APRNNFSVA

SEQ ID NO: 46009 - protein, 9 aa, Homo Sapiens
LGLGLEASA

SEQ ID NO: 46010 - protein, 9 aa, Homo Sapiens
VLLFLIHVD

SEQ ID NO: 46011 - protein, 9 aa, Homo Sapiens
VNRFYRRLC

SEQ ID NO: 46012 - protein, 9 aa, Homo Sapiens
PGLGGEAVG

SEQ ID NO: 46013 - protein, 9 aa, Homo Sapiens
LQDETLGAA

SEQ ID NO: 46014 - protein, 9 aa, Homo Sapiens
HCSVLWCTL

SEQ ID NO: 46015 - protein, 9 aa, Homo Sapiens
RYTLVFNSY

SEQ ID NO: 46016 - protein, 9 aa, Homo Sapiens
ALPATQDVH

SEQ ID NO: 46017 - protein, 9 aa, Homo Sapiens
GRDGGGAMA

SEQ ID NO: 46018 - protein, 9 aa, Homo Sapiens
ALLRAQAAS

SEQ ID NO: 46019 - protein, 9 aa, Homo Sapiens
AAEYQLNNS

SEQ ID NO: 46020 - protein, 9 aa, Homo Sapiens
GQVRGGRVR

SEQ ID NO: 46021 - protein, 9 aa, Homo Sapiens
KQEVALPLW

SEQ ID NO: 46022 - protein, 9 aa, Homo Sapiens
LGGEAVGTG

SEQ ID NO: 46023 - protein, 9 aa, Homo Sapiens
HCPRHCPPW

SEQ ID NO: 46024 - protein, 9 aa, Homo Sapiens
VLWTTPPLQ

SEQ ID NO: 46025 - protein, 9 aa, Homo Sapiens
RGGRVRLHR

SEQ ID NO: 46026 - protein, 9 aa, Homo Sapiens
TLGAASVPS

SEQ ID NO: 46027 - protein, 9 aa, Homo Sapiens
EAPRNNFSV

SEQ ID NO: 46028 - protein, 9 aa, Homo Sapiens
DAPAIQPVL

SEQ ID NO: 46029 - protein, 9 aa, Homo Sapiens
NGGSCRQTG

SEQ ID NO: 46030 - protein, 9 aa, Homo Sapiens
TPQEHPGLG

SEQ ID NO: 46031 - protein, 9 aa, Homo Sapiens
SSDCPIHCS

SEQ ID NO: 46032 - protein, 9 aa, Homo Sapiens
RSSDCPIHC

SEQ ID NO: 46033 - protein, 9 aa, Homo Sapiens
MKAIGQTEL

SEQ ID NO: 46034 - protein, 9 aa, Homo Sapiens
AGEGAPHGK

SEQ ID NO: 46035 - protein, 9 aa, Homo Sapiens
EYQLNNSAS

SEQ ID NO: 46036 - protein, 9 aa, Homo Sapiens
NLGPDQHTL

SEQ ID NO: 46037 - protein, 9 aa, Homo Sapiens
RAQAASAGR

SEQ ID NO: 46038 - protein, 9 aa, Homo Sapiens
RGQPSNMVN

SEQ ID NO: 46039 - protein, 9 aa, Homo Sapiens
KPAGPVTTV

SEQ ID NO: 46040 - protein, 9 aa, Homo Sapiens
YSERNVSLT

SEQ ID NO: 46041 - protein, 9 aa, Homo Sapiens
LLPENLRKE

SEQ ID NO: 46042 - protein, 9 aa, Homo Sapiens
VRGGRVRLH

SEQ ID NO: 46043 - protein, 9 aa, Homo Sapiens
LKSKACFVA

SEQ ID NO: 46044 - protein, 9 aa, Homo Sapiens
QPWAAVQAQ

SEQ ID NO: 46045 - protein, 9 aa, Homo Sapiens
SWACTAAHG

SEQ ID NO: 46046 - protein, 9 aa, Homo Sapiens
EASASPLST

SEQ ID NO: 46047 - protein, 9 aa, Homo Sapiens
NLLDKIVKK

SEQ ID NO: 46048 - protein, 9 aa, Homo Sapiens
PQGSQRNPG

SEQ ID NO: 46049 - protein, 9 aa, Homo Sapiens
PRNNFSVAQ

SEQ ID NO: 46050 - protein, 9 aa, Homo Sapiens
PLAAARALP

SEQ ID NO: 46051 - protein, 9 aa, Homo Sapiens
QEDQGLTKE

SEQ ID NO: 46052 - protein, 9 aa, Homo Sapiens
QGPQGSQRN

SEQ ID NO: 46053 - protein, 9 aa, Homo Sapiens
GKLAGVQEE

SEQ ID NO: 46054 - protein, 9 aa, Homo Sapiens
QEHPGLGGE

SEQ ID NO: 46055 - protein, 9 aa, Homo Sapiens
LVINQEDVR

SEQ ID NO: 46056 - protein, 9 aa, Homo Sapiens
QVRGGRVRL

SEQ ID NO: 46057 - protein, 9 aa, Homo Sapiens
RRLCALVWE

SEQ ID NO: 46058 - protein, 9 aa, Homo Sapiens
HISALQPLQ

SEQ ID NO: 46059 - protein, 9 aa, Homo Sapiens
TQCEKAAEI

SEQ ID NO: 46060 - protein, 9 aa, Homo Sapiens
SLSERWQIL

SEQ ID NO: 46061 - protein, 9 aa, Homo Sapiens
GAASVPSQW

SEQ ID NO: 46062 - protein, 9 aa, Homo Sapiens
ANRAPALLR

SEQ ID NO: 46063 - protein, 9 aa, Homo Sapiens
ENDAEPSAP

SEQ ID NO: 46064 - protein, 9 aa, Homo Sapiens
ARQGALGQV

SEQ ID NO: 46065 - protein, 9 aa, Homo Sapiens
PIHCSVLWC

SEQ ID NO: 46066 - protein, 9 aa, Homo Sapiens
PRFIVYVMG

SEQ ID NO: 46067 - protein, 9 aa, Homo Sapiens
AASVPSQWR

SEQ ID NO: 46068 - protein, 9 aa, Homo Sapiens
LLQGLLGLQ

SEQ ID NO: 46069 - protein, 9 aa, Homo Sapiens
TKDHNSLNN

SEQ ID NO: 46070 - protein, 9 aa, Homo Sapiens
PENLRKELY

SEQ ID NO: 46071 - protein, 9 aa, Homo Sapiens
PLQFSMLWP

SEQ ID NO: 46072 - protein, 9 aa, Homo Sapiens
QPVLWTTPP

SEQ ID NO: 46073 - protein, 9 aa, Homo Sapiens
AAAAQRPEG

SEQ ID NO: 46074 - protein, 9 aa, Homo Sapiens
FNSYSERNV

SEQ ID NO: 46075 - protein, 9 aa, Homo Sapiens
GGRVRLHRE

SEQ ID NO: 46076 - protein, 9 aa, Homo Sapiens
DETLGAASV

SEQ ID NO: 46077 - protein, 9 aa, Homo Sapiens
HGWRPSGSS

SEQ ID NO: 46078 - protein, 9 aa, Homo Sapiens
PQEHPGLGG

SEQ ID NO: 46079 - protein, 9 aa, Homo Sapiens
QDETLGAAS

SEQ ID NO: 46080 - protein, 9 aa, Homo Sapiens
LQPHADHAH

SEQ ID NO: 46081 - protein, 9 aa, Homo Sapiens
KKPSLQFLG

SEQ ID NO: 46082 - protein, 9 aa, Homo Sapiens
NRAPALLRA

SEQ ID NO: 46083 - protein, 9 aa, Homo Sapiens
AECLAAEKA

SEQ ID NO: 46084 - protein, 9 aa, Homo Sapiens
PQTPAAAAQ

SEQ ID NO: 46085 - protein, 9 aa, Homo Sapiens
GRQPWAAVQ

SEQ ID NO: 46086 - protein, 9 aa, Homo Sapiens
QPSNMVNDH

SEQ ID NO: 46087 - protein, 9 aa, Homo Sapiens
RRLKENDAE

SEQ ID NO: 46088 - protein, 9 aa, Homo Sapiens
QRPEGTYAG

SEQ ID NO: 46089 - protein, 9 aa, Homo Sapiens
ARQARGEAE

SEQ ID NO: 46090 - protein, 9 aa, Homo Sapiens
TDKRQIAMK

SEQ ID NO: 46091 - protein, 9 aa, Homo Sapiens
RVPVEELLA

SEQ ID NO: 46092 - protein, 9 aa, Homo Sapiens
QPHADHAHA

SEQ ID NO: 46093 - protein, 9 aa, Homo Sapiens
RFYRRLCAL

SEQ ID NO: 46094 - protein, 9 aa, Homo Sapiens
FSMLWPYYV

SEQ ID NO: 46095 - protein, 9 aa, Homo Sapiens
LLARQARGE

SEQ ID NO: 46096 - protein, 9 aa, Homo Sapiens
QPLQPHADH

SEQ ID NO: 46097 - protein, 9 aa, Homo Sapiens
HSHCPRHCP

SEQ ID NO: 46098 - protein, 9 aa, Homo Sapiens
GPRFIVYVM

SEQ ID NO: 46099 - protein, 9 aa, Homo Sapiens
PVEELLARQ

SEQ ID NO: 46100 - protein, 9 aa, Homo Sapiens
FLRIPILYG

SEQ ID NO: 46101 - protein, 9 aa, Homo Sapiens
ENLRKELYE

SEQ ID NO: 46102 - protein, 9 aa, Homo Sapiens
NSASYYLNQ

SEQ ID NO: 46103 - protein, 9 aa, Homo Sapiens
PHGKLAGVQ

SEQ ID NO: 46104 - protein, 9 aa, Homo Sapiens
EERVPVEEL

SEQ ID NO: 46105 - protein, 9 aa, Homo Sapiens
QITQLLPEN

SEQ ID NO: 46106 - protein, 9 aa, Homo Sapiens
DNLGPDQHT

SEQ ID NO: 46107 - protein, 9 aa, Homo Sapiens
DKIVKKPSL

SEQ ID NO: 46108 - protein, 9 aa, Homo Sapiens
ETLGAASVP

SEQ ID NO: 46109 - protein, 9 aa, Homo Sapiens
LLFLIHVDS

SEQ ID NO: 46110 - protein, 9 aa, Homo Sapiens
SEEPLGRQP

SEQ ID NO: 46111 - protein, 9 aa, Homo Sapiens
KACFVAENL

SEQ ID NO: 46112 - protein, 9 aa, Homo Sapiens
DHAHADAPA

SEQ ID NO: 46113 - protein, 9 aa, Homo Sapiens
SDCPIHCSV

SEQ ID NO: 46114 - protein, 9 aa, Homo Sapiens
DVDQREAPR

SEQ ID NO: 46115 - protein, 9 aa, Homo Sapiens
ALGQVRGGR

SEQ ID NO: 46116 - protein, 9 aa, Homo Sapiens
TKLRRIAST

SEQ ID NO: 46117 - protein, 9 aa, Homo Sapiens
LGRQPWAAV

SEQ ID NO: 46118 - protein, 9 aa, Homo Sapiens
QRNPGRKGE

SEQ ID NO: 46119 - protein, 9 aa, Homo Sapiens
ALPLWLSFS

SEQ ID NO: 46120 - protein, 9 aa, Homo Sapiens
KPSLQFLGQ

SEQ ID NO: 46121 - protein, 9 aa, Homo Sapiens
LQHGHRHGL

SEQ ID NO: 46122 - protein, 9 aa, Homo Sapiens
RSGDAQLTI

SEQ ID NO: 46123 - protein, 9 aa, Homo Sapiens
RQARGEAEA

SEQ ID NO: 46124 - protein, 9 aa, Homo Sapiens
CRSLSERWQ

SEQ ID NO: 46125 - protein, 9 aa, Homo Sapiens
SYSERNVSL

SEQ ID NO: 46126 - protein, 9 aa, Homo Sapiens
EVALPLWLS

SEQ ID NO: 46127 - protein, 9 aa, Homo Sapiens
ETKDHNSLN

SEQ ID NO: 46128 - protein, 9 aa, Homo Sapiens
VPRGQPSNM

SEQ ID NO: 46129 - protein, 9 aa, Homo Sapiens
EDVRNNRSI

SEQ ID NO: 46130 - protein, 9 aa, Homo Sapiens
ENNLGAAFL

SEQ ID NO: 46131 - protein, 9 aa, Homo Sapiens
QCEKAAEIA

SEQ ID NO: 46132 - protein, 9 aa, Homo Sapiens
TTPPLQHGH

SEQ ID NO: 46133 - protein, 9 aa, Homo Sapiens
LLRAQAASA

SEQ ID NO: 46134 - protein, 9 aa, Homo Sapiens
SPQVPNDNL

SEQ ID NO: 46135 - protein, 9 aa, Homo Sapiens
RLHSHCPRH

SEQ ID NO: 46136 - protein, 9 aa, Homo Sapiens
AGVQEERVP

SEQ ID NO: 46137 - protein, 9 aa, Homo Sapiens
PTAECLAAE

SEQ ID NO: 46138 - protein, 9 aa, Homo Sapiens
RARREEQTK

SEQ ID NO: 46139 - protein, 9 aa, Homo Sapiens
ERARLFHLG

SEQ ID NO: 46140 - protein, 9 aa, Homo Sapiens
GGSCRQTGD

SEQ ID NO: 46141 - protein, 9 aa, Homo Sapiens
ISALQPLQP

SEQ ID NO: 46142 - protein, 9 aa, Homo Sapiens
RALPATQDV

SEQ ID NO: 46143 - protein, 9 aa, Homo Sapiens
VAENLMRVL

SEQ ID NO: 46144 - protein, 9 aa, Homo Sapiens
RSPTAECLA

SEQ ID NO: 46145 - protein, 9 aa, Homo Sapiens
IHVDSRLHT

SEQ ID NO: 46146 - protein, 9 aa, Homo Sapiens
VMRSSDCPI

SEQ ID NO: 46147 - protein, 9 aa, Homo Sapiens
LARERARLF

SEQ ID NO: 46148 - protein, 9 aa, Homo Sapiens
IHCSVLWCT

SEQ ID NO: 46149 - protein, 9 aa, Homo Sapiens
ETDKRQIAM

SEQ ID NO: 46150 - protein, 9 aa, Homo Sapiens
FVAENLMRV

SEQ ID NO: 46151 - protein, 9 aa, Homo Sapiens
SCRQTGDFT

SEQ ID NO: 46152 - protein, 9 aa, Homo Sapiens
VPNDNLGPD

SEQ ID NO: 46153 - protein, 9 aa, Homo Sapiens
SLSHISALQ

SEQ ID NO: 46154 - protein, 9 aa, Homo Sapiens
QARGEAEAR

SEQ ID NO: 46155 - protein, 9 aa, Homo Sapiens
AEPSAPPYD

SEQ ID NO: 46156 - protein, 9 aa, Homo Sapiens
HLGRRCALA

SEQ ID NO: 46157 - protein, 9 aa, Homo Sapiens
AEYQLNNSA

SEQ ID NO: 46158 - protein, 9 aa, Homo Sapiens
TKEYGNSPL

SEQ ID NO: 46159 - protein, 9 aa, Homo Sapiens
LCALVWEVR

SEQ ID NO: 46160 - protein, 9 aa, Homo Sapiens
EQTKLRRIA

SEQ ID NO: 46161 - protein, 9 aa, Homo Sapiens
LGAAFLRIP

SEQ ID NO: 46162 - protein, 9 aa, Homo Sapiens
GRLHSHCPR

SEQ ID NO: 46163 - protein, 9 aa, Homo Sapiens
DCPIHCSVL

SEQ ID NO: 46164 - protein, 9 aa, Homo Sapiens
KEYGNSPLH

SEQ ID NO: 46165 - protein, 9 aa, Homo Sapiens
ARREEQTKL

SEQ ID NO: 46166 - protein, 9 aa, Homo Sapiens
SHCPRHCPP

SEQ ID NO: 46167 - protein, 9 aa, Homo Sapiens
HVDSRLHTP

SEQ ID NO: 46168 - protein, 9 aa, Homo Sapiens
QGLTKEYGN

SEQ ID NO: 46169 - protein, 9 aa, Homo Sapiens
NNSASYYLN

SEQ ID NO: 46170 - protein, 9 aa, Homo Sapiens
HGKLAGVQE

SEQ ID NO: 46171 - protein, 9 aa, Homo Sapiens
LLARERARL

SEQ ID NO: 46172 - protein, 9 aa, Homo Sapiens
ACTAAHGWR

SEQ ID NO: 46173 - protein, 9 aa, Homo Sapiens
SQKHISSPL

SEQ ID NO: 46174 - protein, 9 aa, Homo Sapiens
DQREAPRNN

SEQ ID NO: 46175 - protein, 9 aa, Homo Sapiens
PQEEPQEVL

SEQ ID NO: 46176 - protein, 9 aa, Homo Sapiens
ASASPLSTP

SEQ ID NO: 46177 - protein, 9 aa, Homo Sapiens
GPVTTVPCD

SEQ ID NO: 46178 - protein, 9 aa, Homo Sapiens
WKQLYSNIP

SEQ ID NO: 46179 - protein, 9 aa, Homo Sapiens
WSLCRLLVA

SEQ ID NO: 46180 - protein, 9 aa, Homo Sapiens
TPSSNKSAL

SEQ ID NO: 46181 - protein, 9 aa, Homo Sapiens
WESRLHRAK

SEQ ID NO: 46182 - protein, 9 aa, Homo Sapiens
VTKWRQCHL

SEQ ID NO: 46183 - protein, 9 aa, Homo Sapiens
DDNTKVVNF

SEQ ID NO: 46184 - protein, 9 aa, Homo Sapiens
KEEGEARLK

SEQ ID NO: 46185 - protein, 9 aa, Homo Sapiens
PNPEDVPRK

SEQ ID NO: 46186 - protein, 9 aa, Homo Sapiens
GHIGQQGRG

SEQ ID NO: 46187 - protein, 9 aa, Homo Sapiens
EDFDPAPIK

SEQ ID NO: 46188 - protein, 9 aa, Homo Sapiens
RIFFFYFQC

SEQ ID NO: 46189 - protein, 9 aa, Homo Sapiens
YDGRKADLW

SEQ ID NO: 46190 - protein, 9 aa, Homo Sapiens
CVSHPLPPS

SEQ ID NO: 46191 - protein, 9 aa, Homo Sapiens
KNLTATLLL

SEQ ID NO: 46192 - protein, 9 aa, Homo Sapiens
NNPLAFEVA

SEQ ID NO: 46193 - protein, 9 aa, Homo Sapiens
TTGPQGAAE

SEQ ID NO: 46194 - protein, 9 aa, Homo Sapiens
SVAMSSWES

SEQ ID NO: 46195 - protein, 9 aa, Homo Sapiens
LLHEDLALQ

SEQ ID NO: 46196 - protein, 9 aa, Homo Sapiens
AFGLPGRRS

SEQ ID NO: 46197 - protein, 9 aa, Homo Sapiens
DERKQWALA

SEQ ID NO: 46198 - protein, 9 aa, Homo Sapiens
QHGILPSIR

SEQ ID NO: 46199 - protein, 9 aa, Homo Sapiens
DLALQWVVS

SEQ ID NO: 46200 - protein, 9 aa, Homo Sapiens
QRGPGTQCC

SEQ ID NO: 46201 - protein, 9 aa, Homo Sapiens
HQQQQQQMQ

SEQ ID NO: 46202 - protein, 9 aa, Homo Sapiens
EDSYPGLAG

SEQ ID NO: 46203 - protein, 9 aa, Homo Sapiens
FLFVIEELL

SEQ ID NO: 46204 - protein, 9 aa, Homo Sapiens
YAERLAARE

SEQ ID NO: 46205 - protein, 9 aa, Homo Sapiens
SRAGGVFEE

SEQ ID NO: 46206 - protein, 9 aa, Homo Sapiens
RKAQADSSS

SEQ ID NO: 46207 - protein, 9 aa, Homo Sapiens
PITRKEAST

SEQ ID NO: 46208 - protein, 9 aa, Homo Sapiens
DNVFENNPL

SEQ ID NO: 46209 - protein, 9 aa, Homo Sapiens
TRKEASTSM

SEQ ID NO: 46210 - protein, 9 aa, Homo Sapiens
SYATEIILK

SEQ ID NO: 46211 - protein, 9 aa, Homo Sapiens
LQSTMVCVD

SEQ ID NO: 46212 - protein, 9 aa, Homo Sapiens
AHFSLLQAP

SEQ ID NO: 46213 - protein, 9 aa, Homo Sapiens
ADVETYFRT

SEQ ID NO: 46214 - protein, 9 aa, Homo Sapiens
WLSGFLTNF

SEQ ID NO: 46215 - protein, 9 aa, Homo Sapiens
GPQGQIHPD

SEQ ID NO: 46216 - protein, 9 aa, Homo Sapiens
LRLDKGSYE

SEQ ID NO: 46217 - protein, 9 aa, Homo Sapiens
LPLCGHPQG

SEQ ID NO: 46218 - protein, 9 aa, Homo Sapiens
SLSKGIEPP

SEQ ID NO: 46219 - protein, 9 aa, Homo Sapiens
PLPWAPRPT

SEQ ID NO: 46220 - protein, 9 aa, Homo Sapiens
TTFRDAHQA

SEQ ID NO: 46221 - protein, 9 aa, Homo Sapiens
RMELGGRPT

SEQ ID NO: 46222 - protein, 9 aa, Homo Sapiens
NLPFETRTA

SEQ ID NO: 46223 - protein, 9 aa, Homo Sapiens
SESSVCKEL

SEQ ID NO: 46224 - protein, 9 aa, Homo Sapiens
AWPSLELDP

SEQ ID NO: 46225 - protein, 9 aa, Homo Sapiens
NEKSNLKEV

SEQ ID NO: 46226 - protein, 9 aa, Homo Sapiens
KRASTRSSG

SEQ ID NO: 46227 - protein, 9 aa, Homo Sapiens
KYDIPAKAA

SEQ ID NO: 46228 - protein, 9 aa, Homo Sapiens
PSAAPAACL

SEQ ID NO: 46229 - protein, 9 aa, Homo Sapiens
KTSTSHGDG

SEQ ID NO: 46230 - protein, 9 aa, Homo Sapiens
LEEIAGNTA

SEQ ID NO: 46231 - protein, 9 aa, Homo Sapiens
SASTTGPQG

SEQ ID NO: 46232 - protein, 9 aa, Homo Sapiens
RSKWSSSHP

SEQ ID NO: 46233 - protein, 9 aa, Homo Sapiens
FPQFYPFGI

SEQ ID NO: 46234 - protein, 9 aa, Homo Sapiens
RCCRPGPGP

SEQ ID NO: 46235 - protein, 9 aa, Homo Sapiens
YAQICPSAA

SEQ ID NO: 46236 - protein, 9 aa, Homo Sapiens
IFEALKRRL

SEQ ID NO: 46237 - protein, 9 aa, Homo Sapiens
SNNSNPVEN

SEQ ID NO: 46238 - protein, 9 aa, Homo Sapiens
VVQDDPRLI

SEQ ID NO: 46239 - protein, 9 aa, Homo Sapiens
ACNPLMPIY

SEQ ID NO: 46240 - protein, 9 aa, Homo Sapiens
PHRRGISIV

SEQ ID NO: 46241 - protein, 9 aa, Homo Sapiens
PDTNRMELG

SEQ ID NO: 46242 - protein, 9 aa, Homo Sapiens
PANQNLSQK

SEQ ID NO: 46243 - protein, 9 aa, Homo Sapiens
LTATLLLEK

SEQ ID NO: 46244 - protein, 9 aa, Homo Sapiens
GCRDRHVTL

SEQ ID NO: 46245 - protein, 9 aa, Homo Sapiens
EIPLHVLSK

SEQ ID NO: 46246 - protein, 9 aa, Homo Sapiens
KEASTSMTM

SEQ ID NO: 46247 - protein, 9 aa, Homo Sapiens
RSPQISGGR

SEQ ID NO: 46248 - protein, 9 aa, Homo Sapiens
FETRTAVKN

SEQ ID NO: 46249 - protein, 9 aa, Homo Sapiens
WAPRFFVML

SEQ ID NO: 46250 - protein, 9 aa, Homo Sapiens
LSMKFQALR

SEQ ID NO: 46251 - protein, 9 aa, Homo Sapiens
ASSIAAPAS

SEQ ID NO: 46252 - protein, 9 aa, Homo Sapiens
KGIEPPSEG

SEQ ID NO: 46253 - protein, 9 aa, Homo Sapiens
KPSPKDNIP

SEQ ID NO: 46254 - protein, 9 aa, Homo Sapiens
AHCGGLGCR

SEQ ID NO: 46255 - protein, 9 aa, Homo Sapiens
VEVIILINL

SEQ ID NO: 46256 - protein, 9 aa, Homo Sapiens
REEVAGGQN

SEQ ID NO: 46257 - protein, 9 aa, Homo Sapiens
FMGPVEVII

SEQ ID NO: 46258 - protein, 9 aa, Homo Sapiens
GGLRCLRWK

SEQ ID NO: 46259 - protein, 9 aa, Homo Sapiens
PAPGAQPLE

SEQ ID NO: 46260 - protein, 9 aa, Homo Sapiens
KAQADSSSP

SEQ ID NO: 46261 - protein, 9 aa, Homo Sapiens
WPEDSYPGL

SEQ ID NO: 46262 - protein, 9 aa, Homo Sapiens
RTHRSKWSS

SEQ ID NO: 46263 - protein, 9 aa, Homo Sapiens
SLTSKKGLA

SEQ ID NO: 46264 - protein, 9 aa, Homo Sapiens
LDKVQSIPE

SEQ ID NO: 46265 - protein, 9 aa, Homo Sapiens
TLAGDAFPE

SEQ ID NO: 46266 - protein, 9 aa, Homo Sapiens
TGPSQSCHS

SEQ ID NO: 46267 - protein, 9 aa, Homo Sapiens
QKGILHKDT

SEQ ID NO: 46268 - protein, 9 aa, Homo Sapiens
TNRMELGGR

SEQ ID NO: 46269 - protein, 9 aa, Homo Sapiens
PGHPPADGR

SEQ ID NO: 46270 - protein, 9 aa, Homo Sapiens
GYMDEKEPG

SEQ ID NO: 46271 - protein, 9 aa, Homo Sapiens
GDGGVYSSS

SEQ ID NO: 46272 - protein, 9 aa, Homo Sapiens
KRTAAKQSE

SEQ ID NO: 46273 - protein, 9 aa, Homo Sapiens
HRYSGETCN

SEQ ID NO: 46274 - protein, 9 aa, Homo Sapiens
SPEGGLSVA

SEQ ID NO: 46275 - protein, 9 aa, Homo Sapiens
EDLALQWVV

SEQ ID NO: 46276 - protein, 9 aa, Homo Sapiens
AFSYATEII

SEQ ID NO: 46277 - protein, 9 aa, Homo Sapiens
HPNLAELEN

SEQ ID NO: 46278 - protein, 9 aa, Homo Sapiens
RVTGVDTEP

SEQ ID NO: 46279 - protein, 9 aa, Homo Sapiens
MGPVEVIIL

SEQ ID NO: 46280 - protein, 9 aa, Homo Sapiens
NRTHRSKWS

SEQ ID NO: 46281 - protein, 9 aa, Homo Sapiens
IGQQGRGCA

SEQ ID NO: 46282 - protein, 9 aa, Homo Sapiens
TQAIKTAFR

SEQ ID NO: 46283 - protein, 9 aa, Homo Sapiens
FGLPGRRSP

SEQ ID NO: 46284 - protein, 9 aa, Homo Sapiens
TTPTSSRWW

SEQ ID NO: 46285 - protein, 9 aa, Homo Sapiens
VVPTSQSLS

SEQ ID NO: 46286 - protein, 9 aa, Homo Sapiens
WPKRCCRPG

SEQ ID NO: 46287 - protein, 9 aa, Homo Sapiens
ERRRLEEQQ

SEQ ID NO: 46288 - protein, 9 aa, Homo Sapiens
SCVRRQKFN

SEQ ID NO: 46289 - protein, 9 aa, Homo Sapiens
CLPLCGHPQ

SEQ ID NO: 46290 - protein, 9 aa, Homo Sapiens
FEVFFFTIG

SEQ ID NO: 46291 - protein, 9 aa, Homo Sapiens
LYDFFLACN

SEQ ID NO: 46292 - protein, 9 aa, Homo Sapiens
TTLAACSCV

SEQ ID NO: 46293 - protein, 9 aa, Homo Sapiens
LGMESLWNH

SEQ ID NO: 46294 - protein, 9 aa, Homo Sapiens
GMFGPLVLF

SEQ ID NO: 46295 - protein, 9 aa, Homo Sapiens
QKHVRTYTG

SEQ ID NO: 46296 - protein, 9 aa, Homo Sapiens
LLWAPRFFV

SEQ ID NO: 46297 - protein, 9 aa, Homo Sapiens
QGRGCAGRP

SEQ ID NO: 46298 - protein, 9 aa, Homo Sapiens
LGDRDVLSA

SEQ ID NO: 46299 - protein, 9 aa, Homo Sapiens
QTRIATEEP

SEQ ID NO: 46300 - protein, 9 aa, Homo Sapiens
RADVTKWRQ

SEQ ID NO: 46301 - protein, 9 aa, Homo Sapiens
NVILLLHIK

SEQ ID NO: 46302 - protein, 9 aa, Homo Sapiens
STECVSHPL

SEQ ID NO: 46303 - protein, 9 aa, Homo Sapiens
WTHTLSPLR

SEQ ID NO: 46304 - protein, 9 aa, Homo Sapiens
DPLFPRTTQ

SEQ ID NO: 46305 - protein, 9 aa, Homo Sapiens
KTPSSNKSA

SEQ ID NO: 46306 - protein, 9 aa, Homo Sapiens
HDEESGQNP

SEQ ID NO: 46307 - protein, 9 aa, Homo Sapiens
TSVSMSGGA

SEQ ID NO: 46308 - protein, 9 aa, Homo Sapiens
CSVLQGTGP

SEQ ID NO: 46309 - protein, 9 aa, Homo Sapiens
QKYDIPAKA

SEQ ID NO: 46310 - protein, 9 aa, Homo Sapiens
WGKEVISSF

SEQ ID NO: 46311 - protein, 9 aa, Homo Sapiens
LLPGRLGLV

SEQ ID NO: 46312 - protein, 9 aa, Homo Sapiens
CCAPQHGIL

SEQ ID NO: 46313 - protein, 9 aa, Homo Sapiens
TRTAVKNFM

SEQ ID NO: 46314 - protein, 9 aa, Homo Sapiens
PSVSIVQSC

SEQ ID NO: 46315 - protein, 9 aa, Homo Sapiens
WLQLGPQGQ

SEQ ID NO: 46316 - protein, 9 aa, Homo Sapiens
GVWGFPRTP

SEQ ID NO: 46317 - protein, 9 aa, Homo Sapiens
PEFLSHESL

SEQ ID NO: 46318 - protein, 9 aa, Homo Sapiens
ICEVVRPLV

SEQ ID NO: 46319 - protein, 9 aa, Homo Sapiens
LAACSCVRR

SEQ ID NO: 46320 - protein, 9 aa, Homo Sapiens
HKKFDKVWT

SEQ ID NO: 46321 - protein, 9 aa, Homo Sapiens
PRCPPEPDA

SEQ ID NO: 46322 - protein, 9 aa, Homo Sapiens
ALLGEAGIP

SEQ ID NO: 46323 - protein, 9 aa, Homo Sapiens
GGRTRDRAY

SEQ ID NO: 46324 - protein, 9 aa, Homo Sapiens
NPLMPIYFA

SEQ ID NO: 46325 - protein, 9 aa, Homo Sapiens
SSCPLSPPE

SEQ ID NO: 46326 - protein, 9 aa, Homo Sapiens
NLHHVGPLS

SEQ ID NO: 46327 - protein, 9 aa, Homo Sapiens
ELEDERKQW

SEQ ID NO: 46328 - protein, 9 aa, Homo Sapiens
AGRPQRGPG

SEQ ID NO: 46329 - protein, 9 aa, Homo Sapiens
EEVAGGQNR

SEQ ID NO: 46330 - protein, 9 aa, Homo Sapiens
HIEWPEFLS

SEQ ID NO: 46331 - protein, 9 aa, Homo Sapiens
RANRLWAGT

SEQ ID NO: 46332 - protein, 9 aa, Homo Sapiens
RRREQEQEQ

SEQ ID NO: 46333 - protein, 9 aa, Homo Sapiens
RYFPTKIRA

SEQ ID NO: 46334 - protein, 9 aa, Homo Sapiens
TRTLDFLQG

SEQ ID NO: 46335 - protein, 9 aa, Homo Sapiens
LGCRDRHVT

SEQ ID NO: 46336 - protein, 9 aa, Homo Sapiens
NGYHIAPGS

SEQ ID NO: 46337 - protein, 9 aa, Homo Sapiens
EEGDLLPGR

SEQ ID NO: 46338 - protein, 9 aa, Homo Sapiens
ADSPPPPRS

SEQ ID NO: 46339 - protein, 9 aa, Homo Sapiens
VIHVLNVEK

SEQ ID NO: 46340 - protein, 9 aa, Homo Sapiens
KSHTQFSNL

SEQ ID NO: 46341 - protein, 9 aa, Homo Sapiens
EVQSAVRVV

SEQ ID NO: 46342 - protein, 9 aa, Homo Sapiens
RLWAGTLPP

SEQ ID NO: 46343 - protein, 9 aa, Homo Sapiens
DSFGDPLFP

SEQ ID NO: 46344 - protein, 9 aa, Homo Sapiens
LLEKAYAKM

SEQ ID NO: 46345 - protein, 9 aa, Homo Sapiens
ENFVRCIAL

SEQ ID NO: 46346 - protein, 9 aa, Homo Sapiens
DLPARPWPR

SEQ ID NO: 46347 - protein, 9 aa, Homo Sapiens
RLIEVFLVL

SEQ ID NO: 46348 - protein, 9 aa, Homo Sapiens
NPQMQYTLS

SEQ ID NO: 46349 - protein, 9 aa, Homo Sapiens
THGRFLKIG

SEQ ID NO: 46350 - protein, 9 aa, Homo Sapiens
AKTPSSNKS

SEQ ID NO: 46351 - protein, 9 aa, Homo Sapiens
NRLWAGTLP

SEQ ID NO: 46352 - protein, 9 aa, Homo Sapiens
DCGLREEVA

SEQ ID NO: 46353 - protein, 9 aa, Homo Sapiens
DADLEDRQK

SEQ ID NO: 46354 - protein, 9 aa, Homo Sapiens
ICEVCHKSH

SEQ ID NO: 46355 - protein, 9 aa, Homo Sapiens
SDMQDHAPA

SEQ ID NO: 46356 - protein, 9 aa, Homo Sapiens
CLRWKILLN

SEQ ID NO: 46357 - protein, 9 aa, Homo Sapiens
ASRDRVIHV

SEQ ID NO: 46358 - protein, 9 aa, Homo Sapiens
PRALVRSTT

SEQ ID NO: 46359 - protein, 9 aa, Homo Sapiens
PRLIEVFLV

SEQ ID NO: 46360 - protein, 9 aa, Homo Sapiens
DFLQGCNEK

SEQ ID NO: 46361 - protein, 9 aa, Homo Sapiens
TADSFGDPL

SEQ ID NO: 46362 - protein, 9 aa, Homo Sapiens
LTNFPPLML

SEQ ID NO: 46363 - protein, 9 aa, Homo Sapiens
KLIRTKKRT

SEQ ID NO: 46364 - protein, 9 aa, Homo Sapiens
ALARLDLPA

SEQ ID NO: 46365 - protein, 9 aa, Homo Sapiens
KMRDELRAH

SEQ ID NO: 46366 - protein, 9 aa, Homo Sapiens
KQAQELEQT

SEQ ID NO: 46367 - protein, 9 aa, Homo Sapiens
DEHFLGMES

SEQ ID NO: 46368 - protein, 9 aa, Homo Sapiens
ECVSHPLPP

SEQ ID NO: 46369 - protein, 9 aa, Homo Sapiens
HEDLALQWV

SEQ ID NO: 46370 - protein, 9 aa, Homo Sapiens
ESPGAAVWG

SEQ ID NO: 46371 - protein, 9 aa, Homo Sapiens
LSDVDDNTK

SEQ ID NO: 46372 - protein, 9 aa, Homo Sapiens
HVGPLSDIF

SEQ ID NO: 46373 - protein, 9 aa, Homo Sapiens
ENSSRAGGV

SEQ ID NO: 46374 - protein, 9 aa, Homo Sapiens
IGEAFQVLP

SEQ ID NO: 46375 - protein, 9 aa, Homo Sapiens
SGFLTNFPP

SEQ ID NO: 46376 - protein, 9 aa, Homo Sapiens
CNPLMPIYF

SEQ ID NO: 46377 - protein, 9 aa, Homo Sapiens
TFRDAHQAL

SEQ ID NO: 46378 - protein, 9 aa, Homo Sapiens
FLQGCNEKS

SEQ ID NO: 46379 - protein, 9 aa, Homo Sapiens
SVFADVETY

SEQ ID NO: 46380 - protein, 9 aa, Homo Sapiens
LAYHSKMQE

SEQ ID NO: 46381 - protein, 9 aa, Homo Sapiens
ARTTPTSSR

SEQ ID NO: 46382 - protein, 9 aa, Homo Sapiens
MSVSAAVLR

SEQ ID NO: 46383 - protein, 9 aa, Homo Sapiens
EVCHKSHTQ

SEQ ID NO: 46384 - protein, 9 aa, Homo Sapiens
TSSRWWRAS

SEQ ID NO: 46385 - protein, 9 aa, Homo Sapiens
PGSYHCTCP

SEQ ID NO: 46386 - protein, 9 aa, Homo Sapiens
EALLEEIAG

SEQ ID NO: 46387 - protein, 9 aa, Homo Sapiens
PLCGHPQGH

SEQ ID NO: 46388 - protein, 9 aa, Homo Sapiens
NITGGAVSL

SEQ ID NO: 46389 - protein, 9 aa, Homo Sapiens
ALTVADLQR

SEQ ID NO: 46390 - protein, 9 aa, Homo Sapiens
GGHIGQQGR

SEQ ID NO: 46391 - protein, 9 aa, Homo Sapiens
AWLSGFLTN

SEQ ID NO: 46392 - protein, 9 aa, Homo Sapiens
ENNPLAFEV

SEQ ID NO: 46393 - protein, 9 aa, Homo Sapiens
TYFRTCHEN

SEQ ID NO: 46394 - protein, 9 aa, Homo Sapiens
YATEIILKT

SEQ ID NO: 46395 - protein, 9 aa, Homo Sapiens
DFPQFYPFG

SEQ ID NO: 46396 - protein, 9 aa, Homo Sapiens
LATSVLKNE

SEQ ID NO: 46397 - protein, 9 aa, Homo Sapiens
GQNRKRAPG

SEQ ID NO: 46398 - protein, 9 aa, Homo Sapiens
CKRLNKLTL

SEQ ID NO: 46399 - protein, 9 aa, Homo Sapiens
VSHPLPPSY

SEQ ID NO: 46400 - protein, 9 aa, Homo Sapiens
LSAPASPVT

SEQ ID NO: 46401 - protein, 9 aa, Homo Sapiens
FFFTIGITW

SEQ ID NO: 46402 - protein, 9 aa, Homo Sapiens
AQAVLRRRE

SEQ ID NO: 46403 - protein, 9 aa, Homo Sapiens
LWHWPEDSY

SEQ ID NO: 46404 - protein, 9 aa, Homo Sapiens
LNKLTLSVS

SEQ ID NO: 46405 - protein, 9 aa, Homo Sapiens
HTNRVCSLQ

SEQ ID NO: 46406 - protein, 9 aa, Homo Sapiens
WGEGSLYQQ

SEQ ID NO: 46407 - protein, 9 aa, Homo Sapiens
TKVVNFDWD

SEQ ID NO: 46408 - protein, 9 aa, Homo Sapiens
APGILHRRA

SEQ ID NO: 46409 - protein, 9 aa, Homo Sapiens
GSYEDAKAY

SEQ ID NO: 46410 - protein, 9 aa, Homo Sapiens
QLGPQGQIH

SEQ ID NO: 46411 - protein, 9 aa, Homo Sapiens
TDGDRLRLQ

SEQ ID NO: 46412 - protein, 9 aa, Homo Sapiens
PPPPDTNRM

SEQ ID NO: 46413 - protein, 9 aa, Homo Sapiens
SVVGAPGGV

SEQ ID NO: 46414 - protein, 9 aa, Homo Sapiens
AAPASWRTS

SEQ ID NO: 46415 - protein, 9 aa, Homo Sapiens
DAMYRLWGA

SEQ ID NO: 46416 - protein, 9 aa, Homo Sapiens
TKIRALVAD

SEQ ID NO: 46417 - protein, 9 aa, Homo Sapiens
QTDDNMEIL

SEQ ID NO: 46418 - protein, 9 aa, Homo Sapiens
SIAAPASWR

SEQ ID NO: 46419 - protein, 9 aa, Homo Sapiens
GHTNRVCSL

SEQ ID NO: 46420 - protein, 9 aa, Homo Sapiens
SPLRSSCYW

SEQ ID NO: 46421 - protein, 9 aa, Homo Sapiens
AVRVVHSWA

SEQ ID NO: 46422 - protein, 9 aa, Homo Sapiens
EADCGLREE

SEQ ID NO: 46423 - protein, 9 aa, Homo Sapiens
PAIPRRGFA

SEQ ID NO: 46424 - protein, 9 aa, Homo Sapiens
APASWRTSW

SEQ ID NO: 46425 - protein, 9 aa, Homo Sapiens
KIGKFDLSQ

SEQ ID NO: 46426 - protein, 9 aa, Homo Sapiens
CDCSGRSQE

SEQ ID NO: 46427 - protein, 9 aa, Homo Sapiens
PIARLSFSG

SEQ ID NO: 46428 - protein, 9 aa, Homo Sapiens
HRSKWSSSH

SEQ ID NO: 46429 - protein, 9 aa, Homo Sapiens
ETRTAVKNF

SEQ ID NO: 46430 - protein, 9 aa, Homo Sapiens
KLAYHSKMQ

SEQ ID NO: 46431 - protein, 9 aa, Homo Sapiens
FPTKIRALV

SEQ ID NO: 46432 - protein, 9 aa, Homo Sapiens
HKSHTQFSN

SEQ ID NO: 46433 - protein, 9 aa, Homo Sapiens
DLEDRQKFE

SEQ ID NO: 46434 - protein, 9 aa, Homo Sapiens
VLRRREQEQ

SEQ ID NO: 46435 - protein, 9 aa, Homo Sapiens
IECLDYPDP

SEQ ID NO: 46436 - protein, 9 aa, Homo Sapiens
RSHTLLRFH

SEQ ID NO: 46437 - protein, 9 aa, Homo Sapiens
SKDDVVVAE

SEQ ID NO: 46438 - protein, 9 aa, Homo Sapiens
SALMIETAG

SEQ ID NO: 46439 - protein, 9 aa, Homo Sapiens
FTLLWAPRF

SEQ ID NO: 46440 - protein, 9 aa, Homo Sapiens
IIKLSMKFQ

SEQ ID NO: 46441 - protein, 9 aa, Homo Sapiens
ILPSIRCHL

SEQ ID NO: 46442 - protein, 9 aa, Homo Sapiens
GIHVRQELL

SEQ ID NO: 46443 - protein, 9 aa, Homo Sapiens
EVALIDSHK

SEQ ID NO: 46444 - protein, 9 aa, Homo Sapiens
CGLREEVAG

SEQ ID NO: 46445 - protein, 9 aa, Homo Sapiens
EPGAQKPRQ

SEQ ID NO: 46446 - protein, 9 aa, Homo Sapiens
VLQGTGPSQ

SEQ ID NO: 46447 - protein, 9 aa, Homo Sapiens
EEIINFTSR

SEQ ID NO: 46448 - protein, 9 aa, Homo Sapiens
APGAQPLEM

SEQ ID NO: 46449 - protein, 9 aa, Homo Sapiens
SRIFFFYFQ

SEQ ID NO: 46450 - protein, 9 aa, Homo Sapiens
TTWLSTECV

SEQ ID NO: 46451 - protein, 9 aa, Homo Sapiens
DDFEVFFFT

SEQ ID NO: 46452 - protein, 9 aa, Homo Sapiens
MHQQQQQQM

SEQ ID NO: 46453 - protein, 9 aa, Homo Sapiens
SALARLDLP

SEQ ID NO: 46454 - protein, 9 aa, Homo Sapiens
GGQNRKRAP

SEQ ID NO: 46455 - protein, 9 aa, Homo Sapiens
ATLLLEKCL

SEQ ID NO: 46456 - protein, 9 aa, Homo Sapiens
FLKIGKFDL

SEQ ID NO: 46457 - protein, 9 aa, Homo Sapiens
LFPEEPLPL

SEQ ID NO: 46458 - protein, 9 aa, Homo Sapiens
FDPAPIKSK

SEQ ID NO: 46459 - protein, 9 aa, Homo Sapiens
VLQSTMVCV

SEQ ID NO: 46460 - protein, 9 aa, Homo Sapiens
HSMNQRRGR

SEQ ID NO: 46461 - protein, 9 aa, Homo Sapiens
DCSGRSQEC

SEQ ID NO: 46462 - protein, 9 aa, Homo Sapiens
PEVALIDSH

SEQ ID NO: 46463 - protein, 9 aa, Homo Sapiens
CPSAAPAAC

SEQ ID NO: 46464 - protein, 9 aa, Homo Sapiens
SNIPGSSFS

SEQ ID NO: 46465 - protein, 9 aa, Homo Sapiens
ACLTEEQKT

SEQ ID NO: 46466 - protein, 9 aa, Homo Sapiens
PGPGPLPWA

SEQ ID NO: 46467 - protein, 9 aa, Homo Sapiens
PSQSCHSAL

SEQ ID NO: 46468 - protein, 9 aa, Homo Sapiens
SSIVDRYDS

SEQ ID NO: 46469 - protein, 9 aa, Homo Sapiens
SGELPSKRW

SEQ ID NO: 46470 - protein, 9 aa, Homo Sapiens
LSPLRSSCY

SEQ ID NO: 46471 - protein, 9 aa, Homo Sapiens
SMSVSAAVL

SEQ ID NO: 46472 - protein, 9 aa, Homo Sapiens
KEVISSFDT

SEQ ID NO: 46473 - protein, 9 aa, Homo Sapiens
KRAPGILHR

SEQ ID NO: 46474 - protein, 9 aa, Homo Sapiens
SWWPTARTT

SEQ ID NO: 46475 - protein, 9 aa, Homo Sapiens
KVVIKYTKL

SEQ ID NO: 46476 - protein, 9 aa, Homo Sapiens
KRTGNKHDL

SEQ ID NO: 46477 - protein, 9 aa, Homo Sapiens
LDADLEDRQ

SEQ ID NO: 46478 - protein, 9 aa, Homo Sapiens
EMLPGWTHT

SEQ ID NO: 46479 - protein, 9 aa, Homo Sapiens
DVLSAPASP

SEQ ID NO: 46480 - protein, 9 aa, Homo Sapiens
KVNITGGAV

SEQ ID NO: 46481 - protein, 9 aa, Homo Sapiens
TPEVALIDS

SEQ ID NO: 46482 - protein, 9 aa, Homo Sapiens
SNPVENEDA

SEQ ID NO: 46483 - protein, 9 aa, Homo Sapiens
RDKRLAWAE

SEQ ID NO: 46484 - protein, 9 aa, Homo Sapiens
SPTPHNADG

SEQ ID NO: 46485 - protein, 9 aa, Homo Sapiens
PVIYVQTLQ

SEQ ID NO: 46486 - protein, 9 aa, Homo Sapiens
EFLSHESLL

SEQ ID NO: 46487 - protein, 9 aa, Homo Sapiens
GAWSLCRLL

SEQ ID NO: 46488 - protein, 9 aa, Homo Sapiens
RTDGVEYLL

SEQ ID NO: 46489 - protein, 9 aa, Homo Sapiens
YPFRREQPE

SEQ ID NO: 46490 - protein, 9 aa, Homo Sapiens
YMDEKEPGA

SEQ ID NO: 46491 - protein, 9 aa, Homo Sapiens
LSGFLTNFP

SEQ ID NO: 46492 - protein, 9 aa, Homo Sapiens
DFGMSRQGD

SEQ ID NO: 46493 - protein, 9 aa, Homo Sapiens
RKNRERIES

SEQ ID NO: 46494 - protein, 9 aa, Homo Sapiens
QISGGRKSP

SEQ ID NO: 46495 - protein, 9 aa, Homo Sapiens
IVCMEDFED

SEQ ID NO: 46496 - protein, 9 aa, Homo Sapiens
PSLELDPTA

SEQ ID NO: 46497 - protein, 9 aa, Homo Sapiens
WALAVASKK

SEQ ID NO: 46498 - protein, 9 aa, Homo Sapiens
GTGAAVSTQ

SEQ ID NO: 46499 - protein, 9 aa, Homo Sapiens
CSGRSQECY

SEQ ID NO: 46500 - protein, 9 aa, Homo Sapiens
ADSSSPTPH

SEQ ID NO: 46501 - protein, 9 aa, Homo Sapiens
DFEVFFFTI

SEQ ID NO: 46502 - protein, 9 aa, Homo Sapiens
ARSPRGWDQ

SEQ ID NO: 46503 - protein, 9 aa, Homo Sapiens
PEGGLSVAG

SEQ ID NO: 46504 - protein, 9 aa, Homo Sapiens
AAVSTQPGP

SEQ ID NO: 46505 - protein, 9 aa, Homo Sapiens
MMENYLVKI

SEQ ID NO: 46506 - protein, 9 aa, Homo Sapiens
EHPVDHVGN

SEQ ID NO: 46507 - protein, 9 aa, Homo Sapiens
ALLATRVRT

SEQ ID NO: 46508 - protein, 9 aa, Homo Sapiens
HNLPGSYHC

SEQ ID NO: 46509 - protein, 9 aa, Homo Sapiens
YHCTCPDGY

SEQ ID NO: 46510 - protein, 9 aa, Homo Sapiens
ELPSKRWNP

SEQ ID NO: 46511 - protein, 9 aa, Homo Sapiens
GERICEVVR

SEQ ID NO: 46512 - protein, 9 aa, Homo Sapiens
KGTYIHALN

SEQ ID NO: 46513 - protein, 9 aa, Homo Sapiens
CGHPQGHCH

SEQ ID NO: 46514 - protein, 9 aa, Homo Sapiens
TKPANQNLS

SEQ ID NO: 46515 - protein, 9 aa, Homo Sapiens
QDEHFLGME

SEQ ID NO: 46516 - protein, 9 aa, Homo Sapiens
LLGEAGIPL

SEQ ID NO: 46517 - protein, 9 aa, Homo Sapiens
ITRKEASTS

SEQ ID NO: 46518 - protein, 9 aa, Homo Sapiens
KRLAWAENS

SEQ ID NO: 46519 - protein, 9 aa, Homo Sapiens
HRRAHCGGL

SEQ ID NO: 46520 - protein, 9 aa, Homo Sapiens
YAFSYATEI

SEQ ID NO: 46521 - protein, 9 aa, Homo Sapiens
LMIETAGNP

SEQ ID NO: 46522 - protein, 9 aa, Homo Sapiens
STSHGDGGH

SEQ ID NO: 46523 - protein, 9 aa, Homo Sapiens
TSTSHGDGG

SEQ ID NO: 46524 - protein, 9 aa, Homo Sapiens
RLIHLFSWE

SEQ ID NO: 46525 - protein, 9 aa, Homo Sapiens
NSSRAGGVF

SEQ ID NO: 46526 - protein, 9 aa, Homo Sapiens
SMAAWRWDL

SEQ ID NO: 46527 - protein, 9 aa, Homo Sapiens
LGEAGIPLE

SEQ ID NO: 46528 - protein, 9 aa, Homo Sapiens
SSFLWLQLG

SEQ ID NO: 46529 - protein, 9 aa, Homo Sapiens
AGDAFPEES

SEQ ID NO: 46530 - protein, 9 aa, Homo Sapiens
AVEGQIKFS

SEQ ID NO: 46531 - protein, 9 aa, Homo Sapiens
GQIKFSTGS

SEQ ID NO: 46532 - protein, 9 aa, Homo Sapiens
GNDRANRLW

SEQ ID NO: 46533 - protein, 9 aa, Homo Sapiens
GSLKASLTS

SEQ ID NO: 46534 - protein, 9 aa, Homo Sapiens
SSSPTPHNA

SEQ ID NO: 46535 - protein, 9 aa, Homo Sapiens
CMQQATPCI

SEQ ID NO: 46536 - protein, 9 aa, Homo Sapiens
WTFLFVIEE

SEQ ID NO: 46537 - protein, 9 aa, Homo Sapiens
QKLAYHSKM

SEQ ID NO: 46538 - protein, 9 aa, Homo Sapiens
NRDKRLAWA

SEQ ID NO: 46539 - protein, 9 aa, Homo Sapiens
VRENSSRAG

SEQ ID NO: 46540 - protein, 9 aa, Homo Sapiens
EEILDKVQS

SEQ ID NO: 46541 - protein, 9 aa, Homo Sapiens
NGDGLKTKR

SEQ ID NO: 46542 - protein, 9 aa, Homo Sapiens
FLTNFPPLM

SEQ ID NO: 46543 - protein, 9 aa, Homo Sapiens
FFLQESPVI

SEQ ID NO: 46544 - protein, 9 aa, Homo Sapiens
GPLSDIFNG

SEQ ID NO: 46545 - protein, 9 aa, Homo Sapiens
EQEQEQARQ

SEQ ID NO: 46546 - protein, 9 aa, Homo Sapiens
SSFDTPLET

SEQ ID NO: 46547 - protein, 9 aa, Homo Sapiens
LSVAGPGAP

SEQ ID NO: 46548 - protein, 9 aa, Homo Sapiens
KDTNMPMDM

SEQ ID NO: 46549 - protein, 9 aa, Homo Sapiens
IILKTFQIN

SEQ ID NO: 46550 - protein, 9 aa, Homo Sapiens
RWWRASSIA

SEQ ID NO: 46551 - protein, 9 aa, Homo Sapiens
HTLLRFHSR

SEQ ID NO: 46552 - protein, 9 aa, Homo Sapiens
YDIPAKAAT

SEQ ID NO: 46553 - protein, 9 aa, Homo Sapiens
MESLWNHKN

SEQ ID NO: 46554 - protein, 9 aa, Homo Sapiens
ANQNLSQKA

SEQ ID NO: 46555 - protein, 9 aa, Homo Sapiens
LGAGKGDGA

SEQ ID NO: 46556 - protein, 9 aa, Homo Sapiens
RSRGSHWPP

SEQ ID NO: 46557 - protein, 9 aa, Homo Sapiens
HSARSPRGW

SEQ ID NO: 46558 - protein, 9 aa, Homo Sapiens
EVAGGQNRK

SEQ ID NO: 46559 - protein, 9 aa, Homo Sapiens
DRVTGVDTE

SEQ ID NO: 46560 - protein, 9 aa, Homo Sapiens
PQHGILPSI

SEQ ID NO: 46561 - protein, 9 aa, Homo Sapiens
SRGLVAHMP

SEQ ID NO: 46562 - protein, 9 aa, Homo Sapiens
LWAGTLPPG

SEQ ID NO: 46563 - protein, 9 aa, Homo Sapiens
HSLPDKVVI

SEQ ID NO: 46564 - protein, 9 aa, Homo Sapiens
PLVLFCYAL

SEQ ID NO: 46565 - protein, 9 aa, Homo Sapiens
SSAASASTT

SEQ ID NO: 46566 - protein, 9 aa, Homo Sapiens
AASASTTGP

SEQ ID NO: 46567 - protein, 9 aa, Homo Sapiens
LLKTFLKTQ

SEQ ID NO: 46568 - protein, 9 aa, Homo Sapiens
PPPRSRGSH

SEQ ID NO: 46569 - protein, 9 aa, Homo Sapiens
ENEDAVALT

SEQ ID NO: 46570 - protein, 9 aa, Homo Sapiens
TAHFSLLQA

SEQ ID NO: 46571 - protein, 9 aa, Homo Sapiens
SPPPVLHPN

SEQ ID NO: 46572 - protein, 9 aa, Homo Sapiens
EKEPGAQKP

SEQ ID NO: 46573 - protein, 9 aa, Homo Sapiens
PTSQSLSDM

SEQ ID NO: 46574 - protein, 9 aa, Homo Sapiens
CEHPVDHVG

SEQ ID NO: 46575 - protein, 9 aa, Homo Sapiens
GGKRGAFTS

SEQ ID NO: 46576 - protein, 9 aa, Homo Sapiens
RERIESSEE

SEQ ID NO: 46577 - protein, 9 aa, Homo Sapiens
LPRALVRST

SEQ ID NO: 46578 - protein, 9 aa, Homo Sapiens
LIRTKKRTD

SEQ ID NO: 46579 - protein, 9 aa, Homo Sapiens
VRKAMLDWG

SEQ ID NO: 46580 - protein, 9 aa, Homo Sapiens
EGVMMENYL

SEQ ID NO: 46581 - protein, 9 aa, Homo Sapiens
PGILHRRAH

SEQ ID NO: 46582 - protein, 9 aa, Homo Sapiens
GSRADVTKW

SEQ ID NO: 46583 - protein, 9 aa, Homo Sapiens
IPRRGFALS

SEQ ID NO: 46584 - protein, 9 aa, Homo Sapiens
ADLEDRQKF

SEQ ID NO: 46585 - protein, 9 aa, Homo Sapiens
NQLGKNGDG

SEQ ID NO: 46586 - protein, 9 aa, Homo Sapiens
LLTTLAACS

SEQ ID NO: 46587 - protein, 9 aa, Homo Sapiens
DGRKADLWS

SEQ ID NO: 46588 - protein, 9 aa, Homo Sapiens
PAVEGQIKF

SEQ ID NO: 46589 - protein, 9 aa, Homo Sapiens
EIIKLSMKF

SEQ ID NO: 46590 - protein, 9 aa, Homo Sapiens
MQHTTMPHP

SEQ ID NO: 46591 - protein, 9 aa, Homo Sapiens
APAACLPLC

SEQ ID NO: 46592 - protein, 9 aa, Homo Sapiens
LRWKILLNY

SEQ ID NO: 46593 - protein, 9 aa, Homo Sapiens
VLNRDKRLA

SEQ ID NO: 46594 - protein, 9 aa, Homo Sapiens
GMESLWNHK

SEQ ID NO: 46595 - protein, 9 aa, Homo Sapiens
IPLHVLSKV

SEQ ID NO: 46596 - protein, 9 aa, Homo Sapiens
GGHSARSPR

SEQ ID NO: 46597 - protein, 9 aa, Homo Sapiens
NKRTAAKQS

SEQ ID NO: 46598 - protein, 9 aa, Homo Sapiens
KMNGCYEAL

SEQ ID NO: 46599 - protein, 9 aa, Homo Sapiens
GRLGLVGGV

SEQ ID NO: 46600 - protein, 9 aa, Homo Sapiens
HSTFQNWLP

SEQ ID NO: 46601 - protein, 9 aa, Homo Sapiens
RLEETETSP

SEQ ID NO: 46602 - protein, 9 aa, Homo Sapiens
KFLNLWNKF

SEQ ID NO: 46603 - protein, 9 aa, Homo Sapiens
GFLTNFPPL

SEQ ID NO: 46604 - protein, 9 aa, Homo Sapiens
EESGQNPML

SEQ ID NO: 46605 - protein, 9 aa, Homo Sapiens
GEAFQVLPQ

SEQ ID NO: 46606 - protein, 9 aa, Homo Sapiens
VMMENYLVK

SEQ ID NO: 46607 - protein, 9 aa, Homo Sapiens
PVLHPNLAE

SEQ ID NO: 46608 - protein, 9 aa, Homo Sapiens
NPLAFEVAE

SEQ ID NO: 46609 - protein, 9 aa, Homo Sapiens
GQIHPDPTS

SEQ ID NO: 46610 - protein, 9 aa, Homo Sapiens
YWPKRCCRP

SEQ ID NO: 46611 - protein, 9 aa, Homo Sapiens
RAPGILHRR

SEQ ID NO: 46612 - protein, 9 aa, Homo Sapiens
EDVPRKPEP

SEQ ID NO: 46613 - protein, 9 aa, Homo Sapiens
VGLCPRLEE

SEQ ID NO: 46614 - protein, 9 aa, Homo Sapiens
AQELEQTRI

SEQ ID NO: 46615 - protein, 9 aa, Homo Sapiens
KDNVFENNP

SEQ ID NO: 46616 - protein, 9 aa, Homo Sapiens
KFDKVWTPS

SEQ ID NO: 46617 - protein, 9 aa, Homo Sapiens
LNNGLFTLG

SEQ ID NO: 46618 - protein, 9 aa, Homo Sapiens
HIPRLIEVF

SEQ ID NO: 46619 - protein, 9 aa, Homo Sapiens
KSKDDVVVA

SEQ ID NO: 46620 - protein, 9 aa, Homo Sapiens
VIYVQTLQD

SEQ ID NO: 46621 - protein, 9 aa, Homo Sapiens
QNLPFETRT

SEQ ID NO: 46622 - protein, 9 aa, Homo Sapiens
AAWRWDLLR

SEQ ID NO: 46623 - protein, 9 aa, Homo Sapiens
MAAWRWDLL

SEQ ID NO: 46624 - protein, 9 aa, Homo Sapiens
QEGIHVRQE

SEQ ID NO: 46625 - protein, 9 aa, Homo Sapiens
QDEEEDKEE

SEQ ID NO: 46626 - protein, 9 aa, Homo Sapiens
PGRLGLVGG

SEQ ID NO: 46627 - protein, 9 aa, Homo Sapiens
PLFPRTTQI

SEQ ID NO: 46628 - protein, 9 aa, Homo Sapiens
ERLAARELR

SEQ ID NO: 46629 - protein, 9 aa, Homo Sapiens
QEVYENFVR

SEQ ID NO: 46630 - protein, 9 aa, Homo Sapiens
LAYHGDTLS

SEQ ID NO: 46631 - protein, 9 aa, Homo Sapiens
EAKFHKDIA

SEQ ID NO: 46632 - protein, 9 aa, Homo Sapiens
IFFFYFQCV

SEQ ID NO: 46633 - protein, 9 aa, Homo Sapiens
SASRDRVIH

SEQ ID NO: 46634 - protein, 9 aa, Homo Sapiens
QSGELPSKR

SEQ ID NO: 46635 - protein, 9 aa, Homo Sapiens
GNPTCPKVA

SEQ ID NO: 46636 - protein, 9 aa, Homo Sapiens
HIAPGSGDN

SEQ ID NO: 46637 - protein, 9 aa, Homo Sapiens
SSPTPHNAD

SEQ ID NO: 46638 - protein, 9 aa, Homo Sapiens
IIECLDYPD

SEQ ID NO: 46639 - protein, 9 aa, Homo Sapiens
REQEQEQAR

SEQ ID NO: 46640 - protein, 9 aa, Homo Sapiens
DNTKVVNFD

SEQ ID NO: 46641 - protein, 9 aa, Homo Sapiens
VQVAAYVWF

SEQ ID NO: 46642 - protein, 9 aa, Homo Sapiens
LREEVAGGQ

SEQ ID NO: 46643 - protein, 9 aa, Homo Sapiens
WEKELIRQA

SEQ ID NO: 46644 - protein, 9 aa, Homo Sapiens
SSRAGGVFE

SEQ ID NO: 46645 - protein, 9 aa, Homo Sapiens
TSNKSKDDV

SEQ ID NO: 46646 - protein, 9 aa, Homo Sapiens
QPLEMLPGW

SEQ ID NO: 46647 - protein, 9 aa, Homo Sapiens
EEIAGNTAV

SEQ ID NO: 46648 - protein, 9 aa, Homo Sapiens
DTKPANQNL

SEQ ID NO: 46649 - protein, 9 aa, Homo Sapiens
GFFLAARNL

SEQ ID NO: 46650 - protein, 9 aa, Homo Sapiens
RLASMAAWR

SEQ ID NO: 46651 - protein, 9 aa, Homo Sapiens
IGRYRSILQ

SEQ ID NO: 46652 - protein, 9 aa, Homo Sapiens
HQKLAYHSK

SEQ ID NO: 46653 - protein, 9 aa, Homo Sapiens
SRNQLGKNG

SEQ ID NO: 46654 - protein, 9 aa, Homo Sapiens
ALNNGLFTL

SEQ ID NO: 46655 - protein, 9 aa, Homo Sapiens
IWSFMGPVE

SEQ ID NO: 46656 - protein, 9 aa, Homo Sapiens
ELAYHGDTL

SEQ ID NO: 46657 - protein, 9 aa, Homo Sapiens
QHTTMPHPT

SEQ ID NO: 46658 - protein, 9 aa, Homo Sapiens
DDDDDDSDE

SEQ ID NO: 46659 - protein, 9 aa, Homo Sapiens
FLSVVGAPG

SEQ ID NO: 46660 - protein, 9 aa, Homo Sapiens
SMKFQALRL

SEQ ID NO: 46661 - protein, 9 aa, Homo Sapiens
WEGVMMENY

SEQ ID NO: 46662 - protein, 9 aa, Homo Sapiens
KIRALVADF

SEQ ID NO: 46663 - protein, 9 aa, Homo Sapiens
SLSDMQDHA

SEQ ID NO: 46664 - protein, 9 aa, Homo Sapiens
GLFPEEPLP

SEQ ID NO: 46665 - protein, 9 aa, Homo Sapiens
LSPPEISAG

SEQ ID NO: 46666 - protein, 9 aa, Homo Sapiens
GQNLSVRIG

SEQ ID NO: 46667 - protein, 9 aa, Homo Sapiens
LQESPVIYV

SEQ ID NO: 46668 - protein, 9 aa, Homo Sapiens
SMWPPAPGA

SEQ ID NO: 46669 - protein, 9 aa, Homo Sapiens
TFLKTQAIK

SEQ ID NO: 46670 - protein, 9 aa, Homo Sapiens
LQEQQQQQP

SEQ ID NO: 46671 - protein, 9 aa, Homo Sapiens
KADLWSCGV

SEQ ID NO: 46672 - protein, 9 aa, Homo Sapiens
IGVQVAAYV

SEQ ID NO: 46673 - protein, 9 aa, Homo Sapiens
LATHGRFLK

SEQ ID NO: 46674 - protein, 9 aa, Homo Sapiens
SKLEKPLQD

SEQ ID NO: 46675 - protein, 9 aa, Homo Sapiens
IAGNTAVAE

SEQ ID NO: 46676 - protein, 9 aa, Homo Sapiens
PRLIHLFSW

SEQ ID NO: 46677 - protein, 9 aa, Homo Sapiens
AAKQSEENK

SEQ ID NO: 46678 - protein, 9 aa, Homo Sapiens
KALLGEAGI

SEQ ID NO: 46679 - protein, 9 aa, Homo Sapiens
DPAPIKSKF

SEQ ID NO: 46680 - protein, 9 aa, Homo Sapiens
EASTSMTME

SEQ ID NO: 46681 - protein, 9 aa, Homo Sapiens
EDRQKFEMN

SEQ ID NO: 46682 - protein, 9 aa, Homo Sapiens
RKADLWSCG

SEQ ID NO: 46683 - protein, 9 aa, Homo Sapiens
ALMIETAGN

SEQ ID NO: 46684 - protein, 9 aa, Homo Sapiens
KRGAFTSVS

SEQ ID NO: 46685 - protein, 9 aa, Homo Sapiens
SRDRVIHVL

SEQ ID NO: 46686 - protein, 9 aa, Homo Sapiens
WAPRPTTRP

SEQ ID NO: 46687 - protein, 9 aa, Homo Sapiens
DVETYFRTC

SEQ ID NO: 46688 - protein, 9 aa, Homo Sapiens
EPHFIIHVP

SEQ ID NO: 46689 - protein, 9 aa, Homo Sapiens
PTTRPRCWA

SEQ ID NO: 46690 - protein, 9 aa, Homo Sapiens
WPEFLSHES

SEQ ID NO: 46691 - protein, 9 aa, Homo Sapiens
RQLGDWEKE

SEQ ID NO: 46692 - protein, 9 aa, Homo Sapiens
NIDEILEKS

SEQ ID NO: 46693 - protein, 9 aa, Homo Sapiens
DVPRKPEPE

SEQ ID NO: 46694 - protein, 9 aa, Homo Sapiens
KGRKRASTR

SEQ ID NO: 46695 - protein, 9 aa, Homo Sapiens
RGFALSLLA

SEQ ID NO: 46696 - protein, 9 aa, Homo Sapiens
HYYDILELA

SEQ ID NO: 46697 - protein, 9 aa, Homo Sapiens
HGILPSIRC

SEQ ID NO: 46698 - protein, 9 aa, Homo Sapiens
EGACLTEEQ

SEQ ID NO: 46699 - protein, 9 aa, Homo Sapiens
KTFLKTQAI

SEQ ID NO: 46700 - protein, 9 aa, Homo Sapiens
KAMLDWGEG

SEQ ID NO: 46701 - protein, 9 aa, Homo Sapiens
GWQTPEVAL

SEQ ID NO: 46702 - protein, 9 aa, Homo Sapiens
DTNRMELGG

SEQ ID NO: 46703 - protein, 9 aa, Homo Sapiens
FTTMQHTTM

SEQ ID NO: 46704 - protein, 9 aa, Homo Sapiens
RTTPTSSRW

SEQ ID NO: 46705 - protein, 9 aa, Homo Sapiens
ETYFRTCHE

SEQ ID NO: 46706 - protein, 9 aa, Homo Sapiens
TAAKQSEEN

SEQ ID NO: 46707 - protein, 9 aa, Homo Sapiens
APRPTTRPR

SEQ ID NO: 46708 - protein, 9 aa, Homo Sapiens
DSSSPTPHN

SEQ ID NO: 46709 - protein, 9 aa, Homo Sapiens
RTRDRAYKQ

SEQ ID NO: 46710 - protein, 9 aa, Homo Sapiens
PPRTTMPYF

SEQ ID NO: 46711 - protein, 9 aa, Homo Sapiens
VVIKYTKLK

SEQ ID NO: 46712 - protein, 9 aa, Homo Sapiens
SKWSSSHPI

SEQ ID NO: 46713 - protein, 9 aa, Homo Sapiens
TTRPRCWAG

SEQ ID NO: 46714 - protein, 9 aa, Homo Sapiens
TFPGERICE

SEQ ID NO: 46715 - protein, 9 aa, Homo Sapiens
HPITRKEAS

SEQ ID NO: 46716 - protein, 9 aa, Homo Sapiens
PGERICEVV

SEQ ID NO: 46717 - protein, 9 aa, Homo Sapiens
DPTSMWPPA

SEQ ID NO: 46718 - protein, 9 aa, Homo Sapiens
ASASRDRVI

SEQ ID NO: 46719 - protein, 9 aa, Homo Sapiens
KQWALAVAS

SEQ ID NO: 46720 - protein, 9 aa, Homo Sapiens
ILDKVQSIP

SEQ ID NO: 46721 - protein, 9 aa, Homo Sapiens
MSRQGDGGV

SEQ ID NO: 46722 - protein, 9 aa, Homo Sapiens
ALLEEIAGN

SEQ ID NO: 46723 - protein, 9 aa, Homo Sapiens
KKRTDGVEY

SEQ ID NO: 46724 - protein, 9 aa, Homo Sapiens
LRLKGRKRA

SEQ ID NO: 46725 - protein, 9 aa, Homo Sapiens
ASWWPTART

SEQ ID NO: 46726 - protein, 9 aa, Homo Sapiens
VCSLQFDGI

SEQ ID NO: 46727 - protein, 9 aa, Homo Sapiens
MDKCQKHAV

SEQ ID NO: 46728 - protein, 9 aa, Homo Sapiens
KGILHKDTN

SEQ ID NO: 46729 - protein, 9 aa, Homo Sapiens
QLRSVALAF

SEQ ID NO: 46730 - protein, 9 aa, Homo Sapiens
QLGKNGDGL

SEQ ID NO: 46731 - protein, 9 aa, Homo Sapiens
GHSTFQNWL

SEQ ID NO: 46732 - protein, 9 aa, Homo Sapiens
QNPMLKHQD

SEQ ID NO: 46733 - protein, 9 aa, Homo Sapiens
GGDRQLGDW

SEQ ID NO: 46734 - protein, 9 aa, Homo Sapiens
HPDPTSMWP

SEQ ID NO: 46735 - protein, 9 aa, Homo Sapiens
FFVMLYHMY

SEQ ID NO: 46736 - protein, 9 aa, Homo Sapiens
NFTSRGLVA

SEQ ID NO: 46737 - protein, 9 aa, Homo Sapiens
LCRLLVALH

SEQ ID NO: 46738 - protein, 9 aa, Homo Sapiens
KSKLEKPLQ

SEQ ID NO: 46739 - protein, 9 aa, Homo Sapiens
RRRNPQMQY

SEQ ID NO: 46740 - protein, 9 aa, Homo Sapiens
RDRVIHVLN

SEQ ID NO: 46741 - protein, 9 aa, Homo Sapiens
SAASASTTG

SEQ ID NO: 46742 - protein, 9 aa, Homo Sapiens
RICEVVRPL

SEQ ID NO: 46743 - protein, 9 aa, Homo Sapiens
SFMGPVEVI

SEQ ID NO: 46744 - protein, 9 aa, Homo Sapiens
IPRLIEVFL

SEQ ID NO: 46745 - protein, 9 aa, Homo Sapiens
SAVRVVHSW

SEQ ID NO: 46746 - protein, 9 aa, Homo Sapiens
QSAVRVVHS

SEQ ID NO: 46747 - protein, 9 aa, Homo Sapiens
HAVECEKPD

SEQ ID NO: 46748 - protein, 9 aa, Homo Sapiens
TTASWWPTA

SEQ ID NO: 46749 - protein, 9 aa, Homo Sapiens
EGGLSVAGP

SEQ ID NO: 46750 - protein, 9 aa, Homo Sapiens
GVQVAAYVW

SEQ ID NO: 46751 - protein, 9 aa, Homo Sapiens
LHRRAHCGG

SEQ ID NO: 46752 - protein, 9 aa, Homo Sapiens
FFLAARNLI

SEQ ID NO: 46753 - protein, 9 aa, Homo Sapiens
APGSGDNTC

SEQ ID NO: 46754 - protein, 9 aa, Homo Sapiens
LTVADLQRD

SEQ ID NO: 46755 - protein, 9 aa, Homo Sapiens
RLAARELRL

SEQ ID NO: 46756 - protein, 9 aa, Homo Sapiens
APIKSKFDS

SEQ ID NO: 46757 - protein, 9 aa, Homo Sapiens
AQGWQTPEV

SEQ ID NO: 46758 - protein, 9 aa, Homo Sapiens
QALLATRVR

SEQ ID NO: 46759 - protein, 9 aa, Homo Sapiens
CSLQFDGIH

SEQ ID NO: 46760 - protein, 9 aa, Homo Sapiens
RAGGVFEED

SEQ ID NO: 46761 - protein, 9 aa, Homo Sapiens
GATTASWWP

SEQ ID NO: 46762 - protein, 9 aa, Homo Sapiens
PPPPRSRGS

SEQ ID NO: 46763 - protein, 9 aa, Homo Sapiens
EKPLQDLQL

SEQ ID NO: 46764 - protein, 9 aa, Homo Sapiens
RTAAKQSEE

SEQ ID NO: 46765 - protein, 9 aa, Homo Sapiens
FHSREAILE

SEQ ID NO: 46766 - protein, 9 aa, Homo Sapiens
LAGPLALTV

SEQ ID NO: 46767 - protein, 9 aa, Homo Sapiens
HKDTNMPMD

SEQ ID NO: 46768 - protein, 9 aa, Homo Sapiens
YKPSPKDNI

SEQ ID NO: 46769 - protein, 9 aa, Homo Sapiens
IINFTSRGL

SEQ ID NO: 46770 - protein, 9 aa, Homo Sapiens
KEPGAQKPR

SEQ ID NO: 46771 - protein, 9 aa, Homo Sapiens
QGHCHTGRG

SEQ ID NO: 46772 - protein, 9 aa, Homo Sapiens
LSKGIEPPS

SEQ ID NO: 46773 - protein, 9 aa, Homo Sapiens
TGNKHDLEP

SEQ ID NO: 46774 - protein, 9 aa, Homo Sapiens
GDGLKTKRI

SEQ ID NO: 46775 - protein, 9 aa, Homo Sapiens
VLYKPSPKD

SEQ ID NO: 46776 - protein, 9 aa, Homo Sapiens
IHPDPTSMW

SEQ ID NO: 46777 - protein, 9 aa, Homo Sapiens
PRCWAGAAD

SEQ ID NO: 46778 - protein, 9 aa, Homo Sapiens
SIVDRYDSS

SEQ ID NO: 46779 - protein, 9 aa, Homo Sapiens
RLKEYLCVQ

SEQ ID NO: 46780 - protein, 9 aa, Homo Sapiens
MRDELRAHG

SEQ ID NO: 46781 - protein, 9 aa, Homo Sapiens
RGSHWPPGA

SEQ ID NO: 46782 - protein, 9 aa, Homo Sapiens
GPVEVIILI

SEQ ID NO: 46783 - protein, 9 aa, Homo Sapiens
VDTKPANQN

SEQ ID NO: 46784 - protein, 9 aa, Homo Sapiens
WRASSIAAP

SEQ ID NO: 46785 - protein, 9 aa, Homo Sapiens
RRGISIVEK

SEQ ID NO: 46786 - protein, 9 aa, Homo Sapiens
LGQNLSVRI

SEQ ID NO: 46787 - protein, 9 aa, Homo Sapiens
LQKHVRTYT

SEQ ID NO: 46788 - protein, 9 aa, Homo Sapiens
DEKSKLEKP

SEQ ID NO: 46789 - protein, 9 aa, Homo Sapiens
RRLKEYLCV

SEQ ID NO: 46790 - protein, 9 aa, Homo Sapiens
GELPSKRWN

SEQ ID NO: 46791 - protein, 9 aa, Homo Sapiens
SRGSHWPPG

SEQ ID NO: 46792 - protein, 9 aa, Homo Sapiens
LIHLFSWEP

SEQ ID NO: 46793 - protein, 9 aa, Homo Sapiens
SGPSVSIVQ

SEQ ID NO: 46794 - protein, 9 aa, Homo Sapiens
FYPFGIVQH

SEQ ID NO: 46795 - protein, 9 aa, Homo Sapiens
PWAPRPTTR

SEQ ID NO: 46796 - protein, 9 aa, Homo Sapiens
SDMYKALLG

SEQ ID NO: 46797 - protein, 9 aa, Homo Sapiens
INFTSRGLV

SEQ ID NO: 46798 - protein, 9 aa, Homo Sapiens
TLLWAPRFF

SEQ ID NO: 46799 - protein, 9 aa, Homo Sapiens
ADSFGDPLF

SEQ ID NO: 46800 - protein, 9 aa, Homo Sapiens
PLAFEVAEK

SEQ ID NO: 46801 - protein, 9 aa, Homo Sapiens
EPQNLSIRG

SEQ ID NO: 46802 - protein, 9 aa, Homo Sapiens
MWPPAPGAQ

SEQ ID NO: 46803 - protein, 9 aa, Homo Sapiens
TNMPMDMRE

SEQ ID NO: 46804 - protein, 9 aa, Homo Sapiens
LKEEGEARL

SEQ ID NO: 46805 - protein, 9 aa, Homo Sapiens
HTTMPHPTT

SEQ ID NO: 46806 - protein, 9 aa, Homo Sapiens
KQSEENKEN

SEQ ID NO: 46807 - protein, 9 aa, Homo Sapiens
GILPSIRCH

SEQ ID NO: 46808 - protein, 9 aa, Homo Sapiens
RTLDFLQGC

SEQ ID NO: 46809 - protein, 9 aa, Homo Sapiens
PTSSRWWRA

SEQ ID NO: 46810 - protein, 9 aa, Homo Sapiens
RKRAPGILH

SEQ ID NO: 46811 - protein, 9 aa, Homo Sapiens
LPGRLGLVG

SEQ ID NO: 46812 - protein, 9 aa, Homo Sapiens
GPGPLPWAP

SEQ ID NO: 46813 - protein, 9 aa, Homo Sapiens
NFPPLMLLL

SEQ ID NO: 46814 - protein, 9 aa, Homo Sapiens
PAACLPLCG

SEQ ID NO: 46815 - protein, 9 aa, Homo Sapiens
SPEPLDKVT

SEQ ID NO: 46816 - protein, 9 aa, Homo Sapiens
GYGLIGVQV

SEQ ID NO: 46817 - protein, 9 aa, Homo Sapiens
LQLYAQICP

SEQ ID NO: 46818 - protein, 9 aa, Homo Sapiens
QICPSAAPA

SEQ ID NO: 46819 - protein, 9 aa, Homo Sapiens
QVTRTLDFL

SEQ ID NO: 46820 - protein, 9 aa, Homo Sapiens
VSAAVLRLT

SEQ ID NO: 46821 - protein, 9 aa, Homo Sapiens
CHNLPGSYH

SEQ ID NO: 46822 - protein, 9 aa, Homo Sapiens
CEVVRPLVS

SEQ ID NO: 46823 - protein, 9 aa, Homo Sapiens
PHLPRALVR

SEQ ID NO: 46824 - protein, 9 aa, Homo Sapiens
TPTSSRWWR

SEQ ID NO: 46825 - protein, 9 aa, Homo Sapiens
ARLDLPARP

SEQ ID NO: 46826 - protein, 9 aa, Homo Sapiens
EWGGHSARS

SEQ ID NO: 46827 - protein, 9 aa, Homo Sapiens
GRFKFLNLW

SEQ ID NO: 46828 - protein, 9 aa, Homo Sapiens
EILDKVQSI

SEQ ID NO: 46829 - protein, 9 aa, Homo Sapiens
DKRTGNKHD

SEQ ID NO: 46830 - protein, 9 aa, Homo Sapiens
SHWPPGATT

SEQ ID NO: 46831 - protein, 9 aa, Homo Sapiens
YSNVILLLH

SEQ ID NO: 46832 - protein, 9 aa, Homo Sapiens
FVIEELLFA

SEQ ID NO: 46833 - protein, 9 aa, Homo Sapiens
NLSVRIGRY

SEQ ID NO: 46834 - protein, 9 aa, Homo Sapiens
HIGQQGRGC

SEQ ID NO: 46835 - protein, 9 aa, Homo Sapiens
LKDDFEVFF

SEQ ID NO: 46836 - protein, 9 aa, Homo Sapiens
LQLGPQGQI

SEQ ID NO: 46837 - protein, 9 aa, Homo Sapiens
GDGGHIGQQ

SEQ ID NO: 46838 - protein, 9 aa, Homo Sapiens
DVVVAEVEI

SEQ ID NO: 46839 - protein, 9 aa, Homo Sapiens
ARELRLGKE

SEQ ID NO: 46840 - protein, 9 aa, Homo Sapiens
INGYEPQNL

SEQ ID NO: 46841 - protein, 9 aa, Homo Sapiens
ETHRYSGET

SEQ ID NO: 46842 - protein, 9 aa, Homo Sapiens
PGSGDNTCK

SEQ ID NO: 46843 - protein, 9 aa, Homo Sapiens
RTKKRTDGV

SEQ ID NO: 46844 - protein, 9 aa, Homo Sapiens
NTKVVNFDW

SEQ ID NO: 46845 - protein, 9 aa, Homo Sapiens
HRGHIEWPE

SEQ ID NO: 46846 - protein, 9 aa, Homo Sapiens
GGGKRGAFT

SEQ ID NO: 46847 - protein, 9 aa, Homo Sapiens
RLKEEGEAR

SEQ ID NO: 46848 - protein, 9 aa, Homo Sapiens
ILHRRAHCG

SEQ ID NO: 46849 - protein, 9 aa, Homo Sapiens
YDILELAYH

SEQ ID NO: 46850 - protein, 9 aa, Homo Sapiens
ERRLKEEGE

SEQ ID NO: 46851 - protein, 9 aa, Homo Sapiens
TLAACSCVR

SEQ ID NO: 46852 - protein, 9 aa, Homo Sapiens
TPRCPPEPD

SEQ ID NO: 46853 - protein, 9 aa, Homo Sapiens
AWSLCRLLV

SEQ ID NO: 46854 - protein, 9 aa, Homo Sapiens
IEWPEFLSH

SEQ ID NO: 46855 - protein, 9 aa, Homo Sapiens
CVGFFLAAR

SEQ ID NO: 46856 - protein, 9 aa, Homo Sapiens
KWSSSHPIF

SEQ ID NO: 46857 - protein, 9 aa, Homo Sapiens
RLLVALHCL

SEQ ID NO: 46858 - protein, 9 aa, Homo Sapiens
REIPLHVLS

SEQ ID NO: 46859 - protein, 9 aa, Homo Sapiens
QYTLSPENL

SEQ ID NO: 46860 - protein, 9 aa, Homo Sapiens
ACLPLCGHP

SEQ ID NO: 46861 - protein, 9 aa, Homo Sapiens
ADVDTKPAN

SEQ ID NO: 46862 - protein, 9 aa, Homo Sapiens
SFGDPLFPR

SEQ ID NO: 46863 - protein, 9 aa, Homo Sapiens
HGRFLKIGK

SEQ ID NO: 46864 - protein, 9 aa, Homo Sapiens
PTVLEKMRD

SEQ ID NO: 46865 - protein, 9 aa, Homo Sapiens
KRRLKEYLC

SEQ ID NO: 46866 - protein, 9 aa, Homo Sapiens
LGDWEKELI

SEQ ID NO: 46867 - protein, 9 aa, Homo Sapiens
RSSCYWSKR

SEQ ID NO: 46868 - protein, 9 aa, Homo Sapiens
THTGHSTFQ

SEQ ID NO: 46869 - protein, 9 aa, Homo Sapiens
RKQWALAVA

SEQ ID NO: 46870 - protein, 9 aa, Homo Sapiens
HCKRLNKLT

SEQ ID NO: 46871 - protein, 9 aa, Homo Sapiens
VGCMQQATP

SEQ ID NO: 46872 - protein, 9 aa, Homo Sapiens
PYAERLAAR

SEQ ID NO: 46873 - protein, 9 aa, Homo Sapiens
VLSAPASPV

SEQ ID NO: 46874 - protein, 9 aa, Homo Sapiens
LGNDRANRL

SEQ ID NO: 46875 - protein, 9 aa, Homo Sapiens
QFYPFGIVQ

SEQ ID NO: 46876 - protein, 9 aa, Homo Sapiens
KIFEALKRR

SEQ ID NO: 46877 - protein, 9 aa, Homo Sapiens
GYEPQNLSI

SEQ ID NO: 46878 - protein, 9 aa, Homo Sapiens
SAAPAACLP

SEQ ID NO: 46879 - protein, 9 aa, Homo Sapiens
PRKPEPEPS

SEQ ID NO: 46880 - protein, 9 aa, Homo Sapiens
PDAMYRLWG

SEQ ID NO: 46881 - protein, 9 aa, Homo Sapiens
NGYEPQNLS

SEQ ID NO: 46882 - protein, 9 aa, Homo Sapiens
MHPITRKEA

SEQ ID NO: 46883 - protein, 9 aa, Homo Sapiens
KNEKSNLKE

SEQ ID NO: 46884 - protein, 9 aa, Homo Sapiens
DKCQKHAVE

SEQ ID NO: 46885 - protein, 9 aa, Homo Sapiens
REDFDPAPI

SEQ ID NO: 46886 - protein, 9 aa, Homo Sapiens
LAKHLSIPA

SEQ ID NO: 46887 - protein, 9 aa, Homo Sapiens
AGNTAVAEE

SEQ ID NO: 46888 - protein, 9 aa, Homo Sapiens
RSVALAFGL

SEQ ID NO: 46889 - protein, 9 aa, Homo Sapiens
KLCSPYPGQ

SEQ ID NO: 46890 - protein, 9 aa, Homo Sapiens
DGDRLRLQG

SEQ ID NO: 46891 - protein, 9 aa, Homo Sapiens
VFTKPQLWL

SEQ ID NO: 46892 - protein, 9 aa, Homo Sapiens
SPAIPRRGF

SEQ ID NO: 46893 - protein, 9 aa, Homo Sapiens
LSTECVSHP

SEQ ID NO: 46894 - protein, 9 aa, Homo Sapiens
YPAVEGQIK

SEQ ID NO: 46895 - protein, 9 aa, Homo Sapiens
AACLPLCGH

SEQ ID NO: 46896 - protein, 9 aa, Homo Sapiens
TIGEAFQVL

SEQ ID NO: 46897 - protein, 9 aa, Homo Sapiens
LPFETRTAV

SEQ ID NO: 46898 - protein, 9 aa, Homo Sapiens
LPGWTHTLS

SEQ ID NO: 46899 - protein, 9 aa, Homo Sapiens
MIETAGNPT

SEQ ID NO: 46900 - protein, 9 aa, Homo Sapiens
RRLKEEGEA

SEQ ID NO: 46901 - protein, 9 aa, Homo Sapiens
DKRLAWAEN

SEQ ID NO: 46902 - protein, 9 aa, Homo Sapiens
DEFIECEHP

SEQ ID NO: 46903 - protein, 9 aa, Homo Sapiens
ITGGAVSLG

SEQ ID NO: 46904 - protein, 9 aa, Homo Sapiens
YYDILELAY

SEQ ID NO: 46905 - protein, 9 aa, Homo Sapiens
FFLACNPLM

SEQ ID NO: 46906 - protein, 9 aa, Homo Sapiens
CLPCDCSGR

SEQ ID NO: 46907 - protein, 9 aa, Homo Sapiens
QTPEVALID

SEQ ID NO: 46908 - protein, 9 aa, Homo Sapiens
CQLSGPSVS

SEQ ID NO: 46909 - protein, 9 aa, Homo Sapiens
PLRSSCYWS

SEQ ID NO: 46910 - protein, 9 aa, Homo Sapiens
EKSKLEKPL

SEQ ID NO: 46911 - protein, 9 aa, Homo Sapiens
KQLYSNIPG

SEQ ID NO: 46912 - protein, 9 aa, Homo Sapiens
PTSMWPPAP

SEQ ID NO: 46913 - protein, 9 aa, Homo Sapiens
QSTMVCVDN

SEQ ID NO: 46914 - protein, 9 aa, Homo Sapiens
SLLQAPGMQ

SEQ ID NO: 46915 - protein, 9 aa, Homo Sapiens
PLHVLSKVC

SEQ ID NO: 46916 - protein, 9 aa, Homo Sapiens
GAFGFEVSD

SEQ ID NO: 46917 - protein, 9 aa, Homo Sapiens
DIAVLCHKL

SEQ ID NO: 46918 - protein, 9 aa, Homo Sapiens
SVALAFGLP

SEQ ID NO: 46919 - protein, 9 aa, Homo Sapiens
AGKGDGAFG

SEQ ID NO: 46920 - protein, 9 aa, Homo Sapiens
DTKVEEAGR

SEQ ID NO: 46921 - protein, 9 aa, Homo Sapiens
GGLGCRDRH

SEQ ID NO: 46922 - protein, 9 aa, Homo Sapiens
QMQYTLSPE

SEQ ID NO: 46923 - protein, 9 aa, Homo Sapiens
IDEILEKSE

SEQ ID NO: 46924 - protein, 9 aa, Homo Sapiens
GPSQSCHSA

SEQ ID NO: 46925 - protein, 9 aa, Homo Sapiens
GEGSLYQQR

SEQ ID NO: 46926 - protein, 9 aa, Homo Sapiens
LALTVADLQ

SEQ ID NO: 46927 - protein, 9 aa, Homo Sapiens
LPSKRWNPT

SEQ ID NO: 46928 - protein, 9 aa, Homo Sapiens
ISPPPVLHP

SEQ ID NO: 46929 - protein, 9 aa, Homo Sapiens
NNGLFTLGA

SEQ ID NO: 46930 - protein, 9 aa, Homo Sapiens
RERVGCMQQ

SEQ ID NO: 46931 - protein, 9 aa, Homo Sapiens
MNQRRGRTA

SEQ ID NO: 46932 - protein, 9 aa, Homo Sapiens
LKIGKFDLS

SEQ ID NO: 46933 - protein, 9 aa, Homo Sapiens
GRGCAGRPQ

SEQ ID NO: 46934 - protein, 9 aa, Homo Sapiens
SFLSVVGAP

SEQ ID NO: 46935 - protein, 9 aa, Homo Sapiens
ALAFGLPGR

SEQ ID NO: 46936 - protein, 9 aa, Homo Sapiens
GGWMADARL

SEQ ID NO: 46937 - protein, 9 aa, Homo Sapiens
LHPNLAELE

SEQ ID NO: 46938 - protein, 9 aa, Homo Sapiens
VENEDAVAL

SEQ ID NO: 46939 - protein, 9 aa, Homo Sapiens
PQFYPFGIV

SEQ ID NO: 46940 - protein, 9 aa, Homo Sapiens
HPHLPRALV

SEQ ID NO: 46941 - protein, 9 aa, Homo Sapiens
QLSGPSVSI

SEQ ID NO: 46942 - protein, 9 aa, Homo Sapiens
RCWAGAADS

SEQ ID NO: 46943 - protein, 9 aa, Homo Sapiens
HKLIRTKKR

SEQ ID NO: 46944 - protein, 9 aa, Homo Sapiens
PAGYGLIGV

SEQ ID NO: 46945 - protein, 9 aa, Homo Sapiens
LFSSFLWLQ

SEQ ID NO: 46946 - protein, 9 aa, Homo Sapiens
LSDMQDHAP

SEQ ID NO: 46947 - protein, 9 aa, Homo Sapiens
PIKSKFDSL

SEQ ID NO: 46948 - protein, 9 aa, Homo Sapiens
EVIILINLV

SEQ ID NO: 46949 - protein, 9 aa, Homo Sapiens
KVQSIPEKL

SEQ ID NO: 46950 - protein, 9 aa, Homo Sapiens
NPVENEDAV

SEQ ID NO: 46951 - protein, 9 aa, Homo Sapiens
PPDYDDDDD

SEQ ID NO: 46952 - protein, 9 aa, Homo Sapiens
LRSVALAFG

SEQ ID NO: 46953 - protein, 9 aa, Homo Sapiens
TSHGDGGHI

SEQ ID NO: 46954 - protein, 9 aa, Homo Sapiens
RPGPGPLPW

SEQ ID NO: 46955 - protein, 9 aa, Homo Sapiens
GHIEWPEFL

SEQ ID NO: 46956 - protein, 9 aa, Homo Sapiens
LRCLRWKIL

SEQ ID NO: 46957 - protein, 9 aa, Homo Sapiens
LAGDAFPEE

SEQ ID NO: 46958 - protein, 9 aa, Homo Sapiens
THTLSPLRS

SEQ ID NO: 46959 - protein, 9 aa, Homo Sapiens
AGPGAPLEK

SEQ ID NO: 46960 - protein, 9 aa, Homo Sapiens
FRREQPEDL

SEQ ID NO: 46961 - protein, 9 aa, Homo Sapiens
SKDTKVEEA

SEQ ID NO: 46962 - protein, 9 aa, Homo Sapiens
FLQESPVIY

SEQ ID NO: 46963 - protein, 9 aa, Homo Sapiens
HVTLAGDAF

SEQ ID NO: 46964 - protein, 9 aa, Homo Sapiens
APGMQIISH

SEQ ID NO: 46965 - protein, 9 aa, Homo Sapiens
QPFTTMQHT

SEQ ID NO: 46966 - protein, 9 aa, Homo Sapiens
EHFLGMESL

SEQ ID NO: 46967 - protein, 9 aa, Homo Sapiens
KLEKPLQDL

SEQ ID NO: 46968 - protein, 9 aa, Homo Sapiens
RFKFLNLWN

SEQ ID NO: 46969 - protein, 9 aa, Homo Sapiens
KHVRTYTGE

SEQ ID NO: 46970 - protein, 9 aa, Homo Sapiens
QLYAQICPS

SEQ ID NO: 46971 - protein, 9 aa, Homo Sapiens
PLSDIFNGF

SEQ ID NO: 46972 - protein, 9 aa, Homo Sapiens
SLFINGYEP

SEQ ID NO: 46973 - protein, 9 aa, Homo Sapiens
SLELDPTAL

SEQ ID NO: 46974 - protein, 9 aa, Homo Sapiens
YGLIGVQVA

SEQ ID NO: 46975 - protein, 9 aa, Homo Sapiens
FPEEPLPLS

SEQ ID NO: 46976 - protein, 9 aa, Homo Sapiens
SLEAKFHKD

SEQ ID NO: 46977 - protein, 9 aa, Homo Sapiens
GSSCPLSPP

SEQ ID NO: 46978 - protein, 9 aa, Homo Sapiens
QKVNITGGA

SEQ ID NO: 46979 - protein, 9 aa, Homo Sapiens
HKLCSPYPG

SEQ ID NO: 46980 - protein, 9 aa, Homo Sapiens
DRLRLQGGN

SEQ ID NO: 46981 - protein, 9 aa, Homo Sapiens
SQVTRTLDF

SEQ ID NO: 46982 - protein, 9 aa, Homo Sapiens
EARLASMAA

SEQ ID NO: 46983 - protein, 9 aa, Homo Sapiens
TKKRTDGVE

SEQ ID NO: 46984 - protein, 9 aa, Homo Sapiens
NRKRAPGIL

SEQ ID NO: 46985 - protein, 9 aa, Homo Sapiens
GTQCCAPQH

SEQ ID NO: 46986 - protein, 9 aa, Homo Sapiens
ILEKSESSV

SEQ ID NO: 46987 - protein, 9 aa, Homo Sapiens
PQGQIHPDP

SEQ ID NO: 46988 - protein, 9 aa, Homo Sapiens
RLATSVLKN

SEQ ID NO: 46989 - protein, 9 aa, Homo Sapiens
GDRLRLQGG

SEQ ID NO: 46990 - protein, 9 aa, Homo Sapiens
LEAKFHKDI

SEQ ID NO: 46991 - protein, 9 aa, Homo Sapiens
RFLKIGKFD

SEQ ID NO: 46992 - protein, 9 aa, Homo Sapiens
LHHVGPLSD

SEQ ID NO: 46993 - protein, 9 aa, Homo Sapiens
LPCDCSGRS

SEQ ID NO: 46994 - protein, 9 aa, Homo Sapiens
PRPTTRPRC

SEQ ID NO: 46995 - protein, 9 aa, Homo Sapiens
LLQAPGMQI

SEQ ID NO: 46996 - protein, 9 aa, Homo Sapiens
VRSTTKTSG

SEQ ID NO: 46997 - protein, 9 aa, Homo Sapiens
VNITGGAVS

SEQ ID NO: 46998 - protein, 9 aa, Homo Sapiens
GQNPMLKHQ

SEQ ID NO: 46999 - protein, 9 aa, Homo Sapiens
REQPEDLEL

SEQ ID NO: 47000 - protein, 9 aa, Homo Sapiens
SKLLHEDLA

SEQ ID NO: 47001 - protein, 9 aa, Homo Sapiens
LTIVCMEDF

SEQ ID NO: 47002 - protein, 9 aa, Homo Sapiens
AVLRRREQE

SEQ ID NO: 47003 - protein, 9 aa, Homo Sapiens
WGAGYIKDS

SEQ ID NO: 47004 - protein, 9 aa, Homo Sapiens
FLTIVCMED

SEQ ID NO: 47005 - protein, 9 aa, Homo Sapiens
IPPRTTMPY

SEQ ID NO: 47006 - protein, 9 aa, Homo Sapiens
ETAGNPTCP

SEQ ID NO: 47007 - protein, 9 aa, Homo Sapiens
GAQPLEMLP

SEQ ID NO: 47008 - protein, 9 aa, Homo Sapiens
GRKRASTRS

SEQ ID NO: 47009 - protein, 9 aa, Homo Sapiens
SHKKFDKVW

SEQ ID NO: 47010 - protein, 9 aa, Homo Sapiens
TSMWPPAPG

SEQ ID NO: 47011 - protein, 9 aa, Homo Sapiens
DSLFINGYE

SEQ ID NO: 47012 - protein, 9 aa, Homo Sapiens
ERICEVVRP

SEQ ID NO: 47013 - protein, 9 aa, Homo Sapiens
AVSTQPGPL

SEQ ID NO: 47014 - protein, 9 aa, Homo Sapiens
AYHSKMQEA

SEQ ID NO: 47015 - protein, 9 aa, Homo Sapiens
KHAVECEKP

SEQ ID NO: 47016 - protein, 9 aa, Homo Sapiens
KLLHEDLAL

SEQ ID NO: 47017 - protein, 9 aa, Homo Sapiens
AGNPTCPKV

SEQ ID NO: 47018 - protein, 9 aa, Homo Sapiens
YFRTCHENT

SEQ ID NO: 47019 - protein, 9 aa, Homo Sapiens
SVSAAVLRL

SEQ ID NO: 47020 - protein, 9 aa, Homo Sapiens
DRQLGDWEK

SEQ ID NO: 47021 - protein, 9 aa, Homo Sapiens
VLEKMRDEL

SEQ ID NO: 47022 - protein, 9 aa, Homo Sapiens
ISSFDTPLE

SEQ ID NO: 47023 - protein, 9 aa, Homo Sapiens
GLVLNRDKR

SEQ ID NO: 47024 - protein, 9 aa, Homo Sapiens
QAPGMQIIS

SEQ ID NO: 47025 - protein, 9 aa, Homo Sapiens
VTRTLDFLQ

SEQ ID NO: 47026 - protein, 9 aa, Homo Sapiens
SRLHRAKCA

SEQ ID NO: 47027 - protein, 9 aa, Homo Sapiens
KYSNVILLL

SEQ ID NO: 47028 - protein, 9 aa, Homo Sapiens
VKYSNVILL

SEQ ID NO: 47029 - protein, 9 aa, Homo Sapiens
RKRASTRSS

SEQ ID NO: 47030 - protein, 9 aa, Homo Sapiens
EAFQVLPQF

SEQ ID NO: 47031 - protein, 9 aa, Homo Sapiens
DFFLACNPL

SEQ ID NO: 47032 - protein, 9 aa, Homo Sapiens
IVEKLIKTC

SEQ ID NO: 47033 - protein, 9 aa, Homo Sapiens
LGYMDEKEP

SEQ ID NO: 47034 - protein, 9 aa, Homo Sapiens
DRYDSSIFD

SEQ ID NO: 47035 - protein, 9 aa, Homo Sapiens
YPFGIVQHD

SEQ ID NO: 47036 - protein, 9 aa, Homo Sapiens
IHVRQELLK

SEQ ID NO: 47037 - protein, 9 aa, Homo Sapiens
TGHSTFQNW

SEQ ID NO: 47038 - protein, 9 aa, Homo Sapiens
AYAKMNGCY

SEQ ID NO: 47039 - protein, 9 aa, Homo Sapiens
CAPQHGILP

SEQ ID NO: 47040 - protein, 9 aa, Homo Sapiens
PPSEGSKPL

SEQ ID NO: 47041 - protein, 9 aa, Homo Sapiens
VYENFVRCI

SEQ ID NO: 47042 - protein, 9 aa, Homo Sapiens
PPGATTASW

SEQ ID NO: 47043 - protein, 9 aa, Homo Sapiens
CHKSHTQFS

SEQ ID NO: 47044 - protein, 9 aa, Homo Sapiens
SIVEKLIKT

SEQ ID NO: 47045 - protein, 9 aa, Homo Sapiens
KGLHIPRLI

SEQ ID NO: 47046 - protein, 9 aa, Homo Sapiens
PRFFVMLYH

SEQ ID NO: 47047 - protein, 9 aa, Homo Sapiens
DLDADLEDR

SEQ ID NO: 47048 - protein, 9 aa, Homo Sapiens
EESPGAAVW

SEQ ID NO: 47049 - protein, 9 aa, Homo Sapiens
RGPGTQCCA

SEQ ID NO: 47050 - protein, 9 aa, Homo Sapiens
RVCSLQFDG

SEQ ID NO: 47051 - protein, 9 aa, Homo Sapiens
ESGQNPMLK

SEQ ID NO: 47052 - protein, 9 aa, Homo Sapiens
LEDERKQWA

SEQ ID NO: 47053 - protein, 9 aa, Homo Sapiens
DRWTFLFVI

SEQ ID NO: 47054 - protein, 9 aa, Homo Sapiens
CSPYPGQAN

SEQ ID NO: 47055 - protein, 9 aa, Homo Sapiens
LGPPDYDDD

SEQ ID NO: 47056 - protein, 9 aa, Homo Sapiens
LNRDKRLAW

SEQ ID NO: 47057 - protein, 9 aa, Homo Sapiens
AFQVLPQFV

SEQ ID NO: 47058 - protein, 9 aa, Homo Sapiens
TRPRCWAGA

SEQ ID NO: 47059 - protein, 9 aa, Homo Sapiens
FEVQSAVRV

SEQ ID NO: 47060 - protein, 9 aa, Homo Sapiens
RKPEPEPSS

SEQ ID NO: 47061 - protein, 9 aa, Homo Sapiens
TEPHFIIHV

SEQ ID NO: 47062 - protein, 9 aa, Homo Sapiens
FLKTQAIKT

SEQ ID NO: 47063 - protein, 9 aa, Homo Sapiens
GFPRTPGRP

SEQ ID NO: 47064 - protein, 9 aa, Homo Sapiens
PQISGGRKS

SEQ ID NO: 47065 - protein, 9 aa, Homo Sapiens
PSSRSPQIS

SEQ ID NO: 47066 - protein, 9 aa, Homo Sapiens
GRFLKIGKF

SEQ ID NO: 47067 - protein, 9 aa, Homo Sapiens
EEREIIKLS

SEQ ID NO: 47068 - protein, 9 aa, Homo Sapiens
PNQEGIHVR

SEQ ID NO: 47069 - protein, 9 aa, Homo Sapiens
PEDSYPGLA

SEQ ID NO: 47070 - protein, 9 aa, Homo Sapiens
RPTTRPRCW

SEQ ID NO: 47071 - protein, 9 aa, Homo Sapiens
QPGPLPTTQ

SEQ ID NO: 47072 - protein, 9 aa, Homo Sapiens
VSTQPGPLP

SEQ ID NO: 47073 - protein, 9 aa, Homo Sapiens
EMLRLKGRK

SEQ ID NO: 47074 - protein, 9 aa, Homo Sapiens
SPKDNIPAL

SEQ ID NO: 47075 - protein, 9 aa, Homo Sapiens
RPQRGPGTQ

SEQ ID NO: 47076 - protein, 9 aa, Homo Sapiens
RTYTGERPF

SEQ ID NO: 47077 - protein, 9 aa, Homo Sapiens
DIPAKAATA

SEQ ID NO: 47078 - protein, 9 aa, Homo Sapiens
TGGAVSLGH

SEQ ID NO: 47079 - protein, 9 aa, Homo Sapiens
EGEARLKYE

SEQ ID NO: 47080 - protein, 9 aa, Homo Sapiens
FAKTPSSNK

SEQ ID NO: 47081 - protein, 9 aa, Homo Sapiens
LVLNRDKRL

SEQ ID NO: 47082 - protein, 9 aa, Homo Sapiens
AAVWGQPHQ

SEQ ID NO: 47083 - protein, 9 aa, Homo Sapiens
SYPGLAGAS

SEQ ID NO: 47084 - protein, 9 aa, Homo Sapiens
VDRYDSSIF

SEQ ID NO: 47085 - protein, 9 aa, Homo Sapiens
GPPPPDTNR

SEQ ID NO: 47086 - protein, 9 aa, Homo Sapiens
GPPDYDDDD

SEQ ID NO: 47087 - protein, 9 aa, Homo Sapiens
LSVRIGRYR

SEQ ID NO: 47088 - protein, 9 aa, Homo Sapiens
DRVIHVLNV

SEQ ID NO: 47089 - protein, 9 aa, Homo Sapiens
ASTTGPQGA

SEQ ID NO: 47090 - protein, 9 aa, Homo Sapiens
RTPGRPQLS

SEQ ID NO: 47091 - protein, 9 aa, Homo Sapiens
LQAPGMQII

SEQ ID NO: 47092 - protein, 9 aa, Homo Sapiens
QQGRGCAGR

SEQ ID NO: 47093 - protein, 9 aa, Homo Sapiens
LWGAGYIKD

SEQ ID NO: 47094 - protein, 9 aa, Homo Sapiens
CGGLGCRDR

SEQ ID NO: 47095 - protein, 9 aa, Homo Sapiens
YDSSIFDGL

SEQ ID NO: 47096 - protein, 9 aa, Homo Sapiens
EPLDKVTES

SEQ ID NO: 47097 - protein, 9 aa, Homo Sapiens
GIEPPSEGS

SEQ ID NO: 47098 - protein, 9 aa, Homo Sapiens
LGSPFGGWM

SEQ ID NO: 47099 - protein, 9 aa, Homo Sapiens
MISRIFFFY

SEQ ID NO: 47100 - protein, 9 aa, Homo Sapiens
TLLRFHSRE

SEQ ID NO: 47101 - protein, 9 aa, Homo Sapiens
DDPRLIHLF

SEQ ID NO: 47102 - protein, 9 aa, Homo Sapiens
LCSPYPGQA

SEQ ID NO: 47103 - protein, 9 aa, Homo Sapiens
HTGRGAWSL

SEQ ID NO: 47104 - protein, 9 aa, Homo Sapiens
PEDVPRKPE

SEQ ID NO: 47105 - protein, 9 aa, Homo Sapiens
ADLWSCGVI

SEQ ID NO: 47106 - protein, 9 aa, Homo Sapiens
TFTVEGACL

SEQ ID NO: 47107 - protein, 9 aa, Homo Sapiens
FGPLVLFCY

SEQ ID NO: 47108 - protein, 9 aa, Homo Sapiens
LLLHIKSNK

SEQ ID NO: 47109 - protein, 9 aa, Homo Sapiens
FLGMESLWN

SEQ ID NO: 47110 - protein, 9 aa, Homo Sapiens
LRLQGGNPH

SEQ ID NO: 47111 - protein, 9 aa, Homo Sapiens
LQGGNPHGW

SEQ ID NO: 47112 - protein, 9 aa, Homo Sapiens
DLLPGRLGL

SEQ ID NO: 47113 - protein, 9 aa, Homo Sapiens
LFVIEELLF

SEQ ID NO: 47114 - protein, 9 aa, Homo Sapiens
PSKRWNPTQ

SEQ ID NO: 47115 - protein, 9 aa, Homo Sapiens
PRRGFALSL

SEQ ID NO: 47116 - protein, 9 aa, Homo Sapiens
LCGAVLAKH

SEQ ID NO: 47117 - protein, 9 aa, Homo Sapiens
SSALARLDL

SEQ ID NO: 47118 - protein, 9 aa, Homo Sapiens
SPYPGQANN

SEQ ID NO: 47119 - protein, 9 aa, Homo Sapiens
AHQALLATR

SEQ ID NO: 47120 - protein, 9 aa, Homo Sapiens
SSIAAPASW

SEQ ID NO: 47121 - protein, 9 aa, Homo Sapiens
ISRIFFFYF

SEQ ID NO: 47122 - protein, 9 aa, Homo Sapiens
WPSLELDPT

SEQ ID NO: 47123 - protein, 9 aa, Homo Sapiens
ERKQWALAV

SEQ ID NO: 47124 - protein, 9 aa, Homo Sapiens
SVMSKDTKV

SEQ ID NO: 47125 - protein, 9 aa, Homo Sapiens
QPEDLELLP

SEQ ID NO: 47126 - protein, 9 aa, Homo Sapiens
RDRHVTLAG

SEQ ID NO: 47127 - protein, 9 aa, Homo Sapiens
GVDTEPHFI

SEQ ID NO: 47128 - protein, 9 aa, Homo Sapiens
TSVLKNEKS

SEQ ID NO: 47129 - protein, 9 aa, Homo Sapiens
PEEPLPLSV

SEQ ID NO: 47130 - protein, 9 aa, Homo Sapiens
VLFCYALRL

SEQ ID NO: 47131 - protein, 9 aa, Homo Sapiens
ECLDYPDPI

SEQ ID NO: 47132 - protein, 9 aa, Homo Sapiens
HHVGPLSDI

SEQ ID NO: 47133 - protein, 9 aa, Homo Sapiens
FADVETYFR

SEQ ID NO: 47134 - protein, 9 aa, Homo Sapiens
CGAVLAKHL

SEQ ID NO: 47135 - protein, 9 aa, Homo Sapiens
PLEMLPGWT

SEQ ID NO: 47136 - protein, 9 aa, Homo Sapiens
MENYLVKIN

SEQ ID NO: 47137 - protein, 9 aa, Homo Sapiens
NKHDLEPSG

SEQ ID NO: 47138 - protein, 9 aa, Homo Sapiens
LLVALHCLL

SEQ ID NO: 47139 - protein, 9 aa, Homo Sapiens
EGGLRCLRW

SEQ ID NO: 47140 - protein, 9 aa, Homo Sapiens
PFGGWMADA

SEQ ID NO: 47141 - protein, 9 aa, Homo Sapiens
VQSAVRVVH

SEQ ID NO: 47142 - protein, 9 aa, Homo Sapiens
RIGRYRSIL

SEQ ID NO: 47143 - protein, 9 aa, Homo Sapiens
AFTSVSMSG

SEQ ID NO: 47144 - protein, 9 aa, Homo Sapiens
KASLTSKKG

SEQ ID NO: 47145 - protein, 9 aa, Homo Sapiens
SARSPRGWD

SEQ ID NO: 47146 - protein, 9 aa, Homo Sapiens
QGTGPSQSC

SEQ ID NO: 47147 - protein, 9 aa, Homo Sapiens
TGRGAWSLC

SEQ ID NO: 47148 - protein, 9 aa, Homo Sapiens
NGAGKTSTS

SEQ ID NO: 47149 - protein, 9 aa, Homo Sapiens
VCHKSHTQF

SEQ ID NO: 47150 - protein, 9 aa, Homo Sapiens
GLSVAGPGA

SEQ ID NO: 47151 - protein, 9 aa, Homo Sapiens
DDNMEILHS

SEQ ID NO: 47152 - protein, 9 aa, Homo Sapiens
ILELAYHGD

SEQ ID NO: 47153 - protein, 9 aa, Homo Sapiens
QVLPQFVDK

SEQ ID NO: 47154 - protein, 9 aa, Homo Sapiens
KWRQCHLAR

SEQ ID NO: 47155 - protein, 9 aa, Homo Sapiens
TKVEEAGRE

SEQ ID NO: 47156 - protein, 9 aa, Homo Sapiens
HGLFPEEPL

SEQ ID NO: 47157 - protein, 9 aa, Homo Sapiens
DEESGQNPM

SEQ ID NO: 47158 - protein, 9 aa, Homo Sapiens
KAATATSPT

SEQ ID NO: 47159 - protein, 9 aa, Homo Sapiens
RGHIEWPEF

SEQ ID NO: 47160 - protein, 9 aa, Homo Sapiens
AKAATATSP

SEQ ID NO: 47161 - protein, 9 aa, Homo Sapiens
DVDDNTKVV

SEQ ID NO: 47162 - protein, 9 aa, Homo Sapiens
NIPGSSFSS

SEQ ID NO: 47163 - protein, 9 aa, Homo Sapiens
GNKHDLEPS

SEQ ID NO: 47164 - protein, 9 aa, Homo Sapiens
PRLEETETS

SEQ ID NO: 47165 - protein, 9 aa, Homo Sapiens
PQRGPGTQC

SEQ ID NO: 47166 - protein, 9 aa, Homo Sapiens
CLDYPDPII

SEQ ID NO: 47167 - protein, 9 aa, Homo Sapiens
LHKDTNMPM

SEQ ID NO: 47168 - protein, 9 aa, Homo Sapiens
SSVRERVGC

SEQ ID NO: 47169 - protein, 9 aa, Homo Sapiens
GATHTGHST

SEQ ID NO: 47170 - protein, 9 aa, Homo Sapiens
LHIPRLIEV

SEQ ID NO: 47171 - protein, 9 aa, Homo Sapiens
LVALHCLLP

SEQ ID NO: 47172 - protein, 9 aa, Homo Sapiens
RREQPEDLE

SEQ ID NO: 47173 - protein, 9 aa, Homo Sapiens
VPRKPEPEP

SEQ ID NO: 47174 - protein, 9 aa, Homo Sapiens
FSRYFPTKI

SEQ ID NO: 47175 - protein, 9 aa, Homo Sapiens
TTQDEEEDK

SEQ ID NO: 47176 - protein, 9 aa, Homo Sapiens
GAGSSCPLS

SEQ ID NO: 47177 - protein, 9 aa, Homo Sapiens
HTQFSNLCR

SEQ ID NO: 47178 - protein, 9 aa, Homo Sapiens
HVRTYTGER

SEQ ID NO: 47179 - protein, 9 aa, Homo Sapiens
GACLTEEQK

SEQ ID NO: 47180 - protein, 9 aa, Homo Sapiens
KCQKHAVEC

SEQ ID NO: 47181 - protein, 9 aa, Homo Sapiens
LKASLTSKK

SEQ ID NO: 47182 - protein, 9 aa, Homo Sapiens
DFEDMERSL

SEQ ID NO: 47183 - protein, 9 aa, Homo Sapiens
GLIGVQVAA

SEQ ID NO: 47184 - protein, 9 aa, Homo Sapiens
LLEEIAGNT

SEQ ID NO: 47185 - protein, 9 aa, Homo Sapiens
CRPGPGPLP

SEQ ID NO: 47186 - protein, 9 aa, Homo Sapiens
TVEGACLTE

SEQ ID NO: 47187 - protein, 9 aa, Homo Sapiens
GKNGDGLKT

SEQ ID NO: 47188 - protein, 9 aa, Homo Sapiens
ANRLWAGTL

SEQ ID NO: 47189 - protein, 9 aa, Homo Sapiens
GCMQQATPC

SEQ ID NO: 47190 - protein, 9 aa, Homo Sapiens
KRLNKLTLS

SEQ ID NO: 47191 - protein, 9 aa, Homo Sapiens
FTSRGLVAH

SEQ ID NO: 47192 - protein, 9 aa, Homo Sapiens
AFPEESPGA

SEQ ID NO: 47193 - protein, 9 aa, Homo Sapiens
GTYIHALNN

SEQ ID NO: 47194 - protein, 9 aa, Homo Sapiens
PCDCSGRSQ

SEQ ID NO: 47195 - protein, 9 aa, Homo Sapiens
LAARNLIQA

SEQ ID NO: 47196 - protein, 9 aa, Homo Sapiens
TEIILKTFQ

SEQ ID NO: 47197 - protein, 9 aa, Homo Sapiens
TETHRYSGE

SEQ ID NO: 47198 - protein, 9 aa, Homo Sapiens
EEPLPLSVA

SEQ ID NO: 47199 - protein, 9 aa, Homo Sapiens
FSYATEIIL

SEQ ID NO: 47200 - protein, 9 aa, Homo Sapiens
EILEKSESS

SEQ ID NO: 47201 - protein, 9 aa, Homo Sapiens
MYRYWPKRC

SEQ ID NO: 47202 - protein, 9 aa, Homo Sapiens
WPTARTTPT

SEQ ID NO: 47203 - protein, 9 aa, Homo Sapiens
SSCYWSKRM

SEQ ID NO: 47204 - protein, 9 aa, Homo Sapiens
SPPPPRSRG

SEQ ID NO: 47205 - protein, 9 aa, Homo Sapiens
TRDRAYKQV

SEQ ID NO: 47206 - protein, 9 aa, Homo Sapiens
CRDRHVTLA

SEQ ID NO: 47207 - protein, 9 aa, Homo Sapiens
SPVIYVQTL

SEQ ID NO: 47208 - protein, 9 aa, Homo Sapiens
DRHVTLAGD

SEQ ID NO: 47209 - protein, 9 aa, Homo Sapiens
GHCHTGRGA

SEQ ID NO: 47210 - protein, 9 aa, Homo Sapiens
YHIAPGSGD

SEQ ID NO: 47211 - protein, 9 aa, Homo Sapiens
VGPLSDIFN

SEQ ID NO: 47212 - protein, 9 aa, Homo Sapiens
IHLFSWEPG

SEQ ID NO: 47213 - protein, 9 aa, Homo Sapiens
SLPDKVVIK

SEQ ID NO: 47214 - protein, 9 aa, Homo Sapiens
MADARLGRA

SEQ ID NO: 47215 - protein, 9 aa, Homo Sapiens
VWTPSHPSG

SEQ ID NO: 47216 - protein, 9 aa, Homo Sapiens
LYAQICPSA

SEQ ID NO: 47217 - protein, 9 aa, Homo Sapiens
PSPAIPRRG

SEQ ID NO: 47218 - protein, 9 aa, Homo Sapiens
GPGTQCCAP

SEQ ID NO: 47219 - protein, 9 aa, Homo Sapiens
KEEDLPGAQ

SEQ ID NO: 47220 - protein, 9 aa, Homo Sapiens
YHSKMQEAQ

SEQ ID NO: 47221 - protein, 9 aa, Homo Sapiens
QDDPRLIHL

SEQ ID NO: 47222 - protein, 9 aa, Homo Sapiens
PSEGSKPLS

SEQ ID NO: 47223 - protein, 9 aa, Homo Sapiens
LHVLSKVCM

SEQ ID NO: 47224 - protein, 9 aa, Homo Sapiens
RHVTLAGDA

SEQ ID NO: 47225 - protein, 9 aa, Homo Sapiens
RQGDGGVYS

SEQ ID NO: 47226 - protein, 9 aa, Homo Sapiens
YDFFLACNP

SEQ ID NO: 47227 - protein, 9 aa, Homo Sapiens
YFVLYKPSP

SEQ ID NO: 47228 - protein, 9 aa, Homo Sapiens
FPEESPGAA

SEQ ID NO: 47229 - protein, 9 aa, Homo Sapiens
GWMADARLG

SEQ ID NO: 47230 - protein, 9 aa, Homo Sapiens
SNKSALIKL

SEQ ID NO: 47231 - protein, 9 aa, Homo Sapiens
CPPEPDAFN

SEQ ID NO: 47232 - protein, 9 aa, Homo Sapiens
PRTPGRPQL

SEQ ID NO: 47233 - protein, 9 aa, Homo Sapiens
EKAYAKMNG

SEQ ID NO: 47234 - protein, 9 aa, Homo Sapiens
LLEKCLQED

SEQ ID NO: 47235 - protein, 9 aa, Homo Sapiens
DKEEDLPGA

SEQ ID NO: 47236 - protein, 9 aa, Homo Sapiens
QLGYMDEKE

SEQ ID NO: 47237 - protein, 9 aa, Homo Sapiens
FEALKRRLK

SEQ ID NO: 47238 - protein, 9 aa, Homo Sapiens
PGPLPWAPR

SEQ ID NO: 47239 - protein, 9 aa, Homo Sapiens
SYVGLCPRL

SEQ ID NO: 47240 - protein, 9 aa, Homo Sapiens
LFEPKLKCM

SEQ ID NO: 47241 - protein, 9 aa, Homo Sapiens
WPPGATTAS

SEQ ID NO: 47242 - protein, 9 aa, Homo Sapiens
DSYPGLAGA

SEQ ID NO: 47243 - protein, 9 aa, Homo Sapiens
TARTTPTSS

SEQ ID NO: 47244 - protein, 9 aa, Homo Sapiens
GAVLAKHLS

SEQ ID NO: 47245 - protein, 9 aa, Homo Sapiens
QNLSVRIGR

SEQ ID NO: 47246 - protein, 9 aa, Homo Sapiens
YHQKLAYHS

SEQ ID NO: 47247 - protein, 9 aa, Homo Sapiens
AYHGDTLSM

SEQ ID NO: 47248 - protein, 9 aa, Homo Sapiens
VALAFGLPG

SEQ ID NO: 47249 - protein, 9 aa, Homo Sapiens
MASFLSVVG

SEQ ID NO: 47250 - protein, 9 aa, Homo Sapiens
VMSKDTKVE

SEQ ID NO: 47251 - protein, 9 aa, Homo Sapiens
WPPAPGAQP

SEQ ID NO: 47252 - protein, 9 aa, Homo Sapiens
FLWLQLGPQ

SEQ ID NO: 47253 - protein, 9 aa, Homo Sapiens
SSNKSALIK

SEQ ID NO: 47254 - protein, 9 aa, Homo Sapiens
IDLDADLED

SEQ ID NO: 47255 - protein, 9 aa, Homo Sapiens
LACNPLMPI

SEQ ID NO: 47256 - protein, 9 aa, Homo Sapiens
CEGGLRCLR

SEQ ID NO: 47257 - protein, 9 aa, Homo Sapiens
LNLWNKFLL

SEQ ID NO: 47258 - protein, 9 aa, Homo Sapiens
GGVFEEDSQ

SEQ ID NO: 47259 - protein, 9 aa, Homo Sapiens
PPPVLHPNL

SEQ ID NO: 47260 - protein, 9 aa, Homo Sapiens
LYSNIPGSS

SEQ ID NO: 47261 - protein, 9 aa, Homo Sapiens
FKFLNLWNK

SEQ ID NO: 47262 - protein, 9 aa, Homo Sapiens
PRSRGSHWP

SEQ ID NO: 47263 - protein, 9 aa, Homo Sapiens
GEAGIPLEM

SEQ ID NO: 47264 - protein, 9 aa, Homo Sapiens
RYFVLYKPS

SEQ ID NO: 47265 - protein, 9 aa, Homo Sapiens
HWPPGATTA

SEQ ID NO: 47266 - protein, 9 aa, Homo Sapiens
QGGNPHGWR

SEQ ID NO: 47267 - protein, 9 aa, Homo Sapiens
FVRCIALFN

SEQ ID NO: 47268 - protein, 9 aa, Homo Sapiens
HPTVLEKMR

SEQ ID NO: 47269 - protein, 9 aa, Homo Sapiens
NSNPVENED

SEQ ID NO: 47270 - protein, 9 aa, Homo Sapiens
KHPTVLEKM

SEQ ID NO: 47271 - protein, 9 aa, Homo Sapiens
IAAPASWRT

SEQ ID NO: 47272 - protein, 9 aa, Homo Sapiens
CWAGAADSP

SEQ ID NO: 47273 - protein, 9 aa, Homo Sapiens
NFVRCIALF

SEQ ID NO: 47274 - protein, 9 aa, Homo Sapiens
CHTGRGAWS

SEQ ID NO: 47275 - protein, 9 aa, Homo Sapiens
YAKMNGCYE

SEQ ID NO: 47276 - protein, 9 aa, Homo Sapiens
AGYGLIGVQ

SEQ ID NO: 47277 - protein, 9 aa, Homo Sapiens
RPNQEGIHV

SEQ ID NO: 47278 - protein, 9 aa, Homo Sapiens
LGKNGDGLK

SEQ ID NO: 47279 - protein, 9 aa, Homo Sapiens
KDTKVEEAG

SEQ ID NO: 47280 - protein, 9 aa, Homo Sapiens
HALNNGLFT

SEQ ID NO: 47281 - protein, 9 aa, Homo Sapiens
FIECEHPVD

SEQ ID NO: 47282 - protein, 9 aa, Homo Sapiens
DNLHHVGPL

SEQ ID NO: 47283 - protein, 9 aa, Homo Sapiens
DEEWGGHSA

SEQ ID NO: 47284 - protein, 9 aa, Homo Sapiens
AIPRRGFAL

SEQ ID NO: 47285 - protein, 9 aa, Homo Sapiens
SRYFPTKIR

SEQ ID NO: 47286 - protein, 9 aa, Homo Sapiens
PFRREQPED

SEQ ID NO: 47287 - protein, 9 aa, Homo Sapiens
YPGLAGASD

SEQ ID NO: 47288 - protein, 9 aa, Homo Sapiens
MRLAGPLAL

SEQ ID NO: 47289 - protein, 9 aa, Homo Sapiens
TTMQHTTMP

SEQ ID NO: 47290 - protein, 9 aa, Homo Sapiens
GILHKDTNM

SEQ ID NO: 47291 - protein, 9 aa, Homo Sapiens
EWPEFLSHE

SEQ ID NO: 47292 - protein, 9 aa, Homo Sapiens
PPRSRGSHW

SEQ ID NO: 47293 - protein, 9 aa, Homo Sapiens
GKRGAFTSV

SEQ ID NO: 47294 - protein, 9 aa, Homo Sapiens
KNRERIESS

SEQ ID NO: 47295 - protein, 9 aa, Homo Sapiens
PPDTNRMEL

SEQ ID NO: 47296 - protein, 9 aa, Homo Sapiens
RRGFALSLL

SEQ ID NO: 47297 - protein, 9 aa, Homo Sapiens
FSMSVSAAV

SEQ ID NO: 47298 - protein, 9 aa, Homo Sapiens
SMNQRRGRT

SEQ ID NO: 47299 - protein, 9 aa, Homo Sapiens
WTPSHPSGS

SEQ ID NO: 47300 - protein, 9 aa, Homo Sapiens
MTIIECLDY

SEQ ID NO: 47301 - protein, 9 aa, Homo Sapiens
REIIKLSMK

SEQ ID NO: 47302 - protein, 9 aa, Homo Sapiens
SVLKNEKSN

SEQ ID NO: 47303 - protein, 9 aa, Homo Sapiens
ENKRTAAKQ

SEQ ID NO: 47304 - protein, 9 aa, Homo Sapiens
GDWEKELIR

SEQ ID NO: 47305 - protein, 9 aa, Homo Sapiens
CYWSKRMLG

SEQ ID NO: 47306 - protein, 9 aa, Homo Sapiens
IEPPSEGSK

SEQ ID NO: 47307 - protein, 9 aa, Homo Sapiens
GSPFGGWMA

SEQ ID NO: 47308 - protein, 9 aa, Homo Sapiens
NKLTLSVSS

SEQ ID NO: 47309 - protein, 9 aa, Homo Sapiens
LQKYDIPAK

SEQ ID NO: 47310 - protein, 9 aa, Homo Sapiens
VVHSWALAE

SEQ ID NO: 47311 - protein, 9 aa, Homo Sapiens
ALKRRLKEY

SEQ ID NO: 47312 - protein, 9 aa, Homo Sapiens
WSFMGPVEV

SEQ ID NO: 47313 - protein, 9 aa, Homo Sapiens
KFHKDIAVL

SEQ ID NO: 47314 - protein, 9 aa, Homo Sapiens
SVSIVQSCT

SEQ ID NO: 47315 - protein, 9 aa, Homo Sapiens
FFTIGITWI

SEQ ID NO: 47316 - protein, 9 aa, Homo Sapiens
IRTKKRTDG

SEQ ID NO: 47317 - protein, 9 aa, Homo Sapiens
LSFSGRDEN

SEQ ID NO: 47318 - protein, 9 aa, Homo Sapiens
SRWWRASSI

SEQ ID NO: 47319 - protein, 9 aa, Homo Sapiens
SVLQGTGPS

SEQ ID NO: 47320 - protein, 9 aa, Homo Sapiens
PLQDLQLDQ

SEQ ID NO: 47321 - protein, 9 aa, Homo Sapiens
NLPGSYHCT

SEQ ID NO: 47322 - protein, 9 aa, Homo Sapiens
IHSLPDKVV

SEQ ID NO: 47323 - protein, 9 aa, Homo Sapiens
LIGVQVAAY

SEQ ID NO: 47324 - protein, 9 aa, Homo Sapiens
DYPDPIIKR

SEQ ID NO: 47325 - protein, 9 aa, Homo Sapiens
VRCIALFNQ

SEQ ID NO: 47326 - protein, 9 aa, Homo Sapiens
YRYWPKRCC

SEQ ID NO: 47327 - protein, 9 aa, Homo Sapiens
LSGPSVSIV

SEQ ID NO: 47328 - protein, 9 aa, Homo Sapiens
ERVGCMQQA

SEQ ID NO: 47329 - protein, 9 aa, Homo Sapiens
QIHPDPTSM

SEQ ID NO: 47330 - protein, 9 aa, Homo Sapiens
RLWGAGYIK

SEQ ID NO: 47331 - protein, 9 aa, Homo Sapiens
TASWWPTAR

SEQ ID NO: 47332 - protein, 9 aa, Homo Sapiens
MFGPLVLFC

SEQ ID NO: 47333 - protein, 9 aa, Homo Sapiens
SCPLSPPEI

SEQ ID NO: 47334 - protein, 9 aa, Homo Sapiens
PDEFIECEH

SEQ ID NO: 47335 - protein, 9 aa, Homo Sapiens
TPGRPQLSL

SEQ ID NO: 47336 - protein, 9 aa, Homo Sapiens
LCVTTETHR

SEQ ID NO: 47337 - protein, 9 aa, Homo Sapiens
PPAPGAQPL

SEQ ID NO: 47338 - protein, 9 aa, Homo Sapiens
MSKDTKVEE

SEQ ID NO: 47339 - protein, 9 aa, Homo Sapiens
GAGKGDGAF

SEQ ID NO: 47340 - protein, 9 aa, Homo Sapiens
EGDLLPGRL

SEQ ID NO: 47341 - protein, 9 aa, Homo Sapiens
TQDEHFLGM

SEQ ID NO: 47342 - protein, 9 aa, Homo Sapiens
FSPHAGGRT

SEQ ID NO: 47343 - protein, 9 aa, Homo Sapiens
DLQKHVRTY

SEQ ID NO: 47344 - protein, 9 aa, Homo Sapiens
AACSCVRRQ

SEQ ID NO: 47345 - protein, 9 aa, Homo Sapiens
WGFPRTPGR

SEQ ID NO: 47346 - protein, 9 aa, Homo Sapiens
DKVQSIPEK

SEQ ID NO: 47347 - protein, 9 aa, Homo Sapiens
VAGPGAPLE

SEQ ID NO: 47348 - protein, 9 aa, Homo Sapiens
PVEVIILIN

SEQ ID NO: 47349 - protein, 9 aa, Homo Sapiens
TYIHALNNG

SEQ ID NO: 47350 - protein, 9 aa, Homo Sapiens
WAGAADSPP

SEQ ID NO: 47351 - protein, 9 aa, Homo Sapiens
CNLKDDFEV

SEQ ID NO: 47352 - protein, 9 aa, Homo Sapiens
HCTCPDGYR

SEQ ID NO: 47353 - protein, 9 aa, Homo Sapiens
TNFPPLMLL

SEQ ID NO: 47354 - protein, 9 aa, Homo Sapiens
FDKVWTPSH

SEQ ID NO: 47355 - protein, 9 aa, Homo Sapiens
WMADARLGR

SEQ ID NO: 47356 - protein, 9 aa, Homo Sapiens
MSSWESRLH

SEQ ID NO: 47357 - protein, 9 aa, Homo Sapiens
ISGGRKSPV

SEQ ID NO: 47358 - protein, 9 aa, Homo Sapiens
AISPPPVLH

SEQ ID NO: 47359 - protein, 9 aa, Homo Sapiens
RFHSREAIL

SEQ ID NO: 47360 - protein, 9 aa, Homo Sapiens
ILFEPKLKC

SEQ ID NO: 47361 - protein, 9 aa, Homo Sapiens
DPRLIHLFS

SEQ ID NO: 47362 - protein, 9 aa, Homo Sapiens
LSVVGAPGG

SEQ ID NO: 47363 - protein, 9 aa, Homo Sapiens
TQCCAPQHG

SEQ ID NO: 47364 - protein, 9 aa, Homo Sapiens
RVVHSWALA

SEQ ID NO: 47365 - protein, 9 aa, Homo Sapiens
PPPDTNRME

SEQ ID NO: 47366 - protein, 9 aa, Homo Sapiens
LKTFLKTQA

SEQ ID NO: 47367 - protein, 9 aa, Homo Sapiens
HFSLLQAPG

SEQ ID NO: 47368 - protein, 9 aa, Homo Sapiens
ACSCVRRQK

SEQ ID NO: 47369 - protein, 9 aa, Homo Sapiens
GAAVWGQPH

SEQ ID NO: 47370 - protein, 9 aa, Homo Sapiens
RGISIVEKL

SEQ ID NO: 47371 - protein, 9 aa, Homo Sapiens
EGIHVRQEL

SEQ ID NO: 47372 - protein, 9 aa, Homo Sapiens
QKEERRRLE

SEQ ID NO: 47373 - protein, 9 aa, Homo Sapiens
SSRWWRASS

SEQ ID NO: 47374 - protein, 9 aa, Homo Sapiens
AGSSCPLSP

SEQ ID NO: 47375 - protein, 9 aa, Homo Sapiens
QLGDWEKEL

SEQ ID NO: 47376 - protein, 9 aa, Homo Sapiens
NKSALIKLA

SEQ ID NO: 47377 - protein, 9 aa, Homo Sapiens
LFINGYEPQ

SEQ ID NO: 47378 - protein, 9 aa, Homo Sapiens
EREIIKLSM

SEQ ID NO: 47379 - protein, 9 aa, Homo Sapiens
NPEDVPRKP

SEQ ID NO: 47380 - protein, 9 aa, Homo Sapiens
DKVWTPSHP

SEQ ID NO: 47381 - protein, 9 aa, Homo Sapiens
GPGHPPADG

SEQ ID NO: 47382 - protein, 9 aa, Homo Sapiens
MNGCYEALS

SEQ ID NO: 47383 - protein, 9 aa, Homo Sapiens
HCHTGRGAW

SEQ ID NO: 47384 - protein, 9 aa, Homo Sapiens
PFETRTAVK

SEQ ID NO: 47385 - protein, 9 aa, Homo Sapiens
RAHCGGLGC

SEQ ID NO: 47386 - protein, 9 aa, Homo Sapiens
GDGAFGFEV

SEQ ID NO: 47387 - protein, 9 aa, Homo Sapiens
RLSFSGRDE

SEQ ID NO: 47388 - protein, 9 aa, Homo Sapiens
AGGRTRDRA

SEQ ID NO: 47389 - protein, 9 aa, Homo Sapiens
SIVQSCTPP

SEQ ID NO: 47390 - protein, 9 aa, Homo Sapiens
LFPRTTQIL

SEQ ID NO: 47391 - protein, 9 aa, Homo Sapiens
VIKYTKLKK

SEQ ID NO: 47392 - protein, 9 aa, Homo Sapiens
HPVDHVGNA

SEQ ID NO: 47393 - protein, 9 aa, Homo Sapiens
EVFFFTIGI

SEQ ID NO: 47394 - protein, 9 aa, Homo Sapiens
KHLSIPAVF

SEQ ID NO: 47395 - protein, 9 aa, Homo Sapiens
ERIESSEES

SEQ ID NO: 47396 - protein, 9 aa, Homo Sapiens
HWPEDSYPG

SEQ ID NO: 47397 - protein, 9 aa, Homo Sapiens
SYHCTCPDG

SEQ ID NO: 47398 - protein, 9 aa, Homo Sapiens
TVLEKMRDE

SEQ ID NO: 47399 - protein, 9 aa, Homo Sapiens
LDYPDPIIK

SEQ ID NO: 47400 - protein, 9 aa, Homo Sapiens
PLALTVADL

SEQ ID NO: 47401 - protein, 9 aa, Homo Sapiens
RASSIAAPA

SEQ ID NO: 47402 - protein, 9 aa, Homo Sapiens
TLSPLRSSC

SEQ ID NO: 47403 - protein, 9 aa, Homo Sapiens
ILLLHIKSN

SEQ ID NO: 47404 - protein, 9 aa, Homo Sapiens
KDIAVLCHK

SEQ ID NO: 47405 - protein, 9 aa, Homo Sapiens
PEPLDKVTE

SEQ ID NO: 47406 - protein, 9 aa, Homo Sapiens
EEDKEEDLP

SEQ ID NO: 47407 - protein, 9 aa, Homo Sapiens
DTEPHFIIH

SEQ ID NO: 47408 - protein, 9 aa, Homo Sapiens
AARELRLGK

SEQ ID NO: 47409 - protein, 9 aa, Homo Sapiens
QGDGGVYSS

SEQ ID NO: 47410 - protein, 9 aa, Homo Sapiens
HDFPQFYPF

SEQ ID NO: 47411 - protein, 9 aa, Homo Sapiens
THDEESGQN

SEQ ID NO: 47412 - protein, 9 aa, Homo Sapiens
CPLSPPEIS

SEQ ID NO: 47413 - protein, 9 aa, Homo Sapiens
VTTETHRYS

SEQ ID NO: 47414 - protein, 9 aa, Homo Sapiens
IHALNNGLF

SEQ ID NO: 47415 - protein, 9 aa, Homo Sapiens
DAFPEESPG

SEQ ID NO: 47416 - protein, 9 aa, Homo Sapiens
VSIVQSCTP

SEQ ID NO: 47417 - protein, 9 aa, Homo Sapiens
QNRKRAPGI

SEQ ID NO: 47418 - protein, 9 aa, Homo Sapiens
RYWPKRCCR

SEQ ID NO: 47419 - protein, 9 aa, Homo Sapiens
NRVCSLQFD

SEQ ID NO: 47420 - protein, 9 aa, Homo Sapiens
YPGQANNSE

SEQ ID NO: 47421 - protein, 9 aa, Homo Sapiens
WSSSHPIFH

SEQ ID NO: 47422 - protein, 9 aa, Homo Sapiens
THRSKWSSS

SEQ ID NO: 47423 - protein, 9 aa, Homo Sapiens
CEVCHKSHT

SEQ ID NO: 47424 - protein, 9 aa, Homo Sapiens
DRANRLWAG

SEQ ID NO: 47425 - protein, 9 aa, Homo Sapiens
EFIECEHPV

SEQ ID NO: 47426 - protein, 9 aa, Homo Sapiens
HPSSRSPQI

SEQ ID NO: 47427 - protein, 9 aa, Homo Sapiens
KEERRRLEE

SEQ ID NO: 47428 - protein, 9 aa, Homo Sapiens
LEKAYAKMN

SEQ ID NO: 47429 - protein, 9 aa, Homo Sapiens
DKGSYEDAK

SEQ ID NO: 47430 - protein, 9 aa, Homo Sapiens
RVGCMQQAT

SEQ ID NO: 47431 - protein, 9 aa, Homo Sapiens
QELEQTRIA

SEQ ID NO: 47432 - protein, 9 aa, Homo Sapiens
SWESRLHRA

SEQ ID NO: 47433 - protein, 9 aa, Homo Sapiens
AQADSSSPT

SEQ ID NO: 47434 - protein, 9 aa, Homo Sapiens
AGGQNRKRA

SEQ ID NO: 47435 - protein, 9 aa, Homo Sapiens
ADVTKWRQC

SEQ ID NO: 47436 - protein, 9 aa, Homo Sapiens
MLDWGEGSL

SEQ ID NO: 47437 - protein, 9 aa, Homo Sapiens
DILELAYHG

SEQ ID NO: 47438 - protein, 9 aa, Homo Sapiens
SRQGDGGVY

SEQ ID NO: 47439 - protein, 9 aa, Homo Sapiens
GPLPWAPRP

SEQ ID NO: 47440 - protein, 9 aa, Homo Sapiens
RLKGRKRAS

SEQ ID NO: 47441 - protein, 9 aa, Homo Sapiens
PKTPRCPPE

SEQ ID NO: 47442 - protein, 9 aa, Homo Sapiens
FGGWMADAR

SEQ ID NO: 47443 - protein, 9 aa, Homo Sapiens
KVWTPSHPS

SEQ ID NO: 47444 - protein, 9 aa, Homo Sapiens
PSSNKSALI

SEQ ID NO: 47445 - protein, 9 aa, Homo Sapiens
VRTYTGERP

SEQ ID NO: 47446 - protein, 9 aa, Homo Sapiens
HQALLATRV

SEQ ID NO: 47447 - protein, 9 aa, Homo Sapiens
NKSKDDVVV

SEQ ID NO: 47448 - protein, 9 aa, Homo Sapiens
VIPPRTTMP

SEQ ID NO: 47449 - protein, 9 aa, Homo Sapiens
EEWGGHSAR

SEQ ID NO: 47450 - protein, 9 aa, Homo Sapiens
GYHIAPGSG

SEQ ID NO: 47451 - protein, 9 aa, Homo Sapiens
RWTFLFVIE

SEQ ID NO: 47452 - protein, 9 aa, Homo Sapiens
EDFEDMERS

SEQ ID NO: 47453 - protein, 9 aa, Homo Sapiens
PNGYHIAPG

SEQ ID NO: 47454 - protein, 9 aa, Homo Sapiens
QESPVIYVQ

SEQ ID NO: 47455 - protein, 9 aa, Homo Sapiens
APRFFVMLY

SEQ ID NO: 47456 - protein, 9 aa, Homo Sapiens
MLPGWTHTL

SEQ ID NO: 47457 - protein, 9 aa, Homo Sapiens
NEDAVALTC

SEQ ID NO: 47458 - protein, 9 aa, Homo Sapiens
FLACNPLMP

SEQ ID NO: 47459 - protein, 9 aa, Homo Sapiens
ALGPPDYDD

SEQ ID NO: 47460 - protein, 9 aa, Homo Sapiens
MQNLPFETR

SEQ ID NO: 47461 - protein, 9 aa, Homo Sapiens
RLRLQGGNP

SEQ ID NO: 47462 - protein, 9 aa, Homo Sapiens
FLGDRDVLS

SEQ ID NO: 47463 - protein, 9 aa, Homo Sapiens
HLPRALVRS

SEQ ID NO: 47464 - protein, 9 aa, Homo Sapiens
TAGNPTCPK

SEQ ID NO: 47465 - protein, 9 aa, Homo Sapiens
PQGHCHTGR

SEQ ID NO: 47466 - protein, 9 aa, Homo Sapiens
YKALLGEAG

SEQ ID NO: 47467 - protein, 9 aa, Homo Sapiens
LQGTGPSQS

SEQ ID NO: 47468 - protein, 9 aa, Homo Sapiens
HMQNLPFET

SEQ ID NO: 47469 - protein, 9 aa, Homo Sapiens
PDYDDDDDD

SEQ ID NO: 47470 - protein, 9 aa, Homo Sapiens
ASKLLHEDL

SEQ ID NO: 47471 - protein, 9 aa, Homo Sapiens
TGVDTEPHF

SEQ ID NO: 47472 - protein, 9 aa, Homo Sapiens
PDKVVIKYT

SEQ ID NO: 47473 - protein, 9 aa, Homo Sapiens
HVRQELLKF

SEQ ID NO: 47474 - protein, 9 aa, Homo Sapiens
ATEIILKTF

SEQ ID NO: 47475 - protein, 9 aa, Homo Sapiens
PPIARLSFS

SEQ ID NO: 47476 - protein, 9 aa, Homo Sapiens
HTLSPLRSS

SEQ ID NO: 47477 - protein, 9 aa, Homo Sapiens
TSRGLVAHM

SEQ ID NO: 47478 - protein, 9 aa, Homo Sapiens
SAPASPVTV

SEQ ID NO: 47479 - protein, 9 aa, Homo Sapiens
CSCVRRQKF

SEQ ID NO: 47480 - protein, 9 aa, Homo Sapiens
RNFSMSVSA

SEQ ID NO: 47481 - protein, 9 aa, Homo Sapiens
RWKILLNYL

SEQ ID NO: 47482 - protein, 9 aa, Homo Sapiens
VCMEDFEDM

SEQ ID NO: 47483 - protein, 9 aa, Homo Sapiens
TLLLEKCLQ

SEQ ID NO: 47484 - protein, 9 aa, Homo Sapiens
VAMSSWESR

SEQ ID NO: 47485 - protein, 9 aa, Homo Sapiens
YTGERPFQC

SEQ ID NO: 47486 - protein, 9 aa, Homo Sapiens
SDVDDNTKV

SEQ ID NO: 47487 - protein, 9 aa, Homo Sapiens
VVVAEVEIN

SEQ ID NO: 47488 - protein, 9 aa, Homo Sapiens
DVDTKPANQ

SEQ ID NO: 47489 - protein, 9 aa, Homo Sapiens
DGAFGFEVS

SEQ ID NO: 47490 - protein, 9 aa, Homo Sapiens
QLYSNIPGS

SEQ ID NO: 47491 - protein, 9 aa, Homo Sapiens
RREQEQEQA

SEQ ID NO: 47492 - protein, 9 aa, Homo Sapiens
ADCGLREEV

SEQ ID NO: 47493 - protein, 9 aa, Homo Sapiens
WWPTARTTP

SEQ ID NO: 47494 - protein, 9 aa, Homo Sapiens
PHAGGRTRD

SEQ ID NO: 47495 - protein, 9 aa, Homo Sapiens
NGRFKFLNL

SEQ ID NO: 47496 - protein, 9 aa, Homo Sapiens
EKSESSVCK

SEQ ID NO: 47497 - protein, 9 aa, Homo Sapiens
LWLQLGPQG

SEQ ID NO: 47498 - protein, 9 aa, Homo Sapiens
GDAFPEESP

SEQ ID NO: 47499 - protein, 9 aa, Homo Sapiens
RNQLGKNGD

SEQ ID NO: 47500 - protein, 9 aa, Homo Sapiens
SFDTPLETK

SEQ ID NO: 47501 - protein, 9 aa, Homo Sapiens
QWALAVASK

SEQ ID NO: 47502 - protein, 9 aa, Homo Sapiens
QAQELEQTR

SEQ ID NO: 47503 - protein, 9 aa, Homo Sapiens
ESRLHRAKC

SEQ ID NO: 47504 - protein, 9 aa, Homo Sapiens
TDDNMEILH

SEQ ID NO: 47505 - protein, 9 aa, Homo Sapiens
VFADVETYF

SEQ ID NO: 47506 - protein, 9 aa, Homo Sapiens
DGSRADVTK

SEQ ID NO: 47507 - protein, 9 aa, Homo Sapiens
WQTPEVALI

SEQ ID NO: 47508 - protein, 9 aa, Homo Sapiens
KRTDGVEYL

SEQ ID NO: 47509 - protein, 9 aa, Homo Sapiens
DLWSCGVIL

SEQ ID NO: 47510 - protein, 9 aa, Homo Sapiens
QAVLRRREQ

SEQ ID NO: 47511 - protein, 9 aa, Homo Sapiens
LKNEKSNLK

SEQ ID NO: 47512 - protein, 9 aa, Homo Sapiens
GRKADLWSC

SEQ ID NO: 47513 - protein, 9 aa, Homo Sapiens
VFENNPLAF

SEQ ID NO: 47514 - protein, 9 aa, Homo Sapiens
FCYALRLNF

SEQ ID NO: 47515 - protein, 9 aa, Homo Sapiens
GKGDGAFGF

SEQ ID NO: 47516 - protein, 9 aa, Homo Sapiens
SLKASLTSK

SEQ ID NO: 47517 - protein, 9 aa, Homo Sapiens
SNKSKDDVV

SEQ ID NO: 47518 - protein, 9 aa, Homo Sapiens
PKRCCRPGP

SEQ ID NO: 47519 - protein, 9 aa, Homo Sapiens
ALHCLLPAG

SEQ ID NO: 47520 - protein, 9 aa, Homo Sapiens
DGGHIGQQG

SEQ ID NO: 47521 - protein, 9 aa, Homo Sapiens
GRGAWSLCR

SEQ ID NO: 47522 - protein, 9 aa, Homo Sapiens
RRNPQMQYT

SEQ ID NO: 47523 - protein, 9 aa, Homo Sapiens
EIILKTFQI

SEQ ID NO: 47524 - protein, 9 aa, Homo Sapiens
EPPSEGSKP

SEQ ID NO: 47525 - protein, 9 aa, Homo Sapiens
STTGPQGAA

SEQ ID NO: 47526 - protein, 9 aa, Homo Sapiens
CLRLDKGSY

SEQ ID NO: 47527 - protein, 9 aa, Homo Sapiens
RVIPPRTTM

SEQ ID NO: 47528 - protein, 9 aa, Homo Sapiens
RLNKLTLSV

SEQ ID NO: 47529 - protein, 9 aa, Homo Sapiens
EIINFTSRG

SEQ ID NO: 47530 - protein, 9 aa, Homo Sapiens
DPQKVNITG

SEQ ID NO: 47531 - protein, 9 aa, Homo Sapiens
TWLSTECVS

SEQ ID NO: 47532 - protein, 9 aa, Homo Sapiens
GAGKTSTSH

SEQ ID NO: 47533 - protein, 9 aa, Homo Sapiens
ALVRSTTKT

SEQ ID NO: 47534 - protein, 9 aa, Homo Sapiens
VLKNEKSNL

SEQ ID NO: 47535 - protein, 9 aa, Homo Sapiens
QRNFSMSVS

SEQ ID NO: 47536 - protein, 9 aa, Homo Sapiens
TQDEEEDKE

SEQ ID NO: 47537 - protein, 9 aa, Homo Sapiens
RGAWSLCRL

SEQ ID NO: 47538 - protein, 9 aa, Homo Sapiens
AQPLEMLPG

SEQ ID NO: 47539 - protein, 9 aa, Homo Sapiens
ASFLSVVGA

SEQ ID NO: 47540 - protein, 9 aa, Homo Sapiens
ATGATHTGH

SEQ ID NO: 47541 - protein, 9 aa, Homo Sapiens
VQSIPEKLM

SEQ ID NO: 47542 - protein, 9 aa, Homo Sapiens
EEEDKEEDL

SEQ ID NO: 47543 - protein, 9 aa, Homo Sapiens
SECLPCDCS

SEQ ID NO: 47544 - protein, 9 aa, Homo Sapiens
LLLEKCLQE

SEQ ID NO: 47545 - protein, 9 aa, Homo Sapiens
SSSAASAST

SEQ ID NO: 47546 - protein, 9 aa, Homo Sapiens
PQMQYTLSP

SEQ ID NO: 47547 - protein, 9 aa, Homo Sapiens
NFSMSVSAA

SEQ ID NO: 47548 - protein, 9 aa, Homo Sapiens
IPAKAATAT

SEQ ID NO: 47549 - protein, 9 aa, Homo Sapiens
PGAAVWGQP

SEQ ID NO: 47550 - protein, 9 aa, Homo Sapiens
ISPEPLDKV

SEQ ID NO: 47551 - protein, 9 aa, Homo Sapiens
RALVRSTTK

SEQ ID NO: 47552 - protein, 9 aa, Homo Sapiens
QADSSSPTP

SEQ ID NO: 47553 - protein, 9 aa, Homo Sapiens
VTLAGDAFP

SEQ ID NO: 47554 - protein, 9 aa, Homo Sapiens
SDFGMSRQG

SEQ ID NO: 47555 - protein, 9 aa, Homo Sapiens
LEKSESSVC

SEQ ID NO: 47556 - protein, 9 aa, Homo Sapiens
KMSSIVDRY

SEQ ID NO: 47557 - protein, 9 aa, Homo Sapiens
KRCCRPGPG

SEQ ID NO: 47558 - protein, 9 aa, Homo Sapiens
PYHQKLAYH

SEQ ID NO: 47559 - protein, 9 aa, Homo Sapiens
QCCAPQHGI

SEQ ID NO: 47560 - protein, 9 aa, Homo Sapiens
PGAQPLEML

SEQ ID NO: 47561 - protein, 9 aa, Homo Sapiens
TIVCMEDFE

SEQ ID NO: 47562 - protein, 9 aa, Homo Sapiens
FENNPLAFE

SEQ ID NO: 47563 - protein, 9 aa, Homo Sapiens
PSPKDNIPA

SEQ ID NO: 47564 - protein, 9 aa, Homo Sapiens
VDKRTGNKH

SEQ ID NO: 47565 - protein, 9 aa, Homo Sapiens
GHSARSPRG

SEQ ID NO: 47566 - protein, 9 aa, Homo Sapiens
LYKPSPKDN

SEQ ID NO: 47567 - protein, 9 aa, Homo Sapiens
IKLSMKFQA

SEQ ID NO: 47568 - protein, 9 aa, Homo Sapiens
NDRANRLWA

SEQ ID NO: 47569 - protein, 9 aa, Homo Sapiens
GPLVLFCYA

SEQ ID NO: 47570 - protein, 9 aa, Homo Sapiens
EQKEERRRL

SEQ ID NO: 47571 - protein, 9 aa, Homo Sapiens
RFFVMLYHM

SEQ ID NO: 47572 - protein, 9 aa, Homo Sapiens
LFCYALRLN

SEQ ID NO: 47573 - protein, 9 aa, Homo Sapiens
LDNLHHVGP

SEQ ID NO: 47574 - protein, 9 aa, Homo Sapiens
HKDIAVLCH

SEQ ID NO: 47575 - protein, 9 aa, Homo Sapiens
VTGVDTEPH

SEQ ID NO: 47576 - protein, 9 aa, Homo Sapiens
SRADVTKWR

SEQ ID NO: 47577 - protein, 9 aa, Homo Sapiens
LEMLPGWTH

SEQ ID NO: 47578 - protein, 9 aa, Homo Sapiens
EDKEEDLPG

SEQ ID NO: 47579 - protein, 9 aa, Homo Sapiens
CMEDFEDME

SEQ ID NO: 47580 - protein, 9 aa, Homo Sapiens
QSYVGLCPR

SEQ ID NO: 47581 - protein, 9 aa, Homo Sapiens
FGDPLFPRT

SEQ ID NO: 47582 - protein, 9 aa, Homo Sapiens
KKFDKVWTP

SEQ ID NO: 47583 - protein, 9 aa, Homo Sapiens
EVNFREIPL

SEQ ID NO: 47584 - protein, 9 aa, Homo Sapiens
GLGCRDRHV

SEQ ID NO: 47585 - protein, 9 aa, Homo Sapiens
SSRSPQISG

SEQ ID NO: 47586 - protein, 9 aa, Homo Sapiens
ASLTSKKGL

SEQ ID NO: 47587 - protein, 9 aa, Homo Sapiens
GRKNRERIE

SEQ ID NO: 47588 - protein, 9 aa, Homo Sapiens
DEEEDKEED

SEQ ID NO: 47589 - protein, 9 aa, Homo Sapiens
DKVTESART

SEQ ID NO: 47590 - protein, 9 aa, Homo Sapiens
GTGPSQSCH

SEQ ID NO: 47591 - protein, 9 aa, Homo Sapiens
DVTKWRQCH

SEQ ID NO: 47592 - protein, 9 aa, Homo Sapiens
GDRDVLSAP

SEQ ID NO: 47593 - protein, 9 aa, Homo Sapiens
SPHAGGRTR

SEQ ID NO: 47594 - protein, 9 aa, Homo Sapiens
GPLALTVAD

SEQ ID NO: 47595 - protein, 9 aa, Homo Sapiens
PAKAATATS

SEQ ID NO: 47596 - protein, 9 aa, Homo Sapiens
VRVVHSWAL

SEQ ID NO: 47597 - protein, 9 aa, Homo Sapiens
ATHTGHSTF

SEQ ID NO: 47598 - protein, 9 aa, Homo Sapiens
DWGEGSLYQ

SEQ ID NO: 47599 - protein, 9 aa, Homo Sapiens
CCLRLDKGS

SEQ ID NO: 47600 - protein, 9 aa, Homo Sapiens
EQPEDLELL

SEQ ID NO: 47601 - protein, 9 aa, Homo Sapiens
IKSKFDSLD

SEQ ID NO: 47602 - protein, 9 aa, Homo Sapiens
LPWAPRPTT

SEQ ID NO: 47603 - protein, 9 aa, Homo Sapiens
HGDGGHIGQ

SEQ ID NO: 47604 - protein, 9 aa, Homo Sapiens
SGRSQECYF

SEQ ID NO: 47605 - protein, 9 aa, Homo Sapiens
LKTQAIKTA

SEQ ID NO: 47606 - protein, 9 aa, Homo Sapiens
EEGEARLKY

SEQ ID NO: 47607 - protein, 9 aa, Homo Sapiens
CLTEEQKTV

SEQ ID NO: 47608 - protein, 9 aa, Homo Sapiens
CVTTETHRY

SEQ ID NO: 47609 - protein, 9 aa, Homo Sapiens
CSGSLKASL

SEQ ID NO: 47610 - protein, 9 aa, Homo Sapiens
AADSPPPPR

SEQ ID NO: 47611 - protein, 9 aa, Homo Sapiens
PAPIKSKFD

SEQ ID NO: 47612 - protein, 9 aa, Homo Sapiens
RGCAGRPQR

SEQ ID NO: 47613 - protein, 9 aa, Homo Sapiens
LIEVFLVLV

SEQ ID NO: 47614 - protein, 9 aa, Homo Sapiens
RELRLGKEG

SEQ ID NO: 47615 - protein, 9 aa, Homo Sapiens
FRDAHQALL

SEQ ID NO: 47616 - protein, 9 aa, Homo Sapiens
WWKQLYSNI

SEQ ID NO: 47617 - protein, 9 aa, Homo Sapiens
PPEPDAFNP

SEQ ID NO: 47618 - protein, 9 aa, Homo Sapiens
CPRLEETET

SEQ ID NO: 47619 - protein, 9 aa, Homo Sapiens
PEESPGAAV

SEQ ID NO: 47620 - protein, 9 aa, Homo Sapiens
SFLWLQLGP

SEQ ID NO: 47621 - protein, 9 aa, Homo Sapiens
ATTASWWPT

SEQ ID NO: 47622 - protein, 9 aa, Homo Sapiens
GWTHTLSPL

SEQ ID NO: 47623 - protein, 9 aa, Homo Sapiens
VPTSQSLSD

SEQ ID NO: 47624 - protein, 9 aa, Homo Sapiens
RLGLVGGVA

SEQ ID NO: 47625 - protein, 9 aa, Homo Sapiens
RNPQMQYTL

SEQ ID NO: 47626 - protein, 9 aa, Homo Sapiens
SFSGRDENS

SEQ ID NO: 47627 - protein, 9 aa, Homo Sapiens
FPRTPGRPQ

SEQ ID NO: 47628 - protein, 9 aa, Homo Sapiens
GGLSVAGPG

SEQ ID NO: 47629 - protein, 9 aa, Homo Sapiens
DAHQALLAT

SEQ ID NO: 47630 - protein, 9 aa, Homo Sapiens
LAWEGVMME

SEQ ID NO: 47631 - protein, 9 aa, Homo Sapiens
MLRLKGRKR

SEQ ID NO: 47632 - protein, 9 aa, Homo Sapiens
RHKLCSPYP

SEQ ID NO: 47633 - protein, 9 aa, Homo Sapiens
KPEPEPSSS

SEQ ID NO: 47634 - protein, 9 aa, Homo Sapiens
GRPQRGPGT

SEQ ID NO: 47635 - protein, 9 aa, Homo Sapiens
KRWNPTQNV

SEQ ID NO: 47636 - protein, 9 aa, Homo Sapiens
GLCPRLEET

SEQ ID NO: 47637 - protein, 9 aa, Homo Sapiens
ATSVLKNEK

SEQ ID NO: 47638 - protein, 9 aa, Homo Sapiens
AGVWGFPRT

SEQ ID NO: 47639 - protein, 9 aa, Homo Sapiens
EDERKQWAL

SEQ ID NO: 47640 - protein, 9 aa, Homo Sapiens
KPLQDLQLD

SEQ ID NO: 47641 - protein, 9 aa, Homo Sapiens
PTARTTPTS

SEQ ID NO: 47642 - protein, 9 aa, Homo Sapiens
ECLPCDCSG

SEQ ID NO: 47643 - protein, 9 aa, Homo Sapiens
GKEVISSFD

SEQ ID NO: 47644 - protein, 9 aa, Homo Sapiens
LWAPRFFVM

SEQ ID NO: 47645 - protein, 9 aa, Homo Sapiens
LDKGSYEDA

SEQ ID NO: 47646 - protein, 9 aa, Homo Sapiens
HTGHSTFQN

SEQ ID NO: 47647 - protein, 9 aa, Homo Sapiens
VNFREIPLH

SEQ ID NO: 47648 - protein, 9 aa, Homo Sapiens
SHTQFSNLC

SEQ ID NO: 47649 - protein, 9 aa, Homo Sapiens
VRERVGCMQ

SEQ ID NO: 47650 - protein, 9 aa, Homo Sapiens
YENFVRCIA

SEQ ID NO: 47651 - protein, 9 aa, Homo Sapiens
LELAYHGDT

SEQ ID NO: 47652 - protein, 9 aa, Homo Sapiens
TKWRQCHLA

SEQ ID NO: 47653 - protein, 9 aa, Homo Sapiens
HSKMQEAQE

SEQ ID NO: 47654 - protein, 9 aa, Homo Sapiens
DWEKELIRQ

SEQ ID NO: 47655 - protein, 9 aa, Homo Sapiens
IECEHPVDH

SEQ ID NO: 47656 - protein, 9 aa, Homo Sapiens
YIHALNNGL

SEQ ID NO: 47657 - protein, 9 aa, Homo Sapiens
MEDFEDMER

SEQ ID NO: 47658 - protein, 9 aa, Homo Sapiens
ALYPFRREQ

SEQ ID NO: 47659 - protein, 9 aa, Homo Sapiens
VETYFRTCH

SEQ ID NO: 47660 - protein, 9 aa, Homo Sapiens
LGPQGQIHP

SEQ ID NO: 47661 - protein, 9 aa, Homo Sapiens
VQDDPRLIH

SEQ ID NO: 47662 - protein, 9 aa, Homo Sapiens
LLRFHSREA

SEQ ID NO: 47663 - protein, 9 aa, Homo Sapiens
DFDPAPIKS

SEQ ID NO: 47664 - protein, 9 aa, Homo Sapiens
SFAKTPSSN

SEQ ID NO: 47665 - protein, 9 aa, Homo Sapiens
LHEDLALQW

SEQ ID NO: 47666 - protein, 9 aa, Homo Sapiens
ISIVEKLIK

SEQ ID NO: 47667 - protein, 9 aa, Homo Sapiens
WHWPEDSYP

SEQ ID NO: 47668 - protein, 9 aa, Homo Sapiens
KDDFEVFFF

SEQ ID NO: 47669 - protein, 9 aa, Homo Sapiens
LQGHTNRVC

SEQ ID NO: 47670 - protein, 9 aa, Homo Sapiens
PQKVNITGG

SEQ ID NO: 47671 - protein, 9 aa, Homo Sapiens
PQPFTTMQH

SEQ ID NO: 47672 - protein, 9 aa, Homo Sapiens
PLSPPEISA

SEQ ID NO: 47673 - protein, 9 aa, Homo Sapiens
WGGHSARSP

SEQ ID NO: 47674 - protein, 9 aa, Homo Sapiens
RPRCWAGAA

SEQ ID NO: 47675 - protein, 9 aa, Homo Sapiens
TYTGERPFQ

SEQ ID NO: 47676 - protein, 9 aa, Homo Sapiens
QGHTNRVCS

SEQ ID NO: 47677 - protein, 9 aa, Homo Sapiens
GEADCGLRE

SEQ ID NO: 47678 - protein, 9 aa, Homo Sapiens
SHGDGGHIG

SEQ ID NO: 47679 - protein, 9 aa, Homo Sapiens
THRYSGETC

SEQ ID NO: 47680 - protein, 9 aa, Homo Sapiens
TGLVLNRDK

SEQ ID NO: 47681 - protein, 9 aa, Homo Sapiens
PYPGQANNS

SEQ ID NO: 47682 - protein, 9 aa, Homo Sapiens
SGQNPMLKH

SEQ ID NO: 47683 - protein, 9 aa, Homo Sapiens
LRFHSREAI

SEQ ID NO: 47684 - protein, 9 aa, Homo Sapiens
YVGLCPRLE

SEQ ID NO: 47685 - protein, 9 aa, Homo Sapiens
DRDVLSAPA

SEQ ID NO: 47686 - protein, 9 aa, Homo Sapiens
LYPFRREQP

SEQ ID NO: 47687 - protein, 9 aa, Homo Sapiens
KLGAGKGDG

SEQ ID NO: 47688 - protein, 9 aa, Homo Sapiens
GVMMENYLV

SEQ ID NO: 47689 - protein, 9 aa, Homo Sapiens
RRHKLCSPY

SEQ ID NO: 47690 - protein, 9 aa, Homo Sapiens
PGTQCCAPQ

SEQ ID NO: 47691 - protein, 9 aa, Homo Sapiens
EVYENFVRC

SEQ ID NO: 47692 - protein, 9 aa, Homo Sapiens
VALIDSHKL

SEQ ID NO: 47693 - protein, 9 aa, Homo Sapiens
KTPRCPPEP

SEQ ID NO: 47694 - protein, 9 aa, Homo Sapiens
EQTRIATEE

SEQ ID NO: 47695 - protein, 9 aa, Homo Sapiens
LPLSVAPRD

SEQ ID NO: 47696 - protein, 9 aa, Homo Sapiens
FPGERICEV

SEQ ID NO: 47697 - protein, 9 aa, Homo Sapiens
KDDVVVAEV

SEQ ID NO: 47698 - protein, 9 aa, Homo Sapiens
IAPGSGDNT

SEQ ID NO: 47699 - protein, 9 aa, Homo Sapiens
HAGGRTRDR

SEQ ID NO: 47700 - protein, 9 aa, Homo Sapiens
LEKMRDELR

SEQ ID NO: 47701 - protein, 9 aa, Homo Sapiens
RKAMLDWGE

SEQ ID NO: 47702 - protein, 9 aa, Homo Sapiens
LEDRQKFEM

SEQ ID NO: 47703 - protein, 9 aa, Homo Sapiens
IESSEESAP

SEQ ID NO: 47704 - protein, 9 aa, Homo Sapiens
HPQGHCHTG

SEQ ID NO: 47705 - protein, 9 aa, Homo Sapiens
HFLGMESLW

SEQ ID NO: 47706 - protein, 9 aa, Homo Sapiens
FLNLWNKFL

SEQ ID NO: 47707 - protein, 9 aa, Homo Sapiens
AQICPSAAP

SEQ ID NO: 47708 - protein, 9 aa, Homo Sapiens
RLQGGNPHG

SEQ ID NO: 47709 - protein, 9 aa, Homo Sapiens
YVDKRTGNK

SEQ ID NO: 47710 - protein, 9 aa, Homo Sapiens
MVLQSTMVC

SEQ ID NO: 47711 - protein, 9 aa, Homo Sapiens
VLPQFVDKI

SEQ ID NO: 47712 - protein, 9 aa, Homo Sapiens
TRPNQEGIH

SEQ ID NO: 47713 - protein, 9 aa, Homo Sapiens
KPANQNLSQ

SEQ ID NO: 47714 - protein, 9 aa, Homo Sapiens
LEKPLQDLQ

SEQ ID NO: 47715 - protein, 9 aa, Homo Sapiens
LEEILDKVQ

SEQ ID NO: 47716 - protein, 9 aa, Homo Sapiens
GMSRQGDGG

SEQ ID NO: 47717 - protein, 9 aa, Homo Sapiens
KAYAKMNGC

SEQ ID NO: 47718 - protein, 9 aa, Homo Sapiens
IYVQTLQDP

SEQ ID NO: 47719 - protein, 9 aa, Homo Sapiens
SVAGPGAPL

SEQ ID NO: 47720 - protein, 9 aa, Homo Sapiens
MSSIVDRYD

SEQ ID NO: 47721 - protein, 9 aa, Homo Sapiens
EERRRLEEQ

SEQ ID NO: 47722 - protein, 9 aa, Homo Sapiens
DMYKALLGE

SEQ ID NO: 47723 - protein, 9 aa, Homo Sapiens
GILHRRAHC

SEQ ID NO: 47724 - protein, 9 aa, Homo Sapiens
TNRVCSLQF

SEQ ID NO: 47725 - protein, 9 aa, Homo Sapiens
SLCRLLVAL

SEQ ID NO: 47726 - protein, 9 aa, Homo Sapiens
EALKRRLKE

SEQ ID NO: 47727 - protein, 9 aa, Homo Sapiens
RYDSSIFDG

SEQ ID NO: 47728 - protein, 9 aa, Homo Sapiens
NQNLSQKAD

SEQ ID NO: 47729 - protein, 9 aa, Homo Sapiens
HLSIPAVFF

SEQ ID NO: 47730 - protein, 9 aa, Homo Sapiens
ATHGRFLKI

SEQ ID NO: 47731 - protein, 9 aa, Homo Sapiens
RCPPEPDAF

SEQ ID NO: 47732 - protein, 9 aa, Homo Sapiens
LPDKVVIKY

SEQ ID NO: 47733 - protein, 9 aa, Homo Sapiens
VRSAWPSLE

SEQ ID NO: 47734 - protein, 9 aa, Homo Sapiens
ARLSFSGRD

SEQ ID NO: 47735 - protein, 9 aa, Homo Sapiens
LTTLAACSC

SEQ ID NO: 47736 - protein, 9 aa, Homo Sapiens
TLAWEGVMM

SEQ ID NO: 47737 - protein, 9 aa, Homo Sapiens
VEGACLTEE

SEQ ID NO: 47738 - protein, 9 aa, Homo Sapiens
APQHGILPS

SEQ ID NO: 47739 - protein, 9 aa, Homo Sapiens
TGAAVSTQP

SEQ ID NO: 47740 - protein, 9 aa, Homo Sapiens
LKQAQELEQ

SEQ ID NO: 47741 - protein, 9 aa, Homo Sapiens
RCLRWKILL

SEQ ID NO: 47742 - protein, 9 aa, Homo Sapiens
CAGRPQRGP

SEQ ID NO: 47743 - protein, 9 aa, Homo Sapiens
VIEELLFAF

SEQ ID NO: 47744 - protein, 9 aa, Homo Sapiens
VILLLHIKS

SEQ ID NO: 47745 - protein, 9 aa, Homo Sapiens
NNSNPVENE

SEQ ID NO: 47746 - protein, 9 aa, Homo Sapiens
STHDEESGQ

SEQ ID NO: 47747 - protein, 9 aa, Homo Sapiens
KGAGSSCPL

SEQ ID NO: 47748 - protein, 9 aa, Homo Sapiens
ILHKDTNMP

SEQ ID NO: 47749 - protein, 9 aa, Homo Sapiens
KVTESARTQ

SEQ ID NO: 47750 - protein, 9 aa, Homo Sapiens
YPDPIIKRE

SEQ ID NO: 47751 - protein, 9 aa, Homo Sapiens
KRIEEQKEE

SEQ ID NO: 47752 - protein, 9 aa, Homo Sapiens
TFLFVIEEL

SEQ ID NO: 47753 - protein, 9 aa, Homo Sapiens
DKVVIKYTK

SEQ ID NO: 47754 - protein, 9 aa, Homo Sapiens
LVRSTTKTS

SEQ ID NO: 47755 - protein, 9 aa, Homo Sapiens
RGAFTSVSM

SEQ ID NO: 47756 - protein, 9 aa, Homo Sapiens
WWRASSIAA

SEQ ID NO: 47757 - protein, 9 aa, Homo Sapiens
PTKIRALVA

SEQ ID NO: 47758 - protein, 9 aa, Homo Sapiens
VRRRNPQMQ

SEQ ID NO: 47759 - protein, 9 aa, Homo Sapiens
AWEGVMMEN

SEQ ID NO: 47760 - protein, 9 aa, Homo Sapiens
GHPQGHCHT

SEQ ID NO: 47761 - protein, 9 aa, Homo Sapiens
RDVLSAPAS

SEQ ID NO: 47762 - protein, 9 aa, Homo Sapiens
ESPVIYVQT

SEQ ID NO: 47763 - protein, 9 aa, Homo Sapiens
GKTSTSHGD

SEQ ID NO: 47764 - protein, 9 aa, Homo Sapiens
AGGVFEEDS

SEQ ID NO: 47765 - protein, 9 aa, Homo Sapiens
FSQESEVSK

SEQ ID NO: 47766 - protein, 9 aa, Homo Sapiens
WLSTECVSH

SEQ ID NO: 47767 - protein, 9 aa, Homo Sapiens
FQVLPQFVD

SEQ ID NO: 47768 - protein, 9 aa, Homo Sapiens
SPNGYHIAP

SEQ ID NO: 47769 - protein, 9 aa, Homo Sapiens
AGPLALTVA

SEQ ID NO: 47770 - protein, 9 aa, Homo Sapiens
AVECEKPDA

SEQ ID NO: 47771 - protein, 9 aa, Homo Sapiens
LRRREQEQE

SEQ ID NO: 47772 - protein, 9 aa, Homo Sapiens
LRSSCYWSK

SEQ ID NO: 47773 - protein, 9 aa, Homo Sapiens
TGATHTGHS

SEQ ID NO: 47774 - protein, 9 aa, Homo Sapiens
QEQQQQQPG

SEQ ID NO: 47775 - protein, 9 aa, Homo Sapiens
ASMAAWRWD

SEQ ID NO: 47776 - protein, 9 aa, Homo Sapiens
GEARLKYEK

SEQ ID NO: 47777 - protein, 9 aa, Homo Sapiens
NLTATLLLE

SEQ ID NO: 47778 - protein, 9 aa, Homo Sapiens
EQQQQQPGF

SEQ ID NO: 47779 - protein, 9 aa, Homo Sapiens
AGKTSTSHG

SEQ ID NO: 47780 - protein, 9 aa, Homo Sapiens
GSYHCTCPD

SEQ ID NO: 47781 - protein, 9 aa, Homo Sapiens
SRSPQISGG

SEQ ID NO: 47782 - protein, 9 aa, Homo Sapiens
CQKHAVECE

SEQ ID NO: 47783 - protein, 9 aa, Homo Sapiens
PDPTSMWPP

SEQ ID NO: 47784 - protein, 9 aa, Homo Sapiens
SKGIEPPSE

SEQ ID NO: 47785 - protein, 9 aa, Homo Sapiens
VISSFDTPL

SEQ ID NO: 47786 - protein, 9 aa, Homo Sapiens
KLLKTFLKT

SEQ ID NO: 47787 - protein, 9 aa, Homo Sapiens
KGSYEDAKA

SEQ ID NO: 47788 - protein, 9 aa, Homo Sapiens
EGQIKFSTG

SEQ ID NO: 47789 - protein, 9 aa, Homo Sapiens
FTSVSMSGG

SEQ ID NO: 47790 - protein, 9 aa, Homo Sapiens
VFFFTIGIT

SEQ ID NO: 47791 - protein, 9 aa, Homo Sapiens
LWSCGVILF

SEQ ID NO: 47792 - protein, 9 aa, Homo Sapiens
RVIHVLNVE

SEQ ID NO: 47793 - protein, 9 aa, Homo Sapiens
SPGAAVWGQ

SEQ ID NO: 47794 - protein, 9 aa, Homo Sapiens
ECEHPVDHV

SEQ ID NO: 47795 - protein, 9 aa, Homo Sapiens
GAGYIKDSV

SEQ ID NO: 47796 - protein, 9 aa, Homo Sapiens
NFREIPLHV

SEQ ID NO: 47797 - protein, 9 aa, Homo Sapiens
HDRWTFLFV

SEQ ID NO: 47798 - protein, 9 aa, Homo Sapiens
RIESSEESA

SEQ ID NO: 47799 - protein, 9 aa, Homo Sapiens
TMQHTTMPH

SEQ ID NO: 47800 - protein, 9 aa, Homo Sapiens
IRALVADFS

SEQ ID NO: 47801 - protein, 9 aa, Homo Sapiens
SVRERVGCM

SEQ ID NO: 47802 - protein, 9 aa, Homo Sapiens
LLFSSFLWL

SEQ ID NO: 47803 - protein, 9 aa, Homo Sapiens
DDVVVAEVE

SEQ ID NO: 47804 - protein, 9 aa, Homo Sapiens
ASASTTGPQ

SEQ ID NO: 47805 - protein, 9 aa, Homo Sapiens
TLDFLQGCN

SEQ ID NO: 47806 - protein, 9 aa, Homo Sapiens
GQQGRGCAG

SEQ ID NO: 47807 - protein, 9 aa, Homo Sapiens
KSESSVCKE

SEQ ID NO: 47808 - protein, 9 aa, Homo Sapiens
PPVLHPNLA

SEQ ID NO: 47809 - protein, 9 aa, Homo Sapiens
NVFENNPLA

SEQ ID NO: 47810 - protein, 9 aa, Homo Sapiens
LDFLQGCNE

SEQ ID NO: 47811 - protein, 9 aa, Homo Sapiens
TIIECLDYP

SEQ ID NO: 47812 - protein, 9 aa, Homo Sapiens
LDWGEGSLY

SEQ ID NO: 47813 - protein, 9 aa, Homo Sapiens
TECVSHPLP

SEQ ID NO: 47814 - protein, 9 aa, Homo Sapiens
PRTTMPYFL

SEQ ID NO: 47815 - protein, 9 aa, Homo Sapiens
RSAWPSLEL

SEQ ID NO: 47816 - protein, 9 aa, Homo Sapiens
GDLLPGRLG

SEQ ID NO: 47817 - protein, 9 aa, Homo Sapiens
VGRKNRERI

SEQ ID NO: 47818 - protein, 9 aa, Homo Sapiens
QKHAVECEK

SEQ ID NO: 47819 - protein, 9 aa, Homo Sapiens
AMSSWESRL

SEQ ID NO: 47820 - protein, 9 aa, Homo Sapiens
VLHPNLAEL

SEQ ID NO: 47821 - protein, 9 aa, Homo Sapiens
LARLDLPAR

SEQ ID NO: 47822 - protein, 9 aa, Homo Sapiens
LNGRFKFLN

SEQ ID NO: 47823 - protein, 9 aa, Homo Sapiens
AMLDWGEGS

SEQ ID NO: 47824 - protein, 9 aa, Homo Sapiens
DEILEKSES

SEQ ID NO: 47825 - protein, 9 aa, Homo Sapiens
FNRTHRSKW

SEQ ID NO: 47826 - protein, 9 aa, Homo Sapiens
IEVFLVLVQ

SEQ ID NO: 47827 - protein, 9 aa, Homo Sapiens
SHTLLRFHS

SEQ ID NO: 47828 - protein, 9 aa, Homo Sapiens
VRIGRYRSI

SEQ ID NO: 47829 - protein, 9 aa, Homo Sapiens
DSPPPPRSR

SEQ ID NO: 47830 - protein, 9 aa, Homo Sapiens
TATLLLEKC

SEQ ID NO: 47831 - protein, 9 aa, Homo Sapiens
PVENEDAVA

SEQ ID NO: 47832 - protein, 9 aa, Homo Sapiens
RDAHQALLA

SEQ ID NO: 47833 - protein, 9 aa, Homo Sapiens
NRERIESSE

SEQ ID NO: 47834 - protein, 9 aa, Homo Sapiens
IYPAVEGQI

SEQ ID NO: 47835 - protein, 9 aa, Homo Sapiens
TWGKEVISS

SEQ ID NO: 47836 - protein, 9 aa, Homo Sapiens
RYSGETCNQ

SEQ ID NO: 47837 - protein, 9 aa, Homo Sapiens
MYRLWGAGY

SEQ ID NO: 47838 - protein, 9 aa, Homo Sapiens
ELEQTRIAT

SEQ ID NO: 47839 - protein, 9 aa, Homo Sapiens
QIKFSTGSH

SEQ ID NO: 47840 - protein, 9 aa, Homo Sapiens
TSQSLSDMQ

SEQ ID NO: 47841 - protein, 9 aa, Homo Sapiens
GLRCLRWKI

SEQ ID NO: 47842 - protein, 9 aa, Homo Sapiens
LASMAAWRW

SEQ ID NO: 47843 - protein, 9 aa, Homo Sapiens
SQEVYENFV

SEQ ID NO: 47844 - protein, 9 aa, Homo Sapiens
VAGGQNRKR

SEQ ID NO: 47845 - protein, 9 aa, Homo Sapiens
LDLPARPWP

SEQ ID NO: 47846 - protein, 9 aa, Homo Sapiens
TTETHRYSG

SEQ ID NO: 47847 - protein, 9 aa, Homo Sapiens
LPGSYHCTC

SEQ ID NO: 47848 - protein, 9 aa, Homo Sapiens
IDPQKVNIT

SEQ ID NO: 47849 - protein, 9 aa, Homo Sapiens
LPSPAIPRR

SEQ ID NO: 47850 - protein, 9 aa, Homo Sapiens
YEPQNLSIR

SEQ ID NO: 47851 - protein, 9 aa, Homo Sapiens
LAFGLPGRR

SEQ ID NO: 47852 - protein, 9 aa, Homo Sapiens
PLDKVTESA

SEQ ID NO: 47853 - protein, 9 aa, Homo Sapiens
AGAADSPPP

SEQ ID NO: 47854 - protein, 9 aa, Homo Sapiens
QSEENKENL

SEQ ID NO: 47855 - protein, 9 aa, Homo Sapiens
SAWPSLELD

SEQ ID NO: 47856 - protein, 9 aa, Homo Sapiens
AKHLSIPAV

SEQ ID NO: 47857 - protein, 9 aa, Homo Sapiens
QGQIHPDPT

SEQ ID NO: 47858 - protein, 9 aa, Homo Sapiens
KTQAIKTAF

SEQ ID NO: 47859 - protein, 9 aa, Homo Sapiens
GNTAVAEEK

SEQ ID NO: 47860 - protein, 9 aa, Homo Sapiens
FINGYEPQN

SEQ ID NO: 47861 - protein, 9 aa, Homo Sapiens
GCAGRPQRG

SEQ ID NO: 47862 - protein, 9 aa, Homo Sapiens
MTFPGERIC

SEQ ID NO: 47863 - protein, 9 aa, Homo Sapiens
DTNMPMDMR

SEQ ID NO: 47864 - protein, 9 aa, Homo Sapiens
AKMNGCYEA

SEQ ID NO: 47865 - protein, 9 aa, Homo Sapiens
VEGQIKFST

SEQ ID NO: 47866 - protein, 9 aa, Homo Sapiens
HRRGISIVE

SEQ ID NO: 47867 - protein, 9 aa, Homo Sapiens
NLWNKFLLE

SEQ ID NO: 47868 - protein, 9 aa, Homo Sapiens
GAFTSVSMS

SEQ ID NO: 47869 - protein, 9 aa, Homo Sapiens
EIAGNTAVA

SEQ ID NO: 47870 - protein, 9 aa, Homo Sapiens
AMYRLWGAG

SEQ ID NO: 47871 - protein, 9 aa, Homo Sapiens
AKQSEENKE

SEQ ID NO: 47872 - protein, 9 aa, Homo Sapiens
LPKTPRCPP

SEQ ID NO: 47873 - protein, 9 aa, Homo Sapiens
LCGHPQGHC

SEQ ID NO: 47874 - protein, 9 aa, Homo Sapiens
NRMELGGRP

SEQ ID NO: 47875 - protein, 9 aa, Homo Sapiens
GSHWPPGAT

SEQ ID NO: 47876 - protein, 9 aa, Homo Sapiens
VWGFPRTPG

SEQ ID NO: 47877 - protein, 9 aa, Homo Sapiens
KLTLSVSSH

SEQ ID NO: 47878 - protein, 9 aa, Homo Sapiens
LTSKKGLAP

SEQ ID NO: 47879 - protein, 9 aa, Homo Sapiens
FSLLQAPGM

SEQ ID NO: 47880 - protein, 9 aa, Homo Sapiens
RRAHCGGLG

SEQ ID NO: 47881 - protein, 9 aa, Homo Sapiens
IETAGNPTC

SEQ ID NO: 47882 - protein, 9 aa, Homo Sapiens
CTFTVEGAC

SEQ ID NO: 47883 - protein, 9 aa, Homo Sapiens
GDPLFPRTT

SEQ ID NO: 47884 - protein, 9 aa, Homo Sapiens
GAAVSTQPG

SEQ ID NO: 47885 - protein, 9 aa, Homo Sapiens
SPFGGWMAD

SEQ ID NO: 47886 - protein, 9 aa, Homo Sapiens
FSSFLWLQL

SEQ ID NO: 47887 - protein, 9 aa, Homo Sapiens
AERLAAREL

SEQ ID NO: 47888 - protein, 9 aa, Homo Sapiens
GAADSPPPP

SEQ ID NO: 47889 - protein, 9 aa, Homo Sapiens
KVVNFDWDS

SEQ ID NO: 47890 - protein, 9 aa, Homo Sapiens
NQEGIHVRQ

SEQ ID NO: 47891 - protein, 9 aa, Homo Sapiens
GLHIPRLIE

SEQ ID NO: 47892 - protein, 9 aa, Homo Sapiens
SNVILLLHI

SEQ ID NO: 47893 - protein, 9 aa, Homo Sapiens
SMHPITRKE

SEQ ID NO: 47894 - protein, 9 aa, Homo Sapiens
SPQISGGRK

SEQ ID NO: 47895 - protein, 9 aa, Homo Sapiens
SSSALARLD

SEQ ID NO: 47896 - protein, 9 aa, Homo Sapiens
LKGRKRAST

SEQ ID NO: 47897 - protein, 9 aa, Homo Sapiens
EKMRDELRA

SEQ ID NO: 47898 - protein, 9 aa, Homo Sapiens
RLAGPLALT

SEQ ID NO: 47899 - protein, 9 aa, Homo Sapiens
LVLFCYALR

SEQ ID NO: 47900 - protein, 9 aa, Homo Sapiens
CLPKTPRCP

SEQ ID NO: 47901 - protein, 9 aa, Homo Sapiens
LEQTRIATE

SEQ ID NO: 47902 - protein, 9 aa, Homo Sapiens
FLAARNLIQ

SEQ ID NO: 47903 - protein, 9 aa, Homo Sapiens
VEKLIKTCP

SEQ ID NO: 47904 - protein, 9 aa, Homo Sapiens
EVISSFDTP

SEQ ID NO: 47905 - protein, 9 aa, Homo Sapiens
LASASRDRV

SEQ ID NO: 47906 - protein, 9 aa, Homo Sapiens
KYDGRKADL

SEQ ID NO: 47907 - protein, 9 aa, Homo Sapiens
SCYWSKRML

SEQ ID NO: 47908 - protein, 9 aa, Homo Sapiens
VGFFLAARN

SEQ ID NO: 47909 - protein, 9 aa, Homo Sapiens
RLDLPARPW

SEQ ID NO: 47910 - protein, 9 aa, Homo Sapiens
ICPSAAPAA

SEQ ID NO: 47911 - protein, 9 aa, Homo Sapiens
LAARELRLG

SEQ ID NO: 47912 - protein, 9 aa, Homo Sapiens
VALHCLLPA

SEQ ID NO: 47913 - protein, 9 aa, Homo Sapiens
SQSLSDMQD

SEQ ID NO: 47914 - protein, 9 aa, Homo Sapiens
RLDKGSYED

SEQ ID NO: 47915 - protein, 9 aa, Homo Sapiens
SVRIGRYRS

SEQ ID NO: 47916 - protein, 9 aa, Homo Sapiens
PFTTMQHTT

SEQ ID NO: 47917 - protein, 9 aa, Homo Sapiens
FSGRDENSV

SEQ ID NO: 47918 - protein, 9 aa, Homo Sapiens
FTIGEAFQV

SEQ ID NO: 47919 - protein, 9 aa, Homo Sapiens
PGWTHTLSP

SEQ ID NO: 47920 - protein, 9 aa, Homo Sapiens
TLSVSSHIL

SEQ ID NO: 47921 - protein, 9 aa, Homo Sapiens
FVLYKPSPK

SEQ ID NO: 47922 - protein, 9 aa, Homo Sapiens
PGATTASWW

SEQ ID NO: 47923 - protein, 9 aa, Homo Sapiens
NLKDDFEVF

SEQ ID NO: 47924 - protein, 9 aa, Homo Sapiens
ARLASMAAW

SEQ ID NO: 47925 - protein, 9 aa, Homo Sapiens
IVDRYDSSI

SEQ ID NO: 47926 - protein, 9 aa, Homo Sapiens
FTVEGACLT

SEQ ID NO: 47927 - protein, 9 aa, Homo Sapiens
YRLWGAGYI

SEQ ID NO: 47928 - protein, 9 aa, Homo Sapiens
LKRRLKEYL

SEQ ID NO: 47929 - protein, 9 aa, Homo Sapiens
GDRQLGDWE

SEQ ID NO: 47930 - protein, 9 aa, Homo Sapiens
SGSLKASLT

SEQ ID NO: 47931 - protein, 9 aa, Homo Sapiens
VIYPAVEGQ

SEQ ID NO: 47932 - protein, 9 aa, Homo Sapiens
SSWESRLHR

SEQ ID NO: 47933 - protein, 9 aa, Homo Sapiens
VDTEPHFII

SEQ ID NO: 47934 - protein, 9 aa, Homo Sapiens
YSNIPGSSF

SEQ ID NO: 47935 - protein, 9 aa, Homo Sapiens
TQPGPLPTT

SEQ ID NO: 47936 - protein, 9 aa, Homo Sapiens
IPGSSFSST

SEQ ID NO: 47937 - protein, 9 aa, Homo Sapiens
FGMSRQGDG

SEQ ID NO: 47938 - protein, 9 aa, Homo Sapiens
CRLLVALHC

SEQ ID NO: 47939 - protein, 9 aa, Homo Sapiens
DPPIARLSF

SEQ ID NO: 47940 - protein, 9 aa, Homo Sapiens
DEKEPGAQK

SEQ ID NO: 47941 - protein, 9 aa, Homo Sapiens
KLSMKFQAL

SEQ ID NO: 47942 - protein, 9 aa, Homo Sapiens
QSLSDMQDH

SEQ ID NO: 47943 - protein, 9 aa, Homo Sapiens
LASKLLHED

SEQ ID NO: 47944 - protein, 9 aa, Homo Sapiens
GLREEVAGG

SEQ ID NO: 47945 - protein, 9 aa, Homo Sapiens
MDEKEPGAQ

SEQ ID NO: 47946 - protein, 9 aa, Homo Sapiens
IVKYSNVIL

SEQ ID NO: 47947 - protein, 9 aa, Homo Sapiens
PQSGELPSK

SEQ ID NO: 47948 - protein, 9 aa, Homo Sapiens
REEIINFTS

SEQ ID NO: 47949 - protein, 9 aa, Homo Sapiens
AVLAKHLSI

SEQ ID NO: 47950 - protein, 9 aa, Homo Sapiens
FHKDIAVLC

SEQ ID NO: 47951 - protein, 9 aa, Homo Sapiens
GPSVSIVQS

SEQ ID NO: 47952 - protein, 9 aa, Homo Sapiens
STQPGPLPT

SEQ ID NO: 47953 - protein, 9 aa, Homo Sapiens
HCGGLGCRD

SEQ ID NO: 47954 - protein, 9 aa, Homo Sapiens
EERRLKEEG

SEQ ID NO: 47955 - protein, 9 aa, Homo Sapiens
VDDNTKVVN

SEQ ID NO: 47956 - protein, 9 aa, Homo Sapiens
AAPAACLPL

SEQ ID NO: 47957 - protein, 9 aa, Homo Sapiens
YFPTKIRAL

SEQ ID NO: 47958 - protein, 9 aa, Homo Sapiens
IARLSFSGR

SEQ ID NO: 47959 - protein, 9 aa, Homo Sapiens
GRTRDRAYK

SEQ ID NO: 47960 - protein, 9 aa, Homo Sapiens
RKEASTSMT

SEQ ID NO: 47961 - protein, 9 aa, Homo Sapiens
RTGNKHDLE

SEQ ID NO: 47962 - protein, 9 aa, Homo Sapiens
QGWQTPEVA

SEQ ID NO: 47963 - protein, 9 aa, Homo Sapiens
LDKVTESAR

SEQ ID NO: 47964 - protein, 9 aa, Homo Sapiens
FREIPLHVL

SEQ ID NO: 47965 - protein, 9 aa, Homo Sapiens
MYKALLGEA

SEQ ID NO: 47966 - protein, 9 aa, Homo Sapiens
LSVMSKDTK

SEQ ID NO: 47967 - protein, 9 aa, Homo Sapiens
KGDGAFGFE

SEQ ID NO: 47968 - protein, 9 aa, Homo Sapiens
AKFHKDIAV

SEQ ID NO: 47969 - protein, 9 aa, Homo Sapiens
CCRPGPGPL

SEQ ID NO: 47970 - protein, 9 aa, Homo Sapiens
GISIVEKLI

SEQ ID NO: 47971 - protein, 9 aa, Homo Sapiens
SKRWNPTQN

SEQ ID NO: 47972 - protein, 9 aa, Homo Sapiens
EPLPLSVAP

SEQ ID NO: 47973 - protein, 9 aa, Homo Sapiens
MQYTLSPEN

SEQ ID NO: 47974 - protein, 9 aa, Homo Sapiens
VLAKHLSIP

SEQ ID NO: 47975 - protein, 9 aa, Homo Sapiens
EKNLTATLL

SEQ ID NO: 47976 - protein, 9 aa, Homo Sapiens
RISPEPLDK

SEQ ID NO: 47977 - protein, 9 aa, Homo Sapiens
LCPRLEETE

SEQ ID NO: 47978 - protein, 9 aa, Homo Sapiens
IYVDKRTGN

SEQ ID NO: 47979 - protein, 9 aa, Homo Sapiens
LTLSVSSHI

SEQ ID NO: 47980 - protein, 9 aa, Homo Sapiens
QSIPEKLMD

SEQ ID NO: 47981 - protein, 9 aa, Homo Sapiens
PLPLSVAPR

SEQ ID NO: 47982 - protein, 9 aa, Homo Sapiens
RENSSRAGG

SEQ ID NO: 47983 - protein, 9 aa, Homo Sapiens
KNGDGLKTK

SEQ ID NO: 47984 - protein, 9 aa, Homo Sapiens
EEARLASMA

SEQ ID NO: 47985 - protein, 9 aa, Homo Sapiens
FYMIVIPML

SEQ ID NO: 47986 - protein, 9 aa, Homo Sapiens
GLSMSSDFP

SEQ ID NO: 47987 - protein, 9 aa, Homo Sapiens
SDDKENIKL

SEQ ID NO: 47988 - protein, 9 aa, Homo Sapiens
LLGMQPIRV

SEQ ID NO: 47989 - protein, 9 aa, Homo Sapiens
FHDGTNFGF

SEQ ID NO: 47990 - protein, 9 aa, Homo Sapiens
NEHEKTPEH

SEQ ID NO: 47991 - protein, 9 aa, Homo Sapiens
IVDLIGILE

SEQ ID NO: 47992 - protein, 9 aa, Homo Sapiens
QQPVYTTIG

SEQ ID NO: 47993 - protein, 9 aa, Homo Sapiens
FMREFRGLL

SEQ ID NO: 47994 - protein, 9 aa, Homo Sapiens
VIYYFSSNE

SEQ ID NO: 47995 - protein, 9 aa, Homo Sapiens
VYMFHDGTN

SEQ ID NO: 47996 - protein, 9 aa, Homo Sapiens
WFNASQLFS

SEQ ID NO: 47997 - protein, 9 aa, Homo Sapiens
FRHSVVVPH

SEQ ID NO: 47998 - protein, 9 aa, Homo Sapiens
FTLTVVPFQ

SEQ ID NO: 47999 - protein, 9 aa, Homo Sapiens
HSSFTSSFS

SEQ ID NO: 48000 - protein, 9 aa, Homo Sapiens
TAIVDLIGI

SEQ ID NO: 48001 - protein, 9 aa, Homo Sapiens
LLGASLGGI

SEQ ID NO: 48002 - protein, 9 aa, Homo Sapiens
ANLSQGRPV

SEQ ID NO: 48003 - protein, 9 aa, Homo Sapiens
PGMRPLPPG

SEQ ID NO: 48004 - protein, 9 aa, Homo Sapiens
SHSSFTSSF

SEQ ID NO: 48005 - protein, 9 aa, Homo Sapiens
SQLFSFAKQ

SEQ ID NO: 48006 - protein, 9 aa, Homo Sapiens
KTYVFKAKH

SEQ ID NO: 48007 - protein, 9 aa, Homo Sapiens
DMRNLRFDL

SEQ ID NO: 48008 - protein, 9 aa, Homo Sapiens
RRWLTLKEQ

SEQ ID NO: 48009 - protein, 9 aa, Homo Sapiens
GRHLWAQNL

SEQ ID NO: 48010 - protein, 9 aa, Homo Sapiens
NMVPPTVKC

SEQ ID NO: 48011 - protein, 9 aa, Homo Sapiens
NENQWHYVR

SEQ ID NO: 48012 - protein, 9 aa, Homo Sapiens
ATRVFYLLL

SEQ ID NO: 48013 - protein, 9 aa, Homo Sapiens
QGRPVGPAR

SEQ ID NO: 48014 - protein, 9 aa, Homo Sapiens
GGPHHHAQA

SEQ ID NO: 48015 - protein, 9 aa, Homo Sapiens
SSYTSDKDM

SEQ ID NO: 48016 - protein, 9 aa, Homo Sapiens
SSNEFRRRL

SEQ ID NO: 48017 - protein, 9 aa, Homo Sapiens
PGSHSSFTS

SEQ ID NO: 48018 - protein, 9 aa, Homo Sapiens
EWARNVLAR

SEQ ID NO: 48019 - protein, 9 aa, Homo Sapiens
VGLRVIAKW

SEQ ID NO: 48020 - protein, 9 aa, Homo Sapiens
RVIAKWSSN

SEQ ID NO: 48021 - protein, 9 aa, Homo Sapiens
DSSALPSIC

SEQ ID NO: 48022 - protein, 9 aa, Homo Sapiens
AKHEKNAEE

SEQ ID NO: 48023 - protein, 9 aa, Homo Sapiens
PTVKCLTKI

SEQ ID NO: 48024 - protein, 9 aa, Homo Sapiens
LSQGRPVGP

SEQ ID NO: 48025 - protein, 9 aa, Homo Sapiens
ETTDYVPFK

SEQ ID NO: 48026 - protein, 9 aa, Homo Sapiens
PLLGASLGG

SEQ ID NO: 48027 - protein, 9 aa, Homo Sapiens
PSLLNENQW

SEQ ID NO: 48028 - protein, 9 aa, Homo Sapiens
FSFAKQALS

SEQ ID NO: 48029 - protein, 9 aa, Homo Sapiens
GDSDRIQPS

SEQ ID NO: 48030 - protein, 9 aa, Homo Sapiens
QLEQDLAFM

SEQ ID NO: 48031 - protein, 9 aa, Homo Sapiens
TGLHANLSQ

SEQ ID NO: 48032 - protein, 9 aa, Homo Sapiens
ATAPTNETL

SEQ ID NO: 48033 - protein, 9 aa, Homo Sapiens
ENQWHYVRA

SEQ ID NO: 48034 - protein, 9 aa, Homo Sapiens
FQILYANKG

SEQ ID NO: 48035 - protein, 9 aa, Homo Sapiens
LAFMREFRG

SEQ ID NO: 48036 - protein, 9 aa, Homo Sapiens
QDGRRWLTL

SEQ ID NO: 48037 - protein, 9 aa, Homo Sapiens
NVLARYAVP

SEQ ID NO: 48038 - protein, 9 aa, Homo Sapiens
PENLIATAP

SEQ ID NO: 48039 - protein, 9 aa, Homo Sapiens
AVVDPLLGM

SEQ ID NO: 48040 - protein, 9 aa, Homo Sapiens
SSALPSICG

SEQ ID NO: 48041 - protein, 9 aa, Homo Sapiens
NLSQGRPVG

SEQ ID NO: 48042 - protein, 9 aa, Homo Sapiens
MPPPGMRPL

SEQ ID NO: 48043 - protein, 9 aa, Homo Sapiens
SRTPWGSGL

SEQ ID NO: 48044 - protein, 9 aa, Homo Sapiens
SQGRPVGPA

SEQ ID NO: 48045 - protein, 9 aa, Homo Sapiens
VQKNEHEKT

SEQ ID NO: 48046 - protein, 9 aa, Homo Sapiens
HAQAAHHPP

SEQ ID NO: 48047 - protein, 9 aa, Homo Sapiens
MVPPTVKCL

SEQ ID NO: 48048 - protein, 9 aa, Homo Sapiens
QILYANKGE

SEQ ID NO: 48049 - protein, 9 aa, Homo Sapiens
AVSPRKSTR

SEQ ID NO: 48050 - protein, 9 aa, Homo Sapiens
ITLPTTVHY

SEQ ID NO: 48051 - protein, 9 aa, Homo Sapiens
VASVFYMIV

SEQ ID NO: 48052 - protein, 9 aa, Homo Sapiens
LSLHQTADL

SEQ ID NO: 48053 - protein, 9 aa, Homo Sapiens
RTGVMKCAY

SEQ ID NO: 48054 - protein, 9 aa, Homo Sapiens
GRVHWRMNP

SEQ ID NO: 48055 - protein, 9 aa, Homo Sapiens
HSSCSSQSS

SEQ ID NO: 48056 - protein, 9 aa, Homo Sapiens
PPGMRPLPP

SEQ ID NO: 48057 - protein, 9 aa, Homo Sapiens
LAVVDPLLG

SEQ ID NO: 48058 - protein, 9 aa, Homo Sapiens
LLNENQWHY

SEQ ID NO: 48059 - protein, 9 aa, Homo Sapiens
EQDLAFMRE

SEQ ID NO: 48060 - protein, 9 aa, Homo Sapiens
ASLGGIIYL

SEQ ID NO: 48061 - protein, 9 aa, Homo Sapiens
NASQLFSFA

SEQ ID NO: 48062 - protein, 9 aa, Homo Sapiens
APTNETLIV

SEQ ID NO: 48063 - protein, 9 aa, Homo Sapiens
IFQILYANK

SEQ ID NO: 48064 - protein, 9 aa, Homo Sapiens
APLLGASLG

SEQ ID NO: 48065 - protein, 9 aa, Homo Sapiens
PRRMATRVF

SEQ ID NO: 48066 - protein, 9 aa, Homo Sapiens
LGRVHWRMN

SEQ ID NO: 48067 - protein, 9 aa, Homo Sapiens
QKGAAAKEE

SEQ ID NO: 48068 - protein, 9 aa, Homo Sapiens
PVEKKTERI

SEQ ID NO: 48069 - protein, 9 aa, Homo Sapiens
PFKDGKQFE

SEQ ID NO: 48070 - protein, 9 aa, Homo Sapiens
ARNVLARYA

SEQ ID NO: 48071 - protein, 9 aa, Homo Sapiens
PLLGMQPIR

SEQ ID NO: 48072 - protein, 9 aa, Homo Sapiens
MNPSRTPGG

SEQ ID NO: 48073 - protein, 9 aa, Homo Sapiens
FKDGKQFEL

SEQ ID NO: 48074 - protein, 9 aa, Homo Sapiens
MRPLPPGIR

SEQ ID NO: 48075 - protein, 9 aa, Homo Sapiens
NILHNTQKV

SEQ ID NO: 48076 - protein, 9 aa, Homo Sapiens
IAKWSSNGY

SEQ ID NO: 48077 - protein, 9 aa, Homo Sapiens
RRGDSDRIQ

SEQ ID NO: 48078 - protein, 9 aa, Homo Sapiens
YEPLEFIDH

SEQ ID NO: 48079 - protein, 9 aa, Homo Sapiens
LEQDLAFMR

SEQ ID NO: 48080 - protein, 9 aa, Homo Sapiens
KCAYLLHRG

SEQ ID NO: 48081 - protein, 9 aa, Homo Sapiens
SDKDMIVSI

SEQ ID NO: 48082 - protein, 9 aa, Homo Sapiens
GAAAKEEDI

SEQ ID NO: 48083 - protein, 9 aa, Homo Sapiens
HSVVVPHEP

SEQ ID NO: 48084 - protein, 9 aa, Homo Sapiens
HNTQKVTCF

SEQ ID NO: 48085 - protein, 9 aa, Homo Sapiens
MTISNPPDW

SEQ ID NO: 48086 - protein, 9 aa, Homo Sapiens
HSRNLGYMK

SEQ ID NO: 48087 - protein, 9 aa, Homo Sapiens
TPPGSHSSF

SEQ ID NO: 48088 - protein, 9 aa, Homo Sapiens
AGVQQPVYT

SEQ ID NO: 48089 - protein, 9 aa, Homo Sapiens
SVQKNEHEK

SEQ ID NO: 48090 - protein, 9 aa, Homo Sapiens
TERIQKGKN

SEQ ID NO: 48091 - protein, 9 aa, Homo Sapiens
NLIATAPTN

SEQ ID NO: 48092 - protein, 9 aa, Homo Sapiens
SPRKSTRPA

SEQ ID NO: 48093 - protein, 9 aa, Homo Sapiens
SSYGQHSSC

SEQ ID NO: 48094 - protein, 9 aa, Homo Sapiens
LAATPEELA

SEQ ID NO: 48095 - protein, 9 aa, Homo Sapiens
TPVPGRHLW

SEQ ID NO: 48096 - protein, 9 aa, Homo Sapiens
VSPRKSTRP

SEQ ID NO: 48097 - protein, 9 aa, Homo Sapiens
KGECRKDVE

SEQ ID NO: 48098 - protein, 9 aa, Homo Sapiens
VAPLLGASL

SEQ ID NO: 48099 - protein, 9 aa, Homo Sapiens
LPSICGNFP

SEQ ID NO: 48100 - protein, 9 aa, Homo Sapiens
NVYMFHDGT

SEQ ID NO: 48101 - protein, 9 aa, Homo Sapiens
SPSLLNENQ

SEQ ID NO: 48102 - protein, 9 aa, Homo Sapiens
WGSGLELVR

SEQ ID NO: 48103 - protein, 9 aa, Homo Sapiens
EQQQEMAAF

SEQ ID NO: 48104 - protein, 9 aa, Homo Sapiens
WARNVLARY

SEQ ID NO: 48105 - protein, 9 aa, Homo Sapiens
NKGECRKDV

SEQ ID NO: 48106 - protein, 9 aa, Homo Sapiens
SALPSICGN

SEQ ID NO: 48107 - protein, 9 aa, Homo Sapiens
PWGSGLELV

SEQ ID NO: 48108 - protein, 9 aa, Homo Sapiens
RLMVVSDDK

SEQ ID NO: 48109 - protein, 9 aa, Homo Sapiens
EFIDHSRNL

SEQ ID NO: 48110 - protein, 9 aa, Homo Sapiens
AYNMVPPTV

SEQ ID NO: 48111 - protein, 9 aa, Homo Sapiens
LWAQNLLKS

SEQ ID NO: 48112 - protein, 9 aa, Homo Sapiens
RRMATRVFY

SEQ ID NO: 48113 - protein, 9 aa, Homo Sapiens
AAAKEEDIE

SEQ ID NO: 48114 - protein, 9 aa, Homo Sapiens
QHSSCSSQS

SEQ ID NO: 48115 - protein, 9 aa, Homo Sapiens
KEKSGASAS

SEQ ID NO: 48116 - protein, 9 aa, Homo Sapiens
DYVPFKDGK

SEQ ID NO: 48117 - protein, 9 aa, Homo Sapiens
NCVFMTISN

SEQ ID NO: 48118 - protein, 9 aa, Homo Sapiens
SWFNASQLF

SEQ ID NO: 48119 - protein, 9 aa, Homo Sapiens
QLAGSRRRG

SEQ ID NO: 48120 - protein, 9 aa, Homo Sapiens
GMRPLPPGI

SEQ ID NO: 48121 - protein, 9 aa, Homo Sapiens
SRGAAPPPA

SEQ ID NO: 48122 - protein, 9 aa, Homo Sapiens
LRFDLKQEG

SEQ ID NO: 48123 - protein, 9 aa, Homo Sapiens
LRVIAKWSS

SEQ ID NO: 48124 - protein, 9 aa, Homo Sapiens
VMKCAYLLH

SEQ ID NO: 48125 - protein, 9 aa, Homo Sapiens
VVDPLLGMQ

SEQ ID NO: 48126 - protein, 9 aa, Homo Sapiens
PVIYYFSSN

SEQ ID NO: 48127 - protein, 9 aa, Homo Sapiens
VHWRMNPSR

SEQ ID NO: 48128 - protein, 9 aa, Homo Sapiens
LAGSRRRGD

SEQ ID NO: 48129 - protein, 9 aa, Homo Sapiens
SVGPFTLTV

SEQ ID NO: 48130 - protein, 9 aa, Homo Sapiens
GASLGGIIY

SEQ ID NO: 48131 - protein, 9 aa, Homo Sapiens
WVRDRNHRP

SEQ ID NO: 48132 - protein, 9 aa, Homo Sapiens
DAYNMVPPT

SEQ ID NO: 48133 - protein, 9 aa, Homo Sapiens
CVFMTISNP

SEQ ID NO: 48134 - protein, 9 aa, Homo Sapiens
DLAFMREFR

SEQ ID NO: 48135 - protein, 9 aa, Homo Sapiens
CWVRDRNHR

SEQ ID NO: 48136 - protein, 9 aa, Homo Sapiens
KGQKGAAAK

SEQ ID NO: 48137 - protein, 9 aa, Homo Sapiens
RMNPSRTPG

SEQ ID NO: 48138 - protein, 9 aa, Homo Sapiens
TVHYSSVPK

SEQ ID NO: 48139 - protein, 9 aa, Homo Sapiens
AFAAFIDRH

SEQ ID NO: 48140 - protein, 9 aa, Homo Sapiens
QDLAFMREF

SEQ ID NO: 48141 - protein, 9 aa, Homo Sapiens
AQVASVFYM

SEQ ID NO: 48142 - protein, 9 aa, Homo Sapiens
ENLIATAPT

SEQ ID NO: 48143 - protein, 9 aa, Homo Sapiens
TRVFYLLLV

SEQ ID NO: 48144 - protein, 9 aa, Homo Sapiens
LPIVTAIVD

SEQ ID NO: 48145 - protein, 9 aa, Homo Sapiens
DGRRWLTLK

SEQ ID NO: 48146 - protein, 9 aa, Homo Sapiens
EPLEFIDHS

SEQ ID NO: 48147 - protein, 9 aa, Homo Sapiens
VQSPSLLNE

SEQ ID NO: 48148 - protein, 9 aa, Homo Sapiens
TLPTTVHYS

SEQ ID NO: 48149 - protein, 9 aa, Homo Sapiens
YANKGECRK

SEQ ID NO: 48150 - protein, 9 aa, Homo Sapiens
DKDMIVSIF

SEQ ID NO: 48151 - protein, 9 aa, Homo Sapiens
PHEPPEVGS

SEQ ID NO: 48152 - protein, 9 aa, Homo Sapiens
GSRRRGDSD

SEQ ID NO: 48153 - protein, 9 aa, Homo Sapiens
LGQDGRRWL

SEQ ID NO: 48154 - protein, 9 aa, Homo Sapiens
VFKAKHEKN

SEQ ID NO: 48155 - protein, 9 aa, Homo Sapiens
PTPPGSHSS

SEQ ID NO: 48156 - protein, 9 aa, Homo Sapiens
TVKCLTKIW

SEQ ID NO: 48157 - protein, 9 aa, Homo Sapiens
ARYAVPSEL

SEQ ID NO: 48158 - protein, 9 aa, Homo Sapiens
VDLIGILEL

SEQ ID NO: 48159 - protein, 9 aa, Homo Sapiens
TAVSPRKST

SEQ ID NO: 48160 - protein, 9 aa, Homo Sapiens
QQQEMAAFA

SEQ ID NO: 48161 - protein, 9 aa, Homo Sapiens
HLWAQNLLK

SEQ ID NO: 48162 - protein, 9 aa, Homo Sapiens
TISNPPDWT

SEQ ID NO: 48163 - protein, 9 aa, Homo Sapiens
SFNVYMFHD

SEQ ID NO: 48164 - protein, 9 aa, Homo Sapiens
VPHEPPEVG

SEQ ID NO: 48165 - protein, 9 aa, Homo Sapiens
LYANKGECR

SEQ ID NO: 48166 - protein, 9 aa, Homo Sapiens
HWRMNPSRT

SEQ ID NO: 48167 - protein, 9 aa, Homo Sapiens
DCWVRDRNH

SEQ ID NO: 48168 - protein, 9 aa, Homo Sapiens
TYVFKAKHE

SEQ ID NO: 48169 - protein, 9 aa, Homo Sapiens
PHHHAQAAH

SEQ ID NO: 48170 - protein, 9 aa, Homo Sapiens
EMAAFAAFI

SEQ ID NO: 48171 - protein, 9 aa, Homo Sapiens
LARYAVPSE

SEQ ID NO: 48172 - protein, 9 aa, Homo Sapiens
QSPSLLNEN

SEQ ID NO: 48173 - protein, 9 aa, Homo Sapiens
RMATRVFYL

SEQ ID NO: 48174 - protein, 9 aa, Homo Sapiens
RSVGPFTLT

SEQ ID NO: 48175 - protein, 9 aa, Homo Sapiens
EPENLIATA

SEQ ID NO: 48176 - protein, 9 aa, Homo Sapiens
LNENQWHYV

SEQ ID NO: 48177 - protein, 9 aa, Homo Sapiens
DLMTLKWTP

SEQ ID NO: 48178 - protein, 9 aa, Homo Sapiens
FVGLRVIAK

SEQ ID NO: 48179 - protein, 9 aa, Homo Sapiens
GLRVIAKWS

SEQ ID NO: 48180 - protein, 9 aa, Homo Sapiens
SLLNENQWH

SEQ ID NO: 48181 - protein, 9 aa, Homo Sapiens
VGPFTLTVV

SEQ ID NO: 48182 - protein, 9 aa, Homo Sapiens
ASVFYMIVI

SEQ ID NO: 48183 - protein, 9 aa, Homo Sapiens
PLPPGIRGP

SEQ ID NO: 48184 - protein, 9 aa, Homo Sapiens
FDLKQEGHS

SEQ ID NO: 48185 - protein, 9 aa, Homo Sapiens
IYYFSSNEF

SEQ ID NO: 48186 - protein, 9 aa, Homo Sapiens
ICGNFPPPP

SEQ ID NO: 48187 - protein, 9 aa, Homo Sapiens
TADLMTLKW

SEQ ID NO: 48188 - protein, 9 aa, Homo Sapiens
PIVTAIVDL

SEQ ID NO: 48189 - protein, 9 aa, Homo Sapiens
YMIVIPMLN

SEQ ID NO: 48190 - protein, 9 aa, Homo Sapiens
PGRHLWAQN

SEQ ID NO: 48191 - protein, 9 aa, Homo Sapiens
FPVLGGLSM

SEQ ID NO: 48192 - protein, 9 aa, Homo Sapiens
QTSRTPWGS

SEQ ID NO: 48193 - protein, 9 aa, Homo Sapiens
RHLWAQNLL

SEQ ID NO: 48194 - protein, 9 aa, Homo Sapiens
PVPGRHLWA

SEQ ID NO: 48195 - protein, 9 aa, Homo Sapiens
DPLLGMQPI

SEQ ID NO: 48196 - protein, 9 aa, Homo Sapiens
PVLGGLSMS

SEQ ID NO: 48197 - protein, 9 aa, Homo Sapiens
AGSRRRGDS

SEQ ID NO: 48198 - protein, 9 aa, Homo Sapiens
YMFHDGTNF

SEQ ID NO: 48199 - protein, 9 aa, Homo Sapiens
LGGPHHHAQ

SEQ ID NO: 48200 - protein, 9 aa, Homo Sapiens
FKAKHEKNA

SEQ ID NO: 48201 - protein, 9 aa, Homo Sapiens
ADLMTLKWT

SEQ ID NO: 48202 - protein, 9 aa, Homo Sapiens
PSICGNFPP

SEQ ID NO: 48203 - protein, 9 aa, Homo Sapiens
VEKKTERIQ

SEQ ID NO: 48204 - protein, 9 aa, Homo Sapiens
RKSTRPAGP

SEQ ID NO: 48205 - protein, 9 aa, Homo Sapiens
VFYMIVIPM

SEQ ID NO: 48206 - protein, 9 aa, Homo Sapiens
GSHSSFTSS

SEQ ID NO: 48207 - protein, 9 aa, Homo Sapiens
SKEKSGASA

SEQ ID NO: 48208 - protein, 9 aa, Homo Sapiens
SVFYMIVIP

SEQ ID NO: 48209 - protein, 9 aa, Homo Sapiens
GQTSRTPWG

SEQ ID NO: 48210 - protein, 9 aa, Homo Sapiens
GVQQPVYTT

SEQ ID NO: 48211 - protein, 9 aa, Homo Sapiens
YTSDKDMIV

SEQ ID NO: 48212 - protein, 9 aa, Homo Sapiens
RVHWRMNPS

SEQ ID NO: 48213 - protein, 9 aa, Homo Sapiens
KDMIVSIFY

SEQ ID NO: 48214 - protein, 9 aa, Homo Sapiens
PLEFIDHSR

SEQ ID NO: 48215 - protein, 9 aa, Homo Sapiens
GLKGQKGAA

SEQ ID NO: 48216 - protein, 9 aa, Homo Sapiens
MKCAYLLHR

SEQ ID NO: 48217 - protein, 9 aa, Homo Sapiens
SPRRMATRV

SEQ ID NO: 48218 - protein, 9 aa, Homo Sapiens
CLPIVTAIV

SEQ ID NO: 48219 - protein, 9 aa, Homo Sapiens
CGNFPPPPP

SEQ ID NO: 48220 - protein, 9 aa, Homo Sapiens
AAKEEDIEL

SEQ ID NO: 48221 - protein, 9 aa, Homo Sapiens
DPVIYYFSS

SEQ ID NO: 48222 - protein, 9 aa, Homo Sapiens
EALTGLLAA

SEQ ID NO: 48223 - protein, 9 aa, Homo Sapiens
DRNHRPKFS

SEQ ID NO: 48224 - protein, 9 aa, Homo Sapiens
GQKGAAAKE

SEQ ID NO: 48225 - protein, 9 aa, Homo Sapiens
MAAFAAFID

SEQ ID NO: 48226 - protein, 9 aa, Homo Sapiens
AFMREFRGL

SEQ ID NO: 48227 - protein, 9 aa, Homo Sapiens
VVVPHEPPE

SEQ ID NO: 48228 - protein, 9 aa, Homo Sapiens
TSDKDMIVS

SEQ ID NO: 48229 - protein, 9 aa, Homo Sapiens
LMTLKWTPN

SEQ ID NO: 48230 - protein, 9 aa, Homo Sapiens
SYGQHSSCS

SEQ ID NO: 48231 - protein, 9 aa, Homo Sapiens
TPWGSGLEL

SEQ ID NO: 48232 - protein, 9 aa, Homo Sapiens
KGRTGVMKC

SEQ ID NO: 48233 - protein, 9 aa, Homo Sapiens
RPLPPGIRG

SEQ ID NO: 48234 - protein, 9 aa, Homo Sapiens
SLHQTADLM

SEQ ID NO: 48235 - protein, 9 aa, Homo Sapiens
LTNCVFMTI

SEQ ID NO: 48236 - protein, 9 aa, Homo Sapiens
IVTAIVDLI

SEQ ID NO: 48237 - protein, 9 aa, Homo Sapiens
ERIQKGKNN

SEQ ID NO: 48238 - protein, 9 aa, Homo Sapiens
SYTSDKDMI

SEQ ID NO: 48239 - protein, 9 aa, Homo Sapiens
FAAFIDRHY

SEQ ID NO: 48240 - protein, 9 aa, Homo Sapiens
HDGTNFGFM

SEQ ID NO: 48241 - protein, 9 aa, Homo Sapiens
HEPPEVGSD

SEQ ID NO: 48242 - protein, 9 aa, Homo Sapiens
LGELNILHN

SEQ ID NO: 48243 - protein, 9 aa, Homo Sapiens
YLGRVHWRM

SEQ ID NO: 48244 - protein, 9 aa, Homo Sapiens
VLARYAVPS

SEQ ID NO: 48245 - protein, 9 aa, Homo Sapiens
LLAATPEEL

SEQ ID NO: 48246 - protein, 9 aa, Homo Sapiens
TTIGSGIVN

SEQ ID NO: 48247 - protein, 9 aa, Homo Sapiens
VIAKWSSNG

SEQ ID NO: 48248 - protein, 9 aa, Homo Sapiens
KKTERIQKG

SEQ ID NO: 48249 - protein, 9 aa, Homo Sapiens
HQTADLMTL

SEQ ID NO: 48250 - protein, 9 aa, Homo Sapiens
YNMVPPTVK

SEQ ID NO: 48251 - protein, 9 aa, Homo Sapiens
IATAPTNET

SEQ ID NO: 48252 - protein, 9 aa, Homo Sapiens
HEKTPEHSR

SEQ ID NO: 48253 - protein, 9 aa, Homo Sapiens
PFTLTVVPF

SEQ ID NO: 48254 - protein, 9 aa, Homo Sapiens
ELNILHNTQ

SEQ ID NO: 48255 - protein, 9 aa, Homo Sapiens
ISNPPDWTK

SEQ ID NO: 48256 - protein, 9 aa, Homo Sapiens
KSGASASTS

SEQ ID NO: 48257 - protein, 9 aa, Homo Sapiens
ILYANKGEC

SEQ ID NO: 48258 - protein, 9 aa, Homo Sapiens
GPFTLTVVP

SEQ ID NO: 48259 - protein, 9 aa, Homo Sapiens
ANKGECRKD

SEQ ID NO: 48260 - protein, 9 aa, Homo Sapiens
RGAAPPPAR

SEQ ID NO: 48261 - protein, 9 aa, Homo Sapiens
TSRTPWGSG

SEQ ID NO: 48262 - protein, 9 aa, Homo Sapiens
QKNEHEKTP

SEQ ID NO: 48263 - protein, 9 aa, Homo Sapiens
LIATAPTNE

SEQ ID NO: 48264 - protein, 9 aa, Homo Sapiens
GLLAATPEE

SEQ ID NO: 48265 - protein, 9 aa, Homo Sapiens
SICGNFPPP

SEQ ID NO: 48266 - protein, 9 aa, Homo Sapiens
GQDGRRWLT

SEQ ID NO: 48267 - protein, 9 aa, Homo Sapiens
YGQHSSCSS

SEQ ID NO: 48268 - protein, 9 aa, Homo Sapiens
NRLMVVSDD

SEQ ID NO: 48269 - protein, 9 aa, Homo Sapiens
ALPSICGNF

SEQ ID NO: 48270 - protein, 9 aa, Homo Sapiens
EKKTERIQK

SEQ ID NO: 48271 - protein, 9 aa, Homo Sapiens
KGSKEKSGA

SEQ ID NO: 48272 - protein, 9 aa, Homo Sapiens
SSFTSSFSF

SEQ ID NO: 48273 - protein, 9 aa, Homo Sapiens
AQAAHHPPF

SEQ ID NO: 48274 - protein, 9 aa, Homo Sapiens
PVYTTIGSG

SEQ ID NO: 48275 - protein, 9 aa, Homo Sapiens
VPFKDGKQF

SEQ ID NO: 48276 - protein, 9 aa, Homo Sapiens
MATRVFYLL

SEQ ID NO: 48277 - protein, 9 aa, Homo Sapiens
LPPGIRGPP

SEQ ID NO: 48278 - protein, 9 aa, Homo Sapiens
GAAPPPARL

SEQ ID NO: 48279 - protein, 9 aa, Homo Sapiens
NLRFDLKQE

SEQ ID NO: 48280 - protein, 9 aa, Homo Sapiens
VRDRNHRPK

SEQ ID NO: 48281 - protein, 9 aa, Homo Sapiens
SQLEQDLAF

SEQ ID NO: 48282 - protein, 9 aa, Homo Sapiens
PTTVHYSSV

SEQ ID NO: 48283 - protein, 9 aa, Homo Sapiens
LGQTSRTPW

SEQ ID NO: 48284 - protein, 9 aa, Homo Sapiens
HYSSVPKQT

SEQ ID NO: 48285 - protein, 9 aa, Homo Sapiens
TDYVPFKDG

SEQ ID NO: 48286 - protein, 9 aa, Homo Sapiens
GSKEKSGAS

SEQ ID NO: 48287 - protein, 9 aa, Homo Sapiens
GQHSSCSSQ

SEQ ID NO: 48288 - protein, 9 aa, Homo Sapiens
SNEFRRRLS

SEQ ID NO: 48289 - protein, 9 aa, Homo Sapiens
GPHHHAQAA

SEQ ID NO: 48290 - protein, 9 aa, Homo Sapiens
PPGSHSSFT

SEQ ID NO: 48291 - protein, 9 aa, Homo Sapiens
HRPKFSQIV

SEQ ID NO: 48292 - protein, 9 aa, Homo Sapiens
GGLSMSSDF

SEQ ID NO: 48293 - protein, 9 aa, Homo Sapiens
ILHNTQKVT

SEQ ID NO: 48294 - protein, 9 aa, Homo Sapiens
KSTRPAGPQ

SEQ ID NO: 48295 - protein, 9 aa, Homo Sapiens
RNLRFDLKQ

SEQ ID NO: 48296 - protein, 9 aa, Homo Sapiens
MVVSDDKEN

SEQ ID NO: 48297 - protein, 9 aa, Homo Sapiens
LSPRRMATR

SEQ ID NO: 48298 - protein, 9 aa, Homo Sapiens
QPVYTTIGS

SEQ ID NO: 48299 - protein, 9 aa, Homo Sapiens
VPGRHLWAQ

SEQ ID NO: 48300 - protein, 9 aa, Homo Sapiens
YVPFKDGKQ

SEQ ID NO: 48301 - protein, 9 aa, Homo Sapiens
RHSVVVPHE

SEQ ID NO: 48302 - protein, 9 aa, Homo Sapiens
LMVVSDDKE

SEQ ID NO: 48303 - protein, 9 aa, Homo Sapiens
QVASVFYMI

SEQ ID NO: 48304 - protein, 9 aa, Homo Sapiens
TTDYVPFKD

SEQ ID NO: 48305 - protein, 9 aa, Homo Sapiens
SFVGLRVIA

SEQ ID NO: 48306 - protein, 9 aa, Homo Sapiens
LFSFAKQAL

SEQ ID NO: 48307 - protein, 9 aa, Homo Sapiens
HHAQAAHHP

SEQ ID NO: 48308 - protein, 9 aa, Homo Sapiens
KTERIQKGK

SEQ ID NO: 48309 - protein, 9 aa, Homo Sapiens
PPPGMRPLP

SEQ ID NO: 48310 - protein, 9 aa, Homo Sapiens
QLFSFAKQA

SEQ ID NO: 48311 - protein, 9 aa, Homo Sapiens
WAQNLLKSD

SEQ ID NO: 48312 - protein, 9 aa, Homo Sapiens
LEFIDHSRN

SEQ ID NO: 48313 - protein, 9 aa, Homo Sapiens
GRRWLTLKE

SEQ ID NO: 48314 - protein, 9 aa, Homo Sapiens
LTGLLAATP

SEQ ID NO: 48315 - protein, 9 aa, Homo Sapiens
GKGRTGVMK

SEQ ID NO: 48316 - protein, 9 aa, Homo Sapiens
STRPAGPQL

SEQ ID NO: 48317 - protein, 9 aa, Homo Sapiens
PRKSTRPAG

SEQ ID NO: 48318 - protein, 9 aa, Homo Sapiens
RNVLARYAV

SEQ ID NO: 48319 - protein, 9 aa, Homo Sapiens
KDGKQFELC

SEQ ID NO: 48320 - protein, 9 aa, Homo Sapiens
EKSGASAST

SEQ ID NO: 48321 - protein, 9 aa, Homo Sapiens
RWLTLKEQP

SEQ ID NO: 48322 - protein, 9 aa, Homo Sapiens
VPPTVKCLT

SEQ ID NO: 48323 - protein, 9 aa, Homo Sapiens
QTADLMTLK

SEQ ID NO: 48324 - protein, 9 aa, Homo Sapiens
PRSVGPFTL

SEQ ID NO: 48325 - protein, 9 aa, Homo Sapiens
MIVIPMLNP

SEQ ID NO: 48326 - protein, 9 aa, Homo Sapiens
VTAIVDLIG

SEQ ID NO: 48327 - protein, 9 aa, Homo Sapiens
LFPVLGGLS

SEQ ID NO: 48328 - protein, 9 aa, Homo Sapiens
MFHDGTNFG

SEQ ID NO: 48329 - protein, 9 aa, Homo Sapiens
DHSRNLGYM

SEQ ID NO: 48330 - protein, 9 aa, Homo Sapiens
TGVMKCAYL

SEQ ID NO: 48331 - protein, 9 aa, Homo Sapiens
TAPTNETLI

SEQ ID NO: 48332 - protein, 9 aa, Homo Sapiens
WRMNPSRTP

SEQ ID NO: 48333 - protein, 9 aa, Homo Sapiens
SPRSVGPFT

SEQ ID NO: 48334 - protein, 9 aa, Homo Sapiens
HHHAQAAHH

SEQ ID NO: 48335 - protein, 9 aa, Homo Sapiens
FNASQLFSF

SEQ ID NO: 48336 - protein, 9 aa, Homo Sapiens
PGEALTGLL

SEQ ID NO: 48337 - protein, 9 aa, Homo Sapiens
RFDLKQEGH

SEQ ID NO: 48338 - protein, 9 aa, Homo Sapiens
VLGGLSMSS

SEQ ID NO: 48339 - protein, 9 aa, Homo Sapiens
LHNTQKVTC

SEQ ID NO: 48340 - protein, 9 aa, Homo Sapiens
LNILHNTQK

SEQ ID NO: 48341 - protein, 9 aa, Homo Sapiens
IDHSRNLGY

SEQ ID NO: 48342 - protein, 9 aa, Homo Sapiens
TTVHYSSVP

SEQ ID NO: 48343 - protein, 9 aa, Homo Sapiens
GVMKCAYLL

SEQ ID NO: 48344 - protein, 9 aa, Homo Sapiens
KNEHEKTPE

SEQ ID NO: 48345 - protein, 9 aa, Homo Sapiens
LHANLSQGR

SEQ ID NO: 48346 - protein, 9 aa, Homo Sapiens
EHEKTPEHS

SEQ ID NO: 48347 - protein, 9 aa, Homo Sapiens
DLKQEGHSR

SEQ ID NO: 48348 - protein, 9 aa, Homo Sapiens
PPTVKCLTK

SEQ ID NO: 48349 - protein, 9 aa, Homo Sapiens
GRTGVMKCA

SEQ ID NO: 48350 - protein, 9 aa, Homo Sapiens
EKTPEHSRK

SEQ ID NO: 48351 - protein, 9 aa, Homo Sapiens
SSSYTSDKD

SEQ ID NO: 48352 - protein, 9 aa, Homo Sapiens
GLHANLSQG

SEQ ID NO: 48353 - protein, 9 aa, Homo Sapiens
TGLLAATPE

SEQ ID NO: 48354 - protein, 9 aa, Homo Sapiens
RDRNHRPKF

SEQ ID NO: 48355 - protein, 9 aa, Homo Sapiens
YFSSNEFRR

SEQ ID NO: 48356 - protein, 9 aa, Homo Sapiens
GELNILHNT

SEQ ID NO: 48357 - protein, 9 aa, Homo Sapiens
LGMQPIRVK

SEQ ID NO: 48358 - protein, 9 aa, Homo Sapiens
TNCVFMTIS

SEQ ID NO: 48359 - protein, 9 aa, Homo Sapiens
LGASLGGII

SEQ ID NO: 48360 - protein, 9 aa, Homo Sapiens
TLTVVPFQD

SEQ ID NO: 48361 - protein, 9 aa, Homo Sapiens
RLAVVDPLL

SEQ ID NO: 48362 - protein, 9 aa, Homo Sapiens
SCSSQSSGY

SEQ ID NO: 48363 - protein, 9 aa, Homo Sapiens
QEMAAFAAF

SEQ ID NO: 48364 - protein, 9 aa, Homo Sapiens
KGAAAKEED

SEQ ID NO: 48365 - protein, 9 aa, Homo Sapiens
AAFAAFIDR

SEQ ID NO: 48366 - protein, 9 aa, Homo Sapiens
RGDSDRIQP

SEQ ID NO: 48367 - protein, 9 aa, Homo Sapiens
AIVDLIGIL

SEQ ID NO: 48368 - protein, 9 aa, Homo Sapiens
HANLSQGRP

SEQ ID NO: 48369 - protein, 9 aa, Homo Sapiens
RRRGDSDRI

SEQ ID NO: 48370 - protein, 9 aa, Homo Sapiens
QAAHHPPFA

SEQ ID NO: 48371 - protein, 9 aa, Homo Sapiens
VVAPLLGAS

SEQ ID NO: 48372 - protein, 9 aa, Homo Sapiens
VSDDKENIK

SEQ ID NO: 48373 - protein, 9 aa, Homo Sapiens
QLGQDGRRW

SEQ ID NO: 48374 - protein, 9 aa, Homo Sapiens
DGTNFGFMN

SEQ ID NO: 48375 - protein, 9 aa, Homo Sapiens
VQQPVYTTI

SEQ ID NO: 48376 - protein, 9 aa, Homo Sapiens
LHQTADLMT

SEQ ID NO: 48377 - protein, 9 aa, Homo Sapiens
SRRRGDSDR

SEQ ID NO: 48378 - protein, 9 aa, Homo Sapiens
YYFSSNEFR

SEQ ID NO: 48379 - protein, 9 aa, Homo Sapiens
RNHRPKFSQ

SEQ ID NO: 48380 - protein, 9 aa, Homo Sapiens
VVPHEPPEV

SEQ ID NO: 48381 - protein, 9 aa, Homo Sapiens
LSMSSDFPH

SEQ ID NO: 48382 - protein, 9 aa, Homo Sapiens
NSFVGLRVI

SEQ ID NO: 48383 - protein, 9 aa, Homo Sapiens
ASQLFSFAK

SEQ ID NO: 48384 - protein, 9 aa, Homo Sapiens
KDMRNLRFD

SEQ ID NO: 48385 - protein, 9 aa, Homo Sapiens
QITLPTTVH

SEQ ID NO: 48386 - protein, 9 aa, Homo Sapiens
HEKNAEEWL

SEQ ID NO: 48387 - protein, 9 aa, Homo Sapiens
FNVYMFHDG

SEQ ID NO: 48388 - protein, 9 aa, Homo Sapiens
PLSPRRMAT

SEQ ID NO: 48389 - protein, 9 aa, Homo Sapiens
VDPLLGMQP

SEQ ID NO: 48390 - protein, 9 aa, Homo Sapiens
LPTTVHYSS

SEQ ID NO: 48391 - protein, 9 aa, Homo Sapiens
CSSQSSGYG

SEQ ID NO: 48392 - protein, 9 aa, Homo Sapiens
GEALTGLLA

SEQ ID NO: 48393 - protein, 9 aa, Homo Sapiens
RYAVPSELV

SEQ ID NO: 48394 - protein, 9 aa, Homo Sapiens
VHYSSVPKQ

SEQ ID NO: 48395 - protein, 9 aa, Homo Sapiens
VVSDDKENI

SEQ ID NO: 48396 - protein, 9 aa, Homo Sapiens
APVEKKTER

SEQ ID NO: 48397 - protein, 9 aa, Homo Sapiens
SLGGIIYLV

SEQ ID NO: 48398 - protein, 9 aa, Homo Sapiens
FMTISNPPD

SEQ ID NO: 48399 - protein, 9 aa, Homo Sapiens
SRKGSKEKS

SEQ ID NO: 48400 - protein, 9 aa, Homo Sapiens
TRPAGPQLF

SEQ ID NO: 48401 - protein, 9 aa, Homo Sapiens
LKGQKGAAA

SEQ ID NO: 48402 - protein, 9 aa, Homo Sapiens
HSVQKNEHE

SEQ ID NO: 48403 - protein, 9 aa, Homo Sapiens
ALFPVLGGL

SEQ ID NO: 48404 - protein, 9 aa, Homo Sapiens
YVFKAKHEK

SEQ ID NO: 48405 - protein, 9 aa, Homo Sapiens
VFMTISNPP

SEQ ID NO: 48406 - protein, 9 aa, Homo Sapiens
KAKHEKNAE

SEQ ID NO: 48407 - protein, 9 aa, Homo Sapiens
VLGELNILH

SEQ ID NO: 48408 - protein, 9 aa, Homo Sapiens
KSRKGSKEK

SEQ ID NO: 48409 - protein, 9 aa, Homo Sapiens
PSSSYTSDK

SEQ ID NO: 48410 - protein, 9 aa, Homo Sapiens
SFTSSFSFI

SEQ ID NO: 48411 - protein, 9 aa, Homo Sapiens
QQEMAAFAA

SEQ ID NO: 48412 - protein, 9 aa, Homo Sapiens
FIDHSRNLG

SEQ ID NO: 48413 - protein, 9 aa, Homo Sapiens
YTTIGSGIV

SEQ ID NO: 48414 - protein, 9 aa, Homo Sapiens
SSCSSQSSG

SEQ ID NO: 48415 - protein, 9 aa, Homo Sapiens
NHRPKFSQI

SEQ ID NO: 48416 - protein, 9 aa, Homo Sapiens
LGGLSMSSD

SEQ ID NO: 48417 - protein, 9 aa, Homo Sapiens
RTPWGSGLE

SEQ ID NO: 48418 - protein, 9 aa, Homo Sapiens
FSSNEFRRR

SEQ ID NO: 48419 - protein, 9 aa, Homo Sapiens
MRNLRFDLK

SEQ ID NO: 48420 - protein, 9 aa, Homo Sapiens
VYTTIGSGI

SEQ ID NO: 48421 - protein, 9 aa, Homo Sapiens
KHEKNAEEW

SEQ ID NO: 48422 - protein, 9 aa, Homo Sapiens
RIQKGKNNQ

SEQ ID NO: 48423 - protein, 9 aa, Homo Sapiens
RKGSKEKSG

SEQ ID NO: 48424 - protein, 9 aa, Homo Sapiens
SVVVPHEPP

SEQ ID NO: 48425 - protein, 9 aa, Homo Sapiens
WLTLKEQPT

SEQ ID NO: 48426 - protein, 9 aa, Homo Sapiens
ALTGLLAAT

SEQ ID NO: 48427 - protein, 9 aa, Homo Sapiens
SNKMDSLLQ

SEQ ID NO: 48428 - protein, 9 aa, Homo Sapiens
FMDSPQVAH

SEQ ID NO: 48429 - protein, 9 aa, Homo Sapiens
GILSSGKNL

SEQ ID NO: 48430 - protein, 9 aa, Homo Sapiens
AFLQAAKKI

SEQ ID NO: 48431 - protein, 9 aa, Homo Sapiens
PANSHRAPE

SEQ ID NO: 48432 - protein, 9 aa, Homo Sapiens
PEMKGRGKR

SEQ ID NO: 48433 - protein, 9 aa, Homo Sapiens
KMSCASNKM

SEQ ID NO: 48434 - protein, 9 aa, Homo Sapiens
ISLGKVGKL

SEQ ID NO: 48435 - protein, 9 aa, Homo Sapiens
ASAIQKSAG

SEQ ID NO: 48436 - protein, 9 aa, Homo Sapiens
VIEGQQLTF

SEQ ID NO: 48437 - protein, 9 aa, Homo Sapiens
CLRDRASAA

SEQ ID NO: 48438 - protein, 9 aa, Homo Sapiens
EPIANWGLW

SEQ ID NO: 48439 - protein, 9 aa, Homo Sapiens
GDHWALDGH

SEQ ID NO: 48440 - protein, 9 aa, Homo Sapiens
YHQDVDTPN

SEQ ID NO: 48441 - protein, 9 aa, Homo Sapiens
SAIQKSAGA

SEQ ID NO: 48442 - protein, 9 aa, Homo Sapiens
GQTLGQRVP

SEQ ID NO: 48443 - protein, 9 aa, Homo Sapiens
GAPAPPRRE

SEQ ID NO: 48444 - protein, 9 aa, Homo Sapiens
AAFKCWAAA

SEQ ID NO: 48445 - protein, 9 aa, Homo Sapiens
LSLIHRTYP

SEQ ID NO: 48446 - protein, 9 aa, Homo Sapiens
ENVEDAFLQ

SEQ ID NO: 48447 - protein, 9 aa, Homo Sapiens
RLPSVIVLS

SEQ ID NO: 48448 - protein, 9 aa, Homo Sapiens
KIQEEERKP

SEQ ID NO: 48449 - protein, 9 aa, Homo Sapiens
VVPRQRGGL

SEQ ID NO: 48450 - protein, 9 aa, Homo Sapiens
ERNRTQIVF

SEQ ID NO: 48451 - protein, 9 aa, Homo Sapiens
QLQMNMCAL

SEQ ID NO: 48452 - protein, 9 aa, Homo Sapiens
EDAFLQAAK

SEQ ID NO: 48453 - protein, 9 aa, Homo Sapiens
PALEEVPQE

SEQ ID NO: 48454 - protein, 9 aa, Homo Sapiens
VPRQRGGLP

SEQ ID NO: 48455 - protein, 9 aa, Homo Sapiens
RCQPPKGLR

SEQ ID NO: 48456 - protein, 9 aa, Homo Sapiens
QHESRSNQS

SEQ ID NO: 48457 - protein, 9 aa, Homo Sapiens
NSSIPQLLV

SEQ ID NO: 48458 - protein, 9 aa, Homo Sapiens
RGKRCQPPK

SEQ ID NO: 48459 - protein, 9 aa, Homo Sapiens
SGKNLFFNE

SEQ ID NO: 48460 - protein, 9 aa, Homo Sapiens
KEKRVVCET

SEQ ID NO: 48461 - protein, 9 aa, Homo Sapiens
FPCTLLAGN

SEQ ID NO: 48462 - protein, 9 aa, Homo Sapiens
GQQLTFPCT

SEQ ID NO: 48463 - protein, 9 aa, Homo Sapiens
TDLPFPKDA

SEQ ID NO: 48464 - protein, 9 aa, Homo Sapiens
ILISAVLPA

SEQ ID NO: 48465 - protein, 9 aa, Homo Sapiens
KCWAAAIIV

SEQ ID NO: 48466 - protein, 9 aa, Homo Sapiens
VTERLPSVI

SEQ ID NO: 48467 - protein, 9 aa, Homo Sapiens
EEERKPEEK

SEQ ID NO: 48468 - protein, 9 aa, Homo Sapiens
YDYDYVHLQ

SEQ ID NO: 48469 - protein, 9 aa, Homo Sapiens
YTNSSIPQL

SEQ ID NO: 48470 - protein, 9 aa, Homo Sapiens
SPANSHRAP

SEQ ID NO: 48471 - protein, 9 aa, Homo Sapiens
QRVPGFPTA

SEQ ID NO: 48472 - protein, 9 aa, Homo Sapiens
TLPTPPALE

SEQ ID NO: 48473 - protein, 9 aa, Homo Sapiens
LPKRNPPAS

SEQ ID NO: 48474 - protein, 9 aa, Homo Sapiens
EKLLPVVPR

SEQ ID NO: 48475 - protein, 9 aa, Homo Sapiens
VVGRWRVSD

SEQ ID NO: 48476 - protein, 9 aa, Homo Sapiens
HKVKEARRF

SEQ ID NO: 48477 - protein, 9 aa, Homo Sapiens
PQDFEYIWQ

SEQ ID NO: 48478 - protein, 9 aa, Homo Sapiens
PASLDPVQP

SEQ ID NO: 48479 - protein, 9 aa, Homo Sapiens
ALEEVPQEL

SEQ ID NO: 48480 - protein, 9 aa, Homo Sapiens
PAPPRREAQ

SEQ ID NO: 48481 - protein, 9 aa, Homo Sapiens
DGSERSWMY

SEQ ID NO: 48482 - protein, 9 aa, Homo Sapiens
DSPQVAHWL

SEQ ID NO: 48483 - protein, 9 aa, Homo Sapiens
QPAPTVSQQ

SEQ ID NO: 48484 - protein, 9 aa, Homo Sapiens
DSPANSHRA

SEQ ID NO: 48485 - protein, 9 aa, Homo Sapiens
LTGPSFHSP

SEQ ID NO: 48486 - protein, 9 aa, Homo Sapiens
APPGTVTER

SEQ ID NO: 48487 - protein, 9 aa, Homo Sapiens
DLNTLLNLA

SEQ ID NO: 48488 - protein, 9 aa, Homo Sapiens
AGDTQPRFL

SEQ ID NO: 48489 - protein, 9 aa, Homo Sapiens
SLIHRTYPQ

SEQ ID NO: 48490 - protein, 9 aa, Homo Sapiens
KPEEKQRKD

SEQ ID NO: 48491 - protein, 9 aa, Homo Sapiens
PEEKQRKDK

SEQ ID NO: 48492 - protein, 9 aa, Homo Sapiens
GGLPHVERY

SEQ ID NO: 48493 - protein, 9 aa, Homo Sapiens
RAPETQPLA

SEQ ID NO: 48494 - protein, 9 aa, Homo Sapiens
GAPSNPPKD

SEQ ID NO: 48495 - protein, 9 aa, Homo Sapiens
PLIWKKKMS

SEQ ID NO: 48496 - protein, 9 aa, Homo Sapiens
CASNKMDSL

SEQ ID NO: 48497 - protein, 9 aa, Homo Sapiens
NWGLWLHRS

SEQ ID NO: 48498 - protein, 9 aa, Homo Sapiens
MKGRGKRCQ

SEQ ID NO: 48499 - protein, 9 aa, Homo Sapiens
EQPFRMELI

SEQ ID NO: 48500 - protein, 9 aa, Homo Sapiens
SWMYDYDYV

SEQ ID NO: 48501 - protein, 9 aa, Homo Sapiens
AVWLDLISI

SEQ ID NO: 48502 - protein, 9 aa, Homo Sapiens
TVTERLPSV

SEQ ID NO: 48503 - protein, 9 aa, Homo Sapiens
KGRGKRCQP

SEQ ID NO: 48504 - protein, 9 aa, Homo Sapiens
DGFRWNYHQ

SEQ ID NO: 48505 - protein, 9 aa, Homo Sapiens
PPRREAQPE

SEQ ID NO: 48506 - protein, 9 aa, Homo Sapiens
QGFSCHLLS

SEQ ID NO: 48507 - protein, 9 aa, Homo Sapiens
KKTKLTVLE

SEQ ID NO: 48508 - protein, 9 aa, Homo Sapiens
VTLQQLEVA

SEQ ID NO: 48509 - protein, 9 aa, Homo Sapiens
GVRKSAVLL

SEQ ID NO: 48510 - protein, 9 aa, Homo Sapiens
MRSEEASHK

SEQ ID NO: 48511 - protein, 9 aa, Homo Sapiens
QWKTQGGGY

SEQ ID NO: 48512 - protein, 9 aa, Homo Sapiens
LCNRGPSAH

SEQ ID NO: 48513 - protein, 9 aa, Homo Sapiens
ALVVGRWRV

SEQ ID NO: 48514 - protein, 9 aa, Homo Sapiens
ESRSNQSNY

SEQ ID NO: 48515 - protein, 9 aa, Homo Sapiens
HESRSNQSN

SEQ ID NO: 48516 - protein, 9 aa, Homo Sapiens
DVYIGKPSL

SEQ ID NO: 48517 - protein, 9 aa, Homo Sapiens
PVQPHILLK

SEQ ID NO: 48518 - protein, 9 aa, Homo Sapiens
FLDLCYTNS

SEQ ID NO: 48519 - protein, 9 aa, Homo Sapiens
RSWMYDYDY

SEQ ID NO: 48520 - protein, 9 aa, Homo Sapiens
KMDSLLQNM

SEQ ID NO: 48521 - protein, 9 aa, Homo Sapiens
EEFSKLQKK

SEQ ID NO: 48522 - protein, 9 aa, Homo Sapiens
CVCPLVLVV

SEQ ID NO: 48523 - protein, 9 aa, Homo Sapiens
VFKKQLQMN

SEQ ID NO: 48524 - protein, 9 aa, Homo Sapiens
SCASNKMDS

SEQ ID NO: 48525 - protein, 9 aa, Homo Sapiens
WSSSLLTGP

SEQ ID NO: 48526 - protein, 9 aa, Homo Sapiens
DALSKEKRV

SEQ ID NO: 48527 - protein, 9 aa, Homo Sapiens
FMNKFKGDH

SEQ ID NO: 48528 - protein, 9 aa, Homo Sapiens
YLPKRNPPA

SEQ ID NO: 48529 - protein, 9 aa, Homo Sapiens
WMYDYDYVH

SEQ ID NO: 48530 - protein, 9 aa, Homo Sapiens
LLPVVPRQR

SEQ ID NO: 48531 - protein, 9 aa, Homo Sapiens
ERYLPKRNP

SEQ ID NO: 48532 - protein, 9 aa, Homo Sapiens
FRMELIQGS

SEQ ID NO: 48533 - protein, 9 aa, Homo Sapiens
TPPALEEVP

SEQ ID NO: 48534 - protein, 9 aa, Homo Sapiens
NRGPSAHSA

SEQ ID NO: 48535 - protein, 9 aa, Homo Sapiens
SLEQPFRME

SEQ ID NO: 48536 - protein, 9 aa, Homo Sapiens
LNTLLNLAC

SEQ ID NO: 48537 - protein, 9 aa, Homo Sapiens
RYLPKRNPP

SEQ ID NO: 48538 - protein, 9 aa, Homo Sapiens
HFMCDLNTL

SEQ ID NO: 48539 - protein, 9 aa, Homo Sapiens
EEADSYFKV

SEQ ID NO: 48540 - protein, 9 aa, Homo Sapiens
NQLKHSLMK

SEQ ID NO: 48541 - protein, 9 aa, Homo Sapiens
SFLDLCYTN

SEQ ID NO: 48542 - protein, 9 aa, Homo Sapiens
GHGQTLGQR

SEQ ID NO: 48543 - protein, 9 aa, Homo Sapiens
EAAFKCWAA

SEQ ID NO: 48544 - protein, 9 aa, Homo Sapiens
YPYLPTTLQ

SEQ ID NO: 48545 - protein, 9 aa, Homo Sapiens
EIFMNKFKG

SEQ ID NO: 48546 - protein, 9 aa, Homo Sapiens
VGVRKSAVL

SEQ ID NO: 48547 - protein, 9 aa, Homo Sapiens
KPTLRFKAF

SEQ ID NO: 48548 - protein, 9 aa, Homo Sapiens
KYFRLIIMS

SEQ ID NO: 48549 - protein, 9 aa, Homo Sapiens
QPPKGLRGE

SEQ ID NO: 48550 - protein, 9 aa, Homo Sapiens
DTQPRFLQQ

SEQ ID NO: 48551 - protein, 9 aa, Homo Sapiens
EEASHKAVT

SEQ ID NO: 48552 - protein, 9 aa, Homo Sapiens
FGQHESRSN

SEQ ID NO: 48553 - protein, 9 aa, Homo Sapiens
KKKMSCASN

SEQ ID NO: 48554 - protein, 9 aa, Homo Sapiens
SLGKVGKLT

SEQ ID NO: 48555 - protein, 9 aa, Homo Sapiens
DALVVGRWR

SEQ ID NO: 48556 - protein, 9 aa, Homo Sapiens
VLLPPDSRC

SEQ ID NO: 48557 - protein, 9 aa, Homo Sapiens
EGAPSNPPK

SEQ ID NO: 48558 - protein, 9 aa, Homo Sapiens
FGLRFMDSP

SEQ ID NO: 48559 - protein, 9 aa, Homo Sapiens
GDVAMPRKG

SEQ ID NO: 48560 - protein, 9 aa, Homo Sapiens
ASHKAVTTC

SEQ ID NO: 48561 - protein, 9 aa, Homo Sapiens
PTVSQQQAW

SEQ ID NO: 48562 - protein, 9 aa, Homo Sapiens
LTFPCTLLA

SEQ ID NO: 48563 - protein, 9 aa, Homo Sapiens
QAAKKIYQN

SEQ ID NO: 48564 - protein, 9 aa, Homo Sapiens
RQRGGLPHV

SEQ ID NO: 48565 - protein, 9 aa, Homo Sapiens
NCVCPLVLV

SEQ ID NO: 48566 - protein, 9 aa, Homo Sapiens
GPRKYPYLP

SEQ ID NO: 48567 - protein, 9 aa, Homo Sapiens
GPSAHSAHS

SEQ ID NO: 48568 - protein, 9 aa, Homo Sapiens
RMELIQGSK

SEQ ID NO: 48569 - protein, 9 aa, Homo Sapiens
LPTPPALEE

SEQ ID NO: 48570 - protein, 9 aa, Homo Sapiens
LNGFAPLHI

SEQ ID NO: 48571 - protein, 9 aa, Homo Sapiens
IMSKSLVNF

SEQ ID NO: 48572 - protein, 9 aa, Homo Sapiens
GFRWNYHQD

SEQ ID NO: 48573 - protein, 9 aa, Homo Sapiens
NKFKGDHWA

SEQ ID NO: 48574 - protein, 9 aa, Homo Sapiens
RWSSSLLTG

SEQ ID NO: 48575 - protein, 9 aa, Homo Sapiens
IFQGTLLFI

SEQ ID NO: 48576 - protein, 9 aa, Homo Sapiens
SAHSAHSAP

SEQ ID NO: 48577 - protein, 9 aa, Homo Sapiens
RREAQPEAG

SEQ ID NO: 48578 - protein, 9 aa, Homo Sapiens
RKPEEKQRK

SEQ ID NO: 48579 - protein, 9 aa, Homo Sapiens
PPALEEVPQ

SEQ ID NO: 48580 - protein, 9 aa, Homo Sapiens
IAEERNRTQ

SEQ ID NO: 48581 - protein, 9 aa, Homo Sapiens
EMKGRGKRC

SEQ ID NO: 48582 - protein, 9 aa, Homo Sapiens
KGLRGEKLL

SEQ ID NO: 48583 - protein, 9 aa, Homo Sapiens
QEEERKPEE

SEQ ID NO: 48584 - protein, 9 aa, Homo Sapiens
SPQVAHWLD

SEQ ID NO: 48585 - protein, 9 aa, Homo Sapiens
ERLPSVIVL

SEQ ID NO: 48586 - protein, 9 aa, Homo Sapiens
LEINQLKHS

SEQ ID NO: 48587 - protein, 9 aa, Homo Sapiens
LGQRVPGFP

SEQ ID NO: 48588 - protein, 9 aa, Homo Sapiens
IFMNKFKGD

SEQ ID NO: 48589 - protein, 9 aa, Homo Sapiens
LLTGPSFHS

SEQ ID NO: 48590 - protein, 9 aa, Homo Sapiens
QQLEVAEGS

SEQ ID NO: 48591 - protein, 9 aa, Homo Sapiens
VWLDLISIA

SEQ ID NO: 48592 - protein, 9 aa, Homo Sapiens
DSLLQNMWD

SEQ ID NO: 48593 - protein, 9 aa, Homo Sapiens
QEYIKPTLR

SEQ ID NO: 48594 - protein, 9 aa, Homo Sapiens
FSKLQKKTK

SEQ ID NO: 48595 - protein, 9 aa, Homo Sapiens
CNRGPSAHS

SEQ ID NO: 48596 - protein, 9 aa, Homo Sapiens
DAFLQAAKK

SEQ ID NO: 48597 - protein, 9 aa, Homo Sapiens
LIHRTYPQD

SEQ ID NO: 48598 - protein, 9 aa, Homo Sapiens
QPRFLQQDK

SEQ ID NO: 48599 - protein, 9 aa, Homo Sapiens
ERSWMYDYD

SEQ ID NO: 48600 - protein, 9 aa, Homo Sapiens
LDPVQPHIL

SEQ ID NO: 48601 - protein, 9 aa, Homo Sapiens
RLIIMSKSL

SEQ ID NO: 48602 - protein, 9 aa, Homo Sapiens
TQPRFLQQD

SEQ ID NO: 48603 - protein, 9 aa, Homo Sapiens
TLRFKAFSG

SEQ ID NO: 48604 - protein, 9 aa, Homo Sapiens
EINQLKHSL

SEQ ID NO: 48605 - protein, 9 aa, Homo Sapiens
DDALSKEKR

SEQ ID NO: 48606 - protein, 9 aa, Homo Sapiens
MRWLAVWLD

SEQ ID NO: 48607 - protein, 9 aa, Homo Sapiens
SAVLLPPDS

SEQ ID NO: 48608 - protein, 9 aa, Homo Sapiens
RWNYHQDVD

SEQ ID NO: 48609 - protein, 9 aa, Homo Sapiens
TLQVKPEMK

SEQ ID NO: 48610 - protein, 9 aa, Homo Sapiens
DLNQWKTQG

SEQ ID NO: 48611 - protein, 9 aa, Homo Sapiens
PRKYPYLPT

SEQ ID NO: 48612 - protein, 9 aa, Homo Sapiens
GLEYEYRGL

SEQ ID NO: 48613 - protein, 9 aa, Homo Sapiens
GPSFHSPEK

SEQ ID NO: 48614 - protein, 9 aa, Homo Sapiens
ALNGFAPLH

SEQ ID NO: 48615 - protein, 9 aa, Homo Sapiens
MGRAAAGTA

SEQ ID NO: 48616 - protein, 9 aa, Homo Sapiens
PTLRFKAFS

SEQ ID NO: 48617 - protein, 9 aa, Homo Sapiens
QFLSLIHRT

SEQ ID NO: 48618 - protein, 9 aa, Homo Sapiens
NRDLQLEIN

SEQ ID NO: 48619 - protein, 9 aa, Homo Sapiens
AVLPAAFRV

SEQ ID NO: 48620 - protein, 9 aa, Homo Sapiens
FKCWAAAII

SEQ ID NO: 48621 - protein, 9 aa, Homo Sapiens
EYSEINTSK

SEQ ID NO: 48622 - protein, 9 aa, Homo Sapiens
LSSGKNLFF

SEQ ID NO: 48623 - protein, 9 aa, Homo Sapiens
GTVTERLPS

SEQ ID NO: 48624 - protein, 9 aa, Homo Sapiens
LISHCEGPS

SEQ ID NO: 48625 - protein, 9 aa, Homo Sapiens
APLHIACKK

SEQ ID NO: 48626 - protein, 9 aa, Homo Sapiens
LHQPAPTVS

SEQ ID NO: 48627 - protein, 9 aa, Homo Sapiens
VEAAFKCWA

SEQ ID NO: 48628 - protein, 9 aa, Homo Sapiens
MYDYDYVHL

SEQ ID NO: 48629 - protein, 9 aa, Homo Sapiens
RDVYIGKPS

SEQ ID NO: 48630 - protein, 9 aa, Homo Sapiens
YIKPTLRFK

SEQ ID NO: 48631 - protein, 9 aa, Homo Sapiens
MSCASNKMD

SEQ ID NO: 48632 - protein, 9 aa, Homo Sapiens
PGTVTERLP

SEQ ID NO: 48633 - protein, 9 aa, Homo Sapiens
SLLTGPSFH

SEQ ID NO: 48634 - protein, 9 aa, Homo Sapiens
PHVERYLPK

SEQ ID NO: 48635 - protein, 9 aa, Homo Sapiens
VTFLKNGDV

SEQ ID NO: 48636 - protein, 9 aa, Homo Sapiens
GRGKRCQPP

SEQ ID NO: 48637 - protein, 9 aa, Homo Sapiens
LNQWKTQGG

SEQ ID NO: 48638 - protein, 9 aa, Homo Sapiens
NTLLNLACT

SEQ ID NO: 48639 - protein, 9 aa, Homo Sapiens
PRREAQPEA

SEQ ID NO: 48640 - protein, 9 aa, Homo Sapiens
QLEVAEGSP

SEQ ID NO: 48641 - protein, 9 aa, Homo Sapiens
EERNRTQIV

SEQ ID NO: 48642 - protein, 9 aa, Homo Sapiens
EKRVVCETE

SEQ ID NO: 48643 - protein, 9 aa, Homo Sapiens
GQHESRSNQ

SEQ ID NO: 48644 - protein, 9 aa, Homo Sapiens
YSGLEYEYR

SEQ ID NO: 48645 - protein, 9 aa, Homo Sapiens
ILLKRHQEP

SEQ ID NO: 48646 - protein, 9 aa, Homo Sapiens
LKRHQEPIA

SEQ ID NO: 48647 - protein, 9 aa, Homo Sapiens
IGKPSLDRP

SEQ ID NO: 48648 - protein, 9 aa, Homo Sapiens
WKKKMSCAS

SEQ ID NO: 48649 - protein, 9 aa, Homo Sapiens
RGPRKYPYL

SEQ ID NO: 48650 - protein, 9 aa, Homo Sapiens
ALSKEKRVV

SEQ ID NO: 48651 - protein, 9 aa, Homo Sapiens
FLKNGDVAM

SEQ ID NO: 48652 - protein, 9 aa, Homo Sapiens
WLAVWLDLI

SEQ ID NO: 48653 - protein, 9 aa, Homo Sapiens
PSNPPKDVY

SEQ ID NO: 48654 - protein, 9 aa, Homo Sapiens
KPQQLISHC

SEQ ID NO: 48655 - protein, 9 aa, Homo Sapiens
CPLVLVVLS

SEQ ID NO: 48656 - protein, 9 aa, Homo Sapiens
QEPIANWGL

SEQ ID NO: 48657 - protein, 9 aa, Homo Sapiens
AITMCVLCL

SEQ ID NO: 48658 - protein, 9 aa, Homo Sapiens
HRAPETQPL

SEQ ID NO: 48659 - protein, 9 aa, Homo Sapiens
FLSLIHRTY

SEQ ID NO: 48660 - protein, 9 aa, Homo Sapiens
QLISHCEGP

SEQ ID NO: 48661 - protein, 9 aa, Homo Sapiens
QPHILLKRH

SEQ ID NO: 48662 - protein, 9 aa, Homo Sapiens
FQGTLLFIY

SEQ ID NO: 48663 - protein, 9 aa, Homo Sapiens
PTPPALEEV

SEQ ID NO: 48664 - protein, 9 aa, Homo Sapiens
NVTLQQLEV

SEQ ID NO: 48665 - protein, 9 aa, Homo Sapiens
YIWQNFVEQ

SEQ ID NO: 48666 - protein, 9 aa, Homo Sapiens
AEERNRTQI

SEQ ID NO: 48667 - protein, 9 aa, Homo Sapiens
RAAAGTAAL

SEQ ID NO: 48668 - protein, 9 aa, Homo Sapiens
GLRGEKLLP

SEQ ID NO: 48669 - protein, 9 aa, Homo Sapiens
CPVTFLKNG

SEQ ID NO: 48670 - protein, 9 aa, Homo Sapiens
TKYFRLIIM

SEQ ID NO: 48671 - protein, 9 aa, Homo Sapiens
PVFTDLPFP

SEQ ID NO: 48672 - protein, 9 aa, Homo Sapiens
SHKAVTTCS

SEQ ID NO: 48673 - protein, 9 aa, Homo Sapiens
KQLQMNMCA

SEQ ID NO: 48674 - protein, 9 aa, Homo Sapiens
LGKVGKLTQ

SEQ ID NO: 48675 - protein, 9 aa, Homo Sapiens
PPGTVTERL

SEQ ID NO: 48676 - protein, 9 aa, Homo Sapiens
GLDALVVGR

SEQ ID NO: 48677 - protein, 9 aa, Homo Sapiens
SMRSEEASH

SEQ ID NO: 48678 - protein, 9 aa, Homo Sapiens
QVKPEMKGR

SEQ ID NO: 48679 - protein, 9 aa, Homo Sapiens
SRALNGFAP

SEQ ID NO: 48680 - protein, 9 aa, Homo Sapiens
KSAVLLPPD

SEQ ID NO: 48681 - protein, 9 aa, Homo Sapiens
QLTFPCTLL

SEQ ID NO: 48682 - protein, 9 aa, Homo Sapiens
EYIWQNFVE

SEQ ID NO: 48683 - protein, 9 aa, Homo Sapiens
IYFRPSSSY

SEQ ID NO: 48684 - protein, 9 aa, Homo Sapiens
YPHTRDVYI

SEQ ID NO: 48685 - protein, 9 aa, Homo Sapiens
FLQAAKKIY

SEQ ID NO: 48686 - protein, 9 aa, Homo Sapiens
NYHQDVDTP

SEQ ID NO: 48687 - protein, 9 aa, Homo Sapiens
AALLGPEAE

SEQ ID NO: 48688 - protein, 9 aa, Homo Sapiens
LQLEINQLK

SEQ ID NO: 48689 - protein, 9 aa, Homo Sapiens
FRLIIMSKS

SEQ ID NO: 48690 - protein, 9 aa, Homo Sapiens
HLLSVSEID

SEQ ID NO: 48691 - protein, 9 aa, Homo Sapiens
FAPLHIACK

SEQ ID NO: 48692 - protein, 9 aa, Homo Sapiens
LEYEYRGLI

SEQ ID NO: 48693 - protein, 9 aa, Homo Sapiens
SYFKVLCAK

SEQ ID NO: 48694 - protein, 9 aa, Homo Sapiens
PPKGLRGEK

SEQ ID NO: 48695 - protein, 9 aa, Homo Sapiens
QTPEGAPSN

SEQ ID NO: 48696 - protein, 9 aa, Homo Sapiens
KPEMKGRGK

SEQ ID NO: 48697 - protein, 9 aa, Homo Sapiens
LSSSRGPRK

SEQ ID NO: 48698 - protein, 9 aa, Homo Sapiens
KLLPVVPRQ

SEQ ID NO: 48699 - protein, 9 aa, Homo Sapiens
MDSPQVAHW

SEQ ID NO: 48700 - protein, 9 aa, Homo Sapiens
LIWKKKMSC

SEQ ID NO: 48701 - protein, 9 aa, Homo Sapiens
SDDALSKEK

SEQ ID NO: 48702 - protein, 9 aa, Homo Sapiens
YLPTTLQVK

SEQ ID NO: 48703 - protein, 9 aa, Homo Sapiens
GIEEADSYF

SEQ ID NO: 48704 - protein, 9 aa, Homo Sapiens
LFIYFRPSS

SEQ ID NO: 48705 - protein, 9 aa, Homo Sapiens
SLLQNMWDG

SEQ ID NO: 48706 - protein, 9 aa, Homo Sapiens
SSRGPRKYP

SEQ ID NO: 48707 - protein, 9 aa, Homo Sapiens
KEARRFLPL

SEQ ID NO: 48708 - protein, 9 aa, Homo Sapiens
YEYRGLIKL

SEQ ID NO: 48709 - protein, 9 aa, Homo Sapiens
RTQIVFQSF

SEQ ID NO: 48710 - protein, 9 aa, Homo Sapiens
IEEADSYFK

SEQ ID NO: 48711 - protein, 9 aa, Homo Sapiens
VCPLVLVVL

SEQ ID NO: 48712 - protein, 9 aa, Homo Sapiens
PVVPRQRGG

SEQ ID NO: 48713 - protein, 9 aa, Homo Sapiens
PAPTVSQQQ

SEQ ID NO: 48714 - protein, 9 aa, Homo Sapiens
KVQKKSKSG

SEQ ID NO: 48715 - protein, 9 aa, Homo Sapiens
KISLGKVGK

SEQ ID NO: 48716 - protein, 9 aa, Homo Sapiens
QKKSKSGEG

SEQ ID NO: 48717 - protein, 9 aa, Homo Sapiens
CHLLSVSEI

SEQ ID NO: 48718 - protein, 9 aa, Homo Sapiens
PKRNPPASL

SEQ ID NO: 48719 - protein, 9 aa, Homo Sapiens
EGYSGLEYE

SEQ ID NO: 48720 - protein, 9 aa, Homo Sapiens
QGTLLFIYF

SEQ ID NO: 48721 - protein, 9 aa, Homo Sapiens
TQIVFQSFA

SEQ ID NO: 48722 - protein, 9 aa, Homo Sapiens
LFPVFTDLP

SEQ ID NO: 48723 - protein, 9 aa, Homo Sapiens
ISHCEGPSA

SEQ ID NO: 48724 - protein, 9 aa, Homo Sapiens
LPVVPRQRG

SEQ ID NO: 48725 - protein, 9 aa, Homo Sapiens
FDGFRWNYH

SEQ ID NO: 48726 - protein, 9 aa, Homo Sapiens
LEQPFRMEL

SEQ ID NO: 48727 - protein, 9 aa, Homo Sapiens
LCYTNSSIP

SEQ ID NO: 48728 - protein, 9 aa, Homo Sapiens
RWLAVWLDL

SEQ ID NO: 48729 - protein, 9 aa, Homo Sapiens
GENVTLQQL

SEQ ID NO: 48730 - protein, 9 aa, Homo Sapiens
RQKVQKKSK

SEQ ID NO: 48731 - protein, 9 aa, Homo Sapiens
KFKGDHWAL

SEQ ID NO: 48732 - protein, 9 aa, Homo Sapiens
GKNLFFNED

SEQ ID NO: 48733 - protein, 9 aa, Homo Sapiens
FEYIWQNFV

SEQ ID NO: 48734 - protein, 9 aa, Homo Sapiens
GKRCQPPKG

SEQ ID NO: 48735 - protein, 9 aa, Homo Sapiens
RSEEASHKA

SEQ ID NO: 48736 - protein, 9 aa, Homo Sapiens
FMCDLNTLL

SEQ ID NO: 48737 - protein, 9 aa, Homo Sapiens
TERLPSVIV

SEQ ID NO: 48738 - protein, 9 aa, Homo Sapiens
IEGQQLTFP

SEQ ID NO: 48739 - protein, 9 aa, Homo Sapiens
GSERSWMYD

SEQ ID NO: 48740 - protein, 9 aa, Homo Sapiens
STTEYSEIN

SEQ ID NO: 48741 - protein, 9 aa, Homo Sapiens
DFEYIWQNF

SEQ ID NO: 48742 - protein, 9 aa, Homo Sapiens
PQQLISHCE

SEQ ID NO: 48743 - protein, 9 aa, Homo Sapiens
YIGKPSLDR

SEQ ID NO: 48744 - protein, 9 aa, Homo Sapiens
FPVFTDLPF

SEQ ID NO: 48745 - protein, 9 aa, Homo Sapiens
APPRREAQP

SEQ ID NO: 48746 - protein, 9 aa, Homo Sapiens
RGEKLLPVV

SEQ ID NO: 48747 - protein, 9 aa, Homo Sapiens
EYIKPTLRF

SEQ ID NO: 48748 - protein, 9 aa, Homo Sapiens
ASNKMDSLL

SEQ ID NO: 48749 - protein, 9 aa, Homo Sapiens
KSAGATANR

SEQ ID NO: 48750 - protein, 9 aa, Homo Sapiens
KTKYFRLII

SEQ ID NO: 48751 - protein, 9 aa, Homo Sapiens
NGFAPLHIA

SEQ ID NO: 48752 - protein, 9 aa, Homo Sapiens
LKNGDVAMP

SEQ ID NO: 48753 - protein, 9 aa, Homo Sapiens
SVLQFLSLI

SEQ ID NO: 48754 - protein, 9 aa, Homo Sapiens
LEEVPQELQ

SEQ ID NO: 48755 - protein, 9 aa, Homo Sapiens
CGILSSGKN

SEQ ID NO: 48756 - protein, 9 aa, Homo Sapiens
LQKKTKLTV

SEQ ID NO: 48757 - protein, 9 aa, Homo Sapiens
APAPPRREA

SEQ ID NO: 48758 - protein, 9 aa, Homo Sapiens
QKKTKLTVL

SEQ ID NO: 48759 - protein, 9 aa, Homo Sapiens
NPPASLDPV

SEQ ID NO: 48760 - protein, 9 aa, Homo Sapiens
GYSGLEYEY

SEQ ID NO: 48761 - protein, 9 aa, Homo Sapiens
LLPPDSRCC

SEQ ID NO: 48762 - protein, 9 aa, Homo Sapiens
GPEAEPSRH

SEQ ID NO: 48763 - protein, 9 aa, Homo Sapiens
MATQGFSCH

SEQ ID NO: 48764 - protein, 9 aa, Homo Sapiens
HQEPIANWG

SEQ ID NO: 48765 - protein, 9 aa, Homo Sapiens
GTAALLGPE

SEQ ID NO: 48766 - protein, 9 aa, Homo Sapiens
AAAGTAALL

SEQ ID NO: 48767 - protein, 9 aa, Homo Sapiens
AAFRVAKKR

SEQ ID NO: 48768 - protein, 9 aa, Homo Sapiens
TEYSEINTS

SEQ ID NO: 48769 - protein, 9 aa, Homo Sapiens
DLQLEINQL

SEQ ID NO: 48770 - protein, 9 aa, Homo Sapiens
KRCQPPKGL

SEQ ID NO: 48771 - protein, 9 aa, Homo Sapiens
MNMCALEEE

SEQ ID NO: 48772 - protein, 9 aa, Homo Sapiens
LQAAKKIYQ

SEQ ID NO: 48773 - protein, 9 aa, Homo Sapiens
GRAAAGTAA

SEQ ID NO: 48774 - protein, 9 aa, Homo Sapiens
ELFPVFTDL

SEQ ID NO: 48775 - protein, 9 aa, Homo Sapiens
PHTRDVYIG

SEQ ID NO: 48776 - protein, 9 aa, Homo Sapiens
ASLDPVQPH

SEQ ID NO: 48777 - protein, 9 aa, Homo Sapiens
LAGDTQPRF

SEQ ID NO: 48778 - protein, 9 aa, Homo Sapiens
NPPKDVYYA

SEQ ID NO: 48779 - protein, 9 aa, Homo Sapiens
QMNMCALEE

SEQ ID NO: 48780 - protein, 9 aa, Homo Sapiens
QDFEYIWQN

SEQ ID NO: 48781 - protein, 9 aa, Homo Sapiens
MNCVCPLVL

SEQ ID NO: 48782 - protein, 9 aa, Homo Sapiens
REEFSKLQK

SEQ ID NO: 48783 - protein, 9 aa, Homo Sapiens
HVERYLPKR

SEQ ID NO: 48784 - protein, 9 aa, Homo Sapiens
KRHQEPIAN

SEQ ID NO: 48785 - protein, 9 aa, Homo Sapiens
GFSCHLLSV

SEQ ID NO: 48786 - protein, 9 aa, Homo Sapiens
KLQKKTKLT

SEQ ID NO: 48787 - protein, 9 aa, Homo Sapiens
TPEGAPSNP

SEQ ID NO: 48788 - protein, 9 aa, Homo Sapiens
DQEYIKPTL

SEQ ID NO: 48789 - protein, 9 aa, Homo Sapiens
APSNPPKDV

SEQ ID NO: 48790 - protein, 9 aa, Homo Sapiens
EYRGLIKLY

SEQ ID NO: 48791 - protein, 9 aa, Homo Sapiens
TNSSIPQLL

SEQ ID NO: 48792 - protein, 9 aa, Homo Sapiens
LPAAFRVAK

SEQ ID NO: 48793 - protein, 9 aa, Homo Sapiens
FRWNYHQDV

SEQ ID NO: 48794 - protein, 9 aa, Homo Sapiens
CYTNSSIPQ

SEQ ID NO: 48795 - protein, 9 aa, Homo Sapiens
AMRWLAVWL

SEQ ID NO: 48796 - protein, 9 aa, Homo Sapiens
WGLWLHRSL

SEQ ID NO: 48797 - protein, 9 aa, Homo Sapiens
PFRMELIQG

SEQ ID NO: 48798 - protein, 9 aa, Homo Sapiens
LVVGRWRVS

SEQ ID NO: 48799 - protein, 9 aa, Homo Sapiens
KGDHWALDG

SEQ ID NO: 48800 - protein, 9 aa, Homo Sapiens
HCEGPSASE

SEQ ID NO: 48801 - protein, 9 aa, Homo Sapiens
IGIEEADSY

SEQ ID NO: 48802 - protein, 9 aa, Homo Sapiens
PPASLDPVQ

SEQ ID NO: 48803 - protein, 9 aa, Homo Sapiens
YFRLIIMSK

SEQ ID NO: 48804 - protein, 9 aa, Homo Sapiens
HPGAPAPPR

SEQ ID NO: 48805 - protein, 9 aa, Homo Sapiens
ANWGLWLHR

SEQ ID NO: 48806 - protein, 9 aa, Homo Sapiens
RNPPASLDP

SEQ ID NO: 48807 - protein, 9 aa, Homo Sapiens
RGGLPHVER

SEQ ID NO: 48808 - protein, 9 aa, Homo Sapiens
EGQQLTFPC

SEQ ID NO: 48809 - protein, 9 aa, Homo Sapiens
LALAGDTQP

SEQ ID NO: 48810 - protein, 9 aa, Homo Sapiens
PSAHSAHSA

SEQ ID NO: 48811 - protein, 9 aa, Homo Sapiens
PVTFLKNGD

SEQ ID NO: 48812 - protein, 9 aa, Homo Sapiens
LLQNMWDGN

SEQ ID NO: 48813 - protein, 9 aa, Homo Sapiens
GDTQPRFLQ

SEQ ID NO: 48814 - protein, 9 aa, Homo Sapiens
EASHKAVTT

SEQ ID NO: 48815 - protein, 9 aa, Homo Sapiens
PASAIQKSA

SEQ ID NO: 48816 - protein, 9 aa, Homo Sapiens
APETQPLAP

SEQ ID NO: 48817 - protein, 9 aa, Homo Sapiens
RDLQLEINQ

SEQ ID NO: 48818 - protein, 9 aa, Homo Sapiens
IIAEERNRT

SEQ ID NO: 48819 - protein, 9 aa, Homo Sapiens
SKLQKKTKL

SEQ ID NO: 48820 - protein, 9 aa, Homo Sapiens
TQGFSCHLL

SEQ ID NO: 48821 - protein, 9 aa, Homo Sapiens
KCGILSSGK

SEQ ID NO: 48822 - protein, 9 aa, Homo Sapiens
SRGPRKYPY

SEQ ID NO: 48823 - protein, 9 aa, Homo Sapiens
SERSWMYDY

SEQ ID NO: 48824 - protein, 9 aa, Homo Sapiens
LSKEKRVVC

SEQ ID NO: 48825 - protein, 9 aa, Homo Sapiens
NSHRAPETQ

SEQ ID NO: 48826 - protein, 9 aa, Homo Sapiens
LPHVERYLP

SEQ ID NO: 48827 - protein, 9 aa, Homo Sapiens
IWQNFVEQE

SEQ ID NO: 48828 - protein, 9 aa, Homo Sapiens
MDSLLQNMW

SEQ ID NO: 48829 - protein, 9 aa, Homo Sapiens
LGPEAEPSR

SEQ ID NO: 48830 - protein, 9 aa, Homo Sapiens
PRQRGGLPH

SEQ ID NO: 48831 - protein, 9 aa, Homo Sapiens
SCHLLSVSE

SEQ ID NO: 48832 - protein, 9 aa, Homo Sapiens
GLPHVERYL

SEQ ID NO: 48833 - protein, 9 aa, Homo Sapiens
VSPASAIQK

SEQ ID NO: 48834 - protein, 9 aa, Homo Sapiens
CQPPKGLRG

SEQ ID NO: 48835 - protein, 9 aa, Homo Sapiens
ILSSGKNLF

SEQ ID NO: 48836 - protein, 9 aa, Homo Sapiens
VQPHILLKR

SEQ ID NO: 48837 - protein, 9 aa, Homo Sapiens
IHRTYPQDP

SEQ ID NO: 48838 - protein, 9 aa, Homo Sapiens
VLQFLSLIH

SEQ ID NO: 48839 - protein, 9 aa, Homo Sapiens
WAAAIIVLT

SEQ ID NO: 48840 - protein, 9 aa, Homo Sapiens
LDLCYTNSS

SEQ ID NO: 48841 - protein, 9 aa, Homo Sapiens
GEKLLPVVP

SEQ ID NO: 48842 - protein, 9 aa, Homo Sapiens
HGQTLGQRV

SEQ ID NO: 48843 - protein, 9 aa, Homo Sapiens
NSRALNGFA

SEQ ID NO: 48844 - protein, 9 aa, Homo Sapiens
GTLLFIYFR

SEQ ID NO: 48845 - protein, 9 aa, Homo Sapiens
HQPAPTVSQ

SEQ ID NO: 48846 - protein, 9 aa, Homo Sapiens
FTDLPFPKD

SEQ ID NO: 48847 - protein, 9 aa, Homo Sapiens
NQWKTQGGG

SEQ ID NO: 48848 - protein, 9 aa, Homo Sapiens
SLSSSRGPR

SEQ ID NO: 48849 - protein, 9 aa, Homo Sapiens
LAVWLDLIS

SEQ ID NO: 48850 - protein, 9 aa, Homo Sapiens
VLCLRDRAS

SEQ ID NO: 48851 - protein, 9 aa, Homo Sapiens
SHCQHKVKE

SEQ ID NO: 48852 - protein, 9 aa, Homo Sapiens
TRDVYIGKP

SEQ ID NO: 48853 - protein, 9 aa, Homo Sapiens
RKYPYLPTT

SEQ ID NO: 48854 - protein, 9 aa, Homo Sapiens
DGENVTLQQ

SEQ ID NO: 48855 - protein, 9 aa, Homo Sapiens
KKSKSGEGE

SEQ ID NO: 48856 - protein, 9 aa, Homo Sapiens
LQFLSLIHR

SEQ ID NO: 48857 - protein, 9 aa, Homo Sapiens
IKPTLRFKA

SEQ ID NO: 48858 - protein, 9 aa, Homo Sapiens
QHKVKEARR

SEQ ID NO: 48859 - protein, 9 aa, Homo Sapiens
HTRDVYIGK

SEQ ID NO: 48860 - protein, 9 aa, Homo Sapiens
MCDLNTLLN

SEQ ID NO: 48861 - protein, 9 aa, Homo Sapiens
PHILLKRHQ

SEQ ID NO: 48862 - protein, 9 aa, Homo Sapiens
PKGLRGEKL

SEQ ID NO: 48863 - protein, 9 aa, Homo Sapiens
DPVQPHILL

SEQ ID NO: 48864 - protein, 9 aa, Homo Sapiens
KYPYLPTTL

SEQ ID NO: 48865 - protein, 9 aa, Homo Sapiens
EEVPQELQS

SEQ ID NO: 48866 - protein, 9 aa, Homo Sapiens
SEEASHKAV

SEQ ID NO: 48867 - protein, 9 aa, Homo Sapiens
DLPFPKDAS

SEQ ID NO: 48868 - protein, 9 aa, Homo Sapiens
MELIQGSKV

SEQ ID NO: 48869 - protein, 9 aa, Homo Sapiens
LLGPEAEPS

SEQ ID NO: 48870 - protein, 9 aa, Homo Sapiens
KPQDFEYIW

SEQ ID NO: 48871 - protein, 9 aa, Homo Sapiens
AHSAHSAPT

SEQ ID NO: 48872 - protein, 9 aa, Homo Sapiens
FIYFRPSSS

SEQ ID NO: 48873 - protein, 9 aa, Homo Sapiens
LISAVLPAA

SEQ ID NO: 48874 - protein, 9 aa, Homo Sapiens
QKVQKKSKS

SEQ ID NO: 48875 - protein, 9 aa, Homo Sapiens
PEGAPSNPP

SEQ ID NO: 48876 - protein, 9 aa, Homo Sapiens
PQVAHWLDG

SEQ ID NO: 48877 - protein, 9 aa, Homo Sapiens
QKSAGATAN

SEQ ID NO: 48878 - protein, 9 aa, Homo Sapiens
EFSKLQKKT

SEQ ID NO: 48879 - protein, 9 aa, Homo Sapiens
QLEINQLKH

SEQ ID NO: 48880 - protein, 9 aa, Homo Sapiens
SKEKRVVCE

SEQ ID NO: 48881 - protein, 9 aa, Homo Sapiens
KVKEARRFL

SEQ ID NO: 48882 - protein, 9 aa, Homo Sapiens
TVSQQQAWP

SEQ ID NO: 48883 - protein, 9 aa, Homo Sapiens
RKPQQLISH

SEQ ID NO: 48884 - protein, 9 aa, Homo Sapiens
NQSNYGQHG

SEQ ID NO: 48885 - protein, 9 aa, Homo Sapiens
MNKFKGDHW

SEQ ID NO: 48886 - protein, 9 aa, Homo Sapiens
ERKPEEKQR

SEQ ID NO: 48887 - protein, 9 aa, Homo Sapiens
LPLIWKKKM

SEQ ID NO: 48888 - protein, 9 aa, Homo Sapiens
ALAGDTQPR

SEQ ID NO: 48889 - protein, 9 aa, Homo Sapiens
SAVLPAAFR

SEQ ID NO: 48890 - protein, 9 aa, Homo Sapiens
LQVKPEMKG

SEQ ID NO: 48891 - protein, 9 aa, Homo Sapiens
PAAFRVAKK

SEQ ID NO: 48892 - protein, 9 aa, Homo Sapiens
RKSAVLLPP

SEQ ID NO: 48893 - protein, 9 aa, Homo Sapiens
DHFMCDLNT

SEQ ID NO: 48894 - protein, 9 aa, Homo Sapiens
TFPCTLLAG

SEQ ID NO: 48895 - protein, 9 aa, Homo Sapiens
RGPSAHSAH

SEQ ID NO: 48896 - protein, 9 aa, Homo Sapiens
LLKRHQEPI

SEQ ID NO: 48897 - protein, 9 aa, Homo Sapiens
LQNMWDGNI

SEQ ID NO: 48898 - protein, 9 aa, Homo Sapiens
EERKPEEKQ

SEQ ID NO: 48899 - protein, 9 aa, Homo Sapiens
ITMCVLCLR

SEQ ID NO: 48900 - protein, 9 aa, Homo Sapiens
VRKSAVLLP

SEQ ID NO: 48901 - protein, 9 aa, Homo Sapiens
LRGEKLLPV

SEQ ID NO: 48902 - protein, 9 aa, Homo Sapiens
RALNGFAPL

SEQ ID NO: 48903 - protein, 9 aa, Homo Sapiens
TMCVLCLRD

SEQ ID NO: 48904 - protein, 9 aa, Homo Sapiens
VYIGKPSLD

SEQ ID NO: 48905 - protein, 9 aa, Homo Sapiens
DSYFKVLCA

SEQ ID NO: 48906 - protein, 9 aa, Homo Sapiens
AIQKSAGAT

SEQ ID NO: 48907 - protein, 9 aa, Homo Sapiens
MKPQDFEYI

SEQ ID NO: 48908 - protein, 9 aa, Homo Sapiens
HQDVDTPNL

SEQ ID NO: 48909 - protein, 9 aa, Homo Sapiens
RSNQSNYGQ

SEQ ID NO: 48910 - protein, 9 aa, Homo Sapiens
GKVGKLTQT

SEQ ID NO: 48911 - protein, 9 aa, Homo Sapiens
PLVLVVLSL

SEQ ID NO: 48912 - protein, 9 aa, Homo Sapiens
APTVSQQQA

SEQ ID NO: 48913 - protein, 9 aa, Homo Sapiens
NRTQIVFQS

SEQ ID NO: 48914 - protein, 9 aa, Homo Sapiens
SGLEYEYRG

SEQ ID NO: 48915 - protein, 9 aa, Homo Sapiens
TLLFIYFRP

SEQ ID NO: 48916 - protein, 9 aa, Homo Sapiens
KVGKLTQTS

SEQ ID NO: 48917 - protein, 9 aa, Homo Sapiens
IWKKKMSCA

SEQ ID NO: 48918 - protein, 9 aa, Homo Sapiens
TTEYSEINT

SEQ ID NO: 48919 - protein, 9 aa, Homo Sapiens
NKMDSLLQN

SEQ ID NO: 48920 - protein, 9 aa, Homo Sapiens
SKSGEGENT

SEQ ID NO: 48921 - protein, 9 aa, Homo Sapiens
VAITMCVLC

SEQ ID NO: 48922 - protein, 9 aa, Homo Sapiens
FKGDHWALD

SEQ ID NO: 48923 - protein, 9 aa, Homo Sapiens
TGPSFHSPE

SEQ ID NO: 48924 - protein, 9 aa, Homo Sapiens
LPTTLQVKP

SEQ ID NO: 48925 - protein, 9 aa, Homo Sapiens
VSQQQAWPG

SEQ ID NO: 48926 - protein, 9 aa, Homo Sapiens
VEDAFLQAA

SEQ ID NO: 48927 - protein, 9 aa, Homo Sapiens
SPASAIQKS

SEQ ID NO: 48928 - protein, 9 aa, Homo Sapiens
IANWGLWLH

SEQ ID NO: 48929 - protein, 9 aa, Homo Sapiens
LQMNMCALE

SEQ ID NO: 48930 - protein, 9 aa, Homo Sapiens
QDQEYIKPT

SEQ ID NO: 48931 - protein, 9 aa, Homo Sapiens
RVPGFPTAP

SEQ ID NO: 48932 - protein, 9 aa, Homo Sapiens
TAALLGPEA

SEQ ID NO: 48933 - protein, 9 aa, Homo Sapiens
AVEAAFKCW

SEQ ID NO: 48934 - protein, 9 aa, Homo Sapiens
IQKSAGATA

SEQ ID NO: 48935 - protein, 9 aa, Homo Sapiens
LCLRDRASA

SEQ ID NO: 48936 - protein, 9 aa, Homo Sapiens
ANSHRAPET

SEQ ID NO: 48937 - protein, 9 aa, Homo Sapiens
GQRVPGFPT

SEQ ID NO: 48938 - protein, 9 aa, Homo Sapiens
SSSLLTGPS

SEQ ID NO: 48939 - protein, 9 aa, Homo Sapiens
EARRFLPLV

SEQ ID NO: 48940 - protein, 9 aa, Homo Sapiens
PTTLQVKPE

SEQ ID NO: 48941 - protein, 9 aa, Homo Sapiens
PLALAGDTQ

SEQ ID NO: 48942 - protein, 9 aa, Homo Sapiens
KRNPPASLD

SEQ ID NO: 48943 - protein, 9 aa, Homo Sapiens
TFLKNGDVA

SEQ ID NO: 48944 - protein, 9 aa, Homo Sapiens
PYLPTTLQV

SEQ ID NO: 48945 - protein, 9 aa, Homo Sapiens
KKMSCASNK

SEQ ID NO: 48946 - protein, 9 aa, Homo Sapiens
TLQQLEVAE

SEQ ID NO: 48947 - protein, 9 aa, Homo Sapiens
HILLKRHQE

SEQ ID NO: 48948 - protein, 9 aa, Homo Sapiens
EADSYFKVL

SEQ ID NO: 48949 - protein, 9 aa, Homo Sapiens
KRVVCETEV

SEQ ID NO: 48950 - protein, 9 aa, Homo Sapiens
IQEEERKPE

SEQ ID NO: 48951 - protein, 9 aa, Homo Sapiens
NMCALEEEK

SEQ ID NO: 48952 - protein, 9 aa, Homo Sapiens
SNPPKDVYY

SEQ ID NO: 48953 - protein, 9 aa, Homo Sapiens
RNRTQIVFQ

SEQ ID NO: 48954 - protein, 9 aa, Homo Sapiens
DLCYTNSSI

SEQ ID NO: 48955 - protein, 9 aa, Homo Sapiens
SSGKNLFFN

SEQ ID NO: 48956 - protein, 9 aa, Homo Sapiens
KNGDVAMPR

SEQ ID NO: 48957 - protein, 9 aa, Homo Sapiens
TLGQRVPGF

SEQ ID NO: 48958 - protein, 9 aa, Homo Sapiens
AFKCWAAAI

SEQ ID NO: 48959 - protein, 9 aa, Homo Sapiens
LDALVVGRW

SEQ ID NO: 48960 - protein, 9 aa, Homo Sapiens
VQKKSKSGE

SEQ ID NO: 48961 - protein, 9 aa, Homo Sapiens
CVLCLRDRA

SEQ ID NO: 48962 - protein, 9 aa, Homo Sapiens
WNYHQDVDT

SEQ ID NO: 48963 - protein, 9 aa, Homo Sapiens
ALLGPEAEP

SEQ ID NO: 48964 - protein, 9 aa, Homo Sapiens
LSMRSEEAS

SEQ ID NO: 48965 - protein, 9 aa, Homo Sapiens
VKPEMKGRG

SEQ ID NO: 48966 - protein, 9 aa, Homo Sapiens
MCVLCLRDR

SEQ ID NO: 48967 - protein, 9 aa, Homo Sapiens
GGLDALVVG

SEQ ID NO: 48968 - protein, 9 aa, Homo Sapiens
VKEARRFLP

SEQ ID NO: 48969 - protein, 9 aa, Homo Sapiens
TLLNLACTD

SEQ ID NO: 48970 - protein, 9 aa, Homo Sapiens
ADSYFKVLC

SEQ ID NO: 48971 - protein, 9 aa, Homo Sapiens
VLPAAFRVA

SEQ ID NO: 48972 - protein, 9 aa, Homo Sapiens
ISAVLPAAF

SEQ ID NO: 48973 - protein, 9 aa, Homo Sapiens
CAMRWLAVW

SEQ ID NO: 48974 - protein, 9 aa, Homo Sapiens
KNLFFNEDG

SEQ ID NO: 48975 - protein, 9 aa, Homo Sapiens
QTLGQRVPG

SEQ ID NO: 48976 - protein, 9 aa, Homo Sapiens
AAGTAALLG

SEQ ID NO: 48977 - protein, 9 aa, Homo Sapiens
SHCEGPSAS

SEQ ID NO: 48978 - protein, 9 aa, Homo Sapiens
ENVTLQQLE

SEQ ID NO: 48979 - protein, 9 aa, Homo Sapiens
RHQEPIANW

SEQ ID NO: 48980 - protein, 9 aa, Homo Sapiens
VFTDLPFPK

SEQ ID NO: 48981 - protein, 9 aa, Homo Sapiens
SNQSNYGQH

SEQ ID NO: 48982 - protein, 9 aa, Homo Sapiens
QRGGLPHVE

SEQ ID NO: 48983 - protein, 9 aa, Homo Sapiens
GFAPLHIAC

SEQ ID NO: 48984 - protein, 9 aa, Homo Sapiens
ATQGFSCHL

SEQ ID NO: 48985 - protein, 9 aa, Homo Sapiens
YFKVLCAKD

SEQ ID NO: 48986 - protein, 9 aa, Homo Sapiens
QPFRMELIQ

SEQ ID NO: 48987 - protein, 9 aa, Homo Sapiens
KSKSGEGEN

SEQ ID NO: 48988 - protein, 9 aa, Homo Sapiens
CWAAAIIVL

SEQ ID NO: 48989 - protein, 9 aa, Homo Sapiens
IIMSKSLVN

SEQ ID NO: 48990 - protein, 9 aa, Homo Sapiens
QQLISHCEG

SEQ ID NO: 48991 - protein, 9 aa, Homo Sapiens
KKQLQMNMC

SEQ ID NO: 48992 - protein, 9 aa, Homo Sapiens
EYEYRGLIK

SEQ ID NO: 48993 - protein, 9 aa, Homo Sapiens
LQQLEVAEG

SEQ ID NO: 48994 - protein, 9 aa, Homo Sapiens
LLFIYFRPS

SEQ ID NO: 48995 - protein, 9 aa, Homo Sapiens
GLRFMDSPQ

SEQ ID NO: 48996 - protein, 9 aa, Homo Sapiens
PIANWGLWL

SEQ ID NO: 48997 - protein, 9 aa, Homo Sapiens
SHRAPETQP

SEQ ID NO: 48998 - protein, 9 aa, Homo Sapiens
WLDLISIAL

SEQ ID NO: 48999 - protein, 9 aa, Homo Sapiens
PLHQPAPTV

SEQ ID NO: 49000 - protein, 9 aa, Homo Sapiens
LGGLDALVV

SEQ ID NO: 49001 - protein, 9 aa, Homo Sapiens
RELFPVFTD

SEQ ID NO: 49002 - protein, 9 aa, Homo Sapiens
INQLKHSLM

SEQ ID NO: 49003 - protein, 9 aa, Homo Sapiens
SRSNQSNYG

SEQ ID NO: 49004 - protein, 9 aa, Homo Sapiens
SLDPVQPHI

SEQ ID NO: 49005 - protein, 9 aa, Homo Sapiens
CQHKVKEAR

SEQ ID NO: 49006 - protein, 9 aa, Homo Sapiens
WSLEQPFRM

SEQ ID NO: 49007 - protein, 9 aa, Homo Sapiens
AVLLPPDSR

SEQ ID NO: 49008 - protein, 9 aa, Homo Sapiens
VERYLPKRN

SEQ ID NO: 49009 - protein, 9 aa, Homo Sapiens
FSCHLLSVS

SEQ ID NO: 49010 - protein, 9 aa, Homo Sapiens
RFMDSPQVA

SEQ ID NO: 49011 - protein, 9 aa, Homo Sapiens
PGAPAPPRR

SEQ ID NO: 49012 - protein, 9 aa, Homo Sapiens
HSAHSAPTS

SEQ ID NO: 49013 - protein, 9 aa, Homo Sapiens
NVEDAFLQA

SEQ ID NO: 49014 - protein, 9 aa, Homo Sapiens
QLGGLDALV

SEQ ID NO: 49015 - protein, 9 aa, Homo Sapiens
NGDVAMPRK

SEQ ID NO: 49016 - protein, 9 aa, Homo Sapiens
HCQHKVKEA

SEQ ID NO: 49017 - protein, 9 aa, Homo Sapiens
AGTAALLGP

SEQ ID NO: 49018 - protein, 9 aa, Homo Sapiens
SSLLTGPSF

SEQ ID NO: 49019 - protein, 9 aa, Homo Sapiens
QQLTFPCTL

SEQ ID NO: 49020 - protein, 9 aa, Homo Sapiens
TTLQVKPEM

SEQ ID NO: 49021 - protein, 9 aa, Homo Sapiens
CDLNTLLNL

SEQ ID NO: 49022 - protein, 9 aa, Homo Sapiens
NRQKVQKKS

SEQ ID NO: 49023 - protein, 9 aa, Homo Sapiens
LRFMDSPQV

SEQ ID NO: 49024 - protein, 9 aa, Homo Sapiens
LIIMSKSLV

SEQ ID NO: 49025 - protein, 9 aa, Homo Sapiens
FKKQLQMNM

SEQ ID NO: 49026 - protein, 9 aa, Homo Sapiens
SSSRGPRKY

SEQ ID NO: 49027 - protein, 9 aa, Homo Sapiens
IPQLTRAVQ

SEQ ID NO: 49028 - protein, 9 aa, Homo Sapiens
QLRQLRMVQ

SEQ ID NO: 49029 - protein, 9 aa, Homo Sapiens
KMLLIQGAT

SEQ ID NO: 49030 - protein, 9 aa, Homo Sapiens
RMLLKAIIW

SEQ ID NO: 49031 - protein, 9 aa, Homo Sapiens
LGEGAVKMP

SEQ ID NO: 49032 - protein, 9 aa, Homo Sapiens
RGINASKDL

SEQ ID NO: 49033 - protein, 9 aa, Homo Sapiens
LVGLIYKDM

SEQ ID NO: 49034 - protein, 9 aa, Homo Sapiens
VTCSLDRNL

SEQ ID NO: 49035 - protein, 9 aa, Homo Sapiens
KYSEVFQAI

SEQ ID NO: 49036 - protein, 9 aa, Homo Sapiens
QMREAFRML

SEQ ID NO: 49037 - protein, 9 aa, Homo Sapiens
QAPLSVFGG

SEQ ID NO: 49038 - protein, 9 aa, Homo Sapiens
SFTSDIIPR

SEQ ID NO: 49039 - protein, 9 aa, Homo Sapiens
LMETDCVSS

SEQ ID NO: 49040 - protein, 9 aa, Homo Sapiens
ACPGSRSGR

SEQ ID NO: 49041 - protein, 9 aa, Homo Sapiens
NVDRRQIIL

SEQ ID NO: 49042 - protein, 9 aa, Homo Sapiens
KNMILDLQN

SEQ ID NO: 49043 - protein, 9 aa, Homo Sapiens
NALLMYSRI

SEQ ID NO: 49044 - protein, 9 aa, Homo Sapiens
CAKSFETEA

SEQ ID NO: 49045 - protein, 9 aa, Homo Sapiens
RCVPDAAGD

SEQ ID NO: 49046 - protein, 9 aa, Homo Sapiens
LRQLRMVQR

SEQ ID NO: 49047 - protein, 9 aa, Homo Sapiens
TPVKRIPQL

SEQ ID NO: 49048 - protein, 9 aa, Homo Sapiens
LQDSPVGDP

SEQ ID NO: 49049 - protein, 9 aa, Homo Sapiens
NIGRKCDRI

SEQ ID NO: 49050 - protein, 9 aa, Homo Sapiens
GDVVNHDLA

SEQ ID NO: 49051 - protein, 9 aa, Homo Sapiens
FSPCVGQVT

SEQ ID NO: 49052 - protein, 9 aa, Homo Sapiens
VCGWLGPKT

SEQ ID NO: 49053 - protein, 9 aa, Homo Sapiens
KKGSFLIDS

SEQ ID NO: 49054 - protein, 9 aa, Homo Sapiens
RAQTGLDMR

SEQ ID NO: 49055 - protein, 9 aa, Homo Sapiens
GSFLIDSST

SEQ ID NO: 49056 - protein, 9 aa, Homo Sapiens
GGISSPALT

SEQ ID NO: 49057 - protein, 9 aa, Homo Sapiens
VAKPLIVAH

SEQ ID NO: 49058 - protein, 9 aa, Homo Sapiens
SEWWFKTAY

SEQ ID NO: 49059 - protein, 9 aa, Homo Sapiens
RTASSFQWL

SEQ ID NO: 49060 - protein, 9 aa, Homo Sapiens
GTKRKRDVR

SEQ ID NO: 49061 - protein, 9 aa, Homo Sapiens
CLQQIEELK

SEQ ID NO: 49062 - protein, 9 aa, Homo Sapiens
MFNPMYAFF

SEQ ID NO: 49063 - protein, 9 aa, Homo Sapiens
ANSKISQVC

SEQ ID NO: 49064 - protein, 9 aa, Homo Sapiens
TVLNPPVTA

SEQ ID NO: 49065 - protein, 9 aa, Homo Sapiens
DFFSALPSQ

SEQ ID NO: 49066 - protein, 9 aa, Homo Sapiens
GQDSETVLD

SEQ ID NO: 49067 - protein, 9 aa, Homo Sapiens
QWENKVKKE

SEQ ID NO: 49068 - protein, 9 aa, Homo Sapiens
AVKMPLDVD

SEQ ID NO: 49069 - protein, 9 aa, Homo Sapiens
LLEVGQPQV

SEQ ID NO: 49070 - protein, 9 aa, Homo Sapiens
WSHLGNVSF

SEQ ID NO: 49071 - protein, 9 aa, Homo Sapiens
ELEQFMEYQ

SEQ ID NO: 49072 - protein, 9 aa, Homo Sapiens
RGSVGHALH

SEQ ID NO: 49073 - protein, 9 aa, Homo Sapiens
SKQAEDTTC

SEQ ID NO: 49074 - protein, 9 aa, Homo Sapiens
EDSTMCVVC

SEQ ID NO: 49075 - protein, 9 aa, Homo Sapiens
VRHIGLVQK

SEQ ID NO: 49076 - protein, 9 aa, Homo Sapiens
KKACAVWNR

SEQ ID NO: 49077 - protein, 9 aa, Homo Sapiens
ASINPVRFQ

SEQ ID NO: 49078 - protein, 9 aa, Homo Sapiens
KEEVNVEGL

SEQ ID NO: 49079 - protein, 9 aa, Homo Sapiens
QPGQSYSLP

SEQ ID NO: 49080 - protein, 9 aa, Homo Sapiens
QRPTIPGTT

SEQ ID NO: 49081 - protein, 9 aa, Homo Sapiens
VILTCDATG

SEQ ID NO: 49082 - protein, 9 aa, Homo Sapiens
HSPHGCCPN

SEQ ID NO: 49083 - protein, 9 aa, Homo Sapiens
GRVLERRTQ

SEQ ID NO: 49084 - protein, 9 aa, Homo Sapiens
TASSFQWLL

SEQ ID NO: 49085 - protein, 9 aa, Homo Sapiens
YSEVFQAIN

SEQ ID NO: 49086 - protein, 9 aa, Homo Sapiens
QRTVCKMQL

SEQ ID NO: 49087 - protein, 9 aa, Homo Sapiens
IINLIKDKR

SEQ ID NO: 49088 - protein, 9 aa, Homo Sapiens
AWYHNFRVT

SEQ ID NO: 49089 - protein, 9 aa, Homo Sapiens
THRPHLKPK

SEQ ID NO: 49090 - protein, 9 aa, Homo Sapiens
VGGTIKSPT

SEQ ID NO: 49091 - protein, 9 aa, Homo Sapiens
TESLCLVQT

SEQ ID NO: 49092 - protein, 9 aa, Homo Sapiens
SDINGFVKF

SEQ ID NO: 49093 - protein, 9 aa, Homo Sapiens
AANVAGSEE

SEQ ID NO: 49094 - protein, 9 aa, Homo Sapiens
QLLKELMQI

SEQ ID NO: 49095 - protein, 9 aa, Homo Sapiens
WYHNFRVTM

SEQ ID NO: 49096 - protein, 9 aa, Homo Sapiens
LKGNKYESD

SEQ ID NO: 49097 - protein, 9 aa, Homo Sapiens
LQALKLQEA

SEQ ID NO: 49098 - protein, 9 aa, Homo Sapiens
WILWRSCLK

SEQ ID NO: 49099 - protein, 9 aa, Homo Sapiens
PLTTVLNPP

SEQ ID NO: 49100 - protein, 9 aa, Homo Sapiens
FLKYDMSIH

SEQ ID NO: 49101 - protein, 9 aa, Homo Sapiens
NMTTVTCSL

SEQ ID NO: 49102 - protein, 9 aa, Homo Sapiens
WRNFKANTK

SEQ ID NO: 49103 - protein, 9 aa, Homo Sapiens
VAGSEECSA

SEQ ID NO: 49104 - protein, 9 aa, Homo Sapiens
EECSAVLTV

SEQ ID NO: 49105 - protein, 9 aa, Homo Sapiens
NLICSEDNA

SEQ ID NO: 49106 - protein, 9 aa, Homo Sapiens
HLTEEEKNR

SEQ ID NO: 49107 - protein, 9 aa, Homo Sapiens
DICIYSSPI

SEQ ID NO: 49108 - protein, 9 aa, Homo Sapiens
YSRLQGFLL

SEQ ID NO: 49109 - protein, 9 aa, Homo Sapiens
NYKFLLQFL

SEQ ID NO: 49110 - protein, 9 aa, Homo Sapiens
LPSLSPTVS

SEQ ID NO: 49111 - protein, 9 aa, Homo Sapiens
FVFLDICIY

SEQ ID NO: 49112 - protein, 9 aa, Homo Sapiens
VTSKVGLSE

SEQ ID NO: 49113 - protein, 9 aa, Homo Sapiens
MDVSKTKQS

SEQ ID NO: 49114 - protein, 9 aa, Homo Sapiens
VAELKQTGR

SEQ ID NO: 49115 - protein, 9 aa, Homo Sapiens
DINGFVKFL

SEQ ID NO: 49116 - protein, 9 aa, Homo Sapiens
RLRTIVLKM

SEQ ID NO: 49117 - protein, 9 aa, Homo Sapiens
RVIIWKTKD

SEQ ID NO: 49118 - protein, 9 aa, Homo Sapiens
CSEDNAVSA

SEQ ID NO: 49119 - protein, 9 aa, Homo Sapiens
FMEYQGASS

SEQ ID NO: 49120 - protein, 9 aa, Homo Sapiens
QRGRGCGQA

SEQ ID NO: 49121 - protein, 9 aa, Homo Sapiens
SLARKKPLF

SEQ ID NO: 49122 - protein, 9 aa, Homo Sapiens
KKNKPHLMA

SEQ ID NO: 49123 - protein, 9 aa, Homo Sapiens
FCASTLDPP

SEQ ID NO: 49124 - protein, 9 aa, Homo Sapiens
IKKEPLDDE

SEQ ID NO: 49125 - protein, 9 aa, Homo Sapiens
KEKFMTVDQ

SEQ ID NO: 49126 - protein, 9 aa, Homo Sapiens
SPLAEIDST

SEQ ID NO: 49127 - protein, 9 aa, Homo Sapiens
MNFVDPKEF

SEQ ID NO: 49128 - protein, 9 aa, Homo Sapiens
LSDTCKPLK

SEQ ID NO: 49129 - protein, 9 aa, Homo Sapiens
DRRQIILDL

SEQ ID NO: 49130 - protein, 9 aa, Homo Sapiens
HLGNVSFSA

SEQ ID NO: 49131 - protein, 9 aa, Homo Sapiens
VDCKKKFLD

SEQ ID NO: 49132 - protein, 9 aa, Homo Sapiens
VHRMIKEKI

SEQ ID NO: 49133 - protein, 9 aa, Homo Sapiens
INASKDLPE

SEQ ID NO: 49134 - protein, 9 aa, Homo Sapiens
PAYMKSSKG

SEQ ID NO: 49135 - protein, 9 aa, Homo Sapiens
TPAAPLTTV

SEQ ID NO: 49136 - protein, 9 aa, Homo Sapiens
VKYHKNEML

SEQ ID NO: 49137 - protein, 9 aa, Homo Sapiens
VRNLQKRQV

SEQ ID NO: 49138 - protein, 9 aa, Homo Sapiens
IQYAWANSK

SEQ ID NO: 49139 - protein, 9 aa, Homo Sapiens
SHLPEGLFC

SEQ ID NO: 49140 - protein, 9 aa, Homo Sapiens
QMKELSMVT

SEQ ID NO: 49141 - protein, 9 aa, Homo Sapiens
DKSHLPEGL

SEQ ID NO: 49142 - protein, 9 aa, Homo Sapiens
WLKLFLNAN

SEQ ID NO: 49143 - protein, 9 aa, Homo Sapiens
FDATNPLTL

SEQ ID NO: 49144 - protein, 9 aa, Homo Sapiens
EVRHIGLVQ

SEQ ID NO: 49145 - protein, 9 aa, Homo Sapiens
SGFHKDYIE

SEQ ID NO: 49146 - protein, 9 aa, Homo Sapiens
PTIPGTTAQ

SEQ ID NO: 49147 - protein, 9 aa, Homo Sapiens
TQQLPDTSS

SEQ ID NO: 49148 - protein, 9 aa, Homo Sapiens
ENEEKGKEN

SEQ ID NO: 49149 - protein, 9 aa, Homo Sapiens
LLKAIIWIL

SEQ ID NO: 49150 - protein, 9 aa, Homo Sapiens
ERRPMPGPS

SEQ ID NO: 49151 - protein, 9 aa, Homo Sapiens
ICSEDNAVS

SEQ ID NO: 49152 - protein, 9 aa, Homo Sapiens
STNVAELLV

SEQ ID NO: 49153 - protein, 9 aa, Homo Sapiens
LTETKYINL

SEQ ID NO: 49154 - protein, 9 aa, Homo Sapiens
LRFNKHYKH

SEQ ID NO: 49155 - protein, 9 aa, Homo Sapiens
CLGEGAVKM

SEQ ID NO: 49156 - protein, 9 aa, Homo Sapiens
QKENEEKGK

SEQ ID NO: 49157 - protein, 9 aa, Homo Sapiens
VIVGGVRIV

SEQ ID NO: 49158 - protein, 9 aa, Homo Sapiens
VECNFGQKE

SEQ ID NO: 49159 - protein, 9 aa, Homo Sapiens
EEKGKENED

SEQ ID NO: 49160 - protein, 9 aa, Homo Sapiens
DLLLSSNIL

SEQ ID NO: 49161 - protein, 9 aa, Homo Sapiens
TGRTDISPR

SEQ ID NO: 49162 - protein, 9 aa, Homo Sapiens
LSVFGGDSV

SEQ ID NO: 49163 - protein, 9 aa, Homo Sapiens
AVEYHINDG

SEQ ID NO: 49164 - protein, 9 aa, Homo Sapiens
LSDTQPQPS

SEQ ID NO: 49165 - protein, 9 aa, Homo Sapiens
PPCLGGACP

SEQ ID NO: 49166 - protein, 9 aa, Homo Sapiens
FTHESTFGV

SEQ ID NO: 49167 - protein, 9 aa, Homo Sapiens
KPIFWNFMF

SEQ ID NO: 49168 - protein, 9 aa, Homo Sapiens
KCKDCGKAY

SEQ ID NO: 49169 - protein, 9 aa, Homo Sapiens
GNKYESDVE

SEQ ID NO: 49170 - protein, 9 aa, Homo Sapiens
GMAGGRGSV

SEQ ID NO: 49171 - protein, 9 aa, Homo Sapiens
CKEILNKAN

SEQ ID NO: 49172 - protein, 9 aa, Homo Sapiens
WANSKISQV

SEQ ID NO: 49173 - protein, 9 aa, Homo Sapiens
KVHQSNSEV

SEQ ID NO: 49174 - protein, 9 aa, Homo Sapiens
SCMNPQTFK

SEQ ID NO: 49175 - protein, 9 aa, Homo Sapiens
MIKEKIVGE

SEQ ID NO: 49176 - protein, 9 aa, Homo Sapiens
SQGLPGPPG

SEQ ID NO: 49177 - protein, 9 aa, Homo Sapiens
SKISQVCAT

SEQ ID NO: 49178 - protein, 9 aa, Homo Sapiens
NFMSSICNN

SEQ ID NO: 49179 - protein, 9 aa, Homo Sapiens
GLFCAESAN

SEQ ID NO: 49180 - protein, 9 aa, Homo Sapiens
AIIWILWRS

SEQ ID NO: 49181 - protein, 9 aa, Homo Sapiens
RFQSSAMVP

SEQ ID NO: 49182 - protein, 9 aa, Homo Sapiens
ETFSKQAED

SEQ ID NO: 49183 - protein, 9 aa, Homo Sapiens
NRGINASKD

SEQ ID NO: 49184 - protein, 9 aa, Homo Sapiens
YMIEDFLEF

SEQ ID NO: 49185 - protein, 9 aa, Homo Sapiens
HGCCPNGHT

SEQ ID NO: 49186 - protein, 9 aa, Homo Sapiens
IQPGTNVLN

SEQ ID NO: 49187 - protein, 9 aa, Homo Sapiens
QAINITNNE

SEQ ID NO: 49188 - protein, 9 aa, Homo Sapiens
SERIKAIQK

SEQ ID NO: 49189 - protein, 9 aa, Homo Sapiens
IIGTLELLV

SEQ ID NO: 49190 - protein, 9 aa, Homo Sapiens
KETLGRYGS

SEQ ID NO: 49191 - protein, 9 aa, Homo Sapiens
ILDLQNQKY

SEQ ID NO: 49192 - protein, 9 aa, Homo Sapiens
HKETFSKQA

SEQ ID NO: 49193 - protein, 9 aa, Homo Sapiens
GKVKEQKQT

SEQ ID NO: 49194 - protein, 9 aa, Homo Sapiens
TCSLDRNLS

SEQ ID NO: 49195 - protein, 9 aa, Homo Sapiens
ANLLPAWYH

SEQ ID NO: 49196 - protein, 9 aa, Homo Sapiens
SFETEAALN

SEQ ID NO: 49197 - protein, 9 aa, Homo Sapiens
SKVNLQSPL

SEQ ID NO: 49198 - protein, 9 aa, Homo Sapiens
FLEFERPVE

SEQ ID NO: 49199 - protein, 9 aa, Homo Sapiens
KHLKEVFKE

SEQ ID NO: 49200 - protein, 9 aa, Homo Sapiens
TSFTHESTF

SEQ ID NO: 49201 - protein, 9 aa, Homo Sapiens
SSDFAKKFV

SEQ ID NO: 49202 - protein, 9 aa, Homo Sapiens
SDMYCLVGL

SEQ ID NO: 49203 - protein, 9 aa, Homo Sapiens
QVVVCGGGI

SEQ ID NO: 49204 - protein, 9 aa, Homo Sapiens
REVRHIGLV

SEQ ID NO: 49205 - protein, 9 aa, Homo Sapiens
GSRSGRVLE

SEQ ID NO: 49206 - protein, 9 aa, Homo Sapiens
ERVKYVLYV

SEQ ID NO: 49207 - protein, 9 aa, Homo Sapiens
PQNLSHVMR

SEQ ID NO: 49208 - protein, 9 aa, Homo Sapiens
CDNKRADLV

SEQ ID NO: 49209 - protein, 9 aa, Homo Sapiens
EKSVEVPKA

SEQ ID NO: 49210 - protein, 9 aa, Homo Sapiens
VMRVAKPLI

SEQ ID NO: 49211 - protein, 9 aa, Homo Sapiens
YQGASSPGI

SEQ ID NO: 49212 - protein, 9 aa, Homo Sapiens
KTKDVILDE

SEQ ID NO: 49213 - protein, 9 aa, Homo Sapiens
INVLSHLPS

SEQ ID NO: 49214 - protein, 9 aa, Homo Sapiens
KVYTENVDR

SEQ ID NO: 49215 - protein, 9 aa, Homo Sapiens
HIAPVIMLF

SEQ ID NO: 49216 - protein, 9 aa, Homo Sapiens
DMRESYGQT

SEQ ID NO: 49217 - protein, 9 aa, Homo Sapiens
LKQTGRTDI

SEQ ID NO: 49218 - protein, 9 aa, Homo Sapiens
QSYSLPWSC

SEQ ID NO: 49219 - protein, 9 aa, Homo Sapiens
DLKEQVAPL

SEQ ID NO: 49220 - protein, 9 aa, Homo Sapiens
GCCPNGHTA

SEQ ID NO: 49221 - protein, 9 aa, Homo Sapiens
PESDINGFV

SEQ ID NO: 49222 - protein, 9 aa, Homo Sapiens
AATKNLSDT

SEQ ID NO: 49223 - protein, 9 aa, Homo Sapiens
GLSELTSNV

SEQ ID NO: 49224 - protein, 9 aa, Homo Sapiens
QVDDLEGFA

SEQ ID NO: 49225 - protein, 9 aa, Homo Sapiens
EDLLLSSNI

SEQ ID NO: 49226 - protein, 9 aa, Homo Sapiens
SRSGRVLER

SEQ ID NO: 49227 - protein, 9 aa, Homo Sapiens
NIKLQFCHQ

SEQ ID NO: 49228 - protein, 9 aa, Homo Sapiens
LQKRQVPGP

SEQ ID NO: 49229 - protein, 9 aa, Homo Sapiens
GDVSQKHGS

SEQ ID NO: 49230 - protein, 9 aa, Homo Sapiens
HNFRVTMVT

SEQ ID NO: 49231 - protein, 9 aa, Homo Sapiens
SKMKNMILD

SEQ ID NO: 49232 - protein, 9 aa, Homo Sapiens
SQATGILSE

SEQ ID NO: 49233 - protein, 9 aa, Homo Sapiens
CASTLDPPA

SEQ ID NO: 49234 - protein, 9 aa, Homo Sapiens
HRPHLKPKT

SEQ ID NO: 49235 - protein, 9 aa, Homo Sapiens
SFQWLLSTF

SEQ ID NO: 49236 - protein, 9 aa, Homo Sapiens
GVSHRARPR

SEQ ID NO: 49237 - protein, 9 aa, Homo Sapiens
GKTCGARPP

SEQ ID NO: 49238 - protein, 9 aa, Homo Sapiens
TNAFIVSFT

SEQ ID NO: 49239 - protein, 9 aa, Homo Sapiens
TKQSKHEAA

SEQ ID NO: 49240 - protein, 9 aa, Homo Sapiens
DLFKGIIYY

SEQ ID NO: 49241 - protein, 9 aa, Homo Sapiens
IAPVIMLFV

SEQ ID NO: 49242 - protein, 9 aa, Homo Sapiens
SETSYQPGQ

SEQ ID NO: 49243 - protein, 9 aa, Homo Sapiens
RASQSTVAV

SEQ ID NO: 49244 - protein, 9 aa, Homo Sapiens
KSERRPMPG

SEQ ID NO: 49245 - protein, 9 aa, Homo Sapiens
ILDACIKLE

SEQ ID NO: 49246 - protein, 9 aa, Homo Sapiens
PPRVSGKTC

SEQ ID NO: 49247 - protein, 9 aa, Homo Sapiens
VCGGGITGT

SEQ ID NO: 49248 - protein, 9 aa, Homo Sapiens
KKFQRISKR

SEQ ID NO: 49249 - protein, 9 aa, Homo Sapiens
EAQTELRCH

SEQ ID NO: 49250 - protein, 9 aa, Homo Sapiens
SHRARPRLL

SEQ ID NO: 49251 - protein, 9 aa, Homo Sapiens
TIHSNCQQN

SEQ ID NO: 49252 - protein, 9 aa, Homo Sapiens
PTLVYRHGW

SEQ ID NO: 49253 - protein, 9 aa, Homo Sapiens
EEFALRDQK

SEQ ID NO: 49254 - protein, 9 aa, Homo Sapiens
RIVYPSAFV

SEQ ID NO: 49255 - protein, 9 aa, Homo Sapiens
KCKVCAKSF

SEQ ID NO: 49256 - protein, 9 aa, Homo Sapiens
HNCAVECNF

SEQ ID NO: 49257 - protein, 9 aa, Homo Sapiens
NRWRYGETV

SEQ ID NO: 49258 - protein, 9 aa, Homo Sapiens
QLQQQLSDT

SEQ ID NO: 49259 - protein, 9 aa, Homo Sapiens
LPWSCNSWC

SEQ ID NO: 49260 - protein, 9 aa, Homo Sapiens
QSEYSAFKA

SEQ ID NO: 49261 - protein, 9 aa, Homo Sapiens
KEDEKKEDV

SEQ ID NO: 49262 - protein, 9 aa, Homo Sapiens
TTVLNPPVT

SEQ ID NO: 49263 - protein, 9 aa, Homo Sapiens
REHLAAVQQ

SEQ ID NO: 49264 - protein, 9 aa, Homo Sapiens
STKFNLICS

SEQ ID NO: 49265 - protein, 9 aa, Homo Sapiens
PRLRTIVLK

SEQ ID NO: 49266 - protein, 9 aa, Homo Sapiens
VIFIFTQVF

SEQ ID NO: 49267 - protein, 9 aa, Homo Sapiens
ELMQIPNFR

SEQ ID NO: 49268 - protein, 9 aa, Homo Sapiens
LLTLLPAVA

SEQ ID NO: 49269 - protein, 9 aa, Homo Sapiens
ESDINGFVK

SEQ ID NO: 49270 - protein, 9 aa, Homo Sapiens
TPLQMDARE

SEQ ID NO: 49271 - protein, 9 aa, Homo Sapiens
AAPLTTVLN

SEQ ID NO: 49272 - protein, 9 aa, Homo Sapiens
IWKTKDVIL

SEQ ID NO: 49273 - protein, 9 aa, Homo Sapiens
LDIQNDRNS

SEQ ID NO: 49274 - protein, 9 aa, Homo Sapiens
RTDISPREN

SEQ ID NO: 49275 - protein, 9 aa, Homo Sapiens
MKELSMVTE

SEQ ID NO: 49276 - protein, 9 aa, Homo Sapiens
LSQATGILS

SEQ ID NO: 49277 - protein, 9 aa, Homo Sapiens
TVTCSLDRN

SEQ ID NO: 49278 - protein, 9 aa, Homo Sapiens
SNPVILTCD

SEQ ID NO: 49279 - protein, 9 aa, Homo Sapiens
YVLYVLYFD

SEQ ID NO: 49280 - protein, 9 aa, Homo Sapiens
NCQQNSNAS

SEQ ID NO: 49281 - protein, 9 aa, Homo Sapiens
PCLGGACPG

SEQ ID NO: 49282 - protein, 9 aa, Homo Sapiens
DCCGTKKSC

SEQ ID NO: 49283 - protein, 9 aa, Homo Sapiens
PREALNKIT

SEQ ID NO: 49284 - protein, 9 aa, Homo Sapiens
IKFLKMKIA

SEQ ID NO: 49285 - protein, 9 aa, Homo Sapiens
LLLSSNILQ

SEQ ID NO: 49286 - protein, 9 aa, Homo Sapiens
RVLHSYEEL

SEQ ID NO: 49287 - protein, 9 aa, Homo Sapiens
LNKEEVNVE

SEQ ID NO: 49288 - protein, 9 aa, Homo Sapiens
EYPNGYSTH

SEQ ID NO: 49289 - protein, 9 aa, Homo Sapiens
KGIIYYRHF

SEQ ID NO: 49290 - protein, 9 aa, Homo Sapiens
VSHRARPRL

SEQ ID NO: 49291 - protein, 9 aa, Homo Sapiens
LIQGATLIF

SEQ ID NO: 49292 - protein, 9 aa, Homo Sapiens
VCAKSFETE

SEQ ID NO: 49293 - protein, 9 aa, Homo Sapiens
ILSERIKAI

SEQ ID NO: 49294 - protein, 9 aa, Homo Sapiens
DSTMCVVCS

SEQ ID NO: 49295 - protein, 9 aa, Homo Sapiens
LARKKPLFI

SEQ ID NO: 49296 - protein, 9 aa, Homo Sapiens
HTSGSLLNA

SEQ ID NO: 49297 - protein, 9 aa, Homo Sapiens
ADINFFSEQ

SEQ ID NO: 49298 - protein, 9 aa, Homo Sapiens
PKPANQIVL

SEQ ID NO: 49299 - protein, 9 aa, Homo Sapiens
MHLEQNHQQ

SEQ ID NO: 49300 - protein, 9 aa, Homo Sapiens
EVTSKVGLS

SEQ ID NO: 49301 - protein, 9 aa, Homo Sapiens
KKVKKGSFL

SEQ ID NO: 49302 - protein, 9 aa, Homo Sapiens
WKTKDVILD

SEQ ID NO: 49303 - protein, 9 aa, Homo Sapiens
SCLKRRLTL

SEQ ID NO: 49304 - protein, 9 aa, Homo Sapiens
WLSEWWFKT

SEQ ID NO: 49305 - protein, 9 aa, Homo Sapiens
EQNHQQIYG

SEQ ID NO: 49306 - protein, 9 aa, Homo Sapiens
RSSDFAKKF

SEQ ID NO: 49307 - protein, 9 aa, Homo Sapiens
IKMNRGINA

SEQ ID NO: 49308 - protein, 9 aa, Homo Sapiens
KTCGARPPC

SEQ ID NO: 49309 - protein, 9 aa, Homo Sapiens
LPKVAYAMA

SEQ ID NO: 49310 - protein, 9 aa, Homo Sapiens
IPAPSQKAP

SEQ ID NO: 49311 - protein, 9 aa, Homo Sapiens
RKKACAVWN

SEQ ID NO: 49312 - protein, 9 aa, Homo Sapiens
HTETGNTGE

SEQ ID NO: 49313 - protein, 9 aa, Homo Sapiens
NLNIKLQFC

SEQ ID NO: 49314 - protein, 9 aa, Homo Sapiens
MRTASSFQW

SEQ ID NO: 49315 - protein, 9 aa, Homo Sapiens
LVIFIFTQV

SEQ ID NO: 49316 - protein, 9 aa, Homo Sapiens
GKYSEVFQA

SEQ ID NO: 49317 - protein, 9 aa, Homo Sapiens
ILPILTCGV

SEQ ID NO: 49318 - protein, 9 aa, Homo Sapiens
ESSCDNKRA

SEQ ID NO: 49319 - protein, 9 aa, Homo Sapiens
YWMNCCCTE

SEQ ID NO: 49320 - protein, 9 aa, Homo Sapiens
EEGSQGLPG

SEQ ID NO: 49321 - protein, 9 aa, Homo Sapiens
DAIPDHEAL

SEQ ID NO: 49322 - protein, 9 aa, Homo Sapiens
HLAAVQQKL

SEQ ID NO: 49323 - protein, 9 aa, Homo Sapiens
GSVGHALHA

SEQ ID NO: 49324 - protein, 9 aa, Homo Sapiens
SFSAVIEAL

SEQ ID NO: 49325 - protein, 9 aa, Homo Sapiens
EKGKENEDK

SEQ ID NO: 49326 - protein, 9 aa, Homo Sapiens
RDQLLSQMK

SEQ ID NO: 49327 - protein, 9 aa, Homo Sapiens
RTIVLKMPM

SEQ ID NO: 49328 - protein, 9 aa, Homo Sapiens
ESVKENLAI

SEQ ID NO: 49329 - protein, 9 aa, Homo Sapiens
MFLKYDMSI

SEQ ID NO: 49330 - protein, 9 aa, Homo Sapiens
VGILYVNDN

SEQ ID NO: 49331 - protein, 9 aa, Homo Sapiens
PHLTPLQMD

SEQ ID NO: 49332 - protein, 9 aa, Homo Sapiens
RFNKHYKHD

SEQ ID NO: 49333 - protein, 9 aa, Homo Sapiens
NHTSGSLLN

SEQ ID NO: 49334 - protein, 9 aa, Homo Sapiens
VVVGILYVN

SEQ ID NO: 49335 - protein, 9 aa, Homo Sapiens
FFCLQQIEE

SEQ ID NO: 49336 - protein, 9 aa, Homo Sapiens
VDPKEFDIP

SEQ ID NO: 49337 - protein, 9 aa, Homo Sapiens
LLTETKYIN

SEQ ID NO: 49338 - protein, 9 aa, Homo Sapiens
AQTGLDMRE

SEQ ID NO: 49339 - protein, 9 aa, Homo Sapiens
EVYKLSLEM

SEQ ID NO: 49340 - protein, 9 aa, Homo Sapiens
NSKISQVCA

SEQ ID NO: 49341 - protein, 9 aa, Homo Sapiens
GLKGEEGSQ

SEQ ID NO: 49342 - protein, 9 aa, Homo Sapiens
QKKYLYRYP

SEQ ID NO: 49343 - protein, 9 aa, Homo Sapiens
LRCHFLQMN

SEQ ID NO: 49344 - protein, 9 aa, Homo Sapiens
CGARPPCLG

SEQ ID NO: 49345 - protein, 9 aa, Homo Sapiens
GRLRQSDMA

SEQ ID NO: 49346 - protein, 9 aa, Homo Sapiens
WIQPGTNVL

SEQ ID NO: 49347 - protein, 9 aa, Homo Sapiens
GVHRMIKEK

SEQ ID NO: 49348 - protein, 9 aa, Homo Sapiens
DSPVGDPMD

SEQ ID NO: 49349 - protein, 9 aa, Homo Sapiens
HLLEVGQPQ

SEQ ID NO: 49350 - protein, 9 aa, Homo Sapiens
LLVIFIFTQ

SEQ ID NO: 49351 - protein, 9 aa, Homo Sapiens
LGAVIGTDC

SEQ ID NO: 49352 - protein, 9 aa, Homo Sapiens
GIFVVHIAP

SEQ ID NO: 49353 - protein, 9 aa, Homo Sapiens
YGVHRMIKE

SEQ ID NO: 49354 - protein, 9 aa, Homo Sapiens
EKKEDVEEL

SEQ ID NO: 49355 - protein, 9 aa, Homo Sapiens
EVNVEGLHI

SEQ ID NO: 49356 - protein, 9 aa, Homo Sapiens
QSIMTPAIP

SEQ ID NO: 49357 - protein, 9 aa, Homo Sapiens
LQSSKKFQR

SEQ ID NO: 49358 - protein, 9 aa, Homo Sapiens
FKYIIGTLE

SEQ ID NO: 49359 - protein, 9 aa, Homo Sapiens
HLKEVFKER

SEQ ID NO: 49360 - protein, 9 aa, Homo Sapiens
LSERIKAIQ

SEQ ID NO: 49361 - protein, 9 aa, Homo Sapiens
CVSSDDECV

SEQ ID NO: 49362 - protein, 9 aa, Homo Sapiens
VGESNLPSL

SEQ ID NO: 49363 - protein, 9 aa, Homo Sapiens
YVNDNPPIF

SEQ ID NO: 49364 - protein, 9 aa, Homo Sapiens
KGNKYESDV

SEQ ID NO: 49365 - protein, 9 aa, Homo Sapiens
VKYVLYVLY

SEQ ID NO: 49366 - protein, 9 aa, Homo Sapiens
VIIWKTKDV

SEQ ID NO: 49367 - protein, 9 aa, Homo Sapiens
SIMTPAIPE

SEQ ID NO: 49368 - protein, 9 aa, Homo Sapiens
AGKSERRPM

SEQ ID NO: 49369 - protein, 9 aa, Homo Sapiens
FKVIQTELN

SEQ ID NO: 49370 - protein, 9 aa, Homo Sapiens
KMKNMILDL

SEQ ID NO: 49371 - protein, 9 aa, Homo Sapiens
NLPSLSPTV

SEQ ID NO: 49372 - protein, 9 aa, Homo Sapiens
LICSEDNAV

SEQ ID NO: 49373 - protein, 9 aa, Homo Sapiens
EKMYWMNCC

SEQ ID NO: 49374 - protein, 9 aa, Homo Sapiens
LNTEKMYWM

SEQ ID NO: 49375 - protein, 9 aa, Homo Sapiens
SVDHTETGN

SEQ ID NO: 49376 - protein, 9 aa, Homo Sapiens
LAEIDSTNV

SEQ ID NO: 49377 - protein, 9 aa, Homo Sapiens
TCKPLKKRN

SEQ ID NO: 49378 - protein, 9 aa, Homo Sapiens
ALNAWKEKF

SEQ ID NO: 49379 - protein, 9 aa, Homo Sapiens
GAVKMPLDV

SEQ ID NO: 49380 - protein, 9 aa, Homo Sapiens
LIVRDPGAH

SEQ ID NO: 49381 - protein, 9 aa, Homo Sapiens
KRMRTASSF

SEQ ID NO: 49382 - protein, 9 aa, Homo Sapiens
GGLLRPPRV

SEQ ID NO: 49383 - protein, 9 aa, Homo Sapiens
DSWRNFKAN

SEQ ID NO: 49384 - protein, 9 aa, Homo Sapiens
VSFTSDIIP

SEQ ID NO: 49385 - protein, 9 aa, Homo Sapiens
IKLQFCHQR

SEQ ID NO: 49386 - protein, 9 aa, Homo Sapiens
RMRTASSFQ

SEQ ID NO: 49387 - protein, 9 aa, Homo Sapiens
IYSSPIGRL

SEQ ID NO: 49388 - protein, 9 aa, Homo Sapiens
MPLDVDWTL

SEQ ID NO: 49389 - protein, 9 aa, Homo Sapiens
SEGEEEIEP

SEQ ID NO: 49390 - protein, 9 aa, Homo Sapiens
AYQRPTIPG

SEQ ID NO: 49391 - protein, 9 aa, Homo Sapiens
KLFLNANRF

SEQ ID NO: 49392 - protein, 9 aa, Homo Sapiens
LPAWYHNFR

SEQ ID NO: 49393 - protein, 9 aa, Homo Sapiens
TAGGLLRPP

SEQ ID NO: 49394 - protein, 9 aa, Homo Sapiens
LCHNCAVEC

SEQ ID NO: 49395 - protein, 9 aa, Homo Sapiens
RDAIPDHEA

SEQ ID NO: 49396 - protein, 9 aa, Homo Sapiens
KMPLDVDWT

SEQ ID NO: 49397 - protein, 9 aa, Homo Sapiens
KAIIWILWR

SEQ ID NO: 49398 - protein, 9 aa, Homo Sapiens
GEGESAGGI

SEQ ID NO: 49399 - protein, 9 aa, Homo Sapiens
GDGFEGEKG

SEQ ID NO: 49400 - protein, 9 aa, Homo Sapiens
LIEQRTVCK

SEQ ID NO: 49401 - protein, 9 aa, Homo Sapiens
LLSQMKELS

SEQ ID NO: 49402 - protein, 9 aa, Homo Sapiens
VTIHSNCQQ

SEQ ID NO: 49403 - protein, 9 aa, Homo Sapiens
FKLLPGDIH

SEQ ID NO: 49404 - protein, 9 aa, Homo Sapiens
EVKYHKNEM

SEQ ID NO: 49405 - protein, 9 aa, Homo Sapiens
GISSPALTL

SEQ ID NO: 49406 - protein, 9 aa, Homo Sapiens
YQPESDING

SEQ ID NO: 49407 - protein, 9 aa, Homo Sapiens
SAGGISSPA

SEQ ID NO: 49408 - protein, 9 aa, Homo Sapiens
RNLQKRQVP

SEQ ID NO: 49409 - protein, 9 aa, Homo Sapiens
LSEWWFKTA

SEQ ID NO: 49410 - protein, 9 aa, Homo Sapiens
VNRPLDREE

SEQ ID NO: 49411 - protein, 9 aa, Homo Sapiens
YELLAILDA

SEQ ID NO: 49412 - protein, 9 aa, Homo Sapiens
RQSDMAGSS

SEQ ID NO: 49413 - protein, 9 aa, Homo Sapiens
GKEDEKKED

SEQ ID NO: 49414 - protein, 9 aa, Homo Sapiens
DLVVMGDGF

SEQ ID NO: 49415 - protein, 9 aa, Homo Sapiens
DVRGQEGTL

SEQ ID NO: 49416 - protein, 9 aa, Homo Sapiens
NEERLTWHS

SEQ ID NO: 49417 - protein, 9 aa, Homo Sapiens
VFQAINITN

SEQ ID NO: 49418 - protein, 9 aa, Homo Sapiens
RKCDRILSQ

SEQ ID NO: 49419 - protein, 9 aa, Homo Sapiens
KGQGLWVTF

SEQ ID NO: 49420 - protein, 9 aa, Homo Sapiens
WAQRGRGCG

SEQ ID NO: 49421 - protein, 9 aa, Homo Sapiens
LSSMHLEQN

SEQ ID NO: 49422 - protein, 9 aa, Homo Sapiens
YIIGTLELL

SEQ ID NO: 49423 - protein, 9 aa, Homo Sapiens
RQLRMVQRE

SEQ ID NO: 49424 - protein, 9 aa, Homo Sapiens
MEQLELQRD

SEQ ID NO: 49425 - protein, 9 aa, Homo Sapiens
TMCVVCSHH

SEQ ID NO: 49426 - protein, 9 aa, Homo Sapiens
TDKSHLPEG

SEQ ID NO: 49427 - protein, 9 aa, Homo Sapiens
RSCLKRRLT

SEQ ID NO: 49428 - protein, 9 aa, Homo Sapiens
KQFNRDIEV

SEQ ID NO: 49429 - protein, 9 aa, Homo Sapiens
DFLEFERPV

SEQ ID NO: 49430 - protein, 9 aa, Homo Sapiens
FMFFICLFI

SEQ ID NO: 49431 - protein, 9 aa, Homo Sapiens
IPKPANQIV

SEQ ID NO: 49432 - protein, 9 aa, Homo Sapiens
DCGKAYNLS

SEQ ID NO: 49433 - protein, 9 aa, Homo Sapiens
KDQTVIVGK

SEQ ID NO: 49434 - protein, 9 aa, Homo Sapiens
QLLADLENS

SEQ ID NO: 49435 - protein, 9 aa, Homo Sapiens
GFLQRDLFK

SEQ ID NO: 49436 - protein, 9 aa, Homo Sapiens
KQAEDTTCE

SEQ ID NO: 49437 - protein, 9 aa, Homo Sapiens
PQTFKFDRP

SEQ ID NO: 49438 - protein, 9 aa, Homo Sapiens
KGTKRKRDV

SEQ ID NO: 49439 - protein, 9 aa, Homo Sapiens
IFKVIQTEL

SEQ ID NO: 49440 - protein, 9 aa, Homo Sapiens
SSEGEEEIE

SEQ ID NO: 49441 - protein, 9 aa, Homo Sapiens
TPAIPEATE

SEQ ID NO: 49442 - protein, 9 aa, Homo Sapiens
KCDRILSQV

SEQ ID NO: 49443 - protein, 9 aa, Homo Sapiens
WEPGKEDEK

SEQ ID NO: 49444 - protein, 9 aa, Homo Sapiens
RPTIPGTTA

SEQ ID NO: 49445 - protein, 9 aa, Homo Sapiens
KYDMSIHDV

SEQ ID NO: 49446 - protein, 9 aa, Homo Sapiens
HLKPKTTLS

SEQ ID NO: 49447 - protein, 9 aa, Homo Sapiens
GLLRPPRVS

SEQ ID NO: 49448 - protein, 9 aa, Homo Sapiens
KGRPGPPGP

SEQ ID NO: 49449 - protein, 9 aa, Homo Sapiens
ECNFGQKEK

SEQ ID NO: 49450 - protein, 9 aa, Homo Sapiens
EFERPVEHM

SEQ ID NO: 49451 - protein, 9 aa, Homo Sapiens
SKPIFWNFM

SEQ ID NO: 49452 - protein, 9 aa, Homo Sapiens
PQDSKVNLQ

SEQ ID NO: 49453 - protein, 9 aa, Homo Sapiens
LIVKHIYSE

SEQ ID NO: 49454 - protein, 9 aa, Homo Sapiens
VTFKLLPGD

SEQ ID NO: 49455 - protein, 9 aa, Homo Sapiens
AEQQSAWAM

SEQ ID NO: 49456 - protein, 9 aa, Homo Sapiens
VDRNILKGQ

SEQ ID NO: 49457 - protein, 9 aa, Homo Sapiens
GIQDSFKKE

SEQ ID NO: 49458 - protein, 9 aa, Homo Sapiens
RQLQQQLSD

SEQ ID NO: 49459 - protein, 9 aa, Homo Sapiens
ILDVVKAHK

SEQ ID NO: 49460 - protein, 9 aa, Homo Sapiens
QTDVYRANA

SEQ ID NO: 49461 - protein, 9 aa, Homo Sapiens
VMGDGFEGE

SEQ ID NO: 49462 - protein, 9 aa, Homo Sapiens
TKARRAVDR

SEQ ID NO: 49463 - protein, 9 aa, Homo Sapiens
MILDLQNQK

SEQ ID NO: 49464 - protein, 9 aa, Homo Sapiens
PAAPLTTVL

SEQ ID NO: 49465 - protein, 9 aa, Homo Sapiens
SMHLEQNHQ

SEQ ID NO: 49466 - protein, 9 aa, Homo Sapiens
TPTLEKKNK

SEQ ID NO: 49467 - protein, 9 aa, Homo Sapiens
VSGFHKDYI

SEQ ID NO: 49468 - protein, 9 aa, Homo Sapiens
KANTKGKKE

SEQ ID NO: 49469 - protein, 9 aa, Homo Sapiens
RVSGKTCGA

SEQ ID NO: 49470 - protein, 9 aa, Homo Sapiens
QKRQVPGPG

SEQ ID NO: 49471 - protein, 9 aa, Homo Sapiens
RRTQQLPDT

SEQ ID NO: 49472 - protein, 9 aa, Homo Sapiens
ATLIFDEAD

SEQ ID NO: 49473 - protein, 9 aa, Homo Sapiens
KNRYKADRN

SEQ ID NO: 49474 - protein, 9 aa, Homo Sapiens
MPPLLAISL

SEQ ID NO: 49475 - protein, 9 aa, Homo Sapiens
IGFSNYKFL

SEQ ID NO: 49476 - protein, 9 aa, Homo Sapiens
VYRANAKEI

SEQ ID NO: 49477 - protein, 9 aa, Homo Sapiens
KTKQSKHEA

SEQ ID NO: 49478 - protein, 9 aa, Homo Sapiens
MLLIQGATL

SEQ ID NO: 49479 - protein, 9 aa, Homo Sapiens
FKANTKGKK

SEQ ID NO: 49480 - protein, 9 aa, Homo Sapiens
TVIVGKAPP

SEQ ID NO: 49481 - protein, 9 aa, Homo Sapiens
KFLKMKIAE

SEQ ID NO: 49482 - protein, 9 aa, Homo Sapiens
VVMGDGFEG

SEQ ID NO: 49483 - protein, 9 aa, Homo Sapiens
IMTPAIPEA

SEQ ID NO: 49484 - protein, 9 aa, Homo Sapiens
SQMREAFRM

SEQ ID NO: 49485 - protein, 9 aa, Homo Sapiens
PPAYMKSSK

SEQ ID NO: 49486 - protein, 9 aa, Homo Sapiens
CSLDRNLSV

SEQ ID NO: 49487 - protein, 9 aa, Homo Sapiens
SSYSQMREA

SEQ ID NO: 49488 - protein, 9 aa, Homo Sapiens
KKEDVEELL

SEQ ID NO: 49489 - protein, 9 aa, Homo Sapiens
QKTENGKVK

SEQ ID NO: 49490 - protein, 9 aa, Homo Sapiens
KDGEEKVHQ

SEQ ID NO: 49491 - protein, 9 aa, Homo Sapiens
LMYSRIKLY

SEQ ID NO: 49492 - protein, 9 aa, Homo Sapiens
CGWLGPKTC

SEQ ID NO: 49493 - protein, 9 aa, Homo Sapiens
LFPREALNK

SEQ ID NO: 49494 - protein, 9 aa, Homo Sapiens
ENGKVKEQK

SEQ ID NO: 49495 - protein, 9 aa, Homo Sapiens
TSVDHTETG

SEQ ID NO: 49496 - protein, 9 aa, Homo Sapiens
YVNRPLDRE

SEQ ID NO: 49497 - protein, 9 aa, Homo Sapiens
YQPGQSYSL

SEQ ID NO: 49498 - protein, 9 aa, Homo Sapiens
YYLRVIIWK

SEQ ID NO: 49499 - protein, 9 aa, Homo Sapiens
KRTGWTYGY

SEQ ID NO: 49500 - protein, 9 aa, Homo Sapiens
LVTIHSNCQ

SEQ ID NO: 49501 - protein, 9 aa, Homo Sapiens
QRDLFKGII

SEQ ID NO: 49502 - protein, 9 aa, Homo Sapiens
RKKNKKVRV

SEQ ID NO: 49503 - protein, 9 aa, Homo Sapiens
TWGGRASQS

SEQ ID NO: 49504 - protein, 9 aa, Homo Sapiens
MRVAKPLIV

SEQ ID NO: 49505 - protein, 9 aa, Homo Sapiens
VEVPKASSS

SEQ ID NO: 49506 - protein, 9 aa, Homo Sapiens
KVKKGSFLI

SEQ ID NO: 49507 - protein, 9 aa, Homo Sapiens
FFRTSPGDR

SEQ ID NO: 49508 - protein, 9 aa, Homo Sapiens
LTTVLNPPV

SEQ ID NO: 49509 - protein, 9 aa, Homo Sapiens
NKHYKHDLK

SEQ ID NO: 49510 - protein, 9 aa, Homo Sapiens
SSDDECVGV

SEQ ID NO: 49511 - protein, 9 aa, Homo Sapiens
IRIKKEPLD

SEQ ID NO: 49512 - protein, 9 aa, Homo Sapiens
VCKMQLEEQ

SEQ ID NO: 49513 - protein, 9 aa, Homo Sapiens
LLFPREALN

SEQ ID NO: 49514 - protein, 9 aa, Homo Sapiens
YGETVPIDE

SEQ ID NO: 49515 - protein, 9 aa, Homo Sapiens
EESIRKKAC

SEQ ID NO: 49516 - protein, 9 aa, Homo Sapiens
MGDGFEGEK

SEQ ID NO: 49517 - protein, 9 aa, Homo Sapiens
EYQGASSPG

SEQ ID NO: 49518 - protein, 9 aa, Homo Sapiens
HLLEEKIKF

SEQ ID NO: 49519 - protein, 9 aa, Homo Sapiens
QATGILSER

SEQ ID NO: 49520 - protein, 9 aa, Homo Sapiens
PLTLCVKIV

SEQ ID NO: 49521 - protein, 9 aa, Homo Sapiens
AIFKVIQTE

SEQ ID NO: 49522 - protein, 9 aa, Homo Sapiens
LRVIIWKTK

SEQ ID NO: 49523 - protein, 9 aa, Homo Sapiens
FAEKVSGFH

SEQ ID NO: 49524 - protein, 9 aa, Homo Sapiens
MTPAIPEAT

SEQ ID NO: 49525 - protein, 9 aa, Homo Sapiens
QMDVSKTKQ

SEQ ID NO: 49526 - protein, 9 aa, Homo Sapiens
YNCKEAINV

SEQ ID NO: 49527 - protein, 9 aa, Homo Sapiens
WNFMFFICL

SEQ ID NO: 49528 - protein, 9 aa, Homo Sapiens
DVSKTKQSK

SEQ ID NO: 49529 - protein, 9 aa, Homo Sapiens
TNPLTLCVK

SEQ ID NO: 49530 - protein, 9 aa, Homo Sapiens
VNQEIEHFQ

SEQ ID NO: 49531 - protein, 9 aa, Homo Sapiens
SHRDAIPDH

SEQ ID NO: 49532 - protein, 9 aa, Homo Sapiens
QTVIVGKAP

SEQ ID NO: 49533 - protein, 9 aa, Homo Sapiens
LMQIPNFRI

SEQ ID NO: 49534 - protein, 9 aa, Homo Sapiens
CPGSRSGRV

SEQ ID NO: 49535 - protein, 9 aa, Homo Sapiens
YQRPTIPGT

SEQ ID NO: 49536 - protein, 9 aa, Homo Sapiens
SSCDNKRAD

SEQ ID NO: 49537 - protein, 9 aa, Homo Sapiens
AFRMLLKAI

SEQ ID NO: 49538 - protein, 9 aa, Homo Sapiens
TYIPWEKVQ

SEQ ID NO: 49539 - protein, 9 aa, Homo Sapiens
LPQNLSHVM

SEQ ID NO: 49540 - protein, 9 aa, Homo Sapiens
GWLGPKTCS

SEQ ID NO: 49541 - protein, 9 aa, Homo Sapiens
EKVKNAFTK

SEQ ID NO: 49542 - protein, 9 aa, Homo Sapiens
MKTEKLLKT

SEQ ID NO: 49543 - protein, 9 aa, Homo Sapiens
EIINLIKDK

SEQ ID NO: 49544 - protein, 9 aa, Homo Sapiens
KLQEADINF

SEQ ID NO: 49545 - protein, 9 aa, Homo Sapiens
RVDSWRNFK

SEQ ID NO: 49546 - protein, 9 aa, Homo Sapiens
QRERLEAEL

SEQ ID NO: 49547 - protein, 9 aa, Homo Sapiens
MRVLHSYEE

SEQ ID NO: 49548 - protein, 9 aa, Homo Sapiens
EYQQYLDAT

SEQ ID NO: 49549 - protein, 9 aa, Homo Sapiens
VSGKTCGAR

SEQ ID NO: 49550 - protein, 9 aa, Homo Sapiens
EEVNVEGLH

SEQ ID NO: 49551 - protein, 9 aa, Homo Sapiens
DLSLEDSTM

SEQ ID NO: 49552 - protein, 9 aa, Homo Sapiens
GECEQSEYS

SEQ ID NO: 49553 - protein, 9 aa, Homo Sapiens
TSSYSQMRE

SEQ ID NO: 49554 - protein, 9 aa, Homo Sapiens
HLKDPWLDG

SEQ ID NO: 49555 - protein, 9 aa, Homo Sapiens
FDIPRHGTK

SEQ ID NO: 49556 - protein, 9 aa, Homo Sapiens
RARPRLLES

SEQ ID NO: 49557 - protein, 9 aa, Homo Sapiens
MYCLVGLIY

SEQ ID NO: 49558 - protein, 9 aa, Homo Sapiens
VNHDLAVGD

SEQ ID NO: 49559 - protein, 9 aa, Homo Sapiens
AILDACIKL

SEQ ID NO: 49560 - protein, 9 aa, Homo Sapiens
SPHGCCPNG

SEQ ID NO: 49561 - protein, 9 aa, Homo Sapiens
KFLLQFLAY

SEQ ID NO: 49562 - protein, 9 aa, Homo Sapiens
QTGLDMRES

SEQ ID NO: 49563 - protein, 9 aa, Homo Sapiens
FGGDSVVLR

SEQ ID NO: 49564 - protein, 9 aa, Homo Sapiens
EGAVKMPLD

SEQ ID NO: 49565 - protein, 9 aa, Homo Sapiens
PAIPAPSQK

SEQ ID NO: 49566 - protein, 9 aa, Homo Sapiens
KCKQRKKNK

SEQ ID NO: 49567 - protein, 9 aa, Homo Sapiens
DQTVIVGKA

SEQ ID NO: 49568 - protein, 9 aa, Homo Sapiens
MERVKYVLY

SEQ ID NO: 49569 - protein, 9 aa, Homo Sapiens
SEDNAVSAA

SEQ ID NO: 49570 - protein, 9 aa, Homo Sapiens
YIENVDRNI

SEQ ID NO: 49571 - protein, 9 aa, Homo Sapiens
LTAEQQSAW

SEQ ID NO: 49572 - protein, 9 aa, Homo Sapiens
NQEIEHFQQ

SEQ ID NO: 49573 - protein, 9 aa, Homo Sapiens
INDGNTDEC

SEQ ID NO: 49574 - protein, 9 aa, Homo Sapiens
RVHLLEVGQ

SEQ ID NO: 49575 - protein, 9 aa, Homo Sapiens
CKVCAKSFE

SEQ ID NO: 49576 - protein, 9 aa, Homo Sapiens
NGLFAEKVS

SEQ ID NO: 49577 - protein, 9 aa, Homo Sapiens
DQREHLAAV

SEQ ID NO: 49578 - protein, 9 aa, Homo Sapiens
VQVDDLEGF

SEQ ID NO: 49579 - protein, 9 aa, Homo Sapiens
RANAKEIPR

SEQ ID NO: 49580 - protein, 9 aa, Homo Sapiens
QNHQQIYGE

SEQ ID NO: 49581 - protein, 9 aa, Homo Sapiens
SNYKFLLQF

SEQ ID NO: 49582 - protein, 9 aa, Homo Sapiens
LPEGLFCAE

SEQ ID NO: 49583 - protein, 9 aa, Homo Sapiens
DHTETGNTG

SEQ ID NO: 49584 - protein, 9 aa, Homo Sapiens
VIAFNEERL

SEQ ID NO: 49585 - protein, 9 aa, Homo Sapiens
TAEQQSAWA

SEQ ID NO: 49586 - protein, 9 aa, Homo Sapiens
FPREALNKI

SEQ ID NO: 49587 - protein, 9 aa, Homo Sapiens
AAGDCCGTK

SEQ ID NO: 49588 - protein, 9 aa, Homo Sapiens
KSCFSPCVG

SEQ ID NO: 49589 - protein, 9 aa, Homo Sapiens
KSCMNPQTF

SEQ ID NO: 49590 - protein, 9 aa, Homo Sapiens
GQPQVVLEV

SEQ ID NO: 49591 - protein, 9 aa, Homo Sapiens
VHQSNSEVW

SEQ ID NO: 49592 - protein, 9 aa, Homo Sapiens
SEYSAFKAD

SEQ ID NO: 49593 - protein, 9 aa, Homo Sapiens
PQLTRAVQE

SEQ ID NO: 49594 - protein, 9 aa, Homo Sapiens
SDFAKKFVQ

SEQ ID NO: 49595 - protein, 9 aa, Homo Sapiens
ALNTEKMYW

SEQ ID NO: 49596 - protein, 9 aa, Homo Sapiens
DMYCLVGLI

SEQ ID NO: 49597 - protein, 9 aa, Homo Sapiens
QQSAWAMYF

SEQ ID NO: 49598 - protein, 9 aa, Homo Sapiens
EKKNKPHLM

SEQ ID NO: 49599 - protein, 9 aa, Homo Sapiens
GEEEIEPFP

SEQ ID NO: 49600 - protein, 9 aa, Homo Sapiens
KFMTVDQDG

SEQ ID NO: 49601 - protein, 9 aa, Homo Sapiens
EYSKMKNMI

SEQ ID NO: 49602 - protein, 9 aa, Homo Sapiens
LKSKTKARR

SEQ ID NO: 49603 - protein, 9 aa, Homo Sapiens
SICNNLFEA

SEQ ID NO: 49604 - protein, 9 aa, Homo Sapiens
PTPTLEKKN

SEQ ID NO: 49605 - protein, 9 aa, Homo Sapiens
VPKASSSLV

SEQ ID NO: 49606 - protein, 9 aa, Homo Sapiens
NLQKRQVPG

SEQ ID NO: 49607 - protein, 9 aa, Homo Sapiens
ARPPCLGGA

SEQ ID NO: 49608 - protein, 9 aa, Homo Sapiens
KFQRISKRT

SEQ ID NO: 49609 - protein, 9 aa, Homo Sapiens
CNNLFEALF

SEQ ID NO: 49610 - protein, 9 aa, Homo Sapiens
PSLSPTVSV

SEQ ID NO: 49611 - protein, 9 aa, Homo Sapiens
AGSEECSAV

SEQ ID NO: 49612 - protein, 9 aa, Homo Sapiens
LEQNHQQIY

SEQ ID NO: 49613 - protein, 9 aa, Homo Sapiens
GSEECSAVL

SEQ ID NO: 49614 - protein, 9 aa, Homo Sapiens
VLERRTQQL

SEQ ID NO: 49615 - protein, 9 aa, Homo Sapiens
TTKAYQRPT

SEQ ID NO: 49616 - protein, 9 aa, Homo Sapiens
YTENVDRRQ

SEQ ID NO: 49617 - protein, 9 aa, Homo Sapiens
WKEKFMTVD

SEQ ID NO: 49618 - protein, 9 aa, Homo Sapiens
PKEFDIPRH

SEQ ID NO: 49619 - protein, 9 aa, Homo Sapiens
EGAKHLDGC

SEQ ID NO: 49620 - protein, 9 aa, Homo Sapiens
RQTWGGRAS

SEQ ID NO: 49621 - protein, 9 aa, Homo Sapiens
RYQPESDIN

SEQ ID NO: 49622 - protein, 9 aa, Homo Sapiens
FNLICSEDN

SEQ ID NO: 49623 - protein, 9 aa, Homo Sapiens
MTFMERVKY

SEQ ID NO: 49624 - protein, 9 aa, Homo Sapiens
CIYSSPIGR

SEQ ID NO: 49625 - protein, 9 aa, Homo Sapiens
NVAGSEECS

SEQ ID NO: 49626 - protein, 9 aa, Homo Sapiens
MRESYGQTE

SEQ ID NO: 49627 - protein, 9 aa, Homo Sapiens
GEGAVKMPL

SEQ ID NO: 49628 - protein, 9 aa, Homo Sapiens
HYELLAILD

SEQ ID NO: 49629 - protein, 9 aa, Homo Sapiens
NFKANTKGK

SEQ ID NO: 49630 - protein, 9 aa, Homo Sapiens
NEEKGKENE

SEQ ID NO: 49631 - protein, 9 aa, Homo Sapiens
LGMKMPSIS

SEQ ID NO: 49632 - protein, 9 aa, Homo Sapiens
KIPREKTFI

SEQ ID NO: 49633 - protein, 9 aa, Homo Sapiens
PQRTHRPHL

SEQ ID NO: 49634 - protein, 9 aa, Homo Sapiens
QLIAAYSLV

SEQ ID NO: 49635 - protein, 9 aa, Homo Sapiens
TLCVKIVQG

SEQ ID NO: 49636 - protein, 9 aa, Homo Sapiens
CNSWCFTSE

SEQ ID NO: 49637 - protein, 9 aa, Homo Sapiens
EFDIPRHGT

SEQ ID NO: 49638 - protein, 9 aa, Homo Sapiens
DKLKGNKYE

SEQ ID NO: 49639 - protein, 9 aa, Homo Sapiens
TYGYVPLSS

SEQ ID NO: 49640 - protein, 9 aa, Homo Sapiens
WVTFKLLPG

SEQ ID NO: 49641 - protein, 9 aa, Homo Sapiens
KRQVPGPGA

SEQ ID NO: 49642 - protein, 9 aa, Homo Sapiens
SDMAGSSQN

SEQ ID NO: 49643 - protein, 9 aa, Homo Sapiens
DCVSSDDEC

SEQ ID NO: 49644 - protein, 9 aa, Homo Sapiens
LVYRHGWNY

SEQ ID NO: 49645 - protein, 9 aa, Homo Sapiens
LAVGDRLRV

SEQ ID NO: 49646 - protein, 9 aa, Homo Sapiens
MKNMILDLQ

SEQ ID NO: 49647 - protein, 9 aa, Homo Sapiens
ELRCHFLQM

SEQ ID NO: 49648 - protein, 9 aa, Homo Sapiens
LLRPPRVSG

SEQ ID NO: 49649 - protein, 9 aa, Homo Sapiens
LADLENSSM

SEQ ID NO: 49650 - protein, 9 aa, Homo Sapiens
ESIRKKACA

SEQ ID NO: 49651 - protein, 9 aa, Homo Sapiens
LEAQVELAS

SEQ ID NO: 49652 - protein, 9 aa, Homo Sapiens
QDTSVDHTE

SEQ ID NO: 49653 - protein, 9 aa, Homo Sapiens
DQLLSQMKE

SEQ ID NO: 49654 - protein, 9 aa, Homo Sapiens
FTAMYKILD

SEQ ID NO: 49655 - protein, 9 aa, Homo Sapiens
YSTHMHCVW

SEQ ID NO: 49656 - protein, 9 aa, Homo Sapiens
KSKPIFWNF

SEQ ID NO: 49657 - protein, 9 aa, Homo Sapiens
LQAPLSVFG

SEQ ID NO: 49658 - protein, 9 aa, Homo Sapiens
TFILIVKHI

SEQ ID NO: 49659 - protein, 9 aa, Homo Sapiens
FRSSDFAKK

SEQ ID NO: 49660 - protein, 9 aa, Homo Sapiens
NLSHVMRVA

SEQ ID NO: 49661 - protein, 9 aa, Homo Sapiens
LERRTQQLP

SEQ ID NO: 49662 - protein, 9 aa, Homo Sapiens
FLLQFLAYS

SEQ ID NO: 49663 - protein, 9 aa, Homo Sapiens
EAFRMLLKA

SEQ ID NO: 49664 - protein, 9 aa, Homo Sapiens
VHLLEVGQP

SEQ ID NO: 49665 - protein, 9 aa, Homo Sapiens
IPREKTFIL

SEQ ID NO: 49666 - protein, 9 aa, Homo Sapiens
YLDATAEGG

SEQ ID NO: 49667 - protein, 9 aa, Homo Sapiens
YVPLSSNSP

SEQ ID NO: 49668 - protein, 9 aa, Homo Sapiens
TENVDRRQI

SEQ ID NO: 49669 - protein, 9 aa, Homo Sapiens
MREAFRMLL

SEQ ID NO: 49670 - protein, 9 aa, Homo Sapiens
KVKEQKQTN

SEQ ID NO: 49671 - protein, 9 aa, Homo Sapiens
SSNILQQLP

SEQ ID NO: 49672 - protein, 9 aa, Homo Sapiens
SLRMFLKYD

SEQ ID NO: 49673 - protein, 9 aa, Homo Sapiens
KVQVDDLEG

SEQ ID NO: 49674 - protein, 9 aa, Homo Sapiens
GFLLTQDQL

SEQ ID NO: 49675 - protein, 9 aa, Homo Sapiens
EILNKANHM

SEQ ID NO: 49676 - protein, 9 aa, Homo Sapiens
NHMKKSLEK

SEQ ID NO: 49677 - protein, 9 aa, Homo Sapiens
CNFGQKEKP

SEQ ID NO: 49678 - protein, 9 aa, Homo Sapiens
FWNFMFFIC

SEQ ID NO: 49679 - protein, 9 aa, Homo Sapiens
LQGFLLTQD

SEQ ID NO: 49680 - protein, 9 aa, Homo Sapiens
KSKTKARRA

SEQ ID NO: 49681 - protein, 9 aa, Homo Sapiens
SHVDLVVMG

SEQ ID NO: 49682 - protein, 9 aa, Homo Sapiens
APLSVFGGD

SEQ ID NO: 49683 - protein, 9 aa, Homo Sapiens
PVIENNVCN

SEQ ID NO: 49684 - protein, 9 aa, Homo Sapiens
ANHMKKSLE

SEQ ID NO: 49685 - protein, 9 aa, Homo Sapiens
IGDVVNHDL

SEQ ID NO: 49686 - protein, 9 aa, Homo Sapiens
ELNRWRYGE

SEQ ID NO: 49687 - protein, 9 aa, Homo Sapiens
FPRLRTIVL

SEQ ID NO: 49688 - protein, 9 aa, Homo Sapiens
IHSNCQQNS

SEQ ID NO: 49689 - protein, 9 aa, Homo Sapiens
TMKTEKLLK

SEQ ID NO: 49690 - protein, 9 aa, Homo Sapiens
HFQQAIEKD

SEQ ID NO: 49691 - protein, 9 aa, Homo Sapiens
RETCTESLC

SEQ ID NO: 49692 - protein, 9 aa, Homo Sapiens
STLNHTSGS

SEQ ID NO: 49693 - protein, 9 aa, Homo Sapiens
DEAGILPIL

SEQ ID NO: 49694 - protein, 9 aa, Homo Sapiens
WRAQTGLDM

SEQ ID NO: 49695 - protein, 9 aa, Homo Sapiens
VEYHINDGN

SEQ ID NO: 49696 - protein, 9 aa, Homo Sapiens
NPQTFKFDR

SEQ ID NO: 49697 - protein, 9 aa, Homo Sapiens
MTTVTCSLD

SEQ ID NO: 49698 - protein, 9 aa, Homo Sapiens
SLPWSCNSW

SEQ ID NO: 49699 - protein, 9 aa, Homo Sapiens
RTQQLPDTS

SEQ ID NO: 49700 - protein, 9 aa, Homo Sapiens
ALRFNKHYK

SEQ ID NO: 49701 - protein, 9 aa, Homo Sapiens
KEDNSSEGE

SEQ ID NO: 49702 - protein, 9 aa, Homo Sapiens
IQIPKPANQ

SEQ ID NO: 49703 - protein, 9 aa, Homo Sapiens
TKRKRDVRG

SEQ ID NO: 49704 - protein, 9 aa, Homo Sapiens
AINKLSGVI

SEQ ID NO: 49705 - protein, 9 aa, Homo Sapiens
CKMQLEEQV

SEQ ID NO: 49706 - protein, 9 aa, Homo Sapiens
SNCQQNSNA

SEQ ID NO: 49707 - protein, 9 aa, Homo Sapiens
VGKAPPETR

SEQ ID NO: 49708 - protein, 9 aa, Homo Sapiens
KYVLYVLYF

SEQ ID NO: 49709 - protein, 9 aa, Homo Sapiens
DQKKYLYRY

SEQ ID NO: 49710 - protein, 9 aa, Homo Sapiens
SKKFQRISK

SEQ ID NO: 49711 - protein, 9 aa, Homo Sapiens
NGHTASLGP

SEQ ID NO: 49712 - protein, 9 aa, Homo Sapiens
RDQKKYLYR

SEQ ID NO: 49713 - protein, 9 aa, Homo Sapiens
IVYPSAFVL

SEQ ID NO: 49714 - protein, 9 aa, Homo Sapiens
IQGATLIFD

SEQ ID NO: 49715 - protein, 9 aa, Homo Sapiens
GTDCGTIES

SEQ ID NO: 49716 - protein, 9 aa, Homo Sapiens
QYAWANSKI

SEQ ID NO: 49717 - protein, 9 aa, Homo Sapiens
PGQSYSLPW

SEQ ID NO: 49718 - protein, 9 aa, Homo Sapiens
CPQIVIAFN

SEQ ID NO: 49719 - protein, 9 aa, Homo Sapiens
FRMLLKAII

SEQ ID NO: 49720 - protein, 9 aa, Homo Sapiens
ESNLPSLSP

SEQ ID NO: 49721 - protein, 9 aa, Homo Sapiens
PNGYSTHMH

SEQ ID NO: 49722 - protein, 9 aa, Homo Sapiens
GYVPLSSNS

SEQ ID NO: 49723 - protein, 9 aa, Homo Sapiens
IAFNEERLT

SEQ ID NO: 49724 - protein, 9 aa, Homo Sapiens
SPCVGQVTE

SEQ ID NO: 49725 - protein, 9 aa, Homo Sapiens
ADGVMRTMK

SEQ ID NO: 49726 - protein, 9 aa, Homo Sapiens
KHIYSETSY

SEQ ID NO: 49727 - protein, 9 aa, Homo Sapiens
LSRLQDSPV

SEQ ID NO: 49728 - protein, 9 aa, Homo Sapiens
SLSSMHLEQ

SEQ ID NO: 49729 - protein, 9 aa, Homo Sapiens
DTQPQPSTN

SEQ ID NO: 49730 - protein, 9 aa, Homo Sapiens
QEADINFFS

SEQ ID NO: 49731 - protein, 9 aa, Homo Sapiens
NVLSHLPSH

SEQ ID NO: 49732 - protein, 9 aa, Homo Sapiens
EVPKASSSL

SEQ ID NO: 49733 - protein, 9 aa, Homo Sapiens
ILYVNDNPP

SEQ ID NO: 49734 - protein, 9 aa, Homo Sapiens
DGEEKVHQS

SEQ ID NO: 49735 - protein, 9 aa, Homo Sapiens
TALLESSCD

SEQ ID NO: 49736 - protein, 9 aa, Homo Sapiens
VKEQKQTNT

SEQ ID NO: 49737 - protein, 9 aa, Homo Sapiens
RLEDLKEQV

SEQ ID NO: 49738 - protein, 9 aa, Homo Sapiens
GMKMPSISG

SEQ ID NO: 49739 - protein, 9 aa, Homo Sapiens
PPPSTLNHT

SEQ ID NO: 49740 - protein, 9 aa, Homo Sapiens
LKRRLTLML

SEQ ID NO: 49741 - protein, 9 aa, Homo Sapiens
QSNSEVWPH

SEQ ID NO: 49742 - protein, 9 aa, Homo Sapiens
CAVECNFGQ

SEQ ID NO: 49743 - protein, 9 aa, Homo Sapiens
NAFTKTHPA

SEQ ID NO: 49744 - protein, 9 aa, Homo Sapiens
KKETLGRYG

SEQ ID NO: 49745 - protein, 9 aa, Homo Sapiens
TDLSLEDST

SEQ ID NO: 49746 - protein, 9 aa, Homo Sapiens
LNHTSGSLL

SEQ ID NO: 49747 - protein, 9 aa, Homo Sapiens
LSLEMEQLE

SEQ ID NO: 49748 - protein, 9 aa, Homo Sapiens
YQQYLDATA

SEQ ID NO: 49749 - protein, 9 aa, Homo Sapiens
EKCKQRKKN

SEQ ID NO: 49750 - protein, 9 aa, Homo Sapiens
LTPVKRIPQ

SEQ ID NO: 49751 - protein, 9 aa, Homo Sapiens
FCLQQIEEL

SEQ ID NO: 49752 - protein, 9 aa, Homo Sapiens
LKKVKKGSF

SEQ ID NO: 49753 - protein, 9 aa, Homo Sapiens
IENNVCNRY

SEQ ID NO: 49754 - protein, 9 aa, Homo Sapiens
RLRQSDMAG

SEQ ID NO: 49755 - protein, 9 aa, Homo Sapiens
YSSPIGRLI

SEQ ID NO: 49756 - protein, 9 aa, Homo Sapiens
YPNGYSTHM

SEQ ID NO: 49757 - protein, 9 aa, Homo Sapiens
DTCKPLKKR

SEQ ID NO: 49758 - protein, 9 aa, Homo Sapiens
KYHKNEMLQ

SEQ ID NO: 49759 - protein, 9 aa, Homo Sapiens
GESNLPSLS

SEQ ID NO: 49760 - protein, 9 aa, Homo Sapiens
VVCGGGITG

SEQ ID NO: 49761 - protein, 9 aa, Homo Sapiens
EGSQGLPGP

SEQ ID NO: 49762 - protein, 9 aa, Homo Sapiens
RHYLLTLLP

SEQ ID NO: 49763 - protein, 9 aa, Homo Sapiens
RGCGQAWGA

SEQ ID NO: 49764 - protein, 9 aa, Homo Sapiens
LEMEQLELQ

SEQ ID NO: 49765 - protein, 9 aa, Homo Sapiens
DEILQSSKK

SEQ ID NO: 49766 - protein, 9 aa, Homo Sapiens
VKQFNRDIE

SEQ ID NO: 49767 - protein, 9 aa, Homo Sapiens
YLLGMKMPS

SEQ ID NO: 49768 - protein, 9 aa, Homo Sapiens
LLTPVKRIP

SEQ ID NO: 49769 - protein, 9 aa, Homo Sapiens
DHEALVGPL

SEQ ID NO: 49770 - protein, 9 aa, Homo Sapiens
REALNKITL

SEQ ID NO: 49771 - protein, 9 aa, Homo Sapiens
KISQVCATK

SEQ ID NO: 49772 - protein, 9 aa, Homo Sapiens
LTCGVLNNE

SEQ ID NO: 49773 - protein, 9 aa, Homo Sapiens
LLMYSRIKL

SEQ ID NO: 49774 - protein, 9 aa, Homo Sapiens
TDCVSSDDE

SEQ ID NO: 49775 - protein, 9 aa, Homo Sapiens
LEQFMEYQG

SEQ ID NO: 49776 - protein, 9 aa, Homo Sapiens
RYGETVPID

SEQ ID NO: 49777 - protein, 9 aa, Homo Sapiens
NPVRFQSSA

SEQ ID NO: 49778 - protein, 9 aa, Homo Sapiens
NSSMFTGDL

SEQ ID NO: 49779 - protein, 9 aa, Homo Sapiens
VGGHLLTET

SEQ ID NO: 49780 - protein, 9 aa, Homo Sapiens
SEECSAVLT

SEQ ID NO: 49781 - protein, 9 aa, Homo Sapiens
SINPVRFQS

SEQ ID NO: 49782 - protein, 9 aa, Homo Sapiens
QDYEELEKH

SEQ ID NO: 49783 - protein, 9 aa, Homo Sapiens
QQQKQPHLT

SEQ ID NO: 49784 - protein, 9 aa, Homo Sapiens
CCPNGHTAS

SEQ ID NO: 49785 - protein, 9 aa, Homo Sapiens
LKDQTVIVG

SEQ ID NO: 49786 - protein, 9 aa, Homo Sapiens
FASNIRIKK

SEQ ID NO: 49787 - protein, 9 aa, Homo Sapiens
RMFLKYDMS

SEQ ID NO: 49788 - protein, 9 aa, Homo Sapiens
TWIQPGTNV

SEQ ID NO: 49789 - protein, 9 aa, Homo Sapiens
FSKQAEDTT

SEQ ID NO: 49790 - protein, 9 aa, Homo Sapiens
ETDCVSSDD

SEQ ID NO: 49791 - protein, 9 aa, Homo Sapiens
RHGWNYEHL

SEQ ID NO: 49792 - protein, 9 aa, Homo Sapiens
TYIENVDRN

SEQ ID NO: 49793 - protein, 9 aa, Homo Sapiens
KMPSISGPL

SEQ ID NO: 49794 - protein, 9 aa, Homo Sapiens
AWKEKFMTV

SEQ ID NO: 49795 - protein, 9 aa, Homo Sapiens
GYEVTSKVG

SEQ ID NO: 49796 - protein, 9 aa, Homo Sapiens
VDHTETGNT

SEQ ID NO: 49797 - protein, 9 aa, Homo Sapiens
IVIAFNEER

SEQ ID NO: 49798 - protein, 9 aa, Homo Sapiens
DEKKEDVEE

SEQ ID NO: 49799 - protein, 9 aa, Homo Sapiens
SQMKELSMV

SEQ ID NO: 49800 - protein, 9 aa, Homo Sapiens
VVVCGGGIT

SEQ ID NO: 49801 - protein, 9 aa, Homo Sapiens
STMCVVCSH

SEQ ID NO: 49802 - protein, 9 aa, Homo Sapiens
KLNTMKHLL

SEQ ID NO: 49803 - protein, 9 aa, Homo Sapiens
EVIVGGVRI

SEQ ID NO: 49804 - protein, 9 aa, Homo Sapiens
PDHEALVGP

SEQ ID NO: 49805 - protein, 9 aa, Homo Sapiens
IKSPTNNEK

SEQ ID NO: 49806 - protein, 9 aa, Homo Sapiens
CVGQVTEDC

SEQ ID NO: 49807 - protein, 9 aa, Homo Sapiens
VSQKHGSGP

SEQ ID NO: 49808 - protein, 9 aa, Homo Sapiens
KNAFTKTHP

SEQ ID NO: 49809 - protein, 9 aa, Homo Sapiens
RPPRVSGKT

SEQ ID NO: 49810 - protein, 9 aa, Homo Sapiens
ETSYQPGQS

SEQ ID NO: 49811 - protein, 9 aa, Homo Sapiens
LSSNILQQL

SEQ ID NO: 49812 - protein, 9 aa, Homo Sapiens
GGRASQSTV

SEQ ID NO: 49813 - protein, 9 aa, Homo Sapiens
LHYELLAIL

SEQ ID NO: 49814 - protein, 9 aa, Homo Sapiens
NGFVKFLSE

SEQ ID NO: 49815 - protein, 9 aa, Homo Sapiens
CVPDAAGDC

SEQ ID NO: 49816 - protein, 9 aa, Homo Sapiens
IIWKTKDVI

SEQ ID NO: 49817 - protein, 9 aa, Homo Sapiens
MKSSKGRPG

SEQ ID NO: 49818 - protein, 9 aa, Homo Sapiens
EFALRDQKK

SEQ ID NO: 49819 - protein, 9 aa, Homo Sapiens
QGLWVTFKL

SEQ ID NO: 49820 - protein, 9 aa, Homo Sapiens
ADLLTAEQQ

SEQ ID NO: 49821 - protein, 9 aa, Homo Sapiens
EHFQQAIEK

SEQ ID NO: 49822 - protein, 9 aa, Homo Sapiens
DNSSEGEEE

SEQ ID NO: 49823 - protein, 9 aa, Homo Sapiens
SEVFQAINI

SEQ ID NO: 49824 - protein, 9 aa, Homo Sapiens
AENLNIKLQ

SEQ ID NO: 49825 - protein, 9 aa, Homo Sapiens
YSQMREAFR

SEQ ID NO: 49826 - protein, 9 aa, Homo Sapiens
SWSFHKLNT

SEQ ID NO: 49827 - protein, 9 aa, Homo Sapiens
LQEADINFF

SEQ ID NO: 49828 - protein, 9 aa, Homo Sapiens
SRLQGFLLT

SEQ ID NO: 49829 - protein, 9 aa, Homo Sapiens
ENVDRNILK

SEQ ID NO: 49830 - protein, 9 aa, Homo Sapiens
LVSEYQQYL

SEQ ID NO: 49831 - protein, 9 aa, Homo Sapiens
GSQGLPGPP

SEQ ID NO: 49832 - protein, 9 aa, Homo Sapiens
NWLSEWWFK

SEQ ID NO: 49833 - protein, 9 aa, Homo Sapiens
KKYLYRYPG

SEQ ID NO: 49834 - protein, 9 aa, Homo Sapiens
KKVSSAIFK

SEQ ID NO: 49835 - protein, 9 aa, Homo Sapiens
MNRGINASK

SEQ ID NO: 49836 - protein, 9 aa, Homo Sapiens
FERPVEHMT

SEQ ID NO: 49837 - protein, 9 aa, Homo Sapiens
LNTMKHLLL

SEQ ID NO: 49838 - protein, 9 aa, Homo Sapiens
GATLIFDEA

SEQ ID NO: 49839 - protein, 9 aa, Homo Sapiens
WCFTSEGAK

SEQ ID NO: 49840 - protein, 9 aa, Homo Sapiens
KVGLSELTS

SEQ ID NO: 49841 - protein, 9 aa, Homo Sapiens
LLGMKMPSI

SEQ ID NO: 49842 - protein, 9 aa, Homo Sapiens
HVMRVAKPL

SEQ ID NO: 49843 - protein, 9 aa, Homo Sapiens
GLFAEKVSG

SEQ ID NO: 49844 - protein, 9 aa, Homo Sapiens
EWREVRHIG

SEQ ID NO: 49845 - protein, 9 aa, Homo Sapiens
ETCTESLCL

SEQ ID NO: 49846 - protein, 9 aa, Homo Sapiens
NNLFEALFP

SEQ ID NO: 49847 - protein, 9 aa, Homo Sapiens
PREKTFILP

SEQ ID NO: 49848 - protein, 9 aa, Homo Sapiens
KVSSAIFKV

SEQ ID NO: 49849 - protein, 9 aa, Homo Sapiens
ASLARKKPL

SEQ ID NO: 49850 - protein, 9 aa, Homo Sapiens
IFWNFMFFI

SEQ ID NO: 49851 - protein, 9 aa, Homo Sapiens
LWRSCLKRR

SEQ ID NO: 49852 - protein, 9 aa, Homo Sapiens
HIYSETSYQ

SEQ ID NO: 49853 - protein, 9 aa, Homo Sapiens
SRWLKLFLN

SEQ ID NO: 49854 - protein, 9 aa, Homo Sapiens
KKKFLDALE

SEQ ID NO: 49855 - protein, 9 aa, Homo Sapiens
QSAWAMYFE

SEQ ID NO: 49856 - protein, 9 aa, Homo Sapiens
NKYESDVEL

SEQ ID NO: 49857 - protein, 9 aa, Homo Sapiens
DSETVLDIQ

SEQ ID NO: 49858 - protein, 9 aa, Homo Sapiens
GILSERIKA

SEQ ID NO: 49859 - protein, 9 aa, Homo Sapiens
SVKENLAIN

SEQ ID NO: 49860 - protein, 9 aa, Homo Sapiens
QDSPVGDPM

SEQ ID NO: 49861 - protein, 9 aa, Homo Sapiens
DETYIENVD

SEQ ID NO: 49862 - protein, 9 aa, Homo Sapiens
WKVYVNRPL

SEQ ID NO: 49863 - protein, 9 aa, Homo Sapiens
WGGRASQST

SEQ ID NO: 49864 - protein, 9 aa, Homo Sapiens
ERRTQQLPD

SEQ ID NO: 49865 - protein, 9 aa, Homo Sapiens
KVNLQSPLK

SEQ ID NO: 49866 - protein, 9 aa, Homo Sapiens
TAIVKQFNR

SEQ ID NO: 49867 - protein, 9 aa, Homo Sapiens
GRGCGQAWG

SEQ ID NO: 49868 - protein, 9 aa, Homo Sapiens
SNIRIKKEP

SEQ ID NO: 49869 - protein, 9 aa, Homo Sapiens
NRYKADRNP

SEQ ID NO: 49870 - protein, 9 aa, Homo Sapiens
VGEGESAGG

SEQ ID NO: 49871 - protein, 9 aa, Homo Sapiens
METDCVSSD

SEQ ID NO: 49872 - protein, 9 aa, Homo Sapiens
KENLAINKL

SEQ ID NO: 49873 - protein, 9 aa, Homo Sapiens
YIPWEKVQV

SEQ ID NO: 49874 - protein, 9 aa, Homo Sapiens
FNRDIEVLQ

SEQ ID NO: 49875 - protein, 9 aa, Homo Sapiens
GGRGSVGHA

SEQ ID NO: 49876 - protein, 9 aa, Homo Sapiens
MPSISGPLG

SEQ ID NO: 49877 - protein, 9 aa, Homo Sapiens
QRKKNKKVR

SEQ ID NO: 49878 - protein, 9 aa, Homo Sapiens
HALSRLQDS

SEQ ID NO: 49879 - protein, 9 aa, Homo Sapiens
IDSTNVAEL

SEQ ID NO: 49880 - protein, 9 aa, Homo Sapiens
EYSAFKADP

SEQ ID NO: 49881 - protein, 9 aa, Homo Sapiens
QDSKVNLQS

SEQ ID NO: 49882 - protein, 9 aa, Homo Sapiens
LGQSIMTPA

SEQ ID NO: 49883 - protein, 9 aa, Homo Sapiens
ILNKEEVNV

SEQ ID NO: 49884 - protein, 9 aa, Homo Sapiens
GARPPCLGG

SEQ ID NO: 49885 - protein, 9 aa, Homo Sapiens
GLIYKDMFL

SEQ ID NO: 49886 - protein, 9 aa, Homo Sapiens
SLKPENLLT

SEQ ID NO: 49887 - protein, 9 aa, Homo Sapiens
FIFTQVFLI

SEQ ID NO: 49888 - protein, 9 aa, Homo Sapiens
AWANSKISQ

SEQ ID NO: 49889 - protein, 9 aa, Homo Sapiens
LWVTFKLLP

SEQ ID NO: 49890 - protein, 9 aa, Homo Sapiens
APAIPAPSQ

SEQ ID NO: 49891 - protein, 9 aa, Homo Sapiens
SRVVVGILY

SEQ ID NO: 49892 - protein, 9 aa, Homo Sapiens
LKLFLNANR

SEQ ID NO: 49893 - protein, 9 aa, Homo Sapiens
ECEQSEYSA

SEQ ID NO: 49894 - protein, 9 aa, Homo Sapiens
RFLLFPREA

SEQ ID NO: 49895 - protein, 9 aa, Homo Sapiens
AMAMDWFIA

SEQ ID NO: 49896 - protein, 9 aa, Homo Sapiens
DCKKKFLDA

SEQ ID NO: 49897 - protein, 9 aa, Homo Sapiens
TELRCHFLQ

SEQ ID NO: 49898 - protein, 9 aa, Homo Sapiens
GLDMRESYG

SEQ ID NO: 49899 - protein, 9 aa, Homo Sapiens
KFVQTDLPF

SEQ ID NO: 49900 - protein, 9 aa, Homo Sapiens
EQVAPLEKV

SEQ ID NO: 49901 - protein, 9 aa, Homo Sapiens
KLKNKTNKQ

SEQ ID NO: 49902 - protein, 9 aa, Homo Sapiens
LKMLLIQGA

SEQ ID NO: 49903 - protein, 9 aa, Homo Sapiens
KENEEKGKE

SEQ ID NO: 49904 - protein, 9 aa, Homo Sapiens
KNLSDTCKP

SEQ ID NO: 49905 - protein, 9 aa, Homo Sapiens
TQTDVYRAN

SEQ ID NO: 49906 - protein, 9 aa, Homo Sapiens
LRPPRVSGK

SEQ ID NO: 49907 - protein, 9 aa, Homo Sapiens
QSKHEAARL

SEQ ID NO: 49908 - protein, 9 aa, Homo Sapiens
GTIKSPTNN

SEQ ID NO: 49909 - protein, 9 aa, Homo Sapiens
RLIVRDPGA

SEQ ID NO: 49910 - protein, 9 aa, Homo Sapiens
YRHGWNYEH

SEQ ID NO: 49911 - protein, 9 aa, Homo Sapiens
EKHLKEVFK

SEQ ID NO: 49912 - protein, 9 aa, Homo Sapiens
KNKKVRVTV

SEQ ID NO: 49913 - protein, 9 aa, Homo Sapiens
INMTTVTCS

SEQ ID NO: 49914 - protein, 9 aa, Homo Sapiens
ENLAINKLS

SEQ ID NO: 49915 - protein, 9 aa, Homo Sapiens
MEYQGASSP

SEQ ID NO: 49916 - protein, 9 aa, Homo Sapiens
IVSFTSDII

SEQ ID NO: 49917 - protein, 9 aa, Homo Sapiens
IGRKCDRIL

SEQ ID NO: 49918 - protein, 9 aa, Homo Sapiens
GGHLLTETK

SEQ ID NO: 49919 - protein, 9 aa, Homo Sapiens
EILQSSKKF

SEQ ID NO: 49920 - protein, 9 aa, Homo Sapiens
RWRYGETVP

SEQ ID NO: 49921 - protein, 9 aa, Homo Sapiens
YDMSIHDVS

SEQ ID NO: 49922 - protein, 9 aa, Homo Sapiens
AQTELRCHF

SEQ ID NO: 49923 - protein, 9 aa, Homo Sapiens
RIPQLTRAV

SEQ ID NO: 49924 - protein, 9 aa, Homo Sapiens
AEKVSGFHK

SEQ ID NO: 49925 - protein, 9 aa, Homo Sapiens
GACPGSRSG

SEQ ID NO: 49926 - protein, 9 aa, Homo Sapiens
TAMYKILDV

SEQ ID NO: 49927 - protein, 9 aa, Homo Sapiens
QLSDTQPQP

SEQ ID NO: 49928 - protein, 9 aa, Homo Sapiens
FSAVIEALI

SEQ ID NO: 49929 - protein, 9 aa, Homo Sapiens
VLDIQNDRN

SEQ ID NO: 49930 - protein, 9 aa, Homo Sapiens
DVAENLNIK

SEQ ID NO: 49931 - protein, 9 aa, Homo Sapiens
GEEGSQGLP

SEQ ID NO: 49932 - protein, 9 aa, Homo Sapiens
NHDLAVGDR

SEQ ID NO: 49933 - protein, 9 aa, Homo Sapiens
NPVILTCDA

SEQ ID NO: 49934 - protein, 9 aa, Homo Sapiens
VSKSCFSPC

SEQ ID NO: 49935 - protein, 9 aa, Homo Sapiens
AVIGTDCGT

SEQ ID NO: 49936 - protein, 9 aa, Homo Sapiens
AFFRTSPGD

SEQ ID NO: 49937 - protein, 9 aa, Homo Sapiens
DNLFKYIIG

SEQ ID NO: 49938 - protein, 9 aa, Homo Sapiens
MYAFFRTSP

SEQ ID NO: 49939 - protein, 9 aa, Homo Sapiens
ASQSTVAVV

SEQ ID NO: 49940 - protein, 9 aa, Homo Sapiens
LDACIKLEK

SEQ ID NO: 49941 - protein, 9 aa, Homo Sapiens
NKEEVNVEG

SEQ ID NO: 49942 - protein, 9 aa, Homo Sapiens
IFIFTQVFL

SEQ ID NO: 49943 - protein, 9 aa, Homo Sapiens
EYHINDGNT

SEQ ID NO: 49944 - protein, 9 aa, Homo Sapiens
LRQSDMAGS

SEQ ID NO: 49945 - protein, 9 aa, Homo Sapiens
FQAINITNN

SEQ ID NO: 49946 - protein, 9 aa, Homo Sapiens
PGQDSETVL

SEQ ID NO: 49947 - protein, 9 aa, Homo Sapiens
KPENLLTRL

SEQ ID NO: 49948 - protein, 9 aa, Homo Sapiens
DRNILKGQD

SEQ ID NO: 49949 - protein, 9 aa, Homo Sapiens
IVGKAPPET

SEQ ID NO: 49950 - protein, 9 aa, Homo Sapiens
ILTCGVLNN

SEQ ID NO: 49951 - protein, 9 aa, Homo Sapiens
FVDPKEFDI

SEQ ID NO: 49952 - protein, 9 aa, Homo Sapiens
NVSFSAVIE

SEQ ID NO: 49953 - protein, 9 aa, Homo Sapiens
NLLTRLLKR

SEQ ID NO: 49954 - protein, 9 aa, Homo Sapiens
NEPQDSKVN

SEQ ID NO: 49955 - protein, 9 aa, Homo Sapiens
TGILSERIK

SEQ ID NO: 49956 - protein, 9 aa, Homo Sapiens
TSEGAKHLD

SEQ ID NO: 49957 - protein, 9 aa, Homo Sapiens
KLVMEIINL

SEQ ID NO: 49958 - protein, 9 aa, Homo Sapiens
TEKMYWMNC

SEQ ID NO: 49959 - protein, 9 aa, Homo Sapiens
SRRRPFFCL

SEQ ID NO: 49960 - protein, 9 aa, Homo Sapiens
KRDVRGQEG

SEQ ID NO: 49961 - protein, 9 aa, Homo Sapiens
RRQIILDLQ

SEQ ID NO: 49962 - protein, 9 aa, Homo Sapiens
IHTLAQLIA

SEQ ID NO: 49963 - protein, 9 aa, Homo Sapiens
NLSDTCKPL

SEQ ID NO: 49964 - protein, 9 aa, Homo Sapiens
FKGIIYYRH

SEQ ID NO: 49965 - protein, 9 aa, Homo Sapiens
ILNKANHMK

SEQ ID NO: 49966 - protein, 9 aa, Homo Sapiens
QSAGKSERR

SEQ ID NO: 49967 - protein, 9 aa, Homo Sapiens
HGWNYEHLF

SEQ ID NO: 49968 - protein, 9 aa, Homo Sapiens
FNEERLTWH

SEQ ID NO: 49969 - protein, 9 aa, Homo Sapiens
RLYGVHRMI

SEQ ID NO: 49970 - protein, 9 aa, Homo Sapiens
EQKTENGKV

SEQ ID NO: 49971 - protein, 9 aa, Homo Sapiens
AQYWKRNNT

SEQ ID NO: 49972 - protein, 9 aa, Homo Sapiens
LEDSTMCVV

SEQ ID NO: 49973 - protein, 9 aa, Homo Sapiens
FTQVFLIDN

SEQ ID NO: 49974 - protein, 9 aa, Homo Sapiens
RTGWTYGYV

SEQ ID NO: 49975 - protein, 9 aa, Homo Sapiens
AALLKSKTK

SEQ ID NO: 49976 - protein, 9 aa, Homo Sapiens
SFKKETLGR

SEQ ID NO: 49977 - protein, 9 aa, Homo Sapiens
MRTMKTEKL

SEQ ID NO: 49978 - protein, 9 aa, Homo Sapiens
EAINVLSHL

SEQ ID NO: 49979 - protein, 9 aa, Homo Sapiens
GGVRIVYPS

SEQ ID NO: 49980 - protein, 9 aa, Homo Sapiens
DNKRADLVF

SEQ ID NO: 49981 - protein, 9 aa, Homo Sapiens
QDSETVLDI

SEQ ID NO: 49982 - protein, 9 aa, Homo Sapiens
QALKLQEAD

SEQ ID NO: 49983 - protein, 9 aa, Homo Sapiens
MSSICNNLF

SEQ ID NO: 49984 - protein, 9 aa, Homo Sapiens
SHLGNVSFS

SEQ ID NO: 49985 - protein, 9 aa, Homo Sapiens
FNNYVDCKK

SEQ ID NO: 49986 - protein, 9 aa, Homo Sapiens
RKRDVRGQE

SEQ ID NO: 49987 - protein, 9 aa, Homo Sapiens
ETKYINLSL

SEQ ID NO: 49988 - protein, 9 aa, Homo Sapiens
DATNPLTLC

SEQ ID NO: 49989 - protein, 9 aa, Homo Sapiens
AEIDSTNVA

SEQ ID NO: 49990 - protein, 9 aa, Homo Sapiens
ECRETCTES

SEQ ID NO: 49991 - protein, 9 aa, Homo Sapiens
QIVIAFNEE

SEQ ID NO: 49992 - protein, 9 aa, Homo Sapiens
EGEEEIEPF

SEQ ID NO: 49993 - protein, 9 aa, Homo Sapiens
NAFIVSFTS

SEQ ID NO: 49994 - protein, 9 aa, Homo Sapiens
QSEWKVYVN

SEQ ID NO: 49995 - protein, 9 aa, Homo Sapiens
PPSTLNHTS

SEQ ID NO: 49996 - protein, 9 aa, Homo Sapiens
SCNSWCFTS

SEQ ID NO: 49997 - protein, 9 aa, Homo Sapiens
ENVDRRQII

SEQ ID NO: 49998 - protein, 9 aa, Homo Sapiens
MIEDFLEFE

SEQ ID NO: 49999 - protein, 9 aa, Homo Sapiens
SDDECVGVL

SEQ ID NO: 50000 - protein, 9 aa, Homo Sapiens
KIKFLKMKI

SEQ ID NO: 50001 - protein, 9 aa, Homo Sapiens
PPLLAISLF

SEQ ID NO: 50002 - protein, 9 aa, Homo Sapiens
CMNPQTFKF

SEQ ID NO: 50003 - protein, 9 aa, Homo Sapiens
SFLIDSSTI

SEQ ID NO: 50004 - protein, 9 aa, Homo Sapiens
CFTSEGAKH

SEQ ID NO: 50005 - protein, 9 aa, Homo Sapiens
YVDCKKKFL

SEQ ID NO: 50006 - protein, 9 aa, Homo Sapiens
KVYVNRPLD

SEQ ID NO: 50007 - protein, 9 aa, Homo Sapiens
EADINFFSE

SEQ ID NO: 50008 - protein, 9 aa, Homo Sapiens
ASKDLPEEY

SEQ ID NO: 50009 - protein, 9 aa, Homo Sapiens
LEKKNKPHL

SEQ ID NO: 50010 - protein, 9 aa, Homo Sapiens
LAAVQQKLM

SEQ ID NO: 50011 - protein, 9 aa, Homo Sapiens
GDCCGTKKS

SEQ ID NO: 50012 - protein, 9 aa, Homo Sapiens
THMHCVWRI

SEQ ID NO: 50013 - protein, 9 aa, Homo Sapiens
VDSWRNFKA

SEQ ID NO: 50014 - protein, 9 aa, Homo Sapiens
ETYIENVDR

SEQ ID NO: 50015 - protein, 9 aa, Homo Sapiens
VAGNALLMY

SEQ ID NO: 50016 - protein, 9 aa, Homo Sapiens
QQYLDATAE

SEQ ID NO: 50017 - protein, 9 aa, Homo Sapiens
PSISGPLGF

SEQ ID NO: 50018 - protein, 9 aa, Homo Sapiens
LLESSCDNK

SEQ ID NO: 50019 - protein, 9 aa, Homo Sapiens
ITAIVKQFN

SEQ ID NO: 50020 - protein, 9 aa, Homo Sapiens
PDAAGDCCG

SEQ ID NO: 50021 - protein, 9 aa, Homo Sapiens
SLEDSTMCV

SEQ ID NO: 50022 - protein, 9 aa, Homo Sapiens
HRARPRLLE

SEQ ID NO: 50023 - protein, 9 aa, Homo Sapiens
AYMKSSKGR

SEQ ID NO: 50024 - protein, 9 aa, Homo Sapiens
EVLGQSIMT

SEQ ID NO: 50025 - protein, 9 aa, Homo Sapiens
RVAKPLIVA

SEQ ID NO: 50026 - protein, 9 aa, Homo Sapiens
SDTCKPLKK

SEQ ID NO: 50027 - protein, 9 aa, Homo Sapiens
TKYINLSLH

SEQ ID NO: 50028 - protein, 9 aa, Homo Sapiens
AQLPVIENN

SEQ ID NO: 50029 - protein, 9 aa, Homo Sapiens
CRETCTESL

SEQ ID NO: 50030 - protein, 9 aa, Homo Sapiens
RTMKTEKLL

SEQ ID NO: 50031 - protein, 9 aa, Homo Sapiens
KQPHLTPLQ

SEQ ID NO: 50032 - protein, 9 aa, Homo Sapiens
KHYKHDLKF

SEQ ID NO: 50033 - protein, 9 aa, Homo Sapiens
QFNRDIEVL

SEQ ID NO: 50034 - protein, 9 aa, Homo Sapiens
QRTHRPHLK

SEQ ID NO: 50035 - protein, 9 aa, Homo Sapiens
IFTQVFLID

SEQ ID NO: 50036 - protein, 9 aa, Homo Sapiens
CDGMGDVSQ

SEQ ID NO: 50037 - protein, 9 aa, Homo Sapiens
RNFKANTKG

SEQ ID NO: 50038 - protein, 9 aa, Homo Sapiens
NASKDLPEE

SEQ ID NO: 50039 - protein, 9 aa, Homo Sapiens
TKGSRWLKL

SEQ ID NO: 50040 - protein, 9 aa, Homo Sapiens
DTSVDHTET

SEQ ID NO: 50041 - protein, 9 aa, Homo Sapiens
NLAINKLSG

SEQ ID NO: 50042 - protein, 9 aa, Homo Sapiens
WENKVKKEN

SEQ ID NO: 50043 - protein, 9 aa, Homo Sapiens
VYVNRPLDR

SEQ ID NO: 50044 - protein, 9 aa, Homo Sapiens
DFAKKFVQT

SEQ ID NO: 50045 - protein, 9 aa, Homo Sapiens
LKYDMSIHD

SEQ ID NO: 50046 - protein, 9 aa, Homo Sapiens
GGRGMRVLH

SEQ ID NO: 50047 - protein, 9 aa, Homo Sapiens
CLVGLIYKD

SEQ ID NO: 50048 - protein, 9 aa, Homo Sapiens
HINDGNTDE

SEQ ID NO: 50049 - protein, 9 aa, Homo Sapiens
VEKCKQRKK

SEQ ID NO: 50050 - protein, 9 aa, Homo Sapiens
TQAQVVVCG

SEQ ID NO: 50051 - protein, 9 aa, Homo Sapiens
QQQLSDTQP

SEQ ID NO: 50052 - protein, 9 aa, Homo Sapiens
CVAGNALLM

SEQ ID NO: 50053 - protein, 9 aa, Homo Sapiens
GHLLTETKY

SEQ ID NO: 50054 - protein, 9 aa, Homo Sapiens
NKVGTSFTH

SEQ ID NO: 50055 - protein, 9 aa, Homo Sapiens
EDFLEFERP

SEQ ID NO: 50056 - protein, 9 aa, Homo Sapiens
LEDLKEQVA

SEQ ID NO: 50057 - protein, 9 aa, Homo Sapiens
SADSASLAR

SEQ ID NO: 50058 - protein, 9 aa, Homo Sapiens
KTKARRAVD

SEQ ID NO: 50059 - protein, 9 aa, Homo Sapiens
KVKNAFTKT

SEQ ID NO: 50060 - protein, 9 aa, Homo Sapiens
HRMIKEKIV

SEQ ID NO: 50061 - protein, 9 aa, Homo Sapiens
DSTNVAELL

SEQ ID NO: 50062 - protein, 9 aa, Homo Sapiens
RTVCKMQLE

SEQ ID NO: 50063 - protein, 9 aa, Homo Sapiens
NVDRNILKG

SEQ ID NO: 50064 - protein, 9 aa, Homo Sapiens
TDVYRANAK

SEQ ID NO: 50065 - protein, 9 aa, Homo Sapiens
HQSNSEVWP

SEQ ID NO: 50066 - protein, 9 aa, Homo Sapiens
QVPGPGAAG

SEQ ID NO: 50067 - protein, 9 aa, Homo Sapiens
HLPEGLFCA

SEQ ID NO: 50068 - protein, 9 aa, Homo Sapiens
EMFNPMYAF

SEQ ID NO: 50069 - protein, 9 aa, Homo Sapiens
DPWLDGNQL

SEQ ID NO: 50070 - protein, 9 aa, Homo Sapiens
YHINDGNTD

SEQ ID NO: 50071 - protein, 9 aa, Homo Sapiens
PMYAFFRTS

SEQ ID NO: 50072 - protein, 9 aa, Homo Sapiens
KFNLICSED

SEQ ID NO: 50073 - protein, 9 aa, Homo Sapiens
ICDISPLRL

SEQ ID NO: 50074 - protein, 9 aa, Homo Sapiens
RDVAENLNI

SEQ ID NO: 50075 - protein, 9 aa, Homo Sapiens
TVLDIQNDR

SEQ ID NO: 50076 - protein, 9 aa, Homo Sapiens
EEKVHQSNS

SEQ ID NO: 50077 - protein, 9 aa, Homo Sapiens
ANQSAGKSE

SEQ ID NO: 50078 - protein, 9 aa, Homo Sapiens
NSSLLPQNL

SEQ ID NO: 50079 - protein, 9 aa, Homo Sapiens
KILDVVKAH

SEQ ID NO: 50080 - protein, 9 aa, Homo Sapiens
SVFGGDSVV

SEQ ID NO: 50081 - protein, 9 aa, Homo Sapiens
LEFERPVEH

SEQ ID NO: 50082 - protein, 9 aa, Homo Sapiens
DGMGDVSQK

SEQ ID NO: 50083 - protein, 9 aa, Homo Sapiens
ENKVGTSFT

SEQ ID NO: 50084 - protein, 9 aa, Homo Sapiens
LIAAYSLVD

SEQ ID NO: 50085 - protein, 9 aa, Homo Sapiens
EALNKITLL

SEQ ID NO: 50086 - protein, 9 aa, Homo Sapiens
ILTCDATGI

SEQ ID NO: 50087 - protein, 9 aa, Homo Sapiens
LDICIYSSP

SEQ ID NO: 50088 - protein, 9 aa, Homo Sapiens
LASAKEFQI

SEQ ID NO: 50089 - protein, 9 aa, Homo Sapiens
ASSSLVQYD

SEQ ID NO: 50090 - protein, 9 aa, Homo Sapiens
PAWYHNFRV

SEQ ID NO: 50091 - protein, 9 aa, Homo Sapiens
SVNQEIEHF

SEQ ID NO: 50092 - protein, 9 aa, Homo Sapiens
RGMRVLHSY

SEQ ID NO: 50093 - protein, 9 aa, Homo Sapiens
VDDKLKNKT

SEQ ID NO: 50094 - protein, 9 aa, Homo Sapiens
IVGGVRIVY

SEQ ID NO: 50095 - protein, 9 aa, Homo Sapiens
NAWKEKFMT

SEQ ID NO: 50096 - protein, 9 aa, Homo Sapiens
GKSERRPMP

SEQ ID NO: 50097 - protein, 9 aa, Homo Sapiens
LKEQVAPLE

SEQ ID NO: 50098 - protein, 9 aa, Homo Sapiens
MDNLFKYII

SEQ ID NO: 50099 - protein, 9 aa, Homo Sapiens
KDCGKAYNL

SEQ ID NO: 50100 - protein, 9 aa, Homo Sapiens
ANVAGSEEC

SEQ ID NO: 50101 - protein, 9 aa, Homo Sapiens
YSLPWSCNS

SEQ ID NO: 50102 - protein, 9 aa, Homo Sapiens
WLGPKTCSR

SEQ ID NO: 50103 - protein, 9 aa, Homo Sapiens
SYQPGQSYS

SEQ ID NO: 50104 - protein, 9 aa, Homo Sapiens
ADSASLARK

SEQ ID NO: 50105 - protein, 9 aa, Homo Sapiens
TCGARPPCL

SEQ ID NO: 50106 - protein, 9 aa, Homo Sapiens
LLTAEQQSA

SEQ ID NO: 50107 - protein, 9 aa, Homo Sapiens
NRPLDREEQ

SEQ ID NO: 50108 - protein, 9 aa, Homo Sapiens
PIFWNFMFF

SEQ ID NO: 50109 - protein, 9 aa, Homo Sapiens
NFVDPKEFD

SEQ ID NO: 50110 - protein, 9 aa, Homo Sapiens
LLSSNILQQ

SEQ ID NO: 50111 - protein, 9 aa, Homo Sapiens
PEGLFCAES

SEQ ID NO: 50112 - protein, 9 aa, Homo Sapiens
RVKYVLYVL

SEQ ID NO: 50113 - protein, 9 aa, Homo Sapiens
VGTSFTHES

SEQ ID NO: 50114 - protein, 9 aa, Homo Sapiens
LDATAEGGG

SEQ ID NO: 50115 - protein, 9 aa, Homo Sapiens
AGDCCGTKK

SEQ ID NO: 50116 - protein, 9 aa, Homo Sapiens
MGDVSQKHG

SEQ ID NO: 50117 - protein, 9 aa, Homo Sapiens
QQLPDTSSY

SEQ ID NO: 50118 - protein, 9 aa, Homo Sapiens
SSMHLEQNH

SEQ ID NO: 50119 - protein, 9 aa, Homo Sapiens
RVCGWLGPK

SEQ ID NO: 50120 - protein, 9 aa, Homo Sapiens
VGECEQSEY

SEQ ID NO: 50121 - protein, 9 aa, Homo Sapiens
GALLHLKDP

SEQ ID NO: 50122 - protein, 9 aa, Homo Sapiens
VETISNPVI

SEQ ID NO: 50123 - protein, 9 aa, Homo Sapiens
YAWANSKIS

SEQ ID NO: 50124 - protein, 9 aa, Homo Sapiens
TSYQPGQSY

SEQ ID NO: 50125 - protein, 9 aa, Homo Sapiens
AGAKYLSET

SEQ ID NO: 50126 - protein, 9 aa, Homo Sapiens
IENAGAKYL

SEQ ID NO: 50127 - protein, 9 aa, Homo Sapiens
NELNRWRYG

SEQ ID NO: 50128 - protein, 9 aa, Homo Sapiens
RRRPFFCLQ

SEQ ID NO: 50129 - protein, 9 aa, Homo Sapiens
VHDFFSALP

SEQ ID NO: 50130 - protein, 9 aa, Homo Sapiens
FKTAYLQYR

SEQ ID NO: 50131 - protein, 9 aa, Homo Sapiens
VIGTDCGTI

SEQ ID NO: 50132 - protein, 9 aa, Homo Sapiens
QPESDINGF

SEQ ID NO: 50133 - protein, 9 aa, Homo Sapiens
LRTIVLKMP

SEQ ID NO: 50134 - protein, 9 aa, Homo Sapiens
KQKENEEKG

SEQ ID NO: 50135 - protein, 9 aa, Homo Sapiens
KEAINVLSH

SEQ ID NO: 50136 - protein, 9 aa, Homo Sapiens
VKKGSFLID

SEQ ID NO: 50137 - protein, 9 aa, Homo Sapiens
RGRGCGQAW

SEQ ID NO: 50138 - protein, 9 aa, Homo Sapiens
EHLTEEEKN

SEQ ID NO: 50139 - protein, 9 aa, Homo Sapiens
EQSEYSAFK

SEQ ID NO: 50140 - protein, 9 aa, Homo Sapiens
ATGILSERI

SEQ ID NO: 50141 - protein, 9 aa, Homo Sapiens
QAEDTTCEI

SEQ ID NO: 50142 - protein, 9 aa, Homo Sapiens
KYESDVELT

SEQ ID NO: 50143 - protein, 9 aa, Homo Sapiens
RTHRPHLKP

SEQ ID NO: 50144 - protein, 9 aa, Homo Sapiens
RGKYSEVFQ

SEQ ID NO: 50145 - protein, 9 aa, Homo Sapiens
MAGGRGSVG

SEQ ID NO: 50146 - protein, 9 aa, Homo Sapiens
GKSCMNPQT

SEQ ID NO: 50147 - protein, 9 aa, Homo Sapiens
EEKNRYKAD

SEQ ID NO: 50148 - protein, 9 aa, Homo Sapiens
TGLDMRESY

SEQ ID NO: 50149 - protein, 9 aa, Homo Sapiens
LLPQNLSHV

SEQ ID NO: 50150 - protein, 9 aa, Homo Sapiens
GILPILTCG

SEQ ID NO: 50151 - protein, 9 aa, Homo Sapiens
QDSFKKETL

SEQ ID NO: 50152 - protein, 9 aa, Homo Sapiens
VYRHGWNYE

SEQ ID NO: 50153 - protein, 9 aa, Homo Sapiens
SSPLAEIDS

SEQ ID NO: 50154 - protein, 9 aa, Homo Sapiens
REKTFILPP

SEQ ID NO: 50155 - protein, 9 aa, Homo Sapiens
SEYQQYLDA

SEQ ID NO: 50156 - protein, 9 aa, Homo Sapiens
FLLFPREAL

SEQ ID NO: 50157 - protein, 9 aa, Homo Sapiens
VYTENVDRR

SEQ ID NO: 50158 - protein, 9 aa, Homo Sapiens
LNSSLLPQN

SEQ ID NO: 50159 - protein, 9 aa, Homo Sapiens
EKFMTVDQD

SEQ ID NO: 50160 - protein, 9 aa, Homo Sapiens
QNLSHVMRV

SEQ ID NO: 50161 - protein, 9 aa, Homo Sapiens
SSLLPQNLS

SEQ ID NO: 50162 - protein, 9 aa, Homo Sapiens
YKILDVVKA

SEQ ID NO: 50163 - protein, 9 aa, Homo Sapiens
LVVMGDGFE

SEQ ID NO: 50164 - protein, 9 aa, Homo Sapiens
LRMFLKYDM

SEQ ID NO: 50165 - protein, 9 aa, Homo Sapiens
FKGQWENKV

SEQ ID NO: 50166 - protein, 9 aa, Homo Sapiens
RVVVGILYV

SEQ ID NO: 50167 - protein, 9 aa, Homo Sapiens
LHSYEELEE

SEQ ID NO: 50168 - protein, 9 aa, Homo Sapiens
LRMVQRERL

SEQ ID NO: 50169 - protein, 9 aa, Homo Sapiens
KGSFLIDSS

SEQ ID NO: 50170 - protein, 9 aa, Homo Sapiens
VLGQSIMTP

SEQ ID NO: 50171 - protein, 9 aa, Homo Sapiens
DLAVGDRLR

SEQ ID NO: 50172 - protein, 9 aa, Homo Sapiens
KEFDIPRHG

SEQ ID NO: 50173 - protein, 9 aa, Homo Sapiens
ASNIRIKKE

SEQ ID NO: 50174 - protein, 9 aa, Homo Sapiens
SDTQPQPST

SEQ ID NO: 50175 - protein, 9 aa, Homo Sapiens
NCKEAINVL

SEQ ID NO: 50176 - protein, 9 aa, Homo Sapiens
AELKQTGRT

SEQ ID NO: 50177 - protein, 9 aa, Homo Sapiens
PKASSSLVQ

SEQ ID NO: 50178 - protein, 9 aa, Homo Sapiens
FIVSFTSDI

SEQ ID NO: 50179 - protein, 9 aa, Homo Sapiens
MKMPSISGP

SEQ ID NO: 50180 - protein, 9 aa, Homo Sapiens
GSRWLKLFL

SEQ ID NO: 50181 - protein, 9 aa, Homo Sapiens
CTESLCLVQ

SEQ ID NO: 50182 - protein, 9 aa, Homo Sapiens
LGNVSFSAV

SEQ ID NO: 50183 - protein, 9 aa, Homo Sapiens
PVRFQSSAM

SEQ ID NO: 50184 - protein, 9 aa, Homo Sapiens
ENLLTRLLK

SEQ ID NO: 50185 - protein, 9 aa, Homo Sapiens
AQLIAAYSL

SEQ ID NO: 50186 - protein, 9 aa, Homo Sapiens
TQVFLIDNL

SEQ ID NO: 50187 - protein, 9 aa, Homo Sapiens
RDVRGQEGT

SEQ ID NO: 50188 - protein, 9 aa, Homo Sapiens
RIKKEPLDD

SEQ ID NO: 50189 - protein, 9 aa, Homo Sapiens
TGWTYGYVP

SEQ ID NO: 50190 - protein, 9 aa, Homo Sapiens
IKLVMEIIN

SEQ ID NO: 50191 - protein, 9 aa, Homo Sapiens
LKLQEADIN

SEQ ID NO: 50192 - protein, 9 aa, Homo Sapiens
NQSAGKSER

SEQ ID NO: 50193 - protein, 9 aa, Homo Sapiens
VELASAKEF

SEQ ID NO: 50194 - protein, 9 aa, Homo Sapiens
DRILSQVSY

SEQ ID NO: 50195 - protein, 9 aa, Homo Sapiens
KNKTNKQTL

SEQ ID NO: 50196 - protein, 9 aa, Homo Sapiens
AKKVSSAIF

SEQ ID NO: 50197 - protein, 9 aa, Homo Sapiens
RDLFKGIIY

SEQ ID NO: 50198 - protein, 9 aa, Homo Sapiens
LSHVMRVAK

SEQ ID NO: 50199 - protein, 9 aa, Homo Sapiens
GMGDVSQKH

SEQ ID NO: 50200 - protein, 9 aa, Homo Sapiens
HYKHDLKFF

SEQ ID NO: 50201 - protein, 9 aa, Homo Sapiens
KYLSETLTS

SEQ ID NO: 50202 - protein, 9 aa, Homo Sapiens
KEQVAPLEK

SEQ ID NO: 50203 - protein, 9 aa, Homo Sapiens
EKVHQSNSE

SEQ ID NO: 50204 - protein, 9 aa, Homo Sapiens
AGGLLRPPR

SEQ ID NO: 50205 - protein, 9 aa, Homo Sapiens
GTSFTHEST

SEQ ID NO: 50206 - protein, 9 aa, Homo Sapiens
DLLTAEQQS

SEQ ID NO: 50207 - protein, 9 aa, Homo Sapiens
SKTKQSKHE

SEQ ID NO: 50208 - protein, 9 aa, Homo Sapiens
KSHLPEGLF

SEQ ID NO: 50209 - protein, 9 aa, Homo Sapiens
VIVGKAPPE

SEQ ID NO: 50210 - protein, 9 aa, Homo Sapiens
SQKHGSGPV

SEQ ID NO: 50211 - protein, 9 aa, Homo Sapiens
ELEKHLKEV

SEQ ID NO: 50212 - protein, 9 aa, Homo Sapiens
EDLKEQVAP

SEQ ID NO: 50213 - protein, 9 aa, Homo Sapiens
AVECNFGQK

SEQ ID NO: 50214 - protein, 9 aa, Homo Sapiens
VGQPQVVLE

SEQ ID NO: 50215 - protein, 9 aa, Homo Sapiens
NVEGLHING

SEQ ID NO: 50216 - protein, 9 aa, Homo Sapiens
DISPLRLIV

SEQ ID NO: 50217 - protein, 9 aa, Homo Sapiens
KVCAKSFET

SEQ ID NO: 50218 - protein, 9 aa, Homo Sapiens
LSPTVSVNP

SEQ ID NO: 50219 - protein, 9 aa, Homo Sapiens
SPTNNEKNF

SEQ ID NO: 50220 - protein, 9 aa, Homo Sapiens
SNILQQLPD

SEQ ID NO: 50221 - protein, 9 aa, Homo Sapiens
LPILTCGVL

SEQ ID NO: 50222 - protein, 9 aa, Homo Sapiens
YCLVGLIYK

SEQ ID NO: 50223 - protein, 9 aa, Homo Sapiens
GRGMRVLHS

SEQ ID NO: 50224 - protein, 9 aa, Homo Sapiens
RMVQRERLE

SEQ ID NO: 50225 - protein, 9 aa, Homo Sapiens
APPPSTLNH

SEQ ID NO: 50226 - protein, 9 aa, Homo Sapiens
SETVLDIQN

SEQ ID NO: 50227 - protein, 9 aa, Homo Sapiens
EEDQREHLA

SEQ ID NO: 50228 - protein, 9 aa, Homo Sapiens
RMIKEKIVG

SEQ ID NO: 50229 - protein, 9 aa, Homo Sapiens
VSFSAVIEA

SEQ ID NO: 50230 - protein, 9 aa, Homo Sapiens
YHNFRVTMV

SEQ ID NO: 50231 - protein, 9 aa, Homo Sapiens
AGNALLMYS

SEQ ID NO: 50232 - protein, 9 aa, Homo Sapiens
GRGSVGHAL

SEQ ID NO: 50233 - protein, 9 aa, Homo Sapiens
EIEHFQQAI

SEQ ID NO: 50234 - protein, 9 aa, Homo Sapiens
ILQSSKKFQ

SEQ ID NO: 50235 - protein, 9 aa, Homo Sapiens
KKEPLDDEY

SEQ ID NO: 50236 - protein, 9 aa, Homo Sapiens
VSSDDECVG

SEQ ID NO: 50237 - protein, 9 aa, Homo Sapiens
LFKGIIYYR

SEQ ID NO: 50238 - protein, 9 aa, Homo Sapiens
YSKMKNMIL

SEQ ID NO: 50239 - protein, 9 aa, Homo Sapiens
NKPHLMAED

SEQ ID NO: 50240 - protein, 9 aa, Homo Sapiens
SEGAKHLDG

SEQ ID NO: 50241 - protein, 9 aa, Homo Sapiens
EDNSSEGEE

SEQ ID NO: 50242 - protein, 9 aa, Homo Sapiens
TFDATNPLT

SEQ ID NO: 50243 - protein, 9 aa, Homo Sapiens
PGSRSGRVL

SEQ ID NO: 50244 - protein, 9 aa, Homo Sapiens
KIEKVKNAF

SEQ ID NO: 50245 - protein, 9 aa, Homo Sapiens
NTMKHLLLL

SEQ ID NO: 50246 - protein, 9 aa, Homo Sapiens
DSLRMFLKY

SEQ ID NO: 50247 - protein, 9 aa, Homo Sapiens
TVDDKLKNK

SEQ ID NO: 50248 - protein, 9 aa, Homo Sapiens
TISNPVILT

SEQ ID NO: 50249 - protein, 9 aa, Homo Sapiens
NSSEGEEEI

SEQ ID NO: 50250 - protein, 9 aa, Homo Sapiens
WRSCLKRRL

SEQ ID NO: 50251 - protein, 9 aa, Homo Sapiens
PWLDGNQLS

SEQ ID NO: 50252 - protein, 9 aa, Homo Sapiens
VPGPGAAGG

SEQ ID NO: 50253 - protein, 9 aa, Homo Sapiens
NTEKMYWMN

SEQ ID NO: 50254 - protein, 9 aa, Homo Sapiens
TNNEKNFLC

SEQ ID NO: 50255 - protein, 9 aa, Homo Sapiens
AIVKQFNRD

SEQ ID NO: 50256 - protein, 9 aa, Homo Sapiens
EQQSAWAMY

SEQ ID NO: 50257 - protein, 9 aa, Homo Sapiens
TASINPVRF

SEQ ID NO: 50258 - protein, 9 aa, Homo Sapiens
KQSKHEAAR

SEQ ID NO: 50259 - protein, 9 aa, Homo Sapiens
EAGILPILT

SEQ ID NO: 50260 - protein, 9 aa, Homo Sapiens
FMERVKYVL

SEQ ID NO: 50261 - protein, 9 aa, Homo Sapiens
AYAMAMDWF

SEQ ID NO: 50262 - protein, 9 aa, Homo Sapiens
VDRRQIILD

SEQ ID NO: 50263 - protein, 9 aa, Homo Sapiens
AFNEERLTW

SEQ ID NO: 50264 - protein, 9 aa, Homo Sapiens
RVLERRTQQ

SEQ ID NO: 50265 - protein, 9 aa, Homo Sapiens
AKSFETEAA

SEQ ID NO: 50266 - protein, 9 aa, Homo Sapiens
IVKHIYSET

SEQ ID NO: 50267 - protein, 9 aa, Homo Sapiens
ATNPLTLCV

SEQ ID NO: 50268 - protein, 9 aa, Homo Sapiens
VPDAAGDCC

SEQ ID NO: 50269 - protein, 9 aa, Homo Sapiens
EPQDSKVNL

SEQ ID NO: 50270 - protein, 9 aa, Homo Sapiens
SVEVPKASS

SEQ ID NO: 50271 - protein, 9 aa, Homo Sapiens
VLKMPMKLT

SEQ ID NO: 50272 - protein, 9 aa, Homo Sapiens
LFLNANRFT

SEQ ID NO: 50273 - protein, 9 aa, Homo Sapiens
MYKILDVVK

SEQ ID NO: 50274 - protein, 9 aa, Homo Sapiens
VVGILYVND

SEQ ID NO: 50275 - protein, 9 aa, Homo Sapiens
LKNKTNKQT

SEQ ID NO: 50276 - protein, 9 aa, Homo Sapiens
PTQAQVVVC

SEQ ID NO: 50277 - protein, 9 aa, Homo Sapiens
ILQQLPDSI

SEQ ID NO: 50278 - protein, 9 aa, Homo Sapiens
QREHLAAVQ

SEQ ID NO: 50279 - protein, 9 aa, Homo Sapiens
EKEDNSSEG

SEQ ID NO: 50280 - protein, 9 aa, Homo Sapiens
HLCRVCGWL

SEQ ID NO: 50281 - protein, 9 aa, Homo Sapiens
NLFKYIIGT

SEQ ID NO: 50282 - protein, 9 aa, Homo Sapiens
PCVGQVTED

SEQ ID NO: 50283 - protein, 9 aa, Homo Sapiens
SKSCFSPCV

SEQ ID NO: 50284 - protein, 9 aa, Homo Sapiens
QKQPHLTPL

SEQ ID NO: 50285 - protein, 9 aa, Homo Sapiens
RIENAGAKY

SEQ ID NO: 50286 - protein, 9 aa, Homo Sapiens
SISGPLGFF

SEQ ID NO: 50287 - protein, 9 aa, Homo Sapiens
FLIDSSTID

SEQ ID NO: 50288 - protein, 9 aa, Homo Sapiens
LPVIENNVC

SEQ ID NO: 50289 - protein, 9 aa, Homo Sapiens
QTGRTDISP

SEQ ID NO: 50290 - protein, 9 aa, Homo Sapiens
EILNKEEVN

SEQ ID NO: 50291 - protein, 9 aa, Homo Sapiens
LLIQGATLI

SEQ ID NO: 50292 - protein, 9 aa, Homo Sapiens
IEQRTVCKM

SEQ ID NO: 50293 - protein, 9 aa, Homo Sapiens
ALLKSKTKA

SEQ ID NO: 50294 - protein, 9 aa, Homo Sapiens
QVELASAKE

SEQ ID NO: 50295 - protein, 9 aa, Homo Sapiens
QTELRCHFL

SEQ ID NO: 50296 - protein, 9 aa, Homo Sapiens
YMKSSKGRP

SEQ ID NO: 50297 - protein, 9 aa, Homo Sapiens
IEKVKNAFT

SEQ ID NO: 50298 - protein, 9 aa, Homo Sapiens
LSLEDSTMC

SEQ ID NO: 50299 - protein, 9 aa, Homo Sapiens
DFTAMYKIL

SEQ ID NO: 50300 - protein, 9 aa, Homo Sapiens
MSDKLKGNK

SEQ ID NO: 50301 - protein, 9 aa, Homo Sapiens
GATAGGLLR

SEQ ID NO: 50302 - protein, 9 aa, Homo Sapiens
PQLLADLEN

SEQ ID NO: 50303 - protein, 9 aa, Homo Sapiens
NPMYAFFRT

SEQ ID NO: 50304 - protein, 9 aa, Homo Sapiens
LPTQAQVVV

SEQ ID NO: 50305 - protein, 9 aa, Homo Sapiens
SLSPTVSVN

SEQ ID NO: 50306 - protein, 9 aa, Homo Sapiens
TTVDDKLKN

SEQ ID NO: 50307 - protein, 9 aa, Homo Sapiens
KNKPHLMAE

SEQ ID NO: 50308 - protein, 9 aa, Homo Sapiens
KVSGFHKDY

SEQ ID NO: 50309 - protein, 9 aa, Homo Sapiens
RKCKVCAKS

SEQ ID NO: 50310 - protein, 9 aa, Homo Sapiens
YAMAMDWFI

SEQ ID NO: 50311 - protein, 9 aa, Homo Sapiens
LLPAVALCP

SEQ ID NO: 50312 - protein, 9 aa, Homo Sapiens
IPDHEALVG

SEQ ID NO: 50313 - protein, 9 aa, Homo Sapiens
DPKEFDIPR

SEQ ID NO: 50314 - protein, 9 aa, Homo Sapiens
QSDMAGSSQ

SEQ ID NO: 50315 - protein, 9 aa, Homo Sapiens
NAKEIPRIF

SEQ ID NO: 50316 - protein, 9 aa, Homo Sapiens
AGGRGSVGH

SEQ ID NO: 50317 - protein, 9 aa, Homo Sapiens
GRVHLLEVG

SEQ ID NO: 50318 - protein, 9 aa, Homo Sapiens
VIENNVCNR

SEQ ID NO: 50319 - protein, 9 aa, Homo Sapiens
MEIINLIKD

SEQ ID NO: 50320 - protein, 9 aa, Homo Sapiens
FWSLKPENL

SEQ ID NO: 50321 - protein, 9 aa, Homo Sapiens
EALVHDFFS

SEQ ID NO: 50322 - protein, 9 aa, Homo Sapiens
AALNAWKEK

SEQ ID NO: 50323 - protein, 9 aa, Homo Sapiens
LTLCVKIVQ

SEQ ID NO: 50324 - protein, 9 aa, Homo Sapiens
RLQDSPVGD

SEQ ID NO: 50325 - protein, 9 aa, Homo Sapiens
LDMRESYGQ

SEQ ID NO: 50326 - protein, 9 aa, Homo Sapiens
EHLAAVQQK

SEQ ID NO: 50327 - protein, 9 aa, Homo Sapiens
MLLKAIIWI

SEQ ID NO: 50328 - protein, 9 aa, Homo Sapiens
CLKRRLTLM

SEQ ID NO: 50329 - protein, 9 aa, Homo Sapiens
IRKKACAVW

SEQ ID NO: 50330 - protein, 9 aa, Homo Sapiens
TQDTSVDHT

SEQ ID NO: 50331 - protein, 9 aa, Homo Sapiens
FVVHIAPVI

SEQ ID NO: 50332 - protein, 9 aa, Homo Sapiens
ENWLSEWWF

SEQ ID NO: 50333 - protein, 9 aa, Homo Sapiens
QEIEHFQQA

SEQ ID NO: 50334 - protein, 9 aa, Homo Sapiens
LKGEEGSQG

SEQ ID NO: 50335 - protein, 9 aa, Homo Sapiens
KAYQRPTIP

SEQ ID NO: 50336 - protein, 9 aa, Homo Sapiens
HIGLVQKLI

SEQ ID NO: 50337 - protein, 9 aa, Homo Sapiens
DKLKNKTNK

SEQ ID NO: 50338 - protein, 9 aa, Homo Sapiens
SDKLKGNKY

SEQ ID NO: 50339 - protein, 9 aa, Homo Sapiens
TKNLSDTCK

SEQ ID NO: 50340 - protein, 9 aa, Homo Sapiens
IPTLVYRHG

SEQ ID NO: 50341 - protein, 9 aa, Homo Sapiens
ETISNPVIL

SEQ ID NO: 50342 - protein, 9 aa, Homo Sapiens
NLFEALFPG

SEQ ID NO: 50343 - protein, 9 aa, Homo Sapiens
WSFHKLNTM

SEQ ID NO: 50344 - protein, 9 aa, Homo Sapiens
GNVSFSAVI

SEQ ID NO: 50345 - protein, 9 aa, Homo Sapiens
ICIYSSPIG

SEQ ID NO: 50346 - protein, 9 aa, Homo Sapiens
SERRPMPGP

SEQ ID NO: 50347 - protein, 9 aa, Homo Sapiens
DCGTIESGL

SEQ ID NO: 50348 - protein, 9 aa, Homo Sapiens
SSFQWLLST

SEQ ID NO: 50349 - protein, 9 aa, Homo Sapiens
ICNNLFEAL

SEQ ID NO: 50350 - protein, 9 aa, Homo Sapiens
VATNAFIVS

SEQ ID NO: 50351 - protein, 9 aa, Homo Sapiens
ALKLQEADI

SEQ ID NO: 50352 - protein, 9 aa, Homo Sapiens
GRKCDRILS

SEQ ID NO: 50353 - protein, 9 aa, Homo Sapiens
IENVDRNIL

SEQ ID NO: 50354 - protein, 9 aa, Homo Sapiens
PFFCLQQIE

SEQ ID NO: 50355 - protein, 9 aa, Homo Sapiens
QVFLIDNLD

SEQ ID NO: 50356 - protein, 9 aa, Homo Sapiens
LKDPWLDGN

SEQ ID NO: 50357 - protein, 9 aa, Homo Sapiens
AQVELASAK

SEQ ID NO: 50358 - protein, 9 aa, Homo Sapiens
KARRAVDRG

SEQ ID NO: 50359 - protein, 9 aa, Homo Sapiens
HSNCQQNSN

SEQ ID NO: 50360 - protein, 9 aa, Homo Sapiens
KDPWLDGNQ

SEQ ID NO: 50361 - protein, 9 aa, Homo Sapiens
QIPNFRITV

SEQ ID NO: 50362 - protein, 9 aa, Homo Sapiens
DVSQKHGSG

SEQ ID NO: 50363 - protein, 9 aa, Homo Sapiens
CHNCAVECN

SEQ ID NO: 50364 - protein, 9 aa, Homo Sapiens
TLVYRHGWN

SEQ ID NO: 50365 - protein, 9 aa, Homo Sapiens
FSNYKFLLQ

SEQ ID NO: 50366 - protein, 9 aa, Homo Sapiens
KRKRDVRGQ

SEQ ID NO: 50367 - protein, 9 aa, Homo Sapiens
FKKETLGRY

SEQ ID NO: 50368 - protein, 9 aa, Homo Sapiens
QQKQPHLTP

SEQ ID NO: 50369 - protein, 9 aa, Homo Sapiens
AKKFVQTDL

SEQ ID NO: 50370 - protein, 9 aa, Homo Sapiens
MYSRIKLYP

SEQ ID NO: 50371 - protein, 9 aa, Homo Sapiens
GVMRTMKTE

SEQ ID NO: 50372 - protein, 9 aa, Homo Sapiens
INLIKDKRK

SEQ ID NO: 50373 - protein, 9 aa, Homo Sapiens
DSASLARKK

SEQ ID NO: 50374 - protein, 9 aa, Homo Sapiens
LKPKTTLSP

SEQ ID NO: 50375 - protein, 9 aa, Homo Sapiens
VVHIAPVIM

SEQ ID NO: 50376 - protein, 9 aa, Homo Sapiens
QQLSDTQPQ

SEQ ID NO: 50377 - protein, 9 aa, Homo Sapiens
ALLESSCDN

SEQ ID NO: 50378 - protein, 9 aa, Homo Sapiens
NGKVKEQKQ

SEQ ID NO: 50379 - protein, 9 aa, Homo Sapiens
PGTNVLNCS

SEQ ID NO: 50380 - protein, 9 aa, Homo Sapiens
DKQKENEEK

SEQ ID NO: 50381 - protein, 9 aa, Homo Sapiens
WRGWAQRGR

SEQ ID NO: 50382 - protein, 9 aa, Homo Sapiens
INPVRFQSS

SEQ ID NO: 50383 - protein, 9 aa, Homo Sapiens
AAYSLVDPE

SEQ ID NO: 50384 - protein, 9 aa, Homo Sapiens
QGLPGPPGQ

SEQ ID NO: 50385 - protein, 9 aa, Homo Sapiens
WSLKPENLL

SEQ ID NO: 50386 - protein, 9 aa, Homo Sapiens
KLIEQRTVC

SEQ ID NO: 50387 - protein, 9 aa, Homo Sapiens
ELLAILDAC

SEQ ID NO: 50388 - protein, 9 aa, Homo Sapiens
VGHALHAGS

SEQ ID NO: 50389 - protein, 9 aa, Homo Sapiens
SYSQMREAF

SEQ ID NO: 50390 - protein, 9 aa, Homo Sapiens
SLDRNLSVL

SEQ ID NO: 50391 - protein, 9 aa, Homo Sapiens
EDKQKENEE

SEQ ID NO: 50392 - protein, 9 aa, Homo Sapiens
VHIAPVIML

SEQ ID NO: 50393 - protein, 9 aa, Homo Sapiens
QKHGSGPVV

SEQ ID NO: 50394 - protein, 9 aa, Homo Sapiens
IHLLEEKIK

SEQ ID NO: 50395 - protein, 9 aa, Homo Sapiens
FILIVKHIY

SEQ ID NO: 50396 - protein, 9 aa, Homo Sapiens
TTVTCSLDR

SEQ ID NO: 50397 - protein, 9 aa, Homo Sapiens
THESTFGVG

SEQ ID NO: 50398 - protein, 9 aa, Homo Sapiens
IAAYSLVDP

SEQ ID NO: 50399 - protein, 9 aa, Homo Sapiens
AALYSRLQG

SEQ ID NO: 50400 - protein, 9 aa, Homo Sapiens
RRPFFCLQQ

SEQ ID NO: 50401 - protein, 9 aa, Homo Sapiens
ADLENSSMF

SEQ ID NO: 50402 - protein, 9 aa, Homo Sapiens
PLAEIDSTN

SEQ ID NO: 50403 - protein, 9 aa, Homo Sapiens
AQRGRGCGQ

SEQ ID NO: 50404 - protein, 9 aa, Homo Sapiens
RCHFLQMNL

SEQ ID NO: 50405 - protein, 9 aa, Homo Sapiens
PRFLLFPRE

SEQ ID NO: 50406 - protein, 9 aa, Homo Sapiens
VKMPLDVDW

SEQ ID NO: 50407 - protein, 9 aa, Homo Sapiens
SIRKKACAV

SEQ ID NO: 50408 - protein, 9 aa, Homo Sapiens
SGKTCGARP

SEQ ID NO: 50409 - protein, 9 aa, Homo Sapiens
KLSLEMEQL

SEQ ID NO: 50410 - protein, 9 aa, Homo Sapiens
QPGTNVLNC

SEQ ID NO: 50411 - protein, 9 aa, Homo Sapiens
EAQVELASA

SEQ ID NO: 50412 - protein, 9 aa, Homo Sapiens
VGLIYKDMF

SEQ ID NO: 50413 - protein, 9 aa, Homo Sapiens
SCDNKRADL

SEQ ID NO: 50414 - protein, 9 aa, Homo Sapiens
EVFQAINIT

SEQ ID NO: 50415 - protein, 9 aa, Homo Sapiens
ADKIEKVKN

SEQ ID NO: 50416 - protein, 9 aa, Homo Sapiens
ALVTIHSNC

SEQ ID NO: 50417 - protein, 9 aa, Homo Sapiens
RPFFCLQQI

SEQ ID NO: 50418 - protein, 9 aa, Homo Sapiens
EPGKEDEKK

SEQ ID NO: 50419 - protein, 9 aa, Homo Sapiens
NFMFFICLF

SEQ ID NO: 50420 - protein, 9 aa, Homo Sapiens
KSVEVPKAS

SEQ ID NO: 50421 - protein, 9 aa, Homo Sapiens
VGLSELTSN

SEQ ID NO: 50422 - protein, 9 aa, Homo Sapiens
IVLKMPMKL

SEQ ID NO: 50423 - protein, 9 aa, Homo Sapiens
KASSSLVQY

SEQ ID NO: 50424 - protein, 9 aa, Homo Sapiens
ANAKEIPRI

SEQ ID NO: 50425 - protein, 9 aa, Homo Sapiens
KGEEGSQGL

SEQ ID NO: 50426 - protein, 9 aa, Homo Sapiens
YFCASTLDP

SEQ ID NO: 50427 - protein, 9 aa, Homo Sapiens
DAAGDCCGT

SEQ ID NO: 50428 - protein, 9 aa, Homo Sapiens
SSKKFQRIS

SEQ ID NO: 50429 - protein, 9 aa, Homo Sapiens
HYLLTLLPA

SEQ ID NO: 50430 - protein, 9 aa, Homo Sapiens
YSETSYQPG

SEQ ID NO: 50431 - protein, 9 aa, Homo Sapiens
FFSALPSQL

SEQ ID NO: 50432 - protein, 9 aa, Homo Sapiens
ALLHLKDPW

SEQ ID NO: 50433 - protein, 9 aa, Homo Sapiens
ERDQLLSQM

SEQ ID NO: 50434 - protein, 9 aa, Homo Sapiens
KVKKENTKE

SEQ ID NO: 50435 - protein, 9 aa, Homo Sapiens
ELKQTGRTD

SEQ ID NO: 50436 - protein, 9 aa, Homo Sapiens
SPLRLIVRD

SEQ ID NO: 50437 - protein, 9 aa, Homo Sapiens
VSSAIFKVI

SEQ ID NO: 50438 - protein, 9 aa, Homo Sapiens
AKPLIVAHS

SEQ ID NO: 50439 - protein, 9 aa, Homo Sapiens
LNIKLQFCH

SEQ ID NO: 50440 - protein, 9 aa, Homo Sapiens
GLWVTFKLL

SEQ ID NO: 50441 - protein, 9 aa, Homo Sapiens
QPHLTPLQM

SEQ ID NO: 50442 - protein, 9 aa, Homo Sapiens
SASLARKKP

SEQ ID NO: 50443 - protein, 9 aa, Homo Sapiens
PKVAYAMAM

SEQ ID NO: 50444 - protein, 9 aa, Homo Sapiens
VMRTMKTEK

SEQ ID NO: 50445 - protein, 9 aa, Homo Sapiens
EKTFILPPS

SEQ ID NO: 50446 - protein, 9 aa, Homo Sapiens
ENELNRWRY

SEQ ID NO: 50447 - protein, 9 aa, Homo Sapiens
EEKIKFLKM

SEQ ID NO: 50448 - protein, 9 aa, Homo Sapiens
TFMERVKYV

SEQ ID NO: 50449 - protein, 9 aa, Homo Sapiens
KKFVQTDLP

SEQ ID NO: 50450 - protein, 9 aa, Homo Sapiens
LKELMQIPN

SEQ ID NO: 50451 - protein, 9 aa, Homo Sapiens
PSRRRPFFC

SEQ ID NO: 50452 - protein, 9 aa, Homo Sapiens
CKEAINVLS

SEQ ID NO: 50453 - protein, 9 aa, Homo Sapiens
WSCNSWCFT

SEQ ID NO: 50454 - protein, 9 aa, Homo Sapiens
KTENGKVKE

SEQ ID NO: 50455 - protein, 9 aa, Homo Sapiens
NANEPQDSK

SEQ ID NO: 50456 - protein, 9 aa, Homo Sapiens
PTNNEKNFL

SEQ ID NO: 50457 - protein, 9 aa, Homo Sapiens
AQEALVHDF

SEQ ID NO: 50458 - protein, 9 aa, Homo Sapiens
PVILTCDAT

SEQ ID NO: 50459 - protein, 9 aa, Homo Sapiens
FTSEGAKHL

SEQ ID NO: 50460 - protein, 9 aa, Homo Sapiens
GRTDISPRE

SEQ ID NO: 50461 - protein, 9 aa, Homo Sapiens
WWFKTAYLQ

SEQ ID NO: 50462 - protein, 9 aa, Homo Sapiens
KSPTNNEKN

SEQ ID NO: 50463 - protein, 9 aa, Homo Sapiens
PGKEDEKKE

SEQ ID NO: 50464 - protein, 9 aa, Homo Sapiens
FEEDQREHL

SEQ ID NO: 50465 - protein, 9 aa, Homo Sapiens
LAINKLSGV

SEQ ID NO: 50466 - protein, 9 aa, Homo Sapiens
VLNPPVTAT

SEQ ID NO: 50467 - protein, 9 aa, Homo Sapiens
RQVPGPGAA

SEQ ID NO: 50468 - protein, 9 aa, Homo Sapiens
RWLKLFLNA

SEQ ID NO: 50469 - protein, 9 aa, Homo Sapiens
TIPGTTAQP

SEQ ID NO: 50470 - protein, 9 aa, Homo Sapiens
KLKGNKYES

SEQ ID NO: 50471 - protein, 9 aa, Homo Sapiens
TETKYINLS

SEQ ID NO: 50472 - protein, 9 aa, Homo Sapiens
LNRWRYGET

SEQ ID NO: 50473 - protein, 9 aa, Homo Sapiens
NMILDLQNQ

SEQ ID NO: 50474 - protein, 9 aa, Homo Sapiens
SWRNFKANT

SEQ ID NO: 50475 - protein, 9 aa, Homo Sapiens
GQSIMTPAI

SEQ ID NO: 50476 - protein, 9 aa, Homo Sapiens
SSICNNLFE

SEQ ID NO: 50477 - protein, 9 aa, Homo Sapiens
NKRMRTASS

SEQ ID NO: 50478 - protein, 9 aa, Homo Sapiens
LGGACPGSR

SEQ ID NO: 50479 - protein, 9 aa, Homo Sapiens
PWEKVQVDD

SEQ ID NO: 50480 - protein, 9 aa, Homo Sapiens
DSFKKETLG

SEQ ID NO: 50481 - protein, 9 aa, Homo Sapiens
NKTNKQTLE

SEQ ID NO: 50482 - protein, 9 aa, Homo Sapiens
DVVNHDLAV

SEQ ID NO: 50483 - protein, 9 aa, Homo Sapiens
KEILNKANH

SEQ ID NO: 50484 - protein, 9 aa, Homo Sapiens
FMSSICNNL

SEQ ID NO: 50485 - protein, 9 aa, Homo Sapiens
SLPKVAYAM

SEQ ID NO: 50486 - protein, 9 aa, Homo Sapiens
NVLNCSHDF

SEQ ID NO: 50487 - protein, 9 aa, Homo Sapiens
YKHDLKFFT

SEQ ID NO: 50488 - protein, 9 aa, Homo Sapiens
ILWRSCLKR

SEQ ID NO: 50489 - protein, 9 aa, Homo Sapiens
KANHMKKSL

SEQ ID NO: 50490 - protein, 9 aa, Homo Sapiens
TCTESLCLV

SEQ ID NO: 50491 - protein, 9 aa, Homo Sapiens
PTASINPVR

SEQ ID NO: 50492 - protein, 9 aa, Homo Sapiens
RPHLKPKTT

SEQ ID NO: 50493 - protein, 9 aa, Homo Sapiens
IIWILWRSC

SEQ ID NO: 50494 - protein, 9 aa, Homo Sapiens
GGTIKSPTN

SEQ ID NO: 50495 - protein, 9 aa, Homo Sapiens
TDCGTIESG

SEQ ID NO: 50496 - protein, 9 aa, Homo Sapiens
NDGNTDECF

SEQ ID NO: 50497 - protein, 9 aa, Homo Sapiens
LTEEEKNRY

SEQ ID NO: 50498 - protein, 9 aa, Homo Sapiens
AHLCRVCGW

SEQ ID NO: 50499 - protein, 9 aa, Homo Sapiens
QEALVHDFF

SEQ ID NO: 50500 - protein, 9 aa, Homo Sapiens
YEELEKHLK

SEQ ID NO: 50501 - protein, 9 aa, Homo Sapiens
EIDSTNVAE

SEQ ID NO: 50502 - protein, 9 aa, Homo Sapiens
EQFMEYQGA

SEQ ID NO: 50503 - protein, 9 aa, Homo Sapiens
SGRVLERRT

SEQ ID NO: 50504 - protein, 9 aa, Homo Sapiens
TNVLNCSHD

SEQ ID NO: 50505 - protein, 9 aa, Homo Sapiens
KMNRGINAS

SEQ ID NO: 50506 - protein, 9 aa, Homo Sapiens
TFSKQAEDT

SEQ ID NO: 50507 - protein, 9 aa, Homo Sapiens
CFSPCVGQV

SEQ ID NO: 50508 - protein, 9 aa, Homo Sapiens
REAFRMLLK

SEQ ID NO: 50509 - protein, 9 aa, Homo Sapiens
DTSSYSQMR

SEQ ID NO: 50510 - protein, 9 aa, Homo Sapiens
VEVKYHKNE

SEQ ID NO: 50511 - protein, 9 aa, Homo Sapiens
ETLGRYGSC

SEQ ID NO: 50512 - protein, 9 aa, Homo Sapiens
IFVVHIAPV

SEQ ID NO: 50513 - protein, 9 aa, Homo Sapiens
KGSRWLKLF

SEQ ID NO: 50514 - protein, 9 aa, Homo Sapiens
EGLFCAESA

SEQ ID NO: 50515 - protein, 9 aa, Homo Sapiens
TLEKKNKPH

SEQ ID NO: 50516 - protein, 9 aa, Homo Sapiens
NCAVECNFG

SEQ ID NO: 50517 - protein, 9 aa, Homo Sapiens
IQDSFKKET

SEQ ID NO: 50518 - protein, 9 aa, Homo Sapiens
KETFSKQAE

SEQ ID NO: 50519 - protein, 9 aa, Homo Sapiens
LNAWKEKFM

SEQ ID NO: 50520 - protein, 9 aa, Homo Sapiens
TETGNTGES

SEQ ID NO: 50521 - protein, 9 aa, Homo Sapiens
QVAPLEKVR

SEQ ID NO: 50522 - protein, 9 aa, Homo Sapiens
WTYGYVPLS

SEQ ID NO: 50523 - protein, 9 aa, Homo Sapiens
ENNVCNRYE

SEQ ID NO: 50524 - protein, 9 aa, Homo Sapiens
QIPKPANQI

SEQ ID NO: 50525 - protein, 9 aa, Homo Sapiens
SHVMRVAKP

SEQ ID NO: 50526 - protein, 9 aa, Homo Sapiens
WLEAQVELA

SEQ ID NO: 50527 - protein, 9 aa, Homo Sapiens
HRDAIPDHE

SEQ ID NO: 50528 - protein, 9 aa, Homo Sapiens
LQRDLFKGI

SEQ ID NO: 50529 - protein, 9 aa, Homo Sapiens
ALYSRLQGF

SEQ ID NO: 50530 - protein, 9 aa, Homo Sapiens
LEKHLKEVF

SEQ ID NO: 50531 - protein, 9 aa, Homo Sapiens
TLAQLIAAY

SEQ ID NO: 50532 - protein, 9 aa, Homo Sapiens
VNVEGLHIN

SEQ ID NO: 50533 - protein, 9 aa, Homo Sapiens
HKLNTMKHL

SEQ ID NO: 50534 - protein, 9 aa, Homo Sapiens
LEGRLRQSD

SEQ ID NO: 50535 - protein, 9 aa, Homo Sapiens
PLSVFGGDS

SEQ ID NO: 50536 - protein, 9 aa, Homo Sapiens
EDEKKEDVE

SEQ ID NO: 50537 - protein, 9 aa, Homo Sapiens
NVCNRYEFL

SEQ ID NO: 50538 - protein, 9 aa, Homo Sapiens
ELASAKEFQ

SEQ ID NO: 50539 - protein, 9 aa, Homo Sapiens
MAMDWFIAV

SEQ ID NO: 50540 - protein, 9 aa, Homo Sapiens
ATKNLSDTC

SEQ ID NO: 50541 - protein, 9 aa, Homo Sapiens
SKVGLSELT

SEQ ID NO: 50542 - protein, 9 aa, Homo Sapiens
ALRDQKKYL

SEQ ID NO: 50543 - protein, 9 aa, Homo Sapiens
LLEGRLRQS

SEQ ID NO: 50544 - protein, 9 aa, Homo Sapiens
KGQWENKVK

SEQ ID NO: 50545 - protein, 9 aa, Homo Sapiens
VLHSYEELE

SEQ ID NO: 50546 - protein, 9 aa, Homo Sapiens
NILQQLPDS

SEQ ID NO: 50547 - protein, 9 aa, Homo Sapiens
ALVHDFFSA

SEQ ID NO: 50548 - protein, 9 aa, Homo Sapiens
WFKTAYLQY

SEQ ID NO: 50549 - protein, 9 aa, Homo Sapiens
EEWREVRHI

SEQ ID NO: 50550 - protein, 9 aa, Homo Sapiens
GINASKDLP

SEQ ID NO: 50551 - protein, 9 aa, Homo Sapiens
DELEQFMEY

SEQ ID NO: 50552 - protein, 9 aa, Homo Sapiens
YLLTLLPAV

SEQ ID NO: 50553 - protein, 9 aa, Homo Sapiens
VMEIINLIK

SEQ ID NO: 50554 - protein, 9 aa, Homo Sapiens
ASSFQWLLS

SEQ ID NO: 50555 - protein, 9 aa, Homo Sapiens
LLHLKDPWL

SEQ ID NO: 50556 - protein, 9 aa, Homo Sapiens
AFIVSFTSD

SEQ ID NO: 50557 - protein, 9 aa, Homo Sapiens
IWILWRSCL

SEQ ID NO: 50558 - protein, 9 aa, Homo Sapiens
DKIEKVKNA

SEQ ID NO: 50559 - protein, 9 aa, Homo Sapiens
AIPDHEALV

SEQ ID NO: 50560 - protein, 9 aa, Homo Sapiens
AINVLSHLP

SEQ ID NO: 50561 - protein, 9 aa, Homo Sapiens
DYEELEKHL

SEQ ID NO: 50562 - protein, 9 aa, Homo Sapiens
HVDLVVMGD

SEQ ID NO: 50563 - protein, 9 aa, Homo Sapiens
IKEKIVGEK

SEQ ID NO: 50564 - protein, 9 aa, Homo Sapiens
SWCFTSEGA

SEQ ID NO: 50565 - protein, 9 aa, Homo Sapiens
HFLQMNLLR

SEQ ID NO: 50566 - protein, 9 aa, Homo Sapiens
LMDNLFKYI

SEQ ID NO: 50567 - protein, 9 aa, Homo Sapiens
LYGVHRMIK

SEQ ID NO: 50568 - protein, 9 aa, Homo Sapiens
LKPENLLTR

SEQ ID NO: 50569 - protein, 9 aa, Homo Sapiens
ATAGGLLRP

SEQ ID NO: 50570 - protein, 9 aa, Homo Sapiens
VGGVRIVYP

SEQ ID NO: 50571 - protein, 9 aa, Homo Sapiens
YLRVIIWKT

SEQ ID NO: 50572 - protein, 9 aa, Homo Sapiens
VVNHDLAVG

SEQ ID NO: 50573 - protein, 9 aa, Homo Sapiens
LAQLIAAYS

SEQ ID NO: 50574 - protein, 9 aa, Homo Sapiens
ISNPVILTC

SEQ ID NO: 50575 - protein, 9 aa, Homo Sapiens
VRGQEGTLA

SEQ ID NO: 50576 - protein, 9 aa, Homo Sapiens
LLEEKIKFL

SEQ ID NO: 50577 - protein, 9 aa, Homo Sapiens
NIRIKKEPL

SEQ ID NO: 50578 - protein, 9 aa, Homo Sapiens
LFAEKVSGF

SEQ ID NO: 50579 - protein, 9 aa, Homo Sapiens
LFWSLKPEN

SEQ ID NO: 50580 - protein, 9 aa, Homo Sapiens
QSSKKFQRI

SEQ ID NO: 50581 - protein, 9 aa, Homo Sapiens
GFSNYKFLL

SEQ ID NO: 50582 - protein, 9 aa, Homo Sapiens
NSVNQEIEH

SEQ ID NO: 50583 - protein, 9 aa, Homo Sapiens
AGGISSPAL

SEQ ID NO: 50584 - protein, 9 aa, Homo Sapiens
HDFFSALPS

SEQ ID NO: 50585 - protein, 9 aa, Homo Sapiens
ETVLDIQND

SEQ ID NO: 50586 - protein, 9 aa, Homo Sapiens
LNKANHMKK

SEQ ID NO: 50587 - protein, 9 aa, Homo Sapiens
KARHYLLTL

SEQ ID NO: 50588 - protein, 9 aa, Homo Sapiens
SLEMEQLEL

SEQ ID NO: 50589 - protein, 9 aa, Homo Sapiens
SVGHALHAG

SEQ ID NO: 50590 - protein, 9 aa, Homo Sapiens
LHLKDPWLD

SEQ ID NO: 50591 - protein, 9 aa, Homo Sapiens
PTLEKKNKP

SEQ ID NO: 50592 - protein, 9 aa, Homo Sapiens
HDLAVGDRL

SEQ ID NO: 50593 - protein, 9 aa, Homo Sapiens
PDTSSYSQM

SEQ ID NO: 50594 - protein, 9 aa, Homo Sapiens
IYSETSYQP

SEQ ID NO: 50595 - protein, 9 aa, Homo Sapiens
LTWIQPGTN

SEQ ID NO: 50596 - protein, 9 aa, Homo Sapiens
RAVEYHIND

SEQ ID NO: 50597 - protein, 9 aa, Homo Sapiens
LRLIVRDPG

SEQ ID NO: 50598 - protein, 9 aa, Homo Sapiens
VENIGRKCD

SEQ ID NO: 50599 - protein, 9 aa, Homo Sapiens
WRYGETVPI

SEQ ID NO: 50600 - protein, 9 aa, Homo Sapiens
VDLVVMGDG

SEQ ID NO: 50601 - protein, 9 aa, Homo Sapiens
TLLPAVALC

SEQ ID NO: 50602 - protein, 9 aa, Homo Sapiens
EKVQVDDLE

SEQ ID NO: 50603 - protein, 9 aa, Homo Sapiens
KQTGRTDIS

SEQ ID NO: 50604 - protein, 9 aa, Homo Sapiens
STHMHCVWR

SEQ ID NO: 50605 - protein, 9 aa, Homo Sapiens
GWAQRGRGC

SEQ ID NO: 50606 - protein, 9 aa, Homo Sapiens
NKVKKENTK

SEQ ID NO: 50607 - protein, 9 aa, Homo Sapiens
RHIGLVQKL

SEQ ID NO: 50608 - protein, 9 aa, Homo Sapiens
SRLQDSPVG

SEQ ID NO: 50609 - protein, 9 aa, Homo Sapiens
PILTCGVLN

SEQ ID NO: 50610 - protein, 9 aa, Homo Sapiens
EALVTIHSN

SEQ ID NO: 50611 - protein, 9 aa, Homo Sapiens
QLPVIENNV

SEQ ID NO: 50612 - protein, 9 aa, Homo Sapiens
EELEKHLKE

SEQ ID NO: 50613 - protein, 9 aa, Homo Sapiens
CPNGHTASL

SEQ ID NO: 50614 - protein, 9 aa, Homo Sapiens
PRVSGKTCG

SEQ ID NO: 50615 - protein, 9 aa, Homo Sapiens
TFKLLPGDI

SEQ ID NO: 50616 - protein, 9 aa, Homo Sapiens
VQRERLEAE

SEQ ID NO: 50617 - protein, 9 aa, Homo Sapiens
SSKGRPGPP

SEQ ID NO: 50618 - protein, 9 aa, Homo Sapiens
VKHIYSETS

SEQ ID NO: 50619 - protein, 9 aa, Homo Sapiens
WEKVQVDDL

SEQ ID NO: 50620 - protein, 9 aa, Homo Sapiens
LTPLQMDAR

SEQ ID NO: 50621 - protein, 9 aa, Homo Sapiens
YAFFRTSPG

SEQ ID NO: 50622 - protein, 9 aa, Homo Sapiens
NAGAKYLSE

SEQ ID NO: 50623 - protein, 9 aa, Homo Sapiens
DDFTAMYKI

SEQ ID NO: 50624 - protein, 9 aa, Homo Sapiens
GVRIVYPSA

SEQ ID NO: 50625 - protein, 9 aa, Homo Sapiens
QLLSQMKEL

SEQ ID NO: 50626 - protein, 9 aa, Homo Sapiens
QFMEYQGAS

SEQ ID NO: 50627 - protein, 9 aa, Homo Sapiens
FNPMYAFFR

SEQ ID NO: 50628 - protein, 9 aa, Homo Sapiens
EVGQPQVVL

SEQ ID NO: 50629 - protein, 9 aa, Homo Sapiens
DLENSSMFT

SEQ ID NO: 50630 - protein, 9 aa, Homo Sapiens
AMYKILDVV

SEQ ID NO: 50631 - protein, 9 aa, Homo Sapiens
GESAGGISS

SEQ ID NO: 50632 - protein, 9 aa, Homo Sapiens
YSAFKADPK

SEQ ID NO: 50633 - protein, 9 aa, Homo Sapiens
QWLEAQVEL

SEQ ID NO: 50634 - protein, 9 aa, Homo Sapiens
FALRDQKKY

SEQ ID NO: 50635 - protein, 9 aa, Homo Sapiens
RPPCLGGAC

SEQ ID NO: 50636 - protein, 9 aa, Homo Sapiens
SYSLPWSCN

SEQ ID NO: 50637 - protein, 9 aa, Homo Sapiens
HLEQNHQQI

SEQ ID NO: 50638 - protein, 9 aa, Homo Sapiens
PNGHTASLG

SEQ ID NO: 50639 - protein, 9 aa, Homo Sapiens
VAANVAGSE

SEQ ID NO: 50640 - protein, 9 aa, Homo Sapiens
VLSHLPSHH

SEQ ID NO: 50641 - protein, 9 aa, Homo Sapiens
NPLTLCVKI

SEQ ID NO: 50642 - protein, 9 aa, Homo Sapiens
FLDICIYSS

SEQ ID NO: 50643 - protein, 9 aa, Homo Sapiens
IEDFLEFER

SEQ ID NO: 50644 - protein, 9 aa, Homo Sapiens
LLAILDACI

SEQ ID NO: 50645 - protein, 9 aa, Homo Sapiens
NKANHMKKS

SEQ ID NO: 50646 - protein, 9 aa, Homo Sapiens
QAQVVVCGG

SEQ ID NO: 50647 - protein, 9 aa, Homo Sapiens
VAYAMAMDW

SEQ ID NO: 50648 - protein, 9 aa, Homo Sapiens
VKKENTKEE

SEQ ID NO: 50649 - protein, 9 aa, Homo Sapiens
EGRLRQSDM

SEQ ID NO: 50650 - protein, 9 aa, Homo Sapiens
NYVDCKKKF

SEQ ID NO: 50651 - protein, 9 aa, Homo Sapiens
KSSKGRPGP

SEQ ID NO: 50652 - protein, 9 aa, Homo Sapiens
ISPLRLIVR

SEQ ID NO: 50653 - protein, 9 aa, Homo Sapiens
KEPLDDEYD

SEQ ID NO: 50654 - protein, 9 aa, Homo Sapiens
KRIPQLTRA

SEQ ID NO: 50655 - protein, 9 aa, Homo Sapiens
QLPDTSSYS

SEQ ID NO: 50656 - protein, 9 aa, Homo Sapiens
TIKSPTNNE

SEQ ID NO: 50657 - protein, 9 aa, Homo Sapiens
SEWKVYVNR

SEQ ID NO: 50658 - protein, 9 aa, Homo Sapiens
SPVGDPMDL

SEQ ID NO: 50659 - protein, 9 aa, Homo Sapiens
KHDLKFFTT

SEQ ID NO: 50660 - protein, 9 aa, Homo Sapiens
EWKVYVNRP

SEQ ID NO: 50661 - protein, 9 aa, Homo Sapiens
YRANAKEIP

SEQ ID NO: 50662 - protein, 9 aa, Homo Sapiens
CRVCGWLGP

SEQ ID NO: 50663 - protein, 9 aa, Homo Sapiens
PEYPNGYST

SEQ ID NO: 50664 - protein, 9 aa, Homo Sapiens
GWNYEHLFM

SEQ ID NO: 50665 - protein, 9 aa, Homo Sapiens
QTFKFDRPA

SEQ ID NO: 50666 - protein, 9 aa, Homo Sapiens
LRDQKKYLY

SEQ ID NO: 50667 - protein, 9 aa, Homo Sapiens
AGILPILTC

SEQ ID NO: 50668 - protein, 9 aa, Homo Sapiens
GQGLWVTFK

SEQ ID NO: 50669 - protein, 9 aa, Homo Sapiens
LLKELMQIP

SEQ ID NO: 50670 - protein, 9 aa, Homo Sapiens
QGFLLTQDQ

SEQ ID NO: 50671 - protein, 9 aa, Homo Sapiens
GAKYLSETL

SEQ ID NO: 50672 - protein, 9 aa, Homo Sapiens
LFKYIIGTL

SEQ ID NO: 50673 - protein, 9 aa, Homo Sapiens
GRASQSTVA

SEQ ID NO: 50674 - protein, 9 aa, Homo Sapiens
TKFNLICSE

SEQ ID NO: 50675 - protein, 9 aa, Homo Sapiens
FHKLNTMKH

SEQ ID NO: 50676 - protein, 9 aa, Homo Sapiens
IGLVQKLIV

SEQ ID NO: 50677 - protein, 9 aa, Homo Sapiens
MQIPNFRIT

SEQ ID NO: 50678 - protein, 9 aa, Homo Sapiens
SNLPSLSPT

SEQ ID NO: 50679 - protein, 9 aa, Homo Sapiens
CDISPLRLI

SEQ ID NO: 50680 - protein, 9 aa, Homo Sapiens
IIQIPKPAN

SEQ ID NO: 50681 - protein, 9 aa, Homo Sapiens
KVAYAMAMD

SEQ ID NO: 50682 - protein, 9 aa, Homo Sapiens
GEEKVHQSN

SEQ ID NO: 50683 - protein, 9 aa, Homo Sapiens
LAILDACIK

SEQ ID NO: 50684 - protein, 9 aa, Homo Sapiens
GQSYSLPWS

SEQ ID NO: 50685 - protein, 9 aa, Homo Sapiens
PVKRIPQLT

SEQ ID NO: 50686 - protein, 9 aa, Homo Sapiens
ENSSMFTGD

SEQ ID NO: 50687 - protein, 9 aa, Homo Sapiens
DGVMRTMKT

SEQ ID NO: 50688 - protein, 9 aa, Homo Sapiens
EKVSGFHKD

SEQ ID NO: 50689 - protein, 9 aa, Homo Sapiens
CLGGACPGS

SEQ ID NO: 50690 - protein, 9 aa, Homo Sapiens
ESAGGISSP

SEQ ID NO: 50691 - protein, 9 aa, Homo Sapiens
ALSRLQDSP

SEQ ID NO: 50692 - protein, 9 aa, Homo Sapiens
PWSCNSWCF

SEQ ID NO: 50693 - protein, 9 aa, Homo Sapiens
ARHYLLTLL

SEQ ID NO: 50694 - protein, 9 aa, Homo Sapiens
ATNAFIVSF

SEQ ID NO: 50695 - protein, 9 aa, Homo Sapiens
FNKHYKHDL

SEQ ID NO: 50696 - protein, 9 aa, Homo Sapiens
LHKETFSKQ

SEQ ID NO: 50697 - protein, 9 aa, Homo Sapiens
INGFVKFLS

SEQ ID NO: 50698 - protein, 9 aa, Homo Sapiens
LYSRLQGFL

SEQ ID NO: 50699 - protein, 9 aa, Homo Sapiens
CDECRETCT

SEQ ID NO: 50700 - protein, 9 aa, Homo Sapiens
KTEKLLKTV

SEQ ID NO: 50701 - protein, 9 aa, Homo Sapiens
FLQRDLFKG

SEQ ID NO: 50702 - protein, 9 aa, Homo Sapiens
LLPAWYHNF

SEQ ID NO: 50703 - protein, 9 aa, Homo Sapiens
SCFSPCVGQ

SEQ ID NO: 50704 - protein, 9 aa, Homo Sapiens
VSKTKQSKH

SEQ ID NO: 50705 - protein, 9 aa, Homo Sapiens
YEVTSKVGL

SEQ ID NO: 50706 - protein, 9 aa, Homo Sapiens
YKLSLEMEQ

SEQ ID NO: 50707 - protein, 9 aa, Homo Sapiens
QTWGGRASQ

SEQ ID NO: 50708 - protein, 9 aa, Homo Sapiens
DECRETCTE

SEQ ID NO: 50709 - protein, 9 aa, Homo Sapiens
LTLLPAVAL

SEQ ID NO: 50710 - protein, 9 aa, Homo Sapiens
LSQMKELSM

SEQ ID NO: 50711 - protein, 9 aa, Homo Sapiens
SKTKARRAV

SEQ ID NO: 50712 - protein, 9 aa, Homo Sapiens
LVHDFFSAL

SEQ ID NO: 50713 - protein, 9 aa, Homo Sapiens
KVGTSFTHE

SEQ ID NO: 50714 - protein, 9 aa, Homo Sapiens
CKKKFLDAL

SEQ ID NO: 50715 - protein, 9 aa, Homo Sapiens
EMEQLELQR

SEQ ID NO: 50716 - protein, 9 aa, Homo Sapiens
HTLAQLIAA

SEQ ID NO: 50717 - protein, 9 aa, Homo Sapiens
NITAIVKQF

SEQ ID NO: 50718 - protein, 9 aa, Homo Sapiens
SFTHESTFG

SEQ ID NO: 50719 - protein, 9 aa, Homo Sapiens
MNPQTFKFD

SEQ ID NO: 50720 - protein, 9 aa, Homo Sapiens
TFKFDRPAL

SEQ ID NO: 50721 - protein, 9 aa, Homo Sapiens
NLIKDKRKD

SEQ ID NO: 50722 - protein, 9 aa, Homo Sapiens
EDQREHLAA

SEQ ID NO: 50723 - protein, 9 aa, Homo Sapiens
DDKLKNKTN

SEQ ID NO: 50724 - protein, 9 aa, Homo Sapiens
PSTLNHTSG

SEQ ID NO: 50725 - protein, 9 aa, Homo Sapiens
GYSTHMHCV

SEQ ID NO: 50726 - protein, 9 aa, Homo Sapiens
YKFLLQFLA

SEQ ID NO: 50727 - protein, 9 aa, Homo Sapiens
LYVNDNPPI

SEQ ID NO: 50728 - protein, 9 aa, Homo Sapiens
LQQQLSDTQ

SEQ ID NO: 50729 - protein, 9 aa, Homo Sapiens
GGGRGMRVL

SEQ ID NO: 50730 - protein, 9 aa, Homo Sapiens
SAGKSERRP

SEQ ID NO: 50731 - protein, 9 aa, Homo Sapiens
NLLPAWYHN

SEQ ID NO: 50732 - protein, 9 aa, Homo Sapiens
CDRILSQVS

SEQ ID NO: 50733 - protein, 9 aa, Homo Sapiens
ILIVKHIYS

SEQ ID NO: 50734 - protein, 9 aa, Homo Sapiens
ENKVKKENT

SEQ ID NO: 50735 - protein, 9 aa, Homo Sapiens
APLTTVLNP

SEQ ID NO: 50736 - protein, 9 aa, Homo Sapiens
LESSCDNKR

SEQ ID NO: 50737 - protein, 9 aa, Homo Sapiens
NSWCFTSEG

SEQ ID NO: 50738 - protein, 9 aa, Homo Sapiens
AIPAPSQKA

SEQ ID NO: 50739 - protein, 9 aa, Homo Sapiens
FAKKFVQTD

SEQ ID NO: 50740 - protein, 9 aa, Homo Sapiens
TLNHTSGSL

SEQ ID NO: 50741 - protein, 9 aa, Homo Sapiens
LLQFLAYSV

SEQ ID NO: 50742 - protein, 9 aa, Homo Sapiens
LENSSMFTG

SEQ ID NO: 50743 - protein, 9 aa, Homo Sapiens
TVCKMQLEE

SEQ ID NO: 50744 - protein, 9 aa, Homo Sapiens
CKQRKKNKK

SEQ ID NO: 50745 - protein, 9 aa, Homo Sapiens
EQRTVCKMQ

SEQ ID NO: 50746 - protein, 9 aa, Homo Sapiens
ARPRLLESS

SEQ ID NO: 50747 - protein, 9 aa, Homo Sapiens
NGYSTHMHC

SEQ ID NO: 50748 - protein, 9 aa, Homo Sapiens
KQRKKNKKV

SEQ ID NO: 50749 - protein, 9 aa, Homo Sapiens
ANEPQDSKV

SEQ ID NO: 50750 - protein, 9 aa, Homo Sapiens
QLRMVQRER

SEQ ID NO: 50751 - protein, 9 aa, Homo Sapiens
YGYVPLSSN

SEQ ID NO: 50752 - protein, 9 aa, Homo Sapiens
GAVIGTDCG

SEQ ID NO: 50753 - protein, 9 aa, Homo Sapiens
KELMQIPNF

SEQ ID NO: 50754 - protein, 9 aa, Homo Sapiens
EEEKNRYKA

SEQ ID NO: 50755 - protein, 9 aa, Homo Sapiens
VKRIPQLTR

SEQ ID NO: 50756 - protein, 9 aa, Homo Sapiens
CEQSEYSAF

SEQ ID NO: 50757 - protein, 9 aa, Homo Sapiens
SAIFKVIQT

SEQ ID NO: 50758 - protein, 9 aa, Homo Sapiens
PLRLIVRDP

SEQ ID NO: 50759 - protein, 9 aa, Homo Sapiens
WMNCCCTEL

SEQ ID NO: 50760 - protein, 9 aa, Homo Sapiens
TKAYQRPTI

SEQ ID NO: 50761 - protein, 9 aa, Homo Sapiens
MYWMNCCCT

SEQ ID NO: 50762 - protein, 9 aa, Homo Sapiens
LKAIIWILW

SEQ ID NO: 50763 - protein, 9 aa, Homo Sapiens
VKENLAINK

SEQ ID NO: 50764 - protein, 9 aa, Homo Sapiens
IEHFQQAIE

SEQ ID NO: 50765 - protein, 9 aa, Homo Sapiens
GWTYGYVPL

SEQ ID NO: 50766 - protein, 9 aa, Homo Sapiens
LLADLENSS

SEQ ID NO: 50767 - protein, 9 aa, Homo Sapiens
IVKQFNRDI

SEQ ID NO: 50768 - protein, 9 aa, Homo Sapiens
GGACPGSRS

SEQ ID NO: 50769 - protein, 9 aa, Homo Sapiens
IGTDCGTIE

SEQ ID NO: 50770 - protein, 9 aa, Homo Sapiens
SKGRPGPPG

SEQ ID NO: 50771 - protein, 9 aa, Homo Sapiens
HLTPLQMDA

SEQ ID NO: 50772 - protein, 9 aa, Homo Sapiens
TSKVGLSEL

SEQ ID NO: 50773 - protein, 9 aa, Homo Sapiens
CHFLQMNLL

SEQ ID NO: 50774 - protein, 9 aa, Homo Sapiens
VAPLEKVRI

SEQ ID NO: 50775 - protein, 9 aa, Homo Sapiens
GTNVLNCSH

SEQ ID NO: 50776 - protein, 9 aa, Homo Sapiens
HEALVGPLH

SEQ ID NO: 50777 - protein, 9 aa, Homo Sapiens
GKAPPETRL

SEQ ID NO: 50778 - protein, 9 aa, Homo Sapiens
EWWFKTAYL

SEQ ID NO: 50779 - protein, 9 aa, Homo Sapiens
VAENLNIKL

SEQ ID NO: 50780 - protein, 9 aa, Homo Sapiens
SSAIFKVIQ

SEQ ID NO: 50781 - protein, 9 aa, Homo Sapiens
TIVLKMPMK

SEQ ID NO: 50782 - protein, 9 aa, Homo Sapiens
RFNNYVDCK

SEQ ID NO: 50783 - protein, 9 aa, Homo Sapiens
KYIIGTLEL

SEQ ID NO: 50784 - protein, 9 aa, Homo Sapiens
AKYLSETLT

SEQ ID NO: 50785 - protein, 9 aa, Homo Sapiens
GMRVLHSYE

SEQ ID NO: 50786 - protein, 9 aa, Homo Sapiens
WRQTWGGRA

SEQ ID NO: 50787 - protein, 9 aa, Homo Sapiens
GNALLMYSR

SEQ ID NO: 50788 - protein, 9 aa, Homo Sapiens
SESVKENLA

SEQ ID NO: 50789 - protein, 9 aa, Homo Sapiens
RPRLLESSL

SEQ ID NO: 50790 - protein, 9 aa, Homo Sapiens
ALLMYSRIK

SEQ ID NO: 50791 - protein, 9 aa, Homo Sapiens
LEEKIKFLK

SEQ ID NO: 50792 - protein, 9 aa, Homo Sapiens
GILYVNDNP

SEQ ID NO: 50793 - protein, 9 aa, Homo Sapiens
ENAGAKYLS

SEQ ID NO: 50794 - protein, 9 aa, Homo Sapiens
KKNKKVRVT

SEQ ID NO: 50795 - protein, 9 aa, Homo Sapiens
VSWSFHKLN

SEQ ID NO: 50796 - protein, 9 aa, Homo Sapiens
NNVCNRYEF

SEQ ID NO: 50797 - protein, 9 aa, Homo Sapiens
VYKLSLEME

SEQ ID NO: 50798 - protein, 9 aa, Homo Sapiens
VRIVYPSAF

SEQ ID NO: 50799 - protein, 9 aa, Homo Sapiens
TEEEKNRYK

SEQ ID NO: 50800 - protein, 9 aa, Homo Sapiens
KSFETEAAL

SEQ ID NO: 50801 - protein, 9 aa, Homo Sapiens
MVQRERLEA

SEQ ID NO: 50802 - protein, 9 aa, Homo Sapiens
NNYVDCKKK

SEQ ID NO: 50803 - protein, 9 aa, Homo Sapiens
ENIGRKCDR

SEQ ID NO: 50804 - protein, 9 aa, Homo Sapiens
EGESAGGIS

SEQ ID NO: 50805 - protein, 9 aa, Homo Sapiens
LIYKDMFLD

SEQ ID NO: 50806 - protein, 9 aa, Homo Sapiens
VSEYQQYLD

SEQ ID NO: 50807 - protein, 9 aa, Homo Sapiens
LLKSKTKAR

SEQ ID NO: 50808 - protein, 9 aa, Homo Sapiens
PVIMLFVST

SEQ ID NO: 50809 - protein, 9 aa, Homo Sapiens
RGWAQRGRG

SEQ ID NO: 50810 - protein, 9 aa, Homo Sapiens
PENLLTRLL

SEQ ID NO: 50811 - protein, 9 aa, Homo Sapiens
PQIVIAFNE

SEQ ID NO: 50812 - protein, 9 aa, Homo Sapiens
NRIENAGAK

SEQ ID NO: 50813 - protein, 9 aa, Homo Sapiens
GQWENKVKK

SEQ ID NO: 50814 - protein, 9 aa, Homo Sapiens
APVIMLFVS

SEQ ID NO: 50815 - protein, 9 aa, Homo Sapiens
NRAVEYHIN

SEQ ID NO: 50816 - protein, 9 aa, Homo Sapiens
IPNFRITVV

SEQ ID NO: 50817 - protein, 9 aa, Homo Sapiens
DSKVNLQSP

SEQ ID NO: 50818 - protein, 9 aa, Homo Sapiens
GGDSVVLRC

SEQ ID NO: 50819 - protein, 9 aa, Homo Sapiens
KMYWMNCCC

SEQ ID NO: 50820 - protein, 9 aa, Homo Sapiens
VFGGDSVVL

SEQ ID NO: 50821 - protein, 9 aa, Homo Sapiens
ARKKPLFIT

SEQ ID NO: 50822 - protein, 9 aa, Homo Sapiens
RSGRVLERR

SEQ ID NO: 50823 - protein, 9 aa, Homo Sapiens
DVYRANAKE

SEQ ID NO: 50824 - protein, 9 aa, Homo Sapiens
QYLDATAEG

SEQ ID NO: 50825 - protein, 9 aa, Homo Sapiens
VRFQSSAMV

SEQ ID NO: 50826 - protein, 9 aa, Homo Sapiens
VLGAVIGTD

SEQ ID NO: 50827 - protein, 9 aa, Homo Sapiens
EKIKFLKMK

SEQ ID NO: 50828 - protein, 9 aa, Homo Sapiens
LEVGQPQVV

SEQ ID NO: 50829 - protein, 9 aa, Homo Sapiens
RKKPLFITT

SEQ ID NO: 50830 - protein, 9 aa, Homo Sapiens
RLQGFLLTQ

SEQ ID NO: 50831 - protein, 9 aa, Homo Sapiens
IPWEKVQVD

SEQ ID NO: 50832 - protein, 9 aa, Homo Sapiens
LVMEIINLI

SEQ ID NO: 50833 - protein, 9 aa, Homo Sapiens
VFLDICIYS

SEQ ID NO: 50834 - protein, 9 aa, Homo Sapiens
HLLTETKYI

SEQ ID NO: 50835 - protein, 9 aa, Homo Sapiens
QGATLIFDE

SEQ ID NO: 50836 - protein, 9 aa, Homo Sapiens
EKNRYKADR

SEQ ID NO: 50837 - protein, 9 aa, Homo Sapiens
SFHKLNTMK

SEQ ID NO: 50838 - protein, 9 aa, Homo Sapiens
SLLPQNLSH

SEQ ID NO: 50839 - protein, 9 aa, Homo Sapiens
LPDTSSYSQ

SEQ ID NO: 50840 - protein, 9 aa, Homo Sapiens
LCRVCGWLG

SEQ ID NO: 50841 - protein, 9 aa, Homo Sapiens
WREVRHIGL

SEQ ID NO: 50842 - protein, 9 aa, Homo Sapiens
LKMPMKLTV

SEQ ID NO: 50843 - protein, 9 aa, Homo Sapiens
ENLNIKLQF

SEQ ID NO: 50844 - protein, 9 aa, Homo Sapiens
PHLKPKTTL

SEQ ID NO: 50845 - protein, 9 aa, Homo Sapiens
PHGCCPNGH

SEQ ID NO: 50846 - protein, 9 aa, Homo Sapiens
TENGKVKEQ

SEQ ID NO: 50847 - protein, 9 aa, Homo Sapiens
VKNAFTKTH

SEQ ID NO: 50848 - protein, 9 aa, Homo Sapiens
AQVVVCGGG

SEQ ID NO: 50849 - protein, 9 aa, Homo Sapiens
SGDTSTPLL

SEQ ID NO: 50850 - protein, 9 aa, Homo Sapiens
PTRRHRGEK

SEQ ID NO: 50851 - protein, 9 aa, Homo Sapiens
QAGFPPITR

SEQ ID NO: 50852 - protein, 9 aa, Homo Sapiens
NNNEMVALR

SEQ ID NO: 50853 - protein, 9 aa, Homo Sapiens
YRPHLALDT

SEQ ID NO: 50854 - protein, 9 aa, Homo Sapiens
RRWQMLLLE

SEQ ID NO: 50855 - protein, 9 aa, Homo Sapiens
IDTKFHTND

SEQ ID NO: 50856 - protein, 9 aa, Homo Sapiens
YDEFLKLLG

SEQ ID NO: 50857 - protein, 9 aa, Homo Sapiens
MQVGFQKGT

SEQ ID NO: 50858 - protein, 9 aa, Homo Sapiens
SPDAMQVGF

SEQ ID NO: 50859 - protein, 9 aa, Homo Sapiens
AGFPPITRT

SEQ ID NO: 50860 - protein, 9 aa, Homo Sapiens
SPDAMQVGK

SEQ ID NO: 50861 - protein, 9 aa, Homo Sapiens
LLRYAQTQA

SEQ ID NO: 50862 - protein, 9 aa, Homo Sapiens
GTIVENGVH

SEQ ID NO: 50863 - protein, 9 aa, Homo Sapiens
PGQKINQQE

SEQ ID NO: 50864 - protein, 9 aa, Homo Sapiens
PDAMQVGKG

SEQ ID NO: 50865 - protein, 9 aa, Homo Sapiens
QNIHGKDID

SEQ ID NO: 50866 - protein, 9 aa, Homo Sapiens
TSRLSERTS

SEQ ID NO: 50867 - protein, 9 aa, Homo Sapiens
QFHIDADSG

SEQ ID NO: 50868 - protein, 9 aa, Homo Sapiens
RVLLVVTSW

SEQ ID NO: 50869 - protein, 9 aa, Homo Sapiens
KCQAGFPPI

SEQ ID NO: 50870 - protein, 9 aa, Homo Sapiens
NEMVALRDP

SEQ ID NO: 50871 - protein, 9 aa, Homo Sapiens
GAFLLPAAH

SEQ ID NO: 50872 - protein, 9 aa, Homo Sapiens
TPSGDTSTP

SEQ ID NO: 50873 - protein, 9 aa, Homo Sapiens
EFLKLLGIS

SEQ ID NO: 50874 - protein, 9 aa, Homo Sapiens
NYDEFLKLL

SEQ ID NO: 50875 - protein, 9 aa, Homo Sapiens
AFLLPAAHW

SEQ ID NO: 50876 - protein, 9 aa, Homo Sapiens
KMENESLNS

SEQ ID NO: 50877 - protein, 9 aa, Homo Sapiens
RLLLLSRTF

SEQ ID NO: 50878 - protein, 9 aa, Homo Sapiens
PPAPTRRHR

SEQ ID NO: 50879 - protein, 9 aa, Homo Sapiens
TIMNKKVRV

SEQ ID NO: 50880 - protein, 9 aa, Homo Sapiens
LRDPNNPYD

SEQ ID NO: 50881 - protein, 9 aa, Homo Sapiens
FSSSGKPDV

SEQ ID NO: 50882 - protein, 9 aa, Homo Sapiens
SFSSSGKPD

SEQ ID NO: 50883 - protein, 9 aa, Homo Sapiens
MVALRDPNN

SEQ ID NO: 50884 - protein, 9 aa, Homo Sapiens
AIPGQKINQ

SEQ ID NO: 50885 - protein, 9 aa, Homo Sapiens
NWSSARNSA

SEQ ID NO: 50886 - protein, 9 aa, Homo Sapiens
ASPDAMQVG

SEQ ID NO: 50887 - protein, 9 aa, Homo Sapiens
QDEHPKTIF

SEQ ID NO: 50888 - protein, 9 aa, Homo Sapiens
CQAGFPPIT

SEQ ID NO: 50889 - protein, 9 aa, Homo Sapiens
EMYQPSYDS

SEQ ID NO: 50890 - protein, 9 aa, Homo Sapiens
RGEMDLNGD

SEQ ID NO: 50891 - protein, 9 aa, Homo Sapiens
TQSMRSGAG

SEQ ID NO: 50892 - protein, 9 aa, Homo Sapiens
RLAYPVSLC

SEQ ID NO: 50893 - protein, 9 aa, Homo Sapiens
LTELSLRRW

SEQ ID NO: 50894 - protein, 9 aa, Homo Sapiens
RHRGEKKPG

SEQ ID NO: 50895 - protein, 9 aa, Homo Sapiens
SRLLLLSRT

SEQ ID NO: 50896 - protein, 9 aa, Homo Sapiens
AHWNHLESP

SEQ ID NO: 50897 - protein, 9 aa, Homo Sapiens
AMQVGFQKG

SEQ ID NO: 50898 - protein, 9 aa, Homo Sapiens
HLALDTIYQ

SEQ ID NO: 50899 - protein, 9 aa, Homo Sapiens
KKAVVSGIY

SEQ ID NO: 50900 - protein, 9 aa, Homo Sapiens
DVNIPKIVT

SEQ ID NO: 50901 - protein, 9 aa, Homo Sapiens
IRGEMDLNG

SEQ ID NO: 50902 - protein, 9 aa, Homo Sapiens
ERTSVYQHS

SEQ ID NO: 50903 - protein, 9 aa, Homo Sapiens
QLFHNLFHR

SEQ ID NO: 50904 - protein, 9 aa, Homo Sapiens
HWNHLESPE

SEQ ID NO: 50905 - protein, 9 aa, Homo Sapiens
TELSLRRWQ

SEQ ID NO: 50906 - protein, 9 aa, Homo Sapiens
SKYSKCQAG

SEQ ID NO: 50907 - protein, 9 aa, Homo Sapiens
RVKGPPQAN

SEQ ID NO: 50908 - protein, 9 aa, Homo Sapiens
TSRLLLLSR

SEQ ID NO: 50909 - protein, 9 aa, Homo Sapiens
RYAQTQATG

SEQ ID NO: 50910 - protein, 9 aa, Homo Sapiens
KRMHSLKWD

SEQ ID NO: 50911 - protein, 9 aa, Homo Sapiens
QVGFQKGTR

SEQ ID NO: 50912 - protein, 9 aa, Homo Sapiens
SERTSVYQH

SEQ ID NO: 50913 - protein, 9 aa, Homo Sapiens
REEVLQLSS

SEQ ID NO: 50914 - protein, 9 aa, Homo Sapiens
RLYRPHLAL

SEQ ID NO: 50915 - protein, 9 aa, Homo Sapiens
PPPVPNPGY

SEQ ID NO: 50916 - protein, 9 aa, Homo Sapiens
PAAHWNHLE

SEQ ID NO: 50917 - protein, 9 aa, Homo Sapiens
EHPKTIFSK

SEQ ID NO: 50918 - protein, 9 aa, Homo Sapiens
LDTIYQIMY

SEQ ID NO: 50919 - protein, 9 aa, Homo Sapiens
LRRWQMLLL

SEQ ID NO: 50920 - protein, 9 aa, Homo Sapiens
YAQTQATGG

SEQ ID NO: 50921 - protein, 9 aa, Homo Sapiens
NSASAAEAR

SEQ ID NO: 50922 - protein, 9 aa, Homo Sapiens
WQMLLLETL

SEQ ID NO: 50923 - protein, 9 aa, Homo Sapiens
LRVTLCCDG

SEQ ID NO: 50924 - protein, 9 aa, Homo Sapiens
VNIPKIVTD

SEQ ID NO: 50925 - protein, 9 aa, Homo Sapiens
KPRMCKYTS

SEQ ID NO: 50926 - protein, 9 aa, Homo Sapiens
FYVDLETKD

SEQ ID NO: 50927 - protein, 9 aa, Homo Sapiens
HATWKTVRN

SEQ ID NO: 50928 - protein, 9 aa, Homo Sapiens
KTIFSKDKD

SEQ ID NO: 50929 - protein, 9 aa, Homo Sapiens
ALRDPNNPY

SEQ ID NO: 50930 - protein, 9 aa, Homo Sapiens
SYLRQLFHN

SEQ ID NO: 50931 - protein, 9 aa, Homo Sapiens
PKTIFSKDK

SEQ ID NO: 50932 - protein, 9 aa, Homo Sapiens
EKKLLEMTA

SEQ ID NO: 50933 - protein, 9 aa, Homo Sapiens
GFVQTILVR

SEQ ID NO: 50934 - protein, 9 aa, Homo Sapiens
GQKINQQEE

SEQ ID NO: 50935 - protein, 9 aa, Homo Sapiens
MTAKADKLK

SEQ ID NO: 50936 - protein, 9 aa, Homo Sapiens
KTVRNKLKN

SEQ ID NO: 50937 - protein, 9 aa, Homo Sapiens
VGFAMAIAA

SEQ ID NO: 50938 - protein, 9 aa, Homo Sapiens
SGGTIVENG

SEQ ID NO: 50939 - protein, 9 aa, Homo Sapiens
ETSRLSERT

SEQ ID NO: 50940 - protein, 9 aa, Homo Sapiens
LSRLAYPVS

SEQ ID NO: 50941 - protein, 9 aa, Homo Sapiens
IQACTTTPC

SEQ ID NO: 50942 - protein, 9 aa, Homo Sapiens
MQACFAVGA

SEQ ID NO: 50943 - protein, 9 aa, Homo Sapiens
MNKKVRVLL

SEQ ID NO: 50944 - protein, 9 aa, Homo Sapiens
IPGQKINQQ

SEQ ID NO: 50945 - protein, 9 aa, Homo Sapiens
QTILVRRRY

SEQ ID NO: 50946 - protein, 9 aa, Homo Sapiens
LAYPVSLCG

SEQ ID NO: 50947 - protein, 9 aa, Homo Sapiens
DMISESKME

SEQ ID NO: 50948 - protein, 9 aa, Homo Sapiens
WSSARNSAS

SEQ ID NO: 50949 - protein, 9 aa, Homo Sapiens
HSLKWDQPI

SEQ ID NO: 50950 - protein, 9 aa, Homo Sapiens
ETKDTVWQL

SEQ ID NO: 50951 - protein, 9 aa, Homo Sapiens
KFHTNDIAI

SEQ ID NO: 50952 - protein, 9 aa, Homo Sapiens
VVSGIYLEA

SEQ ID NO: 50953 - protein, 9 aa, Homo Sapiens
VSGIYLEAD

SEQ ID NO: 50954 - protein, 9 aa, Homo Sapiens
RLVIDTKFH

SEQ ID NO: 50955 - protein, 9 aa, Homo Sapiens
GFAMAIAAS

SEQ ID NO: 50956 - protein, 9 aa, Homo Sapiens
RTSRLLLLS

SEQ ID NO: 50957 - protein, 9 aa, Homo Sapiens
SRLSERTSV

SEQ ID NO: 50958 - protein, 9 aa, Homo Sapiens
VRVLLVVTS

SEQ ID NO: 50959 - protein, 9 aa, Homo Sapiens
RVTLCCDGN

SEQ ID NO: 50960 - protein, 9 aa, Homo Sapiens
TQDEHPKTI

SEQ ID NO: 50961 - protein, 9 aa, Homo Sapiens
KTTQSMRSG

SEQ ID NO: 50962 - protein, 9 aa, Homo Sapiens
TKFHTNDIA

SEQ ID NO: 50963 - protein, 9 aa, Homo Sapiens
CKYTSSRFK

SEQ ID NO: 50964 - protein, 9 aa, Homo Sapiens
RQGTGWKLV

SEQ ID NO: 50965 - protein, 9 aa, Homo Sapiens
SKRMHSLKW

SEQ ID NO: 50966 - protein, 9 aa, Homo Sapiens
GTGWKLVKS

SEQ ID NO: 50967 - protein, 9 aa, Homo Sapiens
ASTLSTPSG

SEQ ID NO: 50968 - protein, 9 aa, Homo Sapiens
YQHSKYSKC

SEQ ID NO: 50969 - protein, 9 aa, Homo Sapiens
KLLEMTAKA

SEQ ID NO: 50970 - protein, 9 aa, Homo Sapiens
QHSKYSKCQ

SEQ ID NO: 50971 - protein, 9 aa, Homo Sapiens
SASAAEARS

SEQ ID NO: 50972 - protein, 9 aa, Homo Sapiens
ACFAVGAFL

SEQ ID NO: 50973 - protein, 9 aa, Homo Sapiens
PPITRTSRL

SEQ ID NO: 50974 - protein, 9 aa, Homo Sapiens
AQTQATGGK

SEQ ID NO: 50975 - protein, 9 aa, Homo Sapiens
VRNKLKNHP

SEQ ID NO: 50976 - protein, 9 aa, Homo Sapiens
LYRPHLALD

SEQ ID NO: 50977 - protein, 9 aa, Homo Sapiens
AMAIAASKV

SEQ ID NO: 50978 - protein, 9 aa, Homo Sapiens
PETSRLSER

SEQ ID NO: 50979 - protein, 9 aa, Homo Sapiens
HSKYSKCQA

SEQ ID NO: 50980 - protein, 9 aa, Homo Sapiens
QTQATGGKK

SEQ ID NO: 50981 - protein, 9 aa, Homo Sapiens
CLYKPRMCK

SEQ ID NO: 50982 - protein, 9 aa, Homo Sapiens
AVVSGIYLE

SEQ ID NO: 50983 - protein, 9 aa, Homo Sapiens
MQVGKGASP

SEQ ID NO: 50984 - protein, 9 aa, Homo Sapiens
LSLRRWQML

SEQ ID NO: 50985 - protein, 9 aa, Homo Sapiens
FGQSIRGEM

SEQ ID NO: 50986 - protein, 9 aa, Homo Sapiens
VALRDPNNP

SEQ ID NO: 50987 - protein, 9 aa, Homo Sapiens
KVRVLLVVT

SEQ ID NO: 50988 - protein, 9 aa, Homo Sapiens
VKKAVVSGI

SEQ ID NO: 50989 - protein, 9 aa, Homo Sapiens
ARNSASAAE

SEQ ID NO: 50990 - protein, 9 aa, Homo Sapiens
DFSGSFSSS

SEQ ID NO: 50991 - protein, 9 aa, Homo Sapiens
NKKVRVLLV

SEQ ID NO: 50992 - protein, 9 aa, Homo Sapiens
PHLALDTIY

SEQ ID NO: 50993 - protein, 9 aa, Homo Sapiens
DLVLLKTRE

SEQ ID NO: 50994 - protein, 9 aa, Homo Sapiens
RPPPVPNPG

SEQ ID NO: 50995 - protein, 9 aa, Homo Sapiens
FPPITRTSR

SEQ ID NO: 50996 - protein, 9 aa, Homo Sapiens
DIDLLRTTV

SEQ ID NO: 50997 - protein, 9 aa, Homo Sapiens
SIRGEMDLN

SEQ ID NO: 50998 - protein, 9 aa, Homo Sapiens
NIHGKDIDL

SEQ ID NO: 50999 - protein, 9 aa, Homo Sapiens
LMRALRDVN

SEQ ID NO: 51000 - protein, 9 aa, Homo Sapiens
TIFSKDKDI

SEQ ID NO: 51001 - protein, 9 aa, Homo Sapiens
NNEMVALRD

SEQ ID NO: 51002 - protein, 9 aa, Homo Sapiens
FSGSFSSSG

SEQ ID NO: 51003 - protein, 9 aa, Homo Sapiens
PPVPNPGYE

SEQ ID NO: 51004 - protein, 9 aa, Homo Sapiens
CFAVGAFLL

SEQ ID NO: 51005 - protein, 9 aa, Homo Sapiens
SEKNYDEFL

SEQ ID NO: 51006 - protein, 9 aa, Homo Sapiens
VTLCCDGNF

SEQ ID NO: 51007 - protein, 9 aa, Homo Sapiens
LKLLGISSD

SEQ ID NO: 51008 - protein, 9 aa, Homo Sapiens
LPAAHWNHL

SEQ ID NO: 51009 - protein, 9 aa, Homo Sapiens
GGTIVENGV

SEQ ID NO: 51010 - protein, 9 aa, Homo Sapiens
LLPAAHWNH

SEQ ID NO: 51011 - protein, 9 aa, Homo Sapiens
CCDGNFCNV

SEQ ID NO: 51012 - protein, 9 aa, Homo Sapiens
WKTVRNKLK

SEQ ID NO: 51013 - protein, 9 aa, Homo Sapiens
SDAIPGQKI

SEQ ID NO: 51014 - protein, 9 aa, Homo Sapiens
VGAFLLPAA

SEQ ID NO: 51015 - protein, 9 aa, Homo Sapiens
AMQVGKGAS

SEQ ID NO: 51016 - protein, 9 aa, Homo Sapiens
PNPGYEPIR

SEQ ID NO: 51017 - protein, 9 aa, Homo Sapiens
TSVYQHSKY

SEQ ID NO: 51018 - protein, 9 aa, Homo Sapiens
LCCDGNFCN

SEQ ID NO: 51019 - protein, 9 aa, Homo Sapiens
HNLFHRQGF

SEQ ID NO: 51020 - protein, 9 aa, Homo Sapiens
QSIRGEMDL

SEQ ID NO: 51021 - protein, 9 aa, Homo Sapiens
ALRDVNIPK

SEQ ID NO: 51022 - protein, 9 aa, Homo Sapiens
LSDAIPGQK

SEQ ID NO: 51023 - protein, 9 aa, Homo Sapiens
YHIQACTTT

SEQ ID NO: 51024 - protein, 9 aa, Homo Sapiens
HRGEKKPGR

SEQ ID NO: 51025 - protein, 9 aa, Homo Sapiens
AEMYQPSYD

SEQ ID NO: 51026 - protein, 9 aa, Homo Sapiens
DGFVQTILV

SEQ ID NO: 51027 - protein, 9 aa, Homo Sapiens
MENESLNSI

SEQ ID NO: 51028 - protein, 9 aa, Homo Sapiens
RRHRGEKKP

SEQ ID NO: 51029 - protein, 9 aa, Homo Sapiens
KYHIQACTT

SEQ ID NO: 51030 - protein, 9 aa, Homo Sapiens
RGRQGTGWK

SEQ ID NO: 51031 - protein, 9 aa, Homo Sapiens
RNSASAAEA

SEQ ID NO: 51032 - protein, 9 aa, Homo Sapiens
RMCKYTSSR

SEQ ID NO: 51033 - protein, 9 aa, Homo Sapiens
RDVNIPKIV

SEQ ID NO: 51034 - protein, 9 aa, Homo Sapiens
LGSKRMHSL

SEQ ID NO: 51035 - protein, 9 aa, Homo Sapiens
VKGPPQANR

SEQ ID NO: 51036 - protein, 9 aa, Homo Sapiens
SARNSASAA

SEQ ID NO: 51037 - protein, 9 aa, Homo Sapiens
STPSGDTST

SEQ ID NO: 51038 - protein, 9 aa, Homo Sapiens
LEDNLPQFH

SEQ ID NO: 51039 - protein, 9 aa, Homo Sapiens
RLSERTSVY

SEQ ID NO: 51040 - protein, 9 aa, Homo Sapiens
ATWKTVRNK

SEQ ID NO: 51041 - protein, 9 aa, Homo Sapiens
PITRTSRLL

SEQ ID NO: 51042 - protein, 9 aa, Homo Sapiens
ACTTTPCML

SEQ ID NO: 51043 - protein, 9 aa, Homo Sapiens
CCLYKPRMC

SEQ ID NO: 51044 - protein, 9 aa, Homo Sapiens
APTRRHRGE

SEQ ID NO: 51045 - protein, 9 aa, Homo Sapiens
VGKYHIQAC

SEQ ID NO: 51046 - protein, 9 aa, Homo Sapiens
RSGGTIVEN

SEQ ID NO: 51047 - protein, 9 aa, Homo Sapiens
EVGFAMAIA

SEQ ID NO: 51048 - protein, 9 aa, Homo Sapiens
VLMRALRDV

SEQ ID NO: 51049 - protein, 9 aa, Homo Sapiens
FLKLLGISS

SEQ ID NO: 51050 - protein, 9 aa, Homo Sapiens
IVENGVHKL

SEQ ID NO: 51051 - protein, 9 aa, Homo Sapiens
QLGSKRMHS

SEQ ID NO: 51052 - protein, 9 aa, Homo Sapiens
ITRTSRLLL

SEQ ID NO: 51053 - protein, 9 aa, Homo Sapiens
VQTILVRRR

SEQ ID NO: 51054 - protein, 9 aa, Homo Sapiens
LRQLFHNLF

SEQ ID NO: 51055 - protein, 9 aa, Homo Sapiens
HLESPETSR

SEQ ID NO: 51056 - protein, 9 aa, Homo Sapiens
FAMAIAASK

SEQ ID NO: 51057 - protein, 9 aa, Homo Sapiens
LPQFHIDAD

SEQ ID NO: 51058 - protein, 9 aa, Homo Sapiens
RVLEVGFAM

SEQ ID NO: 51059 - protein, 9 aa, Homo Sapiens
PDAMQVGFQ

SEQ ID NO: 51060 - protein, 9 aa, Homo Sapiens
FHNLFHRQG

SEQ ID NO: 51061 - protein, 9 aa, Homo Sapiens
DTVWQLPMF

SEQ ID NO: 51062 - protein, 9 aa, Homo Sapiens
KKLLEMTAK

SEQ ID NO: 51063 - protein, 9 aa, Homo Sapiens
LRDVNIPKI

SEQ ID NO: 51064 - protein, 9 aa, Homo Sapiens
ELSLRRWQM

SEQ ID NO: 51065 - protein, 9 aa, Homo Sapiens
FVQTILVRR

SEQ ID NO: 51066 - protein, 9 aa, Homo Sapiens
NPGYEPIRK

SEQ ID NO: 51067 - protein, 9 aa, Homo Sapiens
EMVALRDPN

SEQ ID NO: 51068 - protein, 9 aa, Homo Sapiens
YKPRMCKYT

SEQ ID NO: 51069 - protein, 9 aa, Homo Sapiens
PGPRVKGPP

SEQ ID NO: 51070 - protein, 9 aa, Homo Sapiens
TLCCDGNFC

SEQ ID NO: 51071 - protein, 9 aa, Homo Sapiens
SSARNSASA

SEQ ID NO: 51072 - protein, 9 aa, Homo Sapiens
TRTSRLLLL

SEQ ID NO: 51073 - protein, 9 aa, Homo Sapiens
QPSYDSMLS

SEQ ID NO: 51074 - protein, 9 aa, Homo Sapiens
LKTREEVLQ

SEQ ID NO: 51075 - protein, 9 aa, Homo Sapiens
ATGGKKVIQ

SEQ ID NO: 51076 - protein, 9 aa, Homo Sapiens
ALLSRLAYP

SEQ ID NO: 51077 - protein, 9 aa, Homo Sapiens
DTKFHTNDI

SEQ ID NO: 51078 - protein, 9 aa, Homo Sapiens
ENESLNSIH

SEQ ID NO: 51079 - protein, 9 aa, Homo Sapiens
FLLPAAHWN

SEQ ID NO: 51080 - protein, 9 aa, Homo Sapiens
KKPGPRVKG

SEQ ID NO: 51081 - protein, 9 aa, Homo Sapiens
LVRRRYLPG

SEQ ID NO: 51082 - protein, 9 aa, Homo Sapiens
QACFAVGAF

SEQ ID NO: 51083 - protein, 9 aa, Homo Sapiens
YVDLETKDT

SEQ ID NO: 51084 - protein, 9 aa, Homo Sapiens
KEKKLLEMT

SEQ ID NO: 51085 - protein, 9 aa, Homo Sapiens
DAMQVGFQK

SEQ ID NO: 51086 - protein, 9 aa, Homo Sapiens
GSFSSSGKP

SEQ ID NO: 51087 - protein, 9 aa, Homo Sapiens
QKINQQEEP

SEQ ID NO: 51088 - protein, 9 aa, Homo Sapiens
ALDTIYQIM

SEQ ID NO: 51089 - protein, 9 aa, Homo Sapiens
PRMCKYTSS

SEQ ID NO: 51090 - protein, 9 aa, Homo Sapiens
QEDFSGSFS

SEQ ID NO: 51091 - protein, 9 aa, Homo Sapiens
KKKPGPRVK

SEQ ID NO: 51092 - protein, 9 aa, Homo Sapiens
YMQNIHGKD

SEQ ID NO: 51093 - protein, 9 aa, Homo Sapiens
MYQPSYDSM

SEQ ID NO: 51094 - protein, 9 aa, Homo Sapiens
PRVKGPPQA

SEQ ID NO: 51095 - protein, 9 aa, Homo Sapiens
KAVVSGIYL

SEQ ID NO: 51096 - protein, 9 aa, Homo Sapiens
YSKCQAGFP

SEQ ID NO: 51097 - protein, 9 aa, Homo Sapiens
RALRDVNIP

SEQ ID NO: 51098 - protein, 9 aa, Homo Sapiens
DALLSRLAY

SEQ ID NO: 51099 - protein, 9 aa, Homo Sapiens
TQATGGKKV

SEQ ID NO: 51100 - protein, 9 aa, Homo Sapiens
LYKPRMCKY

SEQ ID NO: 51101 - protein, 9 aa, Homo Sapiens
LSTPSGDTS

SEQ ID NO: 51102 - protein, 9 aa, Homo Sapiens
DLETKDTVW

SEQ ID NO: 51103 - protein, 9 aa, Homo Sapiens
ILVRRRYLP

SEQ ID NO: 51104 - protein, 9 aa, Homo Sapiens
EDNLPQFHI

SEQ ID NO: 51105 - protein, 9 aa, Homo Sapiens
STLAEMYQP

SEQ ID NO: 51106 - protein, 9 aa, Homo Sapiens
MTIMNKKVR

SEQ ID NO: 51107 - protein, 9 aa, Homo Sapiens
KDIDLLRTT

SEQ ID NO: 51108 - protein, 9 aa, Homo Sapiens
YSYLRQLFH

SEQ ID NO: 51109 - protein, 9 aa, Homo Sapiens
TWKTVRNKL

SEQ ID NO: 51110 - protein, 9 aa, Homo Sapiens
ISESKMENE

SEQ ID NO: 51111 - protein, 9 aa, Homo Sapiens
CDGNFCNVF

SEQ ID NO: 51112 - protein, 9 aa, Homo Sapiens
YEVRSGGTI

SEQ ID NO: 51113 - protein, 9 aa, Homo Sapiens
KDTVWQLPM

SEQ ID NO: 51114 - protein, 9 aa, Homo Sapiens
VDLETKDTV

SEQ ID NO: 51115 - protein, 9 aa, Homo Sapiens
MHSLKWDQP

SEQ ID NO: 51116 - protein, 9 aa, Homo Sapiens
DSRLVIDTK

SEQ ID NO: 51117 - protein, 9 aa, Homo Sapiens
ESKMENESL

SEQ ID NO: 51118 - protein, 9 aa, Homo Sapiens
TLAEMYQPS

SEQ ID NO: 51119 - protein, 9 aa, Homo Sapiens
LVLLKTREE

SEQ ID NO: 51120 - protein, 9 aa, Homo Sapiens
KFFGQSIRG

SEQ ID NO: 51121 - protein, 9 aa, Homo Sapiens
GASPDAMQV

SEQ ID NO: 51122 - protein, 9 aa, Homo Sapiens
LRYAQTQAT

SEQ ID NO: 51123 - protein, 9 aa, Homo Sapiens
LEVGFAMAI

SEQ ID NO: 51124 - protein, 9 aa, Homo Sapiens
TIVENGVHK

SEQ ID NO: 51125 - protein, 9 aa, Homo Sapiens
GFPPITRTS

SEQ ID NO: 51126 - protein, 9 aa, Homo Sapiens
AVGAFLLPA

SEQ ID NO: 51127 - protein, 9 aa, Homo Sapiens
VLLKTREEV

SEQ ID NO: 51128 - protein, 9 aa, Homo Sapiens
KTREEVLQL

SEQ ID NO: 51129 - protein, 9 aa, Homo Sapiens
WNHLESPET

SEQ ID NO: 51130 - protein, 9 aa, Homo Sapiens
FAVGAFLLP

SEQ ID NO: 51131 - protein, 9 aa, Homo Sapiens
GQSIRGEMD

SEQ ID NO: 51132 - protein, 9 aa, Homo Sapiens
GYEPIRKGQ

SEQ ID NO: 51133 - protein, 9 aa, Homo Sapiens
TRRHRGEKK

SEQ ID NO: 51134 - protein, 9 aa, Homo Sapiens
DAMQVGKGA

SEQ ID NO: 51135 - protein, 9 aa, Homo Sapiens
VRRRYLPGI

SEQ ID NO: 51136 - protein, 9 aa, Homo Sapiens
GIYLEADVR

SEQ ID NO: 51137 - protein, 9 aa, Homo Sapiens
EMTAKADKL

SEQ ID NO: 51138 - protein, 9 aa, Homo Sapiens
TLSTPSGDT

SEQ ID NO: 51139 - protein, 9 aa, Homo Sapiens
FLSDAIPGQ

SEQ ID NO: 51140 - protein, 9 aa, Homo Sapiens
SLRRWQMLL

SEQ ID NO: 51141 - protein, 9 aa, Homo Sapiens
VPNPGYEPI

SEQ ID NO: 51142 - protein, 9 aa, Homo Sapiens
YQPSYDSML

SEQ ID NO: 51143 - protein, 9 aa, Homo Sapiens
HIDADSGAI

SEQ ID NO: 51144 - protein, 9 aa, Homo Sapiens
TAKADKLKR

SEQ ID NO: 51145 - protein, 9 aa, Homo Sapiens
SKCQAGFPP

SEQ ID NO: 51146 - protein, 9 aa, Homo Sapiens
QSMRSGAGV

SEQ ID NO: 51147 - protein, 9 aa, Homo Sapiens
RNKLKNHPD

SEQ ID NO: 51148 - protein, 9 aa, Homo Sapiens
SVYQHSKYS

SEQ ID NO: 51149 - protein, 9 aa, Homo Sapiens
LKFFGQSIR

SEQ ID NO: 51150 - protein, 9 aa, Homo Sapiens
LALDTIYQI

SEQ ID NO: 51151 - protein, 9 aa, Homo Sapiens
DNLPQFHID

SEQ ID NO: 51152 - protein, 9 aa, Homo Sapiens
SMRSGAGVQ

SEQ ID NO: 51153 - protein, 9 aa, Homo Sapiens
VLEVGFAMA

SEQ ID NO: 51154 - protein, 9 aa, Homo Sapiens
MRSGAGVQA

SEQ ID NO: 51155 - protein, 9 aa, Homo Sapiens
KPGPRVKGP

SEQ ID NO: 51156 - protein, 9 aa, Homo Sapiens
MISESKMEN

SEQ ID NO: 51157 - protein, 9 aa, Homo Sapiens
RDLVLLKTR

SEQ ID NO: 51158 - protein, 9 aa, Homo Sapiens
DEFLKLLGI

SEQ ID NO: 51159 - protein, 9 aa, Homo Sapiens
APPAPTRRH

SEQ ID NO: 51160 - protein, 9 aa, Homo Sapiens
LLSRLAYPV

SEQ ID NO: 51161 - protein, 9 aa, Homo Sapiens
QATGGKKVI

SEQ ID NO: 51162 - protein, 9 aa, Homo Sapiens
GGASPDAMQ

SEQ ID NO: 51163 - protein, 9 aa, Homo Sapiens
PVPNPGYEP

SEQ ID NO: 51164 - protein, 9 aa, Homo Sapiens
HGKDIDLLR

SEQ ID NO: 51165 - protein, 9 aa, Homo Sapiens
PVGKYHIQA

SEQ ID NO: 51166 - protein, 9 aa, Homo Sapiens
YPVSLCGAL

SEQ ID NO: 51167 - protein, 9 aa, Homo Sapiens
MRALRDVNI

SEQ ID NO: 51168 - protein, 9 aa, Homo Sapiens
SRLAYPVSL

SEQ ID NO: 51169 - protein, 9 aa, Homo Sapiens
SESKMENES

SEQ ID NO: 51170 - protein, 9 aa, Homo Sapiens
IYLEADVRL

SEQ ID NO: 51171 - protein, 9 aa, Homo Sapiens
AYPVSLCGA

SEQ ID NO: 51172 - protein, 9 aa, Homo Sapiens
KGPPQANRN

SEQ ID NO: 51173 - protein, 9 aa, Homo Sapiens
STLSTPSGD

SEQ ID NO: 51174 - protein, 9 aa, Homo Sapiens
PSGDTSTPL

SEQ ID NO: 51175 - protein, 9 aa, Homo Sapiens
ASAAEARSM

SEQ ID NO: 51176 - protein, 9 aa, Homo Sapiens
EQLGSKRMH

SEQ ID NO: 51177 - protein, 9 aa, Homo Sapiens
KYSKCQAGF

SEQ ID NO: 51178 - protein, 9 aa, Homo Sapiens
MQNIHGKDI

SEQ ID NO: 51179 - protein, 9 aa, Homo Sapiens
GKDIDLLRT

SEQ ID NO: 51180 - protein, 9 aa, Homo Sapiens
LESPETSRL

SEQ ID NO: 51181 - protein, 9 aa, Homo Sapiens
LAEMYQPSY

SEQ ID NO: 51182 - protein, 9 aa, Homo Sapiens
DAIPGQKIN

SEQ ID NO: 51183 - protein, 9 aa, Homo Sapiens
EDFSGSFSS

SEQ ID NO: 51184 - protein, 9 aa, Homo Sapiens
GRQGTGWKL

SEQ ID NO: 51185 - protein, 9 aa, Homo Sapiens
RPHLALDTI

SEQ ID NO: 51186 - protein, 9 aa, Homo Sapiens
PKTTQSMRS

SEQ ID NO: 51187 - protein, 9 aa, Homo Sapiens
QACTTTPCM

SEQ ID NO: 51188 - protein, 9 aa, Homo Sapiens
TREEVLQLS

SEQ ID NO: 51189 - protein, 9 aa, Homo Sapiens
GRVLEVGFA

SEQ ID NO: 51190 - protein, 9 aa, Homo Sapiens
EASTLSTPS

SEQ ID NO: 51191 - protein, 9 aa, Homo Sapiens
HIQACTTTP

SEQ ID NO: 51192 - protein, 9 aa, Homo Sapiens
AAHWNHLES

SEQ ID NO: 51193 - protein, 9 aa, Homo Sapiens
NLPQFHIDA

SEQ ID NO: 51194 - protein, 9 aa, Homo Sapiens
IFSKDKDII

SEQ ID NO: 51195 - protein, 9 aa, Homo Sapiens
KKVRVLLVV

SEQ ID NO: 51196 - protein, 9 aa, Homo Sapiens
LLEMTAKAD

SEQ ID NO: 51197 - protein, 9 aa, Homo Sapiens
PGYEPIRKG

SEQ ID NO: 51198 - protein, 9 aa, Homo Sapiens
LSERTSVYQ

SEQ ID NO: 51199 - protein, 9 aa, Homo Sapiens
PQFHIDADS

SEQ ID NO: 51200 - protein, 9 aa, Homo Sapiens
LFHNLFHRQ

SEQ ID NO: 51201 - protein, 9 aa, Homo Sapiens
LVIDTKFHT

SEQ ID NO: 51202 - protein, 9 aa, Homo Sapiens
SGAGVQAAH

SEQ ID NO: 51203 - protein, 9 aa, Homo Sapiens
LLKTREEVL

SEQ ID NO: 51204 - protein, 9 aa, Homo Sapiens
SGSFSSSGK

SEQ ID NO: 51205 - protein, 9 aa, Homo Sapiens
TVRNKLKNH

SEQ ID NO: 51206 - protein, 9 aa, Homo Sapiens
LEMTAKADK

SEQ ID NO: 51207 - protein, 9 aa, Homo Sapiens
IHGKDIDLL

SEQ ID NO: 51208 - protein, 9 aa, Homo Sapiens
YLRQLFHNL

SEQ ID NO: 51209 - protein, 9 aa, Homo Sapiens
VIDTKFHTN

SEQ ID NO: 51210 - protein, 9 aa, Homo Sapiens
PAPTRRHRG

SEQ ID NO: 51211 - protein, 9 aa, Homo Sapiens
SPETSRLSE

SEQ ID NO: 51212 - protein, 9 aa, Homo Sapiens
IMNKKVRVL

SEQ ID NO: 51213 - protein, 9 aa, Homo Sapiens
NHLESPETS

SEQ ID NO: 51214 - protein, 9 aa, Homo Sapiens
HPKTIFSKD

SEQ ID NO: 51215 - protein, 9 aa, Homo Sapiens
TILVRRRYL

SEQ ID NO: 51216 - protein, 9 aa, Homo Sapiens
QGTGWKLVK

SEQ ID NO: 51217 - protein, 9 aa, Homo Sapiens
VYQHSKYSK

SEQ ID NO: 51218 - protein, 9 aa, Homo Sapiens
MCKYTSSRF

SEQ ID NO: 51219 - protein, 9 aa, Homo Sapiens
VRSGGTIVE

SEQ ID NO: 51220 - protein, 9 aa, Homo Sapiens
ESPETSRLS

SEQ ID NO: 51221 - protein, 9 aa, Homo Sapiens
YHATWKTVR

SEQ ID NO: 51222 - protein, 9 aa, Homo Sapiens
QVGKGASPF

SEQ ID NO: 51223 - protein, 9 aa, Homo Sapiens
SKMENESLN

SEQ ID NO: 51224 - protein, 9 aa, Homo Sapiens
EKNYDEFLK

SEQ ID NO: 51225 - protein, 9 aa, Homo Sapiens
HQEDFSGSF

SEQ ID NO: 51226 - protein, 9 aa, Homo Sapiens
SRLVIDTKF

SEQ ID NO: 51227 - protein, 9 aa, Homo Sapiens
TKDTVWQLP

SEQ ID NO: 51228 - protein, 9 aa, Homo Sapiens
RQLFHNLFH

SEQ ID NO: 51229 - protein, 9 aa, Homo Sapiens
GPRVKGPPQ

SEQ ID NO: 51230 - protein, 9 aa, Homo Sapiens
RMHSLKWDQ

SEQ ID NO: 51231 - protein, 9 aa, Homo Sapiens
DEHPKTIFS

SEQ ID NO: 51232 - protein, 9 aa, Homo Sapiens
GKYHIQACT

SEQ ID NO: 51233 - protein, 9 aa, Homo Sapiens
KNYDEFLKL

SEQ ID NO: 51234 - protein, 9 aa, Homo Sapiens
GSKRMHSLK

SEQ ID NO: 51235 - protein, 9 aa, Homo Sapiens
RSGAGVQAA

SEQ ID NO: 51236 - protein, 9 aa, Homo Sapiens
TTQSMRSGA

SEQ ID NO: 51237 - protein, 9 aa, Homo Sapiens
RTSVYQHSK

SEQ ID NO: 51238 - protein, 9 aa, Homo Sapiens
LETKDTVWQ

SEQ ID NO: 51239 - protein, 9 aa, Homo Sapiens
RWQMLLLET

SEQ ID NO: 51240 - protein, 9 aa, Homo Sapiens
FFGQSIRGE

SEQ ID NO: 51241 - protein, 9 aa, Homo Sapiens
FHIDADSGA

SEQ ID NO: 51242 - protein, 9 aa, Homo Sapiens
NSTLAEMYQ

SEQ ID NO: 51243 - protein, 9 aa, Homo Sapiens
SGIYLEADV

SEQ ID NO: 51244 - protein, 9 aa, Homo Sapiens
EVRSGGTIV

SEQ ID NO: 51245 - protein, 9 aa, Homo Sapiens
LPLALGLPI

SEQ ID NO: 51246 - protein, 9 aa, Homo Sapiens
GMASLILKP

SEQ ID NO: 51247 - protein, 9 aa, Homo Sapiens
KIPNLVPEG

SEQ ID NO: 51248 - protein, 9 aa, Homo Sapiens
MNHFLYNLK

SEQ ID NO: 51249 - protein, 9 aa, Homo Sapiens
IILQTYRTI

SEQ ID NO: 51250 - protein, 9 aa, Homo Sapiens
DLLRHQRTH

SEQ ID NO: 51251 - protein, 9 aa, Homo Sapiens
ILQTYRTIA

SEQ ID NO: 51252 - protein, 9 aa, Homo Sapiens
FTFSFPCYQ

SEQ ID NO: 51253 - protein, 9 aa, Homo Sapiens
LEEGNKELM

SEQ ID NO: 51254 - protein, 9 aa, Homo Sapiens
RLDAHGEFG

SEQ ID NO: 51255 - protein, 9 aa, Homo Sapiens
AGLRLPLAV

SEQ ID NO: 51256 - protein, 9 aa, Homo Sapiens
ISFMFNGTS

SEQ ID NO: 51257 - protein, 9 aa, Homo Sapiens
PLALGLPIT

SEQ ID NO: 51258 - protein, 9 aa, Homo Sapiens
GARDWTISR

SEQ ID NO: 51259 - protein, 9 aa, Homo Sapiens
GGKGRTGVM

SEQ ID NO: 51260 - protein, 9 aa, Homo Sapiens
ILVILQEAY

SEQ ID NO: 51261 - protein, 9 aa, Homo Sapiens
LEILKVIGR

SEQ ID NO: 51262 - protein, 9 aa, Homo Sapiens
EWDARESII

SEQ ID NO: 51263 - protein, 9 aa, Homo Sapiens
NLVPEGSVD

SEQ ID NO: 51264 - protein, 9 aa, Homo Sapiens
SKGRIQRQH

SEQ ID NO: 51265 - protein, 9 aa, Homo Sapiens
ELTRLDAHG

SEQ ID NO: 51266 - protein, 9 aa, Homo Sapiens
IQRQHEITG

SEQ ID NO: 51267 - protein, 9 aa, Homo Sapiens
SLVIVSGVT

SEQ ID NO: 51268 - protein, 9 aa, Homo Sapiens
VDLMLLANL

SEQ ID NO: 51269 - protein, 9 aa, Homo Sapiens
PASLETSIL

SEQ ID NO: 51270 - protein, 9 aa, Homo Sapiens
ARESIIRKV

SEQ ID NO: 51271 - protein, 9 aa, Homo Sapiens
VPEGSVDGD

SEQ ID NO: 51272 - protein, 9 aa, Homo Sapiens
DKSDLLRHQ

SEQ ID NO: 51273 - protein, 9 aa, Homo Sapiens
YKLTFTEAQ

SEQ ID NO: 51274 - protein, 9 aa, Homo Sapiens
WDARESIIR

SEQ ID NO: 51275 - protein, 9 aa, Homo Sapiens
VFYITVIIM

SEQ ID NO: 51276 - protein, 9 aa, Homo Sapiens
DDVGNSVHE

SEQ ID NO: 51277 - protein, 9 aa, Homo Sapiens
TTLSGALAT

SEQ ID NO: 51278 - protein, 9 aa, Homo Sapiens
PIILQTYRT

SEQ ID NO: 51279 - protein, 9 aa, Homo Sapiens
LVIVSGVTA

SEQ ID NO: 51280 - protein, 9 aa, Homo Sapiens
EGNKELMKE

SEQ ID NO: 51281 - protein, 9 aa, Homo Sapiens
PKCLHQLPP

SEQ ID NO: 51282 - protein, 9 aa, Homo Sapiens
ALATVSRNP

SEQ ID NO: 51283 - protein, 9 aa, Homo Sapiens
KEEWDARES

SEQ ID NO: 51284 - protein, 9 aa, Homo Sapiens
GKIPNLVPE

SEQ ID NO: 51285 - protein, 9 aa, Homo Sapiens
YPERESNQE

SEQ ID NO: 51286 - protein, 9 aa, Homo Sapiens
NKRCRHGAT

SEQ ID NO: 51287 - protein, 9 aa, Homo Sapiens
PLMQRMNSH

SEQ ID NO: 51288 - protein, 9 aa, Homo Sapiens
SFPCYQTKL

SEQ ID NO: 51289 - protein, 9 aa, Homo Sapiens
PKMNHFLYN

SEQ ID NO: 51290 - protein, 9 aa, Homo Sapiens
AAVDLMLLA

SEQ ID NO: 51291 - protein, 9 aa, Homo Sapiens
RLKHKVAER

SEQ ID NO: 51292 - protein, 9 aa, Homo Sapiens
DFDNEEILT

SEQ ID NO: 51293 - protein, 9 aa, Homo Sapiens
DTDGLGSVE

SEQ ID NO: 51294 - protein, 9 aa, Homo Sapiens
DSCVQDAAA

SEQ ID NO: 51295 - protein, 9 aa, Homo Sapiens
ESIIRKVVD

SEQ ID NO: 51296 - protein, 9 aa, Homo Sapiens
HVAAIHCKG

SEQ ID NO: 51297 - protein, 9 aa, Homo Sapiens
PFITVDEPE

SEQ ID NO: 51298 - protein, 9 aa, Homo Sapiens
KGARDWTIS

SEQ ID NO: 51299 - protein, 9 aa, Homo Sapiens
VIYPERESN

SEQ ID NO: 51300 - protein, 9 aa, Homo Sapiens
ATTLSGALA

SEQ ID NO: 51301 - protein, 9 aa, Homo Sapiens
EAIPPKMNH

SEQ ID NO: 51302 - protein, 9 aa, Homo Sapiens
HVLAALPAA

SEQ ID NO: 51303 - protein, 9 aa, Homo Sapiens
DERMLCFLD

SEQ ID NO: 51304 - protein, 9 aa, Homo Sapiens
PITALLLLM

SEQ ID NO: 51305 - protein, 9 aa, Homo Sapiens
LPEPLLLHV

SEQ ID NO: 51306 - protein, 9 aa, Homo Sapiens
NSVHELEKS

SEQ ID NO: 51307 - protein, 9 aa, Homo Sapiens
YAVDERMLC

SEQ ID NO: 51308 - protein, 9 aa, Homo Sapiens
SQVKLETRQ

SEQ ID NO: 51309 - protein, 9 aa, Homo Sapiens
QIYPLMQRM

SEQ ID NO: 51310 - protein, 9 aa, Homo Sapiens
VRSRLKHKV

SEQ ID NO: 51311 - protein, 9 aa, Homo Sapiens
VGAAVDLML

SEQ ID NO: 51312 - protein, 9 aa, Homo Sapiens
LKDPFITVD

SEQ ID NO: 51313 - protein, 9 aa, Homo Sapiens
GATSLGSKM

SEQ ID NO: 51314 - protein, 9 aa, Homo Sapiens
RGFRDKSDL

SEQ ID NO: 51315 - protein, 9 aa, Homo Sapiens
PERKTSQVK

SEQ ID NO: 51316 - protein, 9 aa, Homo Sapiens
HFLYNLKEN

SEQ ID NO: 51317 - protein, 9 aa, Homo Sapiens
GGRYKLTFT

SEQ ID NO: 51318 - protein, 9 aa, Homo Sapiens
KMNHFLYNL

SEQ ID NO: 51319 - protein, 9 aa, Homo Sapiens
RTIANYEKT

SEQ ID NO: 51320 - protein, 9 aa, Homo Sapiens
EVIYPERES

SEQ ID NO: 51321 - protein, 9 aa, Homo Sapiens
RYKLTFTEA

SEQ ID NO: 51322 - protein, 9 aa, Homo Sapiens
SGVTAEEKK

SEQ ID NO: 51323 - protein, 9 aa, Homo Sapiens
LYLLRAGLR

SEQ ID NO: 51324 - protein, 9 aa, Homo Sapiens
AIPPKMNHF

SEQ ID NO: 51325 - protein, 9 aa, Homo Sapiens
LCLRYIPQL

SEQ ID NO: 51326 - protein, 9 aa, Homo Sapiens
DLKDPFITV

SEQ ID NO: 51327 - protein, 9 aa, Homo Sapiens
VDERMLCFL

SEQ ID NO: 51328 - protein, 9 aa, Homo Sapiens
LTFTEAQRA

SEQ ID NO: 51329 - protein, 9 aa, Homo Sapiens
YDEPSCQVI

SEQ ID NO: 51330 - protein, 9 aa, Homo Sapiens
MLLANLRLT

SEQ ID NO: 51331 - protein, 9 aa, Homo Sapiens
QPTCAKVGN

SEQ ID NO: 51332 - protein, 9 aa, Homo Sapiens
KNDDFDNEE

SEQ ID NO: 51333 - protein, 9 aa, Homo Sapiens
VPVPIFSDS

SEQ ID NO: 51334 - protein, 9 aa, Homo Sapiens
ASIQIYPLM

SEQ ID NO: 51335 - protein, 9 aa, Homo Sapiens
NHFLYNLKE

SEQ ID NO: 51336 - protein, 9 aa, Homo Sapiens
PEPLLLHVL

SEQ ID NO: 51337 - protein, 9 aa, Homo Sapiens
GLRLPLAVA

SEQ ID NO: 51338 - protein, 9 aa, Homo Sapiens
EGRAGMASL

SEQ ID NO: 51339 - protein, 9 aa, Homo Sapiens
VGNSVHELE

SEQ ID NO: 51340 - protein, 9 aa, Homo Sapiens
DEPSCQVIL

SEQ ID NO: 51341 - protein, 9 aa, Homo Sapiens
IDVPVPIFS

SEQ ID NO: 51342 - protein, 9 aa, Homo Sapiens
DRLCLRYIP

SEQ ID NO: 51343 - protein, 9 aa, Homo Sapiens
FDNEEILTY

SEQ ID NO: 51344 - protein, 9 aa, Homo Sapiens
NKNDDFDNE

SEQ ID NO: 51345 - protein, 9 aa, Homo Sapiens
VLPLALGLP

SEQ ID NO: 51346 - protein, 9 aa, Homo Sapiens
EDLEILKVI

SEQ ID NO: 51347 - protein, 9 aa, Homo Sapiens
ERMLCFLDD

SEQ ID NO: 51348 - protein, 9 aa, Homo Sapiens
YPLMQRMNS

SEQ ID NO: 51349 - protein, 9 aa, Homo Sapiens
LLEEGNKEL

SEQ ID NO: 51350 - protein, 9 aa, Homo Sapiens
GAVGISFMF

SEQ ID NO: 51351 - protein, 9 aa, Homo Sapiens
SSKYDEPSC

SEQ ID NO: 51352 - protein, 9 aa, Homo Sapiens
NANKNDDFD

SEQ ID NO: 51353 - protein, 9 aa, Homo Sapiens
KGAVGISFM

SEQ ID NO: 51354 - protein, 9 aa, Homo Sapiens
SLILKPNTS

SEQ ID NO: 51355 - protein, 9 aa, Homo Sapiens
LTRLDAHGE

SEQ ID NO: 51356 - protein, 9 aa, Homo Sapiens
ATSPENAGP

SEQ ID NO: 51357 - protein, 9 aa, Homo Sapiens
PLLLHVLAA

SEQ ID NO: 51358 - protein, 9 aa, Homo Sapiens
PCYQTKLDE

SEQ ID NO: 51359 - protein, 9 aa, Homo Sapiens
HVGAAVDLM

SEQ ID NO: 51360 - protein, 9 aa, Homo Sapiens
NSDRLCLRY

SEQ ID NO: 51361 - protein, 9 aa, Homo Sapiens
DARESIIRK

SEQ ID NO: 51362 - protein, 9 aa, Homo Sapiens
RDKSDLLRH

SEQ ID NO: 51363 - protein, 9 aa, Homo Sapiens
VPIFSDSDP

SEQ ID NO: 51364 - protein, 9 aa, Homo Sapiens
QQATSPENA

SEQ ID NO: 51365 - protein, 9 aa, Homo Sapiens
LGLWEQASI

SEQ ID NO: 51366 - protein, 9 aa, Homo Sapiens
WLKGARDWT

SEQ ID NO: 51367 - protein, 9 aa, Homo Sapiens
KEDLLEEGN

SEQ ID NO: 51368 - protein, 9 aa, Homo Sapiens
YNANKNDDF

SEQ ID NO: 51369 - protein, 9 aa, Homo Sapiens
GSVEAAAPP

SEQ ID NO: 51370 - protein, 9 aa, Homo Sapiens
LALGLPITA

SEQ ID NO: 51371 - protein, 9 aa, Homo Sapiens
VSGVTAEEK

SEQ ID NO: 51372 - protein, 9 aa, Homo Sapiens
YNSDRLCLR

SEQ ID NO: 51373 - protein, 9 aa, Homo Sapiens
DEPDLKDPF

SEQ ID NO: 51374 - protein, 9 aa, Homo Sapiens
VTAEEKKVK

SEQ ID NO: 51375 - protein, 9 aa, Homo Sapiens
CRHGATSLG

SEQ ID NO: 51376 - protein, 9 aa, Homo Sapiens
LVPEGSVDG

SEQ ID NO: 51377 - protein, 9 aa, Homo Sapiens
REDLEILKV

SEQ ID NO: 51378 - protein, 9 aa, Homo Sapiens
KIIEVIYPE

SEQ ID NO: 51379 - protein, 9 aa, Homo Sapiens
GFRDKSDLL

SEQ ID NO: 51380 - protein, 9 aa, Homo Sapiens
FYDPQQDDG

SEQ ID NO: 51381 - protein, 9 aa, Homo Sapiens
MASLILKPN

SEQ ID NO: 51382 - protein, 9 aa, Homo Sapiens
KVGNAQFKG

SEQ ID NO: 51383 - protein, 9 aa, Homo Sapiens
ASISQGFRN

SEQ ID NO: 51384 - protein, 9 aa, Homo Sapiens
PDLKDPFIT

SEQ ID NO: 51385 - protein, 9 aa, Homo Sapiens
ASPSPQRHG

SEQ ID NO: 51386 - protein, 9 aa, Homo Sapiens
LATVSRNPL

SEQ ID NO: 51387 - protein, 9 aa, Homo Sapiens
ILQEAYKQQ

SEQ ID NO: 51388 - protein, 9 aa, Homo Sapiens
RCRHGATSL

SEQ ID NO: 51389 - protein, 9 aa, Homo Sapiens
TSILYLRDQ

SEQ ID NO: 51390 - protein, 9 aa, Homo Sapiens
LIAIFVFYI

SEQ ID NO: 51391 - protein, 9 aa, Homo Sapiens
IYPERESNQ

SEQ ID NO: 51392 - protein, 9 aa, Homo Sapiens
PPKIIEVIY

SEQ ID NO: 51393 - protein, 9 aa, Homo Sapiens
DVGNSVHEL

SEQ ID NO: 51394 - protein, 9 aa, Homo Sapiens
RMLCFLDDF

SEQ ID NO: 51395 - protein, 9 aa, Homo Sapiens
SCVQDAAAL

SEQ ID NO: 51396 - protein, 9 aa, Homo Sapiens
YQTKLDESF

SEQ ID NO: 51397 - protein, 9 aa, Homo Sapiens
SPSPQRHGG

SEQ ID NO: 51398 - protein, 9 aa, Homo Sapiens
AQPLGELTR

SEQ ID NO: 51399 - protein, 9 aa, Homo Sapiens
EEGNKELMK

SEQ ID NO: 51400 - protein, 9 aa, Homo Sapiens
EDLLEEGNK

SEQ ID NO: 51401 - protein, 9 aa, Homo Sapiens
NRDSCVQDA

SEQ ID NO: 51402 - protein, 9 aa, Homo Sapiens
RYIPQLTDE

SEQ ID NO: 51403 - protein, 9 aa, Homo Sapiens
RLCLRYIPQ

SEQ ID NO: 51404 - protein, 9 aa, Homo Sapiens
TIANYEKTS

SEQ ID NO: 51405 - protein, 9 aa, Homo Sapiens
IIDVPVPIF

SEQ ID NO: 51406 - protein, 9 aa, Homo Sapiens
DDFDNEEIL

SEQ ID NO: 51407 - protein, 9 aa, Homo Sapiens
NWLKGARDW

SEQ ID NO: 51408 - protein, 9 aa, Homo Sapiens
CYQTKLDES

SEQ ID NO: 51409 - protein, 9 aa, Homo Sapiens
RQMILVILQ

SEQ ID NO: 51410 - protein, 9 aa, Homo Sapiens
DNIIVSELQ

SEQ ID NO: 51411 - protein, 9 aa, Homo Sapiens
LRAGLRLPL

SEQ ID NO: 51412 - protein, 9 aa, Homo Sapiens
KCLHQLPPD

SEQ ID NO: 51413 - protein, 9 aa, Homo Sapiens
HGGWSTDGG

SEQ ID NO: 51414 - protein, 9 aa, Homo Sapiens
ENGFYDPQQ

SEQ ID NO: 51415 - protein, 9 aa, Homo Sapiens
QRHGGWSTD

SEQ ID NO: 51416 - protein, 9 aa, Homo Sapiens
RCENGFYDP

SEQ ID NO: 51417 - protein, 9 aa, Homo Sapiens
IIVSELQFV

SEQ ID NO: 51418 - protein, 9 aa, Homo Sapiens
GLPITALLL

SEQ ID NO: 51419 - protein, 9 aa, Homo Sapiens
KLTFTEAQR

SEQ ID NO: 51420 - protein, 9 aa, Homo Sapiens
GSHLIAIFV

SEQ ID NO: 51421 - protein, 9 aa, Homo Sapiens
NIIVSELQF

SEQ ID NO: 51422 - protein, 9 aa, Homo Sapiens
GRGFRDKSD

SEQ ID NO: 51423 - protein, 9 aa, Homo Sapiens
HREDLEILK

SEQ ID NO: 51424 - protein, 9 aa, Homo Sapiens
RHGATSLGS

SEQ ID NO: 51425 - protein, 9 aa, Homo Sapiens
PLGELTRLD

SEQ ID NO: 51426 - protein, 9 aa, Homo Sapiens
LPITALLLL

SEQ ID NO: 51427 - protein, 9 aa, Homo Sapiens
GRYKLTFTE

SEQ ID NO: 51428 - protein, 9 aa, Homo Sapiens
LCFLDDFES

SEQ ID NO: 51429 - protein, 9 aa, Homo Sapiens
DLLEEGNKE

SEQ ID NO: 51430 - protein, 9 aa, Homo Sapiens
IPPKMNHFL

SEQ ID NO: 51431 - protein, 9 aa, Homo Sapiens
RKTSQVKLE

SEQ ID NO: 51432 - protein, 9 aa, Homo Sapiens
KVRSRLKHK

SEQ ID NO: 51433 - protein, 9 aa, Homo Sapiens
QMRLHREDL

SEQ ID NO: 51434 - protein, 9 aa, Homo Sapiens
NKGAVGISF

SEQ ID NO: 51435 - protein, 9 aa, Homo Sapiens
QMILVILQE

SEQ ID NO: 51436 - protein, 9 aa, Homo Sapiens
VNRDSCVQD

SEQ ID NO: 51437 - protein, 9 aa, Homo Sapiens
LQFVESSGG

SEQ ID NO: 51438 - protein, 9 aa, Homo Sapiens
CKNCFKPKC

SEQ ID NO: 51439 - protein, 9 aa, Homo Sapiens
DVPVPIFSD

SEQ ID NO: 51440 - protein, 9 aa, Homo Sapiens
LHREDLEIL

SEQ ID NO: 51441 - protein, 9 aa, Homo Sapiens
KRCRHGATS

SEQ ID NO: 51442 - protein, 9 aa, Homo Sapiens
VILQEAYKQ

SEQ ID NO: 51443 - protein, 9 aa, Homo Sapiens
AGMASLILK

SEQ ID NO: 51444 - protein, 9 aa, Homo Sapiens
SRLKHKVAE

SEQ ID NO: 51445 - protein, 9 aa, Homo Sapiens
KRFGNWLKG

SEQ ID NO: 51446 - protein, 9 aa, Homo Sapiens
FGNWLKGAR

SEQ ID NO: 51447 - protein, 9 aa, Homo Sapiens
AVGISFMFN

SEQ ID NO: 51448 - protein, 9 aa, Homo Sapiens
QATSPENAG

SEQ ID NO: 51449 - protein, 9 aa, Homo Sapiens
EGHRCENGF

SEQ ID NO: 51450 - protein, 9 aa, Homo Sapiens
HEITGKKTT

SEQ ID NO: 51451 - protein, 9 aa, Homo Sapiens
EQPTCAKVG

SEQ ID NO: 51452 - protein, 9 aa, Homo Sapiens
GNKGAVGIS

SEQ ID NO: 51453 - protein, 9 aa, Homo Sapiens
SQRPERKTS

SEQ ID NO: 51454 - protein, 9 aa, Homo Sapiens
GNKELMKEY

SEQ ID NO: 51455 - protein, 9 aa, Homo Sapiens
RAGMASLIL

SEQ ID NO: 51456 - protein, 9 aa, Homo Sapiens
LKVRSRLKH

SEQ ID NO: 51457 - protein, 9 aa, Homo Sapiens
MGIPQQATS

SEQ ID NO: 51458 - protein, 9 aa, Homo Sapiens
PQQATSPEN

SEQ ID NO: 51459 - protein, 9 aa, Homo Sapiens
HGATSLGSK

SEQ ID NO: 51460 - protein, 9 aa, Homo Sapiens
GRIQRQHEI

SEQ ID NO: 51461 - protein, 9 aa, Homo Sapiens
EDNIIVSEL

SEQ ID NO: 51462 - protein, 9 aa, Homo Sapiens
GIPQQATSP

SEQ ID NO: 51463 - protein, 9 aa, Homo Sapiens
GNSVHELEK

SEQ ID NO: 51464 - protein, 9 aa, Homo Sapiens
LGSVEAAAP

SEQ ID NO: 51465 - protein, 9 aa, Homo Sapiens
IVSELQFVE

SEQ ID NO: 51466 - protein, 9 aa, Homo Sapiens
RIQRQHEIT

SEQ ID NO: 51467 - protein, 9 aa, Homo Sapiens
LMLLANLRL

SEQ ID NO: 51468 - protein, 9 aa, Homo Sapiens
SELQFVESS

SEQ ID NO: 51469 - protein, 9 aa, Homo Sapiens
TSQVKLETR

SEQ ID NO: 51470 - protein, 9 aa, Homo Sapiens
QTYRTIANY

SEQ ID NO: 51471 - protein, 9 aa, Homo Sapiens
TKEEWDARE

SEQ ID NO: 51472 - protein, 9 aa, Homo Sapiens
KSDLLRHQR

SEQ ID NO: 51473 - protein, 9 aa, Homo Sapiens
RDSCVQDAA

SEQ ID NO: 51474 - protein, 9 aa, Homo Sapiens
RQHEITGKK

SEQ ID NO: 51475 - protein, 9 aa, Homo Sapiens
SDLLRHQRT

SEQ ID NO: 51476 - protein, 9 aa, Homo Sapiens
VIVSGVTAE

SEQ ID NO: 51477 - protein, 9 aa, Homo Sapiens
IQIYPLMQR

SEQ ID NO: 51478 - protein, 9 aa, Homo Sapiens
LMQRMNSHS

SEQ ID NO: 51479 - protein, 9 aa, Homo Sapiens
GLYLLRAGL

SEQ ID NO: 51480 - protein, 9 aa, Homo Sapiens
GKEDLLEEG

SEQ ID NO: 51481 - protein, 9 aa, Homo Sapiens
LWEQASISQ

SEQ ID NO: 51482 - protein, 9 aa, Homo Sapiens
DAAALQQQY

SEQ ID NO: 51483 - protein, 9 aa, Homo Sapiens
EPSCQVILE

SEQ ID NO: 51484 - protein, 9 aa, Homo Sapiens
EDEPDLKDP

SEQ ID NO: 51485 - protein, 9 aa, Homo Sapiens
PSCQVILEA

SEQ ID NO: 51486 - protein, 9 aa, Homo Sapiens
SLETSILYL

SEQ ID NO: 51487 - protein, 9 aa, Homo Sapiens
RESIIRKVV

SEQ ID NO: 51488 - protein, 9 aa, Homo Sapiens
LQTYRTIAN

SEQ ID NO: 51489 - protein, 9 aa, Homo Sapiens
PASDTDGLG

SEQ ID NO: 51490 - protein, 9 aa, Homo Sapiens
PNLVPEGSV

SEQ ID NO: 51491 - protein, 9 aa, Homo Sapiens
LLRAGLRLP

SEQ ID NO: 51492 - protein, 9 aa, Homo Sapiens
HKVAERRSS

SEQ ID NO: 51493 - protein, 9 aa, Homo Sapiens
LRYIPQLTD

SEQ ID NO: 51494 - protein, 9 aa, Homo Sapiens
GALATVSRN

SEQ ID NO: 51495 - protein, 9 aa, Homo Sapiens
EMGIPQQAT

SEQ ID NO: 51496 - protein, 9 aa, Homo Sapiens
EPLLLHVLA

SEQ ID NO: 51497 - protein, 9 aa, Homo Sapiens
IEVIYPERE

SEQ ID NO: 51498 - protein, 9 aa, Homo Sapiens
EPDLKDPFI

SEQ ID NO: 51499 - protein, 9 aa, Homo Sapiens
KGGKGRTGV

SEQ ID NO: 51500 - protein, 9 aa, Homo Sapiens
YLLRAGLRL

SEQ ID NO: 51501 - protein, 9 aa, Homo Sapiens
LGNKGAVGI

SEQ ID NO: 51502 - protein, 9 aa, Homo Sapiens
NDDFDNEEI

SEQ ID NO: 51503 - protein, 9 aa, Homo Sapiens
IIEVIYPER

SEQ ID NO: 51504 - protein, 9 aa, Homo Sapiens
AAIHCKGGK

SEQ ID NO: 51505 - protein, 9 aa, Homo Sapiens
GFTFSFPCY

SEQ ID NO: 51506 - protein, 9 aa, Homo Sapiens
AVDERMLCF

SEQ ID NO: 51507 - protein, 9 aa, Homo Sapiens
SCQVILEAL

SEQ ID NO: 51508 - protein, 9 aa, Homo Sapiens
CFLDDFESC

SEQ ID NO: 51509 - protein, 9 aa, Homo Sapiens
VQDAAALQQ

SEQ ID NO: 51510 - protein, 9 aa, Homo Sapiens
TEAQRACAE

SEQ ID NO: 51511 - protein, 9 aa, Homo Sapiens
DGLGSVEAA

SEQ ID NO: 51512 - protein, 9 aa, Homo Sapiens
ELQFVESSG

SEQ ID NO: 51513 - protein, 9 aa, Homo Sapiens
AKVGNAQFK

SEQ ID NO: 51514 - protein, 9 aa, Homo Sapiens
ELPEPLLLH

SEQ ID NO: 51515 - protein, 9 aa, Homo Sapiens
SKDDVGNSV

SEQ ID NO: 51516 - protein, 9 aa, Homo Sapiens
FKPKCLHQL

SEQ ID NO: 51517 - protein, 9 aa, Homo Sapiens
QHEITGKKT

SEQ ID NO: 51518 - protein, 9 aa, Homo Sapiens
IYPLMQRMN

SEQ ID NO: 51519 - protein, 9 aa, Homo Sapiens
KHKVAERRS

SEQ ID NO: 51520 - protein, 9 aa, Homo Sapiens
DPFITVDEP

SEQ ID NO: 51521 - protein, 9 aa, Homo Sapiens
ASLETSILY

SEQ ID NO: 51522 - protein, 9 aa, Homo Sapiens
GNWLKGARD

SEQ ID NO: 51523 - protein, 9 aa, Homo Sapiens
LRLPLAVAL

SEQ ID NO: 51524 - protein, 9 aa, Homo Sapiens
KNCFKPKCL

SEQ ID NO: 51525 - protein, 9 aa, Homo Sapiens
PIFSDSDPA

SEQ ID NO: 51526 - protein, 9 aa, Homo Sapiens
KDPFITVDE

SEQ ID NO: 51527 - protein, 9 aa, Homo Sapiens
TFTEAQRAC

SEQ ID NO: 51528 - protein, 9 aa, Homo Sapiens
NGFYDPQQD

SEQ ID NO: 51529 - protein, 9 aa, Homo Sapiens
SDTDGLGSV

SEQ ID NO: 51530 - protein, 9 aa, Homo Sapiens
GRAGMASLI

SEQ ID NO: 51531 - protein, 9 aa, Homo Sapiens
YRTIANYEK

SEQ ID NO: 51532 - protein, 9 aa, Homo Sapiens
SILYLRDQG

SEQ ID NO: 51533 - protein, 9 aa, Homo Sapiens
AIFVFYITV

SEQ ID NO: 51534 - protein, 9 aa, Homo Sapiens
TFSFPCYQT

SEQ ID NO: 51535 - protein, 9 aa, Homo Sapiens
EQASISQGF

SEQ ID NO: 51536 - protein, 9 aa, Homo Sapiens
ANKNDDFDN

SEQ ID NO: 51537 - protein, 9 aa, Homo Sapiens
PTCAKVGNA

SEQ ID NO: 51538 - protein, 9 aa, Homo Sapiens
KYDEPSCQV

SEQ ID NO: 51539 - protein, 9 aa, Homo Sapiens
LKGARDWTI

SEQ ID NO: 51540 - protein, 9 aa, Homo Sapiens
DLMLLANLR

SEQ ID NO: 51541 - protein, 9 aa, Homo Sapiens
GFYDPQQDD

SEQ ID NO: 51542 - protein, 9 aa, Homo Sapiens
QRQHEITGK

SEQ ID NO: 51543 - protein, 9 aa, Homo Sapiens
CFKPKCLHQ

SEQ ID NO: 51544 - protein, 9 aa, Homo Sapiens
RPERKTSQV

SEQ ID NO: 51545 - protein, 9 aa, Homo Sapiens
AIIDVPVPI

SEQ ID NO: 51546 - protein, 9 aa, Homo Sapiens
RHGGWSTDG

SEQ ID NO: 51547 - protein, 9 aa, Homo Sapiens
KTSQVKLET

SEQ ID NO: 51548 - protein, 9 aa, Homo Sapiens
ASDTDGLGS

SEQ ID NO: 51549 - protein, 9 aa, Homo Sapiens
SIQIYPLMQ

SEQ ID NO: 51550 - protein, 9 aa, Homo Sapiens
TSLGSKMFV

SEQ ID NO: 51551 - protein, 9 aa, Homo Sapiens
PPKMNHFLY

SEQ ID NO: 51552 - protein, 9 aa, Homo Sapiens
RLHREDLEI

SEQ ID NO: 51553 - protein, 9 aa, Homo Sapiens
TCAKVGNAQ

SEQ ID NO: 51554 - protein, 9 aa, Homo Sapiens
VSELQFVES

SEQ ID NO: 51555 - protein, 9 aa, Homo Sapiens
ATSLGSKMF

SEQ ID NO: 51556 - protein, 9 aa, Homo Sapiens
IFSDSDPAA

SEQ ID NO: 51557 - protein, 9 aa, Homo Sapiens
RSRLKHKVA

SEQ ID NO: 51558 - protein, 9 aa, Homo Sapiens
RFGNWLKGA

SEQ ID NO: 51559 - protein, 9 aa, Homo Sapiens
MSSKDDVGN

SEQ ID NO: 51560 - protein, 9 aa, Homo Sapiens
GISFMFNGT

SEQ ID NO: 51561 - protein, 9 aa, Homo Sapiens
FSFPCYQTK

SEQ ID NO: 51562 - protein, 9 aa, Homo Sapiens
LKHKVAERR

SEQ ID NO: 51563 - protein, 9 aa, Homo Sapiens
TDGLGSVEA

SEQ ID NO: 51564 - protein, 9 aa, Homo Sapiens
SSKDDVGNS

SEQ ID NO: 51565 - protein, 9 aa, Homo Sapiens
CLRYIPQLT

SEQ ID NO: 51566 - protein, 9 aa, Homo Sapiens
DLEILKVIG

SEQ ID NO: 51567 - protein, 9 aa, Homo Sapiens
GHRCENGFY

SEQ ID NO: 51568 - protein, 9 aa, Homo Sapiens
GELTRLDAH

SEQ ID NO: 51569 - protein, 9 aa, Homo Sapiens
CQVILEALA

SEQ ID NO: 51570 - protein, 9 aa, Homo Sapiens
SISQGFRNA

SEQ ID NO: 51571 - protein, 9 aa, Homo Sapiens
MILVILQEA

SEQ ID NO: 51572 - protein, 9 aa, Homo Sapiens
LHVLAALPA

SEQ ID NO: 51573 - protein, 9 aa, Homo Sapiens
QPLGELTRL

SEQ ID NO: 51574 - protein, 9 aa, Homo Sapiens
RAGLRLPLA

SEQ ID NO: 51575 - protein, 9 aa, Homo Sapiens
ISQGFRNAA

SEQ ID NO: 51576 - protein, 9 aa, Homo Sapiens
HLIAIFVFY

SEQ ID NO: 51577 - protein, 9 aa, Homo Sapiens
IPNLVPEGS

SEQ ID NO: 51578 - protein, 9 aa, Homo Sapiens
PQRHGGWST

SEQ ID NO: 51579 - protein, 9 aa, Homo Sapiens
LGLPITALL

SEQ ID NO: 51580 - protein, 9 aa, Homo Sapiens
LILKPNTSL

SEQ ID NO: 51581 - protein, 9 aa, Homo Sapiens
FVFYITVII

SEQ ID NO: 51582 - protein, 9 aa, Homo Sapiens
KDDVGNSVH

SEQ ID NO: 51583 - protein, 9 aa, Homo Sapiens
AASPSPQRH

SEQ ID NO: 51584 - protein, 9 aa, Homo Sapiens
KASIQIYPL

SEQ ID NO: 51585 - protein, 9 aa, Homo Sapiens
LLHVLAALP

SEQ ID NO: 51586 - protein, 9 aa, Homo Sapiens
CVQDAAALQ

SEQ ID NO: 51587 - protein, 9 aa, Homo Sapiens
IFVFYITVI

SEQ ID NO: 51588 - protein, 9 aa, Homo Sapiens
VGNAQFKGT

SEQ ID NO: 51589 - protein, 9 aa, Homo Sapiens
QASISQGFR

SEQ ID NO: 51590 - protein, 9 aa, Homo Sapiens
QRPERKTSQ

SEQ ID NO: 51591 - protein, 9 aa, Homo Sapiens
GVTAEEKKV

SEQ ID NO: 51592 - protein, 9 aa, Homo Sapiens
WEQASISQG

SEQ ID NO: 51593 - protein, 9 aa, Homo Sapiens
LETSILYLR

SEQ ID NO: 51594 - protein, 9 aa, Homo Sapiens
CAKVGNAQF

SEQ ID NO: 51595 - protein, 9 aa, Homo Sapiens
PVPIFSDSD

SEQ ID NO: 51596 - protein, 9 aa, Homo Sapiens
SSLVIVSGV

SEQ ID NO: 51597 - protein, 9 aa, Homo Sapiens
SKYDEPSCQ

SEQ ID NO: 51598 - protein, 9 aa, Homo Sapiens
TKGKIPNLV

SEQ ID NO: 51599 - protein, 9 aa, Homo Sapiens
PPPASLETS

SEQ ID NO: 51600 - protein, 9 aa, Homo Sapiens
LGELTRLDA

SEQ ID NO: 51601 - protein, 9 aa, Homo Sapiens
VGISFMFNG

SEQ ID NO: 51602 - protein, 9 aa, Homo Sapiens
MRLHREDLE

SEQ ID NO: 51603 - protein, 9 aa, Homo Sapiens
GNAQFKGTQ

SEQ ID NO: 51604 - protein, 9 aa, Homo Sapiens
SHLIAIFVF

SEQ ID NO: 51605 - protein, 9 aa, Homo Sapiens
GLWEQASIS

SEQ ID NO: 51606 - protein, 9 aa, Homo Sapiens
IPQQATSPE

SEQ ID NO: 51607 - protein, 9 aa, Homo Sapiens
SRQMILVIL

SEQ ID NO: 51608 - protein, 9 aa, Homo Sapiens
IAIFVFYIT

SEQ ID NO: 51609 - protein, 9 aa, Homo Sapiens
GAAVDLMLL

SEQ ID NO: 51610 - protein, 9 aa, Homo Sapiens
ASLILKPNT

SEQ ID NO: 51611 - protein, 9 aa, Homo Sapiens
PSPQRHGGW

SEQ ID NO: 51612 - protein, 9 aa, Homo Sapiens
IVSGVTAEE

SEQ ID NO: 51613 - protein, 9 aa, Homo Sapiens
ERKTSQVKL

SEQ ID NO: 51614 - protein, 9 aa, Homo Sapiens
EEWDARESI

SEQ ID NO: 51615 - protein, 9 aa, Homo Sapiens
ETSILYLRD

SEQ ID NO: 51616 - protein, 9 aa, Homo Sapiens
NEMGIPQQA

SEQ ID NO: 51617 - protein, 9 aa, Homo Sapiens
LVILQEAYK

SEQ ID NO: 51618 - protein, 9 aa, Homo Sapiens
FRDKSDLLR

SEQ ID NO: 51619 - protein, 9 aa, Homo Sapiens
TLSGALATV

SEQ ID NO: 51620 - protein, 9 aa, Homo Sapiens
GLGSVEAAA

SEQ ID NO: 51621 - protein, 9 aa, Homo Sapiens
FTEAQRACA

SEQ ID NO: 51622 - protein, 9 aa, Homo Sapiens
CLHQLPPDP

SEQ ID NO: 51623 - protein, 9 aa, Homo Sapiens
FPCYQTKLD

SEQ ID NO: 51624 - protein, 9 aa, Homo Sapiens
AVDLMLLAN

SEQ ID NO: 51625 - protein, 9 aa, Homo Sapiens
PKIIEVIYP

SEQ ID NO: 51626 - protein, 9 aa, Homo Sapiens
LQEAYKQQN

SEQ ID NO: 51627 - protein, 9 aa, Homo Sapiens
SGALATVSR

SEQ ID NO: 51628 - protein, 9 aa, Homo Sapiens
CENGFYDPQ

SEQ ID NO: 51629 - protein, 9 aa, Homo Sapiens
QDAAALQQQ

SEQ ID NO: 51630 - protein, 9 aa, Homo Sapiens
LLLHVLAAL

SEQ ID NO: 51631 - protein, 9 aa, Homo Sapiens
NCFKPKCLH

SEQ ID NO: 51632 - protein, 9 aa, Homo Sapiens
SPQRHGGWS

SEQ ID NO: 51633 - protein, 9 aa, Homo Sapiens
TRLDAHGEF

SEQ ID NO: 51634 - protein, 9 aa, Homo Sapiens
TYRTIANYE

SEQ ID NO: 51635 - protein, 9 aa, Homo Sapiens
MLCFLDDFE

SEQ ID NO: 51636 - protein, 9 aa, Homo Sapiens
LSGALATVS

SEQ ID NO: 51637 - protein, 9 aa, Homo Sapiens
HRCENGFYD

SEQ ID NO: 51638 - protein, 9 aa, Homo Sapiens
KGRIQRQHE

SEQ ID NO: 51639 - protein, 9 aa, Homo Sapiens
ALGLPITAL

SEQ ID NO: 51640 - protein, 9 aa, Homo Sapiens
KPKCLHQLP

SEQ ID NO: 51641 - protein, 9 aa, Homo Sapiens
PPASLETSI

SEQ ID NO: 51642 - protein, 9 aa, Homo Sapiens
KGKIPNLVP

SEQ ID NO: 51643 - protein, 9 aa, Homo Sapiens
ATVSRNPLE

SEQ ID NO: 51644 - protein, 9 aa, Homo Sapiens
VAAIHCKGG

SEQ ID NO: 51645 - protein, 9 aa, Homo Sapiens
SDRLCLRYI

SEQ ID NO: 51646 - protein, 9 aa, Homo Sapiens
YMLHETAAP

SEQ ID NO: 51647 - protein, 9 aa, Homo Sapiens
DRQCQSSHY

SEQ ID NO: 51648 - protein, 9 aa, Homo Sapiens
IRGVGFVAS

SEQ ID NO: 51649 - protein, 9 aa, Homo Sapiens
ECRPPKSPG

SEQ ID NO: 51650 - protein, 9 aa, Homo Sapiens
SSPVGIPGT

SEQ ID NO: 51651 - protein, 9 aa, Homo Sapiens
PSEGCTPLT

SEQ ID NO: 51652 - protein, 9 aa, Homo Sapiens
TWRKLSRLL

SEQ ID NO: 51653 - protein, 9 aa, Homo Sapiens
KHFIGQHEE

SEQ ID NO: 51654 - protein, 9 aa, Homo Sapiens
DRLGPATEH

SEQ ID NO: 51655 - protein, 9 aa, Homo Sapiens
TGGARGTFH

SEQ ID NO: 51656 - protein, 9 aa, Homo Sapiens
SPGPSHTSN

SEQ ID NO: 51657 - protein, 9 aa, Homo Sapiens
SCATAGTET

SEQ ID NO: 51658 - protein, 9 aa, Homo Sapiens
CRPPKSPGP

SEQ ID NO: 51659 - protein, 9 aa, Homo Sapiens
ISPASASQV

SEQ ID NO: 51660 - protein, 9 aa, Homo Sapiens
SLKDYKEKT

SEQ ID NO: 51661 - protein, 9 aa, Homo Sapiens
SQVAGTTGL

SEQ ID NO: 51662 - protein, 9 aa, Homo Sapiens
NVYHHLTGE

SEQ ID NO: 51663 - protein, 9 aa, Homo Sapiens
NLLTWRKLS

SEQ ID NO: 51664 - protein, 9 aa, Homo Sapiens
LNLLTWRKL

SEQ ID NO: 51665 - protein, 9 aa, Homo Sapiens
YSIPGRGTV

SEQ ID NO: 51666 - protein, 9 aa, Homo Sapiens
LLFMLVMVW

SEQ ID NO: 51667 - protein, 9 aa, Homo Sapiens
AAPSDIVGA

SEQ ID NO: 51668 - protein, 9 aa, Homo Sapiens
HYFQRHLGL

SEQ ID NO: 51669 - protein, 9 aa, Homo Sapiens
HRPECRPPK

SEQ ID NO: 51670 - protein, 9 aa, Homo Sapiens
KGYDLSVDA

SEQ ID NO: 51671 - protein, 9 aa, Homo Sapiens
EFMYPARAP

SEQ ID NO: 51672 - protein, 9 aa, Homo Sapiens
VGPNGDFSS

SEQ ID NO: 51673 - protein, 9 aa, Homo Sapiens
GIRGVGFVA

SEQ ID NO: 51674 - protein, 9 aa, Homo Sapiens
MYPARAPSV

SEQ ID NO: 51675 - protein, 9 aa, Homo Sapiens
TPSEGCTPL

SEQ ID NO: 51676 - protein, 9 aa, Homo Sapiens
KDYKEKTGK

SEQ ID NO: 51677 - protein, 9 aa, Homo Sapiens
GTETGGARG

SEQ ID NO: 51678 - protein, 9 aa, Homo Sapiens
FSPPPTCPR

SEQ ID NO: 51679 - protein, 9 aa, Homo Sapiens
AFVTKNNAL

SEQ ID NO: 51680 - protein, 9 aa, Homo Sapiens
EEDEDRLGP

SEQ ID NO: 51681 - protein, 9 aa, Homo Sapiens
ESFQLVTVH

SEQ ID NO: 51682 - protein, 9 aa, Homo Sapiens
WRKLSRLLD

SEQ ID NO: 51683 - protein, 9 aa, Homo Sapiens
PECRPPKSP

SEQ ID NO: 51684 - protein, 9 aa, Homo Sapiens
DEDRLGPAT

SEQ ID NO: 51685 - protein, 9 aa, Homo Sapiens
GPATEHLRK

SEQ ID NO: 51686 - protein, 9 aa, Homo Sapiens
PSHTSNSSN

SEQ ID NO: 51687 - protein, 9 aa, Homo Sapiens
IRINLVFLS

SEQ ID NO: 51688 - protein, 9 aa, Homo Sapiens
GYKSIRINL

SEQ ID NO: 51689 - protein, 9 aa, Homo Sapiens
SHTSNSSNA

SEQ ID NO: 51690 - protein, 9 aa, Homo Sapiens
RVHTGQRPY

SEQ ID NO: 51691 - protein, 9 aa, Homo Sapiens
LSVDAIPIK

SEQ ID NO: 51692 - protein, 9 aa, Homo Sapiens
VMVWQSVFN

SEQ ID NO: 51693 - protein, 9 aa, Homo Sapiens
DLSVDAIPI

SEQ ID NO: 51694 - protein, 9 aa, Homo Sapiens
GCTPLTSIP

SEQ ID NO: 51695 - protein, 9 aa, Homo Sapiens
ATAGTETGG

SEQ ID NO: 51696 - protein, 9 aa, Homo Sapiens
LCSVFPPHL

SEQ ID NO: 51697 - protein, 9 aa, Homo Sapiens
PKSPGPREK

SEQ ID NO: 51698 - protein, 9 aa, Homo Sapiens
TEFMYPARA

SEQ ID NO: 51699 - protein, 9 aa, Homo Sapiens
GGLETGNSK

SEQ ID NO: 51700 - protein, 9 aa, Homo Sapiens
AAIWKKLVI

SEQ ID NO: 51701 - protein, 9 aa, Homo Sapiens
ILGHYFQRH

SEQ ID NO: 51702 - protein, 9 aa, Homo Sapiens
FQLVTVHQS

SEQ ID NO: 51703 - protein, 9 aa, Homo Sapiens
LKHFIGQHE

SEQ ID NO: 51704 - protein, 9 aa, Homo Sapiens
ILKVAESFQ

SEQ ID NO: 51705 - protein, 9 aa, Homo Sapiens
LWEGGIRGV

SEQ ID NO: 51706 - protein, 9 aa, Homo Sapiens
TDRQCQSSH

SEQ ID NO: 51707 - protein, 9 aa, Homo Sapiens
RSWPFLCSF

SEQ ID NO: 51708 - protein, 9 aa, Homo Sapiens
YKSIRINLV

SEQ ID NO: 51709 - protein, 9 aa, Homo Sapiens
GIPGTPTWN

SEQ ID NO: 51710 - protein, 9 aa, Homo Sapiens
CQSSHYSQP

SEQ ID NO: 51711 - protein, 9 aa, Homo Sapiens
KSIRINLVF

SEQ ID NO: 51712 - protein, 9 aa, Homo Sapiens
GPSHTSNSS

SEQ ID NO: 51713 - protein, 9 aa, Homo Sapiens
EVVRHCPHH

SEQ ID NO: 51714 - protein, 9 aa, Homo Sapiens
GPNGDFSSP

SEQ ID NO: 51715 - protein, 9 aa, Homo Sapiens
FSSQNVYHH

SEQ ID NO: 51716 - protein, 9 aa, Homo Sapiens
AATEFMYPA

SEQ ID NO: 51717 - protein, 9 aa, Homo Sapiens
PSPGPSHTS

SEQ ID NO: 51718 - protein, 9 aa, Homo Sapiens
HYSQTDRQC

SEQ ID NO: 51719 - protein, 9 aa, Homo Sapiens
MAAIWKKLV

SEQ ID NO: 51720 - protein, 9 aa, Homo Sapiens
GGIRGVGFV

SEQ ID NO: 51721 - protein, 9 aa, Homo Sapiens
GHYFQRHLG

SEQ ID NO: 51722 - protein, 9 aa, Homo Sapiens
VYHHLTGEL

SEQ ID NO: 51723 - protein, 9 aa, Homo Sapiens
VRHCPHHER

SEQ ID NO: 51724 - protein, 9 aa, Homo Sapiens
WEGGIRGVG

SEQ ID NO: 51725 - protein, 9 aa, Homo Sapiens
PVEAVYSIP

SEQ ID NO: 51726 - protein, 9 aa, Homo Sapiens
YDLSVDAIP

SEQ ID NO: 51727 - protein, 9 aa, Homo Sapiens
FMYPARAPS

SEQ ID NO: 51728 - protein, 9 aa, Homo Sapiens
WKKLVIVGD

SEQ ID NO: 51729 - protein, 9 aa, Homo Sapiens
SPPPTCPRK

SEQ ID NO: 51730 - protein, 9 aa, Homo Sapiens
VECLLSLKD

SEQ ID NO: 51731 - protein, 9 aa, Homo Sapiens
TAGTETGGA

SEQ ID NO: 51732 - protein, 9 aa, Homo Sapiens
ATEFMYPAR

SEQ ID NO: 51733 - protein, 9 aa, Homo Sapiens
HISSNYGNN

SEQ ID NO: 51734 - protein, 9 aa, Homo Sapiens
RQCQSSHYS

SEQ ID NO: 51735 - protein, 9 aa, Homo Sapiens
PGPSHTSNS

SEQ ID NO: 51736 - protein, 9 aa, Homo Sapiens
MLHETAAPS

SEQ ID NO: 51737 - protein, 9 aa, Homo Sapiens
PTCPRKVAI

SEQ ID NO: 51738 - protein, 9 aa, Homo Sapiens
QCQSSHYSQ

SEQ ID NO: 51739 - protein, 9 aa, Homo Sapiens
ACLPAFVTK

SEQ ID NO: 51740 - protein, 9 aa, Homo Sapiens
ETGNSKEEE

SEQ ID NO: 51741 - protein, 9 aa, Homo Sapiens
GNSKEEEDA

SEQ ID NO: 51742 - protein, 9 aa, Homo Sapiens
HHLTGELYV

SEQ ID NO: 51743 - protein, 9 aa, Homo Sapiens
RPQIHISSN

SEQ ID NO: 51744 - protein, 9 aa, Homo Sapiens
GQHEEFETA

SEQ ID NO: 51745 - protein, 9 aa, Homo Sapiens
MVWQSVFNK

SEQ ID NO: 51746 - protein, 9 aa, Homo Sapiens
RKVAISQRR

SEQ ID NO: 51747 - protein, 9 aa, Homo Sapiens
SVDAIPIKA

SEQ ID NO: 51748 - protein, 9 aa, Homo Sapiens
ETGGARGTF

SEQ ID NO: 51749 - protein, 9 aa, Homo Sapiens
SQNVYHHLT

SEQ ID NO: 51750 - protein, 9 aa, Homo Sapiens
RPECRPPKS

SEQ ID NO: 51751 - protein, 9 aa, Homo Sapiens
YFQRHLGLA

SEQ ID NO: 51752 - protein, 9 aa, Homo Sapiens
YYMLHETAA

SEQ ID NO: 51753 - protein, 9 aa, Homo Sapiens
QNVYHHLTG

SEQ ID NO: 51754 - protein, 9 aa, Homo Sapiens
AGTETGGAR

SEQ ID NO: 51755 - protein, 9 aa, Homo Sapiens
KWSLWEGGI

SEQ ID NO: 51756 - protein, 9 aa, Homo Sapiens
LETGNSKEE

SEQ ID NO: 51757 - protein, 9 aa, Homo Sapiens
GLETGNSKE

SEQ ID NO: 51758 - protein, 9 aa, Homo Sapiens
CPRKVAISQ

SEQ ID NO: 51759 - protein, 9 aa, Homo Sapiens
DYKEKTGKE

SEQ ID NO: 51760 - protein, 9 aa, Homo Sapiens
SISPASASQ

SEQ ID NO: 51761 - protein, 9 aa, Homo Sapiens
ECLLSLKDY

SEQ ID NO: 51762 - protein, 9 aa, Homo Sapiens
LTWRKLSRL

SEQ ID NO: 51763 - protein, 9 aa, Homo Sapiens
NGYKSIRIN

SEQ ID NO: 51764 - protein, 9 aa, Homo Sapiens
ILLFMLVMV

SEQ ID NO: 51765 - protein, 9 aa, Homo Sapiens
PRKVAISQR

SEQ ID NO: 51766 - protein, 9 aa, Homo Sapiens
PGVGPNGDF

SEQ ID NO: 51767 - protein, 9 aa, Homo Sapiens
YHHLTGELY

SEQ ID NO: 51768 - protein, 9 aa, Homo Sapiens
INLVFLSRS

SEQ ID NO: 51769 - protein, 9 aa, Homo Sapiens
VAESFQLVT

SEQ ID NO: 51770 - protein, 9 aa, Homo Sapiens
LPVEAVYSI

SEQ ID NO: 51771 - protein, 9 aa, Homo Sapiens
STPSEGCTP

SEQ ID NO: 51772 - protein, 9 aa, Homo Sapiens
HEEFETARD

SEQ ID NO: 51773 - protein, 9 aa, Homo Sapiens
KLCSVFPPH

SEQ ID NO: 51774 - protein, 9 aa, Homo Sapiens
IEEDEDRLG

SEQ ID NO: 51775 - protein, 9 aa, Homo Sapiens
SDLNLLTWR

SEQ ID NO: 51776 - protein, 9 aa, Homo Sapiens
LKRKGYDLS

SEQ ID NO: 51777 - protein, 9 aa, Homo Sapiens
HLGLANGVV

SEQ ID NO: 51778 - protein, 9 aa, Homo Sapiens
TETGGARGT

SEQ ID NO: 51779 - protein, 9 aa, Homo Sapiens
QYYMLHETA

SEQ ID NO: 51780 - protein, 9 aa, Homo Sapiens
SPSPGPSHT

SEQ ID NO: 51781 - protein, 9 aa, Homo Sapiens
FQRHLGLAN

SEQ ID NO: 51782 - protein, 9 aa, Homo Sapiens
ESSPVGIPG

SEQ ID NO: 51783 - protein, 9 aa, Homo Sapiens
TGNSKEEED

SEQ ID NO: 51784 - protein, 9 aa, Homo Sapiens
CLLSLKDYK

SEQ ID NO: 51785 - protein, 9 aa, Homo Sapiens
TEVVRHCPH

SEQ ID NO: 51786 - protein, 9 aa, Homo Sapiens
KSPGPREKT

SEQ ID NO: 51787 - protein, 9 aa, Homo Sapiens
QHMTEVVRH

SEQ ID NO: 51788 - protein, 9 aa, Homo Sapiens
FMLVMVWQS

SEQ ID NO: 51789 - protein, 9 aa, Homo Sapiens
SVFPPHLVE

SEQ ID NO: 51790 - protein, 9 aa, Homo Sapiens
WPFLCSFRV

SEQ ID NO: 51791 - protein, 9 aa, Homo Sapiens
LHETAAPSD

SEQ ID NO: 51792 - protein, 9 aa, Homo Sapiens
SGKPGVGPN

SEQ ID NO: 51793 - protein, 9 aa, Homo Sapiens
ETAAPSDIV

SEQ ID NO: 51794 - protein, 9 aa, Homo Sapiens
HETAAPSDI

SEQ ID NO: 51795 - protein, 9 aa, Homo Sapiens
TCPRKVAIS

SEQ ID NO: 51796 - protein, 9 aa, Homo Sapiens
LPAFVTKNN

SEQ ID NO: 51797 - protein, 9 aa, Homo Sapiens
LVMVWQSVF

SEQ ID NO: 51798 - protein, 9 aa, Homo Sapiens
LGPATEHLR

SEQ ID NO: 51799 - protein, 9 aa, Homo Sapiens
QIHISSNYG

SEQ ID NO: 51800 - protein, 9 aa, Homo Sapiens
QTDRQCQSS

SEQ ID NO: 51801 - protein, 9 aa, Homo Sapiens
SILLFMLVM

SEQ ID NO: 51802 - protein, 9 aa, Homo Sapiens
LLTWRKLSR

SEQ ID NO: 51803 - protein, 9 aa, Homo Sapiens
TAAPSDIVG

SEQ ID NO: 51804 - protein, 9 aa, Homo Sapiens
EESSPVGIP

SEQ ID NO: 51805 - protein, 9 aa, Homo Sapiens
CTPLTSIPV

SEQ ID NO: 51806 - protein, 9 aa, Homo Sapiens
VTKNNALIF

SEQ ID NO: 51807 - protein, 9 aa, Homo Sapiens
IWKKLVIVG

SEQ ID NO: 51808 - protein, 9 aa, Homo Sapiens
IPGTPTWNP

SEQ ID NO: 51809 - protein, 9 aa, Homo Sapiens
SWPFLCSFR

SEQ ID NO: 51810 - protein, 9 aa, Homo Sapiens
LFMLVMVWQ

SEQ ID NO: 51811 - protein, 9 aa, Homo Sapiens
SIRINLVFL

SEQ ID NO: 51812 - protein, 9 aa, Homo Sapiens
EFSSQNVYH

SEQ ID NO: 51813 - protein, 9 aa, Homo Sapiens
ASDLNLLTW

SEQ ID NO: 51814 - protein, 9 aa, Homo Sapiens
IPGRGTVVT

SEQ ID NO: 51815 - protein, 9 aa, Homo Sapiens
PISTPSEGC

SEQ ID NO: 51816 - protein, 9 aa, Homo Sapiens
NGDFSSPGS

SEQ ID NO: 51817 - protein, 9 aa, Homo Sapiens
SSQNVYHHL

SEQ ID NO: 51818 - protein, 9 aa, Homo Sapiens
GDFAATEFM

SEQ ID NO: 51819 - protein, 9 aa, Homo Sapiens
DLNLLTWRK

SEQ ID NO: 51820 - protein, 9 aa, Homo Sapiens
SIPGRGTVV

SEQ ID NO: 51821 - protein, 9 aa, Homo Sapiens
AVYSIPGRG

SEQ ID NO: 51822 - protein, 9 aa, Homo Sapiens
DFAATEFMY

SEQ ID NO: 51823 - protein, 9 aa, Homo Sapiens
RSPSPGPSH

SEQ ID NO: 51824 - protein, 9 aa, Homo Sapiens
LGHYFQRHL

SEQ ID NO: 51825 - protein, 9 aa, Homo Sapiens
RLKHFIGQH

SEQ ID NO: 51826 - protein, 9 aa, Homo Sapiens
VYSIPGRGT

SEQ ID NO: 51827 - protein, 9 aa, Homo Sapiens
QKRSWPFLC

SEQ ID NO: 51828 - protein, 9 aa, Homo Sapiens
EDEDRLGPA

SEQ ID NO: 51829 - protein, 9 aa, Homo Sapiens
KRSWPFLCS

SEQ ID NO: 51830 - protein, 9 aa, Homo Sapiens
KPGVGPNGD

SEQ ID NO: 51831 - protein, 9 aa, Homo Sapiens
KNNALIFEE

SEQ ID NO: 51832 - protein, 9 aa, Homo Sapiens
VVRHCPHHE

SEQ ID NO: 51833 - protein, 9 aa, Homo Sapiens
HCPHHERCS

SEQ ID NO: 51834 - protein, 9 aa, Homo Sapiens
RLGPATEHL

SEQ ID NO: 51835 - protein, 9 aa, Homo Sapiens
EGCTPLTSI

SEQ ID NO: 51836 - protein, 9 aa, Homo Sapiens
PQIHISSNY

SEQ ID NO: 51837 - protein, 9 aa, Homo Sapiens
FAATEFMYP

SEQ ID NO: 51838 - protein, 9 aa, Homo Sapiens
FIGQHEEFE

SEQ ID NO: 51839 - protein, 9 aa, Homo Sapiens
KVAESFQLV

SEQ ID NO: 51840 - protein, 9 aa, Homo Sapiens
FLCSFRVLR

SEQ ID NO: 51841 - protein, 9 aa, Homo Sapiens
SQTDRQCQS

SEQ ID NO: 51842 - protein, 9 aa, Homo Sapiens
IHISSNYGN

SEQ ID NO: 51843 - protein, 9 aa, Homo Sapiens
SFQLVTVHQ

SEQ ID NO: 51844 - protein, 9 aa, Homo Sapiens
YTKLCSVFP

SEQ ID NO: 51845 - protein, 9 aa, Homo Sapiens
QVAGTTGLL

SEQ ID NO: 51846 - protein, 9 aa, Homo Sapiens
EDRLGPATE

SEQ ID NO: 51847 - protein, 9 aa, Homo Sapiens
MTEVVRHCP

SEQ ID NO: 51848 - protein, 9 aa, Homo Sapiens
ASVYTKLCS

SEQ ID NO: 51849 - protein, 9 aa, Homo Sapiens
GKPGVGPNG

SEQ ID NO: 51850 - protein, 9 aa, Homo Sapiens
ISTPSEGCT

SEQ ID NO: 51851 - protein, 9 aa, Homo Sapiens
SPVGIPGTP

SEQ ID NO: 51852 - protein, 9 aa, Homo Sapiens
VYTKLCSVF

SEQ ID NO: 51853 - protein, 9 aa, Homo Sapiens
CATAGTETG

SEQ ID NO: 51854 - protein, 9 aa, Homo Sapiens
LLSLKDYKE

SEQ ID NO: 51855 - protein, 9 aa, Homo Sapiens
TKLCSVFPP

SEQ ID NO: 51856 - protein, 9 aa, Homo Sapiens
HMTEVVRHC

SEQ ID NO: 51857 - protein, 9 aa, Homo Sapiens
HFIGQHEEF

SEQ ID NO: 51858 - protein, 9 aa, Homo Sapiens
TKNNALIFE

SEQ ID NO: 51859 - protein, 9 aa, Homo Sapiens
CLPAFVTKN

SEQ ID NO: 51860 - protein, 9 aa, Homo Sapiens
SEGCTPLTS

SEQ ID NO: 51861 - protein, 9 aa, Homo Sapiens
CRPQIHISS

SEQ ID NO: 51862 - protein, 9 aa, Homo Sapiens
SNYGNNPLN

SEQ ID NO: 51863 - protein, 9 aa, Homo Sapiens
PFLCSFRVL

SEQ ID NO: 51864 - protein, 9 aa, Homo Sapiens
KRKGYDLSV

SEQ ID NO: 51865 - protein, 9 aa, Homo Sapiens
AIWKKLVIV

SEQ ID NO: 51866 - protein, 9 aa, Homo Sapiens
CSFRVLRVF

SEQ ID NO: 51867 - protein, 9 aa, Homo Sapiens
EAVYSIPGR

SEQ ID NO: 51868 - protein, 9 aa, Homo Sapiens
SVYTKLCSV

SEQ ID NO: 51869 - protein, 9 aa, Homo Sapiens
ISSNYGNNP

SEQ ID NO: 51870 - protein, 9 aa, Homo Sapiens
VEAVYSIPG

SEQ ID NO: 51871 - protein, 9 aa, Homo Sapiens
RHLGLANGV

SEQ ID NO: 51872 - protein, 9 aa, Homo Sapiens
LCSFRVLRV

SEQ ID NO: 51873 - protein, 9 aa, Homo Sapiens
EGGIRGVGF

SEQ ID NO: 51874 - protein, 9 aa, Homo Sapiens
FVTKNNALI

SEQ ID NO: 51875 - protein, 9 aa, Homo Sapiens
SSNYGNNPL

SEQ ID NO: 51876 - protein, 9 aa, Homo Sapiens
IGQHEEFET

SEQ ID NO: 51877 - protein, 9 aa, Homo Sapiens
VGIPGTPTW

SEQ ID NO: 51878 - protein, 9 aa, Homo Sapiens
YSQTDRQCQ

SEQ ID NO: 51879 - protein, 9 aa, Homo Sapiens
NSKEEEDAP

SEQ ID NO: 51880 - protein, 9 aa, Homo Sapiens
LKVAESFQL

SEQ ID NO: 51881 - protein, 9 aa, Homo Sapiens
RHCPHHERC

SEQ ID NO: 51882 - protein, 9 aa, Homo Sapiens
SLWEGGIRG

SEQ ID NO: 51883 - protein, 9 aa, Homo Sapiens
CSVFPPHLV

SEQ ID NO: 51884 - protein, 9 aa, Homo Sapiens
QRHLGLANG

SEQ ID NO: 51885 - protein, 9 aa, Homo Sapiens
RPPKSPGPR

SEQ ID NO: 51886 - protein, 9 aa, Homo Sapiens
KEESSPVGI

SEQ ID NO: 51887 - protein, 9 aa, Homo Sapiens
PVGIPGTPT

SEQ ID NO: 51888 - protein, 9 aa, Homo Sapiens
LSLKDYKEK

SEQ ID NO: 51889 - protein, 9 aa, Homo Sapiens
PAFVTKNNA

SEQ ID NO: 51890 - protein, 9 aa, Homo Sapiens
PPPTCPRKV

SEQ ID NO: 51891 - protein, 9 aa, Homo Sapiens
SKEEEDAPA

SEQ ID NO: 51892 - protein, 9 aa, Homo Sapiens
GVGPNGDFS

SEQ ID NO: 51893 - protein, 9 aa, Homo Sapiens
GYDLSVDAI

SEQ ID NO: 51894 - protein, 9 aa, Homo Sapiens
WSLWEGGIR

SEQ ID NO: 51895 - protein, 9 aa, Homo Sapiens
FILKVAESF

SEQ ID NO: 51896 - protein, 9 aa, Homo Sapiens
AESFQLVTV

SEQ ID NO: 51897 - protein, 9 aa, Homo Sapiens
QHEEFETAR

SEQ ID NO: 51898 - protein, 9 aa, Homo Sapiens
PNGYKSIRI

SEQ ID NO: 51899 - protein, 9 aa, Homo Sapiens
RKGYDLSVD

SEQ ID NO: 51900 - protein, 9 aa, Homo Sapiens
PPKSPGPRE

SEQ ID NO: 51901 - protein, 9 aa, Homo Sapiens
PPTCPRKVA

SEQ ID NO: 51902 - protein, 9 aa, Homo Sapiens
LKDYKEKTG

SEQ ID NO: 51903 - protein, 9 aa, Homo Sapiens
KEEEDAPAV

SEQ ID NO: 51904 - protein, 9 aa, Homo Sapiens
PNGDFSSPG

SEQ ID NO: 51905 - protein, 9 aa, Homo Sapiens
MLVMVWQSV

SEQ ID NO: 51906 - protein, 9 aa, Homo Sapiens
RINLVFLSR

SEQ ID NO: 51907 - protein, 9 aa, Homo Sapiens
QRSPSPGPS

SEQ ID NO: 51908 - protein, 9 aa, Homo Sapiens
EVHQFYPLL

SEQ ID NO: 51909 - protein, 9 aa, Homo Sapiens
FNLSLSRRS

SEQ ID NO: 51910 - protein, 9 aa, Homo Sapiens
KGSMVLTCH

SEQ ID NO: 51911 - protein, 9 aa, Homo Sapiens
DAPWTLGNA

SEQ ID NO: 51912 - protein, 9 aa, Homo Sapiens
EQCAVEEGR

SEQ ID NO: 51913 - protein, 9 aa, Homo Sapiens
TAGGGGQGS

SEQ ID NO: 51914 - protein, 9 aa, Homo Sapiens
LSGQRAKES

SEQ ID NO: 51915 - protein, 9 aa, Homo Sapiens
SISATTPAA

SEQ ID NO: 51916 - protein, 9 aa, Homo Sapiens
LPSAHLDEV

SEQ ID NO: 51917 - protein, 9 aa, Homo Sapiens
SAPGNSLEQ

SEQ ID NO: 51918 - protein, 9 aa, Homo Sapiens
VGVLVGGNW

SEQ ID NO: 51919 - protein, 9 aa, Homo Sapiens
SHGVESVKK

SEQ ID NO: 51920 - protein, 9 aa, Homo Sapiens
DIYDRYCEA

SEQ ID NO: 51921 - protein, 9 aa, Homo Sapiens
ILSYIVSYY

SEQ ID NO: 51922 - protein, 9 aa, Homo Sapiens
DIESPTYTN

SEQ ID NO: 51923 - protein, 9 aa, Homo Sapiens
SSDNSRSIL

SEQ ID NO: 51924 - protein, 9 aa, Homo Sapiens
TKYYLNDFD

SEQ ID NO: 51925 - protein, 9 aa, Homo Sapiens
EALFLQEVF

SEQ ID NO: 51926 - protein, 9 aa, Homo Sapiens
NQTCYFSIP

SEQ ID NO: 51927 - protein, 9 aa, Homo Sapiens
DSKLHQLPS

SEQ ID NO: 51928 - protein, 9 aa, Homo Sapiens
LQEVFQAER

SEQ ID NO: 51929 - protein, 9 aa, Homo Sapiens
KGLKTYLLS

SEQ ID NO: 51930 - protein, 9 aa, Homo Sapiens
DLNVFLLRR

SEQ ID NO: 51931 - protein, 9 aa, Homo Sapiens
MAAVSMWDV

SEQ ID NO: 51932 - protein, 9 aa, Homo Sapiens
CEAGAEGGC

SEQ ID NO: 51933 - protein, 9 aa, Homo Sapiens
RHNIRNQLR

SEQ ID NO: 51934 - protein, 9 aa, Homo Sapiens
VLLVLGRLL

SEQ ID NO: 51935 - protein, 9 aa, Homo Sapiens
GGQGSMPRV

SEQ ID NO: 51936 - protein, 9 aa, Homo Sapiens
LCVLCLNLS

SEQ ID NO: 51937 - protein, 9 aa, Homo Sapiens
VPKERDKEL

SEQ ID NO: 51938 - protein, 9 aa, Homo Sapiens
SLEKKQRAP

SEQ ID NO: 51939 - protein, 9 aa, Homo Sapiens
SGDIKNNHS

SEQ ID NO: 51940 - protein, 9 aa, Homo Sapiens
PSKKKLKLA

SEQ ID NO: 51941 - protein, 9 aa, Homo Sapiens
SQKFEPTGI

SEQ ID NO: 51942 - protein, 9 aa, Homo Sapiens
ASCLQKISQ

SEQ ID NO: 51943 - protein, 9 aa, Homo Sapiens
PLQVTTTLK

SEQ ID NO: 51944 - protein, 9 aa, Homo Sapiens
CVDINSSVK

SEQ ID NO: 51945 - protein, 9 aa, Homo Sapiens
SLSSTELGI

SEQ ID NO: 51946 - protein, 9 aa, Homo Sapiens
FHTIISQIN

SEQ ID NO: 51947 - protein, 9 aa, Homo Sapiens
LSHGVESVK

SEQ ID NO: 51948 - protein, 9 aa, Homo Sapiens
LKTYLLSGQ

SEQ ID NO: 51949 - protein, 9 aa, Homo Sapiens
SGLPVHACA

SEQ ID NO: 51950 - protein, 9 aa, Homo Sapiens
SDRSGPDEL

SEQ ID NO: 51951 - protein, 9 aa, Homo Sapiens
NETPKKKKE

SEQ ID NO: 51952 - protein, 9 aa, Homo Sapiens
LRLNELAKF

SEQ ID NO: 51953 - protein, 9 aa, Homo Sapiens
SGNLEDSTS

SEQ ID NO: 51954 - protein, 9 aa, Homo Sapiens
YAGTVVAMP

SEQ ID NO: 51955 - protein, 9 aa, Homo Sapiens
WMRRHLSPD

SEQ ID NO: 51956 - protein, 9 aa, Homo Sapiens
RNDKNTSYI

SEQ ID NO: 51957 - protein, 9 aa, Homo Sapiens
NNHSGESLG

SEQ ID NO: 51958 - protein, 9 aa, Homo Sapiens
NRYNNFRTF

SEQ ID NO: 51959 - protein, 9 aa, Homo Sapiens
LNKPPQFSF

SEQ ID NO: 51960 - protein, 9 aa, Homo Sapiens
NDLNVFLLR

SEQ ID NO: 51961 - protein, 9 aa, Homo Sapiens
HYVQNISHD

SEQ ID NO: 51962 - protein, 9 aa, Homo Sapiens
FTLEFHESR

SEQ ID NO: 51963 - protein, 9 aa, Homo Sapiens
LEMHMQLFQ

SEQ ID NO: 51964 - protein, 9 aa, Homo Sapiens
DDTSINRYN

SEQ ID NO: 51965 - protein, 9 aa, Homo Sapiens
KSTTPFSKS

SEQ ID NO: 51966 - protein, 9 aa, Homo Sapiens
GGASEVEVK

SEQ ID NO: 51967 - protein, 9 aa, Homo Sapiens
TLGGASEVE

SEQ ID NO: 51968 - protein, 9 aa, Homo Sapiens
GTVVAMPLA

SEQ ID NO: 51969 - protein, 9 aa, Homo Sapiens
RDPRSPYEI

SEQ ID NO: 51970 - protein, 9 aa, Homo Sapiens
NRCLSPQRV

SEQ ID NO: 51971 - protein, 9 aa, Homo Sapiens
LVARFRQLR

SEQ ID NO: 51972 - protein, 9 aa, Homo Sapiens
KTYLLSGQR

SEQ ID NO: 51973 - protein, 9 aa, Homo Sapiens
INSPKDFTE

SEQ ID NO: 51974 - protein, 9 aa, Homo Sapiens
PEFLTHQYR

SEQ ID NO: 51975 - protein, 9 aa, Homo Sapiens
LLQEEQEGG

SEQ ID NO: 51976 - protein, 9 aa, Homo Sapiens
KEASMMDYV

SEQ ID NO: 51977 - protein, 9 aa, Homo Sapiens
TEDLRSLEK

SEQ ID NO: 51978 - protein, 9 aa, Homo Sapiens
RRMQSISAG

SEQ ID NO: 51979 - protein, 9 aa, Homo Sapiens
SPTYTNLNR

SEQ ID NO: 51980 - protein, 9 aa, Homo Sapiens
QICLLGEVL

SEQ ID NO: 51981 - protein, 9 aa, Homo Sapiens
FQAERLLLQ

SEQ ID NO: 51982 - protein, 9 aa, Homo Sapiens
STSAPGNSL

SEQ ID NO: 51983 - protein, 9 aa, Homo Sapiens
LSTAMRMYE

SEQ ID NO: 51984 - protein, 9 aa, Homo Sapiens
EVPKERDKE

SEQ ID NO: 51985 - protein, 9 aa, Homo Sapiens
SKHGTLRPG

SEQ ID NO: 51986 - protein, 9 aa, Homo Sapiens
RSQRFKCAG

SEQ ID NO: 51987 - protein, 9 aa, Homo Sapiens
TTRGLYPLF

SEQ ID NO: 51988 - protein, 9 aa, Homo Sapiens
LFNDLNVFL

SEQ ID NO: 51989 - protein, 9 aa, Homo Sapiens
CASVYYTII

SEQ ID NO: 51990 - protein, 9 aa, Homo Sapiens
DVGWSSWTK

SEQ ID NO: 51991 - protein, 9 aa, Homo Sapiens
TLQVANQDD

SEQ ID NO: 51992 - protein, 9 aa, Homo Sapiens
NLYITVFPL

SEQ ID NO: 51993 - protein, 9 aa, Homo Sapiens
CRDFGKGFI

SEQ ID NO: 51994 - protein, 9 aa, Homo Sapiens
MLHETAAPS

SEQ ID NO: 51995 - protein, 9 aa, Homo Sapiens
QNISHDDNG

SEQ ID NO: 51996 - protein, 9 aa, Homo Sapiens
RYVYENTQC

SEQ ID NO: 51997 - protein, 9 aa, Homo Sapiens
GSMVLTCHT

SEQ ID NO: 51998 - protein, 9 aa, Homo Sapiens
KAEDEYVNK

SEQ ID NO: 51999 - protein, 9 aa, Homo Sapiens
FQVRDHPPY

SEQ ID NO: 52000 - protein, 9 aa, Homo Sapiens
VEKSLKGWK

SEQ ID NO: 52001 - protein, 9 aa, Homo Sapiens
VATRPSLIL

SEQ ID NO: 52002 - protein, 9 aa, Homo Sapiens
HGHGEPPER

SEQ ID NO: 52003 - protein, 9 aa, Homo Sapiens
NSLEQHFTG

SEQ ID NO: 52004 - protein, 9 aa, Homo Sapiens
GRLLLSCFE

SEQ ID NO: 52005 - protein, 9 aa, Homo Sapiens
LSGSYFFRG

SEQ ID NO: 52006 - protein, 9 aa, Homo Sapiens
LLGEVLLAS

SEQ ID NO: 52007 - protein, 9 aa, Homo Sapiens
VGWSSWTKF

SEQ ID NO: 52008 - protein, 9 aa, Homo Sapiens
DDIQHLVDP

SEQ ID NO: 52009 - protein, 9 aa, Homo Sapiens
SSCKPREPL

SEQ ID NO: 52010 - protein, 9 aa, Homo Sapiens
EISNTDYFF

SEQ ID NO: 52011 - protein, 9 aa, Homo Sapiens
GTASRSSDV

SEQ ID NO: 52012 - protein, 9 aa, Homo Sapiens
PFHRDLFRY

SEQ ID NO: 52013 - protein, 9 aa, Homo Sapiens
AFNGINNSE

SEQ ID NO: 52014 - protein, 9 aa, Homo Sapiens
KCLSYAKDF

SEQ ID NO: 52015 - protein, 9 aa, Homo Sapiens
CVGVLVGGN

SEQ ID NO: 52016 - protein, 9 aa, Homo Sapiens
SRRSSARES

SEQ ID NO: 52017 - protein, 9 aa, Homo Sapiens
HQLPSIDFS

SEQ ID NO: 52018 - protein, 9 aa, Homo Sapiens
LKVQCSPEL

SEQ ID NO: 52019 - protein, 9 aa, Homo Sapiens
QLLCVGVLV

SEQ ID NO: 52020 - protein, 9 aa, Homo Sapiens
SLVEVPKER

SEQ ID NO: 52021 - protein, 9 aa, Homo Sapiens
LVLGRLLLS

SEQ ID NO: 52022 - protein, 9 aa, Homo Sapiens
PEQTYGQDV

SEQ ID NO: 52023 - protein, 9 aa, Homo Sapiens
ILVMLEIVT

SEQ ID NO: 52024 - protein, 9 aa, Homo Sapiens
IQALQELVA

SEQ ID NO: 52025 - protein, 9 aa, Homo Sapiens
FEPTGIGHL

SEQ ID NO: 52026 - protein, 9 aa, Homo Sapiens
QGSTSGLPV

SEQ ID NO: 52027 - protein, 9 aa, Homo Sapiens
EHLSSSLKQ

SEQ ID NO: 52028 - protein, 9 aa, Homo Sapiens
GEVLLASVM

SEQ ID NO: 52029 - protein, 9 aa, Homo Sapiens
DNGDACFIL

SEQ ID NO: 52030 - protein, 9 aa, Homo Sapiens
LVEVPKERD

SEQ ID NO: 52031 - protein, 9 aa, Homo Sapiens
NETIQAAFE

SEQ ID NO: 52032 - protein, 9 aa, Homo Sapiens
GNSNVGTSG

SEQ ID NO: 52033 - protein, 9 aa, Homo Sapiens
NGDACFILS

SEQ ID NO: 52034 - protein, 9 aa, Homo Sapiens
ESTHSTWLA

SEQ ID NO: 52035 - protein, 9 aa, Homo Sapiens
FKCAGMESG

SEQ ID NO: 52036 - protein, 9 aa, Homo Sapiens
SACVKVMAA

SEQ ID NO: 52037 - protein, 9 aa, Homo Sapiens
KSYICRDFG

SEQ ID NO: 52038 - protein, 9 aa, Homo Sapiens
CLSYAKDFQ

SEQ ID NO: 52039 - protein, 9 aa, Homo Sapiens
TLPFCGPYD

SEQ ID NO: 52040 - protein, 9 aa, Homo Sapiens
STKYYLNDF

SEQ ID NO: 52041 - protein, 9 aa, Homo Sapiens
TVTEKGSMV

SEQ ID NO: 52042 - protein, 9 aa, Homo Sapiens
STELGIRSE

SEQ ID NO: 52043 - protein, 9 aa, Homo Sapiens
EKSTTPFSK

SEQ ID NO: 52044 - protein, 9 aa, Homo Sapiens
IPFLVILIN

SEQ ID NO: 52045 - protein, 9 aa, Homo Sapiens
GNRRHNIRN

SEQ ID NO: 52046 - protein, 9 aa, Homo Sapiens
ITTPSKKKL

SEQ ID NO: 52047 - protein, 9 aa, Homo Sapiens
LLSCFELLL

SEQ ID NO: 52048 - protein, 9 aa, Homo Sapiens
GPVVASFHG

SEQ ID NO: 52049 - protein, 9 aa, Homo Sapiens
FQNTNAETV

SEQ ID NO: 52050 - protein, 9 aa, Homo Sapiens
TAAFRALSH

SEQ ID NO: 52051 - protein, 9 aa, Homo Sapiens
RCLSPQRVL

SEQ ID NO: 52052 - protein, 9 aa, Homo Sapiens
YVNKPLYLN

SEQ ID NO: 52053 - protein, 9 aa, Homo Sapiens
CVKVMAAVS

SEQ ID NO: 52054 - protein, 9 aa, Homo Sapiens
DHPPYHLIK

SEQ ID NO: 52055 - protein, 9 aa, Homo Sapiens
ALFLQEVFQ

SEQ ID NO: 52056 - protein, 9 aa, Homo Sapiens
QVRDHPPYH

SEQ ID NO: 52057 - protein, 9 aa, Homo Sapiens
YIHMIDGDR

SEQ ID NO: 52058 - protein, 9 aa, Homo Sapiens
QGAQKAENM

SEQ ID NO: 52059 - protein, 9 aa, Homo Sapiens
LHETAAPSD

SEQ ID NO: 52060 - protein, 9 aa, Homo Sapiens
LEDQNKLRL

SEQ ID NO: 52061 - protein, 9 aa, Homo Sapiens
CGNRRHNIR

SEQ ID NO: 52062 - protein, 9 aa, Homo Sapiens
AKDFQLSAQ

SEQ ID NO: 52063 - protein, 9 aa, Homo Sapiens
KVASGCVDI

SEQ ID NO: 52064 - protein, 9 aa, Homo Sapiens
DCNWIVVNS

SEQ ID NO: 52065 - protein, 9 aa, Homo Sapiens
LFIFMGRSS

SEQ ID NO: 52066 - protein, 9 aa, Homo Sapiens
SPLSREKLR

SEQ ID NO: 52067 - protein, 9 aa, Homo Sapiens
RSSARESNT

SEQ ID NO: 52068 - protein, 9 aa, Homo Sapiens
SPLFIFMGR

SEQ ID NO: 52069 - protein, 9 aa, Homo Sapiens
FINAEDRGY

SEQ ID NO: 52070 - protein, 9 aa, Homo Sapiens
CGPYDVDSF

SEQ ID NO: 52071 - protein, 9 aa, Homo Sapiens
KQLCASVYY

SEQ ID NO: 52072 - protein, 9 aa, Homo Sapiens
RSLEKKQRA

SEQ ID NO: 52073 - protein, 9 aa, Homo Sapiens
CLQKISQIC

SEQ ID NO: 52074 - protein, 9 aa, Homo Sapiens
VSPSSMEPF

SEQ ID NO: 52075 - protein, 9 aa, Homo Sapiens
ILPMSCASC

SEQ ID NO: 52076 - protein, 9 aa, Homo Sapiens
PQRVLLQLK

SEQ ID NO: 52077 - protein, 9 aa, Homo Sapiens
HGLGKVLEF

SEQ ID NO: 52078 - protein, 9 aa, Homo Sapiens
DKNTSYIHM

SEQ ID NO: 52079 - protein, 9 aa, Homo Sapiens
PTGIGHLET

SEQ ID NO: 52080 - protein, 9 aa, Homo Sapiens
NKLRLNELA

SEQ ID NO: 52081 - protein, 9 aa, Homo Sapiens
SYFFRGGVG

SEQ ID NO: 52082 - protein, 9 aa, Homo Sapiens
IQKMTEHVA

SEQ ID NO: 52083 - protein, 9 aa, Homo Sapiens
HFDSDAPWT

SEQ ID NO: 52084 - protein, 9 aa, Homo Sapiens
PAEQKSCTT

SEQ ID NO: 52085 - protein, 9 aa, Homo Sapiens
SYICRDFGK

SEQ ID NO: 52086 - protein, 9 aa, Homo Sapiens
VILINTTHK

SEQ ID NO: 52087 - protein, 9 aa, Homo Sapiens
LSYAKDFQL

SEQ ID NO: 52088 - protein, 9 aa, Homo Sapiens
HPFHRDLFR

SEQ ID NO: 52089 - protein, 9 aa, Homo Sapiens
LNVFLLRRP

SEQ ID NO: 52090 - protein, 9 aa, Homo Sapiens
QPALVQPGA

SEQ ID NO: 52091 - protein, 9 aa, Homo Sapiens
LVILINTTH

SEQ ID NO: 52092 - protein, 9 aa, Homo Sapiens
ALSQTGFSY

SEQ ID NO: 52093 - protein, 9 aa, Homo Sapiens
EDSKHGTLR

SEQ ID NO: 52094 - protein, 9 aa, Homo Sapiens
SGGPVVASF

SEQ ID NO: 52095 - protein, 9 aa, Homo Sapiens
LPVHACAQL

SEQ ID NO: 52096 - protein, 9 aa, Homo Sapiens
RHGHGEPPE

SEQ ID NO: 52097 - protein, 9 aa, Homo Sapiens
QSWISTWNH

SEQ ID NO: 52098 - protein, 9 aa, Homo Sapiens
QGAWPYEGV

SEQ ID NO: 52099 - protein, 9 aa, Homo Sapiens
GGVPEMEAH

SEQ ID NO: 52100 - protein, 9 aa, Homo Sapiens
SVMLLKLFI

SEQ ID NO: 52101 - protein, 9 aa, Homo Sapiens
EFLSGSYFF

SEQ ID NO: 52102 - protein, 9 aa, Homo Sapiens
AAAEAALSQ

SEQ ID NO: 52103 - protein, 9 aa, Homo Sapiens
ATRPSLILD

SEQ ID NO: 52104 - protein, 9 aa, Homo Sapiens
TTPSKKKLK

SEQ ID NO: 52105 - protein, 9 aa, Homo Sapiens
KISGNLEDS

SEQ ID NO: 52106 - protein, 9 aa, Homo Sapiens
YPSVSPSSM

SEQ ID NO: 52107 - protein, 9 aa, Homo Sapiens
QGSMPRVRY

SEQ ID NO: 52108 - protein, 9 aa, Homo Sapiens
ASTSAPGNS

SEQ ID NO: 52109 - protein, 9 aa, Homo Sapiens
GGMTPTASF

SEQ ID NO: 52110 - protein, 9 aa, Homo Sapiens
VTEKGSMVL

SEQ ID NO: 52111 - protein, 9 aa, Homo Sapiens
HQVEHLSSS

SEQ ID NO: 52112 - protein, 9 aa, Homo Sapiens
NVATRPSLI

SEQ ID NO: 52113 - protein, 9 aa, Homo Sapiens
LLSGQRAKE

SEQ ID NO: 52114 - protein, 9 aa, Homo Sapiens
ERILQERER

SEQ ID NO: 52115 - protein, 9 aa, Homo Sapiens
EIQALQELV

SEQ ID NO: 52116 - protein, 9 aa, Homo Sapiens
MDNGDACFI

SEQ ID NO: 52117 - protein, 9 aa, Homo Sapiens
FHVHQRVHT

SEQ ID NO: 52118 - protein, 9 aa, Homo Sapiens
FLSGSYFFR

SEQ ID NO: 52119 - protein, 9 aa, Homo Sapiens
GMTPTASFS

SEQ ID NO: 52120 - protein, 9 aa, Homo Sapiens
RGLYPLFGM

SEQ ID NO: 52121 - protein, 9 aa, Homo Sapiens
SDVLKNIYM

SEQ ID NO: 52122 - protein, 9 aa, Homo Sapiens
ALSHGVESV

SEQ ID NO: 52123 - protein, 9 aa, Homo Sapiens
VLKNIYMLC

SEQ ID NO: 52124 - protein, 9 aa, Homo Sapiens
GDACFILSS

SEQ ID NO: 52125 - protein, 9 aa, Homo Sapiens
KYYLNDFDR

SEQ ID NO: 52126 - protein, 9 aa, Homo Sapiens
YAKDFQLSA

SEQ ID NO: 52127 - protein, 9 aa, Homo Sapiens
GRPKLNLAK

SEQ ID NO: 52128 - protein, 9 aa, Homo Sapiens
YDVDSFFCD

SEQ ID NO: 52129 - protein, 9 aa, Homo Sapiens
KEFLSGSYF

SEQ ID NO: 52130 - protein, 9 aa, Homo Sapiens
EKLRSPSAA

SEQ ID NO: 52131 - protein, 9 aa, Homo Sapiens
NSNVGTSGD

SEQ ID NO: 52132 - protein, 9 aa, Homo Sapiens
QDSSGFHVH

SEQ ID NO: 52133 - protein, 9 aa, Homo Sapiens
HNIRNQLRR

SEQ ID NO: 52134 - protein, 9 aa, Homo Sapiens
RMQSISAGF

SEQ ID NO: 52135 - protein, 9 aa, Homo Sapiens
SKKKLKLAP

SEQ ID NO: 52136 - protein, 9 aa, Homo Sapiens
AETVSTNCI

SEQ ID NO: 52137 - protein, 9 aa, Homo Sapiens
FRYAKLMEW

SEQ ID NO: 52138 - protein, 9 aa, Homo Sapiens
PELVALETV

SEQ ID NO: 52139 - protein, 9 aa, Homo Sapiens
CKPREPLCP

SEQ ID NO: 52140 - protein, 9 aa, Homo Sapiens
SLGASSRLL

SEQ ID NO: 52141 - protein, 9 aa, Homo Sapiens
MRRHLSPDY

SEQ ID NO: 52142 - protein, 9 aa, Homo Sapiens
ETVSTNCIP

SEQ ID NO: 52143 - protein, 9 aa, Homo Sapiens
HQFYPLLKV

SEQ ID NO: 52144 - protein, 9 aa, Homo Sapiens
GYEIIEPGN

SEQ ID NO: 52145 - protein, 9 aa, Homo Sapiens
WLANGSLMI

SEQ ID NO: 52146 - protein, 9 aa, Homo Sapiens
ERLLLQEEQ

SEQ ID NO: 52147 - protein, 9 aa, Homo Sapiens
QGQQLLCVG

SEQ ID NO: 52148 - protein, 9 aa, Homo Sapiens
IYDRYCEAG

SEQ ID NO: 52149 - protein, 9 aa, Homo Sapiens
MDYVLYSLD

SEQ ID NO: 52150 - protein, 9 aa, Homo Sapiens
QHYVQNISH

SEQ ID NO: 52151 - protein, 9 aa, Homo Sapiens
QLSTAMRMY

SEQ ID NO: 52152 - protein, 9 aa, Homo Sapiens
GFHQKALQG

SEQ ID NO: 52153 - protein, 9 aa, Homo Sapiens
IESPTYTNL

SEQ ID NO: 52154 - protein, 9 aa, Homo Sapiens
RDHPPYHLI

SEQ ID NO: 52155 - protein, 9 aa, Homo Sapiens
PASTSAPGN

SEQ ID NO: 52156 - protein, 9 aa, Homo Sapiens
RYCEAGAEG

SEQ ID NO: 52157 - protein, 9 aa, Homo Sapiens
NAEDRGYEI

SEQ ID NO: 52158 - protein, 9 aa, Homo Sapiens
TEHVAEILT

SEQ ID NO: 52159 - protein, 9 aa, Homo Sapiens
LVEKSLKGW

SEQ ID NO: 52160 - protein, 9 aa, Homo Sapiens
PATSISATT

SEQ ID NO: 52161 - protein, 9 aa, Homo Sapiens
DFDRVADPA

SEQ ID NO: 52162 - protein, 9 aa, Homo Sapiens
DRYCEAGAE

SEQ ID NO: 52163 - protein, 9 aa, Homo Sapiens
QPGADQPAL

SEQ ID NO: 52164 - protein, 9 aa, Homo Sapiens
PGADQPALV

SEQ ID NO: 52165 - protein, 9 aa, Homo Sapiens
LCASVYYTI

SEQ ID NO: 52166 - protein, 9 aa, Homo Sapiens
SGTASRSSD

SEQ ID NO: 52167 - protein, 9 aa, Homo Sapiens
QVANQDDLP

SEQ ID NO: 52168 - protein, 9 aa, Homo Sapiens
LVMLEIVTE

SEQ ID NO: 52169 - protein, 9 aa, Homo Sapiens
TSYIHMIDG

SEQ ID NO: 52170 - protein, 9 aa, Homo Sapiens
LGEVLLASV

SEQ ID NO: 52171 - protein, 9 aa, Homo Sapiens
MTEHVAEIL

SEQ ID NO: 52172 - protein, 9 aa, Homo Sapiens
LSPDYRVHI

SEQ ID NO: 52173 - protein, 9 aa, Homo Sapiens
KLAPLQVTT

SEQ ID NO: 52174 - protein, 9 aa, Homo Sapiens
WNHGLKRLW

SEQ ID NO: 52175 - protein, 9 aa, Homo Sapiens
EQTLNVATR

SEQ ID NO: 52176 - protein, 9 aa, Homo Sapiens
STWNHGLKR

SEQ ID NO: 52177 - protein, 9 aa, Homo Sapiens
TEKGSMVLT

SEQ ID NO: 52178 - protein, 9 aa, Homo Sapiens
SGPDELENN

SEQ ID NO: 52179 - protein, 9 aa, Homo Sapiens
YMLHETAAP

SEQ ID NO: 52180 - protein, 9 aa, Homo Sapiens
DFGKGFIQK

SEQ ID NO: 52181 - protein, 9 aa, Homo Sapiens
PVVASFHGT

SEQ ID NO: 52182 - protein, 9 aa, Homo Sapiens
GINNSEFHT

SEQ ID NO: 52183 - protein, 9 aa, Homo Sapiens
LQERERLKR

SEQ ID NO: 52184 - protein, 9 aa, Homo Sapiens
TSQVLVEKS

SEQ ID NO: 52185 - protein, 9 aa, Homo Sapiens
QHLVDPVFA

SEQ ID NO: 52186 - protein, 9 aa, Homo Sapiens
DRHGHGEPP

SEQ ID NO: 52187 - protein, 9 aa, Homo Sapiens
HRDLFRYAK

SEQ ID NO: 52188 - protein, 9 aa, Homo Sapiens
SCASCLQKI

SEQ ID NO: 52189 - protein, 9 aa, Homo Sapiens
AALSQTGFS

SEQ ID NO: 52190 - protein, 9 aa, Homo Sapiens
FANRCLSPQ

SEQ ID NO: 52191 - protein, 9 aa, Homo Sapiens
FRQSFPLLE

SEQ ID NO: 52192 - protein, 9 aa, Homo Sapiens
KKLKLAPLQ

SEQ ID NO: 52193 - protein, 9 aa, Homo Sapiens
PQFSFEKAR

SEQ ID NO: 52194 - protein, 9 aa, Homo Sapiens
VRYVYENTQ

SEQ ID NO: 52195 - protein, 9 aa, Homo Sapiens
HQKALQGAQ

SEQ ID NO: 52196 - protein, 9 aa, Homo Sapiens
ENKQLCASV

SEQ ID NO: 52197 - protein, 9 aa, Homo Sapiens
CPAEQKSCT

SEQ ID NO: 52198 - protein, 9 aa, Homo Sapiens
QQLLCVGVL

SEQ ID NO: 52199 - protein, 9 aa, Homo Sapiens
AVQLLEDSK

SEQ ID NO: 52200 - protein, 9 aa, Homo Sapiens
QEEQEGGWR

SEQ ID NO: 52201 - protein, 9 aa, Homo Sapiens
AISLLPSAH

SEQ ID NO: 52202 - protein, 9 aa, Homo Sapiens
CEFKRAKCK

SEQ ID NO: 52203 - protein, 9 aa, Homo Sapiens
SMMDYVLYS

SEQ ID NO: 52204 - protein, 9 aa, Homo Sapiens
DTERNGPET

SEQ ID NO: 52205 - protein, 9 aa, Homo Sapiens
KKKEALFLQ

SEQ ID NO: 52206 - protein, 9 aa, Homo Sapiens
QNKLRLNEL

SEQ ID NO: 52207 - protein, 9 aa, Homo Sapiens
TVVAMPLAG

SEQ ID NO: 52208 - protein, 9 aa, Homo Sapiens
TGDGTLGGA

SEQ ID NO: 52209 - protein, 9 aa, Homo Sapiens
CEGDSGGPV

SEQ ID NO: 52210 - protein, 9 aa, Homo Sapiens
GLRHQVEHL

SEQ ID NO: 52211 - protein, 9 aa, Homo Sapiens
PSSMEPFLP

SEQ ID NO: 52212 - protein, 9 aa, Homo Sapiens
DQNKLRLNE

SEQ ID NO: 52213 - protein, 9 aa, Homo Sapiens
PQINSPKDF

SEQ ID NO: 52214 - protein, 9 aa, Homo Sapiens
SSPDQSLKR

SEQ ID NO: 52215 - protein, 9 aa, Homo Sapiens
GDSGGPVVA

SEQ ID NO: 52216 - protein, 9 aa, Homo Sapiens
SMPRVRYYA

SEQ ID NO: 52217 - protein, 9 aa, Homo Sapiens
NSSTPANYF

SEQ ID NO: 52218 - protein, 9 aa, Homo Sapiens
LSLSRRSSA

SEQ ID NO: 52219 - protein, 9 aa, Homo Sapiens
FDAHFTLEF

SEQ ID NO: 52220 - protein, 9 aa, Homo Sapiens
WPYEGVHRK

SEQ ID NO: 52221 - protein, 9 aa, Homo Sapiens
AAVTIGTAI

SEQ ID NO: 52222 - protein, 9 aa, Homo Sapiens
GCVDINSSV

SEQ ID NO: 52223 - protein, 9 aa, Homo Sapiens
FLSRCEFKR

SEQ ID NO: 52224 - protein, 9 aa, Homo Sapiens
TKEASMMDY

SEQ ID NO: 52225 - protein, 9 aa, Homo Sapiens
NEKSTTPFS

SEQ ID NO: 52226 - protein, 9 aa, Homo Sapiens
SPSSMEPFL

SEQ ID NO: 52227 - protein, 9 aa, Homo Sapiens
STHSTWLAN

SEQ ID NO: 52228 - protein, 9 aa, Homo Sapiens
RYEAGEIRW

SEQ ID NO: 52229 - protein, 9 aa, Homo Sapiens
SWISTWNHG

SEQ ID NO: 52230 - protein, 9 aa, Homo Sapiens
DLFRYAKLM

SEQ ID NO: 52231 - protein, 9 aa, Homo Sapiens
QERERLKRQ

SEQ ID NO: 52232 - protein, 9 aa, Homo Sapiens
LGASSRLLR

SEQ ID NO: 52233 - protein, 9 aa, Homo Sapiens
GFDAHFTLE

SEQ ID NO: 52234 - protein, 9 aa, Homo Sapiens
AGTVVAMPL

SEQ ID NO: 52235 - protein, 9 aa, Homo Sapiens
QFSFEKARV

SEQ ID NO: 52236 - protein, 9 aa, Homo Sapiens
KDFQLSAQL

SEQ ID NO: 52237 - protein, 9 aa, Homo Sapiens
SSLSSCKPR

SEQ ID NO: 52238 - protein, 9 aa, Homo Sapiens
SRSSDVLKN

SEQ ID NO: 52239 - protein, 9 aa, Homo Sapiens
RPELVALET

SEQ ID NO: 52240 - protein, 9 aa, Homo Sapiens
RLLLSCFEL

SEQ ID NO: 52241 - protein, 9 aa, Homo Sapiens
VRQKERQLT

SEQ ID NO: 52242 - protein, 9 aa, Homo Sapiens
LSREKLRSP

SEQ ID NO: 52243 - protein, 9 aa, Homo Sapiens
TSAPGNSLE

SEQ ID NO: 52244 - protein, 9 aa, Homo Sapiens
RESACVKVM

SEQ ID NO: 52245 - protein, 9 aa, Homo Sapiens
LILPMSCAS

SEQ ID NO: 52246 - protein, 9 aa, Homo Sapiens
FNGINNSEF

SEQ ID NO: 52247 - protein, 9 aa, Homo Sapiens
DEQCAVEEG

SEQ ID NO: 52248 - protein, 9 aa, Homo Sapiens
MGRSSLLSR

SEQ ID NO: 52249 - protein, 9 aa, Homo Sapiens
DTSINRYNN

SEQ ID NO: 52250 - protein, 9 aa, Homo Sapiens
GIGHLETLH

SEQ ID NO: 52251 - protein, 9 aa, Homo Sapiens
HGEPPERHG

SEQ ID NO: 52252 - protein, 9 aa, Homo Sapiens
QKISQICLL

SEQ ID NO: 52253 - protein, 9 aa, Homo Sapiens
QKFEPTGIG

SEQ ID NO: 52254 - protein, 9 aa, Homo Sapiens
PYEGVHRKP

SEQ ID NO: 52255 - protein, 9 aa, Homo Sapiens
YVQNISHDD

SEQ ID NO: 52256 - protein, 9 aa, Homo Sapiens
SGFHVHQRV

SEQ ID NO: 52257 - protein, 9 aa, Homo Sapiens
NKPLYLNTF

SEQ ID NO: 52258 - protein, 9 aa, Homo Sapiens
QQQLSTAMR

SEQ ID NO: 52259 - protein, 9 aa, Homo Sapiens
ERRRMQSIS

SEQ ID NO: 52260 - protein, 9 aa, Homo Sapiens
LKCLSYAKD

SEQ ID NO: 52261 - protein, 9 aa, Homo Sapiens
CRRNLDIES

SEQ ID NO: 52262 - protein, 9 aa, Homo Sapiens
LEKKQRAPL

SEQ ID NO: 52263 - protein, 9 aa, Homo Sapiens
CRMLFNDLN

SEQ ID NO: 52264 - protein, 9 aa, Homo Sapiens
NGPETNHQN

SEQ ID NO: 52265 - protein, 9 aa, Homo Sapiens
STWLANGSL

SEQ ID NO: 52266 - protein, 9 aa, Homo Sapiens
YLNDFDRVA

SEQ ID NO: 52267 - protein, 9 aa, Homo Sapiens
SLGFDAHFT

SEQ ID NO: 52268 - protein, 9 aa, Homo Sapiens
AVEEGRNCY

SEQ ID NO: 52269 - protein, 9 aa, Homo Sapiens
GSGTASRSS

SEQ ID NO: 52270 - protein, 9 aa, Homo Sapiens
LWRSLARKE

SEQ ID NO: 52271 - protein, 9 aa, Homo Sapiens
LQGAWPYEG

SEQ ID NO: 52272 - protein, 9 aa, Homo Sapiens
ETNHQNPQN

SEQ ID NO: 52273 - protein, 9 aa, Homo Sapiens
RLLLQEEQE

SEQ ID NO: 52274 - protein, 9 aa, Homo Sapiens
QINETIQAA

SEQ ID NO: 52275 - protein, 9 aa, Homo Sapiens
YEIIEPGNQ

SEQ ID NO: 52276 - protein, 9 aa, Homo Sapiens
GQGSMPRVR

SEQ ID NO: 52277 - protein, 9 aa, Homo Sapiens
LPSIDFSGG

SEQ ID NO: 52278 - protein, 9 aa, Homo Sapiens
SVSPSSMEP

SEQ ID NO: 52279 - protein, 9 aa, Homo Sapiens
ASMMDYVLY

SEQ ID NO: 52280 - protein, 9 aa, Homo Sapiens
KERQLTDAK

SEQ ID NO: 52281 - protein, 9 aa, Homo Sapiens
EMEAHGGYT

SEQ ID NO: 52282 - protein, 9 aa, Homo Sapiens
SIPVFNLVS

SEQ ID NO: 52283 - protein, 9 aa, Homo Sapiens
GGGGQGSMP

SEQ ID NO: 52284 - protein, 9 aa, Homo Sapiens
GLKRLWRSL

SEQ ID NO: 52285 - protein, 9 aa, Homo Sapiens
SQICLLGEV

SEQ ID NO: 52286 - protein, 9 aa, Homo Sapiens
ASSRLLRYR

SEQ ID NO: 52287 - protein, 9 aa, Homo Sapiens
RDIYDRYCE

SEQ ID NO: 52288 - protein, 9 aa, Homo Sapiens
ITVFPLPKA

SEQ ID NO: 52289 - protein, 9 aa, Homo Sapiens
PFLVILINT

SEQ ID NO: 52290 - protein, 9 aa, Homo Sapiens
TFVGRPKLN

SEQ ID NO: 52291 - protein, 9 aa, Homo Sapiens
SPQRVLLQL

SEQ ID NO: 52292 - protein, 9 aa, Homo Sapiens
VPEMEAHGG

SEQ ID NO: 52293 - protein, 9 aa, Homo Sapiens
LQHYVQNIS

SEQ ID NO: 52294 - protein, 9 aa, Homo Sapiens
PSSLSSCKP

SEQ ID NO: 52295 - protein, 9 aa, Homo Sapiens
SMVLTCHTN

SEQ ID NO: 52296 - protein, 9 aa, Homo Sapiens
GFHVHQRVH

SEQ ID NO: 52297 - protein, 9 aa, Homo Sapiens
MMDYVLYSL

SEQ ID NO: 52298 - protein, 9 aa, Homo Sapiens
LLASVMLLK

SEQ ID NO: 52299 - protein, 9 aa, Homo Sapiens
IISQINETI

SEQ ID NO: 52300 - protein, 9 aa, Homo Sapiens
ACVKVMAAV

SEQ ID NO: 52301 - protein, 9 aa, Homo Sapiens
VLEFQKNRC

SEQ ID NO: 52302 - protein, 9 aa, Homo Sapiens
QKMTEHVAE

SEQ ID NO: 52303 - protein, 9 aa, Homo Sapiens
DKISGNLED

SEQ ID NO: 52304 - protein, 9 aa, Homo Sapiens
TPTASFSQH

SEQ ID NO: 52305 - protein, 9 aa, Homo Sapiens
TIISQINET

SEQ ID NO: 52306 - protein, 9 aa, Homo Sapiens
KRLWRSLAR

SEQ ID NO: 52307 - protein, 9 aa, Homo Sapiens
CNWIVVNSS

SEQ ID NO: 52308 - protein, 9 aa, Homo Sapiens
NLSLSRRSS

SEQ ID NO: 52309 - protein, 9 aa, Homo Sapiens
ICLLGEVLL

SEQ ID NO: 52310 - protein, 9 aa, Homo Sapiens
TWNHGLKRL

SEQ ID NO: 52311 - protein, 9 aa, Homo Sapiens
GGIGGVPEM

SEQ ID NO: 52312 - protein, 9 aa, Homo Sapiens
QYYMLHETA

SEQ ID NO: 52313 - protein, 9 aa, Homo Sapiens
RGYEIIEPG

SEQ ID NO: 52314 - protein, 9 aa, Homo Sapiens
NKPPQFSFE

SEQ ID NO: 52315 - protein, 9 aa, Homo Sapiens
VIQKMTEHV

SEQ ID NO: 52316 - protein, 9 aa, Homo Sapiens
CASCLQKIS

SEQ ID NO: 52317 - protein, 9 aa, Homo Sapiens
IQHLVDPVF

SEQ ID NO: 52318 - protein, 9 aa, Homo Sapiens
SAGFQSLKT

SEQ ID NO: 52319 - protein, 9 aa, Homo Sapiens
GAQKAENML

SEQ ID NO: 52320 - protein, 9 aa, Homo Sapiens
VLLYEPQIN

SEQ ID NO: 52321 - protein, 9 aa, Homo Sapiens
DAHFTLEFH

SEQ ID NO: 52322 - protein, 9 aa, Homo Sapiens
FMGRSSLLS

SEQ ID NO: 52323 - protein, 9 aa, Homo Sapiens
GDTHFDSDA

SEQ ID NO: 52324 - protein, 9 aa, Homo Sapiens
EVFQAERLL

SEQ ID NO: 52325 - protein, 9 aa, Homo Sapiens
GAWPYEGVH

SEQ ID NO: 52326 - protein, 9 aa, Homo Sapiens
AAFRALSHG

SEQ ID NO: 52327 - protein, 9 aa, Homo Sapiens
SFRQSFPLL

SEQ ID NO: 52328 - protein, 9 aa, Homo Sapiens
CYFSIPVFN

SEQ ID NO: 52329 - protein, 9 aa, Homo Sapiens
SAHLDEVGI

SEQ ID NO: 52330 - protein, 9 aa, Homo Sapiens
EGDSGGPVV

SEQ ID NO: 52331 - protein, 9 aa, Homo Sapiens
LSSCKPREP

SEQ ID NO: 52332 - protein, 9 aa, Homo Sapiens
DRGYEIIEP

SEQ ID NO: 52333 - protein, 9 aa, Homo Sapiens
LKLILVMLE

SEQ ID NO: 52334 - protein, 9 aa, Homo Sapiens
TPFSKSNTP

SEQ ID NO: 52335 - protein, 9 aa, Homo Sapiens
ELVALETVK

SEQ ID NO: 52336 - protein, 9 aa, Homo Sapiens
RNGPETNHQ

SEQ ID NO: 52337 - protein, 9 aa, Homo Sapiens
LVALETVKG

SEQ ID NO: 52338 - protein, 9 aa, Homo Sapiens
AHLDEVGIS

SEQ ID NO: 52339 - protein, 9 aa, Homo Sapiens
SSGFHVHQR

SEQ ID NO: 52340 - protein, 9 aa, Homo Sapiens
LLLYFWYSS

SEQ ID NO: 52341 - protein, 9 aa, Homo Sapiens
GLKTYLLSG

SEQ ID NO: 52342 - protein, 9 aa, Homo Sapiens
YNNFRTFLQ

SEQ ID NO: 52343 - protein, 9 aa, Homo Sapiens
TVFPLPKAA

SEQ ID NO: 52344 - protein, 9 aa, Homo Sapiens
YPLFGMCEK

SEQ ID NO: 52345 - protein, 9 aa, Homo Sapiens
TNAETVSTN

SEQ ID NO: 52346 - protein, 9 aa, Homo Sapiens
KKKKEALFL

SEQ ID NO: 52347 - protein, 9 aa, Homo Sapiens
RSSPHSSPG

SEQ ID NO: 52348 - protein, 9 aa, Homo Sapiens
QRFKCAGME

SEQ ID NO: 52349 - protein, 9 aa, Homo Sapiens
YPLLKVQCS

SEQ ID NO: 52350 - protein, 9 aa, Homo Sapiens
GNLEDSTSL

SEQ ID NO: 52351 - protein, 9 aa, Homo Sapiens
TAAPSDIVG

SEQ ID NO: 52352 - protein, 9 aa, Homo Sapiens
DVDSFFCDL

SEQ ID NO: 52353 - protein, 9 aa, Homo Sapiens
SFQDSSGFH

SEQ ID NO: 52354 - protein, 9 aa, Homo Sapiens
FCGPYDVDS

SEQ ID NO: 52355 - protein, 9 aa, Homo Sapiens
NLDIESPTY

SEQ ID NO: 52356 - protein, 9 aa, Homo Sapiens
IKNNHSGES

SEQ ID NO: 52357 - protein, 9 aa, Homo Sapiens
NKQLCASVY

SEQ ID NO: 52358 - protein, 9 aa, Homo Sapiens
LSPQRVLLQ

SEQ ID NO: 52359 - protein, 9 aa, Homo Sapiens
LEFQKNRCD

SEQ ID NO: 52360 - protein, 9 aa, Homo Sapiens
FQGQQLLCV

SEQ ID NO: 52361 - protein, 9 aa, Homo Sapiens
QERILQERE

SEQ ID NO: 52362 - protein, 9 aa, Homo Sapiens
SLKRSSPHS

SEQ ID NO: 52363 - protein, 9 aa, Homo Sapiens
RTTRGLYPL

SEQ ID NO: 52364 - protein, 9 aa, Homo Sapiens
GRSSLLSRS

SEQ ID NO: 52365 - protein, 9 aa, Homo Sapiens
APLQVTTTL

SEQ ID NO: 52366 - protein, 9 aa, Homo Sapiens
FLQEVFQAE

SEQ ID NO: 52367 - protein, 9 aa, Homo Sapiens
GSDESSLIF

SEQ ID NO: 52368 - protein, 9 aa, Homo Sapiens
PEMEAHGGY

SEQ ID NO: 52369 - protein, 9 aa, Homo Sapiens
TCYFSIPVF

SEQ ID NO: 52370 - protein, 9 aa, Homo Sapiens
TYDLNKPPQ

SEQ ID NO: 52371 - protein, 9 aa, Homo Sapiens
QYRYEAGEI

SEQ ID NO: 52372 - protein, 9 aa, Homo Sapiens
AERLLLQEE

SEQ ID NO: 52373 - protein, 9 aa, Homo Sapiens
TTLKLILVM

SEQ ID NO: 52374 - protein, 9 aa, Homo Sapiens
TTPAASTEN

SEQ ID NO: 52375 - protein, 9 aa, Homo Sapiens
AHTSQVLVE

SEQ ID NO: 52376 - protein, 9 aa, Homo Sapiens
FFRGGVGWW

SEQ ID NO: 52377 - protein, 9 aa, Homo Sapiens
IGGVPEMEA

SEQ ID NO: 52378 - protein, 9 aa, Homo Sapiens
AAFNGINNS

SEQ ID NO: 52379 - protein, 9 aa, Homo Sapiens
SPASKPEWQ

SEQ ID NO: 52380 - protein, 9 aa, Homo Sapiens
EKSLKGWKE

SEQ ID NO: 52381 - protein, 9 aa, Homo Sapiens
EDQNKLRLN

SEQ ID NO: 52382 - protein, 9 aa, Homo Sapiens
KIQSWISTW

SEQ ID NO: 52383 - protein, 9 aa, Homo Sapiens
LNVATRPSL

SEQ ID NO: 52384 - protein, 9 aa, Homo Sapiens
MEPFLPSKE

SEQ ID NO: 52385 - protein, 9 aa, Homo Sapiens
INTTHKEFD

SEQ ID NO: 52386 - protein, 9 aa, Homo Sapiens
IFMGRSSLL

SEQ ID NO: 52387 - protein, 9 aa, Homo Sapiens
IQSWISTWN

SEQ ID NO: 52388 - protein, 9 aa, Homo Sapiens
SYIHMIDGD

SEQ ID NO: 52389 - protein, 9 aa, Homo Sapiens
CLSPQRVLL

SEQ ID NO: 52390 - protein, 9 aa, Homo Sapiens
GDDRHGHGE

SEQ ID NO: 52391 - protein, 9 aa, Homo Sapiens
PSIDFSGGN

SEQ ID NO: 52392 - protein, 9 aa, Homo Sapiens
PLSREKLRS

SEQ ID NO: 52393 - protein, 9 aa, Homo Sapiens
EKGSMVLTC

SEQ ID NO: 52394 - protein, 9 aa, Homo Sapiens
ALQELVARF

SEQ ID NO: 52395 - protein, 9 aa, Homo Sapiens
PLFIFMGRS

SEQ ID NO: 52396 - protein, 9 aa, Homo Sapiens
AIRPELVAL

SEQ ID NO: 52397 - protein, 9 aa, Homo Sapiens
SRCEFKRAK

SEQ ID NO: 52398 - protein, 9 aa, Homo Sapiens
LYPLFGMCE

SEQ ID NO: 52399 - protein, 9 aa, Homo Sapiens
GQDVGWSSW

SEQ ID NO: 52400 - protein, 9 aa, Homo Sapiens
ISLLPSAHL

SEQ ID NO: 52401 - protein, 9 aa, Homo Sapiens
WVIVRYVYE

SEQ ID NO: 52402 - protein, 9 aa, Homo Sapiens
PGNSLEQHF

SEQ ID NO: 52403 - protein, 9 aa, Homo Sapiens
HPPYHLIKA

SEQ ID NO: 52404 - protein, 9 aa, Homo Sapiens
WIVVNSSTP

SEQ ID NO: 52405 - protein, 9 aa, Homo Sapiens
DNSRSILSY

SEQ ID NO: 52406 - protein, 9 aa, Homo Sapiens
SCLQKISQI

SEQ ID NO: 52407 - protein, 9 aa, Homo Sapiens
PVCGNRRHN

SEQ ID NO: 52408 - protein, 9 aa, Homo Sapiens
FKRAKCKDP

SEQ ID NO: 52409 - protein, 9 aa, Homo Sapiens
SGNSNVGTS

SEQ ID NO: 52410 - protein, 9 aa, Homo Sapiens
LLLQEEQEG

SEQ ID NO: 52411 - protein, 9 aa, Homo Sapiens
HSTWLANGS

SEQ ID NO: 52412 - protein, 9 aa, Homo Sapiens
EVLLASVML

SEQ ID NO: 52413 - protein, 9 aa, Homo Sapiens
LSSTELGIR

SEQ ID NO: 52414 - protein, 9 aa, Homo Sapiens
GKMLSPASK

SEQ ID NO: 52415 - protein, 9 aa, Homo Sapiens
LRSPSAALS

SEQ ID NO: 52416 - protein, 9 aa, Homo Sapiens
FYPLLKVQC

SEQ ID NO: 52417 - protein, 9 aa, Homo Sapiens
KPPQFSFEK

SEQ ID NO: 52418 - protein, 9 aa, Homo Sapiens
TRPSLILDT

SEQ ID NO: 52419 - protein, 9 aa, Homo Sapiens
LTHQYRYEA

SEQ ID NO: 52420 - protein, 9 aa, Homo Sapiens
KMTEHVAEI

SEQ ID NO: 52421 - protein, 9 aa, Homo Sapiens
SFCGSYAGT

SEQ ID NO: 52422 - protein, 9 aa, Homo Sapiens
VNKPLYLNT

SEQ ID NO: 52423 - protein, 9 aa, Homo Sapiens
ELCPAEQKS

SEQ ID NO: 52424 - protein, 9 aa, Homo Sapiens
PTEDLRSLE

SEQ ID NO: 52425 - protein, 9 aa, Homo Sapiens
FSIPVFNLV

SEQ ID NO: 52426 - protein, 9 aa, Homo Sapiens
VLGRLLLSC

SEQ ID NO: 52427 - protein, 9 aa, Homo Sapiens
KNIYMLCVL

SEQ ID NO: 52428 - protein, 9 aa, Homo Sapiens
LYFWYSSTC

SEQ ID NO: 52429 - protein, 9 aa, Homo Sapiens
ETAAPSDIV

SEQ ID NO: 52430 - protein, 9 aa, Homo Sapiens
ARKECLILP

SEQ ID NO: 52431 - protein, 9 aa, Homo Sapiens
SCTTGCGRI

SEQ ID NO: 52432 - protein, 9 aa, Homo Sapiens
RSPYEISNT

SEQ ID NO: 52433 - protein, 9 aa, Homo Sapiens
GKVLEFQKN

SEQ ID NO: 52434 - protein, 9 aa, Homo Sapiens
EDEYVNKPL

SEQ ID NO: 52435 - protein, 9 aa, Homo Sapiens
QRVLLQLKY

SEQ ID NO: 52436 - protein, 9 aa, Homo Sapiens
EDRGYEIIE

SEQ ID NO: 52437 - protein, 9 aa, Homo Sapiens
RHLSPDYRV

SEQ ID NO: 52438 - protein, 9 aa, Homo Sapiens
RKECLILPM

SEQ ID NO: 52439 - protein, 9 aa, Homo Sapiens
LRHQVEHLS

SEQ ID NO: 52440 - protein, 9 aa, Homo Sapiens
PVFANVVQT

SEQ ID NO: 52441 - protein, 9 aa, Homo Sapiens
HTSQVLVEK

SEQ ID NO: 52442 - protein, 9 aa, Homo Sapiens
AEQTLNVAT

SEQ ID NO: 52443 - protein, 9 aa, Homo Sapiens
QDVGWSSWT

SEQ ID NO: 52444 - protein, 9 aa, Homo Sapiens
KYQQQLSTA

SEQ ID NO: 52445 - protein, 9 aa, Homo Sapiens
YEGVHRKPS

SEQ ID NO: 52446 - protein, 9 aa, Homo Sapiens
NAAVTIGTA

SEQ ID NO: 52447 - protein, 9 aa, Homo Sapiens
SFPLLEMHM

SEQ ID NO: 52448 - protein, 9 aa, Homo Sapiens
SQRFKCAGM

SEQ ID NO: 52449 - protein, 9 aa, Homo Sapiens
AEAALSQTG

SEQ ID NO: 52450 - protein, 9 aa, Homo Sapiens
YEPQINSPK

SEQ ID NO: 52451 - protein, 9 aa, Homo Sapiens
EKTLQVANQ

SEQ ID NO: 52452 - protein, 9 aa, Homo Sapiens
IVVNSSTPA

SEQ ID NO: 52453 - protein, 9 aa, Homo Sapiens
WISTWNHGL

SEQ ID NO: 52454 - protein, 9 aa, Homo Sapiens
SLARKECLI

SEQ ID NO: 52455 - protein, 9 aa, Homo Sapiens
LQKISQICL

SEQ ID NO: 52456 - protein, 9 aa, Homo Sapiens
CRSQRFKCA

SEQ ID NO: 52457 - protein, 9 aa, Homo Sapiens
ISAGFQSLK

SEQ ID NO: 52458 - protein, 9 aa, Homo Sapiens
ALASDRSGP

SEQ ID NO: 52459 - protein, 9 aa, Homo Sapiens
EFKRAKCKD

SEQ ID NO: 52460 - protein, 9 aa, Homo Sapiens
TFLSRCEFK

SEQ ID NO: 52461 - protein, 9 aa, Homo Sapiens
TYLLSGQRA

SEQ ID NO: 52462 - protein, 9 aa, Homo Sapiens
FNDLNVFLL

SEQ ID NO: 52463 - protein, 9 aa, Homo Sapiens
TCCSTFNLS

SEQ ID NO: 52464 - protein, 9 aa, Homo Sapiens
FSLGFDAHF

SEQ ID NO: 52465 - protein, 9 aa, Homo Sapiens
PETNHQNPQ

SEQ ID NO: 52466 - protein, 9 aa, Homo Sapiens
FHQKALQGA

SEQ ID NO: 52467 - protein, 9 aa, Homo Sapiens
LYITVFPLP

SEQ ID NO: 52468 - protein, 9 aa, Homo Sapiens
ARESNTGSG

SEQ ID NO: 52469 - protein, 9 aa, Homo Sapiens
LINTTHKEF

SEQ ID NO: 52470 - protein, 9 aa, Homo Sapiens
MRAKMDNGD

SEQ ID NO: 52471 - protein, 9 aa, Homo Sapiens
SINRYNNFR

SEQ ID NO: 52472 - protein, 9 aa, Homo Sapiens
NHSGESLGA

SEQ ID NO: 52473 - protein, 9 aa, Homo Sapiens
PVHACAQLS

SEQ ID NO: 52474 - protein, 9 aa, Homo Sapiens
KKIQSWIST

SEQ ID NO: 52475 - protein, 9 aa, Homo Sapiens
AQTSLVEVP

SEQ ID NO: 52476 - protein, 9 aa, Homo Sapiens
STGDGTLGG

SEQ ID NO: 52477 - protein, 9 aa, Homo Sapiens
GPETNHQNP

SEQ ID NO: 52478 - protein, 9 aa, Homo Sapiens
PWVIVRYVY

SEQ ID NO: 52479 - protein, 9 aa, Homo Sapiens
ALVQPGAGQ

SEQ ID NO: 52480 - protein, 9 aa, Homo Sapiens
INRYNNFRT

SEQ ID NO: 52481 - protein, 9 aa, Homo Sapiens
QKSCTTGCG

SEQ ID NO: 52482 - protein, 9 aa, Homo Sapiens
RRRMQSISA

SEQ ID NO: 52483 - protein, 9 aa, Homo Sapiens
RLLRYRQEL

SEQ ID NO: 52484 - protein, 9 aa, Homo Sapiens
ARTTRGLYP

SEQ ID NO: 52485 - protein, 9 aa, Homo Sapiens
LPMSCASCL

SEQ ID NO: 52486 - protein, 9 aa, Homo Sapiens
GSGNSNVGT

SEQ ID NO: 52487 - protein, 9 aa, Homo Sapiens
EPATSISAT

SEQ ID NO: 52488 - protein, 9 aa, Homo Sapiens
GNSLEQHFT

SEQ ID NO: 52489 - protein, 9 aa, Homo Sapiens
EHVAEILTG

SEQ ID NO: 52490 - protein, 9 aa, Homo Sapiens
LGFDAHFTL

SEQ ID NO: 52491 - protein, 9 aa, Homo Sapiens
SSLIFDQIP

SEQ ID NO: 52492 - protein, 9 aa, Homo Sapiens
MVLTCHTNN

SEQ ID NO: 52493 - protein, 9 aa, Homo Sapiens
NIRNQLRRN

SEQ ID NO: 52494 - protein, 9 aa, Homo Sapiens
WYSSTCCST

SEQ ID NO: 52495 - protein, 9 aa, Homo Sapiens
GGPVVASFH

SEQ ID NO: 52496 - protein, 9 aa, Homo Sapiens
TAMRMYERR

SEQ ID NO: 52497 - protein, 9 aa, Homo Sapiens
LLQGAWPYE

SEQ ID NO: 52498 - protein, 9 aa, Homo Sapiens
DQERILQER

SEQ ID NO: 52499 - protein, 9 aa, Homo Sapiens
LLLSCFELL

SEQ ID NO: 52500 - protein, 9 aa, Homo Sapiens
YDLNKPPQF

SEQ ID NO: 52501 - protein, 9 aa, Homo Sapiens
TASRSSDVL

SEQ ID NO: 52502 - protein, 9 aa, Homo Sapiens
VSDEAVKKI

SEQ ID NO: 52503 - protein, 9 aa, Homo Sapiens
QEVFQAERL

SEQ ID NO: 52504 - protein, 9 aa, Homo Sapiens
THSTWLANG

SEQ ID NO: 52505 - protein, 9 aa, Homo Sapiens
QVTTTLKLI

SEQ ID NO: 52506 - protein, 9 aa, Homo Sapiens
RRNLDIESP

SEQ ID NO: 52507 - protein, 9 aa, Homo Sapiens
KECLILPMS

SEQ ID NO: 52508 - protein, 9 aa, Homo Sapiens
YSSTCCSTF

SEQ ID NO: 52509 - protein, 9 aa, Homo Sapiens
EEQEGGWRR

SEQ ID NO: 52510 - protein, 9 aa, Homo Sapiens
APGNSLEQH

SEQ ID NO: 52511 - protein, 9 aa, Homo Sapiens
TWLANGSLM

SEQ ID NO: 52512 - protein, 9 aa, Homo Sapiens
IQPGADQPA

SEQ ID NO: 52513 - protein, 9 aa, Homo Sapiens
DFQLSAQLC

SEQ ID NO: 52514 - protein, 9 aa, Homo Sapiens
SDNSRSILS

SEQ ID NO: 52515 - protein, 9 aa, Homo Sapiens
PFSKSNTPT

SEQ ID NO: 52516 - protein, 9 aa, Homo Sapiens
KVLEFQKNR

SEQ ID NO: 52517 - protein, 9 aa, Homo Sapiens
VHQFYPLLK

SEQ ID NO: 52518 - protein, 9 aa, Homo Sapiens
FLTHQYRYE

SEQ ID NO: 52519 - protein, 9 aa, Homo Sapiens
EASMMDYVL

SEQ ID NO: 52520 - protein, 9 aa, Homo Sapiens
LVDPVFANV

SEQ ID NO: 52521 - protein, 9 aa, Homo Sapiens
SPGNLYITV

SEQ ID NO: 52522 - protein, 9 aa, Homo Sapiens
YDRYCEAGA

SEQ ID NO: 52523 - protein, 9 aa, Homo Sapiens
NDFDRVADP

SEQ ID NO: 52524 - protein, 9 aa, Homo Sapiens
NIYMLCVLC

SEQ ID NO: 52525 - protein, 9 aa, Homo Sapiens
QTSLVEVPK

SEQ ID NO: 52526 - protein, 9 aa, Homo Sapiens
ICRDFGKGF

SEQ ID NO: 52527 - protein, 9 aa, Homo Sapiens
LKGLKTYLL

SEQ ID NO: 52528 - protein, 9 aa, Homo Sapiens
LQEEQEGGW

SEQ ID NO: 52529 - protein, 9 aa, Homo Sapiens
QVEHLSSSL

SEQ ID NO: 52530 - protein, 9 aa, Homo Sapiens
NDKNTSYIH

SEQ ID NO: 52531 - protein, 9 aa, Homo Sapiens
GSMPRVRYY

SEQ ID NO: 52532 - protein, 9 aa, Homo Sapiens
KALQGAQKA

SEQ ID NO: 52533 - protein, 9 aa, Homo Sapiens
DESSLIFDQ

SEQ ID NO: 52534 - protein, 9 aa, Homo Sapiens
SNAAVTIGT

SEQ ID NO: 52535 - protein, 9 aa, Homo Sapiens
KPTEDLRSL

SEQ ID NO: 52536 - protein, 9 aa, Homo Sapiens
DRSGPDELE

SEQ ID NO: 52537 - protein, 9 aa, Homo Sapiens
DGTLGGASE

SEQ ID NO: 52538 - protein, 9 aa, Homo Sapiens
RDLFRYAKL

SEQ ID NO: 52539 - protein, 9 aa, Homo Sapiens
DSDAPWTLG

SEQ ID NO: 52540 - protein, 9 aa, Homo Sapiens
TSLVEVPKE

SEQ ID NO: 52541 - protein, 9 aa, Homo Sapiens
ISATTPAAS

SEQ ID NO: 52542 - protein, 9 aa, Homo Sapiens
KNNHSGESL

SEQ ID NO: 52543 - protein, 9 aa, Homo Sapiens
RGKMLSPAS

SEQ ID NO: 52544 - protein, 9 aa, Homo Sapiens
IEWMRRHLS

SEQ ID NO: 52545 - protein, 9 aa, Homo Sapiens
LKRSSPHSS

SEQ ID NO: 52546 - protein, 9 aa, Homo Sapiens
CSTFNLSLS

SEQ ID NO: 52547 - protein, 9 aa, Homo Sapiens
VNSSTPANY

SEQ ID NO: 52548 - protein, 9 aa, Homo Sapiens
LARKECLIL

SEQ ID NO: 52549 - protein, 9 aa, Homo Sapiens
TERNGPETN

SEQ ID NO: 52550 - protein, 9 aa, Homo Sapiens
LAPLQVTTT

SEQ ID NO: 52551 - protein, 9 aa, Homo Sapiens
TELGIRSEM

SEQ ID NO: 52552 - protein, 9 aa, Homo Sapiens
RLWRSLARK

SEQ ID NO: 52553 - protein, 9 aa, Homo Sapiens
YPYEKTLQV

SEQ ID NO: 52554 - protein, 9 aa, Homo Sapiens
LSRRSSARE

SEQ ID NO: 52555 - protein, 9 aa, Homo Sapiens
LPFCGPYDV

SEQ ID NO: 52556 - protein, 9 aa, Homo Sapiens
DQSLKRSSP

SEQ ID NO: 52557 - protein, 9 aa, Homo Sapiens
LLYEPQINS

SEQ ID NO: 52558 - protein, 9 aa, Homo Sapiens
DPRSPYEIS

SEQ ID NO: 52559 - protein, 9 aa, Homo Sapiens
YITVFPLPK

SEQ ID NO: 52560 - protein, 9 aa, Homo Sapiens
SYAGTVVAM

SEQ ID NO: 52561 - protein, 9 aa, Homo Sapiens
FQKNRCDNN

SEQ ID NO: 52562 - protein, 9 aa, Homo Sapiens
ECLILPMSC

SEQ ID NO: 52563 - protein, 9 aa, Homo Sapiens
NSRSILSYI

SEQ ID NO: 52564 - protein, 9 aa, Homo Sapiens
DSGGPVVAS

SEQ ID NO: 52565 - protein, 9 aa, Homo Sapiens
FRALSHGVE

SEQ ID NO: 52566 - protein, 9 aa, Homo Sapiens
KSCTTGCGR

SEQ ID NO: 52567 - protein, 9 aa, Homo Sapiens
TGIGHLETL

SEQ ID NO: 52568 - protein, 9 aa, Homo Sapiens
YYMLHETAA

SEQ ID NO: 52569 - protein, 9 aa, Homo Sapiens
CAGMESGYA

SEQ ID NO: 52570 - protein, 9 aa, Homo Sapiens
MLCVLCLNL

SEQ ID NO: 52571 - protein, 9 aa, Homo Sapiens
FSQHTAGGM

SEQ ID NO: 52572 - protein, 9 aa, Homo Sapiens
LKLAPLQVT

SEQ ID NO: 52573 - protein, 9 aa, Homo Sapiens
VALETVKGR

SEQ ID NO: 52574 - protein, 9 aa, Homo Sapiens
NRRHNIRNQ

SEQ ID NO: 52575 - protein, 9 aa, Homo Sapiens
HFTLEFHES

SEQ ID NO: 52576 - protein, 9 aa, Homo Sapiens
STSGLPVHA

SEQ ID NO: 52577 - protein, 9 aa, Homo Sapiens
FDRVADPAY

SEQ ID NO: 52578 - protein, 9 aa, Homo Sapiens
HLVDPVFAN

SEQ ID NO: 52579 - protein, 9 aa, Homo Sapiens
LDIESPTYT

SEQ ID NO: 52580 - protein, 9 aa, Homo Sapiens
ESPTYTNLN

SEQ ID NO: 52581 - protein, 9 aa, Homo Sapiens
PDELENNPE

SEQ ID NO: 52582 - protein, 9 aa, Homo Sapiens
ESACVKVMA

SEQ ID NO: 52583 - protein, 9 aa, Homo Sapiens
EPQINSPKD

SEQ ID NO: 52584 - protein, 9 aa, Homo Sapiens
TTTLKLILV

SEQ ID NO: 52585 - protein, 9 aa, Homo Sapiens
FLLQGAWPY

SEQ ID NO: 52586 - protein, 9 aa, Homo Sapiens
PKKKKEALF

SEQ ID NO: 52587 - protein, 9 aa, Homo Sapiens
GPYDVDSFF

SEQ ID NO: 52588 - protein, 9 aa, Homo Sapiens
STCCSTFNL

SEQ ID NO: 52589 - protein, 9 aa, Homo Sapiens
SPDQSLKRS

SEQ ID NO: 52590 - protein, 9 aa, Homo Sapiens
KNTSYIHMI

SEQ ID NO: 52591 - protein, 9 aa, Homo Sapiens
YQQQLSTAM

SEQ ID NO: 52592 - protein, 9 aa, Homo Sapiens
AFRALSHGV

SEQ ID NO: 52593 - protein, 9 aa, Homo Sapiens
VQNISHDDN

SEQ ID NO: 52594 - protein, 9 aa, Homo Sapiens
SDESSLIFD

SEQ ID NO: 52595 - protein, 9 aa, Homo Sapiens
FVGRPKLNL

SEQ ID NO: 52596 - protein, 9 aa, Homo Sapiens
STAMRMYER

SEQ ID NO: 52597 - protein, 9 aa, Homo Sapiens
VQLLEDSKH

SEQ ID NO: 52598 - protein, 9 aa, Homo Sapiens
VMLLKLFIV

SEQ ID NO: 52599 - protein, 9 aa, Homo Sapiens
FFSNAAVTI

SEQ ID NO: 52600 - protein, 9 aa, Homo Sapiens
IYMLCVLCL

SEQ ID NO: 52601 - protein, 9 aa, Homo Sapiens
TGSGTASRS

SEQ ID NO: 52602 - protein, 9 aa, Homo Sapiens
KEMDKISGN

SEQ ID NO: 52603 - protein, 9 aa, Homo Sapiens
LTVGSDESS

SEQ ID NO: 52604 - protein, 9 aa, Homo Sapiens
VDINSSVKG

SEQ ID NO: 52605 - protein, 9 aa, Homo Sapiens
VDSKLHQLP

SEQ ID NO: 52606 - protein, 9 aa, Homo Sapiens
DLNKPPQFS

SEQ ID NO: 52607 - protein, 9 aa, Homo Sapiens
GSYAGTVVA

SEQ ID NO: 52608 - protein, 9 aa, Homo Sapiens
LQELVARFR

SEQ ID NO: 52609 - protein, 9 aa, Homo Sapiens
GASSRLLRY

SEQ ID NO: 52610 - protein, 9 aa, Homo Sapiens
DPVFANVVQ

SEQ ID NO: 52611 - protein, 9 aa, Homo Sapiens
NGINNSEFH

SEQ ID NO: 52612 - protein, 9 aa, Homo Sapiens
VKVMAAVSM

SEQ ID NO: 52613 - protein, 9 aa, Homo Sapiens
PYDVDSFFC

SEQ ID NO: 52614 - protein, 9 aa, Homo Sapiens
FKENKQLCA

SEQ ID NO: 52615 - protein, 9 aa, Homo Sapiens
LLYFWYSST

SEQ ID NO: 52616 - protein, 9 aa, Homo Sapiens
LASDRSGPD

SEQ ID NO: 52617 - protein, 9 aa, Homo Sapiens
KLKLAPLQV

SEQ ID NO: 52618 - protein, 9 aa, Homo Sapiens
SQVLVEKSL

SEQ ID NO: 52619 - protein, 9 aa, Homo Sapiens
YVYENTQCW

SEQ ID NO: 52620 - protein, 9 aa, Homo Sapiens
RYNNFRTFL

SEQ ID NO: 52621 - protein, 9 aa, Homo Sapiens
RAISLLPSA

SEQ ID NO: 52622 - protein, 9 aa, Homo Sapiens
PLLEMHMQL

SEQ ID NO: 52623 - protein, 9 aa, Homo Sapiens
FDSDAPWTL

SEQ ID NO: 52624 - protein, 9 aa, Homo Sapiens
GDGTLGGAS

SEQ ID NO: 52625 - protein, 9 aa, Homo Sapiens
QALQELVAR

SEQ ID NO: 52626 - protein, 9 aa, Homo Sapiens
RSPSAALSE

SEQ ID NO: 52627 - protein, 9 aa, Homo Sapiens
QVLLYEPQI

SEQ ID NO: 52628 - protein, 9 aa, Homo Sapiens
QSISAGFQS

SEQ ID NO: 52629 - protein, 9 aa, Homo Sapiens
VHACAQLSP

SEQ ID NO: 52630 - protein, 9 aa, Homo Sapiens
HTIISQINE

SEQ ID NO: 52631 - protein, 9 aa, Homo Sapiens
QLLEDSKHG

SEQ ID NO: 52632 - protein, 9 aa, Homo Sapiens
GSYFFRGGV

SEQ ID NO: 52633 - protein, 9 aa, Homo Sapiens
APWTLGNAN

SEQ ID NO: 52634 - protein, 9 aa, Homo Sapiens
VYENTQCWE

SEQ ID NO: 52635 - protein, 9 aa, Homo Sapiens
ISQICLLGE

SEQ ID NO: 52636 - protein, 9 aa, Homo Sapiens
SSARESNTG

SEQ ID NO: 52637 - protein, 9 aa, Homo Sapiens
VANQDDLPG

SEQ ID NO: 52638 - protein, 9 aa, Homo Sapiens
TTPFSKSNT

SEQ ID NO: 52639 - protein, 9 aa, Homo Sapiens
EQEGGWRRR

SEQ ID NO: 52640 - protein, 9 aa, Homo Sapiens
EFQKNRCDN

SEQ ID NO: 52641 - protein, 9 aa, Homo Sapiens
PESTHSTWL

SEQ ID NO: 52642 - protein, 9 aa, Homo Sapiens
RSGPDELEN

SEQ ID NO: 52643 - protein, 9 aa, Homo Sapiens
NTNAETVST

SEQ ID NO: 52644 - protein, 9 aa, Homo Sapiens
MTPTASFSQ

SEQ ID NO: 52645 - protein, 9 aa, Homo Sapiens
RHQVEHLSS

SEQ ID NO: 52646 - protein, 9 aa, Homo Sapiens
SRSILSYIV

SEQ ID NO: 52647 - protein, 9 aa, Homo Sapiens
LLKVQCSPE

SEQ ID NO: 52648 - protein, 9 aa, Homo Sapiens
RILQERERL

SEQ ID NO: 52649 - protein, 9 aa, Homo Sapiens
AVTIGTAIA

SEQ ID NO: 52650 - protein, 9 aa, Homo Sapiens
KEALFLQEV

SEQ ID NO: 52651 - protein, 9 aa, Homo Sapiens
KSSDNSRSI

SEQ ID NO: 52652 - protein, 9 aa, Homo Sapiens
RGSGNSNVG

SEQ ID NO: 52653 - protein, 9 aa, Homo Sapiens
SLSSCKPRE

SEQ ID NO: 52654 - protein, 9 aa, Homo Sapiens
SSMEPFLPS

SEQ ID NO: 52655 - protein, 9 aa, Homo Sapiens
SISAGFQSL

SEQ ID NO: 52656 - protein, 9 aa, Homo Sapiens
DLRSLEKKQ

SEQ ID NO: 52657 - protein, 9 aa, Homo Sapiens
VEEGRNCYF

SEQ ID NO: 52658 - protein, 9 aa, Homo Sapiens
SKPEWQRWA

SEQ ID NO: 52659 - protein, 9 aa, Homo Sapiens
STTPFSKSN

SEQ ID NO: 52660 - protein, 9 aa, Homo Sapiens
FCRSQRFKC

SEQ ID NO: 52661 - protein, 9 aa, Homo Sapiens
SFSQHTAGG

SEQ ID NO: 52662 - protein, 9 aa, Homo Sapiens
PRSPYEISN

SEQ ID NO: 52663 - protein, 9 aa, Homo Sapiens
WTAAFNGIN

SEQ ID NO: 52664 - protein, 9 aa, Homo Sapiens
LCPAEQKSC

SEQ ID NO: 52665 - protein, 9 aa, Homo Sapiens
SARESNTGS

SEQ ID NO: 52666 - protein, 9 aa, Homo Sapiens
EDLRSLEKK

SEQ ID NO: 52667 - protein, 9 aa, Homo Sapiens
DIKNNHSGE

SEQ ID NO: 52668 - protein, 9 aa, Homo Sapiens
ELLLYFWYS

SEQ ID NO: 52669 - protein, 9 aa, Homo Sapiens
INNSEFHTG

SEQ ID NO: 52670 - protein, 9 aa, Homo Sapiens
LFRYAKLME

SEQ ID NO: 52671 - protein, 9 aa, Homo Sapiens
PSVSPSSME

SEQ ID NO: 52672 - protein, 9 aa, Homo Sapiens
VFQAERLLL

SEQ ID NO: 52673 - protein, 9 aa, Homo Sapiens
SSKTFVGRP

SEQ ID NO: 52674 - protein, 9 aa, Homo Sapiens
MQSISAGFQ

SEQ ID NO: 52675 - protein, 9 aa, Homo Sapiens
SRLLRYRQE

SEQ ID NO: 52676 - protein, 9 aa, Homo Sapiens
LCVGVLVGG

SEQ ID NO: 52677 - protein, 9 aa, Homo Sapiens
VTIGTAIAA

SEQ ID NO: 52678 - protein, 9 aa, Homo Sapiens
YFWYSSTCC

SEQ ID NO: 52679 - protein, 9 aa, Homo Sapiens
YICRDFGKG

SEQ ID NO: 52680 - protein, 9 aa, Homo Sapiens
RSLARKECL

SEQ ID NO: 52681 - protein, 9 aa, Homo Sapiens
NAETVSTNC

SEQ ID NO: 52682 - protein, 9 aa, Homo Sapiens
ISTWNHGLK

SEQ ID NO: 52683 - protein, 9 aa, Homo Sapiens
LKNIYMLCV

SEQ ID NO: 52684 - protein, 9 aa, Homo Sapiens
GPDELENNP

SEQ ID NO: 52685 - protein, 9 aa, Homo Sapiens
RCEFKRAKC

SEQ ID NO: 52686 - protein, 9 aa, Homo Sapiens
QTCYFSIPV

SEQ ID NO: 52687 - protein, 9 aa, Homo Sapiens
SPDYRVHII

SEQ ID NO: 52688 - protein, 9 aa, Homo Sapiens
LPESTHSTW

SEQ ID NO: 52689 - protein, 9 aa, Homo Sapiens
KKEALFLQE

SEQ ID NO: 52690 - protein, 9 aa, Homo Sapiens
PALVQPGAG

SEQ ID NO: 52691 - protein, 9 aa, Homo Sapiens
GQQLLCVGV

SEQ ID NO: 52692 - protein, 9 aa, Homo Sapiens
VDPVFANVV

SEQ ID NO: 52693 - protein, 9 aa, Homo Sapiens
QFYPLLKVQ

SEQ ID NO: 52694 - protein, 9 aa, Homo Sapiens
GLGKVLEFQ

SEQ ID NO: 52695 - protein, 9 aa, Homo Sapiens
EKSYICRDF

SEQ ID NO: 52696 - protein, 9 aa, Homo Sapiens
FIFMGRSSL

SEQ ID NO: 52697 - protein, 9 aa, Homo Sapiens
ASFSQHTAG

SEQ ID NO: 52698 - protein, 9 aa, Homo Sapiens
LGRLLLSCF

SEQ ID NO: 52699 - protein, 9 aa, Homo Sapiens
TSINRYNNF

SEQ ID NO: 52700 - protein, 9 aa, Homo Sapiens
RAAAEAALS

SEQ ID NO: 52701 - protein, 9 aa, Homo Sapiens
ILQERERLK

SEQ ID NO: 52702 - protein, 9 aa, Homo Sapiens
TPKKKKEAL

SEQ ID NO: 52703 - protein, 9 aa, Homo Sapiens
TRGLYPLFG

SEQ ID NO: 52704 - protein, 9 aa, Homo Sapiens
EWMRRHLSP

SEQ ID NO: 52705 - protein, 9 aa, Homo Sapiens
SATTPAAST

SEQ ID NO: 52706 - protein, 9 aa, Homo Sapiens
ELEDQNKLR

SEQ ID NO: 52707 - protein, 9 aa, Homo Sapiens
MLLKLFIVD

SEQ ID NO: 52708 - protein, 9 aa, Homo Sapiens
AWPYEGVHR

SEQ ID NO: 52709 - protein, 9 aa, Homo Sapiens
VEVPKERDK

SEQ ID NO: 52710 - protein, 9 aa, Homo Sapiens
QCAVEEGRN

SEQ ID NO: 52711 - protein, 9 aa, Homo Sapiens
LLCVGVLVG

SEQ ID NO: 52712 - protein, 9 aa, Homo Sapiens
SSRLLRYRQ

SEQ ID NO: 52713 - protein, 9 aa, Homo Sapiens
VLVEKSLKG

SEQ ID NO: 52714 - protein, 9 aa, Homo Sapiens
RQSFPLLEM

SEQ ID NO: 52715 - protein, 9 aa, Homo Sapiens
ALETVKGRS

SEQ ID NO: 52716 - protein, 9 aa, Homo Sapiens
QSFPLLEMH

SEQ ID NO: 52717 - protein, 9 aa, Homo Sapiens
LSPASKPEW

SEQ ID NO: 52718 - protein, 9 aa, Homo Sapiens
NTSYIHMID

SEQ ID NO: 52719 - protein, 9 aa, Homo Sapiens
SGCVDINSS

SEQ ID NO: 52720 - protein, 9 aa, Homo Sapiens
KMLSPASKP

SEQ ID NO: 52721 - protein, 9 aa, Homo Sapiens
EPPERHGRD

SEQ ID NO: 52722 - protein, 9 aa, Homo Sapiens
LQVANQDDL

SEQ ID NO: 52723 - protein, 9 aa, Homo Sapiens
QVLVEKSLK

SEQ ID NO: 52724 - protein, 9 aa, Homo Sapiens
EFLTHQYRY

SEQ ID NO: 52725 - protein, 9 aa, Homo Sapiens
FSKSNTPTP

SEQ ID NO: 52726 - protein, 9 aa, Homo Sapiens
GESLGASSR

SEQ ID NO: 52727 - protein, 9 aa, Homo Sapiens
ATSISATTP

SEQ ID NO: 52728 - protein, 9 aa, Homo Sapiens
AEQKSCTTG

SEQ ID NO: 52729 - protein, 9 aa, Homo Sapiens
QAERLLLQE

SEQ ID NO: 52730 - protein, 9 aa, Homo Sapiens
LYEPQINSP

SEQ ID NO: 52731 - protein, 9 aa, Homo Sapiens
HQYRYEAGE

SEQ ID NO: 52732 - protein, 9 aa, Homo Sapiens
PYEISNTDY

SEQ ID NO: 52733 - protein, 9 aa, Homo Sapiens
EAVQLLEDS

SEQ ID NO: 52734 - protein, 9 aa, Homo Sapiens
AKMDNGDAC

SEQ ID NO: 52735 - protein, 9 aa, Homo Sapiens
ERNGPETNH

SEQ ID NO: 52736 - protein, 9 aa, Homo Sapiens
RPKLNLAKK

SEQ ID NO: 52737 - protein, 9 aa, Homo Sapiens
CLILPMSCA

SEQ ID NO: 52738 - protein, 9 aa, Homo Sapiens
QPKVASGCV

SEQ ID NO: 52739 - protein, 9 aa, Homo Sapiens
PSAHLDEVG

SEQ ID NO: 52740 - protein, 9 aa, Homo Sapiens
SSTCCSTFN

SEQ ID NO: 52741 - protein, 9 aa, Homo Sapiens
FWYSSTCCS

SEQ ID NO: 52742 - protein, 9 aa, Homo Sapiens
LLVLGRLLL

SEQ ID NO: 52743 - protein, 9 aa, Homo Sapiens
KTLQVANQD

SEQ ID NO: 52744 - protein, 9 aa, Homo Sapiens
VTTTLKLIL

SEQ ID NO: 52745 - protein, 9 aa, Homo Sapiens
NNSEFHTGQ

SEQ ID NO: 52746 - protein, 9 aa, Homo Sapiens
AEDRGYEII

SEQ ID NO: 52747 - protein, 9 aa, Homo Sapiens
ALQGAQKAE

SEQ ID NO: 52748 - protein, 9 aa, Homo Sapiens
TTVTEKGSM

SEQ ID NO: 52749 - protein, 9 aa, Homo Sapiens
SSTELGIRS

SEQ ID NO: 52750 - protein, 9 aa, Homo Sapiens
TASFSQHTA

SEQ ID NO: 52751 - protein, 9 aa, Homo Sapiens
KLILVMLEI

SEQ ID NO: 52752 - protein, 9 aa, Homo Sapiens
LNEKSTTPF

SEQ ID NO: 52753 - protein, 9 aa, Homo Sapiens
QLCASVYYT

SEQ ID NO: 52754 - protein, 9 aa, Homo Sapiens
VLLASVMLL

SEQ ID NO: 52755 - protein, 9 aa, Homo Sapiens
LRSLEKKQR

SEQ ID NO: 52756 - protein, 9 aa, Homo Sapiens
DSSGFHVHQ

SEQ ID NO: 52757 - protein, 9 aa, Homo Sapiens
KISQICLLG

SEQ ID NO: 52758 - protein, 9 aa, Homo Sapiens
LLPSAHLDE

SEQ ID NO: 52759 - protein, 9 aa, Homo Sapiens
KTFVGRPKL

SEQ ID NO: 52760 - protein, 9 aa, Homo Sapiens
RDFGKGFIQ

SEQ ID NO: 52761 - protein, 9 aa, Homo Sapiens
FSNAAVTIG

SEQ ID NO: 52762 - protein, 9 aa, Homo Sapiens
YLLSGQRAK

SEQ ID NO: 52763 - protein, 9 aa, Homo Sapiens
YYLNDFDRV

SEQ ID NO: 52764 - protein, 9 aa, Homo Sapiens
VVASFHGTW

SEQ ID NO: 52765 - protein, 9 aa, Homo Sapiens
VRDHPPYHL

SEQ ID NO: 52766 - protein, 9 aa, Homo Sapiens
DDDTSINRY

SEQ ID NO: 52767 - protein, 9 aa, Homo Sapiens
DTHFDSDAP

SEQ ID NO: 52768 - protein, 9 aa, Homo Sapiens
AGGGGQGSM

SEQ ID NO: 52769 - protein, 9 aa, Homo Sapiens
QNTNAETVS

SEQ ID NO: 52770 - protein, 9 aa, Homo Sapiens
CRGSGNSNV

SEQ ID NO: 52771 - protein, 9 aa, Homo Sapiens
LNDFDRVAD

SEQ ID NO: 52772 - protein, 9 aa, Homo Sapiens
GIGGVPEME

SEQ ID NO: 52773 - protein, 9 aa, Homo Sapiens
FQDSSGFHV

SEQ ID NO: 52774 - protein, 9 aa, Homo Sapiens
DVLKNIYML

SEQ ID NO: 52775 - protein, 9 aa, Homo Sapiens
ELVARFRQL

SEQ ID NO: 52776 - protein, 9 aa, Homo Sapiens
GASEVEVKN

SEQ ID NO: 52777 - protein, 9 aa, Homo Sapiens
QKERQLTDA

SEQ ID NO: 52778 - protein, 9 aa, Homo Sapiens
PLLKVQCSP

SEQ ID NO: 52779 - protein, 9 aa, Homo Sapiens
GHGEPPERH

SEQ ID NO: 52780 - protein, 9 aa, Homo Sapiens
RESNTGSGT

SEQ ID NO: 52781 - protein, 9 aa, Homo Sapiens
VMAAVSMWD

SEQ ID NO: 52782 - protein, 9 aa, Homo Sapiens
SYAKDFQLS

SEQ ID NO: 52783 - protein, 9 aa, Homo Sapiens
RRSSARESN

SEQ ID NO: 52784 - protein, 9 aa, Homo Sapiens
ESNTGSGTA

SEQ ID NO: 52785 - protein, 9 aa, Homo Sapiens
YRQELLLYF

SEQ ID NO: 52786 - protein, 9 aa, Homo Sapiens
NVFLLRRPP

SEQ ID NO: 52787 - protein, 9 aa, Homo Sapiens
VCGNRRHNI

SEQ ID NO: 52788 - protein, 9 aa, Homo Sapiens
LASVMLLKL

SEQ ID NO: 52789 - protein, 9 aa, Homo Sapiens
KVMAAVSMW

SEQ ID NO: 52790 - protein, 9 aa, Homo Sapiens
LRAAAEAAL

SEQ ID NO: 52791 - protein, 9 aa, Homo Sapiens
CCRGSGNSN

SEQ ID NO: 52792 - protein, 9 aa, Homo Sapiens
YFSIPVFNL

SEQ ID NO: 52793 - protein, 9 aa, Homo Sapiens
EQTYGQDVG

SEQ ID NO: 52794 - protein, 9 aa, Homo Sapiens
LGKVLEFQK

SEQ ID NO: 52795 - protein, 9 aa, Homo Sapiens
LVIQKMTEH

SEQ ID NO: 52796 - protein, 9 aa, Homo Sapiens
RALSHGVES

SEQ ID NO: 52797 - protein, 9 aa, Homo Sapiens
RSPLFIFMG

SEQ ID NO: 52798 - protein, 9 aa, Homo Sapiens
PKLNLAKKA

SEQ ID NO: 52799 - protein, 9 aa, Homo Sapiens
VGRPKLNLA

SEQ ID NO: 52800 - protein, 9 aa, Homo Sapiens
HLSSSLKQK

SEQ ID NO: 52801 - protein, 9 aa, Homo Sapiens
NFQVRDHPP

SEQ ID NO: 52802 - protein, 9 aa, Homo Sapiens
PCCRGSGNS

SEQ ID NO: 52803 - protein, 9 aa, Homo Sapiens
MLFNDLNVF

SEQ ID NO: 52804 - protein, 9 aa, Homo Sapiens
HGVESVKKE

SEQ ID NO: 52805 - protein, 9 aa, Homo Sapiens
LLEDSKHGT

SEQ ID NO: 52806 - protein, 9 aa, Homo Sapiens
RRNDKNTSY

SEQ ID NO: 52807 - protein, 9 aa, Homo Sapiens
VASGCVDIN

SEQ ID NO: 52808 - protein, 9 aa, Homo Sapiens
QQLSTAMRM

SEQ ID NO: 52809 - protein, 9 aa, Homo Sapiens
HLSPDYRVH

SEQ ID NO: 52810 - protein, 9 aa, Homo Sapiens
FPLLEMHMQ

SEQ ID NO: 52811 - protein, 9 aa, Homo Sapiens
NWIVVNSST

SEQ ID NO: 52812 - protein, 9 aa, Homo Sapiens
ELGIRSEMG

SEQ ID NO: 52813 - protein, 9 aa, Homo Sapiens
LQVTTTLKL

SEQ ID NO: 52814 - protein, 9 aa, Homo Sapiens
KCAGMESGY

SEQ ID NO: 52815 - protein, 9 aa, Homo Sapiens
ISGNLEDST

SEQ ID NO: 52816 - protein, 9 aa, Homo Sapiens
YCEAGAEGG

SEQ ID NO: 52817 - protein, 9 aa, Homo Sapiens
SDAPWTLGN

SEQ ID NO: 52818 - protein, 9 aa, Homo Sapiens
ARDPRSPYE

SEQ ID NO: 52819 - protein, 9 aa, Homo Sapiens
GTLGGASEV

SEQ ID NO: 52820 - protein, 9 aa, Homo Sapiens
INAEDRGYE

SEQ ID NO: 52821 - protein, 9 aa, Homo Sapiens
YKYQQQLST

SEQ ID NO: 52822 - protein, 9 aa, Homo Sapiens
QTLNVATRP

SEQ ID NO: 52823 - protein, 9 aa, Homo Sapiens
TFNLSLSRR

SEQ ID NO: 52824 - protein, 9 aa, Homo Sapiens
SILSYIVSY

SEQ ID NO: 52825 - protein, 9 aa, Homo Sapiens
LGIRSEMGQ

SEQ ID NO: 52826 - protein, 9 aa, Homo Sapiens
HHPFHRDLF

SEQ ID NO: 52827 - protein, 9 aa, Homo Sapiens
ASVMLLKLF

SEQ ID NO: 52828 - protein, 9 aa, Homo Sapiens
NLEDSTSLS

SEQ ID NO: 52829 - protein, 9 aa, Homo Sapiens
TVGSDESSL

SEQ ID NO: 52830 - protein, 9 aa, Homo Sapiens
QGLRHQVEH

SEQ ID NO: 52831 - protein, 9 aa, Homo Sapiens
KKKLKLAPL

SEQ ID NO: 52832 - protein, 9 aa, Homo Sapiens
MSCASCLQK

SEQ ID NO: 52833 - protein, 9 aa, Homo Sapiens
KENKQLCAS

SEQ ID NO: 52834 - protein, 9 aa, Homo Sapiens
SLSRRSSAR

SEQ ID NO: 52835 - protein, 9 aa, Homo Sapiens
TIGTAIAAF

SEQ ID NO: 52836 - protein, 9 aa, Homo Sapiens
RRHNIRNQL

SEQ ID NO: 52837 - protein, 9 aa, Homo Sapiens
RAKMDNGDA

SEQ ID NO: 52838 - protein, 9 aa, Homo Sapiens
VGSDESSLI

SEQ ID NO: 52839 - protein, 9 aa, Homo Sapiens
YEISNTDYF

SEQ ID NO: 52840 - protein, 9 aa, Homo Sapiens
ETPKKKKEA

SEQ ID NO: 52841 - protein, 9 aa, Homo Sapiens
CGSYAGTVV

SEQ ID NO: 52842 - protein, 9 aa, Homo Sapiens
PYEKTLQVA

SEQ ID NO: 52843 - protein, 9 aa, Homo Sapiens
MLSPASKPE

SEQ ID NO: 52844 - protein, 9 aa, Homo Sapiens
PMSCASCLQ

SEQ ID NO: 52845 - protein, 9 aa, Homo Sapiens
DQPALVQPG

SEQ ID NO: 52846 - protein, 9 aa, Homo Sapiens
SSLSSTELG

SEQ ID NO: 52847 - protein, 9 aa, Homo Sapiens
VSTNCIPIK

SEQ ID NO: 52848 - protein, 9 aa, Homo Sapiens
FSPGNLYIT

SEQ ID NO: 52849 - protein, 9 aa, Homo Sapiens
ASGCVDINS

SEQ ID NO: 52850 - protein, 9 aa, Homo Sapiens
CCSTFNLSL

SEQ ID NO: 52851 - protein, 9 aa, Homo Sapiens
KRSSPHSSP

SEQ ID NO: 52852 - protein, 9 aa, Homo Sapiens
EAALSQTGF

SEQ ID NO: 52853 - protein, 9 aa, Homo Sapiens
TLKLILVML

SEQ ID NO: 52854 - protein, 9 aa, Homo Sapiens
LLEMHMQLF

SEQ ID NO: 52855 - protein, 9 aa, Homo Sapiens
LILVMLEIV

SEQ ID NO: 52856 - protein, 9 aa, Homo Sapiens
ASVYYTIIH

SEQ ID NO: 52857 - protein, 9 aa, Homo Sapiens
SQINETIQA

SEQ ID NO: 52858 - protein, 9 aa, Homo Sapiens
INETIQAAF

SEQ ID NO: 52859 - protein, 9 aa, Homo Sapiens
ETKEASMMD

SEQ ID NO: 52860 - protein, 9 aa, Homo Sapiens
DEYVNKPLY

SEQ ID NO: 52861 - protein, 9 aa, Homo Sapiens
IGHLETLHM

SEQ ID NO: 52862 - protein, 9 aa, Homo Sapiens
DIQHLVDPV

SEQ ID NO: 52863 - protein, 9 aa, Homo Sapiens
GEPPERHGR

SEQ ID NO: 52864 - protein, 9 aa, Homo Sapiens
ERQLTDAKQ

SEQ ID NO: 52865 - protein, 9 aa, Homo Sapiens
RMLFNDLNV

SEQ ID NO: 52866 - protein, 9 aa, Homo Sapiens
ADQPALVQP

SEQ ID NO: 52867 - protein, 9 aa, Homo Sapiens
PKVASGCVD

SEQ ID NO: 52868 - protein, 9 aa, Homo Sapiens
ISSLSSTEL

SEQ ID NO: 52869 - protein, 9 aa, Homo Sapiens
ASRSSDVLK

SEQ ID NO: 52870 - protein, 9 aa, Homo Sapiens
PDQSLKRSS

SEQ ID NO: 52871 - protein, 9 aa, Homo Sapiens
YEKTLQVAN

SEQ ID NO: 52872 - protein, 9 aa, Homo Sapiens
TDTERNGPE

SEQ ID NO: 52873 - protein, 9 aa, Homo Sapiens
GLPVHACAQ

SEQ ID NO: 52874 - protein, 9 aa, Homo Sapiens
AAEAALSQT

SEQ ID NO: 52875 - protein, 9 aa, Homo Sapiens
AHFTLEFHE

SEQ ID NO: 52876 - protein, 9 aa, Homo Sapiens
TPSKKKLKL

SEQ ID NO: 52877 - protein, 9 aa, Homo Sapiens
AEDEYVNKP

SEQ ID NO: 52878 - protein, 9 aa, Homo Sapiens
PTASFSQHT

SEQ ID NO: 52879 - protein, 9 aa, Homo Sapiens
YRYEAGEIR

SEQ ID NO: 52880 - protein, 9 aa, Homo Sapiens
RSILSYIVS

SEQ ID NO: 52881 - protein, 9 aa, Homo Sapiens
TSGLPVHAC

SEQ ID NO: 52882 - protein, 9 aa, Homo Sapiens
NTGSGTASR

SEQ ID NO: 52883 - protein, 9 aa, Homo Sapiens
LSQTGFSYD

SEQ ID NO: 52884 - protein, 9 aa, Homo Sapiens
PASKPEWQR

SEQ ID NO: 52885 - protein, 9 aa, Homo Sapiens
SMEPFLPSK

SEQ ID NO: 52886 - protein, 9 aa, Homo Sapiens
LTDAKQCVQ

SEQ ID NO: 52887 - protein, 9 aa, Homo Sapiens
AVKKIQSWI

SEQ ID NO: 52888 - protein, 9 aa, Homo Sapiens
MDKISGNLE

SEQ ID NO: 52889 - protein, 9 aa, Homo Sapiens
VEHLSSSLK

SEQ ID NO: 52890 - protein, 9 aa, Homo Sapiens
AAPSDIVGA

SEQ ID NO: 52891 - protein, 9 aa, Homo Sapiens
RQLTDAKQC

SEQ ID NO: 52892 - protein, 9 aa, Homo Sapiens
VKKIQSWIS

SEQ ID NO: 52893 - protein, 9 aa, Homo Sapiens
ERDQERILQ

SEQ ID NO: 52894 - protein, 9 aa, Homo Sapiens
RLNELAKFR

SEQ ID NO: 52895 - protein, 9 aa, Homo Sapiens
GSTSGLPVH

SEQ ID NO: 52896 - protein, 9 aa, Homo Sapiens
HVAEILTGS

SEQ ID NO: 52897 - protein, 9 aa, Homo Sapiens
THQYRYEAG

SEQ ID NO: 52898 - protein, 9 aa, Homo Sapiens
GNLYITVFP

SEQ ID NO: 52899 - protein, 9 aa, Homo Sapiens
HGLKRLWRS

SEQ ID NO: 52900 - protein, 9 aa, Homo Sapiens
FHRDLFRYA

SEQ ID NO: 52901 - protein, 9 aa, Homo Sapiens
RNLDIESPT

SEQ ID NO: 52902 - protein, 9 aa, Homo Sapiens
ESLGASSRL

SEQ ID NO: 52903 - protein, 9 aa, Homo Sapiens
SCKPREPLC

SEQ ID NO: 52904 - protein, 9 aa, Homo Sapiens
RSSDVLKNI

SEQ ID NO: 52905 - protein, 9 aa, Homo Sapiens
EMDKISGNL

SEQ ID NO: 52906 - protein, 9 aa, Homo Sapiens
SPYEISNTD

SEQ ID NO: 52907 - protein, 9 aa, Homo Sapiens
SDEAVKKIQ

SEQ ID NO: 52908 - protein, 9 aa, Homo Sapiens
RQELLLYFW

SEQ ID NO: 52909 - protein, 9 aa, Homo Sapiens
TDAKQCVQF

SEQ ID NO: 52910 - protein, 9 aa, Homo Sapiens
FLVILINTT

SEQ ID NO: 52911 - protein, 9 aa, Homo Sapiens
YGQDVGWSS

SEQ ID NO: 52912 - protein, 9 aa, Homo Sapiens
EAVKKIQSW

SEQ ID NO: 52913 - protein, 9 aa, Homo Sapiens
TSISATTPA

SEQ ID NO: 52914 - protein, 9 aa, Homo Sapiens
QSLKRSSPH

SEQ ID NO: 52915 - protein, 9 aa, Homo Sapiens
FCGSYAGTV

SEQ ID NO: 52916 - protein, 9 aa, Homo Sapiens
QLPSIDFSG

SEQ ID NO: 52917 - protein, 9 aa, Homo Sapiens
SKTFVGRPK

SEQ ID NO: 52918 - protein, 9 aa, Homo Sapiens
KRDIYDRYC

SEQ ID NO: 52919 - protein, 9 aa, Homo Sapiens
NTTHKEFDA

SEQ ID NO: 52920 - protein, 9 aa, Homo Sapiens
PGNLYITVF

SEQ ID NO: 52921 - protein, 9 aa, Homo Sapiens
LQGAQKAEN

SEQ ID NO: 52922 - protein, 9 aa, Homo Sapiens
GADQPALVQ

SEQ ID NO: 52923 - protein, 9 aa, Homo Sapiens
LKRLWRSLA

SEQ ID NO: 52924 - protein, 9 aa, Homo Sapiens
LLRYRQELL

SEQ ID NO: 52925 - protein, 9 aa, Homo Sapiens
QKALQGAQK

SEQ ID NO: 52926 - protein, 9 aa, Homo Sapiens
TVSTNCIPI

SEQ ID NO: 52927 - protein, 9 aa, Homo Sapiens
KLHQLPSID

SEQ ID NO: 52928 - protein, 9 aa, Homo Sapiens
ASKPEWQRW

SEQ ID NO: 52929 - protein, 9 aa, Homo Sapiens
ISHDDNGYR

SEQ ID NO: 52930 - protein, 9 aa, Homo Sapiens
SKLHQLPSI

SEQ ID NO: 52931 - protein, 9 aa, Homo Sapiens
STFNLSLSR

SEQ ID NO: 52932 - protein, 9 aa, Homo Sapiens
KLRLNELAK

SEQ ID NO: 52933 - protein, 9 aa, Homo Sapiens
GGGQGSMPR

SEQ ID NO: 52934 - protein, 9 aa, Homo Sapiens
VIVRYVYEN

SEQ ID NO: 52935 - protein, 9 aa, Homo Sapiens
EGGIGGVPE

SEQ ID NO: 52936 - protein, 9 aa, Homo Sapiens
FGKGFIQKG

SEQ ID NO: 52937 - protein, 9 aa, Homo Sapiens
LFLQEVFQA

SEQ ID NO: 52938 - protein, 9 aa, Homo Sapiens
ATTPAASTE

SEQ ID NO: 52939 - protein, 9 aa, Homo Sapiens
IPWVIVRYV

SEQ ID NO: 52940 - protein, 9 aa, Homo Sapiens
RDQERILQE

SEQ ID NO: 52941 - protein, 9 aa, Homo Sapiens
KRAKCKDPQ

SEQ ID NO: 52942 - protein, 9 aa, Homo Sapiens
KPLYLNTFA

SEQ ID NO: 52943 - protein, 9 aa, Homo Sapiens
GVPEMEAHG

SEQ ID NO: 52944 - protein, 9 aa, Homo Sapiens
EQKSCTTGC

SEQ ID NO: 52945 - protein, 9 aa, Homo Sapiens
DDRHGHGEP

SEQ ID NO: 52946 - protein, 9 aa, Homo Sapiens
NHGLKRLWR

SEQ ID NO: 52947 - protein, 9 aa, Homo Sapiens
QELVARFRQ

SEQ ID NO: 52948 - protein, 9 aa, Homo Sapiens
PKERDKELV

SEQ ID NO: 52949 - protein, 9 aa, Homo Sapiens
HETAAPSDI

SEQ ID NO: 52950 - protein, 9 aa, Homo Sapiens
LGGASEVEV

SEQ ID NO: 52951 - protein, 9 aa, Homo Sapiens
YFFRGGVGW

SEQ ID NO: 52952 - protein, 9 aa, Homo Sapiens
NISHDDNGY

SEQ ID NO: 52953 - protein, 9 aa, Homo Sapiens
QLTDAKQCV

SEQ ID NO: 52954 - protein, 9 aa, Homo Sapiens
RRHLSPDYR

SEQ ID NO: 52955 - protein, 9 aa, Homo Sapiens
KFEPTGIGH

SEQ ID NO: 52956 - protein, 9 aa, Homo Sapiens
LRYRQELLL

SEQ ID NO: 52957 - protein, 9 aa, Homo Sapiens
QTYGQDVGW

SEQ ID NO: 52958 - protein, 9 aa, Homo Sapiens
PFCGPYDVD

SEQ ID NO: 52959 - protein, 9 aa, Homo Sapiens
SREKLRSPS

SEQ ID NO: 52960 - protein, 9 aa, Homo Sapiens
LSRCEFKRA

SEQ ID NO: 52961 - protein, 9 aa, Homo Sapiens
RFKCAGMES

SEQ ID NO: 52962 - protein, 9 aa, Homo Sapiens
RQKERQLTD

SEQ ID NO: 52963 - protein, 9 aa, Homo Sapiens
GSPSSLSSC

SEQ ID NO: 52964 - protein, 9 aa, Homo Sapiens
ISQINETIQ

SEQ ID NO: 52965 - protein, 9 aa, Homo Sapiens
KMDNGDACF

SEQ ID NO: 52966 - protein, 9 aa, Homo Sapiens
LEDSKHGTL

SEQ ID NO: 52967 - protein, 9 aa, Homo Sapiens
SGESLGASS

SEQ ID NO: 52968 - protein, 9 aa, Homo Sapiens
CAVEEGRNC

SEQ ID NO: 52969 - protein, 9 aa, Homo Sapiens
PPYHLIKAR

SEQ ID NO: 52970 - protein, 9 aa, Homo Sapiens
HSGESLGAS

SEQ ID NO: 52971 - protein, 9 aa, Homo Sapiens
YMLCVLCLN

SEQ ID NO: 52972 - protein, 9 aa, Homo Sapiens
LHQLPSIDF

SEQ ID NO: 52973 - protein, 9 aa, Homo Sapiens
DEAVKKIQS

SEQ ID NO: 52974 - protein, 9 aa, Homo Sapiens
SSTPANYFH

SEQ ID NO: 52975 - protein, 9 aa, Homo Sapiens
TLNVATRPS

SEQ ID NO: 52976 - protein, 9 aa, Homo Sapiens
EYVNKPLYL

SEQ ID NO: 52977 - protein, 9 aa, Homo Sapiens
ESSLIFDQI

SEQ ID NO: 52978 - protein, 9 aa, Homo Sapiens
GLYPLFGMC

SEQ ID NO: 52979 - protein, 9 aa, Homo Sapiens
DACFILSSR

SEQ ID NO: 52980 - protein, 9 aa, Homo Sapiens
HAIRPELVA

SEQ ID NO: 52981 - protein, 9 aa, Homo Sapiens
SLQHYVQNI

SEQ ID NO: 52982 - protein, 9 aa, Homo Sapiens
SGSYFFRGG

SEQ ID NO: 52983 - protein, 9 aa, Homo Sapiens
REKLRSPSA

SEQ ID NO: 52984 - protein, 9 aa, Homo Sapiens
IVRYVYENT

SEQ ID NO: 52985 - protein, 9 aa, Homo Sapiens
ANRCLSPQR

SEQ ID NO: 52986 - protein, 9 aa, Homo Sapiens
TARTTRGLY

SEQ ID NO: 52987 - protein, 9 aa, Homo Sapiens
SNTGSGTAS

SEQ ID NO: 52988 - protein, 9 aa, Homo Sapiens
DYVLYSLDL

SEQ ID NO: 52989 - protein, 9 aa, Homo Sapiens
SLLPSAHLD

SEQ ID NO: 52990 - protein, 9 aa, Homo Sapiens
PPQFSFEKA

SEQ ID NO: 52991 - protein, 9 aa, Homo Sapiens
QNQTCYFSI

SEQ ID NO: 52992 - protein, 9 aa, Homo Sapiens
IRPELVALE

SEQ ID NO: 52993 - protein, 9 aa, Homo Sapiens
TYGQDVGWS

SEQ ID NO: 52994 - protein, 9 aa, Homo Sapiens
TAAFNGINN

SEQ ID NO: 52995 - protein, 9 aa, Homo Sapiens
CLLGEVLLA

SEQ ID NO: 52996 - protein, 9 aa, Homo Sapiens
NSGDIKNNH

SEQ ID NO: 52997 - protein, 9 aa, Homo Sapiens
FPCCRGSGN

SEQ ID NO: 52998 - protein, 9 aa, Homo Sapiens
EPTGIGHLE

SEQ ID NO: 52999 - protein, 9 aa, Homo Sapiens
GDIKNNHSG

SEQ ID NO: 53000 - protein, 9 aa, Homo Sapiens
ASDRSGPDE

SEQ ID NO: 53001 - protein, 9 aa, Homo Sapiens
THFDSDAPW

SEQ ID NO: 53002 - protein, 9 aa, Homo Sapiens
SEIQALQEL

SEQ ID NO: 53003 - protein, 9 aa, Homo Sapiens
IPVFNLVSL

SEQ ID NO: 53004 - protein, 9 aa, Homo Sapiens
KLRSPSAAL

SEQ ID NO: 53005 - protein, 9 aa, Homo Sapiens
SLIFDQIPE

SEQ ID NO: 53006 - protein, 9 aa, Homo Sapiens
QINSPKDFT

SEQ ID NO: 53007 - protein, 9 aa, Homo Sapiens
PYHLIKARA

SEQ ID NO: 53008 - protein, 9 aa, Homo Sapiens
SPSSLSSCK

SEQ ID NO: 53009 - protein, 9 aa, Homo Sapiens
WRSLARKEC

SEQ ID NO: 53010 - protein, 9 aa, Homo Sapiens
QELLLYFWY

SEQ ID NO: 53011 - protein, 9 aa, Homo Sapiens
IGTAIAAFY

SEQ ID NO: 53012 - protein, 9 aa, Homo Sapiens
ILINTTHKE

SEQ ID NO: 53013 - protein, 9 aa, Homo Sapiens
SSDVLKNIY

SEQ ID NO: 53014 - protein, 9 aa, Homo Sapiens
VVNSSTPAN

SEQ ID NO: 53015 - protein, 9 aa, Homo Sapiens
DSKHGTLRP

SEQ ID NO: 53016 - protein, 9 aa, Homo Sapiens
RYRQELLLY

SEQ ID NO: 53017 - protein, 9 aa, Homo Sapiens
NSSQETQRS

SEQ ID NO: 53018 - protein, 9 aa, Homo Sapiens
SFFFFETES

SEQ ID NO: 53019 - protein, 9 aa, Homo Sapiens
DSSSVDENA

SEQ ID NO: 53020 - protein, 9 aa, Homo Sapiens
HTLMEEAPP

SEQ ID NO: 53021 - protein, 9 aa, Homo Sapiens
RNLKQISEQ

SEQ ID NO: 53022 - protein, 9 aa, Homo Sapiens
PEEHTLMEE

SEQ ID NO: 53023 - protein, 9 aa, Homo Sapiens
DSSQSFQEF

SEQ ID NO: 53024 - protein, 9 aa, Homo Sapiens
KSSVAMGTS

SEQ ID NO: 53025 - protein, 9 aa, Homo Sapiens
FSTSSRVGS

SEQ ID NO: 53026 - protein, 9 aa, Homo Sapiens
LPDLPPPPP

SEQ ID NO: 53027 - protein, 9 aa, Homo Sapiens
LTSGFRETS

SEQ ID NO: 53028 - protein, 9 aa, Homo Sapiens
LSQALRKAE

SEQ ID NO: 53029 - protein, 9 aa, Homo Sapiens
KHLHDLQDI

SEQ ID NO: 53030 - protein, 9 aa, Homo Sapiens
ASSIAANMM

SEQ ID NO: 53031 - protein, 9 aa, Homo Sapiens
EEFTARGFG

SEQ ID NO: 53032 - protein, 9 aa, Homo Sapiens
QALKLTMSA

SEQ ID NO: 53033 - protein, 9 aa, Homo Sapiens
LLWHNVSAV

SEQ ID NO: 53034 - protein, 9 aa, Homo Sapiens
DGGMSIWNV

SEQ ID NO: 53035 - protein, 9 aa, Homo Sapiens
EKIIQGPGV

SEQ ID NO: 53036 - protein, 9 aa, Homo Sapiens
MKMILQALG

SEQ ID NO: 53037 - protein, 9 aa, Homo Sapiens
PEQSPLGAK

SEQ ID NO: 53038 - protein, 9 aa, Homo Sapiens
VKTPQEGEK

SEQ ID NO: 53039 - protein, 9 aa, Homo Sapiens
LLKQMVYFE

SEQ ID NO: 53040 - protein, 9 aa, Homo Sapiens
RDYHVSRHI

SEQ ID NO: 53041 - protein, 9 aa, Homo Sapiens
RRPALPSAL

SEQ ID NO: 53042 - protein, 9 aa, Homo Sapiens
VRELRSKVE

SEQ ID NO: 53043 - protein, 9 aa, Homo Sapiens
VITRPQKQD

SEQ ID NO: 53044 - protein, 9 aa, Homo Sapiens
PQKQDMKDD

SEQ ID NO: 53045 - protein, 9 aa, Homo Sapiens
MEEDKFSRC

SEQ ID NO: 53046 - protein, 9 aa, Homo Sapiens
TTCCKAIKL

SEQ ID NO: 53047 - protein, 9 aa, Homo Sapiens
GERVAIEPG

SEQ ID NO: 53048 - protein, 9 aa, Homo Sapiens
TSGFRETSS

SEQ ID NO: 53049 - protein, 9 aa, Homo Sapiens
IVATHVCQF

SEQ ID NO: 53050 - protein, 9 aa, Homo Sapiens
IPQIVATHV

SEQ ID NO: 53051 - protein, 9 aa, Homo Sapiens
NHFLEITDE

SEQ ID NO: 53052 - protein, 9 aa, Homo Sapiens
LGFEHITPM

SEQ ID NO: 53053 - protein, 9 aa, Homo Sapiens
TISPLVVAK

SEQ ID NO: 53054 - protein, 9 aa, Homo Sapiens
VLFLDQYFN

SEQ ID NO: 53055 - protein, 9 aa, Homo Sapiens
DKFSRCALR

SEQ ID NO: 53056 - protein, 9 aa, Homo Sapiens
ANRPKYTTD

SEQ ID NO: 53057 - protein, 9 aa, Homo Sapiens
RVLEIQAGM

SEQ ID NO: 53058 - protein, 9 aa, Homo Sapiens
VSGKSSVAM

SEQ ID NO: 53059 - protein, 9 aa, Homo Sapiens
AVCSGCVNF

SEQ ID NO: 53060 - protein, 9 aa, Homo Sapiens
AQELRQYKV

SEQ ID NO: 53061 - protein, 9 aa, Homo Sapiens
LVSQVRCSK

SEQ ID NO: 53062 - protein, 9 aa, Homo Sapiens
RGGYAAKKE

SEQ ID NO: 53063 - protein, 9 aa, Homo Sapiens
SLDCGTMRS

SEQ ID NO: 53064 - protein, 9 aa, Homo Sapiens
LGSEPRSVN

SEQ ID NO: 53065 - protein, 9 aa, Homo Sapiens
ATQSNALSS

SEQ ID NO: 53066 - protein, 9 aa, Homo Sapiens
ASVTQAGVQ

SEQ ID NO: 53067 - protein, 9 aa, Homo Sapiens
TVFLGPGVL

SEQ ID NO: 53068 - protein, 9 aa, Homo Sapiens
LSTALLVQV

SEQ ID NO: 53069 - protein, 9 aa, Homo Sapiens
NQSQALKLT

SEQ ID NO: 53070 - protein, 9 aa, Homo Sapiens
PRRPALPSA

SEQ ID NO: 53071 - protein, 9 aa, Homo Sapiens
RGLSQALRK

SEQ ID NO: 53072 - protein, 9 aa, Homo Sapiens
HLRGISGLR

SEQ ID NO: 53073 - protein, 9 aa, Homo Sapiens
CCKAIKLFV

SEQ ID NO: 53074 - protein, 9 aa, Homo Sapiens
RKNIKPTSA

SEQ ID NO: 53075 - protein, 9 aa, Homo Sapiens
SAGKRHGSH

SEQ ID NO: 53076 - protein, 9 aa, Homo Sapiens
MTPTVFSSH

SEQ ID NO: 53077 - protein, 9 aa, Homo Sapiens
SCSQKRLLL

SEQ ID NO: 53078 - protein, 9 aa, Homo Sapiens
IPEEHTLME

SEQ ID NO: 53079 - protein, 9 aa, Homo Sapiens
LRSKVELEY

SEQ ID NO: 53080 - protein, 9 aa, Homo Sapiens
GKSSVAMGT

SEQ ID NO: 53081 - protein, 9 aa, Homo Sapiens
YAAKKEERQ

SEQ ID NO: 53082 - protein, 9 aa, Homo Sapiens
EMGPPVLGL

SEQ ID NO: 53083 - protein, 9 aa, Homo Sapiens
NDSRDPDRQ

SEQ ID NO: 53084 - protein, 9 aa, Homo Sapiens
CALRDAYCS

SEQ ID NO: 53085 - protein, 9 aa, Homo Sapiens
IAASSIAAN

SEQ ID NO: 53086 - protein, 9 aa, Homo Sapiens
VSAVGSCRW

SEQ ID NO: 53087 - protein, 9 aa, Homo Sapiens
PIADSYYGL

SEQ ID NO: 53088 - protein, 9 aa, Homo Sapiens
FVERKDEQG

SEQ ID NO: 53089 - protein, 9 aa, Homo Sapiens
QPSLDCGTM

SEQ ID NO: 53090 - protein, 9 aa, Homo Sapiens
LSDFHQGAK

SEQ ID NO: 53091 - protein, 9 aa, Homo Sapiens
TAKSGSTPI

SEQ ID NO: 53092 - protein, 9 aa, Homo Sapiens
EKHLHDLQD

SEQ ID NO: 53093 - protein, 9 aa, Homo Sapiens
SSPSSLLCA

SEQ ID NO: 53094 - protein, 9 aa, Homo Sapiens
DMLEESPFV

SEQ ID NO: 53095 - protein, 9 aa, Homo Sapiens
FSGVRWLTR

SEQ ID NO: 53096 - protein, 9 aa, Homo Sapiens
PRRQALFFP

SEQ ID NO: 53097 - protein, 9 aa, Homo Sapiens
KEEQLLSPL

SEQ ID NO: 53098 - protein, 9 aa, Homo Sapiens
GSIKSLRTF

SEQ ID NO: 53099 - protein, 9 aa, Homo Sapiens
SPHCLPAVF

SEQ ID NO: 53100 - protein, 9 aa, Homo Sapiens
LSMSIRWLA

SEQ ID NO: 53101 - protein, 9 aa, Homo Sapiens
HRLQDAEEH

SEQ ID NO: 53102 - protein, 9 aa, Homo Sapiens
HFLEITDED

SEQ ID NO: 53103 - protein, 9 aa, Homo Sapiens
WMANQSQAL

SEQ ID NO: 53104 - protein, 9 aa, Homo Sapiens
HVYLAYTED

SEQ ID NO: 53105 - protein, 9 aa, Homo Sapiens
PVSDAFKTE

SEQ ID NO: 53106 - protein, 9 aa, Homo Sapiens
VFSSHHTAG

SEQ ID NO: 53107 - protein, 9 aa, Homo Sapiens
VGFKEKISL

SEQ ID NO: 53108 - protein, 9 aa, Homo Sapiens
FLGHNVHAR

SEQ ID NO: 53109 - protein, 9 aa, Homo Sapiens
DFHQGAKGW

SEQ ID NO: 53110 - protein, 9 aa, Homo Sapiens
EKGSIKSLR

SEQ ID NO: 53111 - protein, 9 aa, Homo Sapiens
GDVGPDPIA

SEQ ID NO: 53112 - protein, 9 aa, Homo Sapiens
FTTELYTQT

SEQ ID NO: 53113 - protein, 9 aa, Homo Sapiens
HVKAARATM

SEQ ID NO: 53114 - protein, 9 aa, Homo Sapiens
AFIRDYHVS

SEQ ID NO: 53115 - protein, 9 aa, Homo Sapiens
TQAGVQWRY

SEQ ID NO: 53116 - protein, 9 aa, Homo Sapiens
SDSGTCHSP

SEQ ID NO: 53117 - protein, 9 aa, Homo Sapiens
SSVDENARI

SEQ ID NO: 53118 - protein, 9 aa, Homo Sapiens
IIQGPGVDE

SEQ ID NO: 53119 - protein, 9 aa, Homo Sapiens
HDLQDIFDP

SEQ ID NO: 53120 - protein, 9 aa, Homo Sapiens
YHVSRHILT

SEQ ID NO: 53121 - protein, 9 aa, Homo Sapiens
YNSYDISKD

SEQ ID NO: 53122 - protein, 9 aa, Homo Sapiens
DQGAEMDNS

SEQ ID NO: 53123 - protein, 9 aa, Homo Sapiens
KKLAHRLQD

SEQ ID NO: 53124 - protein, 9 aa, Homo Sapiens
KLSKGGPGS

SEQ ID NO: 53125 - protein, 9 aa, Homo Sapiens
LAMCQDKDN

SEQ ID NO: 53126 - protein, 9 aa, Homo Sapiens
EDAERPQGL

SEQ ID NO: 53127 - protein, 9 aa, Homo Sapiens
HCLPAVFSS

SEQ ID NO: 53128 - protein, 9 aa, Homo Sapiens
MSLKDGRKN

SEQ ID NO: 53129 - protein, 9 aa, Homo Sapiens
SPDRRAWLL

SEQ ID NO: 53130 - protein, 9 aa, Homo Sapiens
DCYFFFLFH

SEQ ID NO: 53131 - protein, 9 aa, Homo Sapiens
RCSKSGMNF

SEQ ID NO: 53132 - protein, 9 aa, Homo Sapiens
LGPGVLFLD

SEQ ID NO: 53133 - protein, 9 aa, Homo Sapiens
PIPQIVATH

SEQ ID NO: 53134 - protein, 9 aa, Homo Sapiens
EQSPLGAKF

SEQ ID NO: 53135 - protein, 9 aa, Homo Sapiens
DTVFLGPGV

SEQ ID NO: 53136 - protein, 9 aa, Homo Sapiens
SKDTLYVSK

SEQ ID NO: 53137 - protein, 9 aa, Homo Sapiens
ARSSAGKRH

SEQ ID NO: 53138 - protein, 9 aa, Homo Sapiens
LSLPIHVKA

SEQ ID NO: 53139 - protein, 9 aa, Homo Sapiens
PGVDEPLSE

SEQ ID NO: 53140 - protein, 9 aa, Homo Sapiens
EQLKQAQEL

SEQ ID NO: 53141 - protein, 9 aa, Homo Sapiens
AKKEERQQW

SEQ ID NO: 53142 - protein, 9 aa, Homo Sapiens
VQTVKLSKG

SEQ ID NO: 53143 - protein, 9 aa, Homo Sapiens
EPLAGLEPL

SEQ ID NO: 53144 - protein, 9 aa, Homo Sapiens
EEQLLSPLP

SEQ ID NO: 53145 - protein, 9 aa, Homo Sapiens
KTEQVKYSE

SEQ ID NO: 53146 - protein, 9 aa, Homo Sapiens
WHNVSAVGS

SEQ ID NO: 53147 - protein, 9 aa, Homo Sapiens
SGTVGFKEK

SEQ ID NO: 53148 - protein, 9 aa, Homo Sapiens
LTITLEDSS

SEQ ID NO: 53149 - protein, 9 aa, Homo Sapiens
LEESPFVKM

SEQ ID NO: 53150 - protein, 9 aa, Homo Sapiens
VMKLACSDT

SEQ ID NO: 53151 - protein, 9 aa, Homo Sapiens
GPGVDEPLS

SEQ ID NO: 53152 - protein, 9 aa, Homo Sapiens
MDMQAVHRA

SEQ ID NO: 53153 - protein, 9 aa, Homo Sapiens
SVALRNLKQ

SEQ ID NO: 53154 - protein, 9 aa, Homo Sapiens
ISKDTLYVS

SEQ ID NO: 53155 - protein, 9 aa, Homo Sapiens
AKGWWARSV

SEQ ID NO: 53156 - protein, 9 aa, Homo Sapiens
NFSQLFAHA

SEQ ID NO: 53157 - protein, 9 aa, Homo Sapiens
LRNLKQISE

SEQ ID NO: 53158 - protein, 9 aa, Homo Sapiens
RGSQGRGGG

SEQ ID NO: 53159 - protein, 9 aa, Homo Sapiens
ATLESEEDS

SEQ ID NO: 53160 - protein, 9 aa, Homo Sapiens
WDFSEAVCS

SEQ ID NO: 53161 - protein, 9 aa, Homo Sapiens
GTTCCKAIK

SEQ ID NO: 53162 - protein, 9 aa, Homo Sapiens
VNRLSATAC

SEQ ID NO: 53163 - protein, 9 aa, Homo Sapiens
VKAARATMV

SEQ ID NO: 53164 - protein, 9 aa, Homo Sapiens
MYLEGSIYE

SEQ ID NO: 53165 - protein, 9 aa, Homo Sapiens
ENARIVSGN

SEQ ID NO: 53166 - protein, 9 aa, Homo Sapiens
TELYTQTVN

SEQ ID NO: 53167 - protein, 9 aa, Homo Sapiens
PEEFTARGF

SEQ ID NO: 53168 - protein, 9 aa, Homo Sapiens
SLKDGRKNI

SEQ ID NO: 53169 - protein, 9 aa, Homo Sapiens
YTEDSLRQS

SEQ ID NO: 53170 - protein, 9 aa, Homo Sapiens
ELRSKVELE

SEQ ID NO: 53171 - protein, 9 aa, Homo Sapiens
ADSARQQER

SEQ ID NO: 53172 - protein, 9 aa, Homo Sapiens
TLCSFFFFE

SEQ ID NO: 53173 - protein, 9 aa, Homo Sapiens
FVVYKQMRP

SEQ ID NO: 53174 - protein, 9 aa, Homo Sapiens
PADLPVAKR

SEQ ID NO: 53175 - protein, 9 aa, Homo Sapiens
ALLWHNVSA

SEQ ID NO: 53176 - protein, 9 aa, Homo Sapiens
PIKWTAPQS

SEQ ID NO: 53177 - protein, 9 aa, Homo Sapiens
EQQAKCLLK

SEQ ID NO: 53178 - protein, 9 aa, Homo Sapiens
LPIHVKAAR

SEQ ID NO: 53179 - protein, 9 aa, Homo Sapiens
RRQALFFPS

SEQ ID NO: 53180 - protein, 8 aa, Homo Sapiens
KRLCTVRD

SEQ ID NO: 53181 - protein, 9 aa, Homo Sapiens
TPQRALPRV

SEQ ID NO: 53182 - protein, 9 aa, Homo Sapiens
LPSALGELG

SEQ ID NO: 53183 - protein, 9 aa, Homo Sapiens
PQEGEKQSQ

SEQ ID NO: 53184 - protein, 9 aa, Homo Sapiens
GSRLENHFL

SEQ ID NO: 53185 - protein, 9 aa, Homo Sapiens
VGPDPIADS

SEQ ID NO: 53186 - protein, 9 aa, Homo Sapiens
NSYDISKDT

SEQ ID NO: 53187 - protein, 9 aa, Homo Sapiens
LSKGGPGSA

SEQ ID NO: 53188 - protein, 9 aa, Homo Sapiens
FAYLLPVWI

SEQ ID NO: 53189 - protein, 9 aa, Homo Sapiens
PDHFLPQSY

SEQ ID NO: 53190 - protein, 9 aa, Homo Sapiens
IEFCYTIAH

SEQ ID NO: 53191 - protein, 9 aa, Homo Sapiens
DTLNDSRDP

SEQ ID NO: 53192 - protein, 9 aa, Homo Sapiens
VSGTVGFKE

SEQ ID NO: 53193 - protein, 9 aa, Homo Sapiens
PALPSALGE

SEQ ID NO: 53194 - protein, 9 aa, Homo Sapiens
CKAIKLFVE

SEQ ID NO: 53195 - protein, 9 aa, Homo Sapiens
NRLAQRCYP

SEQ ID NO: 53196 - protein, 9 aa, Homo Sapiens
GAEMDNSSQ

SEQ ID NO: 53197 - protein, 9 aa, Homo Sapiens
EPKANRPKY

SEQ ID NO: 53198 - protein, 9 aa, Homo Sapiens
KGSIKSLRT

SEQ ID NO: 53199 - protein, 9 aa, Homo Sapiens
SEQQAKCLL

SEQ ID NO: 53200 - protein, 9 aa, Homo Sapiens
APRVPFYCS

SEQ ID NO: 53201 - protein, 9 aa, Homo Sapiens
GFKEKISLS

SEQ ID NO: 53202 - protein, 9 aa, Homo Sapiens
GYAAKKEER

SEQ ID NO: 53203 - protein, 9 aa, Homo Sapiens
NSTWRTVNR

SEQ ID NO: 53204 - protein, 9 aa, Homo Sapiens
RLAQRCYPT

SEQ ID NO: 53205 - protein, 9 aa, Homo Sapiens
SQGRGGGGT

SEQ ID NO: 53206 - protein, 9 aa, Homo Sapiens
VDSSQSFQE

SEQ ID NO: 53207 - protein, 9 aa, Homo Sapiens
APSKLGFII

SEQ ID NO: 53208 - protein, 9 aa, Homo Sapiens
YTIAHKYLF

SEQ ID NO: 53209 - protein, 9 aa, Homo Sapiens
MSIRWLAMD

SEQ ID NO: 53210 - protein, 9 aa, Homo Sapiens
EEKIINDEN

SEQ ID NO: 53211 - protein, 9 aa, Homo Sapiens
PSCSQKRLL

SEQ ID NO: 53212 - protein, 9 aa, Homo Sapiens
SLPIHVKAA

SEQ ID NO: 53213 - protein, 9 aa, Homo Sapiens
RSSAGKRHG

SEQ ID NO: 53214 - protein, 9 aa, Homo Sapiens
DSRDPDRQP

SEQ ID NO: 53215 - protein, 9 aa, Homo Sapiens
ASICRRTAT

SEQ ID NO: 53216 - protein, 9 aa, Homo Sapiens
EEGSRLENH

SEQ ID NO: 53217 - protein, 9 aa, Homo Sapiens
AMCQDKDNT

SEQ ID NO: 53218 - protein, 9 aa, Homo Sapiens
ENHFLEITD

SEQ ID NO: 53219 - protein, 9 aa, Homo Sapiens
KTEMELLQA

SEQ ID NO: 53220 - protein, 9 aa, Homo Sapiens
QSPLGAKFQ

SEQ ID NO: 53221 - protein, 9 aa, Homo Sapiens
YSVALRNLK

SEQ ID NO: 53222 - protein, 9 aa, Homo Sapiens
PELLRFLGH

SEQ ID NO: 53223 - protein, 9 aa, Homo Sapiens
TTDPTQKAN

SEQ ID NO: 53224 - protein, 9 aa, Homo Sapiens
PVLGLPGLK

SEQ ID NO: 53225 - protein, 9 aa, Homo Sapiens
CLPAVFSSS

SEQ ID NO: 53226 - protein, 9 aa, Homo Sapiens
ATHVCQFLE

SEQ ID NO: 53227 - protein, 9 aa, Homo Sapiens
DMKDDQDHY

SEQ ID NO: 53228 - protein, 9 aa, Homo Sapiens
SYDSLSEDA

SEQ ID NO: 53229 - protein, 9 aa, Homo Sapiens
TLNDSRDPD

SEQ ID NO: 53230 - protein, 9 aa, Homo Sapiens
ISPLVVAKG

SEQ ID NO: 53231 - protein, 9 aa, Homo Sapiens
SRHHPEQSP

SEQ ID NO: 53232 - protein, 9 aa, Homo Sapiens
HTTDPTQKA

SEQ ID NO: 53233 - protein, 9 aa, Homo Sapiens
CLSDLVFAY

SEQ ID NO: 53234 - protein, 9 aa, Homo Sapiens
RVPFYCSEC

SEQ ID NO: 53235 - protein, 9 aa, Homo Sapiens
LCATPIPLP

SEQ ID NO: 53236 - protein, 9 aa, Homo Sapiens
LSPLPPSPM

SEQ ID NO: 53237 - protein, 9 aa, Homo Sapiens
PPTLPDLPP

SEQ ID NO: 53238 - protein, 9 aa, Homo Sapiens
LVFAYLLPV

SEQ ID NO: 53239 - protein, 9 aa, Homo Sapiens
AYLLPVWIS

SEQ ID NO: 53240 - protein, 9 aa, Homo Sapiens
IAANMMSAA

SEQ ID NO: 53241 - protein, 9 aa, Homo Sapiens
TAIHLRGIS

SEQ ID NO: 53242 - protein, 9 aa, Homo Sapiens
SCLSMSIRW

SEQ ID NO: 53243 - protein, 9 aa, Homo Sapiens
YKQMRPQDA

SEQ ID NO: 53244 - protein, 9 aa, Homo Sapiens
PSLDCGTMR

SEQ ID NO: 53245 - protein, 9 aa, Homo Sapiens
GSGSGGGGL

SEQ ID NO: 53246 - protein, 9 aa, Homo Sapiens
IKSLRTFLL

SEQ ID NO: 53247 - protein, 9 aa, Homo Sapiens
VAKGGTAWL

SEQ ID NO: 53248 - protein, 9 aa, Homo Sapiens
RGGRGRGSQ

SEQ ID NO: 53249 - protein, 9 aa, Homo Sapiens
YCSECGKSF

SEQ ID NO: 53250 - protein, 9 aa, Homo Sapiens
LPPSCSQKR

SEQ ID NO: 53251 - protein, 9 aa, Homo Sapiens
WARGGYAAK

SEQ ID NO: 53252 - protein, 9 aa, Homo Sapiens
RRTATGDVQ

SEQ ID NO: 53253 - protein, 9 aa, Homo Sapiens
DAAGEPKAN

SEQ ID NO: 53254 - protein, 9 aa, Homo Sapiens
VSLPEEFTA

SEQ ID NO: 53255 - protein, 9 aa, Homo Sapiens
PPLGFEHIT

SEQ ID NO: 53256 - protein, 9 aa, Homo Sapiens
QQKNDQQVK

SEQ ID NO: 53257 - protein, 9 aa, Homo Sapiens
SASVTQAGV

SEQ ID NO: 53258 - protein, 9 aa, Homo Sapiens
EEDKFSRCA

SEQ ID NO: 53259 - protein, 9 aa, Homo Sapiens
EDCYFFFLF

SEQ ID NO: 53260 - protein, 9 aa, Homo Sapiens
RKYWDVPPL

SEQ ID NO: 53261 - protein, 9 aa, Homo Sapiens
INQGVAPMV

SEQ ID NO: 53262 - protein, 9 aa, Homo Sapiens
SLPPSCSQK

SEQ ID NO: 53263 - protein, 9 aa, Homo Sapiens
KGGTAWLEW

SEQ ID NO: 53264 - protein, 9 aa, Homo Sapiens
KPAVTAERC

SEQ ID NO: 53265 - protein, 9 aa, Homo Sapiens
MCQDKDNTL

SEQ ID NO: 53266 - protein, 9 aa, Homo Sapiens
GSTPILKCP

SEQ ID NO: 53267 - protein, 9 aa, Homo Sapiens
PTLPDLPPP

SEQ ID NO: 53268 - protein, 9 aa, Homo Sapiens
SNALSSVSC

SEQ ID NO: 53269 - protein, 9 aa, Homo Sapiens
ILLEKGSIK

SEQ ID NO: 53270 - protein, 9 aa, Homo Sapiens
EIPEEHTLM

SEQ ID NO: 53271 - protein, 9 aa, Homo Sapiens
VNSTWRTVN

SEQ ID NO: 53272 - protein, 9 aa, Homo Sapiens
EVVQVMKLA

SEQ ID NO: 53273 - protein, 9 aa, Homo Sapiens
LLFVNEATR

SEQ ID NO: 53274 - protein, 9 aa, Homo Sapiens
RPADLPVAK

SEQ ID NO: 53275 - protein, 9 aa, Homo Sapiens
SQALRKAEA

SEQ ID NO: 53276 - protein, 9 aa, Homo Sapiens
STGKSELRR

SEQ ID NO: 53277 - protein, 9 aa, Homo Sapiens
QGRGGGGTR

SEQ ID NO: 53278 - protein, 9 aa, Homo Sapiens
CGITAIQMA

SEQ ID NO: 53279 - protein, 9 aa, Homo Sapiens
GGKTEQVKY

SEQ ID NO: 53280 - protein, 9 aa, Homo Sapiens
FLGPGVLFL

SEQ ID NO: 53281 - protein, 9 aa, Homo Sapiens
HHTAGGMTP

SEQ ID NO: 53282 - protein, 9 aa, Homo Sapiens
VYFEKVKLT

SEQ ID NO: 53283 - protein, 9 aa, Homo Sapiens
SGSTPILKC

SEQ ID NO: 53284 - protein, 9 aa, Homo Sapiens
QAQELRQYK

SEQ ID NO: 53285 - protein, 9 aa, Homo Sapiens
PLVVAKGGT

SEQ ID NO: 53286 - protein, 9 aa, Homo Sapiens
YLAYTEDSL

SEQ ID NO: 53287 - protein, 9 aa, Homo Sapiens
YFFFLFHMY

SEQ ID NO: 53288 - protein, 9 aa, Homo Sapiens
TGTTCCKAI

SEQ ID NO: 53289 - protein, 9 aa, Homo Sapiens
KGWWARSVG

SEQ ID NO: 53290 - protein, 9 aa, Homo Sapiens
GLMDMQAVH

SEQ ID NO: 53291 - protein, 9 aa, Homo Sapiens
TPPRRPALP

SEQ ID NO: 53292 - protein, 9 aa, Homo Sapiens
ILSLPIHVK

SEQ ID NO: 53293 - protein, 9 aa, Homo Sapiens
NPEEVKTPQ

SEQ ID NO: 53294 - protein, 9 aa, Homo Sapiens
GTTGTTCCK

SEQ ID NO: 53295 - protein, 9 aa, Homo Sapiens
AFSGVRWLT

SEQ ID NO: 53296 - protein, 9 aa, Homo Sapiens
YFEKVKLTN

SEQ ID NO: 53297 - protein, 9 aa, Homo Sapiens
GGRGRGSQG

SEQ ID NO: 53298 - protein, 9 aa, Homo Sapiens
TTVKKFFST

SEQ ID NO: 53299 - protein, 9 aa, Homo Sapiens
TWRTVNRLS

SEQ ID NO: 53300 - protein, 9 aa, Homo Sapiens
SIAANMMSA

SEQ ID NO: 53301 - protein, 9 aa, Homo Sapiens
RALPRVAFW

SEQ ID NO: 53302 - protein, 9 aa, Homo Sapiens
VPPTLPDLP

SEQ ID NO: 53303 - protein, 9 aa, Homo Sapiens
ALPSALGEL

SEQ ID NO: 53304 - protein, 9 aa, Homo Sapiens
AIQMAEGAP

SEQ ID NO: 53305 - protein, 9 aa, Homo Sapiens
VKYSETYCM

SEQ ID NO: 53306 - protein, 9 aa, Homo Sapiens
HQGAKGWWA

SEQ ID NO: 53307 - protein, 9 aa, Homo Sapiens
FFLFHMYQR

SEQ ID NO: 53308 - protein, 9 aa, Homo Sapiens
DFSEAVCSG

SEQ ID NO: 53309 - protein, 9 aa, Homo Sapiens
YVQTVKLSK

SEQ ID NO: 53310 - protein, 9 aa, Homo Sapiens
ATGDVQVLG

SEQ ID NO: 53311 - protein, 9 aa, Homo Sapiens
GHNVHARKN

SEQ ID NO: 53312 - protein, 9 aa, Homo Sapiens
MANQSQALK

SEQ ID NO: 53313 - protein, 9 aa, Homo Sapiens
FFFETESAS

SEQ ID NO: 53314 - protein, 9 aa, Homo Sapiens
DRRAWLLTS

SEQ ID NO: 53315 - protein, 9 aa, Homo Sapiens
TAIQMAEGA

SEQ ID NO: 53316 - protein, 9 aa, Homo Sapiens
SRCALRDAY

SEQ ID NO: 53317 - protein, 9 aa, Homo Sapiens
NMMSAAAIA

SEQ ID NO: 53318 - protein, 9 aa, Homo Sapiens
VFAYLLPVW

SEQ ID NO: 53319 - protein, 9 aa, Homo Sapiens
PVAKRASLN

SEQ ID NO: 53320 - protein, 9 aa, Homo Sapiens
WLLTSLMLV

SEQ ID NO: 53321 - protein, 9 aa, Homo Sapiens
LAQRCYPTQ

SEQ ID NO: 53322 - protein, 9 aa, Homo Sapiens
IQAGMYLEG

SEQ ID NO: 53323 - protein, 9 aa, Homo Sapiens
DISKDTLYV

SEQ ID NO: 53324 - protein, 9 aa, Homo Sapiens
SQALKLTMS

SEQ ID NO: 53325 - protein, 9 aa, Homo Sapiens
MLEESPFVK

SEQ ID NO: 53326 - protein, 9 aa, Homo Sapiens
VEPQPPPKG

SEQ ID NO: 53327 - protein, 9 aa, Homo Sapiens
VSDAFKTEM

SEQ ID NO: 53328 - protein, 9 aa, Homo Sapiens
RYLGSLQPL

SEQ ID NO: 53329 - protein, 9 aa, Homo Sapiens
YKNSSTGKS

SEQ ID NO: 53330 - protein, 9 aa, Homo Sapiens
RRRPRRQAL

SEQ ID NO: 53331 - protein, 9 aa, Homo Sapiens
APQSLAYNT

SEQ ID NO: 53332 - protein, 9 aa, Homo Sapiens
KYSETYCMF

SEQ ID NO: 53333 - protein, 9 aa, Homo Sapiens
ATSASCLSM

SEQ ID NO: 53334 - protein, 9 aa, Homo Sapiens
FVKMTLPWG

SEQ ID NO: 53335 - protein, 9 aa, Homo Sapiens
TQSNALSSV

SEQ ID NO: 53336 - protein, 9 aa, Homo Sapiens
EDKFSRCAL

SEQ ID NO: 53337 - protein, 9 aa, Homo Sapiens
CKPAVTAER

SEQ ID NO: 53338 - protein, 9 aa, Homo Sapiens
RGRGSQGRG

SEQ ID NO: 53339 - protein, 9 aa, Homo Sapiens
VFLGPGVLF

SEQ ID NO: 53340 - protein, 9 aa, Homo Sapiens
VKANLVVQE

SEQ ID NO: 53341 - protein, 9 aa, Homo Sapiens
PEEVKTPQE

SEQ ID NO: 53342 - protein, 9 aa, Homo Sapiens
LSPHCLPAV

SEQ ID NO: 53343 - protein, 9 aa, Homo Sapiens
AAKKEERQQ

SEQ ID NO: 53344 - protein, 9 aa, Homo Sapiens
GPGVLFLDQ

SEQ ID NO: 53345 - protein, 9 aa, Homo Sapiens
NRRPILTIT

SEQ ID NO: 53346 - protein, 9 aa, Homo Sapiens
PLKACKTPQ

SEQ ID NO: 53347 - protein, 9 aa, Homo Sapiens
GRLKWIFRR

SEQ ID NO: 53348 - protein, 9 aa, Homo Sapiens
KMILQALGK

SEQ ID NO: 53349 - protein, 9 aa, Homo Sapiens
EFTARGFGP

SEQ ID NO: 53350 - protein, 9 aa, Homo Sapiens
FQAKQMTSP

SEQ ID NO: 53351 - protein, 9 aa, Homo Sapiens
LSLSTALLV

SEQ ID NO: 53352 - protein, 9 aa, Homo Sapiens
QDQGAEMDN

SEQ ID NO: 53353 - protein, 9 aa, Homo Sapiens
VVSGTVGFK

SEQ ID NO: 53354 - protein, 9 aa, Homo Sapiens
DVEPQPPPK

SEQ ID NO: 53355 - protein, 9 aa, Homo Sapiens
VCKPAVTAE

SEQ ID NO: 53356 - protein, 9 aa, Homo Sapiens
VKMTLPWGT

SEQ ID NO: 53357 - protein, 9 aa, Homo Sapiens
QSLAYNTFS

SEQ ID NO: 53358 - protein, 9 aa, Homo Sapiens
WTLGTLGSE

SEQ ID NO: 53359 - protein, 9 aa, Homo Sapiens
IQGPGVDEP

SEQ ID NO: 53360 - protein, 9 aa, Homo Sapiens
DGRLKWIFR

SEQ ID NO: 53361 - protein, 9 aa, Homo Sapiens
PQSYTCFFL

SEQ ID NO: 53362 - protein, 9 aa, Homo Sapiens
RSKVELEYP

SEQ ID NO: 53363 - protein, 9 aa, Homo Sapiens
PTQKANLKL

SEQ ID NO: 53364 - protein, 9 aa, Homo Sapiens
LAYVGTAIH

SEQ ID NO: 53365 - protein, 9 aa, Homo Sapiens
LFVNEATRV

SEQ ID NO: 53366 - protein, 9 aa, Homo Sapiens
AKGGTAWLE

SEQ ID NO: 53367 - protein, 9 aa, Homo Sapiens
CYFFFLFHM

SEQ ID NO: 53368 - protein, 9 aa, Homo Sapiens
HVSRHILTH

SEQ ID NO: 53369 - protein, 9 aa, Homo Sapiens
QTLCSFFFF

SEQ ID NO: 53370 - protein, 9 aa, Homo Sapiens
QWMANQSQA

SEQ ID NO: 53371 - protein, 9 aa, Homo Sapiens
KRHGSHHQQ

SEQ ID NO: 53372 - protein, 9 aa, Homo Sapiens
SQPSLDCGT

SEQ ID NO: 53373 - protein, 9 aa, Homo Sapiens
AANMMSAAA

SEQ ID NO: 53374 - protein, 9 aa, Homo Sapiens
TSASCLSMS

SEQ ID NO: 53375 - protein, 9 aa, Homo Sapiens
GDSSSVDEN

SEQ ID NO: 53376 - protein, 9 aa, Homo Sapiens
AQRCYPTQP

SEQ ID NO: 53377 - protein, 9 aa, Homo Sapiens
VCGHLIMKM

SEQ ID NO: 53378 - protein, 9 aa, Homo Sapiens
VHRAQPLGF

SEQ ID NO: 53379 - protein, 9 aa, Homo Sapiens
CYTIAHKYL

SEQ ID NO: 53380 - protein, 9 aa, Homo Sapiens
EYVQTVKLS

SEQ ID NO: 53381 - protein, 9 aa, Homo Sapiens
GEWSGKQPM

SEQ ID NO: 53382 - protein, 9 aa, Homo Sapiens
CEVVQVMKL

SEQ ID NO: 53383 - protein, 9 aa, Homo Sapiens
SARQQERHY

SEQ ID NO: 53384 - protein, 9 aa, Homo Sapiens
ALSSVSCMP

SEQ ID NO: 53385 - protein, 9 aa, Homo Sapiens
DCGTMRSSL

SEQ ID NO: 53386 - protein, 9 aa, Homo Sapiens
GRGRGSQGR

SEQ ID NO: 53387 - protein, 9 aa, Homo Sapiens
CSGCVNFEG

SEQ ID NO: 53388 - protein, 9 aa, Homo Sapiens
LLCATPIPL

SEQ ID NO: 53389 - protein, 9 aa, Homo Sapiens
VATHVCQFL

SEQ ID NO: 53390 - protein, 9 aa, Homo Sapiens
TEDSLRQSL

SEQ ID NO: 53391 - protein, 9 aa, Homo Sapiens
FFETESASV

SEQ ID NO: 53392 - protein, 9 aa, Homo Sapiens
IAHKYLFEG

SEQ ID NO: 53393 - protein, 9 aa, Homo Sapiens
VITLWYPPP

SEQ ID NO: 53394 - protein, 9 aa, Homo Sapiens
PNRLAQRCY

SEQ ID NO: 53395 - protein, 9 aa, Homo Sapiens
DVGPDPIAD

SEQ ID NO: 53396 - protein, 9 aa, Homo Sapiens
LFVVYKQMR

SEQ ID NO: 53397 - protein, 9 aa, Homo Sapiens
MDNSSQETQ

SEQ ID NO: 53398 - protein, 9 aa, Homo Sapiens
MDGGMSIWN

SEQ ID NO: 53399 - protein, 9 aa, Homo Sapiens
LKDGRKNIK

SEQ ID NO: 53400 - protein, 9 aa, Homo Sapiens
SMSIRWLAM

SEQ ID NO: 53401 - protein, 9 aa, Homo Sapiens
TNVSGKSSV

SEQ ID NO: 53402 - protein, 9 aa, Homo Sapiens
NEATRVFHD

SEQ ID NO: 53403 - protein, 9 aa, Homo Sapiens
KAFIRDYHV

SEQ ID NO: 53404 - protein, 9 aa, Homo Sapiens
RALLGLDKL

SEQ ID NO: 53405 - protein, 9 aa, Homo Sapiens
EQLLSPLPP

SEQ ID NO: 53406 - protein, 9 aa, Homo Sapiens
LPVKANLVV

SEQ ID NO: 53407 - protein, 9 aa, Homo Sapiens
PDPIADSYY

SEQ ID NO: 53408 - protein, 9 aa, Homo Sapiens
GKQPMCIKA

SEQ ID NO: 53409 - protein, 9 aa, Homo Sapiens
VSGFVERKD

SEQ ID NO: 53410 - protein, 9 aa, Homo Sapiens
IKTPLKACK

SEQ ID NO: 53411 - protein, 9 aa, Homo Sapiens
QDMKDDQDH

SEQ ID NO: 53412 - protein, 9 aa, Homo Sapiens
FKTEMELLQ

SEQ ID NO: 53413 - protein, 9 aa, Homo Sapiens
CLSMSIRWL

SEQ ID NO: 53414 - protein, 9 aa, Homo Sapiens
WEGEAEQGK

SEQ ID NO: 53415 - protein, 9 aa, Homo Sapiens
GLDKLLGRA

SEQ ID NO: 53416 - protein, 9 aa, Homo Sapiens
KAARATMVL

SEQ ID NO: 53417 - protein, 9 aa, Homo Sapiens
SNSDSGTCH

SEQ ID NO: 53418 - protein, 9 aa, Homo Sapiens
SSQSFQEFC

SEQ ID NO: 53419 - protein, 9 aa, Homo Sapiens
IWNVKSLES

SEQ ID NO: 53420 - protein, 9 aa, Homo Sapiens
PHDGRLKWI

SEQ ID NO: 53421 - protein, 9 aa, Homo Sapiens
PTVFSSHHT

SEQ ID NO: 53422 - protein, 9 aa, Homo Sapiens
EDSLRQSLM

SEQ ID NO: 53423 - protein, 9 aa, Homo Sapiens
LGIKTPLKA

SEQ ID NO: 53424 - protein, 9 aa, Homo Sapiens
FSCFFFIGM

SEQ ID NO: 53425 - protein, 9 aa, Homo Sapiens
FVNEATRVF

SEQ ID NO: 53426 - protein, 9 aa, Homo Sapiens
ALEEVADSA

SEQ ID NO: 53427 - protein, 9 aa, Homo Sapiens
QALRKAEAD

SEQ ID NO: 53428 - protein, 9 aa, Homo Sapiens
GGLEPLAGL

SEQ ID NO: 53429 - protein, 9 aa, Homo Sapiens
PPGVINQGV

SEQ ID NO: 53430 - protein, 9 aa, Homo Sapiens
TDPTQKANL

SEQ ID NO: 53431 - protein, 9 aa, Homo Sapiens
LGLDKLLGR

SEQ ID NO: 53432 - protein, 9 aa, Homo Sapiens
KKFFSTSSR

SEQ ID NO: 53433 - protein, 9 aa, Homo Sapiens
EVLPVKANL

SEQ ID NO: 53434 - protein, 9 aa, Homo Sapiens
TVKKFFSTS

SEQ ID NO: 53435 - protein, 9 aa, Homo Sapiens
SQSFQEFCS

SEQ ID NO: 53436 - protein, 9 aa, Homo Sapiens
ITLWYPPPE

SEQ ID NO: 53437 - protein, 9 aa, Homo Sapiens
IYLLAMCQD

SEQ ID NO: 53438 - protein, 9 aa, Homo Sapiens
LPVPPTLPD

SEQ ID NO: 53439 - protein, 9 aa, Homo Sapiens
QLLKQMVYF

SEQ ID NO: 53440 - protein, 9 aa, Homo Sapiens
LAHRLQDAE

SEQ ID NO: 53441 - protein, 9 aa, Homo Sapiens
AFKTEMELL

SEQ ID NO: 53442 - protein, 9 aa, Homo Sapiens
GEMGPPVLG

SEQ ID NO: 53443 - protein, 9 aa, Homo Sapiens
AEQLKQAQE

SEQ ID NO: 53444 - protein, 9 aa, Homo Sapiens
SDLVFAYLL

SEQ ID NO: 53445 - protein, 9 aa, Homo Sapiens
SSSVDENAR

SEQ ID NO: 53446 - protein, 9 aa, Homo Sapiens
SEDAERPQG

SEQ ID NO: 53447 - protein, 9 aa, Homo Sapiens
KQQEENIEK

SEQ ID NO: 53448 - protein, 9 aa, Homo Sapiens
AEMDNSSQE

SEQ ID NO: 53449 - protein, 9 aa, Homo Sapiens
AYVGTAIHL

SEQ ID NO: 53450 - protein, 9 aa, Homo Sapiens
LKQAQELRQ

SEQ ID NO: 53451 - protein, 9 aa, Homo Sapiens
KDGRKNIKP

SEQ ID NO: 53452 - protein, 9 aa, Homo Sapiens
LYEKDDYRG

SEQ ID NO: 53453 - protein, 9 aa, Homo Sapiens
SIKSLRTFL

SEQ ID NO: 53454 - protein, 9 aa, Homo Sapiens
YEKDDYRGL

SEQ ID NO: 53455 - protein, 9 aa, Homo Sapiens
NATLESEED

SEQ ID NO: 53456 - protein, 9 aa, Homo Sapiens
PRVPFYCSE

SEQ ID NO: 53457 - protein, 9 aa, Homo Sapiens
SVCGHLIMK

SEQ ID NO: 53458 - protein, 9 aa, Homo Sapiens
TSSLTSGFR

SEQ ID NO: 53459 - protein, 9 aa, Homo Sapiens
VTPLSPHCL

SEQ ID NO: 53460 - protein, 9 aa, Homo Sapiens
LDKLLGRAE

SEQ ID NO: 53461 - protein, 9 aa, Homo Sapiens
EVFHNVDPD

SEQ ID NO: 53462 - protein, 9 aa, Homo Sapiens
LSDLVFAYL

SEQ ID NO: 53463 - protein, 9 aa, Homo Sapiens
PLAGLEPLD

SEQ ID NO: 53464 - protein, 9 aa, Homo Sapiens
WRTVNRLSA

SEQ ID NO: 53465 - protein, 9 aa, Homo Sapiens
FCYTIAHKY

SEQ ID NO: 53466 - protein, 9 aa, Homo Sapiens
KLVSQVRCS

SEQ ID NO: 53467 - protein, 9 aa, Homo Sapiens
GTMRSSLTP

SEQ ID NO: 53468 - protein, 9 aa, Homo Sapiens
YWDVPPLGF

SEQ ID NO: 53469 - protein, 9 aa, Homo Sapiens
STALLVQVS

SEQ ID NO: 53470 - protein, 9 aa, Homo Sapiens
KASIYLLAM

SEQ ID NO: 53471 - protein, 9 aa, Homo Sapiens
KFSRCALRD

SEQ ID NO: 53472 - protein, 9 aa, Homo Sapiens
PVTPLSPHC

SEQ ID NO: 53473 - protein, 9 aa, Homo Sapiens
QLLSPLPPS

SEQ ID NO: 53474 - protein, 9 aa, Homo Sapiens
GEDCYFFFL

SEQ ID NO: 53475 - protein, 9 aa, Homo Sapiens
KQISEQIHA

SEQ ID NO: 53476 - protein, 9 aa, Homo Sapiens
EEVKTPQEG

SEQ ID NO: 53477 - protein, 9 aa, Homo Sapiens
TAERCDRCR

SEQ ID NO: 53478 - protein, 9 aa, Homo Sapiens
PLGFEHITP

SEQ ID NO: 53479 - protein, 9 aa, Homo Sapiens
YLGSLQPLP

SEQ ID NO: 53480 - protein, 9 aa, Homo Sapiens
YLLAMCQDK

SEQ ID NO: 53481 - protein, 9 aa, Homo Sapiens
SYDISKDTL

SEQ ID NO: 53482 - protein, 9 aa, Homo Sapiens
KWTAPQSLA

SEQ ID NO: 53483 - protein, 9 aa, Homo Sapiens
INKEVLPVK

SEQ ID NO: 53484 - protein, 9 aa, Homo Sapiens
GTPPRRPAL

SEQ ID NO: 53485 - protein, 9 aa, Homo Sapiens
EWSGKQPMC

SEQ ID NO: 53486 - protein, 9 aa, Homo Sapiens
QIVATHVCQ

SEQ ID NO: 53487 - protein, 9 aa, Homo Sapiens
VAQVDSSQS

SEQ ID NO: 53488 - protein, 9 aa, Homo Sapiens
GLEPLAGLE

SEQ ID NO: 53489 - protein, 9 aa, Homo Sapiens
KTPLKACKT

SEQ ID NO: 53490 - protein, 9 aa, Homo Sapiens
TCCKAIKLF

SEQ ID NO: 53491 - protein, 9 aa, Homo Sapiens
EFCYTIAHK

SEQ ID NO: 53492 - protein, 9 aa, Homo Sapiens
KEVLPVKAN

SEQ ID NO: 53493 - protein, 9 aa, Homo Sapiens
SQVRCSKSG

SEQ ID NO: 53494 - protein, 9 aa, Homo Sapiens
DSLRQSLMK

SEQ ID NO: 53495 - protein, 9 aa, Homo Sapiens
TNATLESEE

SEQ ID NO: 53496 - protein, 9 aa, Homo Sapiens
FPIKWTAPQ

SEQ ID NO: 53497 - protein, 9 aa, Homo Sapiens
IADSYYGLL

SEQ ID NO: 53498 - protein, 9 aa, Homo Sapiens
QKQDMKDDQ

SEQ ID NO: 53499 - protein, 9 aa, Homo Sapiens
ESEEDSRYM

SEQ ID NO: 53500 - protein, 9 aa, Homo Sapiens
ESPFVKMTL

SEQ ID NO: 53501 - protein, 9 aa, Homo Sapiens
SGSGGGGLG

SEQ ID NO: 53502 - protein, 9 aa, Homo Sapiens
ALLFVNEAT

SEQ ID NO: 53503 - protein, 9 aa, Homo Sapiens
PPKGPDGGG

SEQ ID NO: 53504 - protein, 9 aa, Homo Sapiens
QVMKLACSD

SEQ ID NO: 53505 - protein, 9 aa, Homo Sapiens
ALLVQVSVE

SEQ ID NO: 53506 - protein, 9 aa, Homo Sapiens
DNSSQETQR

SEQ ID NO: 53507 - protein, 9 aa, Homo Sapiens
HHPEQSPLG

SEQ ID NO: 53508 - protein, 9 aa, Homo Sapiens
QELRQYKVL

SEQ ID NO: 53509 - protein, 9 aa, Homo Sapiens
SDAFKTEME

SEQ ID NO: 53510 - protein, 9 aa, Homo Sapiens
VERKDEQGR

SEQ ID NO: 53511 - protein, 9 aa, Homo Sapiens
LYTQTVNFG

SEQ ID NO: 53512 - protein, 9 aa, Homo Sapiens
AGEPKANRP

SEQ ID NO: 53513 - protein, 9 aa, Homo Sapiens
PILTITLED

SEQ ID NO: 53514 - protein, 9 aa, Homo Sapiens
ERKDEQGRL

SEQ ID NO: 53515 - protein, 9 aa, Homo Sapiens
PKANRPKYT

SEQ ID NO: 53516 - protein, 9 aa, Homo Sapiens
GLSQALRKA

SEQ ID NO: 53517 - protein, 9 aa, Homo Sapiens
KGPDGGGLP

SEQ ID NO: 53518 - protein, 9 aa, Homo Sapiens
KDTLYVSKS

SEQ ID NO: 53519 - protein, 9 aa, Homo Sapiens
SAVGSCRWV

SEQ ID NO: 53520 - protein, 9 aa, Homo Sapiens
QGPGVDEPL

SEQ ID NO: 53521 - protein, 9 aa, Homo Sapiens
DAERPQGLA

SEQ ID NO: 53522 - protein, 9 aa, Homo Sapiens
AQVDSSQSF

SEQ ID NO: 53523 - protein, 9 aa, Homo Sapiens
SCGITAIQM

SEQ ID NO: 53524 - protein, 9 aa, Homo Sapiens
GTGGLEPLA

SEQ ID NO: 53525 - protein, 9 aa, Homo Sapiens
MALITFRKN

SEQ ID NO: 53526 - protein, 9 aa, Homo Sapiens
RELRSKVEL

SEQ ID NO: 53527 - protein, 9 aa, Homo Sapiens
HNVDPDGTM

SEQ ID NO: 53528 - protein, 9 aa, Homo Sapiens
VYLAYTEDS

SEQ ID NO: 53529 - protein, 9 aa, Homo Sapiens
RPQKQDMKD

SEQ ID NO: 53530 - protein, 9 aa, Homo Sapiens
PPPELLLGE

SEQ ID NO: 53531 - protein, 9 aa, Homo Sapiens
SASCLSMSI

SEQ ID NO: 53532 - protein, 9 aa, Homo Sapiens
NIEKMRAED

SEQ ID NO: 53533 - protein, 9 aa, Homo Sapiens
NLKQISEQI

SEQ ID NO: 53534 - protein, 9 aa, Homo Sapiens
DLPVAKRAS

SEQ ID NO: 53535 - protein, 9 aa, Homo Sapiens
WYPPPELLL

SEQ ID NO: 53536 - protein, 9 aa, Homo Sapiens
NKEKIIQGP

SEQ ID NO: 53537 - protein, 9 aa, Homo Sapiens
GFWEGEAEQ

SEQ ID NO: 53538 - protein, 9 aa, Homo Sapiens
VVSLPEEFT

SEQ ID NO: 53539 - protein, 9 aa, Homo Sapiens
LEITNATLE

SEQ ID NO: 53540 - protein, 9 aa, Homo Sapiens
LRKAEADGA

SEQ ID NO: 53541 - protein, 9 aa, Homo Sapiens
KHTTDPTQK

SEQ ID NO: 53542 - protein, 9 aa, Homo Sapiens
NVDPDGTMS

SEQ ID NO: 53543 - protein, 9 aa, Homo Sapiens
VADSARQQE

SEQ ID NO: 53544 - protein, 9 aa, Homo Sapiens
YPPPELLLG

SEQ ID NO: 53545 - protein, 9 aa, Homo Sapiens
EQGKAGDPH

SEQ ID NO: 53546 - protein, 9 aa, Homo Sapiens
QKANLKLAL

SEQ ID NO: 53547 - protein, 9 aa, Homo Sapiens
WSCGITAIQ

SEQ ID NO: 53548 - protein, 9 aa, Homo Sapiens
LLGLDKLLG

SEQ ID NO: 53549 - protein, 9 aa, Homo Sapiens
SLSTALLVQ

SEQ ID NO: 53550 - protein, 9 aa, Homo Sapiens
PDLPPPPPP

SEQ ID NO: 53551 - protein, 9 aa, Homo Sapiens
AAFSGVRWL

SEQ ID NO: 53552 - protein, 9 aa, Homo Sapiens
VKHTTDPTQ

SEQ ID NO: 53553 - protein, 9 aa, Homo Sapiens
EITNATLES

SEQ ID NO: 53554 - protein, 9 aa, Homo Sapiens
FSSHHTAGG

SEQ ID NO: 53555 - protein, 9 aa, Homo Sapiens
KDDYRGLMS

SEQ ID NO: 53556 - protein, 9 aa, Homo Sapiens
NALSSVSCM

SEQ ID NO: 53557 - protein, 9 aa, Homo Sapiens
DSGTCHSPS

SEQ ID NO: 53558 - protein, 9 aa, Homo Sapiens
QMVYFEKVK

SEQ ID NO: 53559 - protein, 9 aa, Homo Sapiens
SIYLLAMCQ

SEQ ID NO: 53560 - protein, 9 aa, Homo Sapiens
EKDDYRGLM

SEQ ID NO: 53561 - protein, 9 aa, Homo Sapiens
KIIQGPGVD

SEQ ID NO: 53562 - protein, 9 aa, Homo Sapiens
SSFTTELYT

SEQ ID NO: 53563 - protein, 9 aa, Homo Sapiens
RTATGDVQV

SEQ ID NO: 53564 - protein, 9 aa, Homo Sapiens
EEEKIINDE

SEQ ID NO: 53565 - protein, 9 aa, Homo Sapiens
EPMKEEQLL

SEQ ID NO: 53566 - protein, 9 aa, Homo Sapiens
QMAEGAPPL

SEQ ID NO: 53567 - protein, 9 aa, Homo Sapiens
QGAKGWWAR

SEQ ID NO: 53568 - protein, 9 aa, Homo Sapiens
FRETSSSER

SEQ ID NO: 53569 - protein, 9 aa, Homo Sapiens
GGYAAKKEE

SEQ ID NO: 53570 - protein, 9 aa, Homo Sapiens
RCALRDAYC

SEQ ID NO: 53571 - protein, 9 aa, Homo Sapiens
LSPDRRAWL

SEQ ID NO: 53572 - protein, 9 aa, Homo Sapiens
NRPKYTTDN

SEQ ID NO: 53573 - protein, 9 aa, Homo Sapiens
EHTLMEEAP

SEQ ID NO: 53574 - protein, 9 aa, Homo Sapiens
TFRKNLYRL

SEQ ID NO: 53575 - protein, 9 aa, Homo Sapiens
QQAKCLLKN

SEQ ID NO: 53576 - protein, 9 aa, Homo Sapiens
ASCLSMSIR

SEQ ID NO: 53577 - protein, 9 aa, Homo Sapiens
QLKQAQELR

SEQ ID NO: 53578 - protein, 9 aa, Homo Sapiens
GEPKANRPK

SEQ ID NO: 53579 - protein, 9 aa, Homo Sapiens
NSQQKNDQQ

SEQ ID NO: 53580 - protein, 9 aa, Homo Sapiens
VCSGCVNFE

SEQ ID NO: 53581 - protein, 9 aa, Homo Sapiens
PKYKNSSTG

SEQ ID NO: 53582 - protein, 9 aa, Homo Sapiens
QAKQMTSPL

SEQ ID NO: 53583 - protein, 9 aa, Homo Sapiens
RPILTITLE

SEQ ID NO: 53584 - protein, 9 aa, Homo Sapiens
AKKKLAHRL

SEQ ID NO: 53585 - protein, 9 aa, Homo Sapiens
GFRETSSSE

SEQ ID NO: 53586 - protein, 9 aa, Homo Sapiens
TTAKSGSTP

SEQ ID NO: 53587 - protein, 9 aa, Homo Sapiens
EGEAEQGKA

SEQ ID NO: 53588 - protein, 9 aa, Homo Sapiens
RRPILTITL

SEQ ID NO: 53589 - protein, 9 aa, Homo Sapiens
QRCYPTQPC

SEQ ID NO: 53590 - protein, 9 aa, Homo Sapiens
QKNDQQVKQ

SEQ ID NO: 53591 - protein, 9 aa, Homo Sapiens
CATPIPLPL

SEQ ID NO: 53592 - protein, 9 aa, Homo Sapiens
PPPKGPDGG

SEQ ID NO: 53593 - protein, 9 aa, Homo Sapiens
PRVAFWPCS

SEQ ID NO: 53594 - protein, 9 aa, Homo Sapiens
EQLLKQMVY

SEQ ID NO: 53595 - protein, 9 aa, Homo Sapiens
VALRNLKQI

SEQ ID NO: 53596 - protein, 9 aa, Homo Sapiens
QEGEKQSQC

SEQ ID NO: 53597 - protein, 9 aa, Homo Sapiens
TITLEDSSG

SEQ ID NO: 53598 - protein, 9 aa, Homo Sapiens
FIISGPILQ

SEQ ID NO: 53599 - protein, 9 aa, Homo Sapiens
FFFFETESA

SEQ ID NO: 53600 - protein, 9 aa, Homo Sapiens
ALITFRKNL

SEQ ID NO: 53601 - protein, 9 aa, Homo Sapiens
SQKRLLLWA

SEQ ID NO: 53602 - protein, 9 aa, Homo Sapiens
VLPVKANLV

SEQ ID NO: 53603 - protein, 9 aa, Homo Sapiens
KVITLWYPP

SEQ ID NO: 53604 - protein, 9 aa, Homo Sapiens
DENARIVSG

SEQ ID NO: 53605 - protein, 9 aa, Homo Sapiens
RPNRLAQRC

SEQ ID NO: 53606 - protein, 9 aa, Homo Sapiens
DYHVSRHIL

SEQ ID NO: 53607 - protein, 9 aa, Homo Sapiens
EEVFHNVDP

SEQ ID NO: 53608 - protein, 9 aa, Homo Sapiens
DGRKNIKPT

SEQ ID NO: 53609 - protein, 9 aa, Homo Sapiens
PFVKMTLPW

SEQ ID NO: 53610 - protein, 9 aa, Homo Sapiens
QTVKLSKGG

SEQ ID NO: 53611 - protein, 9 aa, Homo Sapiens
VQVMKLACS

SEQ ID NO: 53612 - protein, 9 aa, Homo Sapiens
TATGDVQVL

SEQ ID NO: 53613 - protein, 9 aa, Homo Sapiens
PQSLAYNTF

SEQ ID NO: 53614 - protein, 9 aa, Homo Sapiens
QAGMYLEGS

SEQ ID NO: 53615 - protein, 9 aa, Homo Sapiens
RKDEQGRLL

SEQ ID NO: 53616 - protein, 9 aa, Homo Sapiens
PNALFVVYK

SEQ ID NO: 53617 - protein, 9 aa, Homo Sapiens
SFTTELYTQ

SEQ ID NO: 53618 - protein, 9 aa, Homo Sapiens
VLSLSTALL

SEQ ID NO: 53619 - protein, 9 aa, Homo Sapiens
VDENARIVS

SEQ ID NO: 53620 - protein, 9 aa, Homo Sapiens
CKPLGIKTP

SEQ ID NO: 53621 - protein, 9 aa, Homo Sapiens
GTLGSEPRS

SEQ ID NO: 53622 - protein, 9 aa, Homo Sapiens
AHRLQDAEE

SEQ ID NO: 53623 - protein, 9 aa, Homo Sapiens
QPPPKGPDG

SEQ ID NO: 53624 - protein, 9 aa, Homo Sapiens
QSQALKLTM

SEQ ID NO: 53625 - protein, 9 aa, Homo Sapiens
GSQGRGGGG

SEQ ID NO: 53626 - protein, 9 aa, Homo Sapiens
AERCDRCRS

SEQ ID NO: 53627 - protein, 9 aa, Homo Sapiens
TVGFKEKIS

SEQ ID NO: 53628 - protein, 9 aa, Homo Sapiens
KRLLLWAGG

SEQ ID NO: 53629 - protein, 9 aa, Homo Sapiens
KNIKPTSAW

SEQ ID NO: 53630 - protein, 9 aa, Homo Sapiens
LENHFLEIT

SEQ ID NO: 53631 - protein, 9 aa, Homo Sapiens
QQWMANQSQ

SEQ ID NO: 53632 - protein, 9 aa, Homo Sapiens
TLGTLGSEP

SEQ ID NO: 53633 - protein, 9 aa, Homo Sapiens
EDDELEEEK

SEQ ID NO: 53634 - protein, 9 aa, Homo Sapiens
TPGEMGPPV

SEQ ID NO: 53635 - protein, 9 aa, Homo Sapiens
LLVQVSVED

SEQ ID NO: 53636 - protein, 9 aa, Homo Sapiens
SSHHTAGGM

SEQ ID NO: 53637 - protein, 9 aa, Homo Sapiens
KFFSTSSRV

SEQ ID NO: 53638 - protein, 9 aa, Homo Sapiens
STTNVSGKS

SEQ ID NO: 53639 - protein, 9 aa, Homo Sapiens
QVRELRSKV

SEQ ID NO: 53640 - protein, 9 aa, Homo Sapiens
HKYLFEGKH

SEQ ID NO: 53641 - protein, 9 aa, Homo Sapiens
FYCSECGKS

SEQ ID NO: 53642 - protein, 9 aa, Homo Sapiens
QVRCSKSGM

SEQ ID NO: 53643 - protein, 9 aa, Homo Sapiens
KIINDENFL

SEQ ID NO: 53644 - protein, 9 aa, Homo Sapiens
STWRTVNRL

SEQ ID NO: 53645 - protein, 9 aa, Homo Sapiens
PPSTFQAKQ

SEQ ID NO: 53646 - protein, 9 aa, Homo Sapiens
HLIMKMILQ

SEQ ID NO: 53647 - protein, 9 aa, Homo Sapiens
TVKLSKGGP

SEQ ID NO: 53648 - protein, 9 aa, Homo Sapiens
GEAEQGKAG

SEQ ID NO: 53649 - protein, 9 aa, Homo Sapiens
EKIINDENF

SEQ ID NO: 53650 - protein, 9 aa, Homo Sapiens
ARGGYAAKK

SEQ ID NO: 53651 - protein, 9 aa, Homo Sapiens
WDVPPLGFE

SEQ ID NO: 53652 - protein, 9 aa, Homo Sapiens
GVLFLDQYF

SEQ ID NO: 53653 - protein, 9 aa, Homo Sapiens
QGKAGDPHR

SEQ ID NO: 53654 - protein, 9 aa, Homo Sapiens
LPVAKRASL

SEQ ID NO: 53655 - protein, 9 aa, Homo Sapiens
AKSGSTPIL

SEQ ID NO: 53656 - protein, 9 aa, Homo Sapiens
ELEEEKIIN

SEQ ID NO: 53657 - protein, 9 aa, Homo Sapiens
GSGGGGLGS

SEQ ID NO: 53658 - protein, 9 aa, Homo Sapiens
LFAHAKTHK

SEQ ID NO: 53659 - protein, 9 aa, Homo Sapiens
AVGSCRWVR

SEQ ID NO: 53660 - protein, 9 aa, Homo Sapiens
EAKKKLAHR

SEQ ID NO: 53661 - protein, 9 aa, Homo Sapiens
QARSSAGKR

SEQ ID NO: 53662 - protein, 9 aa, Homo Sapiens
GPPVLGLPG

SEQ ID NO: 53663 - protein, 9 aa, Homo Sapiens
SSTGKSELR

SEQ ID NO: 53664 - protein, 9 aa, Homo Sapiens
SGTCHSPSL

SEQ ID NO: 53665 - protein, 9 aa, Homo Sapiens
VLEIQAGMY

SEQ ID NO: 53666 - protein, 9 aa, Homo Sapiens
VINQGVAPM

SEQ ID NO: 53667 - protein, 9 aa, Homo Sapiens
KYEKHLHDL

SEQ ID NO: 53668 - protein, 9 aa, Homo Sapiens
LEIQAGMYL

SEQ ID NO: 53669 - protein, 9 aa, Homo Sapiens
FIRDYHVSR

SEQ ID NO: 53670 - protein, 9 aa, Homo Sapiens
LWYPPPELL

SEQ ID NO: 53671 - protein, 9 aa, Homo Sapiens
ILTITLEDS

SEQ ID NO: 53672 - protein, 9 aa, Homo Sapiens
PDRRAWLLT

SEQ ID NO: 53673 - protein, 9 aa, Homo Sapiens
FTNFSQLFA

SEQ ID NO: 53674 - protein, 9 aa, Homo Sapiens
TMRSSLTPL

SEQ ID NO: 53675 - protein, 9 aa, Homo Sapiens
EMAALLFVN

SEQ ID NO: 53676 - protein, 9 aa, Homo Sapiens
TESASVTQA

SEQ ID NO: 53677 - protein, 9 aa, Homo Sapiens
HNVSAVGSC

SEQ ID NO: 53678 - protein, 9 aa, Homo Sapiens
EVFGDTLND

SEQ ID NO: 53679 - protein, 9 aa, Homo Sapiens
SVDENARIV

SEQ ID NO: 53680 - protein, 9 aa, Homo Sapiens
TGKSELRRT

SEQ ID NO: 53681 - protein, 9 aa, Homo Sapiens
QMTSPLVSD

SEQ ID NO: 53682 - protein, 9 aa, Homo Sapiens
VNSQQKNDQ

SEQ ID NO: 53683 - protein, 9 aa, Homo Sapiens
KCLLKNENT

SEQ ID NO: 53684 - protein, 9 aa, Homo Sapiens
PFYCSECGK

SEQ ID NO: 53685 - protein, 9 aa, Homo Sapiens
IPPPGVINQ

SEQ ID NO: 53686 - protein, 9 aa, Homo Sapiens
PGIPPPGVI

SEQ ID NO: 53687 - protein, 9 aa, Homo Sapiens
LEEVADSAR

SEQ ID NO: 53688 - protein, 9 aa, Homo Sapiens
VPLEIPEEH

SEQ ID NO: 53689 - protein, 9 aa, Homo Sapiens
LEKGSIKSL

SEQ ID NO: 53690 - protein, 9 aa, Homo Sapiens
QALFFPSQV

SEQ ID NO: 53691 - protein, 9 aa, Homo Sapiens
QVKYSETYC

SEQ ID NO: 53692 - protein, 9 aa, Homo Sapiens
LCSFFFFET

SEQ ID NO: 53693 - protein, 9 aa, Homo Sapiens
QEYVQTVKL

SEQ ID NO: 53694 - protein, 9 aa, Homo Sapiens
QRALPRVAF

SEQ ID NO: 53695 - protein, 9 aa, Homo Sapiens
VSQVRCSKS

SEQ ID NO: 53696 - protein, 9 aa, Homo Sapiens
AKCLLKNEN

SEQ ID NO: 53697 - protein, 9 aa, Homo Sapiens
SIWNVKSLE

SEQ ID NO: 53698 - protein, 9 aa, Homo Sapiens
NRPQVRELR

SEQ ID NO: 53699 - protein, 9 aa, Homo Sapiens
SQQKNDQQV

SEQ ID NO: 53700 - protein, 9 aa, Homo Sapiens
TQKANLKLA

SEQ ID NO: 53701 - protein, 9 aa, Homo Sapiens
FKEKISLSE

SEQ ID NO: 53702 - protein, 9 aa, Homo Sapiens
EPQPPPKGP

SEQ ID NO: 53703 - protein, 9 aa, Homo Sapiens
EENIEKMRA

SEQ ID NO: 53704 - protein, 9 aa, Homo Sapiens
ALRKAEADG

SEQ ID NO: 53705 - protein, 9 aa, Homo Sapiens
DELEEEKII

SEQ ID NO: 53706 - protein, 9 aa, Homo Sapiens
AVHRAQPLG

SEQ ID NO: 53707 - protein, 9 aa, Homo Sapiens
QPMCIKACR

SEQ ID NO: 53708 - protein, 9 aa, Homo Sapiens
GALEEVADS

SEQ ID NO: 53709 - protein, 9 aa, Homo Sapiens
RFLGHNVHA

SEQ ID NO: 53710 - protein, 9 aa, Homo Sapiens
ISEQQAKCL

SEQ ID NO: 53711 - protein, 9 aa, Homo Sapiens
AEQGKAGDP

SEQ ID NO: 53712 - protein, 9 aa, Homo Sapiens
EMDNSSQET

SEQ ID NO: 53713 - protein, 9 aa, Homo Sapiens
HRAQPLGFN

SEQ ID NO: 53714 - protein, 9 aa, Homo Sapiens
HVCQFLELC

SEQ ID NO: 53715 - protein, 9 aa, Homo Sapiens
YLLPVWISP

SEQ ID NO: 53716 - protein, 9 aa, Homo Sapiens
MKLACSDTL

SEQ ID NO: 53717 - protein, 9 aa, Homo Sapiens
HFLPQSYTC

SEQ ID NO: 53718 - protein, 9 aa, Homo Sapiens
FCEVVQVMK

SEQ ID NO: 53719 - protein, 9 aa, Homo Sapiens
LVVSLPEEF

SEQ ID NO: 53720 - protein, 9 aa, Homo Sapiens
GIKTPLKAC

SEQ ID NO: 53721 - protein, 9 aa, Homo Sapiens
PSSPSSLLC

SEQ ID NO: 53722 - protein, 9 aa, Homo Sapiens
NSSTGKSEL

SEQ ID NO: 53723 - protein, 9 aa, Homo Sapiens
LAYTEDSLR

SEQ ID NO: 53724 - protein, 9 aa, Homo Sapiens
GAKGWWARS

SEQ ID NO: 53725 - protein, 9 aa, Homo Sapiens
KQDMKDDQD

SEQ ID NO: 53726 - protein, 9 aa, Homo Sapiens
MSIWNVKSL

SEQ ID NO: 53727 - protein, 9 aa, Homo Sapiens
SPSSLLCAT

SEQ ID NO: 53728 - protein, 9 aa, Homo Sapiens
HKLRLYEKD

SEQ ID NO: 53729 - protein, 9 aa, Homo Sapiens
FFFLFHMYQ

SEQ ID NO: 53730 - protein, 9 aa, Homo Sapiens
VRCSKSGMN

SEQ ID NO: 53731 - protein, 9 aa, Homo Sapiens
MGPPVLGLP

SEQ ID NO: 53732 - protein, 9 aa, Homo Sapiens
KKKLAHRLQ

SEQ ID NO: 53733 - protein, 9 aa, Homo Sapiens
YVVSGTVGF

SEQ ID NO: 53734 - protein, 9 aa, Homo Sapiens
PSATQSNAL

SEQ ID NO: 53735 - protein, 9 aa, Homo Sapiens
DKLLGRAEV

SEQ ID NO: 53736 - protein, 9 aa, Homo Sapiens
SSLLCATPI

SEQ ID NO: 53737 - protein, 9 aa, Homo Sapiens
TPILKCPTQ

SEQ ID NO: 53738 - protein, 9 aa, Homo Sapiens
PLEIPEEHT

SEQ ID NO: 53739 - protein, 9 aa, Homo Sapiens
YVGTAIHLR

SEQ ID NO: 53740 - protein, 9 aa, Homo Sapiens
LWHNVSAVG

SEQ ID NO: 53741 - protein, 9 aa, Homo Sapiens
PMKEEQLLS

SEQ ID NO: 53742 - protein, 9 aa, Homo Sapiens
KYKNSSTGK

SEQ ID NO: 53743 - protein, 9 aa, Homo Sapiens
TALLVQVSV

SEQ ID NO: 53744 - protein, 9 aa, Homo Sapiens
LHDLQDIFD

SEQ ID NO: 53745 - protein, 9 aa, Homo Sapiens
TLESEEDSR

SEQ ID NO: 53746 - protein, 9 aa, Homo Sapiens
KKEERQQWE

SEQ ID NO: 53747 - protein, 9 aa, Homo Sapiens
CSFFFFETE

SEQ ID NO: 53748 - protein, 9 aa, Homo Sapiens
GLSPDRRAW

SEQ ID NO: 53749 - protein, 9 aa, Homo Sapiens
NRLSATACG

SEQ ID NO: 53750 - protein, 9 aa, Homo Sapiens
LESEEDSRY

SEQ ID NO: 53751 - protein, 9 aa, Homo Sapiens
AIHLRGISG

SEQ ID NO: 53752 - protein, 9 aa, Homo Sapiens
CHSPSLEEP

SEQ ID NO: 53753 - protein, 9 aa, Homo Sapiens
CSQKRLLLW

SEQ ID NO: 53754 - protein, 9 aa, Homo Sapiens
EQVKYSETY

SEQ ID NO: 53755 - protein, 9 aa, Homo Sapiens
KPGERVAIE

SEQ ID NO: 53756 - protein, 9 aa, Homo Sapiens
PIHVKAARA

SEQ ID NO: 53757 - protein, 9 aa, Homo Sapiens
EEHTLMEEA

SEQ ID NO: 53758 - protein, 9 aa, Homo Sapiens
TTNVSGKSS

SEQ ID NO: 53759 - protein, 9 aa, Homo Sapiens
HPEQSPLGA

SEQ ID NO: 53760 - protein, 9 aa, Homo Sapiens
ASIYLLAMC

SEQ ID NO: 53761 - protein, 9 aa, Homo Sapiens
WLSWTLGTL

SEQ ID NO: 53762 - protein, 9 aa, Homo Sapiens
LKQISEQIH

SEQ ID NO: 53763 - protein, 9 aa, Homo Sapiens
PLSPHCLPA

SEQ ID NO: 53764 - protein, 9 aa, Homo Sapiens
KHLKPGERV

SEQ ID NO: 53765 - protein, 9 aa, Homo Sapiens
NKEVLPVKA

SEQ ID NO: 53766 - protein, 9 aa, Homo Sapiens
SGKQPMCIK

SEQ ID NO: 53767 - protein, 9 aa, Homo Sapiens
SINKEVLPV

SEQ ID NO: 53768 - protein, 9 aa, Homo Sapiens
CSKSGMNFT

SEQ ID NO: 53769 - protein, 9 aa, Homo Sapiens
TLWYPPPEL

SEQ ID NO: 53770 - protein, 9 aa, Homo Sapiens
QLFAHAKTH

SEQ ID NO: 53771 - protein, 9 aa, Homo Sapiens
IHVKAARAT

SEQ ID NO: 53772 - protein, 9 aa, Homo Sapiens
RHHPEQSPL

SEQ ID NO: 53773 - protein, 9 aa, Homo Sapiens
TLGSEPRSV

SEQ ID NO: 53774 - protein, 9 aa, Homo Sapiens
AGKRHGSHH

SEQ ID NO: 53775 - protein, 9 aa, Homo Sapiens
KLRLYEKDD

SEQ ID NO: 53776 - protein, 9 aa, Homo Sapiens
VNEATRVFH

SEQ ID NO: 53777 - protein, 9 aa, Homo Sapiens
NSDSGTCHS

SEQ ID NO: 53778 - protein, 9 aa, Homo Sapiens
AKRASLNYW

SEQ ID NO: 53779 - protein, 9 aa, Homo Sapiens
GFIISGPIL

SEQ ID NO: 53780 - protein, 9 aa, Homo Sapiens
GDTLNDSRD

SEQ ID NO: 53781 - protein, 9 aa, Homo Sapiens
PHCLPAVFS

SEQ ID NO: 53782 - protein, 9 aa, Homo Sapiens
KSGSTPILK

SEQ ID NO: 53783 - protein, 9 aa, Homo Sapiens
CGTTGTTCC

SEQ ID NO: 53784 - protein, 9 aa, Homo Sapiens
EIQAGMYLE

SEQ ID NO: 53785 - protein, 9 aa, Homo Sapiens
LLAMCQDKD

SEQ ID NO: 53786 - protein, 9 aa, Homo Sapiens
STPILKCPT

SEQ ID NO: 53787 - protein, 9 aa, Homo Sapiens
SICRRTATG

SEQ ID NO: 53788 - protein, 9 aa, Homo Sapiens
LLEKGSIKS

SEQ ID NO: 53789 - protein, 9 aa, Homo Sapiens
DPIADSYYG

SEQ ID NO: 53790 - protein, 9 aa, Homo Sapiens
AWLLTSLML

SEQ ID NO: 53791 - protein, 9 aa, Homo Sapiens
QAKCLLKNE

SEQ ID NO: 53792 - protein, 9 aa, Homo Sapiens
RRRRPRRQA

SEQ ID NO: 53793 - protein, 9 aa, Homo Sapiens
KRASLNYWR

SEQ ID NO: 53794 - protein, 9 aa, Homo Sapiens
RTVNRLSAT

SEQ ID NO: 53795 - protein, 9 aa, Homo Sapiens
SHHTAGGMT

SEQ ID NO: 53796 - protein, 9 aa, Homo Sapiens
KEAKQQEEN

SEQ ID NO: 53797 - protein, 9 aa, Homo Sapiens
SHKLRLYEK

SEQ ID NO: 53798 - protein, 9 aa, Homo Sapiens
ELLRFLGHN

SEQ ID NO: 53799 - protein, 9 aa, Homo Sapiens
ENIEKMRAE

SEQ ID NO: 53800 - protein, 9 aa, Homo Sapiens
SSLTSGFRE

SEQ ID NO: 53801 - protein, 9 aa, Homo Sapiens
DAFKTEMEL

SEQ ID NO: 53802 - protein, 9 aa, Homo Sapiens
TPLSPHCLP

SEQ ID NO: 53803 - protein, 9 aa, Homo Sapiens
IRDYHVSRH

SEQ ID NO: 53804 - protein, 9 aa, Homo Sapiens
HPHDGRLKW

SEQ ID NO: 53805 - protein, 9 aa, Homo Sapiens
HLKPGERVA

SEQ ID NO: 53806 - protein, 9 aa, Homo Sapiens
MKEEQLLSP

SEQ ID NO: 53807 - protein, 9 aa, Homo Sapiens
GTTAKSGST

SEQ ID NO: 53808 - protein, 9 aa, Homo Sapiens
LLSPLPPSP

SEQ ID NO: 53809 - protein, 9 aa, Homo Sapiens
FSQLFAHAK

SEQ ID NO: 53810 - protein, 9 aa, Homo Sapiens
TTELYTQTV

SEQ ID NO: 53811 - protein, 9 aa, Homo Sapiens
HLHDLQDIF

SEQ ID NO: 53812 - protein, 9 aa, Homo Sapiens
AAPRVPFYC

SEQ ID NO: 53813 - protein, 9 aa, Homo Sapiens
HSPSLEEPM

SEQ ID NO: 53814 - protein, 9 aa, Homo Sapiens
PGEMGPPVL

SEQ ID NO: 53815 - protein, 9 aa, Homo Sapiens
IVAQVDSSQ

SEQ ID NO: 53816 - protein, 9 aa, Homo Sapiens
RRPRRQALF

SEQ ID NO: 53817 - protein, 9 aa, Homo Sapiens
FRKNLYRLS

SEQ ID NO: 53818 - protein, 9 aa, Homo Sapiens
ALLGLDKLL

SEQ ID NO: 53819 - protein, 9 aa, Homo Sapiens
DVPPLGFEH

SEQ ID NO: 53820 - protein, 9 aa, Homo Sapiens
LMDMQAVHR

SEQ ID NO: 53821 - protein, 9 aa, Homo Sapiens
EEAKKKLAH

SEQ ID NO: 53822 - protein, 9 aa, Homo Sapiens
YDSLSEDAE

SEQ ID NO: 53823 - protein, 9 aa, Homo Sapiens
AYTEDSLRQ

SEQ ID NO: 53824 - protein, 9 aa, Homo Sapiens
TFQAKQMTS

SEQ ID NO: 53825 - protein, 9 aa, Homo Sapiens
VKHLKPGER

SEQ ID NO: 53826 - protein, 9 aa, Homo Sapiens
FFCEVVQVM

SEQ ID NO: 53827 - protein, 9 aa, Homo Sapiens
MAALLFVNE

SEQ ID NO: 53828 - protein, 9 aa, Homo Sapiens
PKGPDGGGL

SEQ ID NO: 53829 - protein, 9 aa, Homo Sapiens
MCIKACREP

SEQ ID NO: 53830 - protein, 9 aa, Homo Sapiens
AASSIAANM

SEQ ID NO: 53831 - protein, 9 aa, Homo Sapiens
GMSIWNVKS

SEQ ID NO: 53832 - protein, 9 aa, Homo Sapiens
QSFQEFCST

SEQ ID NO: 53833 - protein, 9 aa, Homo Sapiens
PLGIKTPLK

SEQ ID NO: 53834 - protein, 9 aa, Homo Sapiens
NARIVSGND

SEQ ID NO: 53835 - protein, 9 aa, Homo Sapiens
NVKSLESAL

SEQ ID NO: 53836 - protein, 9 aa, Homo Sapiens
TVNRLSATA

SEQ ID NO: 53837 - protein, 9 aa, Homo Sapiens
PPSCSQKRL

SEQ ID NO: 53838 - protein, 9 aa, Homo Sapiens
PLPVPPTLP

SEQ ID NO: 53839 - protein, 9 aa, Homo Sapiens
FFSTSSRVG

SEQ ID NO: 53840 - protein, 9 aa, Homo Sapiens
RPALPSALG

SEQ ID NO: 53841 - protein, 9 aa, Homo Sapiens
FGDTLNDSR

SEQ ID NO: 53842 - protein, 9 aa, Homo Sapiens
SQLFAHAKT

SEQ ID NO: 53843 - protein, 9 aa, Homo Sapiens
IQMAEGAPP

SEQ ID NO: 53844 - protein, 9 aa, Homo Sapiens
KLLGRAEVD

SEQ ID NO: 53845 - protein, 9 aa, Homo Sapiens
CRRTATGDV

SEQ ID NO: 53846 - protein, 9 aa, Homo Sapiens
FHQGAKGWW

SEQ ID NO: 53847 - protein, 9 aa, Homo Sapiens
KQMTSPLVS

SEQ ID NO: 53848 - protein, 9 aa, Homo Sapiens
GPDPIADSY

SEQ ID NO: 53849 - protein, 9 aa, Homo Sapiens
NVSGKSSVA

SEQ ID NO: 53850 - protein, 9 aa, Homo Sapiens
AGMYLEGSI

SEQ ID NO: 53851 - protein, 9 aa, Homo Sapiens
HKAPSKLGF

SEQ ID NO: 53852 - protein, 9 aa, Homo Sapiens
ADLPVAKRA

SEQ ID NO: 53853 - protein, 9 aa, Homo Sapiens
VFSCFFFIG

SEQ ID NO: 53854 - protein, 9 aa, Homo Sapiens
AKQMTSPLV

SEQ ID NO: 53855 - protein, 9 aa, Homo Sapiens
EVADSARQQ

SEQ ID NO: 53856 - protein, 9 aa, Homo Sapiens
KPLGIKTPL

SEQ ID NO: 53857 - protein, 9 aa, Homo Sapiens
TVFSSHHTA

SEQ ID NO: 53858 - protein, 9 aa, Homo Sapiens
NALFVVYKQ

SEQ ID NO: 53859 - protein, 9 aa, Homo Sapiens
AKLVSQVRC

SEQ ID NO: 53860 - protein, 9 aa, Homo Sapiens
LPRVAFWPC

SEQ ID NO: 53861 - protein, 9 aa, Homo Sapiens
RKAEADGAA

SEQ ID NO: 53862 - protein, 9 aa, Homo Sapiens
EAEQGKAGD

SEQ ID NO: 53863 - protein, 9 aa, Homo Sapiens
SGCVNFEGA

SEQ ID NO: 53864 - protein, 9 aa, Homo Sapiens
LPEEFTARG

SEQ ID NO: 53865 - protein, 9 aa, Homo Sapiens
LHPHDGRLK

SEQ ID NO: 53866 - protein, 9 aa, Homo Sapiens
DLVFAYLLP

SEQ ID NO: 53867 - protein, 9 aa, Homo Sapiens
LAGLEPLDS

SEQ ID NO: 53868 - protein, 9 aa, Homo Sapiens
LLGRAEVDL

SEQ ID NO: 53869 - protein, 9 aa, Homo Sapiens
ELYTQTVNF

SEQ ID NO: 53870 - protein, 9 aa, Homo Sapiens
LITFRKNLY

SEQ ID NO: 53871 - protein, 9 aa, Homo Sapiens
NIKPTSAWN

SEQ ID NO: 53872 - protein, 9 aa, Homo Sapiens
GHLIMKMIL

SEQ ID NO: 53873 - protein, 9 aa, Homo Sapiens
QSNALSSVS

SEQ ID NO: 53874 - protein, 9 aa, Homo Sapiens
VLGLPGLKG

SEQ ID NO: 53875 - protein, 9 aa, Homo Sapiens
RLENHFLEI

SEQ ID NO: 53876 - protein, 9 aa, Homo Sapiens
TEMELLQAG

SEQ ID NO: 53877 - protein, 9 aa, Homo Sapiens
KEKIIQGPG

SEQ ID NO: 53878 - protein, 9 aa, Homo Sapiens
ITFRKNLYR

SEQ ID NO: 53879 - protein, 9 aa, Homo Sapiens
LVSGFVERK

SEQ ID NO: 53880 - protein, 9 aa, Homo Sapiens
KYWDVPPLG

SEQ ID NO: 53881 - protein, 9 aa, Homo Sapiens
AAAPRVPFY

SEQ ID NO: 53882 - protein, 9 aa, Homo Sapiens
VFHNVDPDG

SEQ ID NO: 53883 - protein, 9 aa, Homo Sapiens
RRAWLLTSL

SEQ ID NO: 53884 - protein, 9 aa, Homo Sapiens
MLEEVFHNV

SEQ ID NO: 53885 - protein, 9 aa, Homo Sapiens
ALFVVYKQM

SEQ ID NO: 53886 - protein, 9 aa, Homo Sapiens
SSIAANMMS

SEQ ID NO: 53887 - protein, 9 aa, Homo Sapiens
DHFLPQSYT

SEQ ID NO: 53888 - protein, 9 aa, Homo Sapiens
VGTAIHLRG

SEQ ID NO: 53889 - protein, 9 aa, Homo Sapiens
LGFIISGPI

SEQ ID NO: 53890 - protein, 9 aa, Homo Sapiens
LSWTLGTLG

SEQ ID NO: 53891 - protein, 9 aa, Homo Sapiens
EESPFVKMT

SEQ ID NO: 53892 - protein, 9 aa, Homo Sapiens
ANMMSAAAI

SEQ ID NO: 53893 - protein, 9 aa, Homo Sapiens
ITNATLESE

SEQ ID NO: 53894 - protein, 9 aa, Homo Sapiens
GGMSIWNVK

SEQ ID NO: 53895 - protein, 9 aa, Homo Sapiens
PQIVATHVC

SEQ ID NO: 53896 - protein, 9 aa, Homo Sapiens
CLLKNENTR

SEQ ID NO: 53897 - protein, 9 aa, Homo Sapiens
TRPQKQDMK

SEQ ID NO: 53898 - protein, 9 aa, Homo Sapiens
ITRPQKQDM

SEQ ID NO: 53899 - protein, 9 aa, Homo Sapiens
ICRRTATGD

SEQ ID NO: 53900 - protein, 9 aa, Homo Sapiens
KQPMCIKAC

SEQ ID NO: 53901 - protein, 9 aa, Homo Sapiens
ITAIQMAEG

SEQ ID NO: 53902 - protein, 9 aa, Homo Sapiens
SLLCATPIP

SEQ ID NO: 53903 - protein, 9 aa, Homo Sapiens
FLPQSYTCF

SEQ ID NO: 53904 - protein, 9 aa, Homo Sapiens
PGVLFLDQY

SEQ ID NO: 53905 - protein, 9 aa, Homo Sapiens
YPKYKNSST

SEQ ID NO: 53906 - protein, 9 aa, Homo Sapiens
TTGTTCCKA

SEQ ID NO: 53907 - protein, 9 aa, Homo Sapiens
SATQSNALS

SEQ ID NO: 53908 - protein, 9 aa, Homo Sapiens
IKWTAPQSL

SEQ ID NO: 53909 - protein, 9 aa, Homo Sapiens
VAKRASLNY

SEQ ID NO: 53910 - protein, 9 aa, Homo Sapiens
DSARQQERH

SEQ ID NO: 53911 - protein, 9 aa, Homo Sapiens
EGSRLENHF

SEQ ID NO: 53912 - protein, 9 aa, Homo Sapiens
GKTEQVKYS

SEQ ID NO: 53913 - protein, 9 aa, Homo Sapiens
SPLVVAKGG

SEQ ID NO: 53914 - protein, 9 aa, Homo Sapiens
SDFHQGAKG

SEQ ID NO: 53915 - protein, 9 aa, Homo Sapiens
ASTTNVSGK

SEQ ID NO: 53916 - protein, 9 aa, Homo Sapiens
NDQQVKQNS

SEQ ID NO: 53917 - protein, 9 aa, Homo Sapiens
QVDSSQSFQ

SEQ ID NO: 53918 - protein, 9 aa, Homo Sapiens
MQAVHRAQP

SEQ ID NO: 53919 - protein, 9 aa, Homo Sapiens
RLYEKDDYR

SEQ ID NO: 53920 - protein, 9 aa, Homo Sapiens
KAEADGAAW

SEQ ID NO: 53921 - protein, 9 aa, Homo Sapiens
VVYKQMRPQ

SEQ ID NO: 53922 - protein, 9 aa, Homo Sapiens
QGAEMDNSS

SEQ ID NO: 53923 - protein, 9 aa, Homo Sapiens
HDGRLKWIF

SEQ ID NO: 53924 - protein, 9 aa, Homo Sapiens
VTAERCDRC

SEQ ID NO: 53925 - protein, 9 aa, Homo Sapiens
AHKYLFEGK

SEQ ID NO: 53926 - protein, 9 aa, Homo Sapiens
LEPLAGLEP

SEQ ID NO: 53927 - protein, 9 aa, Homo Sapiens
FHNVDPDGT

SEQ ID NO: 53928 - protein, 9 aa, Homo Sapiens
QKRLLLWAG

SEQ ID NO: 53929 - protein, 9 aa, Homo Sapiens
IMKMILQAL

SEQ ID NO: 53930 - protein, 9 aa, Homo Sapiens
VSRHILTHT

SEQ ID NO: 53931 - protein, 9 aa, Homo Sapiens
LPSATQSNA

SEQ ID NO: 53932 - protein, 9 aa, Homo Sapiens
WNVKSLESA

SEQ ID NO: 53933 - protein, 9 aa, Homo Sapiens
STSSRVGSK

SEQ ID NO: 53934 - protein, 9 aa, Homo Sapiens
TPTVFSSHH

SEQ ID NO: 53935 - protein, 9 aa, Homo Sapiens
KLGFIISGP

SEQ ID NO: 53936 - protein, 9 aa, Homo Sapiens
LSEDAERPQ

SEQ ID NO: 53937 - protein, 9 aa, Homo Sapiens
QQEENIEKM

SEQ ID NO: 53938 - protein, 9 aa, Homo Sapiens
GTAIHLRGI

SEQ ID NO: 53939 - protein, 9 aa, Homo Sapiens
FTARGFGPL

SEQ ID NO: 53940 - protein, 9 aa, Homo Sapiens
SRLENHFLE

SEQ ID NO: 53941 - protein, 9 aa, Homo Sapiens
TSSRVGSKK

SEQ ID NO: 53942 - protein, 9 aa, Homo Sapiens
SVKHLKPGE

SEQ ID NO: 53943 - protein, 9 aa, Homo Sapiens
LIMKMILQA

SEQ ID NO: 53944 - protein, 9 aa, Homo Sapiens
PPPGVINQG

SEQ ID NO: 53945 - protein, 9 aa, Homo Sapiens
EAVCSGCVN

SEQ ID NO: 53946 - protein, 9 aa, Homo Sapiens
AVTAERCDR

SEQ ID NO: 53947 - protein, 9 aa, Homo Sapiens
ERVAIEPGA

SEQ ID NO: 53948 - protein, 9 aa, Homo Sapiens
KANRPKYTT

SEQ ID NO: 53949 - protein, 9 aa, Homo Sapiens
DSLSEDAER

SEQ ID NO: 53950 - protein, 9 aa, Homo Sapiens
ETESASVTQ

SEQ ID NO: 53951 - protein, 9 aa, Homo Sapiens
PPRRPALPS

SEQ ID NO: 53952 - protein, 9 aa, Homo Sapiens
GIPPPGVIN

SEQ ID NO: 53953 - protein, 9 aa, Homo Sapiens
PGVINQGVA

SEQ ID NO: 53954 - protein, 9 aa, Homo Sapiens
SLPEEFTAR

SEQ ID NO: 53955 - protein, 9 aa, Homo Sapiens
PSTFQAKQM

SEQ ID NO: 53956 - protein, 9 aa, Homo Sapiens
PGERVAIEP

SEQ ID NO: 53957 - protein, 9 aa, Homo Sapiens
TLPDLPPPP

SEQ ID NO: 53958 - protein, 9 aa, Homo Sapiens
QSYTCFFLL

SEQ ID NO: 53959 - protein, 9 aa, Homo Sapiens
PSKYEKHLH

SEQ ID NO: 53960 - protein, 9 aa, Homo Sapiens
CVCKPAVTA

SEQ ID NO: 53961 - protein, 9 aa, Homo Sapiens
PTSSLTSGF

SEQ ID NO: 53962 - protein, 9 aa, Homo Sapiens
GFVERKDEQ

SEQ ID NO: 53963 - protein, 9 aa, Homo Sapiens
PSKLGFIIS

SEQ ID NO: 53964 - protein, 9 aa, Homo Sapiens
KSLRTFLLT

SEQ ID NO: 53965 - protein, 9 aa, Homo Sapiens
PAVTAERCD

SEQ ID NO: 53966 - protein, 9 aa, Homo Sapiens
VKKFFSTSS

SEQ ID NO: 53967 - protein, 9 aa, Homo Sapiens
SGFRETSSS

SEQ ID NO: 53968 - protein, 9 aa, Homo Sapiens
SLTSGFRET

SEQ ID NO: 53969 - protein, 9 aa, Homo Sapiens
DSYDSLSED

SEQ ID NO: 53970 - protein, 9 aa, Homo Sapiens
MVFSCFFFI

SEQ ID NO: 53971 - protein, 9 aa, Homo Sapiens
GMYLEGSIY

SEQ ID NO: 53972 - protein, 9 aa, Homo Sapiens
KQMRPQDAF

SEQ ID NO: 53973 - protein, 9 aa, Homo Sapiens
TIAHKYLFE

SEQ ID NO: 53974 - protein, 9 aa, Homo Sapiens
MVYFEKVKL

SEQ ID NO: 53975 - protein, 9 aa, Homo Sapiens
NPPDHFLPQ

SEQ ID NO: 53976 - protein, 9 aa, Homo Sapiens
TGGLEPLAG

SEQ ID NO: 53977 - protein, 9 aa, Homo Sapiens
FETESASVT

SEQ ID NO: 53978 - protein, 9 aa, Homo Sapiens
AALLFVNEA

SEQ ID NO: 53979 - protein, 9 aa, Homo Sapiens
VDPDGTMSV

SEQ ID NO: 53980 - protein, 9 aa, Homo Sapiens
CGTMRSSLT

SEQ ID NO: 53981 - protein, 9 aa, Homo Sapiens
LLRFLGHNV

SEQ ID NO: 53982 - protein, 9 aa, Homo Sapiens
PQRALPRVA

SEQ ID NO: 53983 - protein, 9 aa, Homo Sapiens
SSAGKRHGS

SEQ ID NO: 53984 - protein, 9 aa, Homo Sapiens
LGTLGSEPR

SEQ ID NO: 53985 - protein, 9 aa, Homo Sapiens
WTAPQSLAY

SEQ ID NO: 53986 - protein, 9 aa, Homo Sapiens
YSETYCMFQ

SEQ ID NO: 53987 - protein, 9 aa, Homo Sapiens
SLSRHHPEQ

SEQ ID NO: 53988 - protein, 9 aa, Homo Sapiens
EQARSSAGK

SEQ ID NO: 53989 - protein, 9 aa, Homo Sapiens
KQMVYFEKV

SEQ ID NO: 53990 - protein, 9 aa, Homo Sapiens
QSSFTTELY

SEQ ID NO: 53991 - protein, 9 aa, Homo Sapiens
FSEAVCSGC

SEQ ID NO: 53992 - protein, 9 aa, Homo Sapiens
ALRNLKQIS

SEQ ID NO: 53993 - protein, 9 aa, Homo Sapiens
KNDQQVKQN

SEQ ID NO: 53994 - protein, 9 aa, Homo Sapiens
SLSEDAERP

SEQ ID NO: 53995 - protein, 9 aa, Homo Sapiens
SVLSLSTAL

SEQ ID NO: 53996 - protein, 9 aa, Homo Sapiens
VFGDTLNDS

SEQ ID NO: 53997 - protein, 9 aa, Homo Sapiens
FAHAKTHKG

SEQ ID NO: 53998 - protein, 9 aa, Homo Sapiens
SGGGGLGSS

SEQ ID NO: 53999 - protein, 9 aa, Homo Sapiens
SEAVCSGCV

SEQ ID NO: 54000 - protein, 9 aa, Homo Sapiens
YEKHLHDLQ

SEQ ID NO: 54001 - protein, 9 aa, Homo Sapiens
FWEGEAEQG

SEQ ID NO: 54002 - protein, 9 aa, Homo Sapiens
RPQVRELRS

SEQ ID NO: 54003 - protein, 9 aa, Homo Sapiens
LEEVFHNVD

SEQ ID NO: 54004 - protein, 9 aa, Homo Sapiens
ALPRVAFWP

SEQ ID NO: 54005 - protein, 9 aa, Homo Sapiens
KLAHRLQDA

SEQ ID NO: 54006 - protein, 9 aa, Homo Sapiens
VPFYCSECG

SEQ ID NO: 54007 - protein, 9 aa, Homo Sapiens
GTCHSPSLE

SEQ ID NO: 54008 - protein, 9 aa, Homo Sapiens
GRKNIKPTS

SEQ ID NO: 54009 - protein, 9 aa, Homo Sapiens
SLVSGFVER

SEQ ID NO: 54010 - protein, 9 aa, Homo Sapiens
RAWLLTSLM

SEQ ID NO: 54011 - protein, 9 aa, Homo Sapiens
AAGEPKANR

SEQ ID NO: 54012 - protein, 9 aa, Homo Sapiens
SKLGFIISG

SEQ ID NO: 54013 - protein, 9 aa, Homo Sapiens
PPDHFLPQS

SEQ ID NO: 54014 - protein, 9 aa, Homo Sapiens
LKPGERVAI

SEQ ID NO: 54015 - protein, 9 aa, Homo Sapiens
KTPQEGEKQ

SEQ ID NO: 54016 - protein, 9 aa, Homo Sapiens
GKRHGSHHQ

SEQ ID NO: 54017 - protein, 9 aa, Homo Sapiens
DPTQKANLK

SEQ ID NO: 54018 - protein, 9 aa, Homo Sapiens
CGHLIMKMI

SEQ ID NO: 54019 - protein, 9 aa, Homo Sapiens
SWTLGTLGS

SEQ ID NO: 54020 - protein, 9 aa, Homo Sapiens
LKQMVYFEK

SEQ ID NO: 54021 - protein, 9 aa, Homo Sapiens
LGHNVHARK

SEQ ID NO: 54022 - protein, 9 aa, Homo Sapiens
IISEQQAKC

SEQ ID NO: 54023 - protein, 9 aa, Homo Sapiens
LVVAKGGTA

SEQ ID NO: 54024 - protein, 9 aa, Homo Sapiens
LKWIFRRVL

SEQ ID NO: 54025 - protein, 9 aa, Homo Sapiens
LEIPEEHTL

SEQ ID NO: 54026 - protein, 9 aa, Homo Sapiens
TAPQSLAYN

SEQ ID NO: 54027 - protein, 9 aa, Homo Sapiens
GVINQGVAP

SEQ ID NO: 54028 - protein, 9 aa, Homo Sapiens
EMELLQAGL

SEQ ID NO: 54029 - protein, 9 aa, Homo Sapiens
SKYEKHLHD

SEQ ID NO: 54030 - protein, 9 aa, Homo Sapiens
LAEQLKQAQ

SEQ ID NO: 54031 - protein, 9 aa, Homo Sapiens
LNDSRDPDR

SEQ ID NO: 54032 - protein, 9 aa, Homo Sapiens
LDCGTMRSS

SEQ ID NO: 54033 - protein, 9 aa, Homo Sapiens
QAVHRAQPL

SEQ ID NO: 54034 - protein, 9 aa, Homo Sapiens
SFTNFSQLF

SEQ ID NO: 54035 - protein, 9 aa, Homo Sapiens
RVAFWPCSP

SEQ ID NO: 54036 - protein, 9 aa, Homo Sapiens
PSSLLCATP

SEQ ID NO: 54037 - protein, 9 aa, Homo Sapiens
VPPLGFEHI

SEQ ID NO: 54038 - protein, 9 aa, Homo Sapiens
VVAKGGTAW

SEQ ID NO: 54039 - protein, 9 aa, Homo Sapiens
QEENIEKMR

SEQ ID NO: 54040 - protein, 9 aa, Homo Sapiens
WSGKQPMCI

SEQ ID NO: 54041 - protein, 9 aa, Homo Sapiens
KQAQELRQY

SEQ ID NO: 54042 - protein, 9 aa, Homo Sapiens
SRRRRPRRQ

SEQ ID NO: 54043 - protein, 9 aa, Homo Sapiens
LEEEKIIND

SEQ ID NO: 54044 - protein, 9 aa, Homo Sapiens
YDISKDTLY

SEQ ID NO: 54045 - protein, 9 aa, Homo Sapiens
TPLKACKTP

SEQ ID NO: 54046 - protein, 9 aa, Homo Sapiens
RQALFFPSQ

SEQ ID NO: 54047 - protein, 9 aa, Homo Sapiens
GITAIQMAE

SEQ ID NO: 54048 - protein, 9 aa, Homo Sapiens
RLKWIFRRV

SEQ ID NO: 54049 - protein, 9 aa, Homo Sapiens
EEVADSARQ

SEQ ID NO: 54050 - protein, 9 aa, Homo Sapiens
EAKQQEENI

SEQ ID NO: 54051 - protein, 9 aa, Homo Sapiens
VVQVMKLAC

SEQ ID NO: 54052 - protein, 9 aa, Homo Sapiens
LRFLGHNVH

SEQ ID NO: 54053 - protein, 9 aa, Homo Sapiens
IHLRGISGL

SEQ ID NO: 54054 - protein, 9 aa, Homo Sapiens
THVCQFLEL

SEQ ID NO: 54055 - protein, 9 aa, Homo Sapiens
KWIFRRVLY

SEQ ID NO: 54056 - protein, 9 aa, Homo Sapiens
TNFSQLFAH

SEQ ID NO: 54057 - protein, 9 aa, Homo Sapiens
MAAFSGVRW

SEQ ID NO: 54058 - protein, 9 aa, Homo Sapiens
DMQAVHRAQ

SEQ ID NO: 54059 - protein, 9 aa, Homo Sapiens
VKLSKGGPG

SEQ ID NO: 54060 - protein, 9 aa, Homo Sapiens
DDELEEEKI

SEQ ID NO: 54061 - protein, 9 aa, Homo Sapiens
HNVHARKNK

SEQ ID NO: 54062 - protein, 9 aa, Homo Sapiens
ANQSQALKL

SEQ ID NO: 54063 - protein, 9 aa, Homo Sapiens
PMCIKACRE

SEQ ID NO: 54064 - protein, 9 aa, Homo Sapiens
PQVRELRSK

SEQ ID NO: 54065 - protein, 9 aa, Homo Sapiens
RASICRRTA

SEQ ID NO: 54066 - protein, 9 aa, Homo Sapiens
GTVGFKEKI

SEQ ID NO: 54067 - protein, 9 aa, Homo Sapiens
RPRRQALFF

SEQ ID NO: 54068 - protein, 9 aa, Homo Sapiens
YTQTVNFGT

SEQ ID NO: 54069 - protein, 9 aa, Homo Sapiens
LSRHHPEQS

SEQ ID NO: 54070 - protein, 9 aa, Homo Sapiens
AKQQEENIE

SEQ ID NO: 54071 - protein, 9 aa, Homo Sapiens
STFQAKQMT

SEQ ID NO: 54072 - protein, 9 aa, Homo Sapiens
NKVITLWYP

SEQ ID NO: 54073 - protein, 9 aa, Homo Sapiens
VYKQMRPQD

SEQ ID NO: 54074 - protein, 9 aa, Homo Sapiens
RYNSYDISK

SEQ ID NO: 54075 - protein, 9 aa, Homo Sapiens
PPVLGLPGL

SEQ ID NO: 54076 - protein, 9 aa, Homo Sapiens
TPQEGEKQS

SEQ ID NO: 54077 - protein, 9 aa, Homo Sapiens
LRLYEKDDY

SEQ ID NO: 54078 - protein, 9 aa, Homo Sapiens
SPFVKMTLP

SEQ ID NO: 54079 - protein, 9 aa, Homo Sapiens
LPQSYTCFF

SEQ ID NO: 54080 - protein, 9 aa, Homo Sapiens
ESASVTQAG

SEQ ID NO: 54081 - protein, 9 aa, Homo Sapiens
ADSYYGLLG

SEQ ID NO: 54082 - protein, 9 aa, Homo Sapiens
AGLEPLDSN

SEQ ID NO: 54083 - protein, 9 aa, Homo Sapiens
KAPSKLGFI

SEQ ID NO: 54084 - protein, 9 aa, Homo Sapiens
PVKANLVVQ

SEQ ID NO: 54085 - protein, 9 aa, Homo Sapiens
FTPQRALPR

SEQ ID NO: 54086 - protein, 9 aa, Homo Sapiens
PVPPTLPDL

SEQ ID NO: 54087 - protein, 9 aa, Homo Sapiens
FSRCALRDA

SEQ ID NO: 54088 - protein, 9 aa, Homo Sapiens
KNSSTGKSE

SEQ ID NO: 54089 - protein, 9 aa, Homo Sapiens
SGFVERKDE

SEQ ID NO: 54090 - protein, 9 aa, Homo Sapiens
SGKSSVAMG

SEQ ID NO: 54091 - protein, 9 aa, Homo Sapiens
GRGSQGRGG

SEQ ID NO: 54092 - protein, 9 aa, Homo Sapiens
EVKTPQEGE

SEQ ID NO: 54093 - protein, 9 aa, Homo Sapiens
TEQVKYSET

SEQ ID NO: 54094 - protein, 9 aa, Homo Sapiens
NVSAVGSCR

SEQ ID NO: 54095 - protein, 9 aa, Homo Sapiens
PQPPPKGPD

SEQ ID NO: 54096 - protein, 9 aa, Homo Sapiens
TCHSPSLEE

SEQ ID NO: 54097 - protein, 9 aa, Homo Sapiens
LHLGAGEGP

SEQ ID NO: 54098 - protein, 9 aa, Homo Sapiens
TEVMHAKET

SEQ ID NO: 54099 - protein, 9 aa, Homo Sapiens
RAKSLERRS

SEQ ID NO: 54100 - protein, 9 aa, Homo Sapiens
KEKFLVTPR

SEQ ID NO: 54101 - protein, 9 aa, Homo Sapiens
QALTASESN

SEQ ID NO: 54102 - protein, 9 aa, Homo Sapiens
SESNRGPSL

SEQ ID NO: 54103 - protein, 9 aa, Homo Sapiens
TLEEEEEDG

SEQ ID NO: 54104 - protein, 9 aa, Homo Sapiens
GSCHVAHHL

SEQ ID NO: 54105 - protein, 9 aa, Homo Sapiens
IRALDCKAL

SEQ ID NO: 54106 - protein, 9 aa, Homo Sapiens
GAVIYEIQR

SEQ ID NO: 54107 - protein, 9 aa, Homo Sapiens
KKKNMDAKN

SEQ ID NO: 54108 - protein, 9 aa, Homo Sapiens
LHETAAPSD

SEQ ID NO: 54109 - protein, 9 aa, Homo Sapiens
SCHVAHHLQ

SEQ ID NO: 54110 - protein, 9 aa, Homo Sapiens
KKNMDAKNG

SEQ ID NO: 54111 - protein, 9 aa, Homo Sapiens
RPPPPQLQG

SEQ ID NO: 54112 - protein, 9 aa, Homo Sapiens
ARDLLLWLP

SEQ ID NO: 54113 - protein, 9 aa, Homo Sapiens
KKKIIEDKT

SEQ ID NO: 54114 - protein, 9 aa, Homo Sapiens
TISPLVVAK

SEQ ID NO: 54115 - protein, 9 aa, Homo Sapiens
IVPARLSEA

SEQ ID NO: 54116 - protein, 9 aa, Homo Sapiens
GSRPRPPPP

SEQ ID NO: 54117 - protein, 9 aa, Homo Sapiens
QLQGADATE

SEQ ID NO: 54118 - protein, 9 aa, Homo Sapiens
KDEEWDQES

SEQ ID NO: 54119 - protein, 9 aa, Homo Sapiens
ATEVMHAKE

SEQ ID NO: 54120 - protein, 9 aa, Homo Sapiens
IETLQAEIK

SEQ ID NO: 54121 - protein, 9 aa, Homo Sapiens
NRHQCSVHE

SEQ ID NO: 54122 - protein, 9 aa, Homo Sapiens
TPAYNHLPG

SEQ ID NO: 54123 - protein, 9 aa, Homo Sapiens
LVLVSTFFI

SEQ ID NO: 54124 - protein, 9 aa, Homo Sapiens
NSLRSEIET

SEQ ID NO: 54125 - protein, 9 aa, Homo Sapiens
AKKKNMDAK

SEQ ID NO: 54126 - protein, 9 aa, Homo Sapiens
LPTGSLRCI

SEQ ID NO: 54127 - protein, 9 aa, Homo Sapiens
TKKTGYRPK

SEQ ID NO: 54128 - protein, 9 aa, Homo Sapiens
DQIRALDCK

SEQ ID NO: 54129 - protein, 9 aa, Homo Sapiens
RAQPVPCPP

SEQ ID NO: 54130 - protein, 9 aa, Homo Sapiens
RGPLSNLSE

SEQ ID NO: 54131 - protein, 9 aa, Homo Sapiens
LAEELQKKP

SEQ ID NO: 54132 - protein, 9 aa, Homo Sapiens
ETLLVSADD

SEQ ID NO: 54133 - protein, 9 aa, Homo Sapiens
FLLRQLLSE

SEQ ID NO: 54134 - protein, 9 aa, Homo Sapiens
DAPPSASVQ

SEQ ID NO: 54135 - protein, 9 aa, Homo Sapiens
DEAAGLVEG

SEQ ID NO: 54136 - protein, 9 aa, Homo Sapiens
CSVHEECRD

SEQ ID NO: 54137 - protein, 9 aa, Homo Sapiens
TPDEAAGLV

SEQ ID NO: 54138 - protein, 9 aa, Homo Sapiens
PAYNHLPGW

SEQ ID NO: 54139 - protein, 9 aa, Homo Sapiens
QKKKKIIED

SEQ ID NO: 54140 - protein, 9 aa, Homo Sapiens
NFAQAYAQG

SEQ ID NO: 54141 - protein, 9 aa, Homo Sapiens
LQGADATEV

SEQ ID NO: 54142 - protein, 9 aa, Homo Sapiens
MPYTGAVIY

SEQ ID NO: 54143 - protein, 9 aa, Homo Sapiens
GIIQQQKKV

SEQ ID NO: 54144 - protein, 9 aa, Homo Sapiens
GLLRAQPVP

SEQ ID NO: 54145 - protein, 9 aa, Homo Sapiens
WGLQFLLRQ

SEQ ID NO: 54146 - protein, 9 aa, Homo Sapiens
MLHETAAPS

SEQ ID NO: 54147 - protein, 9 aa, Homo Sapiens
STFFIFWSP

SEQ ID NO: 54148 - protein, 9 aa, Homo Sapiens
QNKVIFIRG

SEQ ID NO: 54149 - protein, 9 aa, Homo Sapiens
FGSVARMCA

SEQ ID NO: 54150 - protein, 9 aa, Homo Sapiens
FCEKDEEWD

SEQ ID NO: 54151 - protein, 9 aa, Homo Sapiens
NSYQAKKKN

SEQ ID NO: 54152 - protein, 9 aa, Homo Sapiens
PRDYARFKK

SEQ ID NO: 54153 - protein, 9 aa, Homo Sapiens
TGQFHVYSE

SEQ ID NO: 54154 - protein, 9 aa, Homo Sapiens
LNSESNFAQ

SEQ ID NO: 54155 - protein, 9 aa, Homo Sapiens
IKMCLLKLC

SEQ ID NO: 54156 - protein, 9 aa, Homo Sapiens
SCMLFGTLV

SEQ ID NO: 54157 - protein, 9 aa, Homo Sapiens
SYQAKKKNM

SEQ ID NO: 54158 - protein, 9 aa, Homo Sapiens
TISPRLCFS

SEQ ID NO: 54159 - protein, 9 aa, Homo Sapiens
VKMFDKLNR

SEQ ID NO: 54160 - protein, 9 aa, Homo Sapiens
QDLLISFGI

SEQ ID NO: 54161 - protein, 9 aa, Homo Sapiens
LLASLPTGS

SEQ ID NO: 54162 - protein, 9 aa, Homo Sapiens
FAQAYAQGI

SEQ ID NO: 54163 - protein, 9 aa, Homo Sapiens
SLLNQKDLR

SEQ ID NO: 54164 - protein, 9 aa, Homo Sapiens
FHVYSELPK

SEQ ID NO: 54165 - protein, 9 aa, Homo Sapiens
LTASESNRG

SEQ ID NO: 54166 - protein, 8 aa, Homo Sapiens
DELALSFS

SEQ ID NO: 54167 - protein, 9 aa, Homo Sapiens
SPRLCFSSL

SEQ ID NO: 54168 - protein, 9 aa, Homo Sapiens
EQKKKKIIE

SEQ ID NO: 54169 - protein, 9 aa, Homo Sapiens
KIQDLLISF

SEQ ID NO: 54170 - protein, 9 aa, Homo Sapiens
HVYSELPKP

SEQ ID NO: 54171 - protein, 9 aa, Homo Sapiens
LARGPLSNL

SEQ ID NO: 54172 - protein, 9 aa, Homo Sapiens
TPPMVLLQT

SEQ ID NO: 54173 - protein, 9 aa, Homo Sapiens
IQDLLISFG

SEQ ID NO: 54174 - protein, 9 aa, Homo Sapiens
PRVLPLIFP

SEQ ID NO: 54175 - protein, 9 aa, Homo Sapiens
QFHVYSELP

SEQ ID NO: 54176 - protein, 9 aa, Homo Sapiens
IVTDTPAYN

SEQ ID NO: 54177 - protein, 9 aa, Homo Sapiens
KNMDAKNGQ

SEQ ID NO: 54178 - protein, 9 aa, Homo Sapiens
IELTVEYPC

SEQ ID NO: 54179 - protein, 9 aa, Homo Sapiens
TASESNRGP

SEQ ID NO: 54180 - protein, 9 aa, Homo Sapiens
KCKECKCSS

SEQ ID NO: 54181 - protein, 9 aa, Homo Sapiens
MCLLKLCKS

SEQ ID NO: 54182 - protein, 9 aa, Homo Sapiens
KKKKIIEDK

SEQ ID NO: 54183 - protein, 9 aa, Homo Sapiens
ATGQFHVYS

SEQ ID NO: 54184 - protein, 9 aa, Homo Sapiens
RSEIETLQA

SEQ ID NO: 54185 - protein, 9 aa, Homo Sapiens
SESNFAQAY

SEQ ID NO: 54186 - protein, 9 aa, Homo Sapiens
PLEEVDEEG

SEQ ID NO: 54187 - protein, 9 aa, Homo Sapiens
DTKKTGYRP

SEQ ID NO: 54188 - protein, 9 aa, Homo Sapiens
IQNKVIFIR

SEQ ID NO: 54189 - protein, 9 aa, Homo Sapiens
KRHTRGLSR

SEQ ID NO: 54190 - protein, 9 aa, Homo Sapiens
HAKETLLVS

SEQ ID NO: 54191 - protein, 9 aa, Homo Sapiens
KIIDDTMAQ

SEQ ID NO: 54192 - protein, 9 aa, Homo Sapiens
TLQAEIKRI

SEQ ID NO: 54193 - protein, 9 aa, Homo Sapiens
YDYGHTGHG

SEQ ID NO: 54194 - protein, 9 aa, Homo Sapiens
KGVPIQNKV

SEQ ID NO: 54195 - protein, 9 aa, Homo Sapiens
AHHLQPVGS

SEQ ID NO: 54196 - protein, 9 aa, Homo Sapiens
LLLVLVSTF

SEQ ID NO: 54197 - protein, 9 aa, Homo Sapiens
PLIFPHHIH

SEQ ID NO: 54198 - protein, 9 aa, Homo Sapiens
EGPIQLGIP

SEQ ID NO: 54199 - protein, 9 aa, Homo Sapiens
YTGAVIYEI

SEQ ID NO: 54200 - protein, 9 aa, Homo Sapiens
CKCKECKCS

SEQ ID NO: 54201 - protein, 9 aa, Homo Sapiens
FRQRVLLCP

SEQ ID NO: 54202 - protein, 9 aa, Homo Sapiens
VANHVVQSL

SEQ ID NO: 54203 - protein, 9 aa, Homo Sapiens
LRQLLSEHV

SEQ ID NO: 54204 - protein, 9 aa, Homo Sapiens
RSSLRDLRS

SEQ ID NO: 54205 - protein, 9 aa, Homo Sapiens
LGRGWGLQF

SEQ ID NO: 54206 - protein, 9 aa, Homo Sapiens
GWGCGIVGS

SEQ ID NO: 54207 - protein, 9 aa, Homo Sapiens
APPSASVQW

SEQ ID NO: 54208 - protein, 9 aa, Homo Sapiens
AEELQKKPL

SEQ ID NO: 54209 - protein, 9 aa, Homo Sapiens
VGSRPRPPP

SEQ ID NO: 54210 - protein, 9 aa, Homo Sapiens
RLRSSLRDL

SEQ ID NO: 54211 - protein, 9 aa, Homo Sapiens
ISPLVVAKG

SEQ ID NO: 54212 - protein, 9 aa, Homo Sapiens
PPQLQGADA

SEQ ID NO: 54213 - protein, 9 aa, Homo Sapiens
PPPPQLQGA

SEQ ID NO: 54214 - protein, 9 aa, Homo Sapiens
TGAVIYEIQ

SEQ ID NO: 54215 - protein, 9 aa, Homo Sapiens
SFFFFRQRV

SEQ ID NO: 54216 - protein, 9 aa, Homo Sapiens
LISFGILKP

SEQ ID NO: 54217 - protein, 9 aa, Homo Sapiens
EGGRFCEKD

SEQ ID NO: 54218 - protein, 9 aa, Homo Sapiens
LVSTFFIFW

SEQ ID NO: 54219 - protein, 9 aa, Homo Sapiens
QIRALDCKA

SEQ ID NO: 54220 - protein, 9 aa, Homo Sapiens
PRLCFSSLG

SEQ ID NO: 54221 - protein, 9 aa, Homo Sapiens
PLLAAWEVG

SEQ ID NO: 54222 - protein, 9 aa, Homo Sapiens
ECKCSSCKK

SEQ ID NO: 54223 - protein, 9 aa, Homo Sapiens
FFFFRQRVL

SEQ ID NO: 54224 - protein, 9 aa, Homo Sapiens
IKKIQDLLI

SEQ ID NO: 54225 - protein, 9 aa, Homo Sapiens
LRAQPVPCP

SEQ ID NO: 54226 - protein, 9 aa, Homo Sapiens
ADDDVADPA

SEQ ID NO: 54227 - protein, 9 aa, Homo Sapiens
RLLLVLVST

SEQ ID NO: 54228 - protein, 9 aa, Homo Sapiens
YMLHETAAP

SEQ ID NO: 54229 - protein, 9 aa, Homo Sapiens
KKIQDLLIS

SEQ ID NO: 54230 - protein, 9 aa, Homo Sapiens
RPRPPPPQL

SEQ ID NO: 54231 - protein, 9 aa, Homo Sapiens
SRPRPPPPQ

SEQ ID NO: 54232 - protein, 9 aa, Homo Sapiens
QLLLASLPT

SEQ ID NO: 54233 - protein, 9 aa, Homo Sapiens
WLPLLAAWE

SEQ ID NO: 54234 - protein, 9 aa, Homo Sapiens
LLVSADDDV

SEQ ID NO: 54235 - protein, 9 aa, Homo Sapiens
VTPRDYARF

SEQ ID NO: 54236 - protein, 9 aa, Homo Sapiens
HHLQPVGSR

SEQ ID NO: 54237 - protein, 9 aa, Homo Sapiens
VLVSTFFIF

SEQ ID NO: 54238 - protein, 9 aa, Homo Sapiens
DLLLWLPLL

SEQ ID NO: 54239 - protein, 9 aa, Homo Sapiens
LASLPTGSL

SEQ ID NO: 54240 - protein, 9 aa, Homo Sapiens
LGLLRAQPV

SEQ ID NO: 54241 - protein, 9 aa, Homo Sapiens
ASVQWCRKC

SEQ ID NO: 54242 - protein, 9 aa, Homo Sapiens
RQLLSEHVQ

SEQ ID NO: 54243 - protein, 9 aa, Homo Sapiens
KMFDKLNRD

SEQ ID NO: 54244 - protein, 9 aa, Homo Sapiens
IFPHHIHQT

SEQ ID NO: 54245 - protein, 9 aa, Homo Sapiens
RDYARFKKS

SEQ ID NO: 54246 - protein, 9 aa, Homo Sapiens
NFGSVARMC

SEQ ID NO: 54247 - protein, 9 aa, Homo Sapiens
AGEGPIQLG

SEQ ID NO: 54248 - protein, 9 aa, Homo Sapiens
RIKMCLLKL

SEQ ID NO: 54249 - protein, 9 aa, Homo Sapiens
WDTKKTGYR

SEQ ID NO: 54250 - protein, 9 aa, Homo Sapiens
HIHQTISPR

SEQ ID NO: 54251 - protein, 9 aa, Homo Sapiens
THLGVKMFD

SEQ ID NO: 54252 - protein, 9 aa, Homo Sapiens
LGIPRVLPL

SEQ ID NO: 54253 - protein, 9 aa, Homo Sapiens
LFSFFFFRQ

SEQ ID NO: 54254 - protein, 9 aa, Homo Sapiens
RFCEKDEEW

SEQ ID NO: 54255 - protein, 9 aa, Homo Sapiens
GADATEVMH

SEQ ID NO: 54256 - protein, 9 aa, Homo Sapiens
GGWGCGIVG

SEQ ID NO: 54257 - protein, 9 aa, Homo Sapiens
ADQIRALDC

SEQ ID NO: 54258 - protein, 9 aa, Homo Sapiens
ALSCMLFGT

SEQ ID NO: 54259 - protein, 9 aa, Homo Sapiens
QLLSEHVQG

SEQ ID NO: 54260 - protein, 9 aa, Homo Sapiens
MKIIDDTMA

SEQ ID NO: 54261 - protein, 9 aa, Homo Sapiens
NNFGSVARM

SEQ ID NO: 54262 - protein, 9 aa, Homo Sapiens
ALDCKALVG

SEQ ID NO: 54263 - protein, 9 aa, Homo Sapiens
SALALSCML

SEQ ID NO: 54264 - protein, 9 aa, Homo Sapiens
QPVGSRPRP

SEQ ID NO: 54265 - protein, 9 aa, Homo Sapiens
SLQNIWKET

SEQ ID NO: 54266 - protein, 9 aa, Homo Sapiens
QTISPRLCF

SEQ ID NO: 54267 - protein, 9 aa, Homo Sapiens
AKGGTAWLE

SEQ ID NO: 54268 - protein, 9 aa, Homo Sapiens
HEECRDYAT

SEQ ID NO: 54269 - protein, 9 aa, Homo Sapiens
QGGWGCGIV

SEQ ID NO: 54270 - protein, 9 aa, Homo Sapiens
KETLLVSAD

SEQ ID NO: 54271 - protein, 9 aa, Homo Sapiens
DLAEELQKK

SEQ ID NO: 54272 - protein, 9 aa, Homo Sapiens
GLQFLLRQL

SEQ ID NO: 54273 - protein, 9 aa, Homo Sapiens
LQNIWKETV

SEQ ID NO: 54274 - protein, 9 aa, Homo Sapiens
SASVQWCRK

SEQ ID NO: 54275 - protein, 9 aa, Homo Sapiens
GQPRLRSSL

SEQ ID NO: 54276 - protein, 9 aa, Homo Sapiens
GHGPSGGSR

SEQ ID NO: 54277 - protein, 9 aa, Homo Sapiens
LERRSTEPS

SEQ ID NO: 54278 - protein, 9 aa, Homo Sapiens
KFLVTPRDY

SEQ ID NO: 54279 - protein, 9 aa, Homo Sapiens
FSSLGRGWG

SEQ ID NO: 54280 - protein, 9 aa, Homo Sapiens
LLLASLPTG

SEQ ID NO: 54281 - protein, 9 aa, Homo Sapiens
HVQGGWGCG

SEQ ID NO: 54282 - protein, 9 aa, Homo Sapiens
GAGEGPIQL

SEQ ID NO: 54283 - protein, 9 aa, Homo Sapiens
YGHTGHGPS

SEQ ID NO: 54284 - protein, 9 aa, Homo Sapiens
IQLGIPRVL

SEQ ID NO: 54285 - protein, 9 aa, Homo Sapiens
QPRLRSSLR

SEQ ID NO: 54286 - protein, 9 aa, Homo Sapiens
TLLVSADDD

SEQ ID NO: 54287 - protein, 9 aa, Homo Sapiens
EKTPDEAAG

SEQ ID NO: 54288 - protein, 9 aa, Homo Sapiens
QNIWKETVP

SEQ ID NO: 54289 - protein, 9 aa, Homo Sapiens
TCEKRHTRG

SEQ ID NO: 54290 - protein, 9 aa, Homo Sapiens
QYYMLHETA

SEQ ID NO: 54291 - protein, 9 aa, Homo Sapiens
ISPRLCFSS

SEQ ID NO: 54292 - protein, 9 aa, Homo Sapiens
ESNFAQAYA

SEQ ID NO: 54293 - protein, 9 aa, Homo Sapiens
AAGLVEGTS

SEQ ID NO: 54294 - protein, 9 aa, Homo Sapiens
HTHLGVKMF

SEQ ID NO: 54295 - protein, 9 aa, Homo Sapiens
HTGHGPSGG

SEQ ID NO: 54296 - protein, 9 aa, Homo Sapiens
PTGSLRCIT

SEQ ID NO: 54297 - protein, 9 aa, Homo Sapiens
GIPRVLPLI

SEQ ID NO: 54298 - protein, 9 aa, Homo Sapiens
HGPSGGSRK

SEQ ID NO: 54299 - protein, 9 aa, Homo Sapiens
TGFINGDLI

SEQ ID NO: 54300 - protein, 9 aa, Homo Sapiens
KTGYRPKSC

SEQ ID NO: 54301 - protein, 9 aa, Homo Sapiens
SSLGRGWGL

SEQ ID NO: 54302 - protein, 9 aa, Homo Sapiens
VPCPPACKC

SEQ ID NO: 54303 - protein, 9 aa, Homo Sapiens
LLSEHVQGG

SEQ ID NO: 54304 - protein, 9 aa, Homo Sapiens
EECRDYATG

SEQ ID NO: 54305 - protein, 9 aa, Homo Sapiens
TAAPSDIVG

SEQ ID NO: 54306 - protein, 9 aa, Homo Sapiens
DIVPARLSE

SEQ ID NO: 54307 - protein, 9 aa, Homo Sapiens
PGSCHVAHH

SEQ ID NO: 54308 - protein, 9 aa, Homo Sapiens
SGPFCEHTP

SEQ ID NO: 54309 - protein, 9 aa, Homo Sapiens
KGGTAWLEW

SEQ ID NO: 54310 - protein, 9 aa, Homo Sapiens
PPLEEVDEE

SEQ ID NO: 54311 - protein, 9 aa, Homo Sapiens
VMHAKETLL

SEQ ID NO: 54312 - protein, 9 aa, Homo Sapiens
KKIIEDKTF

SEQ ID NO: 54313 - protein, 9 aa, Homo Sapiens
DRAKMPYTG

SEQ ID NO: 54314 - protein, 9 aa, Homo Sapiens
QKKPLNSEI

SEQ ID NO: 54315 - protein, 9 aa, Homo Sapiens
FPHHIHQTI

SEQ ID NO: 54316 - protein, 9 aa, Homo Sapiens
ITNNFGSVA

SEQ ID NO: 54317 - protein, 9 aa, Homo Sapiens
IIDDTMAQL

SEQ ID NO: 54318 - protein, 9 aa, Homo Sapiens
EYDYGHTGH

SEQ ID NO: 54319 - protein, 9 aa, Homo Sapiens
EHVQGGWGC

SEQ ID NO: 54320 - protein, 9 aa, Homo Sapiens
ATGFINGDL

SEQ ID NO: 54321 - protein, 9 aa, Homo Sapiens
RPPLEEVDE

SEQ ID NO: 54322 - protein, 9 aa, Homo Sapiens
FCEHTPPMV

SEQ ID NO: 54323 - protein, 9 aa, Homo Sapiens
NHVVQSLLN

SEQ ID NO: 54324 - protein, 9 aa, Homo Sapiens
RVLPLIFPH

SEQ ID NO: 54325 - protein, 9 aa, Homo Sapiens
VQSLLNQKD

SEQ ID NO: 54326 - protein, 9 aa, Homo Sapiens
GYRPKSCEV

SEQ ID NO: 54327 - protein, 9 aa, Homo Sapiens
SSVTCEKRH

SEQ ID NO: 54328 - protein, 9 aa, Homo Sapiens
YPCRCGALS

SEQ ID NO: 54329 - protein, 9 aa, Homo Sapiens
VAHHLQPVG

SEQ ID NO: 54330 - protein, 9 aa, Homo Sapiens
PVPCPPACK

SEQ ID NO: 54331 - protein, 9 aa, Homo Sapiens
FFRQRVLLC

SEQ ID NO: 54332 - protein, 9 aa, Homo Sapiens
FLFSFFFFR

SEQ ID NO: 54333 - protein, 9 aa, Homo Sapiens
CEKRHTRGL

SEQ ID NO: 54334 - protein, 9 aa, Homo Sapiens
NRGPSLLQT

SEQ ID NO: 54335 - protein, 9 aa, Homo Sapiens
KCSSCKKSC

SEQ ID NO: 54336 - protein, 9 aa, Homo Sapiens
FSFFFFRQR

SEQ ID NO: 54337 - protein, 9 aa, Homo Sapiens
FSGPFCEHT

SEQ ID NO: 54338 - protein, 9 aa, Homo Sapiens
LLVLVSTFF

SEQ ID NO: 54339 - protein, 9 aa, Homo Sapiens
ETAAPSDIV

SEQ ID NO: 54340 - protein, 9 aa, Homo Sapiens
LQEPLARGP

SEQ ID NO: 54341 - protein, 9 aa, Homo Sapiens
DPGVLPWGT

SEQ ID NO: 54342 - protein, 9 aa, Homo Sapiens
EKDEEWDQE

SEQ ID NO: 54343 - protein, 9 aa, Homo Sapiens
LVTITNNFG

SEQ ID NO: 54344 - protein, 9 aa, Homo Sapiens
LQPVGSRPR

SEQ ID NO: 54345 - protein, 9 aa, Homo Sapiens
GKGVPIQNK

SEQ ID NO: 54346 - protein, 9 aa, Homo Sapiens
SNRGPSLLQ

SEQ ID NO: 54347 - protein, 9 aa, Homo Sapiens
IPRVLPLIF

SEQ ID NO: 54348 - protein, 9 aa, Homo Sapiens
EKFLVTPRD

SEQ ID NO: 54349 - protein, 9 aa, Homo Sapiens
DCKALVGLS

SEQ ID NO: 54350 - protein, 9 aa, Homo Sapiens
VSHTHLGVK

SEQ ID NO: 54351 - protein, 9 aa, Homo Sapiens
EHTPPMVLL

SEQ ID NO: 54352 - protein, 9 aa, Homo Sapiens
VDIVPARLS

SEQ ID NO: 54353 - protein, 9 aa, Homo Sapiens
HLGVKMFDK

SEQ ID NO: 54354 - protein, 9 aa, Homo Sapiens
KSLERRSTE

SEQ ID NO: 54355 - protein, 9 aa, Homo Sapiens
DLLISFGIL

SEQ ID NO: 54356 - protein, 9 aa, Homo Sapiens
AKSLERRST

SEQ ID NO: 54357 - protein, 9 aa, Homo Sapiens
SHTHLGVKM

SEQ ID NO: 54358 - protein, 9 aa, Homo Sapiens
SADDDVADP

SEQ ID NO: 54359 - protein, 9 aa, Homo Sapiens
ELTVEYPCR

SEQ ID NO: 54360 - protein, 9 aa, Homo Sapiens
AEQKKKKII

SEQ ID NO: 54361 - protein, 9 aa, Homo Sapiens
VPARLSEAE

SEQ ID NO: 54362 - protein, 9 aa, Homo Sapiens
GPIQLGIPR

SEQ ID NO: 54363 - protein, 9 aa, Homo Sapiens
LRSEIETLQ

SEQ ID NO: 54364 - protein, 9 aa, Homo Sapiens
ANHVVQSLL

SEQ ID NO: 54365 - protein, 9 aa, Homo Sapiens
ARGPLSNLS

SEQ ID NO: 54366 - protein, 9 aa, Homo Sapiens
GGRFCEKDE

SEQ ID NO: 54367 - protein, 9 aa, Homo Sapiens
PRPPPPQLQ

SEQ ID NO: 54368 - protein, 9 aa, Homo Sapiens
RHTRGLSRI

SEQ ID NO: 54369 - protein, 9 aa, Homo Sapiens
DDTMAQLQD

SEQ ID NO: 54370 - protein, 9 aa, Homo Sapiens
GHTGHGPSG

SEQ ID NO: 54371 - protein, 9 aa, Homo Sapiens
SVTCEKRHT

SEQ ID NO: 54372 - protein, 9 aa, Homo Sapiens
QLGIPRVLP

SEQ ID NO: 54373 - protein, 9 aa, Homo Sapiens
INGDLIESF

SEQ ID NO: 54374 - protein, 9 aa, Homo Sapiens
QCSVHEECR

SEQ ID NO: 54375 - protein, 9 aa, Homo Sapiens
EVANHVVQS

SEQ ID NO: 54376 - protein, 9 aa, Homo Sapiens
NMDAKNGQT

SEQ ID NO: 54377 - protein, 9 aa, Homo Sapiens
CKCSSCKKS

SEQ ID NO: 54378 - protein, 9 aa, Homo Sapiens
GRFCEKDEE

SEQ ID NO: 54379 - protein, 9 aa, Homo Sapiens
VFGQPRLRS

SEQ ID NO: 54380 - protein, 9 aa, Homo Sapiens
VEYPCRCGA

SEQ ID NO: 54381 - protein, 9 aa, Homo Sapiens
HVAHHLQPV

SEQ ID NO: 54382 - protein, 9 aa, Homo Sapiens
PPPQLQGAD

SEQ ID NO: 54383 - protein, 9 aa, Homo Sapiens
KKTGYRPKS

SEQ ID NO: 54384 - protein, 9 aa, Homo Sapiens
QFLLRQLLS

SEQ ID NO: 54385 - protein, 9 aa, Homo Sapiens
PVGSRPRPP

SEQ ID NO: 54386 - protein, 9 aa, Homo Sapiens
LCFSSLGRG

SEQ ID NO: 54387 - protein, 9 aa, Homo Sapiens
QVDIVPARL

SEQ ID NO: 54388 - protein, 9 aa, Homo Sapiens
HQTISPRLC

SEQ ID NO: 54389 - protein, 9 aa, Homo Sapiens
CEKDEEWDQ

SEQ ID NO: 54390 - protein, 9 aa, Homo Sapiens
CLLKLCKSK

SEQ ID NO: 54391 - protein, 9 aa, Homo Sapiens
LIFPHHIHQ

SEQ ID NO: 54392 - protein, 9 aa, Homo Sapiens
HMKIIDDTM

SEQ ID NO: 54393 - protein, 9 aa, Homo Sapiens
HTRGLSRIV

SEQ ID NO: 54394 - protein, 9 aa, Homo Sapiens
RAKMPYTGA

SEQ ID NO: 54395 - protein, 9 aa, Homo Sapiens
TPRDYARFK

SEQ ID NO: 54396 - protein, 9 aa, Homo Sapiens
HHIHQTISP

SEQ ID NO: 54397 - protein, 9 aa, Homo Sapiens
PDEAAGLVE

SEQ ID NO: 54398 - protein, 9 aa, Homo Sapiens
KMCLLKLCK

SEQ ID NO: 54399 - protein, 9 aa, Homo Sapiens
LLLWLPLLA

SEQ ID NO: 54400 - protein, 9 aa, Homo Sapiens
VHEECRDYA

SEQ ID NO: 54401 - protein, 9 aa, Homo Sapiens
SLPTGSLRC

SEQ ID NO: 54402 - protein, 9 aa, Homo Sapiens
AYNHLPGWE

SEQ ID NO: 54403 - protein, 9 aa, Homo Sapiens
YYMLHETAA

SEQ ID NO: 54404 - protein, 9 aa, Homo Sapiens
PCRCGALSP

SEQ ID NO: 54405 - protein, 9 aa, Homo Sapiens
DADQIRALD

SEQ ID NO: 54406 - protein, 9 aa, Homo Sapiens
LWLPLLAAW

SEQ ID NO: 54407 - protein, 9 aa, Homo Sapiens
DATEVMHAK

SEQ ID NO: 54408 - protein, 9 aa, Homo Sapiens
AQAYAQGIS

SEQ ID NO: 54409 - protein, 9 aa, Homo Sapiens
LVTPRDYAR

SEQ ID NO: 54410 - protein, 9 aa, Homo Sapiens
ERRSTEPSV

SEQ ID NO: 54411 - protein, 9 aa, Homo Sapiens
CKECKCSSC

SEQ ID NO: 54412 - protein, 9 aa, Homo Sapiens
LPLLAAWEV

SEQ ID NO: 54413 - protein, 9 aa, Homo Sapiens
HVVQSLLNQ

SEQ ID NO: 54414 - protein, 9 aa, Homo Sapiens
QEPLARGPL

SEQ ID NO: 54415 - protein, 9 aa, Homo Sapiens
LQFLLRQLL

SEQ ID NO: 54416 - protein, 9 aa, Homo Sapiens
VFSALALSC

SEQ ID NO: 54417 - protein, 9 aa, Homo Sapiens
GVKMFDKLN

SEQ ID NO: 54418 - protein, 9 aa, Homo Sapiens
PARLSEAEW

SEQ ID NO: 54419 - protein, 9 aa, Homo Sapiens
PHRRAKSLE

SEQ ID NO: 54420 - protein, 9 aa, Homo Sapiens
PATGFINGD

SEQ ID NO: 54421 - protein, 9 aa, Homo Sapiens
ETNHSSLQN

SEQ ID NO: 54422 - protein, 9 aa, Homo Sapiens
NHSSLQNIW

SEQ ID NO: 54423 - protein, 9 aa, Homo Sapiens
PSASVQWCR

SEQ ID NO: 54424 - protein, 9 aa, Homo Sapiens
HETAAPSDI

SEQ ID NO: 54425 - protein, 9 aa, Homo Sapiens
TLVTITNNF

SEQ ID NO: 54426 - protein, 9 aa, Homo Sapiens
FSALALSCM

SEQ ID NO: 54427 - protein, 9 aa, Homo Sapiens
YRPKSCEVP

SEQ ID NO: 54428 - protein, 9 aa, Homo Sapiens
GWGLQFLLR

SEQ ID NO: 54429 - protein, 9 aa, Homo Sapiens
LSCMLFGTL

SEQ ID NO: 54430 - protein, 9 aa, Homo Sapiens
QAYAQGISR

SEQ ID NO: 54431 - protein, 9 aa, Homo Sapiens
PQLQGADAT

SEQ ID NO: 54432 - protein, 9 aa, Homo Sapiens
YNHLPGWED

SEQ ID NO: 54433 - protein, 9 aa, Homo Sapiens
NSESNFAQA

SEQ ID NO: 54434 - protein, 9 aa, Homo Sapiens
EVMHAKETL

SEQ ID NO: 54435 - protein, 9 aa, Homo Sapiens
ESNRGPSLL

SEQ ID NO: 54436 - protein, 9 aa, Homo Sapiens
EIETLQAEI

SEQ ID NO: 54437 - protein, 9 aa, Homo Sapiens
AQPVPCPPA

SEQ ID NO: 54438 - protein, 9 aa, Homo Sapiens
CHVAHHLQP

SEQ ID NO: 54439 - protein, 9 aa, Homo Sapiens
PIQNKVIFI

SEQ ID NO: 54440 - protein, 9 aa, Homo Sapiens
LSEHVQGGW

SEQ ID NO: 54441 - protein, 9 aa, Homo Sapiens
ALALSCMLF

SEQ ID NO: 54442 - protein, 9 aa, Homo Sapiens
LLISFGILK

SEQ ID NO: 54443 - protein, 9 aa, Homo Sapiens
SSLQNIWKE

SEQ ID NO: 54444 - protein, 9 aa, Homo Sapiens
HLGAGEGPI

SEQ ID NO: 54445 - protein, 9 aa, Homo Sapiens
VLPLIFPHH

SEQ ID NO: 54446 - protein, 9 aa, Homo Sapiens
WGTLEEEEE

SEQ ID NO: 54447 - protein, 9 aa, Homo Sapiens
VLPWGTLEE

SEQ ID NO: 54448 - protein, 9 aa, Homo Sapiens
VAKGGTAWL

SEQ ID NO: 54449 - protein, 9 aa, Homo Sapiens
PRLRSSLRD

SEQ ID NO: 54450 - protein, 9 aa, Homo Sapiens
PWGTLEEEE

SEQ ID NO: 54451 - protein, 9 aa, Homo Sapiens
PYTGAVIYE

SEQ ID NO: 54452 - protein, 9 aa, Homo Sapiens
ARLSEAEWM

SEQ ID NO: 54453 - protein, 9 aa, Homo Sapiens
VQWCRKCFG

SEQ ID NO: 54454 - protein, 9 aa, Homo Sapiens
KMPYTGAVI

SEQ ID NO: 54455 - protein, 9 aa, Homo Sapiens
LKLCKSKAK

SEQ ID NO: 54456 - protein, 9 aa, Homo Sapiens
ELQKKPLNS

SEQ ID NO: 54457 - protein, 9 aa, Homo Sapiens
VTCEKRHTR

SEQ ID NO: 54458 - protein, 9 aa, Homo Sapiens
LPLIFPHHI

SEQ ID NO: 54459 - protein, 9 aa, Homo Sapiens
QWCRKCFGA

SEQ ID NO: 54460 - protein, 9 aa, Homo Sapiens
PPSASVQWC

SEQ ID NO: 54461 - protein, 9 aa, Homo Sapiens
LVSADDDVA

SEQ ID NO: 54462 - protein, 9 aa, Homo Sapiens
LRSSLRDLR

SEQ ID NO: 54463 - protein, 9 aa, Homo Sapiens
RRAKSLERR

SEQ ID NO: 54464 - protein, 9 aa, Homo Sapiens
LPWGTLEEE

SEQ ID NO: 54465 - protein, 9 aa, Homo Sapiens
FFLFSFFFF

SEQ ID NO: 54466 - protein, 9 aa, Homo Sapiens
DTMAQLQDL

SEQ ID NO: 54467 - protein, 9 aa, Homo Sapiens
SEHVQGGWG

SEQ ID NO: 54468 - protein, 9 aa, Homo Sapiens
TVEYPCRCG

SEQ ID NO: 54469 - protein, 9 aa, Homo Sapiens
CRCGALSPT

SEQ ID NO: 54470 - protein, 9 aa, Homo Sapiens
QSLLNQKDL

SEQ ID NO: 54471 - protein, 9 aa, Homo Sapiens
GTLEEEEED

SEQ ID NO: 54472 - protein, 9 aa, Homo Sapiens
GLVEGTSAK

SEQ ID NO: 54473 - protein, 9 aa, Homo Sapiens
VTDTPAYNH

SEQ ID NO: 54474 - protein, 9 aa, Homo Sapiens
SETNHSSLQ

SEQ ID NO: 54475 - protein, 9 aa, Homo Sapiens
IIQQQKKVI

SEQ ID NO: 54476 - protein, 9 aa, Homo Sapiens
IMRIKMCLL

SEQ ID NO: 54477 - protein, 9 aa, Homo Sapiens
CEHTPPMVL

SEQ ID NO: 54478 - protein, 9 aa, Homo Sapiens
NRPPLEEVD

SEQ ID NO: 54479 - protein, 9 aa, Homo Sapiens
VSADDDVAD

SEQ ID NO: 54480 - protein, 9 aa, Homo Sapiens
GQFHVYSEL

SEQ ID NO: 54481 - protein, 9 aa, Homo Sapiens
AGLVEGTSA

SEQ ID NO: 54482 - protein, 9 aa, Homo Sapiens
VPIQNKVIF

SEQ ID NO: 54483 - protein, 9 aa, Homo Sapiens
CMLFGTLVA

SEQ ID NO: 54484 - protein, 9 aa, Homo Sapiens
SEIETLQAE

SEQ ID NO: 54485 - protein, 9 aa, Homo Sapiens
RLCFSSLGR

SEQ ID NO: 54486 - protein, 9 aa, Homo Sapiens
VPQVDIVPA

SEQ ID NO: 54487 - protein, 9 aa, Homo Sapiens
SVHEECRDY

SEQ ID NO: 54488 - protein, 9 aa, Homo Sapiens
QPVPCPPAC

SEQ ID NO: 54489 - protein, 9 aa, Homo Sapiens
ETLQAEIKR

SEQ ID NO: 54490 - protein, 9 aa, Homo Sapiens
KKPLNSEIR

SEQ ID NO: 54491 - protein, 9 aa, Homo Sapiens
ALTASESNR

SEQ ID NO: 54492 - protein, 9 aa, Homo Sapiens
QAKKKNMDA

SEQ ID NO: 54493 - protein, 9 aa, Homo Sapiens
MHAKETLLV

SEQ ID NO: 54494 - protein, 9 aa, Homo Sapiens
FFFRQRVLL

SEQ ID NO: 54495 - protein, 9 aa, Homo Sapiens
GFINGDLIE

SEQ ID NO: 54496 - protein, 9 aa, Homo Sapiens
FGQPRLRSS

SEQ ID NO: 54497 - protein, 9 aa, Homo Sapiens
SSCKKSCCS

SEQ ID NO: 54498 - protein, 9 aa, Homo Sapiens
LDCKALVGL

SEQ ID NO: 54499 - protein, 9 aa, Homo Sapiens
HRRAKSLER

SEQ ID NO: 54500 - protein, 9 aa, Homo Sapiens
IHQTISPRL

SEQ ID NO: 54501 - protein, 9 aa, Homo Sapiens
LGVKMFDKL

SEQ ID NO: 54502 - protein, 9 aa, Homo Sapiens
RNRPPLEEV

SEQ ID NO: 54503 - protein, 9 aa, Homo Sapiens
PLARGPLSN

SEQ ID NO: 54504 - protein, 9 aa, Homo Sapiens
VQGGWGCGI

SEQ ID NO: 54505 - protein, 9 aa, Homo Sapiens
SPLVVAKGG

SEQ ID NO: 54506 - protein, 9 aa, Homo Sapiens
VSTFFIFWS

SEQ ID NO: 54507 - protein, 9 aa, Homo Sapiens
PFCEHTPPM

SEQ ID NO: 54508 - protein, 9 aa, Homo Sapiens
TFFIFWSPF

SEQ ID NO: 54509 - protein, 9 aa, Homo Sapiens
DDDVADPAL

SEQ ID NO: 54510 - protein, 9 aa, Homo Sapiens
GLLQEPLAR

SEQ ID NO: 54511 - protein, 9 aa, Homo Sapiens
ASLPTGSLR

SEQ ID NO: 54512 - protein, 9 aa, Homo Sapiens
LALSCMLFG

SEQ ID NO: 54513 - protein, 9 aa, Homo Sapiens
RGWGLQFLL

SEQ ID NO: 54514 - protein, 9 aa, Homo Sapiens
SVQWCRKCF

SEQ ID NO: 54515 - protein, 9 aa, Homo Sapiens
DDLAEELQK

SEQ ID NO: 54516 - protein, 9 aa, Homo Sapiens
CSSCKKSCC

SEQ ID NO: 54517 - protein, 9 aa, Homo Sapiens
DTPAYNHLP

SEQ ID NO: 54518 - protein, 9 aa, Homo Sapiens
LQKKPLNSE

SEQ ID NO: 54519 - protein, 9 aa, Homo Sapiens
SNFAQAYAQ

SEQ ID NO: 54520 - protein, 9 aa, Homo Sapiens
GVPIQNKVI

SEQ ID NO: 54521 - protein, 9 aa, Homo Sapiens
VDGKGVPIQ

SEQ ID NO: 54522 - protein, 9 aa, Homo Sapiens
LEEVDEEGE

SEQ ID NO: 54523 - protein, 9 aa, Homo Sapiens
EELQKKPLN

SEQ ID NO: 54524 - protein, 9 aa, Homo Sapiens
LLQEPLARG

SEQ ID NO: 54525 - protein, 9 aa, Homo Sapiens
ADATEVMHA

SEQ ID NO: 54526 - protein, 9 aa, Homo Sapiens
SSLRDLRSP

SEQ ID NO: 54527 - protein, 9 aa, Homo Sapiens
HSSLQNIWK

SEQ ID NO: 54528 - protein, 9 aa, Homo Sapiens
RHQCSVHEE

SEQ ID NO: 54529 - protein, 9 aa, Homo Sapiens
VYSELPKPS

SEQ ID NO: 54530 - protein, 9 aa, Homo Sapiens
EAAGLVEGT

SEQ ID NO: 54531 - protein, 9 aa, Homo Sapiens
LLRQLLSEH

SEQ ID NO: 54532 - protein, 9 aa, Homo Sapiens
AWDTKKTGY

SEQ ID NO: 54533 - protein, 9 aa, Homo Sapiens
PLVVAKGGT

SEQ ID NO: 54534 - protein, 9 aa, Homo Sapiens
KAEQKKKKI

SEQ ID NO: 54535 - protein, 9 aa, Homo Sapiens
TGSLRCITC

SEQ ID NO: 54536 - protein, 9 aa, Homo Sapiens
TDTPAYNHL

SEQ ID NO: 54537 - protein, 9 aa, Homo Sapiens
EYPCRCGAL

SEQ ID NO: 54538 - protein, 9 aa, Homo Sapiens
AAPSDIVGA

SEQ ID NO: 54539 - protein, 9 aa, Homo Sapiens
PHHIHQTIS

SEQ ID NO: 54540 - protein, 9 aa, Homo Sapiens
HTPPMVLLQ

SEQ ID NO: 54541 - protein, 9 aa, Homo Sapiens
PQVDIVPAR

SEQ ID NO: 54542 - protein, 9 aa, Homo Sapiens
YSELPKPSI

SEQ ID NO: 54543 - protein, 9 aa, Homo Sapiens
AKMPYTGAV

SEQ ID NO: 54544 - protein, 9 aa, Homo Sapiens
LTVEYPCRC

SEQ ID NO: 54545 - protein, 9 aa, Homo Sapiens
KTPDEAAGL

SEQ ID NO: 54546 - protein, 9 aa, Homo Sapiens
GPFCEHTPP

SEQ ID NO: 54547 - protein, 9 aa, Homo Sapiens
HLQPVGSRP

SEQ ID NO: 54548 - protein, 9 aa, Homo Sapiens
CFSSLGRGW

SEQ ID NO: 54549 - protein, 9 aa, Homo Sapiens
ASESNRGPS

SEQ ID NO: 54550 - protein, 9 aa, Homo Sapiens
SLRSEIETL

SEQ ID NO: 54551 - protein, 9 aa, Homo Sapiens
PIQLGIPRV

SEQ ID NO: 54552 - protein, 9 aa, Homo Sapiens
YQAKKKNMD

SEQ ID NO: 54553 - protein, 9 aa, Homo Sapiens
TNHSSLQNI

SEQ ID NO: 54554 - protein, 9 aa, Homo Sapiens
IDDTMAQLQ

SEQ ID NO: 54555 - protein, 9 aa, Homo Sapiens
VVQSLLNQK

SEQ ID NO: 54556 - protein, 9 aa, Homo Sapiens
FLVTPRDYA

SEQ ID NO: 54557 - protein, 9 aa, Homo Sapiens
FINGDLIES

SEQ ID NO: 54558 - protein, 9 aa, Homo Sapiens
EPATGFING

SEQ ID NO: 54559 - protein, 9 aa, Homo Sapiens
DYGHTGHGP

SEQ ID NO: 54560 - protein, 9 aa, Homo Sapiens
LVVAKGGTA

SEQ ID NO: 54561 - protein, 9 aa, Homo Sapiens
GEGPIQLGI

SEQ ID NO: 54562 - protein, 9 aa, Homo Sapiens
LLKLCKSKA

SEQ ID NO: 54563 - protein, 9 aa, Homo Sapiens
KECKCSSCK

SEQ ID NO: 54564 - protein, 9 aa, Homo Sapiens
EKRHTRGLS

SEQ ID NO: 54565 - protein, 9 aa, Homo Sapiens
TGHGPSGGS

SEQ ID NO: 54566 - protein, 9 aa, Homo Sapiens
TGYRPKSCE

SEQ ID NO: 54567 - protein, 9 aa, Homo Sapiens
SLERRSTEP

SEQ ID NO: 54568 - protein, 9 aa, Homo Sapiens
TITNNFGSV

SEQ ID NO: 54569 - protein, 9 aa, Homo Sapiens
VVAKGGTAW

SEQ ID NO: 54570 - protein, 9 aa, Homo Sapiens
MRIKMCLLK

SEQ ID NO: 54571 - protein, 9 aa, Homo Sapiens
VTITNNFGS

SEQ ID NO: 54572 - protein, 9 aa, Homo Sapiens
PGVLPWGTL

SEQ ID NO: 54573 - protein, 9 aa, Homo Sapiens
QRHMKIIDD

SEQ ID NO: 54574 - protein, 9 aa, Homo Sapiens
RALDCKALV

SEQ ID NO: 54575 - protein, 9 aa, Homo Sapiens
TEPATGFIN

SEQ ID NO: 54576 - protein, 9 aa, Homo Sapiens
SLGRGWGLQ

SEQ ID NO: 54577 - protein, 9 aa, Homo Sapiens
DEEWDQESA

SEQ ID NO: 54578 - protein, 9 aa, Homo Sapiens
RDLLLWLPL

SEQ ID NO: 54579 - protein, 9 aa, Homo Sapiens
IQQQKKVIC

SEQ ID NO: 54580 - protein, 9 aa, Homo Sapiens
LLRAQPVPC

SEQ ID NO: 54581 - protein, 9 aa, Homo Sapiens
LGAGEGPIQ

SEQ ID NO: 54582 - protein, 9 aa, Homo Sapiens
RHMKIIDDT

SEQ ID NO: 54583 - protein, 9 aa, Homo Sapiens
EPLARGPLS

SEQ ID NO: 54584 - protein, 9 aa, Homo Sapiens
NGDLIESFL

SEQ ID NO: 54585 - protein, 9 aa, Homo Sapiens
QGADATEVM

SEQ ID NO: 54586 - protein, 9 aa, Homo Sapiens
DGKGVPIQN

SEQ ID NO: 54587 - protein, 9 aa, Homo Sapiens
HQCSVHEEC

SEQ ID NO: 54588 - protein, 9 aa, Homo Sapiens
GIVTDTPAY

SEQ ID NO: 54589 - protein, 9 aa, Homo Sapiens
KKAEQKKKK

SEQ ID NO: 54590 - protein, 9 aa, Homo Sapiens
LLWLPLLAA

SEQ ID NO: 54591 - protein, 9 aa, Homo Sapiens
AKETLLVSA

SEQ ID NO: 54592 - protein, 9 aa, Homo Sapiens
TNNFGSVAR

SEQ ID NO: 54593 - protein, 9 aa, Homo Sapiens
ISFGILKPD

SEQ ID NO: 54594 - protein, 9 aa, Homo Sapiens
SELPKPSIS

SEQ ID NO: 54595 - protein, 9 aa, Homo Sapiens
GRGWGLQFL

SEQ ID NO: 54596 - protein, 9 aa, Homo Sapiens
GVLPWGTLE

SEQ ID NO: 54597 - protein, 9 aa, Homo Sapiens
LRCRDLAFS

SEQ ID NO: 54598 - protein, 9 aa, Homo Sapiens
GRKLRTFSD

SEQ ID NO: 54599 - protein, 9 aa, Homo Sapiens
DPEDERVAG

SEQ ID NO: 54600 - protein, 9 aa, Homo Sapiens
SRKQATECL

SEQ ID NO: 54601 - protein, 9 aa, Homo Sapiens
PTTVMDPSA

SEQ ID NO: 54602 - protein, 9 aa, Homo Sapiens
PGSGKTILS

SEQ ID NO: 54603 - protein, 9 aa, Homo Sapiens
TVPLLGTAI

SEQ ID NO: 54604 - protein, 9 aa, Homo Sapiens
WNLNPVFGG

SEQ ID NO: 54605 - protein, 9 aa, Homo Sapiens
DVRHHCQQT

SEQ ID NO: 54606 - protein, 9 aa, Homo Sapiens
TPSGCLELS

SEQ ID NO: 54607 - protein, 9 aa, Homo Sapiens
QPQNPLLGK

SEQ ID NO: 54608 - protein, 9 aa, Homo Sapiens
AFSLRLLRA

SEQ ID NO: 54609 - protein, 9 aa, Homo Sapiens
HCQQTTCDR

SEQ ID NO: 54610 - protein, 9 aa, Homo Sapiens
PGGAGASPG

SEQ ID NO: 54611 - protein, 9 aa, Homo Sapiens
ASQIWNLNP

SEQ ID NO: 54612 - protein, 9 aa, Homo Sapiens
MHGRQRVHR

SEQ ID NO: 54613 - protein, 9 aa, Homo Sapiens
SSKNTAKGL

SEQ ID NO: 54614 - protein, 9 aa, Homo Sapiens
SGKTILSRI

SEQ ID NO: 54615 - protein, 9 aa, Homo Sapiens
AFYIFTSVP

SEQ ID NO: 54616 - protein, 9 aa, Homo Sapiens
YIIKNKSKY

SEQ ID NO: 54617 - protein, 9 aa, Homo Sapiens
GLGTMVTEP

SEQ ID NO: 54618 - protein, 9 aa, Homo Sapiens
FECDECPEK

SEQ ID NO: 54619 - protein, 9 aa, Homo Sapiens
PLDFNDYKL

SEQ ID NO: 54620 - protein, 9 aa, Homo Sapiens
VTCYDRAFS

SEQ ID NO: 54621 - protein, 9 aa, Homo Sapiens
PLLGTAIVT

SEQ ID NO: 54622 - protein, 9 aa, Homo Sapiens
MDPEDERVA

SEQ ID NO: 54623 - protein, 9 aa, Homo Sapiens
VPDAIKSQC

SEQ ID NO: 54624 - protein, 9 aa, Homo Sapiens
IPTQNTQVR

SEQ ID NO: 54625 - protein, 9 aa, Homo Sapiens
HTPRRQEEV

SEQ ID NO: 54626 - protein, 9 aa, Homo Sapiens
GEPPMSSLR

SEQ ID NO: 54627 - protein, 9 aa, Homo Sapiens
SSCMGGMNQ

SEQ ID NO: 54628 - protein, 9 aa, Homo Sapiens
LRFCNFTTI

SEQ ID NO: 54629 - protein, 9 aa, Homo Sapiens
AAKIRAVEQ

SEQ ID NO: 54630 - protein, 9 aa, Homo Sapiens
CDECPEKLY

SEQ ID NO: 54631 - protein, 9 aa, Homo Sapiens
PTMSTDMLS

SEQ ID NO: 54632 - protein, 9 aa, Homo Sapiens
QIPTQNTQV

SEQ ID NO: 54633 - protein, 9 aa, Homo Sapiens
FSLRLLRAD

SEQ ID NO: 54634 - protein, 9 aa, Homo Sapiens
FYIIKNKSK

SEQ ID NO: 54635 - protein, 9 aa, Homo Sapiens
AQHLAFFSH

SEQ ID NO: 54636 - protein, 9 aa, Homo Sapiens
VTEPVLRPV

SEQ ID NO: 54637 - protein, 9 aa, Homo Sapiens
MVTEPVLRP

SEQ ID NO: 54638 - protein, 9 aa, Homo Sapiens
PCSSPVGGG

SEQ ID NO: 54639 - protein, 9 aa, Homo Sapiens
KGKDARIKK

SEQ ID NO: 54640 - protein, 9 aa, Homo Sapiens
DARIKKESL

SEQ ID NO: 54641 - protein, 9 aa, Homo Sapiens
RIKKESLGH

SEQ ID NO: 54642 - protein, 9 aa, Homo Sapiens
CCALCHAPA

SEQ ID NO: 54643 - protein, 9 aa, Homo Sapiens
GRPRGHLLC

SEQ ID NO: 54644 - protein, 9 aa, Homo Sapiens
KKRYSRKQA

SEQ ID NO: 54645 - protein, 9 aa, Homo Sapiens
HICNFSLDW

SEQ ID NO: 54646 - protein, 9 aa, Homo Sapiens
YTSPDESTA

SEQ ID NO: 54647 - protein, 9 aa, Homo Sapiens
PEDERVAGV

SEQ ID NO: 54648 - protein, 9 aa, Homo Sapiens
QCQFPPPLI

SEQ ID NO: 54649 - protein, 9 aa, Homo Sapiens
GPPGTGPGG

SEQ ID NO: 54650 - protein, 9 aa, Homo Sapiens
TMVTEPVLR

SEQ ID NO: 54651 - protein, 9 aa, Homo Sapiens
EPPMSSLRK

SEQ ID NO: 54652 - protein, 9 aa, Homo Sapiens
RMSAEMNRI

SEQ ID NO: 54653 - protein, 9 aa, Homo Sapiens
RAGRKLRTF

SEQ ID NO: 54654 - protein, 9 aa, Homo Sapiens
ARTCSQEPL

SEQ ID NO: 54655 - protein, 9 aa, Homo Sapiens
IKSQCQFPP

SEQ ID NO: 54656 - protein, 9 aa, Homo Sapiens
MSSLRKQVL

SEQ ID NO: 54657 - protein, 9 aa, Homo Sapiens
ASPGLQLHP

SEQ ID NO: 54658 - protein, 9 aa, Homo Sapiens
WKRWKKCYF

SEQ ID NO: 54659 - protein, 9 aa, Homo Sapiens
NIPLKQLMV

SEQ ID NO: 54660 - protein, 9 aa, Homo Sapiens
PGETVMYVA

SEQ ID NO: 54661 - protein, 9 aa, Homo Sapiens
ADKIKSGIH

SEQ ID NO: 54662 - protein, 9 aa, Homo Sapiens
GKTILSRIL

SEQ ID NO: 54663 - protein, 9 aa, Homo Sapiens
RKLHICNFS

SEQ ID NO: 54664 - protein, 9 aa, Homo Sapiens
FVFFELTVD

SEQ ID NO: 54665 - protein, 9 aa, Homo Sapiens
LLRCRDLAF

SEQ ID NO: 54666 - protein, 9 aa, Homo Sapiens
DYKLLMATH

SEQ ID NO: 54667 - protein, 9 aa, Homo Sapiens
LDFNDYKLL

SEQ ID NO: 54668 - protein, 9 aa, Homo Sapiens
SQGRGHVVV

SEQ ID NO: 54669 - protein, 9 aa, Homo Sapiens
FYIFTSVPS

SEQ ID NO: 54670 - protein, 9 aa, Homo Sapiens
LELSDSCQP

SEQ ID NO: 54671 - protein, 9 aa, Homo Sapiens
PRRQEEVLL

SEQ ID NO: 54672 - protein, 9 aa, Homo Sapiens
DERVAGVMS

SEQ ID NO: 54673 - protein, 9 aa, Homo Sapiens
PITDPASAH

SEQ ID NO: 54674 - protein, 9 aa, Homo Sapiens
GHVVVHCSA

SEQ ID NO: 54675 - protein, 9 aa, Homo Sapiens
DFNDYKLLM

SEQ ID NO: 54676 - protein, 9 aa, Homo Sapiens
GKACESCYA

SEQ ID NO: 54677 - protein, 9 aa, Homo Sapiens
AKVDKIKEV

SEQ ID NO: 54678 - protein, 9 aa, Homo Sapiens
LGTAIVTIL

SEQ ID NO: 54679 - protein, 9 aa, Homo Sapiens
QTLRPRRTK

SEQ ID NO: 54680 - protein, 9 aa, Homo Sapiens
DHLKECEHI

SEQ ID NO: 54681 - protein, 9 aa, Homo Sapiens
WTTLFQDSA

SEQ ID NO: 54682 - protein, 9 aa, Homo Sapiens
PPCSSPVGG

SEQ ID NO: 54683 - protein, 9 aa, Homo Sapiens
EMNRIATHL

SEQ ID NO: 54684 - protein, 9 aa, Homo Sapiens
LFQDSASPS

SEQ ID NO: 54685 - protein, 9 aa, Homo Sapiens
VAFYIFTSV

SEQ ID NO: 54686 - protein, 9 aa, Homo Sapiens
KVFVFFELT

SEQ ID NO: 54687 - protein, 9 aa, Homo Sapiens
DAIKSQCQF

SEQ ID NO: 54688 - protein, 9 aa, Homo Sapiens
GASPGLQLH

SEQ ID NO: 54689 - protein, 9 aa, Homo Sapiens
ACTLLDGLN

SEQ ID NO: 54690 - protein, 9 aa, Homo Sapiens
RFAKPVYPR

SEQ ID NO: 54691 - protein, 9 aa, Homo Sapiens
SKPSSKNTA

SEQ ID NO: 54692 - protein, 9 aa, Homo Sapiens
DIGNCTYFF

SEQ ID NO: 54693 - protein, 9 aa, Homo Sapiens
IVTFTPFYI

SEQ ID NO: 54694 - protein, 9 aa, Homo Sapiens
PVYPRQTLQ

SEQ ID NO: 54695 - protein, 9 aa, Homo Sapiens
KPVYPRQTL

SEQ ID NO: 54696 - protein, 9 aa, Homo Sapiens
VIKAIGQVA

SEQ ID NO: 54697 - protein, 9 aa, Homo Sapiens
RYTSPDEST

SEQ ID NO: 54698 - protein, 9 aa, Homo Sapiens
AFFSHFSAR

SEQ ID NO: 54699 - protein, 9 aa, Homo Sapiens
RSHTPRRQE

SEQ ID NO: 54700 - protein, 9 aa, Homo Sapiens
INGRPRGHL

SEQ ID NO: 54701 - protein, 9 aa, Homo Sapiens
DRTFQKCAA

SEQ ID NO: 54702 - protein, 9 aa, Homo Sapiens
MRRPPGGSR

SEQ ID NO: 54703 - protein, 9 aa, Homo Sapiens
AIKSQCQFP

SEQ ID NO: 54704 - protein, 9 aa, Homo Sapiens
RTFQKCAAV

SEQ ID NO: 54705 - protein, 9 aa, Homo Sapiens
FRMSAEMNR

SEQ ID NO: 54706 - protein, 9 aa, Homo Sapiens
LVPITDPAS

SEQ ID NO: 54707 - protein, 9 aa, Homo Sapiens
GGELWGVNI

SEQ ID NO: 54708 - protein, 9 aa, Homo Sapiens
PQPGETVMY

SEQ ID NO: 54709 - protein, 9 aa, Homo Sapiens
ETVMYVAGA

SEQ ID NO: 54710 - protein, 9 aa, Homo Sapiens
PGGSRPQPR

SEQ ID NO: 54711 - protein, 9 aa, Homo Sapiens
FEVFFFTIG

SEQ ID NO: 54712 - protein, 9 aa, Homo Sapiens
QVAFGKAYL

SEQ ID NO: 54713 - protein, 9 aa, Homo Sapiens
MRGIQCKWK

SEQ ID NO: 54714 - protein, 9 aa, Homo Sapiens
IKAIGQVAF

SEQ ID NO: 54715 - protein, 9 aa, Homo Sapiens
PGLQLHPRL

SEQ ID NO: 54716 - protein, 9 aa, Homo Sapiens
KKKRYSRKQ

SEQ ID NO: 54717 - protein, 9 aa, Homo Sapiens
EDVRHHCQQ

SEQ ID NO: 54718 - protein, 9 aa, Homo Sapiens
GELWGVNIP

SEQ ID NO: 54719 - protein, 9 aa, Homo Sapiens
FQDSASPSS

SEQ ID NO: 54720 - protein, 9 aa, Homo Sapiens
SRALCQACT

SEQ ID NO: 54721 - protein, 9 aa, Homo Sapiens
QVGSVLGLS

SEQ ID NO: 54722 - protein, 9 aa, Homo Sapiens
VRQVMEREF

SEQ ID NO: 54723 - protein, 9 aa, Homo Sapiens
CQACTLLDG

SEQ ID NO: 54724 - protein, 9 aa, Homo Sapiens
LVNDVKDCG

SEQ ID NO: 54725 - protein, 9 aa, Homo Sapiens
PPGPPGTGP

SEQ ID NO: 54726 - protein, 9 aa, Homo Sapiens
PSSKNTAKG

SEQ ID NO: 54727 - protein, 9 aa, Homo Sapiens
RQRVHRDIK

SEQ ID NO: 54728 - protein, 9 aa, Homo Sapiens
AKIRAVEQR

SEQ ID NO: 54729 - protein, 9 aa, Homo Sapiens
VFVFFELTV

SEQ ID NO: 54730 - protein, 9 aa, Homo Sapiens
RGHVVVHCS

SEQ ID NO: 54731 - protein, 9 aa, Homo Sapiens
PRGHLLCVD

SEQ ID NO: 54732 - protein, 9 aa, Homo Sapiens
RYSRKQATE

SEQ ID NO: 54733 - protein, 9 aa, Homo Sapiens
DESTAVVSV

SEQ ID NO: 54734 - protein, 9 aa, Homo Sapiens
RRQEEVLLR

SEQ ID NO: 54735 - protein, 9 aa, Homo Sapiens
HGRQRVHRD

SEQ ID NO: 54736 - protein, 9 aa, Homo Sapiens
IPYSDQTLR

SEQ ID NO: 54737 - protein, 9 aa, Homo Sapiens
KEVIEPGFL

SEQ ID NO: 54738 - protein, 9 aa, Homo Sapiens
GETVMYVAG

SEQ ID NO: 54739 - protein, 9 aa, Homo Sapiens
DSRFLANAV

SEQ ID NO: 54740 - protein, 9 aa, Homo Sapiens
DLAFSLRLL

SEQ ID NO: 54741 - protein, 9 aa, Homo Sapiens
VSSYDIGNC

SEQ ID NO: 54742 - protein, 9 aa, Homo Sapiens
NSFRMSAEM

SEQ ID NO: 54743 - protein, 9 aa, Homo Sapiens
KCYFVLVQV

SEQ ID NO: 54744 - protein, 9 aa, Homo Sapiens
HYPTMSTDM

SEQ ID NO: 54745 - protein, 9 aa, Homo Sapiens
LANAVLQEN

SEQ ID NO: 54746 - protein, 9 aa, Homo Sapiens
GSYVHYPTM

SEQ ID NO: 54747 - protein, 9 aa, Homo Sapiens
RCRDLAFSL

SEQ ID NO: 54748 - protein, 9 aa, Homo Sapiens
IKEVIEPGF

SEQ ID NO: 54749 - protein, 9 aa, Homo Sapiens
QIWNLNPVF

SEQ ID NO: 54750 - protein, 9 aa, Homo Sapiens
RQVGSVLGL

SEQ ID NO: 54751 - protein, 9 aa, Homo Sapiens
HFSARGPAH

SEQ ID NO: 54752 - protein, 9 aa, Homo Sapiens
GNCTYFFFR

SEQ ID NO: 54753 - protein, 9 aa, Homo Sapiens
TSPDESTAV

SEQ ID NO: 54754 - protein, 9 aa, Homo Sapiens
QPGETVMYV

SEQ ID NO: 54755 - protein, 9 aa, Homo Sapiens
SSPVGGGDP

SEQ ID NO: 54756 - protein, 9 aa, Homo Sapiens
SQEPLRGGC

SEQ ID NO: 54757 - protein, 9 aa, Homo Sapiens
DCGKAFNQQ

SEQ ID NO: 54758 - protein, 9 aa, Homo Sapiens
RTCSQEPLR

SEQ ID NO: 54759 - protein, 9 aa, Homo Sapiens
VGSVLGLSP

SEQ ID NO: 54760 - protein, 9 aa, Homo Sapiens
IIKNKSKYH

SEQ ID NO: 54761 - protein, 9 aa, Homo Sapiens
SKNTAKGLS

SEQ ID NO: 54762 - protein, 9 aa, Homo Sapiens
LLGPQLLGA

SEQ ID NO: 54763 - protein, 9 aa, Homo Sapiens
SCMGGMNQR

SEQ ID NO: 54764 - protein, 9 aa, Homo Sapiens
GPPCSSPVG

SEQ ID NO: 54765 - protein, 9 aa, Homo Sapiens
IWNLNPVFG

SEQ ID NO: 54766 - protein, 9 aa, Homo Sapiens
IEEDVRHHC

SEQ ID NO: 54767 - protein, 9 aa, Homo Sapiens
VRHHCQQTT

SEQ ID NO: 54768 - protein, 9 aa, Homo Sapiens
LAFSLRLLR

SEQ ID NO: 54769 - protein, 9 aa, Homo Sapiens
VLGLSPGGG

SEQ ID NO: 54770 - protein, 9 aa, Homo Sapiens
ERVAGVMSV

SEQ ID NO: 54771 - protein, 9 aa, Homo Sapiens
RALCQACTL

SEQ ID NO: 54772 - protein, 9 aa, Homo Sapiens
KIKSGIHNT

SEQ ID NO: 54773 - protein, 9 aa, Homo Sapiens
GRGHVVVHC

SEQ ID NO: 54774 - protein, 9 aa, Homo Sapiens
AGASPGLQL

SEQ ID NO: 54775 - protein, 9 aa, Homo Sapiens
KDDFEVFFF

SEQ ID NO: 54776 - protein, 9 aa, Homo Sapiens
DECPEKLYH

SEQ ID NO: 54777 - protein, 9 aa, Homo Sapiens
KLLMATHGF

SEQ ID NO: 54778 - protein, 9 aa, Homo Sapiens
GNKLFECDE

SEQ ID NO: 54779 - protein, 9 aa, Homo Sapiens
TAVVSVNNQ

SEQ ID NO: 54780 - protein, 9 aa, Homo Sapiens
KVWKRWKKC

SEQ ID NO: 54781 - protein, 9 aa, Homo Sapiens
DRAFSNYCE

SEQ ID NO: 54782 - protein, 9 aa, Homo Sapiens
QNTQVRQVM

SEQ ID NO: 54783 - protein, 9 aa, Homo Sapiens
CSQEPLRGG

SEQ ID NO: 54784 - protein, 9 aa, Homo Sapiens
QDGRKLHIC

SEQ ID NO: 54785 - protein, 9 aa, Homo Sapiens
FAPQRAGRK

SEQ ID NO: 54786 - protein, 9 aa, Homo Sapiens
SDSCQPYRS

SEQ ID NO: 54787 - protein, 9 aa, Homo Sapiens
LLKKLCNHP

SEQ ID NO: 54788 - protein, 9 aa, Homo Sapiens
LCHAPAGLK

SEQ ID NO: 54789 - protein, 9 aa, Homo Sapiens
SLSSITLLK

SEQ ID NO: 54790 - protein, 9 aa, Homo Sapiens
NPLLGKACE

SEQ ID NO: 54791 - protein, 9 aa, Homo Sapiens
RGHLLCVDT

SEQ ID NO: 54792 - protein, 9 aa, Homo Sapiens
NKALKKKRY

SEQ ID NO: 54793 - protein, 9 aa, Homo Sapiens
YKRENAAKI

SEQ ID NO: 54794 - protein, 9 aa, Homo Sapiens
VNIPLKQLM

SEQ ID NO: 54795 - protein, 9 aa, Homo Sapiens
AFSNYCEEC

SEQ ID NO: 54796 - protein, 9 aa, Homo Sapiens
NKVFVFFEL

SEQ ID NO: 54797 - protein, 9 aa, Homo Sapiens
FNMGCITLA

SEQ ID NO: 54798 - protein, 9 aa, Homo Sapiens
NKLFECDEC

SEQ ID NO: 54799 - protein, 9 aa, Homo Sapiens
SQCQFPPPL

SEQ ID NO: 54800 - protein, 9 aa, Homo Sapiens
QRVHRDIKP

SEQ ID NO: 54801 - protein, 9 aa, Homo Sapiens
FLDEPTTVM

SEQ ID NO: 54802 - protein, 9 aa, Homo Sapiens
TGPGGVAPA

SEQ ID NO: 54803 - protein, 9 aa, Homo Sapiens
FDRDTDKWI

SEQ ID NO: 54804 - protein, 9 aa, Homo Sapiens
DKIKSGIHN

SEQ ID NO: 54805 - protein, 9 aa, Homo Sapiens
NAVLQENYT

SEQ ID NO: 54806 - protein, 9 aa, Homo Sapiens
SSYDIGNCT

SEQ ID NO: 54807 - protein, 9 aa, Homo Sapiens
QVRQVMERE

SEQ ID NO: 54808 - protein, 9 aa, Homo Sapiens
DEPTTVMDP

SEQ ID NO: 54809 - protein, 9 aa, Homo Sapiens
KDARIKKES

SEQ ID NO: 54810 - protein, 9 aa, Homo Sapiens
EVCFNMGCI

SEQ ID NO: 54811 - protein, 9 aa, Homo Sapiens
AIGQVAFGK

SEQ ID NO: 54812 - protein, 9 aa, Homo Sapiens
PGECLVPIT

SEQ ID NO: 54813 - protein, 9 aa, Homo Sapiens
TFQKCAAVV

SEQ ID NO: 54814 - protein, 9 aa, Homo Sapiens
NDYKLLMAT

SEQ ID NO: 54815 - protein, 9 aa, Homo Sapiens
SRPQPRLED

SEQ ID NO: 54816 - protein, 9 aa, Homo Sapiens
ELTVDDQSV

SEQ ID NO: 54817 - protein, 9 aa, Homo Sapiens
TTVMDPSAR

SEQ ID NO: 54818 - protein, 9 aa, Homo Sapiens
QRAGRKLRT

SEQ ID NO: 54819 - protein, 9 aa, Homo Sapiens
CSSPVGGGD

SEQ ID NO: 54820 - protein, 9 aa, Homo Sapiens
NTAKGLSSI

SEQ ID NO: 54821 - protein, 9 aa, Homo Sapiens
CRDLAFSLR

SEQ ID NO: 54822 - protein, 9 aa, Homo Sapiens
LKKGKDARI

SEQ ID NO: 54823 - protein, 9 aa, Homo Sapiens
GPQLLGAPP

SEQ ID NO: 54824 - protein, 9 aa, Homo Sapiens
VLRFCNFTT

SEQ ID NO: 54825 - protein, 9 aa, Homo Sapiens
QGLTHFPET

SEQ ID NO: 54826 - protein, 9 aa, Homo Sapiens
SPGLQLHPR

SEQ ID NO: 54827 - protein, 9 aa, Homo Sapiens
NDCGKAFNQ

SEQ ID NO: 54828 - protein, 9 aa, Homo Sapiens
SASQIWNLN

SEQ ID NO: 54829 - protein, 9 aa, Homo Sapiens
SYDIGNCTY

SEQ ID NO: 54830 - protein, 9 aa, Homo Sapiens
PYSDQTLRP

SEQ ID NO: 54831 - protein, 9 aa, Homo Sapiens
KTILSRILL

SEQ ID NO: 54832 - protein, 9 aa, Homo Sapiens
PGTGPGGVA

SEQ ID NO: 54833 - protein, 9 aa, Homo Sapiens
VFLDEPTTV

SEQ ID NO: 54834 - protein, 9 aa, Homo Sapiens
VFFELTVDD

SEQ ID NO: 54835 - protein, 9 aa, Homo Sapiens
RLASQGRGH

SEQ ID NO: 54836 - protein, 9 aa, Homo Sapiens
EASTARTCS

SEQ ID NO: 54837 - protein, 9 aa, Homo Sapiens
KALKKKRYS

SEQ ID NO: 54838 - protein, 9 aa, Homo Sapiens
NAAKIRAVE

SEQ ID NO: 54839 - protein, 9 aa, Homo Sapiens
YPRQTLQTE

SEQ ID NO: 54840 - protein, 9 aa, Homo Sapiens
SNTTCCALC

SEQ ID NO: 54841 - protein, 9 aa, Homo Sapiens
LRMNLEDHL

SEQ ID NO: 54842 - protein, 9 aa, Homo Sapiens
SSLRKQVLT

SEQ ID NO: 54843 - protein, 9 aa, Homo Sapiens
KKCYFVLVQ

SEQ ID NO: 54844 - protein, 9 aa, Homo Sapiens
LEELDLVND

SEQ ID NO: 54845 - protein, 9 aa, Homo Sapiens
ELMCFDRDT

SEQ ID NO: 54846 - protein, 9 aa, Homo Sapiens
PLKKGKDAR

SEQ ID NO: 54847 - protein, 9 aa, Homo Sapiens
KAIGQVAFG

SEQ ID NO: 54848 - protein, 9 aa, Homo Sapiens
YKLLMATHG

SEQ ID NO: 54849 - protein, 9 aa, Homo Sapiens
AVLQENYTH

SEQ ID NO: 54850 - protein, 9 aa, Homo Sapiens
GHLLCVDTT

SEQ ID NO: 54851 - protein, 9 aa, Homo Sapiens
IGNKLFECD

SEQ ID NO: 54852 - protein, 9 aa, Homo Sapiens
VMDPSARRF

SEQ ID NO: 54853 - protein, 9 aa, Homo Sapiens
YDRAFSNYC

SEQ ID NO: 54854 - protein, 9 aa, Homo Sapiens
FFFTIGITW

SEQ ID NO: 54855 - protein, 9 aa, Homo Sapiens
MGCITLAKK

SEQ ID NO: 54856 - protein, 9 aa, Homo Sapiens
MNLEDHLKE

SEQ ID NO: 54857 - protein, 9 aa, Homo Sapiens
CFNMGCITL

SEQ ID NO: 54858 - protein, 9 aa, Homo Sapiens
TVMDPSARR

SEQ ID NO: 54859 - protein, 9 aa, Homo Sapiens
KIEEDVRHH

SEQ ID NO: 54860 - protein, 9 aa, Homo Sapiens
EPVLRPVQV

SEQ ID NO: 54861 - protein, 9 aa, Homo Sapiens
SDQTLRPRR

SEQ ID NO: 54862 - protein, 9 aa, Homo Sapiens
LKDDFEVFF

SEQ ID NO: 54863 - protein, 9 aa, Homo Sapiens
LTHFPETIA

SEQ ID NO: 54864 - protein, 9 aa, Homo Sapiens
TFTPFYIIK

SEQ ID NO: 54865 - protein, 9 aa, Homo Sapiens
VTFTPFYII

SEQ ID NO: 54866 - protein, 9 aa, Homo Sapiens
IGNCTYFFF

SEQ ID NO: 54867 - protein, 9 aa, Homo Sapiens
FFAPQRAGR

SEQ ID NO: 54868 - protein, 9 aa, Homo Sapiens
LSASQIWNL

SEQ ID NO: 54869 - protein, 9 aa, Homo Sapiens
YVHYPTMST

SEQ ID NO: 54870 - protein, 9 aa, Homo Sapiens
GIQCKWKES

SEQ ID NO: 54871 - protein, 9 aa, Homo Sapiens
PPGTGPGGV

SEQ ID NO: 54872 - protein, 9 aa, Homo Sapiens
QNPLLGKAC

SEQ ID NO: 54873 - protein, 9 aa, Homo Sapiens
RKLRTFSDI

SEQ ID NO: 54874 - protein, 9 aa, Homo Sapiens
GGSRPQPRL

SEQ ID NO: 54875 - protein, 9 aa, Homo Sapiens
EPQPGETVM

SEQ ID NO: 54876 - protein, 9 aa, Homo Sapiens
GRQRVHRDI

SEQ ID NO: 54877 - protein, 9 aa, Homo Sapiens
EEVLLRCPG

SEQ ID NO: 54878 - protein, 9 aa, Homo Sapiens
SGIHNTAML

SEQ ID NO: 54879 - protein, 9 aa, Homo Sapiens
GCITLAKKL

SEQ ID NO: 54880 - protein, 9 aa, Homo Sapiens
QGRGHVVVH

SEQ ID NO: 54881 - protein, 9 aa, Homo Sapiens
TLLDGLNRG

SEQ ID NO: 54882 - protein, 9 aa, Homo Sapiens
FFELTVDDQ

SEQ ID NO: 54883 - protein, 9 aa, Homo Sapiens
VCFNMGCIT

SEQ ID NO: 54884 - protein, 9 aa, Homo Sapiens
CNFSLDWDL

SEQ ID NO: 54885 - protein, 9 aa, Homo Sapiens
RYGIALVLR

SEQ ID NO: 54886 - protein, 9 aa, Homo Sapiens
RVHRDIKPE

SEQ ID NO: 54887 - protein, 9 aa, Homo Sapiens
KCAAVVVPS

SEQ ID NO: 54888 - protein, 9 aa, Homo Sapiens
GTVPLLGTA

SEQ ID NO: 54889 - protein, 9 aa, Homo Sapiens
LDLVNDVKD

SEQ ID NO: 54890 - protein, 9 aa, Homo Sapiens
PRQTLQTEM

SEQ ID NO: 54891 - protein, 9 aa, Homo Sapiens
SQIWNLNPV

SEQ ID NO: 54892 - protein, 9 aa, Homo Sapiens
LVLRFCNFT

SEQ ID NO: 54893 - protein, 9 aa, Homo Sapiens
ALCQACTLL

SEQ ID NO: 54894 - protein, 9 aa, Homo Sapiens
EPPPPPPFR

SEQ ID NO: 54895 - protein, 9 aa, Homo Sapiens
KVDKIKEVI

SEQ ID NO: 54896 - protein, 9 aa, Homo Sapiens
LGTMVTEPV

SEQ ID NO: 54897 - protein, 9 aa, Homo Sapiens
SFRMSAEMN

SEQ ID NO: 54898 - protein, 9 aa, Homo Sapiens
ELLQGLTHF

SEQ ID NO: 54899 - protein, 9 aa, Homo Sapiens
TLLKKLCNH

SEQ ID NO: 54900 - protein, 9 aa, Homo Sapiens
STAVVSVNN

SEQ ID NO: 54901 - protein, 9 aa, Homo Sapiens
FLANAVLQE

SEQ ID NO: 54902 - protein, 9 aa, Homo Sapiens
QLLGAPPPP

SEQ ID NO: 54903 - protein, 9 aa, Homo Sapiens
KRWKKCYFV

SEQ ID NO: 54904 - protein, 9 aa, Homo Sapiens
QGPPCSSPV

SEQ ID NO: 54905 - protein, 9 aa, Homo Sapiens
PQNPLLGKA

SEQ ID NO: 54906 - protein, 9 aa, Homo Sapiens
RDLAFSLRL

SEQ ID NO: 54907 - protein, 9 aa, Homo Sapiens
GLSPGGGAE

SEQ ID NO: 54908 - protein, 9 aa, Homo Sapiens
IHNTAMLLK

SEQ ID NO: 54909 - protein, 9 aa, Homo Sapiens
LASQGRGHV

SEQ ID NO: 54910 - protein, 9 aa, Homo Sapiens
LGLSPGGGA

SEQ ID NO: 54911 - protein, 9 aa, Homo Sapiens
GGMNQRPIL

SEQ ID NO: 54912 - protein, 9 aa, Homo Sapiens
GDSRFLANA

SEQ ID NO: 54913 - protein, 9 aa, Homo Sapiens
SRFLANAVL

SEQ ID NO: 54914 - protein, 9 aa, Homo Sapiens
SRLSASQIW

SEQ ID NO: 54915 - protein, 9 aa, Homo Sapiens
ECDECPEKL

SEQ ID NO: 54916 - protein, 9 aa, Homo Sapiens
TTCCALCHA

SEQ ID NO: 54917 - protein, 9 aa, Homo Sapiens
DLVNDVKDC

SEQ ID NO: 54918 - protein, 9 aa, Homo Sapiens
GSGKTILSR

SEQ ID NO: 54919 - protein, 9 aa, Homo Sapiens
GPPGPPGTG

SEQ ID NO: 54920 - protein, 9 aa, Homo Sapiens
LLRMNLEDH

SEQ ID NO: 54921 - protein, 9 aa, Homo Sapiens
PDESTAVVS

SEQ ID NO: 54922 - protein, 9 aa, Homo Sapiens
FFTIGITWI

SEQ ID NO: 54923 - protein, 9 aa, Homo Sapiens
NQRPILTII

SEQ ID NO: 54924 - protein, 9 aa, Homo Sapiens
IKSGIHNTA

SEQ ID NO: 54925 - protein, 9 aa, Homo Sapiens
RFCNFTTIA

SEQ ID NO: 54926 - protein, 9 aa, Homo Sapiens
YIFTSVPSS

SEQ ID NO: 54927 - protein, 9 aa, Homo Sapiens
VIEPGFLTA

SEQ ID NO: 54928 - protein, 9 aa, Homo Sapiens
WGVNIPLKQ

SEQ ID NO: 54929 - protein, 9 aa, Homo Sapiens
HLEELDLVN

SEQ ID NO: 54930 - protein, 9 aa, Homo Sapiens
VFFFTIGIT

SEQ ID NO: 54931 - protein, 9 aa, Homo Sapiens
SAEMNRIAT

SEQ ID NO: 54932 - protein, 9 aa, Homo Sapiens
AGRKLRTFS

SEQ ID NO: 54933 - protein, 9 aa, Homo Sapiens
DDFEVFFFT

SEQ ID NO: 54934 - protein, 9 aa, Homo Sapiens
GTMVTEPVL

SEQ ID NO: 54935 - protein, 9 aa, Homo Sapiens
PLLRMNLED

SEQ ID NO: 54936 - protein, 9 aa, Homo Sapiens
LIPYSDQTL

SEQ ID NO: 54937 - protein, 9 aa, Homo Sapiens
PPGGSRPQP

SEQ ID NO: 54938 - protein, 9 aa, Homo Sapiens
KRYSRKQAT

SEQ ID NO: 54939 - protein, 9 aa, Homo Sapiens
TARTCSQEP

SEQ ID NO: 54940 - protein, 9 aa, Homo Sapiens
NGRPRGHLL

SEQ ID NO: 54941 - protein, 9 aa, Homo Sapiens
TLFQDSASP

SEQ ID NO: 54942 - protein, 9 aa, Homo Sapiens
REDQGPPCS

SEQ ID NO: 54943 - protein, 9 aa, Homo Sapiens
PQRAGRKLR

SEQ ID NO: 54944 - protein, 9 aa, Homo Sapiens
DVIKAIGQV

SEQ ID NO: 54945 - protein, 9 aa, Homo Sapiens
KSGIHNTAM

SEQ ID NO: 54946 - protein, 9 aa, Homo Sapiens
KIKEVIEPG

SEQ ID NO: 54947 - protein, 9 aa, Homo Sapiens
TQNTQVRQV

SEQ ID NO: 54948 - protein, 9 aa, Homo Sapiens
ALVLRFCNF

SEQ ID NO: 54949 - protein, 9 aa, Homo Sapiens
PMSSLRKQV

SEQ ID NO: 54950 - protein, 9 aa, Homo Sapiens
HVVVHCSAG

SEQ ID NO: 54951 - protein, 9 aa, Homo Sapiens
GSVLGLSPG

SEQ ID NO: 54952 - protein, 9 aa, Homo Sapiens
CPELLQGLT

SEQ ID NO: 54953 - protein, 9 aa, Homo Sapiens
GQVAFGKAY

SEQ ID NO: 54954 - protein, 9 aa, Homo Sapiens
DGRKLHICN

SEQ ID NO: 54955 - protein, 9 aa, Homo Sapiens
CALCHAPAG

SEQ ID NO: 54956 - protein, 9 aa, Homo Sapiens
VHYPTMSTD

SEQ ID NO: 54957 - protein, 9 aa, Homo Sapiens
GINGRPRGH

SEQ ID NO: 54958 - protein, 9 aa, Homo Sapiens
KSQCQFPPP

SEQ ID NO: 54959 - protein, 9 aa, Homo Sapiens
CTLLDGLNR

SEQ ID NO: 54960 - protein, 9 aa, Homo Sapiens
GAGASPGLQ

SEQ ID NO: 54961 - protein, 9 aa, Homo Sapiens
LSPGGGAEG

SEQ ID NO: 54962 - protein, 9 aa, Homo Sapiens
PSGCLELSD

SEQ ID NO: 54963 - protein, 9 aa, Homo Sapiens
TILSRILLG

SEQ ID NO: 54964 - protein, 9 aa, Homo Sapiens
DMRGIQCKW

SEQ ID NO: 54965 - protein, 9 aa, Homo Sapiens
GDRTFQKCA

SEQ ID NO: 54966 - protein, 9 aa, Homo Sapiens
APQRAGRKL

SEQ ID NO: 54967 - protein, 9 aa, Homo Sapiens
KACESCYAT

SEQ ID NO: 54968 - protein, 9 aa, Homo Sapiens
CNLKDDFEV

SEQ ID NO: 54969 - protein, 9 aa, Homo Sapiens
RMNLEDHLK

SEQ ID NO: 54970 - protein, 9 aa, Homo Sapiens
FFSHFSARG

SEQ ID NO: 54971 - protein, 9 aa, Homo Sapiens
PQLLGAPPP

SEQ ID NO: 54972 - protein, 9 aa, Homo Sapiens
ICNFSLDWD

SEQ ID NO: 54973 - protein, 9 aa, Homo Sapiens
MSTDMLSVV

SEQ ID NO: 54974 - protein, 9 aa, Homo Sapiens
GTGPGGVAP

SEQ ID NO: 54975 - protein, 9 aa, Homo Sapiens
ITLLKKLCN

SEQ ID NO: 54976 - protein, 9 aa, Homo Sapiens
KKGKDARIK

SEQ ID NO: 54977 - protein, 9 aa, Homo Sapiens
GLLGPQLLG

SEQ ID NO: 54978 - protein, 9 aa, Homo Sapiens
DKIKEVIEP

SEQ ID NO: 54979 - protein, 9 aa, Homo Sapiens
HLLCVDTTQ

SEQ ID NO: 54980 - protein, 9 aa, Homo Sapiens
PTQNTQVRQ

SEQ ID NO: 54981 - protein, 9 aa, Homo Sapiens
GIALVLRFC

SEQ ID NO: 54982 - protein, 9 aa, Homo Sapiens
RGIQCKWKE

SEQ ID NO: 54983 - protein, 9 aa, Homo Sapiens
MSAEMNRIA

SEQ ID NO: 54984 - protein, 9 aa, Homo Sapiens
LDFMHGRQR

SEQ ID NO: 54985 - protein, 9 aa, Homo Sapiens
GSRPQPRLE

SEQ ID NO: 54986 - protein, 9 aa, Homo Sapiens
LFECDECPE

SEQ ID NO: 54987 - protein, 9 aa, Homo Sapiens
EPTTVMDPS

SEQ ID NO: 54988 - protein, 9 aa, Homo Sapiens
RHHCQQTTC

SEQ ID NO: 54989 - protein, 9 aa, Homo Sapiens
QACTLLDGL

SEQ ID NO: 54990 - protein, 9 aa, Homo Sapiens
ENAAKIRAV

SEQ ID NO: 54991 - protein, 9 aa, Homo Sapiens
ELSDSCQPY

SEQ ID NO: 54992 - protein, 9 aa, Homo Sapiens
ELDLVNDVK

SEQ ID NO: 54993 - protein, 9 aa, Homo Sapiens
FSHFSARGP

SEQ ID NO: 54994 - protein, 9 aa, Homo Sapiens
EDERVAGVM

SEQ ID NO: 54995 - protein, 9 aa, Homo Sapiens
DFEVFFFTI

SEQ ID NO: 54996 - protein, 9 aa, Homo Sapiens
SWTTLFQDS

SEQ ID NO: 54997 - protein, 9 aa, Homo Sapiens
FTPFYIIKN

SEQ ID NO: 54998 - protein, 9 aa, Homo Sapiens
CAAVVVPSG

SEQ ID NO: 54999 - protein, 9 aa, Homo Sapiens
VYPRQTLQT

SEQ ID NO: 55000 - protein, 9 aa, Homo Sapiens
IQCKWKESE

SEQ ID NO: 55001 - protein, 9 aa, Homo Sapiens
CMGGMNQRP

SEQ ID NO: 55002 - protein, 9 aa, Homo Sapiens
QRPILTIIT

SEQ ID NO: 55003 - protein, 9 aa, Homo Sapiens
LAFFSHFSA

SEQ ID NO: 55004 - protein, 9 aa, Homo Sapiens
YPTMSTDML

SEQ ID NO: 55005 - protein, 9 aa, Homo Sapiens
SYVHYPTMS

SEQ ID NO: 55006 - protein, 9 aa, Homo Sapiens
PLLGKACES

SEQ ID NO: 55007 - protein, 9 aa, Homo Sapiens
KNTAKGLSS

SEQ ID NO: 55008 - protein, 9 aa, Homo Sapiens
CLVPITDPA

SEQ ID NO: 55009 - protein, 9 aa, Homo Sapiens
NEPPPPPPF

SEQ ID NO: 55010 - protein, 9 aa, Homo Sapiens
SSITLLKKL

SEQ ID NO: 55011 - protein, 9 aa, Homo Sapiens
LMCFDRDTD

SEQ ID NO: 55012 - protein, 9 aa, Homo Sapiens
PSNTTCCAL

SEQ ID NO: 55013 - protein, 9 aa, Homo Sapiens
KRENAAKIR

SEQ ID NO: 55014 - protein, 9 aa, Homo Sapiens
KLHICNFSL

SEQ ID NO: 55015 - protein, 9 aa, Homo Sapiens
FNDYKLLMA

SEQ ID NO: 55016 - protein, 9 aa, Homo Sapiens
ECLVPITDP

SEQ ID NO: 55017 - protein, 9 aa, Homo Sapiens
EVFFFTIGI

SEQ ID NO: 55018 - protein, 9 aa, Homo Sapiens
KIRAVEQRV

SEQ ID NO: 55019 - protein, 9 aa, Homo Sapiens
SHTPRRQEE

SEQ ID NO: 55020 - protein, 9 aa, Homo Sapiens
GLTHFPETI

SEQ ID NO: 55021 - protein, 9 aa, Homo Sapiens
EDHLKECEH

SEQ ID NO: 55022 - protein, 9 aa, Homo Sapiens
RFLANAVLQ

SEQ ID NO: 55023 - protein, 9 aa, Homo Sapiens
LLMATHGFS

SEQ ID NO: 55024 - protein, 9 aa, Homo Sapiens
LGPQLLGAP

SEQ ID NO: 55025 - protein, 9 aa, Homo Sapiens
TCCALCHAP

SEQ ID NO: 55026 - protein, 9 aa, Homo Sapiens
TQVRQVMER

SEQ ID NO: 55027 - protein, 9 aa, Homo Sapiens
LGKACESCY

SEQ ID NO: 55028 - protein, 9 aa, Homo Sapiens
LHICNFSLD

SEQ ID NO: 55029 - protein, 9 aa, Homo Sapiens
CKWKESESR

SEQ ID NO: 55030 - protein, 9 aa, Homo Sapiens
SGCLELSDS

SEQ ID NO: 55031 - protein, 9 aa, Homo Sapiens
RGTVPLLGT

SEQ ID NO: 55032 - protein, 9 aa, Homo Sapiens
LWGVNIPLK

SEQ ID NO: 55033 - protein, 9 aa, Homo Sapiens
EEDVRHHCQ

SEQ ID NO: 55034 - protein, 9 aa, Homo Sapiens
ALCHAPAGL

SEQ ID NO: 55035 - protein, 9 aa, Homo Sapiens
AKGLSSIKS

SEQ ID NO: 55036 - protein, 9 aa, Homo Sapiens
DQTLRPRRT

SEQ ID NO: 55037 - protein, 9 aa, Homo Sapiens
LQGLTHFPE

SEQ ID NO: 55038 - protein, 9 aa, Homo Sapiens
ESTAVVSVN

SEQ ID NO: 55039 - protein, 9 aa, Homo Sapiens
TVMYVAGAF

SEQ ID NO: 55040 - protein, 9 aa, Homo Sapiens
TCSQEPLRG

SEQ ID NO: 55041 - protein, 9 aa, Homo Sapiens
RWKKCYFVL

SEQ ID NO: 55042 - protein, 9 aa, Homo Sapiens
LDEPTTVMD

SEQ ID NO: 55043 - protein, 9 aa, Homo Sapiens
VSSLSSITL

SEQ ID NO: 55044 - protein, 9 aa, Homo Sapiens
QKCAAVVVP

SEQ ID NO: 55045 - protein, 9 aa, Homo Sapiens
FAKPVYPRQ

SEQ ID NO: 55046 - protein, 9 aa, Homo Sapiens
QHLAFFSHF

SEQ ID NO: 55047 - protein, 9 aa, Homo Sapiens
TAKGLSSIK

SEQ ID NO: 55048 - protein, 9 aa, Homo Sapiens
GCLELSDSC

SEQ ID NO: 55049 - protein, 9 aa, Homo Sapiens
TDRGTVPLL

SEQ ID NO: 55050 - protein, 9 aa, Homo Sapiens
RLSASQIWN

SEQ ID NO: 55051 - protein, 9 aa, Homo Sapiens
MYVAGAFDL

SEQ ID NO: 55052 - protein, 9 aa, Homo Sapiens
EELDLVNDV

SEQ ID NO: 55053 - protein, 9 aa, Homo Sapiens
PELLQGLTH

SEQ ID NO: 55054 - protein, 9 aa, Homo Sapiens
ALIPYSDQT

SEQ ID NO: 55055 - protein, 9 aa, Homo Sapiens
NDVKDCGMN

SEQ ID NO: 55056 - protein, 9 aa, Homo Sapiens
ANAVLQENY

SEQ ID NO: 55057 - protein, 9 aa, Homo Sapiens
PGPPGTGPG

SEQ ID NO: 55058 - protein, 9 aa, Homo Sapiens
LGEPPMSSL

SEQ ID NO: 55059 - protein, 9 aa, Homo Sapiens
RMRRPPGGS

SEQ ID NO: 55060 - protein, 9 aa, Homo Sapiens
ARIKKESLG

SEQ ID NO: 55061 - protein, 9 aa, Homo Sapiens
YSDQTLRPR

SEQ ID NO: 55062 - protein, 9 aa, Homo Sapiens
SGDMRGIQC

SEQ ID NO: 55063 - protein, 9 aa, Homo Sapiens
SITLLKKLC

SEQ ID NO: 55064 - protein, 9 aa, Homo Sapiens
RVAGVMSVG

SEQ ID NO: 55065 - protein, 9 aa, Homo Sapiens
CITLAKKLA

SEQ ID NO: 55066 - protein, 9 aa, Homo Sapiens
PDAIKSQCQ

SEQ ID NO: 55067 - protein, 9 aa, Homo Sapiens
GDMRGIQCK

SEQ ID NO: 55068 - protein, 9 aa, Homo Sapiens
RQEEVLLRC

SEQ ID NO: 55069 - protein, 9 aa, Homo Sapiens
IGQVAFGKA

SEQ ID NO: 55070 - protein, 9 aa, Homo Sapiens
THFPETIAG

SEQ ID NO: 55071 - protein, 9 aa, Homo Sapiens
HLAFFSHFS

SEQ ID NO: 55072 - protein, 9 aa, Homo Sapiens
YCVTCYDRA

SEQ ID NO: 55073 - protein, 9 aa, Homo Sapiens
RPRGHLLCV

SEQ ID NO: 55074 - protein, 9 aa, Homo Sapiens
KELMCFDRD

SEQ ID NO: 55075 - protein, 9 aa, Homo Sapiens
HNTAMLLKE

SEQ ID NO: 55076 - protein, 9 aa, Homo Sapiens
FMHGRQRVH

SEQ ID NO: 55077 - protein, 9 aa, Homo Sapiens
RNKVFVFFE

SEQ ID NO: 55078 - protein, 9 aa, Homo Sapiens
NTTCCALCH

SEQ ID NO: 55079 - protein, 9 aa, Homo Sapiens
CQFPPPLIA

SEQ ID NO: 55080 - protein, 9 aa, Homo Sapiens
DFMHGRQRV

SEQ ID NO: 55081 - protein, 9 aa, Homo Sapiens
MCFDRDTDK

SEQ ID NO: 55082 - protein, 9 aa, Homo Sapiens
GRKLHICNF

SEQ ID NO: 55083 - protein, 9 aa, Homo Sapiens
ASQGRGHVV

SEQ ID NO: 55084 - protein, 9 aa, Homo Sapiens
TCYDRAFSN

SEQ ID NO: 55085 - protein, 9 aa, Homo Sapiens
CVTCYDRAF

SEQ ID NO: 55086 - protein, 9 aa, Homo Sapiens
CYFVLVQVS

SEQ ID NO: 55087 - protein, 9 aa, Homo Sapiens
SHFSARGPA

SEQ ID NO: 55088 - protein, 9 aa, Homo Sapiens
DRGTVPLLG

SEQ ID NO: 55089 - protein, 9 aa, Homo Sapiens
VAFGKAYLA

SEQ ID NO: 55090 - protein, 9 aa, Homo Sapiens
TEPVLRPVQ

SEQ ID NO: 55091 - protein, 9 aa, Homo Sapiens
NLKDDFEVF

SEQ ID NO: 55092 - protein, 9 aa, Homo Sapiens
ESSWTTLFQ

SEQ ID NO: 55093 - protein, 9 aa, Homo Sapiens
TMSTDMLSV

SEQ ID NO: 55094 - protein, 9 aa, Homo Sapiens
RAFSNYCEE

SEQ ID NO: 55095 - protein, 9 aa, Homo Sapiens
TTLFQDSAS

SEQ ID NO: 55096 - protein, 9 aa, Homo Sapiens
AKPVYPRQT

SEQ ID NO: 55097 - protein, 9 aa, Homo Sapiens
AGDRTFQKC

SEQ ID NO: 55098 - protein, 9 aa, Homo Sapiens
SPDESTAVV

SEQ ID NO: 55099 - protein, 9 aa, Homo Sapiens
RDTDKWIQK

SEQ ID NO: 55100 - protein, 9 aa, Homo Sapiens
QEEVLLRCP

SEQ ID NO: 55101 - protein, 9 aa, Homo Sapiens
SVAFYIFTS

SEQ ID NO: 55102 - protein, 9 aa, Homo Sapiens
NMGCITLAK

SEQ ID NO: 55103 - protein, 9 aa, Homo Sapiens
GECLVPITD

SEQ ID NO: 55104 - protein, 9 aa, Homo Sapiens
QKELMCFDR

SEQ ID NO: 55105 - protein, 9 aa, Homo Sapiens
LGGELWGVN

SEQ ID NO: 55106 - protein, 9 aa, Homo Sapiens
ENKALKKKR

SEQ ID NO: 55107 - protein, 9 aa, Homo Sapiens
GLQLHPRLR

SEQ ID NO: 55108 - protein, 9 aa, Homo Sapiens
PGLGTMVTE

SEQ ID NO: 55109 - protein, 9 aa, Homo Sapiens
SVLGLSPGG

SEQ ID NO: 55110 - protein, 9 aa, Homo Sapiens
MGGMNQRPI

SEQ ID NO: 55111 - protein, 9 aa, Homo Sapiens
LLQGLTHFP

SEQ ID NO: 55112 - protein, 9 aa, Homo Sapiens
VDKIKEVIE

SEQ ID NO: 55113 - protein, 9 aa, Homo Sapiens
NLEDHLKEC

SEQ ID NO: 55114 - protein, 9 aa, Homo Sapiens
LEDHLKECE

SEQ ID NO: 55115 - protein, 9 aa, Homo Sapiens
VMYVAGAFD

SEQ ID NO: 55116 - protein, 9 aa, Homo Sapiens
LCQACTLLD

SEQ ID NO: 55117 - protein, 9 aa, Homo Sapiens
GVNIPLKQL

SEQ ID NO: 55118 - protein, 9 aa, Homo Sapiens
RQTLQTEMW

SEQ ID NO: 55119 - protein, 9 aa, Homo Sapiens
IRAVEQRVA

SEQ ID NO: 55120 - protein, 9 aa, Homo Sapiens
LLGEPPMSS

SEQ ID NO: 55121 - protein, 9 aa, Homo Sapiens
MNQRPILTI

SEQ ID NO: 55122 - protein, 9 aa, Homo Sapiens
LLGKACESC

SEQ ID NO: 55123 - protein, 9 aa, Homo Sapiens
PPMSSLRKQ

SEQ ID NO: 55124 - protein, 9 aa, Homo Sapiens
HHCQQTTCD

SEQ ID NO: 55125 - protein, 9 aa, Homo Sapiens
GGLLGPQLL

SEQ ID NO: 55126 - protein, 9 aa, Homo Sapiens
KPSSKNTAK

SEQ ID NO: 55127 - protein, 9 aa, Homo Sapiens
CYDRAFSNY

SEQ ID NO: 55128 - protein, 9 aa, Homo Sapiens
DRDTDKWIQ

SEQ ID NO: 55129 - protein, 9 aa, Homo Sapiens
EESSWTTLF

SEQ ID NO: 55130 - protein, 9 aa, Homo Sapiens
TLRPRRTKL

SEQ ID NO: 55131 - protein, 9 aa, Homo Sapiens
GGGGLLGPQ

SEQ ID NO: 55132 - protein, 9 aa, Homo Sapiens
GGGLLGPQL

SEQ ID NO: 55133 - protein, 9 aa, Homo Sapiens
TPRRQEEVL

SEQ ID NO: 55134 - protein, 9 aa, Homo Sapiens
CTYFFFREN

SEQ ID NO: 55135 - protein, 9 aa, Homo Sapiens
PFYIIKNKS

SEQ ID NO: 55136 - protein, 9 aa, Homo Sapiens
ASTARTCSQ

SEQ ID NO: 55137 - protein, 9 aa, Homo Sapiens
GMNQRPILT

SEQ ID NO: 55138 - protein, 9 aa, Homo Sapiens
TDPASAHLV

SEQ ID NO: 55139 - protein, 9 aa, Homo Sapiens
YGIALVLRF

SEQ ID NO: 55140 - protein, 9 aa, Homo Sapiens
GKDARIKKE

SEQ ID NO: 55141 - protein, 9 aa, Homo Sapiens
SSWTTLFQD

SEQ ID NO: 55142 - protein, 9 aa, Homo Sapiens
LSDSCQPYR

SEQ ID NO: 55143 - protein, 9 aa, Homo Sapiens
CFDRDTDKW

SEQ ID NO: 55144 - protein, 9 aa, Homo Sapiens
GIHNTAMLL

SEQ ID NO: 55145 - protein, 9 aa, Homo Sapiens
VPITDPASA

SEQ ID NO: 55146 - protein, 9 aa, Homo Sapiens
RPPGGSRPQ

SEQ ID NO: 55147 - protein, 9 aa, Homo Sapiens
TPFYIIKNK

SEQ ID NO: 55148 - protein, 9 aa, Homo Sapiens
NTQVRQVME

SEQ ID NO: 55149 - protein, 9 aa, Homo Sapiens
IALVLRFCN

SEQ ID NO: 55150 - protein, 9 aa, Homo Sapiens
STARTCSQE

SEQ ID NO: 55151 - protein, 9 aa, Homo Sapiens
ALKKKRYSR

SEQ ID NO: 55152 - protein, 9 aa, Homo Sapiens
VPLLGTAIV

SEQ ID NO: 55153 - protein, 9 aa, Homo Sapiens
WKKCYFVLV

SEQ ID NO: 55154 - protein, 9 aa, Homo Sapiens
ITDPASAHL

SEQ ID NO: 55155 - protein, 9 aa, Homo Sapiens
GGAGASPGL

SEQ ID NO: 55156 - protein, 9 aa, Homo Sapiens
AEMNRIATH

SEQ ID NO: 55157 - protein, 9 aa, Homo Sapiens
RRPPGGSRP

SEQ ID NO: 55158 - protein, 9 aa, Homo Sapiens
EDQGPPCSS

SEQ ID NO: 55159 - protein, 9 aa, Homo Sapiens
NCTYFFFRE

SEQ ID NO: 55160 - protein, 9 aa, Homo Sapiens
LSSITLLKK

SEQ ID NO: 55161 - protein, 9 aa, Homo Sapiens
LLGTAIVTI

SEQ ID NO: 55162 - protein, 9 aa, Homo Sapiens
CNSFRMSAE

SEQ ID NO: 55163 - protein, 9 aa, Homo Sapiens
ELWGVNIPL

SEQ ID NO: 55164 - protein, 9 aa, Homo Sapiens
YDIGNCTYF

SEQ ID NO: 55165 - protein, 9 aa, Homo Sapiens
CLELSDSCQ

SEQ ID NO: 55166 - protein, 9 aa, Homo Sapiens
VNDVKDCGM

SEQ ID NO: 55167 - protein, 9 aa, Homo Sapiens
QCKWKESES

SEQ ID NO: 55168 - protein, 9 aa, Homo Sapiens
YSRKQATEC

SEQ ID NO: 55169 - protein, 9 aa, Homo Sapiens
RENAAKIRA

SEQ ID NO: 55170 - protein, 9 aa, Homo Sapiens
SEVCFNMGC

SEQ ID NO: 55171 - protein, 9 aa, Homo Sapiens
FELTVDDQS

SEQ ID NO: 55172 - protein, 9 aa, Homo Sapiens
ILSRILLGQ

SEQ ID NO: 55173 - protein, 9 aa, Homo Sapiens
DQGPPCSSP

SEQ ID NO: 55174 - protein, 9 aa, Homo Sapiens
EVIEPGFLT

SEQ ID NO: 55175 - protein, 9 aa, Homo Sapiens
FQKCAAVVV

SEQ ID NO: 55176 - protein, 9 aa, Homo Sapiens
VWKRWKKCY

SEQ ID NO: 55177 - protein, 9 aa, Homo Sapiens
KLFECDECP

SEQ ID NO: 55178 - protein, 9 aa, Homo Sapiens
TLLGEPPMS

SEQ ID NO: 55179 - protein, 9 aa, Homo Sapiens
LKKKRYSRK

SEQ ID NO: 55180 - protein, 9 aa, Homo Sapiens
AAGVLACRP

SEQ ID NO: 55181 - protein, 9 aa, Homo Sapiens
GANTASVTC

SEQ ID NO: 55182 - protein, 9 aa, Homo Sapiens
RAIQRLQAQ

SEQ ID NO: 55183 - protein, 9 aa, Homo Sapiens
LGIPTPTIT

SEQ ID NO: 55184 - protein, 9 aa, Homo Sapiens
DLRRCLYVI

SEQ ID NO: 55185 - protein, 9 aa, Homo Sapiens
DGLNLKKSP

SEQ ID NO: 55186 - protein, 9 aa, Homo Sapiens
IQHDLREQP

SEQ ID NO: 55187 - protein, 9 aa, Homo Sapiens
KQKEEEQVR

SEQ ID NO: 55188 - protein, 9 aa, Homo Sapiens
SGGSGRGHH

SEQ ID NO: 55189 - protein, 9 aa, Homo Sapiens
AQELKYLRA

SEQ ID NO: 55190 - protein, 9 aa, Homo Sapiens
LKPTKKVRP

SEQ ID NO: 55191 - protein, 9 aa, Homo Sapiens
AIAQELKYL

SEQ ID NO: 55192 - protein, 9 aa, Homo Sapiens
NMYDINKDG

SEQ ID NO: 55193 - protein, 9 aa, Homo Sapiens
AGHENGKLN

SEQ ID NO: 55194 - protein, 9 aa, Homo Sapiens
EELLPKAID

SEQ ID NO: 55195 - protein, 9 aa, Homo Sapiens
VGLVDEQNE

SEQ ID NO: 55196 - protein, 9 aa, Homo Sapiens
CTGIMTTWR

SEQ ID NO: 55197 - protein, 9 aa, Homo Sapiens
RARTLTVQT

SEQ ID NO: 55198 - protein, 9 aa, Homo Sapiens
DMRKHLMLL

SEQ ID NO: 55199 - protein, 9 aa, Homo Sapiens
TKVLNREQA

SEQ ID NO: 55200 - protein, 9 aa, Homo Sapiens
IDESVARKL

SEQ ID NO: 55201 - protein, 9 aa, Homo Sapiens
YCDRCNGFF

SEQ ID NO: 55202 - protein, 9 aa, Homo Sapiens
VLACRPHPG

SEQ ID NO: 55203 - protein, 9 aa, Homo Sapiens
EPAIIELGM

SEQ ID NO: 55204 - protein, 9 aa, Homo Sapiens
PGQVPDTGA

SEQ ID NO: 55205 - protein, 9 aa, Homo Sapiens
QRLQAQIDN

SEQ ID NO: 55206 - protein, 9 aa, Homo Sapiens
LIHAGKEEA

SEQ ID NO: 55207 - protein, 9 aa, Homo Sapiens
KPTKKVRPQ

SEQ ID NO: 55208 - protein, 9 aa, Homo Sapiens
RKHLMLLSR

SEQ ID NO: 55209 - protein, 9 aa, Homo Sapiens
RMSVFNLSN

SEQ ID NO: 55210 - protein, 9 aa, Homo Sapiens
VSGEGKGST

SEQ ID NO: 55211 - protein, 9 aa, Homo Sapiens
SLVSGEGKG

SEQ ID NO: 55212 - protein, 9 aa, Homo Sapiens
KKQKEEEQV

SEQ ID NO: 55213 - protein, 9 aa, Homo Sapiens
TLTVQTHCA

SEQ ID NO: 55214 - protein, 9 aa, Homo Sapiens
VSDRVERWL

SEQ ID NO: 55215 - protein, 9 aa, Homo Sapiens
KNICHVITH

SEQ ID NO: 55216 - protein, 9 aa, Homo Sapiens
VSFNYPLRP

SEQ ID NO: 55217 - protein, 9 aa, Homo Sapiens
LNRGLKKKK

SEQ ID NO: 55218 - protein, 9 aa, Homo Sapiens
SMDEGMRRT

SEQ ID NO: 55219 - protein, 9 aa, Homo Sapiens
LPFNGCRSG

SEQ ID NO: 55220 - protein, 9 aa, Homo Sapiens
AEKEELRQG

SEQ ID NO: 55221 - protein, 9 aa, Homo Sapiens
DFEGKTSFR

SEQ ID NO: 55222 - protein, 9 aa, Homo Sapiens
TEQKYDCGE

SEQ ID NO: 55223 - protein, 9 aa, Homo Sapiens
VDEQNEASK

SEQ ID NO: 55224 - protein, 9 aa, Homo Sapiens
SLTCTGIMT

SEQ ID NO: 55225 - protein, 9 aa, Homo Sapiens
KAIDESVAR

SEQ ID NO: 55226 - protein, 9 aa, Homo Sapiens
IKKKKKKKK

SEQ ID NO: 55227 - protein, 9 aa, Homo Sapiens
PKLEREFMD

SEQ ID NO: 55228 - protein, 9 aa, Homo Sapiens
PKAIDESVA

SEQ ID NO: 55229 - protein, 9 aa, Homo Sapiens
LRPFGCGIY

SEQ ID NO: 55230 - protein, 9 aa, Homo Sapiens
GKATPKGSK

SEQ ID NO: 55231 - protein, 9 aa, Homo Sapiens
YFQFLRVVR

SEQ ID NO: 55232 - protein, 9 aa, Homo Sapiens
WGPKKNKIY

SEQ ID NO: 55233 - protein, 9 aa, Homo Sapiens
MIADDISDG

SEQ ID NO: 55234 - protein, 9 aa, Homo Sapiens
QTIKFLKHR

SEQ ID NO: 55235 - protein, 9 aa, Homo Sapiens
KEEAIRIRS

SEQ ID NO: 55236 - protein, 9 aa, Homo Sapiens
AKYRANDGT

SEQ ID NO: 55237 - protein, 9 aa, Homo Sapiens
KKKKKKKVC

SEQ ID NO: 55238 - protein, 9 aa, Homo Sapiens
IGKATPKGS

SEQ ID NO: 55239 - protein, 9 aa, Homo Sapiens
YIGFRCAYC

SEQ ID NO: 55240 - protein, 9 aa, Homo Sapiens
HGSSLGQIS

SEQ ID NO: 55241 - protein, 9 aa, Homo Sapiens
GCGIYNKRF

SEQ ID NO: 55242 - protein, 9 aa, Homo Sapiens
FPAASMDEG

SEQ ID NO: 55243 - protein, 9 aa, Homo Sapiens
QEMGSGSYT

SEQ ID NO: 55244 - protein, 9 aa, Homo Sapiens
ADEWKGWMQ

SEQ ID NO: 55245 - protein, 9 aa, Homo Sapiens
KVLNREQAD

SEQ ID NO: 55246 - protein, 9 aa, Homo Sapiens
RGVLLCMDV

SEQ ID NO: 55247 - protein, 9 aa, Homo Sapiens
FNMYDINKD

SEQ ID NO: 55248 - protein, 9 aa, Homo Sapiens
ATPKGSKYV

SEQ ID NO: 55249 - protein, 9 aa, Homo Sapiens
PCLKIKKKK

SEQ ID NO: 55250 - protein, 9 aa, Homo Sapiens
CGIYNKRFK

SEQ ID NO: 55251 - protein, 9 aa, Homo Sapiens
GIDIDFKEV

SEQ ID NO: 55252 - protein, 9 aa, Homo Sapiens
CAAAGVLAC

SEQ ID NO: 55253 - protein, 9 aa, Homo Sapiens
AFNMYDINK

SEQ ID NO: 55254 - protein, 9 aa, Homo Sapiens
QFTYFQFLR

SEQ ID NO: 55255 - protein, 9 aa, Homo Sapiens
GERESLVSG

SEQ ID NO: 55256 - protein, 9 aa, Homo Sapiens
MSNSEKEHR

SEQ ID NO: 55257 - protein, 9 aa, Homo Sapiens
ENGKLNQYS

SEQ ID NO: 55258 - protein, 9 aa, Homo Sapiens
CGERESLVS

SEQ ID NO: 55259 - protein, 9 aa, Homo Sapiens
RPCLKIKKK

SEQ ID NO: 55260 - protein, 9 aa, Homo Sapiens
YKNICHVIT

SEQ ID NO: 55261 - protein, 9 aa, Homo Sapiens
NYPLRPSIK

SEQ ID NO: 55262 - protein, 9 aa, Homo Sapiens
KFLKHRFSP

SEQ ID NO: 55263 - protein, 9 aa, Homo Sapiens
ISQVSTYSD

SEQ ID NO: 55264 - protein, 9 aa, Homo Sapiens
GEPAIIELG

SEQ ID NO: 55265 - protein, 9 aa, Homo Sapiens
GHHVRSFTR

SEQ ID NO: 55266 - protein, 9 aa, Homo Sapiens
RRCLYVIFR

SEQ ID NO: 55267 - protein, 9 aa, Homo Sapiens
SDGLNLKKS

SEQ ID NO: 55268 - protein, 9 aa, Homo Sapiens
EGDLGKETE

SEQ ID NO: 55269 - protein, 9 aa, Homo Sapiens
IAQELKYLR

SEQ ID NO: 55270 - protein, 9 aa, Homo Sapiens
NWAFNMYDI

SEQ ID NO: 55271 - protein, 9 aa, Homo Sapiens
LGMLIEGPP

SEQ ID NO: 55272 - protein, 9 aa, Homo Sapiens
KYARQAINN

SEQ ID NO: 55273 - protein, 9 aa, Homo Sapiens
ELRQGCEEL

SEQ ID NO: 55274 - protein, 9 aa, Homo Sapiens
MYDINKDGY

SEQ ID NO: 55275 - protein, 9 aa, Homo Sapiens
ENISQVSTY

SEQ ID NO: 55276 - protein, 9 aa, Homo Sapiens
DYKNICHVI

SEQ ID NO: 55277 - protein, 9 aa, Homo Sapiens
SQFTYFQFL

SEQ ID NO: 55278 - protein, 9 aa, Homo Sapiens
KATPKGSKY

SEQ ID NO: 55279 - protein, 9 aa, Homo Sapiens
ANTASVTCP

SEQ ID NO: 55280 - protein, 9 aa, Homo Sapiens
IMTTWRART

SEQ ID NO: 55281 - protein, 9 aa, Homo Sapiens
LSAASSSSL

SEQ ID NO: 55282 - protein, 9 aa, Homo Sapiens
RWLQELERE

SEQ ID NO: 55283 - protein, 9 aa, Homo Sapiens
PEGDLGKET

SEQ ID NO: 55284 - protein, 9 aa, Homo Sapiens
GSGRGHHVR

SEQ ID NO: 55285 - protein, 9 aa, Homo Sapiens
GVLLCMDVA

SEQ ID NO: 55286 - protein, 9 aa, Homo Sapiens
LEREFMDGS

SEQ ID NO: 55287 - protein, 9 aa, Homo Sapiens
YLRAQDTII

SEQ ID NO: 55288 - protein, 9 aa, Homo Sapiens
KNGCRHGSS

SEQ ID NO: 55289 - protein, 9 aa, Homo Sapiens
RPHPGQVPD

SEQ ID NO: 55290 - protein, 9 aa, Homo Sapiens
LRAQDTIIT

SEQ ID NO: 55291 - protein, 9 aa, Homo Sapiens
EQADEWKGW

SEQ ID NO: 55292 - protein, 9 aa, Homo Sapiens
AAAGVLACR

SEQ ID NO: 55293 - protein, 9 aa, Homo Sapiens
ETEQKYDCG

SEQ ID NO: 55294 - protein, 9 aa, Homo Sapiens
NECSRAFGF

SEQ ID NO: 55295 - protein, 9 aa, Homo Sapiens
AAGGDMRKH

SEQ ID NO: 55296 - protein, 9 aa, Homo Sapiens
RHGSSLGQI

SEQ ID NO: 55297 - protein, 9 aa, Homo Sapiens
YSDISQRTD

SEQ ID NO: 55298 - protein, 9 aa, Homo Sapiens
KEEEQVRAT

SEQ ID NO: 55299 - protein, 9 aa, Homo Sapiens
SSSLTCTGI

SEQ ID NO: 55300 - protein, 9 aa, Homo Sapiens
TYSDISQRT

SEQ ID NO: 55301 - protein, 9 aa, Homo Sapiens
SCGIKSCRV

SEQ ID NO: 55302 - protein, 9 aa, Homo Sapiens
SSLTCTGIM

SEQ ID NO: 55303 - protein, 9 aa, Homo Sapiens
THCAAAGVL

SEQ ID NO: 55304 - protein, 9 aa, Homo Sapiens
AASSSSLTC

SEQ ID NO: 55305 - protein, 9 aa, Homo Sapiens
PLRPSIKIL

SEQ ID NO: 55306 - protein, 9 aa, Homo Sapiens
TPTITLASP

SEQ ID NO: 55307 - protein, 9 aa, Homo Sapiens
KGEPAIIEL

SEQ ID NO: 55308 - protein, 9 aa, Homo Sapiens
PPAQVPLSA

SEQ ID NO: 55309 - protein, 9 aa, Homo Sapiens
CRHGSSLGQ

SEQ ID NO: 55310 - protein, 9 aa, Homo Sapiens
RLQAQIDNI

SEQ ID NO: 55311 - protein, 9 aa, Homo Sapiens
QHDLREQPP

SEQ ID NO: 55312 - protein, 9 aa, Homo Sapiens
TITLASPVK

SEQ ID NO: 55313 - protein, 9 aa, Homo Sapiens
QAINNGVTS

SEQ ID NO: 55314 - protein, 9 aa, Homo Sapiens
TYFQFLRVV

SEQ ID NO: 55315 - protein, 9 aa, Homo Sapiens
KHLKNGCRH

SEQ ID NO: 55316 - protein, 9 aa, Homo Sapiens
AASMDEGMR

SEQ ID NO: 55317 - protein, 9 aa, Homo Sapiens
VAYDAQKIP

SEQ ID NO: 55318 - protein, 9 aa, Homo Sapiens
RGQTIKFLK

SEQ ID NO: 55319 - protein, 9 aa, Homo Sapiens
NGFFGNPLA

SEQ ID NO: 55320 - protein, 9 aa, Homo Sapiens
LLPKAIDES

SEQ ID NO: 55321 - protein, 9 aa, Homo Sapiens
RVERWLQEL

SEQ ID NO: 55322 - protein, 9 aa, Homo Sapiens
LVSGEGKGS

SEQ ID NO: 55323 - protein, 9 aa, Homo Sapiens
QVSTYSDIS

SEQ ID NO: 55324 - protein, 9 aa, Homo Sapiens
WLQELEREM

SEQ ID NO: 55325 - protein, 9 aa, Homo Sapiens
IYNKRFKLK

SEQ ID NO: 55326 - protein, 9 aa, Homo Sapiens
GEPKLEREF

SEQ ID NO: 55327 - protein, 9 aa, Homo Sapiens
PTITLASPV

SEQ ID NO: 55328 - protein, 9 aa, Homo Sapiens
DTRLQNEGD

SEQ ID NO: 55329 - protein, 9 aa, Homo Sapiens
NRGLKKKKQ

SEQ ID NO: 55330 - protein, 9 aa, Homo Sapiens
PPSPPAQVP

SEQ ID NO: 55331 - protein, 9 aa, Homo Sapiens
QGCEELDMQ

SEQ ID NO: 55332 - protein, 9 aa, Homo Sapiens
DLEAALKPT

SEQ ID NO: 55333 - protein, 9 aa, Homo Sapiens
SGEPKLERE

SEQ ID NO: 55334 - protein, 9 aa, Homo Sapiens
LEKKKQKEE

SEQ ID NO: 55335 - protein, 9 aa, Homo Sapiens
HSQFTYFQF

SEQ ID NO: 55336 - protein, 9 aa, Homo Sapiens
TGRASIQHD

SEQ ID NO: 55337 - protein, 9 aa, Homo Sapiens
CNECSRAFG

SEQ ID NO: 55338 - protein, 9 aa, Homo Sapiens
SNSEKEHRV

SEQ ID NO: 55339 - protein, 9 aa, Homo Sapiens
PKGSKYVEK

SEQ ID NO: 55340 - protein, 9 aa, Homo Sapiens
AINNGVTST

SEQ ID NO: 55341 - protein, 9 aa, Homo Sapiens
FAIMTPLPF

SEQ ID NO: 55342 - protein, 9 aa, Homo Sapiens
EEAIRIRSI

SEQ ID NO: 55343 - protein, 9 aa, Homo Sapiens
CNGFFGNPL

SEQ ID NO: 55344 - protein, 9 aa, Homo Sapiens
QVPDTGANT

SEQ ID NO: 55345 - protein, 9 aa, Homo Sapiens
SGRGHHVRS

SEQ ID NO: 55346 - protein, 9 aa, Homo Sapiens
GRGHHVRSF

SEQ ID NO: 55347 - protein, 9 aa, Homo Sapiens
PFPAASMDE

SEQ ID NO: 55348 - protein, 9 aa, Homo Sapiens
NGVTSTEEL

SEQ ID NO: 55349 - protein, 9 aa, Homo Sapiens
EFMDGSNRK

SEQ ID NO: 55350 - protein, 9 aa, Homo Sapiens
LKIKKKKKK

SEQ ID NO: 55351 - protein, 9 aa, Homo Sapiens
ALVWGPKKN

SEQ ID NO: 55352 - protein, 9 aa, Homo Sapiens
WRARTLTVQ

SEQ ID NO: 55353 - protein, 9 aa, Homo Sapiens
ITLASPVKR

SEQ ID NO: 55354 - protein, 9 aa, Homo Sapiens
KEVAYDAQK

SEQ ID NO: 55355 - protein, 9 aa, Homo Sapiens
CSRAFGFNS

SEQ ID NO: 55356 - protein, 9 aa, Homo Sapiens
KKKKKKKKV

SEQ ID NO: 55357 - protein, 9 aa, Homo Sapiens
PSPPAQVPL

SEQ ID NO: 55358 - protein, 9 aa, Homo Sapiens
YDLEAALKP

SEQ ID NO: 55359 - protein, 9 aa, Homo Sapiens
FEYIGFRCA

SEQ ID NO: 55360 - protein, 9 aa, Homo Sapiens
DLGKETEQK

SEQ ID NO: 55361 - protein, 9 aa, Homo Sapiens
LVDEQNEAS

SEQ ID NO: 55362 - protein, 9 aa, Homo Sapiens
RTGRASIQH

SEQ ID NO: 55363 - protein, 9 aa, Homo Sapiens
DFKEVAYDA

SEQ ID NO: 55364 - protein, 9 aa, Homo Sapiens
LLCMDVAAR

SEQ ID NO: 55365 - protein, 9 aa, Homo Sapiens
PKKNKIYFF

SEQ ID NO: 55366 - protein, 9 aa, Homo Sapiens
ICHVITHGD

SEQ ID NO: 55367 - protein, 9 aa, Homo Sapiens
IDIDFKEVA

SEQ ID NO: 55368 - protein, 9 aa, Homo Sapiens
LKYLRAQDT

SEQ ID NO: 55369 - protein, 9 aa, Homo Sapiens
MTTWRARTL

SEQ ID NO: 55370 - protein, 9 aa, Homo Sapiens
IIAGHENGK

SEQ ID NO: 55371 - protein, 9 aa, Homo Sapiens
IADDISDGL

SEQ ID NO: 55372 - protein, 9 aa, Homo Sapiens
AGGDMRKHL

SEQ ID NO: 55373 - protein, 9 aa, Homo Sapiens
RCLYVIFRG

SEQ ID NO: 55374 - protein, 9 aa, Homo Sapiens
VSGGSGRGH

SEQ ID NO: 55375 - protein, 9 aa, Homo Sapiens
KNVSFNYPL

SEQ ID NO: 55376 - protein, 9 aa, Homo Sapiens
VERWLQELE

SEQ ID NO: 55377 - protein, 9 aa, Homo Sapiens
YPLRPSIKI

SEQ ID NO: 55378 - protein, 9 aa, Homo Sapiens
NDGTCNNLQ

SEQ ID NO: 55379 - protein, 9 aa, Homo Sapiens
YVCNECSRA

SEQ ID NO: 55380 - protein, 9 aa, Homo Sapiens
SEKEHRVQH

SEQ ID NO: 55381 - protein, 9 aa, Homo Sapiens
LQAQIDNIK

SEQ ID NO: 55382 - protein, 9 aa, Homo Sapiens
LGAPQEMGS

SEQ ID NO: 55383 - protein, 9 aa, Homo Sapiens
VAAGGDMRK

SEQ ID NO: 55384 - protein, 9 aa, Homo Sapiens
NVDYKNICH

SEQ ID NO: 55385 - protein, 9 aa, Homo Sapiens
FTYFQFLRV

SEQ ID NO: 55386 - protein, 9 aa, Homo Sapiens
YRKDLGAPQ

SEQ ID NO: 55387 - protein, 9 aa, Homo Sapiens
SSSSLTCTG

SEQ ID NO: 55388 - protein, 9 aa, Homo Sapiens
TRLQNEGDL

SEQ ID NO: 55389 - protein, 9 aa, Homo Sapiens
GPKKNKIYF

SEQ ID NO: 55390 - protein, 9 aa, Homo Sapiens
RGLKKKKQY

SEQ ID NO: 55391 - protein, 9 aa, Homo Sapiens
HENGKLNQY

SEQ ID NO: 55392 - protein, 9 aa, Homo Sapiens
SAASSSSLT

SEQ ID NO: 55393 - protein, 9 aa, Homo Sapiens
FEGKTSFRM

SEQ ID NO: 55394 - protein, 9 aa, Homo Sapiens
AALVWGPKK

SEQ ID NO: 55395 - protein, 9 aa, Homo Sapiens
GAPQEMGSG

SEQ ID NO: 55396 - protein, 9 aa, Homo Sapiens
TTWRARTLT

SEQ ID NO: 55397 - protein, 9 aa, Homo Sapiens
GKTSFRMSV

SEQ ID NO: 55398 - protein, 9 aa, Homo Sapiens
PQEMGSGSY

SEQ ID NO: 55399 - protein, 9 aa, Homo Sapiens
HLKNGCRHG

SEQ ID NO: 55400 - protein, 9 aa, Homo Sapiens
RCNGFFGNP

SEQ ID NO: 55401 - protein, 9 aa, Homo Sapiens
NISQVSTYS

SEQ ID NO: 55402 - protein, 9 aa, Homo Sapiens
QTHCAAAGV

SEQ ID NO: 55403 - protein, 9 aa, Homo Sapiens
RANDGTCNN

SEQ ID NO: 55404 - protein, 9 aa, Homo Sapiens
HVITHGDAK

SEQ ID NO: 55405 - protein, 9 aa, Homo Sapiens
KLEREFMDG

SEQ ID NO: 55406 - protein, 9 aa, Homo Sapiens
QKEEEQVRA

SEQ ID NO: 55407 - protein, 9 aa, Homo Sapiens
GQVPDTGAN

SEQ ID NO: 55408 - protein, 9 aa, Homo Sapiens
VWGPKKNKI

SEQ ID NO: 55409 - protein, 9 aa, Homo Sapiens
GIKSCRVAA

SEQ ID NO: 55410 - protein, 9 aa, Homo Sapiens
LRPSIKILK

SEQ ID NO: 55411 - protein, 9 aa, Homo Sapiens
QVPLSAASS

SEQ ID NO: 55412 - protein, 9 aa, Homo Sapiens
WAFNMYDIN

SEQ ID NO: 55413 - protein, 9 aa, Homo Sapiens
DISDTRLQN

SEQ ID NO: 55414 - protein, 9 aa, Homo Sapiens
VVSDRVERW

SEQ ID NO: 55415 - protein, 9 aa, Homo Sapiens
RASIQHDLR

SEQ ID NO: 55416 - protein, 9 aa, Homo Sapiens
PAQVPLSAA

SEQ ID NO: 55417 - protein, 9 aa, Homo Sapiens
RTLTVQTHC

SEQ ID NO: 55418 - protein, 9 aa, Homo Sapiens
HPGQVPDTG

SEQ ID NO: 55419 - protein, 9 aa, Homo Sapiens
EKLNWAFNM

SEQ ID NO: 55420 - protein, 9 aa, Homo Sapiens
GDMRKHLML

SEQ ID NO: 55421 - protein, 9 aa, Homo Sapiens
FMIADDISD

SEQ ID NO: 55422 - protein, 9 aa, Homo Sapiens
LTVQTHCAA

SEQ ID NO: 55423 - protein, 9 aa, Homo Sapiens
EEQVRATSQ

SEQ ID NO: 55424 - protein, 9 aa, Homo Sapiens
KPYDLRRCL

SEQ ID NO: 55425 - protein, 9 aa, Homo Sapiens
MTPLPFNGC

SEQ ID NO: 55426 - protein, 9 aa, Homo Sapiens
QADEWKGWM

SEQ ID NO: 55427 - protein, 9 aa, Homo Sapiens
KKKQKEEEQ

SEQ ID NO: 55428 - protein, 9 aa, Homo Sapiens
TVGLVDEQN

SEQ ID NO: 55429 - protein, 9 aa, Homo Sapiens
PYDLRRCLY

SEQ ID NO: 55430 - protein, 9 aa, Homo Sapiens
ANDGTCNNL

SEQ ID NO: 55431 - protein, 9 aa, Homo Sapiens
SFRMSVFNL

SEQ ID NO: 55432 - protein, 9 aa, Homo Sapiens
SPPAQVPLS

SEQ ID NO: 55433 - protein, 9 aa, Homo Sapiens
KETEQKYDC

SEQ ID NO: 55434 - protein, 9 aa, Homo Sapiens
LEAALKPTK

SEQ ID NO: 55435 - protein, 9 aa, Homo Sapiens
RRGVLLCMD

SEQ ID NO: 55436 - protein, 9 aa, Homo Sapiens
IQRLQAQID

SEQ ID NO: 55437 - protein, 9 aa, Homo Sapiens
GFRCAYCFF

SEQ ID NO: 55438 - protein, 9 aa, Homo Sapiens
EAALKPTKK

SEQ ID NO: 55439 - protein, 9 aa, Homo Sapiens
HAALVWGPK

SEQ ID NO: 55440 - protein, 9 aa, Homo Sapiens
RLQNEGDLH

SEQ ID NO: 55441 - protein, 9 aa, Homo Sapiens
YRANDGTCN

SEQ ID NO: 55442 - protein, 9 aa, Homo Sapiens
DEGMRRTRC

SEQ ID NO: 55443 - protein, 9 aa, Homo Sapiens
AIMTPLPFN

SEQ ID NO: 55444 - protein, 9 aa, Homo Sapiens
GKEEAIRIR

SEQ ID NO: 55445 - protein, 9 aa, Homo Sapiens
KPPSPPAQV

SEQ ID NO: 55446 - protein, 9 aa, Homo Sapiens
MDEGMRRTR

SEQ ID NO: 55447 - protein, 9 aa, Homo Sapiens
ASIQHDLRE

SEQ ID NO: 55448 - protein, 9 aa, Homo Sapiens
SQVSTYSDI

SEQ ID NO: 55449 - protein, 9 aa, Homo Sapiens
NICHVITHG

SEQ ID NO: 55450 - protein, 9 aa, Homo Sapiens
SRRGVLLCM

SEQ ID NO: 55451 - protein, 9 aa, Homo Sapiens
GQTIKFLKH

SEQ ID NO: 55452 - protein, 9 aa, Homo Sapiens
QNEGDLHGM

SEQ ID NO: 55453 - protein, 9 aa, Homo Sapiens
FRGQTIKFL

SEQ ID NO: 55454 - protein, 9 aa, Homo Sapiens
LVWGPKKNK

SEQ ID NO: 55455 - protein, 9 aa, Homo Sapiens
APQEMGSGS

SEQ ID NO: 55456 - protein, 9 aa, Homo Sapiens
RKDLGAPQE

SEQ ID NO: 55457 - protein, 9 aa, Homo Sapiens
ARQAINNGV

SEQ ID NO: 55458 - protein, 9 aa, Homo Sapiens
ARTLTVQTH

SEQ ID NO: 55459 - protein, 9 aa, Homo Sapiens
NGKLNQYSA

SEQ ID NO: 55460 - protein, 9 aa, Homo Sapiens
KIGKATPKG

SEQ ID NO: 55461 - protein, 9 aa, Homo Sapiens
DTVGLVDEQ

SEQ ID NO: 55462 - protein, 9 aa, Homo Sapiens
KPYVCNECS

SEQ ID NO: 55463 - protein, 9 aa, Homo Sapiens
EYIGFRCAY

SEQ ID NO: 55464 - protein, 9 aa, Homo Sapiens
ECSRAFGFN

SEQ ID NO: 55465 - protein, 9 aa, Homo Sapiens
GVLACRPHP

SEQ ID NO: 55466 - protein, 9 aa, Homo Sapiens
MDVAARGLD

SEQ ID NO: 55467 - protein, 9 aa, Homo Sapiens
RQGCEELDM

SEQ ID NO: 55468 - protein, 9 aa, Homo Sapiens
EVAYDAQKI

SEQ ID NO: 55469 - protein, 9 aa, Homo Sapiens
ALKPTKKVR

SEQ ID NO: 55470 - protein, 9 aa, Homo Sapiens
GHENGKLNQ

SEQ ID NO: 55471 - protein, 9 aa, Homo Sapiens
MHLIHAGKE

SEQ ID NO: 55472 - protein, 9 aa, Homo Sapiens
AIDESVARK

SEQ ID NO: 55473 - protein, 9 aa, Homo Sapiens
GIMTTWRAR

SEQ ID NO: 55474 - protein, 9 aa, Homo Sapiens
AGKEEAIRI

SEQ ID NO: 55475 - protein, 9 aa, Homo Sapiens
SIQHDLREQ

SEQ ID NO: 55476 - protein, 9 aa, Homo Sapiens
IKFLKHRFS

SEQ ID NO: 55477 - protein, 9 aa, Homo Sapiens
KGSKYVEKL

SEQ ID NO: 55478 - protein, 9 aa, Homo Sapiens
AGFYCDRCN

SEQ ID NO: 55479 - protein, 9 aa, Homo Sapiens
GDTVGLVDE

SEQ ID NO: 55480 - protein, 9 aa, Homo Sapiens
IAGHENGKL

SEQ ID NO: 55481 - protein, 9 aa, Homo Sapiens
SDTRLQNEG

SEQ ID NO: 55482 - protein, 9 aa, Homo Sapiens
QFAIMTPLP

SEQ ID NO: 55483 - protein, 9 aa, Homo Sapiens
EGMRRTRCG

SEQ ID NO: 55484 - protein, 9 aa, Homo Sapiens
CLYVIFRGE

SEQ ID NO: 55485 - protein, 9 aa, Homo Sapiens
LKPYDLRRC

SEQ ID NO: 55486 - protein, 9 aa, Homo Sapiens
QELKYLRAQ

SEQ ID NO: 55487 - protein, 9 aa, Homo Sapiens
SRAFGFNSH

SEQ ID NO: 55488 - protein, 9 aa, Homo Sapiens
PDTGANTAS

SEQ ID NO: 55489 - protein, 9 aa, Homo Sapiens
PAIIELGML

SEQ ID NO: 55490 - protein, 9 aa, Homo Sapiens
DRVERWLQE

SEQ ID NO: 55491 - protein, 9 aa, Homo Sapiens
TGANTASVT

SEQ ID NO: 55492 - protein, 9 aa, Homo Sapiens
RPFGCGIYN

SEQ ID NO: 55493 - protein, 9 aa, Homo Sapiens
REFMDGSNR

SEQ ID NO: 55494 - protein, 9 aa, Homo Sapiens
FKEVAYDAQ

SEQ ID NO: 55495 - protein, 9 aa, Homo Sapiens
KYRANDGTC

SEQ ID NO: 55496 - protein, 9 aa, Homo Sapiens
CGIKSCRVA

SEQ ID NO: 55497 - protein, 9 aa, Homo Sapiens
AIIELGMLI

SEQ ID NO: 55498 - protein, 9 aa, Homo Sapiens
AGVLACRPH

SEQ ID NO: 55499 - protein, 9 aa, Homo Sapiens
CGDTVGLVD

SEQ ID NO: 55500 - protein, 9 aa, Homo Sapiens
FGCGIYNKR

SEQ ID NO: 55501 - protein, 9 aa, Homo Sapiens
ELKYLRAQD

SEQ ID NO: 55502 - protein, 9 aa, Homo Sapiens
PFNGCRSGE

SEQ ID NO: 55503 - protein, 9 aa, Homo Sapiens
ERESLVSGE

SEQ ID NO: 55504 - protein, 9 aa, Homo Sapiens
KTSFRMSVF

SEQ ID NO: 55505 - protein, 9 aa, Homo Sapiens
PVAAGGDMR

SEQ ID NO: 55506 - protein, 9 aa, Homo Sapiens
INNGVTSTE

SEQ ID NO: 55507 - protein, 9 aa, Homo Sapiens
HAGKEEAIR

SEQ ID NO: 55508 - protein, 9 aa, Homo Sapiens
DDISDGLNL

SEQ ID NO: 55509 - protein, 9 aa, Homo Sapiens
LKNGCRHGS

SEQ ID NO: 55510 - protein, 9 aa, Homo Sapiens
CHVITHGDA

SEQ ID NO: 55511 - protein, 9 aa, Homo Sapiens
NNGVTSTEE

SEQ ID NO: 55512 - protein, 9 aa, Homo Sapiens
EEELLPKAI

SEQ ID NO: 55513 - protein, 9 aa, Homo Sapiens
LRQGCEELD

SEQ ID NO: 55514 - protein, 9 aa, Homo Sapiens
STYSDISQR

SEQ ID NO: 55515 - protein, 9 aa, Homo Sapiens
DIDFKEVAY

SEQ ID NO: 55516 - protein, 9 aa, Homo Sapiens
IDFKEVAYD

SEQ ID NO: 55517 - protein, 9 aa, Homo Sapiens
GCGDTVGLV

SEQ ID NO: 55518 - protein, 9 aa, Homo Sapiens
NVSFNYPLR

SEQ ID NO: 55519 - protein, 9 aa, Homo Sapiens
PTPTITLAS

SEQ ID NO: 55520 - protein, 9 aa, Homo Sapiens
KEELRQGCE

SEQ ID NO: 55521 - protein, 9 aa, Homo Sapiens
TGIMTTWRA

SEQ ID NO: 55522 - protein, 9 aa, Homo Sapiens
DLGAPQEMG

SEQ ID NO: 55523 - protein, 9 aa, Homo Sapiens
LNREQADEW

SEQ ID NO: 55524 - protein, 9 aa, Homo Sapiens
EGKTSFRMS

SEQ ID NO: 55525 - protein, 9 aa, Homo Sapiens
EEEQVRATS

SEQ ID NO: 55526 - protein, 9 aa, Homo Sapiens
EELRQGCEE

SEQ ID NO: 55527 - protein, 9 aa, Homo Sapiens
MRKHLMLLS

SEQ ID NO: 55528 - protein, 9 aa, Homo Sapiens
VSTYSDISQ

SEQ ID NO: 55529 - protein, 9 aa, Homo Sapiens
ELLPKAIDE

SEQ ID NO: 55530 - protein, 9 aa, Homo Sapiens
LQNEGDLHG

SEQ ID NO: 55531 - protein, 9 aa, Homo Sapiens
PHPGQVPDT

SEQ ID NO: 55532 - protein, 9 aa, Homo Sapiens
FLKHRFSPN

SEQ ID NO: 55533 - protein, 9 aa, Homo Sapiens
FLRVVRLIK

SEQ ID NO: 55534 - protein, 9 aa, Homo Sapiens
QIDNIKNQR

SEQ ID NO: 55535 - protein, 9 aa, Homo Sapiens
RGHHVRSFT

SEQ ID NO: 55536 - protein, 9 aa, Homo Sapiens
VLNREQADE

SEQ ID NO: 55537 - protein, 9 aa, Homo Sapiens
TIKFLKHRF

SEQ ID NO: 55538 - protein, 9 aa, Homo Sapiens
TWRARTLTV

SEQ ID NO: 55539 - protein, 9 aa, Homo Sapiens
PYVCNECSR

SEQ ID NO: 55540 - protein, 9 aa, Homo Sapiens
CDRCNGFFG

SEQ ID NO: 55541 - protein, 9 aa, Homo Sapiens
DRCNGFFGN

SEQ ID NO: 55542 - protein, 9 aa, Homo Sapiens
QDISDTRLQ

SEQ ID NO: 55543 - protein, 9 aa, Homo Sapiens
PLGIPTPTI

SEQ ID NO: 55544 - protein, 9 aa, Homo Sapiens
NREQADEWK

SEQ ID NO: 55545 - protein, 9 aa, Homo Sapiens
PAASMDEGM

SEQ ID NO: 55546 - protein, 9 aa, Homo Sapiens
VCNECSRAF

SEQ ID NO: 55547 - protein, 9 aa, Homo Sapiens
REQADEWKG

SEQ ID NO: 55548 - protein, 9 aa, Homo Sapiens
YDLRRCLYV

SEQ ID NO: 55549 - protein, 9 aa, Homo Sapiens
GDLGKETEQ

SEQ ID NO: 55550 - protein, 9 aa, Homo Sapiens
CRPHPGQVP

SEQ ID NO: 55551 - protein, 9 aa, Homo Sapiens
PLSAASSSS

SEQ ID NO: 55552 - protein, 9 aa, Homo Sapiens
LTCTGIMTT

SEQ ID NO: 55553 - protein, 9 aa, Homo Sapiens
YNKRFKLKH

SEQ ID NO: 55554 - protein, 9 aa, Homo Sapiens
IHAGKEEAI

SEQ ID NO: 55555 - protein, 9 aa, Homo Sapiens
EREFMDGSN

SEQ ID NO: 55556 - protein, 9 aa, Homo Sapiens
GCEELDMQV

SEQ ID NO: 55557 - protein, 9 aa, Homo Sapiens
CIIAGHENG

SEQ ID NO: 55558 - protein, 9 aa, Homo Sapiens
VLLCMDVAA

SEQ ID NO: 55559 - protein, 9 aa, Homo Sapiens
SDRVERWLQ

SEQ ID NO: 55560 - protein, 9 aa, Homo Sapiens
AQVPLSAAS

SEQ ID NO: 55561 - protein, 9 aa, Homo Sapiens
ASMDEGMRR

SEQ ID NO: 55562 - protein, 9 aa, Homo Sapiens
TPLPFNGCR

SEQ ID NO: 55563 - protein, 9 aa, Homo Sapiens
FQFLRVVRL

SEQ ID NO: 55564 - protein, 9 aa, Homo Sapiens
PFGCGIYNK

SEQ ID NO: 55565 - protein, 9 aa, Homo Sapiens
CFHAKYRAN

SEQ ID NO: 55566 - protein, 9 aa, Homo Sapiens
HAKYRANDG

SEQ ID NO: 55567 - protein, 9 aa, Homo Sapiens
CFRGQTIKF

SEQ ID NO: 55568 - protein, 9 aa, Homo Sapiens
NSEKEHRVQ

SEQ ID NO: 55569 - protein, 9 aa, Homo Sapiens
HDLREQPPP

SEQ ID NO: 55570 - protein, 9 aa, Homo Sapiens
VPDTGANTA

SEQ ID NO: 55571 - protein, 9 aa, Homo Sapiens
VQTHCAAAG

SEQ ID NO: 55572 - protein, 9 aa, Homo Sapiens
CLKIKKKKK

SEQ ID NO: 55573 - protein, 9 aa, Homo Sapiens
GKETEQKYD

SEQ ID NO: 55574 - protein, 9 aa, Homo Sapiens
AALKPTKKV

SEQ ID NO: 55575 - protein, 9 aa, Homo Sapiens
FRMSVFNLS

SEQ ID NO: 55576 - protein, 9 aa, Homo Sapiens
ADDISDGLN

SEQ ID NO: 55577 - protein, 9 aa, Homo Sapiens
IPTPTITLA

SEQ ID NO: 55578 - protein, 9 aa, Homo Sapiens
EFEYIGFRC

SEQ ID NO: 55579 - protein, 9 aa, Homo Sapiens
AIQRLQAQI

SEQ ID NO: 55580 - protein, 9 aa, Homo Sapiens
GRASIQHDL

SEQ ID NO: 55581 - protein, 9 aa, Homo Sapiens
YARQAINNG

SEQ ID NO: 55582 - protein, 9 aa, Homo Sapiens
KKNKIYFFR

SEQ ID NO: 55583 - protein, 9 aa, Homo Sapiens
IGFRCAYCF

SEQ ID NO: 55584 - protein, 9 aa, Homo Sapiens
PKPPSPPAQ

SEQ ID NO: 55585 - protein, 9 aa, Homo Sapiens
CMDVAARGL

SEQ ID NO: 55586 - protein, 9 aa, Homo Sapiens
ESLVSGEGK

SEQ ID NO: 55587 - protein, 9 aa, Homo Sapiens
IMTPLPFNG

SEQ ID NO: 55588 - protein, 9 aa, Homo Sapiens
ECIIAGHEN

SEQ ID NO: 55589 - protein, 9 aa, Homo Sapiens
KYLRAQDTI

SEQ ID NO: 55590 - protein, 9 aa, Homo Sapiens
RQAINNGVT

SEQ ID NO: 55591 - protein, 9 aa, Homo Sapiens
GGDMRKHLM

SEQ ID NO: 55592 - protein, 9 aa, Homo Sapiens
GLVDEQNEA

SEQ ID NO: 55593 - protein, 9 aa, Homo Sapiens
LGKETEQKY

SEQ ID NO: 55594 - protein, 9 aa, Homo Sapiens
EEFEYIGFR

SEQ ID NO: 55595 - protein, 9 aa, Homo Sapiens
ERWLQELER

SEQ ID NO: 55596 - protein, 9 aa, Homo Sapiens
ISDTRLQNE

SEQ ID NO: 55597 - protein, 9 aa, Homo Sapiens
TVQTHCAAA

SEQ ID NO: 55598 - protein, 9 aa, Homo Sapiens
ISDGLNLKK

SEQ ID NO: 55599 - protein, 9 aa, Homo Sapiens
LPKAIDESV

SEQ ID NO: 55600 - protein, 9 aa, Homo Sapiens
GIYNKRFKL

SEQ ID NO: 55601 - protein, 9 aa, Homo Sapiens
QCGERESLV

SEQ ID NO: 55602 - protein, 9 aa, Homo Sapiens
IIELGMLIE

SEQ ID NO: 55603 - protein, 9 aa, Homo Sapiens
EPKLEREFM

SEQ ID NO: 55604 - protein, 9 aa, Homo Sapiens
TPKGSKYVE

SEQ ID NO: 55605 - protein, 9 aa, Homo Sapiens
TCTGIMTTW

SEQ ID NO: 55606 - protein, 9 aa, Homo Sapiens
EKEELRQGC

SEQ ID NO: 55607 - protein, 9 aa, Homo Sapiens
LCMDVAARG

SEQ ID NO: 55608 - protein, 9 aa, Homo Sapiens
DTGANTASV

SEQ ID NO: 55609 - protein, 9 aa, Homo Sapiens
FNYPLRPSI

SEQ ID NO: 55610 - protein, 9 aa, Homo Sapiens
PTKKVRPQE

SEQ ID NO: 55611 - protein, 9 aa, Homo Sapiens
NGCRHGSSL

SEQ ID NO: 55612 - protein, 9 aa, Homo Sapiens
FHAKYRAND

SEQ ID NO: 55613 - protein, 9 aa, Homo Sapiens
LRRCLYVIF

SEQ ID NO: 55614 - protein, 9 aa, Homo Sapiens
HCAAAGVLA

SEQ ID NO: 55615 - protein, 9 aa, Homo Sapiens
GCRHGSSLG

SEQ ID NO: 55616 - protein, 9 aa, Homo Sapiens
ASSSSLTCT

SEQ ID NO: 55617 - protein, 9 aa, Homo Sapiens
GFYCDRCNG

SEQ ID NO: 55618 - protein, 9 aa, Homo Sapiens
LKEEFEYIG

SEQ ID NO: 55619 - protein, 9 aa, Homo Sapiens
QFLRVVRLI

SEQ ID NO: 55620 - protein, 9 aa, Homo Sapiens
GSKYVEKLE

SEQ ID NO: 55621 - protein, 9 aa, Homo Sapiens
VPLSAASSS

SEQ ID NO: 55622 - protein, 9 aa, Homo Sapiens
VDYKNICHV

SEQ ID NO: 55623 - protein, 9 aa, Homo Sapiens
LACRPHPGQ

SEQ ID NO: 55624 - protein, 9 aa, Homo Sapiens
AQIDNIKNQ

SEQ ID NO: 55625 - protein, 9 aa, Homo Sapiens
DISDGLNLK

SEQ ID NO: 55626 - protein, 9 aa, Homo Sapiens
SFNYPLRPS

SEQ ID NO: 55627 - protein, 9 aa, Homo Sapiens
TSFRMSVFN

SEQ ID NO: 55628 - protein, 9 aa, Homo Sapiens
GIPTPTITL

SEQ ID NO: 55629 - protein, 9 aa, Homo Sapiens
KDLGAPQEM

SEQ ID NO: 55630 - protein, 9 aa, Homo Sapiens
IELGMLIEG

SEQ ID NO: 55631 - protein, 9 aa, Homo Sapiens
EKKKQKEEE

SEQ ID NO: 55632 - protein, 9 aa, Homo Sapiens
ELGMLIEGP

SEQ ID NO: 55633 - protein, 9 aa, Homo Sapiens
KEEFEYIGF

SEQ ID NO: 55634 - protein, 9 aa, Homo Sapiens
PLPFNGCRS

SEQ ID NO: 55635 - protein, 9 aa, Homo Sapiens
FYCDRCNGF

SEQ ID NO: 55636 - protein, 9 aa, Homo Sapiens
ACRPHPGQV

SEQ ID NO: 55637 - protein, 9 aa, Homo Sapiens
QAQIDNIKN

SEQ ID NO: 55638 - protein, 9 aa, Homo Sapiens
RESLVSGEG

SEQ ID NO: 55639 - protein, 9 aa, Homo Sapiens
GGSGRGHHV

SEQ ID NO: 55640 - protein, 9 aa, Homo Sapiens
HLIHAGKEE

SEQ ID NO: 55641 - protein, 9 aa, Homo Sapiens
YNKLIEYHK

SEQ ID NO: 55642 - protein, 9 aa, Homo Sapiens
NLLPAGASQ

SEQ ID NO: 55643 - protein, 9 aa, Homo Sapiens
FYKQDFARR

SEQ ID NO: 55644 - protein, 9 aa, Homo Sapiens
SEIKKLFQG

SEQ ID NO: 55645 - protein, 9 aa, Homo Sapiens
ASIPQGAHA

SEQ ID NO: 55646 - protein, 9 aa, Homo Sapiens
ASGVSWRSP

SEQ ID NO: 55647 - protein, 9 aa, Homo Sapiens
LPMSWGPSS

SEQ ID NO: 55648 - protein, 9 aa, Homo Sapiens
GKHEPGFFP

SEQ ID NO: 55649 - protein, 9 aa, Homo Sapiens
LCGHAHPQC

SEQ ID NO: 55650 - protein, 9 aa, Homo Sapiens
NQKQDMEIA

SEQ ID NO: 55651 - protein, 9 aa, Homo Sapiens
MIANFSPSH

SEQ ID NO: 55652 - protein, 9 aa, Homo Sapiens
PCCPEHLKR

SEQ ID NO: 55653 - protein, 9 aa, Homo Sapiens
KREFSYPKN

SEQ ID NO: 55654 - protein, 9 aa, Homo Sapiens
ASQSDSEDL

SEQ ID NO: 55655 - protein, 9 aa, Homo Sapiens
FTFRAREKF

SEQ ID NO: 55656 - protein, 9 aa, Homo Sapiens
LCDSPQLSE

SEQ ID NO: 55657 - protein, 9 aa, Homo Sapiens
CKEAINVLS

SEQ ID NO: 55658 - protein, 9 aa, Homo Sapiens
LVLGTPNEY

SEQ ID NO: 55659 - protein, 9 aa, Homo Sapiens
ESHPHSAAY

SEQ ID NO: 55660 - protein, 9 aa, Homo Sapiens
KKTNDLRYI

SEQ ID NO: 55661 - protein, 9 aa, Homo Sapiens
DIFVSTSED

SEQ ID NO: 55662 - protein, 9 aa, Homo Sapiens
WILDKQDML

SEQ ID NO: 55663 - protein, 9 aa, Homo Sapiens
VAFQILVTI

SEQ ID NO: 55664 - protein, 9 aa, Homo Sapiens
ISTSNPWIC

SEQ ID NO: 55665 - protein, 9 aa, Homo Sapiens
DGREHSAYW

SEQ ID NO: 55666 - protein, 9 aa, Homo Sapiens
LGARTPWGQ

SEQ ID NO: 55667 - protein, 9 aa, Homo Sapiens
SNKEGQADV

SEQ ID NO: 55668 - protein, 9 aa, Homo Sapiens
VLTRAPILH

SEQ ID NO: 55669 - protein, 9 aa, Homo Sapiens
AFLDGTLLS

SEQ ID NO: 55670 - protein, 9 aa, Homo Sapiens
GFKGIHGMP

SEQ ID NO: 55671 - protein, 9 aa, Homo Sapiens
LRESILRLQ

SEQ ID NO: 55672 - protein, 9 aa, Homo Sapiens
CTGRDRRTE

SEQ ID NO: 55673 - protein, 9 aa, Homo Sapiens
TGRDRRTEE

SEQ ID NO: 55674 - protein, 9 aa, Homo Sapiens
VRQQPSEYQ

SEQ ID NO: 55675 - protein, 9 aa, Homo Sapiens
VSTHPPDRL

SEQ ID NO: 55676 - protein, 9 aa, Homo Sapiens
DKTQIYIMP

SEQ ID NO: 55677 - protein, 9 aa, Homo Sapiens
MHNTSQDRE

SEQ ID NO: 55678 - protein, 9 aa, Homo Sapiens
KDSDNAEPN

SEQ ID NO: 55679 - protein, 9 aa, Homo Sapiens
ILLKHKVVL

SEQ ID NO: 55680 - protein, 9 aa, Homo Sapiens
WRCWTCTRP

SEQ ID NO: 55681 - protein, 9 aa, Homo Sapiens
NVAATQPGT

SEQ ID NO: 55682 - protein, 9 aa, Homo Sapiens
NADPNLQDK

SEQ ID NO: 55683 - protein, 9 aa, Homo Sapiens
KLSNAISTS

SEQ ID NO: 55684 - protein, 9 aa, Homo Sapiens
SLLTIPISL

SEQ ID NO: 55685 - protein, 9 aa, Homo Sapiens
LKHKVVLQS

SEQ ID NO: 55686 - protein, 9 aa, Homo Sapiens
PASIPQGAH

SEQ ID NO: 55687 - protein, 9 aa, Homo Sapiens
VVVPGILMS

SEQ ID NO: 55688 - protein, 9 aa, Homo Sapiens
AQELRQYKV

SEQ ID NO: 55689 - protein, 9 aa, Homo Sapiens
MVSDNERTT

SEQ ID NO: 55690 - protein, 9 aa, Homo Sapiens
CNRYITIHR

SEQ ID NO: 55691 - protein, 9 aa, Homo Sapiens
SIYYFKQLH

SEQ ID NO: 55692 - protein, 9 aa, Homo Sapiens
VLTCILLKH

SEQ ID NO: 55693 - protein, 9 aa, Homo Sapiens
TRPLRRASG

SEQ ID NO: 55694 - protein, 9 aa, Homo Sapiens
NKLIEYHKN

SEQ ID NO: 55695 - protein, 9 aa, Homo Sapiens
DTGLFPNDE

SEQ ID NO: 55696 - protein, 9 aa, Homo Sapiens
YNRKREFSY

SEQ ID NO: 55697 - protein, 9 aa, Homo Sapiens
SNNGSMHNT

SEQ ID NO: 55698 - protein, 9 aa, Homo Sapiens
NWSKILLHF

SEQ ID NO: 55699 - protein, 9 aa, Homo Sapiens
QQKEQFDSD

SEQ ID NO: 55700 - protein, 9 aa, Homo Sapiens
AMIISIYYF

SEQ ID NO: 55701 - protein, 9 aa, Homo Sapiens
EERNKNFNP

SEQ ID NO: 55702 - protein, 9 aa, Homo Sapiens
FWDDGENKD

SEQ ID NO: 55703 - protein, 9 aa, Homo Sapiens
DGTLLSANE

SEQ ID NO: 55704 - protein, 9 aa, Homo Sapiens
AAQNERLDI

SEQ ID NO: 55705 - protein, 9 aa, Homo Sapiens
DVLYLHHST

SEQ ID NO: 55706 - protein, 9 aa, Homo Sapiens
VRVCACTGR

SEQ ID NO: 55707 - protein, 9 aa, Homo Sapiens
FKSREDSCT

SEQ ID NO: 55708 - protein, 9 aa, Homo Sapiens
ISMPSYQDQ

SEQ ID NO: 55709 - protein, 9 aa, Homo Sapiens
VAQTSLEQF

SEQ ID NO: 55710 - protein, 9 aa, Homo Sapiens
PLFSGKKVI

SEQ ID NO: 55711 - protein, 9 aa, Homo Sapiens
NNQVNGTRA

SEQ ID NO: 55712 - protein, 9 aa, Homo Sapiens
KLIKQVTES

SEQ ID NO: 55713 - protein, 9 aa, Homo Sapiens
ANFSPSHVA

SEQ ID NO: 55714 - protein, 9 aa, Homo Sapiens
RASLGVAFQ

SEQ ID NO: 55715 - protein, 9 aa, Homo Sapiens
YITIHRKSE

SEQ ID NO: 55716 - protein, 9 aa, Homo Sapiens
SDNGSESHP

SEQ ID NO: 55717 - protein, 9 aa, Homo Sapiens
VARAVLCDS

SEQ ID NO: 55718 - protein, 9 aa, Homo Sapiens
ELMCVDGTP

SEQ ID NO: 55719 - protein, 9 aa, Homo Sapiens
GDNVRVSSR

SEQ ID NO: 55720 - protein, 9 aa, Homo Sapiens
EKIKKTNNR

SEQ ID NO: 55721 - protein, 9 aa, Homo Sapiens
PTTKASLLS

SEQ ID NO: 55722 - protein, 9 aa, Homo Sapiens
WDDGENKDT

SEQ ID NO: 55723 - protein, 9 aa, Homo Sapiens
PEVHEKSKR

SEQ ID NO: 55724 - protein, 9 aa, Homo Sapiens
TTKASLLSV

SEQ ID NO: 55725 - protein, 9 aa, Homo Sapiens
LTEMISECT

SEQ ID NO: 55726 - protein, 9 aa, Homo Sapiens
FRAREKFEE

SEQ ID NO: 55727 - protein, 9 aa, Homo Sapiens
AYWKLRKLL

SEQ ID NO: 55728 - protein, 9 aa, Homo Sapiens
QPLFSGKKV

SEQ ID NO: 55729 - protein, 9 aa, Homo Sapiens
WSKILLHFK

SEQ ID NO: 55730 - protein, 9 aa, Homo Sapiens
KSIELAFFA

SEQ ID NO: 55731 - protein, 9 aa, Homo Sapiens
QQITEKEKK

SEQ ID NO: 55732 - protein, 9 aa, Homo Sapiens
LHSLDHGHE

SEQ ID NO: 55733 - protein, 9 aa, Homo Sapiens
GIHGMPGTP

SEQ ID NO: 55734 - protein, 9 aa, Homo Sapiens
EAINVLSHL

SEQ ID NO: 55735 - protein, 9 aa, Homo Sapiens
RVCACTGRD

SEQ ID NO: 55736 - protein, 9 aa, Homo Sapiens
REFSYPKNE

SEQ ID NO: 55737 - protein, 9 aa, Homo Sapiens
DLIKVDLHF

SEQ ID NO: 55738 - protein, 9 aa, Homo Sapiens
EIKYNEKDQ

SEQ ID NO: 55739 - protein, 9 aa, Homo Sapiens
NNRLNSRIN

SEQ ID NO: 55740 - protein, 9 aa, Homo Sapiens
CFPAANPGY

SEQ ID NO: 55741 - protein, 9 aa, Homo Sapiens
QNERLDICQ

SEQ ID NO: 55742 - protein, 9 aa, Homo Sapiens
PSSPLRATA

SEQ ID NO: 55743 - protein, 9 aa, Homo Sapiens
EMISECTEQ

SEQ ID NO: 55744 - protein, 9 aa, Homo Sapiens
IIYIGKRSL

SEQ ID NO: 55745 - protein, 9 aa, Homo Sapiens
ILTEMISEC

SEQ ID NO: 55746 - protein, 9 aa, Homo Sapiens
MKIGQGKHE

SEQ ID NO: 55747 - protein, 9 aa, Homo Sapiens
YNCKEAINV

SEQ ID NO: 55748 - protein, 9 aa, Homo Sapiens
SPINARART

SEQ ID NO: 55749 - protein, 9 aa, Homo Sapiens
LLLCGHAHP

SEQ ID NO: 55750 - protein, 9 aa, Homo Sapiens
RLLAAKTTK

SEQ ID NO: 55751 - protein, 9 aa, Homo Sapiens
LSSEQMSKT

SEQ ID NO: 55752 - protein, 9 aa, Homo Sapiens
LLSANEIPP

SEQ ID NO: 55753 - protein, 9 aa, Homo Sapiens
HESLLTIPI

SEQ ID NO: 55754 - protein, 9 aa, Homo Sapiens
NGSESHPHS

SEQ ID NO: 55755 - protein, 9 aa, Homo Sapiens
VTTSQGLPM

SEQ ID NO: 55756 - protein, 9 aa, Homo Sapiens
SHPHSAAYP

SEQ ID NO: 55757 - protein, 9 aa, Homo Sapiens
TEAEFFELD

SEQ ID NO: 55758 - protein, 9 aa, Homo Sapiens
TPWGQDLVL

SEQ ID NO: 55759 - protein, 9 aa, Homo Sapiens
DNVRVSSRG

SEQ ID NO: 55760 - protein, 9 aa, Homo Sapiens
TAFPQRTDL

SEQ ID NO: 55761 - protein, 9 aa, Homo Sapiens
VYMAHAMHT

SEQ ID NO: 55762 - protein, 9 aa, Homo Sapiens
VYNYFYFLH

SEQ ID NO: 55763 - protein, 9 aa, Homo Sapiens
SQAEETGPP

SEQ ID NO: 55764 - protein, 9 aa, Homo Sapiens
ELTQDTSLT

SEQ ID NO: 55765 - protein, 9 aa, Homo Sapiens
QKKTNDLRY

SEQ ID NO: 55766 - protein, 9 aa, Homo Sapiens
YIVNIMAIV

SEQ ID NO: 55767 - protein, 9 aa, Homo Sapiens
EQLKQAQEL

SEQ ID NO: 55768 - protein, 9 aa, Homo Sapiens
NDLVLKFSS

SEQ ID NO: 55769 - protein, 9 aa, Homo Sapiens
HFKFNNRTS

SEQ ID NO: 55770 - protein, 9 aa, Homo Sapiens
PRPGSTADP

SEQ ID NO: 55771 - protein, 9 aa, Homo Sapiens
RNTMLGHTN

SEQ ID NO: 55772 - protein, 9 aa, Homo Sapiens
TSLTENDDS

SEQ ID NO: 55773 - protein, 9 aa, Homo Sapiens
RADVGKVLR

SEQ ID NO: 55774 - protein, 9 aa, Homo Sapiens
ILSYTIIIR

SEQ ID NO: 55775 - protein, 9 aa, Homo Sapiens
PPAPGDSTP

SEQ ID NO: 55776 - protein, 9 aa, Homo Sapiens
PPPASIPQG

SEQ ID NO: 55777 - protein, 9 aa, Homo Sapiens
DGQGFTASL

SEQ ID NO: 55778 - protein, 9 aa, Homo Sapiens
QLKQAQELR

SEQ ID NO: 55779 - protein, 9 aa, Homo Sapiens
EKEKIKKTN

SEQ ID NO: 55780 - protein, 9 aa, Homo Sapiens
WTCTRPLRR

SEQ ID NO: 55781 - protein, 9 aa, Homo Sapiens
NIFHAASTP

SEQ ID NO: 55782 - protein, 9 aa, Homo Sapiens
ISECTEQTL

SEQ ID NO: 55783 - protein, 9 aa, Homo Sapiens
NGSMHNTSQ

SEQ ID NO: 55784 - protein, 9 aa, Homo Sapiens
EHTVTHPQY

SEQ ID NO: 55785 - protein, 9 aa, Homo Sapiens
NDIFVSTSE

SEQ ID NO: 55786 - protein, 9 aa, Homo Sapiens
MGISAMYFY

SEQ ID NO: 55787 - protein, 9 aa, Homo Sapiens
HSMKQDMAL

SEQ ID NO: 55788 - protein, 9 aa, Homo Sapiens
FVSNLRESI

SEQ ID NO: 55789 - protein, 9 aa, Homo Sapiens
NLRESILRL

SEQ ID NO: 55790 - protein, 9 aa, Homo Sapiens
TNNQVNGTR

SEQ ID NO: 55791 - protein, 9 aa, Homo Sapiens
LRSGDELMC

SEQ ID NO: 55792 - protein, 9 aa, Homo Sapiens
SESHPHSAA

SEQ ID NO: 55793 - protein, 9 aa, Homo Sapiens
FACFPAANP

SEQ ID NO: 55794 - protein, 9 aa, Homo Sapiens
IKLNQKQDM

SEQ ID NO: 55795 - protein, 9 aa, Homo Sapiens
KETHAAGPD

SEQ ID NO: 55796 - protein, 9 aa, Homo Sapiens
KKRIKVQTD

SEQ ID NO: 55797 - protein, 9 aa, Homo Sapiens
CMNPQTFKF

SEQ ID NO: 55798 - protein, 9 aa, Homo Sapiens
SFSVTTSQG

SEQ ID NO: 55799 - protein, 9 aa, Homo Sapiens
SIPQGAHAA

SEQ ID NO: 55800 - protein, 9 aa, Homo Sapiens
LQTLTMTNV

SEQ ID NO: 55801 - protein, 9 aa, Homo Sapiens
TVTHPQYVA

SEQ ID NO: 55802 - protein, 9 aa, Homo Sapiens
YNEKDQRER

SEQ ID NO: 55803 - protein, 9 aa, Homo Sapiens
VTYMFDNGG

SEQ ID NO: 55804 - protein, 9 aa, Homo Sapiens
APILHSTPV

SEQ ID NO: 55805 - protein, 9 aa, Homo Sapiens
AVCMELYKP

SEQ ID NO: 55806 - protein, 9 aa, Homo Sapiens
GPEEGEEVS

SEQ ID NO: 55807 - protein, 9 aa, Homo Sapiens
QGLYIGSSL

SEQ ID NO: 55808 - protein, 9 aa, Homo Sapiens
IYIGKRSLR

SEQ ID NO: 55809 - protein, 9 aa, Homo Sapiens
VSWRSPSTC

SEQ ID NO: 55810 - protein, 9 aa, Homo Sapiens
IKKLSNAIS

SEQ ID NO: 55811 - protein, 9 aa, Homo Sapiens
LSYTIIIRT

SEQ ID NO: 55812 - protein, 9 aa, Homo Sapiens
IYIMPDTPE

SEQ ID NO: 55813 - protein, 9 aa, Homo Sapiens
PAANPGYAF

SEQ ID NO: 55814 - protein, 9 aa, Homo Sapiens
ILSSVPHKA

SEQ ID NO: 55815 - protein, 9 aa, Homo Sapiens
AILSSVPHK

SEQ ID NO: 55816 - protein, 9 aa, Homo Sapiens
ENDIFVSTS

SEQ ID NO: 55817 - protein, 9 aa, Homo Sapiens
NLAMIISIY

SEQ ID NO: 55818 - protein, 9 aa, Homo Sapiens
QPSMYKQLR

SEQ ID NO: 55819 - protein, 9 aa, Homo Sapiens
ETHAAGPDS

SEQ ID NO: 55820 - protein, 9 aa, Homo Sapiens
QKSIEVPQA

SEQ ID NO: 55821 - protein, 9 aa, Homo Sapiens
IVCAGQNSS

SEQ ID NO: 55822 - protein, 9 aa, Homo Sapiens
IPVTPPVPT

SEQ ID NO: 55823 - protein, 9 aa, Homo Sapiens
VKKRIKVQT

SEQ ID NO: 55824 - protein, 9 aa, Homo Sapiens
IYGKVRQQP

SEQ ID NO: 55825 - protein, 9 aa, Homo Sapiens
FQILVTIAA

SEQ ID NO: 55826 - protein, 9 aa, Homo Sapiens
KLIYSIGIF

SEQ ID NO: 55827 - protein, 9 aa, Homo Sapiens
GDSCAVCME

SEQ ID NO: 55828 - protein, 9 aa, Homo Sapiens
STADPPHAI

SEQ ID NO: 55829 - protein, 9 aa, Homo Sapiens
ELAFFASCL

SEQ ID NO: 55830 - protein, 9 aa, Homo Sapiens
EASNNGSMH

SEQ ID NO: 55831 - protein, 9 aa, Homo Sapiens
RAREKFEED

SEQ ID NO: 55832 - protein, 9 aa, Homo Sapiens
LHKIQRQIC

SEQ ID NO: 55833 - protein, 9 aa, Homo Sapiens
LLHFKFNNR

SEQ ID NO: 55834 - protein, 9 aa, Homo Sapiens
EQCGEIEAL

SEQ ID NO: 55835 - protein, 9 aa, Homo Sapiens
TNISCELLT

SEQ ID NO: 55836 - protein, 9 aa, Homo Sapiens
GTAFPQRTD

SEQ ID NO: 55837 - protein, 9 aa, Homo Sapiens
NARARTGKC

SEQ ID NO: 55838 - protein, 9 aa, Homo Sapiens
LGTPNEYTW

SEQ ID NO: 55839 - protein, 9 aa, Homo Sapiens
RFVDILPYD

SEQ ID NO: 55840 - protein, 9 aa, Homo Sapiens
KTCMIANFS

SEQ ID NO: 55841 - protein, 9 aa, Homo Sapiens
SQPSMYKQL

SEQ ID NO: 55842 - protein, 9 aa, Homo Sapiens
YTWPGVHSL

SEQ ID NO: 55843 - protein, 9 aa, Homo Sapiens
FHAASTPAT

SEQ ID NO: 55844 - protein, 9 aa, Homo Sapiens
NKVLLLSIK

SEQ ID NO: 55845 - protein, 9 aa, Homo Sapiens
TMLGHTNSV

SEQ ID NO: 55846 - protein, 9 aa, Homo Sapiens
NFNPHLTGK

SEQ ID NO: 55847 - protein, 9 aa, Homo Sapiens
EKLIKQVTE

SEQ ID NO: 55848 - protein, 9 aa, Homo Sapiens
LGHTNSVNH

SEQ ID NO: 55849 - protein, 9 aa, Homo Sapiens
LRRASGVSW

SEQ ID NO: 55850 - protein, 9 aa, Homo Sapiens
ISPINARAR

SEQ ID NO: 55851 - protein, 9 aa, Homo Sapiens
HGRTHTGKK

SEQ ID NO: 55852 - protein, 9 aa, Homo Sapiens
LLCGHAHPQ

SEQ ID NO: 55853 - protein, 9 aa, Homo Sapiens
PQYVAWPDH

SEQ ID NO: 55854 - protein, 9 aa, Homo Sapiens
RAPILHSTP

SEQ ID NO: 55855 - protein, 9 aa, Homo Sapiens
GCYNKLIEY

SEQ ID NO: 55856 - protein, 9 aa, Homo Sapiens
KHEPGFFPK

SEQ ID NO: 55857 - protein, 9 aa, Homo Sapiens
FNQNKNRFV

SEQ ID NO: 55858 - protein, 9 aa, Homo Sapiens
PVVCVDLTP

SEQ ID NO: 55859 - protein, 9 aa, Homo Sapiens
QKETHAAGP

SEQ ID NO: 55860 - protein, 9 aa, Homo Sapiens
SIEVPQAKA

SEQ ID NO: 55861 - protein, 9 aa, Homo Sapiens
GVAIPANII

SEQ ID NO: 55862 - protein, 9 aa, Homo Sapiens
GVLGRMGIS

SEQ ID NO: 55863 - protein, 9 aa, Homo Sapiens
EFEKKRTAA

SEQ ID NO: 55864 - protein, 9 aa, Homo Sapiens
RPGSTADPP

SEQ ID NO: 55865 - protein, 9 aa, Homo Sapiens
EGEEVSQAE

SEQ ID NO: 55866 - protein, 9 aa, Homo Sapiens
EGFQPKRIT

SEQ ID NO: 55867 - protein, 9 aa, Homo Sapiens
GVSTHPPDR

SEQ ID NO: 55868 - protein, 9 aa, Homo Sapiens
EYEIKYNEK

SEQ ID NO: 55869 - protein, 9 aa, Homo Sapiens
GCKLFYKQD

SEQ ID NO: 55870 - protein, 9 aa, Homo Sapiens
CGHAHPQCK

SEQ ID NO: 55871 - protein, 9 aa, Homo Sapiens
NMFYIVNIM

SEQ ID NO: 55872 - protein, 9 aa, Homo Sapiens
AFFASCLSS

SEQ ID NO: 55873 - protein, 9 aa, Homo Sapiens
PSMYKQLRD

SEQ ID NO: 55874 - protein, 9 aa, Homo Sapiens
LTMTNVAAT

SEQ ID NO: 55875 - protein, 9 aa, Homo Sapiens
LDGTLLSAN

SEQ ID NO: 55876 - protein, 9 aa, Homo Sapiens
WLLTFFFLR

SEQ ID NO: 55877 - protein, 9 aa, Homo Sapiens
YSSYLLKNH

SEQ ID NO: 55878 - protein, 9 aa, Homo Sapiens
DLVLQGTQM

SEQ ID NO: 55879 - protein, 9 aa, Homo Sapiens
DVGKVLRRW

SEQ ID NO: 55880 - protein, 9 aa, Homo Sapiens
QELEENKRS

SEQ ID NO: 55881 - protein, 9 aa, Homo Sapiens
YKQLRDIAI

SEQ ID NO: 55882 - protein, 9 aa, Homo Sapiens
QRDIEKKYH

SEQ ID NO: 55883 - protein, 9 aa, Homo Sapiens
GDYCGKEGR

SEQ ID NO: 55884 - protein, 9 aa, Homo Sapiens
QDLVLQGTQ

SEQ ID NO: 55885 - protein, 9 aa, Homo Sapiens
TNNRLNSRI

SEQ ID NO: 55886 - protein, 9 aa, Homo Sapiens
LKSEIKKLF

SEQ ID NO: 55887 - protein, 9 aa, Homo Sapiens
KFKSREDSC

SEQ ID NO: 55888 - protein, 9 aa, Homo Sapiens
GELEQTKNK

SEQ ID NO: 55889 - protein, 9 aa, Homo Sapiens
NEYTWPGVH

SEQ ID NO: 55890 - protein, 9 aa, Homo Sapiens
NLEQCGEIE

SEQ ID NO: 55891 - protein, 9 aa, Homo Sapiens
QKQDMEIAE

SEQ ID NO: 55892 - protein, 9 aa, Homo Sapiens
KQLRDIAID

SEQ ID NO: 55893 - protein, 9 aa, Homo Sapiens
VVPGILMSI

SEQ ID NO: 55894 - protein, 9 aa, Homo Sapiens
YNYFYFLHG

SEQ ID NO: 55895 - protein, 9 aa, Homo Sapiens
GRMGISAMY

SEQ ID NO: 55896 - protein, 9 aa, Homo Sapiens
SPSTCGTQP

SEQ ID NO: 55897 - protein, 9 aa, Homo Sapiens
PAPGDSTPP

SEQ ID NO: 55898 - protein, 9 aa, Homo Sapiens
RKINLEQCG

SEQ ID NO: 55899 - protein, 9 aa, Homo Sapiens
GKVLRRWVD

SEQ ID NO: 55900 - protein, 9 aa, Homo Sapiens
KSKRKSTRP

SEQ ID NO: 55901 - protein, 9 aa, Homo Sapiens
HNDLVLKFS

SEQ ID NO: 55902 - protein, 9 aa, Homo Sapiens
FFTFRAREK

SEQ ID NO: 55903 - protein, 9 aa, Homo Sapiens
APGDSTPPP

SEQ ID NO: 55904 - protein, 9 aa, Homo Sapiens
FPQRTDLFS

SEQ ID NO: 55905 - protein, 9 aa, Homo Sapiens
KSCMNPQTF

SEQ ID NO: 55906 - protein, 9 aa, Homo Sapiens
SDTGLFPND

SEQ ID NO: 55907 - protein, 9 aa, Homo Sapiens
EVRVCACTG

SEQ ID NO: 55908 - protein, 9 aa, Homo Sapiens
VVCVDLTPK

SEQ ID NO: 55909 - protein, 9 aa, Homo Sapiens
EEHTVTHPQ

SEQ ID NO: 55910 - protein, 9 aa, Homo Sapiens
PQTFKFDRP

SEQ ID NO: 55911 - protein, 9 aa, Homo Sapiens
HGGDLFTEN

SEQ ID NO: 55912 - protein, 9 aa, Homo Sapiens
RVKISMPSY

SEQ ID NO: 55913 - protein, 9 aa, Homo Sapiens
TGKKPYQCK

SEQ ID NO: 55914 - protein, 9 aa, Homo Sapiens
EKFEEDRIY

SEQ ID NO: 55915 - protein, 9 aa, Homo Sapiens
EEETKQELE

SEQ ID NO: 55916 - protein, 9 aa, Homo Sapiens
IGDYCGKEG

SEQ ID NO: 55917 - protein, 9 aa, Homo Sapiens
FFHQRDIEK

SEQ ID NO: 55918 - protein, 9 aa, Homo Sapiens
HLIKLNQKQ

SEQ ID NO: 55919 - protein, 9 aa, Homo Sapiens
SPGFKGIHG

SEQ ID NO: 55920 - protein, 9 aa, Homo Sapiens
IFHAASTPA

SEQ ID NO: 55921 - protein, 9 aa, Homo Sapiens
YYFKQLHTP

SEQ ID NO: 55922 - protein, 9 aa, Homo Sapiens
GNQAILSSV

SEQ ID NO: 55923 - protein, 9 aa, Homo Sapiens
VTEEFFHQR

SEQ ID NO: 55924 - protein, 9 aa, Homo Sapiens
ILMSIKLHQ

SEQ ID NO: 55925 - protein, 9 aa, Homo Sapiens
EPNCAVLQV

SEQ ID NO: 55926 - protein, 9 aa, Homo Sapiens
YAKVTYMFD

SEQ ID NO: 55927 - protein, 9 aa, Homo Sapiens
DKCCSPTEQ

SEQ ID NO: 55928 - protein, 9 aa, Homo Sapiens
RKVVVPGIL

SEQ ID NO: 55929 - protein, 9 aa, Homo Sapiens
FASCLSSKC

SEQ ID NO: 55930 - protein, 9 aa, Homo Sapiens
TQKETHAAG

SEQ ID NO: 55931 - protein, 9 aa, Homo Sapiens
KKRTAAIAE

SEQ ID NO: 55932 - protein, 9 aa, Homo Sapiens
MELYKPNDL

SEQ ID NO: 55933 - protein, 9 aa, Homo Sapiens
CGTQPGVST

SEQ ID NO: 55934 - protein, 9 aa, Homo Sapiens
NGHSMKQDM

SEQ ID NO: 55935 - protein, 9 aa, Homo Sapiens
IGSSLERSP

SEQ ID NO: 55936 - protein, 9 aa, Homo Sapiens
TSGETNNQV

SEQ ID NO: 55937 - protein, 9 aa, Homo Sapiens
ATQKETHAA

SEQ ID NO: 55938 - protein, 9 aa, Homo Sapiens
ERNKNFNPH

SEQ ID NO: 55939 - protein, 9 aa, Homo Sapiens
REKFEEDRI

SEQ ID NO: 55940 - protein, 9 aa, Homo Sapiens
IPCCPEHLK

SEQ ID NO: 55941 - protein, 9 aa, Homo Sapiens
LVISPINAR

SEQ ID NO: 55942 - protein, 9 aa, Homo Sapiens
GCESKLHSL

SEQ ID NO: 55943 - protein, 9 aa, Homo Sapiens
QAQELRQYK

SEQ ID NO: 55944 - protein, 9 aa, Homo Sapiens
KRYNRKREF

SEQ ID NO: 55945 - protein, 9 aa, Homo Sapiens
ENNADPNLQ

SEQ ID NO: 55946 - protein, 9 aa, Homo Sapiens
PVTPPVPTL

SEQ ID NO: 55947 - protein, 9 aa, Homo Sapiens
TAQQNLYMN

SEQ ID NO: 55948 - protein, 9 aa, Homo Sapiens
GFQPKRITV

SEQ ID NO: 55949 - protein, 9 aa, Homo Sapiens
HPPDRLLAA

SEQ ID NO: 55950 - protein, 9 aa, Homo Sapiens
TFFFLRNLV

SEQ ID NO: 55951 - protein, 9 aa, Homo Sapiens
IKKTNNRLN

SEQ ID NO: 55952 - protein, 9 aa, Homo Sapiens
ASLGVAFQI

SEQ ID NO: 55953 - protein, 9 aa, Homo Sapiens
IHRKSELAV

SEQ ID NO: 55954 - protein, 9 aa, Homo Sapiens
LTFFFLRNL

SEQ ID NO: 55955 - protein, 9 aa, Homo Sapiens
IEILTEMIS

SEQ ID NO: 55956 - protein, 9 aa, Homo Sapiens
IPANIIHEG

SEQ ID NO: 55957 - protein, 9 aa, Homo Sapiens
HPQCKILRC

SEQ ID NO: 55958 - protein, 9 aa, Homo Sapiens
AEPNCAVLQ

SEQ ID NO: 55959 - protein, 9 aa, Homo Sapiens
KNPLYPITV

SEQ ID NO: 55960 - protein, 9 aa, Homo Sapiens
NNGSMHNTS

SEQ ID NO: 55961 - protein, 9 aa, Homo Sapiens
TPPVPTLPP

SEQ ID NO: 55962 - protein, 9 aa, Homo Sapiens
SLLMVSDNE

SEQ ID NO: 55963 - protein, 9 aa, Homo Sapiens
HGFFFFFSI

SEQ ID NO: 55964 - protein, 9 aa, Homo Sapiens
NVATQKETH

SEQ ID NO: 55965 - protein, 9 aa, Homo Sapiens
SIPPIPVTP

SEQ ID NO: 55966 - protein, 9 aa, Homo Sapiens
YTFFACFPA

SEQ ID NO: 55967 - protein, 9 aa, Homo Sapiens
KNKLEQAQN

SEQ ID NO: 55968 - protein, 9 aa, Homo Sapiens
PGSTADPPH

SEQ ID NO: 55969 - protein, 9 aa, Homo Sapiens
VLGRMGISA

SEQ ID NO: 55970 - protein, 9 aa, Homo Sapiens
RKVQKSIEV

SEQ ID NO: 55971 - protein, 9 aa, Homo Sapiens
IKDGDGQGF

SEQ ID NO: 55972 - protein, 9 aa, Homo Sapiens
KTSGETNNQ

SEQ ID NO: 55973 - protein, 9 aa, Homo Sapiens
GQGFTASLF

SEQ ID NO: 55974 - protein, 9 aa, Homo Sapiens
VCACTGRDR

SEQ ID NO: 55975 - protein, 9 aa, Homo Sapiens
KRIKVQTDD

SEQ ID NO: 55976 - protein, 9 aa, Homo Sapiens
ESLLTIPIS

SEQ ID NO: 55977 - protein, 9 aa, Homo Sapiens
EKQGEKSNK

SEQ ID NO: 55978 - protein, 9 aa, Homo Sapiens
KKTNNRLNS

SEQ ID NO: 55979 - protein, 9 aa, Homo Sapiens
EEGEEVSQA

SEQ ID NO: 55980 - protein, 9 aa, Homo Sapiens
KGVLGRMGI

SEQ ID NO: 55981 - protein, 9 aa, Homo Sapiens
PPPPPPASI

SEQ ID NO: 55982 - protein, 9 aa, Homo Sapiens
DLTPKCGGQ

SEQ ID NO: 55983 - protein, 9 aa, Homo Sapiens
YTNISCELL

SEQ ID NO: 55984 - protein, 9 aa, Homo Sapiens
IYSIGIFFT

SEQ ID NO: 55985 - protein, 9 aa, Homo Sapiens
PEEGEEVSQ

SEQ ID NO: 55986 - protein, 9 aa, Homo Sapiens
RYESSSEDQ

SEQ ID NO: 55987 - protein, 9 aa, Homo Sapiens
IWKGHLGAL

SEQ ID NO: 55988 - protein, 9 aa, Homo Sapiens
HAAGPDSRS

SEQ ID NO: 55989 - protein, 9 aa, Homo Sapiens
GGEGFQPKR

SEQ ID NO: 55990 - protein, 9 aa, Homo Sapiens
DKGVLGRMG

SEQ ID NO: 55991 - protein, 9 aa, Homo Sapiens
KLFYKQDFA

SEQ ID NO: 55992 - protein, 9 aa, Homo Sapiens
MFGIKTEAE

SEQ ID NO: 55993 - protein, 9 aa, Homo Sapiens
PESSVSHLC

SEQ ID NO: 55994 - protein, 9 aa, Homo Sapiens
KVTYMFDNG

SEQ ID NO: 55995 - protein, 9 aa, Homo Sapiens
AWNLLPAGA

SEQ ID NO: 55996 - protein, 9 aa, Homo Sapiens
LVYMAHAMH

SEQ ID NO: 55997 - protein, 9 aa, Homo Sapiens
GPQGNQAIL

SEQ ID NO: 55998 - protein, 9 aa, Homo Sapiens
FFASCLSSK

SEQ ID NO: 55999 - protein, 9 aa, Homo Sapiens
GEEVSQAEE

SEQ ID NO: 56000 - protein, 9 aa, Homo Sapiens
IVNIMAIVL

SEQ ID NO: 56001 - protein, 9 aa, Homo Sapiens
RQICWRCWT

SEQ ID NO: 56002 - protein, 9 aa, Homo Sapiens
TRAPILHST

SEQ ID NO: 56003 - protein, 9 aa, Homo Sapiens
SPVVCVDLT

SEQ ID NO: 56004 - protein, 9 aa, Homo Sapiens
VYYSSYLLK

SEQ ID NO: 56005 - protein, 9 aa, Homo Sapiens
RLRSGDELM

SEQ ID NO: 56006 - protein, 9 aa, Homo Sapiens
RTPWGQDLV

SEQ ID NO: 56007 - protein, 9 aa, Homo Sapiens
VDLIKVDLH

SEQ ID NO: 56008 - protein, 9 aa, Homo Sapiens
GPDYCDIEN

SEQ ID NO: 56009 - protein, 9 aa, Homo Sapiens
LNTEKMYRL

SEQ ID NO: 56010 - protein, 9 aa, Homo Sapiens
VLYPGCDIR

SEQ ID NO: 56011 - protein, 9 aa, Homo Sapiens
NEKDQRERT

SEQ ID NO: 56012 - protein, 9 aa, Homo Sapiens
LHHNDLVLK

SEQ ID NO: 56013 - protein, 9 aa, Homo Sapiens
GHAHPQCKI

SEQ ID NO: 56014 - protein, 9 aa, Homo Sapiens
FEKKRTAAI

SEQ ID NO: 56015 - protein, 9 aa, Homo Sapiens
TEYEIKYNE

SEQ ID NO: 56016 - protein, 9 aa, Homo Sapiens
KSREDSCTK

SEQ ID NO: 56017 - protein, 9 aa, Homo Sapiens
SVTTSQGLP

SEQ ID NO: 56018 - protein, 9 aa, Homo Sapiens
SSPLRATAS

SEQ ID NO: 56019 - protein, 9 aa, Homo Sapiens
QNSSRDVIT

SEQ ID NO: 56020 - protein, 9 aa, Homo Sapiens
HSLDHGHEK

SEQ ID NO: 56021 - protein, 9 aa, Homo Sapiens
FTASLFLAL

SEQ ID NO: 56022 - protein, 9 aa, Homo Sapiens
EAEFFELDV

SEQ ID NO: 56023 - protein, 9 aa, Homo Sapiens
HGMPGTPGL

SEQ ID NO: 56024 - protein, 9 aa, Homo Sapiens
SCAVCMELY

SEQ ID NO: 56025 - protein, 9 aa, Homo Sapiens
EIYGKVRQQ

SEQ ID NO: 56026 - protein, 9 aa, Homo Sapiens
SKNIFHAAS

SEQ ID NO: 56027 - protein, 9 aa, Homo Sapiens
SCMNPQTFK

SEQ ID NO: 56028 - protein, 9 aa, Homo Sapiens
SMHNTSQDR

SEQ ID NO: 56029 - protein, 9 aa, Homo Sapiens
FYFLHGFFF

SEQ ID NO: 56030 - protein, 9 aa, Homo Sapiens
VLQTQPLFS

SEQ ID NO: 56031 - protein, 9 aa, Homo Sapiens
ASEEDNIPS

SEQ ID NO: 56032 - protein, 9 aa, Homo Sapiens
TQDTSLTEN

SEQ ID NO: 56033 - protein, 9 aa, Homo Sapiens
ANLAISITR

SEQ ID NO: 56034 - protein, 9 aa, Homo Sapiens
HRADVGKVL

SEQ ID NO: 56035 - protein, 9 aa, Homo Sapiens
QDMEIAELK

SEQ ID NO: 56036 - protein, 9 aa, Homo Sapiens
MCVDGTPVI

SEQ ID NO: 56037 - protein, 9 aa, Homo Sapiens
TTKVSFSVT

SEQ ID NO: 56038 - protein, 9 aa, Homo Sapiens
AFPQRTDLF

SEQ ID NO: 56039 - protein, 9 aa, Homo Sapiens
VAKWLLTFF

SEQ ID NO: 56040 - protein, 9 aa, Homo Sapiens
ERKHRRMCR

SEQ ID NO: 56041 - protein, 9 aa, Homo Sapiens
NDNDEFEKK

SEQ ID NO: 56042 - protein, 9 aa, Homo Sapiens
CGEIEALSM

SEQ ID NO: 56043 - protein, 9 aa, Homo Sapiens
RYKYTNISC

SEQ ID NO: 56044 - protein, 9 aa, Homo Sapiens
EFFHQRDIE

SEQ ID NO: 56045 - protein, 9 aa, Homo Sapiens
FPNDEGRQG

SEQ ID NO: 56046 - protein, 9 aa, Homo Sapiens
PANIIHEGF

SEQ ID NO: 56047 - protein, 9 aa, Homo Sapiens
KTNDLRYIE

SEQ ID NO: 56048 - protein, 9 aa, Homo Sapiens
DGENKDTIQ

SEQ ID NO: 56049 - protein, 9 aa, Homo Sapiens
QKKYLYRYP

SEQ ID NO: 56050 - protein, 9 aa, Homo Sapiens
KYTNISCEL

SEQ ID NO: 56051 - protein, 9 aa, Homo Sapiens
KRITVILED

SEQ ID NO: 56052 - protein, 9 aa, Homo Sapiens
IGELTQDTS

SEQ ID NO: 56053 - protein, 9 aa, Homo Sapiens
TANMFYIVN

SEQ ID NO: 56054 - protein, 9 aa, Homo Sapiens
EKSKRKSTR

SEQ ID NO: 56055 - protein, 9 aa, Homo Sapiens
NLQDKSGKT

SEQ ID NO: 56056 - protein, 9 aa, Homo Sapiens
ADVLYLHHS

SEQ ID NO: 56057 - protein, 9 aa, Homo Sapiens
LMVSDNERT

SEQ ID NO: 56058 - protein, 9 aa, Homo Sapiens
IIIRTILKI

SEQ ID NO: 56059 - protein, 9 aa, Homo Sapiens
PLRRASGVS

SEQ ID NO: 56060 - protein, 9 aa, Homo Sapiens
NERLDICQQ

SEQ ID NO: 56061 - protein, 9 aa, Homo Sapiens
NTEKMYRLN

SEQ ID NO: 56062 - protein, 9 aa, Homo Sapiens
DYCGKEGRF

SEQ ID NO: 56063 - protein, 9 aa, Homo Sapiens
LYIGSSLER

SEQ ID NO: 56064 - protein, 9 aa, Homo Sapiens
GSSLERSPV

SEQ ID NO: 56065 - protein, 9 aa, Homo Sapiens
LYHRADVGK

SEQ ID NO: 56066 - protein, 9 aa, Homo Sapiens
TPLGCYNKL

SEQ ID NO: 56067 - protein, 9 aa, Homo Sapiens
GASQSDSED

SEQ ID NO: 56068 - protein, 9 aa, Homo Sapiens
KYNEKDQRE

SEQ ID NO: 56069 - protein, 9 aa, Homo Sapiens
SMYKQLRDI

SEQ ID NO: 56070 - protein, 9 aa, Homo Sapiens
AQTSLEQFN

SEQ ID NO: 56071 - protein, 9 aa, Homo Sapiens
PQRTDLFSE

SEQ ID NO: 56072 - protein, 9 aa, Homo Sapiens
PSLVYMAHA

SEQ ID NO: 56073 - protein, 9 aa, Homo Sapiens
RMGISAMYF

SEQ ID NO: 56074 - protein, 9 aa, Homo Sapiens
QITEKEKKT

SEQ ID NO: 56075 - protein, 9 aa, Homo Sapiens
HTVTHPQYV

SEQ ID NO: 56076 - protein, 9 aa, Homo Sapiens
ISIYYFKQL

SEQ ID NO: 56077 - protein, 9 aa, Homo Sapiens
QIYIMPDTP

SEQ ID NO: 56078 - protein, 9 aa, Homo Sapiens
LEQFNVLEM

SEQ ID NO: 56079 - protein, 9 aa, Homo Sapiens
SSLERSPVP

SEQ ID NO: 56080 - protein, 9 aa, Homo Sapiens
CMELYKPND

SEQ ID NO: 56081 - protein, 9 aa, Homo Sapiens
NYFYFLHGF

SEQ ID NO: 56082 - protein, 9 aa, Homo Sapiens
TNDLRYIEM

SEQ ID NO: 56083 - protein, 9 aa, Homo Sapiens
KPEVHEKSK

SEQ ID NO: 56084 - protein, 9 aa, Homo Sapiens
EIKKLFQGS

SEQ ID NO: 56085 - protein, 9 aa, Homo Sapiens
PISLSEKRE

SEQ ID NO: 56086 - protein, 9 aa, Homo Sapiens
AQNERLDIC

SEQ ID NO: 56087 - protein, 9 aa, Homo Sapiens
GDGQGFTAS

SEQ ID NO: 56088 - protein, 9 aa, Homo Sapiens
TEEFFHQRD

SEQ ID NO: 56089 - protein, 9 aa, Homo Sapiens
EEVARAVLC

SEQ ID NO: 56090 - protein, 9 aa, Homo Sapiens
EKVKKRIKV

SEQ ID NO: 56091 - protein, 9 aa, Homo Sapiens
FVDILPYDY

SEQ ID NO: 56092 - protein, 9 aa, Homo Sapiens
LRATASWVL

SEQ ID NO: 56093 - protein, 9 aa, Homo Sapiens
MTNVAATQP

SEQ ID NO: 56094 - protein, 9 aa, Homo Sapiens
LFTENENKD

SEQ ID NO: 56095 - protein, 9 aa, Homo Sapiens
HNTSQDRER

SEQ ID NO: 56096 - protein, 9 aa, Homo Sapiens
KEKKTRKAI

SEQ ID NO: 56097 - protein, 9 aa, Homo Sapiens
NQNKNRFVD

SEQ ID NO: 56098 - protein, 9 aa, Homo Sapiens
SVSHLCPEP

SEQ ID NO: 56099 - protein, 9 aa, Homo Sapiens
IPPIPVTPP

SEQ ID NO: 56100 - protein, 9 aa, Homo Sapiens
PQCKILRCN

SEQ ID NO: 56101 - protein, 9 aa, Homo Sapiens
TIHRKSELA

SEQ ID NO: 56102 - protein, 9 aa, Homo Sapiens
SQRRYVYYS

SEQ ID NO: 56103 - protein, 9 aa, Homo Sapiens
GLPMSWGPS

SEQ ID NO: 56104 - protein, 9 aa, Homo Sapiens
RSGDELMCV

SEQ ID NO: 56105 - protein, 9 aa, Homo Sapiens
DTAQQNLYM

SEQ ID NO: 56106 - protein, 9 aa, Homo Sapiens
LVLQGTQMQ

SEQ ID NO: 56107 - protein, 9 aa, Homo Sapiens
IKKLFQGSP

SEQ ID NO: 56108 - protein, 9 aa, Homo Sapiens
FQPKRITVI

SEQ ID NO: 56109 - protein, 9 aa, Homo Sapiens
NVRVSSRGK

SEQ ID NO: 56110 - protein, 9 aa, Homo Sapiens
YADVLYLHH

SEQ ID NO: 56111 - protein, 9 aa, Homo Sapiens
KVKKRIKVQ

SEQ ID NO: 56112 - protein, 9 aa, Homo Sapiens
PNLQDKSGK

SEQ ID NO: 56113 - protein, 9 aa, Homo Sapiens
TFFACFPAA

SEQ ID NO: 56114 - protein, 9 aa, Homo Sapiens
TLLSANEIP

SEQ ID NO: 56115 - protein, 9 aa, Homo Sapiens
YNFVSNLRE

SEQ ID NO: 56116 - protein, 9 aa, Homo Sapiens
RDIEKKYHL

SEQ ID NO: 56117 - protein, 9 aa, Homo Sapiens
KHKVVLQSR

SEQ ID NO: 56118 - protein, 9 aa, Homo Sapiens
FVSTSEDEP

SEQ ID NO: 56119 - protein, 9 aa, Homo Sapiens
QVLTCILLK

SEQ ID NO: 56120 - protein, 9 aa, Homo Sapiens
AEQLKQAQE

SEQ ID NO: 56121 - protein, 9 aa, Homo Sapiens
TLVILSYTI

SEQ ID NO: 56122 - protein, 9 aa, Homo Sapiens
ADPNLQDKS

SEQ ID NO: 56123 - protein, 9 aa, Homo Sapiens
IKDSDNAEP

SEQ ID NO: 56124 - protein, 9 aa, Homo Sapiens
ELPTTKASL

SEQ ID NO: 56125 - protein, 9 aa, Homo Sapiens
INVLSHLPS

SEQ ID NO: 56126 - protein, 9 aa, Homo Sapiens
QSVKLIYSI

SEQ ID NO: 56127 - protein, 9 aa, Homo Sapiens
IPGVAIPAN

SEQ ID NO: 56128 - protein, 9 aa, Homo Sapiens
ISLSEKREN

SEQ ID NO: 56129 - protein, 9 aa, Homo Sapiens
PPDRLLAAK

SEQ ID NO: 56130 - protein, 9 aa, Homo Sapiens
KVLLLSIKN

SEQ ID NO: 56131 - protein, 9 aa, Homo Sapiens
IEKLIKQVT

SEQ ID NO: 56132 - protein, 9 aa, Homo Sapiens
LGVAFQILV

SEQ ID NO: 56133 - protein, 9 aa, Homo Sapiens
TCGTQPGVS

SEQ ID NO: 56134 - protein, 9 aa, Homo Sapiens
LQGTQMQPL

SEQ ID NO: 56135 - protein, 9 aa, Homo Sapiens
ILLHFKFNN

SEQ ID NO: 56136 - protein, 9 aa, Homo Sapiens
LSNAISTSN

SEQ ID NO: 56137 - protein, 9 aa, Homo Sapiens
ILHSTPVTP

SEQ ID NO: 56138 - protein, 9 aa, Homo Sapiens
DNIPSGRSS

SEQ ID NO: 56139 - protein, 9 aa, Homo Sapiens
GDELMCVDG

SEQ ID NO: 56140 - protein, 9 aa, Homo Sapiens
HSPVDLIKV

SEQ ID NO: 56141 - protein, 9 aa, Homo Sapiens
INARARTGK

SEQ ID NO: 56142 - protein, 9 aa, Homo Sapiens
NPQTFKFDR

SEQ ID NO: 56143 - protein, 9 aa, Homo Sapiens
FSVTTSQGL

SEQ ID NO: 56144 - protein, 9 aa, Homo Sapiens
ESKLHSLDH

SEQ ID NO: 56145 - protein, 9 aa, Homo Sapiens
DFIPGVAIP

SEQ ID NO: 56146 - protein, 9 aa, Homo Sapiens
PGVAIPANI

SEQ ID NO: 56147 - protein, 9 aa, Homo Sapiens
GIPCCPEHL

SEQ ID NO: 56148 - protein, 9 aa, Homo Sapiens
DRLKLERKH

SEQ ID NO: 56149 - protein, 9 aa, Homo Sapiens
LENNADPNL

SEQ ID NO: 56150 - protein, 9 aa, Homo Sapiens
TPSLVYMAH

SEQ ID NO: 56151 - protein, 9 aa, Homo Sapiens
CCPEHLKRL

SEQ ID NO: 56152 - protein, 9 aa, Homo Sapiens
RGPQGNQAI

SEQ ID NO: 56153 - protein, 9 aa, Homo Sapiens
EKEKKTRKA

SEQ ID NO: 56154 - protein, 9 aa, Homo Sapiens
DNGSESHPH

SEQ ID NO: 56155 - protein, 9 aa, Homo Sapiens
ENKDTIQNG

SEQ ID NO: 56156 - protein, 9 aa, Homo Sapiens
SNLRESILR

SEQ ID NO: 56157 - protein, 9 aa, Homo Sapiens
LQKKTNDLR

SEQ ID NO: 56158 - protein, 9 aa, Homo Sapiens
MISECTEQT

SEQ ID NO: 56159 - protein, 9 aa, Homo Sapiens
CAGQNSSRD

SEQ ID NO: 56160 - protein, 9 aa, Homo Sapiens
TGLFPNDEG

SEQ ID NO: 56161 - protein, 9 aa, Homo Sapiens
PSYQDQDDM

SEQ ID NO: 56162 - protein, 9 aa, Homo Sapiens
TQPLFSGKK

SEQ ID NO: 56163 - protein, 9 aa, Homo Sapiens
RFGIPCCPE

SEQ ID NO: 56164 - protein, 9 aa, Homo Sapiens
THAAGPDSR

SEQ ID NO: 56165 - protein, 9 aa, Homo Sapiens
EVIGDYCGK

SEQ ID NO: 56166 - protein, 9 aa, Homo Sapiens
ITEKEKKTR

SEQ ID NO: 56167 - protein, 9 aa, Homo Sapiens
KDKTQIYIM

SEQ ID NO: 56168 - protein, 9 aa, Homo Sapiens
ARAVLCDSP

SEQ ID NO: 56169 - protein, 9 aa, Homo Sapiens
LHHSTEKDI

SEQ ID NO: 56170 - protein, 9 aa, Homo Sapiens
EKKTSGETN

SEQ ID NO: 56171 - protein, 9 aa, Homo Sapiens
QTSLEQFNV

SEQ ID NO: 56172 - protein, 9 aa, Homo Sapiens
VISPINARA

SEQ ID NO: 56173 - protein, 9 aa, Homo Sapiens
FSPSHVATE

SEQ ID NO: 56174 - protein, 9 aa, Homo Sapiens
YMAHAMHTV

SEQ ID NO: 56175 - protein, 9 aa, Homo Sapiens
LFSGKKVIA

SEQ ID NO: 56176 - protein, 9 aa, Homo Sapiens
DLFTENENK

SEQ ID NO: 56177 - protein, 9 aa, Homo Sapiens
GTQPGVSTH

SEQ ID NO: 56178 - protein, 9 aa, Homo Sapiens
LLSIKNPLY

SEQ ID NO: 56179 - protein, 9 aa, Homo Sapiens
QGFTASLFL

SEQ ID NO: 56180 - protein, 9 aa, Homo Sapiens
AGPDYCDIE

SEQ ID NO: 56181 - protein, 9 aa, Homo Sapiens
NKDTIQNGN

SEQ ID NO: 56182 - protein, 9 aa, Homo Sapiens
ETKQELEEN

SEQ ID NO: 56183 - protein, 9 aa, Homo Sapiens
DSTPPPPPP

SEQ ID NO: 56184 - protein, 9 aa, Homo Sapiens
GEEHTVTHP

SEQ ID NO: 56185 - protein, 9 aa, Homo Sapiens
QFDSDGLRG

SEQ ID NO: 56186 - protein, 9 aa, Homo Sapiens
EVSQAEETG

SEQ ID NO: 56187 - protein, 9 aa, Homo Sapiens
KMYRLNCCC

SEQ ID NO: 56188 - protein, 9 aa, Homo Sapiens
QTLTMTNVA

SEQ ID NO: 56189 - protein, 9 aa, Homo Sapiens
GSPGFKGIH

SEQ ID NO: 56190 - protein, 9 aa, Homo Sapiens
RKHRRMCRR

SEQ ID NO: 56191 - protein, 9 aa, Homo Sapiens
WLYQSVKLI

SEQ ID NO: 56192 - protein, 9 aa, Homo Sapiens
NCKEAINVL

SEQ ID NO: 56193 - protein, 9 aa, Homo Sapiens
ITIHRKSEL

SEQ ID NO: 56194 - protein, 9 aa, Homo Sapiens
SDNERTTEG

SEQ ID NO: 56195 - protein, 9 aa, Homo Sapiens
QGLPMSWGP

SEQ ID NO: 56196 - protein, 9 aa, Homo Sapiens
GEKSNKEGQ

SEQ ID NO: 56197 - protein, 9 aa, Homo Sapiens
EKSNKEGQA

SEQ ID NO: 56198 - protein, 9 aa, Homo Sapiens
SLERSPVPS

SEQ ID NO: 56199 - protein, 9 aa, Homo Sapiens
STPLGCYNK

SEQ ID NO: 56200 - protein, 9 aa, Homo Sapiens
MNVMLENYR

SEQ ID NO: 56201 - protein, 9 aa, Homo Sapiens
LQTQPLFSG

SEQ ID NO: 56202 - protein, 9 aa, Homo Sapiens
ANMFYIVNI

SEQ ID NO: 56203 - protein, 9 aa, Homo Sapiens
PINARARTG

SEQ ID NO: 56204 - protein, 9 aa, Homo Sapiens
TPNEYTWPG

SEQ ID NO: 56205 - protein, 9 aa, Homo Sapiens
SREDSCTKF

SEQ ID NO: 56206 - protein, 9 aa, Homo Sapiens
DGDNVRVSS

SEQ ID NO: 56207 - protein, 9 aa, Homo Sapiens
KTNYQSFHF

SEQ ID NO: 56208 - protein, 9 aa, Homo Sapiens
ADPPHAIPN

SEQ ID NO: 56209 - protein, 9 aa, Homo Sapiens
KEQFDSDGL

SEQ ID NO: 56210 - protein, 9 aa, Homo Sapiens
LVLKFSSQG

SEQ ID NO: 56211 - protein, 9 aa, Homo Sapiens
VSNLRESIL

SEQ ID NO: 56212 - protein, 9 aa, Homo Sapiens
MFYIVNIMA

SEQ ID NO: 56213 - protein, 9 aa, Homo Sapiens
AFQILVTIA

SEQ ID NO: 56214 - protein, 9 aa, Homo Sapiens
CILLKHKVV

SEQ ID NO: 56215 - protein, 9 aa, Homo Sapiens
VKHGGDLFT

SEQ ID NO: 56216 - protein, 9 aa, Homo Sapiens
STSNPWICV

SEQ ID NO: 56217 - protein, 9 aa, Homo Sapiens
LTPKCGGQS

SEQ ID NO: 56218 - protein, 9 aa, Homo Sapiens
LDKQDMLKE

SEQ ID NO: 56219 - protein, 9 aa, Homo Sapiens
EFSYPKNES

SEQ ID NO: 56220 - protein, 9 aa, Homo Sapiens
LNQKQDMEI

SEQ ID NO: 56221 - protein, 9 aa, Homo Sapiens
EEFALRDQK

SEQ ID NO: 56222 - protein, 9 aa, Homo Sapiens
NVLSHLPSH

SEQ ID NO: 56223 - protein, 9 aa, Homo Sapiens
FALRDQKKY

SEQ ID NO: 56224 - protein, 9 aa, Homo Sapiens
WDKDKTQIY

SEQ ID NO: 56225 - protein, 9 aa, Homo Sapiens
AIPANIIHE

SEQ ID NO: 56226 - protein, 9 aa, Homo Sapiens
SKTNYQSFH

SEQ ID NO: 56227 - protein, 9 aa, Homo Sapiens
FGIWKGHLG

SEQ ID NO: 56228 - protein, 9 aa, Homo Sapiens
GETNNQVNG

SEQ ID NO: 56229 - protein, 9 aa, Homo Sapiens
HGIIYIGKR

SEQ ID NO: 56230 - protein, 9 aa, Homo Sapiens
VKLIYSIGI

SEQ ID NO: 56231 - protein, 9 aa, Homo Sapiens
EIEKLIKQV

SEQ ID NO: 56232 - protein, 9 aa, Homo Sapiens
LVILSYTII

SEQ ID NO: 56233 - protein, 9 aa, Homo Sapiens
VLSHLPSHH

SEQ ID NO: 56234 - protein, 9 aa, Homo Sapiens
GLYIGSSLE

SEQ ID NO: 56235 - protein, 9 aa, Homo Sapiens
QRQICWRCW

SEQ ID NO: 56236 - protein, 9 aa, Homo Sapiens
KTTKVSFSV

SEQ ID NO: 56237 - protein, 9 aa, Homo Sapiens
DLVLKFSSQ

SEQ ID NO: 56238 - protein, 9 aa, Homo Sapiens
NAISTSNPW

SEQ ID NO: 56239 - protein, 9 aa, Homo Sapiens
TENENKDTP

SEQ ID NO: 56240 - protein, 9 aa, Homo Sapiens
MPEKVKKRI

SEQ ID NO: 56241 - protein, 9 aa, Homo Sapiens
ELEQTKNKL

SEQ ID NO: 56242 - protein, 9 aa, Homo Sapiens
KRASLGVAF

SEQ ID NO: 56243 - protein, 9 aa, Homo Sapiens
SGETNNQVN

SEQ ID NO: 56244 - protein, 9 aa, Homo Sapiens
DPPHAIPNS

SEQ ID NO: 56245 - protein, 9 aa, Homo Sapiens
GEIEALSMA

SEQ ID NO: 56246 - protein, 9 aa, Homo Sapiens
KEKIKKTNN

SEQ ID NO: 56247 - protein, 9 aa, Homo Sapiens
QDTSLTEND

SEQ ID NO: 56248 - protein, 9 aa, Homo Sapiens
YHRADVGKV

SEQ ID NO: 56249 - protein, 9 aa, Homo Sapiens
RLKLERKHR

SEQ ID NO: 56250 - protein, 9 aa, Homo Sapiens
NKLVSLPKI

SEQ ID NO: 56251 - protein, 9 aa, Homo Sapiens
VIGDYCGKE

SEQ ID NO: 56252 - protein, 9 aa, Homo Sapiens
KLFQGSPEP

SEQ ID NO: 56253 - protein, 9 aa, Homo Sapiens
SVLYPGCDI

SEQ ID NO: 56254 - protein, 9 aa, Homo Sapiens
EKKRTAAIA

SEQ ID NO: 56255 - protein, 9 aa, Homo Sapiens
EYTWPGVHS

SEQ ID NO: 56256 - protein, 9 aa, Homo Sapiens
GQDLVLQGT

SEQ ID NO: 56257 - protein, 9 aa, Homo Sapiens
HEPGFFPKL

SEQ ID NO: 56258 - protein, 9 aa, Homo Sapiens
IFRKVQKSI

SEQ ID NO: 56259 - protein, 9 aa, Homo Sapiens
NIPSGRSSV

SEQ ID NO: 56260 - protein, 9 aa, Homo Sapiens
PQGNQAILS

SEQ ID NO: 56261 - protein, 9 aa, Homo Sapiens
KSNKEGQAD

SEQ ID NO: 56262 - protein, 9 aa, Homo Sapiens
FFACFPAAN

SEQ ID NO: 56263 - protein, 9 aa, Homo Sapiens
KECRNTMLG

SEQ ID NO: 56264 - protein, 9 aa, Homo Sapiens
MFDNGGTVF

SEQ ID NO: 56265 - protein, 9 aa, Homo Sapiens
IQRQICWRC

SEQ ID NO: 56266 - protein, 9 aa, Homo Sapiens
LGCYNKLIE

SEQ ID NO: 56267 - protein, 9 aa, Homo Sapiens
IHGMPGTPG

SEQ ID NO: 56268 - protein, 9 aa, Homo Sapiens
VSQAEETGP

SEQ ID NO: 56269 - protein, 9 aa, Homo Sapiens
SDNAEPNCA

SEQ ID NO: 56270 - protein, 9 aa, Homo Sapiens
NNADPNLQD

SEQ ID NO: 56271 - protein, 9 aa, Homo Sapiens
PYTFFACFP

SEQ ID NO: 56272 - protein, 9 aa, Homo Sapiens
MAHAMHTVR

SEQ ID NO: 56273 - protein, 9 aa, Homo Sapiens
TIPISLSEK

SEQ ID NO: 56274 - protein, 9 aa, Homo Sapiens
DGDGQGFTA

SEQ ID NO: 56275 - protein, 9 aa, Homo Sapiens
TEKEKKTRK

SEQ ID NO: 56276 - protein, 9 aa, Homo Sapiens
ESSVSHLCP

SEQ ID NO: 56277 - protein, 9 aa, Homo Sapiens
VILSYTIII

SEQ ID NO: 56278 - protein, 9 aa, Homo Sapiens
RASGVSWRS

SEQ ID NO: 56279 - protein, 9 aa, Homo Sapiens
ALRDQKKYL

SEQ ID NO: 56280 - protein, 9 aa, Homo Sapiens
LIKQVTESS

SEQ ID NO: 56281 - protein, 9 aa, Homo Sapiens
SEGCKLFYK

SEQ ID NO: 56282 - protein, 9 aa, Homo Sapiens
GKSCMNPQT

SEQ ID NO: 56283 - protein, 9 aa, Homo Sapiens
TLTMTNVAA

SEQ ID NO: 56284 - protein, 9 aa, Homo Sapiens
IENVEELFN

SEQ ID NO: 56285 - protein, 9 aa, Homo Sapiens
WKGHLGALT

SEQ ID NO: 56286 - protein, 9 aa, Homo Sapiens
RATASWVLG

SEQ ID NO: 56287 - protein, 9 aa, Homo Sapiens
RCWTCTRPL

SEQ ID NO: 56288 - protein, 9 aa, Homo Sapiens
VCAGQNSSR

SEQ ID NO: 56289 - protein, 9 aa, Homo Sapiens
YCDIENVEE

SEQ ID NO: 56290 - protein, 9 aa, Homo Sapiens
YCGKEGRFE

SEQ ID NO: 56291 - protein, 9 aa, Homo Sapiens
VLYLHHSTE

SEQ ID NO: 56292 - protein, 9 aa, Homo Sapiens
KRSLRKQRF

SEQ ID NO: 56293 - protein, 9 aa, Homo Sapiens
NAEPNCAVL

SEQ ID NO: 56294 - protein, 9 aa, Homo Sapiens
EKMYRLNCC

SEQ ID NO: 56295 - protein, 9 aa, Homo Sapiens
SVKLIYSIG

SEQ ID NO: 56296 - protein, 9 aa, Homo Sapiens
PPPPPASIP

SEQ ID NO: 56297 - protein, 9 aa, Homo Sapiens
QFNVLEMEV

SEQ ID NO: 56298 - protein, 9 aa, Homo Sapiens
QTFKFDRPA

SEQ ID NO: 56299 - protein, 9 aa, Homo Sapiens
STPATLFVV

SEQ ID NO: 56300 - protein, 9 aa, Homo Sapiens
VGKVLRRWV

SEQ ID NO: 56301 - protein, 9 aa, Homo Sapiens
GGDLFTENE

SEQ ID NO: 56302 - protein, 9 aa, Homo Sapiens
VLKFSSQGQ

SEQ ID NO: 56303 - protein, 9 aa, Homo Sapiens
QCGEIEALS

SEQ ID NO: 56304 - protein, 9 aa, Homo Sapiens
KGELEQTKN

SEQ ID NO: 56305 - protein, 9 aa, Homo Sapiens
VHEKSKRKS

SEQ ID NO: 56306 - protein, 9 aa, Homo Sapiens
LRDQKKYLY

SEQ ID NO: 56307 - protein, 9 aa, Homo Sapiens
RTDLFSEPR

SEQ ID NO: 56308 - protein, 9 aa, Homo Sapiens
TASWVLGAR

SEQ ID NO: 56309 - protein, 9 aa, Homo Sapiens
SIELAFFAS

SEQ ID NO: 56310 - protein, 9 aa, Homo Sapiens
VLGTPNEYT

SEQ ID NO: 56311 - protein, 9 aa, Homo Sapiens
KQQQKEQFD

SEQ ID NO: 56312 - protein, 9 aa, Homo Sapiens
LNCCCTELQ

SEQ ID NO: 56313 - protein, 9 aa, Homo Sapiens
DQKKYLYRY

SEQ ID NO: 56314 - protein, 9 aa, Homo Sapiens
LSIKNPLYP

SEQ ID NO: 56315 - protein, 9 aa, Homo Sapiens
RNKNFNPHL

SEQ ID NO: 56316 - protein, 9 aa, Homo Sapiens
EVHEKSKRK

SEQ ID NO: 56317 - protein, 9 aa, Homo Sapiens
LYDGREHSA

SEQ ID NO: 56318 - protein, 9 aa, Homo Sapiens
YYSSYLLKN

SEQ ID NO: 56319 - protein, 9 aa, Homo Sapiens
KVRQQPSEY

SEQ ID NO: 56320 - protein, 9 aa, Homo Sapiens
TMTNVAATQ

SEQ ID NO: 56321 - protein, 9 aa, Homo Sapiens
KQDMEIAEL

SEQ ID NO: 56322 - protein, 9 aa, Homo Sapiens
DDGENKDTI

SEQ ID NO: 56323 - protein, 9 aa, Homo Sapiens
TEMISECTE

SEQ ID NO: 56324 - protein, 9 aa, Homo Sapiens
IMFGIKTEA

SEQ ID NO: 56325 - protein, 9 aa, Homo Sapiens
GFTASLFLA

SEQ ID NO: 56326 - protein, 9 aa, Homo Sapiens
FEVRVCACT

SEQ ID NO: 56327 - protein, 9 aa, Homo Sapiens
AKTCMIANF

SEQ ID NO: 56328 - protein, 9 aa, Homo Sapiens
RRASGVSWR

SEQ ID NO: 56329 - protein, 9 aa, Homo Sapiens
IANFSPSHV

SEQ ID NO: 56330 - protein, 9 aa, Homo Sapiens
HHNDLVLKF

SEQ ID NO: 56331 - protein, 9 aa, Homo Sapiens
ECRNTMLGH

SEQ ID NO: 56332 - protein, 9 aa, Homo Sapiens
ICWRCWTCT

SEQ ID NO: 56333 - protein, 9 aa, Homo Sapiens
RYNRKREFS

SEQ ID NO: 56334 - protein, 9 aa, Homo Sapiens
TLYNFVSNL

SEQ ID NO: 56335 - protein, 9 aa, Homo Sapiens
LLLSIKNPL

SEQ ID NO: 56336 - protein, 9 aa, Homo Sapiens
TCMIANFSP

SEQ ID NO: 56337 - protein, 9 aa, Homo Sapiens
GDSTPPPPP

SEQ ID NO: 56338 - protein, 9 aa, Homo Sapiens
PNCAVLQVN

SEQ ID NO: 56339 - protein, 9 aa, Homo Sapiens
SSSDTGLFP

SEQ ID NO: 56340 - protein, 9 aa, Homo Sapiens
SLPKINLTA

SEQ ID NO: 56341 - protein, 9 aa, Homo Sapiens
MIISIYYFK

SEQ ID NO: 56342 - protein, 9 aa, Homo Sapiens
EHLKRLLIV

SEQ ID NO: 56343 - protein, 9 aa, Homo Sapiens
DTSLTENDD

SEQ ID NO: 56344 - protein, 9 aa, Homo Sapiens
PEHLKRLLI

SEQ ID NO: 56345 - protein, 9 aa, Homo Sapiens
LEQTKNKLE

SEQ ID NO: 56346 - protein, 9 aa, Homo Sapiens
PVDLIKVDL

SEQ ID NO: 56347 - protein, 9 aa, Homo Sapiens
HHSTEKDIC

SEQ ID NO: 56348 - protein, 9 aa, Homo Sapiens
SWVLGARTP

SEQ ID NO: 56349 - protein, 9 aa, Homo Sapiens
LVSLPKINL

SEQ ID NO: 56350 - protein, 9 aa, Homo Sapiens
LLTFFFLRN

SEQ ID NO: 56351 - protein, 9 aa, Homo Sapiens
GYGCESKLH

SEQ ID NO: 56352 - protein, 9 aa, Homo Sapiens
DYCDIENVE

SEQ ID NO: 56353 - protein, 9 aa, Homo Sapiens
VQKSIEVPQ

SEQ ID NO: 56354 - protein, 9 aa, Homo Sapiens
LEERNKNFN

SEQ ID NO: 56355 - protein, 9 aa, Homo Sapiens
ILEERNKNF

SEQ ID NO: 56356 - protein, 9 aa, Homo Sapiens
ILDKQDMLK

SEQ ID NO: 56357 - protein, 9 aa, Homo Sapiens
SYQDQDDMA

SEQ ID NO: 56358 - protein, 9 aa, Homo Sapiens
VTPPVPTLP

SEQ ID NO: 56359 - protein, 9 aa, Homo Sapiens
KSIEVPQAK

SEQ ID NO: 56360 - protein, 9 aa, Homo Sapiens
TKASLLSVA

SEQ ID NO: 56361 - protein, 9 aa, Homo Sapiens
LSGNKLVSL

SEQ ID NO: 56362 - protein, 9 aa, Homo Sapiens
KKSQPSMYK

SEQ ID NO: 56363 - protein, 9 aa, Homo Sapiens
KCCSPTEQK

SEQ ID NO: 56364 - protein, 9 aa, Homo Sapiens
PGILMSIKL

SEQ ID NO: 56365 - protein, 9 aa, Homo Sapiens
SWRSPSTCG

SEQ ID NO: 56366 - protein, 9 aa, Homo Sapiens
SLVLQTQPL

SEQ ID NO: 56367 - protein, 9 aa, Homo Sapiens
SAGPDYCDI

SEQ ID NO: 56368 - protein, 9 aa, Homo Sapiens
LYNFVSNLR

SEQ ID NO: 56369 - protein, 9 aa, Homo Sapiens
IKQVTESSH

SEQ ID NO: 56370 - protein, 9 aa, Homo Sapiens
PFNQNKNRF

SEQ ID NO: 56371 - protein, 9 aa, Homo Sapiens
TKNKLEQAQ

SEQ ID NO: 56372 - protein, 9 aa, Homo Sapiens
WSPVVCVDL

SEQ ID NO: 56373 - protein, 9 aa, Homo Sapiens
GTPNEYTWP

SEQ ID NO: 56374 - protein, 9 aa, Homo Sapiens
GSMHNTSQD

SEQ ID NO: 56375 - protein, 9 aa, Homo Sapiens
LAISITRYE

SEQ ID NO: 56376 - protein, 9 aa, Homo Sapiens
CESKLHSLD

SEQ ID NO: 56377 - protein, 9 aa, Homo Sapiens
PAGASQSDS

SEQ ID NO: 56378 - protein, 9 aa, Homo Sapiens
TKVSFSVTT

SEQ ID NO: 56379 - protein, 9 aa, Homo Sapiens
NRFVDILPY

SEQ ID NO: 56380 - protein, 9 aa, Homo Sapiens
KKTRKAIVA

SEQ ID NO: 56381 - protein, 9 aa, Homo Sapiens
EAFLDGTLL

SEQ ID NO: 56382 - protein, 9 aa, Homo Sapiens
GELTQDTSL

SEQ ID NO: 56383 - protein, 9 aa, Homo Sapiens
KNRFVDILP

SEQ ID NO: 56384 - protein, 9 aa, Homo Sapiens
YTIIIRTIL

SEQ ID NO: 56385 - protein, 9 aa, Homo Sapiens
WNLLPAGAS

SEQ ID NO: 56386 - protein, 9 aa, Homo Sapiens
LPAGASQSD

SEQ ID NO: 56387 - protein, 9 aa, Homo Sapiens
CWRCWTCTR

SEQ ID NO: 56388 - protein, 9 aa, Homo Sapiens
EQTKNKLEQ

SEQ ID NO: 56389 - protein, 9 aa, Homo Sapiens
CRNTMLGHT

SEQ ID NO: 56390 - protein, 9 aa, Homo Sapiens
HRKSELAVN

SEQ ID NO: 56391 - protein, 9 aa, Homo Sapiens
SITRYESSS

SEQ ID NO: 56392 - protein, 9 aa, Homo Sapiens
IKTEAEFFE

SEQ ID NO: 56393 - protein, 9 aa, Homo Sapiens
PPPPASIPQ

SEQ ID NO: 56394 - protein, 9 aa, Homo Sapiens
AGQNSSRDV

SEQ ID NO: 56395 - protein, 9 aa, Homo Sapiens
FGIPCCPEH

SEQ ID NO: 56396 - protein, 9 aa, Homo Sapiens
KNFNPHLTG

SEQ ID NO: 56397 - protein, 9 aa, Homo Sapiens
GSTADPPHA

SEQ ID NO: 56398 - protein, 9 aa, Homo Sapiens
QPSEYQDKE

SEQ ID NO: 56399 - protein, 9 aa, Homo Sapiens
TQEVIGDYC

SEQ ID NO: 56400 - protein, 9 aa, Homo Sapiens
DKQDMLKER

SEQ ID NO: 56401 - protein, 9 aa, Homo Sapiens
LYLHHSTEK

SEQ ID NO: 56402 - protein, 9 aa, Homo Sapiens
GSTPLGCYN

SEQ ID NO: 56403 - protein, 9 aa, Homo Sapiens
NIMAIVLLS

SEQ ID NO: 56404 - protein, 9 aa, Homo Sapiens
VKISMPSYQ

SEQ ID NO: 56405 - protein, 9 aa, Homo Sapiens
RSPSTCGTQ

SEQ ID NO: 56406 - protein, 9 aa, Homo Sapiens
MLGHTNSVN

SEQ ID NO: 56407 - protein, 9 aa, Homo Sapiens
FQGSPEPIE

SEQ ID NO: 56408 - protein, 9 aa, Homo Sapiens
HAHPQCKIL

SEQ ID NO: 56409 - protein, 9 aa, Homo Sapiens
TQIYIMPDT

SEQ ID NO: 56410 - protein, 9 aa, Homo Sapiens
KDGDGQGFT

SEQ ID NO: 56411 - protein, 9 aa, Homo Sapiens
VAATQPGTT

SEQ ID NO: 56412 - protein, 9 aa, Homo Sapiens
IRYKYTNIS

SEQ ID NO: 56413 - protein, 9 aa, Homo Sapiens
LAFFASCLS

SEQ ID NO: 56414 - protein, 9 aa, Homo Sapiens
VLQGTQMQP

SEQ ID NO: 56415 - protein, 9 aa, Homo Sapiens
ELDGDNVRV

SEQ ID NO: 56416 - protein, 9 aa, Homo Sapiens
VCMELYKPN

SEQ ID NO: 56417 - protein, 9 aa, Homo Sapiens
AISTSNPWI

SEQ ID NO: 56418 - protein, 9 aa, Homo Sapiens
FPAANPGYA

SEQ ID NO: 56419 - protein, 9 aa, Homo Sapiens
VPGILMSIK

SEQ ID NO: 56420 - protein, 9 aa, Homo Sapiens
SQGLPMSWG

SEQ ID NO: 56421 - protein, 9 aa, Homo Sapiens
DKDKTQIYI

SEQ ID NO: 56422 - protein, 9 aa, Homo Sapiens
LLAAKTTKV

SEQ ID NO: 56423 - protein, 9 aa, Homo Sapiens
LFPNDEGRQ

SEQ ID NO: 56424 - protein, 9 aa, Homo Sapiens
QTQPLFSGK

SEQ ID NO: 56425 - protein, 9 aa, Homo Sapiens
SEENDIFVS

SEQ ID NO: 56426 - protein, 9 aa, Homo Sapiens
LHGFFFFFS

SEQ ID NO: 56427 - protein, 9 aa, Homo Sapiens
CACTGRDRR

SEQ ID NO: 56428 - protein, 9 aa, Homo Sapiens
QTKNKLEQA

SEQ ID NO: 56429 - protein, 9 aa, Homo Sapiens
MVELDGDNV

SEQ ID NO: 56430 - protein, 9 aa, Homo Sapiens
KQELEENKR

SEQ ID NO: 56431 - protein, 9 aa, Homo Sapiens
SKRKSTRPH

SEQ ID NO: 56432 - protein, 9 aa, Homo Sapiens
QEVIGDYCG

SEQ ID NO: 56433 - protein, 9 aa, Homo Sapiens
PIPVTPPVP

SEQ ID NO: 56434 - protein, 9 aa, Homo Sapiens
DFFWDDGEN

SEQ ID NO: 56435 - protein, 9 aa, Homo Sapiens
SASEEDNIP

SEQ ID NO: 56436 - protein, 9 aa, Homo Sapiens
LLKHKVVLQ

SEQ ID NO: 56437 - protein, 9 aa, Homo Sapiens
IKVDLHFMK

SEQ ID NO: 56438 - protein, 9 aa, Homo Sapiens
KIVEEETKQ

SEQ ID NO: 56439 - protein, 9 aa, Homo Sapiens
FKGIHGMPG

SEQ ID NO: 56440 - protein, 9 aa, Homo Sapiens
LTIPISLSE

SEQ ID NO: 56441 - protein, 9 aa, Homo Sapiens
STPSLVYMA

SEQ ID NO: 56442 - protein, 9 aa, Homo Sapiens
DRLLAAKTT

SEQ ID NO: 56443 - protein, 9 aa, Homo Sapiens
GVAFQILVT

SEQ ID NO: 56444 - protein, 9 aa, Homo Sapiens
YIMPDTPEI

SEQ ID NO: 56445 - protein, 9 aa, Homo Sapiens
SSDTGLFPN

SEQ ID NO: 56446 - protein, 9 aa, Homo Sapiens
MNPQTFKFD

SEQ ID NO: 56447 - protein, 9 aa, Homo Sapiens
TFKFDRPAL

SEQ ID NO: 56448 - protein, 9 aa, Homo Sapiens
SIKNPLYPI

SEQ ID NO: 56449 - protein, 9 aa, Homo Sapiens
QQQKEQFDS

SEQ ID NO: 56450 - protein, 9 aa, Homo Sapiens
NRYITIHRK

SEQ ID NO: 56451 - protein, 9 aa, Homo Sapiens
GPSSPLRAT

SEQ ID NO: 56452 - protein, 9 aa, Homo Sapiens
PSTCGTQPG

SEQ ID NO: 56453 - protein, 9 aa, Homo Sapiens
KSEIKKLFQ

SEQ ID NO: 56454 - protein, 9 aa, Homo Sapiens
PDYCDIENV

SEQ ID NO: 56455 - protein, 9 aa, Homo Sapiens
CYNKLIEYH

SEQ ID NO: 56456 - protein, 9 aa, Homo Sapiens
PPASIPQGA

SEQ ID NO: 56457 - protein, 9 aa, Homo Sapiens
DPNLQDKSG

SEQ ID NO: 56458 - protein, 9 aa, Homo Sapiens
KKTSGETNN

SEQ ID NO: 56459 - protein, 9 aa, Homo Sapiens
KLHSLDHGH

SEQ ID NO: 56460 - protein, 9 aa, Homo Sapiens
QRTDLFSEP

SEQ ID NO: 56461 - protein, 9 aa, Homo Sapiens
KDKCCSPTE

SEQ ID NO: 56462 - protein, 9 aa, Homo Sapiens
LFQGSPEPI

SEQ ID NO: 56463 - protein, 9 aa, Homo Sapiens
LKFSSQGQI

SEQ ID NO: 56464 - protein, 9 aa, Homo Sapiens
PILHSTPVT

SEQ ID NO: 56465 - protein, 9 aa, Homo Sapiens
EEVSQAEET

SEQ ID NO: 56466 - protein, 9 aa, Homo Sapiens
PGFKGIHGM

SEQ ID NO: 56467 - protein, 9 aa, Homo Sapiens
RYITIHRKS

SEQ ID NO: 56468 - protein, 9 aa, Homo Sapiens
SECTEQTLF

SEQ ID NO: 56469 - protein, 9 aa, Homo Sapiens
THTGKKPYQ

SEQ ID NO: 56470 - protein, 9 aa, Homo Sapiens
IELAFFASC

SEQ ID NO: 56471 - protein, 9 aa, Homo Sapiens
LSDNGSESH

SEQ ID NO: 56472 - protein, 9 aa, Homo Sapiens
TSLEQFNVL

SEQ ID NO: 56473 - protein, 9 aa, Homo Sapiens
VELDGDNVR

SEQ ID NO: 56474 - protein, 9 aa, Homo Sapiens
ASCLSSKCI

SEQ ID NO: 56475 - protein, 9 aa, Homo Sapiens
QGTQMQPLP

SEQ ID NO: 56476 - protein, 9 aa, Homo Sapiens
HLGALTADV

SEQ ID NO: 56477 - protein, 9 aa, Homo Sapiens
PWGQDLVLQ

SEQ ID NO: 56478 - protein, 9 aa, Homo Sapiens
FKFNNRTSV

SEQ ID NO: 56479 - protein, 9 aa, Homo Sapiens
YMFDNGGTV

SEQ ID NO: 56480 - protein, 9 aa, Homo Sapiens
KQGEKSNKE

SEQ ID NO: 56481 - protein, 9 aa, Homo Sapiens
LERSPVPSP

SEQ ID NO: 56482 - protein, 9 aa, Homo Sapiens
FLSGNKLVS

SEQ ID NO: 56483 - protein, 9 aa, Homo Sapiens
DLQKKTNDL

SEQ ID NO: 56484 - protein, 9 aa, Homo Sapiens
HRRMCRRDP

SEQ ID NO: 56485 - protein, 9 aa, Homo Sapiens
KVVVPGILM

SEQ ID NO: 56486 - protein, 9 aa, Homo Sapiens
DIENVEELF

SEQ ID NO: 56487 - protein, 9 aa, Homo Sapiens
KQAQELRQY

SEQ ID NO: 56488 - protein, 9 aa, Homo Sapiens
QRRYVYYSS

SEQ ID NO: 56489 - protein, 9 aa, Homo Sapiens
FFWDDGENK

SEQ ID NO: 56490 - protein, 9 aa, Homo Sapiens
HEKSKRKST

SEQ ID NO: 56491 - protein, 9 aa, Homo Sapiens
CSEGCKLFY

SEQ ID NO: 56492 - protein, 9 aa, Homo Sapiens
EGKQQQKEQ

SEQ ID NO: 56493 - protein, 9 aa, Homo Sapiens
AVLCDSPQL

SEQ ID NO: 56494 - protein, 9 aa, Homo Sapiens
WGPSSPLRA

SEQ ID NO: 56495 - protein, 9 aa, Homo Sapiens
TNVAATQPG

SEQ ID NO: 56496 - protein, 9 aa, Homo Sapiens
SGVSWRSPS

SEQ ID NO: 56497 - protein, 9 aa, Homo Sapiens
KEAINVLSH

SEQ ID NO: 56498 - protein, 9 aa, Homo Sapiens
ARARTGKCE

SEQ ID NO: 56499 - protein, 9 aa, Homo Sapiens
DELMCVDGT

SEQ ID NO: 56500 - protein, 9 aa, Homo Sapiens
GKRSLRKQR

SEQ ID NO: 56501 - protein, 9 aa, Homo Sapiens
IEVPQAKAQ

SEQ ID NO: 56502 - protein, 9 aa, Homo Sapiens
HAASTPATL

SEQ ID NO: 56503 - protein, 9 aa, Homo Sapiens
ETNNQVNGT

SEQ ID NO: 56504 - protein, 9 aa, Homo Sapiens
PNEYTWPGV

SEQ ID NO: 56505 - protein, 9 aa, Homo Sapiens
IYYFKQLHT

SEQ ID NO: 56506 - protein, 9 aa, Homo Sapiens
RLNCCCTEL

SEQ ID NO: 56507 - protein, 9 aa, Homo Sapiens
NKEGQADVQ

SEQ ID NO: 56508 - protein, 9 aa, Homo Sapiens
LKQAQELRQ

SEQ ID NO: 56509 - protein, 9 aa, Homo Sapiens
LDGDNVRVS

SEQ ID NO: 56510 - protein, 9 aa, Homo Sapiens
KGHLGALTA

SEQ ID NO: 56511 - protein, 9 aa, Homo Sapiens
GQGKHEPGF

SEQ ID NO: 56512 - protein, 9 aa, Homo Sapiens
LPTTKASLL

SEQ ID NO: 56513 - protein, 9 aa, Homo Sapiens
RRYVYYSSY

SEQ ID NO: 56514 - protein, 9 aa, Homo Sapiens
ISITRYESS

SEQ ID NO: 56515 - protein, 9 aa, Homo Sapiens
TTSQGLPMS

SEQ ID NO: 56516 - protein, 9 aa, Homo Sapiens
CKLFYKQDF

SEQ ID NO: 56517 - protein, 9 aa, Homo Sapiens
KKYLYRYPG

SEQ ID NO: 56518 - protein, 9 aa, Homo Sapiens
QGNQAILSS

SEQ ID NO: 56519 - protein, 9 aa, Homo Sapiens
KTEAEFFEL

SEQ ID NO: 56520 - protein, 9 aa, Homo Sapiens
LTCILLKHK

SEQ ID NO: 56521 - protein, 9 aa, Homo Sapiens
GILMSIKLH

SEQ ID NO: 56522 - protein, 9 aa, Homo Sapiens
FIPGVAIPA

SEQ ID NO: 56523 - protein, 9 aa, Homo Sapiens
GVSWRSPST

SEQ ID NO: 56524 - protein, 9 aa, Homo Sapiens
EQFDSDGLR

SEQ ID NO: 56525 - protein, 9 aa, Homo Sapiens
LHSTPVTPP

SEQ ID NO: 56526 - protein, 9 aa, Homo Sapiens
NRKREFSYP

SEQ ID NO: 56527 - protein, 9 aa, Homo Sapiens
LDICQQEIE

SEQ ID NO: 56528 - protein, 9 aa, Homo Sapiens
KEEIEKLIK

SEQ ID NO: 56529 - protein, 9 aa, Homo Sapiens
INLEQCGEI

SEQ ID NO: 56530 - protein, 9 aa, Homo Sapiens
SNAISTSNP

SEQ ID NO: 56531 - protein, 9 aa, Homo Sapiens
ADVGKVLRR

SEQ ID NO: 56532 - protein, 9 aa, Homo Sapiens
TKQELEENK

SEQ ID NO: 56533 - protein, 9 aa, Homo Sapiens
TCILLKHKV

SEQ ID NO: 56534 - protein, 9 aa, Homo Sapiens
QELRQYKVL

SEQ ID NO: 56535 - protein, 9 aa, Homo Sapiens
EENDIFVST

SEQ ID NO: 56536 - protein, 9 aa, Homo Sapiens
VCVDLTPKC

SEQ ID NO: 56537 - protein, 9 aa, Homo Sapiens
EDLQKKTND

SEQ ID NO: 56538 - protein, 9 aa, Homo Sapiens
GALTADVKE

SEQ ID NO: 56539 - protein, 9 aa, Homo Sapiens
KSQPSMYKQ

SEQ ID NO: 56540 - protein, 9 aa, Homo Sapiens
MYKQLRDIA

SEQ ID NO: 56541 - protein, 9 aa, Homo Sapiens
HKIQRQICW

SEQ ID NO: 56542 - protein, 9 aa, Homo Sapiens
ICQQEIESS

SEQ ID NO: 56543 - protein, 9 aa, Homo Sapiens
VSFSVTTSQ

SEQ ID NO: 56544 - protein, 9 aa, Homo Sapiens
GHSMKQDMA

SEQ ID NO: 56545 - protein, 9 aa, Homo Sapiens
DEKIRYKYT

SEQ ID NO: 56546 - protein, 9 aa, Homo Sapiens
KNIFHAAST

SEQ ID NO: 56547 - protein, 9 aa, Homo Sapiens
DSCAVCMEL

SEQ ID NO: 56548 - protein, 9 aa, Homo Sapiens
TRYESSSED

SEQ ID NO: 56549 - protein, 9 aa, Homo Sapiens
RQQITEKEK

SEQ ID NO: 56550 - protein, 9 aa, Homo Sapiens
SLEQFNVLE

SEQ ID NO: 56551 - protein, 9 aa, Homo Sapiens
RDQKKYLYR

SEQ ID NO: 56552 - protein, 9 aa, Homo Sapiens
LHFKFNNRT

SEQ ID NO: 56553 - protein, 9 aa, Homo Sapiens
SYTIIIRTI

SEQ ID NO: 56554 - protein, 9 aa, Homo Sapiens
IFVSTSEDE

SEQ ID NO: 56555 - protein, 9 aa, Homo Sapiens
EKKTRKAIV

SEQ ID NO: 56556 - protein, 9 aa, Homo Sapiens
VLGARTPWG

SEQ ID NO: 56557 - protein, 9 aa, Homo Sapiens
LFYKQDFAR

SEQ ID NO: 56558 - protein, 9 aa, Homo Sapiens
QQPSEYQDK

SEQ ID NO: 56559 - protein, 9 aa, Homo Sapiens
SKILLHFKF

SEQ ID NO: 56560 - protein, 9 aa, Homo Sapiens
AASTPATLF

SEQ ID NO: 56561 - protein, 9 aa, Homo Sapiens
CAVCMELYK

SEQ ID NO: 56562 - protein, 9 aa, Homo Sapiens
QWILDKQDM

SEQ ID NO: 56563 - protein, 9 aa, Homo Sapiens
THPPDRLLA

SEQ ID NO: 56564 - protein, 9 aa, Homo Sapiens
GSESHPHSA

SEQ ID NO: 56565 - protein, 9 aa, Homo Sapiens
YGCESKLHS

SEQ ID NO: 56566 - protein, 9 aa, Homo Sapiens
KKPEVHEKS

SEQ ID NO: 56567 - protein, 9 aa, Homo Sapiens
SPVDLIKVD

SEQ ID NO: 56568 - protein, 9 aa, Homo Sapiens
ACFPAANPG

SEQ ID NO: 56569 - protein, 9 aa, Homo Sapiens
VEEETKQEL

SEQ ID NO: 56570 - protein, 9 aa, Homo Sapiens
HSTPVTPPP

SEQ ID NO: 56571 - protein, 9 aa, Homo Sapiens
VDKGVLGRM

SEQ ID NO: 56572 - protein, 9 aa, Homo Sapiens
GRTHTGKKP

SEQ ID NO: 56573 - protein, 9 aa, Homo Sapiens
QKEQFDSDG

SEQ ID NO: 56574 - protein, 9 aa, Homo Sapiens
EVARAVLCD

SEQ ID NO: 56575 - protein, 9 aa, Homo Sapiens
AINVLSHLP

SEQ ID NO: 56576 - protein, 9 aa, Homo Sapiens
YVYYSSYLL

SEQ ID NO: 56577 - protein, 9 aa, Homo Sapiens
WGQDLVLQG

SEQ ID NO: 56578 - protein, 9 aa, Homo Sapiens
VSTSEDEPE

SEQ ID NO: 56579 - protein, 9 aa, Homo Sapiens
LTRAPILHS

SEQ ID NO: 56580 - protein, 9 aa, Homo Sapiens
YLHHSTEKD

SEQ ID NO: 56581 - protein, 9 aa, Homo Sapiens
DMKIGQGKH

SEQ ID NO: 56582 - protein, 9 aa, Homo Sapiens
TYMFDNGGT

SEQ ID NO: 56583 - protein, 9 aa, Homo Sapiens
QAILSSVPH

SEQ ID NO: 56584 - protein, 9 aa, Homo Sapiens
VLCDSPQLS

SEQ ID NO: 56585 - protein, 9 aa, Homo Sapiens
IGQGKHEPG

SEQ ID NO: 56586 - protein, 9 aa, Homo Sapiens
SSEQMSKTN

SEQ ID NO: 56587 - protein, 9 aa, Homo Sapiens
DEFEKKRTA

SEQ ID NO: 56588 - protein, 9 aa, Homo Sapiens
IISIYYFKQ

SEQ ID NO: 56589 - protein, 9 aa, Homo Sapiens
NKNFNPHLT

SEQ ID NO: 56590 - protein, 9 aa, Homo Sapiens
IKVQTDDGS

SEQ ID NO: 56591 - protein, 9 aa, Homo Sapiens
LAMIISIYY

SEQ ID NO: 56592 - protein, 9 aa, Homo Sapiens
VDLTPKCGG

SEQ ID NO: 56593 - protein, 9 aa, Homo Sapiens
CDIENVEEL

SEQ ID NO: 56594 - protein, 9 aa, Homo Sapiens
AIVCAGQNS

SEQ ID NO: 56595 - protein, 9 aa, Homo Sapiens
LEQCGEIEA

SEQ ID NO: 56596 - protein, 9 aa, Homo Sapiens
KTQIYIMPD

SEQ ID NO: 56597 - protein, 9 aa, Homo Sapiens
HSAYWKLRK

SEQ ID NO: 56598 - protein, 9 aa, Homo Sapiens
YQSVKLIYS

SEQ ID NO: 56599 - protein, 9 aa, Homo Sapiens
EHSAYWKLR

SEQ ID NO: 56600 - protein, 9 aa, Homo Sapiens
SSVSHLCPE

SEQ ID NO: 56601 - protein, 9 aa, Homo Sapiens
KKLFQGSPE

SEQ ID NO: 56602 - protein, 9 aa, Homo Sapiens
YRLNCCCTE

SEQ ID NO: 56603 - protein, 9 aa, Homo Sapiens
YFLHGFFFF

SEQ ID NO: 56604 - protein, 9 aa, Homo Sapiens
GLFPNDEGR

SEQ ID NO: 56605 - protein, 9 aa, Homo Sapiens
KLERKHRRM

SEQ ID NO: 56606 - protein, 9 aa, Homo Sapiens
AKDKCCSPT

SEQ ID NO: 56607 - protein, 9 aa, Homo Sapiens
YFYFLHGFF

SEQ ID NO: 56608 - protein, 9 aa, Homo Sapiens
GIIYIGKRS

SEQ ID NO: 56609 - protein, 9 aa, Homo Sapiens
NFSPSHVAT

SEQ ID NO: 56610 - protein, 9 aa, Homo Sapiens
MSWGPSSPL

SEQ ID NO: 56611 - protein, 9 aa, Homo Sapiens
LYQSVKLIY

SEQ ID NO: 56612 - protein, 9 aa, Homo Sapiens
LMSIKLHQD

SEQ ID NO: 56613 - protein, 9 aa, Homo Sapiens
CMIANFSPS

SEQ ID NO: 56614 - protein, 9 aa, Homo Sapiens
KFFTFRARE

SEQ ID NO: 56615 - protein, 9 aa, Homo Sapiens
NERTTEGTS

SEQ ID NO: 56616 - protein, 9 aa, Homo Sapiens
SPLRATASW

SEQ ID NO: 56617 - protein, 9 aa, Homo Sapiens
LQDKSGKTA

SEQ ID NO: 56618 - protein, 9 aa, Homo Sapiens
SGNKLVSLP

SEQ ID NO: 56619 - protein, 9 aa, Homo Sapiens
LKEEIEKLI

SEQ ID NO: 56620 - protein, 9 aa, Homo Sapiens
DNERTTEGT

SEQ ID NO: 56621 - protein, 9 aa, Homo Sapiens
SEQMSKTNY

SEQ ID NO: 56622 - protein, 9 aa, Homo Sapiens
TCTRPLRRA

SEQ ID NO: 56623 - protein, 9 aa, Homo Sapiens
GEGFQPKRI

SEQ ID NO: 56624 - protein, 9 aa, Homo Sapiens
APRPGSTAD

SEQ ID NO: 56625 - protein, 9 aa, Homo Sapiens
KIQRQICWR

SEQ ID NO: 56626 - protein, 9 aa, Homo Sapiens
NKNRFVDIL

SEQ ID NO: 56627 - protein, 9 aa, Homo Sapiens
KVQKSIEVP

SEQ ID NO: 56628 - protein, 9 aa, Homo Sapiens
RPLRRASGV

SEQ ID NO: 56629 - protein, 9 aa, Homo Sapiens
NLAISITRY

SEQ ID NO: 56630 - protein, 9 aa, Homo Sapiens
CTRPLRRAS

SEQ ID NO: 56631 - protein, 9 aa, Homo Sapiens
LVLQTQPLF

SEQ ID NO: 56632 - protein, 9 aa, Homo Sapiens
QICWRCWTC

SEQ ID NO: 56633 - protein, 9 aa, Homo Sapiens
VTHPQYVAW

SEQ ID NO: 56634 - protein, 9 aa, Homo Sapiens
FSYPKNESF

SEQ ID NO: 56635 - protein, 9 aa, Homo Sapiens
DSDNAEPNC

SEQ ID NO: 56636 - protein, 9 aa, Homo Sapiens
ASWVLGART

SEQ ID NO: 56637 - protein, 9 aa, Homo Sapiens
IPSGRSSVS

SEQ ID NO: 56638 - protein, 9 aa, Homo Sapiens
GIWKGHLGA

SEQ ID NO: 56639 - protein, 9 aa, Homo Sapiens
QNKNRFVDI

SEQ ID NO: 56640 - protein, 9 aa, Homo Sapiens
QPGVSTHPP

SEQ ID NO: 56641 - protein, 9 aa, Homo Sapiens
RIKVQTDDG

SEQ ID NO: 56642 - protein, 9 aa, Homo Sapiens
PDRLLAAKT

SEQ ID NO: 56643 - protein, 9 aa, Homo Sapiens
AVAQTSLEQ

SEQ ID NO: 56644 - protein, 9 aa, Homo Sapiens
VATQKETHA

SEQ ID NO: 56645 - protein, 9 aa, Homo Sapiens
GDLFTENEN

SEQ ID NO: 56646 - protein, 9 aa, Homo Sapiens
HVAIVCAGQ

SEQ ID NO: 56647 - protein, 9 aa, Homo Sapiens
SWGPSSPLR

SEQ ID NO: 56648 - protein, 9 aa, Homo Sapiens
RYVYYSSYL

SEQ ID NO: 56649 - protein, 9 aa, Homo Sapiens
KISMPSYQD

SEQ ID NO: 56650 - protein, 9 aa, Homo Sapiens
EGCKLFYKQ

SEQ ID NO: 56651 - protein, 9 aa, Homo Sapiens
TEKMYRLNC

SEQ ID NO: 56652 - protein, 9 aa, Homo Sapiens
HPHSAAYPF

SEQ ID NO: 56653 - protein, 9 aa, Homo Sapiens
YIGSSLERS

SEQ ID NO: 56654 - protein, 9 aa, Homo Sapiens
AAKTTKVSF

SEQ ID NO: 56655 - protein, 9 aa, Homo Sapiens
GIKTEAEFF

SEQ ID NO: 56656 - protein, 9 aa, Homo Sapiens
ITEYEIKYN

SEQ ID NO: 56657 - protein, 9 aa, Homo Sapiens
LKFKSREDS

SEQ ID NO: 56658 - protein, 9 aa, Homo Sapiens
GREHSAYWK

SEQ ID NO: 56659 - protein, 9 aa, Homo Sapiens
DNAEPNCAV

SEQ ID NO: 56660 - protein, 9 aa, Homo Sapiens
LNGHSMKQD

SEQ ID NO: 56661 - protein, 9 aa, Homo Sapiens
PLVISPINA

SEQ ID NO: 56662 - protein, 9 aa, Homo Sapiens
LTQDTSLTE

SEQ ID NO: 56663 - protein, 9 aa, Homo Sapiens
PGGEGFQPK

SEQ ID NO: 56664 - protein, 9 aa, Homo Sapiens
EEDNIPSGR

SEQ ID NO: 56665 - protein, 9 aa, Homo Sapiens
RQQPSEYQD

SEQ ID NO: 56666 - protein, 9 aa, Homo Sapiens
SLTENDDSD

SEQ ID NO: 56667 - protein, 9 aa, Homo Sapiens
ARTPWGQDL

SEQ ID NO: 56668 - protein, 9 aa, Homo Sapiens
AKVTYMFDN

SEQ ID NO: 56669 - protein, 9 aa, Homo Sapiens
KLNQKQDME

SEQ ID NO: 56670 - protein, 9 aa, Homo Sapiens
ITRYESSSE

SEQ ID NO: 56671 - protein, 9 aa, Homo Sapiens
LILEERNKN

SEQ ID NO: 56672 - protein, 9 aa, Homo Sapiens
KEGQADVQM

SEQ ID NO: 56673 - protein, 9 aa, Homo Sapiens
GHLGALTAD

SEQ ID NO: 56674 - protein, 9 aa, Homo Sapiens
YQDQDDMAE

SEQ ID NO: 56675 - protein, 9 aa, Homo Sapiens
EYADVLYLH

SEQ ID NO: 56676 - protein, 9 aa, Homo Sapiens
GARTPWGQD

SEQ ID NO: 56677 - protein, 9 aa, Homo Sapiens
SAYWKLRKL

SEQ ID NO: 56678 - protein, 9 aa, Homo Sapiens
TSQGLPMSW

SEQ ID NO: 56679 - protein, 9 aa, Homo Sapiens
ERLDICQQE

SEQ ID NO: 56680 - protein, 9 aa, Homo Sapiens
IGKRSLRKQ

SEQ ID NO: 56681 - protein, 9 aa, Homo Sapiens
RLYHRADVG

SEQ ID NO: 56682 - protein, 9 aa, Homo Sapiens
IKYNEKDQR

SEQ ID NO: 56683 - protein, 9 aa, Homo Sapiens
PKRITVILE

SEQ ID NO: 56684 - protein, 9 aa, Homo Sapiens
IYAKVTYMF

SEQ ID NO: 56685 - protein, 9 aa, Homo Sapiens
KHRRMCRRD

SEQ ID NO: 56686 - protein, 9 aa, Homo Sapiens
TFRAREKFE

SEQ ID NO: 56687 - protein, 9 aa, Homo Sapiens
TIIIRTILK

SEQ ID NO: 56688 - protein, 9 aa, Homo Sapiens
KIGQGKHEP

SEQ ID NO: 56689 - protein, 9 aa, Homo Sapiens
GTLLSANEI

SEQ ID NO: 56690 - protein, 9 aa, Homo Sapiens
SKLHSLDHG

SEQ ID NO: 56691 - protein, 9 aa, Homo Sapiens
AISITRYES

SEQ ID NO: 56692 - protein, 9 aa, Homo Sapiens
DLFSEPRPT

SEQ ID NO: 56693 - protein, 9 aa, Homo Sapiens
IPISLSEKR

SEQ ID NO: 56694 - protein, 9 aa, Homo Sapiens
KRTAAIAEV

SEQ ID NO: 56695 - protein, 9 aa, Homo Sapiens
SLGVAFQIL

SEQ ID NO: 56696 - protein, 9 aa, Homo Sapiens
LLEDLQKKT

SEQ ID NO: 56697 - protein, 9 aa, Homo Sapiens
VAIVCAGQN

SEQ ID NO: 56698 - protein, 9 aa, Homo Sapiens
TQPGVSTHP

SEQ ID NO: 56699 - protein, 9 aa, Homo Sapiens
LVAKWLLTF

SEQ ID NO: 56700 - protein, 9 aa, Homo Sapiens
AMVELDGDN

SEQ ID NO: 56701 - protein, 9 aa, Homo Sapiens
STHPPDRLL

SEQ ID NO: 56702 - protein, 9 aa, Homo Sapiens
KTNNRLNSR

SEQ ID NO: 56703 - protein, 9 aa, Homo Sapiens
CDLHKIQRQ

SEQ ID NO: 56704 - protein, 9 aa, Homo Sapiens
EEIEKLIKQ

SEQ ID NO: 56705 - protein, 9 aa, Homo Sapiens
AGASQSDSE

SEQ ID NO: 56706 - protein, 9 aa, Homo Sapiens
CWTCTRPLR

SEQ ID NO: 56707 - protein, 9 aa, Homo Sapiens
EQMSKTNYQ

SEQ ID NO: 56708 - protein, 9 aa, Homo Sapiens
LGALTADVK

SEQ ID NO: 56709 - protein, 9 aa, Homo Sapiens
CGKEGRFEM

SEQ ID NO: 56710 - protein, 9 aa, Homo Sapiens
MSKTNYQSF

SEQ ID NO: 56711 - protein, 9 aa, Homo Sapiens
VAIPANIIH

SEQ ID NO: 56712 - protein, 9 aa, Homo Sapiens
QGKHEPGFF

SEQ ID NO: 56713 - protein, 9 aa, Homo Sapiens
LGRMGISAM

SEQ ID NO: 56714 - protein, 9 aa, Homo Sapiens
WVLGARTPW

SEQ ID NO: 56715 - protein, 9 aa, Homo Sapiens
QMSKTNYQS

SEQ ID NO: 56716 - protein, 9 aa, Homo Sapiens
KHGGDLFTE

SEQ ID NO: 56717 - protein, 9 aa, Homo Sapiens
LLTIPISLS

SEQ ID NO: 56718 - protein, 9 aa, Homo Sapiens
YGKVRQQPS

SEQ ID NO: 56719 - protein, 9 aa, Homo Sapiens
CPEHLKRLL

SEQ ID NO: 56720 - protein, 9 aa, Homo Sapiens
NDEFEKKRT

SEQ ID NO: 56721 - protein, 9 aa, Homo Sapiens
FLDGTLLSA

SEQ ID NO: 56722 - protein, 9 aa, Homo Sapiens
GQNSSRDVI

SEQ ID NO: 56723 - protein, 9 aa, Homo Sapiens
QDMLKERQK

SEQ ID NO: 56724 - protein, 9 aa, Homo Sapiens
MLKERQKDL

SEQ ID NO: 56725 - protein, 9 aa, Homo Sapiens
PMSWGPSSP

SEQ ID NO: 56726 - protein, 9 aa, Homo Sapiens
YEIKYNEKD

SEQ ID NO: 56727 - protein, 9 aa, Homo Sapiens
RAVLCDSPQ

SEQ ID NO: 56728 - protein, 9 aa, Homo Sapiens
NFVSNLRES

SEQ ID NO: 56729 - protein, 9 aa, Homo Sapiens
EKIRYKYTN

SEQ ID NO: 56730 - protein, 9 aa, Homo Sapiens
EILTEMISE

SEQ ID NO: 56731 - protein, 9 aa, Homo Sapiens
FYIVNIMAI

SEQ ID NO: 56732 - protein, 9 aa, Homo Sapiens
PLGCYNKLI

SEQ ID NO: 56733 - protein, 9 aa, Homo Sapiens
VSLPKINLT

SEQ ID NO: 56734 - protein, 9 aa, Homo Sapiens
GKQQQKEQF

SEQ ID NO: 56735 - protein, 9 aa, Homo Sapiens
ASTPATLFV

SEQ ID NO: 56736 - protein, 9 aa, Homo Sapiens
TADPPHAIP

SEQ ID NO: 56737 - protein, 9 aa, Homo Sapiens
RSLRKQRFM

SEQ ID NO: 56738 - protein, 9 aa, Homo Sapiens
CIYAKVTYM

SEQ ID NO: 56739 - protein, 9 aa, Homo Sapiens
AEFFELDVV

SEQ ID NO: 56740 - protein, 9 aa, Homo Sapiens
PGDSTPPPP

SEQ ID NO: 56741 - protein, 9 aa, Homo Sapiens
IKNPLYPIT

SEQ ID NO: 56742 - protein, 9 aa, Homo Sapiens
IPQGAHAAS

SEQ ID NO: 56743 - protein, 9 aa, Homo Sapiens
NQAILSSVP

SEQ ID NO: 56744 - protein, 9 aa, Homo Sapiens
ALSSEQMSK

SEQ ID NO: 56745 - protein, 9 aa, Homo Sapiens
GKVRQQPSE

SEQ ID NO: 56746 - protein, 9 aa, Homo Sapiens
FHQRDIEKK

SEQ ID NO: 56747 - protein, 9 aa, Homo Sapiens
SMPSYQDQD

SEQ ID NO: 56748 - protein, 9 aa, Homo Sapiens
GSLLMVSDN

SEQ ID NO: 56749 - protein, 9 aa, Homo Sapiens
PPIPVTPPV

SEQ ID NO: 56750 - protein, 9 aa, Homo Sapiens
NKLEQAQNE

SEQ ID NO: 56751 - protein, 9 aa, Homo Sapiens
TDLFSEPRP

SEQ ID NO: 56752 - protein, 9 aa, Homo Sapiens
PSIPPIPVT

SEQ ID NO: 56753 - protein, 9 aa, Homo Sapiens
LLMVSDNER

SEQ ID NO: 56754 - protein, 9 aa, Homo Sapiens
ASNNGSMHN

SEQ ID NO: 56755 - protein, 9 aa, Homo Sapiens
EETKQELEE

SEQ ID NO: 56756 - protein, 9 aa, Homo Sapiens
AHAMHTVRM

SEQ ID NO: 56757 - protein, 9 aa, Homo Sapiens
FTENENKDT

SEQ ID NO: 56758 - protein, 9 aa, Homo Sapiens
SGDELMCVD

SEQ ID NO: 56759 - protein, 9 aa, Homo Sapiens
DICQQEIES

SEQ ID NO: 56760 - protein, 9 aa, Homo Sapiens
DMLKERQKD

SEQ ID NO: 56761 - protein, 9 aa, Homo Sapiens
AKWLLTFFF

SEQ ID NO: 56762 - protein, 9 aa, Homo Sapiens
LIYSIGIFF

SEQ ID NO: 56763 - protein, 9 aa, Homo Sapiens
KLVSLPKIN

SEQ ID NO: 56764 - protein, 9 aa, Homo Sapiens
KQDMLKERQ

SEQ ID NO: 56765 - protein, 9 aa, Homo Sapiens
EQFNVLEME

SEQ ID NO: 56766 - protein, 9 aa, Homo Sapiens
FRKVQKSIE

SEQ ID NO: 56767 - protein, 9 aa, Homo Sapiens
HQRDIEKKY

SEQ ID NO: 56768 - protein, 9 aa, Homo Sapiens
VNIMAIVLL

SEQ ID NO: 56769 - protein, 9 aa, Homo Sapiens
MPSYQDQDD

SEQ ID NO: 56770 - protein, 9 aa, Homo Sapiens
KIKKTNNRL

SEQ ID NO: 56771 - protein, 9 aa, Homo Sapiens
LAEQLKQAQ

SEQ ID NO: 56772 - protein, 9 aa, Homo Sapiens
HCNRYITIH

SEQ ID NO: 56773 - protein, 9 aa, Homo Sapiens
KILLHFKFN

SEQ ID NO: 56774 - protein, 9 aa, Homo Sapiens
QKECRNTML

SEQ ID NO: 56775 - protein, 9 aa, Homo Sapiens
KVSFSVTTS

SEQ ID NO: 56776 - protein, 9 aa, Homo Sapiens
YKYTNISCE

SEQ ID NO: 56777 - protein, 9 aa, Homo Sapiens
ACTGRDRRT

SEQ ID NO: 56778 - protein, 9 aa, Homo Sapiens
DNDEFEKKR

SEQ ID NO: 56779 - protein, 9 aa, Homo Sapiens
LSANEIPPL

SEQ ID NO: 56780 - protein, 9 aa, Homo Sapiens
MYRLNCCCT

SEQ ID NO: 56781 - protein, 9 aa, Homo Sapiens
EFALRDQKK

SEQ ID NO: 56782 - protein, 9 aa, Homo Sapiens
EEFFHQRDI

SEQ ID NO: 56783 - protein, 9 aa, Homo Sapiens
REHSAYWKL

SEQ ID NO: 56784 - protein, 9 aa, Homo Sapiens
RLDICQQEI

SEQ ID NO: 56785 - protein, 9 aa, Homo Sapiens
FLHHNDLVL

SEQ ID NO: 56786 - protein, 9 aa, Homo Sapiens
EHSPVDLIK

SEQ ID NO: 56787 - protein, 9 aa, Homo Sapiens
KINLEQCGE

SEQ ID NO: 56788 - protein, 9 aa, Homo Sapiens
KIRYKYTNI

SEQ ID NO: 56789 - protein, 9 aa, Homo Sapiens
AREKFEEDR

SEQ ID NO: 56790 - protein, 9 aa, Homo Sapiens
SSYLLKNHL

SEQ ID NO: 56791 - protein, 9 aa, Homo Sapiens
WRSPSTCGT

SEQ ID NO: 56792 - protein, 9 aa, Homo Sapiens
SLVYMAHAM

SEQ ID NO: 56793 - protein, 9 aa, Homo Sapiens
CVDLTPKCG

SEQ ID NO: 56794 - protein, 9 aa, Homo Sapiens
AKTTKVSFS

SEQ ID NO: 56795 - protein, 9 aa, Homo Sapiens
PSGRSSVSS

SEQ ID NO: 56796 - protein, 9 aa, Homo Sapiens
VSDNERTTE

SEQ ID NO: 56797 - protein, 9 aa, Homo Sapiens
KGIHGMPGT

SEQ ID NO: 56798 - protein, 9 aa, Homo Sapiens
RKREFSYPK

SEQ ID NO: 56799 - protein, 9 aa, Homo Sapiens
DGDSCAVCM

SEQ ID NO: 56800 - protein, 9 aa, Homo Sapiens
LKLERKHRR

SEQ ID NO: 56801 - protein, 9 aa, Homo Sapiens
PLRATASWV

SEQ ID NO: 56802 - protein, 9 aa, Homo Sapiens
FLHGFFFFF

SEQ ID NO: 56803 - protein, 9 aa, Homo Sapiens
STSEDEPES

SEQ ID NO: 56804 - protein, 9 aa, Homo Sapiens
LHGRTHTGK

SEQ ID NO: 56805 - protein, 9 aa, Homo Sapiens
NTMLGHTNS

SEQ ID NO: 56806 - protein, 9 aa, Homo Sapiens
LERKHRRMC

SEQ ID NO: 56807 - protein, 9 aa, Homo Sapiens
VLLLSIKNP

SEQ ID NO: 56808 - protein, 9 aa, Homo Sapiens
CEHSPVDLI

SEQ ID NO: 56809 - protein, 9 aa, Homo Sapiens
LLPAGASQS

SEQ ID NO: 56810 - protein, 9 aa, Homo Sapiens
LIKVDLHFM

SEQ ID NO: 56811 - protein, 9 aa, Homo Sapiens
SEEDNIPSG

SEQ ID NO: 56812 - protein, 9 aa, Homo Sapiens
GENKDTIQN

SEQ ID NO: 56813 - protein, 9 aa, Homo Sapiens
LAAKTTKVS

SEQ ID NO: 56814 - protein, 9 aa, Homo Sapiens
QPKRITVIL

SEQ ID NO: 56815 - protein, 9 aa, Homo Sapiens
PEKVKKRIK

SEQ ID NO: 56816 - protein, 9 aa, Homo Sapiens
YIGKRSLRK

SEQ ID NO: 56817 - protein, 9 aa, Homo Sapiens
STCGTQPGV

SEQ ID NO: 56818 - protein, 9 aa, Homo Sapiens
FGIKTEAEF

SEQ ID NO: 56819 - protein, 9 aa, Homo Sapiens
DLHKIQRQI

SEQ ID NO: 56820 - protein, 9 aa, Homo Sapiens
LIKLNQKQD

SEQ ID NO: 56821 - protein, 9 aa, Homo Sapiens
GNKLVSLPK

SEQ ID NO: 56822 - protein, 9 aa, Homo Sapiens
QGEKSNKEG

SEQ ID NO: 56823 - protein, 9 aa, Homo Sapiens
KKLSNAIST

SEQ ID NO: 56824 - protein, 9 aa, Homo Sapiens
AHPQCKILR

SEQ ID NO: 56825 - protein, 9 aa, Homo Sapiens
LEDLQKKTN

SEQ ID NO: 56826 - protein, 9 aa, Homo Sapiens
THPQYVAWP

SEQ ID NO: 56827 - protein, 9 aa, Homo Sapiens
IVEEETKQE

SEQ ID NO: 56828 - protein, 9 aa, Homo Sapiens
LMCVDGTPV

SEQ ID NO: 56829 - protein, 9 aa, Homo Sapiens
PNDEGRQGD

SEQ ID NO: 56830 - protein, 9 aa, Homo Sapiens
EDNIPSGRS

SEQ ID NO: 56831 - protein, 9 aa, Homo Sapiens
FCSEGCKLF

SEQ ID NO: 56832 - protein, 9 aa, Homo Sapiens
HPQYVAWPD

SEQ ID NO: 56833 - protein, 9 aa, Homo Sapiens
ATASWVLGA

SEQ ID NO: 56834 - protein, 9 aa, Homo Sapiens
CDSPQLSEG

SEQ ID NO: 56835 - protein, 9 aa, Homo Sapiens
KWLLTFFFL

SEQ ID NO: 56836 - protein, 9 aa, Homo Sapiens
PGVSTHPPD

SEQ ID NO: 56837 - protein, 9 aa, Homo Sapiens
SGEPFLRHV

SEQ ID NO: 56838 - protein, 9 aa, Homo Sapiens
IASFTKVFK

SEQ ID NO: 56839 - protein, 9 aa, Homo Sapiens
LGDPMTPTE

SEQ ID NO: 56840 - protein, 9 aa, Homo Sapiens
EPPPQWLCP

SEQ ID NO: 56841 - protein, 9 aa, Homo Sapiens
MPRGQALPA

SEQ ID NO: 56842 - protein, 9 aa, Homo Sapiens
TSSQTSSIV

SEQ ID NO: 56843 - protein, 9 aa, Homo Sapiens
VINVIEPGL

SEQ ID NO: 56844 - protein, 9 aa, Homo Sapiens
PPRAGASGS

SEQ ID NO: 56845 - protein, 9 aa, Homo Sapiens
GDEVIAVVS

SEQ ID NO: 56846 - protein, 9 aa, Homo Sapiens
LQKYKKIKE

SEQ ID NO: 56847 - protein, 9 aa, Homo Sapiens
RNTQFRGVS

SEQ ID NO: 56848 - protein, 9 aa, Homo Sapiens
GIPSRVINN

SEQ ID NO: 56849 - protein, 9 aa, Homo Sapiens
SLRAPSCLD

SEQ ID NO: 56850 - protein, 9 aa, Homo Sapiens
IKEFARAAI

SEQ ID NO: 56851 - protein, 9 aa, Homo Sapiens
LCTSSQTSS

SEQ ID NO: 56852 - protein, 9 aa, Homo Sapiens
SKRKEKLEN

SEQ ID NO: 56853 - protein, 9 aa, Homo Sapiens
GTMMEVKVK

SEQ ID NO: 56854 - protein, 9 aa, Homo Sapiens
LCPGPLQQR

SEQ ID NO: 56855 - protein, 9 aa, Homo Sapiens
RKKLGDPMT

SEQ ID NO: 56856 - protein, 9 aa, Homo Sapiens
FKVGSHEYS

SEQ ID NO: 56857 - protein, 9 aa, Homo Sapiens
DENRQRLLE

SEQ ID NO: 56858 - protein, 9 aa, Homo Sapiens
YTPQFRPTP

SEQ ID NO: 56859 - protein, 9 aa, Homo Sapiens
KKGLINKKM

SEQ ID NO: 56860 - protein, 9 aa, Homo Sapiens
PSCLDAFRD

SEQ ID NO: 56861 - protein, 9 aa, Homo Sapiens
CVLPCLGVH

SEQ ID NO: 56862 - protein, 9 aa, Homo Sapiens
RYMPRAVLV

SEQ ID NO: 56863 - protein, 9 aa, Homo Sapiens
CTGGVVVHP

SEQ ID NO: 56864 - protein, 9 aa, Homo Sapiens
EVVRHCPHH

SEQ ID NO: 56865 - protein, 9 aa, Homo Sapiens
KGLINKKMV

SEQ ID NO: 56866 - protein, 9 aa, Homo Sapiens
HCPHHERCS

SEQ ID NO: 56867 - protein, 9 aa, Homo Sapiens
RRRGHNGMD

SEQ ID NO: 56868 - protein, 9 aa, Homo Sapiens
PQWLCPGPL

SEQ ID NO: 56869 - protein, 9 aa, Homo Sapiens
YDLLRNTQF

SEQ ID NO: 56870 - protein, 9 aa, Homo Sapiens
ESESSSESY

SEQ ID NO: 56871 - protein, 9 aa, Homo Sapiens
HMTEVVRHC

SEQ ID NO: 56872 - protein, 9 aa, Homo Sapiens
AGLSSHAQA

SEQ ID NO: 56873 - protein, 9 aa, Homo Sapiens
NLCHRPEID

SEQ ID NO: 56874 - protein, 9 aa, Homo Sapiens
DDIRYELFL

SEQ ID NO: 56875 - protein, 9 aa, Homo Sapiens
MMEVKVKTE

SEQ ID NO: 56876 - protein, 9 aa, Homo Sapiens
AEQGTMMEV

SEQ ID NO: 56877 - protein, 9 aa, Homo Sapiens
GQALPAPCQ

SEQ ID NO: 56878 - protein, 9 aa, Homo Sapiens
INNFNSAHD

SEQ ID NO: 56879 - protein, 9 aa, Homo Sapiens
LLRNTQFRG

SEQ ID NO: 56880 - protein, 9 aa, Homo Sapiens
RARPVLWVG

SEQ ID NO: 56881 - protein, 9 aa, Homo Sapiens
LRVPLPGAL

SEQ ID NO: 56882 - protein, 9 aa, Homo Sapiens
LKTLGARAW

SEQ ID NO: 56883 - protein, 9 aa, Homo Sapiens
QALPAPCQC

SEQ ID NO: 56884 - protein, 9 aa, Homo Sapiens
KKKNLHGAS

SEQ ID NO: 56885 - protein, 9 aa, Homo Sapiens
LLLRARPVL

SEQ ID NO: 56886 - protein, 9 aa, Homo Sapiens
AEYKVINVI

SEQ ID NO: 56887 - protein, 9 aa, Homo Sapiens
VPLPGALWP

SEQ ID NO: 56888 - protein, 9 aa, Homo Sapiens
SRIIQRLDM

SEQ ID NO: 56889 - protein, 9 aa, Homo Sapiens
EYKVINVIE

SEQ ID NO: 56890 - protein, 9 aa, Homo Sapiens
EHLHLEVHQ

SEQ ID NO: 56891 - protein, 9 aa, Homo Sapiens
IQRLDMVPH

SEQ ID NO: 56892 - protein, 9 aa, Homo Sapiens
QRLLEKCKE

SEQ ID NO: 56893 - protein, 9 aa, Homo Sapiens
RAGASGSEP

SEQ ID NO: 56894 - protein, 9 aa, Homo Sapiens
STVHIMKNR

SEQ ID NO: 56895 - protein, 9 aa, Homo Sapiens
NNFNSAHDT

SEQ ID NO: 56896 - protein, 9 aa, Homo Sapiens
GLSSHAQAH

SEQ ID NO: 56897 - protein, 9 aa, Homo Sapiens
RVFLNNLCH

SEQ ID NO: 56898 - protein, 9 aa, Homo Sapiens
QPKLPSLKT

SEQ ID NO: 56899 - protein, 9 aa, Homo Sapiens
VGVHMYTSS

SEQ ID NO: 56900 - protein, 9 aa, Homo Sapiens
AMPRGQALP

SEQ ID NO: 56901 - protein, 9 aa, Homo Sapiens
SEPPPQWLC

SEQ ID NO: 56902 - protein, 9 aa, Homo Sapiens
YQPMLYRRS

SEQ ID NO: 56903 - protein, 9 aa, Homo Sapiens
GPACGHDHP

SEQ ID NO: 56904 - protein, 9 aa, Homo Sapiens
AGASGSEPP

SEQ ID NO: 56905 - protein, 9 aa, Homo Sapiens
LRARPVLWV

SEQ ID NO: 56906 - protein, 9 aa, Homo Sapiens
NTQFRGVSL

SEQ ID NO: 56907 - protein, 9 aa, Homo Sapiens
INKKMVKRE

SEQ ID NO: 56908 - protein, 9 aa, Homo Sapiens
NGCVLPCLG

SEQ ID NO: 56909 - protein, 9 aa, Homo Sapiens
LKHSHPTDE

SEQ ID NO: 56910 - protein, 9 aa, Homo Sapiens
PQSYRNRTA

SEQ ID NO: 56911 - protein, 9 aa, Homo Sapiens
FSNKEQQVT

SEQ ID NO: 56912 - protein, 9 aa, Homo Sapiens
SEQVLLCTS

SEQ ID NO: 56913 - protein, 9 aa, Homo Sapiens
SCLDAFRDP

SEQ ID NO: 56914 - protein, 9 aa, Homo Sapiens
GEYVGPACG

SEQ ID NO: 56915 - protein, 9 aa, Homo Sapiens
HIMKNRNGG

SEQ ID NO: 56916 - protein, 9 aa, Homo Sapiens
GTRQPKLPS

SEQ ID NO: 56917 - protein, 9 aa, Homo Sapiens
PLQQRPQIW

SEQ ID NO: 56918 - protein, 9 aa, Homo Sapiens
GSKRKEKLE

SEQ ID NO: 56919 - protein, 9 aa, Homo Sapiens
LVAELPGLP

SEQ ID NO: 56920 - protein, 9 aa, Homo Sapiens
IPSRVINNF

SEQ ID NO: 56921 - protein, 9 aa, Homo Sapiens
VGSHEYSYE

SEQ ID NO: 56922 - protein, 9 aa, Homo Sapiens
GTEIRWAEP

SEQ ID NO: 56923 - protein, 9 aa, Homo Sapiens
LLEKCKELM

SEQ ID NO: 56924 - protein, 9 aa, Homo Sapiens
NKKMVKREK

SEQ ID NO: 56925 - protein, 9 aa, Homo Sapiens
VSTVHIMKN

SEQ ID NO: 56926 - protein, 9 aa, Homo Sapiens
YWLYTLRAA

SEQ ID NO: 56927 - protein, 9 aa, Homo Sapiens
ELPGLPTTA

SEQ ID NO: 56928 - protein, 9 aa, Homo Sapiens
KKKAGGGGS

SEQ ID NO: 56929 - protein, 9 aa, Homo Sapiens
AQAHLRDFG

SEQ ID NO: 56930 - protein, 9 aa, Homo Sapiens
WATILLSPI

SEQ ID NO: 56931 - protein, 9 aa, Homo Sapiens
MTEVVRHCP

SEQ ID NO: 56932 - protein, 9 aa, Homo Sapiens
PDSFKVGSH

SEQ ID NO: 56933 - protein, 9 aa, Homo Sapiens
RAAAGTRQP

SEQ ID NO: 56934 - protein, 9 aa, Homo Sapiens
KVGSHEYSY

SEQ ID NO: 56935 - protein, 9 aa, Homo Sapiens
WLYTLRAAA

SEQ ID NO: 56936 - protein, 9 aa, Homo Sapiens
NSLRCPHLR

SEQ ID NO: 56937 - protein, 9 aa, Homo Sapiens
KVINVIEPG

SEQ ID NO: 56938 - protein, 9 aa, Homo Sapiens
IGNNINVIF

SEQ ID NO: 56939 - protein, 9 aa, Homo Sapiens
QAHLRDFGI

SEQ ID NO: 56940 - protein, 9 aa, Homo Sapiens
KAGGGGSKR

SEQ ID NO: 56941 - protein, 9 aa, Homo Sapiens
VLLCTSSQT

SEQ ID NO: 56942 - protein, 9 aa, Homo Sapiens
PPLHKNLDE

SEQ ID NO: 56943 - protein, 9 aa, Homo Sapiens
GRSSWRCTK

SEQ ID NO: 56944 - protein, 9 aa, Homo Sapiens
TILLSPIFS

SEQ ID NO: 56945 - protein, 9 aa, Homo Sapiens
TPSTTPGPH

SEQ ID NO: 56946 - protein, 9 aa, Homo Sapiens
VPGGKGDPP

SEQ ID NO: 56947 - protein, 9 aa, Homo Sapiens
GGRYMPRAV

SEQ ID NO: 56948 - protein, 9 aa, Homo Sapiens
WRCTKKLTY

SEQ ID NO: 56949 - protein, 9 aa, Homo Sapiens
SHAQAHLRD

SEQ ID NO: 56950 - protein, 9 aa, Homo Sapiens
LSERYNGCV

SEQ ID NO: 56951 - protein, 9 aa, Homo Sapiens
NILMSGPLT

SEQ ID NO: 56952 - protein, 9 aa, Homo Sapiens
SGGRYMPRA

SEQ ID NO: 56953 - protein, 9 aa, Homo Sapiens
LRCPHLRVP

SEQ ID NO: 56954 - protein, 9 aa, Homo Sapiens
GSEPPPQWL

SEQ ID NO: 56955 - protein, 9 aa, Homo Sapiens
EQGTMMEVK

SEQ ID NO: 56956 - protein, 9 aa, Homo Sapiens
LSPIFSFVL

SEQ ID NO: 56957 - protein, 9 aa, Homo Sapiens
KLTYWLYTL

SEQ ID NO: 56958 - protein, 9 aa, Homo Sapiens
SPIFSFVLG

SEQ ID NO: 56959 - protein, 9 aa, Homo Sapiens
QLSEKLIGN

SEQ ID NO: 56960 - protein, 9 aa, Homo Sapiens
ASGSEPPPQ

SEQ ID NO: 56961 - protein, 9 aa, Homo Sapiens
WPGRSSWRC

SEQ ID NO: 56962 - protein, 9 aa, Homo Sapiens
LELNNPFPN

SEQ ID NO: 56963 - protein, 9 aa, Homo Sapiens
PMLYRRSQR

SEQ ID NO: 56964 - protein, 9 aa, Homo Sapiens
SLKTLGARA

SEQ ID NO: 56965 - protein, 9 aa, Homo Sapiens
SSSESYSDT

SEQ ID NO: 56966 - protein, 9 aa, Homo Sapiens
LCHRPEIDN

SEQ ID NO: 56967 - protein, 9 aa, Homo Sapiens
AANILMSGP

SEQ ID NO: 56968 - protein, 9 aa, Homo Sapiens
CHRPEIDNI

SEQ ID NO: 56969 - protein, 9 aa, Homo Sapiens
PRGQALPAP

SEQ ID NO: 56970 - protein, 9 aa, Homo Sapiens
QFRGVSLNL

SEQ ID NO: 56971 - protein, 9 aa, Homo Sapiens
DEREKSTFR

SEQ ID NO: 56972 - protein, 9 aa, Homo Sapiens
ASFTKVFKS

SEQ ID NO: 56973 - protein, 9 aa, Homo Sapiens
WFLWRQLGE

SEQ ID NO: 56974 - protein, 9 aa, Homo Sapiens
FISYTPQFR

SEQ ID NO: 56975 - protein, 9 aa, Homo Sapiens
DEVIAVVSM

SEQ ID NO: 56976 - protein, 9 aa, Homo Sapiens
VVHPQAVTE

SEQ ID NO: 56977 - protein, 9 aa, Homo Sapiens
GGSKRKEKL

SEQ ID NO: 56978 - protein, 9 aa, Homo Sapiens
HPTDEKDFS

SEQ ID NO: 56979 - protein, 9 aa, Homo Sapiens
FTKVFKSNV

SEQ ID NO: 56980 - protein, 9 aa, Homo Sapiens
IIQRLDMVP

SEQ ID NO: 56981 - protein, 9 aa, Homo Sapiens
SSWRCTKKL

SEQ ID NO: 56982 - protein, 9 aa, Homo Sapiens
QLRFPQSYR

SEQ ID NO: 56983 - protein, 9 aa, Homo Sapiens
LLCTSSQTS

SEQ ID NO: 56984 - protein, 9 aa, Homo Sapiens
LYTLRAAAG

SEQ ID NO: 56985 - protein, 9 aa, Homo Sapiens
ELFLSCDKD

SEQ ID NO: 56986 - protein, 9 aa, Homo Sapiens
LRAAAGTRQ

SEQ ID NO: 56987 - protein, 9 aa, Homo Sapiens
SHEYSYEQF

SEQ ID NO: 56988 - protein, 9 aa, Homo Sapiens
RAMPRGQAL

SEQ ID NO: 56989 - protein, 9 aa, Homo Sapiens
LWRQLGEFP

SEQ ID NO: 56990 - protein, 9 aa, Homo Sapiens
TSHGSGEPF

SEQ ID NO: 56991 - protein, 9 aa, Homo Sapiens
LDAFRDPQF

SEQ ID NO: 56992 - protein, 9 aa, Homo Sapiens
LYDLLRNTQ

SEQ ID NO: 56993 - protein, 9 aa, Homo Sapiens
PRAGASGSE

SEQ ID NO: 56994 - protein, 9 aa, Homo Sapiens
LSRIIQRLD

SEQ ID NO: 56995 - protein, 9 aa, Homo Sapiens
QVLLLRARP

SEQ ID NO: 56996 - protein, 9 aa, Homo Sapiens
LNNPFPNSL

SEQ ID NO: 56997 - protein, 9 aa, Homo Sapiens
VSIGRSLQE

SEQ ID NO: 56998 - protein, 9 aa, Homo Sapiens
GGGGSKRKE

SEQ ID NO: 56999 - protein, 9 aa, Homo Sapiens
VLLLRARPV

SEQ ID NO: 57000 - protein, 9 aa, Homo Sapiens
NVIEPGLLF

SEQ ID NO: 57001 - protein, 9 aa, Homo Sapiens
TEVVRHCPH

SEQ ID NO: 57002 - protein, 9 aa, Homo Sapiens
IMKNRNGGG

SEQ ID NO: 57003 - protein, 9 aa, Homo Sapiens
RPKKGLINK

SEQ ID NO: 57004 - protein, 9 aa, Homo Sapiens
KNLDEREKS

SEQ ID NO: 57005 - protein, 9 aa, Homo Sapiens
GRYMPRAVL

SEQ ID NO: 57006 - protein, 9 aa, Homo Sapiens
ANILMSGPL

SEQ ID NO: 57007 - protein, 9 aa, Homo Sapiens
GPLQQRPQI

SEQ ID NO: 57008 - protein, 9 aa, Homo Sapiens
RRGHNGMDE

SEQ ID NO: 57009 - protein, 9 aa, Homo Sapiens
EFARAAIAQ

SEQ ID NO: 57010 - protein, 9 aa, Homo Sapiens
AYAANILMS

SEQ ID NO: 57011 - protein, 9 aa, Homo Sapiens
VAELPGLPT

SEQ ID NO: 57012 - protein, 9 aa, Homo Sapiens
CPGPLQQRP

SEQ ID NO: 57013 - protein, 9 aa, Homo Sapiens
HRPEIDNIF

SEQ ID NO: 57014 - protein, 9 aa, Homo Sapiens
RIIQRLDMV

SEQ ID NO: 57015 - protein, 9 aa, Homo Sapiens
PSRVINNFN

SEQ ID NO: 57016 - protein, 9 aa, Homo Sapiens
SSESYSDTE

SEQ ID NO: 57017 - protein, 9 aa, Homo Sapiens
EYVGPACGH

SEQ ID NO: 57018 - protein, 9 aa, Homo Sapiens
AGTRQPKLP

SEQ ID NO: 57019 - protein, 9 aa, Homo Sapiens
PSTTPGPHV

SEQ ID NO: 57020 - protein, 9 aa, Homo Sapiens
IRYELFLSC

SEQ ID NO: 57021 - protein, 9 aa, Homo Sapiens
NRQRLLEKC

SEQ ID NO: 57022 - protein, 9 aa, Homo Sapiens
ESSSESYSD

SEQ ID NO: 57023 - protein, 9 aa, Homo Sapiens
PTPSTTPGP

SEQ ID NO: 57024 - protein, 9 aa, Homo Sapiens
MSEQVLLCT

SEQ ID NO: 57025 - protein, 9 aa, Homo Sapiens
SRKKLGDPM

SEQ ID NO: 57026 - protein, 9 aa, Homo Sapiens
SGTEIRWAE

SEQ ID NO: 57027 - protein, 9 aa, Homo Sapiens
DPMTPTEKK

SEQ ID NO: 57028 - protein, 9 aa, Homo Sapiens
KSTECITSI

SEQ ID NO: 57029 - protein, 9 aa, Homo Sapiens
HLHLEVHQT

SEQ ID NO: 57030 - protein, 9 aa, Homo Sapiens
EASGGRYMP

SEQ ID NO: 57031 - protein, 9 aa, Homo Sapiens
GEPFLRHVH

SEQ ID NO: 57032 - protein, 9 aa, Homo Sapiens
AVVSMNYDP

SEQ ID NO: 57033 - protein, 9 aa, Homo Sapiens
QVIASFTKV

SEQ ID NO: 57034 - protein, 9 aa, Homo Sapiens
SAEQGTMME

SEQ ID NO: 57035 - protein, 9 aa, Homo Sapiens
MEVKVKTEL

SEQ ID NO: 57036 - protein, 9 aa, Homo Sapiens
SHGSGEPFL

SEQ ID NO: 57037 - protein, 9 aa, Homo Sapiens
VGPACGHDH

SEQ ID NO: 57038 - protein, 9 aa, Homo Sapiens
LLGHNHDIF

SEQ ID NO: 57039 - protein, 9 aa, Homo Sapiens
GDPPLVDAA

SEQ ID NO: 57040 - protein, 9 aa, Homo Sapiens
EIYQPMLYR

SEQ ID NO: 57041 - protein, 9 aa, Homo Sapiens
DSVLSRIIQ

SEQ ID NO: 57042 - protein, 9 aa, Homo Sapiens
SLQENLVPC

SEQ ID NO: 57043 - protein, 9 aa, Homo Sapiens
EKLIGNNIN

SEQ ID NO: 57044 - protein, 9 aa, Homo Sapiens
PPPPRAGAS

SEQ ID NO: 57045 - protein, 9 aa, Homo Sapiens
LVSRKKLGD

SEQ ID NO: 57046 - protein, 9 aa, Homo Sapiens
QVLLCTSSQ

SEQ ID NO: 57047 - protein, 9 aa, Homo Sapiens
STTPGPHVP

SEQ ID NO: 57048 - protein, 9 aa, Homo Sapiens
YVGPACGHD

SEQ ID NO: 57049 - protein, 9 aa, Homo Sapiens
LEKCKELMK

SEQ ID NO: 57050 - protein, 9 aa, Homo Sapiens
PPQWLCPGP

SEQ ID NO: 57051 - protein, 9 aa, Homo Sapiens
YKKIKEFAR

SEQ ID NO: 57052 - protein, 9 aa, Homo Sapiens
ARAWKDSYR

SEQ ID NO: 57053 - protein, 9 aa, Homo Sapiens
FLWRQLGEF

SEQ ID NO: 57054 - protein, 9 aa, Homo Sapiens
WKDSYRSQN

SEQ ID NO: 57055 - protein, 9 aa, Homo Sapiens
TPGPHVPLM

SEQ ID NO: 57056 - protein, 9 aa, Homo Sapiens
SLELNNPFP

SEQ ID NO: 57057 - protein, 9 aa, Homo Sapiens
GGKGDPPLV

SEQ ID NO: 57058 - protein, 9 aa, Homo Sapiens
GDPMTPTEK

SEQ ID NO: 57059 - protein, 9 aa, Homo Sapiens
ADSVLSRII

SEQ ID NO: 57060 - protein, 9 aa, Homo Sapiens
DWVCPPSRG

SEQ ID NO: 57061 - protein, 9 aa, Homo Sapiens
QHILVAELP

SEQ ID NO: 57062 - protein, 9 aa, Homo Sapiens
GHNGMDEPM

SEQ ID NO: 57063 - protein, 9 aa, Homo Sapiens
GSGEPFLRH

SEQ ID NO: 57064 - protein, 9 aa, Homo Sapiens
PGQHILVAE

SEQ ID NO: 57065 - protein, 9 aa, Homo Sapiens
RGQVLLLRA

SEQ ID NO: 57066 - protein, 9 aa, Homo Sapiens
LLRARPVLW

SEQ ID NO: 57067 - protein, 9 aa, Homo Sapiens
YKVINVIEP

SEQ ID NO: 57068 - protein, 9 aa, Homo Sapiens
SWFLWRQLG

SEQ ID NO: 57069 - protein, 9 aa, Homo Sapiens
LYRRSQRSE

SEQ ID NO: 57070 - protein, 9 aa, Homo Sapiens
LMSGPLTLK

SEQ ID NO: 57071 - protein, 9 aa, Homo Sapiens
RQLGEFPVT

SEQ ID NO: 57072 - protein, 9 aa, Homo Sapiens
PFPNSLRCP

SEQ ID NO: 57073 - protein, 9 aa, Homo Sapiens
TRQPKLPSL

SEQ ID NO: 57074 - protein, 9 aa, Homo Sapiens
ALPAPCQCP

SEQ ID NO: 57075 - protein, 9 aa, Homo Sapiens
TQFRGVSLN

SEQ ID NO: 57076 - protein, 9 aa, Homo Sapiens
PDWVCPPSR

SEQ ID NO: 57077 - protein, 9 aa, Homo Sapiens
LSSHAQAHL

SEQ ID NO: 57078 - protein, 9 aa, Homo Sapiens
ASGGRYMPR

SEQ ID NO: 57079 - protein, 9 aa, Homo Sapiens
RYNGCVLPC

SEQ ID NO: 57080 - protein, 9 aa, Homo Sapiens
HNGMDEPMF

SEQ ID NO: 57081 - protein, 9 aa, Homo Sapiens
YRRSQRSEE

SEQ ID NO: 57082 - protein, 9 aa, Homo Sapiens
LGEFPVTAL

SEQ ID NO: 57083 - protein, 9 aa, Homo Sapiens
LSEKLIGNN

SEQ ID NO: 57084 - protein, 9 aa, Homo Sapiens
WLCPGPLQQ

SEQ ID NO: 57085 - protein, 9 aa, Homo Sapiens
AWKDSYRSQ

SEQ ID NO: 57086 - protein, 9 aa, Homo Sapiens
LRAPSCLDA

SEQ ID NO: 57087 - protein, 9 aa, Homo Sapiens
PNSLRCPHL

SEQ ID NO: 57088 - protein, 9 aa, Homo Sapiens
SESYSDTES

SEQ ID NO: 57089 - protein, 9 aa, Homo Sapiens
RAGLSSHAQ

SEQ ID NO: 57090 - protein, 9 aa, Homo Sapiens
EKCKELMKR

SEQ ID NO: 57091 - protein, 9 aa, Homo Sapiens
SRGICNCSY

SEQ ID NO: 57092 - protein, 9 aa, Homo Sapiens
RVINNFNSA

SEQ ID NO: 57093 - protein, 9 aa, Homo Sapiens
QLSERYNGC

SEQ ID NO: 57094 - protein, 9 aa, Homo Sapiens
QFLLGHNHD

SEQ ID NO: 57095 - protein, 9 aa, Homo Sapiens
YELFLSCDK

SEQ ID NO: 57096 - protein, 9 aa, Homo Sapiens
APVHIDVGV

SEQ ID NO: 57097 - protein, 9 aa, Homo Sapiens
ILMSGPLTL

SEQ ID NO: 57098 - protein, 9 aa, Homo Sapiens
HPQAVTEQS

SEQ ID NO: 57099 - protein, 9 aa, Homo Sapiens
GALWPGRSS

SEQ ID NO: 57100 - protein, 9 aa, Homo Sapiens
HILVAELPG

SEQ ID NO: 57101 - protein, 9 aa, Homo Sapiens
SVLSRIIQR

SEQ ID NO: 57102 - protein, 9 aa, Homo Sapiens
PGFSNKEQQ

SEQ ID NO: 57103 - protein, 9 aa, Homo Sapiens
DKKKKNLHG

SEQ ID NO: 57104 - protein, 9 aa, Homo Sapiens
AGGGGSKRK

SEQ ID NO: 57105 - protein, 9 aa, Homo Sapiens
LTYWLYTLR

SEQ ID NO: 57106 - protein, 9 aa, Homo Sapiens
LPAPCQCPR

SEQ ID NO: 57107 - protein, 9 aa, Homo Sapiens
NQVPGGKGD

SEQ ID NO: 57108 - protein, 9 aa, Homo Sapiens
KIKEFARAA

SEQ ID NO: 57109 - protein, 9 aa, Homo Sapiens
AAAGTRQPK

SEQ ID NO: 57110 - protein, 9 aa, Homo Sapiens
IVSIGRSLQ

SEQ ID NO: 57111 - protein, 9 aa, Homo Sapiens
RGQALPAPC

SEQ ID NO: 57112 - protein, 9 aa, Homo Sapiens
LDEREKSTF

SEQ ID NO: 57113 - protein, 9 aa, Homo Sapiens
HGASAPEQS

SEQ ID NO: 57114 - protein, 9 aa, Homo Sapiens
QHMTEVVRH

SEQ ID NO: 57115 - protein, 9 aa, Homo Sapiens
PESQPFISY

SEQ ID NO: 57116 - protein, 9 aa, Homo Sapiens
ILVAELPGL

SEQ ID NO: 57117 - protein, 9 aa, Homo Sapiens
PTDEKDFSF

SEQ ID NO: 57118 - protein, 9 aa, Homo Sapiens
PKKGLINKK

SEQ ID NO: 57119 - protein, 9 aa, Homo Sapiens
PGGKGDPPL

SEQ ID NO: 57120 - protein, 9 aa, Homo Sapiens
HYSHKSTEC

SEQ ID NO: 57121 - protein, 9 aa, Homo Sapiens
YRRRGHNGM

SEQ ID NO: 57122 - protein, 9 aa, Homo Sapiens
VVSMNYDPI

SEQ ID NO: 57123 - protein, 9 aa, Homo Sapiens
LLLKHSHPT

SEQ ID NO: 57124 - protein, 9 aa, Homo Sapiens
RVPLPGALW

SEQ ID NO: 57125 - protein, 9 aa, Homo Sapiens
TTPGPHVPL

SEQ ID NO: 57126 - protein, 9 aa, Homo Sapiens
LHGASAPEQ

SEQ ID NO: 57127 - protein, 9 aa, Homo Sapiens
LSAEQGTMM

SEQ ID NO: 57128 - protein, 9 aa, Homo Sapiens
MSGPLTLKL

SEQ ID NO: 57129 - protein, 9 aa, Homo Sapiens
MLYRRSQRS

SEQ ID NO: 57130 - protein, 9 aa, Homo Sapiens
AAYAANILM

SEQ ID NO: 57131 - protein, 9 aa, Homo Sapiens
GLHPTPSTT

SEQ ID NO: 57132 - protein, 9 aa, Homo Sapiens
SLHGEYVGP

SEQ ID NO: 57133 - protein, 9 aa, Homo Sapiens
SQFLLGHNH

SEQ ID NO: 57134 - protein, 9 aa, Homo Sapiens
PHLRVPLPG

SEQ ID NO: 57135 - protein, 9 aa, Homo Sapiens
KKLTYWLYT

SEQ ID NO: 57136 - protein, 9 aa, Homo Sapiens
RCTGGVVVH

SEQ ID NO: 57137 - protein, 9 aa, Homo Sapiens
PGALWPGRS

SEQ ID NO: 57138 - protein, 9 aa, Homo Sapiens
ATLEPPGFS

SEQ ID NO: 57139 - protein, 9 aa, Homo Sapiens
DSFKVGSHE

SEQ ID NO: 57140 - protein, 9 aa, Homo Sapiens
SIGRSLQEN

SEQ ID NO: 57141 - protein, 9 aa, Homo Sapiens
GRSLQENLV

SEQ ID NO: 57142 - protein, 9 aa, Homo Sapiens
KLIGNNINV

SEQ ID NO: 57143 - protein, 9 aa, Homo Sapiens
PPPRAGASG

SEQ ID NO: 57144 - protein, 9 aa, Homo Sapiens
YSDTESSTT

SEQ ID NO: 57145 - protein, 9 aa, Homo Sapiens
SFKVGSHEY

SEQ ID NO: 57146 - protein, 9 aa, Homo Sapiens
GQHILVAEL

SEQ ID NO: 57147 - protein, 9 aa, Homo Sapiens
VLSRIIQRL

SEQ ID NO: 57148 - protein, 9 aa, Homo Sapiens
NLHGASAPE

SEQ ID NO: 57149 - protein, 9 aa, Homo Sapiens
KLGDPMTPT

SEQ ID NO: 57150 - protein, 9 aa, Homo Sapiens
PIFSFVLGV

SEQ ID NO: 57151 - protein, 9 aa, Homo Sapiens
SKSQFLLGH

SEQ ID NO: 57152 - protein, 9 aa, Homo Sapiens
ELNNPFPNS

SEQ ID NO: 57153 - protein, 9 aa, Homo Sapiens
SHPTDEKDF

SEQ ID NO: 57154 - protein, 9 aa, Homo Sapiens
WVCPPSRGI

SEQ ID NO: 57155 - protein, 9 aa, Homo Sapiens
PACGHDHPY

SEQ ID NO: 57156 - protein, 9 aa, Homo Sapiens
SRVINNFNS

SEQ ID NO: 57157 - protein, 9 aa, Homo Sapiens
GQLSEKLIG

SEQ ID NO: 57158 - protein, 9 aa, Homo Sapiens
NAAEYKVIN

SEQ ID NO: 57159 - protein, 9 aa, Homo Sapiens
NNPFPNSLR

SEQ ID NO: 57160 - protein, 9 aa, Homo Sapiens
IGRSLQENL

SEQ ID NO: 57161 - protein, 9 aa, Homo Sapiens
PGPLQQRPQ

SEQ ID NO: 57162 - protein, 9 aa, Homo Sapiens
IYQPMLYRR

SEQ ID NO: 57163 - protein, 9 aa, Homo Sapiens
LIGNNINVI

SEQ ID NO: 57164 - protein, 9 aa, Homo Sapiens
YAANILMSG

SEQ ID NO: 57165 - protein, 9 aa, Homo Sapiens
RCPHLRVPL

SEQ ID NO: 57166 - protein, 9 aa, Homo Sapiens
PVHIDVGVH

SEQ ID NO: 57167 - protein, 9 aa, Homo Sapiens
ERYNGCVLP

SEQ ID NO: 57168 - protein, 9 aa, Homo Sapiens
IDVGVHMYT

SEQ ID NO: 57169 - protein, 9 aa, Homo Sapiens
RQRLLEKCK

SEQ ID NO: 57170 - protein, 9 aa, Homo Sapiens
GGVVVHPQA

SEQ ID NO: 57171 - protein, 9 aa, Homo Sapiens
PATLEPPGF

SEQ ID NO: 57172 - protein, 9 aa, Homo Sapiens
ISYTPQFRP

SEQ ID NO: 57173 - protein, 9 aa, Homo Sapiens
RLLEKCKEL

SEQ ID NO: 57174 - protein, 9 aa, Homo Sapiens
KYKKIKEFA

SEQ ID NO: 57175 - protein, 9 aa, Homo Sapiens
KNLHGASAP

SEQ ID NO: 57176 - protein, 9 aa, Homo Sapiens
CPHLRVPLP

SEQ ID NO: 57177 - protein, 9 aa, Homo Sapiens
DVGVHMYTS

SEQ ID NO: 57178 - protein, 9 aa, Homo Sapiens
QWLCPGPLQ

SEQ ID NO: 57179 - protein, 9 aa, Homo Sapiens
LLKHSHPTD

SEQ ID NO: 57180 - protein, 9 aa, Homo Sapiens
PSRGICNCS

SEQ ID NO: 57181 - protein, 9 aa, Homo Sapiens
QGTMMEVKV

SEQ ID NO: 57182 - protein, 9 aa, Homo Sapiens
WRQLGEFPV

SEQ ID NO: 57183 - protein, 9 aa, Homo Sapiens
MASSGTEIR

SEQ ID NO: 57184 - protein, 9 aa, Homo Sapiens
QKYKKIKEF

SEQ ID NO: 57185 - protein, 9 aa, Homo Sapiens
YEHLHLEVH

SEQ ID NO: 57186 - protein, 9 aa, Homo Sapiens
SSGTEIRWA

SEQ ID NO: 57187 - protein, 9 aa, Homo Sapiens
KHSHPTDEK

SEQ ID NO: 57188 - protein, 9 aa, Homo Sapiens
ENRQRLLEK

SEQ ID NO: 57189 - protein, 9 aa, Homo Sapiens
GASAPEQSL

SEQ ID NO: 57190 - protein, 9 aa, Homo Sapiens
DIRYELFLS

SEQ ID NO: 57191 - protein, 9 aa, Homo Sapiens
GLINKKMVK

SEQ ID NO: 57192 - protein, 9 aa, Homo Sapiens
PSLKTLGAR

SEQ ID NO: 57193 - protein, 9 aa, Homo Sapiens
GFSNKEQQV

SEQ ID NO: 57194 - protein, 9 aa, Homo Sapiens
SWRCTKKLT

SEQ ID NO: 57195 - protein, 9 aa, Homo Sapiens
AAGTRQPKL

SEQ ID NO: 57196 - protein, 9 aa, Homo Sapiens
VCPPSRGIC

SEQ ID NO: 57197 - protein, 9 aa, Homo Sapiens
INVIEPGLL

SEQ ID NO: 57198 - protein, 9 aa, Homo Sapiens
RAWKDSYRS

SEQ ID NO: 57199 - protein, 9 aa, Homo Sapiens
HEASGGRYM

SEQ ID NO: 57200 - protein, 9 aa, Homo Sapiens
MPRAVLVDL

SEQ ID NO: 57201 - protein, 9 aa, Homo Sapiens
DRQLRFPQS

SEQ ID NO: 57202 - protein, 9 aa, Homo Sapiens
HEYSYEQFL

SEQ ID NO: 57203 - protein, 9 aa, Homo Sapiens
KGDEVIAVV

SEQ ID NO: 57204 - protein, 9 aa, Homo Sapiens
EQVLLCTSS

SEQ ID NO: 57205 - protein, 9 aa, Homo Sapiens
HKNLDEREK

SEQ ID NO: 57206 - protein, 9 aa, Homo Sapiens
EREKSTFRE

SEQ ID NO: 57207 - protein, 9 aa, Homo Sapiens
RHCPHHERC

SEQ ID NO: 57208 - protein, 9 aa, Homo Sapiens
VDRQLRFPQ

SEQ ID NO: 57209 - protein, 9 aa, Homo Sapiens
VINNFNSAH

SEQ ID NO: 57210 - protein, 9 aa, Homo Sapiens
PFISYTPQF

SEQ ID NO: 57211 - protein, 9 aa, Homo Sapiens
QPFISYTPQ

SEQ ID NO: 57212 - protein, 9 aa, Homo Sapiens
LGIPSRVIN

SEQ ID NO: 57213 - protein, 9 aa, Homo Sapiens
ASSGTEIRW

SEQ ID NO: 57214 - protein, 9 aa, Homo Sapiens
GASGSEPPP

SEQ ID NO: 57215 - protein, 9 aa, Homo Sapiens
VSMNYDPIV

SEQ ID NO: 57216 - protein, 9 aa, Homo Sapiens
GVHMYTSSL

SEQ ID NO: 57217 - protein, 9 aa, Homo Sapiens
VHMYTSSLA

SEQ ID NO: 57218 - protein, 9 aa, Homo Sapiens
HLRVPLPGA

SEQ ID NO: 57219 - protein, 9 aa, Homo Sapiens
KKLGDPMTP

SEQ ID NO: 57220 - protein, 9 aa, Homo Sapiens
SGSEPPPQW

SEQ ID NO: 57221 - protein, 9 aa, Homo Sapiens
TLGARAWKD

SEQ ID NO: 57222 - protein, 9 aa, Homo Sapiens
SHKSTECIT

SEQ ID NO: 57223 - protein, 9 aa, Homo Sapiens
HIDVGVHMY

SEQ ID NO: 57224 - protein, 9 aa, Homo Sapiens
PKLPSLKTL

SEQ ID NO: 57225 - protein, 9 aa, Homo Sapiens
KSQFLLGHN

SEQ ID NO: 57226 - protein, 9 aa, Homo Sapiens
TLEPPGFSN

SEQ ID NO: 57227 - protein, 9 aa, Homo Sapiens
VIAVVSMNY

SEQ ID NO: 57228 - protein, 9 aa, Homo Sapiens
NLDEREKST

SEQ ID NO: 57229 - protein, 9 aa, Homo Sapiens
VSRKKLGDP

SEQ ID NO: 57230 - protein, 9 aa, Homo Sapiens
LPGALWPGR

SEQ ID NO: 57231 - protein, 9 aa, Homo Sapiens
HGEYVGPAC

SEQ ID NO: 57232 - protein, 9 aa, Homo Sapiens
SFTKVFKSN

SEQ ID NO: 57233 - protein, 9 aa, Homo Sapiens
CSWFLWRQL

SEQ ID NO: 57234 - protein, 9 aa, Homo Sapiens
RRPKKGLIN

SEQ ID NO: 57235 - protein, 9 aa, Homo Sapiens
ALWPGRSSW

SEQ ID NO: 57236 - protein, 9 aa, Homo Sapiens
FLLGHNHDI

SEQ ID NO: 57237 - protein, 9 aa, Homo Sapiens
GMDEPMFTQ

SEQ ID NO: 57238 - protein, 9 aa, Homo Sapiens
SYSDTESST

SEQ ID NO: 57239 - protein, 9 aa, Homo Sapiens
NPNDDIRYE

SEQ ID NO: 57240 - protein, 9 aa, Homo Sapiens
ARPVLWVGV

SEQ ID NO: 57241 - protein, 9 aa, Homo Sapiens
HPTPSTTPG

SEQ ID NO: 57242 - protein, 9 aa, Homo Sapiens
LLSPIFSFV

SEQ ID NO: 57243 - protein, 9 aa, Homo Sapiens
AELPGLPTT

SEQ ID NO: 57244 - protein, 9 aa, Homo Sapiens
RQPKLPSLK

SEQ ID NO: 57245 - protein, 9 aa, Homo Sapiens
GYEHLHLEV

SEQ ID NO: 57246 - protein, 9 aa, Homo Sapiens
TVHIMKNRN

SEQ ID NO: 57247 - protein, 9 aa, Homo Sapiens
TKKLTYWLY

SEQ ID NO: 57248 - protein, 9 aa, Homo Sapiens
KKAGGGGSK

SEQ ID NO: 57249 - protein, 9 aa, Homo Sapiens
RQLRFPQSY

SEQ ID NO: 57250 - protein, 9 aa, Homo Sapiens
GKGDPPLVD

SEQ ID NO: 57251 - protein, 9 aa, Homo Sapiens
GNNINVIFA

SEQ ID NO: 57252 - protein, 9 aa, Homo Sapiens
VVVHPQAVT

SEQ ID NO: 57253 - protein, 9 aa, Homo Sapiens
ILLSPIFSF

SEQ ID NO: 57254 - protein, 9 aa, Homo Sapiens
PPGFSNKEQ

SEQ ID NO: 57255 - protein, 9 aa, Homo Sapiens
SYTPQFRPT

SEQ ID NO: 57256 - protein, 9 aa, Homo Sapiens
CTSSQTSSI

SEQ ID NO: 57257 - protein, 9 aa, Homo Sapiens
VHIMKNRNG

SEQ ID NO: 57258 - protein, 9 aa, Homo Sapiens
SEKLIGNNI

SEQ ID NO: 57259 - protein, 9 aa, Homo Sapiens
DPDWVCPPS

SEQ ID NO: 57260 - protein, 9 aa, Homo Sapiens
QLGEFPVTA

SEQ ID NO: 57261 - protein, 9 aa, Homo Sapiens
QVPGGKGDP

SEQ ID NO: 57262 - protein, 9 aa, Homo Sapiens
YSHKSTECI

SEQ ID NO: 57263 - protein, 9 aa, Homo Sapiens
LEPPGFSNK

SEQ ID NO: 57264 - protein, 9 aa, Homo Sapiens
EVIAVVSMN

SEQ ID NO: 57265 - protein, 9 aa, Homo Sapiens
PPPQWLCPG

SEQ ID NO: 57266 - protein, 9 aa, Homo Sapiens
TYWLYTLRA

SEQ ID NO: 57267 - protein, 9 aa, Homo Sapiens
LRFPQSYRN

SEQ ID NO: 57268 - protein, 9 aa, Homo Sapiens
ESYSDTESS

SEQ ID NO: 57269 - protein, 9 aa, Homo Sapiens
DAFRDPQFQ

SEQ ID NO: 57270 - protein, 9 aa, Homo Sapiens
KKIKEFARA

SEQ ID NO: 57271 - protein, 9 aa, Homo Sapiens
STECITSIV

SEQ ID NO: 57272 - protein, 9 aa, Homo Sapiens
PPSRGICNC

SEQ ID NO: 57273 - protein, 9 aa, Homo Sapiens
KLPSLKTLG

SEQ ID NO: 57274 - protein, 9 aa, Homo Sapiens
TMMEVKVKT

SEQ ID NO: 57275 - protein, 9 aa, Homo Sapiens
ESQPFISYT

SEQ ID NO: 57276 - protein, 9 aa, Homo Sapiens
GCVLPCLGV

SEQ ID NO: 57277 - protein, 9 aa, Homo Sapiens
KTLGARAWK

SEQ ID NO: 57278 - protein, 9 aa, Homo Sapiens
HAQAHLRDF

SEQ ID NO: 57279 - protein, 9 aa, Homo Sapiens
MKNRNGGGS

SEQ ID NO: 57280 - protein, 9 aa, Homo Sapiens
LQQRPQIWN

SEQ ID NO: 57281 - protein, 9 aa, Homo Sapiens
PLPGALWPG

SEQ ID NO: 57282 - protein, 9 aa, Homo Sapiens
PGRSSWRCT

SEQ ID NO: 57283 - protein, 9 aa, Homo Sapiens
CRRSAVPLS

SEQ ID NO: 57284 - protein, 9 aa, Homo Sapiens
VHPQAVTEQ

SEQ ID NO: 57285 - protein, 9 aa, Homo Sapiens
SSHAQAHLR

SEQ ID NO: 57286 - protein, 9 aa, Homo Sapiens
SERYNGCVL

SEQ ID NO: 57287 - protein, 9 aa, Homo Sapiens
NPFPNSLRC

SEQ ID NO: 57288 - protein, 9 aa, Homo Sapiens
HNHDIFDLR

SEQ ID NO: 57289 - protein, 9 aa, Homo Sapiens
RAPSCLDAF

SEQ ID NO: 57290 - protein, 9 aa, Homo Sapiens
TGGVVVHPQ

SEQ ID NO: 57291 - protein, 9 aa, Homo Sapiens
QHYSHKSTE

SEQ ID NO: 57292 - protein, 9 aa, Homo Sapiens
NDDIRYELF

SEQ ID NO: 57293 - protein, 9 aa, Homo Sapiens
CPPSRGICN

SEQ ID NO: 57294 - protein, 9 aa, Homo Sapiens
GVVVHPQAV

SEQ ID NO: 57295 - protein, 9 aa, Homo Sapiens
VHIDVGVHM

SEQ ID NO: 57296 - protein, 9 aa, Homo Sapiens
RCTKKLTYW

SEQ ID NO: 57297 - protein, 9 aa, Homo Sapiens
GGGSKRKEK

SEQ ID NO: 57298 - protein, 9 aa, Homo Sapiens
LINKKMVKR

SEQ ID NO: 57299 - protein, 9 aa, Homo Sapiens
SQPFISYTP

SEQ ID NO: 57300 - protein, 9 aa, Homo Sapiens
DIVSIGRSL

SEQ ID NO: 57301 - protein, 9 aa, Homo Sapiens
RSLQENLVP

SEQ ID NO: 57302 - protein, 9 aa, Homo Sapiens
LNNLCHRPE

SEQ ID NO: 57303 - protein, 9 aa, Homo Sapiens
EPPGFSNKE

SEQ ID NO: 57304 - protein, 9 aa, Homo Sapiens
GQVLLLRAR

SEQ ID NO: 57305 - protein, 9 aa, Homo Sapiens
CLDAFRDPQ

SEQ ID NO: 57306 - protein, 9 aa, Homo Sapiens
SESSSESYS

SEQ ID NO: 57307 - protein, 9 aa, Homo Sapiens
KKKKNLHGA

SEQ ID NO: 57308 - protein, 9 aa, Homo Sapiens
IAVVSMNYD

SEQ ID NO: 57309 - protein, 9 aa, Homo Sapiens
LHGEYVGPA

SEQ ID NO: 57310 - protein, 9 aa, Homo Sapiens
KEFARAAIA

SEQ ID NO: 57311 - protein, 9 aa, Homo Sapiens
TDEKDFSFP

SEQ ID NO: 57312 - protein, 9 aa, Homo Sapiens
FPQSYRNRT

SEQ ID NO: 57313 - protein, 9 aa, Homo Sapiens
NGMDEPMFT

SEQ ID NO: 57314 - protein, 9 aa, Homo Sapiens
YTLRAAAGT

SEQ ID NO: 57315 - protein, 9 aa, Homo Sapiens
APSCLDAFR

SEQ ID NO: 57316 - protein, 9 aa, Homo Sapiens
VFLNNLCHR

SEQ ID NO: 57317 - protein, 9 aa, Homo Sapiens
TLRAAAGTR

SEQ ID NO: 57318 - protein, 9 aa, Homo Sapiens
GHNHDIFDL

SEQ ID NO: 57319 - protein, 9 aa, Homo Sapiens
ECITSIVGH

SEQ ID NO: 57320 - protein, 9 aa, Homo Sapiens
ASLELNNPF

SEQ ID NO: 57321 - protein, 9 aa, Homo Sapiens
QSYRNRTAS

SEQ ID NO: 57322 - protein, 9 aa, Homo Sapiens
NNLCHRPEI

SEQ ID NO: 57323 - protein, 9 aa, Homo Sapiens
VRHCPHHER

SEQ ID NO: 57324 - protein, 9 aa, Homo Sapiens
VVRHCPHHE

SEQ ID NO: 57325 - protein, 9 aa, Homo Sapiens
GSHEYSYEQ

SEQ ID NO: 57326 - protein, 9 aa, Homo Sapiens
QPMLYRRSQ

SEQ ID NO: 57327 - protein, 9 aa, Homo Sapiens
SLRCPHLRV

SEQ ID NO: 57328 - protein, 9 aa, Homo Sapiens
YNGCVLPCL

SEQ ID NO: 57329 - protein, 9 aa, Homo Sapiens
ATILLSPIF

SEQ ID NO: 57330 - protein, 9 aa, Homo Sapiens
GARAWKDSY

SEQ ID NO: 57331 - protein, 9 aa, Homo Sapiens
IFSFVLGVF

SEQ ID NO: 57332 - protein, 9 aa, Homo Sapiens
VIASFTKVF

SEQ ID NO: 57333 - protein, 9 aa, Homo Sapiens
HKSTECITS

SEQ ID NO: 57334 - protein, 9 aa, Homo Sapiens
AEIYQPMLY

SEQ ID NO: 57335 - protein, 9 aa, Homo Sapiens
LGARAWKDS

SEQ ID NO: 57336 - protein, 9 aa, Homo Sapiens
LRNTQFRGV

SEQ ID NO: 57337 - protein, 9 aa, Homo Sapiens
LWPGRSSWR

SEQ ID NO: 57338 - protein, 9 aa, Homo Sapiens
LHKNLDERE

SEQ ID NO: 57339 - protein, 9 aa, Homo Sapiens
LHPTPSTTP

SEQ ID NO: 57340 - protein, 9 aa, Homo Sapiens
TECITSIVG

SEQ ID NO: 57341 - protein, 9 aa, Homo Sapiens
NNQVPGGKG

SEQ ID NO: 57342 - protein, 9 aa, Homo Sapiens
AAEYKVINV

SEQ ID NO: 57343 - protein, 9 aa, Homo Sapiens
RFPQSYRNR

SEQ ID NO: 57344 - protein, 9 aa, Homo Sapiens
RGHNGMDEP

SEQ ID NO: 57345 - protein, 9 aa, Homo Sapiens
FLNNLCHRP

SEQ ID NO: 57346 - protein, 9 aa, Homo Sapiens
PLHKNLDER

SEQ ID NO: 57347 - protein, 9 aa, Homo Sapiens
HSHPTDEKD

SEQ ID NO: 57348 - protein, 9 aa, Homo Sapiens
LPSLKTLGA

SEQ ID NO: 57349 - protein, 9 aa, Homo Sapiens
RYELFLSCD

SEQ ID NO: 57350 - protein, 9 aa, Homo Sapiens
PNDDIRYEL

SEQ ID NO: 57351 - protein, 9 aa, Homo Sapiens
HGSGEPFLR

SEQ ID NO: 57352 - protein, 9 aa, Homo Sapiens
YMPRAVLVD

SEQ ID NO: 57353 - protein, 9 aa, Homo Sapiens
LQENLVPCD

SEQ ID NO: 57354 - protein, 9 aa, Homo Sapiens
RSSWRCTKK

SEQ ID NO: 57355 - protein, 9 aa, Homo Sapiens
CYRRRGHNG

SEQ ID NO: 57356 - protein, 9 aa, Homo Sapiens
KGDPPLVDA

SEQ ID NO: 57357 - protein, 9 aa, Homo Sapiens
CTKKLTYWL

SEQ ID NO: 57358 - protein, 9 aa, Homo Sapiens
FPNSLRCPH

SEQ ID NO: 57359 - protein, 9 aa, Homo Sapiens
DLLRNTQFR

SEQ ID NO: 57360 - protein, 9 aa, Homo Sapiens
KKNLHGASA

SEQ ID NO: 57361 - protein, 9 aa, Homo Sapiens
LGHNHDIFD

SEQ ID NO: 57362 - protein, 9 aa, Homo Sapiens
CVGKCQGLF

SEQ ID NO: 57363 - protein, 9 aa, Homo Sapiens
RLYEYDDLK

SEQ ID NO: 57364 - protein, 9 aa, Homo Sapiens
AATLAVSPC

SEQ ID NO: 57365 - protein, 9 aa, Homo Sapiens
WNTAPHQIP

SEQ ID NO: 57366 - protein, 9 aa, Homo Sapiens
TAVNATPAN

SEQ ID NO: 57367 - protein, 9 aa, Homo Sapiens
ASDYWSLLL

SEQ ID NO: 57368 - protein, 9 aa, Homo Sapiens
PLRDEDDLD

SEQ ID NO: 57369 - protein, 9 aa, Homo Sapiens
CKEAINVLS

SEQ ID NO: 57370 - protein, 9 aa, Homo Sapiens
VGHGDSSRC

SEQ ID NO: 57371 - protein, 9 aa, Homo Sapiens
KWLLVPGIF

SEQ ID NO: 57372 - protein, 9 aa, Homo Sapiens
GPPTVTREG

SEQ ID NO: 57373 - protein, 9 aa, Homo Sapiens
QLEQPMQET

SEQ ID NO: 57374 - protein, 9 aa, Homo Sapiens
FLMGVLLRV

SEQ ID NO: 57375 - protein, 9 aa, Homo Sapiens
KTRSACGLV

SEQ ID NO: 57376 - protein, 9 aa, Homo Sapiens
DYWSLLLEF

SEQ ID NO: 57377 - protein, 9 aa, Homo Sapiens
AAAEAVRAL

SEQ ID NO: 57378 - protein, 9 aa, Homo Sapiens
LVPGIFFFL

SEQ ID NO: 57379 - protein, 9 aa, Homo Sapiens
EAVRALKSP

SEQ ID NO: 57380 - protein, 9 aa, Homo Sapiens
GPGGPLGYP

SEQ ID NO: 57381 - protein, 9 aa, Homo Sapiens
YRQVRGVTQ

SEQ ID NO: 57382 - protein, 9 aa, Homo Sapiens
PSAAAEAVR

SEQ ID NO: 57383 - protein, 9 aa, Homo Sapiens
TTYEFQIYS

SEQ ID NO: 57384 - protein, 9 aa, Homo Sapiens
LRLYEYDDL

SEQ ID NO: 57385 - protein, 9 aa, Homo Sapiens
GPCRQPPEA

SEQ ID NO: 57386 - protein, 9 aa, Homo Sapiens
ECEKKKLLI

SEQ ID NO: 57387 - protein, 9 aa, Homo Sapiens
EKKKLLIHL

SEQ ID NO: 57388 - protein, 9 aa, Homo Sapiens
QPMQETVRH

SEQ ID NO: 57389 - protein, 9 aa, Homo Sapiens
FEVEHECVG

SEQ ID NO: 57390 - protein, 9 aa, Homo Sapiens
LEKMKHLNI

SEQ ID NO: 57391 - protein, 9 aa, Homo Sapiens
AFEVEHECV

SEQ ID NO: 57392 - protein, 9 aa, Homo Sapiens
GVLLRVFVE

SEQ ID NO: 57393 - protein, 9 aa, Homo Sapiens
HPCIFRCHP

SEQ ID NO: 57394 - protein, 9 aa, Homo Sapiens
SPRYLGTSM

SEQ ID NO: 57395 - protein, 9 aa, Homo Sapiens
PPSHWDRKC

SEQ ID NO: 57396 - protein, 9 aa, Homo Sapiens
CPPPPGLPH

SEQ ID NO: 57397 - protein, 9 aa, Homo Sapiens
CGGWLLPER

SEQ ID NO: 57398 - protein, 9 aa, Homo Sapiens
LNKIIEKMA

SEQ ID NO: 57399 - protein, 9 aa, Homo Sapiens
GNVSELRTF

SEQ ID NO: 57400 - protein, 9 aa, Homo Sapiens
AAHHHHAAP

SEQ ID NO: 57401 - protein, 9 aa, Homo Sapiens
EAINVLSHL

SEQ ID NO: 57402 - protein, 9 aa, Homo Sapiens
KEQIKLLKS

SEQ ID NO: 57403 - protein, 9 aa, Homo Sapiens
KLILLFVYA

SEQ ID NO: 57404 - protein, 9 aa, Homo Sapiens
FVDLGNVSE

SEQ ID NO: 57405 - protein, 9 aa, Homo Sapiens
YNCKEAINV

SEQ ID NO: 57406 - protein, 9 aa, Homo Sapiens
NATPANPLP

SEQ ID NO: 57407 - protein, 9 aa, Homo Sapiens
GNVLPMFYV

SEQ ID NO: 57408 - protein, 9 aa, Homo Sapiens
AEAVRALKS

SEQ ID NO: 57409 - protein, 9 aa, Homo Sapiens
VASDYWSLL

SEQ ID NO: 57410 - protein, 9 aa, Homo Sapiens
QECEKKKLL

SEQ ID NO: 57411 - protein, 9 aa, Homo Sapiens
DGYRQVRGV

SEQ ID NO: 57412 - protein, 9 aa, Homo Sapiens
EKMKHLNIV

SEQ ID NO: 57413 - protein, 9 aa, Homo Sapiens
LVTNRIVDN

SEQ ID NO: 57414 - protein, 9 aa, Homo Sapiens
LHAKFYADP

SEQ ID NO: 57415 - protein, 9 aa, Homo Sapiens
CRVCCVAEG

SEQ ID NO: 57416 - protein, 9 aa, Homo Sapiens
LDGEMDWKL

SEQ ID NO: 57417 - protein, 9 aa, Homo Sapiens
PMQETVRHS

SEQ ID NO: 57418 - protein, 9 aa, Homo Sapiens
GPCVVASDY

SEQ ID NO: 57419 - protein, 9 aa, Homo Sapiens
SQLGRYPKY

SEQ ID NO: 57420 - protein, 9 aa, Homo Sapiens
MGVLLRVFV

SEQ ID NO: 57421 - protein, 9 aa, Homo Sapiens
GGPLGYPGE

SEQ ID NO: 57422 - protein, 9 aa, Homo Sapiens
AAEGAVLRL

SEQ ID NO: 57423 - protein, 9 aa, Homo Sapiens
AIALFFLMG

SEQ ID NO: 57424 - protein, 9 aa, Homo Sapiens
LRTTYEFQI

SEQ ID NO: 57425 - protein, 9 aa, Homo Sapiens
YNILINLDH

SEQ ID NO: 57426 - protein, 9 aa, Homo Sapiens
ALFFLMGVL

SEQ ID NO: 57427 - protein, 9 aa, Homo Sapiens
VPGIFFFLE

SEQ ID NO: 57428 - protein, 9 aa, Homo Sapiens
QSPFGSCLW

SEQ ID NO: 57429 - protein, 9 aa, Homo Sapiens
LSELEDYVS

SEQ ID NO: 57430 - protein, 9 aa, Homo Sapiens
YYGTVMGMY

SEQ ID NO: 57431 - protein, 9 aa, Homo Sapiens
LFFLMGVLL

SEQ ID NO: 57432 - protein, 9 aa, Homo Sapiens
WLLVPGIFF

SEQ ID NO: 57433 - protein, 9 aa, Homo Sapiens
PSSHTVGAT

SEQ ID NO: 57434 - protein, 9 aa, Homo Sapiens
LEKDKTGLG

SEQ ID NO: 57435 - protein, 9 aa, Homo Sapiens
EDYVSYETV

SEQ ID NO: 57436 - protein, 9 aa, Homo Sapiens
LDALGPPTV

SEQ ID NO: 57437 - protein, 9 aa, Homo Sapiens
GAVLRLYEY

SEQ ID NO: 57438 - protein, 9 aa, Homo Sapiens
AHSGMCVCP

SEQ ID NO: 57439 - protein, 9 aa, Homo Sapiens
LILLFVYAD

SEQ ID NO: 57440 - protein, 9 aa, Homo Sapiens
HWDRKCQTT

SEQ ID NO: 57441 - protein, 9 aa, Homo Sapiens
PGDKWVRWN

SEQ ID NO: 57442 - protein, 9 aa, Homo Sapiens
PCVVASDYW

SEQ ID NO: 57443 - protein, 9 aa, Homo Sapiens
GYPGEKGEK

SEQ ID NO: 57444 - protein, 9 aa, Homo Sapiens
LPDGYRQVR

SEQ ID NO: 57445 - protein, 9 aa, Homo Sapiens
HHAAPHHHH

SEQ ID NO: 57446 - protein, 9 aa, Homo Sapiens
AQEFDYKKN

SEQ ID NO: 57447 - protein, 9 aa, Homo Sapiens
SDYWSLLLE

SEQ ID NO: 57448 - protein, 9 aa, Homo Sapiens
TVMGMYFRP

SEQ ID NO: 57449 - protein, 9 aa, Homo Sapiens
EMDWKLRLP

SEQ ID NO: 57450 - protein, 9 aa, Homo Sapiens
WDLCGGWLL

SEQ ID NO: 57451 - protein, 9 aa, Homo Sapiens
EVEHECVGK

SEQ ID NO: 57452 - protein, 9 aa, Homo Sapiens
RALKSPLVP

SEQ ID NO: 57453 - protein, 9 aa, Homo Sapiens
GEMDWKLRL

SEQ ID NO: 57454 - protein, 9 aa, Homo Sapiens
VFTGHATPL

SEQ ID NO: 57455 - protein, 9 aa, Homo Sapiens
LLPKLILLF

SEQ ID NO: 57456 - protein, 9 aa, Homo Sapiens
APHHHHHHH

SEQ ID NO: 57457 - protein, 9 aa, Homo Sapiens
PPTVTREGG

SEQ ID NO: 57458 - protein, 9 aa, Homo Sapiens
FRCHPGECP

SEQ ID NO: 57459 - protein, 9 aa, Homo Sapiens
ATSPRLHAK

SEQ ID NO: 57460 - protein, 9 aa, Homo Sapiens
DTVLLRTTY

SEQ ID NO: 57461 - protein, 9 aa, Homo Sapiens
CIFRCHPGE

SEQ ID NO: 57462 - protein, 9 aa, Homo Sapiens
GQVEVHFQG

SEQ ID NO: 57463 - protein, 9 aa, Homo Sapiens
DFQCWEKVQ

SEQ ID NO: 57464 - protein, 9 aa, Homo Sapiens
IHLPPSHWD

SEQ ID NO: 57465 - protein, 9 aa, Homo Sapiens
TDQLDGEMD

SEQ ID NO: 57466 - protein, 9 aa, Homo Sapiens
GVLLPKLIL

SEQ ID NO: 57467 - protein, 9 aa, Homo Sapiens
DSSRCQTAM

SEQ ID NO: 57468 - protein, 9 aa, Homo Sapiens
EWPLRDEDD

SEQ ID NO: 57469 - protein, 9 aa, Homo Sapiens
ATLAVSPCC

SEQ ID NO: 57470 - protein, 9 aa, Homo Sapiens
RSACGLVLY

SEQ ID NO: 57471 - protein, 9 aa, Homo Sapiens
LGCLHPCIF

SEQ ID NO: 57472 - protein, 9 aa, Homo Sapiens
HLNIVAFFN

SEQ ID NO: 57473 - protein, 9 aa, Homo Sapiens
DYVSYETVF

SEQ ID NO: 57474 - protein, 9 aa, Homo Sapiens
NAVLKEQIK

SEQ ID NO: 57475 - protein, 9 aa, Homo Sapiens
LYYGTVMGM

SEQ ID NO: 57476 - protein, 9 aa, Homo Sapiens
EGQVEVHFQ

SEQ ID NO: 57477 - protein, 9 aa, Homo Sapiens
GGWLLPERH

SEQ ID NO: 57478 - protein, 9 aa, Homo Sapiens
NDKQPILLN

SEQ ID NO: 57479 - protein, 9 aa, Homo Sapiens
SAAAEAVRA

SEQ ID NO: 57480 - protein, 9 aa, Homo Sapiens
FFLMGVLLR

SEQ ID NO: 57481 - protein, 9 aa, Homo Sapiens
AAAEGAVLR

SEQ ID NO: 57482 - protein, 9 aa, Homo Sapiens
DTETYLLEK

SEQ ID NO: 57483 - protein, 9 aa, Homo Sapiens
KSFIAVLVT

SEQ ID NO: 57484 - protein, 9 aa, Homo Sapiens
LNIVAFFNS

SEQ ID NO: 57485 - protein, 9 aa, Homo Sapiens
PCIFRCHPG

SEQ ID NO: 57486 - protein, 9 aa, Homo Sapiens
GMCVCPPPP

SEQ ID NO: 57487 - protein, 9 aa, Homo Sapiens
RFPQSPFGS

SEQ ID NO: 57488 - protein, 9 aa, Homo Sapiens
QLGRYPKYK

SEQ ID NO: 57489 - protein, 9 aa, Homo Sapiens
QGVWNTVCD

SEQ ID NO: 57490 - protein, 9 aa, Homo Sapiens
DALGPPTVT

SEQ ID NO: 57491 - protein, 9 aa, Homo Sapiens
RSHSKSQLG

SEQ ID NO: 57492 - protein, 9 aa, Homo Sapiens
AINVLSHLP

SEQ ID NO: 57493 - protein, 9 aa, Homo Sapiens
NKIIEKMAT

SEQ ID NO: 57494 - protein, 9 aa, Homo Sapiens
ASADTETYL

SEQ ID NO: 57495 - protein, 9 aa, Homo Sapiens
VMGMYFRPL

SEQ ID NO: 57496 - protein, 9 aa, Homo Sapiens
SACGLVLYF

SEQ ID NO: 57497 - protein, 9 aa, Homo Sapiens
EKVQASQIT

SEQ ID NO: 57498 - protein, 9 aa, Homo Sapiens
ELRTFRVLR

SEQ ID NO: 57499 - protein, 9 aa, Homo Sapiens
TRSACGLVL

SEQ ID NO: 57500 - protein, 9 aa, Homo Sapiens
AAEAVRALK

SEQ ID NO: 57501 - protein, 9 aa, Homo Sapiens
HTVGATTSL

SEQ ID NO: 57502 - protein, 9 aa, Homo Sapiens
HAKFYADPV

SEQ ID NO: 57503 - protein, 9 aa, Homo Sapiens
GPLGYPGEK

SEQ ID NO: 57504 - protein, 9 aa, Homo Sapiens
YECVGPCRQ

SEQ ID NO: 57505 - protein, 9 aa, Homo Sapiens
PTVTREGGD

SEQ ID NO: 57506 - protein, 9 aa, Homo Sapiens
RAPSSHTVG

SEQ ID NO: 57507 - protein, 9 aa, Homo Sapiens
RTTYEFQIY

SEQ ID NO: 57508 - protein, 9 aa, Homo Sapiens
ATNAVLKEQ

SEQ ID NO: 57509 - protein, 9 aa, Homo Sapiens
ILLNKIIEK

SEQ ID NO: 57510 - protein, 9 aa, Homo Sapiens
DKTGLGLSL

SEQ ID NO: 57511 - protein, 9 aa, Homo Sapiens
NDFQCWEKV

SEQ ID NO: 57512 - protein, 9 aa, Homo Sapiens
PRLHAKFYA

SEQ ID NO: 57513 - protein, 9 aa, Homo Sapiens
QLDGEMDWK

SEQ ID NO: 57514 - protein, 9 aa, Homo Sapiens
GRYPKYKNS

SEQ ID NO: 57515 - protein, 9 aa, Homo Sapiens
IMKEKKKAW

SEQ ID NO: 57516 - protein, 9 aa, Homo Sapiens
TIQTSAQEF

SEQ ID NO: 57517 - protein, 9 aa, Homo Sapiens
LPPSHWDRK

SEQ ID NO: 57518 - protein, 9 aa, Homo Sapiens
DLGNVSELR

SEQ ID NO: 57519 - protein, 9 aa, Homo Sapiens
DCSVGHGDS

SEQ ID NO: 57520 - protein, 9 aa, Homo Sapiens
ALGPPTVTR

SEQ ID NO: 57521 - protein, 9 aa, Homo Sapiens
GTVMGMYFR

SEQ ID NO: 57522 - protein, 9 aa, Homo Sapiens
KSQLGRYPK

SEQ ID NO: 57523 - protein, 9 aa, Homo Sapiens
PFGSCLWPV

SEQ ID NO: 57524 - protein, 9 aa, Homo Sapiens
SFIAVLVTN

SEQ ID NO: 57525 - protein, 9 aa, Homo Sapiens
EVHFQGVWN

SEQ ID NO: 57526 - protein, 9 aa, Homo Sapiens
CVVASDYWS

SEQ ID NO: 57527 - protein, 9 aa, Homo Sapiens
TNAVLKEQI

SEQ ID NO: 57528 - protein, 9 aa, Homo Sapiens
CSVGHGDSS

SEQ ID NO: 57529 - protein, 9 aa, Homo Sapiens
PSHWDRKCQ

SEQ ID NO: 57530 - protein, 9 aa, Homo Sapiens
VQASQITAS

SEQ ID NO: 57531 - protein, 9 aa, Homo Sapiens
HLPPSHWDR

SEQ ID NO: 57532 - protein, 9 aa, Homo Sapiens
INVLSHLPS

SEQ ID NO: 57533 - protein, 9 aa, Homo Sapiens
PQSPFGSCL

SEQ ID NO: 57534 - protein, 9 aa, Homo Sapiens
YEFQIYSWK

SEQ ID NO: 57535 - protein, 9 aa, Homo Sapiens
WEKVQASQI

SEQ ID NO: 57536 - protein, 9 aa, Homo Sapiens
KQPILLNKI

SEQ ID NO: 57537 - protein, 9 aa, Homo Sapiens
EQPMQETVR

SEQ ID NO: 57538 - protein, 9 aa, Homo Sapiens
QVKDGTAVN

SEQ ID NO: 57539 - protein, 9 aa, Homo Sapiens
VRALKSPLV

SEQ ID NO: 57540 - protein, 9 aa, Homo Sapiens
SELEDYVSY

SEQ ID NO: 57541 - protein, 9 aa, Homo Sapiens
QPILLNKII

SEQ ID NO: 57542 - protein, 9 aa, Homo Sapiens
FQLKTRSAC

SEQ ID NO: 57543 - protein, 9 aa, Homo Sapiens
VEHECVGKC

SEQ ID NO: 57544 - protein, 9 aa, Homo Sapiens
LLNKIIEKM

SEQ ID NO: 57545 - protein, 9 aa, Homo Sapiens
LLQLEQPMQ

SEQ ID NO: 57546 - protein, 9 aa, Homo Sapiens
LIHLPPSHW

SEQ ID NO: 57547 - protein, 9 aa, Homo Sapiens
IFRCHPGEC

SEQ ID NO: 57548 - protein, 9 aa, Homo Sapiens
PEYNILINL

SEQ ID NO: 57549 - protein, 9 aa, Homo Sapiens
GWLLPERHT

SEQ ID NO: 57550 - protein, 9 aa, Homo Sapiens
FIAVLVTNR

SEQ ID NO: 57551 - protein, 9 aa, Homo Sapiens
DGTAVNATP

SEQ ID NO: 57552 - protein, 9 aa, Homo Sapiens
LGRYPKYKN

SEQ ID NO: 57553 - protein, 9 aa, Homo Sapiens
VVASDYWSL

SEQ ID NO: 57554 - protein, 9 aa, Homo Sapiens
TLAVSPCCW

SEQ ID NO: 57555 - protein, 9 aa, Homo Sapiens
SHWDRKCQT

SEQ ID NO: 57556 - protein, 9 aa, Homo Sapiens
NCKEAINVL

SEQ ID NO: 57557 - protein, 9 aa, Homo Sapiens
HHHHAAPHH

SEQ ID NO: 57558 - protein, 9 aa, Homo Sapiens
KLASADTET

SEQ ID NO: 57559 - protein, 9 aa, Homo Sapiens
FPQSPFGSC

SEQ ID NO: 57560 - protein, 9 aa, Homo Sapiens
LRDEDDLDN

SEQ ID NO: 57561 - protein, 9 aa, Homo Sapiens
PPPGLPHPC

SEQ ID NO: 57562 - protein, 9 aa, Homo Sapiens
AVTTIQTSA

SEQ ID NO: 57563 - protein, 9 aa, Homo Sapiens
VLLRTTYEF

SEQ ID NO: 57564 - protein, 9 aa, Homo Sapiens
PGIFFFLEK

SEQ ID NO: 57565 - protein, 9 aa, Homo Sapiens
RPEYNILIN

SEQ ID NO: 57566 - protein, 9 aa, Homo Sapiens
IPISPRYLG

SEQ ID NO: 57567 - protein, 9 aa, Homo Sapiens
TGDEEEEDG

SEQ ID NO: 57568 - protein, 9 aa, Homo Sapiens
NVLSHLPSH

SEQ ID NO: 57569 - protein, 9 aa, Homo Sapiens
CGLVLYFDD

SEQ ID NO: 57570 - protein, 9 aa, Homo Sapiens
RTDQLDGEM

SEQ ID NO: 57571 - protein, 9 aa, Homo Sapiens
DTKGCRVCC

SEQ ID NO: 57572 - protein, 9 aa, Homo Sapiens
VLSHLPSHH

SEQ ID NO: 57573 - protein, 9 aa, Homo Sapiens
FLDALGPPT

SEQ ID NO: 57574 - protein, 9 aa, Homo Sapiens
KGCRVCCVA

SEQ ID NO: 57575 - protein, 9 aa, Homo Sapiens
HSGMCVCPP

SEQ ID NO: 57576 - protein, 9 aa, Homo Sapiens
ACGLVLYFD

SEQ ID NO: 57577 - protein, 9 aa, Homo Sapiens
QLKTRSACG

SEQ ID NO: 57578 - protein, 9 aa, Homo Sapiens
VLVTNRIVD

SEQ ID NO: 57579 - protein, 9 aa, Homo Sapiens
KMKHLNIVA

SEQ ID NO: 57580 - protein, 9 aa, Homo Sapiens
VSELRTFRV

SEQ ID NO: 57581 - protein, 9 aa, Homo Sapiens
IFFFLEKAI

SEQ ID NO: 57582 - protein, 9 aa, Homo Sapiens
NARCIPISP

SEQ ID NO: 57583 - protein, 9 aa, Homo Sapiens
NRAPSSHTV

SEQ ID NO: 57584 - protein, 9 aa, Homo Sapiens
DKWVRWNTA

SEQ ID NO: 57585 - protein, 9 aa, Homo Sapiens
IIELEKDKT

SEQ ID NO: 57586 - protein, 9 aa, Homo Sapiens
KLLIHLPPS

SEQ ID NO: 57587 - protein, 9 aa, Homo Sapiens
DNARCIPIS

SEQ ID NO: 57588 - protein, 9 aa, Homo Sapiens
LEQPMQETV

SEQ ID NO: 57589 - protein, 9 aa, Homo Sapiens
ECVGKCQGL

SEQ ID NO: 57590 - protein, 9 aa, Homo Sapiens
AVNATPANP

SEQ ID NO: 57591 - protein, 9 aa, Homo Sapiens
DLCGGWLLP

SEQ ID NO: 57592 - protein, 9 aa, Homo Sapiens
FTGHATPLP

SEQ ID NO: 57593 - protein, 9 aa, Homo Sapiens
IEATNAVLK

SEQ ID NO: 57594 - protein, 9 aa, Homo Sapiens
KDGTAVNAT

SEQ ID NO: 57595 - protein, 9 aa, Homo Sapiens
KTKTGNVLP

SEQ ID NO: 57596 - protein, 9 aa, Homo Sapiens
MKSFIAVLV

SEQ ID NO: 57597 - protein, 9 aa, Homo Sapiens
GMYFRPLTN

SEQ ID NO: 57598 - protein, 9 aa, Homo Sapiens
MSRPEYNIL

SEQ ID NO: 57599 - protein, 9 aa, Homo Sapiens
LLIHLPPSH

SEQ ID NO: 57600 - protein, 9 aa, Homo Sapiens
APSSHTVGA

SEQ ID NO: 57601 - protein, 9 aa, Homo Sapiens
LLRTTYEFQ

SEQ ID NO: 57602 - protein, 9 aa, Homo Sapiens
KKKLLIHLP

SEQ ID NO: 57603 - protein, 9 aa, Homo Sapiens
PGGPLGYPG

SEQ ID NO: 57604 - protein, 9 aa, Homo Sapiens
CWEKVQASQ

SEQ ID NO: 57605 - protein, 9 aa, Homo Sapiens
CVCPPPPGL

SEQ ID NO: 57606 - protein, 9 aa, Homo Sapiens
QTSAQEFDY

SEQ ID NO: 57607 - protein, 9 aa, Homo Sapiens
CLHPCIFRC

SEQ ID NO: 57608 - protein, 9 aa, Homo Sapiens
IELEKDKTG

SEQ ID NO: 57609 - protein, 9 aa, Homo Sapiens
AVLRLYEYD

SEQ ID NO: 57610 - protein, 9 aa, Homo Sapiens
CNRAPSSHT

SEQ ID NO: 57611 - protein, 9 aa, Homo Sapiens
GCRVCCVAE

SEQ ID NO: 57612 - protein, 9 aa, Homo Sapiens
ITGDEEEED

SEQ ID NO: 57613 - protein, 9 aa, Homo Sapiens
HFQGVWNTV

SEQ ID NO: 57614 - protein, 9 aa, Homo Sapiens
ECVGPCRQP

SEQ ID NO: 57615 - protein, 9 aa, Homo Sapiens
FATSPRLHA

SEQ ID NO: 57616 - protein, 9 aa, Homo Sapiens
HSKSQLGRY

SEQ ID NO: 57617 - protein, 9 aa, Homo Sapiens
VHFQGVWNT

SEQ ID NO: 57618 - protein, 9 aa, Homo Sapiens
LMGVLLRVF

SEQ ID NO: 57619 - protein, 9 aa, Homo Sapiens
TETYLLEKS

SEQ ID NO: 57620 - protein, 9 aa, Homo Sapiens
DEEEEDGGG

SEQ ID NO: 57621 - protein, 9 aa, Homo Sapiens
DQLDGEMDW

SEQ ID NO: 57622 - protein, 9 aa, Homo Sapiens
GDKWVRWNT

SEQ ID NO: 57623 - protein, 9 aa, Homo Sapiens
QCWEKVQAS

SEQ ID NO: 57624 - protein, 9 aa, Homo Sapiens
VLKEQIKLL

SEQ ID NO: 57625 - protein, 9 aa, Homo Sapiens
TSAQEFDYK

SEQ ID NO: 57626 - protein, 9 aa, Homo Sapiens
LELPDGYRQ

SEQ ID NO: 57627 - protein, 9 aa, Homo Sapiens
LPERHTKEQ

SEQ ID NO: 57628 - protein, 9 aa, Homo Sapiens
FLAYECVGP

SEQ ID NO: 57629 - protein, 9 aa, Homo Sapiens
SKSQLGRYP

SEQ ID NO: 57630 - protein, 9 aa, Homo Sapiens
NILINLDHV

SEQ ID NO: 57631 - protein, 9 aa, Homo Sapiens
MDWKLRLPV

SEQ ID NO: 57632 - protein, 9 aa, Homo Sapiens
AVRALKSPL

SEQ ID NO: 57633 - protein, 9 aa, Homo Sapiens
SRFPQSPFG

SEQ ID NO: 57634 - protein, 9 aa, Homo Sapiens
AEGAVLRLY

SEQ ID NO: 57635 - protein, 9 aa, Homo Sapiens
PISPRYLGT

SEQ ID NO: 57636 - protein, 9 aa, Homo Sapiens
ADTETYLLE

SEQ ID NO: 57637 - protein, 9 aa, Homo Sapiens
GYRQVRGVT

SEQ ID NO: 57638 - protein, 9 aa, Homo Sapiens
TKGCRVCCV

SEQ ID NO: 57639 - protein, 9 aa, Homo Sapiens
YPGEKGEKG

SEQ ID NO: 57640 - protein, 9 aa, Homo Sapiens
GKLASADTE

SEQ ID NO: 57641 - protein, 9 aa, Homo Sapiens
HSRFPQSPF

SEQ ID NO: 57642 - protein, 9 aa, Homo Sapiens
EYNILINLD

SEQ ID NO: 57643 - protein, 9 aa, Homo Sapiens
IALFFLMGV

SEQ ID NO: 57644 - protein, 9 aa, Homo Sapiens
KHLNIVAFF

SEQ ID NO: 57645 - protein, 9 aa, Homo Sapiens
VCCVAEGAS

SEQ ID NO: 57646 - protein, 9 aa, Homo Sapiens
HECVGKCQG

SEQ ID NO: 57647 - protein, 9 aa, Homo Sapiens
SSHTVGATT

SEQ ID NO: 57648 - protein, 9 aa, Homo Sapiens
ELPDGYRQV

SEQ ID NO: 57649 - protein, 9 aa, Homo Sapiens
VKDGTAVNA

SEQ ID NO: 57650 - protein, 9 aa, Homo Sapiens
IAVLVTNRI

SEQ ID NO: 57651 - protein, 9 aa, Homo Sapiens
VSYETVFEN

SEQ ID NO: 57652 - protein, 9 aa, Homo Sapiens
FGSCLWPVL

SEQ ID NO: 57653 - protein, 9 aa, Homo Sapiens
SAQEFDYKK

SEQ ID NO: 57654 - protein, 9 aa, Homo Sapiens
LQLEQPMQE

SEQ ID NO: 57655 - protein, 9 aa, Homo Sapiens
RWNTAPHQI

SEQ ID NO: 57656 - protein, 9 aa, Homo Sapiens
FQGVWNTVC

SEQ ID NO: 57657 - protein, 9 aa, Homo Sapiens
ARCIPISPR

SEQ ID NO: 57658 - protein, 9 aa, Homo Sapiens
SSRCQTAMP

SEQ ID NO: 57659 - protein, 9 aa, Homo Sapiens
TTIQTSAQE

SEQ ID NO: 57660 - protein, 9 aa, Homo Sapiens
KEAINVLSH

SEQ ID NO: 57661 - protein, 9 aa, Homo Sapiens
SADTETYLL

SEQ ID NO: 57662 - protein, 9 aa, Homo Sapiens
GDEEEEDGG

SEQ ID NO: 57663 - protein, 9 aa, Homo Sapiens
LGYPGEKGE

SEQ ID NO: 57664 - protein, 9 aa, Homo Sapiens
LCNRAPSSH

SEQ ID NO: 57665 - protein, 9 aa, Homo Sapiens
FMSRPEYNI

SEQ ID NO: 57666 - protein, 9 aa, Homo Sapiens
PILLNKIIE

SEQ ID NO: 57667 - protein, 9 aa, Homo Sapiens
YGTVMGMYF

SEQ ID NO: 57668 - protein, 9 aa, Homo Sapiens
NVLPMFYVY

SEQ ID NO: 57669 - protein, 9 aa, Homo Sapiens
LGNVSELRT

SEQ ID NO: 57670 - protein, 9 aa, Homo Sapiens
CVGPCRQPP

SEQ ID NO: 57671 - protein, 9 aa, Homo Sapiens
YVSYETVFE

SEQ ID NO: 57672 - protein, 9 aa, Homo Sapiens
PPGLPHPCM

SEQ ID NO: 57673 - protein, 9 aa, Homo Sapiens
KKLLIHLPP

SEQ ID NO: 57674 - protein, 9 aa, Homo Sapiens
WLLPERHTK

SEQ ID NO: 57675 - protein, 9 aa, Homo Sapiens
LCGGWLLPE

SEQ ID NO: 57676 - protein, 9 aa, Homo Sapiens
SLSELEDYV

SEQ ID NO: 57677 - protein, 9 aa, Homo Sapiens
PCRQPPEAL

SEQ ID NO: 57678 - protein, 9 aa, Homo Sapiens
VNATPANPL

SEQ ID NO: 57679 - protein, 9 aa, Homo Sapiens
LPKLILLFV

SEQ ID NO: 57680 - protein, 9 aa, Homo Sapiens
YKTKTGNVL

SEQ ID NO: 57681 - protein, 9 aa, Homo Sapiens
PKLILLFVY

SEQ ID NO: 57682 - protein, 9 aa, Homo Sapiens
EHECVGKCQ

SEQ ID NO: 57683 - protein, 9 aa, Homo Sapiens
ISPRYLGTS

SEQ ID NO: 57684 - protein, 9 aa, Homo Sapiens
LLVPGIFFF

SEQ ID NO: 57685 - protein, 9 aa, Homo Sapiens
LASADTETY

SEQ ID NO: 57686 - protein, 9 aa, Homo Sapiens
VLLPKLILL

SEQ ID NO: 57687 - protein, 9 aa, Homo Sapiens
CIMKEKKKA

SEQ ID NO: 57688 - protein, 9 aa, Homo Sapiens
RYKTKTGNV

SEQ ID NO: 57689 - protein, 9 aa, Homo Sapiens
AVLVTNRIV

SEQ ID NO: 57690 - protein, 9 aa, Homo Sapiens
PDGYRQVRG

SEQ ID NO: 57691 - protein, 9 aa, Homo Sapiens
WVRWNTAPH

SEQ ID NO: 57692 - protein, 9 aa, Homo Sapiens
DLELPDGYR

SEQ ID NO: 57693 - protein, 9 aa, Homo Sapiens
LEDYVSYET

SEQ ID NO: 57694 - protein, 9 aa, Homo Sapiens
GCLHPCIFR

SEQ ID NO: 57695 - protein, 9 aa, Homo Sapiens
CFATSPRLH

SEQ ID NO: 57696 - protein, 9 aa, Homo Sapiens
GTAVNATPA

SEQ ID NO: 57697 - protein, 9 aa, Homo Sapiens
SHSKSQLGR

SEQ ID NO: 57698 - protein, 9 aa, Homo Sapiens
MYFRPLTNY

SEQ ID NO: 57699 - protein, 9 aa, Homo Sapiens
LGPPTVTRE

SEQ ID NO: 57700 - protein, 9 aa, Homo Sapiens
RCIPISPRY

SEQ ID NO: 57701 - protein, 9 aa, Homo Sapiens
VTTIQTSAQ

SEQ ID NO: 57702 - protein, 9 aa, Homo Sapiens
VLRLYEYDD

SEQ ID NO: 57703 - protein, 9 aa, Homo Sapiens
QDTKGCRVC

SEQ ID NO: 57704 - protein, 9 aa, Homo Sapiens
ILLEKMKHL

SEQ ID NO: 57705 - protein, 9 aa, Homo Sapiens
ELEKDKTGL

SEQ ID NO: 57706 - protein, 9 aa, Homo Sapiens
SHTVGATTS

SEQ ID NO: 57707 - protein, 9 aa, Homo Sapiens
LGPGGPLGY

SEQ ID NO: 57708 - protein, 9 aa, Homo Sapiens
LKTRSACGL

SEQ ID NO: 57709 - protein, 9 aa, Homo Sapiens
AVLKEQIKL

SEQ ID NO: 57710 - protein, 9 aa, Homo Sapiens
SRPEYNILI

SEQ ID NO: 57711 - protein, 9 aa, Homo Sapiens
ILINLDHVE

SEQ ID NO: 57712 - protein, 9 aa, Homo Sapiens
PGVLLPKLI

SEQ ID NO: 57713 - protein, 9 aa, Homo Sapiens
LKEQIKLLK

SEQ ID NO: 57714 - protein, 9 aa, Homo Sapiens
RLHAKFYAD

SEQ ID NO: 57715 - protein, 9 aa, Homo Sapiens
VLQECEKKK

SEQ ID NO: 57716 - protein, 9 aa, Homo Sapiens
DKQPILLNK

SEQ ID NO: 57717 - protein, 9 aa, Homo Sapiens
KVQASQITA

SEQ ID NO: 57718 - protein, 9 aa, Homo Sapiens
EGAVLRLYE

SEQ ID NO: 57719 - protein, 9 aa, Homo Sapiens
TGLGLSLAG

SEQ ID NO: 57720 - protein, 9 aa, Homo Sapiens
GIFFFLEKA

SEQ ID NO: 57721 - protein, 9 aa, Homo Sapiens
GDSSRCQTA

SEQ ID NO: 57722 - protein, 9 aa, Homo Sapiens
SVFTGHATP

SEQ ID NO: 57723 - protein, 9 aa, Homo Sapiens
VGPCRQPPE

SEQ ID NO: 57724 - protein, 9 aa, Homo Sapiens
VGKCQGLFA

SEQ ID NO: 57725 - protein, 9 aa, Homo Sapiens
KWVRWNTAP

SEQ ID NO: 57726 - protein, 9 aa, Homo Sapiens
WDRKCQTTP

SEQ ID NO: 57727 - protein, 9 aa, Homo Sapiens
FQCWEKVQA

SEQ ID NO: 57728 - protein, 9 aa, Homo Sapiens
VCPPPPGLP

SEQ ID NO: 57729 - protein, 9 aa, Homo Sapiens
KTGNVLPMF

SEQ ID NO: 57730 - protein, 9 aa, Homo Sapiens
FFFLEKAIG

SEQ ID NO: 57731 - protein, 9 aa, Homo Sapiens
FDLELPDGY

SEQ ID NO: 57732 - protein, 9 aa, Homo Sapiens
LHPCIFRCH

SEQ ID NO: 57733 - protein, 9 aa, Homo Sapiens
CEKKKLLIH

SEQ ID NO: 57734 - protein, 9 aa, Homo Sapiens
LAYECVGPC

SEQ ID NO: 57735 - protein, 9 aa, Homo Sapiens
WLLQLEQPM

SEQ ID NO: 57736 - protein, 9 aa, Homo Sapiens
ELEDYVSYE

SEQ ID NO: 57737 - protein, 9 aa, Homo Sapiens
KTGLGLSLA

SEQ ID NO: 57738 - protein, 9 aa, Homo Sapiens
LLEKMKHLN

SEQ ID NO: 57739 - protein, 9 aa, Homo Sapiens
VEVHFQGVW

SEQ ID NO: 57740 - protein, 9 aa, Homo Sapiens
CIPISPRYL

SEQ ID NO: 57741 - protein, 9 aa, Homo Sapiens
QVEVHFQGV

SEQ ID NO: 57742 - protein, 9 aa, Homo Sapiens
HAAPHHHHH

SEQ ID NO: 57743 - protein, 9 aa, Homo Sapiens
EKDKTGLGL

SEQ ID NO: 57744 - protein, 9 aa, Homo Sapiens
AYECVGPCR

SEQ ID NO: 57745 - protein, 9 aa, Homo Sapiens
VLPMFYVYD

SEQ ID NO: 57746 - protein, 9 aa, Homo Sapiens
SPFGSCLWP

SEQ ID NO: 57747 - protein, 9 aa, Homo Sapiens
SGMCVCPPP

SEQ ID NO: 57748 - protein, 9 aa, Homo Sapiens
AHHHHAAPH

SEQ ID NO: 57749 - protein, 9 aa, Homo Sapiens
KDKTGLGLS

SEQ ID NO: 57750 - protein, 9 aa, Homo Sapiens
DRKCQTTPR

SEQ ID NO: 57751 - protein, 9 aa, Homo Sapiens
EATNAVLKE

SEQ ID NO: 57752 - protein, 9 aa, Homo Sapiens
YWSLLLEFL

SEQ ID NO: 57753 - protein, 9 aa, Homo Sapiens
MKHLNIVAF

SEQ ID NO: 57754 - protein, 9 aa, Homo Sapiens
VRWNTAPHQ

SEQ ID NO: 57755 - protein, 9 aa, Homo Sapiens
IQTSAQEFD

SEQ ID NO: 57756 - protein, 9 aa, Homo Sapiens
IQDTKGCRV

SEQ ID NO: 57757 - protein, 9 aa, Homo Sapiens
MCVCPPPPG

SEQ ID NO: 57758 - protein, 9 aa, Homo Sapiens
HHHAAPHHH

SEQ ID NO: 57759 - protein, 9 aa, Homo Sapiens
VDLGNVSEL

SEQ ID NO: 57760 - protein, 9 aa, Homo Sapiens
RVCCVAEGA

SEQ ID NO: 57761 - protein, 9 aa, Homo Sapiens
HGDSSRCQT

SEQ ID NO: 57762 - protein, 9 aa, Homo Sapiens
ILLFVYADD

SEQ ID NO: 57763 - protein, 9 aa, Homo Sapiens
TVLLRTTYE

SEQ ID NO: 57764 - protein, 9 aa, Homo Sapiens
DGEMDWKLR

SEQ ID NO: 57765 - protein, 9 aa, Homo Sapiens
WPLRDEDDL

SEQ ID NO: 57766 - protein, 9 aa, Homo Sapiens
LQECEKKKL

SEQ ID NO: 57767 - protein, 9 aa, Homo Sapiens
TGKLASADT

SEQ ID NO: 57768 - protein, 9 aa, Homo Sapiens
PLGYPGEKG

SEQ ID NO: 57769 - protein, 9 aa, Homo Sapiens
PPPPGLPHP

SEQ ID NO: 57770 - protein, 9 aa, Homo Sapiens
TYEFQIYSW

SEQ ID NO: 57771 - protein, 9 aa, Homo Sapiens
TKTGNVLPM

SEQ ID NO: 57772 - protein, 9 aa, Homo Sapiens
DMKSFIAVL

SEQ ID NO: 57773 - protein, 9 aa, Homo Sapiens
TWLLQLEQP

SEQ ID NO: 57774 - protein, 9 aa, Homo Sapiens
GHGDSSRCQ

SEQ ID NO: 57775 - protein, 9 aa, Homo Sapiens
TGNVLPMFY

SEQ ID NO: 57776 - protein, 9 aa, Homo Sapiens
NVSELRTFR

SEQ ID NO: 57777 - protein, 9 aa, Homo Sapiens
TSPRLHAKF

SEQ ID NO: 57778 - protein, 9 aa, Homo Sapiens
LLPERHTKE

SEQ ID NO: 57779 - protein, 9 aa, Homo Sapiens
TVTREGGDP

SEQ ID NO: 57780 - protein, 9 aa, Homo Sapiens
SPRLHAKFY

SEQ ID NO: 57781 - protein, 9 aa, Homo Sapiens
SVGHGDSSR

SEQ ID NO: 57782 - protein, 9 aa, Homo Sapiens
LPGDKWVRW

SEQ ID NO: 57783 - protein, 9 aa, Homo Sapiens
SELRTFRVL

SEQ ID NO: 57784 - protein, 9 aa, Homo Sapiens
GSQLNESMD

SEQ ID NO: 57785 - protein, 9 aa, Homo Sapiens
GAESICLNT

SEQ ID NO: 57786 - protein, 9 aa, Homo Sapiens
APIKITWAT

SEQ ID NO: 57787 - protein, 9 aa, Homo Sapiens
VLSHLPSHH

SEQ ID NO: 57788 - protein, 9 aa, Homo Sapiens
SSSRARSWA

SEQ ID NO: 57789 - protein, 9 aa, Homo Sapiens
ILYSAQIAC

SEQ ID NO: 57790 - protein, 9 aa, Homo Sapiens
ALYMHVKKV

SEQ ID NO: 57791 - protein, 9 aa, Homo Sapiens
LGDGVDQTS

SEQ ID NO: 57792 - protein, 9 aa, Homo Sapiens
HVATIQCRS

SEQ ID NO: 57793 - protein, 9 aa, Homo Sapiens
SPNLATFVF

SEQ ID NO: 57794 - protein, 9 aa, Homo Sapiens
FTCTGQHTS

SEQ ID NO: 57795 - protein, 9 aa, Homo Sapiens
QGPRDIPSL

SEQ ID NO: 57796 - protein, 9 aa, Homo Sapiens
CKEAINVLS

SEQ ID NO: 57797 - protein, 9 aa, Homo Sapiens
QGESCFQGP

SEQ ID NO: 57798 - protein, 9 aa, Homo Sapiens
FSVVPPVSI

SEQ ID NO: 57799 - protein, 9 aa, Homo Sapiens
QHTSVHLGQ

SEQ ID NO: 57800 - protein, 9 aa, Homo Sapiens
LYMHVKKVS

SEQ ID NO: 57801 - protein, 9 aa, Homo Sapiens
LHFQEVQTK

SEQ ID NO: 57802 - protein, 9 aa, Homo Sapiens
MVCEAPLAL

SEQ ID NO: 57803 - protein, 9 aa, Homo Sapiens
NLATFVFSV

SEQ ID NO: 57804 - protein, 9 aa, Homo Sapiens
WGGAGGSPK

SEQ ID NO: 57805 - protein, 9 aa, Homo Sapiens
FFDRGTSIV

SEQ ID NO: 57806 - protein, 9 aa, Homo Sapiens
FQEVQTKLR

SEQ ID NO: 57807 - protein, 9 aa, Homo Sapiens
AILMYVFCT

SEQ ID NO: 57808 - protein, 9 aa, Homo Sapiens
GFFDRGTSI

SEQ ID NO: 57809 - protein, 9 aa, Homo Sapiens
LATFVFSVV

SEQ ID NO: 57810 - protein, 9 aa, Homo Sapiens
TWATDNREI

SEQ ID NO: 57811 - protein, 9 aa, Homo Sapiens
LKVFIGSPC

SEQ ID NO: 57812 - protein, 9 aa, Homo Sapiens
RSAFHHSYL

SEQ ID NO: 57813 - protein, 9 aa, Homo Sapiens
WGGEKWGGA

SEQ ID NO: 57814 - protein, 9 aa, Homo Sapiens
WAPGPRDTD

SEQ ID NO: 57815 - protein, 9 aa, Homo Sapiens
FLSALYMHV

SEQ ID NO: 57816 - protein, 9 aa, Homo Sapiens
HTSVHLGQL

SEQ ID NO: 57817 - protein, 9 aa, Homo Sapiens
VPEKKMPFA

SEQ ID NO: 57818 - protein, 9 aa, Homo Sapiens
NTPICMVCE

SEQ ID NO: 57819 - protein, 9 aa, Homo Sapiens
EGFFDRGTS

SEQ ID NO: 57820 - protein, 9 aa, Homo Sapiens
NLPTIAQVT

SEQ ID NO: 57821 - protein, 9 aa, Homo Sapiens
PNLATFVFS

SEQ ID NO: 57822 - protein, 9 aa, Homo Sapiens
LIVGKGPCL

SEQ ID NO: 57823 - protein, 9 aa, Homo Sapiens
LMYVFCTDC

SEQ ID NO: 57824 - protein, 9 aa, Homo Sapiens
CLNTKEDKN

SEQ ID NO: 57825 - protein, 9 aa, Homo Sapiens
HLFKTPQLK

SEQ ID NO: 57826 - protein, 9 aa, Homo Sapiens
TQGPRDIPS

SEQ ID NO: 57827 - protein, 9 aa, Homo Sapiens
GKGPCLLGE

SEQ ID NO: 57828 - protein, 9 aa, Homo Sapiens
EDSMDCGSA

SEQ ID NO: 57829 - protein, 9 aa, Homo Sapiens
CWHFFTITA

SEQ ID NO: 57830 - protein, 9 aa, Homo Sapiens
AQFREDHPD

SEQ ID NO: 57831 - protein, 9 aa, Homo Sapiens
QCRSNGKWD

SEQ ID NO: 57832 - protein, 9 aa, Homo Sapiens
PRDIPSLVV

SEQ ID NO: 57833 - protein, 9 aa, Homo Sapiens
VLKVFIGSP

SEQ ID NO: 57834 - protein, 9 aa, Homo Sapiens
LIEFAAVNS

SEQ ID NO: 57835 - protein, 9 aa, Homo Sapiens
DLLAEDSMD

SEQ ID NO: 57836 - protein, 9 aa, Homo Sapiens
IGSPCGLNL

SEQ ID NO: 57837 - protein, 9 aa, Homo Sapiens
PIKITWATD

SEQ ID NO: 57838 - protein, 9 aa, Homo Sapiens
ASMAPELSD

SEQ ID NO: 57839 - protein, 9 aa, Homo Sapiens
EKKMPFAPP

SEQ ID NO: 57840 - protein, 9 aa, Homo Sapiens
VKKVSSAIL

SEQ ID NO: 57841 - protein, 9 aa, Homo Sapiens
GTHDKMICR

SEQ ID NO: 57842 - protein, 9 aa, Homo Sapiens
PTIAQVTIE

SEQ ID NO: 57843 - protein, 9 aa, Homo Sapiens
TYGYLQGES

SEQ ID NO: 57844 - protein, 9 aa, Homo Sapiens
QVMRLVKLL

SEQ ID NO: 57845 - protein, 9 aa, Homo Sapiens
VFCTDCWLI

SEQ ID NO: 57846 - protein, 9 aa, Homo Sapiens
FERNLAQFR

SEQ ID NO: 57847 - protein, 9 aa, Homo Sapiens
FAAVNSFTN

SEQ ID NO: 57848 - protein, 9 aa, Homo Sapiens
PVKSLCHLA

SEQ ID NO: 57849 - protein, 9 aa, Homo Sapiens
ARSWAPGPR

SEQ ID NO: 57850 - protein, 9 aa, Homo Sapiens
LDMSRVILY

SEQ ID NO: 57851 - protein, 9 aa, Homo Sapiens
SRVILYSAQ

SEQ ID NO: 57852 - protein, 9 aa, Homo Sapiens
MASWGGEKW

SEQ ID NO: 57853 - protein, 9 aa, Homo Sapiens
WATDNREIR

SEQ ID NO: 57854 - protein, 9 aa, Homo Sapiens
MNTPICMVC

SEQ ID NO: 57855 - protein, 9 aa, Homo Sapiens
DGVDQTSTI

SEQ ID NO: 57856 - protein, 9 aa, Homo Sapiens
ILMYVFCTD

SEQ ID NO: 57857 - protein, 9 aa, Homo Sapiens
QTKLRIHLL

SEQ ID NO: 57858 - protein, 9 aa, Homo Sapiens
WNLPTIAQV

SEQ ID NO: 57859 - protein, 9 aa, Homo Sapiens
IFTCTGQHT

SEQ ID NO: 57860 - protein, 9 aa, Homo Sapiens
SICLLFPQY

SEQ ID NO: 57861 - protein, 9 aa, Homo Sapiens
VTDLIVGKG

SEQ ID NO: 57862 - protein, 9 aa, Homo Sapiens
VMNVLKVFI

SEQ ID NO: 57863 - protein, 9 aa, Homo Sapiens
TGQHTSVHL

SEQ ID NO: 57864 - protein, 9 aa, Homo Sapiens
YVFCTDCWL

SEQ ID NO: 57865 - protein, 9 aa, Homo Sapiens
SITFFRLFQ

SEQ ID NO: 57866 - protein, 9 aa, Homo Sapiens
FTITARVIT

SEQ ID NO: 57867 - protein, 9 aa, Homo Sapiens
GEKWGGAGG

SEQ ID NO: 57868 - protein, 9 aa, Homo Sapiens
FDRGTSIVE

SEQ ID NO: 57869 - protein, 9 aa, Homo Sapiens
RGTSIVEDK

SEQ ID NO: 57870 - protein, 9 aa, Homo Sapiens
HDKMICREL

SEQ ID NO: 57871 - protein, 9 aa, Homo Sapiens
VFIGSPCGL

SEQ ID NO: 57872 - protein, 9 aa, Homo Sapiens
QEFERNLAQ

SEQ ID NO: 57873 - protein, 9 aa, Homo Sapiens
TITARVITF

SEQ ID NO: 57874 - protein, 9 aa, Homo Sapiens
HVKKVSSAI

SEQ ID NO: 57875 - protein, 9 aa, Homo Sapiens
MSRVILYSA

SEQ ID NO: 57876 - protein, 9 aa, Homo Sapiens
SMDCGSAEE

SEQ ID NO: 57877 - protein, 9 aa, Homo Sapiens
RLFQVMRLV

SEQ ID NO: 57878 - protein, 9 aa, Homo Sapiens
LEEGSQLNE

SEQ ID NO: 57879 - protein, 9 aa, Homo Sapiens
LSALYMHVK

SEQ ID NO: 57880 - protein, 9 aa, Homo Sapiens
ATFVFSVVP

SEQ ID NO: 57881 - protein, 9 aa, Homo Sapiens
REGRHWASI

SEQ ID NO: 57882 - protein, 9 aa, Homo Sapiens
KGPCLLGEP

SEQ ID NO: 57883 - protein, 9 aa, Homo Sapiens
ESICLNTKE

SEQ ID NO: 57884 - protein, 9 aa, Homo Sapiens
SICLNTKED

SEQ ID NO: 57885 - protein, 9 aa, Homo Sapiens
EAINVLSHL

SEQ ID NO: 57886 - protein, 9 aa, Homo Sapiens
YMHVKKVSS

SEQ ID NO: 57887 - protein, 9 aa, Homo Sapiens
TCTGQHTSV

SEQ ID NO: 57888 - protein, 9 aa, Homo Sapiens
ICLLFPQYC

SEQ ID NO: 57889 - protein, 9 aa, Homo Sapiens
SQLNESMDH

SEQ ID NO: 57890 - protein, 9 aa, Homo Sapiens
LLHFQEVQT

SEQ ID NO: 57891 - protein, 9 aa, Homo Sapiens
SAILMYVFC

SEQ ID NO: 57892 - protein, 9 aa, Homo Sapiens
GESCFQGPH

SEQ ID NO: 57893 - protein, 9 aa, Homo Sapiens
DMSRVILYS

SEQ ID NO: 57894 - protein, 9 aa, Homo Sapiens
TSIVEDKLV

SEQ ID NO: 57895 - protein, 9 aa, Homo Sapiens
GLDMSRVIL

SEQ ID NO: 57896 - protein, 9 aa, Homo Sapiens
FCWHFFTIT

SEQ ID NO: 57897 - protein, 9 aa, Homo Sapiens
GDGVDQTST

SEQ ID NO: 57898 - protein, 9 aa, Homo Sapiens
YNCKEAINV

SEQ ID NO: 57899 - protein, 9 aa, Homo Sapiens
WASICLLFP

SEQ ID NO: 57900 - protein, 9 aa, Homo Sapiens
VEGFFDRGT

SEQ ID NO: 57901 - protein, 9 aa, Homo Sapiens
AINVLSHLP

SEQ ID NO: 57902 - protein, 9 aa, Homo Sapiens
DSMDCGSAE

SEQ ID NO: 57903 - protein, 9 aa, Homo Sapiens
AVNSFTNIQ

SEQ ID NO: 57904 - protein, 9 aa, Homo Sapiens
RNLAQFRED

SEQ ID NO: 57905 - protein, 9 aa, Homo Sapiens
LASQSLPAM

SEQ ID NO: 57906 - protein, 9 aa, Homo Sapiens
LCHLASQSL

SEQ ID NO: 57907 - protein, 9 aa, Homo Sapiens
ALGDGVDQT

SEQ ID NO: 57908 - protein, 9 aa, Homo Sapiens
MLGTHDKMI

SEQ ID NO: 57909 - protein, 9 aa, Homo Sapiens
HHSYLHLAE

SEQ ID NO: 57910 - protein, 9 aa, Homo Sapiens
SMLGTHDKM

SEQ ID NO: 57911 - protein, 9 aa, Homo Sapiens
SWAPGPRDT

SEQ ID NO: 57912 - protein, 9 aa, Homo Sapiens
TPQLKPCQS

SEQ ID NO: 57913 - protein, 9 aa, Homo Sapiens
AFHHSYLHL

SEQ ID NO: 57914 - protein, 9 aa, Homo Sapiens
AEDSMDCGS

SEQ ID NO: 57915 - protein, 9 aa, Homo Sapiens
DCGSAEEVT

SEQ ID NO: 57916 - protein, 9 aa, Homo Sapiens
ETYGYLQGE

SEQ ID NO: 57917 - protein, 9 aa, Homo Sapiens
MDCGSAEEV

SEQ ID NO: 57918 - protein, 9 aa, Homo Sapiens
QLKPCQSDG

SEQ ID NO: 57919 - protein, 9 aa, Homo Sapiens
EEGSQLNES

SEQ ID NO: 57920 - protein, 9 aa, Homo Sapiens
KSLCHLASQ

SEQ ID NO: 57921 - protein, 9 aa, Homo Sapiens
VATIQCRSN

SEQ ID NO: 57922 - protein, 9 aa, Homo Sapiens
VFSVVPPVS

SEQ ID NO: 57923 - protein, 9 aa, Homo Sapiens
YLQGESCFQ

SEQ ID NO: 57924 - protein, 9 aa, Homo Sapiens
SYASMAPEL

SEQ ID NO: 57925 - protein, 9 aa, Homo Sapiens
MPFAPPKKP

SEQ ID NO: 57926 - protein, 9 aa, Homo Sapiens
EDELEEGSQ

SEQ ID NO: 57927 - protein, 9 aa, Homo Sapiens
IEFAAVNSF

SEQ ID NO: 57928 - protein, 9 aa, Homo Sapiens
KWGGAGGSP

SEQ ID NO: 57929 - protein, 9 aa, Homo Sapiens
AAVNSFTNI

SEQ ID NO: 57930 - protein, 9 aa, Homo Sapiens
PAGAESICL

SEQ ID NO: 57931 - protein, 9 aa, Homo Sapiens
QISYASMAP

SEQ ID NO: 57932 - protein, 9 aa, Homo Sapiens
CLLGEPAWN

SEQ ID NO: 57933 - protein, 9 aa, Homo Sapiens
LAEDSMDCG

SEQ ID NO: 57934 - protein, 9 aa, Homo Sapiens
IKITWATDN

SEQ ID NO: 57935 - protein, 9 aa, Homo Sapiens
AQHHVATIQ

SEQ ID NO: 57936 - protein, 9 aa, Homo Sapiens
VPMNTPICM

SEQ ID NO: 57937 - protein, 9 aa, Homo Sapiens
SLCHLASQS

SEQ ID NO: 57938 - protein, 9 aa, Homo Sapiens
VQTKLRIHL

SEQ ID NO: 57939 - protein, 9 aa, Homo Sapiens
PICMVCEAP

SEQ ID NO: 57940 - protein, 9 aa, Homo Sapiens
CSAILMYVF

SEQ ID NO: 57941 - protein, 9 aa, Homo Sapiens
SFTNIQMEK

SEQ ID NO: 57942 - protein, 9 aa, Homo Sapiens
LKPCQSDGN

SEQ ID NO: 57943 - protein, 9 aa, Homo Sapiens
IPQISYASM

SEQ ID NO: 57944 - protein, 9 aa, Homo Sapiens
ATDNREIRP

SEQ ID NO: 57945 - protein, 9 aa, Homo Sapiens
AEEVTDLIV

SEQ ID NO: 57946 - protein, 9 aa, Homo Sapiens
ASICLLFPQ

SEQ ID NO: 57947 - protein, 9 aa, Homo Sapiens
RPRSAFHHS

SEQ ID NO: 57948 - protein, 9 aa, Homo Sapiens
SENARTQGP

SEQ ID NO: 57949 - protein, 9 aa, Homo Sapiens
ACSAILMYV

SEQ ID NO: 57950 - protein, 9 aa, Homo Sapiens
CHLASQSLP

SEQ ID NO: 57951 - protein, 9 aa, Homo Sapiens
TFFRLFQVM

SEQ ID NO: 57952 - protein, 9 aa, Homo Sapiens
FQVMRLVKL

SEQ ID NO: 57953 - protein, 9 aa, Homo Sapiens
HFFTITARV

SEQ ID NO: 57954 - protein, 9 aa, Homo Sapiens
SMAPELSDD

SEQ ID NO: 57955 - protein, 9 aa, Homo Sapiens
PRSAFHHSY

SEQ ID NO: 57956 - protein, 9 aa, Homo Sapiens
LGTHDKMIC

SEQ ID NO: 57957 - protein, 9 aa, Homo Sapiens
RSWAPGPRD

SEQ ID NO: 57958 - protein, 9 aa, Homo Sapiens
TDNREIRPG

SEQ ID NO: 57959 - protein, 9 aa, Homo Sapiens
DRGTSIVED

SEQ ID NO: 57960 - protein, 9 aa, Homo Sapiens
AGAESICLN

SEQ ID NO: 57961 - protein, 9 aa, Homo Sapiens
GEPAWNSRS

SEQ ID NO: 57962 - protein, 9 aa, Homo Sapiens
IQCRSNGKW

SEQ ID NO: 57963 - protein, 9 aa, Homo Sapiens
VKSLCHLAS

SEQ ID NO: 57964 - protein, 9 aa, Homo Sapiens
FKTPQLKPC

SEQ ID NO: 57965 - protein, 9 aa, Homo Sapiens
ICLNTKEDK

SEQ ID NO: 57966 - protein, 9 aa, Homo Sapiens
ARTQGPRDI

SEQ ID NO: 57967 - protein, 9 aa, Homo Sapiens
PRPRSAFHH

SEQ ID NO: 57968 - protein, 9 aa, Homo Sapiens
PFAPPKKPE

SEQ ID NO: 57969 - protein, 9 aa, Homo Sapiens
GSAEEVTDL

SEQ ID NO: 57970 - protein, 9 aa, Homo Sapiens
FWNLPTIAQ

SEQ ID NO: 57971 - protein, 9 aa, Homo Sapiens
ITWATDNRE

SEQ ID NO: 57972 - protein, 9 aa, Homo Sapiens
LFQVMRLVK

SEQ ID NO: 57973 - protein, 9 aa, Homo Sapiens
EFERNLAQF

SEQ ID NO: 57974 - protein, 9 aa, Homo Sapiens
LNFWNLPTI

SEQ ID NO: 57975 - protein, 9 aa, Homo Sapiens
LLGEPAWNS

SEQ ID NO: 57976 - protein, 9 aa, Homo Sapiens
FAPPKKPEV

SEQ ID NO: 57977 - protein, 9 aa, Homo Sapiens
INVLSHLPS

SEQ ID NO: 57978 - protein, 9 aa, Homo Sapiens
ASWGGEKWG

SEQ ID NO: 57979 - protein, 9 aa, Homo Sapiens
DLIVGKGPC

SEQ ID NO: 57980 - protein, 9 aa, Homo Sapiens
SSRARSWAP

SEQ ID NO: 57981 - protein, 9 aa, Homo Sapiens
LFKTPQLKP

SEQ ID NO: 57982 - protein, 9 aa, Homo Sapiens
LGEPAWNSR

SEQ ID NO: 57983 - protein, 9 aa, Homo Sapiens
CGSAEEVTD

SEQ ID NO: 57984 - protein, 9 aa, Homo Sapiens
RHWASICLL

SEQ ID NO: 57985 - protein, 9 aa, Homo Sapiens
HFQEVQTKL

SEQ ID NO: 57986 - protein, 9 aa, Homo Sapiens
PQLKPCQSD

SEQ ID NO: 57987 - protein, 9 aa, Homo Sapiens
MNVLKVFIG

SEQ ID NO: 57988 - protein, 9 aa, Homo Sapiens
KMPFAPPKK

SEQ ID NO: 57989 - protein, 9 aa, Homo Sapiens
EKWGGAGGS

SEQ ID NO: 57990 - protein, 9 aa, Homo Sapiens
FRLFQVMRL

SEQ ID NO: 57991 - protein, 9 aa, Homo Sapiens
SAEEVTDLI

SEQ ID NO: 57992 - protein, 9 aa, Homo Sapiens
EEVTDLIVG

SEQ ID NO: 57993 - protein, 9 aa, Homo Sapiens
ELEEGSQLN

SEQ ID NO: 57994 - protein, 9 aa, Homo Sapiens
NARTQGPRD

SEQ ID NO: 57995 - protein, 9 aa, Homo Sapiens
FFRLFQVMR

SEQ ID NO: 57996 - protein, 9 aa, Homo Sapiens
TDLIVGKGP

SEQ ID NO: 57997 - protein, 9 aa, Homo Sapiens
LLAEDSMDC

SEQ ID NO: 57998 - protein, 9 aa, Homo Sapiens
PQISYASMA

SEQ ID NO: 57999 - protein, 9 aa, Homo Sapiens
NFWNLPTIA

SEQ ID NO: 58000 - protein, 9 aa, Homo Sapiens
LYSAQIACG

SEQ ID NO: 58001 - protein, 9 aa, Homo Sapiens
TIQCRSNGK

SEQ ID NO: 58002 - protein, 9 aa, Homo Sapiens
ITARVITFA

SEQ ID NO: 58003 - protein, 9 aa, Homo Sapiens
KKMPFAPPK

SEQ ID NO: 58004 - protein, 9 aa, Homo Sapiens
FIGSPCGLN

SEQ ID NO: 58005 - protein, 9 aa, Homo Sapiens
ISYASMAPE

SEQ ID NO: 58006 - protein, 9 aa, Homo Sapiens
VILYSAQIA

SEQ ID NO: 58007 - protein, 9 aa, Homo Sapiens
ENARTQGPR

SEQ ID NO: 58008 - protein, 9 aa, Homo Sapiens
EFAAVNSFT

SEQ ID NO: 58009 - protein, 9 aa, Homo Sapiens
HWASICLLF

SEQ ID NO: 58010 - protein, 9 aa, Homo Sapiens
GPRPRSAFH

SEQ ID NO: 58011 - protein, 9 aa, Homo Sapiens
ITFFRLFQV

SEQ ID NO: 58012 - protein, 9 aa, Homo Sapiens
EPAGAESIC

SEQ ID NO: 58013 - protein, 9 aa, Homo Sapiens
GPRDIPSLV

SEQ ID NO: 58014 - protein, 9 aa, Homo Sapiens
WHFFTITAR

SEQ ID NO: 58015 - protein, 9 aa, Homo Sapiens
SEDELEEGS

SEQ ID NO: 58016 - protein, 9 aa, Homo Sapiens
KITWATDNR

SEQ ID NO: 58017 - protein, 9 aa, Homo Sapiens
GDLLAEDSM

SEQ ID NO: 58018 - protein, 9 aa, Homo Sapiens
PCLLGEPAW

SEQ ID NO: 58019 - protein, 9 aa, Homo Sapiens
NVLKVFIGS

SEQ ID NO: 58020 - protein, 9 aa, Homo Sapiens
GPCLLGEPA

SEQ ID NO: 58021 - protein, 9 aa, Homo Sapiens
LQGESCFQG

SEQ ID NO: 58022 - protein, 9 aa, Homo Sapiens
SRARSWAPG

SEQ ID NO: 58023 - protein, 9 aa, Homo Sapiens
LAQFREDHP

SEQ ID NO: 58024 - protein, 9 aa, Homo Sapiens
EGSQLNESM

SEQ ID NO: 58025 - protein, 9 aa, Homo Sapiens
DELEEGSQL

SEQ ID NO: 58026 - protein, 9 aa, Homo Sapiens
LPTIAQVTI

SEQ ID NO: 58027 - protein, 9 aa, Homo Sapiens
HLASQSLPA

SEQ ID NO: 58028 - protein, 9 aa, Homo Sapiens
MHVKKVSSA

SEQ ID NO: 58029 - protein, 9 aa, Homo Sapiens
NSFTNIQME

SEQ ID NO: 58030 - protein, 9 aa, Homo Sapiens
EGRHWASIC

SEQ ID NO: 58031 - protein, 9 aa, Homo Sapiens
GQHTSVHLG

SEQ ID NO: 58032 - protein, 9 aa, Homo Sapiens
KTPQLKPCQ

SEQ ID NO: 58033 - protein, 9 aa, Homo Sapiens
GTSIVEDKL

SEQ ID NO: 58034 - protein, 9 aa, Homo Sapiens
GYLQGESCF

SEQ ID NO: 58035 - protein, 9 aa, Homo Sapiens
TSVHLGQLD

SEQ ID NO: 58036 - protein, 9 aa, Homo Sapiens
RVILYSAQI

SEQ ID NO: 58037 - protein, 9 aa, Homo Sapiens
VPVKSLCHL

SEQ ID NO: 58038 - protein, 9 aa, Homo Sapiens
ATIQCRSNG

SEQ ID NO: 58039 - protein, 9 aa, Homo Sapiens
MYVFCTDCW

SEQ ID NO: 58040 - protein, 9 aa, Homo Sapiens
VVPEKKMPF

SEQ ID NO: 58041 - protein, 9 aa, Homo Sapiens
SWGGEKWGG

SEQ ID NO: 58042 - protein, 9 aa, Homo Sapiens
HHVATIQCR

SEQ ID NO: 58043 - protein, 9 aa, Homo Sapiens
THDKMICRE

SEQ ID NO: 58044 - protein, 9 aa, Homo Sapiens
AESICLNTK

SEQ ID NO: 58045 - protein, 9 aa, Homo Sapiens
HALGDGVDQ

SEQ ID NO: 58046 - protein, 9 aa, Homo Sapiens
QEVQTKLRI

SEQ ID NO: 58047 - protein, 9 aa, Homo Sapiens
DKMICRELC

SEQ ID NO: 58048 - protein, 9 aa, Homo Sapiens
EVQTKLRIH

SEQ ID NO: 58049 - protein, 9 aa, Homo Sapiens
QHHVATIQC

SEQ ID NO: 58050 - protein, 9 aa, Homo Sapiens
TPICMVCEA

SEQ ID NO: 58051 - protein, 9 aa, Homo Sapiens
NCKEAINVL

SEQ ID NO: 58052 - protein, 9 aa, Homo Sapiens
GRHWASICL

SEQ ID NO: 58053 - protein, 9 aa, Homo Sapiens
ERNLAQFRE

SEQ ID NO: 58054 - protein, 9 aa, Homo Sapiens
SAFHHSYLH

SEQ ID NO: 58055 - protein, 9 aa, Homo Sapiens
EVTDLIVGK

SEQ ID NO: 58056 - protein, 9 aa, Homo Sapiens
YGYLQGESC

SEQ ID NO: 58057 - protein, 9 aa, Homo Sapiens
YASMAPELS

SEQ ID NO: 58058 - protein, 9 aa, Homo Sapiens
RTQGPRDIP

SEQ ID NO: 58059 - protein, 9 aa, Homo Sapiens
KVFIGSPCG

SEQ ID NO: 58060 - protein, 9 aa, Homo Sapiens
IVGKGPCLL

SEQ ID NO: 58061 - protein, 9 aa, Homo Sapiens
GGEKWGGAG

SEQ ID NO: 58062 - protein, 9 aa, Homo Sapiens
FVFSVVPPV

SEQ ID NO: 58063 - protein, 9 aa, Homo Sapiens
RARSWAPGP

SEQ ID NO: 58064 - protein, 9 aa, Homo Sapiens
FFTITARVI

SEQ ID NO: 58065 - protein, 9 aa, Homo Sapiens
TARVITFAL

SEQ ID NO: 58066 - protein, 9 aa, Homo Sapiens
QFREDHPDL

SEQ ID NO: 58067 - protein, 9 aa, Homo Sapiens
KEAINVLSH

SEQ ID NO: 58068 - protein, 9 aa, Homo Sapiens
VNSFTNIQM

SEQ ID NO: 58069 - protein, 9 aa, Homo Sapiens
TFVFSVVPP

SEQ ID NO: 58070 - protein, 9 aa, Homo Sapiens
CMVCEAPLA

SEQ ID NO: 58071 - protein, 9 aa, Homo Sapiens
CTGQHTSVH

SEQ ID NO: 58072 - protein, 9 aa, Homo Sapiens
VGKGPCLLG

SEQ ID NO: 58073 - protein, 9 aa, Homo Sapiens
METYGYLQG

SEQ ID NO: 58074 - protein, 9 aa, Homo Sapiens
MAPELSDDR

SEQ ID NO: 58075 - protein, 9 aa, Homo Sapiens
GSSSRARSW

SEQ ID NO: 58076 - protein, 9 aa, Homo Sapiens
SALYMHVKK

SEQ ID NO: 58077 - protein, 9 aa, Homo Sapiens
IAQVTIEAE

SEQ ID NO: 58078 - protein, 9 aa, Homo Sapiens
PEKKMPFAP

SEQ ID NO: 58079 - protein, 9 aa, Homo Sapiens
ICMVCEAPL

SEQ ID NO: 58080 - protein, 9 aa, Homo Sapiens
NVLSHLPSH

SEQ ID NO: 58081 - protein, 9 aa, Homo Sapiens
TIAQVTIEA

SEQ ID NO: 58082 - protein, 9 aa, Homo Sapiens
NLAQFREDH

SEQ ID NO: 58083 - protein, 9 aa, Homo Sapiens
FHHSYLHLA

SEQ ID NO: 58084 - protein, 9 aa, Homo Sapiens
KPCQSDGNK

SEQ ID NO: 58085 - protein, 9 aa, Homo Sapiens
PMNTPICMV

SEQ ID NO: 58086 - protein, 9 aa, Homo Sapiens
ALLHFQEVQ

SEQ ID NO: 58087 - protein, 9 aa, Homo Sapiens
CLYLLAAPA

SEQ ID NO: 58088 - protein, 9 aa, Homo Sapiens
RRFPFIGDD

SEQ ID NO: 58089 - protein, 9 aa, Homo Sapiens
WNLNPVFGG

SEQ ID NO: 58090 - protein, 9 aa, Homo Sapiens
ELRIETQGQ

SEQ ID NO: 58091 - protein, 9 aa, Homo Sapiens
PLTEEEEED

SEQ ID NO: 58092 - protein, 9 aa, Homo Sapiens
DILKKKSEN

SEQ ID NO: 58093 - protein, 9 aa, Homo Sapiens
ECLYLLAAP

SEQ ID NO: 58094 - protein, 9 aa, Homo Sapiens
FPFIGDDDN

SEQ ID NO: 58095 - protein, 9 aa, Homo Sapiens
KQMNDARHG

SEQ ID NO: 58096 - protein, 9 aa, Homo Sapiens
KEGRDMANR

SEQ ID NO: 58097 - protein, 9 aa, Homo Sapiens
LTEEEEEDG

SEQ ID NO: 58098 - protein, 9 aa, Homo Sapiens
GTKDSYSVI

SEQ ID NO: 58099 - protein, 9 aa, Homo Sapiens
LKKKSENGR

SEQ ID NO: 58100 - protein, 9 aa, Homo Sapiens
SASQIWNLN

SEQ ID NO: 58101 - protein, 9 aa, Homo Sapiens
DDDNDDGHP

SEQ ID NO: 58102 - protein, 9 aa, Homo Sapiens
NALAFRNSW

SEQ ID NO: 58103 - protein, 9 aa, Homo Sapiens
QIWNLNPVF

SEQ ID NO: 58104 - protein, 9 aa, Homo Sapiens
ARDKIFFLH

SEQ ID NO: 58105 - protein, 9 aa, Homo Sapiens
VPHRPPLPK

SEQ ID NO: 58106 - protein, 9 aa, Homo Sapiens
NDVECPPVS

SEQ ID NO: 58107 - protein, 9 aa, Homo Sapiens
YDPFVLFVQ

SEQ ID NO: 58108 - protein, 9 aa, Homo Sapiens
CLLDFIYTA

SEQ ID NO: 58109 - protein, 9 aa, Homo Sapiens
LWCPHPQRV

SEQ ID NO: 58110 - protein, 9 aa, Homo Sapiens
RVFQAGVQK

SEQ ID NO: 58111 - protein, 9 aa, Homo Sapiens
GHVMMARQK

SEQ ID NO: 58112 - protein, 9 aa, Homo Sapiens
FLLVDCTVV

SEQ ID NO: 58113 - protein, 9 aa, Homo Sapiens
IKCSHLRVF

SEQ ID NO: 58114 - protein, 9 aa, Homo Sapiens
PVRSKEGRD

SEQ ID NO: 58115 - protein, 9 aa, Homo Sapiens
PFVLFVQPV

SEQ ID NO: 58116 - protein, 9 aa, Homo Sapiens
ASQIWNLNP

SEQ ID NO: 58117 - protein, 9 aa, Homo Sapiens
FIGDDDNDD

SEQ ID NO: 58118 - protein, 9 aa, Homo Sapiens
DCTVVMSGS

SEQ ID NO: 58119 - protein, 9 aa, Homo Sapiens
EPVRSKEGR

SEQ ID NO: 58120 - protein, 9 aa, Homo Sapiens
KQEPVRSKE

SEQ ID NO: 58121 - protein, 9 aa, Homo Sapiens
MAGDMSLSE

SEQ ID NO: 58122 - protein, 9 aa, Homo Sapiens
YTRKHGNLT

SEQ ID NO: 58123 - protein, 9 aa, Homo Sapiens
VDCTVVMSG

SEQ ID NO: 58124 - protein, 9 aa, Homo Sapiens
GLQKSHGRD

SEQ ID NO: 58125 - protein, 9 aa, Homo Sapiens
KIGGVALWR

SEQ ID NO: 58126 - protein, 9 aa, Homo Sapiens
NGRSEGHSY

SEQ ID NO: 58127 - protein, 9 aa, Homo Sapiens
ALAFRNSWQ

SEQ ID NO: 58128 - protein, 9 aa, Homo Sapiens
ALALLWDVP

SEQ ID NO: 58129 - protein, 9 aa, Homo Sapiens
TKDSYSVIC

SEQ ID NO: 58130 - protein, 9 aa, Homo Sapiens
HLRVFQAGV

SEQ ID NO: 58131 - protein, 9 aa, Homo Sapiens
FVLFVQPVV

SEQ ID NO: 58132 - protein, 9 aa, Homo Sapiens
LFYTIIVPM

SEQ ID NO: 58133 - protein, 9 aa, Homo Sapiens
RAMAGDMSL

SEQ ID NO: 58134 - protein, 9 aa, Homo Sapiens
IWNLNPVFG

SEQ ID NO: 58135 - protein, 9 aa, Homo Sapiens
IYTRKHGNL

SEQ ID NO: 58136 - protein, 9 aa, Homo Sapiens
ETVSIYTRK

SEQ ID NO: 58137 - protein, 9 aa, Homo Sapiens
NGRSKAFST

SEQ ID NO: 58138 - protein, 9 aa, Homo Sapiens
DVECPPVSS

SEQ ID NO: 58139 - protein, 9 aa, Homo Sapiens
CALALLWDV

SEQ ID NO: 58140 - protein, 9 aa, Homo Sapiens
IEMSTAGWV

SEQ ID NO: 58141 - protein, 9 aa, Homo Sapiens
HFLQGLCGL

SEQ ID NO: 58142 - protein, 9 aa, Homo Sapiens
AGLQCLLDF

SEQ ID NO: 58143 - protein, 9 aa, Homo Sapiens
NKMRKKIGG

SEQ ID NO: 58144 - protein, 9 aa, Homo Sapiens
SSLNKMRKK

SEQ ID NO: 58145 - protein, 9 aa, Homo Sapiens
MSLSENYAF

SEQ ID NO: 58146 - protein, 9 aa, Homo Sapiens
KSHGRDGTR

SEQ ID NO: 58147 - protein, 9 aa, Homo Sapiens
KKSENGRSK

SEQ ID NO: 58148 - protein, 9 aa, Homo Sapiens
EQSTGQAMK

SEQ ID NO: 58149 - protein, 9 aa, Homo Sapiens
AKKTTLAHE

SEQ ID NO: 58150 - protein, 9 aa, Homo Sapiens
KCSHLRVFQ

SEQ ID NO: 58151 - protein, 9 aa, Homo Sapiens
MRKKIGGVA

SEQ ID NO: 58152 - protein, 9 aa, Homo Sapiens
FCCDGHVMM

SEQ ID NO: 58153 - protein, 9 aa, Homo Sapiens
EMSTAGWVG

SEQ ID NO: 58154 - protein, 9 aa, Homo Sapiens
CSHLRVFQA

SEQ ID NO: 58155 - protein, 9 aa, Homo Sapiens
TVVMSGSYS

SEQ ID NO: 58156 - protein, 9 aa, Homo Sapiens
DMSLSENYA

SEQ ID NO: 58157 - protein, 9 aa, Homo Sapiens
EEEDGAGAT

SEQ ID NO: 58158 - protein, 9 aa, Homo Sapiens
HPQRVSIPG

SEQ ID NO: 58159 - protein, 9 aa, Homo Sapiens
SPHFLQGLC

SEQ ID NO: 58160 - protein, 9 aa, Homo Sapiens
VFQAGVQKL

SEQ ID NO: 58161 - protein, 9 aa, Homo Sapiens
PFGPCSTLF

SEQ ID NO: 58162 - protein, 9 aa, Homo Sapiens
LRIETQGQY

SEQ ID NO: 58163 - protein, 9 aa, Homo Sapiens
SQIWNLNPV

SEQ ID NO: 58164 - protein, 9 aa, Homo Sapiens
TAGWVGRFR

SEQ ID NO: 58165 - protein, 9 aa, Homo Sapiens
PLPFGPCST

SEQ ID NO: 58166 - protein, 9 aa, Homo Sapiens
EEEEEDGAG

SEQ ID NO: 58167 - protein, 9 aa, Homo Sapiens
KECLYLLAA

SEQ ID NO: 58168 - protein, 9 aa, Homo Sapiens
SHLRVFQAG

SEQ ID NO: 58169 - protein, 9 aa, Homo Sapiens
ANALAFRNS

SEQ ID NO: 58170 - protein, 9 aa, Homo Sapiens
EGHSYRSRS

SEQ ID NO: 58171 - protein, 9 aa, Homo Sapiens
RNSWQEETR

SEQ ID NO: 58172 - protein, 9 aa, Homo Sapiens
LSASQIWNL

SEQ ID NO: 58173 - protein, 9 aa, Homo Sapiens
VRSKEGRDM

SEQ ID NO: 58174 - protein, 9 aa, Homo Sapiens
TNDRGLQKS

SEQ ID NO: 58175 - protein, 9 aa, Homo Sapiens
YSVICSTAQ

SEQ ID NO: 58176 - protein, 9 aa, Homo Sapiens
IAQSCSPAF

SEQ ID NO: 58177 - protein, 9 aa, Homo Sapiens
KIFFLHGKV

SEQ ID NO: 58178 - protein, 9 aa, Homo Sapiens
HSYRSRSRS

SEQ ID NO: 58179 - protein, 9 aa, Homo Sapiens
PFIGDDDND

SEQ ID NO: 58180 - protein, 9 aa, Homo Sapiens
FFLHGKVNE

SEQ ID NO: 58181 - protein, 9 aa, Homo Sapiens
RIETQGQYD

SEQ ID NO: 58182 - protein, 9 aa, Homo Sapiens
FRNSWQEET

SEQ ID NO: 58183 - protein, 9 aa, Homo Sapiens
AFRNSWQEE

SEQ ID NO: 58184 - protein, 9 aa, Homo Sapiens
TGQAMKYSV

SEQ ID NO: 58185 - protein, 9 aa, Homo Sapiens
AANALAFRN

SEQ ID NO: 58186 - protein, 9 aa, Homo Sapiens
SDMDMSMEH

SEQ ID NO: 58187 - protein, 9 aa, Homo Sapiens
ECPPVSSPP

SEQ ID NO: 58188 - protein, 9 aa, Homo Sapiens
QGTKDSYSV

SEQ ID NO: 58189 - protein, 9 aa, Homo Sapiens
SLNKMRKKI

SEQ ID NO: 58190 - protein, 9 aa, Homo Sapiens
CPHPQRVSI

SEQ ID NO: 58191 - protein, 9 aa, Homo Sapiens
IETQGQYDE

SEQ ID NO: 58192 - protein, 9 aa, Homo Sapiens
PRLWCPHPQ

SEQ ID NO: 58193 - protein, 9 aa, Homo Sapiens
VPSAAGLQC

SEQ ID NO: 58194 - protein, 9 aa, Homo Sapiens
MKQMNDARH

SEQ ID NO: 58195 - protein, 9 aa, Homo Sapiens
SENGRSKAF

SEQ ID NO: 58196 - protein, 9 aa, Homo Sapiens
RGLQKSHGR

SEQ ID NO: 58197 - protein, 9 aa, Homo Sapiens
SVICSTAQR

SEQ ID NO: 58198 - protein, 9 aa, Homo Sapiens
HIEMSTAGW

SEQ ID NO: 58199 - protein, 9 aa, Homo Sapiens
SYSVICSTA

SEQ ID NO: 58200 - protein, 9 aa, Homo Sapiens
SRAMAGDMS

SEQ ID NO: 58201 - protein, 9 aa, Homo Sapiens
RFPFIGDDD

SEQ ID NO: 58202 - protein, 9 aa, Homo Sapiens
ASRAMAGDM

SEQ ID NO: 58203 - protein, 9 aa, Homo Sapiens
GELRIETQG

SEQ ID NO: 58204 - protein, 9 aa, Homo Sapiens
LNKMRKKIG

SEQ ID NO: 58205 - protein, 9 aa, Homo Sapiens
TKECLYLLA

SEQ ID NO: 58206 - protein, 9 aa, Homo Sapiens
IGDDDNDDG

SEQ ID NO: 58207 - protein, 9 aa, Homo Sapiens
AGWVGRFRP

SEQ ID NO: 58208 - protein, 9 aa, Homo Sapiens
GDMSLSENY

SEQ ID NO: 58209 - protein, 9 aa, Homo Sapiens
DSYSVICST

SEQ ID NO: 58210 - protein, 9 aa, Homo Sapiens
LPFGPCSTL

SEQ ID NO: 58211 - protein, 9 aa, Homo Sapiens
MSTAGWVGR

SEQ ID NO: 58212 - protein, 9 aa, Homo Sapiens
HVMMARQKG

SEQ ID NO: 58213 - protein, 9 aa, Homo Sapiens
NIAQSCSPA

SEQ ID NO: 58214 - protein, 9 aa, Homo Sapiens
AGDMSLSEN

SEQ ID NO: 58215 - protein, 9 aa, Homo Sapiens
ETKECLYLL

SEQ ID NO: 58216 - protein, 9 aa, Homo Sapiens
WYNGRSEGH

SEQ ID NO: 58217 - protein, 9 aa, Homo Sapiens
FFLETKECL

SEQ ID NO: 58218 - protein, 9 aa, Homo Sapiens
RLSASQIWN

SEQ ID NO: 58219 - protein, 9 aa, Homo Sapiens
HGELRIETQ

SEQ ID NO: 58220 - protein, 9 aa, Homo Sapiens
IKHAKKTTL

SEQ ID NO: 58221 - protein, 9 aa, Homo Sapiens
DPFVLFVQP

SEQ ID NO: 58222 - protein, 9 aa, Homo Sapiens
LPNIAQSCS

SEQ ID NO: 58223 - protein, 9 aa, Homo Sapiens
YNGRSEGHS

SEQ ID NO: 58224 - protein, 9 aa, Homo Sapiens
LRVFQAGVQ

SEQ ID NO: 58225 - protein, 9 aa, Homo Sapiens
RNDVECPPV

SEQ ID NO: 58226 - protein, 9 aa, Homo Sapiens
RSKEGRDMA

SEQ ID NO: 58227 - protein, 9 aa, Homo Sapiens
PCSTLFENS

SEQ ID NO: 58228 - protein, 9 aa, Homo Sapiens
GRSEGHSYR

SEQ ID NO: 58229 - protein, 9 aa, Homo Sapiens
ESARDKIFF

SEQ ID NO: 58230 - protein, 9 aa, Homo Sapiens
GHSYRSRSR

SEQ ID NO: 58231 - protein, 9 aa, Homo Sapiens
LLVDCTVVM

SEQ ID NO: 58232 - protein, 9 aa, Homo Sapiens
LSPHFLQGL

SEQ ID NO: 58233 - protein, 9 aa, Homo Sapiens
EDGAGATLS

SEQ ID NO: 58234 - protein, 9 aa, Homo Sapiens
DRSIKYILS

SEQ ID NO: 58235 - protein, 9 aa, Homo Sapiens
GSDMDMSME

SEQ ID NO: 58236 - protein, 9 aa, Homo Sapiens
IFFLHGKVN

SEQ ID NO: 58237 - protein, 9 aa, Homo Sapiens
VTRNDVECP

SEQ ID NO: 58238 - protein, 9 aa, Homo Sapiens
DMDRGDRSI

SEQ ID NO: 58239 - protein, 9 aa, Homo Sapiens
RQHIEMSTA

SEQ ID NO: 58240 - protein, 9 aa, Homo Sapiens
GDDDNDDGH

SEQ ID NO: 58241 - protein, 9 aa, Homo Sapiens
QKSHGRDGT

SEQ ID NO: 58242 - protein, 9 aa, Homo Sapiens
SAPLPFGPC

SEQ ID NO: 58243 - protein, 9 aa, Homo Sapiens
QEPVRSKEG

SEQ ID NO: 58244 - protein, 9 aa, Homo Sapiens
LLWDVPHRP

SEQ ID NO: 58245 - protein, 9 aa, Homo Sapiens
ASLSPHFLQ

SEQ ID NO: 58246 - protein, 9 aa, Homo Sapiens
AMKYSVLLV

SEQ ID NO: 58247 - protein, 9 aa, Homo Sapiens
PNIAQSCSP

SEQ ID NO: 58248 - protein, 9 aa, Homo Sapiens
RKKIGGVAL

SEQ ID NO: 58249 - protein, 9 aa, Homo Sapiens
RHGGWTTKM

SEQ ID NO: 58250 - protein, 9 aa, Homo Sapiens
MKYSVLLVL

SEQ ID NO: 58251 - protein, 9 aa, Homo Sapiens
PPVSSPPCQ

SEQ ID NO: 58252 - protein, 9 aa, Homo Sapiens
MDRGDRSIK

SEQ ID NO: 58253 - protein, 9 aa, Homo Sapiens
LALLWDVPH

SEQ ID NO: 58254 - protein, 9 aa, Homo Sapiens
LRVLPNIAQ

SEQ ID NO: 58255 - protein, 9 aa, Homo Sapiens
CDGHVMMAR

SEQ ID NO: 58256 - protein, 9 aa, Homo Sapiens
VLFVQPVVF

SEQ ID NO: 58257 - protein, 9 aa, Homo Sapiens
DVPHRPPLP

SEQ ID NO: 58258 - protein, 9 aa, Homo Sapiens
KTTLAHEKM

SEQ ID NO: 58259 - protein, 9 aa, Homo Sapiens
DKIFFLHGK

SEQ ID NO: 58260 - protein, 9 aa, Homo Sapiens
AEPIKHAKK

SEQ ID NO: 58261 - protein, 9 aa, Homo Sapiens
TQGQYDEEE

SEQ ID NO: 58262 - protein, 9 aa, Homo Sapiens
PVSSPPCQS

SEQ ID NO: 58263 - protein, 9 aa, Homo Sapiens
GDRSIKYIL

SEQ ID NO: 58264 - protein, 9 aa, Homo Sapiens
SDMDRGDRS

SEQ ID NO: 58265 - protein, 9 aa, Homo Sapiens
FLQGLCGLV

SEQ ID NO: 58266 - protein, 9 aa, Homo Sapiens
REQSTGQAM

SEQ ID NO: 58267 - protein, 9 aa, Homo Sapiens
WDVPHRPPL

SEQ ID NO: 58268 - protein, 9 aa, Homo Sapiens
TRNDVECPP

SEQ ID NO: 58269 - protein, 9 aa, Homo Sapiens
PSAAGLQCL

SEQ ID NO: 58270 - protein, 9 aa, Homo Sapiens
PEVTRNDVE

SEQ ID NO: 58271 - protein, 9 aa, Homo Sapiens
STAGWVGRF

SEQ ID NO: 58272 - protein, 9 aa, Homo Sapiens
HAKKTTLAH

SEQ ID NO: 58273 - protein, 9 aa, Homo Sapiens
KFLLVDCTV

SEQ ID NO: 58274 - protein, 9 aa, Homo Sapiens
KKTTLAHEK

SEQ ID NO: 58275 - protein, 9 aa, Homo Sapiens
MIKCSHLRV

SEQ ID NO: 58276 - protein, 9 aa, Homo Sapiens
IVPMLNPLI

SEQ ID NO: 58277 - protein, 9 aa, Homo Sapiens
FMKQMNDAR

SEQ ID NO: 58278 - protein, 9 aa, Homo Sapiens
STGQAMKYS

SEQ ID NO: 58279 - protein, 9 aa, Homo Sapiens
KHAKKTTLA

SEQ ID NO: 58280 - protein, 9 aa, Homo Sapiens
EEEEDGAGA

SEQ ID NO: 58281 - protein, 9 aa, Homo Sapiens
ARHGGWTTK

SEQ ID NO: 58282 - protein, 9 aa, Homo Sapiens
LTNDRGLQK

SEQ ID NO: 58283 - protein, 9 aa, Homo Sapiens
DARHGGWTT

SEQ ID NO: 58284 - protein, 9 aa, Homo Sapiens
PQRVSIPGH

SEQ ID NO: 58285 - protein, 9 aa, Homo Sapiens
EVTRNDVEC

SEQ ID NO: 58286 - protein, 9 aa, Homo Sapiens
RDKIFFLHG

SEQ ID NO: 58287 - protein, 9 aa, Homo Sapiens
DMDMSMEHR

SEQ ID NO: 58288 - protein, 9 aa, Homo Sapiens
AQSCSPAFG

SEQ ID NO: 58289 - protein, 9 aa, Homo Sapiens
RSIKYILSG

SEQ ID NO: 58290 - protein, 9 aa, Homo Sapiens
TVSIYTRKH

SEQ ID NO: 58291 - protein, 9 aa, Homo Sapiens
MKQEPVRSK

SEQ ID NO: 58292 - protein, 9 aa, Homo Sapiens
DRGDRSIKY

SEQ ID NO: 58293 - protein, 9 aa, Homo Sapiens
ETQGQYDEE

SEQ ID NO: 58294 - protein, 9 aa, Homo Sapiens
VSIYTRKHG

SEQ ID NO: 58295 - protein, 9 aa, Homo Sapiens
PHPQRVSIP

SEQ ID NO: 58296 - protein, 9 aa, Homo Sapiens
SEGHSYRSR

SEQ ID NO: 58297 - protein, 9 aa, Homo Sapiens
KSENGRSKA

SEQ ID NO: 58298 - protein, 9 aa, Homo Sapiens
WETVSIYTR

SEQ ID NO: 58299 - protein, 9 aa, Homo Sapiens
RVLPNIAQS

SEQ ID NO: 58300 - protein, 9 aa, Homo Sapiens
QAANALAFR

SEQ ID NO: 58301 - protein, 9 aa, Homo Sapiens
SLSPHFLQG

SEQ ID NO: 58302 - protein, 9 aa, Homo Sapiens
RNTFCCDGH

SEQ ID NO: 58303 - protein, 9 aa, Homo Sapiens
DGAGATLSR

SEQ ID NO: 58304 - protein, 9 aa, Homo Sapiens
RWQLNGSDM

SEQ ID NO: 58305 - protein, 9 aa, Homo Sapiens
ENGRSKAFS

SEQ ID NO: 58306 - protein, 9 aa, Homo Sapiens
ILKKKSENG

SEQ ID NO: 58307 - protein, 9 aa, Homo Sapiens
SIYTRKHGN

SEQ ID NO: 58308 - protein, 9 aa, Homo Sapiens
VSSPPCQSR

SEQ ID NO: 58309 - protein, 9 aa, Homo Sapiens
EEDGAGATL

SEQ ID NO: 58310 - protein, 9 aa, Homo Sapiens
NDARHGGWT

SEQ ID NO: 58311 - protein, 9 aa, Homo Sapiens
FLETKECLY

SEQ ID NO: 58312 - protein, 9 aa, Homo Sapiens
QGQYDEEEM

SEQ ID NO: 58313 - protein, 9 aa, Homo Sapiens
DRGLQKSHG

SEQ ID NO: 58314 - protein, 9 aa, Homo Sapiens
QAMKYSVLL

SEQ ID NO: 58315 - protein, 9 aa, Homo Sapiens
KMRKKIGGV

SEQ ID NO: 58316 - protein, 9 aa, Homo Sapiens
SKEGRDMAN

SEQ ID NO: 58317 - protein, 9 aa, Homo Sapiens
QLNGSDMDM

SEQ ID NO: 58318 - protein, 9 aa, Homo Sapiens
SAAGLQCLL

SEQ ID NO: 58319 - protein, 9 aa, Homo Sapiens
KKIGGVALW

SEQ ID NO: 58320 - protein, 9 aa, Homo Sapiens
EPIKHAKKT

SEQ ID NO: 58321 - protein, 9 aa, Homo Sapiens
PHFLQGLCG

SEQ ID NO: 58322 - protein, 9 aa, Homo Sapiens
SRLSASQIW

SEQ ID NO: 58323 - protein, 9 aa, Homo Sapiens
NGSDMDMSM

SEQ ID NO: 58324 - protein, 9 aa, Homo Sapiens
QWETVSIYT

SEQ ID NO: 58325 - protein, 9 aa, Homo Sapiens
RSEGHSYRS

SEQ ID NO: 58326 - protein, 9 aa, Homo Sapiens
LETKECLYL

SEQ ID NO: 58327 - protein, 9 aa, Homo Sapiens
SYYDPFVLF

SEQ ID NO: 58328 - protein, 9 aa, Homo Sapiens
CPPVSSPPC

SEQ ID NO: 58329 - protein, 9 aa, Homo Sapiens
AAGLQCLLD

SEQ ID NO: 58330 - protein, 9 aa, Homo Sapiens
LQCLLDFIY

SEQ ID NO: 58331 - protein, 9 aa, Homo Sapiens
LNGSDMDMS

SEQ ID NO: 58332 - protein, 9 aa, Homo Sapiens
VICSTAQRM

SEQ ID NO: 58333 - protein, 9 aa, Homo Sapiens
LLRVLPNIA

SEQ ID NO: 58334 - protein, 9 aa, Homo Sapiens
YYDPFVLFV

SEQ ID NO: 58335 - protein, 9 aa, Homo Sapiens
QASLSPHFL

SEQ ID NO: 58336 - protein, 9 aa, Homo Sapiens
QSTGQAMKY

SEQ ID NO: 58337 - protein, 9 aa, Homo Sapiens
QMNDARHGG

SEQ ID NO: 58338 - protein, 9 aa, Homo Sapiens
DGHVMMARQ

SEQ ID NO: 58339 - protein, 9 aa, Homo Sapiens
MNDARHGGW

SEQ ID NO: 58340 - protein, 9 aa, Homo Sapiens
RGDRSIKYI

SEQ ID NO: 58341 - protein, 9 aa, Homo Sapiens
LQKSHGRDG

SEQ ID NO: 58342 - protein, 9 aa, Homo Sapiens
QRVSIPGHC

SEQ ID NO: 58343 - protein, 9 aa, Homo Sapiens
RESARDKIF

SEQ ID NO: 58344 - protein, 9 aa, Homo Sapiens
QHIEMSTAG

SEQ ID NO: 58345 - protein, 9 aa, Homo Sapiens
QCLLDFIYT

SEQ ID NO: 58346 - protein, 9 aa, Homo Sapiens
FVQPVVFQA

SEQ ID NO: 58347 - protein, 9 aa, Homo Sapiens
WCPHPQRVS

SEQ ID NO: 58348 - protein, 9 aa, Homo Sapiens
NDRGLQKSH

SEQ ID NO: 58349 - protein, 9 aa, Homo Sapiens
ALLWDVPHR

SEQ ID NO: 58350 - protein, 9 aa, Homo Sapiens
AMAGDMSLS

SEQ ID NO: 58351 - protein, 9 aa, Homo Sapiens
TEEEEEDGA

SEQ ID NO: 58352 - protein, 9 aa, Homo Sapiens
LAFRNSWQE

SEQ ID NO: 58353 - protein, 9 aa, Homo Sapiens
APLPFGPCS

SEQ ID NO: 58354 - protein, 9 aa, Homo Sapiens
IQWETVSIY

SEQ ID NO: 58355 - protein, 9 aa, Homo Sapiens
SARDKIFFL

SEQ ID NO: 58356 - protein, 9 aa, Homo Sapiens
LFVQPVVFQ

SEQ ID NO: 58357 - protein, 9 aa, Homo Sapiens
LWDVPHRPP

SEQ ID NO: 58358 - protein, 9 aa, Homo Sapiens
GQAMKYSVL

SEQ ID NO: 58359 - protein, 9 aa, Homo Sapiens
GPCSTLFEN

SEQ ID NO: 58360 - protein, 9 aa, Homo Sapiens
HSDMDRGDR

SEQ ID NO: 58361 - protein, 9 aa, Homo Sapiens
LVDCTVVMS

SEQ ID NO: 58362 - protein, 9 aa, Homo Sapiens
RLWCPHPQR

SEQ ID NO: 58363 - protein, 9 aa, Homo Sapiens
NTFCCDGHV

SEQ ID NO: 58364 - protein, 9 aa, Homo Sapiens
KKKSENGRS

SEQ ID NO: 58365 - protein, 9 aa, Homo Sapiens
CTVVMSGSY

SEQ ID NO: 58366 - protein, 9 aa, Homo Sapiens
FGPCSTLFE

SEQ ID NO: 58367 - protein, 9 aa, Homo Sapiens
KDSYSVICS

SEQ ID NO: 58368 - protein, 9 aa, Homo Sapiens
WQLNGSDMD

SEQ ID NO: 58369 - protein, 9 aa, Homo Sapiens
VECPPVSSP

SEQ ID NO: 58370 - protein, 9 aa, Homo Sapiens
CCDGHVMMA

SEQ ID NO: 58371 - protein, 9 aa, Homo Sapiens
MDMSMEHRY

SEQ ID NO: 58372 - protein, 9 aa, Homo Sapiens
VLPNIAQSC

SEQ ID NO: 58373 - protein, 9 aa, Homo Sapiens
CSTLFENSP

SEQ ID NO: 58374 - protein, 9 aa, Homo Sapiens
GLQCLLDFI

SEQ ID NO: 58375 - protein, 9 aa, Homo Sapiens
TFCCDGHVM

SEQ ID NO: 58376 - protein, 9 aa, Homo Sapiens
EKFLLVDCT

SEQ ID NO: 58377 - protein, 9 aa, Homo Sapiens
AFFLETKEC

SEQ ID NO: 58378 - protein, 9 aa, Homo Sapiens
KRRFPFIGD

SEQ ID NO: 58379 - protein, 9 aa, Homo Sapiens
PIKHAKKTT

SEQ ID NO: 58380 - protein, 9 aa, Homo Sapiens
ITRNPLREI

SEQ ID NO: 58381 - protein, 9 aa, Homo Sapiens
FLSSEQFIT

SEQ ID NO: 58382 - protein, 9 aa, Homo Sapiens
TPGSANELR

SEQ ID NO: 58383 - protein, 9 aa, Homo Sapiens
LNLIGPRPV

SEQ ID NO: 58384 - protein, 9 aa, Homo Sapiens
WDSLAAASG

SEQ ID NO: 58385 - protein, 9 aa, Homo Sapiens
FSPFPLNNI

SEQ ID NO: 58386 - protein, 9 aa, Homo Sapiens
VSKLFCDDI

SEQ ID NO: 58387 - protein, 9 aa, Homo Sapiens
SFIHSYNRI

SEQ ID NO: 58388 - protein, 9 aa, Homo Sapiens
RVKPETQGQ

SEQ ID NO: 58389 - protein, 9 aa, Homo Sapiens
KPETQGQFR

SEQ ID NO: 58390 - protein, 9 aa, Homo Sapiens
DKRSLVKHI

SEQ ID NO: 58391 - protein, 9 aa, Homo Sapiens
LDAFLRSHS

SEQ ID NO: 58392 - protein, 9 aa, Homo Sapiens
EGHRVAGVF

SEQ ID NO: 58393 - protein, 9 aa, Homo Sapiens
SSGGRMHAP

SEQ ID NO: 58394 - protein, 9 aa, Homo Sapiens
GPPSPIENE

SEQ ID NO: 58395 - protein, 9 aa, Homo Sapiens
LVNQYAVDG

SEQ ID NO: 58396 - protein, 9 aa, Homo Sapiens
HVLEQIHPL

SEQ ID NO: 58397 - protein, 9 aa, Homo Sapiens
PVTHAISDY

SEQ ID NO: 58398 - protein, 9 aa, Homo Sapiens
EKEESQPAV

SEQ ID NO: 58399 - protein, 9 aa, Homo Sapiens
LKKVGLNPK

SEQ ID NO: 58400 - protein, 9 aa, Homo Sapiens
LRDKCECIR

SEQ ID NO: 58401 - protein, 9 aa, Homo Sapiens
CEAVEMEVQ

SEQ ID NO: 58402 - protein, 9 aa, Homo Sapiens
CRHRFWQSQ

SEQ ID NO: 58403 - protein, 9 aa, Homo Sapiens
FMTRYTKKT

SEQ ID NO: 58404 - protein, 9 aa, Homo Sapiens
RDFDLFCNI

SEQ ID NO: 58405 - protein, 9 aa, Homo Sapiens
EDNKKEYVH

SEQ ID NO: 58406 - protein, 9 aa, Homo Sapiens
APFDLFLWA

SEQ ID NO: 58407 - protein, 9 aa, Homo Sapiens
GESGERETL

SEQ ID NO: 58408 - protein, 9 aa, Homo Sapiens
FQTGECELF

SEQ ID NO: 58409 - protein, 9 aa, Homo Sapiens
HRVAGVFTV

SEQ ID NO: 58410 - protein, 9 aa, Homo Sapiens
RNPVTHAIS

SEQ ID NO: 58411 - protein, 9 aa, Homo Sapiens
GLDSMFAGL

SEQ ID NO: 58412 - protein, 9 aa, Homo Sapiens
LVKHIGDLL

SEQ ID NO: 58413 - protein, 9 aa, Homo Sapiens
LMDYQNLSE

SEQ ID NO: 58414 - protein, 9 aa, Homo Sapiens
RQVVIKFDQ

SEQ ID NO: 58415 - protein, 9 aa, Homo Sapiens
CKDKDFAKD

SEQ ID NO: 58416 - protein, 9 aa, Homo Sapiens
PSLDAFLRS

SEQ ID NO: 58417 - protein, 9 aa, Homo Sapiens
QLGCIALTT

SEQ ID NO: 58418 - protein, 9 aa, Homo Sapiens
HPVFWKIQF

SEQ ID NO: 58419 - protein, 9 aa, Homo Sapiens
VYAFKARGV

SEQ ID NO: 58420 - protein, 9 aa, Homo Sapiens
NPLREIALE

SEQ ID NO: 58421 - protein, 9 aa, Homo Sapiens
LLYKILMDY

SEQ ID NO: 58422 - protein, 9 aa, Homo Sapiens
SQNLMQRAS

SEQ ID NO: 58423 - protein, 9 aa, Homo Sapiens
VAMCHQVCR

SEQ ID NO: 58424 - protein, 9 aa, Homo Sapiens
MEVTPGQMY

SEQ ID NO: 58425 - protein, 9 aa, Homo Sapiens
RSRIRTCVP

SEQ ID NO: 58426 - protein, 9 aa, Homo Sapiens
LQGRLQLFL

SEQ ID NO: 58427 - protein, 9 aa, Homo Sapiens
KHLGIYSVV

SEQ ID NO: 58428 - protein, 9 aa, Homo Sapiens
ESGERETLN

SEQ ID NO: 58429 - protein, 9 aa, Homo Sapiens
KKEYQVLQD

SEQ ID NO: 58430 - protein, 9 aa, Homo Sapiens
NFVKNRRGR

SEQ ID NO: 58431 - protein, 9 aa, Homo Sapiens
FCDDITLNQ

SEQ ID NO: 58432 - protein, 9 aa, Homo Sapiens
RIRTCVPPQ

SEQ ID NO: 58433 - protein, 9 aa, Homo Sapiens
ALTTFSLGF

SEQ ID NO: 58434 - protein, 9 aa, Homo Sapiens
VCASITAIL

SEQ ID NO: 58435 - protein, 9 aa, Homo Sapiens
QGSLSTRKR

SEQ ID NO: 58436 - protein, 9 aa, Homo Sapiens
VNFSPLGHL

SEQ ID NO: 58437 - protein, 9 aa, Homo Sapiens
RSLVKHIGD

SEQ ID NO: 58438 - protein, 9 aa, Homo Sapiens
EEMDVYVST

SEQ ID NO: 58439 - protein, 9 aa, Homo Sapiens
DQQLIALQS

SEQ ID NO: 58440 - protein, 9 aa, Homo Sapiens
PPSFPPQSM

SEQ ID NO: 58441 - protein, 9 aa, Homo Sapiens
NYTLPSAET

SEQ ID NO: 58442 - protein, 9 aa, Homo Sapiens
VEVQLHPAG

SEQ ID NO: 58443 - protein, 9 aa, Homo Sapiens
SFMVSNSNM

SEQ ID NO: 58444 - protein, 9 aa, Homo Sapiens
YLRPGALAA

SEQ ID NO: 58445 - protein, 9 aa, Homo Sapiens
NPVTHAISD

SEQ ID NO: 58446 - protein, 9 aa, Homo Sapiens
YLGMLDCAR

SEQ ID NO: 58447 - protein, 9 aa, Homo Sapiens
MTRYTKKTS

SEQ ID NO: 58448 - protein, 9 aa, Homo Sapiens
SRDDSFHVI

SEQ ID NO: 58449 - protein, 9 aa, Homo Sapiens
RIKKEYQVL

SEQ ID NO: 58450 - protein, 9 aa, Homo Sapiens
CSVHTPESS

SEQ ID NO: 58451 - protein, 9 aa, Homo Sapiens
SGGHSEEEA

SEQ ID NO: 58452 - protein, 9 aa, Homo Sapiens
NGAPWDSLA

SEQ ID NO: 58453 - protein, 9 aa, Homo Sapiens
TFDPGESGE

SEQ ID NO: 58454 - protein, 9 aa, Homo Sapiens
DPSLDAFLR

SEQ ID NO: 58455 - protein, 9 aa, Homo Sapiens
NLSDSPYNV

SEQ ID NO: 58456 - protein, 9 aa, Homo Sapiens
SPKQKYCHV

SEQ ID NO: 58457 - protein, 9 aa, Homo Sapiens
QVQGTVTIW

SEQ ID NO: 58458 - protein, 9 aa, Homo Sapiens
PVLFPGVAL

SEQ ID NO: 58459 - protein, 9 aa, Homo Sapiens
SCRHRFWQS

SEQ ID NO: 58460 - protein, 9 aa, Homo Sapiens
KWCKPYNFA

SEQ ID NO: 58461 - protein, 9 aa, Homo Sapiens
MWKWLQQPE

SEQ ID NO: 58462 - protein, 9 aa, Homo Sapiens
FLSSQEQMC

SEQ ID NO: 58463 - protein, 9 aa, Homo Sapiens
IHKKRQTEK

SEQ ID NO: 58464 - protein, 9 aa, Homo Sapiens
YCLNFFKTT

SEQ ID NO: 58465 - protein, 9 aa, Homo Sapiens
TIWNISALS

SEQ ID NO: 58466 - protein, 9 aa, Homo Sapiens
NNKLYGFVF

SEQ ID NO: 58467 - protein, 9 aa, Homo Sapiens
CKLHNLSDS

SEQ ID NO: 58468 - protein, 9 aa, Homo Sapiens
WFFNFQTGE

SEQ ID NO: 58469 - protein, 9 aa, Homo Sapiens
ATSSAGNEG

SEQ ID NO: 58470 - protein, 9 aa, Homo Sapiens
FVVNIATIF

SEQ ID NO: 58471 - protein, 9 aa, Homo Sapiens
GFVFTGASK

SEQ ID NO: 58472 - protein, 9 aa, Homo Sapiens
PLSEDFVCM

SEQ ID NO: 58473 - protein, 9 aa, Homo Sapiens
SSSVFPTSC

SEQ ID NO: 58474 - protein, 9 aa, Homo Sapiens
PLRSSCAYA

SEQ ID NO: 58475 - protein, 9 aa, Homo Sapiens
LWHSLSRKE

SEQ ID NO: 58476 - protein, 9 aa, Homo Sapiens
KTGQYLGML

SEQ ID NO: 58477 - protein, 9 aa, Homo Sapiens
LLETERKVF

SEQ ID NO: 58478 - protein, 9 aa, Homo Sapiens
CKPYNFATL

SEQ ID NO: 58479 - protein, 9 aa, Homo Sapiens
ATCSHYTQL

SEQ ID NO: 58480 - protein, 9 aa, Homo Sapiens
STYLLYVYR

SEQ ID NO: 58481 - protein, 9 aa, Homo Sapiens
LQLFLSSEQ

SEQ ID NO: 58482 - protein, 9 aa, Homo Sapiens
AYRSRDDSF

SEQ ID NO: 58483 - protein, 9 aa, Homo Sapiens
VSPKQKYCH

SEQ ID NO: 58484 - protein, 9 aa, Homo Sapiens
AVKGKVLEK

SEQ ID NO: 58485 - protein, 9 aa, Homo Sapiens
KVGLNPKKD

SEQ ID NO: 58486 - protein, 9 aa, Homo Sapiens
FGEATQYRR

SEQ ID NO: 58487 - protein, 9 aa, Homo Sapiens
GERETLNTE

SEQ ID NO: 58488 - protein, 9 aa, Homo Sapiens
LRTRIKSGK

SEQ ID NO: 58489 - protein, 9 aa, Homo Sapiens
TLPSAETPL

SEQ ID NO: 58490 - protein, 9 aa, Homo Sapiens
VIKFDQNVF

SEQ ID NO: 58491 - protein, 9 aa, Homo Sapiens
VVPKGEDEE

SEQ ID NO: 58492 - protein, 9 aa, Homo Sapiens
FASVAEVQE

SEQ ID NO: 58493 - protein, 9 aa, Homo Sapiens
VSATSTTTN

SEQ ID NO: 58494 - protein, 9 aa, Homo Sapiens
KNRRGRPRK

SEQ ID NO: 58495 - protein, 9 aa, Homo Sapiens
VSESDQMSE

SEQ ID NO: 58496 - protein, 9 aa, Homo Sapiens
SKALKGDHC

SEQ ID NO: 58497 - protein, 9 aa, Homo Sapiens
ALRCVFCRR

SEQ ID NO: 58498 - protein, 9 aa, Homo Sapiens
ASATPRLAA

SEQ ID NO: 58499 - protein, 9 aa, Homo Sapiens
FLWACIAGT

SEQ ID NO: 58500 - protein, 9 aa, Homo Sapiens
GYNLANMAR

SEQ ID NO: 58501 - protein, 9 aa, Homo Sapiens
TTEQISGLR

SEQ ID NO: 58502 - protein, 9 aa, Homo Sapiens
SIVADVHRT

SEQ ID NO: 58503 - protein, 9 aa, Homo Sapiens
KQKYCHVIL

SEQ ID NO: 58504 - protein, 9 aa, Homo Sapiens
PSFPVMVSG

SEQ ID NO: 58505 - protein, 9 aa, Homo Sapiens
FIHPSSVLI

SEQ ID NO: 58506 - protein, 9 aa, Homo Sapiens
SYLRPGALA

SEQ ID NO: 58507 - protein, 9 aa, Homo Sapiens
QGQFRLLGD

SEQ ID NO: 58508 - protein, 9 aa, Homo Sapiens
TSSAGNEGL

SEQ ID NO: 58509 - protein, 9 aa, Homo Sapiens
TSCRHRFWQ

SEQ ID NO: 58510 - protein, 9 aa, Homo Sapiens
RIKSGKAII

SEQ ID NO: 58511 - protein, 9 aa, Homo Sapiens
KLFCDDITL

SEQ ID NO: 58512 - protein, 9 aa, Homo Sapiens
SAGNEGLGG

SEQ ID NO: 58513 - protein, 9 aa, Homo Sapiens
GKSYTHGSL

SEQ ID NO: 58514 - protein, 9 aa, Homo Sapiens
MKGAPEHIL

SEQ ID NO: 58515 - protein, 9 aa, Homo Sapiens
VPPSFPVMV

SEQ ID NO: 58516 - protein, 9 aa, Homo Sapiens
MRDFDLFCN

SEQ ID NO: 58517 - protein, 9 aa, Homo Sapiens
GRGSRSRIR

SEQ ID NO: 58518 - protein, 9 aa, Homo Sapiens
ATNSAGTGY

SEQ ID NO: 58519 - protein, 9 aa, Homo Sapiens
SLYVVLPGG

SEQ ID NO: 58520 - protein, 9 aa, Homo Sapiens
CHQVCRLPP

SEQ ID NO: 58521 - protein, 9 aa, Homo Sapiens
PYEKVNFSW

SEQ ID NO: 58522 - protein, 9 aa, Homo Sapiens
VATNSAGTG

SEQ ID NO: 58523 - protein, 9 aa, Homo Sapiens
PAVKGKVLE

SEQ ID NO: 58524 - protein, 9 aa, Homo Sapiens
AISQNLMQR

SEQ ID NO: 58525 - protein, 9 aa, Homo Sapiens
PVFWKIQFT

SEQ ID NO: 58526 - protein, 9 aa, Homo Sapiens
CASITAILF

SEQ ID NO: 58527 - protein, 9 aa, Homo Sapiens
LANMARCWT

SEQ ID NO: 58528 - protein, 9 aa, Homo Sapiens
KRITCGDFI

SEQ ID NO: 58529 - protein, 9 aa, Homo Sapiens
PSAETPLAL

SEQ ID NO: 58530 - protein, 9 aa, Homo Sapiens
TEQISGLRT

SEQ ID NO: 58531 - protein, 9 aa, Homo Sapiens
LRSSCAYAP

SEQ ID NO: 58532 - protein, 9 aa, Homo Sapiens
GNVTLHCFS

SEQ ID NO: 58533 - protein, 9 aa, Homo Sapiens
ISGLRTAWR

SEQ ID NO: 58534 - protein, 9 aa, Homo Sapiens
FQRLVRKIA

SEQ ID NO: 58535 - protein, 9 aa, Homo Sapiens
LGHLLASGS

SEQ ID NO: 58536 - protein, 9 aa, Homo Sapiens
GHRVAGVFT

SEQ ID NO: 58537 - protein, 9 aa, Homo Sapiens
EAVEDCKDK

SEQ ID NO: 58538 - protein, 9 aa, Homo Sapiens
EDCKDKDFA

SEQ ID NO: 58539 - protein, 9 aa, Homo Sapiens
STTTNMTVG

SEQ ID NO: 58540 - protein, 9 aa, Homo Sapiens
CMRARLQQE

SEQ ID NO: 58541 - protein, 9 aa, Homo Sapiens
WKIQFTQMS

SEQ ID NO: 58542 - protein, 9 aa, Homo Sapiens
QETGLRDKC

SEQ ID NO: 58543 - protein, 9 aa, Homo Sapiens
RKRPEIWSP

SEQ ID NO: 58544 - protein, 9 aa, Homo Sapiens
NRPFSPFPL

SEQ ID NO: 58545 - protein, 9 aa, Homo Sapiens
TNLIDQQLI

SEQ ID NO: 58546 - protein, 9 aa, Homo Sapiens
LKSVNPEKF

SEQ ID NO: 58547 - protein, 9 aa, Homo Sapiens
EFARVKKGA

SEQ ID NO: 58548 - protein, 9 aa, Homo Sapiens
TGKKPYACA

SEQ ID NO: 58549 - protein, 9 aa, Homo Sapiens
LPGGEESGE

SEQ ID NO: 58550 - protein, 9 aa, Homo Sapiens
HVCASITAI

SEQ ID NO: 58551 - protein, 9 aa, Homo Sapiens
IKIVGLANS

SEQ ID NO: 58552 - protein, 9 aa, Homo Sapiens
TEDNKKEYV

SEQ ID NO: 58553 - protein, 9 aa, Homo Sapiens
VIKIVGLAN

SEQ ID NO: 58554 - protein, 9 aa, Homo Sapiens
LIKELPEFV

SEQ ID NO: 58555 - protein, 9 aa, Homo Sapiens
SHYTQLVWA

SEQ ID NO: 58556 - protein, 9 aa, Homo Sapiens
AACKIEAWY

SEQ ID NO: 58557 - protein, 9 aa, Homo Sapiens
PCAEEVMQM

SEQ ID NO: 58558 - protein, 9 aa, Homo Sapiens
QGSILVMHQ

SEQ ID NO: 58559 - protein, 9 aa, Homo Sapiens
RLSFCEELW

SEQ ID NO: 58560 - protein, 9 aa, Homo Sapiens
APPQRHLLL

SEQ ID NO: 58561 - protein, 9 aa, Homo Sapiens
KFMTRYTKK

SEQ ID NO: 58562 - protein, 9 aa, Homo Sapiens
VDMGFLHVH

SEQ ID NO: 58563 - protein, 9 aa, Homo Sapiens
KGDHCCGET

SEQ ID NO: 58564 - protein, 9 aa, Homo Sapiens
LGLDSMFAG

SEQ ID NO: 58565 - protein, 9 aa, Homo Sapiens
QQPEFQRMS

SEQ ID NO: 58566 - protein, 9 aa, Homo Sapiens
DLSSEQYKM

SEQ ID NO: 58567 - protein, 9 aa, Homo Sapiens
SDQMSEVKA

SEQ ID NO: 58568 - protein, 9 aa, Homo Sapiens
QISGLRTAW

SEQ ID NO: 58569 - protein, 9 aa, Homo Sapiens
EKQQSAKPD

SEQ ID NO: 58570 - protein, 9 aa, Homo Sapiens
FWKIQFTQM

SEQ ID NO: 58571 - protein, 9 aa, Homo Sapiens
KVNFSWYNG

SEQ ID NO: 58572 - protein, 9 aa, Homo Sapiens
PSPIENEDF

SEQ ID NO: 58573 - protein, 9 aa, Homo Sapiens
GDHCCGETE

SEQ ID NO: 58574 - protein, 9 aa, Homo Sapiens
LQTQGSLST

SEQ ID NO: 58575 - protein, 9 aa, Homo Sapiens
VQLHPAGQL

SEQ ID NO: 58576 - protein, 9 aa, Homo Sapiens
GITFLSGGH

SEQ ID NO: 58577 - protein, 9 aa, Homo Sapiens
IYSVVPNHK

SEQ ID NO: 58578 - protein, 9 aa, Homo Sapiens
ERKVFASVA

SEQ ID NO: 58579 - protein, 9 aa, Homo Sapiens
GLNPKKDIH

SEQ ID NO: 58580 - protein, 9 aa, Homo Sapiens
DTCEANEET

SEQ ID NO: 58581 - protein, 9 aa, Homo Sapiens
PVRTCAVDM

SEQ ID NO: 58582 - protein, 9 aa, Homo Sapiens
QTGECELFA

SEQ ID NO: 58583 - protein, 9 aa, Homo Sapiens
AMSTYLLYV

SEQ ID NO: 58584 - protein, 9 aa, Homo Sapiens
HSEEEASIN

SEQ ID NO: 58585 - protein, 9 aa, Homo Sapiens
GQYLGMLDC

SEQ ID NO: 58586 - protein, 9 aa, Homo Sapiens
WETRQVVIK

SEQ ID NO: 58587 - protein, 9 aa, Homo Sapiens
QQLIALQSG

SEQ ID NO: 58588 - protein, 9 aa, Homo Sapiens
LQNLIKDYH

SEQ ID NO: 58589 - protein, 9 aa, Homo Sapiens
CAVDMGFLH

SEQ ID NO: 58590 - protein, 9 aa, Homo Sapiens
RTRIKSGKA

SEQ ID NO: 58591 - protein, 9 aa, Homo Sapiens
YRQMAFEFA

SEQ ID NO: 58592 - protein, 9 aa, Homo Sapiens
DGSLYVVLP

SEQ ID NO: 58593 - protein, 9 aa, Homo Sapiens
FSRLSFCEE

SEQ ID NO: 58594 - protein, 9 aa, Homo Sapiens
VNGAPWDSL

SEQ ID NO: 58595 - protein, 9 aa, Homo Sapiens
GDNCCKLHN

SEQ ID NO: 58596 - protein, 9 aa, Homo Sapiens
TERKVFASV

SEQ ID NO: 58597 - protein, 9 aa, Homo Sapiens
ETERKVFAS

SEQ ID NO: 58598 - protein, 9 aa, Homo Sapiens
LVRKIAQDF

SEQ ID NO: 58599 - protein, 9 aa, Homo Sapiens
MFSRLSFCE

SEQ ID NO: 58600 - protein, 9 aa, Homo Sapiens
GTTAATSSA

SEQ ID NO: 58601 - protein, 9 aa, Homo Sapiens
RPFSPFPLN

SEQ ID NO: 58602 - protein, 9 aa, Homo Sapiens
NLIDQQLIA

SEQ ID NO: 58603 - protein, 9 aa, Homo Sapiens
TLTKLKRNT

SEQ ID NO: 58604 - protein, 9 aa, Homo Sapiens
GAKKGPPSP

SEQ ID NO: 58605 - protein, 9 aa, Homo Sapiens
HILDRCSTI

SEQ ID NO: 58606 - protein, 9 aa, Homo Sapiens
MIVTNKVIK

SEQ ID NO: 58607 - protein, 9 aa, Homo Sapiens
RKIAQDFKT

SEQ ID NO: 58608 - protein, 9 aa, Homo Sapiens
KKRQTEKKP

SEQ ID NO: 58609 - protein, 9 aa, Homo Sapiens
HQVELIKRD

SEQ ID NO: 58610 - protein, 9 aa, Homo Sapiens
HPAGQLCDV

SEQ ID NO: 58611 - protein, 9 aa, Homo Sapiens
ACSLQTQGS

SEQ ID NO: 58612 - protein, 9 aa, Homo Sapiens
GFSLLWHSL

SEQ ID NO: 58613 - protein, 9 aa, Homo Sapiens
LFLWACIAG

SEQ ID NO: 58614 - protein, 9 aa, Homo Sapiens
EFTLTKLKR

SEQ ID NO: 58615 - protein, 9 aa, Homo Sapiens
AFKARGVPE

SEQ ID NO: 58616 - protein, 9 aa, Homo Sapiens
LSSEQYKMT

SEQ ID NO: 58617 - protein, 9 aa, Homo Sapiens
YSHVLEQIH

SEQ ID NO: 58618 - protein, 9 aa, Homo Sapiens
GHNIGKRIT

SEQ ID NO: 58619 - protein, 9 aa, Homo Sapiens
GFQSFMVSN

SEQ ID NO: 58620 - protein, 9 aa, Homo Sapiens
RGAFGEATQ

SEQ ID NO: 58621 - protein, 9 aa, Homo Sapiens
LYVVLPGGE

SEQ ID NO: 58622 - protein, 9 aa, Homo Sapiens
SMFAGLEGV

SEQ ID NO: 58623 - protein, 9 aa, Homo Sapiens
PEIWSPSAI

SEQ ID NO: 58624 - protein, 9 aa, Homo Sapiens
LPFQRLVRK

SEQ ID NO: 58625 - protein, 9 aa, Homo Sapiens
QIHPLETEQ

SEQ ID NO: 58626 - protein, 9 aa, Homo Sapiens
ETLNTEGKS

SEQ ID NO: 58627 - protein, 9 aa, Homo Sapiens
FIHSYNRIR

SEQ ID NO: 58628 - protein, 9 aa, Homo Sapiens
GAFGEATQY

SEQ ID NO: 58629 - protein, 9 aa, Homo Sapiens
TNKVIKIVG

SEQ ID NO: 58630 - protein, 9 aa, Homo Sapiens
FSWYNGTVN

SEQ ID NO: 58631 - protein, 9 aa, Homo Sapiens
LLYVYRLEY

SEQ ID NO: 58632 - protein, 9 aa, Homo Sapiens
IVTNKVIKI

SEQ ID NO: 58633 - protein, 9 aa, Homo Sapiens
VLFPGVALL

SEQ ID NO: 58634 - protein, 9 aa, Homo Sapiens
QFTQMSLQL

SEQ ID NO: 58635 - protein, 9 aa, Homo Sapiens
PYNFATLAT

SEQ ID NO: 58636 - protein, 9 aa, Homo Sapiens
FNLWRRHLK

SEQ ID NO: 58637 - protein, 9 aa, Homo Sapiens
YTLPSAETP

SEQ ID NO: 58638 - protein, 9 aa, Homo Sapiens
LDITRNPLR

SEQ ID NO: 58639 - protein, 9 aa, Homo Sapiens
GARYVGSIV

SEQ ID NO: 58640 - protein, 9 aa, Homo Sapiens
FNFQTGECE

SEQ ID NO: 58641 - protein, 9 aa, Homo Sapiens
MARCWTYLT

SEQ ID NO: 58642 - protein, 9 aa, Homo Sapiens
WKWLQQPEF

SEQ ID NO: 58643 - protein, 9 aa, Homo Sapiens
PPAALRCVF

SEQ ID NO: 58644 - protein, 9 aa, Homo Sapiens
VEDCKDKDF

SEQ ID NO: 58645 - protein, 9 aa, Homo Sapiens
DNCCKLHNL

SEQ ID NO: 58646 - protein, 9 aa, Homo Sapiens
HAIPLRSSC

SEQ ID NO: 58647 - protein, 9 aa, Homo Sapiens
QNLMQRASP

SEQ ID NO: 58648 - protein, 9 aa, Homo Sapiens
RQLFEIEIQ

SEQ ID NO: 58649 - protein, 9 aa, Homo Sapiens
HVPPSFPVM

SEQ ID NO: 58650 - protein, 9 aa, Homo Sapiens
SLDAFLRSH

SEQ ID NO: 58651 - protein, 9 aa, Homo Sapiens
CFSQVAFGS

SEQ ID NO: 58652 - protein, 9 aa, Homo Sapiens
SATSTTTNM

SEQ ID NO: 58653 - protein, 9 aa, Homo Sapiens
HQVCRLPPA

SEQ ID NO: 58654 - protein, 9 aa, Homo Sapiens
GLRTAWRYD

SEQ ID NO: 58655 - protein, 9 aa, Homo Sapiens
LIGPRPVDV

SEQ ID NO: 58656 - protein, 9 aa, Homo Sapiens
CGRGSRSRI

SEQ ID NO: 58657 - protein, 9 aa, Homo Sapiens
LTPAPPQRH

SEQ ID NO: 58658 - protein, 9 aa, Homo Sapiens
NPEKFISYP

SEQ ID NO: 58659 - protein, 9 aa, Homo Sapiens
CIALTTFSL

SEQ ID NO: 58660 - protein, 9 aa, Homo Sapiens
VVLPGGEES

SEQ ID NO: 58661 - protein, 9 aa, Homo Sapiens
HLGIYSVVP

SEQ ID NO: 58662 - protein, 9 aa, Homo Sapiens
NTSFVVNIA

SEQ ID NO: 58663 - protein, 9 aa, Homo Sapiens
GKSFSQGSI

SEQ ID NO: 58664 - protein, 9 aa, Homo Sapiens
PKDWAVQYC

SEQ ID NO: 58665 - protein, 9 aa, Homo Sapiens
LPSRFLCAQ

SEQ ID NO: 58666 - protein, 9 aa, Homo Sapiens
LTTFSLGFL

SEQ ID NO: 58667 - protein, 9 aa, Homo Sapiens
TRNPLREIA

SEQ ID NO: 58668 - protein, 9 aa, Homo Sapiens
SEVKAESQD

SEQ ID NO: 58669 - protein, 9 aa, Homo Sapiens
QSAKPDPPH

SEQ ID NO: 58670 - protein, 9 aa, Homo Sapiens
SFSQGSILV

SEQ ID NO: 58671 - protein, 9 aa, Homo Sapiens
ERTFDPGES

SEQ ID NO: 58672 - protein, 9 aa, Homo Sapiens
TGLRDKCEC

SEQ ID NO: 58673 - protein, 9 aa, Homo Sapiens
TEKQQSAKP

SEQ ID NO: 58674 - protein, 9 aa, Homo Sapiens
PRPVDVLSE

SEQ ID NO: 58675 - protein, 9 aa, Homo Sapiens
RQTEKKPFK

SEQ ID NO: 58676 - protein, 9 aa, Homo Sapiens
IQFTQMSLQ

SEQ ID NO: 58677 - protein, 9 aa, Homo Sapiens
NATCSHYTQ

SEQ ID NO: 58678 - protein, 9 aa, Homo Sapiens
HKREQDHSL

SEQ ID NO: 58679 - protein, 9 aa, Homo Sapiens
KREQDHSLS

SEQ ID NO: 58680 - protein, 9 aa, Homo Sapiens
PQRHLLLTG

SEQ ID NO: 58681 - protein, 9 aa, Homo Sapiens
GFVAMCHQV

SEQ ID NO: 58682 - protein, 9 aa, Homo Sapiens
RLQETGLRD

SEQ ID NO: 58683 - protein, 9 aa, Homo Sapiens
IKDYHAQCN

SEQ ID NO: 58684 - protein, 9 aa, Homo Sapiens
YAFKARGVP

SEQ ID NO: 58685 - protein, 9 aa, Homo Sapiens
MCGKSFSQG

SEQ ID NO: 58686 - protein, 9 aa, Homo Sapiens
VTIWNISAL

SEQ ID NO: 58687 - protein, 9 aa, Homo Sapiens
IKRDEVSLH

SEQ ID NO: 58688 - protein, 9 aa, Homo Sapiens
VVPNHKADA

SEQ ID NO: 58689 - protein, 9 aa, Homo Sapiens
NSNMSFVEF

SEQ ID NO: 58690 - protein, 9 aa, Homo Sapiens
KFISYPLLE

SEQ ID NO: 58691 - protein, 9 aa, Homo Sapiens
SPFPLNNIS

SEQ ID NO: 58692 - protein, 9 aa, Homo Sapiens
CLRRPVLFP

SEQ ID NO: 58693 - protein, 9 aa, Homo Sapiens
CLAPFDLFL

SEQ ID NO: 58694 - protein, 9 aa, Homo Sapiens
SEQYKMTEC

SEQ ID NO: 58695 - protein, 9 aa, Homo Sapiens
DAFLRSHSH

SEQ ID NO: 58696 - protein, 9 aa, Homo Sapiens
SSQEQMCGT

SEQ ID NO: 58697 - protein, 9 aa, Homo Sapiens
SRIRTCVPP

SEQ ID NO: 58698 - protein, 9 aa, Homo Sapiens
GEATQYRRT

SEQ ID NO: 58699 - protein, 9 aa, Homo Sapiens
FFNFQTGEC

SEQ ID NO: 58700 - protein, 9 aa, Homo Sapiens
KILMDYQNL

SEQ ID NO: 58701 - protein, 9 aa, Homo Sapiens
EKFISYPLL

SEQ ID NO: 58702 - protein, 9 aa, Homo Sapiens
RHLLLTGHE

SEQ ID NO: 58703 - protein, 9 aa, Homo Sapiens
ANELRRPPP

SEQ ID NO: 58704 - protein, 9 aa, Homo Sapiens
SRLSFCEEL

SEQ ID NO: 58705 - protein, 9 aa, Homo Sapiens
NCCKLHNLS

SEQ ID NO: 58706 - protein, 9 aa, Homo Sapiens
FSLLWHSLS

SEQ ID NO: 58707 - protein, 9 aa, Homo Sapiens
QPDAANFNL

SEQ ID NO: 58708 - protein, 9 aa, Homo Sapiens
QKYCHVILG

SEQ ID NO: 58709 - protein, 9 aa, Homo Sapiens
WAVQYCEAV

SEQ ID NO: 58710 - protein, 9 aa, Homo Sapiens
FSYRQMAFE

SEQ ID NO: 58711 - protein, 9 aa, Homo Sapiens
RMWKWLQQP

SEQ ID NO: 58712 - protein, 9 aa, Homo Sapiens
CGKSFSQGS

SEQ ID NO: 58713 - protein, 9 aa, Homo Sapiens
ILVTEDNKK

SEQ ID NO: 58714 - protein, 9 aa, Homo Sapiens
FDLFLWACI

SEQ ID NO: 58715 - protein, 9 aa, Homo Sapiens
KEESQPAVK

SEQ ID NO: 58716 - protein, 9 aa, Homo Sapiens
CCGETETPK

SEQ ID NO: 58717 - protein, 9 aa, Homo Sapiens
VCMRARLQQ

SEQ ID NO: 58718 - protein, 9 aa, Homo Sapiens
VVIKFDQNV

SEQ ID NO: 58719 - protein, 9 aa, Homo Sapiens
DLFLWACIA

SEQ ID NO: 58720 - protein, 9 aa, Homo Sapiens
TTFSLGFLL

SEQ ID NO: 58721 - protein, 9 aa, Homo Sapiens
HGFVAMCHQ

SEQ ID NO: 58722 - protein, 9 aa, Homo Sapiens
DAANFNLWR

SEQ ID NO: 58723 - protein, 9 aa, Homo Sapiens
KRPEIWSPS

SEQ ID NO: 58724 - protein, 9 aa, Homo Sapiens
TPAPPQRHL

SEQ ID NO: 58725 - protein, 9 aa, Homo Sapiens
CNIEPTEYI

SEQ ID NO: 58726 - protein, 9 aa, Homo Sapiens
AKKGPPSPI

SEQ ID NO: 58727 - protein, 9 aa, Homo Sapiens
HSLSRKEKP

SEQ ID NO: 58728 - protein, 9 aa, Homo Sapiens
GAPEHILDR

SEQ ID NO: 58729 - protein, 9 aa, Homo Sapiens
RHVPPSFPV

SEQ ID NO: 58730 - protein, 9 aa, Homo Sapiens
GHSEEEASI

SEQ ID NO: 58731 - protein, 9 aa, Homo Sapiens
NFATLATDF

SEQ ID NO: 58732 - protein, 9 aa, Homo Sapiens
APWDSLAAA

SEQ ID NO: 58733 - protein, 9 aa, Homo Sapiens
IKKEYQVLQ

SEQ ID NO: 58734 - protein, 9 aa, Homo Sapiens
FNTSFVVNI

SEQ ID NO: 58735 - protein, 9 aa, Homo Sapiens
EQIHPLETE

SEQ ID NO: 58736 - protein, 9 aa, Homo Sapiens
HGHNIGKRI

SEQ ID NO: 58737 - protein, 9 aa, Homo Sapiens
CAEEVMQMC

SEQ ID NO: 58738 - protein, 9 aa, Homo Sapiens
RKCLRKFQN

SEQ ID NO: 58739 - protein, 9 aa, Homo Sapiens
TDMEVTPGQ

SEQ ID NO: 58740 - protein, 9 aa, Homo Sapiens
FPTSCRHRF

SEQ ID NO: 58741 - protein, 9 aa, Homo Sapiens
YKMTECPAA

SEQ ID NO: 58742 - protein, 9 aa, Homo Sapiens
PEHILDRCS

SEQ ID NO: 58743 - protein, 9 aa, Homo Sapiens
VRNPVTHAI

SEQ ID NO: 58744 - protein, 9 aa, Homo Sapiens
FSPLGHLLA

SEQ ID NO: 58745 - protein, 9 aa, Homo Sapiens
SLVNQYAVD

SEQ ID NO: 58746 - protein, 9 aa, Homo Sapiens
PFQRLVRKI

SEQ ID NO: 58747 - protein, 9 aa, Homo Sapiens
ELIKRDEVS

SEQ ID NO: 58748 - protein, 9 aa, Homo Sapiens
LRLDKRSLV

SEQ ID NO: 58749 - protein, 9 aa, Homo Sapiens
SLVKHIGDL

SEQ ID NO: 58750 - protein, 9 aa, Homo Sapiens
GKKPYACAD

SEQ ID NO: 58751 - protein, 9 aa, Homo Sapiens
LNTEGKSGK

SEQ ID NO: 58752 - protein, 9 aa, Homo Sapiens
NFQTGECEL

SEQ ID NO: 58753 - protein, 9 aa, Homo Sapiens
KVKAACKIE

SEQ ID NO: 58754 - protein, 9 aa, Homo Sapiens
GLRDKCECI

SEQ ID NO: 58755 - protein, 9 aa, Homo Sapiens
TTTNMTVGP

SEQ ID NO: 58756 - protein, 9 aa, Homo Sapiens
FTLTKLKRN

SEQ ID NO: 58757 - protein, 9 aa, Homo Sapiens
PGSANELRR

SEQ ID NO: 58758 - protein, 9 aa, Homo Sapiens
MSLHSAQYL

SEQ ID NO: 58759 - protein, 9 aa, Homo Sapiens
SMRDFDLFC

SEQ ID NO: 58760 - protein, 9 aa, Homo Sapiens
YNFATLATD

SEQ ID NO: 58761 - protein, 9 aa, Homo Sapiens
PPSPIENED

SEQ ID NO: 58762 - protein, 9 aa, Homo Sapiens
TLGLDSMFA

SEQ ID NO: 58763 - protein, 9 aa, Homo Sapiens
YVVLPGGEE

SEQ ID NO: 58764 - protein, 9 aa, Homo Sapiens
LIDQQLIAL

SEQ ID NO: 58765 - protein, 9 aa, Homo Sapiens
KVEDLYELL

SEQ ID NO: 58766 - protein, 9 aa, Homo Sapiens
EANEETLET

SEQ ID NO: 58767 - protein, 9 aa, Homo Sapiens
FLKKVGLNP

SEQ ID NO: 58768 - protein, 9 aa, Homo Sapiens
KSFIHSYNR

SEQ ID NO: 58769 - protein, 9 aa, Homo Sapiens
VDTCEANEE

SEQ ID NO: 58770 - protein, 9 aa, Homo Sapiens
LVTEDNKKE

SEQ ID NO: 58771 - protein, 9 aa, Homo Sapiens
LAASGSVPH

SEQ ID NO: 58772 - protein, 9 aa, Homo Sapiens
ALKGDHCCG

SEQ ID NO: 58773 - protein, 9 aa, Homo Sapiens
ASITAILFM

SEQ ID NO: 58774 - protein, 9 aa, Homo Sapiens
LHNLSDSPY

SEQ ID NO: 58775 - protein, 9 aa, Homo Sapiens
KQSTPSTAS

SEQ ID NO: 58776 - protein, 9 aa, Homo Sapiens
GKSFIHSYN

SEQ ID NO: 58777 - protein, 9 aa, Homo Sapiens
PVNGAPWDS

SEQ ID NO: 58778 - protein, 9 aa, Homo Sapiens
HPSSVLIKE

SEQ ID NO: 58779 - protein, 9 aa, Homo Sapiens
TQGQFRLLG

SEQ ID NO: 58780 - protein, 9 aa, Homo Sapiens
IKSGKAIIN

SEQ ID NO: 58781 - protein, 9 aa, Homo Sapiens
SAETPLALE

SEQ ID NO: 58782 - protein, 9 aa, Homo Sapiens
APEHILDRC

SEQ ID NO: 58783 - protein, 9 aa, Homo Sapiens
RLDKRSLVK

SEQ ID NO: 58784 - protein, 9 aa, Homo Sapiens
LIKDYHAQC

SEQ ID NO: 58785 - protein, 9 aa, Homo Sapiens
KNLQRAISQ

SEQ ID NO: 58786 - protein, 9 aa, Homo Sapiens
QSFMVSNSN

SEQ ID NO: 58787 - protein, 9 aa, Homo Sapiens
YLHSFMRRG

SEQ ID NO: 58788 - protein, 9 aa, Homo Sapiens
ANMARCWTY

SEQ ID NO: 58789 - protein, 9 aa, Homo Sapiens
FPLNNISST

SEQ ID NO: 58790 - protein, 9 aa, Homo Sapiens
SVSKLFCDD

SEQ ID NO: 58791 - protein, 9 aa, Homo Sapiens
FYVEVQLHP

SEQ ID NO: 58792 - protein, 9 aa, Homo Sapiens
RLVRKIAQD

SEQ ID NO: 58793 - protein, 9 aa, Homo Sapiens
AGVFTVPDK

SEQ ID NO: 58794 - protein, 9 aa, Homo Sapiens
GGYNLANMA

SEQ ID NO: 58795 - protein, 9 aa, Homo Sapiens
REKKQSTPS

SEQ ID NO: 58796 - protein, 9 aa, Homo Sapiens
ELLKHKFMT

SEQ ID NO: 58797 - protein, 9 aa, Homo Sapiens
SPSAIVHSR

SEQ ID NO: 58798 - protein, 9 aa, Homo Sapiens
FVFTGASKF

SEQ ID NO: 58799 - protein, 9 aa, Homo Sapiens
NLQRAISQN

SEQ ID NO: 58800 - protein, 9 aa, Homo Sapiens
ILMDYQNLS

SEQ ID NO: 58801 - protein, 9 aa, Homo Sapiens
HKKRQTEKK

SEQ ID NO: 58802 - protein, 9 aa, Homo Sapiens
IEAWYRCWR

SEQ ID NO: 58803 - protein, 9 aa, Homo Sapiens
HNLSDSPYN

SEQ ID NO: 58804 - protein, 9 aa, Homo Sapiens
SCYLHSFMR

SEQ ID NO: 58805 - protein, 9 aa, Homo Sapiens
PELSLLGDA

SEQ ID NO: 58806 - protein, 9 aa, Homo Sapiens
VHTGKKPYA

SEQ ID NO: 58807 - protein, 9 aa, Homo Sapiens
PAALRCVFC

SEQ ID NO: 58808 - protein, 9 aa, Homo Sapiens
KKVGLNPKK

SEQ ID NO: 58809 - protein, 9 aa, Homo Sapiens
SLSSSSSAS

SEQ ID NO: 58810 - protein, 9 aa, Homo Sapiens
TCEANEETL

SEQ ID NO: 58811 - protein, 9 aa, Homo Sapiens
LRPGALAAV

SEQ ID NO: 58812 - protein, 9 aa, Homo Sapiens
GFPFPGPPS

SEQ ID NO: 58813 - protein, 9 aa, Homo Sapiens
GEISRIKKE

SEQ ID NO: 58814 - protein, 9 aa, Homo Sapiens
QGEISRIKK

SEQ ID NO: 58815 - protein, 9 aa, Homo Sapiens
SSVLIKELP

SEQ ID NO: 58816 - protein, 9 aa, Homo Sapiens
PRLAASGSV

SEQ ID NO: 58817 - protein, 9 aa, Homo Sapiens
SMLTDVKHL

SEQ ID NO: 58818 - protein, 9 aa, Homo Sapiens
GPPSFPPQS

SEQ ID NO: 58819 - protein, 9 aa, Homo Sapiens
FHGFVAMCH

SEQ ID NO: 58820 - protein, 9 aa, Homo Sapiens
RMHAPASGS

SEQ ID NO: 58821 - protein, 9 aa, Homo Sapiens
PKQKYCHVI

SEQ ID NO: 58822 - protein, 9 aa, Homo Sapiens
GAPWDSLAA

SEQ ID NO: 58823 - protein, 9 aa, Homo Sapiens
CARNATCSH

SEQ ID NO: 58824 - protein, 9 aa, Homo Sapiens
KIQFTQMSL

SEQ ID NO: 58825 - protein, 9 aa, Homo Sapiens
EKPPAALRC

SEQ ID NO: 58826 - protein, 9 aa, Homo Sapiens
HREKKQSTP

SEQ ID NO: 58827 - protein, 9 aa, Homo Sapiens
VHTPESSHE

SEQ ID NO: 58828 - protein, 9 aa, Homo Sapiens
ANVTEKQQS

SEQ ID NO: 58829 - protein, 9 aa, Homo Sapiens
MSTYLLYVY

SEQ ID NO: 58830 - protein, 9 aa, Homo Sapiens
PFPLNNISS

SEQ ID NO: 58831 - protein, 9 aa, Homo Sapiens
HQHQVELIK

SEQ ID NO: 58832 - protein, 9 aa, Homo Sapiens
WCSVHTPES

SEQ ID NO: 58833 - protein, 9 aa, Homo Sapiens
EDEEMDVYV

SEQ ID NO: 58834 - protein, 9 aa, Homo Sapiens
VFASVAEVQ

SEQ ID NO: 58835 - protein, 9 aa, Homo Sapiens
RPEIWSPSA

SEQ ID NO: 58836 - protein, 9 aa, Homo Sapiens
QLHPAGQLC

SEQ ID NO: 58837 - protein, 9 aa, Homo Sapiens
HYPCAEEVM

SEQ ID NO: 58838 - protein, 9 aa, Homo Sapiens
KDKDFAKDE

SEQ ID NO: 58839 - protein, 9 aa, Homo Sapiens
TFSLGFLLA

SEQ ID NO: 58840 - protein, 9 aa, Homo Sapiens
GSIVADVHR

SEQ ID NO: 58841 - protein, 9 aa, Homo Sapiens
FSQVAFGSF

SEQ ID NO: 58842 - protein, 9 aa, Homo Sapiens
VSNSNMSFV

SEQ ID NO: 58843 - protein, 9 aa, Homo Sapiens
LGTTAATSS

SEQ ID NO: 58844 - protein, 9 aa, Homo Sapiens
LFLSSEQFI

SEQ ID NO: 58845 - protein, 9 aa, Homo Sapiens
RRPVLFPGV

SEQ ID NO: 58846 - protein, 9 aa, Homo Sapiens
SGLRTAWRY

SEQ ID NO: 58847 - protein, 9 aa, Homo Sapiens
DHCCGETET

SEQ ID NO: 58848 - protein, 9 aa, Homo Sapiens
QQSAKPDPP

SEQ ID NO: 58849 - protein, 9 aa, Homo Sapiens
ASYLRPGAL

SEQ ID NO: 58850 - protein, 9 aa, Homo Sapiens
RRMWKWLQQ

SEQ ID NO: 58851 - protein, 9 aa, Homo Sapiens
CYLHSFMRR

SEQ ID NO: 58852 - protein, 9 aa, Homo Sapiens
NFSWYNGTV

SEQ ID NO: 58853 - protein, 9 aa, Homo Sapiens
DLKLVSNIL

SEQ ID NO: 58854 - protein, 9 aa, Homo Sapiens
NVTEKQQSA

SEQ ID NO: 58855 - protein, 9 aa, Homo Sapiens
SYTHGSLEV

SEQ ID NO: 58856 - protein, 9 aa, Homo Sapiens
LLQNLIKDY

SEQ ID NO: 58857 - protein, 9 aa, Homo Sapiens
RCVFCRRGP

SEQ ID NO: 58858 - protein, 9 aa, Homo Sapiens
SKLFCDDIT

SEQ ID NO: 58859 - protein, 9 aa, Homo Sapiens
SQPAVKGKV

SEQ ID NO: 58860 - protein, 9 aa, Homo Sapiens
GSRSRIRTC

SEQ ID NO: 58861 - protein, 9 aa, Homo Sapiens
NELRRPPPR

SEQ ID NO: 58862 - protein, 9 aa, Homo Sapiens
IEIQAAIGS

SEQ ID NO: 58863 - protein, 9 aa, Homo Sapiens
QSTPSTASL

SEQ ID NO: 58864 - protein, 9 aa, Homo Sapiens
PSSVLIKEL

SEQ ID NO: 58865 - protein, 9 aa, Homo Sapiens
NIHKKRQTE

SEQ ID NO: 58866 - protein, 9 aa, Homo Sapiens
PVDVLSELS

SEQ ID NO: 58867 - protein, 9 aa, Homo Sapiens
FCEELWKIQ

SEQ ID NO: 58868 - protein, 9 aa, Homo Sapiens
EVQLHPAGQ

SEQ ID NO: 58869 - protein, 9 aa, Homo Sapiens
LKGDHCCGE

SEQ ID NO: 58870 - protein, 9 aa, Homo Sapiens
ITAILFMFS

SEQ ID NO: 58871 - protein, 9 aa, Homo Sapiens
QPAVKGKVL

SEQ ID NO: 58872 - protein, 9 aa, Homo Sapiens
LEQIHPLET

SEQ ID NO: 58873 - protein, 9 aa, Homo Sapiens
MVSNSNMSF

SEQ ID NO: 58874 - protein, 9 aa, Homo Sapiens
KAIINYANY

SEQ ID NO: 58875 - protein, 9 aa, Homo Sapiens
LNPKKDIHF

SEQ ID NO: 58876 - protein, 9 aa, Homo Sapiens
TDVKHLSSG

SEQ ID NO: 58877 - protein, 9 aa, Homo Sapiens
CSLGRSCYL

SEQ ID NO: 58878 - protein, 9 aa, Homo Sapiens
FKARGVPET

SEQ ID NO: 58879 - protein, 9 aa, Homo Sapiens
LSGGHSEEE

SEQ ID NO: 58880 - protein, 9 aa, Homo Sapiens
FLSGGHSEE

SEQ ID NO: 58881 - protein, 9 aa, Homo Sapiens
SHRKFTDME

SEQ ID NO: 58882 - protein, 9 aa, Homo Sapiens
SEDFVCMRA

SEQ ID NO: 58883 - protein, 9 aa, Homo Sapiens
GQFRLLGDV

SEQ ID NO: 58884 - protein, 9 aa, Homo Sapiens
FMVSNSNMS

SEQ ID NO: 58885 - protein, 9 aa, Homo Sapiens
TCTVYAFKA

SEQ ID NO: 58886 - protein, 9 aa, Homo Sapiens
FCNIEPTEY

SEQ ID NO: 58887 - protein, 9 aa, Homo Sapiens
GGNVTLHCF

SEQ ID NO: 58888 - protein, 9 aa, Homo Sapiens
FVKNRRGRP

SEQ ID NO: 58889 - protein, 9 aa, Homo Sapiens
ERTPGSANE

SEQ ID NO: 58890 - protein, 9 aa, Homo Sapiens
RLQLFLSSE

SEQ ID NO: 58891 - protein, 9 aa, Homo Sapiens
TTNMTVGPE

SEQ ID NO: 58892 - protein, 9 aa, Homo Sapiens
VDVDLKLVS

SEQ ID NO: 58893 - protein, 9 aa, Homo Sapiens
IKELPEFVV

SEQ ID NO: 58894 - protein, 9 aa, Homo Sapiens
AAYALGKSY

SEQ ID NO: 58895 - protein, 9 aa, Homo Sapiens
PGAKKGPPS

SEQ ID NO: 58896 - protein, 9 aa, Homo Sapiens
QFRLLGDVQ

SEQ ID NO: 58897 - protein, 9 aa, Homo Sapiens
KMTECPAAL

SEQ ID NO: 58898 - protein, 9 aa, Homo Sapiens
SYRQMAFEF

SEQ ID NO: 58899 - protein, 9 aa, Homo Sapiens
LDSMFAGLE

SEQ ID NO: 58900 - protein, 9 aa, Homo Sapiens
SFVVNIATI

SEQ ID NO: 58901 - protein, 9 aa, Homo Sapiens
DVDLKLVSN

SEQ ID NO: 58902 - protein, 9 aa, Homo Sapiens
LGKSYTHGS

SEQ ID NO: 58903 - protein, 9 aa, Homo Sapiens
LTDVKHLSS

SEQ ID NO: 58904 - protein, 9 aa, Homo Sapiens
LYKILMDYQ

SEQ ID NO: 58905 - protein, 9 aa, Homo Sapiens
LTNLIDQQL

SEQ ID NO: 58906 - protein, 9 aa, Homo Sapiens
DNKKEYVHL

SEQ ID NO: 58907 - protein, 9 aa, Homo Sapiens
KGFNTSFVV

SEQ ID NO: 58908 - protein, 9 aa, Homo Sapiens
ADGSLYVVL

SEQ ID NO: 58909 - protein, 9 aa, Homo Sapiens
VVDTCEANE

SEQ ID NO: 58910 - protein, 9 aa, Homo Sapiens
LMCGKSFSQ

SEQ ID NO: 58911 - protein, 9 aa, Homo Sapiens
SAKPDPPHS

SEQ ID NO: 58912 - protein, 9 aa, Homo Sapiens
IRTCVPPQH

SEQ ID NO: 58913 - protein, 9 aa, Homo Sapiens
NTEGKSGKG

SEQ ID NO: 58914 - protein, 9 aa, Homo Sapiens
RITCGDFIG

SEQ ID NO: 58915 - protein, 9 aa, Homo Sapiens
RKVFASVAE

SEQ ID NO: 58916 - protein, 9 aa, Homo Sapiens
AVEDCKDKD

SEQ ID NO: 58917 - protein, 9 aa, Homo Sapiens
KPPAALRCV

SEQ ID NO: 58918 - protein, 9 aa, Homo Sapiens
MFAGLEGVI

SEQ ID NO: 58919 - protein, 9 aa, Homo Sapiens
FTQMSLQLL

SEQ ID NO: 58920 - protein, 9 aa, Homo Sapiens
ENRPFSPFP

SEQ ID NO: 58921 - protein, 9 aa, Homo Sapiens
KGEDEEMDV

SEQ ID NO: 58922 - protein, 9 aa, Homo Sapiens
EQYKMTECP

SEQ ID NO: 58923 - protein, 9 aa, Homo Sapiens
VQYCEAVEM

SEQ ID NO: 58924 - protein, 9 aa, Homo Sapiens
QMAFEFARV

SEQ ID NO: 58925 - protein, 9 aa, Homo Sapiens
PETQGQFRL

SEQ ID NO: 58926 - protein, 9 aa, Homo Sapiens
GKRITCGDF

SEQ ID NO: 58927 - protein, 9 aa, Homo Sapiens
CCSLGRSCY

SEQ ID NO: 58928 - protein, 9 aa, Homo Sapiens
QNNKLYGFV

SEQ ID NO: 58929 - protein, 9 aa, Homo Sapiens
TEKKPFKCK

SEQ ID NO: 58930 - protein, 9 aa, Homo Sapiens
PDAANFNLW

SEQ ID NO: 58931 - protein, 9 aa, Homo Sapiens
DFVCMRARL

SEQ ID NO: 58932 - protein, 9 aa, Homo Sapiens
EKKQSTPST

SEQ ID NO: 58933 - protein, 9 aa, Homo Sapiens
QRAISQNLM

SEQ ID NO: 58934 - protein, 9 aa, Homo Sapiens
GFNTSFVVN

SEQ ID NO: 58935 - protein, 9 aa, Homo Sapiens
DVKHLSSGG

SEQ ID NO: 58936 - protein, 9 aa, Homo Sapiens
LAQLDPSLD

SEQ ID NO: 58937 - protein, 9 aa, Homo Sapiens
CEELWKIQS

SEQ ID NO: 58938 - protein, 9 aa, Homo Sapiens
HSHRKFTDM

SEQ ID NO: 58939 - protein, 9 aa, Homo Sapiens
APDAYRSRD

SEQ ID NO: 58940 - protein, 9 aa, Homo Sapiens
EESQPAVKG

SEQ ID NO: 58941 - protein, 9 aa, Homo Sapiens
QMSEVKAES

SEQ ID NO: 58942 - protein, 9 aa, Homo Sapiens
RPVDVLSEL

SEQ ID NO: 58943 - protein, 9 aa, Homo Sapiens
ARNATCSHY

SEQ ID NO: 58944 - protein, 9 aa, Homo Sapiens
KKQSTPSTA

SEQ ID NO: 58945 - protein, 9 aa, Homo Sapiens
NFNLWRRHL

SEQ ID NO: 58946 - protein, 9 aa, Homo Sapiens
VFWKIQFTQ

SEQ ID NO: 58947 - protein, 9 aa, Homo Sapiens
SLHSAQYLR

SEQ ID NO: 58948 - protein, 9 aa, Homo Sapiens
DKDFAKDEN

SEQ ID NO: 58949 - protein, 9 aa, Homo Sapiens
LGRSCYLHS

SEQ ID NO: 58950 - protein, 9 aa, Homo Sapiens
NSAGTGYSA

SEQ ID NO: 58951 - protein, 9 aa, Homo Sapiens
ALGKSYTHG

SEQ ID NO: 58952 - protein, 9 aa, Homo Sapiens
SLQGRLQLF

SEQ ID NO: 58953 - protein, 9 aa, Homo Sapiens
IHPSSVLIK

SEQ ID NO: 58954 - protein, 9 aa, Homo Sapiens
RTPGSANEL

SEQ ID NO: 58955 - protein, 9 aa, Homo Sapiens
ACLAPFDLF

SEQ ID NO: 58956 - protein, 9 aa, Homo Sapiens
SSCAYAPSG

SEQ ID NO: 58957 - protein, 9 aa, Homo Sapiens
TVTIWNISA

SEQ ID NO: 58958 - protein, 9 aa, Homo Sapiens
IVADVHRTL

SEQ ID NO: 58959 - protein, 9 aa, Homo Sapiens
CPYEKVNFS

SEQ ID NO: 58960 - protein, 9 aa, Homo Sapiens
FPFPGPPSF

SEQ ID NO: 58961 - protein, 9 aa, Homo Sapiens
NKLYGFVFT

SEQ ID NO: 58962 - protein, 9 aa, Homo Sapiens
IGPRPVDVL

SEQ ID NO: 58963 - protein, 9 aa, Homo Sapiens
AFEFARVKK

SEQ ID NO: 58964 - protein, 9 aa, Homo Sapiens
PLGHLLASG

SEQ ID NO: 58965 - protein, 9 aa, Homo Sapiens
RQMAFEFAR

SEQ ID NO: 58966 - protein, 9 aa, Homo Sapiens
SRIKKEYQV

SEQ ID NO: 58967 - protein, 9 aa, Homo Sapiens
LCAQSHSTS

SEQ ID NO: 58968 - protein, 9 aa, Homo Sapiens
TGYSAPANL

SEQ ID NO: 58969 - protein, 9 aa, Homo Sapiens
MIYFDEFTL

SEQ ID NO: 58970 - protein, 9 aa, Homo Sapiens
QTEKKPFKC

SEQ ID NO: 58971 - protein, 9 aa, Homo Sapiens
AFRTSHYPC

SEQ ID NO: 58972 - protein, 9 aa, Homo Sapiens
VTEKQQSAK

SEQ ID NO: 58973 - protein, 9 aa, Homo Sapiens
QRLVRKIAQ

SEQ ID NO: 58974 - protein, 9 aa, Homo Sapiens
LQQPEFQRM

SEQ ID NO: 58975 - protein, 9 aa, Homo Sapiens
AIPLRSSCA

SEQ ID NO: 58976 - protein, 9 aa, Homo Sapiens
QYAVDGTNV

SEQ ID NO: 58977 - protein, 9 aa, Homo Sapiens
TPRLAASGS

SEQ ID NO: 58978 - protein, 9 aa, Homo Sapiens
RETLNTEGK

SEQ ID NO: 58979 - protein, 9 aa, Homo Sapiens
SVNPEKFIS

SEQ ID NO: 58980 - protein, 9 aa, Homo Sapiens
PGPPSFPPQ

SEQ ID NO: 58981 - protein, 9 aa, Homo Sapiens
HSNYTLPSA

SEQ ID NO: 58982 - protein, 9 aa, Homo Sapiens
ANILVTEDN

SEQ ID NO: 58983 - protein, 9 aa, Homo Sapiens
CVVDTCEAN

SEQ ID NO: 58984 - protein, 9 aa, Homo Sapiens
VKPETQGQF

SEQ ID NO: 58985 - protein, 9 aa, Homo Sapiens
VGSIVADVH

SEQ ID NO: 58986 - protein, 9 aa, Homo Sapiens
VVRNPVTHA

SEQ ID NO: 58987 - protein, 9 aa, Homo Sapiens
SPIENEDFC

SEQ ID NO: 58988 - protein, 9 aa, Homo Sapiens
GKAIINYAN

SEQ ID NO: 58989 - protein, 9 aa, Homo Sapiens
FQSFMVSNS

SEQ ID NO: 58990 - protein, 9 aa, Homo Sapiens
LGMLDCARR

SEQ ID NO: 58991 - protein, 9 aa, Homo Sapiens
GTVTIWNIS

SEQ ID NO: 58992 - protein, 9 aa, Homo Sapiens
DEFTLTKLK

SEQ ID NO: 58993 - protein, 9 aa, Homo Sapiens
LSSQEQMCG

SEQ ID NO: 58994 - protein, 9 aa, Homo Sapiens
QLDPSLDAF

SEQ ID NO: 58995 - protein, 9 aa, Homo Sapiens
WHSLSRKEK

SEQ ID NO: 58996 - protein, 9 aa, Homo Sapiens
ITFLSGGHS

SEQ ID NO: 58997 - protein, 9 aa, Homo Sapiens
KSVNPEKFI

SEQ ID NO: 58998 - protein, 9 aa, Homo Sapiens
ACKIEAWYR

SEQ ID NO: 58999 - protein, 9 aa, Homo Sapiens
KIEAWYRCW

SEQ ID NO: 59000 - protein, 9 aa, Homo Sapiens
VDGTNVAIN

SEQ ID NO: 59001 - protein, 9 aa, Homo Sapiens
VLEQIHPLE

SEQ ID NO: 59002 - protein, 9 aa, Homo Sapiens
AVQYCEAVE

SEQ ID NO: 59003 - protein, 9 aa, Homo Sapiens
HSLSSSSSA

SEQ ID NO: 59004 - protein, 9 aa, Homo Sapiens
GANILVTED

SEQ ID NO: 59005 - protein, 9 aa, Homo Sapiens
REQDHSLSS

SEQ ID NO: 59006 - protein, 9 aa, Homo Sapiens
SHYPCAEEV

SEQ ID NO: 59007 - protein, 9 aa, Homo Sapiens
PVDVDLKLV

SEQ ID NO: 59008 - protein, 9 aa, Homo Sapiens
QYSHVLEQI

SEQ ID NO: 59009 - protein, 9 aa, Homo Sapiens
RFLCAQSHS

SEQ ID NO: 59010 - protein, 9 aa, Homo Sapiens
ISRIKKEYQ

SEQ ID NO: 59011 - protein, 9 aa, Homo Sapiens
HCCGETETP

SEQ ID NO: 59012 - protein, 9 aa, Homo Sapiens
SGGRMHAPA

SEQ ID NO: 59013 - protein, 9 aa, Homo Sapiens
PTSCRHRFW

SEQ ID NO: 59014 - protein, 9 aa, Homo Sapiens
VTNKVIKIV

SEQ ID NO: 59015 - protein, 9 aa, Homo Sapiens
MAFEFARVK

SEQ ID NO: 59016 - protein, 9 aa, Homo Sapiens
VKNRRGRPR

SEQ ID NO: 59017 - protein, 9 aa, Homo Sapiens
QYLGMLDCA

SEQ ID NO: 59018 - protein, 9 aa, Homo Sapiens
QLFLSSEQF

SEQ ID NO: 59019 - protein, 9 aa, Homo Sapiens
NLANMARCW

SEQ ID NO: 59020 - protein, 9 aa, Homo Sapiens
MLDITRNPL

SEQ ID NO: 59021 - protein, 9 aa, Homo Sapiens
KVIKIVGLA

SEQ ID NO: 59022 - protein, 9 aa, Homo Sapiens
SFCEELWKI

SEQ ID NO: 59023 - protein, 9 aa, Homo Sapiens
AVVVASYLR

SEQ ID NO: 59024 - protein, 9 aa, Homo Sapiens
SVHTPESSH

SEQ ID NO: 59025 - protein, 9 aa, Homo Sapiens
TCVNFSPLG

SEQ ID NO: 59026 - protein, 9 aa, Homo Sapiens
ARKCLRKFQ

SEQ ID NO: 59027 - protein, 9 aa, Homo Sapiens
VNQYAVDGT

SEQ ID NO: 59028 - protein, 9 aa, Homo Sapiens
AASGSVPHD

SEQ ID NO: 59029 - protein, 9 aa, Homo Sapiens
SMLDITRNP

SEQ ID NO: 59030 - protein, 9 aa, Homo Sapiens
QLIALQSGL

SEQ ID NO: 59031 - protein, 9 aa, Homo Sapiens
SNYTLPSAE

SEQ ID NO: 59032 - protein, 9 aa, Homo Sapiens
GKWCKPYNF

SEQ ID NO: 59033 - protein, 9 aa, Homo Sapiens
NVTLHCFSQ

SEQ ID NO: 59034 - protein, 9 aa, Homo Sapiens
KGPPSPIEN

SEQ ID NO: 59035 - protein, 9 aa, Homo Sapiens
GGRMHAPAS

SEQ ID NO: 59036 - protein, 9 aa, Homo Sapiens
THREKKQST

SEQ ID NO: 59037 - protein, 9 aa, Homo Sapiens
DSMFAGLEG

SEQ ID NO: 59038 - protein, 9 aa, Homo Sapiens
GCIALTTFS

SEQ ID NO: 59039 - protein, 9 aa, Homo Sapiens
LAPFDLFLW

SEQ ID NO: 59040 - protein, 9 aa, Homo Sapiens
MCLRRPVLF

SEQ ID NO: 59041 - protein, 9 aa, Homo Sapiens
KWLQQPEFQ

SEQ ID NO: 59042 - protein, 9 aa, Homo Sapiens
HAPASGSAC

SEQ ID NO: 59043 - protein, 9 aa, Homo Sapiens
ILFMFSLLY

SEQ ID NO: 59044 - protein, 9 aa, Homo Sapiens
LAVVVASYL

SEQ ID NO: 59045 - protein, 9 aa, Homo Sapiens
WERTPGSAN

SEQ ID NO: 59046 - protein, 9 aa, Homo Sapiens
YQNLSEHVL

SEQ ID NO: 59047 - protein, 9 aa, Homo Sapiens
HNIGKRITC

SEQ ID NO: 59048 - protein, 9 aa, Homo Sapiens
LFCDDITLN

SEQ ID NO: 59049 - protein, 9 aa, Homo Sapiens
ITLGLDSMF

SEQ ID NO: 59050 - protein, 9 aa, Homo Sapiens
VELIKRDEV

SEQ ID NO: 59051 - protein, 9 aa, Homo Sapiens
SESDQMSEV

SEQ ID NO: 59052 - protein, 9 aa, Homo Sapiens
TSACSLQTQ

SEQ ID NO: 59053 - protein, 9 aa, Homo Sapiens
FFKTTKLSF

SEQ ID NO: 59054 - protein, 9 aa, Homo Sapiens
TSHYPCAEE

SEQ ID NO: 59055 - protein, 9 aa, Homo Sapiens
VLPGGEESG

SEQ ID NO: 59056 - protein, 9 aa, Homo Sapiens
LFEIEIQAA

SEQ ID NO: 59057 - protein, 9 aa, Homo Sapiens
CSHYTQLVW

SEQ ID NO: 59058 - protein, 9 aa, Homo Sapiens
LYGFVFTGA

SEQ ID NO: 59059 - protein, 9 aa, Homo Sapiens
TFPVNGAPW

SEQ ID NO: 59060 - protein, 9 aa, Homo Sapiens
TLHCFSQVA

SEQ ID NO: 59061 - protein, 9 aa, Homo Sapiens
MCHQVCRLP

SEQ ID NO: 59062 - protein, 9 aa, Homo Sapiens
IPLRSSCAY

SEQ ID NO: 59063 - protein, 9 aa, Homo Sapiens
KFDQNVFTA

SEQ ID NO: 59064 - protein, 9 aa, Homo Sapiens
YLLYVYRLE

SEQ ID NO: 59065 - protein, 9 aa, Homo Sapiens
RKEGHRVAG

SEQ ID NO: 59066 - protein, 9 aa, Homo Sapiens
SLWLFLSSQ

SEQ ID NO: 59067 - protein, 9 aa, Homo Sapiens
IGKRITCGD

SEQ ID NO: 59068 - protein, 9 aa, Homo Sapiens
LQRAISQNL

SEQ ID NO: 59069 - protein, 9 aa, Homo Sapiens
MVTCTVYAF

SEQ ID NO: 59070 - protein, 9 aa, Homo Sapiens
CTVYAFKAR

SEQ ID NO: 59071 - protein, 9 aa, Homo Sapiens
KLVSNILES

SEQ ID NO: 59072 - protein, 9 aa, Homo Sapiens
TLNTEGKSG

SEQ ID NO: 59073 - protein, 9 aa, Homo Sapiens
KHKFMTRYT

SEQ ID NO: 59074 - protein, 9 aa, Homo Sapiens
NFFKTTKLS

SEQ ID NO: 59075 - protein, 9 aa, Homo Sapiens
VAGVFTVPD

SEQ ID NO: 59076 - protein, 9 aa, Homo Sapiens
SANELRRPP

SEQ ID NO: 59077 - protein, 9 aa, Homo Sapiens
LSLLGDADH

SEQ ID NO: 59078 - protein, 9 aa, Homo Sapiens
VLRLDKRSL

SEQ ID NO: 59079 - protein, 9 aa, Homo Sapiens
ELSLLGDAD

SEQ ID NO: 59080 - protein, 9 aa, Homo Sapiens
PPQRHLLLT

SEQ ID NO: 59081 - protein, 9 aa, Homo Sapiens
PGESGERET

SEQ ID NO: 59082 - protein, 9 aa, Homo Sapiens
SAGTGYSAP

SEQ ID NO: 59083 - protein, 9 aa, Homo Sapiens
KHLSSGGNV

SEQ ID NO: 59084 - protein, 9 aa, Homo Sapiens
GTHREKKQS

SEQ ID NO: 59085 - protein, 9 aa, Homo Sapiens
HTPESSHEG

SEQ ID NO: 59086 - protein, 9 aa, Homo Sapiens
LIALQSGLQ

SEQ ID NO: 59087 - protein, 9 aa, Homo Sapiens
ATSTTTNMT

SEQ ID NO: 59088 - protein, 9 aa, Homo Sapiens
VLIKELPEF

SEQ ID NO: 59089 - protein, 9 aa, Homo Sapiens
GSANELRRP

SEQ ID NO: 59090 - protein, 9 aa, Homo Sapiens
KFTDMEVTP

SEQ ID NO: 59091 - protein, 9 aa, Homo Sapiens
LNFFKTTKL

SEQ ID NO: 59092 - protein, 9 aa, Homo Sapiens
QVWCSVHTP

SEQ ID NO: 59093 - protein, 9 aa, Homo Sapiens
TNVSVSKLF

SEQ ID NO: 59094 - protein, 9 aa, Homo Sapiens
DKVEDLYEL

SEQ ID NO: 59095 - protein, 9 aa, Homo Sapiens
AMCHQVCRL

SEQ ID NO: 59096 - protein, 9 aa, Homo Sapiens
ETQGQFRLL

SEQ ID NO: 59097 - protein, 9 aa, Homo Sapiens
YCHVILGDK

SEQ ID NO: 59098 - protein, 9 aa, Homo Sapiens
NIGKRITCG

SEQ ID NO: 59099 - protein, 9 aa, Homo Sapiens
VMKGAPEHI

SEQ ID NO: 59100 - protein, 9 aa, Homo Sapiens
LPRQLFEIE

SEQ ID NO: 59101 - protein, 9 aa, Homo Sapiens
YNRIRHQRV

SEQ ID NO: 59102 - protein, 9 aa, Homo Sapiens
LLWHSLSRK

SEQ ID NO: 59103 - protein, 9 aa, Homo Sapiens
EHILDRCST

SEQ ID NO: 59104 - protein, 9 aa, Homo Sapiens
FPVNGAPWD

SEQ ID NO: 59105 - protein, 9 aa, Homo Sapiens
FTDMEVTPG

SEQ ID NO: 59106 - protein, 9 aa, Homo Sapiens
WLQQPEFQR

SEQ ID NO: 59107 - protein, 9 aa, Homo Sapiens
RNPLREIAL

SEQ ID NO: 59108 - protein, 9 aa, Homo Sapiens
VWCSVHTPE

SEQ ID NO: 59109 - protein, 9 aa, Homo Sapiens
LVSATSTTT

SEQ ID NO: 59110 - protein, 9 aa, Homo Sapiens
YCEAVEMEV

SEQ ID NO: 59111 - protein, 9 aa, Homo Sapiens
KALKGDHCC

SEQ ID NO: 59112 - protein, 9 aa, Homo Sapiens
VTHAISDYT

SEQ ID NO: 59113 - protein, 9 aa, Homo Sapiens
AYALGKSYT

SEQ ID NO: 59114 - protein, 9 aa, Homo Sapiens
KIAQDFKTD

SEQ ID NO: 59115 - protein, 9 aa, Homo Sapiens
NRIRHQRVH

SEQ ID NO: 59116 - protein, 9 aa, Homo Sapiens
VQGTVTIWN

SEQ ID NO: 59117 - protein, 9 aa, Homo Sapiens
EELWKIQSS

SEQ ID NO: 59118 - protein, 9 aa, Homo Sapiens
RAISQNLMQ

SEQ ID NO: 59119 - protein, 9 aa, Homo Sapiens
SQEQMCGTH

SEQ ID NO: 59120 - protein, 9 aa, Homo Sapiens
VYTKCEGDK

SEQ ID NO: 59121 - protein, 9 aa, Homo Sapiens
DKERTFDPG

SEQ ID NO: 59122 - protein, 9 aa, Homo Sapiens
FPGPPSFPP

SEQ ID NO: 59123 - protein, 9 aa, Homo Sapiens
WNISALSSG

SEQ ID NO: 59124 - protein, 9 aa, Homo Sapiens
ECARNATCS

SEQ ID NO: 59125 - protein, 9 aa, Homo Sapiens
KQQSAKPDP

SEQ ID NO: 59126 - protein, 9 aa, Homo Sapiens
IALTTFSLG

SEQ ID NO: 59127 - protein, 9 aa, Homo Sapiens
TSFVVNIAT

SEQ ID NO: 59128 - protein, 9 aa, Homo Sapiens
GTGYSAPAN

SEQ ID NO: 59129 - protein, 9 aa, Homo Sapiens
VPFLKKVGL

SEQ ID NO: 59130 - protein, 9 aa, Homo Sapiens
ESDQMSEVK

SEQ ID NO: 59131 - protein, 9 aa, Homo Sapiens
TRWFFNFQT

SEQ ID NO: 59132 - protein, 9 aa, Homo Sapiens
KRQTEKKPF

SEQ ID NO: 59133 - protein, 9 aa, Homo Sapiens
AFGEATQYR

SEQ ID NO: 59134 - protein, 9 aa, Homo Sapiens
LITLGLDSM

SEQ ID NO: 59135 - protein, 9 aa, Homo Sapiens
SGERETLNT

SEQ ID NO: 59136 - protein, 9 aa, Homo Sapiens
RWFFNFQTG

SEQ ID NO: 59137 - protein, 9 aa, Homo Sapiens
LQETGLRDK

SEQ ID NO: 59138 - protein, 9 aa, Homo Sapiens
IQYSHVLEQ

SEQ ID NO: 59139 - protein, 9 aa, Homo Sapiens
PKGFNTSFV

SEQ ID NO: 59140 - protein, 9 aa, Homo Sapiens
TNMTVGPEG

SEQ ID NO: 59141 - protein, 9 aa, Homo Sapiens
ETGLRDKCE

SEQ ID NO: 59142 - protein, 9 aa, Homo Sapiens
NLWRRHLKL

SEQ ID NO: 59143 - protein, 9 aa, Homo Sapiens
DLLQNLIKD

SEQ ID NO: 59144 - protein, 9 aa, Homo Sapiens
HKFMTRYTK

SEQ ID NO: 59145 - protein, 9 aa, Homo Sapiens
DQMSEVKAE

SEQ ID NO: 59146 - protein, 9 aa, Homo Sapiens
YTHGSLEVG

SEQ ID NO: 59147 - protein, 9 aa, Homo Sapiens
MDYQNLSEH

SEQ ID NO: 59148 - protein, 9 aa, Homo Sapiens
SSAGNEGLG

SEQ ID NO: 59149 - protein, 9 aa, Homo Sapiens
SQGSILVMH

SEQ ID NO: 59150 - protein, 9 aa, Homo Sapiens
IHSYNRIRH

SEQ ID NO: 59151 - protein, 9 aa, Homo Sapiens
SCAYAPSGN

SEQ ID NO: 59152 - protein, 9 aa, Homo Sapiens
VVNIATIFE

SEQ ID NO: 59153 - protein, 9 aa, Homo Sapiens
DITRNPLRE

SEQ ID NO: 59154 - protein, 9 aa, Homo Sapiens
MHAPASGSA

SEQ ID NO: 59155 - protein, 9 aa, Homo Sapiens
VVVRNPVTH

SEQ ID NO: 59156 - protein, 9 aa, Homo Sapiens
SFPPQSMFG

SEQ ID NO: 59157 - protein, 9 aa, Homo Sapiens
ANFNLWRRH

SEQ ID NO: 59158 - protein, 9 aa, Homo Sapiens
YFDEFTLTK

SEQ ID NO: 59159 - protein, 9 aa, Homo Sapiens
YRSRDDSFH

SEQ ID NO: 59160 - protein, 9 aa, Homo Sapiens
VGLNPKKDI

SEQ ID NO: 59161 - protein, 9 aa, Homo Sapiens
KGAPEHILD

SEQ ID NO: 59162 - protein, 9 aa, Homo Sapiens
LSFCEELWK

SEQ ID NO: 59163 - protein, 9 aa, Homo Sapiens
HRHVPPSFP

SEQ ID NO: 59164 - protein, 9 aa, Homo Sapiens
CHVILGDKV

SEQ ID NO: 59165 - protein, 9 aa, Homo Sapiens
VRSSGGRMH

SEQ ID NO: 59166 - protein, 9 aa, Homo Sapiens
VVASYLRPG

SEQ ID NO: 59167 - protein, 9 aa, Homo Sapiens
TEGKSGKGQ

SEQ ID NO: 59168 - protein, 9 aa, Homo Sapiens
NNFVKNRRG

SEQ ID NO: 59169 - protein, 9 aa, Homo Sapiens
TFLSGGHSE

SEQ ID NO: 59170 - protein, 9 aa, Homo Sapiens
EIWSPSAIV

SEQ ID NO: 59171 - protein, 9 aa, Homo Sapiens
LDPSLDAFL

SEQ ID NO: 59172 - protein, 9 aa, Homo Sapiens
PAPPQRHLL

SEQ ID NO: 59173 - protein, 9 aa, Homo Sapiens
SSEQYKMTE

SEQ ID NO: 59174 - protein, 9 aa, Homo Sapiens
LHSAQYLRQ

SEQ ID NO: 59175 - protein, 9 aa, Homo Sapiens
PFPGPPSFP

SEQ ID NO: 59176 - protein, 9 aa, Homo Sapiens
CSLQTQGSL

SEQ ID NO: 59177 - protein, 9 aa, Homo Sapiens
GQAPDAYRS

SEQ ID NO: 59178 - protein, 9 aa, Homo Sapiens
DFDLFCNIE

SEQ ID NO: 59179 - protein, 9 aa, Homo Sapiens
LWLFLSSQE

SEQ ID NO: 59180 - protein, 9 aa, Homo Sapiens
LIKRDEVSL

SEQ ID NO: 59181 - protein, 9 aa, Homo Sapiens
PFSPFPLNN

SEQ ID NO: 59182 - protein, 9 aa, Homo Sapiens
KKPYACADC

SEQ ID NO: 59183 - protein, 9 aa, Homo Sapiens
HAISDYTQT

SEQ ID NO: 59184 - protein, 9 aa, Homo Sapiens
VTLHCFSQV

SEQ ID NO: 59185 - protein, 9 aa, Homo Sapiens
QPEFQRMSA

SEQ ID NO: 59186 - protein, 9 aa, Homo Sapiens
YVEVQLHPA

SEQ ID NO: 59187 - protein, 9 aa, Homo Sapiens
VRTCAVDMG

SEQ ID NO: 59188 - protein, 9 aa, Homo Sapiens
SRSRIRTCV

SEQ ID NO: 59189 - protein, 9 aa, Homo Sapiens
LSEDFVCMR

SEQ ID NO: 59190 - protein, 9 aa, Homo Sapiens
PSFPPQSMF

SEQ ID NO: 59191 - protein, 9 aa, Homo Sapiens
SVVPNHKAD

SEQ ID NO: 59192 - protein, 9 aa, Homo Sapiens
CAQSHSTSP

SEQ ID NO: 59193 - protein, 9 aa, Homo Sapiens
THAISDYTQ

SEQ ID NO: 59194 - protein, 9 aa, Homo Sapiens
VPNHKADAV

SEQ ID NO: 59195 - protein, 9 aa, Homo Sapiens
KPYNFATLA

SEQ ID NO: 59196 - protein, 9 aa, Homo Sapiens
YNLANMARC

SEQ ID NO: 59197 - protein, 9 aa, Homo Sapiens
HLLLTGHED

SEQ ID NO: 59198 - protein, 9 aa, Homo Sapiens
KSFSQGSIL

SEQ ID NO: 59199 - protein, 9 aa, Homo Sapiens
DHSLSSSSS

SEQ ID NO: 59200 - protein, 9 aa, Homo Sapiens
FDLFCNIEP

SEQ ID NO: 59201 - protein, 9 aa, Homo Sapiens
NLIGPRPVD

SEQ ID NO: 59202 - protein, 9 aa, Homo Sapiens
EDLSSEQYK

SEQ ID NO: 59203 - protein, 9 aa, Homo Sapiens
LKHKFMTRY

SEQ ID NO: 59204 - protein, 9 aa, Homo Sapiens
KLYGFVFTG

SEQ ID NO: 59205 - protein, 9 aa, Homo Sapiens
QGTVTIWNI

SEQ ID NO: 59206 - protein, 9 aa, Homo Sapiens
LGCIALTTF

SEQ ID NO: 59207 - protein, 9 aa, Homo Sapiens
QDHSLSSSS

SEQ ID NO: 59208 - protein, 9 aa, Homo Sapiens
QVELIKRDE

SEQ ID NO: 59209 - protein, 9 aa, Homo Sapiens
ATQYRRTED

SEQ ID NO: 59210 - protein, 9 aa, Homo Sapiens
MLTDVKHLS

SEQ ID NO: 59211 - protein, 9 aa, Homo Sapiens
KKGPPSPIE

SEQ ID NO: 59212 - protein, 9 aa, Homo Sapiens
LLKHKFMTR

SEQ ID NO: 59213 - protein, 9 aa, Homo Sapiens
YVYRLEYMR

SEQ ID NO: 59214 - protein, 9 aa, Homo Sapiens
RVAGVFTVP

SEQ ID NO: 59215 - protein, 9 aa, Homo Sapiens
ASGSVPHDS

SEQ ID NO: 59216 - protein, 9 aa, Homo Sapiens
HSAQYLRQA

SEQ ID NO: 59217 - protein, 9 aa, Homo Sapiens
EATQYRRTE

SEQ ID NO: 59218 - protein, 9 aa, Homo Sapiens
RGSRSRIRT

SEQ ID NO: 59219 - protein, 9 aa, Homo Sapiens
PFLKKVGLN

SEQ ID NO: 59220 - protein, 9 aa, Homo Sapiens
LRCVFCRRG

SEQ ID NO: 59221 - protein, 9 aa, Homo Sapiens
EQISGLRTA

SEQ ID NO: 59222 - protein, 9 aa, Homo Sapiens
ALRKTGQYL

SEQ ID NO: 59223 - protein, 9 aa, Homo Sapiens
IWSPSAIVH

SEQ ID NO: 59224 - protein, 9 aa, Homo Sapiens
KIVGLANSM

SEQ ID NO: 59225 - protein, 9 aa, Homo Sapiens
RNATCSHYT

SEQ ID NO: 59226 - protein, 9 aa, Homo Sapiens
TNSAGTGYS

SEQ ID NO: 59227 - protein, 9 aa, Homo Sapiens
KERTFDPGE

SEQ ID NO: 59228 - protein, 9 aa, Homo Sapiens
TRIKSGKAI

SEQ ID NO: 59229 - protein, 9 aa, Homo Sapiens
VASYLRPGA

SEQ ID NO: 59230 - protein, 9 aa, Homo Sapiens
RTAWRYDMD

SEQ ID NO: 59231 - protein, 9 aa, Homo Sapiens
SENRPFSPF

SEQ ID NO: 59232 - protein, 9 aa, Homo Sapiens
SPLGHLLAS

SEQ ID NO: 59233 - protein, 9 aa, Homo Sapiens
SVFPTSCRH

SEQ ID NO: 59234 - protein, 9 aa, Homo Sapiens
LTKLKRNTG

SEQ ID NO: 59235 - protein, 9 aa, Homo Sapiens
KLHNLSDSP

SEQ ID NO: 59236 - protein, 9 aa, Homo Sapiens
CEANEETLE

SEQ ID NO: 59237 - protein, 9 aa, Homo Sapiens
LSLVNQYAV

SEQ ID NO: 59238 - protein, 9 aa, Homo Sapiens
VRKIAQDFK

SEQ ID NO: 59239 - protein, 9 aa, Homo Sapiens
ARYVGSIVA

SEQ ID NO: 59240 - protein, 9 aa, Homo Sapiens
FRTSHYPCA

SEQ ID NO: 59241 - protein, 9 aa, Homo Sapiens
MTRWFFNFQ

SEQ ID NO: 59242 - protein, 9 aa, Homo Sapiens
EKKPFKCKE

SEQ ID NO: 59243 - protein, 9 aa, Homo Sapiens
QRHLLLTGH

SEQ ID NO: 59244 - protein, 9 aa, Homo Sapiens
FAQVWCSVH

SEQ ID NO: 59245 - protein, 9 aa, Homo Sapiens
QYKMTECPA

SEQ ID NO: 59246 - protein, 9 aa, Homo Sapiens
PVSPKQKYC

SEQ ID NO: 59247 - protein, 9 aa, Homo Sapiens
YALGKSYTH

SEQ ID NO: 59248 - protein, 9 aa, Homo Sapiens
LDKRSLVKH

SEQ ID NO: 59249 - protein, 9 aa, Homo Sapiens
MPLSEDFVC

SEQ ID NO: 59250 - protein, 9 aa, Homo Sapiens
GGGYNLANM

SEQ ID NO: 59251 - protein, 9 aa, Homo Sapiens
LETERKVFA

SEQ ID NO: 59252 - protein, 9 aa, Homo Sapiens
GRMHAPASG

SEQ ID NO: 59253 - protein, 9 aa, Homo Sapiens
RSSGGRMHA

SEQ ID NO: 59254 - protein, 9 aa, Homo Sapiens
SLGRSCYLH

SEQ ID NO: 59255 - protein, 9 aa, Homo Sapiens
LICVVDTCE

SEQ ID NO: 59256 - protein, 9 aa, Homo Sapiens
APVDVDLKL

SEQ ID NO: 59257 - protein, 9 aa, Homo Sapiens
FDEFTLTKL

SEQ ID NO: 59258 - protein, 9 aa, Homo Sapiens
NLIKDYHAQ

SEQ ID NO: 59259 - protein, 9 aa, Homo Sapiens
LGIYSVVPN

SEQ ID NO: 59260 - protein, 9 aa, Homo Sapiens
IDQQLIALQ

SEQ ID NO: 59261 - protein, 9 aa, Homo Sapiens
GRLQLFLSS

SEQ ID NO: 59262 - protein, 9 aa, Homo Sapiens
PFDLFLWAC

SEQ ID NO: 59263 - protein, 9 aa, Homo Sapiens
EISRIKKEY

SEQ ID NO: 59264 - protein, 9 aa, Homo Sapiens
PKGEDEEMD

SEQ ID NO: 59265 - protein, 9 aa, Homo Sapiens
LHPAGQLCD

SEQ ID NO: 59266 - protein, 9 aa, Homo Sapiens
EIQAAIGSK

SEQ ID NO: 59267 - protein, 9 aa, Homo Sapiens
RQNNKLYGF

SEQ ID NO: 59268 - protein, 9 aa, Homo Sapiens
GSLYVVLPG

SEQ ID NO: 59269 - protein, 9 aa, Homo Sapiens
EGDKVEDLY

SEQ ID NO: 59270 - protein, 9 aa, Homo Sapiens
NQYAVDGTN

SEQ ID NO: 59271 - protein, 9 aa, Homo Sapiens
DAYRSRDDS

SEQ ID NO: 59272 - protein, 9 aa, Homo Sapiens
EDFVCMRAR

SEQ ID NO: 59273 - protein, 9 aa, Homo Sapiens
LWRRHLKLT

SEQ ID NO: 59274 - protein, 9 aa, Homo Sapiens
LRKEGHRVA

SEQ ID NO: 59275 - protein, 9 aa, Homo Sapiens
QYRRTEDDS

SEQ ID NO: 59276 - protein, 9 aa, Homo Sapiens
RKTGQYLGM

SEQ ID NO: 59277 - protein, 9 aa, Homo Sapiens
IYFDEFTLT

SEQ ID NO: 59278 - protein, 9 aa, Homo Sapiens
RSRDDSFHV

SEQ ID NO: 59279 - protein, 9 aa, Homo Sapiens
LYVYRLEYM

SEQ ID NO: 59280 - protein, 9 aa, Homo Sapiens
QNLIKDYHA

SEQ ID NO: 59281 - protein, 9 aa, Homo Sapiens
SATPRLAAS

SEQ ID NO: 59282 - protein, 9 aa, Homo Sapiens
PSRFLCAQS

SEQ ID NO: 59283 - protein, 9 aa, Homo Sapiens
YKILMDYQN

SEQ ID NO: 59284 - protein, 9 aa, Homo Sapiens
ITCGDFIGN

SEQ ID NO: 59285 - protein, 9 aa, Homo Sapiens
TCSHYTQLV

SEQ ID NO: 59286 - protein, 9 aa, Homo Sapiens
VDLKLVSNI

SEQ ID NO: 59287 - protein, 9 aa, Homo Sapiens
LKLVSNILE

SEQ ID NO: 59288 - protein, 9 aa, Homo Sapiens
NFSPLGHLL

SEQ ID NO: 59289 - protein, 9 aa, Homo Sapiens
WLFLSSQEQ

SEQ ID NO: 59290 - protein, 9 aa, Homo Sapiens
RYVGSIVAD

SEQ ID NO: 59291 - protein, 9 aa, Homo Sapiens
SYNRIRHQR

SEQ ID NO: 59292 - protein, 9 aa, Homo Sapiens
DMGFLHVHQ

SEQ ID NO: 59293 - protein, 9 aa, Homo Sapiens
CLNFFKTTK

SEQ ID NO: 59294 - protein, 9 aa, Homo Sapiens
QGRLQLFLS

SEQ ID NO: 59295 - protein, 9 aa, Homo Sapiens
LFLSSQEQM

SEQ ID NO: 59296 - protein, 9 aa, Homo Sapiens
GIYSVVPNH

SEQ ID NO: 59297 - protein, 9 aa, Homo Sapiens
EARKCLRKF

SEQ ID NO: 59298 - protein, 9 aa, Homo Sapiens
RTSHYPCAE

SEQ ID NO: 59299 - protein, 9 aa, Homo Sapiens
PSAIVHSRE

SEQ ID NO: 59300 - protein, 9 aa, Homo Sapiens
QVVIKFDQN

SEQ ID NO: 59301 - protein, 9 aa, Homo Sapiens
IDYCLNFFK

SEQ ID NO: 59302 - protein, 9 aa, Homo Sapiens
FDPGESGER

SEQ ID NO: 59303 - protein, 9 aa, Homo Sapiens
TVYAFKARG

SEQ ID NO: 59304 - protein, 9 aa, Homo Sapiens
PEKEESQPA

SEQ ID NO: 59305 - protein, 9 aa, Homo Sapiens
FAMSTYLLY

SEQ ID NO: 59306 - protein, 9 aa, Homo Sapiens
TCAVDMGFL

SEQ ID NO: 59307 - protein, 9 aa, Homo Sapiens
EAWYRCWRA

SEQ ID NO: 59308 - protein, 9 aa, Homo Sapiens
DLFCNIEPT

SEQ ID NO: 59309 - protein, 9 aa, Homo Sapiens
RTFDPGESG

SEQ ID NO: 59310 - protein, 9 aa, Homo Sapiens
QHQVELIKR

SEQ ID NO: 59311 - protein, 9 aa, Homo Sapiens
FGFSLLWHS

SEQ ID NO: 59312 - protein, 9 aa, Homo Sapiens
ERETLNTEG

SEQ ID NO: 59313 - protein, 9 aa, Homo Sapiens
WSPSAIVHS

SEQ ID NO: 59314 - protein, 9 aa, Homo Sapiens
GGHSEEEAS

SEQ ID NO: 59315 - protein, 9 aa, Homo Sapiens
ESQPAVKGK

SEQ ID NO: 59316 - protein, 9 aa, Homo Sapiens
LPSAETPLA

SEQ ID NO: 59317 - protein, 9 aa, Homo Sapiens
SNSNMSFVE

SEQ ID NO: 59318 - protein, 9 aa, Homo Sapiens
DRLPSRFLC

SEQ ID NO: 59319 - protein, 9 aa, Homo Sapiens
AVDMGFLHV

SEQ ID NO: 59320 - protein, 9 aa, Homo Sapiens
MSEVKAESQ

SEQ ID NO: 59321 - protein, 9 aa, Homo Sapiens
DMEVTPGQM

SEQ ID NO: 59322 - protein, 9 aa, Homo Sapiens
CEGDKVEDL

SEQ ID NO: 59323 - protein, 9 aa, Homo Sapiens
ASMLDITRN

SEQ ID NO: 59324 - protein, 9 aa, Homo Sapiens
FVAMCHQVC

SEQ ID NO: 59325 - protein, 9 aa, Homo Sapiens
VNFSWYNGT

SEQ ID NO: 59326 - protein, 9 aa, Homo Sapiens
KSGKAIINY

SEQ ID NO: 59327 - protein, 9 aa, Homo Sapiens
HRKFTDMEV

SEQ ID NO: 59328 - protein, 9 aa, Homo Sapiens
AQLDPSLDA

SEQ ID NO: 59329 - protein, 9 aa, Homo Sapiens
QQGEISRIK

SEQ ID NO: 59330 - protein, 9 aa, Homo Sapiens
VVVASYLRP

SEQ ID NO: 59331 - protein, 9 aa, Homo Sapiens
VEKPPAALR

SEQ ID NO: 59332 - protein, 9 aa, Homo Sapiens
RHQRVHTGK

SEQ ID NO: 59333 - protein, 9 aa, Homo Sapiens
CCKLHNLSD

SEQ ID NO: 59334 - protein, 9 aa, Homo Sapiens
TQGSLSTRK

SEQ ID NO: 59335 - protein, 9 aa, Homo Sapiens
SLLWHSLSR

SEQ ID NO: 59336 - protein, 9 aa, Homo Sapiens
AILFMFSLL

SEQ ID NO: 59337 - protein, 9 aa, Homo Sapiens
IKFDQNVFT

SEQ ID NO: 59338 - protein, 9 aa, Homo Sapiens
RPVLFPGVA

SEQ ID NO: 59339 - protein, 9 aa, Homo Sapiens
FLCAQSHST

SEQ ID NO: 59340 - protein, 9 aa, Homo Sapiens
VGKWCKPYN

SEQ ID NO: 59341 - protein, 9 aa, Homo Sapiens
SVLIKELPE

SEQ ID NO: 59342 - protein, 9 aa, Homo Sapiens
TYLLYVYRL

SEQ ID NO: 59343 - protein, 9 aa, Homo Sapiens
VKAACKIEA

SEQ ID NO: 59344 - protein, 9 aa, Homo Sapiens
AQVWCSVHT

SEQ ID NO: 59345 - protein, 9 aa, Homo Sapiens
KYCHVILGD

SEQ ID NO: 59346 - protein, 9 aa, Homo Sapiens
SITAILFMF

SEQ ID NO: 59347 - protein, 9 aa, Homo Sapiens
AATSSAGNE

SEQ ID NO: 59348 - protein, 9 aa, Homo Sapiens
RTCAVDMGF

SEQ ID NO: 59349 - protein, 9 aa, Homo Sapiens
MAPVDVDLK

SEQ ID NO: 59350 - protein, 9 aa, Homo Sapiens
RLAASGSVP

SEQ ID NO: 59351 - protein, 9 aa, Homo Sapiens
QYCEAVEME

SEQ ID NO: 59352 - protein, 9 aa, Homo Sapiens
TKCEGDKVE

SEQ ID NO: 59353 - protein, 9 aa, Homo Sapiens
LVMKGAPEH

SEQ ID NO: 59354 - protein, 9 aa, Homo Sapiens
ETRQVVIKF

SEQ ID NO: 59355 - protein, 9 aa, Homo Sapiens
LRRPVLFPG

SEQ ID NO: 59356 - protein, 9 aa, Homo Sapiens
EEARKCLRK

SEQ ID NO: 59357 - protein, 9 aa, Homo Sapiens
TSTTTNMTV

SEQ ID NO: 59358 - protein, 9 aa, Homo Sapiens
EQDHSLSSS

SEQ ID NO: 59359 - protein, 9 aa, Homo Sapiens
RSCYLHSFM

SEQ ID NO: 59360 - protein, 9 aa, Homo Sapiens
GGTHREKKQ

SEQ ID NO: 59361 - protein, 9 aa, Homo Sapiens
SLQTQGSLS

SEQ ID NO: 59362 - protein, 9 aa, Homo Sapiens
TRQVVIKFD

SEQ ID NO: 59363 - protein, 9 aa, Homo Sapiens
KCLRKFQNI

SEQ ID NO: 59364 - protein, 9 aa, Homo Sapiens
PPSFPVMVS

SEQ ID NO: 59365 - protein, 9 aa, Homo Sapiens
MFYVEVQLH

SEQ ID NO: 59366 - protein, 9 aa, Homo Sapiens
KEGHRVAGV

SEQ ID NO: 59367 - protein, 9 aa, Homo Sapiens
TAATSSAGN

SEQ ID NO: 59368 - protein, 9 aa, Homo Sapiens
SFPVMVSGL

SEQ ID NO: 59369 - protein, 9 aa, Homo Sapiens
SGKAIINYA

SEQ ID NO: 59370 - protein, 9 aa, Homo Sapiens
KTGNNFVKN

SEQ ID NO: 59371 - protein, 9 aa, Homo Sapiens
SHVLEQIHP

SEQ ID NO: 59372 - protein, 9 aa, Homo Sapiens
YEKVNFSWY

SEQ ID NO: 59373 - protein, 9 aa, Homo Sapiens
RDKCECIRG

SEQ ID NO: 59374 - protein, 9 aa, Homo Sapiens
NRRGRPRKQ

SEQ ID NO: 59375 - protein, 9 aa, Homo Sapiens
VPKGEDEEM

SEQ ID NO: 59376 - protein, 9 aa, Homo Sapiens
DCKDKDFAK

SEQ ID NO: 59377 - protein, 9 aa, Homo Sapiens
DYHAQCNFF

SEQ ID NO: 59378 - protein, 9 aa, Homo Sapiens
KSYTHGSLE

SEQ ID NO: 59379 - protein, 9 aa, Homo Sapiens
FKTTKLSFK

SEQ ID NO: 59380 - protein, 9 aa, Homo Sapiens
TPVRTCAVD

SEQ ID NO: 59381 - protein, 9 aa, Homo Sapiens
KDYHAQCNF

SEQ ID NO: 59382 - protein, 9 aa, Homo Sapiens
LVVPKGEDE

SEQ ID NO: 59383 - protein, 9 aa, Homo Sapiens
YTKCEGDKV

SEQ ID NO: 59384 - protein, 9 aa, Homo Sapiens
VKHLSSGGN

SEQ ID NO: 59385 - protein, 9 aa, Homo Sapiens
GNNFVKNRR

SEQ ID NO: 59386 - protein, 9 aa, Homo Sapiens
QEQMCGTHR

SEQ ID NO: 59387 - protein, 9 aa, Homo Sapiens
YPCAEEVMQ

SEQ ID NO: 59388 - protein, 9 aa, Homo Sapiens
AHSNYTLPS

SEQ ID NO: 59389 - protein, 9 aa, Homo Sapiens
PRQLFEIEI

SEQ ID NO: 59390 - protein, 9 aa, Homo Sapiens
ALNLIGPRP

SEQ ID NO: 59391 - protein, 9 aa, Homo Sapiens
KVFASVAEV

SEQ ID NO: 59392 - protein, 9 aa, Homo Sapiens
SACSLQTQG

SEQ ID NO: 59393 - protein, 9 aa, Homo Sapiens
HCFSQVAFG

SEQ ID NO: 59394 - protein, 9 aa, Homo Sapiens
CIDYCLNFF

SEQ ID NO: 59395 - protein, 9 aa, Homo Sapiens
CKIEAWYRC

SEQ ID NO: 59396 - protein, 9 aa, Homo Sapiens
PEKFISYPL

SEQ ID NO: 59397 - protein, 9 aa, Homo Sapiens
PDAYRSRDD

SEQ ID NO: 59398 - protein, 9 aa, Homo Sapiens
TTAATSSAG

SEQ ID NO: 59399 - protein, 9 aa, Homo Sapiens
YGARYVGSI

SEQ ID NO: 59400 - protein, 9 aa, Homo Sapiens
PWDSLAAAS

SEQ ID NO: 59401 - protein, 9 aa, Homo Sapiens
FSQGSILVM

SEQ ID NO: 59402 - protein, 9 aa, Homo Sapiens
NMARCWTYL

SEQ ID NO: 59403 - protein, 9 aa, Homo Sapiens
LHCFSQVAF

SEQ ID NO: 59404 - protein, 9 aa, Homo Sapiens
ICVVDTCEA

SEQ ID NO: 59405 - protein, 9 aa, Homo Sapiens
DKCECIRGR

SEQ ID NO: 59406 - protein, 9 aa, Homo Sapiens
CVNFSPLGH

SEQ ID NO: 59407 - protein, 9 aa, Homo Sapiens
NVSVSKLFC

SEQ ID NO: 59408 - protein, 9 aa, Homo Sapiens
TGNNFVKNR

SEQ ID NO: 59409 - protein, 9 aa, Homo Sapiens
FEFARVKKG

SEQ ID NO: 59410 - protein, 9 aa, Homo Sapiens
HLSSGGNVN

SEQ ID NO: 59411 - protein, 9 aa, Homo Sapiens
VFPTSCRHR

SEQ ID NO: 59412 - protein, 9 aa, Homo Sapiens
VNPEKFISY

SEQ ID NO: 59413 - protein, 9 aa, Homo Sapiens
EVKAESQDF

SEQ ID NO: 59414 - protein, 9 aa, Homo Sapiens
RSSCAYAPS

SEQ ID NO: 59415 - protein, 9 aa, Homo Sapiens
KAACKIEAW

SEQ ID NO: 59416 - protein, 9 aa, Homo Sapiens
TGQYLGMLD

SEQ ID NO: 59417 - protein, 9 aa, Homo Sapiens
ATPRLAASG

SEQ ID NO: 59418 - protein, 9 aa, Homo Sapiens
GEDEEMDVY

SEQ ID NO: 59419 - protein, 9 aa, Homo Sapiens
NKVIKIVGL

SEQ ID NO: 59420 - protein, 9 aa, Homo Sapiens
YSVVPNHKA

SEQ ID NO: 59421 - protein, 9 aa, Homo Sapiens
EIEIQAAIG

SEQ ID NO: 59422 - protein, 9 aa, Homo Sapiens
TAILFMFSL

SEQ ID NO: 59423 - protein, 9 aa, Homo Sapiens
EKVNFSWYN

SEQ ID NO: 59424 - protein, 9 aa, Homo Sapiens
KCPYEKVNF

SEQ ID NO: 59425 - protein, 9 aa, Homo Sapiens
VTCTVYAFK

SEQ ID NO: 59426 - protein, 9 aa, Homo Sapiens
IWNISALSS

SEQ ID NO: 59427 - protein, 9 aa, Homo Sapiens
YAVDGTNVA

SEQ ID NO: 59428 - protein, 9 aa, Homo Sapiens
TQYRRTEDD

SEQ ID NO: 59429 - protein, 9 aa, Homo Sapiens
FVCMRARLQ

SEQ ID NO: 59430 - protein, 9 aa, Homo Sapiens
LRTAWRYDM

SEQ ID NO: 59431 - protein, 9 aa, Homo Sapiens
KRSLVKHIG

SEQ ID NO: 59432 - protein, 9 aa, Homo Sapiens
VSVSKLFCD

SEQ ID NO: 59433 - protein, 9 aa, Homo Sapiens
KDWAVQYCE

SEQ ID NO: 59434 - protein, 9 aa, Homo Sapiens
KFGFSLLWH

SEQ ID NO: 59435 - protein, 9 aa, Homo Sapiens
QLFEIEIQA

SEQ ID NO: 59436 - protein, 9 aa, Homo Sapiens
HSYNRIRHQ

SEQ ID NO: 59437 - protein, 9 aa, Homo Sapiens
DYQNLSEHV

SEQ ID NO: 59438 - protein, 9 aa, Homo Sapiens
QAPDAYRSR

SEQ ID NO: 59439 - protein, 9 aa, Homo Sapiens
KDFAKDENI

SEQ ID NO: 59440 - protein, 9 aa, Homo Sapiens
GPRPVDVLS

SEQ ID NO: 59441 - protein, 9 aa, Homo Sapiens
GDKVEDLYE

SEQ ID NO: 59442 - protein, 9 aa, Homo Sapiens
KCEGDKVED

SEQ ID NO: 59443 - protein, 9 aa, Homo Sapiens
DPGESGERE

SEQ ID NO: 59444 - protein, 9 aa, Homo Sapiens
DYCLNFFKT

SEQ ID NO: 59445 - protein, 9 aa, Homo Sapiens
GRSCYLHSF

SEQ ID NO: 59446 - protein, 9 aa, Homo Sapiens
AANFNLWRR

SEQ ID NO: 59447 - protein, 9 aa, Homo Sapiens
SRFLCAQSH

SEQ ID NO: 59448 - protein, 9 aa, Homo Sapiens
SSVFPTSCR

SEQ ID NO: 59449 - protein, 9 aa, Homo Sapiens
YVGSIVADV

SEQ ID NO: 59450 - protein, 9 aa, Homo Sapiens
NILVTEDNK

SEQ ID NO: 59451 - protein, 9 aa, Homo Sapiens
WCKPYNFAT

SEQ ID NO: 59452 - protein, 9 aa, Homo Sapiens
RLPSRFLCA

SEQ ID NO: 59453 - protein, 9 aa, Homo Sapiens
CLRKFQNIC

SEQ ID NO: 59454 - protein, 9 aa, Homo Sapiens
AVDGTNVAI

SEQ ID NO: 59455 - protein, 9 aa, Homo Sapiens
KRDEVSLHK

SEQ ID NO: 59456 - protein, 9 aa, Homo Sapiens
LSSSSSASP

SEQ ID NO: 59457 - protein, 9 aa, Homo Sapiens
LFCNIEPTE

SEQ ID NO: 59458 - protein, 9 aa, Homo Sapiens
EGKSGKGQN

SEQ ID NO: 59459 - protein, 9 aa, Homo Sapiens
RKFTDMEVT

SEQ ID NO: 59460 - protein, 9 aa, Homo Sapiens
GYSAPANLY

SEQ ID NO: 59461 - protein, 9 aa, Homo Sapiens
FEIEIQAAI

SEQ ID NO: 59462 - protein, 9 aa, Homo Sapiens
YGFVFTGAS

SEQ ID NO: 59463 - protein, 9 aa, Homo Sapiens
AALRCVFCR

SEQ ID NO: 59464 - protein, 9 aa, Homo Sapiens
QTQGSLSTR

SEQ ID NO: 59465 - protein, 9 aa, Homo Sapiens
AGTGYSAPA

SEQ ID NO: 59466 - protein, 9 aa, Homo Sapiens
RLKSVNPEK

SEQ ID NO: 59467 - protein, 9 aa, Homo Sapiens
DEEMDVYVS

SEQ ID NO: 59468 - protein, 9 aa, Homo Sapiens
ISQNLMQRA

SEQ ID NO: 59469 - protein, 9 aa, Homo Sapiens
VTEDNKKEY

SEQ ID NO: 59470 - protein, 9 aa, Homo Sapiens
VTCVNFSPL

SEQ ID NO: 59471 - protein, 9 aa, Homo Sapiens
KELLKHKFM

SEQ ID NO: 59472 - protein, 9 aa, Homo Sapiens
DWAVQYCEA

SEQ ID NO: 59473 - protein, 9 aa, Homo Sapiens
LRKTGQYLG

SEQ ID NO: 59474 - protein, 9 aa, Homo Sapiens
MACHRSSSF

SEQ ID NO: 59475 - protein, 9 aa, Homo Sapiens
LFPAPAAHR

SEQ ID NO: 59476 - protein, 9 aa, Homo Sapiens
KDNIAQVDY

SEQ ID NO: 59477 - protein, 9 aa, Homo Sapiens
WRKYLEWED

SEQ ID NO: 59478 - protein, 9 aa, Homo Sapiens
LPNIQAVLS

SEQ ID NO: 59479 - protein, 9 aa, Homo Sapiens
SNPGLEMAT

SEQ ID NO: 59480 - protein, 9 aa, Homo Sapiens
IGNKQAHKQ

SEQ ID NO: 59481 - protein, 9 aa, Homo Sapiens
KGAGITIYL

SEQ ID NO: 59482 - protein, 9 aa, Homo Sapiens
AHRTLTYLS

SEQ ID NO: 59483 - protein, 9 aa, Homo Sapiens
DKQTKTKGS

SEQ ID NO: 59484 - protein, 9 aa, Homo Sapiens
CPYNLANNS

SEQ ID NO: 59485 - protein, 9 aa, Homo Sapiens
LANNSQVRM

SEQ ID NO: 59486 - protein, 9 aa, Homo Sapiens
SSISPALPA

SEQ ID NO: 59487 - protein, 9 aa, Homo Sapiens
HLFFLIGNK

SEQ ID NO: 59488 - protein, 9 aa, Homo Sapiens
HPIRWYPNI

SEQ ID NO: 59489 - protein, 9 aa, Homo Sapiens
DDAEEEEED

SEQ ID NO: 59490 - protein, 9 aa, Homo Sapiens
ITEKGAGIT

SEQ ID NO: 59491 - protein, 9 aa, Homo Sapiens
AITFSIKVV

SEQ ID NO: 59492 - protein, 9 aa, Homo Sapiens
QSRSWSRSD

SEQ ID NO: 59493 - protein, 9 aa, Homo Sapiens
SQKERFAFL

SEQ ID NO: 59494 - protein, 9 aa, Homo Sapiens
VYTEEEEES

SEQ ID NO: 59495 - protein, 9 aa, Homo Sapiens
QRVYLHLQR

SEQ ID NO: 59496 - protein, 9 aa, Homo Sapiens
SRSWSRSDS

SEQ ID NO: 59497 - protein, 9 aa, Homo Sapiens
VGESSISPA

SEQ ID NO: 59498 - protein, 9 aa, Homo Sapiens
LNPTSRSLL

SEQ ID NO: 59499 - protein, 9 aa, Homo Sapiens
QINADKQTK

SEQ ID NO: 59500 - protein, 9 aa, Homo Sapiens
GGTEEEEEA

SEQ ID NO: 59501 - protein, 9 aa, Homo Sapiens
LETKSASVA

SEQ ID NO: 59502 - protein, 9 aa, Homo Sapiens
YTEEEEESQ

SEQ ID NO: 59503 - protein, 9 aa, Homo Sapiens
ARCVSSLKD

SEQ ID NO: 59504 - protein, 9 aa, Homo Sapiens
FARCVSSLK

SEQ ID NO: 59505 - protein, 9 aa, Homo Sapiens
ASRLFPLLL

SEQ ID NO: 59506 - protein, 9 aa, Homo Sapiens
ELPAEPLVQ

SEQ ID NO: 59507 - protein, 9 aa, Homo Sapiens
LKELHLSNM

SEQ ID NO: 59508 - protein, 9 aa, Homo Sapiens
CAFVVINGG

SEQ ID NO: 59509 - protein, 9 aa, Homo Sapiens
LAKSSNSRQ

SEQ ID NO: 59510 - protein, 9 aa, Homo Sapiens
SLGVPASHV

SEQ ID NO: 59511 - protein, 9 aa, Homo Sapiens
INGGIVIGD

SEQ ID NO: 59512 - protein, 9 aa, Homo Sapiens
EKRTFHHWL

SEQ ID NO: 59513 - protein, 9 aa, Homo Sapiens
QTEILSALR

SEQ ID NO: 59514 - protein, 9 aa, Homo Sapiens
QSQKQINAD

SEQ ID NO: 59515 - protein, 9 aa, Homo Sapiens
GSKSQSRSW

SEQ ID NO: 59516 - protein, 9 aa, Homo Sapiens
NWQATKASQ

SEQ ID NO: 59517 - protein, 9 aa, Homo Sapiens
ILSALRDHE

SEQ ID NO: 59518 - protein, 9 aa, Homo Sapiens
SGGGEAGTA

SEQ ID NO: 59519 - protein, 9 aa, Homo Sapiens
SQKQINADK

SEQ ID NO: 59520 - protein, 9 aa, Homo Sapiens
EPLVQSREG

SEQ ID NO: 59521 - protein, 9 aa, Homo Sapiens
AVSTRVRWC

SEQ ID NO: 59522 - protein, 9 aa, Homo Sapiens
TEEEEEAEG

SEQ ID NO: 59523 - protein, 9 aa, Homo Sapiens
GATLTTMLA

SEQ ID NO: 59524 - protein, 9 aa, Homo Sapiens
NSQVRMLAD

SEQ ID NO: 59525 - protein, 9 aa, Homo Sapiens
QGTQSCYNY

SEQ ID NO: 59526 - protein, 9 aa, Homo Sapiens
LHLQRTRRP

SEQ ID NO: 59527 - protein, 9 aa, Homo Sapiens
TEILSALRD

SEQ ID NO: 59528 - protein, 9 aa, Homo Sapiens
ALFKANTAL

SEQ ID NO: 59529 - protein, 9 aa, Homo Sapiens
SFNLGTLET

SEQ ID NO: 59530 - protein, 9 aa, Homo Sapiens
GEQGASRLF

SEQ ID NO: 59531 - protein, 9 aa, Homo Sapiens
GTAQDLSER

SEQ ID NO: 59532 - protein, 9 aa, Homo Sapiens
CEQEERLHE

SEQ ID NO: 59533 - protein, 9 aa, Homo Sapiens
PPGIMVGES

SEQ ID NO: 59534 - protein, 9 aa, Homo Sapiens
HVLSFGPQE

SEQ ID NO: 59535 - protein, 9 aa, Homo Sapiens
QMWRKYLEW

SEQ ID NO: 59536 - protein, 9 aa, Homo Sapiens
QAVLSVTKE

SEQ ID NO: 59537 - protein, 9 aa, Homo Sapiens
RKYLEWEDS

SEQ ID NO: 59538 - protein, 9 aa, Homo Sapiens
DAEEEEEDE

SEQ ID NO: 59539 - protein, 9 aa, Homo Sapiens
YGRVGRRGR

SEQ ID NO: 59540 - protein, 9 aa, Homo Sapiens
RLAILVKGA

SEQ ID NO: 59541 - protein, 9 aa, Homo Sapiens
DSISSSSSA

SEQ ID NO: 59542 - protein, 9 aa, Homo Sapiens
GTLETKSAS

SEQ ID NO: 59543 - protein, 9 aa, Homo Sapiens
CRALFKANT

SEQ ID NO: 59544 - protein, 9 aa, Homo Sapiens
STKLSDKSR

SEQ ID NO: 59545 - protein, 9 aa, Homo Sapiens
GASRLFPLL

SEQ ID NO: 59546 - protein, 9 aa, Homo Sapiens
MVGESSISP

SEQ ID NO: 59547 - protein, 9 aa, Homo Sapiens
GQRVYLHLQ

SEQ ID NO: 59548 - protein, 9 aa, Homo Sapiens
PEMACHRSS

SEQ ID NO: 59549 - protein, 9 aa, Homo Sapiens
ELHLSNMKT

SEQ ID NO: 59550 - protein, 9 aa, Homo Sapiens
AKNAELDID

SEQ ID NO: 59551 - protein, 9 aa, Homo Sapiens
KYLEWEDSR

SEQ ID NO: 59552 - protein, 9 aa, Homo Sapiens
QKQINADKQ

SEQ ID NO: 59553 - protein, 9 aa, Homo Sapiens
LEMATGALG

SEQ ID NO: 59554 - protein, 9 aa, Homo Sapiens
QGASRLFPL

SEQ ID NO: 59555 - protein, 9 aa, Homo Sapiens
RHKDMRRIR

SEQ ID NO: 59556 - protein, 9 aa, Homo Sapiens
RLFPLLLLD

SEQ ID NO: 59557 - protein, 9 aa, Homo Sapiens
QRTRRPKEE

SEQ ID NO: 59558 - protein, 9 aa, Homo Sapiens
INADKQTKT

SEQ ID NO: 59559 - protein, 9 aa, Homo Sapiens
ATLTTMLAT

SEQ ID NO: 59560 - protein, 9 aa, Homo Sapiens
WAKNAELDI

SEQ ID NO: 59561 - protein, 9 aa, Homo Sapiens
SRSLLNAVD

SEQ ID NO: 59562 - protein, 9 aa, Homo Sapiens
REAEHLCKS

SEQ ID NO: 59563 - protein, 9 aa, Homo Sapiens
NKQAHKQLP

SEQ ID NO: 59564 - protein, 9 aa, Homo Sapiens
VFARCVSSL

SEQ ID NO: 59565 - protein, 9 aa, Homo Sapiens
FPAPAAHRT

SEQ ID NO: 59566 - protein, 9 aa, Homo Sapiens
SSGAVSTRV

SEQ ID NO: 59567 - protein, 9 aa, Homo Sapiens
EAVFARCVS

SEQ ID NO: 59568 - protein, 9 aa, Homo Sapiens
AGTASGGGE

SEQ ID NO: 59569 - protein, 9 aa, Homo Sapiens
HRTLTYLSQ

SEQ ID NO: 59570 - protein, 9 aa, Homo Sapiens
LEWEDSRIG

SEQ ID NO: 59571 - protein, 9 aa, Homo Sapiens
TLNPTSRSL

SEQ ID NO: 59572 - protein, 9 aa, Homo Sapiens
ATKASQKER

SEQ ID NO: 59573 - protein, 9 aa, Homo Sapiens
LKGATLTTM

SEQ ID NO: 59574 - protein, 9 aa, Homo Sapiens
FDTKKVVRG

SEQ ID NO: 59575 - protein, 9 aa, Homo Sapiens
IYKDNIAQV

SEQ ID NO: 59576 - protein, 9 aa, Homo Sapiens
SGAVSTRVR

SEQ ID NO: 59577 - protein, 9 aa, Homo Sapiens
SRLFPLLLL

SEQ ID NO: 59578 - protein, 9 aa, Homo Sapiens
IQAVLSVTK

SEQ ID NO: 59579 - protein, 9 aa, Homo Sapiens
KRGIYKDNI

SEQ ID NO: 59580 - protein, 9 aa, Homo Sapiens
NNSQVRMLA

SEQ ID NO: 59581 - protein, 9 aa, Homo Sapiens
ASGGGEAGT

SEQ ID NO: 59582 - protein, 9 aa, Homo Sapiens
PAPAAHRTL

SEQ ID NO: 59583 - protein, 9 aa, Homo Sapiens
IKVVSGEFS

SEQ ID NO: 59584 - protein, 9 aa, Homo Sapiens
APAAHRTLT

SEQ ID NO: 59585 - protein, 9 aa, Homo Sapiens
VINGGIVIG

SEQ ID NO: 59586 - protein, 9 aa, Homo Sapiens
PASHVLSFG

SEQ ID NO: 59587 - protein, 9 aa, Homo Sapiens
TQGTQSCYN

SEQ ID NO: 59588 - protein, 9 aa, Homo Sapiens
EGYGGTEEE

SEQ ID NO: 59589 - protein, 9 aa, Homo Sapiens
EAITFSIKV

SEQ ID NO: 59590 - protein, 9 aa, Homo Sapiens
TFHHWLMRV

SEQ ID NO: 59591 - protein, 9 aa, Homo Sapiens
PAAHRTLTY

SEQ ID NO: 59592 - protein, 9 aa, Homo Sapiens
TLETKSASV

SEQ ID NO: 59593 - protein, 9 aa, Homo Sapiens
NPTSRSLLN

SEQ ID NO: 59594 - protein, 9 aa, Homo Sapiens
EAEHLCKSF

SEQ ID NO: 59595 - protein, 9 aa, Homo Sapiens
PAGAYGRVG

SEQ ID NO: 59596 - protein, 9 aa, Homo Sapiens
MATGALGGL

SEQ ID NO: 59597 - protein, 9 aa, Homo Sapiens
LFTTGFDTK

SEQ ID NO: 59598 - protein, 9 aa, Homo Sapiens
HQQQQQQMQ

SEQ ID NO: 59599 - protein, 9 aa, Homo Sapiens
TLTTMLATR

SEQ ID NO: 59600 - protein, 9 aa, Homo Sapiens
TSRSLLNAV

SEQ ID NO: 59601 - protein, 9 aa, Homo Sapiens
SVEELPAEP

SEQ ID NO: 59602 - protein, 9 aa, Homo Sapiens
GEAVFARCV

SEQ ID NO: 59603 - protein, 9 aa, Homo Sapiens
SYESGDKTT

SEQ ID NO: 59604 - protein, 9 aa, Homo Sapiens
QKERFAFLF

SEQ ID NO: 59605 - protein, 9 aa, Homo Sapiens
QLETQGTQS

SEQ ID NO: 59606 - protein, 9 aa, Homo Sapiens
LETQGTQSC

SEQ ID NO: 59607 - protein, 9 aa, Homo Sapiens
KLGEQGASR

SEQ ID NO: 59608 - protein, 9 aa, Homo Sapiens
KREAEHLCK

SEQ ID NO: 59609 - protein, 9 aa, Homo Sapiens
HLQRTRRPK

SEQ ID NO: 59610 - protein, 9 aa, Homo Sapiens
LAILVKGAF

SEQ ID NO: 59611 - protein, 9 aa, Homo Sapiens
RKPQSQKQI

SEQ ID NO: 59612 - protein, 9 aa, Homo Sapiens
YKDNIAQVD

SEQ ID NO: 59613 - protein, 9 aa, Homo Sapiens
STSTKLSDK

SEQ ID NO: 59614 - protein, 9 aa, Homo Sapiens
LVKGAFRCM

SEQ ID NO: 59615 - protein, 9 aa, Homo Sapiens
LCHCLSGQR

SEQ ID NO: 59616 - protein, 9 aa, Homo Sapiens
LFFLIGNKQ

SEQ ID NO: 59617 - protein, 9 aa, Homo Sapiens
NPGLEMATG

SEQ ID NO: 59618 - protein, 9 aa, Homo Sapiens
RRKLKGATL

SEQ ID NO: 59619 - protein, 9 aa, Homo Sapiens
LFKANTALE

SEQ ID NO: 59620 - protein, 9 aa, Homo Sapiens
LVRHKDMRR

SEQ ID NO: 59621 - protein, 9 aa, Homo Sapiens
KQTKTKGSF

SEQ ID NO: 59622 - protein, 9 aa, Homo Sapiens
VMEAITFSI

SEQ ID NO: 59623 - protein, 9 aa, Homo Sapiens
RDSYESGDK

SEQ ID NO: 59624 - protein, 9 aa, Homo Sapiens
VSSLKDERI

SEQ ID NO: 59625 - protein, 9 aa, Homo Sapiens
SSNPGLEMA

SEQ ID NO: 59626 - protein, 9 aa, Homo Sapiens
DEGYGGTEE

SEQ ID NO: 59627 - protein, 9 aa, Homo Sapiens
LHLSNMKTV

SEQ ID NO: 59628 - protein, 9 aa, Homo Sapiens
PGLEMATGA

SEQ ID NO: 59629 - protein, 9 aa, Homo Sapiens
FNLGTLETK

SEQ ID NO: 59630 - protein, 9 aa, Homo Sapiens
QDLSERLGR

SEQ ID NO: 59631 - protein, 9 aa, Homo Sapiens
TEKGAGITI

SEQ ID NO: 59632 - protein, 9 aa, Homo Sapiens
KNAELDIDA

SEQ ID NO: 59633 - protein, 9 aa, Homo Sapiens
AVLSVTKEN

SEQ ID NO: 59634 - protein, 9 aa, Homo Sapiens
SALRDHENL

SEQ ID NO: 59635 - protein, 9 aa, Homo Sapiens
QKWAKNAEL

SEQ ID NO: 59636 - protein, 9 aa, Homo Sapiens
PTSRSLLNA

SEQ ID NO: 59637 - protein, 9 aa, Homo Sapiens
LPAEPLVQS

SEQ ID NO: 59638 - protein, 9 aa, Homo Sapiens
QTGTAQDLS

SEQ ID NO: 59639 - protein, 9 aa, Homo Sapiens
SNSRQQGVW

SEQ ID NO: 59640 - protein, 9 aa, Homo Sapiens
EILSALRDH

SEQ ID NO: 59641 - protein, 9 aa, Homo Sapiens
LSSNPGLEM

SEQ ID NO: 59642 - protein, 9 aa, Homo Sapiens
NRKPQSQKQ

SEQ ID NO: 59643 - protein, 9 aa, Homo Sapiens
CLALCHCLS

SEQ ID NO: 59644 - protein, 9 aa, Homo Sapiens
LGTLETKSA

SEQ ID NO: 59645 - protein, 9 aa, Homo Sapiens
VSHPIRWYP

SEQ ID NO: 59646 - protein, 9 aa, Homo Sapiens
YALVSHPIR

SEQ ID NO: 59647 - protein, 9 aa, Homo Sapiens
CHCLSGQRP

SEQ ID NO: 59648 - protein, 9 aa, Homo Sapiens
RGIYKDNIA

SEQ ID NO: 59649 - protein, 9 aa, Homo Sapiens
VSTRVRWCR

SEQ ID NO: 59650 - protein, 9 aa, Homo Sapiens
ILVKGAFRC

SEQ ID NO: 59651 - protein, 9 aa, Homo Sapiens
PQPPAGAYG

SEQ ID NO: 59652 - protein, 9 aa, Homo Sapiens
QPPAGAYGR

SEQ ID NO: 59653 - protein, 9 aa, Homo Sapiens
AKSSNSRQQ

SEQ ID NO: 59654 - protein, 9 aa, Homo Sapiens
GTEEEEEAE

SEQ ID NO: 59655 - protein, 9 aa, Homo Sapiens
SSNSRQQGV

SEQ ID NO: 59656 - protein, 9 aa, Homo Sapiens
APQPPAGAY

SEQ ID NO: 59657 - protein, 9 aa, Homo Sapiens
SQSRSWSRS

SEQ ID NO: 59658 - protein, 9 aa, Homo Sapiens
GGGEAGTAS

SEQ ID NO: 59659 - protein, 9 aa, Homo Sapiens
NLAKSSNSR

SEQ ID NO: 59660 - protein, 9 aa, Homo Sapiens
FCAFVVING

SEQ ID NO: 59661 - protein, 9 aa, Homo Sapiens
ASHVLSFGP

SEQ ID NO: 59662 - protein, 9 aa, Homo Sapiens
SYASTSTKL

SEQ ID NO: 59663 - protein, 9 aa, Homo Sapiens
RTFHHWLMR

SEQ ID NO: 59664 - protein, 9 aa, Homo Sapiens
KLKGATLTT

SEQ ID NO: 59665 - protein, 9 aa, Homo Sapiens
LGEQGASRL

SEQ ID NO: 59666 - protein, 9 aa, Homo Sapiens
SHPIRWYPN

SEQ ID NO: 59667 - protein, 9 aa, Homo Sapiens
AAHRTLTYL

SEQ ID NO: 59668 - protein, 9 aa, Homo Sapiens
AADEGYGGT

SEQ ID NO: 59669 - protein, 9 aa, Homo Sapiens
VRHKDMRRI

SEQ ID NO: 59670 - protein, 9 aa, Homo Sapiens
TEEEEESQE

SEQ ID NO: 59671 - protein, 9 aa, Homo Sapiens
FHHWLMRVD

SEQ ID NO: 59672 - protein, 9 aa, Homo Sapiens
AQDLSERLG

SEQ ID NO: 59673 - protein, 9 aa, Homo Sapiens
FWQKWAKNA

SEQ ID NO: 59674 - protein, 9 aa, Homo Sapiens
NIAQVDYVE

SEQ ID NO: 59675 - protein, 9 aa, Homo Sapiens
GYALVSHPI

SEQ ID NO: 59676 - protein, 9 aa, Homo Sapiens
IMVGESSIS

SEQ ID NO: 59677 - protein, 9 aa, Homo Sapiens
STLNPTSRS

SEQ ID NO: 59678 - protein, 9 aa, Homo Sapiens
PPAGAYGRV

SEQ ID NO: 59679 - protein, 9 aa, Homo Sapiens
KSSNSRQQG

SEQ ID NO: 59680 - protein, 9 aa, Homo Sapiens
AVFARCVSS

SEQ ID NO: 59681 - protein, 9 aa, Homo Sapiens
LQLETQGTQ

SEQ ID NO: 59682 - protein, 9 aa, Homo Sapiens
RVRWCRPDC

SEQ ID NO: 59683 - protein, 9 aa, Homo Sapiens
ESSISPALP

SEQ ID NO: 59684 - protein, 9 aa, Homo Sapiens
SVTKENRKP

SEQ ID NO: 59685 - protein, 9 aa, Homo Sapiens
RSLLNAVDG

SEQ ID NO: 59686 - protein, 9 aa, Homo Sapiens
EELPAEPLV

SEQ ID NO: 59687 - protein, 9 aa, Homo Sapiens
GVPASHVLS

SEQ ID NO: 59688 - protein, 9 aa, Homo Sapiens
KARSRDSYE

SEQ ID NO: 59689 - protein, 9 aa, Homo Sapiens
TKLSDKSRY

SEQ ID NO: 59690 - protein, 9 aa, Homo Sapiens
VKARSRDSY

SEQ ID NO: 59691 - protein, 9 aa, Homo Sapiens
MHQQQQQQM

SEQ ID NO: 59692 - protein, 9 aa, Homo Sapiens
TAQDLSERL

SEQ ID NO: 59693 - protein, 9 aa, Homo Sapiens
NTALEAHIR

SEQ ID NO: 59694 - protein, 9 aa, Homo Sapiens
TGTAQDLSE

SEQ ID NO: 59695 - protein, 9 aa, Homo Sapiens
CTRLAILVK

SEQ ID NO: 59696 - protein, 9 aa, Homo Sapiens
TKENRKPQS

SEQ ID NO: 59697 - protein, 9 aa, Homo Sapiens
LVSHPIRWY

SEQ ID NO: 59698 - protein, 9 aa, Homo Sapiens
YGGTEEEEE

SEQ ID NO: 59699 - protein, 9 aa, Homo Sapiens
LGVPASHVL

SEQ ID NO: 59700 - protein, 9 aa, Homo Sapiens
VPASHVLSF

SEQ ID NO: 59701 - protein, 9 aa, Homo Sapiens
MLFPAPAAH

SEQ ID NO: 59702 - protein, 9 aa, Homo Sapiens
ADEGYGGTE

SEQ ID NO: 59703 - protein, 9 aa, Homo Sapiens
TRLAILVKG

SEQ ID NO: 59704 - protein, 9 aa, Homo Sapiens
WQATKASQK

SEQ ID NO: 59705 - protein, 9 aa, Homo Sapiens
PYNLANNSQ

SEQ ID NO: 59706 - protein, 9 aa, Homo Sapiens
RHLTRFHLP

SEQ ID NO: 59707 - protein, 9 aa, Homo Sapiens
GESSISPAL

SEQ ID NO: 59708 - protein, 9 aa, Homo Sapiens
AASCLALCH

SEQ ID NO: 59709 - protein, 9 aa, Homo Sapiens
GFDTKKVVR

SEQ ID NO: 59710 - protein, 9 aa, Homo Sapiens
YASTSTKLS

SEQ ID NO: 59711 - protein, 9 aa, Homo Sapiens
VRWCRPDCR

SEQ ID NO: 59712 - protein, 9 aa, Homo Sapiens
TFSIKVVSG

SEQ ID NO: 59713 - protein, 9 aa, Homo Sapiens
LSERLGREA

SEQ ID NO: 59714 - protein, 9 aa, Homo Sapiens
PVKLKELHL

SEQ ID NO: 59715 - protein, 9 aa, Homo Sapiens
MITKREAEH

SEQ ID NO: 59716 - protein, 9 aa, Homo Sapiens
GAYGRVGRR

SEQ ID NO: 59717 - protein, 9 aa, Homo Sapiens
AEEEEEDEL

SEQ ID NO: 59718 - protein, 9 aa, Homo Sapiens
GYGGTEEEE

SEQ ID NO: 59719 - protein, 9 aa, Homo Sapiens
VLSVTKENR

SEQ ID NO: 59720 - protein, 9 aa, Homo Sapiens
SQTGTAQDL

SEQ ID NO: 59721 - protein, 9 aa, Homo Sapiens
LSNMKTVDC

SEQ ID NO: 59722 - protein, 9 aa, Homo Sapiens
SHVLSFGPQ

SEQ ID NO: 59723 - protein, 9 aa, Homo Sapiens
TASGGGEAG

SEQ ID NO: 59724 - protein, 9 aa, Homo Sapiens
HWLMRVDSD

SEQ ID NO: 59725 - protein, 9 aa, Homo Sapiens
RSWSRSDSP

SEQ ID NO: 59726 - protein, 9 aa, Homo Sapiens
VSLVRHKDM

SEQ ID NO: 59727 - protein, 9 aa, Homo Sapiens
KGATLTTML

SEQ ID NO: 59728 - protein, 9 aa, Homo Sapiens
EGYALVSHP

SEQ ID NO: 59729 - protein, 9 aa, Homo Sapiens
DLSERLGRE

SEQ ID NO: 59730 - protein, 9 aa, Homo Sapiens
RSRDSYESG

SEQ ID NO: 59731 - protein, 9 aa, Homo Sapiens
ENRKPQSQK

SEQ ID NO: 59732 - protein, 9 aa, Homo Sapiens
RCVSSLKDE

SEQ ID NO: 59733 - protein, 9 aa, Homo Sapiens
SCLALCHCL

SEQ ID NO: 59734 - protein, 9 aa, Homo Sapiens
LLQLETQGT

SEQ ID NO: 59735 - protein, 9 aa, Homo Sapiens
SRDSYESGD

SEQ ID NO: 59736 - protein, 9 aa, Homo Sapiens
LHLFFLIGN

SEQ ID NO: 59737 - protein, 9 aa, Homo Sapiens
LCTRLAILV

SEQ ID NO: 59738 - protein, 9 aa, Homo Sapiens
GLEMATGAL

SEQ ID NO: 59739 - protein, 9 aa, Homo Sapiens
ANTALEAHI

SEQ ID NO: 59740 - protein, 9 aa, Homo Sapiens
SIKVVSGEF

SEQ ID NO: 59741 - protein, 9 aa, Homo Sapiens
TRVRWCRPD

SEQ ID NO: 59742 - protein, 9 aa, Homo Sapiens
NSRQQGVWV

SEQ ID NO: 59743 - protein, 9 aa, Homo Sapiens
LIGNKQAHK

SEQ ID NO: 59744 - protein, 9 aa, Homo Sapiens
SRHLTRFHL

SEQ ID NO: 59745 - protein, 9 aa, Homo Sapiens
TKASQKERF

SEQ ID NO: 59746 - protein, 9 aa, Homo Sapiens
HKDMRRIRS

SEQ ID NO: 59747 - protein, 9 aa, Homo Sapiens
LMRVDSDSW

SEQ ID NO: 59748 - protein, 9 aa, Homo Sapiens
YESGDKTTR

SEQ ID NO: 59749 - protein, 9 aa, Homo Sapiens
KRTFHHWLM

SEQ ID NO: 59750 - protein, 9 aa, Homo Sapiens
TTGFDTKKV

SEQ ID NO: 59751 - protein, 9 aa, Homo Sapiens
RVYLHLQRT

SEQ ID NO: 59752 - protein, 9 aa, Homo Sapiens
ALCHCLSGQ

SEQ ID NO: 59753 - protein, 9 aa, Homo Sapiens
AEHLCKSFL

SEQ ID NO: 59754 - protein, 9 aa, Homo Sapiens
AILVKGAFR

SEQ ID NO: 59755 - protein, 9 aa, Homo Sapiens
KQINADKQT

SEQ ID NO: 59756 - protein, 9 aa, Homo Sapiens
PAEPLVQSR

SEQ ID NO: 59757 - protein, 9 aa, Homo Sapiens
PLVQSREGV

SEQ ID NO: 59758 - protein, 9 aa, Homo Sapiens
SRQQGVWVF

SEQ ID NO: 59759 - protein, 9 aa, Homo Sapiens
YNLANNSQV

SEQ ID NO: 59760 - protein, 9 aa, Homo Sapiens
GTASGGGEA

SEQ ID NO: 59761 - protein, 9 aa, Homo Sapiens
VKLKELHLS

SEQ ID NO: 59762 - protein, 9 aa, Homo Sapiens
PQSQKQINA

SEQ ID NO: 59763 - protein, 9 aa, Homo Sapiens
GNKQAHKQL

SEQ ID NO: 59764 - protein, 9 aa, Homo Sapiens
SSFNLGTLE

SEQ ID NO: 59765 - protein, 9 aa, Homo Sapiens
FLFCAFVVI

SEQ ID NO: 59766 - protein, 9 aa, Homo Sapiens
KSSFNLGTL

SEQ ID NO: 59767 - protein, 9 aa, Homo Sapiens
SKSQSRSWS

SEQ ID NO: 59768 - protein, 9 aa, Homo Sapiens
EMACHRSSS

SEQ ID NO: 59769 - protein, 9 aa, Homo Sapiens
MWRKYLEWE

SEQ ID NO: 59770 - protein, 9 aa, Homo Sapiens
RQQGVWVFE

SEQ ID NO: 59771 - protein, 9 aa, Homo Sapiens
WQKWAKNAE

SEQ ID NO: 59772 - protein, 9 aa, Homo Sapiens
STRVRWCRP

SEQ ID NO: 59773 - protein, 9 aa, Homo Sapiens
ETQGTQSCY

SEQ ID NO: 59774 - protein, 9 aa, Homo Sapiens
ADKQTKTKG

SEQ ID NO: 59775 - protein, 9 aa, Homo Sapiens
VVINGGIVI

SEQ ID NO: 59776 - protein, 9 aa, Homo Sapiens
EMATGALGG

SEQ ID NO: 59777 - protein, 9 aa, Homo Sapiens
ASQKERFAF

SEQ ID NO: 59778 - protein, 9 aa, Homo Sapiens
RSSSFLPAA

SEQ ID NO: 59779 - protein, 9 aa, Homo Sapiens
ARSRDSYES

SEQ ID NO: 59780 - protein, 9 aa, Homo Sapiens
HLSNMKTVD

SEQ ID NO: 59781 - protein, 9 aa, Homo Sapiens
FLIGNKQAH

SEQ ID NO: 59782 - protein, 9 aa, Homo Sapiens
TQSCYNYLY

SEQ ID NO: 59783 - protein, 9 aa, Homo Sapiens
ACHRSSSFL

SEQ ID NO: 59784 - protein, 9 aa, Homo Sapiens
DMRRIRSLQ

SEQ ID NO: 59785 - protein, 9 aa, Homo Sapiens
WEDSRIGDL

SEQ ID NO: 59786 - protein, 9 aa, Homo Sapiens
AAASCLALC

SEQ ID NO: 59787 - protein, 9 aa, Homo Sapiens
AEPLVQSRE

SEQ ID NO: 59788 - protein, 9 aa, Homo Sapiens
CHRSSSFLP

SEQ ID NO: 59789 - protein, 9 aa, Homo Sapiens
SISSSSSAD

SEQ ID NO: 59790 - protein, 9 aa, Homo Sapiens
EWEDSRIGD

SEQ ID NO: 59791 - protein, 9 aa, Homo Sapiens
WLMRVDSDS

SEQ ID NO: 59792 - protein, 9 aa, Homo Sapiens
GIYKDNIAQ

SEQ ID NO: 59793 - protein, 9 aa, Homo Sapiens
QISYASTST

SEQ ID NO: 59794 - protein, 9 aa, Homo Sapiens
NAELDIDAL

SEQ ID NO: 59795 - protein, 9 aa, Homo Sapiens
VMQTEILSA

SEQ ID NO: 59796 - protein, 9 aa, Homo Sapiens
KASQKERFA

SEQ ID NO: 59797 - protein, 9 aa, Homo Sapiens
FSIKVVSGE

SEQ ID NO: 59798 - protein, 9 aa, Homo Sapiens
ALCTRLAIL

SEQ ID NO: 59799 - protein, 9 aa, Homo Sapiens
VYLHLQRTR

SEQ ID NO: 59800 - protein, 9 aa, Homo Sapiens
NLANNSQVR

SEQ ID NO: 59801 - protein, 9 aa, Homo Sapiens
TGFDTKKVV

SEQ ID NO: 59802 - protein, 9 aa, Homo Sapiens
VITEKGAGI

SEQ ID NO: 59803 - protein, 9 aa, Homo Sapiens
CVSSLKDER

SEQ ID NO: 59804 - protein, 9 aa, Homo Sapiens
HRSSSFLPA

SEQ ID NO: 59805 - protein, 9 aa, Homo Sapiens
KPQSQKQIN

SEQ ID NO: 59806 - protein, 9 aa, Homo Sapiens
RKLKGATLT

SEQ ID NO: 59807 - protein, 9 aa, Homo Sapiens
AYGRVGRRG

SEQ ID NO: 59808 - protein, 9 aa, Homo Sapiens
ITFSIKVVS

SEQ ID NO: 59809 - protein, 9 aa, Homo Sapiens
SWSRSDSPP

SEQ ID NO: 59810 - protein, 9 aa, Homo Sapiens
EHLCKSFLG

SEQ ID NO: 59811 - protein, 9 aa, Homo Sapiens
GEGYALVSH

SEQ ID NO: 59812 - protein, 9 aa, Homo Sapiens
LSVTKENRK

SEQ ID NO: 59813 - protein, 9 aa, Homo Sapiens
FFLIGNKQA

SEQ ID NO: 59814 - protein, 9 aa, Homo Sapiens
KDMRRIRSL

SEQ ID NO: 59815 - protein, 9 aa, Homo Sapiens
KANTALEAH

SEQ ID NO: 59816 - protein, 9 aa, Homo Sapiens
HHWLMRVDS

SEQ ID NO: 59817 - protein, 9 aa, Homo Sapiens
GTQSCYNYL

SEQ ID NO: 59818 - protein, 9 aa, Homo Sapiens
EQGASRLFP

SEQ ID NO: 59819 - protein, 9 aa, Homo Sapiens
LSALRDHEN

SEQ ID NO: 59820 - protein, 9 aa, Homo Sapiens
LQRTRRPKE

SEQ ID NO: 59821 - protein, 9 aa, Homo Sapiens
FTTGFDTKK

SEQ ID NO: 59822 - protein, 9 aa, Homo Sapiens
VEELPAEPL

SEQ ID NO: 59823 - protein, 9 aa, Homo Sapiens
ANNSQVRML

SEQ ID NO: 59824 - protein, 9 aa, Homo Sapiens
HLCKSFLGE

SEQ ID NO: 59825 - protein, 9 aa, Homo Sapiens
ASTSTKLSD

SEQ ID NO: 59826 - protein, 9 aa, Homo Sapiens
QATKASQKE

SEQ ID NO: 59827 - protein, 9 aa, Homo Sapiens
LKRGIYKDN

SEQ ID NO: 59828 - protein, 9 aa, Homo Sapiens
ISYASTSTK

SEQ ID NO: 59829 - protein, 9 aa, Homo Sapiens
ITKREAEHL

SEQ ID NO: 59830 - protein, 9 aa, Homo Sapiens
NLGTLETKS

SEQ ID NO: 59831 - protein, 9 aa, Homo Sapiens
NADKQTKTK

SEQ ID NO: 59832 - protein, 9 aa, Homo Sapiens
KWAKNAELD

SEQ ID NO: 59833 - protein, 9 aa, Homo Sapiens
ALVSHPIRW

SEQ ID NO: 59834 - protein, 9 aa, Homo Sapiens
MRRIRSLQR

SEQ ID NO: 59835 - protein, 9 aa, Homo Sapiens
ASCLALCHC

SEQ ID NO: 59836 - protein, 9 aa, Homo Sapiens
SQVRMLADL

SEQ ID NO: 59837 - protein, 9 aa, Homo Sapiens
NIQAVLSVT

SEQ ID NO: 59838 - protein, 9 aa, Homo Sapiens
GIMVGESSI

SEQ ID NO: 59839 - protein, 9 aa, Homo Sapiens
EAGTASGGG

SEQ ID NO: 59840 - protein, 9 aa, Homo Sapiens
AFVVINGGI

SEQ ID NO: 59841 - protein, 9 aa, Homo Sapiens
MEAITFSIK

SEQ ID NO: 59842 - protein, 9 aa, Homo Sapiens
SLVRHKDMR

SEQ ID NO: 59843 - protein, 9 aa, Homo Sapiens
EKGAGITIY

SEQ ID NO: 59844 - protein, 9 aa, Homo Sapiens
LSLGVPASH

SEQ ID NO: 59845 - protein, 9 aa, Homo Sapiens
DNIAQVDYV

SEQ ID NO: 59846 - protein, 9 aa, Homo Sapiens
ALRDHENLK

SEQ ID NO: 59847 - protein, 9 aa, Homo Sapiens
GAGITIYLN

SEQ ID NO: 59848 - protein, 9 aa, Homo Sapiens
KNPEMACHR

SEQ ID NO: 59849 - protein, 9 aa, Homo Sapiens
KSQSRSWSR

SEQ ID NO: 59850 - protein, 9 aa, Homo Sapiens
LALCHCLSG

SEQ ID NO: 59851 - protein, 9 aa, Homo Sapiens
PGIMVGESS

SEQ ID NO: 59852 - protein, 9 aa, Homo Sapiens
PNIQAVLSV

SEQ ID NO: 59853 - protein, 9 aa, Homo Sapiens
GAVSTRVRW

SEQ ID NO: 59854 - protein, 9 aa, Homo Sapiens
DSYESGDKT

SEQ ID NO: 59855 - protein, 9 aa, Homo Sapiens
TSTKLSDKS

SEQ ID NO: 59856 - protein, 9 aa, Homo Sapiens
YLHLQRTRR

SEQ ID NO: 59857 - protein, 9 aa, Homo Sapiens
TKREAEHLC

SEQ ID NO: 59858 - protein, 9 aa, Homo Sapiens
NPEMACHRS

SEQ ID NO: 59859 - protein, 9 aa, Homo Sapiens
ARRKLKGAT

SEQ ID NO: 59860 - protein, 9 aa, Homo Sapiens
KLKELHLSN

SEQ ID NO: 59861 - protein, 9 aa, Homo Sapiens
FVVINGGIV

SEQ ID NO: 59862 - protein, 9 aa, Homo Sapiens
RFLFTTGFD

SEQ ID NO: 59863 - protein, 9 aa, Homo Sapiens
KENRKPQSQ

SEQ ID NO: 59864 - protein, 9 aa, Homo Sapiens
MQTEILSAL

SEQ ID NO: 59865 - protein, 9 aa, Homo Sapiens
NFWQKWAKN

SEQ ID NO: 59866 - protein, 9 aa, Homo Sapiens
LCEQEERLH

SEQ ID NO: 59867 - protein, 9 aa, Homo Sapiens
LFCAFVVIN

SEQ ID NO: 59868 - protein, 9 aa, Homo Sapiens
YLEWEDSRI

SEQ ID NO: 59869 - protein, 9 aa, Homo Sapiens
AGAYGRVGR

SEQ ID NO: 59870 - protein, 9 aa, Homo Sapiens
VTKENRKPQ

SEQ ID NO: 59871 - protein, 9 aa, Homo Sapiens
FKANTALEA

SEQ ID NO: 59872 - protein, 9 aa, Homo Sapiens
PSTLNPTSR

SEQ ID NO: 59873 - protein, 9 aa, Homo Sapiens
WSRSDSPPR

SEQ ID NO: 59874 - protein, 9 aa, Homo Sapiens
KELHLSNMK

SEQ ID NO: 59875 - protein, 9 aa, Homo Sapiens
DTKKVVRGS

SEQ ID NO: 59876 - protein, 9 aa, Homo Sapiens
ISSSSSADD

SEQ ID NO: 59877 - protein, 9 aa, Homo Sapiens
RALFKANTA

SEQ ID NO: 59878 - protein, 9 aa, Homo Sapiens
FLFTTGFDT

SEQ ID NO: 59879 - protein, 9 aa, Homo Sapiens
FCRALFKAN

SEQ ID NO: 59880 - protein, 9 aa, Homo Sapiens
KEKVHEGAR

SEQ ID NO: 59881 - protein, 9 aa, Homo Sapiens
LDQMSKNIT

SEQ ID NO: 59882 - protein, 9 aa, Homo Sapiens
SEFYDGDHD

SEQ ID NO: 59883 - protein, 9 aa, Homo Sapiens
GEKLDPQAR

SEQ ID NO: 59884 - protein, 9 aa, Homo Sapiens
SQGLKLPLW

SEQ ID NO: 59885 - protein, 9 aa, Homo Sapiens
KCQGDASGL

SEQ ID NO: 59886 - protein, 9 aa, Homo Sapiens
KKTNDLRYI

SEQ ID NO: 59887 - protein, 9 aa, Homo Sapiens
CQGDASGLC

SEQ ID NO: 59888 - protein, 9 aa, Homo Sapiens
WSATPTEGV

SEQ ID NO: 59889 - protein, 9 aa, Homo Sapiens
FINPGEILR

SEQ ID NO: 59890 - protein, 9 aa, Homo Sapiens
EVSPLLLEL

SEQ ID NO: 59891 - protein, 9 aa, Homo Sapiens
SSPYTLGEE

SEQ ID NO: 59892 - protein, 9 aa, Homo Sapiens
VLHELCKHL

SEQ ID NO: 59893 - protein, 9 aa, Homo Sapiens
SRYFSEADK

SEQ ID NO: 59894 - protein, 9 aa, Homo Sapiens
NYSRPEAPS

SEQ ID NO: 59895 - protein, 9 aa, Homo Sapiens
RKCQGDASG

SEQ ID NO: 59896 - protein, 9 aa, Homo Sapiens
PPKMSPTFI

SEQ ID NO: 59897 - protein, 9 aa, Homo Sapiens
PDSQRGRMA

SEQ ID NO: 59898 - protein, 9 aa, Homo Sapiens
YPPKMSPTF

SEQ ID NO: 59899 - protein, 9 aa, Homo Sapiens
EAKTASQSS

SEQ ID NO: 59900 - protein, 9 aa, Homo Sapiens
QLQQLWKKL

SEQ ID NO: 59901 - protein, 9 aa, Homo Sapiens
GIIKLIIRR

SEQ ID NO: 59902 - protein, 9 aa, Homo Sapiens
SSWSSGMDF

SEQ ID NO: 59903 - protein, 9 aa, Homo Sapiens
QSRYFSEAD

SEQ ID NO: 59904 - protein, 9 aa, Homo Sapiens
ASSPYTLGE

SEQ ID NO: 59905 - protein, 9 aa, Homo Sapiens
VYRLLQSII

SEQ ID NO: 59906 - protein, 9 aa, Homo Sapiens
LAYLPVNVI

SEQ ID NO: 59907 - protein, 9 aa, Homo Sapiens
LLLLAFQLV

SEQ ID NO: 59908 - protein, 9 aa, Homo Sapiens
KRSSRHHRD

SEQ ID NO: 59909 - protein, 9 aa, Homo Sapiens
HQVVTIMNP

SEQ ID NO: 59910 - protein, 9 aa, Homo Sapiens
CVDGFTTFR

SEQ ID NO: 59911 - protein, 9 aa, Homo Sapiens
GDARRLKEN

SEQ ID NO: 59912 - protein, 9 aa, Homo Sapiens
REKMARLRN

SEQ ID NO: 59913 - protein, 9 aa, Homo Sapiens
PHITASYVA

SEQ ID NO: 59914 - protein, 9 aa, Homo Sapiens
QVFLSAMQW

SEQ ID NO: 59915 - protein, 9 aa, Homo Sapiens
AWAGQLQQL

SEQ ID NO: 59916 - protein, 9 aa, Homo Sapiens
PNSCPEDEP

SEQ ID NO: 59917 - protein, 9 aa, Homo Sapiens
LLAFQLVGQ

SEQ ID NO: 59918 - protein, 9 aa, Homo Sapiens
DSQRGRMAE

SEQ ID NO: 59919 - protein, 9 aa, Homo Sapiens
PQVLDQMSK

SEQ ID NO: 59920 - protein, 9 aa, Homo Sapiens
VVWDMNPGF

SEQ ID NO: 59921 - protein, 9 aa, Homo Sapiens
ACCDVIGGK

SEQ ID NO: 59922 - protein, 9 aa, Homo Sapiens
HTSDAKLTA

SEQ ID NO: 59923 - protein, 9 aa, Homo Sapiens
ILNHSGAYV

SEQ ID NO: 59924 - protein, 9 aa, Homo Sapiens
NFEHICHMT

SEQ ID NO: 59925 - protein, 9 aa, Homo Sapiens
KLFFKKKLT

SEQ ID NO: 59926 - protein, 9 aa, Homo Sapiens
SPNSCPEDE

SEQ ID NO: 59927 - protein, 9 aa, Homo Sapiens
PTLLLSDST

SEQ ID NO: 59928 - protein, 9 aa, Homo Sapiens
VNTCHHPLN

SEQ ID NO: 59929 - protein, 9 aa, Homo Sapiens
LAKACCDVI

SEQ ID NO: 59930 - protein, 9 aa, Homo Sapiens
EAPSEFYDG

SEQ ID NO: 59931 - protein, 9 aa, Homo Sapiens
KEAAPTPVP

SEQ ID NO: 59932 - protein, 9 aa, Homo Sapiens
AEVRHMIAH

SEQ ID NO: 59933 - protein, 9 aa, Homo Sapiens
GKSILCSKQ

SEQ ID NO: 59934 - protein, 9 aa, Homo Sapiens
TCVDGFTTF

SEQ ID NO: 59935 - protein, 9 aa, Homo Sapiens
KVPEITHTV

SEQ ID NO: 59936 - protein, 9 aa, Homo Sapiens
SILCSKQVP

SEQ ID NO: 59937 - protein, 9 aa, Homo Sapiens
VVTIMNPNT

SEQ ID NO: 59938 - protein, 9 aa, Homo Sapiens
MDFCALIHK

SEQ ID NO: 59939 - protein, 9 aa, Homo Sapiens
ASSQPKEAA

SEQ ID NO: 59940 - protein, 9 aa, Homo Sapiens
LNECAAQLP

SEQ ID NO: 59941 - protein, 9 aa, Homo Sapiens
DSPGERFDE

SEQ ID NO: 59942 - protein, 9 aa, Homo Sapiens
KLAEQRPRW

SEQ ID NO: 59943 - protein, 9 aa, Homo Sapiens
PWDSVLRMQ

SEQ ID NO: 59944 - protein, 9 aa, Homo Sapiens
ATCVDGFTT

SEQ ID NO: 59945 - protein, 9 aa, Homo Sapiens
QRDKEIVVD

SEQ ID NO: 59946 - protein, 9 aa, Homo Sapiens
QPDLLHQVV

SEQ ID NO: 59947 - protein, 9 aa, Homo Sapiens
LTLQLDPVI

SEQ ID NO: 59948 - protein, 9 aa, Homo Sapiens
EKEKVHEGA

SEQ ID NO: 59949 - protein, 9 aa, Homo Sapiens
MQKLAEQRP

SEQ ID NO: 59950 - protein, 9 aa, Homo Sapiens
KACCDVIGG

SEQ ID NO: 59951 - protein, 9 aa, Homo Sapiens
QKKTNDLRY

SEQ ID NO: 59952 - protein, 9 aa, Homo Sapiens
GEKVPEITH

SEQ ID NO: 59953 - protein, 9 aa, Homo Sapiens
GKVHYLEDF

SEQ ID NO: 59954 - protein, 9 aa, Homo Sapiens
NRFKVAVVW

SEQ ID NO: 59955 - protein, 9 aa, Homo Sapiens
EVDPQLGLQ

SEQ ID NO: 59956 - protein, 9 aa, Homo Sapiens
LKLPLWRNS

SEQ ID NO: 59957 - protein, 9 aa, Homo Sapiens
VILNHSGAY

SEQ ID NO: 59958 - protein, 9 aa, Homo Sapiens
DPVILNHSG

SEQ ID NO: 59959 - protein, 9 aa, Homo Sapiens
GCNKAGYCE

SEQ ID NO: 59960 - protein, 9 aa, Homo Sapiens
KYILNGTPN

SEQ ID NO: 59961 - protein, 9 aa, Homo Sapiens
DKEKQQKLF

SEQ ID NO: 59962 - protein, 9 aa, Homo Sapiens
FVCGVVYRL

SEQ ID NO: 59963 - protein, 9 aa, Homo Sapiens
PTSISGSPK

SEQ ID NO: 59964 - protein, 9 aa, Homo Sapiens
SVGNQHCNY

SEQ ID NO: 59965 - protein, 9 aa, Homo Sapiens
TEGVCAPGK

SEQ ID NO: 59966 - protein, 9 aa, Homo Sapiens
DVQRDKEIV

SEQ ID NO: 59967 - protein, 9 aa, Homo Sapiens
ALWAHLLSS

SEQ ID NO: 59968 - protein, 9 aa, Homo Sapiens
GRGTDGRLD

SEQ ID NO: 59969 - protein, 9 aa, Homo Sapiens
SPINFEHIC

SEQ ID NO: 59970 - protein, 9 aa, Homo Sapiens
HCNYRSLLF

SEQ ID NO: 59971 - protein, 9 aa, Homo Sapiens
RKNQFNDYT

SEQ ID NO: 59972 - protein, 9 aa, Homo Sapiens
TGKVHYLED

SEQ ID NO: 59973 - protein, 9 aa, Homo Sapiens
TASQSSPET

SEQ ID NO: 59974 - protein, 9 aa, Homo Sapiens
ICHMTVNSA

SEQ ID NO: 59975 - protein, 9 aa, Homo Sapiens
KDRETPLPN

SEQ ID NO: 59976 - protein, 9 aa, Homo Sapiens
EKLDPQARS

SEQ ID NO: 59977 - protein, 9 aa, Homo Sapiens
PQARSSATT

SEQ ID NO: 59978 - protein, 9 aa, Homo Sapiens
LSAMQWILK

SEQ ID NO: 59979 - protein, 9 aa, Homo Sapiens
PKEAAPTPV

SEQ ID NO: 59980 - protein, 9 aa, Homo Sapiens
HMIAHGMIH

SEQ ID NO: 59981 - protein, 9 aa, Homo Sapiens
KVHEGARPM

SEQ ID NO: 59982 - protein, 9 aa, Homo Sapiens
WSSGMDFCA

SEQ ID NO: 59983 - protein, 9 aa, Homo Sapiens
QHPYMSPNS

SEQ ID NO: 59984 - protein, 9 aa, Homo Sapiens
VCGVVYRLL

SEQ ID NO: 59985 - protein, 9 aa, Homo Sapiens
SGMDFCALI

SEQ ID NO: 59986 - protein, 9 aa, Homo Sapiens
GFTTFRCLC

SEQ ID NO: 59987 - protein, 9 aa, Homo Sapiens
LCKHLDSSA

SEQ ID NO: 59988 - protein, 9 aa, Homo Sapiens
AFLYPPKMS

SEQ ID NO: 59989 - protein, 9 aa, Homo Sapiens
LLSDSTLVD

SEQ ID NO: 59990 - protein, 9 aa, Homo Sapiens
MDRKNQFND

SEQ ID NO: 59991 - protein, 9 aa, Homo Sapiens
AHLLSSLRG

SEQ ID NO: 59992 - protein, 9 aa, Homo Sapiens
FQLVGQTRA

SEQ ID NO: 59993 - protein, 9 aa, Homo Sapiens
SQPDLLHQV

SEQ ID NO: 59994 - protein, 9 aa, Homo Sapiens
NQHCNYRSL

SEQ ID NO: 59995 - protein, 9 aa, Homo Sapiens
PEITHTVSG

SEQ ID NO: 59996 - protein, 9 aa, Homo Sapiens
RHMIAHGMI

SEQ ID NO: 59997 - protein, 9 aa, Homo Sapiens
VAVVWDMNP

SEQ ID NO: 59998 - protein, 9 aa, Homo Sapiens
KVAVVWDMN

SEQ ID NO: 59999 - protein, 9 aa, Homo Sapiens
DFCALIHKF

SEQ ID NO: 60000 - protein, 9 aa, Homo Sapiens
SGDARRLKE

SEQ ID NO: 60001 - protein, 9 aa, Homo Sapiens
TQAIRNFPK

SEQ ID NO: 60002 - protein, 9 aa, Homo Sapiens
QDPQVLDQM

SEQ ID NO: 60003 - protein, 9 aa, Homo Sapiens
NNYMMDRKN

SEQ ID NO: 60004 - protein, 9 aa, Homo Sapiens
SRPEAPSEF

SEQ ID NO: 60005 - protein, 9 aa, Homo Sapiens
DSWTGKVHY

SEQ ID NO: 60006 - protein, 9 aa, Homo Sapiens
SSQSRYFSE

SEQ ID NO: 60007 - protein, 9 aa, Homo Sapiens
YQVFLSAMQ

SEQ ID NO: 60008 - protein, 9 aa, Homo Sapiens
FPKSLESWL

SEQ ID NO: 60009 - protein, 9 aa, Homo Sapiens
NVIPSQAFR

SEQ ID NO: 60010 - protein, 9 aa, Homo Sapiens
LQRAERPLR

SEQ ID NO: 60011 - protein, 9 aa, Homo Sapiens
EVLHELCKH

SEQ ID NO: 60012 - protein, 9 aa, Homo Sapiens
VLAFDQEHL

SEQ ID NO: 60013 - protein, 9 aa, Homo Sapiens
QHTSDAKLT

SEQ ID NO: 60014 - protein, 9 aa, Homo Sapiens
NMLLGGVRT

SEQ ID NO: 60015 - protein, 9 aa, Homo Sapiens
AGYCEYSED

SEQ ID NO: 60016 - protein, 9 aa, Homo Sapiens
HYLEDFYVT

SEQ ID NO: 60017 - protein, 9 aa, Homo Sapiens
LQSKDRETP

SEQ ID NO: 60018 - protein, 9 aa, Homo Sapiens
LLHIKEVDP

SEQ ID NO: 60019 - protein, 9 aa, Homo Sapiens
LSQPTSISG

SEQ ID NO: 60020 - protein, 9 aa, Homo Sapiens
MDKHLSSQS

SEQ ID NO: 60021 - protein, 9 aa, Homo Sapiens
WTGKVHYLE

SEQ ID NO: 60022 - protein, 9 aa, Homo Sapiens
NTCHHPLNP

SEQ ID NO: 60023 - protein, 9 aa, Homo Sapiens
SPFPLWQPA

SEQ ID NO: 60024 - protein, 9 aa, Homo Sapiens
EPLLNSPDA

SEQ ID NO: 60025 - protein, 9 aa, Homo Sapiens
SPDALLSSF

SEQ ID NO: 60026 - protein, 9 aa, Homo Sapiens
DEYQVFLSA

SEQ ID NO: 60027 - protein, 9 aa, Homo Sapiens
LAFDQEHLE

SEQ ID NO: 60028 - protein, 9 aa, Homo Sapiens
QAIRNFPKS

SEQ ID NO: 60029 - protein, 9 aa, Homo Sapiens
PGERFDEPI

SEQ ID NO: 60030 - protein, 9 aa, Homo Sapiens
SKRSSRHHR

SEQ ID NO: 60031 - protein, 9 aa, Homo Sapiens
EKMARLRNM

SEQ ID NO: 60032 - protein, 9 aa, Homo Sapiens
YRLLQSIIS

SEQ ID NO: 60033 - protein, 9 aa, Homo Sapiens
PRVRAMAIY

SEQ ID NO: 60034 - protein, 9 aa, Homo Sapiens
PGPRVRAMA

SEQ ID NO: 60035 - protein, 9 aa, Homo Sapiens
GQLQQLWKK

SEQ ID NO: 60036 - protein, 9 aa, Homo Sapiens
MPDSQRGRM

SEQ ID NO: 60037 - protein, 9 aa, Homo Sapiens
VNVIPSQAF

SEQ ID NO: 60038 - protein, 9 aa, Homo Sapiens
LWAHLLSSL

SEQ ID NO: 60039 - protein, 9 aa, Homo Sapiens
QQKLFFKKK

SEQ ID NO: 60040 - protein, 9 aa, Homo Sapiens
HTSLQSKDR

SEQ ID NO: 60041 - protein, 9 aa, Homo Sapiens
THTVSGNTV

SEQ ID NO: 60042 - protein, 9 aa, Homo Sapiens
CNKAGYCEY

SEQ ID NO: 60043 - protein, 9 aa, Homo Sapiens
LHELCKHLD

SEQ ID NO: 60044 - protein, 9 aa, Homo Sapiens
LPASSPYTL

SEQ ID NO: 60045 - protein, 9 aa, Homo Sapiens
EDEYQVFLS

SEQ ID NO: 60046 - protein, 9 aa, Homo Sapiens
GERFDEPIF

SEQ ID NO: 60047 - protein, 9 aa, Homo Sapiens
VVYRLLQSI

SEQ ID NO: 60048 - protein, 9 aa, Homo Sapiens
RFDEPIFIT

SEQ ID NO: 60049 - protein, 9 aa, Homo Sapiens
LNSPDALLS

SEQ ID NO: 60050 - protein, 9 aa, Homo Sapiens
HHPLNPALC

SEQ ID NO: 60051 - protein, 9 aa, Homo Sapiens
QRPRWDNDD

SEQ ID NO: 60052 - protein, 9 aa, Homo Sapiens
GLKLPLWRN

SEQ ID NO: 60053 - protein, 9 aa, Homo Sapiens
PLREDRSRK

SEQ ID NO: 60054 - protein, 9 aa, Homo Sapiens
ADLLHIKEV

SEQ ID NO: 60055 - protein, 9 aa, Homo Sapiens
SSGTTSTTG

SEQ ID NO: 60056 - protein, 9 aa, Homo Sapiens
LCNEEKLII

SEQ ID NO: 60057 - protein, 9 aa, Homo Sapiens
YGIKYILNG

SEQ ID NO: 60058 - protein, 9 aa, Homo Sapiens
STLVDKIQD

SEQ ID NO: 60059 - protein, 9 aa, Homo Sapiens
EKVHEGARP

SEQ ID NO: 60060 - protein, 9 aa, Homo Sapiens
EKVPEITHT

SEQ ID NO: 60061 - protein, 9 aa, Homo Sapiens
MIAHGMIHL

SEQ ID NO: 60062 - protein, 9 aa, Homo Sapiens
LQHHVLPIQ

SEQ ID NO: 60063 - protein, 9 aa, Homo Sapiens
LCSKQVPAQ

SEQ ID NO: 60064 - protein, 9 aa, Homo Sapiens
NFPKSLESW

SEQ ID NO: 60065 - protein, 9 aa, Homo Sapiens
GMDFCALIH

SEQ ID NO: 60066 - protein, 9 aa, Homo Sapiens
WDSVLRMQK

SEQ ID NO: 60067 - protein, 9 aa, Homo Sapiens
TTFRCLCLP

SEQ ID NO: 60068 - protein, 9 aa, Homo Sapiens
RVVSPFPLW

SEQ ID NO: 60069 - protein, 9 aa, Homo Sapiens
ARCQSSPSP

SEQ ID NO: 60070 - protein, 9 aa, Homo Sapiens
SWSSGMDFC

SEQ ID NO: 60071 - protein, 9 aa, Homo Sapiens
PYTLGEENM

SEQ ID NO: 60072 - protein, 9 aa, Homo Sapiens
VGNQHCNYR

SEQ ID NO: 60073 - protein, 9 aa, Homo Sapiens
VLDQMSKNI

SEQ ID NO: 60074 - protein, 9 aa, Homo Sapiens
AEQRPRWDN

SEQ ID NO: 60075 - protein, 9 aa, Homo Sapiens
TTGRGTDGR

SEQ ID NO: 60076 - protein, 9 aa, Homo Sapiens
CTAPQDVQR

SEQ ID NO: 60077 - protein, 9 aa, Homo Sapiens
LMLQRAERP

SEQ ID NO: 60078 - protein, 9 aa, Homo Sapiens
LLEDLQKKT

SEQ ID NO: 60079 - protein, 9 aa, Homo Sapiens
LQHPYMSPN

SEQ ID NO: 60080 - protein, 9 aa, Homo Sapiens
WAHLLSSLR

SEQ ID NO: 60081 - protein, 9 aa, Homo Sapiens
ERPLREDRS

SEQ ID NO: 60082 - protein, 9 aa, Homo Sapiens
IAHGMIHLC

SEQ ID NO: 60083 - protein, 9 aa, Homo Sapiens
INPGEILRG

SEQ ID NO: 60084 - protein, 9 aa, Homo Sapiens
NECAAQLPR

SEQ ID NO: 60085 - protein, 9 aa, Homo Sapiens
PFPLWQPAG

SEQ ID NO: 60086 - protein, 9 aa, Homo Sapiens
YVPHITASY

SEQ ID NO: 60087 - protein, 9 aa, Homo Sapiens
GEILRGFRF

SEQ ID NO: 60088 - protein, 9 aa, Homo Sapiens
AFQLVGQTR

SEQ ID NO: 60089 - protein, 9 aa, Homo Sapiens
QLVGQTRAN

SEQ ID NO: 60090 - protein, 9 aa, Homo Sapiens
TQEVSPLLL

SEQ ID NO: 60091 - protein, 9 aa, Homo Sapiens
EHKCLCNEE

SEQ ID NO: 60092 - protein, 9 aa, Homo Sapiens
SEAKTASQS

SEQ ID NO: 60093 - protein, 9 aa, Homo Sapiens
CNEEKLIIQ

SEQ ID NO: 60094 - protein, 9 aa, Homo Sapiens
KCLCNEEKL

SEQ ID NO: 60095 - protein, 9 aa, Homo Sapiens
KTNDLRYIE

SEQ ID NO: 60096 - protein, 9 aa, Homo Sapiens
GTPNLPNAF

SEQ ID NO: 60097 - protein, 9 aa, Homo Sapiens
VYLPASSPY

SEQ ID NO: 60098 - protein, 9 aa, Homo Sapiens
LSDSTLVDK

SEQ ID NO: 60099 - protein, 9 aa, Homo Sapiens
LDPQARSSA

SEQ ID NO: 60100 - protein, 9 aa, Homo Sapiens
YLPVNVIPS

SEQ ID NO: 60101 - protein, 9 aa, Homo Sapiens
GTTSTTGRG

SEQ ID NO: 60102 - protein, 9 aa, Homo Sapiens
KQQKLFFKK

SEQ ID NO: 60103 - protein, 9 aa, Homo Sapiens
LYPPKMSPT

SEQ ID NO: 60104 - protein, 9 aa, Homo Sapiens
CSKQVPAQD

SEQ ID NO: 60105 - protein, 9 aa, Homo Sapiens
EKQQKLFFK

SEQ ID NO: 60106 - protein, 9 aa, Homo Sapiens
QGDASGLCH

SEQ ID NO: 60107 - protein, 9 aa, Homo Sapiens
PYMSPNSCP

SEQ ID NO: 60108 - protein, 9 aa, Homo Sapiens
RLLQSIISY

SEQ ID NO: 60109 - protein, 9 aa, Homo Sapiens
KRSGDARRL

SEQ ID NO: 60110 - protein, 9 aa, Homo Sapiens
PKQAAQGLH

SEQ ID NO: 60111 - protein, 9 aa, Homo Sapiens
EDLQKKTND

SEQ ID NO: 60112 - protein, 9 aa, Homo Sapiens
VWDMNPGFQ

SEQ ID NO: 60113 - protein, 9 aa, Homo Sapiens
KMARLRNML

SEQ ID NO: 60114 - protein, 9 aa, Homo Sapiens
FGQGPGIIK

SEQ ID NO: 60115 - protein, 9 aa, Homo Sapiens
NPGEILRGF

SEQ ID NO: 60116 - protein, 9 aa, Homo Sapiens
KSILCSKQV

SEQ ID NO: 60117 - protein, 9 aa, Homo Sapiens
HIKEVDPQL

SEQ ID NO: 60118 - protein, 9 aa, Homo Sapiens
ENSKNFGRG

SEQ ID NO: 60119 - protein, 9 aa, Homo Sapiens
LPKQAAQGL

SEQ ID NO: 60120 - protein, 9 aa, Homo Sapiens
AFDQEHLER

SEQ ID NO: 60121 - protein, 9 aa, Homo Sapiens
GYCEYSEDV

SEQ ID NO: 60122 - protein, 9 aa, Homo Sapiens
NFGRGNIKD

SEQ ID NO: 60123 - protein, 9 aa, Homo Sapiens
ILCSKQVPA

SEQ ID NO: 60124 - protein, 9 aa, Homo Sapiens
SSSWSSGMD

SEQ ID NO: 60125 - protein, 9 aa, Homo Sapiens
TPPRTQEVS

SEQ ID NO: 60126 - protein, 9 aa, Homo Sapiens
QPKEAAPTP

SEQ ID NO: 60127 - protein, 9 aa, Homo Sapiens
AHGMIHLCI

SEQ ID NO: 60128 - protein, 9 aa, Homo Sapiens
SPRVYVPHI

SEQ ID NO: 60129 - protein, 9 aa, Homo Sapiens
QEHLERKIL

SEQ ID NO: 60130 - protein, 9 aa, Homo Sapiens
HICHMTVNS

SEQ ID NO: 60131 - protein, 9 aa, Homo Sapiens
QRSKRSSRH

SEQ ID NO: 60132 - protein, 9 aa, Homo Sapiens
NSCPEDEPT

SEQ ID NO: 60133 - protein, 9 aa, Homo Sapiens
SWTGKVHYL

SEQ ID NO: 60134 - protein, 9 aa, Homo Sapiens
HNETKPWDS

SEQ ID NO: 60135 - protein, 9 aa, Homo Sapiens
RSGDARRLK

SEQ ID NO: 60136 - protein, 9 aa, Homo Sapiens
AKRSGDARR

SEQ ID NO: 60137 - protein, 9 aa, Homo Sapiens
AIRNFPKSL

SEQ ID NO: 60138 - protein, 9 aa, Homo Sapiens
EGVCAPGKP

SEQ ID NO: 60139 - protein, 9 aa, Homo Sapiens
AFVCGVVYR

SEQ ID NO: 60140 - protein, 9 aa, Homo Sapiens
HLSSQSRYF

SEQ ID NO: 60141 - protein, 9 aa, Homo Sapiens
VDSTPPPGP

SEQ ID NO: 60142 - protein, 9 aa, Homo Sapiens
IGGKNELSF

SEQ ID NO: 60143 - protein, 9 aa, Homo Sapiens
SKQVPAQDL

SEQ ID NO: 60144 - protein, 9 aa, Homo Sapiens
LQKKTNDLR

SEQ ID NO: 60145 - protein, 9 aa, Homo Sapiens
LLLSDSTLV

SEQ ID NO: 60146 - protein, 9 aa, Homo Sapiens
SMGITPFFC

SEQ ID NO: 60147 - protein, 9 aa, Homo Sapiens
QGPGIIKLI

SEQ ID NO: 60148 - protein, 9 aa, Homo Sapiens
RWNNYMMDR

SEQ ID NO: 60149 - protein, 9 aa, Homo Sapiens
RNMLLGGVR

SEQ ID NO: 60150 - protein, 9 aa, Homo Sapiens
HELCKHLDS

SEQ ID NO: 60151 - protein, 9 aa, Homo Sapiens
SSPETQPML

SEQ ID NO: 60152 - protein, 9 aa, Homo Sapiens
HLLSSLRGY

SEQ ID NO: 60153 - protein, 9 aa, Homo Sapiens
NSKNFGRGN

SEQ ID NO: 60154 - protein, 9 aa, Homo Sapiens
QDVQRDKEI

SEQ ID NO: 60155 - protein, 9 aa, Homo Sapiens
AKTASQSSP

SEQ ID NO: 60156 - protein, 9 aa, Homo Sapiens
QLQRSKRSS

SEQ ID NO: 60157 - protein, 9 aa, Homo Sapiens
VKQHTSDAK

SEQ ID NO: 60158 - protein, 9 aa, Homo Sapiens
HTVSGNTVE

SEQ ID NO: 60159 - protein, 9 aa, Homo Sapiens
LVKQHTSDA

SEQ ID NO: 60160 - protein, 9 aa, Homo Sapiens
QLDPVILNH

SEQ ID NO: 60161 - protein, 9 aa, Homo Sapiens
YCEYSEDVH

SEQ ID NO: 60162 - protein, 9 aa, Homo Sapiens
TCHHPLNPA

SEQ ID NO: 60163 - protein, 9 aa, Homo Sapiens
SQSRYFSEA

SEQ ID NO: 60164 - protein, 9 aa, Homo Sapiens
HPDVHILQH

SEQ ID NO: 60165 - protein, 9 aa, Homo Sapiens
FDSPGERFD

SEQ ID NO: 60166 - protein, 9 aa, Homo Sapiens
RNFPKSLES

SEQ ID NO: 60167 - protein, 9 aa, Homo Sapiens
EHICHMTVN

SEQ ID NO: 60168 - protein, 9 aa, Homo Sapiens
PKSLESWLT

SEQ ID NO: 60169 - protein, 9 aa, Homo Sapiens
ILRGFRFHC

SEQ ID NO: 60170 - protein, 9 aa, Homo Sapiens
REVLHELCK

SEQ ID NO: 60171 - protein, 9 aa, Homo Sapiens
DRKNQFNDY

SEQ ID NO: 60172 - protein, 9 aa, Homo Sapiens
SATPTEGVC

SEQ ID NO: 60173 - protein, 9 aa, Homo Sapiens
TGRGTDGRL

SEQ ID NO: 60174 - protein, 9 aa, Homo Sapiens
WACLNECAA

SEQ ID NO: 60175 - protein, 9 aa, Homo Sapiens
KVHYLEDFY

SEQ ID NO: 60176 - protein, 9 aa, Homo Sapiens
SFINPGEIL

SEQ ID NO: 60177 - protein, 9 aa, Homo Sapiens
RPEAPSEFY

SEQ ID NO: 60178 - protein, 9 aa, Homo Sapiens
VRHMIAHGM

SEQ ID NO: 60179 - protein, 9 aa, Homo Sapiens
SDSTLVDKI

SEQ ID NO: 60180 - protein, 9 aa, Homo Sapiens
VPEITHTVS

SEQ ID NO: 60181 - protein, 9 aa, Homo Sapiens
QSSPETQPM

SEQ ID NO: 60182 - protein, 9 aa, Homo Sapiens
EILRGFRFH

SEQ ID NO: 60183 - protein, 9 aa, Homo Sapiens
RSSRHHRDK

SEQ ID NO: 60184 - protein, 9 aa, Homo Sapiens
GPRVRAMAI

SEQ ID NO: 60185 - protein, 9 aa, Homo Sapiens
GATCVDGFT

SEQ ID NO: 60186 - protein, 9 aa, Homo Sapiens
YSVGNQHCN

SEQ ID NO: 60187 - protein, 9 aa, Homo Sapiens
ITPFFCGKC

SEQ ID NO: 60188 - protein, 9 aa, Homo Sapiens
LFFKKKLTS

SEQ ID NO: 60189 - protein, 9 aa, Homo Sapiens
GLCHTHGWN

SEQ ID NO: 60190 - protein, 9 aa, Homo Sapiens
TTSTTGRGT

SEQ ID NO: 60191 - protein, 9 aa, Homo Sapiens
QQLQRSKRS

SEQ ID NO: 60192 - protein, 9 aa, Homo Sapiens
TSTTGRGTD

SEQ ID NO: 60193 - protein, 9 aa, Homo Sapiens
RPLREDRSR

SEQ ID NO: 60194 - protein, 9 aa, Homo Sapiens
QVLDQMSKN

SEQ ID NO: 60195 - protein, 9 aa, Homo Sapiens
QDVNTCHHP

SEQ ID NO: 60196 - protein, 9 aa, Homo Sapiens
SSQPKEAAP

SEQ ID NO: 60197 - protein, 9 aa, Homo Sapiens
RDKEIVVDT

SEQ ID NO: 60198 - protein, 9 aa, Homo Sapiens
DLLHIKEVD

SEQ ID NO: 60199 - protein, 9 aa, Homo Sapiens
CKHLDSSAA

SEQ ID NO: 60200 - protein, 9 aa, Homo Sapiens
MSKNITRMG

SEQ ID NO: 60201 - protein, 9 aa, Homo Sapiens
ERFDEPIFI

SEQ ID NO: 60202 - protein, 9 aa, Homo Sapiens
TSLQSKDRE

SEQ ID NO: 60203 - protein, 9 aa, Homo Sapiens
TCQSQGLKL

SEQ ID NO: 60204 - protein, 9 aa, Homo Sapiens
PPGPRVRAM

SEQ ID NO: 60205 - protein, 9 aa, Homo Sapiens
CDVIGGKNE

SEQ ID NO: 60206 - protein, 9 aa, Homo Sapiens
AERPLREDR

SEQ ID NO: 60207 - protein, 9 aa, Homo Sapiens
IHTSLQSKD

SEQ ID NO: 60208 - protein, 9 aa, Homo Sapiens
MSPNSCPED

SEQ ID NO: 60209 - protein, 9 aa, Homo Sapiens
TLLLSDSTL

SEQ ID NO: 60210 - protein, 9 aa, Homo Sapiens
AYLPVNVIP

SEQ ID NO: 60211 - protein, 9 aa, Homo Sapiens
LQLDPVILN

SEQ ID NO: 60212 - protein, 9 aa, Homo Sapiens
QARSSATTL

SEQ ID NO: 60213 - protein, 9 aa, Homo Sapiens
SSGMDFCAL

SEQ ID NO: 60214 - protein, 9 aa, Homo Sapiens
WQPAGEPSQ

SEQ ID NO: 60215 - protein, 9 aa, Homo Sapiens
GGAFLYPPK

SEQ ID NO: 60216 - protein, 9 aa, Homo Sapiens
AKACCDVIG

SEQ ID NO: 60217 - protein, 9 aa, Homo Sapiens
VYVPHITAS

SEQ ID NO: 60218 - protein, 9 aa, Homo Sapiens
IKYILNGTP

SEQ ID NO: 60219 - protein, 9 aa, Homo Sapiens
PRTQEVSPL

SEQ ID NO: 60220 - protein, 9 aa, Homo Sapiens
GFGQGPGII

SEQ ID NO: 60221 - protein, 9 aa, Homo Sapiens
SLQSKDRET

SEQ ID NO: 60222 - protein, 9 aa, Homo Sapiens
QKLAEQRPR

SEQ ID NO: 60223 - protein, 9 aa, Homo Sapiens
LFDSPGERF

SEQ ID NO: 60224 - protein, 9 aa, Homo Sapiens
EVLPKQAAQ

SEQ ID NO: 60225 - protein, 9 aa, Homo Sapiens
KNFGRGNIK

SEQ ID NO: 60226 - protein, 9 aa, Homo Sapiens
CQSQGLKLP

SEQ ID NO: 60227 - protein, 9 aa, Homo Sapiens
NSPDALLSS

SEQ ID NO: 60228 - protein, 9 aa, Homo Sapiens
EQRPRWDND

SEQ ID NO: 60229 - protein, 9 aa, Homo Sapiens
DQEHLERKI

SEQ ID NO: 60230 - protein, 9 aa, Homo Sapiens
TPFFCGKCQ

SEQ ID NO: 60231 - protein, 9 aa, Homo Sapiens
PRWDNDDMT

SEQ ID NO: 60232 - protein, 9 aa, Homo Sapiens
DVNTCHHPL

SEQ ID NO: 60233 - protein, 9 aa, Homo Sapiens
LLNSPDALL

SEQ ID NO: 60234 - protein, 9 aa, Homo Sapiens
KPWDSVLRM

SEQ ID NO: 60235 - protein, 9 aa, Homo Sapiens
LSLAYLPVN

SEQ ID NO: 60236 - protein, 9 aa, Homo Sapiens
ALSQPTSIS

SEQ ID NO: 60237 - protein, 9 aa, Homo Sapiens
QSQGLKLPL

SEQ ID NO: 60238 - protein, 9 aa, Homo Sapiens
LLSSLRGYL

SEQ ID NO: 60239 - protein, 9 aa, Homo Sapiens
SLVKQHTSD

SEQ ID NO: 60240 - protein, 9 aa, Homo Sapiens
KHLSSQSRY

SEQ ID NO: 60241 - protein, 9 aa, Homo Sapiens
MAEEHKCLC

SEQ ID NO: 60242 - protein, 9 aa, Homo Sapiens
VLPKQAAQG

SEQ ID NO: 60243 - protein, 9 aa, Homo Sapiens
KQHTSDAKL

SEQ ID NO: 60244 - protein, 9 aa, Homo Sapiens
DGFTTFRCL

SEQ ID NO: 60245 - protein, 9 aa, Homo Sapiens
ACLNECAAQ

SEQ ID NO: 60246 - protein, 9 aa, Homo Sapiens
DQMSKNITR

SEQ ID NO: 60247 - protein, 9 aa, Homo Sapiens
LTQAIRNFP

SEQ ID NO: 60248 - protein, 9 aa, Homo Sapiens
RAERPLRED

SEQ ID NO: 60249 - protein, 9 aa, Homo Sapiens
ETARCQSSP

SEQ ID NO: 60250 - protein, 9 aa, Homo Sapiens
LVGQTRANP

SEQ ID NO: 60251 - protein, 9 aa, Homo Sapiens
PPRTQEVSP

SEQ ID NO: 60252 - protein, 9 aa, Homo Sapiens
HITASYVAS

SEQ ID NO: 60253 - protein, 9 aa, Homo Sapiens
QAAQGLHDP

SEQ ID NO: 60254 - protein, 9 aa, Homo Sapiens
EYQVFLSAM

SEQ ID NO: 60255 - protein, 9 aa, Homo Sapiens
PGIIKLIIR

SEQ ID NO: 60256 - protein, 9 aa, Homo Sapiens
AAKRSGDAR

SEQ ID NO: 60257 - protein, 9 aa, Homo Sapiens
DLLHQVVTI

SEQ ID NO: 60258 - protein, 9 aa, Homo Sapiens
AEEHKCLCN

SEQ ID NO: 60259 - protein, 9 aa, Homo Sapiens
NLFDSPGER

SEQ ID NO: 60260 - protein, 9 aa, Homo Sapiens
LWQPAGEPS

SEQ ID NO: 60261 - protein, 9 aa, Homo Sapiens
RLRNMLLGG

SEQ ID NO: 60262 - protein, 9 aa, Homo Sapiens
ILNGTPNLP

SEQ ID NO: 60263 - protein, 9 aa, Homo Sapiens
TNDLRYIEM

SEQ ID NO: 60264 - protein, 9 aa, Homo Sapiens
WGHPDVHIL

SEQ ID NO: 60265 - protein, 9 aa, Homo Sapiens
LAFQLVGQT

SEQ ID NO: 60266 - protein, 9 aa, Homo Sapiens
FPLWQPAGE

SEQ ID NO: 60267 - protein, 9 aa, Homo Sapiens
GPGIIKLII

SEQ ID NO: 60268 - protein, 9 aa, Homo Sapiens
PRVYVPHIT

SEQ ID NO: 60269 - protein, 9 aa, Homo Sapiens
LQRSKRSSR

SEQ ID NO: 60270 - protein, 9 aa, Homo Sapiens
GAFLYPPKM

SEQ ID NO: 60271 - protein, 9 aa, Homo Sapiens
LHIKEVDPQ

SEQ ID NO: 60272 - protein, 9 aa, Homo Sapiens
QRGRMAEEL

SEQ ID NO: 60273 - protein, 9 aa, Homo Sapiens
PTEGVCAPG

SEQ ID NO: 60274 - protein, 9 aa, Homo Sapiens
QKLFFKKKL

SEQ ID NO: 60275 - protein, 9 aa, Homo Sapiens
PKMSPTFIN

SEQ ID NO: 60276 - protein, 9 aa, Homo Sapiens
EITHTVSGN

SEQ ID NO: 60277 - protein, 9 aa, Homo Sapiens
VFLSAMQWI

SEQ ID NO: 60278 - protein, 9 aa, Homo Sapiens
SGSPKFQPP

SEQ ID NO: 60279 - protein, 9 aa, Homo Sapiens
TPPPGPRVR

SEQ ID NO: 60280 - protein, 9 aa, Homo Sapiens
ELCKHLDSS

SEQ ID NO: 60281 - protein, 9 aa, Homo Sapiens
ECAAQLPRN

SEQ ID NO: 60282 - protein, 9 aa, Homo Sapiens
MGITPFFCG

SEQ ID NO: 60283 - protein, 9 aa, Homo Sapiens
LREVLHELC

SEQ ID NO: 60284 - protein, 9 aa, Homo Sapiens
EEHKCLCNE

SEQ ID NO: 60285 - protein, 9 aa, Homo Sapiens
ARLRNMLLG

SEQ ID NO: 60286 - protein, 9 aa, Homo Sapiens
GVVYRLLQS

SEQ ID NO: 60287 - protein, 9 aa, Homo Sapiens
NYMMDRKNQ

SEQ ID NO: 60288 - protein, 9 aa, Homo Sapiens
LLLAFQLVG

SEQ ID NO: 60289 - protein, 9 aa, Homo Sapiens
RFKVAVVWD

SEQ ID NO: 60290 - protein, 9 aa, Homo Sapiens
RVYVPHITA

SEQ ID NO: 60291 - protein, 9 aa, Homo Sapiens
SPGERFDEP

SEQ ID NO: 60292 - protein, 9 aa, Homo Sapiens
TSISGSPKF

SEQ ID NO: 60293 - protein, 9 aa, Homo Sapiens
SQRGRMAEE

SEQ ID NO: 60294 - protein, 9 aa, Homo Sapiens
DGEKLDPQA

SEQ ID NO: 60295 - protein, 9 aa, Homo Sapiens
AAQGLHDPS

SEQ ID NO: 60296 - protein, 9 aa, Homo Sapiens
NETKPWDSV

SEQ ID NO: 60297 - protein, 9 aa, Homo Sapiens
EVRHMIAHG

SEQ ID NO: 60298 - protein, 9 aa, Homo Sapiens
QYSVGNQHC

SEQ ID NO: 60299 - protein, 9 aa, Homo Sapiens
STTGRGTDG

SEQ ID NO: 60300 - protein, 9 aa, Homo Sapiens
YMMDRKNQF

SEQ ID NO: 60301 - protein, 9 aa, Homo Sapiens
HGMIHLCIY

SEQ ID NO: 60302 - protein, 9 aa, Homo Sapiens
CHMTVNSAE

SEQ ID NO: 60303 - protein, 9 aa, Homo Sapiens
VQRDKEIVV

SEQ ID NO: 60304 - protein, 9 aa, Homo Sapiens
FQDVNTCHH

SEQ ID NO: 60305 - protein, 9 aa, Homo Sapiens
EHLERKILA

SEQ ID NO: 60306 - protein, 9 aa, Homo Sapiens
QHCNYRSLL

SEQ ID NO: 60307 - protein, 9 aa, Homo Sapiens
YTLGEENMD

SEQ ID NO: 60308 - protein, 9 aa, Homo Sapiens
MARLRNMLL

SEQ ID NO: 60309 - protein, 9 aa, Homo Sapiens
RSKRSSRHH

SEQ ID NO: 60310 - protein, 9 aa, Homo Sapiens
LRAWAGQLQ

SEQ ID NO: 60311 - protein, 9 aa, Homo Sapiens
CQSSPSPTN

SEQ ID NO: 60312 - protein, 9 aa, Homo Sapiens
QVVTIMNPN

SEQ ID NO: 60313 - protein, 9 aa, Homo Sapiens
DALLSSFSH

SEQ ID NO: 60314 - protein, 9 aa, Homo Sapiens
EIVAEKEKV

SEQ ID NO: 60315 - protein, 9 aa, Homo Sapiens
HWACLNECA

SEQ ID NO: 60316 - protein, 9 aa, Homo Sapiens
PASSPYTLG

SEQ ID NO: 60317 - protein, 9 aa, Homo Sapiens
NMAAKRSGD

SEQ ID NO: 60318 - protein, 9 aa, Homo Sapiens
SKNFGRGNI

SEQ ID NO: 60319 - protein, 9 aa, Homo Sapiens
QPTSISGSP

SEQ ID NO: 60320 - protein, 9 aa, Homo Sapiens
DLQKKTNDL

SEQ ID NO: 60321 - protein, 9 aa, Homo Sapiens
LSSQSRYFS

SEQ ID NO: 60322 - protein, 9 aa, Homo Sapiens
PDALLSSFS

SEQ ID NO: 60323 - protein, 9 aa, Homo Sapiens
EPASSQPKE

SEQ ID NO: 60324 - protein, 9 aa, Homo Sapiens
TSDAKLTAQ

SEQ ID NO: 60325 - protein, 9 aa, Homo Sapiens
PINFEHICH

SEQ ID NO: 60326 - protein, 9 aa, Homo Sapiens
GQGPGIIKL

SEQ ID NO: 60327 - protein, 9 aa, Homo Sapiens
SQSSPETQP

SEQ ID NO: 60328 - protein, 9 aa, Homo Sapiens
VSPFPLWQP

SEQ ID NO: 60329 - protein, 9 aa, Homo Sapiens
LRGFRFHCQ

SEQ ID NO: 60330 - protein, 9 aa, Homo Sapiens
YDKEKQQKL

SEQ ID NO: 60331 - protein, 9 aa, Homo Sapiens
DPQARSSAT

SEQ ID NO: 60332 - protein, 9 aa, Homo Sapiens
KAGYCEYSE

SEQ ID NO: 60333 - protein, 9 aa, Homo Sapiens
HLERKILAL

SEQ ID NO: 60334 - protein, 9 aa, Homo Sapiens
AGQLQQLWK

SEQ ID NO: 60335 - protein, 9 aa, Homo Sapiens
FDQEHLERK

SEQ ID NO: 60336 - protein, 9 aa, Homo Sapiens
PLWQPAGEP

SEQ ID NO: 60337 - protein, 9 aa, Homo Sapiens
YDSWTGKVH

SEQ ID NO: 60338 - protein, 9 aa, Homo Sapiens
TSLVKQHTS

SEQ ID NO: 60339 - protein, 9 aa, Homo Sapiens
NGTPNLPNA

SEQ ID NO: 60340 - protein, 9 aa, Homo Sapiens
SPYTLGEEN

SEQ ID NO: 60341 - protein, 9 aa, Homo Sapiens
CLCNEEKLI

SEQ ID NO: 60342 - protein, 9 aa, Homo Sapiens
SGTTSTTGR

SEQ ID NO: 60343 - protein, 9 aa, Homo Sapiens
SISGSPKFQ

SEQ ID NO: 60344 - protein, 9 aa, Homo Sapiens
TLQLDPVIL

SEQ ID NO: 60345 - protein, 9 aa, Homo Sapiens
DRETPLPNL

SEQ ID NO: 60346 - protein, 9 aa, Homo Sapiens
VDGFTTFRC

SEQ ID NO: 60347 - protein, 9 aa, Homo Sapiens
KTASQSSPE

SEQ ID NO: 60348 - protein, 9 aa, Homo Sapiens
TPTEGVCAP

SEQ ID NO: 60349 - protein, 9 aa, Homo Sapiens
QQLWKKLGK

SEQ ID NO: 60350 - protein, 9 aa, Homo Sapiens
FLSAMQWIL

SEQ ID NO: 60351 - protein, 9 aa, Homo Sapiens
QMSKNITRM

SEQ ID NO: 60352 - protein, 9 aa, Homo Sapiens
IRNFPKSLE

SEQ ID NO: 60353 - protein, 9 aa, Homo Sapiens
RCQSSPSPT

SEQ ID NO: 60354 - protein, 9 aa, Homo Sapiens
TAPQDVQRD

SEQ ID NO: 60355 - protein, 9 aa, Homo Sapiens
RAWAGQLQQ

SEQ ID NO: 60356 - protein, 9 aa, Homo Sapiens
LPVNVIPSQ

SEQ ID NO: 60357 - protein, 9 aa, Homo Sapiens
ALLSSFSHP

SEQ ID NO: 60358 - protein, 9 aa, Homo Sapiens
KLDPQARSS

SEQ ID NO: 60359 - protein, 9 aa, Homo Sapiens
YSRPEAPSE

SEQ ID NO: 60360 - protein, 9 aa, Homo Sapiens
LDPVILNHS

SEQ ID NO: 60361 - protein, 9 aa, Homo Sapiens
TKPWDSVLR

SEQ ID NO: 60362 - protein, 9 aa, Homo Sapiens
RGNIKDKNS

SEQ ID NO: 60363 - protein, 9 aa, Homo Sapiens
DPQVLDQMS

SEQ ID NO: 60364 - protein, 9 aa, Homo Sapiens
RPRWDNDDM

SEQ ID NO: 60365 - protein, 9 aa, Homo Sapiens
SAMQWILKD

SEQ ID NO: 60366 - protein, 9 aa, Homo Sapiens
PEAPSEFYD

SEQ ID NO: 60367 - protein, 9 aa, Homo Sapiens
SPLLLELQK

SEQ ID NO: 60368 - protein, 9 aa, Homo Sapiens
VPHITASYV

SEQ ID NO: 60369 - protein, 9 aa, Homo Sapiens
MENSKNFGR

SEQ ID NO: 60370 - protein, 9 aa, Homo Sapiens
DSTPPPGPR

SEQ ID NO: 60371 - protein, 9 aa, Homo Sapiens
HPLNPALCI

SEQ ID NO: 60372 - protein, 9 aa, Homo Sapiens
DVIGGKNEL

SEQ ID NO: 60373 - protein, 9 aa, Homo Sapiens
KLPLWRNSS

SEQ ID NO: 60374 - protein, 9 aa, Homo Sapiens
CNYRSLLFP

SEQ ID NO: 60375 - protein, 9 aa, Homo Sapiens
PLLNSPDAL

SEQ ID NO: 60376 - protein, 9 aa, Homo Sapiens
SLAYLPVNV

SEQ ID NO: 60377 - protein, 9 aa, Homo Sapiens
DASGLCHTH

SEQ ID NO: 60378 - protein, 9 aa, Homo Sapiens
WNNYMMDRK

SEQ ID NO: 60379 - protein, 9 aa, Homo Sapiens
DSTLVDKIQ

SEQ ID NO: 60380 - protein, 9 aa, Homo Sapiens
VHYLEDFYV

SEQ ID NO: 60381 - protein, 9 aa, Homo Sapiens
GIKYILNGT

SEQ ID NO: 60382 - protein, 9 aa, Homo Sapiens
VHILQHHVL

SEQ ID NO: 60383 - protein, 9 aa, Homo Sapiens
KEVDPQLGL

SEQ ID NO: 60384 - protein, 9 aa, Homo Sapiens
ASGLCHTHG

SEQ ID NO: 60385 - protein, 9 aa, Homo Sapiens
MAEELILRE

SEQ ID NO: 60386 - protein, 9 aa, Homo Sapiens
FKVAVVWDM

SEQ ID NO: 60387 - protein, 9 aa, Homo Sapiens
ITSLVKQHT

SEQ ID NO: 60388 - protein, 9 aa, Homo Sapiens
STPPPGPRV

SEQ ID NO: 60389 - protein, 9 aa, Homo Sapiens
VIGGKNELS

SEQ ID NO: 60390 - protein, 9 aa, Homo Sapiens
MLQRAERPL

SEQ ID NO: 60391 - protein, 9 aa, Homo Sapiens
RTQEVSPLL

SEQ ID NO: 60392 - protein, 9 aa, Homo Sapiens
DVHILQHHV

SEQ ID NO: 60393 - protein, 9 aa, Homo Sapiens
ILQHHVLPI

SEQ ID NO: 60394 - protein, 9 aa, Homo Sapiens
LAEQRPRWD

SEQ ID NO: 60395 - protein, 9 aa, Homo Sapiens
KGFGQGPGI

SEQ ID NO: 60396 - protein, 9 aa, Homo Sapiens
GITPFFCGK

SEQ ID NO: 60397 - protein, 9 aa, Homo Sapiens
YILNGTPNL

SEQ ID NO: 60398 - protein, 9 aa, Homo Sapiens
PDLLHQVVT

SEQ ID NO: 60399 - protein, 9 aa, Homo Sapiens
PPPGPRVRA

SEQ ID NO: 60400 - protein, 9 aa, Homo Sapiens
GVCAPGKPT

SEQ ID NO: 60401 - protein, 9 aa, Homo Sapiens
VHEGARPMR

SEQ ID NO: 60402 - protein, 9 aa, Homo Sapiens
RKALWAHLL

SEQ ID NO: 60403 - protein, 9 aa, Homo Sapiens
CGVVYRLLQ

SEQ ID NO: 60404 - protein, 9 aa, Homo Sapiens
MAAKRSGDA

SEQ ID NO: 60405 - protein, 9 aa, Homo Sapiens
CCDVIGGKN

SEQ ID NO: 60406 - protein, 9 aa, Homo Sapiens
GRGNIKDKN

SEQ ID NO: 60407 - protein, 9 aa, Homo Sapiens
ARSSATTLR

SEQ ID NO: 60408 - protein, 9 aa, Homo Sapiens
RQQLQRSKR

SEQ ID NO: 60409 - protein, 9 aa, Homo Sapiens
CHHPLNPAL

SEQ ID NO: 60410 - protein, 9 aa, Homo Sapiens
LHNETKPWD

SEQ ID NO: 60411 - protein, 9 aa, Homo Sapiens
FEHICHMTV

SEQ ID NO: 60412 - protein, 9 aa, Homo Sapiens
SKDRETPLP

SEQ ID NO: 60413 - protein, 9 aa, Homo Sapiens
FLHNETKPW

SEQ ID NO: 60414 - protein, 9 aa, Homo Sapiens
IIKLIIRRD

SEQ ID NO: 60415 - protein, 9 aa, Homo Sapiens
LPLWRNSSF

SEQ ID NO: 60416 - protein, 9 aa, Homo Sapiens
FTTFRCLCL

SEQ ID NO: 60417 - protein, 9 aa, Homo Sapiens
MMDRKNQFN

SEQ ID NO: 60418 - protein, 9 aa, Homo Sapiens
PVNVIPSQA

SEQ ID NO: 60419 - protein, 9 aa, Homo Sapiens
SQPKEAAPT

SEQ ID NO: 60420 - protein, 9 aa, Homo Sapiens
QSSPSPTNS

SEQ ID NO: 60421 - protein, 9 aa, Homo Sapiens
QSKDRETPL

SEQ ID NO: 60422 - protein, 9 aa, Homo Sapiens
KADLLHIKE

SEQ ID NO: 60423 - protein, 9 aa, Homo Sapiens
GHPDVHILQ

SEQ ID NO: 60424 - protein, 9 aa, Homo Sapiens
SVLAFDQEH

SEQ ID NO: 60425 - protein, 9 aa, Homo Sapiens
SGLCHTHGW

SEQ ID NO: 60426 - protein, 9 aa, Homo Sapiens
PDVHILQHH

SEQ ID NO: 60427 - protein, 9 aa, Homo Sapiens
SQPTSISGS

SEQ ID NO: 60428 - protein, 9 aa, Homo Sapiens
WDMNPGFQP

SEQ ID NO: 60429 - protein, 9 aa, Homo Sapiens
HPYMSPNSC

SEQ ID NO: 60430 - protein, 9 aa, Homo Sapiens
KALWAHLLS

SEQ ID NO: 60431 - protein, 9 aa, Homo Sapiens
VAEKEKVHE

SEQ ID NO: 60432 - protein, 9 aa, Homo Sapiens
IKEVDPQLG

SEQ ID NO: 60433 - protein, 9 aa, Homo Sapiens
LLHQVVTIM

SEQ ID NO: 60434 - protein, 9 aa, Homo Sapiens
KMSPTFINM

SEQ ID NO: 60435 - protein, 9 aa, Homo Sapiens
YLPASSPYT

SEQ ID NO: 60436 - protein, 9 aa, Homo Sapiens
AVVWDMNPG

SEQ ID NO: 60437 - protein, 9 aa, Homo Sapiens
QRAERPLRE

SEQ ID NO: 60438 - protein, 9 aa, Homo Sapiens
KEKQQKLFF

SEQ ID NO: 60439 - protein, 9 aa, Homo Sapiens
FGRGNIKDK

SEQ ID NO: 60440 - protein, 9 aa, Homo Sapiens
APQDVQRDK

SEQ ID NO: 60441 - protein, 9 aa, Homo Sapiens
LRNMLLGGV

SEQ ID NO: 60442 - protein, 9 aa, Homo Sapiens
ISGSPKFQP

SEQ ID NO: 60443 - protein, 9 aa, Homo Sapiens
KQVPAQDLR

SEQ ID NO: 60444 - protein, 9 aa, Homo Sapiens
ETKPWDSVL

SEQ ID NO: 60445 - protein, 9 aa, Homo Sapiens
ITHTVSGNT

SEQ ID NO: 60446 - protein, 9 aa, Homo Sapiens
RGRMAEELI

SEQ ID NO: 60447 - protein, 9 aa, Homo Sapiens
PVILNHSGA

SEQ ID NO: 60448 - protein, 9 aa, Homo Sapiens
HILQHHVLP

SEQ ID NO: 60449 - protein, 9 aa, Homo Sapiens
LNGTPNLPN

SEQ ID NO: 60450 - protein, 9 aa, Homo Sapiens
RGCNKAGYC

SEQ ID NO: 60451 - protein, 9 aa, Homo Sapiens
ATPTEGVCA

SEQ ID NO: 60452 - protein, 9 aa, Homo Sapiens
QEVSPLLLE

SEQ ID NO: 60453 - protein, 9 aa, Homo Sapiens
KQAAQGLHD

SEQ ID NO: 60454 - protein, 9 aa, Homo Sapiens
GNQHCNYRS

SEQ ID NO: 60455 - protein, 9 aa, Homo Sapiens
GDASGLCHT

SEQ ID NO: 60456 - protein, 9 aa, Homo Sapiens
APSEFYDGD

SEQ ID NO: 60457 - protein, 9 aa, Homo Sapiens
FHWACLNEC

SEQ ID NO: 60458 - protein, 9 aa, Homo Sapiens
VSPLLLELQ

SEQ ID NO: 60459 - protein, 9 aa, Homo Sapiens
LHQVVTIMN

SEQ ID NO: 60460 - protein, 9 aa, Homo Sapiens
FLYPPKMSP

SEQ ID NO: 60461 - protein, 9 aa, Homo Sapiens
RMAEELILR

SEQ ID NO: 60462 - protein, 9 aa, Homo Sapiens
LEDLQKKTN

SEQ ID NO: 60463 - protein, 9 aa, Homo Sapiens
QVPAQDLRK

SEQ ID NO: 60464 - protein, 9 aa, Homo Sapiens
PSEFYDGDH

SEQ ID NO: 60465 - protein, 9 aa, Homo Sapiens
TARCQSSPS

SEQ ID NO: 60466 - protein, 9 aa, Homo Sapiens
CAAQLPRNT

SEQ ID NO: 60467 - protein, 9 aa, Homo Sapiens
WAGQLQQLW

SEQ ID NO: 60468 - protein, 9 aa, Homo Sapiens
IVAEKEKVH

SEQ ID NO: 60469 - protein, 9 aa, Homo Sapiens
KSNFGSEPV

SEQ ID NO: 60470 - protein, 9 aa, Homo Sapiens
VVSPFPLWQ

SEQ ID NO: 60471 - protein, 9 aa, Homo Sapiens
LSSLRGYLK

SEQ ID NO: 60472 - protein, 9 aa, Homo Sapiens
INFEHICHM

SEQ ID NO: 60473 - protein, 9 aa, Homo Sapiens
NKAGYCEYS

SEQ ID NO: 60474 - protein, 9 aa, Homo Sapiens
EPTLLLSDS

SEQ ID NO: 60475 - protein, 9 aa, Homo Sapiens
AEKEKVHEG

SEQ ID NO: 60476 - protein, 9 aa, Homo Sapiens
NNMAAKRSG

SEQ ID NO: 60477 - protein, 9 aa, Homo Sapiens
MSPRVYVPH

SEQ ID NO: 60478 - protein, 9 aa, Homo Sapiens
PQDVQRDKE

SEQ ID NO: 60479 - protein, 9 aa, Homo Sapiens
YMSPNSCPE

SEQ ID NO: 60480 - protein, 9 aa, Homo Sapiens
PASSQPKEA

SEQ ID NO: 60481 - protein, 9 aa, Homo Sapiens
CEYSEDVHL

SEQ ID NO: 60482 - protein, 9 aa, Homo Sapiens
ASQSSPETQ

SEQ ID NO: 60483 - protein, 9 aa, Homo Sapiens
DKHLSSQSR

SEQ ID NO: 60484 - protein, 9 aa, Homo Sapiens
LQQLWKKLG

SEQ ID NO: 60485 - protein, 9 aa, Homo Sapiens
HKCLCNEEK

SEQ ID NO: 60486 - protein, 9 aa, Homo Sapiens
GRMAEELIL

SEQ ID NO: 60487 - protein, 9 aa, Homo Sapiens
QGLKLPLWR

SEQ ID NO: 60488 - protein, 9 aa, Homo Sapiens
VCAPGKPTL

SEQ ID NO: 60489 - protein, 9 aa, Homo Sapiens
VEPASSQPK

SEQ ID NO: 60490 - protein, 9 aa, Homo Sapiens
VGQTRANPM

SEQ ID NO: 60491 - protein, 9 aa, Homo Sapiens
CLNECAAQL

SEQ ID NO: 60492 - protein, 9 aa, Homo Sapiens
PGEILRGFR

SEQ ID NO: 60493 - protein, 9 aa, Homo Sapiens
EGWLHKRGK

SEQ ID NO: 60494 - protein, 9 aa, Homo Sapiens
ECHRRRAAS

SEQ ID NO: 60495 - protein, 9 aa, Homo Sapiens
QGVEVNKNN

SEQ ID NO: 60496 - protein, 9 aa, Homo Sapiens
IWLLILSYV

SEQ ID NO: 60497 - protein, 9 aa, Homo Sapiens
LAVQGAGRV

SEQ ID NO: 60498 - protein, 9 aa, Homo Sapiens
SAKPGYNDI

SEQ ID NO: 60499 - protein, 9 aa, Homo Sapiens
KRKGDDWSQ

SEQ ID NO: 60500 - protein, 9 aa, Homo Sapiens
LSGHLRIYT

SEQ ID NO: 60501 - protein, 9 aa, Homo Sapiens
FALPKKEQE

SEQ ID NO: 60502 - protein, 9 aa, Homo Sapiens
ILFFHYFSV

SEQ ID NO: 60503 - protein, 9 aa, Homo Sapiens
RRPPGMEYC

SEQ ID NO: 60504 - protein, 9 aa, Homo Sapiens
IISVLGCCW

SEQ ID NO: 60505 - protein, 9 aa, Homo Sapiens
VNAGGQKIK

SEQ ID NO: 60506 - protein, 9 aa, Homo Sapiens
SSCMGGINR

SEQ ID NO: 60507 - protein, 9 aa, Homo Sapiens
STSDTSKEE

SEQ ID NO: 60508 - protein, 9 aa, Homo Sapiens
LKKEANVNA

SEQ ID NO: 60509 - protein, 9 aa, Homo Sapiens
GARQAKLTV

SEQ ID NO: 60510 - protein, 9 aa, Homo Sapiens
RSPPVTHSR

SEQ ID NO: 60511 - protein, 9 aa, Homo Sapiens
IYTGEKPFE

SEQ ID NO: 60512 - protein, 9 aa, Homo Sapiens
WKVVTVGDF

SEQ ID NO: 60513 - protein, 9 aa, Homo Sapiens
KVVTVGDFI

SEQ ID NO: 60514 - protein, 9 aa, Homo Sapiens
SPHRGHTLQ

SEQ ID NO: 60515 - protein, 9 aa, Homo Sapiens
DSTFAEQVE

SEQ ID NO: 60516 - protein, 9 aa, Homo Sapiens
EYCYDINRV

SEQ ID NO: 60517 - protein, 9 aa, Homo Sapiens
LFGWIISVL

SEQ ID NO: 60518 - protein, 9 aa, Homo Sapiens
PQSGRIQGM

SEQ ID NO: 60519 - protein, 9 aa, Homo Sapiens
KEQELCVSG

SEQ ID NO: 60520 - protein, 9 aa, Homo Sapiens
LPAANGEGP

SEQ ID NO: 60521 - protein, 9 aa, Homo Sapiens
YNDIITIPT

SEQ ID NO: 60522 - protein, 9 aa, Homo Sapiens
EDEGFYVNT

SEQ ID NO: 60523 - protein, 9 aa, Homo Sapiens
FFPGGTRQR

SEQ ID NO: 60524 - protein, 9 aa, Homo Sapiens
NPSLVIISG

SEQ ID NO: 60525 - protein, 9 aa, Homo Sapiens
FHGNKTTNQ

SEQ ID NO: 60526 - protein, 9 aa, Homo Sapiens
YEGFYQSQS

SEQ ID NO: 60527 - protein, 9 aa, Homo Sapiens
DIKLAVQGA

SEQ ID NO: 60528 - protein, 9 aa, Homo Sapiens
IAVKKEIMY

SEQ ID NO: 60529 - protein, 9 aa, Homo Sapiens
DVTWQGVEV

SEQ ID NO: 60530 - protein, 9 aa, Homo Sapiens
KKRRIDLHT

SEQ ID NO: 60531 - protein, 9 aa, Homo Sapiens
KEEGQDRVQ

SEQ ID NO: 60532 - protein, 9 aa, Homo Sapiens
GHLRIYTGE

SEQ ID NO: 60533 - protein, 9 aa, Homo Sapiens
SPPVTHSRS

SEQ ID NO: 60534 - protein, 9 aa, Homo Sapiens
DKEPFVLPP

SEQ ID NO: 60535 - protein, 9 aa, Homo Sapiens
LGARQAKLT

SEQ ID NO: 60536 - protein, 9 aa, Homo Sapiens
YCYDINRVP

SEQ ID NO: 60537 - protein, 9 aa, Homo Sapiens
KRRIDLHTN

SEQ ID NO: 60538 - protein, 9 aa, Homo Sapiens
VHIAVLSEC

SEQ ID NO: 60539 - protein, 9 aa, Homo Sapiens
QAGSYEGFY

SEQ ID NO: 60540 - protein, 9 aa, Homo Sapiens
PSNYVIDRW

SEQ ID NO: 60541 - protein, 9 aa, Homo Sapiens
KTVTVEFFP

SEQ ID NO: 60542 - protein, 9 aa, Homo Sapiens
QLCQAKTEL

SEQ ID NO: 60543 - protein, 9 aa, Homo Sapiens
GSYEGFYQS

SEQ ID NO: 60544 - protein, 9 aa, Homo Sapiens
RQRAGGGVH

SEQ ID NO: 60545 - protein, 9 aa, Homo Sapiens
VVTVGDFIR

SEQ ID NO: 60546 - protein, 9 aa, Homo Sapiens
GIQPLDSIS

SEQ ID NO: 60547 - protein, 9 aa, Homo Sapiens
NDIITIPTG

SEQ ID NO: 60548 - protein, 9 aa, Homo Sapiens
NYVIDRWLG

SEQ ID NO: 60549 - protein, 9 aa, Homo Sapiens
KITTPSRAE

SEQ ID NO: 60550 - protein, 9 aa, Homo Sapiens
PGAPLQPVL

SEQ ID NO: 60551 - protein, 9 aa, Homo Sapiens
VLQGDHTFD

SEQ ID NO: 60552 - protein, 9 aa, Homo Sapiens
QINVDKEPF

SEQ ID NO: 60553 - protein, 9 aa, Homo Sapiens
FSSSGGQQS

SEQ ID NO: 60554 - protein, 9 aa, Homo Sapiens
VNQKQTVIA

SEQ ID NO: 60555 - protein, 9 aa, Homo Sapiens
LMFSVAPSL

SEQ ID NO: 60556 - protein, 9 aa, Homo Sapiens
PIKPGLLTA

SEQ ID NO: 60557 - protein, 9 aa, Homo Sapiens
CEEHSKHLV

SEQ ID NO: 60558 - protein, 9 aa, Homo Sapiens
TSAKPGYND

SEQ ID NO: 60559 - protein, 9 aa, Homo Sapiens
VCYEDEGFY

SEQ ID NO: 60560 - protein, 9 aa, Homo Sapiens
SQLCQAKTE

SEQ ID NO: 60561 - protein, 9 aa, Homo Sapiens
AIIFDQSFG

SEQ ID NO: 60562 - protein, 9 aa, Homo Sapiens
TFFEPGFGD

SEQ ID NO: 60563 - protein, 9 aa, Homo Sapiens
KGDDWSQLN

SEQ ID NO: 60564 - protein, 9 aa, Homo Sapiens
DLPSNYVID

SEQ ID NO: 60565 - protein, 9 aa, Homo Sapiens
SSFSSSGGQ

SEQ ID NO: 60566 - protein, 9 aa, Homo Sapiens
MEYCYDINR

SEQ ID NO: 60567 - protein, 9 aa, Homo Sapiens
LAEKAKCCN

SEQ ID NO: 60568 - protein, 9 aa, Homo Sapiens
EFFPGGTRQ

SEQ ID NO: 60569 - protein, 9 aa, Homo Sapiens
KEANVNAID

SEQ ID NO: 60570 - protein, 9 aa, Homo Sapiens
LKLAGWQCP

SEQ ID NO: 60571 - protein, 9 aa, Homo Sapiens
AVLQGDHTF

SEQ ID NO: 60572 - protein, 9 aa, Homo Sapiens
EQVEDLMFN

SEQ ID NO: 60573 - protein, 9 aa, Homo Sapiens
PVVCSYFAQ

SEQ ID NO: 60574 - protein, 9 aa, Homo Sapiens
STLPAANGE

SEQ ID NO: 60575 - protein, 9 aa, Homo Sapiens
VVCSYFAQD

SEQ ID NO: 60576 - protein, 9 aa, Homo Sapiens
LTKDSPPIK

SEQ ID NO: 60577 - protein, 9 aa, Homo Sapiens
IIFDQSFGT

SEQ ID NO: 60578 - protein, 9 aa, Homo Sapiens
SQRKMNTLF

SEQ ID NO: 60579 - protein, 9 aa, Homo Sapiens
HGNKTTNQN

SEQ ID NO: 60580 - protein, 9 aa, Homo Sapiens
PKKEQELCV

SEQ ID NO: 60581 - protein, 9 aa, Homo Sapiens
PLQPVLMFS

SEQ ID NO: 60582 - protein, 9 aa, Homo Sapiens
RIYTGEKPF

SEQ ID NO: 60583 - protein, 9 aa, Homo Sapiens
WLHKRGKYI

SEQ ID NO: 60584 - protein, 9 aa, Homo Sapiens
TNGLCIWLL

SEQ ID NO: 60585 - protein, 9 aa, Homo Sapiens
ADLPSNYVI

SEQ ID NO: 60586 - protein, 9 aa, Homo Sapiens
LAVLQGDHT

SEQ ID NO: 60587 - protein, 9 aa, Homo Sapiens
SAIIFDQSF

SEQ ID NO: 60588 - protein, 9 aa, Homo Sapiens
RPPGMEYCY

SEQ ID NO: 60589 - protein, 9 aa, Homo Sapiens
IQGMQPLLL

SEQ ID NO: 60590 - protein, 9 aa, Homo Sapiens
LQINVDKEP

SEQ ID NO: 60591 - protein, 9 aa, Homo Sapiens
LCIWLLILS

SEQ ID NO: 60592 - protein, 9 aa, Homo Sapiens
VTATDADMM

SEQ ID NO: 60593 - protein, 9 aa, Homo Sapiens
ESQLCQAKT

SEQ ID NO: 60594 - protein, 9 aa, Homo Sapiens
SVLGCCWDR

SEQ ID NO: 60595 - protein, 9 aa, Homo Sapiens
DFKSYHNQT

SEQ ID NO: 60596 - protein, 9 aa, Homo Sapiens
YQSQSHKVV

SEQ ID NO: 60597 - protein, 9 aa, Homo Sapiens
HIAVLSECH

SEQ ID NO: 60598 - protein, 9 aa, Homo Sapiens
QPSLNSVNA

SEQ ID NO: 60599 - protein, 9 aa, Homo Sapiens
GFYVNTYGR

SEQ ID NO: 60600 - protein, 9 aa, Homo Sapiens
MNTLFEGRR

SEQ ID NO: 60601 - protein, 9 aa, Homo Sapiens
GLALAVLQG

SEQ ID NO: 60602 - protein, 9 aa, Homo Sapiens
DEGFYVNTY

SEQ ID NO: 60603 - protein, 9 aa, Homo Sapiens
TPLANKITT

SEQ ID NO: 60604 - protein, 9 aa, Homo Sapiens
NLSGHLRIY

SEQ ID NO: 60605 - protein, 9 aa, Homo Sapiens
KPGLLTAET

SEQ ID NO: 60606 - protein, 9 aa, Homo Sapiens
STFAEQVED

SEQ ID NO: 60607 - protein, 9 aa, Homo Sapiens
TWQGVEVNK

SEQ ID NO: 60608 - protein, 9 aa, Homo Sapiens
TSDTSKEEG

SEQ ID NO: 60609 - protein, 9 aa, Homo Sapiens
MTNGLCIWL

SEQ ID NO: 60610 - protein, 9 aa, Homo Sapiens
VTWQGVEVN

SEQ ID NO: 60611 - protein, 9 aa, Homo Sapiens
GQQSSPLTS

SEQ ID NO: 60612 - protein, 9 aa, Homo Sapiens
AQPPGAATL

SEQ ID NO: 60613 - protein, 9 aa, Homo Sapiens
LALAVLQGD

SEQ ID NO: 60614 - protein, 9 aa, Homo Sapiens
QTVIAVKKE

SEQ ID NO: 60615 - protein, 9 aa, Homo Sapiens
KEPFVLPPA

SEQ ID NO: 60616 - protein, 9 aa, Homo Sapiens
SGRIQGMQP

SEQ ID NO: 60617 - protein, 9 aa, Homo Sapiens
NAGGQKIKN

SEQ ID NO: 60618 - protein, 9 aa, Homo Sapiens
FSVHLSLHL

SEQ ID NO: 60619 - protein, 9 aa, Homo Sapiens
SISDSDSEN

SEQ ID NO: 60620 - protein, 9 aa, Homo Sapiens
FGDENGTSN

SEQ ID NO: 60621 - protein, 9 aa, Homo Sapiens
SSRVRQAQP

SEQ ID NO: 60622 - protein, 9 aa, Homo Sapiens
FFHGNKTTN

SEQ ID NO: 60623 - protein, 9 aa, Homo Sapiens
SCMGGINRR

SEQ ID NO: 60624 - protein, 9 aa, Homo Sapiens
HLRIYTGEK

SEQ ID NO: 60625 - protein, 9 aa, Homo Sapiens
ALPKKEQEL

SEQ ID NO: 60626 - protein, 9 aa, Homo Sapiens
LVCYEDEGF

SEQ ID NO: 60627 - protein, 9 aa, Homo Sapiens
GGTRQRAGG

SEQ ID NO: 60628 - protein, 9 aa, Homo Sapiens
LNSVNAGGQ

SEQ ID NO: 60629 - protein, 9 aa, Homo Sapiens
RGKYIKTWR

SEQ ID NO: 60630 - protein, 9 aa, Homo Sapiens
PSAGGKGNE

SEQ ID NO: 60631 - protein, 9 aa, Homo Sapiens
PGYNDIITI

SEQ ID NO: 60632 - protein, 9 aa, Homo Sapiens
PELLEKKRR

SEQ ID NO: 60633 - protein, 9 aa, Homo Sapiens
KLTVQVKEG

SEQ ID NO: 60634 - protein, 9 aa, Homo Sapiens
QSGRIQGMQ

SEQ ID NO: 60635 - protein, 9 aa, Homo Sapiens
LLKKEANVN

SEQ ID NO: 60636 - protein, 9 aa, Homo Sapiens
LRYNMLMSP

SEQ ID NO: 60637 - protein, 9 aa, Homo Sapiens
CQFAFMAQN

SEQ ID NO: 60638 - protein, 9 aa, Homo Sapiens
EEVSFFHGN

SEQ ID NO: 60639 - protein, 9 aa, Homo Sapiens
KDIKLAVQG

SEQ ID NO: 60640 - protein, 9 aa, Homo Sapiens
EEHSKHLVV

SEQ ID NO: 60641 - protein, 9 aa, Homo Sapiens
SRVRQAQPP

SEQ ID NO: 60642 - protein, 9 aa, Homo Sapiens
VQGAGRVGK

SEQ ID NO: 60643 - protein, 9 aa, Homo Sapiens
CYEDEGFYV

SEQ ID NO: 60644 - protein, 9 aa, Homo Sapiens
PEPQSGRIQ

SEQ ID NO: 60645 - protein, 9 aa, Homo Sapiens
RTPLANKIT

SEQ ID NO: 60646 - protein, 9 aa, Homo Sapiens
IKLAVQGAG

SEQ ID NO: 60647 - protein, 9 aa, Homo Sapiens
DIAVTPLKL

SEQ ID NO: 60648 - protein, 9 aa, Homo Sapiens
RQAQPPGAA

SEQ ID NO: 60649 - protein, 9 aa, Homo Sapiens
NALGARQAK

SEQ ID NO: 60650 - protein, 9 aa, Homo Sapiens
QAQPPGAAT

SEQ ID NO: 60651 - protein, 9 aa, Homo Sapiens
WIISVLGCC

SEQ ID NO: 60652 - protein, 9 aa, Homo Sapiens
VTTSIGQDF

SEQ ID NO: 60653 - protein, 9 aa, Homo Sapiens
IDRCWKVVT

SEQ ID NO: 60654 - protein, 9 aa, Homo Sapiens
ISGVLASHY

SEQ ID NO: 60655 - protein, 9 aa, Homo Sapiens
MVTEPPVVC

SEQ ID NO: 60656 - protein, 9 aa, Homo Sapiens
QEDSAIIFD

SEQ ID NO: 60657 - protein, 9 aa, Homo Sapiens
AEKAKCCNR

SEQ ID NO: 60658 - protein, 9 aa, Homo Sapiens
YVIDRWLGE

SEQ ID NO: 60659 - protein, 9 aa, Homo Sapiens
KCGKAFRQS

SEQ ID NO: 60660 - protein, 9 aa, Homo Sapiens
FAFMAQNPR

SEQ ID NO: 60661 - protein, 9 aa, Homo Sapiens
IGADLPSNY

SEQ ID NO: 60662 - protein, 9 aa, Homo Sapiens
MGGINRRPI

SEQ ID NO: 60663 - protein, 9 aa, Homo Sapiens
ICHPLRYNM

SEQ ID NO: 60664 - protein, 9 aa, Homo Sapiens
SDTSKEEGQ

SEQ ID NO: 60665 - protein, 9 aa, Homo Sapiens
MAQNPRSPA

SEQ ID NO: 60666 - protein, 9 aa, Homo Sapiens
KKEANVNAI

SEQ ID NO: 60667 - protein, 9 aa, Homo Sapiens
GGGVHIAVL

SEQ ID NO: 60668 - protein, 9 aa, Homo Sapiens
ALAVLQGDH

SEQ ID NO: 60669 - protein, 9 aa, Homo Sapiens
NKITTPSRA

SEQ ID NO: 60670 - protein, 9 aa, Homo Sapiens
PPIKPGLLT

SEQ ID NO: 60671 - protein, 9 aa, Homo Sapiens
DSISDSDSE

SEQ ID NO: 60672 - protein, 9 aa, Homo Sapiens
TPLKLAGWQ

SEQ ID NO: 60673 - protein, 9 aa, Homo Sapiens
LLCSILFFH

SEQ ID NO: 60674 - protein, 9 aa, Homo Sapiens
VTHSRSLSS

SEQ ID NO: 60675 - protein, 9 aa, Homo Sapiens
KPGYNDIIT

SEQ ID NO: 60676 - protein, 9 aa, Homo Sapiens
TFALPKKEQ

SEQ ID NO: 60677 - protein, 9 aa, Homo Sapiens
NGEGPLQNW

SEQ ID NO: 60678 - protein, 9 aa, Homo Sapiens
QQSSPLTSG

SEQ ID NO: 60679 - protein, 9 aa, Homo Sapiens
DSAIIFDQS

SEQ ID NO: 60680 - protein, 9 aa, Homo Sapiens
LSECHRRRA

SEQ ID NO: 60681 - protein, 9 aa, Homo Sapiens
RYNMLMSPR

SEQ ID NO: 60682 - protein, 9 aa, Homo Sapiens
FAEQVEDLM

SEQ ID NO: 60683 - protein, 9 aa, Homo Sapiens
TMNPSLVII

SEQ ID NO: 60684 - protein, 9 aa, Homo Sapiens
EESQRKMNT

SEQ ID NO: 60685 - protein, 9 aa, Homo Sapiens
AGSYEGFYQ

SEQ ID NO: 60686 - protein, 9 aa, Homo Sapiens
SLVIISGVL

SEQ ID NO: 60687 - protein, 9 aa, Homo Sapiens
SFKRKGDDW

SEQ ID NO: 60688 - protein, 9 aa, Homo Sapiens
NQKQTVIAV

SEQ ID NO: 60689 - protein, 9 aa, Homo Sapiens
PVLMFSVAP

SEQ ID NO: 60690 - protein, 9 aa, Homo Sapiens
FGWIISVLG

SEQ ID NO: 60691 - protein, 9 aa, Homo Sapiens
EMKPSAGGK

SEQ ID NO: 60692 - protein, 9 aa, Homo Sapiens
SYEGFYQSQ

SEQ ID NO: 60693 - protein, 9 aa, Homo Sapiens
GGINRRPIL

SEQ ID NO: 60694 - protein, 9 aa, Homo Sapiens
SSSTSDTSK

SEQ ID NO: 60695 - protein, 9 aa, Homo Sapiens
RKMNTLFEG

SEQ ID NO: 60696 - protein, 9 aa, Homo Sapiens
AASSPHRGH

SEQ ID NO: 60697 - protein, 9 aa, Homo Sapiens
VTSAKPGYN

SEQ ID NO: 60698 - protein, 9 aa, Homo Sapiens
PGIQPLDSI

SEQ ID NO: 60699 - protein, 9 aa, Homo Sapiens
VIISGVLAS

SEQ ID NO: 60700 - protein, 9 aa, Homo Sapiens
NTLFEGRRI

SEQ ID NO: 60701 - protein, 9 aa, Homo Sapiens
INVDKEPFV

SEQ ID NO: 60702 - protein, 9 aa, Homo Sapiens
PVTHSRSLS

SEQ ID NO: 60703 - protein, 9 aa, Homo Sapiens
QPKEMKPSA

SEQ ID NO: 60704 - protein, 9 aa, Homo Sapiens
PPVTHSRSL

SEQ ID NO: 60705 - protein, 9 aa, Homo Sapiens
EPQSGRIQG

SEQ ID NO: 60706 - protein, 9 aa, Homo Sapiens
CSILFFHYF

SEQ ID NO: 60707 - protein, 9 aa, Homo Sapiens
YEDEGFYVN

SEQ ID NO: 60708 - protein, 9 aa, Homo Sapiens
LSSRVRQAQ

SEQ ID NO: 60709 - protein, 9 aa, Homo Sapiens
RRAASSPHR

SEQ ID NO: 60710 - protein, 9 aa, Homo Sapiens
RKGDDWSQL

SEQ ID NO: 60711 - protein, 9 aa, Homo Sapiens
AKLTVQVKE

SEQ ID NO: 60712 - protein, 9 aa, Homo Sapiens
VEDLMFNLH

SEQ ID NO: 60713 - protein, 9 aa, Homo Sapiens
SSTSDTSKE

SEQ ID NO: 60714 - protein, 9 aa, Homo Sapiens
PLDSISDSD

SEQ ID NO: 60715 - protein, 9 aa, Homo Sapiens
KDSPPIKPG

SEQ ID NO: 60716 - protein, 9 aa, Homo Sapiens
RVRQAQPPG

SEQ ID NO: 60717 - protein, 9 aa, Homo Sapiens
NVDKEPFVL

SEQ ID NO: 60718 - protein, 9 aa, Homo Sapiens
EVSFFHGNK

SEQ ID NO: 60719 - protein, 9 aa, Homo Sapiens
APLQPVLMF

SEQ ID NO: 60720 - protein, 9 aa, Homo Sapiens
MSFKRKGDD

SEQ ID NO: 60721 - protein, 9 aa, Homo Sapiens
ISVLGCCWD

SEQ ID NO: 60722 - protein, 9 aa, Homo Sapiens
KCEEHSKHL

SEQ ID NO: 60723 - protein, 9 aa, Homo Sapiens
SILFFHYFS

SEQ ID NO: 60724 - protein, 9 aa, Homo Sapiens
AEQVEDLMF

SEQ ID NO: 60725 - protein, 9 aa, Homo Sapiens
WLLILSYVG

SEQ ID NO: 60726 - protein, 9 aa, Homo Sapiens
CQAKTELEE

SEQ ID NO: 60727 - protein, 9 aa, Homo Sapiens
PLKLAGWQC

SEQ ID NO: 60728 - protein, 9 aa, Homo Sapiens
RIDLHTNVA

SEQ ID NO: 60729 - protein, 9 aa, Homo Sapiens
TFAEQVEDL

SEQ ID NO: 60730 - protein, 9 aa, Homo Sapiens
QRAGGGVHI

SEQ ID NO: 60731 - protein, 9 aa, Homo Sapiens
GVHIAVLSE

SEQ ID NO: 60732 - protein, 9 aa, Homo Sapiens
HLQPKEMKP

SEQ ID NO: 60733 - protein, 9 aa, Homo Sapiens
INRRPILTI

SEQ ID NO: 60734 - protein, 9 aa, Homo Sapiens
DTSKEEGQD

SEQ ID NO: 60735 - protein, 9 aa, Homo Sapiens
YIDRCWKVV

SEQ ID NO: 60736 - protein, 9 aa, Homo Sapiens
QRKMNTLFE

SEQ ID NO: 60737 - protein, 9 aa, Homo Sapiens
CIWLLILSY

SEQ ID NO: 60738 - protein, 9 aa, Homo Sapiens
LQPVLMFSV

SEQ ID NO: 60739 - protein, 9 aa, Homo Sapiens
FPGGTRQRA

SEQ ID NO: 60740 - protein, 9 aa, Homo Sapiens
KKEQELCVS

SEQ ID NO: 60741 - protein, 9 aa, Homo Sapiens
VTPLKLAGW

SEQ ID NO: 60742 - protein, 9 aa, Homo Sapiens
GADLPSNYV

SEQ ID NO: 60743 - protein, 9 aa, Homo Sapiens
NQEDSAIIF

SEQ ID NO: 60744 - protein, 9 aa, Homo Sapiens
SECHRRRAA

SEQ ID NO: 60745 - protein, 9 aa, Homo Sapiens
LPKKEQELC

SEQ ID NO: 60746 - protein, 9 aa, Homo Sapiens
EKAKCCNRR

SEQ ID NO: 60747 - protein, 9 aa, Homo Sapiens
IISGVLASH

SEQ ID NO: 60748 - protein, 9 aa, Homo Sapiens
TVTVEFFPG

SEQ ID NO: 60749 - protein, 9 aa, Homo Sapiens
CYDINRVPE

SEQ ID NO: 60750 - protein, 9 aa, Homo Sapiens
MKPSAGGKG

SEQ ID NO: 60751 - protein, 9 aa, Homo Sapiens
NSSCMGGIN

SEQ ID NO: 60752 - protein, 9 aa, Homo Sapiens
AALESQLCQ

SEQ ID NO: 60753 - protein, 9 aa, Homo Sapiens
ESQRKMNTL

SEQ ID NO: 60754 - protein, 9 aa, Homo Sapiens
HPLRYNMLM

SEQ ID NO: 60755 - protein, 9 aa, Homo Sapiens
PKEMKPSAG

SEQ ID NO: 60756 - protein, 9 aa, Homo Sapiens
EPGFGDENG

SEQ ID NO: 60757 - protein, 9 aa, Homo Sapiens
KLAVQGAGR

SEQ ID NO: 60758 - protein, 9 aa, Homo Sapiens
GWIISVLGC

SEQ ID NO: 60759 - protein, 9 aa, Homo Sapiens
FMAQNPRSP

SEQ ID NO: 60760 - protein, 9 aa, Homo Sapiens
EKKRRIDLH

SEQ ID NO: 60761 - protein, 9 aa, Homo Sapiens
YKCEEHSKH

SEQ ID NO: 60762 - protein, 9 aa, Homo Sapiens
EKCGKAFRQ

SEQ ID NO: 60763 - protein, 9 aa, Homo Sapiens
TSIGQDFKS

SEQ ID NO: 60764 - protein, 9 aa, Homo Sapiens
TSKEEGQDR

SEQ ID NO: 60765 - protein, 9 aa, Homo Sapiens
CMGGINRRP

SEQ ID NO: 60766 - protein, 9 aa, Homo Sapiens
AQNPRSPAS

SEQ ID NO: 60767 - protein, 9 aa, Homo Sapiens
PSLVIISGV

SEQ ID NO: 60768 - protein, 9 aa, Homo Sapiens
SKEEGQDRV

SEQ ID NO: 60769 - protein, 9 aa, Homo Sapiens
RAASSPHRG

SEQ ID NO: 60770 - protein, 9 aa, Homo Sapiens
IAVTPLKLA

SEQ ID NO: 60771 - protein, 9 aa, Homo Sapiens
EGFYVNTYG

SEQ ID NO: 60772 - protein, 9 aa, Homo Sapiens
NNLAEKAKC

SEQ ID NO: 60773 - protein, 9 aa, Homo Sapiens
CWKVVTVGD

SEQ ID NO: 60774 - protein, 9 aa, Homo Sapiens
AVLSECHRR

SEQ ID NO: 60775 - protein, 9 aa, Homo Sapiens
LAGWQCPEC

SEQ ID NO: 60776 - protein, 9 aa, Homo Sapiens
KAKCCNRRL

SEQ ID NO: 60777 - protein, 9 aa, Homo Sapiens
KCCNRRLKS

SEQ ID NO: 60778 - protein, 9 aa, Homo Sapiens
GGLQINVDK

SEQ ID NO: 60779 - protein, 9 aa, Homo Sapiens
AVTPLKLAG

SEQ ID NO: 60780 - protein, 9 aa, Homo Sapiens
QGAGRVGKS

SEQ ID NO: 60781 - protein, 9 aa, Homo Sapiens
VTEPPVVCS

SEQ ID NO: 60782 - protein, 9 aa, Homo Sapiens
VRQAQPPGA

SEQ ID NO: 60783 - protein, 9 aa, Homo Sapiens
RQAKLTVQV

SEQ ID NO: 60784 - protein, 9 aa, Homo Sapiens
QPVLMFSVA

SEQ ID NO: 60785 - protein, 9 aa, Homo Sapiens
FFEPGFGDE

SEQ ID NO: 60786 - protein, 9 aa, Homo Sapiens
SSGGQQSSP

SEQ ID NO: 60787 - protein, 9 aa, Homo Sapiens
KVTFFEPGF

SEQ ID NO: 60788 - protein, 9 aa, Homo Sapiens
GQDFKSYHN

SEQ ID NO: 60789 - protein, 9 aa, Homo Sapiens
DNQEDSAII

SEQ ID NO: 60790 - protein, 9 aa, Homo Sapiens
IILFGWIIS

SEQ ID NO: 60791 - protein, 9 aa, Homo Sapiens
FYQSQSHKV

SEQ ID NO: 60792 - protein, 9 aa, Homo Sapiens
IAVLSECHR

SEQ ID NO: 60793 - protein, 9 aa, Homo Sapiens
PAANGEGPL

SEQ ID NO: 60794 - protein, 9 aa, Homo Sapiens
GGQQSSPLT

SEQ ID NO: 60795 - protein, 9 aa, Homo Sapiens
LRIYTGEKP

SEQ ID NO: 60796 - protein, 9 aa, Homo Sapiens
AANGEGPLQ

SEQ ID NO: 60797 - protein, 9 aa, Homo Sapiens
KTFALPKKE

SEQ ID NO: 60798 - protein, 9 aa, Homo Sapiens
QFAFMAQNP

SEQ ID NO: 60799 - protein, 9 aa, Homo Sapiens
TKDSPPIKP

SEQ ID NO: 60800 - protein, 9 aa, Homo Sapiens
GMEYCYDIN

SEQ ID NO: 60801 - protein, 9 aa, Homo Sapiens
SFSSSGGQQ

SEQ ID NO: 60802 - protein, 9 aa, Homo Sapiens
DCQFAFMAQ

SEQ ID NO: 60803 - protein, 9 aa, Homo Sapiens
QAKLTVQVK

SEQ ID NO: 60804 - protein, 9 aa, Homo Sapiens
SSSGGQQSS

SEQ ID NO: 60805 - protein, 9 aa, Homo Sapiens
MVEFLLKKE

SEQ ID NO: 60806 - protein, 9 aa, Homo Sapiens
MPEPQSGRI

SEQ ID NO: 60807 - protein, 9 aa, Homo Sapiens
VIAVKKEIM

SEQ ID NO: 60808 - protein, 9 aa, Homo Sapiens
SKHLVVGRN

SEQ ID NO: 60809 - protein, 9 aa, Homo Sapiens
LESQLCQAK

SEQ ID NO: 60810 - protein, 9 aa, Homo Sapiens
NSVNAGGQK

SEQ ID NO: 60811 - protein, 9 aa, Homo Sapiens
CCNRRLKSQ

SEQ ID NO: 60812 - protein, 9 aa, Homo Sapiens
TEPPVVCSY

SEQ ID NO: 60813 - protein, 9 aa, Homo Sapiens
SVNAGGQKI

SEQ ID NO: 60814 - protein, 9 aa, Homo Sapiens
TRQRAGGGV

SEQ ID NO: 60815 - protein, 9 aa, Homo Sapiens
GKYIKTWRP

SEQ ID NO: 60816 - protein, 9 aa, Homo Sapiens
KPSAGGKGN

SEQ ID NO: 60817 - protein, 9 aa, Homo Sapiens
GWLHKRGKY

SEQ ID NO: 60818 - protein, 9 aa, Homo Sapiens
PKDIKLAVQ

SEQ ID NO: 60819 - protein, 9 aa, Homo Sapiens
ERTPLANKI

SEQ ID NO: 60820 - protein, 9 aa, Homo Sapiens
QDFKSYHNQ

SEQ ID NO: 60821 - protein, 9 aa, Homo Sapiens
ALGARQAKL

SEQ ID NO: 60822 - protein, 9 aa, Homo Sapiens
RRRAASSPH

SEQ ID NO: 60823 - protein, 9 aa, Homo Sapiens
NGLCIWLLI

SEQ ID NO: 60824 - protein, 9 aa, Homo Sapiens
FKSYHNQTI

SEQ ID NO: 60825 - protein, 9 aa, Homo Sapiens
RAALESQLC

SEQ ID NO: 60826 - protein, 9 aa, Homo Sapiens
YTGEKPFEC

SEQ ID NO: 60827 - protein, 9 aa, Homo Sapiens
AKCCNRRLK

SEQ ID NO: 60828 - protein, 9 aa, Homo Sapiens
EDLMFNLHM

SEQ ID NO: 60829 - protein, 9 aa, Homo Sapiens
LVIISGVLA

SEQ ID NO: 60830 - protein, 9 aa, Homo Sapiens
SSPHRGHTL

SEQ ID NO: 60831 - protein, 9 aa, Homo Sapiens
VEFLLKKEA

SEQ ID NO: 60832 - protein, 9 aa, Homo Sapiens
HKRGKYIKT

SEQ ID NO: 60833 - protein, 9 aa, Homo Sapiens
PGMEYCYDI

SEQ ID NO: 60834 - protein, 9 aa, Homo Sapiens
VPGIQPLDS

SEQ ID NO: 60835 - protein, 9 aa, Homo Sapiens
EHSKHLVVG

SEQ ID NO: 60836 - protein, 9 aa, Homo Sapiens
KEMKPSAGG

SEQ ID NO: 60837 - protein, 9 aa, Homo Sapiens
SNYVIDRWL

SEQ ID NO: 60838 - protein, 9 aa, Homo Sapiens
NLYKCEEHS

SEQ ID NO: 60839 - protein, 9 aa, Homo Sapiens
AFMAQNPRS

SEQ ID NO: 60840 - protein, 9 aa, Homo Sapiens
AKPGYNDII

SEQ ID NO: 60841 - protein, 9 aa, Homo Sapiens
TTSIGQDFK

SEQ ID NO: 60842 - protein, 9 aa, Homo Sapiens
KMNTLFEGR

SEQ ID NO: 60843 - protein, 9 aa, Homo Sapiens
ANKITTPSR

SEQ ID NO: 60844 - protein, 9 aa, Homo Sapiens
IFDQSFGTQ

SEQ ID NO: 60845 - protein, 9 aa, Homo Sapiens
KRGKYIKTW

SEQ ID NO: 60846 - protein, 9 aa, Homo Sapiens
LQPKEMKPS

SEQ ID NO: 60847 - protein, 9 aa, Homo Sapiens
DRCWKVVTV

SEQ ID NO: 60848 - protein, 9 aa, Homo Sapiens
LHKRGKYIK

SEQ ID NO: 60849 - protein, 9 aa, Homo Sapiens
ALESQLCQA

SEQ ID NO: 60850 - protein, 9 aa, Homo Sapiens
AGGGVHIAV

SEQ ID NO: 60851 - protein, 9 aa, Homo Sapiens
EVNKNNCIV

SEQ ID NO: 60852 - protein, 9 aa, Homo Sapiens
ARQAKLTVQ

SEQ ID NO: 60853 - protein, 9 aa, Homo Sapiens
GGVHIAVLS

SEQ ID NO: 60854 - protein, 9 aa, Homo Sapiens
GERTPLANK

SEQ ID NO: 60855 - protein, 9 aa, Homo Sapiens
GFGDENGTS

SEQ ID NO: 60856 - protein, 9 aa, Homo Sapiens
GLCIWLLIL

SEQ ID NO: 60857 - protein, 9 aa, Homo Sapiens
PGGTRQRAG

SEQ ID NO: 60858 - protein, 9 aa, Homo Sapiens
KYIKTWRPR

SEQ ID NO: 60859 - protein, 9 aa, Homo Sapiens
SPPIKPGLL

SEQ ID NO: 60860 - protein, 9 aa, Homo Sapiens
YFSVHLSLH

SEQ ID NO: 60861 - protein, 9 aa, Homo Sapiens
VNKNNCIVY

SEQ ID NO: 60862 - protein, 9 aa, Homo Sapiens
EGFYQSQSH

SEQ ID NO: 60863 - protein, 9 aa, Homo Sapiens
LQGDHTFDG

SEQ ID NO: 60864 - protein, 9 aa, Homo Sapiens
FEPGFGDEN

SEQ ID NO: 60865 - protein, 9 aa, Homo Sapiens
AGGQKIKNE

SEQ ID NO: 60866 - protein, 9 aa, Homo Sapiens
VCSYFAQDL

SEQ ID NO: 60867 - protein, 9 aa, Homo Sapiens
KYIDRCWKV

SEQ ID NO: 60868 - protein, 9 aa, Homo Sapiens
DSPPIKPGL

SEQ ID NO: 60869 - protein, 9 aa, Homo Sapiens
WQGVEVNKN

SEQ ID NO: 60870 - protein, 9 aa, Homo Sapiens
SFFHGNKTT

SEQ ID NO: 60871 - protein, 9 aa, Homo Sapiens
ANGEGPLQN

SEQ ID NO: 60872 - protein, 9 aa, Homo Sapiens
VLSECHRRR

SEQ ID NO: 60873 - protein, 9 aa, Homo Sapiens
HYFSVHLSL

SEQ ID NO: 60874 - protein, 9 aa, Homo Sapiens
QGDHTFDGM

SEQ ID NO: 60875 - protein, 9 aa, Homo Sapiens
VTVEFFPGG

SEQ ID NO: 60876 - protein, 9 aa, Homo Sapiens
LCSILFFHY

SEQ ID NO: 60877 - protein, 9 aa, Homo Sapiens
TVEFFPGGT

SEQ ID NO: 60878 - protein, 9 aa, Homo Sapiens
EANVNAIDY

SEQ ID NO: 60879 - protein, 9 aa, Homo Sapiens
VEVNKNNCI

SEQ ID NO: 60880 - protein, 9 aa, Homo Sapiens
ARSPPVTHS

SEQ ID NO: 60881 - protein, 9 aa, Homo Sapiens
ELSSRVRQA

SEQ ID NO: 60882 - protein, 9 aa, Homo Sapiens
ILFGWIISV

SEQ ID NO: 60883 - protein, 9 aa, Homo Sapiens
RIQGMQPLL

SEQ ID NO: 60884 - protein, 9 aa, Homo Sapiens
VTFFEPGFG

SEQ ID NO: 60885 - protein, 9 aa, Homo Sapiens
QVEDLMFNL

SEQ ID NO: 60886 - protein, 9 aa, Homo Sapiens
GVEVNKNNC

SEQ ID NO: 60887 - protein, 9 aa, Homo Sapiens
AVQGAGRVG

SEQ ID NO: 60888 - protein, 9 aa, Homo Sapiens
FLLKKEANV

SEQ ID NO: 60889 - protein, 9 aa, Homo Sapiens
MNPSLVIIS

SEQ ID NO: 60890 - protein, 9 aa, Homo Sapiens
FYVNTYGRI

SEQ ID NO: 60891 - protein, 9 aa, Homo Sapiens
GTRQRAGGG

SEQ ID NO: 60892 - protein, 9 aa, Homo Sapiens
EVTATDADM

SEQ ID NO: 60893 - protein, 9 aa, Homo Sapiens
QNPRSPASK

SEQ ID NO: 60894 - protein, 9 aa, Homo Sapiens
LCQAKTELE

SEQ ID NO: 60895 - protein, 9 aa, Homo Sapiens
GRIQGMQPL

SEQ ID NO: 60896 - protein, 9 aa, Homo Sapiens
QKQTVIAVK

SEQ ID NO: 60897 - protein, 9 aa, Homo Sapiens
HSKHLVVGR

SEQ ID NO: 60898 - protein, 9 aa, Homo Sapiens
ASSPHRGHT

SEQ ID NO: 60899 - protein, 9 aa, Homo Sapiens
KLAGWQCPE

SEQ ID NO: 60900 - protein, 9 aa, Homo Sapiens
LFFHYFSVH

SEQ ID NO: 60901 - protein, 9 aa, Homo Sapiens
GNKTTNQNV

SEQ ID NO: 60902 - protein, 9 aa, Homo Sapiens
EQELCVSGT

SEQ ID NO: 60903 - protein, 9 aa, Homo Sapiens
HRRRAASSP

SEQ ID NO: 60904 - protein, 9 aa, Homo Sapiens
SGGQQSSPL

SEQ ID NO: 60905 - protein, 9 aa, Homo Sapiens
TVIAVKKEI

SEQ ID NO: 60906 - protein, 9 aa, Homo Sapiens
PLRYNMLMS

SEQ ID NO: 60907 - protein, 9 aa, Homo Sapiens
EDSAIIFDQ

SEQ ID NO: 60908 - protein, 9 aa, Homo Sapiens
SLNSVNAGG

SEQ ID NO: 60909 - protein, 9 aa, Homo Sapiens
LEKKRRIDL

SEQ ID NO: 60910 - protein, 9 aa, Homo Sapiens
VEFFPGGTR

SEQ ID NO: 60911 - protein, 9 aa, Homo Sapiens
KVNQKQTVI

SEQ ID NO: 60912 - protein, 9 aa, Homo Sapiens
GYNDIITIP

SEQ ID NO: 60913 - protein, 9 aa, Homo Sapiens
NKTTNQNVI

SEQ ID NO: 60914 - protein, 9 aa, Homo Sapiens
IGQDFKSYH

SEQ ID NO: 60915 - protein, 9 aa, Homo Sapiens
THSRSLSSP

SEQ ID NO: 60916 - protein, 9 aa, Homo Sapiens
CSYFAQDLW

SEQ ID NO: 60917 - protein, 9 aa, Homo Sapiens
SGHLRIYTG

SEQ ID NO: 60918 - protein, 9 aa, Homo Sapiens
HSRSLSSPS

SEQ ID NO: 60919 - protein, 9 aa, Homo Sapiens
PGFGDENGT

SEQ ID NO: 60920 - protein, 9 aa, Homo Sapiens
PPGMEYCYD

SEQ ID NO: 60921 - protein, 9 aa, Homo Sapiens
CNSSCMGGI

SEQ ID NO: 60922 - protein, 9 aa, Homo Sapiens
RCWKVVTVG

SEQ ID NO: 60923 - protein, 9 aa, Homo Sapiens
VDKEPFVLP

SEQ ID NO: 60924 - protein, 9 aa, Homo Sapiens
TLFEGRRIE

SEQ ID NO: 60925 - protein, 9 aa, Homo Sapiens
RAGGGVHIA

SEQ ID NO: 60926 - protein, 9 aa, Homo Sapiens
RRIDLHTNV

SEQ ID NO: 60927 - protein, 9 aa, Homo Sapiens
ELLEKKRRI

SEQ ID NO: 60928 - protein, 9 aa, Homo Sapiens
IKPGLLTAE

SEQ ID NO: 60929 - protein, 9 aa, Homo Sapiens
HARSPPVTH

SEQ ID NO: 60930 - protein, 9 aa, Homo Sapiens
LYKCEEHSK

SEQ ID NO: 60931 - protein, 9 aa, Homo Sapiens
LLEKKRRID

SEQ ID NO: 60932 - protein, 9 aa, Homo Sapiens
CHPLRYNML

SEQ ID NO: 60933 - protein, 9 aa, Homo Sapiens
FHYFSVHLS

SEQ ID NO: 60934 - protein, 9 aa, Homo Sapiens
FKRKGDDWS

SEQ ID NO: 60935 - protein, 9 aa, Homo Sapiens
NLAEKAKCC

SEQ ID NO: 60936 - protein, 9 aa, Homo Sapiens
FFHYFSVHL

SEQ ID NO: 60937 - protein, 9 aa, Homo Sapiens
GLQINVDKE

SEQ ID NO: 60938 - protein, 9 aa, Homo Sapiens
VSFFHGNKT

SEQ ID NO: 60939 - protein, 9 aa, Homo Sapiens
KQTVIAVKK

SEQ ID NO: 60940 - protein, 9 aa, Homo Sapiens
QPLDSISDS

SEQ ID NO: 60941 - protein, 9 aa, Homo Sapiens
LDSISDSDS

SEQ ID NO: 60942 - protein, 9 aa, Homo Sapiens
AGLALAVLQ

SEQ ID NO: 60943 - protein, 9 aa, Homo Sapiens
CHRRRAASS

SEQ ID NO: 60944 - protein, 9 aa, Homo Sapiens
GFYQSQSHK

SEQ ID NO: 60945 - protein, 9 aa, Homo Sapiens
GINRRPILT

SEQ ID NO: 60946 - protein, 9 aa, Homo Sapiens
TLPAANGEG

SEQ ID NO: 60947 - protein, 9 aa, Homo Sapiens
PLANKITTP

SEQ ID NO: 60948 - protein, 9 aa, Homo Sapiens
VLMFSVAPS

SEQ ID NO: 60949 - protein, 9 aa, Homo Sapiens
EFLLKKEAN

SEQ ID NO: 60950 - protein, 9 aa, Homo Sapiens
LANKITTPS

SEQ ID NO: 60951 - protein, 9 aa, Homo Sapiens
IQPLDSISD

SEQ ID NO: 60952 - protein, 9 aa, Homo Sapiens
SIGQDFKSY

SEQ ID NO: 60953 - protein, 9 aa, Homo Sapiens
LPSNYVIDR

SEQ ID NO: 60954 - protein, 9 aa, Homo Sapiens
PSLNSVNAG

SEQ ID NO: 60955 - protein, 9 aa, Homo Sapiens
IMTNGLCIW

SEQ ID NO: 60956 - protein, 9 aa, Homo Sapiens
GAPLQPVLM

SEQ ID NO: 60957 - protein, 9 aa, Homo Sapiens
GSRIFQQVE

SEQ ID NO: 60958 - protein, 9 aa, Homo Sapiens
MKRINLEKC

SEQ ID NO: 60959 - protein, 9 aa, Homo Sapiens
VNTHTRVSV

SEQ ID NO: 60960 - protein, 9 aa, Homo Sapiens
SPAAPTMLH

SEQ ID NO: 60961 - protein, 9 aa, Homo Sapiens
TVEEVQRRL

SEQ ID NO: 60962 - protein, 9 aa, Homo Sapiens
PGLFLRGHD

SEQ ID NO: 60963 - protein, 9 aa, Homo Sapiens
KEISQERDE

SEQ ID NO: 60964 - protein, 9 aa, Homo Sapiens
LTNTATIPP

SEQ ID NO: 60965 - protein, 9 aa, Homo Sapiens
LCSKKVCNV

SEQ ID NO: 60966 - protein, 9 aa, Homo Sapiens
RMDITLAKT

SEQ ID NO: 60967 - protein, 9 aa, Homo Sapiens
ARKRAVARR

SEQ ID NO: 60968 - protein, 9 aa, Homo Sapiens
PEEARPATG

SEQ ID NO: 60969 - protein, 9 aa, Homo Sapiens
PDQARMDIT

SEQ ID NO: 60970 - protein, 9 aa, Homo Sapiens
YSLSSSFPS

SEQ ID NO: 60971 - protein, 9 aa, Homo Sapiens
DAKTTSTCE

SEQ ID NO: 60972 - protein, 9 aa, Homo Sapiens
QFLDTCEFI

SEQ ID NO: 60973 - protein, 9 aa, Homo Sapiens
KKNKQQQLQ

SEQ ID NO: 60974 - protein, 9 aa, Homo Sapiens
APLGERSFF

SEQ ID NO: 60975 - protein, 9 aa, Homo Sapiens
EIKAHEDKV

SEQ ID NO: 60976 - protein, 9 aa, Homo Sapiens
HPVLLALTN

SEQ ID NO: 60977 - protein, 9 aa, Homo Sapiens
VRREANQAI

SEQ ID NO: 60978 - protein, 9 aa, Homo Sapiens
IAPCPFQDS

SEQ ID NO: 60979 - protein, 9 aa, Homo Sapiens
ILRRRGQQA

SEQ ID NO: 60980 - protein, 9 aa, Homo Sapiens
VDDNPFGTR

SEQ ID NO: 60981 - protein, 9 aa, Homo Sapiens
RSLDDQRAS

SEQ ID NO: 60982 - protein, 9 aa, Homo Sapiens
KLCPHHVAC

SEQ ID NO: 60983 - protein, 9 aa, Homo Sapiens
VELLLMADA

SEQ ID NO: 60984 - protein, 9 aa, Homo Sapiens
QIHGDMVQN

SEQ ID NO: 60985 - protein, 9 aa, Homo Sapiens
LESTNKICQ

SEQ ID NO: 60986 - protein, 9 aa, Homo Sapiens
DKEISQERD

SEQ ID NO: 60987 - protein, 9 aa, Homo Sapiens
MTRGPFRKR

SEQ ID NO: 60988 - protein, 9 aa, Homo Sapiens
KARQVRFED

SEQ ID NO: 60989 - protein, 9 aa, Homo Sapiens
AFGLLILIS

SEQ ID NO: 60990 - protein, 9 aa, Homo Sapiens
SVDDNPFGT

SEQ ID NO: 60991 - protein, 9 aa, Homo Sapiens
KQIHGDMVQ

SEQ ID NO: 60992 - protein, 9 aa, Homo Sapiens
SLQLIMGGA

SEQ ID NO: 60993 - protein, 9 aa, Homo Sapiens
DIFFRFSAV

SEQ ID NO: 60994 - protein, 9 aa, Homo Sapiens
NFGFSAVFE

SEQ ID NO: 60995 - protein, 9 aa, Homo Sapiens
EWENPSTKV

SEQ ID NO: 60996 - protein, 9 aa, Homo Sapiens
PDISATRWI

SEQ ID NO: 60997 - protein, 9 aa, Homo Sapiens
WENPSTKVD

SEQ ID NO: 60998 - protein, 9 aa, Homo Sapiens
ELLLMADAS

SEQ ID NO: 60999 - protein, 9 aa, Homo Sapiens
PPASTAAPA

SEQ ID NO: 61000 - protein, 9 aa, Homo Sapiens
EIYHITYMI

SEQ ID NO: 61001 - protein, 9 aa, Homo Sapiens
QEDVSNSSF

SEQ ID NO: 61002 - protein, 9 aa, Homo Sapiens
SRPKNGLEN

SEQ ID NO: 61003 - protein, 9 aa, Homo Sapiens
PPGQDTSVD

SEQ ID NO: 61004 - protein, 9 aa, Homo Sapiens
RPKLLLLKI

SEQ ID NO: 61005 - protein, 9 aa, Homo Sapiens
KIIILYNDD

SEQ ID NO: 61006 - protein, 9 aa, Homo Sapiens
YTVLNVALL

SEQ ID NO: 61007 - protein, 9 aa, Homo Sapiens
GDSGPQDGA

SEQ ID NO: 61008 - protein, 9 aa, Homo Sapiens
GGGKARQVR

SEQ ID NO: 61009 - protein, 9 aa, Homo Sapiens
PPTLLPSSE

SEQ ID NO: 61010 - protein, 9 aa, Homo Sapiens
VLTNIASGT

SEQ ID NO: 61011 - protein, 9 aa, Homo Sapiens
FVIFNLCLF

SEQ ID NO: 61012 - protein, 9 aa, Homo Sapiens
GNYTVLNVA

SEQ ID NO: 61013 - protein, 9 aa, Homo Sapiens
DHTGVGLSI

SEQ ID NO: 61014 - protein, 9 aa, Homo Sapiens
TFKQIHGDM

SEQ ID NO: 61015 - protein, 9 aa, Homo Sapiens
KGLLLGVTR

SEQ ID NO: 61016 - protein, 9 aa, Homo Sapiens
QSSKCLSYQ

SEQ ID NO: 61017 - protein, 9 aa, Homo Sapiens
ISATRWIFE

SEQ ID NO: 61018 - protein, 9 aa, Homo Sapiens
ALTNTATIP

SEQ ID NO: 61019 - protein, 9 aa, Homo Sapiens
EEVQRRLSP

SEQ ID NO: 61020 - protein, 9 aa, Homo Sapiens
WSTRDNYGK

SEQ ID NO: 61021 - protein, 9 aa, Homo Sapiens
ASRTLYPLN

SEQ ID NO: 61022 - protein, 9 aa, Homo Sapiens
KICQEDVSN

SEQ ID NO: 61023 - protein, 9 aa, Homo Sapiens
AMKRINLEK

SEQ ID NO: 61024 - protein, 9 aa, Homo Sapiens
STAAPAPPP

SEQ ID NO: 61025 - protein, 9 aa, Homo Sapiens
DISATRWIF

SEQ ID NO: 61026 - protein, 9 aa, Homo Sapiens
LLLMADASM

SEQ ID NO: 61027 - protein, 9 aa, Homo Sapiens
LCFLLHMIL

SEQ ID NO: 61028 - protein, 9 aa, Homo Sapiens
APRKRKLSS

SEQ ID NO: 61029 - protein, 9 aa, Homo Sapiens
FTCRSEGNP

SEQ ID NO: 61030 - protein, 9 aa, Homo Sapiens
LDLGGYPNY

SEQ ID NO: 61031 - protein, 9 aa, Homo Sapiens
IMDFAMPYS

SEQ ID NO: 61032 - protein, 9 aa, Homo Sapiens
LYNDDERLA

SEQ ID NO: 61033 - protein, 9 aa, Homo Sapiens
ERDEPAREQ

SEQ ID NO: 61034 - protein, 9 aa, Homo Sapiens
LLLKILHAA

SEQ ID NO: 61035 - protein, 9 aa, Homo Sapiens
LQFEAAWVL

SEQ ID NO: 61036 - protein, 9 aa, Homo Sapiens
GVTPPASTA

SEQ ID NO: 61037 - protein, 9 aa, Homo Sapiens
EDSNDDMDA

SEQ ID NO: 61038 - protein, 9 aa, Homo Sapiens
NTLCSKKVC

SEQ ID NO: 61039 - protein, 9 aa, Homo Sapiens
EDGSRIFQQ

SEQ ID NO: 61040 - protein, 9 aa, Homo Sapiens
YWNRLQFLD

SEQ ID NO: 61041 - protein, 9 aa, Homo Sapiens
HHVACKRLV

SEQ ID NO: 61042 - protein, 9 aa, Homo Sapiens
CSKKVCNVA

SEQ ID NO: 61043 - protein, 9 aa, Homo Sapiens
AKNLMNAAV

SEQ ID NO: 61044 - protein, 9 aa, Homo Sapiens
VITLLMTRG

SEQ ID NO: 61045 - protein, 9 aa, Homo Sapiens
FDPLLRDIP

SEQ ID NO: 61046 - protein, 9 aa, Homo Sapiens
LESDARSEF

SEQ ID NO: 61047 - protein, 9 aa, Homo Sapiens
SLGSELLRD

SEQ ID NO: 61048 - protein, 9 aa, Homo Sapiens
VCLHPELDR

SEQ ID NO: 61049 - protein, 9 aa, Homo Sapiens
KNFQQVIAF

SEQ ID NO: 61050 - protein, 9 aa, Homo Sapiens
ATTSFSTTK

SEQ ID NO: 61051 - protein, 9 aa, Homo Sapiens
QLIMGGAPA

SEQ ID NO: 61052 - protein, 9 aa, Homo Sapiens
KRLLQGDGG

SEQ ID NO: 61053 - protein, 9 aa, Homo Sapiens
GRKEGPLPR

SEQ ID NO: 61054 - protein, 9 aa, Homo Sapiens
LEQEQSSKC

SEQ ID NO: 61055 - protein, 9 aa, Homo Sapiens
TSKYKVTVE

SEQ ID NO: 61056 - protein, 9 aa, Homo Sapiens
PWRRGCQGR

SEQ ID NO: 61057 - protein, 9 aa, Homo Sapiens
SPPVMNPII

SEQ ID NO: 61058 - protein, 9 aa, Homo Sapiens
SDARSEFPQ

SEQ ID NO: 61059 - protein, 9 aa, Homo Sapiens
GPQDGAPGL

SEQ ID NO: 61060 - protein, 9 aa, Homo Sapiens
APRERSSRP

SEQ ID NO: 61061 - protein, 9 aa, Homo Sapiens
PLLQGQVPE

SEQ ID NO: 61062 - protein, 9 aa, Homo Sapiens
QVELLLMAD

SEQ ID NO: 61063 - protein, 9 aa, Homo Sapiens
RSSRPKNGL

SEQ ID NO: 61064 - protein, 9 aa, Homo Sapiens
PIFHEGIKY

SEQ ID NO: 61065 - protein, 9 aa, Homo Sapiens
LNSLQCKQD

SEQ ID NO: 61066 - protein, 9 aa, Homo Sapiens
GGGGKARQV

SEQ ID NO: 61067 - protein, 9 aa, Homo Sapiens
YKLLEQASL

SEQ ID NO: 61068 - protein, 9 aa, Homo Sapiens
PMLCFLLHM

SEQ ID NO: 61069 - protein, 9 aa, Homo Sapiens
PNLFQKYKH

SEQ ID NO: 61070 - protein, 9 aa, Homo Sapiens
LEDADTKNV

SEQ ID NO: 61071 - protein, 9 aa, Homo Sapiens
REETAKKNK

SEQ ID NO: 61072 - protein, 9 aa, Homo Sapiens
LPRARSPDH

SEQ ID NO: 61073 - protein, 9 aa, Homo Sapiens
EKLYKLLEQ

SEQ ID NO: 61074 - protein, 9 aa, Homo Sapiens
TLCSKKVCN

SEQ ID NO: 61075 - protein, 9 aa, Homo Sapiens
TKVDYYKLR

SEQ ID NO: 61076 - protein, 9 aa, Homo Sapiens
CEQPRGRRC

SEQ ID NO: 61077 - protein, 9 aa, Homo Sapiens
PTMLHSSAA

SEQ ID NO: 61078 - protein, 9 aa, Homo Sapiens
GQQAAFMGG

SEQ ID NO: 61079 - protein, 9 aa, Homo Sapiens
GIKYWSCCR

SEQ ID NO: 61080 - protein, 9 aa, Homo Sapiens
TSSSSATTS

SEQ ID NO: 61081 - protein, 9 aa, Homo Sapiens
KVRIFQDCK

SEQ ID NO: 61082 - protein, 9 aa, Homo Sapiens
IFFRFSAVV

SEQ ID NO: 61083 - protein, 9 aa, Homo Sapiens
EDADTKNVA

SEQ ID NO: 61084 - protein, 9 aa, Homo Sapiens
WRRGCQGRK

SEQ ID NO: 61085 - protein, 9 aa, Homo Sapiens
MDFAMPYSS

SEQ ID NO: 61086 - protein, 9 aa, Homo Sapiens
FEAPNLFQK

SEQ ID NO: 61087 - protein, 9 aa, Homo Sapiens
PKKEKVAMK

SEQ ID NO: 61088 - protein, 9 aa, Homo Sapiens
ANIYLLSPP

SEQ ID NO: 61089 - protein, 9 aa, Homo Sapiens
LEEGARPDI

SEQ ID NO: 61090 - protein, 9 aa, Homo Sapiens
RPKNGLENP

SEQ ID NO: 61091 - protein, 9 aa, Homo Sapiens
TTSTCEEKK

SEQ ID NO: 61092 - protein, 9 aa, Homo Sapiens
GFGGGGKAR

SEQ ID NO: 61093 - protein, 9 aa, Homo Sapiens
LPLLQGQVP

SEQ ID NO: 61094 - protein, 9 aa, Homo Sapiens
RQVELLLMA

SEQ ID NO: 61095 - protein, 9 aa, Homo Sapiens
SAVFEHCSE

SEQ ID NO: 61096 - protein, 9 aa, Homo Sapiens
LLLLKILHA

SEQ ID NO: 61097 - protein, 9 aa, Homo Sapiens
QQVIAFFKV

SEQ ID NO: 61098 - protein, 9 aa, Homo Sapiens
TSVMFSPFS

SEQ ID NO: 61099 - protein, 9 aa, Homo Sapiens
TQSLQLIMG

SEQ ID NO: 61100 - protein, 9 aa, Homo Sapiens
TCRSEGNPK

SEQ ID NO: 61101 - protein, 9 aa, Homo Sapiens
QDPKSPFHK

SEQ ID NO: 61102 - protein, 9 aa, Homo Sapiens
VEEVQRRLS

SEQ ID NO: 61103 - protein, 9 aa, Homo Sapiens
ALTNITIPQ

SEQ ID NO: 61104 - protein, 9 aa, Homo Sapiens
GGADLHCRV

SEQ ID NO: 61105 - protein, 9 aa, Homo Sapiens
MRSVSPTMK

SEQ ID NO: 61106 - protein, 9 aa, Homo Sapiens
ESLREIYHI

SEQ ID NO: 61107 - protein, 9 aa, Homo Sapiens
NKICQEDVS

SEQ ID NO: 61108 - protein, 9 aa, Homo Sapiens
PSQSIILAD

SEQ ID NO: 61109 - protein, 9 aa, Homo Sapiens
YITLTQSLQ

SEQ ID NO: 61110 - protein, 9 aa, Homo Sapiens
HGDMVQNQL

SEQ ID NO: 61111 - protein, 9 aa, Homo Sapiens
DHLVNTHTR

SEQ ID NO: 61112 - protein, 9 aa, Homo Sapiens
QCKQDEYAK

SEQ ID NO: 61113 - protein, 9 aa, Homo Sapiens
VVTARKRAV

SEQ ID NO: 61114 - protein, 9 aa, Homo Sapiens
EGARPDISA

SEQ ID NO: 61115 - protein, 9 aa, Homo Sapiens
NLMNAAVLT

SEQ ID NO: 61116 - protein, 9 aa, Homo Sapiens
IHGDMVQNQ

SEQ ID NO: 61117 - protein, 9 aa, Homo Sapiens
GLLEDADTK

SEQ ID NO: 61118 - protein, 9 aa, Homo Sapiens
KKEKVAMKR

SEQ ID NO: 61119 - protein, 9 aa, Homo Sapiens
ARSEFPQPA

SEQ ID NO: 61120 - protein, 9 aa, Homo Sapiens
CVSVVTARK

SEQ ID NO: 61121 - protein, 9 aa, Homo Sapiens
TRESVPLDY

SEQ ID NO: 61122 - protein, 9 aa, Homo Sapiens
PCPFQDSLY

SEQ ID NO: 61123 - protein, 9 aa, Homo Sapiens
RPWRRGCQG

SEQ ID NO: 61124 - protein, 9 aa, Homo Sapiens
TPPNQRGRT

SEQ ID NO: 61125 - protein, 9 aa, Homo Sapiens
KCLSYQGQS

SEQ ID NO: 61126 - protein, 9 aa, Homo Sapiens
LYKNEDDIE

SEQ ID NO: 61127 - protein, 9 aa, Homo Sapiens
ALPSQSIIL

SEQ ID NO: 61128 - protein, 9 aa, Homo Sapiens
SKCLSYQGQ

SEQ ID NO: 61129 - protein, 9 aa, Homo Sapiens
ICQEDVSNS

SEQ ID NO: 61130 - protein, 9 aa, Homo Sapiens
PFQDSLYSD

SEQ ID NO: 61131 - protein, 9 aa, Homo Sapiens
KEKVAMKRI

SEQ ID NO: 61132 - protein, 9 aa, Homo Sapiens
IYHITYMIV

SEQ ID NO: 61133 - protein, 9 aa, Homo Sapiens
QEQSSKCLS

SEQ ID NO: 61134 - protein, 9 aa, Homo Sapiens
SSKCLSYQG

SEQ ID NO: 61135 - protein, 9 aa, Homo Sapiens
KYKVTVEEV

SEQ ID NO: 61136 - protein, 9 aa, Homo Sapiens
QVRPKLLLL

SEQ ID NO: 61137 - protein, 9 aa, Homo Sapiens
NEYVRDLPL

SEQ ID NO: 61138 - protein, 9 aa, Homo Sapiens
SPGGADLHC

SEQ ID NO: 61139 - protein, 9 aa, Homo Sapiens
KVLCCAFST

SEQ ID NO: 61140 - protein, 9 aa, Homo Sapiens
IEISKKIKT

SEQ ID NO: 61141 - protein, 9 aa, Homo Sapiens
PKHKANTYK

SEQ ID NO: 61142 - protein, 9 aa, Homo Sapiens
INTLCSKKV

SEQ ID NO: 61143 - protein, 9 aa, Homo Sapiens
SSSSATTSF

SEQ ID NO: 61144 - protein, 9 aa, Homo Sapiens
DQARMDITL

SEQ ID NO: 61145 - protein, 9 aa, Homo Sapiens
HQIVHTGEA

SEQ ID NO: 61146 - protein, 9 aa, Homo Sapiens
QAPHPRLAS

SEQ ID NO: 61147 - protein, 9 aa, Homo Sapiens
LTNITIPQE

SEQ ID NO: 61148 - protein, 9 aa, Homo Sapiens
SSPVNSDFG

SEQ ID NO: 61149 - protein, 9 aa, Homo Sapiens
QDVSRVIRP

SEQ ID NO: 61150 - protein, 9 aa, Homo Sapiens
KRVDRIILL

SEQ ID NO: 61151 - protein, 9 aa, Homo Sapiens
DDMDADEVF

SEQ ID NO: 61152 - protein, 9 aa, Homo Sapiens
LYVIIGATV

SEQ ID NO: 61153 - protein, 9 aa, Homo Sapiens
KGTGNYTVL

SEQ ID NO: 61154 - protein, 9 aa, Homo Sapiens
KSPFHKSKR

SEQ ID NO: 61155 - protein, 9 aa, Homo Sapiens
NQVRPKLLL

SEQ ID NO: 61156 - protein, 9 aa, Homo Sapiens
LLSPPVMNP

SEQ ID NO: 61157 - protein, 9 aa, Homo Sapiens
GPAVAWARG

SEQ ID NO: 61158 - protein, 9 aa, Homo Sapiens
QGDGGPNTG

SEQ ID NO: 61159 - protein, 9 aa, Homo Sapiens
LFQKYKHYI

SEQ ID NO: 61160 - protein, 9 aa, Homo Sapiens
VTVEEVQRR

SEQ ID NO: 61161 - protein, 9 aa, Homo Sapiens
MDIFFRFSA

SEQ ID NO: 61162 - protein, 9 aa, Homo Sapiens
LRIAPCPFQ

SEQ ID NO: 61163 - protein, 9 aa, Homo Sapiens
PLGERSFFC

SEQ ID NO: 61164 - protein, 9 aa, Homo Sapiens
PHPRLASRG

SEQ ID NO: 61165 - protein, 9 aa, Homo Sapiens
HVACKRLVS

SEQ ID NO: 61166 - protein, 9 aa, Homo Sapiens
VRIFQDCKA

SEQ ID NO: 61167 - protein, 9 aa, Homo Sapiens
SEGNPKPEI

SEQ ID NO: 61168 - protein, 9 aa, Homo Sapiens
NAAVLTVKA

SEQ ID NO: 61169 - protein, 9 aa, Homo Sapiens
DTKNVALEK

SEQ ID NO: 61170 - protein, 9 aa, Homo Sapiens
LPGPTTVEG

SEQ ID NO: 61171 - protein, 9 aa, Homo Sapiens
SVMFSPFSK

SEQ ID NO: 61172 - protein, 9 aa, Homo Sapiens
AMFHEIKML

SEQ ID NO: 61173 - protein, 9 aa, Homo Sapiens
DPLLRDIPG

SEQ ID NO: 61174 - protein, 9 aa, Homo Sapiens
RKRAVARRA

SEQ ID NO: 61175 - protein, 9 aa, Homo Sapiens
DCKAGLLVE

SEQ ID NO: 61176 - protein, 9 aa, Homo Sapiens
TRGFWCLNC

SEQ ID NO: 61177 - protein, 9 aa, Homo Sapiens
ESTNKICQE

SEQ ID NO: 61178 - protein, 9 aa, Homo Sapiens
RSVSPTMKV

SEQ ID NO: 61179 - protein, 9 aa, Homo Sapiens
LLQGDGGPN

SEQ ID NO: 61180 - protein, 9 aa, Homo Sapiens
LFVVITLLM

SEQ ID NO: 61181 - protein, 9 aa, Homo Sapiens
LLNSLQCKQ

SEQ ID NO: 61182 - protein, 9 aa, Homo Sapiens
GACSWRPGH

SEQ ID NO: 61183 - protein, 9 aa, Homo Sapiens
VSDLISVRR

SEQ ID NO: 61184 - protein, 9 aa, Homo Sapiens
REDGSRIFQ

SEQ ID NO: 61185 - protein, 9 aa, Homo Sapiens
VKGLLLGVT

SEQ ID NO: 61186 - protein, 9 aa, Homo Sapiens
VTPPASTAA

SEQ ID NO: 61187 - protein, 9 aa, Homo Sapiens
CQGRKEGPL

SEQ ID NO: 61188 - protein, 9 aa, Homo Sapiens
ELLRDVAIV

SEQ ID NO: 61189 - protein, 9 aa, Homo Sapiens
IFHEGIKYW

SEQ ID NO: 61190 - protein, 9 aa, Homo Sapiens
GPTTVEGET

SEQ ID NO: 61191 - protein, 9 aa, Homo Sapiens
STKVDYYKL

SEQ ID NO: 61192 - protein, 9 aa, Homo Sapiens
VVLYVIIGA

SEQ ID NO: 61193 - protein, 9 aa, Homo Sapiens
LLALTNTAT

SEQ ID NO: 61194 - protein, 9 aa, Homo Sapiens
LCPLPGPTT

SEQ ID NO: 61195 - protein, 9 aa, Homo Sapiens
YQEKLPFTV

SEQ ID NO: 61196 - protein, 9 aa, Homo Sapiens
YHLVCLHPE

SEQ ID NO: 61197 - protein, 9 aa, Homo Sapiens
EFPQPAPDW

SEQ ID NO: 61198 - protein, 9 aa, Homo Sapiens
FEAAWVLTN

SEQ ID NO: 61199 - protein, 9 aa, Homo Sapiens
VIIGATVFK

SEQ ID NO: 61200 - protein, 9 aa, Homo Sapiens
TPSTSSSSA

SEQ ID NO: 61201 - protein, 9 aa, Homo Sapiens
RAYHLVCLH

SEQ ID NO: 61202 - protein, 9 aa, Homo Sapiens
DYQEKLPFT

SEQ ID NO: 61203 - protein, 9 aa, Homo Sapiens
IPGRPVPVA

SEQ ID NO: 61204 - protein, 9 aa, Homo Sapiens
RPATGTACL

SEQ ID NO: 61205 - protein, 9 aa, Homo Sapiens
LNVSPGGAD

SEQ ID NO: 61206 - protein, 9 aa, Homo Sapiens
KFDPLLRDI

SEQ ID NO: 61207 - protein, 9 aa, Homo Sapiens
CVNWSNTFL

SEQ ID NO: 61208 - protein, 9 aa, Homo Sapiens
YLLSPPVMN

SEQ ID NO: 61209 - protein, 9 aa, Homo Sapiens
EEGARPDIS

SEQ ID NO: 61210 - protein, 9 aa, Homo Sapiens
LTSVMFSPF

SEQ ID NO: 61211 - protein, 9 aa, Homo Sapiens
SSATTSFST

SEQ ID NO: 61212 - protein, 9 aa, Homo Sapiens
AVFEHCSEV

SEQ ID NO: 61213 - protein, 9 aa, Homo Sapiens
HMILHSTGQ

SEQ ID NO: 61214 - protein, 9 aa, Homo Sapiens
LPPTLLPSS

SEQ ID NO: 61215 - protein, 9 aa, Homo Sapiens
SQSRSLDDQ

SEQ ID NO: 61216 - protein, 9 aa, Homo Sapiens
VVPQRAPLG

SEQ ID NO: 61217 - protein, 9 aa, Homo Sapiens
FGLLILISV

SEQ ID NO: 61218 - protein, 9 aa, Homo Sapiens
PATGTACLP

SEQ ID NO: 61219 - protein, 9 aa, Homo Sapiens
SDHTGVGLS

SEQ ID NO: 61220 - protein, 9 aa, Homo Sapiens
PSSPVNSDF

SEQ ID NO: 61221 - protein, 9 aa, Homo Sapiens
RSEGNPKPE

SEQ ID NO: 61222 - protein, 9 aa, Homo Sapiens
QFEAAWVLT

SEQ ID NO: 61223 - protein, 9 aa, Homo Sapiens
LHPELDRAP

SEQ ID NO: 61224 - protein, 9 aa, Homo Sapiens
LSIVYGVKQ

SEQ ID NO: 61225 - protein, 9 aa, Homo Sapiens
NKWLNCTYG

SEQ ID NO: 61226 - protein, 9 aa, Homo Sapiens
FPQPAPDWG

SEQ ID NO: 61227 - protein, 9 aa, Homo Sapiens
SKGFRAALP

SEQ ID NO: 61228 - protein, 9 aa, Homo Sapiens
LQCKQDEYA

SEQ ID NO: 61229 - protein, 9 aa, Homo Sapiens
KLLEQASLS

SEQ ID NO: 61230 - protein, 9 aa, Homo Sapiens
DRPWRRGCQ

SEQ ID NO: 61231 - protein, 9 aa, Homo Sapiens
TNKICQEDV

SEQ ID NO: 61232 - protein, 9 aa, Homo Sapiens
WFAKRVDRI

SEQ ID NO: 61233 - protein, 9 aa, Homo Sapiens
QDCKAGLLV

SEQ ID NO: 61234 - protein, 9 aa, Homo Sapiens
STNKICQED

SEQ ID NO: 61235 - protein, 9 aa, Homo Sapiens
DLGGYPNYK

SEQ ID NO: 61236 - protein, 9 aa, Homo Sapiens
VAMKRINLE

SEQ ID NO: 61237 - protein, 9 aa, Homo Sapiens
CRVARGDSG

SEQ ID NO: 61238 - protein, 9 aa, Homo Sapiens
RESVPLDYQ

SEQ ID NO: 61239 - protein, 9 aa, Homo Sapiens
HSSAAEQVT

SEQ ID NO: 61240 - protein, 9 aa, Homo Sapiens
DADEVFGFI

SEQ ID NO: 61241 - protein, 9 aa, Homo Sapiens
RIFQDCKAG

SEQ ID NO: 61242 - protein, 9 aa, Homo Sapiens
VNWSNTFLL

SEQ ID NO: 61243 - protein, 9 aa, Homo Sapiens
APNLFQKYK

SEQ ID NO: 61244 - protein, 9 aa, Homo Sapiens
TKNFQQVIA

SEQ ID NO: 61245 - protein, 9 aa, Homo Sapiens
IMDHRPTTG

SEQ ID NO: 61246 - protein, 9 aa, Homo Sapiens
SSFPSSPVN

SEQ ID NO: 61247 - protein, 9 aa, Homo Sapiens
DLHCRVARG

SEQ ID NO: 61248 - protein, 9 aa, Homo Sapiens
LASSQSRSL

SEQ ID NO: 61249 - protein, 9 aa, Homo Sapiens
RLLNSLQCK

SEQ ID NO: 61250 - protein, 9 aa, Homo Sapiens
YFTCRSEGN

SEQ ID NO: 61251 - protein, 9 aa, Homo Sapiens
TGTACLPFY

SEQ ID NO: 61252 - protein, 9 aa, Homo Sapiens
VVGFFFFVI

SEQ ID NO: 61253 - protein, 9 aa, Homo Sapiens
QHPVLLALT

SEQ ID NO: 61254 - protein, 9 aa, Homo Sapiens
RPGHRGPSS

SEQ ID NO: 61255 - protein, 9 aa, Homo Sapiens
SATTSFSTT

SEQ ID NO: 61256 - protein, 9 aa, Homo Sapiens
VSVVTARKR

SEQ ID NO: 61257 - protein, 9 aa, Homo Sapiens
ATGTACLPF

SEQ ID NO: 61258 - protein, 9 aa, Homo Sapiens
DGSRIFQQV

SEQ ID NO: 61259 - protein, 9 aa, Homo Sapiens
LDTLINEGV

SEQ ID NO: 61260 - protein, 9 aa, Homo Sapiens
FSKMFIGGL

SEQ ID NO: 61261 - protein, 9 aa, Homo Sapiens
RDLPLLQGQ

SEQ ID NO: 61262 - protein, 9 aa, Homo Sapiens
HEDKVLCCA

SEQ ID NO: 61263 - protein, 9 aa, Homo Sapiens
PEAFGLLIL

SEQ ID NO: 61264 - protein, 9 aa, Homo Sapiens
SGPQDGAPG

SEQ ID NO: 61265 - protein, 9 aa, Homo Sapiens
SSQSRSLDD

SEQ ID NO: 61266 - protein, 9 aa, Homo Sapiens
GGKARQVRF

SEQ ID NO: 61267 - protein, 9 aa, Homo Sapiens
NTVYFTCRS

SEQ ID NO: 61268 - protein, 9 aa, Homo Sapiens
FHEGIKYWS

SEQ ID NO: 61269 - protein, 9 aa, Homo Sapiens
HKRLLQGDG

SEQ ID NO: 61270 - protein, 9 aa, Homo Sapiens
NFQQVIAFF

SEQ ID NO: 61271 - protein, 9 aa, Homo Sapiens
LVCLHPELD

SEQ ID NO: 61272 - protein, 9 aa, Homo Sapiens
FAMPYSSRS

SEQ ID NO: 61273 - protein, 9 aa, Homo Sapiens
AQDHKRLLQ

SEQ ID NO: 61274 - protein, 9 aa, Homo Sapiens
PKLLLLKIL

SEQ ID NO: 61275 - protein, 9 aa, Homo Sapiens
VLLALTNTA

SEQ ID NO: 61276 - protein, 9 aa, Homo Sapiens
LMADASMAR

SEQ ID NO: 61277 - protein, 9 aa, Homo Sapiens
CSWRPGHRG

SEQ ID NO: 61278 - protein, 9 aa, Homo Sapiens
NSLQCKQDE

SEQ ID NO: 61279 - protein, 9 aa, Homo Sapiens
TQVKGLLLG

SEQ ID NO: 61280 - protein, 9 aa, Homo Sapiens
AAWVLTNIA

SEQ ID NO: 61281 - protein, 9 aa, Homo Sapiens
NWSNTFLLN

SEQ ID NO: 61282 - protein, 9 aa, Homo Sapiens
APGLFLRGH

SEQ ID NO: 61283 - protein, 9 aa, Homo Sapiens
GKIIILYND

SEQ ID NO: 61284 - protein, 9 aa, Homo Sapiens
TGVGLSIVY

SEQ ID NO: 61285 - protein, 9 aa, Homo Sapiens
IDLLDTLIN

SEQ ID NO: 61286 - protein, 9 aa, Homo Sapiens
LPSQSIILA

SEQ ID NO: 61287 - protein, 9 aa, Homo Sapiens
CQEDVSNSS

SEQ ID NO: 61288 - protein, 9 aa, Homo Sapiens
PDLIQHQIV

SEQ ID NO: 61289 - protein, 9 aa, Homo Sapiens
EFTDHLVNT

SEQ ID NO: 61290 - protein, 9 aa, Homo Sapiens
LRDIPGRPV

SEQ ID NO: 61291 - protein, 9 aa, Homo Sapiens
SRGTLPVDQ

SEQ ID NO: 61292 - protein, 9 aa, Homo Sapiens
PHHVACKRL

SEQ ID NO: 61293 - protein, 9 aa, Homo Sapiens
LLRDVAIVF

SEQ ID NO: 61294 - protein, 9 aa, Homo Sapiens
KTTSTCEEK

SEQ ID NO: 61295 - protein, 9 aa, Homo Sapiens
LEIKAHEDK

SEQ ID NO: 61296 - protein, 9 aa, Homo Sapiens
LLEDADTKN

SEQ ID NO: 61297 - protein, 9 aa, Homo Sapiens
LISVRREAN

SEQ ID NO: 61298 - protein, 9 aa, Homo Sapiens
YVIIGATVF

SEQ ID NO: 61299 - protein, 9 aa, Homo Sapiens
RVIRPLRHQ

SEQ ID NO: 61300 - protein, 9 aa, Homo Sapiens
LALTNTATI

SEQ ID NO: 61301 - protein, 9 aa, Homo Sapiens
MILHSTGQY

SEQ ID NO: 61302 - protein, 9 aa, Homo Sapiens
DLLDTLINE

SEQ ID NO: 61303 - protein, 9 aa, Homo Sapiens
LTQSLQLIM

SEQ ID NO: 61304 - protein, 9 aa, Homo Sapiens
MEKLYKLLE

SEQ ID NO: 61305 - protein, 9 aa, Homo Sapiens
EDDIEISKK

SEQ ID NO: 61306 - protein, 9 aa, Homo Sapiens
LREETAKKN

SEQ ID NO: 61307 - protein, 9 aa, Homo Sapiens
SNDDMDADE

SEQ ID NO: 61308 - protein, 9 aa, Homo Sapiens
APTMLHSSA

SEQ ID NO: 61309 - protein, 9 aa, Homo Sapiens
VTARKRAVA

SEQ ID NO: 61310 - protein, 9 aa, Homo Sapiens
LQLIMGGAP

SEQ ID NO: 61311 - protein, 9 aa, Homo Sapiens
RGHDRPWRR

SEQ ID NO: 61312 - protein, 9 aa, Homo Sapiens
SDLISVRRE

SEQ ID NO: 61313 - protein, 9 aa, Homo Sapiens
RREANQAIN

SEQ ID NO: 61314 - protein, 9 aa, Homo Sapiens
LLASSQSRS

SEQ ID NO: 61315 - protein, 9 aa, Homo Sapiens
DTSVDDNPF

SEQ ID NO: 61316 - protein, 9 aa, Homo Sapiens
LLGVTRHLT

SEQ ID NO: 61317 - protein, 9 aa, Homo Sapiens
MFGDAGGAP

SEQ ID NO: 61318 - protein, 9 aa, Homo Sapiens
ARMDITLAK

SEQ ID NO: 61319 - protein, 9 aa, Homo Sapiens
TLLMTRGPF

SEQ ID NO: 61320 - protein, 9 aa, Homo Sapiens
ARPATGTAC

SEQ ID NO: 61321 - protein, 9 aa, Homo Sapiens
KNLMNAAVL

SEQ ID NO: 61322 - protein, 9 aa, Homo Sapiens
DMVQNQLVV

SEQ ID NO: 61323 - protein, 9 aa, Homo Sapiens
RARSPDHQD

SEQ ID NO: 61324 - protein, 9 aa, Homo Sapiens
MDITLAKTL

SEQ ID NO: 61325 - protein, 9 aa, Homo Sapiens
ILISVSFVA

SEQ ID NO: 61326 - protein, 9 aa, Homo Sapiens
RASRTLYPL

SEQ ID NO: 61327 - protein, 9 aa, Homo Sapiens
SSSATTSFS

SEQ ID NO: 61328 - protein, 9 aa, Homo Sapiens
GFRAALPSQ

SEQ ID NO: 61329 - protein, 9 aa, Homo Sapiens
PLPRARSPD

SEQ ID NO: 61330 - protein, 9 aa, Homo Sapiens
RLASRGTLP

SEQ ID NO: 61331 - protein, 9 aa, Homo Sapiens
PFSKMFIGG

SEQ ID NO: 61332 - protein, 9 aa, Homo Sapiens
AGGAPRKRK

SEQ ID NO: 61333 - protein, 9 aa, Homo Sapiens
NYTVLNVAL

SEQ ID NO: 61334 - protein, 9 aa, Homo Sapiens
TVEGETVQG

SEQ ID NO: 61335 - protein, 9 aa, Homo Sapiens
DHQDVSRVI

SEQ ID NO: 61336 - protein, 9 aa, Homo Sapiens
AAPTMLHSS

SEQ ID NO: 61337 - protein, 9 aa, Homo Sapiens
SKYKVTVEE

SEQ ID NO: 61338 - protein, 9 aa, Homo Sapiens
DMKMRSVSP

SEQ ID NO: 61339 - protein, 9 aa, Homo Sapiens
NEDDIEISK

SEQ ID NO: 61340 - protein, 9 aa, Homo Sapiens
DGVTPPAST

SEQ ID NO: 61341 - protein, 9 aa, Homo Sapiens
SYWNRLQFL

SEQ ID NO: 61342 - protein, 9 aa, Homo Sapiens
GGYPNYKDR

SEQ ID NO: 61343 - protein, 9 aa, Homo Sapiens
EETAKKNKQ

SEQ ID NO: 61344 - protein, 9 aa, Homo Sapiens
FSAVFEHCS

SEQ ID NO: 61345 - protein, 9 aa, Homo Sapiens
FHKSKRQQQ

SEQ ID NO: 61346 - protein, 9 aa, Homo Sapiens
YKVTVEEVQ

SEQ ID NO: 61347 - protein, 9 aa, Homo Sapiens
HQDVSRVIR

SEQ ID NO: 61348 - protein, 9 aa, Homo Sapiens
TSVDDNPFG

SEQ ID NO: 61349 - protein, 9 aa, Homo Sapiens
GILRRRGQQ

SEQ ID NO: 61350 - protein, 9 aa, Homo Sapiens
RDIPGRPVP

SEQ ID NO: 61351 - protein, 9 aa, Homo Sapiens
GKARQVRFE

SEQ ID NO: 61352 - protein, 9 aa, Homo Sapiens
QVIAFFKVS

SEQ ID NO: 61353 - protein, 9 aa, Homo Sapiens
LSPPVMNPI

SEQ ID NO: 61354 - protein, 9 aa, Homo Sapiens
FGGGGKARQ

SEQ ID NO: 61355 - protein, 9 aa, Homo Sapiens
AAKNLMNAA

SEQ ID NO: 61356 - protein, 9 aa, Homo Sapiens
GFSAVFEHC

SEQ ID NO: 61357 - protein, 9 aa, Homo Sapiens
FLVVVLYVI

SEQ ID NO: 61358 - protein, 9 aa, Homo Sapiens
ARPDISATR

SEQ ID NO: 61359 - protein, 9 aa, Homo Sapiens
QLYPGWSTR

SEQ ID NO: 61360 - protein, 9 aa, Homo Sapiens
DIEISKKIK

SEQ ID NO: 61361 - protein, 9 aa, Homo Sapiens
VVVLYVIIG

SEQ ID NO: 61362 - protein, 9 aa, Homo Sapiens
PRLASRGTL

SEQ ID NO: 61363 - protein, 9 aa, Homo Sapiens
FFVIFNLCL

SEQ ID NO: 61364 - protein, 9 aa, Homo Sapiens
KLYKLLEQA

SEQ ID NO: 61365 - protein, 9 aa, Homo Sapiens
RIAPCPFQD

SEQ ID NO: 61366 - protein, 9 aa, Homo Sapiens
MQLYPGWST

SEQ ID NO: 61367 - protein, 9 aa, Homo Sapiens
KLFEAPNLF

SEQ ID NO: 61368 - protein, 9 aa, Homo Sapiens
RIFQQVEQS

SEQ ID NO: 61369 - protein, 9 aa, Homo Sapiens
VGFFFFVIF

SEQ ID NO: 61370 - protein, 9 aa, Homo Sapiens
RRLLNSLQC

SEQ ID NO: 61371 - protein, 9 aa, Homo Sapiens
GLLLGVTRH

SEQ ID NO: 61372 - protein, 9 aa, Homo Sapiens
VIAFFKVSI

SEQ ID NO: 61373 - protein, 9 aa, Homo Sapiens
GNPDLIQHQ

SEQ ID NO: 61374 - protein, 9 aa, Homo Sapiens
PSTSSSSAT

SEQ ID NO: 61375 - protein, 9 aa, Homo Sapiens
EAAWVLTNI

SEQ ID NO: 61376 - protein, 9 aa, Homo Sapiens
FAKRVDRII

SEQ ID NO: 61377 - protein, 9 aa, Homo Sapiens
SWRPGHRGP

SEQ ID NO: 61378 - protein, 9 aa, Homo Sapiens
EKVAMKRIN

SEQ ID NO: 61379 - protein, 9 aa, Homo Sapiens
LLQGQVPEY

SEQ ID NO: 61380 - protein, 9 aa, Homo Sapiens
AKRVDRIIL

SEQ ID NO: 61381 - protein, 9 aa, Homo Sapiens
CPLPGPTTV

SEQ ID NO: 61382 - protein, 9 aa, Homo Sapiens
DMDADEVFG

SEQ ID NO: 61383 - protein, 9 aa, Homo Sapiens
ESDARSEFP

SEQ ID NO: 61384 - protein, 9 aa, Homo Sapiens
KNEDDIEIS

SEQ ID NO: 61385 - protein, 9 aa, Homo Sapiens
TPPASTAAP

SEQ ID NO: 61386 - protein, 9 aa, Homo Sapiens
FNKKGSAMF

SEQ ID NO: 61387 - protein, 9 aa, Homo Sapiens
RPDISATRW

SEQ ID NO: 61388 - protein, 9 aa, Homo Sapiens
QSLQLIMGG

SEQ ID NO: 61389 - protein, 9 aa, Homo Sapiens
KKGSAMFHE

SEQ ID NO: 61390 - protein, 9 aa, Homo Sapiens
KEGPLPRAR

SEQ ID NO: 61391 - protein, 9 aa, Homo Sapiens
EISQERDEP

SEQ ID NO: 61392 - protein, 9 aa, Homo Sapiens
LGSELLRDV

SEQ ID NO: 61393 - protein, 9 aa, Homo Sapiens
GADLHCRVA

SEQ ID NO: 61394 - protein, 9 aa, Homo Sapiens
CLNCEQPRG

SEQ ID NO: 61395 - protein, 9 aa, Homo Sapiens
ASSQSRSLD

SEQ ID NO: 61396 - protein, 9 aa, Homo Sapiens
GVGLSIVYG

SEQ ID NO: 61397 - protein, 9 aa, Homo Sapiens
EYVRDLPLL

SEQ ID NO: 61398 - protein, 9 aa, Homo Sapiens
TTVEGETVQ

SEQ ID NO: 61399 - protein, 9 aa, Homo Sapiens
LLLGVTRHL

SEQ ID NO: 61400 - protein, 9 aa, Homo Sapiens
QTQVKGLLL

SEQ ID NO: 61401 - protein, 9 aa, Homo Sapiens
LYPGWSTRD

SEQ ID NO: 61402 - protein, 9 aa, Homo Sapiens
LFEAPNLFQ

SEQ ID NO: 61403 - protein, 9 aa, Homo Sapiens
ERASRTLYP

SEQ ID NO: 61404 - protein, 9 aa, Homo Sapiens
GPLPRARSP

SEQ ID NO: 61405 - protein, 9 aa, Homo Sapiens
PLPPTLLPS

SEQ ID NO: 61406 - protein, 9 aa, Homo Sapiens
TRDNYGKKK

SEQ ID NO: 61407 - protein, 9 aa, Homo Sapiens
HDRPWRRGC

SEQ ID NO: 61408 - protein, 9 aa, Homo Sapiens
LGGYPNYKD

SEQ ID NO: 61409 - protein, 9 aa, Homo Sapiens
SPFSKMFIG

SEQ ID NO: 61410 - protein, 9 aa, Homo Sapiens
FGKLCPHHV

SEQ ID NO: 61411 - protein, 9 aa, Homo Sapiens
LHSSAAEQV

SEQ ID NO: 61412 - protein, 9 aa, Homo Sapiens
SVNFGFSAV

SEQ ID NO: 61413 - protein, 9 aa, Homo Sapiens
KSYWNRLQF

SEQ ID NO: 61414 - protein, 9 aa, Homo Sapiens
SLQFEAAWV

SEQ ID NO: 61415 - protein, 9 aa, Homo Sapiens
MDADEVFGF

SEQ ID NO: 61416 - protein, 9 aa, Homo Sapiens
ILYNDDERL

SEQ ID NO: 61417 - protein, 9 aa, Homo Sapiens
SRIFQQVEQ

SEQ ID NO: 61418 - protein, 9 aa, Homo Sapiens
RVARGDSGP

SEQ ID NO: 61419 - protein, 9 aa, Homo Sapiens
CRSEGNPKP

SEQ ID NO: 61420 - protein, 9 aa, Homo Sapiens
PFHKSKRQQ

SEQ ID NO: 61421 - protein, 9 aa, Homo Sapiens
LNCEQPRGR

SEQ ID NO: 61422 - protein, 9 aa, Homo Sapiens
QARMDITLA

SEQ ID NO: 61423 - protein, 9 aa, Homo Sapiens
LCPHHVACK

SEQ ID NO: 61424 - protein, 9 aa, Homo Sapiens
LPEEARPAT

SEQ ID NO: 61425 - protein, 9 aa, Homo Sapiens
VPLDYQEKL

SEQ ID NO: 61426 - protein, 9 aa, Homo Sapiens
VLYVIIGAT

SEQ ID NO: 61427 - protein, 9 aa, Homo Sapiens
IILYNDDER

SEQ ID NO: 61428 - protein, 9 aa, Homo Sapiens
NEGVERCCE

SEQ ID NO: 61429 - protein, 9 aa, Homo Sapiens
CPHHVACKR

SEQ ID NO: 61430 - protein, 9 aa, Homo Sapiens
IMANIYLLS

SEQ ID NO: 61431 - protein, 9 aa, Homo Sapiens
NPDLIQHQI

SEQ ID NO: 61432 - protein, 9 aa, Homo Sapiens
GFGKLCPHH

SEQ ID NO: 61433 - protein, 9 aa, Homo Sapiens
KVAMKRINL

SEQ ID NO: 61434 - protein, 9 aa, Homo Sapiens
KAGLLVELV

SEQ ID NO: 61435 - protein, 9 aa, Homo Sapiens
VPIFHEGIK

SEQ ID NO: 61436 - protein, 9 aa, Homo Sapiens
SVVCVNWSN

SEQ ID NO: 61437 - protein, 9 aa, Homo Sapiens
AVAWARGRR

SEQ ID NO: 61438 - protein, 9 aa, Homo Sapiens
RAALPSQSI

SEQ ID NO: 61439 - protein, 9 aa, Homo Sapiens
FQDCKAGLL

SEQ ID NO: 61440 - protein, 9 aa, Homo Sapiens
STSSSSATT

SEQ ID NO: 61441 - protein, 9 aa, Homo Sapiens
LPKHKANTY

SEQ ID NO: 61442 - protein, 9 aa, Homo Sapiens
GDGVTPPAS

SEQ ID NO: 61443 - protein, 9 aa, Homo Sapiens
TGNYTVLNV

SEQ ID NO: 61444 - protein, 9 aa, Homo Sapiens
IKAHEDKVL

SEQ ID NO: 61445 - protein, 9 aa, Homo Sapiens
CFLLHMILH

SEQ ID NO: 61446 - protein, 9 aa, Homo Sapiens
NPEAFGLLI

SEQ ID NO: 61447 - protein, 9 aa, Homo Sapiens
SVSPTMKVP

SEQ ID NO: 61448 - protein, 9 aa, Homo Sapiens
AHEDKVLCC

SEQ ID NO: 61449 - protein, 9 aa, Homo Sapiens
HITYMIVCK

SEQ ID NO: 61450 - protein, 9 aa, Homo Sapiens
FKQIHGDMV

SEQ ID NO: 61451 - protein, 9 aa, Homo Sapiens
EQEQSSKCL

SEQ ID NO: 61452 - protein, 9 aa, Homo Sapiens
MFSPFSKMF

SEQ ID NO: 61453 - protein, 9 aa, Homo Sapiens
SVRREANQA

SEQ ID NO: 61454 - protein, 9 aa, Homo Sapiens
WRPGHRGPS

SEQ ID NO: 61455 - protein, 9 aa, Homo Sapiens
ESVPLDYQE

SEQ ID NO: 61456 - protein, 9 aa, Homo Sapiens
RPLRHQTWA

SEQ ID NO: 61457 - protein, 9 aa, Homo Sapiens
FQQVEQSRS

SEQ ID NO: 61458 - protein, 9 aa, Homo Sapiens
RGQQAAFMG

SEQ ID NO: 61459 - protein, 9 aa, Homo Sapiens
FETALTNIT

SEQ ID NO: 61460 - protein, 9 aa, Homo Sapiens
DLISVRREA

SEQ ID NO: 61461 - protein, 9 aa, Homo Sapiens
SFPSSPVNS

SEQ ID NO: 61462 - protein, 9 aa, Homo Sapiens
IFQQVEQSR

SEQ ID NO: 61463 - protein, 9 aa, Homo Sapiens
SRVIRPLRH

SEQ ID NO: 61464 - protein, 9 aa, Homo Sapiens
SPFHKSKRQ

SEQ ID NO: 61465 - protein, 9 aa, Homo Sapiens
ITYMIVCKL

SEQ ID NO: 61466 - protein, 9 aa, Homo Sapiens
PASTAAPAP

SEQ ID NO: 61467 - protein, 9 aa, Homo Sapiens
VFEHCSEVT

SEQ ID NO: 61468 - protein, 9 aa, Homo Sapiens
DAGGAPRKR

SEQ ID NO: 61469 - protein, 9 aa, Homo Sapiens
MSIMDHRPT

SEQ ID NO: 61470 - protein, 9 aa, Homo Sapiens
LYKLLEQAS

SEQ ID NO: 61471 - protein, 9 aa, Homo Sapiens
ETAKKNKQQ

SEQ ID NO: 61472 - protein, 9 aa, Homo Sapiens
VINTLCSKK

SEQ ID NO: 61473 - protein, 9 aa, Homo Sapiens
LVVVLYVII

SEQ ID NO: 61474 - protein, 9 aa, Homo Sapiens
CEEKKKNRW

SEQ ID NO: 61475 - protein, 9 aa, Homo Sapiens
PGGADLHCR

SEQ ID NO: 61476 - protein, 9 aa, Homo Sapiens
GVPIFHEGI

SEQ ID NO: 61477 - protein, 9 aa, Homo Sapiens
ISVRREANQ

SEQ ID NO: 61478 - protein, 9 aa, Homo Sapiens
LLMTRGPFR

SEQ ID NO: 61479 - protein, 9 aa, Homo Sapiens
TAKKNKQQQ

SEQ ID NO: 61480 - protein, 9 aa, Homo Sapiens
GSDHTGVGL

SEQ ID NO: 61481 - protein, 9 aa, Homo Sapiens
GHDRPWRRG

SEQ ID NO: 61482 - protein, 9 aa, Homo Sapiens
MADASMARL

SEQ ID NO: 61483 - protein, 9 aa, Homo Sapiens
PFNKKGSAM

SEQ ID NO: 61484 - protein, 9 aa, Homo Sapiens
EMEKLYKLL

SEQ ID NO: 61485 - protein, 9 aa, Homo Sapiens
QERDEPARE

SEQ ID NO: 61486 - protein, 9 aa, Homo Sapiens
DFAMPYSSR

SEQ ID NO: 61487 - protein, 9 aa, Homo Sapiens
VARGDSGPQ

SEQ ID NO: 61488 - protein, 9 aa, Homo Sapiens
ENPSTKVDY

SEQ ID NO: 61489 - protein, 9 aa, Homo Sapiens
SPDHQDVSR

SEQ ID NO: 61490 - protein, 9 aa, Homo Sapiens
SELLRDVAI

SEQ ID NO: 61491 - protein, 9 aa, Homo Sapiens
FLPKHKANT

SEQ ID NO: 61492 - protein, 9 aa, Homo Sapiens
HLVNTHTRV

SEQ ID NO: 61493 - protein, 9 aa, Homo Sapiens
VRDLPLLQG

SEQ ID NO: 61494 - protein, 9 aa, Homo Sapiens
NRLQFLDTC

SEQ ID NO: 61495 - protein, 9 aa, Homo Sapiens
HLVCLHPEL

SEQ ID NO: 61496 - protein, 9 aa, Homo Sapiens
RGNKWLNCT

SEQ ID NO: 61497 - protein, 9 aa, Homo Sapiens
PGPAVAWAR

SEQ ID NO: 61498 - protein, 9 aa, Homo Sapiens
ISQERDEPA

SEQ ID NO: 61499 - protein, 9 aa, Homo Sapiens
QLYKNEDDI

SEQ ID NO: 61500 - protein, 9 aa, Homo Sapiens
GTGNYTVLN

SEQ ID NO: 61501 - protein, 9 aa, Homo Sapiens
AKTTSTCEE

SEQ ID NO: 61502 - protein, 9 aa, Homo Sapiens
RRGCQGRKE

SEQ ID NO: 61503 - protein, 9 aa, Homo Sapiens
VVITLLMTR

SEQ ID NO: 61504 - protein, 9 aa, Homo Sapiens
FQDSLYSDP

SEQ ID NO: 61505 - protein, 9 aa, Homo Sapiens
PSTKVDYYK

SEQ ID NO: 61506 - protein, 9 aa, Homo Sapiens
PKSPFHKSK

SEQ ID NO: 61507 - protein, 9 aa, Homo Sapiens
LLDTLINEG

SEQ ID NO: 61508 - protein, 9 aa, Homo Sapiens
AVLEWFAKR

SEQ ID NO: 61509 - protein, 9 aa, Homo Sapiens
VGLSIVYGV

SEQ ID NO: 61510 - protein, 9 aa, Homo Sapiens
QQDPKSPFH

SEQ ID NO: 61511 - protein, 9 aa, Homo Sapiens
LQTQVKGLL

SEQ ID NO: 61512 - protein, 9 aa, Homo Sapiens
VIRPLRHQT

SEQ ID NO: 61513 - protein, 9 aa, Homo Sapiens
DVSRVIRPL

SEQ ID NO: 61514 - protein, 9 aa, Homo Sapiens
PTLLPSSEP

SEQ ID NO: 61515 - protein, 9 aa, Homo Sapiens
TNITIPQEK

SEQ ID NO: 61516 - protein, 9 aa, Homo Sapiens
QDHKRLLQG

SEQ ID NO: 61517 - protein, 9 aa, Homo Sapiens
DEMEKLYKL

SEQ ID NO: 61518 - protein, 9 aa, Homo Sapiens
EQSSKCLSY

SEQ ID NO: 61519 - protein, 9 aa, Homo Sapiens
GGPGPAVAW

SEQ ID NO: 61520 - protein, 9 aa, Homo Sapiens
PRARSPDHQ

SEQ ID NO: 61521 - protein, 9 aa, Homo Sapiens
ITLTQSLQL

SEQ ID NO: 61522 - protein, 9 aa, Homo Sapiens
FGDAGGAPR

SEQ ID NO: 61523 - protein, 9 aa, Homo Sapiens
QDKEISQER

SEQ ID NO: 61524 - protein, 9 aa, Homo Sapiens
ADTKNVALE

SEQ ID NO: 61525 - protein, 9 aa, Homo Sapiens
PLDYQEKLP

SEQ ID NO: 61526 - protein, 9 aa, Homo Sapiens
PVSLPLPPT

SEQ ID NO: 61527 - protein, 9 aa, Homo Sapiens
GFFFFVIFN

SEQ ID NO: 61528 - protein, 9 aa, Homo Sapiens
PRERSSRPK

SEQ ID NO: 61529 - protein, 9 aa, Homo Sapiens
GLLILISVS

SEQ ID NO: 61530 - protein, 9 aa, Homo Sapiens
SEFPQPAPD

SEQ ID NO: 61531 - protein, 9 aa, Homo Sapiens
VSLPLPPTL

SEQ ID NO: 61532 - protein, 9 aa, Homo Sapiens
LPLPPTLLP

SEQ ID NO: 61533 - protein, 9 aa, Homo Sapiens
APHPRLASR

SEQ ID NO: 61534 - protein, 9 aa, Homo Sapiens
FRAALPSQS

SEQ ID NO: 61535 - protein, 9 aa, Homo Sapiens
AKKNKQQQL

SEQ ID NO: 61536 - protein, 9 aa, Homo Sapiens
PDHQDVSRV

SEQ ID NO: 61537 - protein, 9 aa, Homo Sapiens
IKYWSCCRR

SEQ ID NO: 61538 - protein, 9 aa, Homo Sapiens
QGRKEGPLP

SEQ ID NO: 61539 - protein, 9 aa, Homo Sapiens
MLHSSAAEQ

SEQ ID NO: 61540 - protein, 9 aa, Homo Sapiens
NPSTKVDYY

SEQ ID NO: 61541 - protein, 9 aa, Homo Sapiens
TKGTGNYTV

SEQ ID NO: 61542 - protein, 9 aa, Homo Sapiens
DHKRLLQGD

SEQ ID NO: 61543 - protein, 9 aa, Homo Sapiens
NDDERLASQ

SEQ ID NO: 61544 - protein, 9 aa, Homo Sapiens
PAVAWARGR

SEQ ID NO: 61545 - protein, 9 aa, Homo Sapiens
LILISVSFV

SEQ ID NO: 61546 - protein, 9 aa, Homo Sapiens
KVTVEEVQR

SEQ ID NO: 61547 - protein, 9 aa, Homo Sapiens
TNTATIPPI

SEQ ID NO: 61548 - protein, 9 aa, Homo Sapiens
WARGRRLPP

SEQ ID NO: 61549 - protein, 9 aa, Homo Sapiens
EDKVLCCAF

SEQ ID NO: 61550 - protein, 9 aa, Homo Sapiens
MNAAVLTVK

SEQ ID NO: 61551 - protein, 9 aa, Homo Sapiens
DARSEFPQP

SEQ ID NO: 61552 - protein, 9 aa, Homo Sapiens
QRGRTLENL

SEQ ID NO: 61553 - protein, 9 aa, Homo Sapiens
NDMKMRSVS

SEQ ID NO: 61554 - protein, 9 aa, Homo Sapiens
VYFTCRSEG

SEQ ID NO: 61555 - protein, 9 aa, Homo Sapiens
PLLRDIPGR

SEQ ID NO: 61556 - protein, 9 aa, Homo Sapiens
YKNEDDIEI

SEQ ID NO: 61557 - protein, 9 aa, Homo Sapiens
STCEEKKKN

SEQ ID NO: 61558 - protein, 9 aa, Homo Sapiens
RERSSRPKN

SEQ ID NO: 61559 - protein, 9 aa, Homo Sapiens
ASRGTLPVD

SEQ ID NO: 61560 - protein, 9 aa, Homo Sapiens
KSSVINTLC

SEQ ID NO: 61561 - protein, 9 aa, Homo Sapiens
MFHEIKMLR

SEQ ID NO: 61562 - protein, 9 aa, Homo Sapiens
FLRGHDRPW

SEQ ID NO: 61563 - protein, 9 aa, Homo Sapiens
TALTNITIP

SEQ ID NO: 61564 - protein, 9 aa, Homo Sapiens
QVKGLLLGV

SEQ ID NO: 61565 - protein, 9 aa, Homo Sapiens
RPPGQDTSV

SEQ ID NO: 61566 - protein, 9 aa, Homo Sapiens
NQRGRTLEN

SEQ ID NO: 61567 - protein, 9 aa, Homo Sapiens
VSPGGADLH

SEQ ID NO: 61568 - protein, 9 aa, Homo Sapiens
IIILYNDDE

SEQ ID NO: 61569 - protein, 9 aa, Homo Sapiens
ARSPDHQDV

SEQ ID NO: 61570 - protein, 9 aa, Homo Sapiens
SVPLDYQEK

SEQ ID NO: 61571 - protein, 9 aa, Homo Sapiens
IFLVVVLYV

SEQ ID NO: 61572 - protein, 9 aa, Homo Sapiens
QGNPDLIQH

SEQ ID NO: 61573 - protein, 9 aa, Homo Sapiens
HPELDRAPE

SEQ ID NO: 61574 - protein, 9 aa, Homo Sapiens
LMFGDAGGA

SEQ ID NO: 61575 - protein, 9 aa, Homo Sapiens
KAHEDKVLC

SEQ ID NO: 61576 - protein, 9 aa, Homo Sapiens
REIYHITYM

SEQ ID NO: 61577 - protein, 9 aa, Homo Sapiens
LASRGTLPV

SEQ ID NO: 61578 - protein, 9 aa, Homo Sapiens
HTGVGLSIV

SEQ ID NO: 61579 - protein, 9 aa, Homo Sapiens
PTTVEGETV

SEQ ID NO: 61580 - protein, 9 aa, Homo Sapiens
SRTLYPLNF

SEQ ID NO: 61581 - protein, 9 aa, Homo Sapiens
APKKEKVAM

SEQ ID NO: 61582 - protein, 9 aa, Homo Sapiens
SQERDEPAR

SEQ ID NO: 61583 - protein, 9 aa, Homo Sapiens
NIYLLSPPV

SEQ ID NO: 61584 - protein, 9 aa, Homo Sapiens
WNRLQFLDT

SEQ ID NO: 61585 - protein, 9 aa, Homo Sapiens
RSPDHQDVS

SEQ ID NO: 61586 - protein, 9 aa, Homo Sapiens
GLFLRGHDR

SEQ ID NO: 61587 - protein, 9 aa, Homo Sapiens
ILDFETALT

SEQ ID NO: 61588 - protein, 9 aa, Homo Sapiens
AYHLVCLHP

SEQ ID NO: 61589 - protein, 9 aa, Homo Sapiens
VVCVNWSNT

SEQ ID NO: 61590 - protein, 9 aa, Homo Sapiens
GPGPAVAWA

SEQ ID NO: 61591 - protein, 9 aa, Homo Sapiens
DKVLCCAFS

SEQ ID NO: 61592 - protein, 9 aa, Homo Sapiens
LVNTHTRVS

SEQ ID NO: 61593 - protein, 9 aa, Homo Sapiens
EEARPATGT

SEQ ID NO: 61594 - protein, 9 aa, Homo Sapiens
TLTQSLQLI

SEQ ID NO: 61595 - protein, 9 aa, Homo Sapiens
ITLLMTRGP

SEQ ID NO: 61596 - protein, 9 aa, Homo Sapiens
NVSPGGADL

SEQ ID NO: 61597 - protein, 9 aa, Homo Sapiens
MANIYLLSP

SEQ ID NO: 61598 - protein, 9 aa, Homo Sapiens
VRPKLLLLK

SEQ ID NO: 61599 - protein, 9 aa, Homo Sapiens
PAAPTMLHS

SEQ ID NO: 61600 - protein, 9 aa, Homo Sapiens
RPTTGVVTV

SEQ ID NO: 61601 - protein, 9 aa, Homo Sapiens
DHRPTTGVV

SEQ ID NO: 61602 - protein, 9 aa, Homo Sapiens
KNKQQQLQK

SEQ ID NO: 61603 - protein, 9 aa, Homo Sapiens
YNDDERLAS

SEQ ID NO: 61604 - protein, 9 aa, Homo Sapiens
LRRRGQQAA

SEQ ID NO: 61605 - protein, 9 aa, Homo Sapiens
SSRPKNGLE

SEQ ID NO: 61606 - protein, 9 aa, Homo Sapiens
GDAGGAPRK

SEQ ID NO: 61607 - protein, 9 aa, Homo Sapiens
GLSIVYGVK

SEQ ID NO: 61608 - protein, 9 aa, Homo Sapiens
DTLINEGVE

SEQ ID NO: 61609 - protein, 9 aa, Homo Sapiens
YPNYKDRRG

SEQ ID NO: 61610 - protein, 9 aa, Homo Sapiens
ITLAKTLVL

SEQ ID NO: 61611 - protein, 9 aa, Homo Sapiens
SRSLDDQRA

SEQ ID NO: 61612 - protein, 9 aa, Homo Sapiens
GCQGRKEGP

SEQ ID NO: 61613 - protein, 9 aa, Homo Sapiens
IFQDCKAGL

SEQ ID NO: 61614 - protein, 9 aa, Homo Sapiens
FQQVIAFFK

SEQ ID NO: 61615 - protein, 9 aa, Homo Sapiens
TARKRAVAR

SEQ ID NO: 61616 - protein, 9 aa, Homo Sapiens
MKMRSVSPT

SEQ ID NO: 61617 - protein, 9 aa, Homo Sapiens
SKLFEAPNL

SEQ ID NO: 61618 - protein, 9 aa, Homo Sapiens
VPQRAPLGE

SEQ ID NO: 61619 - protein, 9 aa, Homo Sapiens
ACSWRPGHR

SEQ ID NO: 61620 - protein, 9 aa, Homo Sapiens
LQFLDTCEF

SEQ ID NO: 61621 - protein, 9 aa, Homo Sapiens
TREDGSRIF

SEQ ID NO: 61622 - protein, 9 aa, Homo Sapiens
SVINTLCSK

SEQ ID NO: 61623 - protein, 9 aa, Homo Sapiens
ETKGTGNYT

SEQ ID NO: 61624 - protein, 9 aa, Homo Sapiens
LLDLGGYPN

SEQ ID NO: 61625 - protein, 9 aa, Homo Sapiens
GAPGLFLRG

SEQ ID NO: 61626 - protein, 9 aa, Homo Sapiens
SLREIYHIT

SEQ ID NO: 61627 - protein, 9 aa, Homo Sapiens
TLLPSSEPP

SEQ ID NO: 61628 - protein, 9 aa, Homo Sapiens
PQRAPLGER

SEQ ID NO: 61629 - protein, 9 aa, Homo Sapiens
LMTRGPFRK

SEQ ID NO: 61630 - protein, 9 aa, Homo Sapiens
FGFSAVFEH

SEQ ID NO: 61631 - protein, 9 aa, Homo Sapiens
FLLHMILHS

SEQ ID NO: 61632 - protein, 9 aa, Homo Sapiens
EARPATGTA

SEQ ID NO: 61633 - protein, 9 aa, Homo Sapiens
MVQNQLVVQ

SEQ ID NO: 61634 - protein, 9 aa, Homo Sapiens
LRRLLNSLQ

SEQ ID NO: 61635 - protein, 9 aa, Homo Sapiens
HAPRERSSR

SEQ ID NO: 61636 - protein, 9 aa, Homo Sapiens
CLSYQGQSR

SEQ ID NO: 61637 - protein, 9 aa, Homo Sapiens
SLPLPPTLL

SEQ ID NO: 61638 - protein, 9 aa, Homo Sapiens
ALLDLGGYP

SEQ ID NO: 61639 - protein, 9 aa, Homo Sapiens
PGQDTSVDD

SEQ ID NO: 61640 - protein, 9 aa, Homo Sapiens
HCRVARGDS

SEQ ID NO: 61641 - protein, 9 aa, Homo Sapiens
SLSSSFPSS

SEQ ID NO: 61642 - protein, 9 aa, Homo Sapiens
GSELLRDVA

SEQ ID NO: 61643 - protein, 9 aa, Homo Sapiens
GKSYWNRLQ

SEQ ID NO: 61644 - protein, 9 aa, Homo Sapiens
TSTCEEKKK

SEQ ID NO: 61645 - protein, 9 aa, Homo Sapiens
INEGVERCC

SEQ ID NO: 61646 - protein, 9 aa, Homo Sapiens
SVVTARKRA

SEQ ID NO: 61647 - protein, 9 aa, Homo Sapiens
LLGFGGGGK

SEQ ID NO: 61648 - protein, 9 aa, Homo Sapiens
DITLAKTLV

SEQ ID NO: 61649 - protein, 9 aa, Homo Sapiens
GQDTSVDDN

SEQ ID NO: 61650 - protein, 9 aa, Homo Sapiens
LGERSFFCP

SEQ ID NO: 61651 - protein, 9 aa, Homo Sapiens
VAWARGRRL

SEQ ID NO: 61652 - protein, 9 aa, Homo Sapiens
ETALTNITI

SEQ ID NO: 61653 - protein, 9 aa, Homo Sapiens
KGFRAALPS

SEQ ID NO: 61654 - protein, 9 aa, Homo Sapiens
LLILISVSF

SEQ ID NO: 61655 - protein, 9 aa, Homo Sapiens
EGPLPRARS

SEQ ID NO: 61656 - protein, 9 aa, Homo Sapiens
LLNVSPGGA

SEQ ID NO: 61657 - protein, 9 aa, Homo Sapiens
KVDYYKLRY

SEQ ID NO: 61658 - protein, 9 aa, Homo Sapiens
PVVPQRAPL

SEQ ID NO: 61659 - protein, 9 aa, Homo Sapiens
ASTAAPAPP

SEQ ID NO: 61660 - protein, 9 aa, Homo Sapiens
GETKGTGNY

SEQ ID NO: 61661 - protein, 9 aa, Homo Sapiens
HPRLASRGT

SEQ ID NO: 61662 - protein, 9 aa, Homo Sapiens
FTDHLVNTH

SEQ ID NO: 61663 - protein, 9 aa, Homo Sapiens
LQGDGGPNT

SEQ ID NO: 61664 - protein, 9 aa, Homo Sapiens
SNTFLLNGQ

SEQ ID NO: 61665 - protein, 9 aa, Homo Sapiens
EWFAKRVDR

SEQ ID NO: 61666 - protein, 9 aa, Homo Sapiens
GKLCPHHVA

SEQ ID NO: 61667 - protein, 9 aa, Homo Sapiens
GFWCLNCEQ

SEQ ID NO: 61668 - protein, 9 aa, Homo Sapiens
DSGPQDGAP

SEQ ID NO: 61669 - protein, 9 aa, Homo Sapiens
RLLQGDGGP

SEQ ID NO: 61670 - protein, 9 aa, Homo Sapiens
LREIYHITY

SEQ ID NO: 61671 - protein, 9 aa, Homo Sapiens
KLLLLKILH

SEQ ID NO: 61672 - protein, 9 aa, Homo Sapiens
HEGIKYWSC

SEQ ID NO: 61673 - protein, 9 aa, Homo Sapiens
NKKGSAMFH

SEQ ID NO: 61674 - protein, 9 aa, Homo Sapiens
AWARGRRLP

SEQ ID NO: 61675 - protein, 9 aa, Homo Sapiens
HGKIIILYN

SEQ ID NO: 61676 - protein, 9 aa, Homo Sapiens
NLFQKYKHY

SEQ ID NO: 61677 - protein, 9 aa, Homo Sapiens
VMFSPFSKM

SEQ ID NO: 61678 - protein, 9 aa, Homo Sapiens
EQQDPKSPF

SEQ ID NO: 61679 - protein, 9 aa, Homo Sapiens
VCVNWSNTF

SEQ ID NO: 61680 - protein, 9 aa, Homo Sapiens
LFLRGHDRP

SEQ ID NO: 61681 - protein, 9 aa, Homo Sapiens
IYLLSPPVM

SEQ ID NO: 61682 - protein, 9 aa, Homo Sapiens
ARGDSGPQD

SEQ ID NO: 61683 - protein, 9 aa, Homo Sapiens
PLPGPTTVE

SEQ ID NO: 61684 - protein, 9 aa, Homo Sapiens
FVVGFFFFV

SEQ ID NO: 61685 - protein, 9 aa, Homo Sapiens
GWSTRDNYG

SEQ ID NO: 61686 - protein, 9 aa, Homo Sapiens
SIMDHRPTT

SEQ ID NO: 61687 - protein, 9 aa, Homo Sapiens
TCEEKKKNR

SEQ ID NO: 61688 - protein, 9 aa, Homo Sapiens
VGGLLEDAD

SEQ ID NO: 61689 - protein, 9 aa, Homo Sapiens
GGLLEDADT

SEQ ID NO: 61690 - protein, 9 aa, Homo Sapiens
CPFQDSLYS

SEQ ID NO: 61691 - protein, 9 aa, Homo Sapiens
LLRDIPGRP

SEQ ID NO: 61692 - protein, 9 aa, Homo Sapiens
LDFETALTN

SEQ ID NO: 61693 - protein, 9 aa, Homo Sapiens
LDYQEKLPF

SEQ ID NO: 61694 - protein, 9 aa, Homo Sapiens
QRAPLGERS

SEQ ID NO: 61695 - protein, 9 aa, Homo Sapiens
PPNQRGRTL

SEQ ID NO: 61696 - protein, 9 aa, Homo Sapiens
LLEQASLSP

SEQ ID NO: 61697 - protein, 9 aa, Homo Sapiens
VLEWFAKRV

SEQ ID NO: 61698 - protein, 9 aa, Homo Sapiens
FFFVIFNLC

SEQ ID NO: 61699 - protein, 9 aa, Homo Sapiens
RAPLGERSF

SEQ ID NO: 61700 - protein, 9 aa, Homo Sapiens
LMNAAVLTV

SEQ ID NO: 61701 - protein, 9 aa, Homo Sapiens
DLPLLQGQV

SEQ ID NO: 61702 - protein, 9 aa, Homo Sapiens
RSEFPQPAP

SEQ ID NO: 61703 - protein, 9 aa, Homo Sapiens
DGAPGLFLR

SEQ ID NO: 61704 - protein, 9 aa, Homo Sapiens
QEFTDHLVN

SEQ ID NO: 61705 - protein, 9 aa, Homo Sapiens
LRGHDRPWR

SEQ ID NO: 61706 - protein, 9 aa, Homo Sapiens
HRPTTGVVT

SEQ ID NO: 61707 - protein, 9 aa, Homo Sapiens
DLIQHQIVH

SEQ ID NO: 61708 - protein, 9 aa, Homo Sapiens
MSLGSELLR

SEQ ID NO: 61709 - protein, 9 aa, Homo Sapiens
INQVRPKLL

SEQ ID NO: 61710 - protein, 9 aa, Homo Sapiens
SSSFPSSPV

SEQ ID NO: 61711 - protein, 9 aa, Homo Sapiens
YHITYMIVC

SEQ ID NO: 61712 - protein, 9 aa, Homo Sapiens
ARQVELLLM

SEQ ID NO: 61713 - protein, 9 aa, Homo Sapiens
ADLHCRVAR

SEQ ID NO: 61714 - protein, 9 aa, Homo Sapiens
INDMKMRSV

SEQ ID NO: 61715 - protein, 9 aa, Homo Sapiens
NCEQPRGRR

SEQ ID NO: 61716 - protein, 9 aa, Homo Sapiens
TLAKTLVLI

SEQ ID NO: 61717 - protein, 9 aa, Homo Sapiens
TTPPNQRGR

SEQ ID NO: 61718 - protein, 9 aa, Homo Sapiens
RRRGQQAAF

SEQ ID NO: 61719 - protein, 9 aa, Homo Sapiens
GSAMFHEIK

SEQ ID NO: 61720 - protein, 9 aa, Homo Sapiens
PQDGAPGLF

SEQ ID NO: 61721 - protein, 9 aa, Homo Sapiens
PGHRGPSSG

SEQ ID NO: 61722 - protein, 9 aa, Homo Sapiens
TDHLVNTHT

SEQ ID NO: 61723 - protein, 9 aa, Homo Sapiens
FFFFVIFNL

SEQ ID NO: 61724 - protein, 9 aa, Homo Sapiens
TLINEGVER

SEQ ID NO: 61725 - protein, 9 aa, Homo Sapiens
VSPTMKVPV

SEQ ID NO: 61726 - protein, 9 aa, Homo Sapiens
RRGQQAAFM

SEQ ID NO: 61727 - protein, 9 aa, Homo Sapiens
FWCLNCEQP

SEQ ID NO: 61728 - protein, 9 aa, Homo Sapiens
APCPFQDSL

SEQ ID NO: 61729 - protein, 9 aa, Homo Sapiens
DDIEISKKI

SEQ ID NO: 61730 - protein, 9 aa, Homo Sapiens
EFVVGFFFF

SEQ ID NO: 61731 - protein, 9 aa, Homo Sapiens
ERSSRPKNG

SEQ ID NO: 61732 - protein, 9 aa, Homo Sapiens
DFETALTNI

SEQ ID NO: 61733 - protein, 9 aa, Homo Sapiens
WSNTFLLNG

SEQ ID NO: 61734 - protein, 9 aa, Homo Sapiens
SLQCKQDEY

SEQ ID NO: 61735 - protein, 9 aa, Homo Sapiens
QDGAPGLFL

SEQ ID NO: 61736 - protein, 9 aa, Homo Sapiens
KGSAMFHEI

SEQ ID NO: 61737 - protein, 9 aa, Homo Sapiens
LINEGVERC

SEQ ID NO: 61738 - protein, 9 aa, Homo Sapiens
EAFGLLILI

SEQ ID NO: 61739 - protein, 9 aa, Homo Sapiens
GRTLENLIP

SEQ ID NO: 61740 - protein, 9 aa, Homo Sapiens
KRAVARRAA

SEQ ID NO: 61741 - protein, 9 aa, Homo Sapiens
LHMILHSTG

SEQ ID NO: 61742 - protein, 9 aa, Homo Sapiens
VTTPPNQRG

SEQ ID NO: 61743 - protein, 9 aa, Homo Sapiens
SAMFHEIKM

SEQ ID NO: 61744 - protein, 9 aa, Homo Sapiens
PGPTTVEGE

SEQ ID NO: 61745 - protein, 9 aa, Homo Sapiens
TALLDLGGY

SEQ ID NO: 61746 - protein, 9 aa, Homo Sapiens
AAVLEWFAK

SEQ ID NO: 61747 - protein, 9 aa, Homo Sapiens
NDDMDADEV

SEQ ID NO: 61748 - protein, 9 aa, Homo Sapiens
PGWSTRDNY

SEQ ID NO: 61749 - protein, 9 aa, Homo Sapiens
LGFGGGGKA

SEQ ID NO: 61750 - protein, 9 aa, Homo Sapiens
SLRIAPCPF

SEQ ID NO: 61751 - protein, 9 aa, Homo Sapiens
TVYFTCRSE

SEQ ID NO: 61752 - protein, 9 aa, Homo Sapiens
EAPNLFQKY

SEQ ID NO: 61753 - protein, 9 aa, Homo Sapiens
GHRGPSSGG

SEQ ID NO: 61754 - protein, 9 aa, Homo Sapiens
RGRTLENLI

SEQ ID NO: 61755 - protein, 9 aa, Homo Sapiens
YPGWSTRDN

SEQ ID NO: 61756 - protein, 9 aa, Homo Sapiens
FPSSPVNSD

SEQ ID NO: 61757 - protein, 9 aa, Homo Sapiens
DIPGRPVPV

SEQ ID NO: 61758 - protein, 9 aa, Homo Sapiens
LHCRVARGD

SEQ ID NO: 61759 - protein, 9 aa, Homo Sapiens
GDMVQNQLV

SEQ ID NO: 61760 - protein, 9 aa, Homo Sapiens
AVLTVKASY

SEQ ID NO: 61761 - protein, 9 aa, Homo Sapiens
MLCFLLHMI

SEQ ID NO: 61762 - protein, 9 aa, Homo Sapiens
LRDVAIVFS

SEQ ID NO: 61763 - protein, 9 aa, Homo Sapiens
VEWENPSTK

SEQ ID NO: 61764 - protein, 9 aa, Homo Sapiens
QQAAFMGGV

SEQ ID NO: 61765 - protein, 9 aa, Homo Sapiens
PNQRGRTLE

SEQ ID NO: 61766 - protein, 9 aa, Homo Sapiens
GAPRKRKLS

SEQ ID NO: 61767 - protein, 9 aa, Homo Sapiens
SLDDQRASF

SEQ ID NO: 61768 - protein, 9 aa, Homo Sapiens
FSPFSKMFI

SEQ ID NO: 61769 - protein, 9 aa, Homo Sapiens
STRDNYGKK

SEQ ID NO: 61770 - protein, 9 aa, Homo Sapiens
VSRVIRPLR

SEQ ID NO: 61771 - protein, 9 aa, Homo Sapiens
PVLLALTNT

SEQ ID NO: 61772 - protein, 9 aa, Homo Sapiens
EEKKKNRWR

SEQ ID NO: 61773 - protein, 9 aa, Homo Sapiens
IRPLRHQTW

SEQ ID NO: 61774 - protein, 9 aa, Homo Sapiens
LLMADASMA

SEQ ID NO: 61775 - protein, 9 aa, Homo Sapiens
NTHTRVSVQ

SEQ ID NO: 61776 - protein, 9 aa, Homo Sapiens
TGILRRRGQ

SEQ ID NO: 61777 - protein, 9 aa, Homo Sapiens
VNFGFSAVF

SEQ ID NO: 61778 - protein, 9 aa, Homo Sapiens
QSRSLDDQR

SEQ ID NO: 61779 - protein, 9 aa, Homo Sapiens
RGFWCLNCE

SEQ ID NO: 61780 - protein, 9 aa, Homo Sapiens
GYPNYKDRR

SEQ ID NO: 61781 - protein, 9 aa, Homo Sapiens
DSNDDMDAD

SEQ ID NO: 61782 - protein, 9 aa, Homo Sapiens
AALPSQSII

SEQ ID NO: 61783 - protein, 9 aa, Homo Sapiens
QDTSVDDNP

SEQ ID NO: 61784 - protein, 9 aa, Homo Sapiens
ADEVFGFIS

SEQ ID NO: 61785 - protein, 9 aa, Homo Sapiens
MDHRPTTGV

SEQ ID NO: 61786 - protein, 9 aa, Homo Sapiens
LSSSFPSSP

SEQ ID NO: 61787 - protein, 9 aa, Homo Sapiens
CLHPELDRA

SEQ ID NO: 61788 - protein, 9 aa, Homo Sapiens
RKEGPLPRA

SEQ ID NO: 61789 - protein, 9 aa, Homo Sapiens
DPKSPFHKS

SEQ ID NO: 61790 - protein, 9 aa, Homo Sapiens
RGCQGRKEG

SEQ ID NO: 61791 - protein, 9 aa, Homo Sapiens
YVRDLPLLQ

SEQ ID NO: 61792 - protein, 9 aa, Homo Sapiens
TMLHSSAAE

SEQ ID NO: 61793 - protein, 9 aa, Homo Sapiens
FVVITLLMT

SEQ ID NO: 61794 - protein, 9 aa, Homo Sapiens
RDEPAREQS

SEQ ID NO: 61795 - protein, 9 aa, Homo Sapiens
CKAGLLVEL

SEQ ID NO: 61796 - protein, 9 aa, Homo Sapiens
GGAPRKRKL

SEQ ID NO: 61797 - protein, 9 aa, Homo Sapiens
RLQFLDTCE

SEQ ID NO: 61798 - protein, 9 aa, Homo Sapiens
EGIKYWSCC

SEQ ID NO: 61799 - protein, 9 aa, Homo Sapiens
WCLNCEQPR

SEQ ID NO: 61800 - protein, 9 aa, Homo Sapiens
KMRSVSPTM

SEQ ID NO: 61801 - protein, 9 aa, Homo Sapiens
NKQQQLQKL

SEQ ID NO: 61802 - protein, 9 aa, Homo Sapiens
RGDSGPQDG

SEQ ID NO: 61803 - protein, 9 aa, Homo Sapiens
LEWFAKRVD

SEQ ID NO: 61804 - protein, 9 aa, Homo Sapiens
NTFLLNGQL

SEQ ID NO: 61805 - protein, 9 aa, Homo Sapiens
AAVLTVKAS

SEQ ID NO: 61806 - protein, 9 aa, Homo Sapiens
SSVINTLCS

SEQ ID NO: 61807 - protein, 9 aa, Homo Sapiens
GNKWLNCTY

SEQ ID NO: 61808 - protein, 9 aa, Homo Sapiens
QVSDLISVR

SEQ ID NO: 61809 - protein, 9 aa, Homo Sapiens
GARPDISAT

SEQ ID NO: 61810 - protein, 9 aa, Homo Sapiens
LLHMILHST

SEQ ID NO: 61811 - protein, 9 aa, Homo Sapiens
DADTKNVAL

SEQ ID NO: 61812 - protein, 9 aa, Homo Sapiens
NSAVLRLAP

SEQ ID NO: 61813 - protein, 9 aa, Homo Sapiens
YGQHACFCK

SEQ ID NO: 61814 - protein, 9 aa, Homo Sapiens
EWGGCGNDV

SEQ ID NO: 61815 - protein, 9 aa, Homo Sapiens
SVYSAQGQD

SEQ ID NO: 61816 - protein, 9 aa, Homo Sapiens
VKLGALVLP

SEQ ID NO: 61817 - protein, 9 aa, Homo Sapiens
AMYKSLYQA

SEQ ID NO: 61818 - protein, 9 aa, Homo Sapiens
CSITSYRTH

SEQ ID NO: 61819 - protein, 9 aa, Homo Sapiens
CKKQGSGNN

SEQ ID NO: 61820 - protein, 9 aa, Homo Sapiens
SKPGPTRPV

SEQ ID NO: 61821 - protein, 9 aa, Homo Sapiens
DPLPCAVTF

SEQ ID NO: 61822 - protein, 9 aa, Homo Sapiens
FCKKQGSGN

SEQ ID NO: 61823 - protein, 9 aa, Homo Sapiens
NHREKDVVP

SEQ ID NO: 61824 - protein, 9 aa, Homo Sapiens
NGSLKVFKK

SEQ ID NO: 61825 - protein, 9 aa, Homo Sapiens
KWGDAGSEY

SEQ ID NO: 61826 - protein, 9 aa, Homo Sapiens
TNKKMKIEE

SEQ ID NO: 61827 - protein, 9 aa, Homo Sapiens
QGHSIVLLS

SEQ ID NO: 61828 - protein, 9 aa, Homo Sapiens
AMSEEIRQS

SEQ ID NO: 61829 - protein, 9 aa, Homo Sapiens
GVCSITSYR

SEQ ID NO: 61830 - protein, 9 aa, Homo Sapiens
AVPQVGGLL

SEQ ID NO: 61831 - protein, 9 aa, Homo Sapiens
FLQQKAESL

SEQ ID NO: 61832 - protein, 9 aa, Homo Sapiens
LTNKKMKIE

SEQ ID NO: 61833 - protein, 9 aa, Homo Sapiens
TDQPLSQTD

SEQ ID NO: 61834 - protein, 9 aa, Homo Sapiens
FALFYEYDC

SEQ ID NO: 61835 - protein, 9 aa, Homo Sapiens
APYVNYQFR

SEQ ID NO: 61836 - protein, 9 aa, Homo Sapiens
LYQAISRFE

SEQ ID NO: 61837 - protein, 9 aa, Homo Sapiens
MSEEIRQSK

SEQ ID NO: 61838 - protein, 9 aa, Homo Sapiens
AYSFFFFFF

SEQ ID NO: 61839 - protein, 9 aa, Homo Sapiens
LSPEQRALL

SEQ ID NO: 61840 - protein, 9 aa, Homo Sapiens
SDIIRKYIL

SEQ ID NO: 61841 - protein, 9 aa, Homo Sapiens
ELVHDLVDN

SEQ ID NO: 61842 - protein, 9 aa, Homo Sapiens
LTFSPPIYG

SEQ ID NO: 61843 - protein, 9 aa, Homo Sapiens
VYSAQGQDA

SEQ ID NO: 61844 - protein, 9 aa, Homo Sapiens
THMAASVVA

SEQ ID NO: 61845 - protein, 9 aa, Homo Sapiens
GSEYVVEST

SEQ ID NO: 61846 - protein, 9 aa, Homo Sapiens
PTETAQAQR

SEQ ID NO: 61847 - protein, 9 aa, Homo Sapiens
CHSKPGPTR

SEQ ID NO: 61848 - protein, 9 aa, Homo Sapiens
NLHTSVYSA

SEQ ID NO: 61849 - protein, 9 aa, Homo Sapiens
VFKKWDMGH

SEQ ID NO: 61850 - protein, 9 aa, Homo Sapiens
RPAMSEEIR

SEQ ID NO: 61851 - protein, 9 aa, Homo Sapiens
GDAGSEYVV

SEQ ID NO: 61852 - protein, 9 aa, Homo Sapiens
CGNDVDFGD

SEQ ID NO: 61853 - protein, 9 aa, Homo Sapiens
KKWDMGHCS

SEQ ID NO: 61854 - protein, 9 aa, Homo Sapiens
LGQGHSIVL

SEQ ID NO: 61855 - protein, 9 aa, Homo Sapiens
PTRPVPLKK

SEQ ID NO: 61856 - protein, 9 aa, Homo Sapiens
ESLTKDVQS

SEQ ID NO: 61857 - protein, 9 aa, Homo Sapiens
IVLLSELLR

SEQ ID NO: 61858 - protein, 9 aa, Homo Sapiens
DFDDIQKKH

SEQ ID NO: 61859 - protein, 9 aa, Homo Sapiens
WKNLTFSPP

SEQ ID NO: 61860 - protein, 9 aa, Homo Sapiens
ASETHMAAS

SEQ ID NO: 61861 - protein, 9 aa, Homo Sapiens
LPCAVTFSN

SEQ ID NO: 61862 - protein, 9 aa, Homo Sapiens
YPGVCSITS

SEQ ID NO: 61863 - protein, 9 aa, Homo Sapiens
CKFYTWLCG

SEQ ID NO: 61864 - protein, 9 aa, Homo Sapiens
PQRISRHLP

SEQ ID NO: 61865 - protein, 9 aa, Homo Sapiens
IKWGDAGSE

SEQ ID NO: 61866 - protein, 9 aa, Homo Sapiens
HHLSPEQRA

SEQ ID NO: 61867 - protein, 9 aa, Homo Sapiens
HQNKDLMEL

SEQ ID NO: 61868 - protein, 9 aa, Homo Sapiens
SEEIRQSKL

SEQ ID NO: 61869 - protein, 9 aa, Homo Sapiens
HSKPGPTRP

SEQ ID NO: 61870 - protein, 9 aa, Homo Sapiens
VCSITSYRT

SEQ ID NO: 61871 - protein, 9 aa, Homo Sapiens
GAAIFFELK

SEQ ID NO: 61872 - protein, 9 aa, Homo Sapiens
LVDNCVPGD

SEQ ID NO: 61873 - protein, 9 aa, Homo Sapiens
LAPYVNYQF

SEQ ID NO: 61874 - protein, 9 aa, Homo Sapiens
KFYTWLCGV

SEQ ID NO: 61875 - protein, 9 aa, Homo Sapiens
HMAASVVAS

SEQ ID NO: 61876 - protein, 9 aa, Homo Sapiens
TSVYSAQGQ

SEQ ID NO: 61877 - protein, 9 aa, Homo Sapiens
YLLSPTETA

SEQ ID NO: 61878 - protein, 9 aa, Homo Sapiens
WGDAGSEYV

SEQ ID NO: 61879 - protein, 9 aa, Homo Sapiens
NKTEAVPQV

SEQ ID NO: 61880 - protein, 9 aa, Homo Sapiens
KKQGSGNNW

SEQ ID NO: 61881 - protein, 9 aa, Homo Sapiens
LPGRAKEHH

SEQ ID NO: 61882 - protein, 9 aa, Homo Sapiens
TLTNKKMKI

SEQ ID NO: 61883 - protein, 9 aa, Homo Sapiens
VNSAVLRLA

SEQ ID NO: 61884 - protein, 9 aa, Homo Sapiens
KIKWGDAGS

SEQ ID NO: 61885 - protein, 9 aa, Homo Sapiens
FSNSNLKFG

SEQ ID NO: 61886 - protein, 9 aa, Homo Sapiens
TETAQAQRV

SEQ ID NO: 61887 - protein, 9 aa, Homo Sapiens
YKSLYQAIS

SEQ ID NO: 61888 - protein, 9 aa, Homo Sapiens
QQKAESLTK

SEQ ID NO: 61889 - protein, 9 aa, Homo Sapiens
EIRQSKLAA

SEQ ID NO: 61890 - protein, 9 aa, Homo Sapiens
PSHHLSPEQ

SEQ ID NO: 61891 - protein, 9 aa, Homo Sapiens
TSLLRAGVY

SEQ ID NO: 61892 - protein, 9 aa, Homo Sapiens
GCHSKPGPT

SEQ ID NO: 61893 - protein, 9 aa, Homo Sapiens
TGYPGVCSI

SEQ ID NO: 61894 - protein, 9 aa, Homo Sapiens
LIRNHREKD

SEQ ID NO: 61895 - protein, 9 aa, Homo Sapiens
TRPVPLKKR

SEQ ID NO: 61896 - protein, 9 aa, Homo Sapiens
AKYLSSKTA

SEQ ID NO: 61897 - protein, 9 aa, Homo Sapiens
KPGPTRPVP

SEQ ID NO: 61898 - protein, 9 aa, Homo Sapiens
VLRLAPYVN

SEQ ID NO: 61899 - protein, 9 aa, Homo Sapiens
KWDMGHCSA

SEQ ID NO: 61900 - protein, 9 aa, Homo Sapiens
LVLPLVLTL

SEQ ID NO: 61901 - protein, 9 aa, Homo Sapiens
QASEASETH

SEQ ID NO: 61902 - protein, 9 aa, Homo Sapiens
FFFFALFYE

SEQ ID NO: 61903 - protein, 9 aa, Homo Sapiens
VDNCVPGDT

SEQ ID NO: 61904 - protein, 9 aa, Homo Sapiens
YILKYSVFL

SEQ ID NO: 61905 - protein, 9 aa, Homo Sapiens
KYILKYSVF

SEQ ID NO: 61906 - protein, 9 aa, Homo Sapiens
EEIRQSKLA

SEQ ID NO: 61907 - protein, 9 aa, Homo Sapiens
FFFFFALFY

SEQ ID NO: 61908 - protein, 9 aa, Homo Sapiens
YSAQGQDAA

SEQ ID NO: 61909 - protein, 9 aa, Homo Sapiens
SETHMAASV

SEQ ID NO: 61910 - protein, 9 aa, Homo Sapiens
ENKTEAVPQ

SEQ ID NO: 61911 - protein, 9 aa, Homo Sapiens
ETAQAQRVI

SEQ ID NO: 61912 - protein, 9 aa, Homo Sapiens
TFSPPIYGA

SEQ ID NO: 61913 - protein, 9 aa, Homo Sapiens
VLLSELLRE

SEQ ID NO: 61914 - protein, 9 aa, Homo Sapiens
FFTFCFLPG

SEQ ID NO: 61915 - protein, 9 aa, Homo Sapiens
PGPTRPVPL

SEQ ID NO: 61916 - protein, 9 aa, Homo Sapiens
VLPLVLTLL

SEQ ID NO: 61917 - protein, 9 aa, Homo Sapiens
ERDLVNRLK

SEQ ID NO: 61918 - protein, 9 aa, Homo Sapiens
QKKHQNKDL

SEQ ID NO: 61919 - protein, 9 aa, Homo Sapiens
FYTWLCGVF

SEQ ID NO: 61920 - protein, 9 aa, Homo Sapiens
SPTETAQAQ

SEQ ID NO: 61921 - protein, 9 aa, Homo Sapiens
EQEFNKLTY

SEQ ID NO: 61922 - protein, 9 aa, Homo Sapiens
FFELKHYKP

SEQ ID NO: 61923 - protein, 9 aa, Homo Sapiens
LHTSVYSAQ

SEQ ID NO: 61924 - protein, 9 aa, Homo Sapiens
EDVDSWKTS

SEQ ID NO: 61925 - protein, 9 aa, Homo Sapiens
SSEMAKYLS

SEQ ID NO: 61926 - protein, 9 aa, Homo Sapiens
DLVDNCVPG

SEQ ID NO: 61927 - protein, 9 aa, Homo Sapiens
WGGCGNDVD

SEQ ID NO: 61928 - protein, 9 aa, Homo Sapiens
PGVCSITSY

SEQ ID NO: 61929 - protein, 9 aa, Homo Sapiens
SHHLSPEQR

SEQ ID NO: 61930 - protein, 9 aa, Homo Sapiens
RNHREKDVV

SEQ ID NO: 61931 - protein, 9 aa, Homo Sapiens
GAAPPPPPL

SEQ ID NO: 61932 - protein, 9 aa, Homo Sapiens
GQGHSIVLL

SEQ ID NO: 61933 - protein, 9 aa, Homo Sapiens
TLCPTVKPQ

SEQ ID NO: 61934 - protein, 9 aa, Homo Sapiens
LCHKLTTLC

SEQ ID NO: 61935 - protein, 9 aa, Homo Sapiens
PRPAMSEEI

SEQ ID NO: 61936 - protein, 9 aa, Homo Sapiens
KYLSSKTAL

SEQ ID NO: 61937 - protein, 9 aa, Homo Sapiens
LPLVLTLLC

SEQ ID NO: 61938 - protein, 9 aa, Homo Sapiens
DVDSWKTSL

SEQ ID NO: 61939 - protein, 9 aa, Homo Sapiens
CGVFYYFVS

SEQ ID NO: 61940 - protein, 9 aa, Homo Sapiens
FFALFYEYD

SEQ ID NO: 61941 - protein, 9 aa, Homo Sapiens
NDVDFGDEK

SEQ ID NO: 61942 - protein, 9 aa, Homo Sapiens
SEASETHMA

SEQ ID NO: 61943 - protein, 9 aa, Homo Sapiens
HDLVDNCVP

SEQ ID NO: 61944 - protein, 9 aa, Homo Sapiens
ILKYSVFLR

SEQ ID NO: 61945 - protein, 9 aa, Homo Sapiens
PLPCAVTFS

SEQ ID NO: 61946 - protein, 9 aa, Homo Sapiens
CFCKKQGSG

SEQ ID NO: 61947 - protein, 9 aa, Homo Sapiens
TFSNSNLKF

SEQ ID NO: 61948 - protein, 9 aa, Homo Sapiens
KNLTFSPPI

SEQ ID NO: 61949 - protein, 9 aa, Homo Sapiens
GALVLPLVL

SEQ ID NO: 61950 - protein, 9 aa, Homo Sapiens
AIFFELKHY

SEQ ID NO: 61951 - protein, 9 aa, Homo Sapiens
IRNHREKDV

SEQ ID NO: 61952 - protein, 9 aa, Homo Sapiens
ASEASETHM

SEQ ID NO: 61953 - protein, 9 aa, Homo Sapiens
PCAVTFSNS

SEQ ID NO: 61954 - protein, 9 aa, Homo Sapiens
LRVMYTDQP

SEQ ID NO: 61955 - protein, 9 aa, Homo Sapiens
HTSVYSAQG

SEQ ID NO: 61956 - protein, 9 aa, Homo Sapiens
IYLLSPTET

SEQ ID NO: 61957 - protein, 9 aa, Homo Sapiens
FKKWDMGHC

SEQ ID NO: 61958 - protein, 9 aa, Homo Sapiens
KLTTLCPTV

SEQ ID NO: 61959 - protein, 9 aa, Homo Sapiens
GYPGVCSIT

SEQ ID NO: 61960 - protein, 9 aa, Homo Sapiens
KAESLTKDV

SEQ ID NO: 61961 - protein, 9 aa, Homo Sapiens
SEYVVESTG

SEQ ID NO: 61962 - protein, 9 aa, Homo Sapiens
HPQRISRHL

SEQ ID NO: 61963 - protein, 9 aa, Homo Sapiens
PAFHPQRIS

SEQ ID NO: 61964 - protein, 9 aa, Homo Sapiens
ELIRNHREK

SEQ ID NO: 61965 - protein, 9 aa, Homo Sapiens
RLAPYVNYQ

SEQ ID NO: 61966 - protein, 9 aa, Homo Sapiens
VHDLVDNCV

SEQ ID NO: 61967 - protein, 9 aa, Homo Sapiens
SNTLTNKKM

SEQ ID NO: 61968 - protein, 9 aa, Homo Sapiens
TYDGHVLDS

SEQ ID NO: 61969 - protein, 9 aa, Homo Sapiens
DAGSEYVVE

SEQ ID NO: 61970 - protein, 9 aa, Homo Sapiens
IFFELKHYK

SEQ ID NO: 61971 - protein, 9 aa, Homo Sapiens
DSSEMAKYL

SEQ ID NO: 61972 - protein, 9 aa, Homo Sapiens
ISNTLTNKK

SEQ ID NO: 61973 - protein, 9 aa, Homo Sapiens
CHKLTTLCP

SEQ ID NO: 61974 - protein, 9 aa, Homo Sapiens
KKMKIEECI

SEQ ID NO: 61975 - protein, 9 aa, Homo Sapiens
FTFCFLPGR

SEQ ID NO: 61976 - protein, 9 aa, Homo Sapiens
TEAVPQVGG

SEQ ID NO: 61977 - protein, 9 aa, Homo Sapiens
GSLKVFKKW

SEQ ID NO: 61978 - protein, 9 aa, Homo Sapiens
KEERDLVNR

SEQ ID NO: 61979 - protein, 9 aa, Homo Sapiens
RDLVNRLKV

SEQ ID NO: 61980 - protein, 9 aa, Homo Sapiens
HREKDVVPF

SEQ ID NO: 61981 - protein, 9 aa, Homo Sapiens
FNKLTYDGH

SEQ ID NO: 61982 - protein, 9 aa, Homo Sapiens
DIQKKHQNK

SEQ ID NO: 61983 - protein, 9 aa, Homo Sapiens
IRQSKLAAA

SEQ ID NO: 61984 - protein, 9 aa, Homo Sapiens
IRKYILKYS

SEQ ID NO: 61985 - protein, 9 aa, Homo Sapiens
LKHYKPKKR

SEQ ID NO: 61986 - protein, 9 aa, Homo Sapiens
LVNRLKVEQ

SEQ ID NO: 61987 - protein, 9 aa, Homo Sapiens
FCFLPGRAK

SEQ ID NO: 61988 - protein, 9 aa, Homo Sapiens
HSIVLLSEL

SEQ ID NO: 61989 - protein, 9 aa, Homo Sapiens
KSLYQAISR

SEQ ID NO: 61990 - protein, 9 aa, Homo Sapiens
YDGHVLDSE

SEQ ID NO: 61991 - protein, 9 aa, Homo Sapiens
EIQPPSHHL

SEQ ID NO: 61992 - protein, 9 aa, Homo Sapiens
KLTYDGHVL

SEQ ID NO: 61993 - protein, 9 aa, Homo Sapiens
NRLKVEQAR

SEQ ID NO: 61994 - protein, 9 aa, Homo Sapiens
AFFTFCFLP

SEQ ID NO: 61995 - protein, 9 aa, Homo Sapiens
ETHMAASVV

SEQ ID NO: 61996 - protein, 9 aa, Homo Sapiens
NKKMKIEEC

SEQ ID NO: 61997 - protein, 9 aa, Homo Sapiens
ALVLPLVLT

SEQ ID NO: 61998 - protein, 9 aa, Homo Sapiens
ITSYRTHCY

SEQ ID NO: 61999 - protein, 9 aa, Homo Sapiens
EISNTLTNK

SEQ ID NO: 62000 - protein, 9 aa, Homo Sapiens
FHPQRISRH

SEQ ID NO: 62001 - protein, 9 aa, Homo Sapiens
RISRHLPSV

SEQ ID NO: 62002 - protein, 9 aa, Homo Sapiens
DLVNRLKVE

SEQ ID NO: 62003 - protein, 9 aa, Homo Sapiens
DTFLQQKAE

SEQ ID NO: 62004 - protein, 9 aa, Homo Sapiens
YQAISRFES

SEQ ID NO: 62005 - protein, 9 aa, Homo Sapiens
NCVPGDTVT

SEQ ID NO: 62006 - protein, 9 aa, Homo Sapiens
SFFFFFFAL

SEQ ID NO: 62007 - protein, 9 aa, Homo Sapiens
FDDIQKKHQ

SEQ ID NO: 62008 - protein, 9 aa, Homo Sapiens
QVGGLLGKY

SEQ ID NO: 62009 - protein, 9 aa, Homo Sapiens
MYKSLYQAI

SEQ ID NO: 62010 - protein, 9 aa, Homo Sapiens
NTLTNKKMK

SEQ ID NO: 62011 - protein, 9 aa, Homo Sapiens
GNDVDFGDE

SEQ ID NO: 62012 - protein, 9 aa, Homo Sapiens
TCKFYTWLC

SEQ ID NO: 62013 - protein, 9 aa, Homo Sapiens
EKDVVPFQE

SEQ ID NO: 62014 - protein, 9 aa, Homo Sapiens
MYTDQPLSQ

SEQ ID NO: 62015 - protein, 9 aa, Homo Sapiens
RVMYTDQPL

SEQ ID NO: 62016 - protein, 9 aa, Homo Sapiens
VDSWKTSLL

SEQ ID NO: 62017 - protein, 9 aa, Homo Sapiens
IQPPSHHLS

SEQ ID NO: 62018 - protein, 9 aa, Homo Sapiens
GLCHKLTTL

SEQ ID NO: 62019 - protein, 9 aa, Homo Sapiens
LKVFKKWDM

SEQ ID NO: 62020 - protein, 9 aa, Homo Sapiens
KTSLLRAGV

SEQ ID NO: 62021 - protein, 9 aa, Homo Sapiens
IIRKYILKY

SEQ ID NO: 62022 - protein, 9 aa, Homo Sapiens
LSPTETAQA

SEQ ID NO: 62023 - protein, 9 aa, Homo Sapiens
DQPLSQTDP

SEQ ID NO: 62024 - protein, 9 aa, Homo Sapiens
LTTLCPTVK

SEQ ID NO: 62025 - protein, 9 aa, Homo Sapiens
KDVVPFQES

SEQ ID NO: 62026 - protein, 9 aa, Homo Sapiens
EASETHMAA

SEQ ID NO: 62027 - protein, 9 aa, Homo Sapiens
LKYSVFLRH

SEQ ID NO: 62028 - protein, 9 aa, Homo Sapiens
QRISRHLPS

SEQ ID NO: 62029 - protein, 9 aa, Homo Sapiens
WEWGGCGND

SEQ ID NO: 62030 - protein, 9 aa, Homo Sapiens
SAVLRLAPY

SEQ ID NO: 62031 - protein, 9 aa, Homo Sapiens
HACFCKKQG

SEQ ID NO: 62032 - protein, 9 aa, Homo Sapiens
KGAAIFFEL

SEQ ID NO: 62033 - protein, 9 aa, Homo Sapiens
AFHPQRISR

SEQ ID NO: 62034 - protein, 9 aa, Homo Sapiens
LQQKAESLT

SEQ ID NO: 62035 - protein, 9 aa, Homo Sapiens
DNCVPGDTV

SEQ ID NO: 62036 - protein, 9 aa, Homo Sapiens
DSWKTSLLR

SEQ ID NO: 62037 - protein, 9 aa, Homo Sapiens
IQKKHQNKD

SEQ ID NO: 62038 - protein, 9 aa, Homo Sapiens
VPQVGGLLG

SEQ ID NO: 62039 - protein, 9 aa, Homo Sapiens
EERDLVNRL

SEQ ID NO: 62040 - protein, 9 aa, Homo Sapiens
YTDQPLSQT

SEQ ID NO: 62041 - protein, 9 aa, Homo Sapiens
KLGALVLPL

SEQ ID NO: 62042 - protein, 9 aa, Homo Sapiens
TAQAQRVIH

SEQ ID NO: 62043 - protein, 9 aa, Homo Sapiens
QPLSQTDPV

SEQ ID NO: 62044 - protein, 9 aa, Homo Sapiens
YLSSKTALS

SEQ ID NO: 62045 - protein, 9 aa, Homo Sapiens
MAKYLSSKT

SEQ ID NO: 62046 - protein, 9 aa, Homo Sapiens
LLSELLREG

SEQ ID NO: 62047 - protein, 9 aa, Homo Sapiens
CAVTFSNSN

SEQ ID NO: 62048 - protein, 9 aa, Homo Sapiens
HLSPEQRAL

SEQ ID NO: 62049 - protein, 9 aa, Homo Sapiens
TFLQQKAES

SEQ ID NO: 62050 - protein, 9 aa, Homo Sapiens
AVLRLAPYV

SEQ ID NO: 62051 - protein, 9 aa, Homo Sapiens
GNLHTSVYS

SEQ ID NO: 62052 - protein, 9 aa, Homo Sapiens
AGSEYVVES

SEQ ID NO: 62053 - protein, 9 aa, Homo Sapiens
FFFALFYEY

SEQ ID NO: 62054 - protein, 9 aa, Homo Sapiens
QGNLHTSVY

SEQ ID NO: 62055 - protein, 9 aa, Homo Sapiens
YSFFFFFFA

SEQ ID NO: 62056 - protein, 9 aa, Homo Sapiens
FSPPIYGAD

SEQ ID NO: 62057 - protein, 9 aa, Homo Sapiens
YWKNLTFSP

SEQ ID NO: 62058 - protein, 9 aa, Homo Sapiens
KKEERDLVN

SEQ ID NO: 62059 - protein, 9 aa, Homo Sapiens
DIIRKYILK

SEQ ID NO: 62060 - protein, 9 aa, Homo Sapiens
LCPTVKPQT

SEQ ID NO: 62061 - protein, 9 aa, Homo Sapiens
LRLAPYVNY

SEQ ID NO: 62062 - protein, 9 aa, Homo Sapiens
LCGVFYYFV

SEQ ID NO: 62063 - protein, 9 aa, Homo Sapiens
VTFSNSNLK

SEQ ID NO: 62064 - protein, 9 aa, Homo Sapiens
EMAKYLSSK

SEQ ID NO: 62065 - protein, 9 aa, Homo Sapiens
GHSIVLLSE

SEQ ID NO: 62066 - protein, 9 aa, Homo Sapiens
SLKVFKKWD

SEQ ID NO: 62067 - protein, 9 aa, Homo Sapiens
EFNKLTYDG

SEQ ID NO: 62068 - protein, 9 aa, Homo Sapiens
TWLCGVFYY

SEQ ID NO: 62069 - protein, 9 aa, Homo Sapiens
PLRVMYTDQ

SEQ ID NO: 62070 - protein, 9 aa, Homo Sapiens
HKLTTLCPT

SEQ ID NO: 62071 - protein, 9 aa, Homo Sapiens
SWKTSLLRA

SEQ ID NO: 62072 - protein, 9 aa, Homo Sapiens
ELKHYKPKK

SEQ ID NO: 62073 - protein, 9 aa, Homo Sapiens
TTLCPTVKP

SEQ ID NO: 62074 - protein, 9 aa, Homo Sapiens
SITSYRTHC

SEQ ID NO: 62075 - protein, 9 aa, Homo Sapiens
GCGNDVDFG

SEQ ID NO: 62076 - protein, 9 aa, Homo Sapiens
NKLTYDGHV

SEQ ID NO: 62077 - protein, 9 aa, Homo Sapiens
REKDVVPFQ

SEQ ID NO: 62078 - protein, 9 aa, Homo Sapiens
QPPSHHLSP

SEQ ID NO: 62079 - protein, 9 aa, Homo Sapiens
FFFFFFALF

SEQ ID NO: 62080 - protein, 9 aa, Homo Sapiens
AESLTKDVQ

SEQ ID NO: 62081 - protein, 9 aa, Homo Sapiens
AAIFFELKH

SEQ ID NO: 62082 - protein, 9 aa, Homo Sapiens
KVFKKWDMG

SEQ ID NO: 62083 - protein, 9 aa, Homo Sapiens
SLYQAISRF

SEQ ID NO: 62084 - protein, 9 aa, Homo Sapiens
SEMAKYLSS

SEQ ID NO: 62085 - protein, 9 aa, Homo Sapiens
AAMYKSLYQ

SEQ ID NO: 62086 - protein, 9 aa, Homo Sapiens
TPAFHPQRI

SEQ ID NO: 62087 - protein, 9 aa, Homo Sapiens
QKAESLTKD

SEQ ID NO: 62088 - protein, 9 aa, Homo Sapiens
YTWLCGVFY

SEQ ID NO: 62089 - protein, 9 aa, Homo Sapiens
WLCGVFYYF

SEQ ID NO: 62090 - protein, 9 aa, Homo Sapiens
GPTRPVPLK

SEQ ID NO: 62091 - protein, 9 aa, Homo Sapiens
FELKHYKPK

SEQ ID NO: 62092 - protein, 9 aa, Homo Sapiens
PGRAKEHHE

SEQ ID NO: 62093 - protein, 9 aa, Homo Sapiens
TFCFLPGRA

SEQ ID NO: 62094 - protein, 9 aa, Homo Sapiens
LTYDGHVLD

SEQ ID NO: 62095 - protein, 9 aa, Homo Sapiens
KYWKNLTFS

SEQ ID NO: 62096 - protein, 9 aa, Homo Sapiens
LVHDLVDNC

SEQ ID NO: 62097 - protein, 9 aa, Homo Sapiens
PAMSEEIRQ

SEQ ID NO: 62098 - protein, 9 aa, Homo Sapiens
AVTFSNSNL

SEQ ID NO: 62099 - protein, 9 aa, Homo Sapiens
KTEAVPQVG

SEQ ID NO: 62100 - protein, 9 aa, Homo Sapiens
SIVLLSELL

SEQ ID NO: 62101 - protein, 9 aa, Homo Sapiens
PQVGGLLGK

SEQ ID NO: 62102 - protein, 9 aa, Homo Sapiens
QEFNKLTYD

SEQ ID NO: 62103 - protein, 9 aa, Homo Sapiens
SAAMYKSLY

SEQ ID NO: 62104 - protein, 9 aa, Homo Sapiens
LDSSEMAKY

SEQ ID NO: 62105 - protein, 9 aa, Homo Sapiens
AWEWGGCGN

SEQ ID NO: 62106 - protein, 9 aa, Homo Sapiens
NLTFSPPIY

SEQ ID NO: 62107 - protein, 9 aa, Homo Sapiens
LGALVLPLV

SEQ ID NO: 62108 - protein, 9 aa, Homo Sapiens
RKYILKYSV

SEQ ID NO: 62109 - protein, 9 aa, Homo Sapiens
GGCGNDVDF

SEQ ID NO: 62110 - protein, 9 aa, Homo Sapiens
QEDVDSWKT

SEQ ID NO: 62111 - protein, 9 aa, Homo Sapiens
ACFCKKQGS

SEQ ID NO: 62112 - protein, 9 aa, Homo Sapiens
FLPGRAKEH

SEQ ID NO: 62113 - protein, 9 aa, Homo Sapiens
KHQNKDLME

SEQ ID NO: 62114 - protein, 9 aa, Homo Sapiens
KKHQNKDLM

SEQ ID NO: 62115 - protein, 9 aa, Homo Sapiens
EAVPQVGGL

SEQ ID NO: 62116 - protein, 9 aa, Homo Sapiens
GQHACFCKK

SEQ ID NO: 62117 - protein, 9 aa, Homo Sapiens
QHACFCKKQ

SEQ ID NO: 62118 - protein, 9 aa, Homo Sapiens
VNRLKVEQA

SEQ ID NO: 62119 - protein, 9 aa, Homo Sapiens
SPPIYGADV

SEQ ID NO: 62120 - protein, 9 aa, Homo Sapiens
VMYTDQPLS

SEQ ID NO: 62121 - protein, 9 aa, Homo Sapiens
PPSHHLSPE

SEQ ID NO: 62122 - protein, 9 aa, Homo Sapiens
PLVLTLLCS

SEQ ID NO: 62123 - protein, 9 aa, Homo Sapiens
WKTSLLRAG

SEQ ID NO: 62124 - protein, 9 aa, Homo Sapiens
CFLPGRAKE

SEQ ID NO: 62125 - protein, 9 aa, Homo Sapiens
DDIQKKHQN

SEQ ID NO: 62126 - protein, 9 aa, Homo Sapiens
LLSPTETAQ

SEQ ID NO: 62127 - protein, 9 aa, Homo Sapiens
QCLFTTETF

SEQ ID NO: 62128 - protein, 9 aa, Homo Sapiens
GGVYERVGW

SEQ ID NO: 62129 - protein, 9 aa, Homo Sapiens
RNHGETKVK

SEQ ID NO: 62130 - protein, 9 aa, Homo Sapiens
KKKGNKGKK

SEQ ID NO: 62131 - protein, 9 aa, Homo Sapiens
AKGQAFPDV

SEQ ID NO: 62132 - protein, 9 aa, Homo Sapiens
EEMAKSLKV

SEQ ID NO: 62133 - protein, 9 aa, Homo Sapiens
RKRGYNELC

SEQ ID NO: 62134 - protein, 9 aa, Homo Sapiens
QLTNNAVGE

SEQ ID NO: 62135 - protein, 9 aa, Homo Sapiens
RSPSHCLPY

SEQ ID NO: 62136 - protein, 9 aa, Homo Sapiens
YQCLFTTET

SEQ ID NO: 62137 - protein, 9 aa, Homo Sapiens
TGELLHTDG

SEQ ID NO: 62138 - protein, 9 aa, Homo Sapiens
MFCFGQDYV

SEQ ID NO: 62139 - protein, 9 aa, Homo Sapiens
QQGKCLLLW

SEQ ID NO: 62140 - protein, 9 aa, Homo Sapiens
YSHKPAPEG

SEQ ID NO: 62141 - protein, 9 aa, Homo Sapiens
SQNLSAFFN

SEQ ID NO: 62142 - protein, 9 aa, Homo Sapiens
ELLKKCSLY

SEQ ID NO: 62143 - protein, 9 aa, Homo Sapiens
NHGETKVKN

SEQ ID NO: 62144 - protein, 9 aa, Homo Sapiens
EEFRALGIP

SEQ ID NO: 62145 - protein, 9 aa, Homo Sapiens
EEAAGHVTQ

SEQ ID NO: 62146 - protein, 9 aa, Homo Sapiens
GPQLGGVKS

SEQ ID NO: 62147 - protein, 9 aa, Homo Sapiens
NSPPIPYSH

SEQ ID NO: 62148 - protein, 9 aa, Homo Sapiens
SQVLFTVTR

SEQ ID NO: 62149 - protein, 9 aa, Homo Sapiens
GVKSGWHLQ

SEQ ID NO: 62150 - protein, 9 aa, Homo Sapiens
LKAQELERS

SEQ ID NO: 62151 - protein, 9 aa, Homo Sapiens
GKCLLLWQA

SEQ ID NO: 62152 - protein, 9 aa, Homo Sapiens
GKKLVKISE

SEQ ID NO: 62153 - protein, 9 aa, Homo Sapiens
EALEKSADW

SEQ ID NO: 62154 - protein, 9 aa, Homo Sapiens
HNNDCYLEY

SEQ ID NO: 62155 - protein, 9 aa, Homo Sapiens
IEEMAKSLK

SEQ ID NO: 62156 - protein, 9 aa, Homo Sapiens
EKLDRAIAE

SEQ ID NO: 62157 - protein, 9 aa, Homo Sapiens
FDPNCGHRD

SEQ ID NO: 62158 - protein, 9 aa, Homo Sapiens
YSFELVMAA

SEQ ID NO: 62159 - protein, 9 aa, Homo Sapiens
RENHLYVLP

SEQ ID NO: 62160 - protein, 9 aa, Homo Sapiens
NCGHRDIIL

SEQ ID NO: 62161 - protein, 9 aa, Homo Sapiens
SGQGRGDAA

SEQ ID NO: 62162 - protein, 9 aa, Homo Sapiens
LNVHMKNVQ

SEQ ID NO: 62163 - protein, 9 aa, Homo Sapiens
AIAEIAQVR

SEQ ID NO: 62164 - protein, 9 aa, Homo Sapiens
YLEYSFVPE

SEQ ID NO: 62165 - protein, 9 aa, Homo Sapiens
RDPLSKITE

SEQ ID NO: 62166 - protein, 9 aa, Homo Sapiens
GKSFCGRST

SEQ ID NO: 62167 - protein, 9 aa, Homo Sapiens
YKYSFELVM

SEQ ID NO: 62168 - protein, 9 aa, Homo Sapiens
YVSEEFRAL

SEQ ID NO: 62169 - protein, 9 aa, Homo Sapiens
ELERSDSVK

SEQ ID NO: 62170 - protein, 9 aa, Homo Sapiens
LCYCSSSET

SEQ ID NO: 62171 - protein, 9 aa, Homo Sapiens
EKEVEALEK

SEQ ID NO: 62172 - protein, 9 aa, Homo Sapiens
FRALGIPFL

SEQ ID NO: 62173 - protein, 9 aa, Homo Sapiens
LEKSADWVS

SEQ ID NO: 62174 - protein, 9 aa, Homo Sapiens
RKSYERALA

SEQ ID NO: 62175 - protein, 9 aa, Homo Sapiens
RRGEQSDDG

SEQ ID NO: 62176 - protein, 9 aa, Homo Sapiens
HERIHNREK

SEQ ID NO: 62177 - protein, 9 aa, Homo Sapiens
MDGFSRSVI

SEQ ID NO: 62178 - protein, 9 aa, Homo Sapiens
NSRKIQSEP

SEQ ID NO: 62179 - protein, 9 aa, Homo Sapiens
SSIPLYLQV

SEQ ID NO: 62180 - protein, 9 aa, Homo Sapiens
CHWRLNFLE

SEQ ID NO: 62181 - protein, 9 aa, Homo Sapiens
AWDCWNCPE

SEQ ID NO: 62182 - protein, 9 aa, Homo Sapiens
WNLRQKSPA

SEQ ID NO: 62183 - protein, 9 aa, Homo Sapiens
GRSTLNRHS

SEQ ID NO: 62184 - protein, 9 aa, Homo Sapiens
KDKKKGNKG

SEQ ID NO: 62185 - protein, 9 aa, Homo Sapiens
PLKLAGWQC

SEQ ID NO: 62186 - protein, 9 aa, Homo Sapiens
VQVIVKVNN

SEQ ID NO: 62187 - protein, 9 aa, Homo Sapiens
VNVEKTMFD

SEQ ID NO: 62188 - protein, 9 aa, Homo Sapiens
THNNDCYLE

SEQ ID NO: 62189 - protein, 9 aa, Homo Sapiens
ESTPDNLDL

SEQ ID NO: 62190 - protein, 9 aa, Homo Sapiens
ILNDSHPEN

SEQ ID NO: 62191 - protein, 9 aa, Homo Sapiens
GNAWAKYMA

SEQ ID NO: 62192 - protein, 9 aa, Homo Sapiens
KLVSPLCLV

SEQ ID NO: 62193 - protein, 9 aa, Homo Sapiens
YMPQSQNLS

SEQ ID NO: 62194 - protein, 9 aa, Homo Sapiens
LTQVRRENH

SEQ ID NO: 62195 - protein, 9 aa, Homo Sapiens
EVAAVERKR

SEQ ID NO: 62196 - protein, 9 aa, Homo Sapiens
WDKDVAPKL

SEQ ID NO: 62197 - protein, 9 aa, Homo Sapiens
ERVGWHIQG

SEQ ID NO: 62198 - protein, 9 aa, Homo Sapiens
GGQNIFMTE

SEQ ID NO: 62199 - protein, 9 aa, Homo Sapiens
KQKHLHLYC

SEQ ID NO: 62200 - protein, 9 aa, Homo Sapiens
NIFMTEEQK

SEQ ID NO: 62201 - protein, 9 aa, Homo Sapiens
MKNVQVIVK

SEQ ID NO: 62202 - protein, 9 aa, Homo Sapiens
LMVTSITEV

SEQ ID NO: 62203 - protein, 9 aa, Homo Sapiens
NAWAKYMAE

SEQ ID NO: 62204 - protein, 9 aa, Homo Sapiens
SNLYAYIQK

SEQ ID NO: 62205 - protein, 9 aa, Homo Sapiens
DISFPMKGG

SEQ ID NO: 62206 - protein, 9 aa, Homo Sapiens
PLYQCLFTT

SEQ ID NO: 62207 - protein, 9 aa, Homo Sapiens
GIPAILNDS

SEQ ID NO: 62208 - protein, 9 aa, Homo Sapiens
AQSILRDPN

SEQ ID NO: 62209 - protein, 9 aa, Homo Sapiens
PALSNSRKI

SEQ ID NO: 62210 - protein, 9 aa, Homo Sapiens
TLNRHSMVH

SEQ ID NO: 62211 - protein, 9 aa, Homo Sapiens
GQNIFMTEE

SEQ ID NO: 62212 - protein, 9 aa, Homo Sapiens
LCLVPYFRL

SEQ ID NO: 62213 - protein, 9 aa, Homo Sapiens
IATYRHLLQ

SEQ ID NO: 62214 - protein, 9 aa, Homo Sapiens
LDRMMEGKL

SEQ ID NO: 62215 - protein, 9 aa, Homo Sapiens
TPALSNSRK

SEQ ID NO: 62216 - protein, 9 aa, Homo Sapiens
LCIDHCWMA

SEQ ID NO: 62217 - protein, 9 aa, Homo Sapiens
MTVSLLLRD

SEQ ID NO: 62218 - protein, 9 aa, Homo Sapiens
SRKIQSEPA

SEQ ID NO: 62219 - protein, 9 aa, Homo Sapiens
AVERKRGYN

SEQ ID NO: 62220 - protein, 9 aa, Homo Sapiens
KTMFDVLKK

SEQ ID NO: 62221 - protein, 9 aa, Homo Sapiens
LSRHSKWLQ

SEQ ID NO: 62222 - protein, 9 aa, Homo Sapiens
HSKWLQILG

SEQ ID NO: 62223 - protein, 9 aa, Homo Sapiens
VALDLRNHG

SEQ ID NO: 62224 - protein, 9 aa, Homo Sapiens
SMGKTPVSM

SEQ ID NO: 62225 - protein, 9 aa, Homo Sapiens
FDAYMPQSQ

SEQ ID NO: 62226 - protein, 9 aa, Homo Sapiens
ASIIFVTHQ

SEQ ID NO: 62227 - protein, 9 aa, Homo Sapiens
EGDESTPDN

SEQ ID NO: 62228 - protein, 9 aa, Homo Sapiens
IYISGEGDE

SEQ ID NO: 62229 - protein, 9 aa, Homo Sapiens
ASNLYAYIQ

SEQ ID NO: 62230 - protein, 9 aa, Homo Sapiens
LYQCLFTTE

SEQ ID NO: 62231 - protein, 9 aa, Homo Sapiens
SEVSPPSLY

SEQ ID NO: 62232 - protein, 9 aa, Homo Sapiens
ELLHTDGMI

SEQ ID NO: 62233 - protein, 9 aa, Homo Sapiens
HWRLNFLES

SEQ ID NO: 62234 - protein, 9 aa, Homo Sapiens
FAQSILRDP

SEQ ID NO: 62235 - protein, 9 aa, Homo Sapiens
CSLYGKKLV

SEQ ID NO: 62236 - protein, 9 aa, Homo Sapiens
VLTSKGNAW

SEQ ID NO: 62237 - protein, 9 aa, Homo Sapiens
LKAWNHIKK

SEQ ID NO: 62238 - protein, 9 aa, Homo Sapiens
IPLYLQVLN

SEQ ID NO: 62239 - protein, 9 aa, Homo Sapiens
WRLNFLESK

SEQ ID NO: 62240 - protein, 9 aa, Homo Sapiens
HMKNVQVIV

SEQ ID NO: 62241 - protein, 9 aa, Homo Sapiens
ERALASFQE

SEQ ID NO: 62242 - protein, 9 aa, Homo Sapiens
VDSIAEESE

SEQ ID NO: 62243 - protein, 9 aa, Homo Sapiens
DKKKGNKGK

SEQ ID NO: 62244 - protein, 9 aa, Homo Sapiens
LKLAGWQCP

SEQ ID NO: 62245 - protein, 9 aa, Homo Sapiens
QEHQRKEKK

SEQ ID NO: 62246 - protein, 9 aa, Homo Sapiens
TPVSMTGCG

SEQ ID NO: 62247 - protein, 9 aa, Homo Sapiens
RIHNREKPY

SEQ ID NO: 62248 - protein, 9 aa, Homo Sapiens
EVSPPSLYA

SEQ ID NO: 62249 - protein, 9 aa, Homo Sapiens
QACVEANGD

SEQ ID NO: 62250 - protein, 9 aa, Homo Sapiens
HIKKVYASQ

SEQ ID NO: 62251 - protein, 9 aa, Homo Sapiens
CKYQFAWDC

SEQ ID NO: 62252 - protein, 9 aa, Homo Sapiens
RPVDAVNLQ

SEQ ID NO: 62253 - protein, 9 aa, Homo Sapiens
AVGESRFND

SEQ ID NO: 62254 - protein, 9 aa, Homo Sapiens
QELERSDSV

SEQ ID NO: 62255 - protein, 9 aa, Homo Sapiens
FSPSQFLKT

SEQ ID NO: 62256 - protein, 9 aa, Homo Sapiens
QKSPAILHS

SEQ ID NO: 62257 - protein, 9 aa, Homo Sapiens
AVKVFSFVN

SEQ ID NO: 62258 - protein, 9 aa, Homo Sapiens
DGFYQCLAM

SEQ ID NO: 62259 - protein, 9 aa, Homo Sapiens
EPLYQCLFT

SEQ ID NO: 62260 - protein, 9 aa, Homo Sapiens
RDNYNGMSF

SEQ ID NO: 62261 - protein, 9 aa, Homo Sapiens
GMFCFGQDY

SEQ ID NO: 62262 - protein, 9 aa, Homo Sapiens
KPDFVIICT

SEQ ID NO: 62263 - protein, 9 aa, Homo Sapiens
KSGWHLQEG

SEQ ID NO: 62264 - protein, 9 aa, Homo Sapiens
FVTHQYNVT

SEQ ID NO: 62265 - protein, 9 aa, Homo Sapiens
PMKGGRATG

SEQ ID NO: 62266 - protein, 9 aa, Homo Sapiens
PSLYADKPL

SEQ ID NO: 62267 - protein, 9 aa, Homo Sapiens
PPIPYSHKP

SEQ ID NO: 62268 - protein, 9 aa, Homo Sapiens
NGHMPSLTD

SEQ ID NO: 62269 - protein, 9 aa, Homo Sapiens
AAVERKRGY

SEQ ID NO: 62270 - protein, 9 aa, Homo Sapiens
SLTDSPFTG

SEQ ID NO: 62271 - protein, 9 aa, Homo Sapiens
GYEYLCIDH

SEQ ID NO: 62272 - protein, 9 aa, Homo Sapiens
KGGRATGDW

SEQ ID NO: 62273 - protein, 9 aa, Homo Sapiens
FDITDTVRE

SEQ ID NO: 62274 - protein, 9 aa, Homo Sapiens
KKLKAWNHI

SEQ ID NO: 62275 - protein, 9 aa, Homo Sapiens
GEQSDDGFY

SEQ ID NO: 62276 - protein, 9 aa, Homo Sapiens
EVEALEKSA

SEQ ID NO: 62277 - protein, 9 aa, Homo Sapiens
EYLCIDHCW

SEQ ID NO: 62278 - protein, 9 aa, Homo Sapiens
RSDSVKQLK

SEQ ID NO: 62279 - protein, 9 aa, Homo Sapiens
KLKAWNHIK

SEQ ID NO: 62280 - protein, 9 aa, Homo Sapiens
QGLLCYCSS

SEQ ID NO: 62281 - protein, 9 aa, Homo Sapiens
CLVPYFRLL

SEQ ID NO: 62282 - protein, 9 aa, Homo Sapiens
FDWFEYHGH

SEQ ID NO: 62283 - protein, 9 aa, Homo Sapiens
YCHWRLNFL

SEQ ID NO: 62284 - protein, 9 aa, Homo Sapiens
GYLTALQMF

SEQ ID NO: 62285 - protein, 9 aa, Homo Sapiens
TYRHLLQKE

SEQ ID NO: 62286 - protein, 9 aa, Homo Sapiens
KTYCHWRLN

SEQ ID NO: 62287 - protein, 9 aa, Homo Sapiens
VERKRGYNE

SEQ ID NO: 62288 - protein, 9 aa, Homo Sapiens
IIFVTHQYN

SEQ ID NO: 62289 - protein, 9 aa, Homo Sapiens
TMFDVLKKE

SEQ ID NO: 62290 - protein, 9 aa, Homo Sapiens
VKVFSFVNR

SEQ ID NO: 62291 - protein, 9 aa, Homo Sapiens
TVSLLLRDN

SEQ ID NO: 62292 - protein, 9 aa, Homo Sapiens
ISSIPLYLQ

SEQ ID NO: 62293 - protein, 9 aa, Homo Sapiens
GCGPSGQGR

SEQ ID NO: 62294 - protein, 9 aa, Homo Sapiens
LSFDITDTV

SEQ ID NO: 62295 - protein, 9 aa, Homo Sapiens
IAEESEEGL

SEQ ID NO: 62296 - protein, 9 aa, Homo Sapiens
KKLGGQNIF

SEQ ID NO: 62297 - protein, 9 aa, Homo Sapiens
HMPSLTDSP

SEQ ID NO: 62298 - protein, 9 aa, Homo Sapiens
FINQATANL

SEQ ID NO: 62299 - protein, 9 aa, Homo Sapiens
YERALASFQ

SEQ ID NO: 62300 - protein, 9 aa, Homo Sapiens
RSTLNRHSM

SEQ ID NO: 62301 - protein, 9 aa, Homo Sapiens
PSGQGRGDA

SEQ ID NO: 62302 - protein, 9 aa, Homo Sapiens
LLKKCSLYG

SEQ ID NO: 62303 - protein, 9 aa, Homo Sapiens
NDCYLEYSF

SEQ ID NO: 62304 - protein, 9 aa, Homo Sapiens
VRVYKYSFE

SEQ ID NO: 62305 - protein, 9 aa, Homo Sapiens
IHNREKPYE

SEQ ID NO: 62306 - protein, 9 aa, Homo Sapiens
VTPRSTYLC

SEQ ID NO: 62307 - protein, 9 aa, Homo Sapiens
KYQFAWDCW

SEQ ID NO: 62308 - protein, 9 aa, Homo Sapiens
KGNKGKKKE

SEQ ID NO: 62309 - protein, 9 aa, Homo Sapiens
LPGMFCFGQ

SEQ ID NO: 62310 - protein, 9 aa, Homo Sapiens
VLFTVTRGA

SEQ ID NO: 62311 - protein, 9 aa, Homo Sapiens
KLGGQNIFM

SEQ ID NO: 62312 - protein, 9 aa, Homo Sapiens
NLRQKSPAI

SEQ ID NO: 62313 - protein, 9 aa, Homo Sapiens
HTDGMIRKH

SEQ ID NO: 62314 - protein, 9 aa, Homo Sapiens
GVCDRHKDN

SEQ ID NO: 62315 - protein, 9 aa, Homo Sapiens
EQLTNNAVG

SEQ ID NO: 62316 - protein, 9 aa, Homo Sapiens
REELLKKCS

SEQ ID NO: 62317 - protein, 9 aa, Homo Sapiens
LYCDLINFT

SEQ ID NO: 62318 - protein, 9 aa, Homo Sapiens
MKGGRATGD

SEQ ID NO: 62319 - protein, 9 aa, Homo Sapiens
ERSDSVKQL

SEQ ID NO: 62320 - protein, 9 aa, Homo Sapiens
LYADKPLEE

SEQ ID NO: 62321 - protein, 9 aa, Homo Sapiens
PRSTYLCRH

SEQ ID NO: 62322 - protein, 9 aa, Homo Sapiens
WLVNVEKTM

SEQ ID NO: 62323 - protein, 9 aa, Homo Sapiens
EQSDDGFYQ

SEQ ID NO: 62324 - protein, 9 aa, Homo Sapiens
VNRQNFINE

SEQ ID NO: 62325 - protein, 9 aa, Homo Sapiens
QSDDGFYQC

SEQ ID NO: 62326 - protein, 9 aa, Homo Sapiens
LHLYCDLIN

SEQ ID NO: 62327 - protein, 9 aa, Homo Sapiens
CYCSSSETS

SEQ ID NO: 62328 - protein, 9 aa, Homo Sapiens
KSQVLFTVT

SEQ ID NO: 62329 - protein, 9 aa, Homo Sapiens
STYLCRHGE

SEQ ID NO: 62330 - protein, 9 aa, Homo Sapiens
EPDFAQSIL

SEQ ID NO: 62331 - protein, 9 aa, Homo Sapiens
FVIICTRLS

SEQ ID NO: 62332 - protein, 9 aa, Homo Sapiens
LKKCSLYGK

SEQ ID NO: 62333 - protein, 9 aa, Homo Sapiens
GQAFPDVVA

SEQ ID NO: 62334 - protein, 9 aa, Homo Sapiens
NQATANLSP

SEQ ID NO: 62335 - protein, 9 aa, Homo Sapiens
GMDGFSRSV

SEQ ID NO: 62336 - protein, 9 aa, Homo Sapiens
CLMLKVPTT

SEQ ID NO: 62337 - protein, 9 aa, Homo Sapiens
FTTETFETG

SEQ ID NO: 62338 - protein, 9 aa, Homo Sapiens
SIIFVTHQY

SEQ ID NO: 62339 - protein, 9 aa, Homo Sapiens
ALEKSADWV

SEQ ID NO: 62340 - protein, 9 aa, Homo Sapiens
TPRSTYLCR

SEQ ID NO: 62341 - protein, 9 aa, Homo Sapiens
YERVGWHIQ

SEQ ID NO: 62342 - protein, 9 aa, Homo Sapiens
FCGRSTLNR

SEQ ID NO: 62343 - protein, 9 aa, Homo Sapiens
KRSPSHCLP

SEQ ID NO: 62344 - protein, 9 aa, Homo Sapiens
DCYLEYSFV

SEQ ID NO: 62345 - protein, 9 aa, Homo Sapiens
TPSLEEEAA

SEQ ID NO: 62346 - protein, 9 aa, Homo Sapiens
FQRPVDAVN

SEQ ID NO: 62347 - protein, 9 aa, Homo Sapiens
ILGVCDRHK

SEQ ID NO: 62348 - protein, 9 aa, Homo Sapiens
HLHLYCDLI

SEQ ID NO: 62349 - protein, 9 aa, Homo Sapiens
FCFGQDYVN

SEQ ID NO: 62350 - protein, 9 aa, Homo Sapiens
KGNAWAKYM

SEQ ID NO: 62351 - protein, 9 aa, Homo Sapiens
DTPSLEEEA

SEQ ID NO: 62352 - protein, 9 aa, Homo Sapiens
WLQILGKTL

SEQ ID NO: 62353 - protein, 9 aa, Homo Sapiens
GFSRSVIVD

SEQ ID NO: 62354 - protein, 9 aa, Homo Sapiens
RGYNELCDV

SEQ ID NO: 62355 - protein, 9 aa, Homo Sapiens
YCDLINFTW

SEQ ID NO: 62356 - protein, 9 aa, Homo Sapiens
RGEQSDDGF

SEQ ID NO: 62357 - protein, 9 aa, Homo Sapiens
QMFNRTYKL

SEQ ID NO: 62358 - protein, 9 aa, Homo Sapiens
SDDGFYQCL

SEQ ID NO: 62359 - protein, 9 aa, Homo Sapiens
EANGDPIVK

SEQ ID NO: 62360 - protein, 9 aa, Homo Sapiens
NMCRCLMLK

SEQ ID NO: 62361 - protein, 9 aa, Homo Sapiens
QKHLHLYCD

SEQ ID NO: 62362 - protein, 9 aa, Homo Sapiens
LVPYFRLLR

SEQ ID NO: 62363 - protein, 9 aa, Homo Sapiens
SSSETSVLN

SEQ ID NO: 62364 - protein, 9 aa, Homo Sapiens
DGFSRSVIV

SEQ ID NO: 62365 - protein, 9 aa, Homo Sapiens
SGWHLQEGG

SEQ ID NO: 62366 - protein, 9 aa, Homo Sapiens
EYALNMLLH

SEQ ID NO: 62367 - protein, 9 aa, Homo Sapiens
FPDVVAKYQ

SEQ ID NO: 62368 - protein, 9 aa, Homo Sapiens
GNKGKKKEK

SEQ ID NO: 62369 - protein, 9 aa, Homo Sapiens
VEKTMFDVL

SEQ ID NO: 62370 - protein, 9 aa, Homo Sapiens
SRHSKWLQI

SEQ ID NO: 62371 - protein, 9 aa, Homo Sapiens
PASNLYAYI

SEQ ID NO: 62372 - protein, 9 aa, Homo Sapiens
PYSHKPAPE

SEQ ID NO: 62373 - protein, 9 aa, Homo Sapiens
LTALQMFNR

SEQ ID NO: 62374 - protein, 9 aa, Homo Sapiens
CLFTTETFE

SEQ ID NO: 62375 - protein, 9 aa, Homo Sapiens
VDAVNLQLP

SEQ ID NO: 62376 - protein, 9 aa, Homo Sapiens
DSHPENDVY

SEQ ID NO: 62377 - protein, 9 aa, Homo Sapiens
CDLINFTWI

SEQ ID NO: 62378 - protein, 9 aa, Homo Sapiens
YQKNMAGST

SEQ ID NO: 62379 - protein, 9 aa, Homo Sapiens
SPPIPYSHK

SEQ ID NO: 62380 - protein, 9 aa, Homo Sapiens
IAEIAQVRG

SEQ ID NO: 62381 - protein, 9 aa, Homo Sapiens
ENHLYVLPP

SEQ ID NO: 62382 - protein, 9 aa, Homo Sapiens
GRRGEQSDD

SEQ ID NO: 62383 - protein, 9 aa, Homo Sapiens
SLMVTSITE

SEQ ID NO: 62384 - protein, 9 aa, Homo Sapiens
EYSFVPEKY

SEQ ID NO: 62385 - protein, 9 aa, Homo Sapiens
RVYKYSFEL

SEQ ID NO: 62386 - protein, 9 aa, Homo Sapiens
EEGLCERES

SEQ ID NO: 62387 - protein, 9 aa, Homo Sapiens
KSHAEFKKI

SEQ ID NO: 62388 - protein, 9 aa, Homo Sapiens
SILRDPNTP

SEQ ID NO: 62389 - protein, 9 aa, Homo Sapiens
THQYNVTLP

SEQ ID NO: 62390 - protein, 9 aa, Homo Sapiens
QRQQGKCLL

SEQ ID NO: 62391 - protein, 9 aa, Homo Sapiens
KYSFELVMA

SEQ ID NO: 62392 - protein, 9 aa, Homo Sapiens
KHLHLYCDL

SEQ ID NO: 62393 - protein, 9 aa, Homo Sapiens
SPVRVYKYS

SEQ ID NO: 62394 - protein, 9 aa, Homo Sapiens
HCWMAPQRD

SEQ ID NO: 62395 - protein, 9 aa, Homo Sapiens
LHLKSHAEF

SEQ ID NO: 62396 - protein, 9 aa, Homo Sapiens
RQKSPAILH

SEQ ID NO: 62397 - protein, 9 aa, Homo Sapiens
RIVALDLRN

SEQ ID NO: 62398 - protein, 9 aa, Homo Sapiens
ANLSPEDLL

SEQ ID NO: 62399 - protein, 9 aa, Homo Sapiens
PAILNDSHP

SEQ ID NO: 62400 - protein, 9 aa, Homo Sapiens
PVDAVNLQL

SEQ ID NO: 62401 - protein, 9 aa, Homo Sapiens
MVTSITEVA

SEQ ID NO: 62402 - protein, 9 aa, Homo Sapiens
RQQGKCLLL

SEQ ID NO: 62403 - protein, 9 aa, Homo Sapiens
KCSLYGKKL

SEQ ID NO: 62404 - protein, 9 aa, Homo Sapiens
VYKYSFELV

SEQ ID NO: 62405 - protein, 9 aa, Homo Sapiens
YLCIDHCWM

SEQ ID NO: 62406 - protein, 9 aa, Homo Sapiens
QEPDFAQSI

SEQ ID NO: 62407 - protein, 9 aa, Homo Sapiens
DWFEYHGHM

SEQ ID NO: 62408 - protein, 9 aa, Homo Sapiens
KTSSNHENS

SEQ ID NO: 62409 - protein, 9 aa, Homo Sapiens
QNLSAFFNW

SEQ ID NO: 62410 - protein, 9 aa, Homo Sapiens
TSITEVASN

SEQ ID NO: 62411 - protein, 9 aa, Homo Sapiens
LKSHAEFKK

SEQ ID NO: 62412 - protein, 9 aa, Homo Sapiens
DPNCGHRDI

SEQ ID NO: 62413 - protein, 9 aa, Homo Sapiens
MFDWFEYHG

SEQ ID NO: 62414 - protein, 9 aa, Homo Sapiens
NAVGESRFN

SEQ ID NO: 62415 - protein, 9 aa, Homo Sapiens
FTFDPNCGH

SEQ ID NO: 62416 - protein, 9 aa, Homo Sapiens
QFAWDCWNC

SEQ ID NO: 62417 - protein, 9 aa, Homo Sapiens
DKDYQKNMA

SEQ ID NO: 62418 - protein, 9 aa, Homo Sapiens
DKDVAPKLG

SEQ ID NO: 62419 - protein, 9 aa, Homo Sapiens
RWRAKGQAF

SEQ ID NO: 62420 - protein, 9 aa, Homo Sapiens
EHKRKSYER

SEQ ID NO: 62421 - protein, 9 aa, Homo Sapiens
PSLEEEAAG

SEQ ID NO: 62422 - protein, 9 aa, Homo Sapiens
HEDKPDFVI

SEQ ID NO: 62423 - protein, 9 aa, Homo Sapiens
SGEGDESTP

SEQ ID NO: 62424 - protein, 9 aa, Homo Sapiens
GPTKTYCHW

SEQ ID NO: 62425 - protein, 9 aa, Homo Sapiens
LLEKADLNP

SEQ ID NO: 62426 - protein, 9 aa, Homo Sapiens
WDCWNCPER

SEQ ID NO: 62427 - protein, 9 aa, Homo Sapiens
SEEFRALGI

SEQ ID NO: 62428 - protein, 9 aa, Homo Sapiens
TPLKLAGWQ

SEQ ID NO: 62429 - protein, 9 aa, Homo Sapiens
YLNVHMKNV

SEQ ID NO: 62430 - protein, 9 aa, Homo Sapiens
SITEVASNP

SEQ ID NO: 62431 - protein, 9 aa, Homo Sapiens
LLTGELLHT

SEQ ID NO: 62432 - protein, 9 aa, Homo Sapiens
HTYVSEEFR

SEQ ID NO: 62433 - protein, 9 aa, Homo Sapiens
PNCGHRDII

SEQ ID NO: 62434 - protein, 9 aa, Homo Sapiens
YRHLLQKEE

SEQ ID NO: 62435 - protein, 9 aa, Homo Sapiens
YQFAWDCWN

SEQ ID NO: 62436 - protein, 9 aa, Homo Sapiens
AQACVEANG

SEQ ID NO: 62437 - protein, 9 aa, Homo Sapiens
TDSPFTGYI

SEQ ID NO: 62438 - protein, 9 aa, Homo Sapiens
EVHYWKVKR

SEQ ID NO: 62439 - protein, 9 aa, Homo Sapiens
SPPSLYADK

SEQ ID NO: 62440 - protein, 9 aa, Homo Sapiens
SFELVMAAY

SEQ ID NO: 62441 - protein, 9 aa, Homo Sapiens
MLKVPTTEK

SEQ ID NO: 62442 - protein, 9 aa, Homo Sapiens
GVYERVGWH

SEQ ID NO: 62443 - protein, 9 aa, Homo Sapiens
KTQIEEMAK

SEQ ID NO: 62444 - protein, 9 aa, Homo Sapiens
STLNRHSMV

SEQ ID NO: 62445 - protein, 9 aa, Homo Sapiens
RALASFQEE

SEQ ID NO: 62446 - protein, 9 aa, Homo Sapiens
TVTRGARHG

SEQ ID NO: 62447 - protein, 9 aa, Homo Sapiens
VSLLLRDNY

SEQ ID NO: 62448 - protein, 9 aa, Homo Sapiens
MEGKLLKRA

SEQ ID NO: 62449 - protein, 9 aa, Homo Sapiens
TYCHWRLNF

SEQ ID NO: 62450 - protein, 9 aa, Homo Sapiens
TFDPNCGHR

SEQ ID NO: 62451 - protein, 9 aa, Homo Sapiens
AKSLKVFEL

SEQ ID NO: 62452 - protein, 9 aa, Homo Sapiens
LWNLRQKSP

SEQ ID NO: 62453 - protein, 9 aa, Homo Sapiens
QFLKTSSNH

SEQ ID NO: 62454 - protein, 9 aa, Homo Sapiens
SKGNAWAKY

SEQ ID NO: 62455 - protein, 9 aa, Homo Sapiens
VHMKNVQVI

SEQ ID NO: 62456 - protein, 9 aa, Homo Sapiens
VSMTGCGTQ

SEQ ID NO: 62457 - protein, 9 aa, Homo Sapiens
PIPYSHKPA

SEQ ID NO: 62458 - protein, 9 aa, Homo Sapiens
RLPGMFCFG

SEQ ID NO: 62459 - protein, 9 aa, Homo Sapiens
YLQVLNIND

SEQ ID NO: 62460 - protein, 9 aa, Homo Sapiens
VAAVERKRG

SEQ ID NO: 62461 - protein, 9 aa, Homo Sapiens
GDPIVKILG

SEQ ID NO: 62462 - protein, 9 aa, Homo Sapiens
KTPVSMTGC

SEQ ID NO: 62463 - protein, 9 aa, Homo Sapiens
NRLPGMFCF

SEQ ID NO: 62464 - protein, 9 aa, Homo Sapiens
VSEEFRALG

SEQ ID NO: 62465 - protein, 9 aa, Homo Sapiens
ADLNPSLDF

SEQ ID NO: 62466 - protein, 9 aa, Homo Sapiens
AYMPQSQNL

SEQ ID NO: 62467 - protein, 9 aa, Homo Sapiens
SFCGRSTLN

SEQ ID NO: 62468 - protein, 9 aa, Homo Sapiens
PFSPSQFLK

SEQ ID NO: 62469 - protein, 9 aa, Homo Sapiens
GEGLVLRPV

SEQ ID NO: 62470 - protein, 9 aa, Homo Sapiens
DITDTVREW

SEQ ID NO: 62471 - protein, 9 aa, Homo Sapiens
EKTMFDVLK

SEQ ID NO: 62472 - protein, 9 aa, Homo Sapiens
HYWKVKRSP

SEQ ID NO: 62473 - protein, 9 aa, Homo Sapiens
LERSDSVKQ

SEQ ID NO: 62474 - protein, 9 aa, Homo Sapiens
AEESEEGLC

SEQ ID NO: 62475 - protein, 9 aa, Homo Sapiens
GLLCYCSSS

SEQ ID NO: 62476 - protein, 9 aa, Homo Sapiens
GQGRGDAAL

SEQ ID NO: 62477 - protein, 9 aa, Homo Sapiens
SPSQFLKTS

SEQ ID NO: 62478 - protein, 9 aa, Homo Sapiens
ANMCRCLML

SEQ ID NO: 62479 - protein, 9 aa, Homo Sapiens
PVCTADLNR

SEQ ID NO: 62480 - protein, 9 aa, Homo Sapiens
CFGQDYVNM

SEQ ID NO: 62481 - protein, 9 aa, Homo Sapiens
ALHLKSHAE

SEQ ID NO: 62482 - protein, 9 aa, Homo Sapiens
DHCWMAPQR

SEQ ID NO: 62483 - protein, 9 aa, Homo Sapiens
LFINQATAN

SEQ ID NO: 62484 - protein, 9 aa, Homo Sapiens
DDGFYQCLA

SEQ ID NO: 62485 - protein, 9 aa, Homo Sapiens
IGDTPSLEE

SEQ ID NO: 62486 - protein, 9 aa, Homo Sapiens
LEEEAAGHV

SEQ ID NO: 62487 - protein, 9 aa, Homo Sapiens
TQIEEMAKS

SEQ ID NO: 62488 - protein, 9 aa, Homo Sapiens
GESRFNDAA

SEQ ID NO: 62489 - protein, 9 aa, Homo Sapiens
QKEEIRYYG

SEQ ID NO: 62490 - protein, 9 aa, Homo Sapiens
RREELLKKC

SEQ ID NO: 62491 - protein, 9 aa, Homo Sapiens
EFDKDYQKN

SEQ ID NO: 62492 - protein, 9 aa, Homo Sapiens
LMLKVPTTE

SEQ ID NO: 62493 - protein, 9 aa, Homo Sapiens
RKEKKLLEK

SEQ ID NO: 62494 - protein, 9 aa, Homo Sapiens
IDHCWMAPQ

SEQ ID NO: 62495 - protein, 9 aa, Homo Sapiens
KVKRSPSHC

SEQ ID NO: 62496 - protein, 9 aa, Homo Sapiens
MTGCGTQMF

SEQ ID NO: 62497 - protein, 9 aa, Homo Sapiens
LTSKGNAWA

SEQ ID NO: 62498 - protein, 9 aa, Homo Sapiens
KRGYNELCD

SEQ ID NO: 62499 - protein, 9 aa, Homo Sapiens
QGKCLLLWQ

SEQ ID NO: 62500 - protein, 9 aa, Homo Sapiens
NLQLPDYYT

SEQ ID NO: 62501 - protein, 9 aa, Homo Sapiens
DKPDFVIIC

SEQ ID NO: 62502 - protein, 9 aa, Homo Sapiens
YALNMLLHN

SEQ ID NO: 62503 - protein, 9 aa, Homo Sapiens
KASIIFVTH

SEQ ID NO: 62504 - protein, 9 aa, Homo Sapiens
CGPSGQGRG

SEQ ID NO: 62505 - protein, 9 aa, Homo Sapiens
LNPSLDFMD

SEQ ID NO: 62506 - protein, 9 aa, Homo Sapiens
TALQMFNRT

SEQ ID NO: 62507 - protein, 9 aa, Homo Sapiens
SLLLRDNYN

SEQ ID NO: 62508 - protein, 9 aa, Homo Sapiens
KKLVKISEI

SEQ ID NO: 62509 - protein, 9 aa, Homo Sapiens
GGRATGDWA

SEQ ID NO: 62510 - protein, 9 aa, Homo Sapiens
VMQELDRMM

SEQ ID NO: 62511 - protein, 9 aa, Homo Sapiens
NLSPEDLLR

SEQ ID NO: 62512 - protein, 9 aa, Homo Sapiens
PQLGGVKSG

SEQ ID NO: 62513 - protein, 9 aa, Homo Sapiens
ITDTVREWL

SEQ ID NO: 62514 - protein, 9 aa, Homo Sapiens
LLLRDNYNG

SEQ ID NO: 62515 - protein, 9 aa, Homo Sapiens
QKKLGGQNI

SEQ ID NO: 62516 - protein, 9 aa, Homo Sapiens
QNIFMTEEQ

SEQ ID NO: 62517 - protein, 9 aa, Homo Sapiens
CIDHCWMAP

SEQ ID NO: 62518 - protein, 9 aa, Homo Sapiens
SHKPAPEGS

SEQ ID NO: 62519 - protein, 9 aa, Homo Sapiens
AHTYVSEEF

SEQ ID NO: 62520 - protein, 9 aa, Homo Sapiens
AILNDSHPE

SEQ ID NO: 62521 - protein, 9 aa, Homo Sapiens
KKCSLYGKK

SEQ ID NO: 62522 - protein, 9 aa, Homo Sapiens
GDESTPDNL

SEQ ID NO: 62523 - protein, 9 aa, Homo Sapiens
IGMDGFSRS

SEQ ID NO: 62524 - protein, 9 aa, Homo Sapiens
PTKTYCHWR

SEQ ID NO: 62525 - protein, 9 aa, Homo Sapiens
QLGGVKSGW

SEQ ID NO: 62526 - protein, 9 aa, Homo Sapiens
TEVPASNLY

SEQ ID NO: 62527 - protein, 9 aa, Homo Sapiens
DCWNCPERA

SEQ ID NO: 62528 - protein, 9 aa, Homo Sapiens
CSSSETSVL

SEQ ID NO: 62529 - protein, 9 aa, Homo Sapiens
VCTADLNRG

SEQ ID NO: 62530 - protein, 9 aa, Homo Sapiens
LTPALSNSR

SEQ ID NO: 62531 - protein, 9 aa, Homo Sapiens
VEALEKSAD

SEQ ID NO: 62532 - protein, 9 aa, Homo Sapiens
FDKDYQKNM

SEQ ID NO: 62533 - protein, 9 aa, Homo Sapiens
LRDNYNGMS

SEQ ID NO: 62534 - protein, 9 aa, Homo Sapiens
TLLEKADLN

SEQ ID NO: 62535 - protein, 9 aa, Homo Sapiens
LGVCDRHKD

SEQ ID NO: 62536 - protein, 9 aa, Homo Sapiens
EVPASNLYA

SEQ ID NO: 62537 - protein, 9 aa, Homo Sapiens
VTPLKLAGW

SEQ ID NO: 62538 - protein, 9 aa, Homo Sapiens
KLSRHSKWL

SEQ ID NO: 62539 - protein, 9 aa, Homo Sapiens
RMMEGKLLK

SEQ ID NO: 62540 - protein, 9 aa, Homo Sapiens
SIPLYLQVL

SEQ ID NO: 62541 - protein, 9 aa, Homo Sapiens
NNDCYLEYS

SEQ ID NO: 62542 - protein, 9 aa, Homo Sapiens
VKRSPSHCL

SEQ ID NO: 62543 - protein, 9 aa, Homo Sapiens
TNNAVGESR

SEQ ID NO: 62544 - protein, 9 aa, Homo Sapiens
LGGQNIFMT

SEQ ID NO: 62545 - protein, 9 aa, Homo Sapiens
VGESRFNDA

SEQ ID NO: 62546 - protein, 9 aa, Homo Sapiens
GEKEVEALE

SEQ ID NO: 62547 - protein, 9 aa, Homo Sapiens
IGRIGMDGF

SEQ ID NO: 62548 - protein, 9 aa, Homo Sapiens
HLWNLRQKS

SEQ ID NO: 62549 - protein, 9 aa, Homo Sapiens
KAWNHIKKV

SEQ ID NO: 62550 - protein, 9 aa, Homo Sapiens
ISTRDPLSK

SEQ ID NO: 62551 - protein, 9 aa, Homo Sapiens
INQATANLS

SEQ ID NO: 62552 - protein, 9 aa, Homo Sapiens
FAWDCWNCP

SEQ ID NO: 62553 - protein, 9 aa, Homo Sapiens
KDYQKNMAG

SEQ ID NO: 62554 - protein, 9 aa, Homo Sapiens
EKADLNPSL

SEQ ID NO: 62555 - protein, 9 aa, Homo Sapiens
SPLCLVPYF

SEQ ID NO: 62556 - protein, 9 aa, Homo Sapiens
AVNLQLPDY

SEQ ID NO: 62557 - protein, 9 aa, Homo Sapiens
LRKSQVLFT

SEQ ID NO: 62558 - protein, 9 aa, Homo Sapiens
LFTVTRGAR

SEQ ID NO: 62559 - protein, 9 aa, Homo Sapiens
PVSMTGCGT

SEQ ID NO: 62560 - protein, 9 aa, Homo Sapiens
MGCGPSGQG

SEQ ID NO: 62561 - protein, 9 aa, Homo Sapiens
NKALHLKSH

SEQ ID NO: 62562 - protein, 9 aa, Homo Sapiens
LQVLNINDH

SEQ ID NO: 62563 - protein, 9 aa, Homo Sapiens
RRENHLYVL

SEQ ID NO: 62564 - protein, 9 aa, Homo Sapiens
ALDLRNHGE

SEQ ID NO: 62565 - protein, 9 aa, Homo Sapiens
GGVKSGWHL

SEQ ID NO: 62566 - protein, 9 aa, Homo Sapiens
YEYLCIDHC

SEQ ID NO: 62567 - protein, 9 aa, Homo Sapiens
DRHKDNIML

SEQ ID NO: 62568 - protein, 9 aa, Homo Sapiens
EVLTSKGNA

SEQ ID NO: 62569 - protein, 9 aa, Homo Sapiens
KVFSFVNRQ

SEQ ID NO: 62570 - protein, 9 aa, Homo Sapiens
RSTYLCRHG

SEQ ID NO: 62571 - protein, 9 aa, Homo Sapiens
VNLQLPDYY

SEQ ID NO: 62572 - protein, 9 aa, Homo Sapiens
QGRGDAALP

SEQ ID NO: 62573 - protein, 9 aa, Homo Sapiens
LVNVEKTMF

SEQ ID NO: 62574 - protein, 9 aa, Homo Sapiens
IAVTPLKLA

SEQ ID NO: 62575 - protein, 9 aa, Homo Sapiens
LSKITEQEK

SEQ ID NO: 62576 - protein, 9 aa, Homo Sapiens
VHYWKVKRS

SEQ ID NO: 62577 - protein, 9 aa, Homo Sapiens
QIEEMAKSL

SEQ ID NO: 62578 - protein, 9 aa, Homo Sapiens
QDGGVYERV

SEQ ID NO: 62579 - protein, 9 aa, Homo Sapiens
QQKKLGGQN

SEQ ID NO: 62580 - protein, 9 aa, Homo Sapiens
TKTYCHWRL

SEQ ID NO: 62581 - protein, 9 aa, Homo Sapiens
LAGWQCPEC

SEQ ID NO: 62582 - protein, 9 aa, Homo Sapiens
WKVKRSPSH

SEQ ID NO: 62583 - protein, 9 aa, Homo Sapiens
LLCYCSSSE

SEQ ID NO: 62584 - protein, 9 aa, Homo Sapiens
HAEFKKIFG

SEQ ID NO: 62585 - protein, 9 aa, Homo Sapiens
PDFVIICTR

SEQ ID NO: 62586 - protein, 9 aa, Homo Sapiens
MPSLTDSPF

SEQ ID NO: 62587 - protein, 9 aa, Homo Sapiens
AVTPLKLAG

SEQ ID NO: 62588 - protein, 9 aa, Homo Sapiens
KSLKVFELD

SEQ ID NO: 62589 - protein, 9 aa, Homo Sapiens
HQRKEKKLL

SEQ ID NO: 62590 - protein, 9 aa, Homo Sapiens
CRCLMLKVP

SEQ ID NO: 62591 - protein, 9 aa, Homo Sapiens
EESEEGLCE

SEQ ID NO: 62592 - protein, 9 aa, Homo Sapiens
KKGNKGKKK

SEQ ID NO: 62593 - protein, 9 aa, Homo Sapiens
TYVSEEFRA

SEQ ID NO: 62594 - protein, 9 aa, Homo Sapiens
LEKADLNPS

SEQ ID NO: 62595 - protein, 9 aa, Homo Sapiens
YISGEGDES

SEQ ID NO: 62596 - protein, 9 aa, Homo Sapiens
KDNIMLTKS

SEQ ID NO: 62597 - protein, 9 aa, Homo Sapiens
KSPAILHSL

SEQ ID NO: 62598 - protein, 9 aa, Homo Sapiens
LVLRPVCTA

SEQ ID NO: 62599 - protein, 9 aa, Homo Sapiens
GEGDESTPD

SEQ ID NO: 62600 - protein, 9 aa, Homo Sapiens
KNVQVIVKV

SEQ ID NO: 62601 - protein, 9 aa, Homo Sapiens
VTHQYNVTL

SEQ ID NO: 62602 - protein, 9 aa, Homo Sapiens
RIGMDGFSR

SEQ ID NO: 62603 - protein, 9 aa, Homo Sapiens
SQFLKTSSN

SEQ ID NO: 62604 - protein, 9 aa, Homo Sapiens
EWDKDVAPK

SEQ ID NO: 62605 - protein, 9 aa, Homo Sapiens
LKKLKAWNH

SEQ ID NO: 62606 - protein, 9 aa, Homo Sapiens
GRATGDWAK

SEQ ID NO: 62607 - protein, 9 aa, Homo Sapiens
DRAIAEIAQ

SEQ ID NO: 62608 - protein, 9 aa, Homo Sapiens
PPGYLTALQ

SEQ ID NO: 62609 - protein, 9 aa, Homo Sapiens
CWNCPERAL

SEQ ID NO: 62610 - protein, 9 aa, Homo Sapiens
LMTVSLLLR

SEQ ID NO: 62611 - protein, 9 aa, Homo Sapiens
EYHGHMCIS

SEQ ID NO: 62612 - protein, 9 aa, Homo Sapiens
QLKAQELER

SEQ ID NO: 62613 - protein, 9 aa, Homo Sapiens
SKITEQEKD

SEQ ID NO: 62614 - protein, 9 aa, Homo Sapiens
SHAEFKKIF

SEQ ID NO: 62615 - protein, 9 aa, Homo Sapiens
SLEEEAAGH

SEQ ID NO: 62616 - protein, 9 aa, Homo Sapiens
RPVCTADLN

SEQ ID NO: 62617 - protein, 9 aa, Homo Sapiens
IHERIHNRE

SEQ ID NO: 62618 - protein, 9 aa, Homo Sapiens
SFDITDTVR

SEQ ID NO: 62619 - protein, 9 aa, Homo Sapiens
KKLLEKIQS

SEQ ID NO: 62620 - protein, 9 aa, Homo Sapiens
AGQRQQGKC

SEQ ID NO: 62621 - protein, 9 aa, Homo Sapiens
PGIPAILND

SEQ ID NO: 62622 - protein, 9 aa, Homo Sapiens
VSPPSLYAD

SEQ ID NO: 62623 - protein, 9 aa, Homo Sapiens
KEVEALEKS

SEQ ID NO: 62624 - protein, 9 aa, Homo Sapiens
NVHMKNVQV

SEQ ID NO: 62625 - protein, 9 aa, Homo Sapiens
DAVNLQLPD

SEQ ID NO: 62626 - protein, 9 aa, Homo Sapiens
HLYCDLINF

SEQ ID NO: 62627 - protein, 9 aa, Homo Sapiens
WNHIKKVYA

SEQ ID NO: 62628 - protein, 9 aa, Homo Sapiens
VTSITEVAS

SEQ ID NO: 62629 - protein, 9 aa, Homo Sapiens
KNMAGSTLT

SEQ ID NO: 62630 - protein, 9 aa, Homo Sapiens
FSFVNRQNF

SEQ ID NO: 62631 - protein, 9 aa, Homo Sapiens
QVRRENHLY

SEQ ID NO: 62632 - protein, 9 aa, Homo Sapiens
NMAGSTLTF

SEQ ID NO: 62633 - protein, 9 aa, Homo Sapiens
LDRAIAEIA

SEQ ID NO: 62634 - protein, 9 aa, Homo Sapiens
QELDRMMEG

SEQ ID NO: 62635 - protein, 9 aa, Homo Sapiens
GKTPVSMTG

SEQ ID NO: 62636 - protein, 9 aa, Homo Sapiens
GPSGQGRGD

SEQ ID NO: 62637 - protein, 9 aa, Homo Sapiens
CGRSTLNRH

SEQ ID NO: 62638 - protein, 9 aa, Homo Sapiens
PGMFCFGQD

SEQ ID NO: 62639 - protein, 9 aa, Homo Sapiens
NVEKTMFDV

SEQ ID NO: 62640 - protein, 9 aa, Homo Sapiens
SFPMKGGRA

SEQ ID NO: 62641 - protein, 9 aa, Homo Sapiens
NTEVPASNL

SEQ ID NO: 62642 - protein, 9 aa, Homo Sapiens
ERIHNREKP

SEQ ID NO: 62643 - protein, 9 aa, Homo Sapiens
HLYVLPPLQ

SEQ ID NO: 62644 - protein, 9 aa, Homo Sapiens
DLNPSLDFM

SEQ ID NO: 62645 - protein, 9 aa, Homo Sapiens
TAEWLSFDI

SEQ ID NO: 62646 - protein, 9 aa, Homo Sapiens
QSILRDPNT

SEQ ID NO: 62647 - protein, 9 aa, Homo Sapiens
RAKGQAFPD

SEQ ID NO: 62648 - protein, 9 aa, Homo Sapiens
GRIGMDGFS

SEQ ID NO: 62649 - protein, 9 aa, Homo Sapiens
PSLTDSPFT

SEQ ID NO: 62650 - protein, 9 aa, Homo Sapiens
SKWLQILGK

SEQ ID NO: 62651 - protein, 9 aa, Homo Sapiens
RHKDNIMLT

SEQ ID NO: 62652 - protein, 9 aa, Homo Sapiens
ISGEGDEST

SEQ ID NO: 62653 - protein, 9 aa, Homo Sapiens
VRRENHLYV

SEQ ID NO: 62654 - protein, 9 aa, Homo Sapiens
ESEEGLCER

SEQ ID NO: 62655 - protein, 9 aa, Homo Sapiens
YADKPLEES

SEQ ID NO: 62656 - protein, 9 aa, Homo Sapiens
LDLRNHGET

SEQ ID NO: 62657 - protein, 9 aa, Homo Sapiens
LVSPLCLVP

SEQ ID NO: 62658 - protein, 9 aa, Homo Sapiens
ACVEANGDP

SEQ ID NO: 62659 - protein, 9 aa, Homo Sapiens
LFTTETFET

SEQ ID NO: 62660 - protein, 9 aa, Homo Sapiens
LTDSPFTGY

SEQ ID NO: 62661 - protein, 9 aa, Homo Sapiens
ILRDPNTPI

SEQ ID NO: 62662 - protein, 9 aa, Homo Sapiens
KGQAFPDVV

SEQ ID NO: 62663 - protein, 9 aa, Homo Sapiens
PPSLYADKP

SEQ ID NO: 62664 - protein, 9 aa, Homo Sapiens
PKLGSTTVG

SEQ ID NO: 62665 - protein, 9 aa, Homo Sapiens
NREKPYECK

SEQ ID NO: 62666 - protein, 9 aa, Homo Sapiens
LRPVCTADL

SEQ ID NO: 62667 - protein, 9 aa, Homo Sapiens
EELLKKCSL

SEQ ID NO: 62668 - protein, 9 aa, Homo Sapiens
TSKGNAWAK

SEQ ID NO: 62669 - protein, 9 aa, Homo Sapiens
YWKVKRSPS

SEQ ID NO: 62670 - protein, 9 aa, Homo Sapiens
AWFTFDPNC

SEQ ID NO: 62671 - protein, 9 aa, Homo Sapiens
KLDRAIAEI

SEQ ID NO: 62672 - protein, 9 aa, Homo Sapiens
ANGDPIVKI

SEQ ID NO: 62673 - protein, 9 aa, Homo Sapiens
DSIAEESEE

SEQ ID NO: 62674 - protein, 9 aa, Homo Sapiens
RHSKWLQIL

SEQ ID NO: 62675 - protein, 9 aa, Homo Sapiens
LTGELLHTD

SEQ ID NO: 62676 - protein, 9 aa, Homo Sapiens
HKRKSYERA

SEQ ID NO: 62677 - protein, 9 aa, Homo Sapiens
VYERVGWHI

SEQ ID NO: 62678 - protein, 9 aa, Homo Sapiens
DVAPKLGST

SEQ ID NO: 62679 - protein, 9 aa, Homo Sapiens
LQKEEIRYY

SEQ ID NO: 62680 - protein, 9 aa, Homo Sapiens
WRAKGQAFP

SEQ ID NO: 62681 - protein, 9 aa, Homo Sapiens
NKGKKKEKK

SEQ ID NO: 62682 - protein, 9 aa, Homo Sapiens
VLRPVCTAD

SEQ ID NO: 62683 - protein, 9 aa, Homo Sapiens
FVNRQNFIN

SEQ ID NO: 62684 - protein, 9 aa, Homo Sapiens
HQYNVTLPA

SEQ ID NO: 62685 - protein, 9 aa, Homo Sapiens
LTNNAVGES

SEQ ID NO: 62686 - protein, 9 aa, Homo Sapiens
IFVTHQYNV

SEQ ID NO: 62687 - protein, 9 aa, Homo Sapiens
LRNHGETKV

SEQ ID NO: 62688 - protein, 9 aa, Homo Sapiens
DRMMEGKLL

SEQ ID NO: 62689 - protein, 9 aa, Homo Sapiens
FKLSRHSKW

SEQ ID NO: 62690 - protein, 9 aa, Homo Sapiens
YCSSSETSV

SEQ ID NO: 62691 - protein, 9 aa, Homo Sapiens
HKPAPEGSC

SEQ ID NO: 62692 - protein, 9 aa, Homo Sapiens
GQRQQGKCL

SEQ ID NO: 62693 - protein, 9 aa, Homo Sapiens
VIICTRLSP

SEQ ID NO: 62694 - protein, 9 aa, Homo Sapiens
AEEKLDRAI

SEQ ID NO: 62695 - protein, 9 aa, Homo Sapiens
GLVLRPVCT

SEQ ID NO: 62696 - protein, 9 aa, Homo Sapiens
SFVNRQNFI

SEQ ID NO: 62697 - protein, 9 aa, Homo Sapiens
VPYFRLLRL

SEQ ID NO: 62698 - protein, 9 aa, Homo Sapiens
APKLGSTTV

SEQ ID NO: 62699 - protein, 9 aa, Homo Sapiens
KRKSYERAL

SEQ ID NO: 62700 - protein, 9 aa, Homo Sapiens
QKNMAGSTL

SEQ ID NO: 62701 - protein, 9 aa, Homo Sapiens
EEKLDRAIA

SEQ ID NO: 62702 - protein, 9 aa, Homo Sapiens
EKSADWVSD

SEQ ID NO: 62703 - protein, 9 aa, Homo Sapiens
ISSLMVTSI

SEQ ID NO: 62704 - protein, 9 aa, Homo Sapiens
HLLQKEEIR

SEQ ID NO: 62705 - protein, 9 aa, Homo Sapiens
SPAILHSLK

SEQ ID NO: 62706 - protein, 9 aa, Homo Sapiens
IPYSHKPAP

SEQ ID NO: 62707 - protein, 9 aa, Homo Sapiens
VAPKLGSTT

SEQ ID NO: 62708 - protein, 9 aa, Homo Sapiens
PLSKITEQE

SEQ ID NO: 62709 - protein, 9 aa, Homo Sapiens
DEVLTSKGN

SEQ ID NO: 62710 - protein, 9 aa, Homo Sapiens
MGKTPVSMT

SEQ ID NO: 62711 - protein, 9 aa, Homo Sapiens
VKSGWHLQE

SEQ ID NO: 62712 - protein, 9 aa, Homo Sapiens
SEEGLCERE

SEQ ID NO: 62713 - protein, 9 aa, Homo Sapiens
FTVTRGARH

SEQ ID NO: 62714 - protein, 9 aa, Homo Sapiens
RKSQVLFTV

SEQ ID NO: 62715 - protein, 9 aa, Homo Sapiens
TRDPLSKIT

SEQ ID NO: 62716 - protein, 9 aa, Homo Sapiens
ERKRGYNEL

SEQ ID NO: 62717 - protein, 9 aa, Homo Sapiens
DPLSKITEQ

SEQ ID NO: 62718 - protein, 9 aa, Homo Sapiens
MPQSQNLSA

SEQ ID NO: 62719 - protein, 9 aa, Homo Sapiens
VAVKVFSFV

SEQ ID NO: 62720 - protein, 9 aa, Homo Sapiens
DLRNHGETK

SEQ ID NO: 62721 - protein, 9 aa, Homo Sapiens
YGKKLVKIS

SEQ ID NO: 62722 - protein, 9 aa, Homo Sapiens
QISSIPLYL

SEQ ID NO: 62723 - protein, 9 aa, Homo Sapiens
FSRSVIVDT

SEQ ID NO: 62724 - protein, 9 aa, Homo Sapiens
SLYGKKLVK

SEQ ID NO: 62725 - protein, 9 aa, Homo Sapiens
TLTPALSNS

SEQ ID NO: 62726 - protein, 9 aa, Homo Sapiens
KEKKLLEKI

SEQ ID NO: 62727 - protein, 9 aa, Homo Sapiens
LRQKSPAIL

SEQ ID NO: 62728 - protein, 9 aa, Homo Sapiens
DYQKNMAGS

SEQ ID NO: 62729 - protein, 9 aa, Homo Sapiens
YLTALQMFN

SEQ ID NO: 62730 - protein, 9 aa, Homo Sapiens
SSLMVTSIT

SEQ ID NO: 62731 - protein, 9 aa, Homo Sapiens
HVTPRSTYL

SEQ ID NO: 62732 - protein, 9 aa, Homo Sapiens
ELDRMMEGK

SEQ ID NO: 62733 - protein, 9 aa, Homo Sapiens
NHLYVLPPL

SEQ ID NO: 62734 - protein, 9 aa, Homo Sapiens
DFVIICTRL

SEQ ID NO: 62735 - protein, 9 aa, Homo Sapiens
FLKTSSNHE

SEQ ID NO: 62736 - protein, 9 aa, Homo Sapiens
LYLQVLNIN

SEQ ID NO: 62737 - protein, 9 aa, Homo Sapiens
LEYSFVPEK

SEQ ID NO: 62738 - protein, 9 aa, Homo Sapiens
AFPDVVAKY

SEQ ID NO: 62739 - protein, 9 aa, Homo Sapiens
VNGHMPSLT

SEQ ID NO: 62740 - protein, 9 aa, Homo Sapiens
VFSFVNRQN

SEQ ID NO: 62741 - protein, 9 aa, Homo Sapiens
ATANLSPED

SEQ ID NO: 62742 - protein, 9 aa, Homo Sapiens
WLSFDITDT

SEQ ID NO: 62743 - protein, 9 aa, Homo Sapiens
SYERALASF

SEQ ID NO: 62744 - protein, 9 aa, Homo Sapiens
QEPLYQCLF

SEQ ID NO: 62745 - protein, 9 aa, Homo Sapiens
AAGQRQQGK

SEQ ID NO: 62746 - protein, 9 aa, Homo Sapiens
IHVTPRSTY

SEQ ID NO: 62747 - protein, 9 aa, Homo Sapiens
EMAKSLKVF

SEQ ID NO: 62748 - protein, 9 aa, Homo Sapiens
KLAGWQCPE

SEQ ID NO: 62749 - protein, 9 aa, Homo Sapiens
LLQKEEIRY

SEQ ID NO: 62750 - protein, 9 aa, Homo Sapiens
KKKDKKKGN

SEQ ID NO: 62751 - protein, 9 aa, Homo Sapiens
KWLQILGKT

SEQ ID NO: 62752 - protein, 9 aa, Homo Sapiens
DAYMPQSQN

SEQ ID NO: 62753 - protein, 9 aa, Homo Sapiens
NDSHPENDV

SEQ ID NO: 62754 - protein, 9 aa, Homo Sapiens
KSYERALAS

SEQ ID NO: 62755 - protein, 9 aa, Homo Sapiens
NIHVTPRST

SEQ ID NO: 62756 - protein, 9 aa, Homo Sapiens
LGGVKSGWH

SEQ ID NO: 62757 - protein, 9 aa, Homo Sapiens
PDFAQSILR

SEQ ID NO: 62758 - protein, 9 aa, Homo Sapiens
AQELERSDS

SEQ ID NO: 62759 - protein, 9 aa, Homo Sapiens
LKTSSNHEN

SEQ ID NO: 62760 - protein, 9 aa, Homo Sapiens
KLLEKIQSA

SEQ ID NO: 62761 - protein, 9 aa, Homo Sapiens
VSPLCLVPY

SEQ ID NO: 62762 - protein, 9 aa, Homo Sapiens
MAKSLKVFE

SEQ ID NO: 62763 - protein, 9 aa, Homo Sapiens
NNAVGESRF

SEQ ID NO: 62764 - protein, 9 aa, Homo Sapiens
GDTPSLEEE

SEQ ID NO: 62765 - protein, 9 aa, Homo Sapiens
EGLVLRPVC

SEQ ID NO: 62766 - protein, 9 aa, Homo Sapiens
TANLSPEDL

SEQ ID NO: 62767 - protein, 9 aa, Homo Sapiens
CVEANGDPI

SEQ ID NO: 62768 - protein, 9 aa, Homo Sapiens
NVQVIVKVN

SEQ ID NO: 62769 - protein, 9 aa, Homo Sapiens
FPMKGGRAT

SEQ ID NO: 62770 - protein, 9 aa, Homo Sapiens
IPAILNDSH

SEQ ID NO: 62771 - protein, 9 aa, Homo Sapiens
DIAVTPLKL

SEQ ID NO: 62772 - protein, 9 aa, Homo Sapiens
ALSNSRKIQ

SEQ ID NO: 62773 - protein, 9 aa, Homo Sapiens
EWLSFDITD

SEQ ID NO: 62774 - protein, 9 aa, Homo Sapiens
KADLNPSLD

SEQ ID NO: 62775 - protein, 9 aa, Homo Sapiens
IIHERIHNR

SEQ ID NO: 62776 - protein, 9 aa, Homo Sapiens
QVLFTVTRG

SEQ ID NO: 62777 - protein, 9 aa, Homo Sapiens
DESTPDNLD

SEQ ID NO: 62778 - protein, 9 aa, Homo Sapiens
PLCLVPYFR

SEQ ID NO: 62779 - protein, 9 aa, Homo Sapiens
KAQELERSD

SEQ ID NO: 62780 - protein, 9 aa, Homo Sapiens
RHLLQKEEI

SEQ ID NO: 62781 - protein, 9 aa, Homo Sapiens
RCLMLKVPT

SEQ ID NO: 62782 - protein, 9 aa, Homo Sapiens
SIAEESEEG

SEQ ID NO: 62783 - protein, 9 aa, Homo Sapiens
VEANGDPIV

SEQ ID NO: 62784 - protein, 9 aa, Homo Sapiens
STRDPLSKI

SEQ ID NO: 62785 - protein, 9 aa, Homo Sapiens
LQMFNRTYK

SEQ ID NO: 62786 - protein, 9 aa, Homo Sapiens
RVGWHIQGS

SEQ ID NO: 62787 - protein, 9 aa, Homo Sapiens
QAFPDVVAK

SEQ ID NO: 62788 - protein, 9 aa, Homo Sapiens
VCDRHKDNI

SEQ ID NO: 62789 - protein, 9 aa, Homo Sapiens
LSNSRKIQS

SEQ ID NO: 62790 - protein, 9 aa, Homo Sapiens
ITEVASNPA

SEQ ID NO: 62791 - protein, 9 aa, Homo Sapiens
LQGLLCYCS

SEQ ID NO: 62792 - protein, 9 aa, Homo Sapiens
SNSRKIQSE

SEQ ID NO: 62793 - protein, 9 aa, Homo Sapiens
QSQNLSAFF

SEQ ID NO: 62794 - protein, 9 aa, Homo Sapiens
DGGVYERVG

SEQ ID NO: 62795 - protein, 9 aa, Homo Sapiens
KKDKKKGNK

SEQ ID NO: 62796 - protein, 9 aa, Homo Sapiens
WFEYHGHMC

SEQ ID NO: 62797 - protein, 9 aa, Homo Sapiens
SMTGCGTQM

SEQ ID NO: 62798 - protein, 9 aa, Homo Sapiens
LHTDGMIRK

SEQ ID NO: 62799 - protein, 9 aa, Homo Sapiens
AWNHIKKVY

SEQ ID NO: 62800 - protein, 9 aa, Homo Sapiens
LNDSHPEND

SEQ ID NO: 62801 - protein, 9 aa, Homo Sapiens
NPSLDFMDS

SEQ ID NO: 62802 - protein, 9 aa, Homo Sapiens
IVALDLRNH

SEQ ID NO: 62803 - protein, 9 aa, Homo Sapiens
KDVAPKLGS

SEQ ID NO: 62804 - protein, 9 aa, Homo Sapiens
GELLHTDGM

SEQ ID NO: 62805 - protein, 9 aa, Homo Sapiens
QWLVNVEKT

SEQ ID NO: 62806 - protein, 9 aa, Homo Sapiens
SLYADKPLE

SEQ ID NO: 62807 - protein, 9 aa, Homo Sapiens
PVRVYKYSF

SEQ ID NO: 62808 - protein, 9 aa, Homo Sapiens
ATYRHLLQK

SEQ ID NO: 62809 - protein, 9 aa, Homo Sapiens
PSQFLKTSS

SEQ ID NO: 62810 - protein, 9 aa, Homo Sapiens
PLYLQVLNI

SEQ ID NO: 62811 - protein, 9 aa, Homo Sapiens
QRPVDAVNL

SEQ ID NO: 62812 - protein, 9 aa, Homo Sapiens
TYLCRHGES

SEQ ID NO: 62813 - protein, 9 aa, Homo Sapiens
EDKPDFVII

SEQ ID NO: 62814 - protein, 9 aa, Homo Sapiens
EEWDKDVAP

SEQ ID NO: 62815 - protein, 9 aa, Homo Sapiens
GHMPSLTDS

SEQ ID NO: 62816 - protein, 9 aa, Homo Sapiens
NGDPIVKIL

SEQ ID NO: 62817 - protein, 9 aa, Homo Sapiens
HLKSHAEFK

SEQ ID NO: 62818 - protein, 9 aa, Homo Sapiens
AEWLSFDIT

SEQ ID NO: 62819 - protein, 9 aa, Homo Sapiens
FEYHGHMCI

SEQ ID NO: 62820 - protein, 9 aa, Homo Sapiens
GNTEVPASN

SEQ ID NO: 62821 - protein, 9 aa, Homo Sapiens
QRKEKKLLE

SEQ ID NO: 62822 - protein, 9 aa, Homo Sapiens
DFAQSILRD

SEQ ID NO: 62823 - protein, 9 aa, Homo Sapiens
VPASNLYAY

SEQ ID NO: 62824 - protein, 9 aa, Homo Sapiens
QATANLSPE

SEQ ID NO: 62825 - protein, 9 aa, Homo Sapiens
KSFCGRSTL

SEQ ID NO: 62826 - protein, 9 aa, Homo Sapiens
HKDNIMLTK

SEQ ID NO: 62827 - protein, 9 aa, Homo Sapiens
WFTFDPNCG

SEQ ID NO: 62828 - protein, 9 aa, Homo Sapiens
EKKLLEKIQ

SEQ ID NO: 62829 - protein, 9 aa, Homo Sapiens
CGNTEVPAS

SEQ ID NO: 62830 - protein, 9 aa, Homo Sapiens
NHIKKVYAS

SEQ ID NO: 62831 - protein, 9 aa, Homo Sapiens
EFRALGIPF

SEQ ID NO: 62832 - protein, 9 aa, Homo Sapiens
LYGKKLVKI

SEQ ID NO: 62833 - protein, 9 aa, Homo Sapiens
LLRDNYNGM

SEQ ID NO: 62834 - protein, 9 aa, Homo Sapiens
ALQMFNRTY

SEQ ID NO: 62835 - protein, 9 aa, Homo Sapiens
TQVRRENHL

SEQ ID NO: 62836 - protein, 9 aa, Homo Sapiens
CDRHKDNIM

SEQ ID NO: 62837 - protein, 9 aa, Homo Sapiens
KCLLLWQAR

SEQ ID NO: 62838 - protein, 9 aa, Homo Sapiens
CYLEYSFVP

SEQ ID NO: 62839 - protein, 9 aa, Homo Sapiens
ISFPMKGGR

SEQ ID NO: 62840 - protein, 9 aa, Homo Sapiens
RAIAEIAQV

SEQ ID NO: 62841 - protein, 9 aa, Homo Sapiens
MMEGKLLKR

SEQ ID NO: 62842 - protein, 9 aa, Homo Sapiens
EHQRKEKKL

SEQ ID NO: 62843 - protein, 9 aa, Homo Sapiens
KALHLKSHA

SEQ ID NO: 62844 - protein, 9 aa, Homo Sapiens
KITEQEKDF

SEQ ID NO: 62845 - protein, 9 aa, Homo Sapiens
KLLTGELLH

SEQ ID NO: 62846 - protein, 9 aa, Homo Sapiens
MCRCLMLKV

SEQ ID NO: 62847 - protein, 9 aa, Homo Sapiens
CGHRDIILS

SEQ ID NO: 62848 - protein, 9 aa, Homo Sapiens
PQSQNLSAF

SEQ ID NO: 62849 - protein, 9 aa, Homo Sapiens
LLHTDGMIR

SEQ ID NO: 62850 - protein, 9 aa, Homo Sapiens
FGQDYVNMS

SEQ ID NO: 62851 - protein, 9 aa, Homo Sapiens
GQDGGVYER

SEQ ID NO: 62852 - protein, 9 aa, Homo Sapiens
EEEAAGHVT

SEQ ID NO: 62853 - protein, 9 aa, Homo Sapiens
MQELDRMME

SEQ ID NO: 62854 - protein, 9 aa, Homo Sapiens
PGYLTALQM

SEQ ID NO: 62855 - protein, 9 aa, Homo Sapiens
GVGLTLAPA

SEQ ID NO: 62856 - protein, 9 aa, Homo Sapiens
IGGIDGCLC

SEQ ID NO: 62857 - protein, 9 aa, Homo Sapiens
FCYQDFPGP

SEQ ID NO: 62858 - protein, 9 aa, Homo Sapiens
SSPRSFPRP

SEQ ID NO: 62859 - protein, 9 aa, Homo Sapiens
VNPNPRLHM

SEQ ID NO: 62860 - protein, 9 aa, Homo Sapiens
GKLSDNISK

SEQ ID NO: 62861 - protein, 9 aa, Homo Sapiens
AEVLKQRSS

SEQ ID NO: 62862 - protein, 9 aa, Homo Sapiens
LKQRSSRQD

SEQ ID NO: 62863 - protein, 9 aa, Homo Sapiens
KGKLSDNIS

SEQ ID NO: 62864 - protein, 9 aa, Homo Sapiens
SSVAGETLV

SEQ ID NO: 62865 - protein, 9 aa, Homo Sapiens
TLVLAVPSW

SEQ ID NO: 62866 - protein, 9 aa, Homo Sapiens
FHQTQTPDP

SEQ ID NO: 62867 - protein, 9 aa, Homo Sapiens
LSTSLPPPA

SEQ ID NO: 62868 - protein, 9 aa, Homo Sapiens
LPSGSTLLT

SEQ ID NO: 62869 - protein, 9 aa, Homo Sapiens
SLVPGYEDK

SEQ ID NO: 62870 - protein, 9 aa, Homo Sapiens
PPSYTSPAP

SEQ ID NO: 62871 - protein, 9 aa, Homo Sapiens
SISNIQAGS

SEQ ID NO: 62872 - protein, 9 aa, Homo Sapiens
VFYFSILYP

SEQ ID NO: 62873 - protein, 9 aa, Homo Sapiens
DSLKAFILL

SEQ ID NO: 62874 - protein, 9 aa, Homo Sapiens
HNRYEGKHV

SEQ ID NO: 62875 - protein, 9 aa, Homo Sapiens
LWELLPTTL

SEQ ID NO: 62876 - protein, 9 aa, Homo Sapiens
PAITPSSSS

SEQ ID NO: 62877 - protein, 9 aa, Homo Sapiens
SDNISKLEK

SEQ ID NO: 62878 - protein, 9 aa, Homo Sapiens
PQGSGGPLQ

SEQ ID NO: 62879 - protein, 9 aa, Homo Sapiens
RDTDWARLL

SEQ ID NO: 62880 - protein, 9 aa, Homo Sapiens
AVTEDLPSG

SEQ ID NO: 62881 - protein, 9 aa, Homo Sapiens
ELSLAPEGL

SEQ ID NO: 62882 - protein, 9 aa, Homo Sapiens
LFLWELLPT

SEQ ID NO: 62883 - protein, 9 aa, Homo Sapiens
SRLSTSLPP

SEQ ID NO: 62884 - protein, 9 aa, Homo Sapiens
WGVGLTLAP

SEQ ID NO: 62885 - protein, 9 aa, Homo Sapiens
YQDFPGPRE

SEQ ID NO: 62886 - protein, 9 aa, Homo Sapiens
RSFPRPEGT

SEQ ID NO: 62887 - protein, 9 aa, Homo Sapiens
VTEDLPSGS

SEQ ID NO: 62888 - protein, 9 aa, Homo Sapiens
AKLGTSSHP

SEQ ID NO: 62889 - protein, 9 aa, Homo Sapiens
VLKQRSSRQ

SEQ ID NO: 62890 - protein, 9 aa, Homo Sapiens
QRTRPQGSG

SEQ ID NO: 62891 - protein, 9 aa, Homo Sapiens
AFKRGQRLY

SEQ ID NO: 62892 - protein, 9 aa, Homo Sapiens
LKNQLRQMS

SEQ ID NO: 62893 - protein, 9 aa, Homo Sapiens
SGSTLLTLE

SEQ ID NO: 62894 - protein, 9 aa, Homo Sapiens
IDKGPPVIF

SEQ ID NO: 62895 - protein, 9 aa, Homo Sapiens
LQANRIPQC

SEQ ID NO: 62896 - protein, 9 aa, Homo Sapiens
SLTWGVGLT

SEQ ID NO: 62897 - protein, 9 aa, Homo Sapiens
PVIFWISGF

SEQ ID NO: 62898 - protein, 9 aa, Homo Sapiens
VESVGAKHY

SEQ ID NO: 62899 - protein, 9 aa, Homo Sapiens
KAVVQSPQF

SEQ ID NO: 62900 - protein, 9 aa, Homo Sapiens
ESRVSGISI

SEQ ID NO: 62901 - protein, 9 aa, Homo Sapiens
NRYEGKHVS

SEQ ID NO: 62902 - protein, 9 aa, Homo Sapiens
NTVRCGNQY

SEQ ID NO: 62903 - protein, 9 aa, Homo Sapiens
LWHNTVRCG

SEQ ID NO: 62904 - protein, 9 aa, Homo Sapiens
DSVSMFKIE

SEQ ID NO: 62905 - protein, 9 aa, Homo Sapiens
KRGQRLYEK

SEQ ID NO: 62906 - protein, 9 aa, Homo Sapiens
GVVLFLWEL

SEQ ID NO: 62907 - protein, 9 aa, Homo Sapiens
RPQGSGGPL

SEQ ID NO: 62908 - protein, 9 aa, Homo Sapiens
EEFGIMGDH

SEQ ID NO: 62909 - protein, 9 aa, Homo Sapiens
EVLKQRSSR

SEQ ID NO: 62910 - protein, 9 aa, Homo Sapiens
RDHFIQTLS

SEQ ID NO: 62911 - protein, 9 aa, Homo Sapiens
ALLLCNGIR

SEQ ID NO: 62912 - protein, 9 aa, Homo Sapiens
LLCNGIRYK

SEQ ID NO: 62913 - protein, 9 aa, Homo Sapiens
YSRSRDNGP

SEQ ID NO: 62914 - protein, 9 aa, Homo Sapiens
CYQDFPGPR

SEQ ID NO: 62915 - protein, 9 aa, Homo Sapiens
QTQTPDPIL

SEQ ID NO: 62916 - protein, 9 aa, Homo Sapiens
NCSVLKNQL

SEQ ID NO: 62917 - protein, 9 aa, Homo Sapiens
DNEVKAFKR

SEQ ID NO: 62918 - protein, 9 aa, Homo Sapiens
HSVNPNPRL

SEQ ID NO: 62919 - protein, 9 aa, Homo Sapiens
SSHPLHAFA

SEQ ID NO: 62920 - protein, 9 aa, Homo Sapiens
DTGAEILYE

SEQ ID NO: 62921 - protein, 9 aa, Homo Sapiens
IRLSCDTGA

SEQ ID NO: 62922 - protein, 9 aa, Homo Sapiens
EDNCSVLKN

SEQ ID NO: 62923 - protein, 9 aa, Homo Sapiens
SLIASALSI

SEQ ID NO: 62924 - protein, 9 aa, Homo Sapiens
HPLWALRWG

SEQ ID NO: 62925 - protein, 9 aa, Homo Sapiens
ISIDVAVPE

SEQ ID NO: 62926 - protein, 9 aa, Homo Sapiens
RQFCYQDFP

SEQ ID NO: 62927 - protein, 9 aa, Homo Sapiens
PRILQLLVA

SEQ ID NO: 62928 - protein, 9 aa, Homo Sapiens
KTEDYLRKS

SEQ ID NO: 62929 - protein, 9 aa, Homo Sapiens
VIFWISGFY

SEQ ID NO: 62930 - protein, 9 aa, Homo Sapiens
CSVLKNQLR

SEQ ID NO: 62931 - protein, 9 aa, Homo Sapiens
YIRLSCDTG

SEQ ID NO: 62932 - protein, 9 aa, Homo Sapiens
PTTSSLPCP

SEQ ID NO: 62933 - protein, 9 aa, Homo Sapiens
LIASALSIS

SEQ ID NO: 62934 - protein, 9 aa, Homo Sapiens
LTLAPALWW

SEQ ID NO: 62935 - protein, 9 aa, Homo Sapiens
CSLIASALS

SEQ ID NO: 62936 - protein, 9 aa, Homo Sapiens
TEDYLRKSI

SEQ ID NO: 62937 - protein, 9 aa, Homo Sapiens
LRSRNRHSV

SEQ ID NO: 62938 - protein, 9 aa, Homo Sapiens
PRSFPRPEG

SEQ ID NO: 62939 - protein, 9 aa, Homo Sapiens
SWISSELSL

SEQ ID NO: 62940 - protein, 9 aa, Homo Sapiens
LSPPSYTSP

SEQ ID NO: 62941 - protein, 9 aa, Homo Sapiens
EDLPSGSTL

SEQ ID NO: 62942 - protein, 9 aa, Homo Sapiens
AVIGGIDGC

SEQ ID NO: 62943 - protein, 9 aa, Homo Sapiens
GSGGPLQCY

SEQ ID NO: 62944 - protein, 9 aa, Homo Sapiens
FLGDSLKAF

SEQ ID NO: 62945 - protein, 9 aa, Homo Sapiens
LVLAVPSWR

SEQ ID NO: 62946 - protein, 9 aa, Homo Sapiens
EITKQEKDF

SEQ ID NO: 62947 - protein, 9 aa, Homo Sapiens
ISSELSLAP

SEQ ID NO: 62948 - protein, 9 aa, Homo Sapiens
RKSIIQQHM

SEQ ID NO: 62949 - protein, 9 aa, Homo Sapiens
KHVSKHKRN

SEQ ID NO: 62950 - protein, 9 aa, Homo Sapiens
IQTLSLKPL

SEQ ID NO: 62951 - protein, 9 aa, Homo Sapiens
KQEKDFLWS

SEQ ID NO: 62952 - protein, 9 aa, Homo Sapiens
LTVAKLGTS

SEQ ID NO: 62953 - protein, 9 aa, Homo Sapiens
CSFHQTQTP

SEQ ID NO: 62954 - protein, 9 aa, Homo Sapiens
SKLEKQINK

SEQ ID NO: 62955 - protein, 9 aa, Homo Sapiens
AAPRGVCYG

SEQ ID NO: 62956 - protein, 9 aa, Homo Sapiens
HVKHRTLPK

SEQ ID NO: 62957 - protein, 9 aa, Homo Sapiens
PCPPCLQQN

SEQ ID NO: 62958 - protein, 9 aa, Homo Sapiens
YIWNLQANR

SEQ ID NO: 62959 - protein, 9 aa, Homo Sapiens
ESYVESVGA

SEQ ID NO: 62960 - protein, 9 aa, Homo Sapiens
LGDSLKAFI

SEQ ID NO: 62961 - protein, 9 aa, Homo Sapiens
STSLPPPAI

SEQ ID NO: 62962 - protein, 9 aa, Homo Sapiens
VVEAIGDNV

SEQ ID NO: 62963 - protein, 9 aa, Homo Sapiens
TKQEKDFLW

SEQ ID NO: 62964 - protein, 9 aa, Homo Sapiens
QFCYQDFPG

SEQ ID NO: 62965 - protein, 9 aa, Homo Sapiens
SLAPEGLSN

SEQ ID NO: 62966 - protein, 9 aa, Homo Sapiens
PSYTSPAPA

SEQ ID NO: 62967 - protein, 9 aa, Homo Sapiens
NHSFLGDSL

SEQ ID NO: 62968 - protein, 9 aa, Homo Sapiens
VVLFLWELL

SEQ ID NO: 62969 - protein, 9 aa, Homo Sapiens
GIEHVKHRT

SEQ ID NO: 62970 - protein, 9 aa, Homo Sapiens
FIQTLSLKP

SEQ ID NO: 62971 - protein, 9 aa, Homo Sapiens
GDCGQELCR

SEQ ID NO: 62972 - protein, 9 aa, Homo Sapiens
RALLLCNGI

SEQ ID NO: 62973 - protein, 9 aa, Homo Sapiens
FPRPEGTTL

SEQ ID NO: 62974 - protein, 9 aa, Homo Sapiens
RCGNQYQES

SEQ ID NO: 62975 - protein, 9 aa, Homo Sapiens
VRCGNQYQE

SEQ ID NO: 62976 - protein, 9 aa, Homo Sapiens
EGKHVSKHK

SEQ ID NO: 62977 - protein, 9 aa, Homo Sapiens
HQTQTPDPI

SEQ ID NO: 62978 - protein, 9 aa, Homo Sapiens
TRDTDWARL

SEQ ID NO: 62979 - protein, 9 aa, Homo Sapiens
FYFSILYPL

SEQ ID NO: 62980 - protein, 9 aa, Homo Sapiens
LWALRWGRP

SEQ ID NO: 62981 - protein, 9 aa, Homo Sapiens
AIGDNVGTL

SEQ ID NO: 62982 - protein, 9 aa, Homo Sapiens
VCYGADHDL

SEQ ID NO: 62983 - protein, 9 aa, Homo Sapiens
RSRNRHSVN

SEQ ID NO: 62984 - protein, 9 aa, Homo Sapiens
EHVKHRTLP

SEQ ID NO: 62985 - protein, 9 aa, Homo Sapiens
YFSILYPLH

SEQ ID NO: 62986 - protein, 9 aa, Homo Sapiens
YQDPVPAIT

SEQ ID NO: 62987 - protein, 9 aa, Homo Sapiens
TFAHSQEKL

SEQ ID NO: 62988 - protein, 9 aa, Homo Sapiens
HYQDPVPAI

SEQ ID NO: 62989 - protein, 9 aa, Homo Sapiens
PSPRILQLL

SEQ ID NO: 62990 - protein, 9 aa, Homo Sapiens
CPPCLQQNP

SEQ ID NO: 62991 - protein, 9 aa, Homo Sapiens
LSDNISKLE

SEQ ID NO: 62992 - protein, 9 aa, Homo Sapiens
NLQANRIPQ

SEQ ID NO: 62993 - protein, 9 aa, Homo Sapiens
DRDHFIQTL

SEQ ID NO: 62994 - protein, 9 aa, Homo Sapiens
SYTSPAPAA

SEQ ID NO: 62995 - protein, 9 aa, Homo Sapiens
GYIWNLQAN

SEQ ID NO: 62996 - protein, 9 aa, Homo Sapiens
SRNRHSVNP

SEQ ID NO: 62997 - protein, 9 aa, Homo Sapiens
GLDSLVPGY

SEQ ID NO: 62998 - protein, 9 aa, Homo Sapiens
ILYPLHILF

SEQ ID NO: 62999 - protein, 9 aa, Homo Sapiens
YEDKPYKCQ

SEQ ID NO: 63000 - protein, 9 aa, Homo Sapiens
SSQCSFHQT

SEQ ID NO: 63001 - protein, 9 aa, Homo Sapiens
VAVTEDLPS

SEQ ID NO: 63002 - protein, 9 aa, Homo Sapiens
DSLVPGYED

SEQ ID NO: 63003 - protein, 9 aa, Homo Sapiens
RVTRDTDWA

SEQ ID NO: 63004 - protein, 9 aa, Homo Sapiens
LLVAKGTDP

SEQ ID NO: 63005 - protein, 9 aa, Homo Sapiens
NRHSVNPNP

SEQ ID NO: 63006 - protein, 9 aa, Homo Sapiens
SVSMFKIEN

SEQ ID NO: 63007 - protein, 9 aa, Homo Sapiens
DNVGTLGFS

SEQ ID NO: 63008 - protein, 9 aa, Homo Sapiens
AGALGIEHV

SEQ ID NO: 63009 - protein, 9 aa, Homo Sapiens
CLSPPSYTS

SEQ ID NO: 63010 - protein, 9 aa, Homo Sapiens
WNLQANRIP

SEQ ID NO: 63011 - protein, 9 aa, Homo Sapiens
TKAAMGQGF

SEQ ID NO: 63012 - protein, 9 aa, Homo Sapiens
LDNEVKAFK

SEQ ID NO: 63013 - protein, 9 aa, Homo Sapiens
RGVCYGADH

SEQ ID NO: 63014 - protein, 9 aa, Homo Sapiens
TGAEILYEL

SEQ ID NO: 63015 - protein, 9 aa, Homo Sapiens
KAAMGQGFD

SEQ ID NO: 63016 - protein, 9 aa, Homo Sapiens
GISIDVAVP

SEQ ID NO: 63017 - protein, 9 aa, Homo Sapiens
SFLGDSLKA

SEQ ID NO: 63018 - protein, 9 aa, Homo Sapiens
TVAKLGTSS

SEQ ID NO: 63019 - protein, 9 aa, Homo Sapiens
PLWALRWGR

SEQ ID NO: 63020 - protein, 9 aa, Homo Sapiens
YVESVGAKH

SEQ ID NO: 63021 - protein, 9 aa, Homo Sapiens
RLSTSLPPP

SEQ ID NO: 63022 - protein, 9 aa, Homo Sapiens
PSSVAGETL

SEQ ID NO: 63023 - protein, 9 aa, Homo Sapiens
VKAFKRGQR

SEQ ID NO: 63024 - protein, 9 aa, Homo Sapiens
SQYSRSRDN

SEQ ID NO: 63025 - protein, 9 aa, Homo Sapiens
VGLTLAPAL

SEQ ID NO: 63026 - protein, 9 aa, Homo Sapiens
IDVAVPEET

SEQ ID NO: 63027 - protein, 9 aa, Homo Sapiens
NVLSSQCSF

SEQ ID NO: 63028 - protein, 9 aa, Homo Sapiens
VLKNQLRQM

SEQ ID NO: 63029 - protein, 9 aa, Homo Sapiens
DKGPPVIFW

SEQ ID NO: 63030 - protein, 9 aa, Homo Sapiens
SYVESVGAK

SEQ ID NO: 63031 - protein, 9 aa, Homo Sapiens
NMGYIWNLQ

SEQ ID NO: 63032 - protein, 9 aa, Homo Sapiens
TVRCGNQYQ

SEQ ID NO: 63033 - protein, 9 aa, Homo Sapiens
KYARVTRDT

SEQ ID NO: 63034 - protein, 9 aa, Homo Sapiens
GNQYQESPH

SEQ ID NO: 63035 - protein, 9 aa, Homo Sapiens
TWGVGLTLA

SEQ ID NO: 63036 - protein, 9 aa, Homo Sapiens
FPGPREALS

SEQ ID NO: 63037 - protein, 9 aa, Homo Sapiens
RILQLLVAK

SEQ ID NO: 63038 - protein, 9 aa, Homo Sapiens
QLLVAKGTD

SEQ ID NO: 63039 - protein, 9 aa, Homo Sapiens
KCHDSVSMF

SEQ ID NO: 63040 - protein, 9 aa, Homo Sapiens
ITKQEKDFL

SEQ ID NO: 63041 - protein, 9 aa, Homo Sapiens
NISKLEKQI

SEQ ID NO: 63042 - protein, 9 aa, Homo Sapiens
WIDKGPPVI

SEQ ID NO: 63043 - protein, 9 aa, Homo Sapiens
FRQFCYQDF

SEQ ID NO: 63044 - protein, 9 aa, Homo Sapiens
CNGIRYKLL

SEQ ID NO: 63045 - protein, 9 aa, Homo Sapiens
ASQYSRSRD

SEQ ID NO: 63046 - protein, 9 aa, Homo Sapiens
YRLTVAKLG

SEQ ID NO: 63047 - protein, 9 aa, Homo Sapiens
GGIDGCLCL

SEQ ID NO: 63048 - protein, 9 aa, Homo Sapiens
NYELEKIIA

SEQ ID NO: 63049 - protein, 9 aa, Homo Sapiens
IWNLQANRI

SEQ ID NO: 63050 - protein, 9 aa, Homo Sapiens
ALGIEHVKH

SEQ ID NO: 63051 - protein, 9 aa, Homo Sapiens
SLKAFILLG

SEQ ID NO: 63052 - protein, 9 aa, Homo Sapiens
GIRYKLLQE

SEQ ID NO: 63053 - protein, 9 aa, Homo Sapiens
FKYARVTRD

SEQ ID NO: 63054 - protein, 9 aa, Homo Sapiens
SGGPLQCYG

SEQ ID NO: 63055 - protein, 9 aa, Homo Sapiens
EDYLRKSII

SEQ ID NO: 63056 - protein, 9 aa, Homo Sapiens
LSISNIQAG

SEQ ID NO: 63057 - protein, 9 aa, Homo Sapiens
SVAGETLVL

SEQ ID NO: 63058 - protein, 9 aa, Homo Sapiens
WISSELSLA

SEQ ID NO: 63059 - protein, 9 aa, Homo Sapiens
MSASQYSRS

SEQ ID NO: 63060 - protein, 9 aa, Homo Sapiens
VLENYELEK

SEQ ID NO: 63061 - protein, 9 aa, Homo Sapiens
KLGTSSHPL

SEQ ID NO: 63062 - protein, 9 aa, Homo Sapiens
QGSGGPLQC

SEQ ID NO: 63063 - protein, 9 aa, Homo Sapiens
IRYKLLQEG

SEQ ID NO: 63064 - protein, 9 aa, Homo Sapiens
SVLKNQLRQ

SEQ ID NO: 63065 - protein, 9 aa, Homo Sapiens
ETVLENYEL

SEQ ID NO: 63066 - protein, 9 aa, Homo Sapiens
SFPRPEGTT

SEQ ID NO: 63067 - protein, 9 aa, Homo Sapiens
SPAPAAVIP

SEQ ID NO: 63068 - protein, 9 aa, Homo Sapiens
DNCSVLKNQ

SEQ ID NO: 63069 - protein, 9 aa, Homo Sapiens
SHPLHAFAH

SEQ ID NO: 63070 - protein, 9 aa, Homo Sapiens
NIDVFYFSI

SEQ ID NO: 63071 - protein, 9 aa, Homo Sapiens
VAGETLVLA

SEQ ID NO: 63072 - protein, 9 aa, Homo Sapiens
TVLENYELE

SEQ ID NO: 63073 - protein, 9 aa, Homo Sapiens
LTKAAMGQG

SEQ ID NO: 63074 - protein, 9 aa, Homo Sapiens
LKAFILLGV

SEQ ID NO: 63075 - protein, 9 aa, Homo Sapiens
EFGIMGDHT

SEQ ID NO: 63076 - protein, 9 aa, Homo Sapiens
ETLVLAVPS

SEQ ID NO: 63077 - protein, 9 aa, Homo Sapiens
CDTGAEILY

SEQ ID NO: 63078 - protein, 9 aa, Homo Sapiens
PPKEEFGIM

SEQ ID NO: 63079 - protein, 9 aa, Homo Sapiens
VIGGIDGCL

SEQ ID NO: 63080 - protein, 9 aa, Homo Sapiens
SGEDGDCGQ

SEQ ID NO: 63081 - protein, 9 aa, Homo Sapiens
AVVQSPQFT

SEQ ID NO: 63082 - protein, 9 aa, Homo Sapiens
FAHSQEKLE

SEQ ID NO: 63083 - protein, 9 aa, Homo Sapiens
FGVVLFLWE

SEQ ID NO: 63084 - protein, 9 aa, Homo Sapiens
YHGQLTKAA

SEQ ID NO: 63085 - protein, 9 aa, Homo Sapiens
YLGICHPLW

SEQ ID NO: 63086 - protein, 9 aa, Homo Sapiens
HFIQTLSLK

SEQ ID NO: 63087 - protein, 9 aa, Homo Sapiens
MGYIWNLQA

SEQ ID NO: 63088 - protein, 9 aa, Homo Sapiens
EKLEKFRKM

SEQ ID NO: 63089 - protein, 9 aa, Homo Sapiens
GVCYGADHD

SEQ ID NO: 63090 - protein, 9 aa, Homo Sapiens
QDPVPAITP

SEQ ID NO: 63091 - protein, 9 aa, Homo Sapiens
SQCSFHQTQ

SEQ ID NO: 63092 - protein, 9 aa, Homo Sapiens
LQLLVAKGT

SEQ ID NO: 63093 - protein, 9 aa, Homo Sapiens
DHYQDPVPA

SEQ ID NO: 63094 - protein, 9 aa, Homo Sapiens
DPLSEITKQ

SEQ ID NO: 63095 - protein, 9 aa, Homo Sapiens
IEHVKHRTL

SEQ ID NO: 63096 - protein, 9 aa, Homo Sapiens
GTSSHPLHA

SEQ ID NO: 63097 - protein, 9 aa, Homo Sapiens
SPRSFPRPE

SEQ ID NO: 63098 - protein, 9 aa, Homo Sapiens
LAPEGLSNG

SEQ ID NO: 63099 - protein, 9 aa, Homo Sapiens
SALSISNIQ

SEQ ID NO: 63100 - protein, 9 aa, Homo Sapiens
LTAEVLKQR

SEQ ID NO: 63101 - protein, 9 aa, Homo Sapiens
SSLPCPPCL

SEQ ID NO: 63102 - protein, 9 aa, Homo Sapiens
SFHQTQTPD

SEQ ID NO: 63103 - protein, 9 aa, Homo Sapiens
IDGCLCLGG

SEQ ID NO: 63104 - protein, 9 aa, Homo Sapiens
RKETVLENY

SEQ ID NO: 63105 - protein, 9 aa, Homo Sapiens
RTRPQGSGG

SEQ ID NO: 63106 - protein, 9 aa, Homo Sapiens
SLPCPPCLQ

SEQ ID NO: 63107 - protein, 9 aa, Homo Sapiens
EKTEDYLRK

SEQ ID NO: 63108 - protein, 9 aa, Homo Sapiens
CTFAHSQEK

SEQ ID NO: 63109 - protein, 9 aa, Homo Sapiens
ILQLLVAKG

SEQ ID NO: 63110 - protein, 9 aa, Homo Sapiens
IASALSISN

SEQ ID NO: 63111 - protein, 9 aa, Homo Sapiens
HSFLGDSLK

SEQ ID NO: 63112 - protein, 9 aa, Homo Sapiens
SPRILQLLV

SEQ ID NO: 63113 - protein, 9 aa, Homo Sapiens
WALRWGRPR

SEQ ID NO: 63114 - protein, 9 aa, Homo Sapiens
EAIGDNVGT

SEQ ID NO: 63115 - protein, 9 aa, Homo Sapiens
SSKCHDSVS

SEQ ID NO: 63116 - protein, 9 aa, Homo Sapiens
NVGTLGFSV

SEQ ID NO: 63117 - protein, 9 aa, Homo Sapiens
LGICHPLWA

SEQ ID NO: 63118 - protein, 9 aa, Homo Sapiens
KETVLENYE

SEQ ID NO: 63119 - protein, 9 aa, Homo Sapiens
TSSLPCPPC

SEQ ID NO: 63120 - protein, 9 aa, Homo Sapiens
RDPLSEITK

SEQ ID NO: 63121 - protein, 9 aa, Homo Sapiens
VLFGVVLFL

SEQ ID NO: 63122 - protein, 9 aa, Homo Sapiens
GKHVSKHKR

SEQ ID NO: 63123 - protein, 9 aa, Homo Sapiens
WHNTVRCGN

SEQ ID NO: 63124 - protein, 9 aa, Homo Sapiens
EAESYVESV

SEQ ID NO: 63125 - protein, 9 aa, Homo Sapiens
GAEILYELL

SEQ ID NO: 63126 - protein, 9 aa, Homo Sapiens
RFKYARVTR

SEQ ID NO: 63127 - protein, 9 aa, Homo Sapiens
DCGQELCRQ

SEQ ID NO: 63128 - protein, 9 aa, Homo Sapiens
NGIRYKLLQ

SEQ ID NO: 63129 - protein, 9 aa, Homo Sapiens
PGSSPRSFP

SEQ ID NO: 63130 - protein, 9 aa, Homo Sapiens
LGTSSHPLH

SEQ ID NO: 63131 - protein, 9 aa, Homo Sapiens
SLPPPAIAV

SEQ ID NO: 63132 - protein, 9 aa, Homo Sapiens
VVQSPQFTE

SEQ ID NO: 63133 - protein, 9 aa, Homo Sapiens
SASQYSRSR

SEQ ID NO: 63134 - protein, 9 aa, Homo Sapiens
LSCDTGAEI

SEQ ID NO: 63135 - protein, 9 aa, Homo Sapiens
SIDVAVPEE

SEQ ID NO: 63136 - protein, 9 aa, Homo Sapiens
DVFYFSILY

SEQ ID NO: 63137 - protein, 9 aa, Homo Sapiens
HVSKHKRNL

SEQ ID NO: 63138 - protein, 9 aa, Homo Sapiens
SEITKQEKD

SEQ ID NO: 63139 - protein, 9 aa, Homo Sapiens
KYHGQLTKA

SEQ ID NO: 63140 - protein, 9 aa, Homo Sapiens
EVKAFKRGQ

SEQ ID NO: 63141 - protein, 9 aa, Homo Sapiens
DNISKLEKQ

SEQ ID NO: 63142 - protein, 9 aa, Homo Sapiens
QLTKAAMGQ

SEQ ID NO: 63143 - protein, 9 aa, Homo Sapiens
GSSPRSFPR

SEQ ID NO: 63144 - protein, 9 aa, Homo Sapiens
RLTVAKLGT

SEQ ID NO: 63145 - protein, 9 aa, Homo Sapiens
QDFPGPREA

SEQ ID NO: 63146 - protein, 9 aa, Homo Sapiens
TTSSLPCPP

SEQ ID NO: 63147 - protein, 9 aa, Homo Sapiens
TEDLPSGST

SEQ ID NO: 63148 - protein, 9 aa, Homo Sapiens
SELSLAPEG

SEQ ID NO: 63149 - protein, 9 aa, Homo Sapiens
LAAPRGVCY

SEQ ID NO: 63150 - protein, 9 aa, Homo Sapiens
SPPSYTSPA

SEQ ID NO: 63151 - protein, 9 aa, Homo Sapiens
YTSPAPAAV

SEQ ID NO: 63152 - protein, 9 aa, Homo Sapiens
TAEVLKQRS

SEQ ID NO: 63153 - protein, 9 aa, Homo Sapiens
QRSSRQDTK

SEQ ID NO: 63154 - protein, 9 aa, Homo Sapiens
FVVEAIGDN

SEQ ID NO: 63155 - protein, 9 aa, Homo Sapiens
EDGDCGQEL

SEQ ID NO: 63156 - protein, 9 aa, Homo Sapiens
GEDGDCGQE

SEQ ID NO: 63157 - protein, 9 aa, Homo Sapiens
TSPAPAAVI

SEQ ID NO: 63158 - protein, 9 aa, Homo Sapiens
VPAITPSSS

SEQ ID NO: 63159 - protein, 9 aa, Homo Sapiens
CHDSVSMFK

SEQ ID NO: 63160 - protein, 9 aa, Homo Sapiens
GYEDKPYKC

SEQ ID NO: 63161 - protein, 9 aa, Homo Sapiens
GPPVIFWIS

SEQ ID NO: 63162 - protein, 9 aa, Homo Sapiens
LVAKGTDPN

SEQ ID NO: 63163 - protein, 9 aa, Homo Sapiens
VSGISIDVA

SEQ ID NO: 63164 - protein, 9 aa, Homo Sapiens
PPVIFWISG

SEQ ID NO: 63165 - protein, 9 aa, Homo Sapiens
QSPQFTEVL

SEQ ID NO: 63166 - protein, 9 aa, Homo Sapiens
ISKLEKQIN

SEQ ID NO: 63167 - protein, 9 aa, Homo Sapiens
CGQELCRQR

SEQ ID NO: 63168 - protein, 9 aa, Homo Sapiens
SKCHDSVSM

SEQ ID NO: 63169 - protein, 9 aa, Homo Sapiens
PVPAITPSS

SEQ ID NO: 63170 - protein, 9 aa, Homo Sapiens
GCLCLGGQI

SEQ ID NO: 63171 - protein, 9 aa, Homo Sapiens
LVPGYEDKP

SEQ ID NO: 63172 - protein, 9 aa, Homo Sapiens
RLSCDTGAE

SEQ ID NO: 63173 - protein, 9 aa, Homo Sapiens
AITPSSSSR

SEQ ID NO: 63174 - protein, 9 aa, Homo Sapiens
KAFKRGQRL

SEQ ID NO: 63175 - protein, 9 aa, Homo Sapiens
GICHPLWAL

SEQ ID NO: 63176 - protein, 9 aa, Homo Sapiens
HGQLTKAAM

SEQ ID NO: 63177 - protein, 9 aa, Homo Sapiens
TSLPPPAIA

SEQ ID NO: 63178 - protein, 9 aa, Homo Sapiens
SSELSLAPE

SEQ ID NO: 63179 - protein, 9 aa, Homo Sapiens
SIQEAESYV

SEQ ID NO: 63180 - protein, 9 aa, Homo Sapiens
ASALSISNI

SEQ ID NO: 63181 - protein, 9 aa, Homo Sapiens
SSRLSTSLP

SEQ ID NO: 63182 - protein, 9 aa, Homo Sapiens
LSSQCSFHQ

SEQ ID NO: 63183 - protein, 9 aa, Homo Sapiens
KQRSSRQDT

SEQ ID NO: 63184 - protein, 9 aa, Homo Sapiens
TLAPALWWG

SEQ ID NO: 63185 - protein, 9 aa, Homo Sapiens
HDSVSMFKI

SEQ ID NO: 63186 - protein, 9 aa, Homo Sapiens
PRGVCYGAD

SEQ ID NO: 63187 - protein, 9 aa, Homo Sapiens
DYLRKSIIQ

SEQ ID NO: 63188 - protein, 9 aa, Homo Sapiens
TRPQGSGGP

SEQ ID NO: 63189 - protein, 9 aa, Homo Sapiens
VTRDTDWAR

SEQ ID NO: 63190 - protein, 9 aa, Homo Sapiens
FKRGQRLYE

SEQ ID NO: 63191 - protein, 9 aa, Homo Sapiens
DFPGPREAL

SEQ ID NO: 63192 - protein, 9 aa, Homo Sapiens
QCSFHQTQT

SEQ ID NO: 63193 - protein, 9 aa, Homo Sapiens
ENYELEKII

SEQ ID NO: 63194 - protein, 9 aa, Homo Sapiens
FSILYPLHI

SEQ ID NO: 63195 - protein, 9 aa, Homo Sapiens
FLWELLPTT

SEQ ID NO: 63196 - protein, 9 aa, Homo Sapiens
GGPLQCYGV

SEQ ID NO: 63197 - protein, 9 aa, Homo Sapiens
LPCPPCLQQ

SEQ ID NO: 63198 - protein, 9 aa, Homo Sapiens
ALSISNIQA

SEQ ID NO: 63199 - protein, 9 aa, Homo Sapiens
TDRDHFIQT

SEQ ID NO: 63200 - protein, 9 aa, Homo Sapiens
GETLVLAVP

SEQ ID NO: 63201 - protein, 9 aa, Homo Sapiens
FGIMGDHTI

SEQ ID NO: 63202 - protein, 9 aa, Homo Sapiens
DHFIQTLSL

SEQ ID NO: 63203 - protein, 9 aa, Homo Sapiens
SCDTGAEIL

SEQ ID NO: 63204 - protein, 9 aa, Homo Sapiens
SRVSGISID

SEQ ID NO: 63205 - protein, 9 aa, Homo Sapiens
RSSRQDTKG

SEQ ID NO: 63206 - protein, 9 aa, Homo Sapiens
IGDNVGTLG

SEQ ID NO: 63207 - protein, 9 aa, Homo Sapiens
HAGALGIEH

SEQ ID NO: 63208 - protein, 9 aa, Homo Sapiens
GDSLKAFIL

SEQ ID NO: 63209 - protein, 9 aa, Homo Sapiens
FYLAAPRGV

SEQ ID NO: 63210 - protein, 9 aa, Homo Sapiens
LDSLVPGYE

SEQ ID NO: 63211 - protein, 9 aa, Homo Sapiens
HSQEKLEKF

SEQ ID NO: 63212 - protein, 9 aa, Homo Sapiens
DLPSGSTLL

SEQ ID NO: 63213 - protein, 9 aa, Homo Sapiens
DGCLCLGGQ

SEQ ID NO: 63214 - protein, 9 aa, Homo Sapiens
SQEKLEKFR

SEQ ID NO: 63215 - protein, 9 aa, Homo Sapiens
GALGIEHVK

SEQ ID NO: 63216 - protein, 9 aa, Homo Sapiens
RHSVNPNPR

SEQ ID NO: 63217 - protein, 9 aa, Homo Sapiens
VLSSQCSFH

SEQ ID NO: 63218 - protein, 9 aa, Homo Sapiens
QEKLEKFRK

SEQ ID NO: 63219 - protein, 9 aa, Homo Sapiens
APRGVCYGA

SEQ ID NO: 63220 - protein, 9 aa, Homo Sapiens
GIMGDHTIK

SEQ ID NO: 63221 - protein, 9 aa, Homo Sapiens
IHNRYEGKH

SEQ ID NO: 63222 - protein, 9 aa, Homo Sapiens
LSEITKQEK

SEQ ID NO: 63223 - protein, 9 aa, Homo Sapiens
LLLCNGIRY

SEQ ID NO: 63224 - protein, 9 aa, Homo Sapiens
KEEFGIMGD

SEQ ID NO: 63225 - protein, 9 aa, Homo Sapiens
VLFLWELLP

SEQ ID NO: 63226 - protein, 9 aa, Homo Sapiens
VQSPQFTEV

SEQ ID NO: 63227 - protein, 9 aa, Homo Sapiens
PSGSTLLTL

SEQ ID NO: 63228 - protein, 9 aa, Homo Sapiens
ICHPLWALR

SEQ ID NO: 63229 - protein, 9 aa, Homo Sapiens
TSSHPLHAF

SEQ ID NO: 63230 - protein, 9 aa, Homo Sapiens
DGDCGQELC

SEQ ID NO: 63231 - protein, 9 aa, Homo Sapiens
LFGVVLFLW

SEQ ID NO: 63232 - protein, 9 aa, Homo Sapiens
AHSQEKLEK

SEQ ID NO: 63233 - protein, 9 aa, Homo Sapiens
RNRHSVNPN

SEQ ID NO: 63234 - protein, 9 aa, Homo Sapiens
GPTTSSLPC

SEQ ID NO: 63235 - protein, 9 aa, Homo Sapiens
SVNPNPRLH

SEQ ID NO: 63236 - protein, 9 aa, Homo Sapiens
GSGEDGDCG

SEQ ID NO: 63237 - protein, 9 aa, Homo Sapiens
LRKSIIQQH

SEQ ID NO: 63238 - protein, 9 aa, Homo Sapiens
PGYEDKPYK

SEQ ID NO: 63239 - protein, 9 aa, Homo Sapiens
VAKLGTSSH

SEQ ID NO: 63240 - protein, 9 aa, Homo Sapiens
PKEEFGIMG

SEQ ID NO: 63241 - protein, 9 aa, Homo Sapiens
IQEAESYVE

SEQ ID NO: 63242 - protein, 9 aa, Homo Sapiens
PSSRLSTSL

SEQ ID NO: 63243 - protein, 9 aa, Homo Sapiens
VPGYEDKPY

SEQ ID NO: 63244 - protein, 9 aa, Homo Sapiens
SILYPLHIL

SEQ ID NO: 63245 - protein, 9 aa, Homo Sapiens
AGETLVLAV

SEQ ID NO: 63246 - protein, 9 aa, Homo Sapiens
GIDGCLCLG

SEQ ID NO: 63247 - protein, 9 aa, Homo Sapiens
GLTLAPALW

SEQ ID NO: 63248 - protein, 9 aa, Homo Sapiens
KLSDNISKL

SEQ ID NO: 63249 - protein, 9 aa, Homo Sapiens
CHPLWALRW

SEQ ID NO: 63250 - protein, 9 aa, Homo Sapiens
LPPPAIAVP

SEQ ID NO: 63251 - protein, 9 aa, Homo Sapiens
GDNVGTLGF

SEQ ID NO: 63252 - protein, 9 aa, Homo Sapiens
GQLTKAAMG

SEQ ID NO: 63253 - protein, 9 aa, Homo Sapiens
CGNQYQESP

SEQ ID NO: 63254 - protein, 9 aa, Homo Sapiens
SPGSSPRSF

SEQ ID NO: 63255 - protein, 9 aa, Homo Sapiens
KSIIQQHMV

SEQ ID NO: 63256 - protein, 9 aa, Homo Sapiens
ARVTRDTDW

SEQ ID NO: 63257 - protein, 9 aa, Homo Sapiens
NEVKAFKRG

SEQ ID NO: 63258 - protein, 9 aa, Homo Sapiens
YEGKHVSKH

SEQ ID NO: 63259 - protein, 9 aa, Homo Sapiens
PLSEITKQE

SEQ ID NO: 63260 - protein, 9 aa, Homo Sapiens
LTWGVGLTL

SEQ ID NO: 63261 - protein, 9 aa, Homo Sapiens
YARVTRDTD

SEQ ID NO: 63262 - protein, 9 aa, Homo Sapiens
RVSGISIDV

SEQ ID NO: 63263 - protein, 9 aa, Homo Sapiens
RPPKEEFGI

SEQ ID NO: 63264 - protein, 9 aa, Homo Sapiens
CLCLGGQIV

SEQ ID NO: 63265 - protein, 9 aa, Homo Sapiens
LCNGIRYKL

SEQ ID NO: 63266 - protein, 9 aa, Homo Sapiens
AESYVESVG

SEQ ID NO: 63267 - protein, 9 aa, Homo Sapiens
QEAESYVES

SEQ ID NO: 63268 - protein, 9 aa, Homo Sapiens
HNTVRCGNQ

SEQ ID NO: 63269 - protein, 9 aa, Homo Sapiens
YLRKSIIQQ

SEQ ID NO: 63270 - protein, 9 aa, Homo Sapiens
DPVPAITPS

SEQ ID NO: 63271 - protein, 9 aa, Homo Sapiens
RYEGKHVSK

SEQ ID NO: 63272 - protein, 9 aa, Homo Sapiens
IDVFYFSIL

SEQ ID NO: 63273 - protein, 9 aa, Homo Sapiens
KNQLRQMSI

SEQ ID NO: 63274 - protein, 9 aa, Homo Sapiens
QTLSLKPLL

SEQ ID NO: 63275 - protein, 9 aa, Homo Sapiens
GQELCRQRG

SEQ ID NO: 63276 - protein, 9 aa, Homo Sapiens
KGPPVIFWI

SEQ ID NO: 63277 - protein, 9 aa, Homo Sapiens
LENYELEKI

SEQ ID NO: 63278 - protein, 9 aa, Homo Sapiens
LSLAPEGLS

SEQ ID NO: 63279 - protein, 9 aa, Homo Sapiens
NQLRQMSIH

SEQ ID NO: 63280 - protein, 9 aa, Homo Sapiens
KLEKFRKMN

SEQ ID NO: 63281 - protein, 9 aa, Homo Sapiens
YLAAPRGVC

SEQ ID NO: 63282 - protein, 9 aa, Homo Sapiens
YELEKIIAE

SEQ ID NO: 63283 - protein, 9 aa, Homo Sapiens
LGIEHVKHR

SEQ ID NO: 63284 - protein, 9 aa, Homo Sapiens
IFWISGFYF

SEQ ID NO: 63285 - protein, 9 aa, Homo Sapiens
QYSRSRDNG

SEQ ID NO: 63286 - protein, 9 aa, Homo Sapiens
IMGDHTIKS

SEQ ID NO: 63287 - protein, 9 aa, Homo Sapiens
VTDRDHFIQ

SEQ ID NO: 63288 - protein, 9 aa, Homo Sapiens
SGISIDVAV

SEQ ID NO: 63289 - protein, 9 aa, Homo Sapiens
QANRIPQCP

SEQ ID NO: 63290 - protein, 9 aa, Homo Sapiens
VEAIGDNVG

SEQ ID NO: 63291 - protein, 9 aa, Homo Sapiens
GRRRGWCPY

SEQ ID NO: 63292 - protein, 9 aa, Homo Sapiens
PQTLDGQIT

SEQ ID NO: 63293 - protein, 9 aa, Homo Sapiens
YVHHPVDRE

SEQ ID NO: 63294 - protein, 9 aa, Homo Sapiens
GYYPLAEEQ

SEQ ID NO: 63295 - protein, 9 aa, Homo Sapiens
QLLILDEAT

SEQ ID NO: 63296 - protein, 9 aa, Homo Sapiens
PAIAVREAA

SEQ ID NO: 63297 - protein, 9 aa, Homo Sapiens
INIPKNGKL

SEQ ID NO: 63298 - protein, 9 aa, Homo Sapiens
HEELKCMLE

SEQ ID NO: 63299 - protein, 9 aa, Homo Sapiens
SRLSSTSFI

SEQ ID NO: 63300 - protein, 9 aa, Homo Sapiens
CPRAEVLWL

SEQ ID NO: 63301 - protein, 9 aa, Homo Sapiens
VFFINSKSL

SEQ ID NO: 63302 - protein, 9 aa, Homo Sapiens
AMTGKAKRT

SEQ ID NO: 63303 - protein, 9 aa, Homo Sapiens
CDMPPLKSM

SEQ ID NO: 63304 - protein, 9 aa, Homo Sapiens
TVKLGTMIF

SEQ ID NO: 63305 - protein, 9 aa, Homo Sapiens
AWYRSLMPQ

SEQ ID NO: 63306 - protein, 9 aa, Homo Sapiens
WYRSLMPQT

SEQ ID NO: 63307 - protein, 9 aa, Homo Sapiens
FSWSSSFTE

SEQ ID NO: 63308 - protein, 9 aa, Homo Sapiens
HCPRAEVLW

SEQ ID NO: 63309 - protein, 9 aa, Homo Sapiens
HIICITDAH

SEQ ID NO: 63310 - protein, 9 aa, Homo Sapiens
SWSSSFTEH

SEQ ID NO: 63311 - protein, 9 aa, Homo Sapiens
EDSCLHETL

SEQ ID NO: 63312 - protein, 9 aa, Homo Sapiens
THLDNVKLF

SEQ ID NO: 63313 - protein, 9 aa, Homo Sapiens
FQFKLGNQN

SEQ ID NO: 63314 - protein, 9 aa, Homo Sapiens
LPSDNHWVE

SEQ ID NO: 63315 - protein, 9 aa, Homo Sapiens
CITDAHTLS

SEQ ID NO: 63316 - protein, 9 aa, Homo Sapiens
THPPRPRPK

SEQ ID NO: 63317 - protein, 9 aa, Homo Sapiens
VFQFKLGNQ

SEQ ID NO: 63318 - protein, 9 aa, Homo Sapiens
YRINIPKNG

SEQ ID NO: 63319 - protein, 9 aa, Homo Sapiens
QEPPAIAVR

SEQ ID NO: 63320 - protein, 9 aa, Homo Sapiens
TRRPPAKPQ

SEQ ID NO: 63321 - protein, 9 aa, Homo Sapiens
RSLMPQTLD

SEQ ID NO: 63322 - protein, 9 aa, Homo Sapiens
PPAIAVREA

SEQ ID NO: 63323 - protein, 9 aa, Homo Sapiens
KLHFTPHIQ

SEQ ID NO: 63324 - protein, 9 aa, Homo Sapiens
FHHISIPQP

SEQ ID NO: 63325 - protein, 9 aa, Homo Sapiens
DSCLHETLA

SEQ ID NO: 63326 - protein, 9 aa, Homo Sapiens
TSGGTVQLA

SEQ ID NO: 63327 - protein, 9 aa, Homo Sapiens
RAVAHCPRA

SEQ ID NO: 63328 - protein, 9 aa, Homo Sapiens
QFKLGNQNV

SEQ ID NO: 63329 - protein, 9 aa, Homo Sapiens
FLGLLGIYY

SEQ ID NO: 63330 - protein, 9 aa, Homo Sapiens
LKNSRITNV

SEQ ID NO: 63331 - protein, 9 aa, Homo Sapiens
VDAMTGKAK

SEQ ID NO: 63332 - protein, 9 aa, Homo Sapiens
EPPAIAVRE

SEQ ID NO: 63333 - protein, 9 aa, Homo Sapiens
THEGYYPLA

SEQ ID NO: 63334 - protein, 9 aa, Homo Sapiens
LLKTTTRDH

SEQ ID NO: 63335 - protein, 9 aa, Homo Sapiens
KPQRHPSTK

SEQ ID NO: 63336 - protein, 9 aa, Homo Sapiens
QVQVVEQAQ

SEQ ID NO: 63337 - protein, 9 aa, Homo Sapiens
RQIHTNHET

SEQ ID NO: 63338 - protein, 9 aa, Homo Sapiens
HHISIPQPD

SEQ ID NO: 63339 - protein, 9 aa, Homo Sapiens
TGPAATTTA

SEQ ID NO: 63340 - protein, 9 aa, Homo Sapiens
SMVPSLVET

SEQ ID NO: 63341 - protein, 9 aa, Homo Sapiens
VLSEDSCLH

SEQ ID NO: 63342 - protein, 9 aa, Homo Sapiens
RLSSTSFIS

SEQ ID NO: 63343 - protein, 9 aa, Homo Sapiens
KGPVDAMTG

SEQ ID NO: 63344 - protein, 9 aa, Homo Sapiens
QYLRQIHTN

SEQ ID NO: 63345 - protein, 9 aa, Homo Sapiens
YDKERIKKY

SEQ ID NO: 63346 - protein, 9 aa, Homo Sapiens
LTVFFINSK

SEQ ID NO: 63347 - protein, 9 aa, Homo Sapiens
RITNVTRDG

SEQ ID NO: 63348 - protein, 9 aa, Homo Sapiens
SPGNMVSPV

SEQ ID NO: 63349 - protein, 9 aa, Homo Sapiens
VEQAQQVAV

SEQ ID NO: 63350 - protein, 9 aa, Homo Sapiens
LGIYYGILH

SEQ ID NO: 63351 - protein, 9 aa, Homo Sapiens
DKGPVDAMT

SEQ ID NO: 63352 - protein, 9 aa, Homo Sapiens
RGWCPYFLA

SEQ ID NO: 63353 - protein, 9 aa, Homo Sapiens
EGYYPLAEE

SEQ ID NO: 63354 - protein, 9 aa, Homo Sapiens
MLGTGPAAT

SEQ ID NO: 63355 - protein, 9 aa, Homo Sapiens
YYPLAEEQT

SEQ ID NO: 63356 - protein, 9 aa, Homo Sapiens
HPPRPRPKT

SEQ ID NO: 63357 - protein, 9 aa, Homo Sapiens
ERAVTHLDN

SEQ ID NO: 63358 - protein, 9 aa, Homo Sapiens
ADSYGEESD

SEQ ID NO: 63359 - protein, 9 aa, Homo Sapiens
SNKTHIICI

SEQ ID NO: 63360 - protein, 9 aa, Homo Sapiens
SPHSSPGNM

SEQ ID NO: 63361 - protein, 9 aa, Homo Sapiens
LRQIHTNHE

SEQ ID NO: 63362 - protein, 9 aa, Homo Sapiens
LDTQYDKER

SEQ ID NO: 63363 - protein, 9 aa, Homo Sapiens
AFSWSSSFT

SEQ ID NO: 63364 - protein, 9 aa, Homo Sapiens
VSALTVFFI

SEQ ID NO: 63365 - protein, 9 aa, Homo Sapiens
DAIMSDGNL

SEQ ID NO: 63366 - protein, 9 aa, Homo Sapiens
GTGPAATTT

SEQ ID NO: 63367 - protein, 9 aa, Homo Sapiens
PHIQRLNEL

SEQ ID NO: 63368 - protein, 9 aa, Homo Sapiens
TLPSDNHWV

SEQ ID NO: 63369 - protein, 9 aa, Homo Sapiens
LDNVKLFGK

SEQ ID NO: 63370 - protein, 9 aa, Homo Sapiens
VTSGGTVQL

SEQ ID NO: 63371 - protein, 9 aa, Homo Sapiens
KLGTMIFGV

SEQ ID NO: 63372 - protein, 9 aa, Homo Sapiens
DFPFVFHSV

SEQ ID NO: 63373 - protein, 9 aa, Homo Sapiens
SKRTHPPRP

SEQ ID NO: 63374 - protein, 9 aa, Homo Sapiens
VQVVEQAQQ

SEQ ID NO: 63375 - protein, 9 aa, Homo Sapiens
GTNLSLHFF

SEQ ID NO: 63376 - protein, 9 aa, Homo Sapiens
MGFHHISIP

SEQ ID NO: 63377 - protein, 9 aa, Homo Sapiens
ESCDMPPLK

SEQ ID NO: 63378 - protein, 9 aa, Homo Sapiens
LLGIYYGIL

SEQ ID NO: 63379 - protein, 9 aa, Homo Sapiens
HTNHETLLR

SEQ ID NO: 63380 - protein, 9 aa, Homo Sapiens
FVFHSVPEF

SEQ ID NO: 63381 - protein, 9 aa, Homo Sapiens
RAEVLWLMG

SEQ ID NO: 63382 - protein, 9 aa, Homo Sapiens
ALGRRRGWC

SEQ ID NO: 63383 - protein, 9 aa, Homo Sapiens
ATHEGYYPL

SEQ ID NO: 63384 - protein, 9 aa, Homo Sapiens
VPEFGAAIN

SEQ ID NO: 63385 - protein, 9 aa, Homo Sapiens
RINIPKNGK

SEQ ID NO: 63386 - protein, 9 aa, Homo Sapiens
RPELIESAV

SEQ ID NO: 63387 - protein, 9 aa, Homo Sapiens
GNMVSPVGP

SEQ ID NO: 63388 - protein, 9 aa, Homo Sapiens
NGRIYVHHP

SEQ ID NO: 63389 - protein, 9 aa, Homo Sapiens
SSSFTEHKR

SEQ ID NO: 63390 - protein, 9 aa, Homo Sapiens
KNSRITNVT

SEQ ID NO: 63391 - protein, 9 aa, Homo Sapiens
PLGYRINIP

SEQ ID NO: 63392 - protein, 9 aa, Homo Sapiens
HWVEGTAWL

SEQ ID NO: 63393 - protein, 9 aa, Homo Sapiens
VDKLHFTPH

SEQ ID NO: 63394 - protein, 9 aa, Homo Sapiens
TCNECGKGF

SEQ ID NO: 63395 - protein, 9 aa, Homo Sapiens
PQRHPSTKL

SEQ ID NO: 63396 - protein, 9 aa, Homo Sapiens
LLRKTQLLI

SEQ ID NO: 63397 - protein, 9 aa, Homo Sapiens
AIMSDGNLE

SEQ ID NO: 63398 - protein, 9 aa, Homo Sapiens
EGGADSYGE

SEQ ID NO: 63399 - protein, 9 aa, Homo Sapiens
SSPGNMVSP

SEQ ID NO: 63400 - protein, 9 aa, Homo Sapiens
GEKLYTCNE

SEQ ID NO: 63401 - protein, 9 aa, Homo Sapiens
WISALDTQY

SEQ ID NO: 63402 - protein, 9 aa, Homo Sapiens
FHSVPEFGA

SEQ ID NO: 63403 - protein, 9 aa, Homo Sapiens
NHWVEGTAW

SEQ ID NO: 63404 - protein, 9 aa, Homo Sapiens
TNVTRDGFS

SEQ ID NO: 63405 - protein, 9 aa, Homo Sapiens
IHTNHETLL

SEQ ID NO: 63406 - protein, 9 aa, Homo Sapiens
MDAIMSDGN

SEQ ID NO: 63407 - protein, 9 aa, Homo Sapiens
ASVFQFKLG

SEQ ID NO: 63408 - protein, 9 aa, Homo Sapiens
FTPHIQRLN

SEQ ID NO: 63409 - protein, 9 aa, Homo Sapiens
CLHETLALL

SEQ ID NO: 63410 - protein, 9 aa, Homo Sapiens
QRAVAHCPR

SEQ ID NO: 63411 - protein, 9 aa, Homo Sapiens
DHEELKCML

SEQ ID NO: 63412 - protein, 9 aa, Homo Sapiens
HSSPGNMVS

SEQ ID NO: 63413 - protein, 9 aa, Homo Sapiens
RGASVFQFK

SEQ ID NO: 63414 - protein, 9 aa, Homo Sapiens
LGRRRGWCP

SEQ ID NO: 63415 - protein, 9 aa, Homo Sapiens
GFHHISIPQ

SEQ ID NO: 63416 - protein, 9 aa, Homo Sapiens
HFVSALTVF

SEQ ID NO: 63417 - protein, 9 aa, Homo Sapiens
LGYRINIPK

SEQ ID NO: 63418 - protein, 9 aa, Homo Sapiens
MPQTLDGQI

SEQ ID NO: 63419 - protein, 9 aa, Homo Sapiens
VQYLRQIHT

SEQ ID NO: 63420 - protein, 9 aa, Homo Sapiens
VQLADFGLA

SEQ ID NO: 63421 - protein, 9 aa, Homo Sapiens
MPVLSEDSC

SEQ ID NO: 63422 - protein, 9 aa, Homo Sapiens
AHCPRAEVL

SEQ ID NO: 63423 - protein, 9 aa, Homo Sapiens
PELIESAVY

SEQ ID NO: 63424 - protein, 9 aa, Homo Sapiens
MPPLKSMAM

SEQ ID NO: 63425 - protein, 9 aa, Homo Sapiens
GTVQLADFG

SEQ ID NO: 63426 - protein, 9 aa, Homo Sapiens
HIQRLNELE

SEQ ID NO: 63427 - protein, 9 aa, Homo Sapiens
ELIESAVYL

SEQ ID NO: 63428 - protein, 9 aa, Homo Sapiens
VVEQAQQVA

SEQ ID NO: 63429 - protein, 9 aa, Homo Sapiens
KVMDAIMSD

SEQ ID NO: 63430 - protein, 9 aa, Homo Sapiens
HPVDREMTP

SEQ ID NO: 63431 - protein, 9 aa, Homo Sapiens
LQEPPAIAV

SEQ ID NO: 63432 - protein, 9 aa, Homo Sapiens
RRPPAKPQR

SEQ ID NO: 63433 - protein, 9 aa, Homo Sapiens
ALDTQYDKE

SEQ ID NO: 63434 - protein, 9 aa, Homo Sapiens
LGTGPAATT

SEQ ID NO: 63435 - protein, 9 aa, Homo Sapiens
PFVFHSVPE

SEQ ID NO: 63436 - protein, 9 aa, Homo Sapiens
PGNMVSPVG

SEQ ID NO: 63437 - protein, 9 aa, Homo Sapiens
WVEGTAWLP

SEQ ID NO: 63438 - protein, 9 aa, Homo Sapiens
LKTTTRDHE

SEQ ID NO: 63439 - protein, 9 aa, Homo Sapiens
QLADFGLAR

SEQ ID NO: 63440 - protein, 9 aa, Homo Sapiens
KTTTRDHEE

SEQ ID NO: 63441 - protein, 9 aa, Homo Sapiens
IESAVYLYR

SEQ ID NO: 63442 - protein, 9 aa, Homo Sapiens
FPFVFHSVP

SEQ ID NO: 63443 - protein, 9 aa, Homo Sapiens
PAKPQRHPS

SEQ ID NO: 63444 - protein, 9 aa, Homo Sapiens
DNVKLFGKR

SEQ ID NO: 63445 - protein, 9 aa, Homo Sapiens
FLPLGYRIN

SEQ ID NO: 63446 - protein, 9 aa, Homo Sapiens
SVFQFKLGN

SEQ ID NO: 63447 - protein, 9 aa, Homo Sapiens
NMVSPVGPG

SEQ ID NO: 63448 - protein, 9 aa, Homo Sapiens
SGGTVQLAD

SEQ ID NO: 63449 - protein, 9 aa, Homo Sapiens
RTHPPRPRP

SEQ ID NO: 63450 - protein, 9 aa, Homo Sapiens
PAATTTAAT

SEQ ID NO: 63451 - protein, 9 aa, Homo Sapiens
RIYVHHPVD

SEQ ID NO: 63452 - protein, 9 aa, Homo Sapiens
TNHETLLRE

SEQ ID NO: 63453 - protein, 9 aa, Homo Sapiens
ALLRKTQLL

SEQ ID NO: 63454 - protein, 9 aa, Homo Sapiens
ATTTAATTS

SEQ ID NO: 63455 - protein, 9 aa, Homo Sapiens
ISALDTQYD

SEQ ID NO: 63456 - protein, 9 aa, Homo Sapiens
SFTEHKRIH

SEQ ID NO: 63457 - protein, 9 aa, Homo Sapiens
KRTHPPRPR

SEQ ID NO: 63458 - protein, 9 aa, Homo Sapiens
DSYGEESDS

SEQ ID NO: 63459 - protein, 9 aa, Homo Sapiens
RRRGWCPYF

SEQ ID NO: 63460 - protein, 9 aa, Homo Sapiens
KLKKVMDAI

SEQ ID NO: 63461 - protein, 9 aa, Homo Sapiens
FYGTVKLGT

SEQ ID NO: 63462 - protein, 9 aa, Homo Sapiens
PVDAMTGKA

SEQ ID NO: 63463 - protein, 9 aa, Homo Sapiens
KALGRRRGW

SEQ ID NO: 63464 - protein, 9 aa, Homo Sapiens
HFTPHIQRL

SEQ ID NO: 63465 - protein, 9 aa, Homo Sapiens
NIPKNGKLN

SEQ ID NO: 63466 - protein, 9 aa, Homo Sapiens
SEDSCLHET

SEQ ID NO: 63467 - protein, 9 aa, Homo Sapiens
RVQVQVVEQ

SEQ ID NO: 63468 - protein, 9 aa, Homo Sapiens
DNHWVEGTA

SEQ ID NO: 63469 - protein, 9 aa, Homo Sapiens
GIYYGILHS

SEQ ID NO: 63470 - protein, 9 aa, Homo Sapiens
TTRDHEELK

SEQ ID NO: 63471 - protein, 9 aa, Homo Sapiens
SVPEFGAAI

SEQ ID NO: 63472 - protein, 9 aa, Homo Sapiens
VERAVTHLD

SEQ ID NO: 63473 - protein, 9 aa, Homo Sapiens
PVLSEDSCL

SEQ ID NO: 63474 - protein, 9 aa, Homo Sapiens
PESCDMPPL

SEQ ID NO: 63475 - protein, 9 aa, Homo Sapiens
NSRITNVTR

SEQ ID NO: 63476 - protein, 9 aa, Homo Sapiens
KFYGTVKLG

SEQ ID NO: 63477 - protein, 9 aa, Homo Sapiens
WSSSFTEHK

SEQ ID NO: 63478 - protein, 9 aa, Homo Sapiens
ATKTSKRTH

SEQ ID NO: 63479 - protein, 9 aa, Homo Sapiens
VHHPVDREM

SEQ ID NO: 63480 - protein, 9 aa, Homo Sapiens
LLKNSRITN

SEQ ID NO: 63481 - protein, 9 aa, Homo Sapiens
KLQEPPAIA

SEQ ID NO: 63482 - protein, 9 aa, Homo Sapiens
GTVKLGTMI

SEQ ID NO: 63483 - protein, 9 aa, Homo Sapiens
PSDNHWVEG

SEQ ID NO: 63484 - protein, 9 aa, Homo Sapiens
SSTSFISEQ

SEQ ID NO: 63485 - protein, 9 aa, Homo Sapiens
TSFISEQSE

SEQ ID NO: 63486 - protein, 9 aa, Homo Sapiens
VFHSVPEFG

SEQ ID NO: 63487 - protein, 9 aa, Homo Sapiens
TPESCDMPP

SEQ ID NO: 63488 - protein, 9 aa, Homo Sapiens
QYDKERIKK

SEQ ID NO: 63489 - protein, 9 aa, Homo Sapiens
QEGGADSYG

SEQ ID NO: 63490 - protein, 9 aa, Homo Sapiens
HLDNVKLFG

SEQ ID NO: 63491 - protein, 9 aa, Homo Sapiens
HSVPEFGAA

SEQ ID NO: 63492 - protein, 9 aa, Homo Sapiens
IICITDAHT

SEQ ID NO: 63493 - protein, 9 aa, Homo Sapiens
SLHFFPASW

SEQ ID NO: 63494 - protein, 9 aa, Homo Sapiens
LSEDSCLHE

SEQ ID NO: 63495 - protein, 9 aa, Homo Sapiens
VAHCPRAEV

SEQ ID NO: 63496 - protein, 9 aa, Homo Sapiens
TTTAATTSS

SEQ ID NO: 63497 - protein, 9 aa, Homo Sapiens
DLKALGRRR

SEQ ID NO: 63498 - protein, 9 aa, Homo Sapiens
FISEQSERP

SEQ ID NO: 63499 - protein, 9 aa, Homo Sapiens
IYYGILHSI

SEQ ID NO: 63500 - protein, 9 aa, Homo Sapiens
IMSDGNLET

SEQ ID NO: 63501 - protein, 9 aa, Homo Sapiens
EKLQEPPAI

SEQ ID NO: 63502 - protein, 9 aa, Homo Sapiens
KTHIICITD

SEQ ID NO: 63503 - protein, 9 aa, Homo Sapiens
SALTVFFIN

SEQ ID NO: 63504 - protein, 9 aa, Homo Sapiens
LYTCNECGK

SEQ ID NO: 63505 - protein, 9 aa, Homo Sapiens
RPPAKPQRH

SEQ ID NO: 63506 - protein, 9 aa, Homo Sapiens
GYRINIPKN

SEQ ID NO: 63507 - protein, 9 aa, Homo Sapiens
NECGKGFSM

SEQ ID NO: 63508 - protein, 9 aa, Homo Sapiens
LSSTSFISE

SEQ ID NO: 63509 - protein, 9 aa, Homo Sapiens
ITNVTRDGF

SEQ ID NO: 63510 - protein, 9 aa, Homo Sapiens
TPNSMVPSL

SEQ ID NO: 63511 - protein, 9 aa, Homo Sapiens
NSMVPSLVE

SEQ ID NO: 63512 - protein, 9 aa, Homo Sapiens
FLATHEGYY

SEQ ID NO: 63513 - protein, 9 aa, Homo Sapiens
AIAVREAAD

SEQ ID NO: 63514 - protein, 9 aa, Homo Sapiens
YLRQIHTNH

SEQ ID NO: 63515 - protein, 9 aa, Homo Sapiens
AVTHLDNVK

SEQ ID NO: 63516 - protein, 9 aa, Homo Sapiens
RKTQLLILD

SEQ ID NO: 63517 - protein, 9 aa, Homo Sapiens
GASVFQFKL

SEQ ID NO: 63518 - protein, 9 aa, Homo Sapiens
YGEESDSDL

SEQ ID NO: 63519 - protein, 9 aa, Homo Sapiens
YTCNECGKG

SEQ ID NO: 63520 - protein, 9 aa, Homo Sapiens
DTQYDKERI

SEQ ID NO: 63521 - protein, 9 aa, Homo Sapiens
SAVYLYRAT

SEQ ID NO: 63522 - protein, 9 aa, Homo Sapiens
ESAVYLYRA

SEQ ID NO: 63523 - protein, 9 aa, Homo Sapiens
LHFTPHIQR

SEQ ID NO: 63524 - protein, 9 aa, Homo Sapiens
KLYTCNECG

SEQ ID NO: 63525 - protein, 9 aa, Homo Sapiens
ITDAHTLSG

SEQ ID NO: 63526 - protein, 9 aa, Homo Sapiens
NKTHIICIT

SEQ ID NO: 63527 - protein, 9 aa, Homo Sapiens
IAVREAADK

SEQ ID NO: 63528 - protein, 9 aa, Homo Sapiens
SSFTEHKRI

SEQ ID NO: 63529 - protein, 9 aa, Homo Sapiens
GPVDAMTGK

SEQ ID NO: 63530 - protein, 9 aa, Homo Sapiens
KTQLLILDE

SEQ ID NO: 63531 - protein, 9 aa, Homo Sapiens
SCDMPPLKS

SEQ ID NO: 63532 - protein, 9 aa, Homo Sapiens
GTMIFGVIE

SEQ ID NO: 63533 - protein, 9 aa, Homo Sapiens
GGTVQLADF

SEQ ID NO: 63534 - protein, 9 aa, Homo Sapiens
QRHPSTKLS

SEQ ID NO: 63535 - protein, 9 aa, Homo Sapiens
ICITDAHTL

SEQ ID NO: 63536 - protein, 9 aa, Homo Sapiens
ISEQSERPR

SEQ ID NO: 63537 - protein, 9 aa, Homo Sapiens
VKLGTMIFG

SEQ ID NO: 63538 - protein, 9 aa, Homo Sapiens
YRSLMPQTL

SEQ ID NO: 63539 - protein, 9 aa, Homo Sapiens
PTLPSDNHW

SEQ ID NO: 63540 - protein, 9 aa, Homo Sapiens
SFISEQSER

SEQ ID NO: 63541 - protein, 9 aa, Homo Sapiens
QVVEQAQQV

SEQ ID NO: 63542 - protein, 9 aa, Homo Sapiens
GRIYVHHPV

SEQ ID NO: 63543 - protein, 9 aa, Homo Sapiens
FVSALTVFF

SEQ ID NO: 63544 - protein, 9 aa, Homo Sapiens
QIHTNHETL

SEQ ID NO: 63545 - protein, 9 aa, Homo Sapiens
AVAHCPRAE

SEQ ID NO: 63546 - protein, 9 aa, Homo Sapiens
LLLKNSRIT

SEQ ID NO: 63547 - protein, 9 aa, Homo Sapiens
MTGKAKRTL

SEQ ID NO: 63548 - protein, 9 aa, Homo Sapiens
AATTTAATT

SEQ ID NO: 63549 - protein, 9 aa, Homo Sapiens
LMPQTLDGQ

SEQ ID NO: 63550 - protein, 9 aa, Homo Sapiens
RALLRKTQL

SEQ ID NO: 63551 - protein, 9 aa, Homo Sapiens
HFFPASWQG

SEQ ID NO: 63552 - protein, 9 aa, Homo Sapiens
DMPPLKSMA

SEQ ID NO: 63553 - protein, 9 aa, Homo Sapiens
SRITNVTRD

SEQ ID NO: 63554 - protein, 9 aa, Homo Sapiens
LHFFPASWQ

SEQ ID NO: 63555 - protein, 9 aa, Homo Sapiens
YGTVKLGTM

SEQ ID NO: 63556 - protein, 9 aa, Homo Sapiens
PRAEVLWLM

SEQ ID NO: 63557 - protein, 9 aa, Homo Sapiens
SALDTQYDK

SEQ ID NO: 63558 - protein, 9 aa, Homo Sapiens
EKLYTCNEC

SEQ ID NO: 63559 - protein, 9 aa, Homo Sapiens
VQVQVVEQA

SEQ ID NO: 63560 - protein, 9 aa, Homo Sapiens
LKALGRRRG

SEQ ID NO: 63561 - protein, 9 aa, Homo Sapiens
PNSMVPSLV

SEQ ID NO: 63562 - protein, 9 aa, Homo Sapiens
RDHEELKCM

SEQ ID NO: 63563 - protein, 9 aa, Homo Sapiens
THIICITDA

SEQ ID NO: 63564 - protein, 9 aa, Homo Sapiens
FKLGNQNVE

SEQ ID NO: 63565 - protein, 9 aa, Homo Sapiens
NLSLHFFPA

SEQ ID NO: 63566 - protein, 9 aa, Homo Sapiens
LSLHFFPAS

SEQ ID NO: 63567 - protein, 9 aa, Homo Sapiens
QTLDGQITM

SEQ ID NO: 63568 - protein, 9 aa, Homo Sapiens
GADSYGEES

SEQ ID NO: 63569 - protein, 9 aa, Homo Sapiens
LATHEGYYP

SEQ ID NO: 63570 - protein, 9 aa, Homo Sapiens
TGEKLYTCN

SEQ ID NO: 63571 - protein, 9 aa, Homo Sapiens
FTEHKRIHA

SEQ ID NO: 63572 - protein, 9 aa, Homo Sapiens
LGLLGIYYG

SEQ ID NO: 63573 - protein, 9 aa, Homo Sapiens
SCLHETLAL

SEQ ID NO: 63574 - protein, 9 aa, Homo Sapiens
RRGWCPYFL

SEQ ID NO: 63575 - protein, 9 aa, Homo Sapiens
SYGEESDSD

SEQ ID NO: 63576 - protein, 9 aa, Homo Sapiens
LGTMIFGVI

SEQ ID NO: 63577 - protein, 9 aa, Homo Sapiens
FFINSKSLS

SEQ ID NO: 63578 - protein, 9 aa, Homo Sapiens
LVTSGGTVQ

SEQ ID NO: 63579 - protein, 9 aa, Homo Sapiens
GGADSYGEE

SEQ ID NO: 63580 - protein, 9 aa, Homo Sapiens
PPAKPQRHP

SEQ ID NO: 63581 - protein, 9 aa, Homo Sapiens
LIESAVYLY

SEQ ID NO: 63582 - protein, 9 aa, Homo Sapiens
AVYLYRATG

SEQ ID NO: 63583 - protein, 9 aa, Homo Sapiens
GEESDSDLS

SEQ ID NO: 63584 - protein, 9 aa, Homo Sapiens
VTPESCDMP

SEQ ID NO: 63585 - protein, 9 aa, Homo Sapiens
STSFISEQS

SEQ ID NO: 63586 - protein, 9 aa, Homo Sapiens
GLLGIYYGI

SEQ ID NO: 63587 - protein, 9 aa, Homo Sapiens
TQYDKERIK

SEQ ID NO: 63588 - protein, 9 aa, Homo Sapiens
LRKTQLLIL

SEQ ID NO: 63589 - protein, 9 aa, Homo Sapiens
LLILDEATA

SEQ ID NO: 63590 - protein, 9 aa, Homo Sapiens
EQAQQVAVQ

SEQ ID NO: 63591 - protein, 9 aa, Homo Sapiens
KTSKRTHPP

SEQ ID NO: 63592 - protein, 9 aa, Homo Sapiens
RAVTHLDNV

SEQ ID NO: 63593 - protein, 9 aa, Homo Sapiens
GPAATTTAA

SEQ ID NO: 63594 - protein, 9 aa, Homo Sapiens
YGILHSIYG

SEQ ID NO: 63595 - protein, 9 aa, Homo Sapiens
TGTNLSLHF

SEQ ID NO: 63596 - protein, 9 aa, Homo Sapiens
ATGTNLSLH

SEQ ID NO: 63597 - protein, 9 aa, Homo Sapiens
VYLYRATGD

SEQ ID NO: 63598 - protein, 9 aa, Homo Sapiens
TKTSKRTHP

SEQ ID NO: 63599 - protein, 9 aa, Homo Sapiens
PHSSPGNMV

SEQ ID NO: 63600 - protein, 9 aa, Homo Sapiens
VTHLDNVKL

SEQ ID NO: 63601 - protein, 9 aa, Homo Sapiens
VMDAIMSDG

SEQ ID NO: 63602 - protein, 9 aa, Homo Sapiens
YPLAEEQTE

SEQ ID NO: 63603 - protein, 9 aa, Homo Sapiens
LKKVMDAIM

SEQ ID NO: 63604 - protein, 9 aa, Homo Sapiens
WVTPESCDM

SEQ ID NO: 63605 - protein, 9 aa, Homo Sapiens
ALTVFFINS

SEQ ID NO: 63606 - protein, 9 aa, Homo Sapiens
AKPQRHPST

SEQ ID NO: 63607 - protein, 9 aa, Homo Sapiens
TVQLADFGL

SEQ ID NO: 63608 - protein, 9 aa, Homo Sapiens
TPHIQRLNE

SEQ ID NO: 63609 - protein, 9 aa, Homo Sapiens
DAMTGKAKR

SEQ ID NO: 63610 - protein, 9 aa, Homo Sapiens
MVSPVGPGS

SEQ ID NO: 63611 - protein, 9 aa, Homo Sapiens
SLMPQTLDG

SEQ ID NO: 63612 - protein, 9 aa, Homo Sapiens
KKVMDAIMS

SEQ ID NO: 63613 - protein, 9 aa, Homo Sapiens
LRGASVFQF

SEQ ID NO: 63614 - protein, 9 aa, Homo Sapiens
SDNHWVEGT

SEQ ID NO: 63615 - protein, 9 aa, Homo Sapiens
DKLHFTPHI

SEQ ID NO: 63616 - protein, 9 aa, Homo Sapiens
QAQQVAVQE

SEQ ID NO: 63617 - protein, 9 aa, Homo Sapiens
HEGYYPLAE

SEQ ID NO: 63618 - protein, 9 aa, Homo Sapiens
TQLLILDEA

SEQ ID NO: 63619 - protein, 9 aa, Homo Sapiens
TVFFINSKS

SEQ ID NO: 63620 - protein, 9 aa, Homo Sapiens
TRDHEELKC

SEQ ID NO: 63621 - protein, 9 aa, Homo Sapiens
KAFSWSSSF

SEQ ID NO: 63622 - protein, 9 aa, Homo Sapiens
VDKGPVDAM

SEQ ID NO: 63623 - protein, 9 aa, Homo Sapiens
YYGILHSIY

SEQ ID NO: 63624 - protein, 9 aa, Homo Sapiens
TTTRDHEEL

SEQ ID NO: 63625 - protein, 9 aa, Homo Sapiens
IYVHHPVDR

SEQ ID NO: 63626 - protein, 9 aa, Homo Sapiens
TSKRTHPPR

SEQ ID NO: 63627 - protein, 9 aa, Homo Sapiens
TNLSLHFFP

SEQ ID NO: 63628 - protein, 9 aa, Homo Sapiens
HHPVDREMT

SEQ ID NO: 63629 - protein, 9 aa, Homo Sapiens
LPLGYRINI

SEQ ID NO: 63630 - protein, 9 aa, Homo Sapiens
ENGRIYVHH

SEQ ID NO: 63631 - protein, 9 aa, Homo Sapiens
EGHAVLIVK

SEQ ID NO: 63632 - protein, 9 aa, Homo Sapiens
HRVKSPELY

SEQ ID NO: 63633 - protein, 9 aa, Homo Sapiens
YKAVRRGGA

SEQ ID NO: 63634 - protein, 9 aa, Homo Sapiens
VFGGATLYG

SEQ ID NO: 63635 - protein, 9 aa, Homo Sapiens
FAEIFLEKI

SEQ ID NO: 63636 - protein, 9 aa, Homo Sapiens
DHADFHHRV

SEQ ID NO: 63637 - protein, 9 aa, Homo Sapiens
LADYYIKCF

SEQ ID NO: 63638 - protein, 9 aa, Homo Sapiens
NPMLDKELR

SEQ ID NO: 63639 - protein, 9 aa, Homo Sapiens
QVDKEKDEV

SEQ ID NO: 63640 - protein, 9 aa, Homo Sapiens
RSADIKVIM

SEQ ID NO: 63641 - protein, 9 aa, Homo Sapiens
ASLTASGFP

SEQ ID NO: 63642 - protein, 9 aa, Homo Sapiens
KKNVEGEVE

SEQ ID NO: 63643 - protein, 9 aa, Homo Sapiens
PAVWVATTK

SEQ ID NO: 63644 - protein, 9 aa, Homo Sapiens
KAGECVEDI

SEQ ID NO: 63645 - protein, 9 aa, Homo Sapiens
IQFFFHCNW

SEQ ID NO: 63646 - protein, 9 aa, Homo Sapiens
GDTHTIIPT

SEQ ID NO: 63647 - protein, 9 aa, Homo Sapiens
NVEGEVEME

SEQ ID NO: 63648 - protein, 9 aa, Homo Sapiens
FNSSYAMEQ

SEQ ID NO: 63649 - protein, 9 aa, Homo Sapiens
SFAYIPWKF

SEQ ID NO: 63650 - protein, 9 aa, Homo Sapiens
GKEIIHLVL

SEQ ID NO: 63651 - protein, 9 aa, Homo Sapiens
TNSNAIISW

SEQ ID NO: 63652 - protein, 9 aa, Homo Sapiens
VIKSAFYPP

SEQ ID NO: 63653 - protein, 9 aa, Homo Sapiens
DALSYMNIQ

SEQ ID NO: 63654 - protein, 9 aa, Homo Sapiens
NNSDSGFFT

SEQ ID NO: 63655 - protein, 9 aa, Homo Sapiens
LKAGECVED

SEQ ID NO: 63656 - protein, 9 aa, Homo Sapiens
LQRIRQSED

SEQ ID NO: 63657 - protein, 9 aa, Homo Sapiens
SAVSRDKYS

SEQ ID NO: 63658 - protein, 9 aa, Homo Sapiens
GHMFHIDFD

SEQ ID NO: 63659 - protein, 9 aa, Homo Sapiens
TPPSVIISW

SEQ ID NO: 63660 - protein, 9 aa, Homo Sapiens
LNQVLVLKK

SEQ ID NO: 63661 - protein, 9 aa, Homo Sapiens
MALMDNGEN

SEQ ID NO: 63662 - protein, 9 aa, Homo Sapiens
SYNEIKIKF

SEQ ID NO: 63663 - protein, 9 aa, Homo Sapiens
SLASLTASG

SEQ ID NO: 63664 - protein, 9 aa, Homo Sapiens
RKVQKSIEV

SEQ ID NO: 63665 - protein, 9 aa, Homo Sapiens
DPSQVELLE

SEQ ID NO: 63666 - protein, 9 aa, Homo Sapiens
EIIHLVLDR

SEQ ID NO: 63667 - protein, 9 aa, Homo Sapiens
MGCAIIAGL

SEQ ID NO: 63668 - protein, 9 aa, Homo Sapiens
LKEKKEKKT

SEQ ID NO: 63669 - protein, 9 aa, Homo Sapiens
ITCKKFDTV

SEQ ID NO: 63670 - protein, 9 aa, Homo Sapiens
GCAIIAGLL

SEQ ID NO: 63671 - protein, 9 aa, Homo Sapiens
VNFFKLHTF

SEQ ID NO: 63672 - protein, 9 aa, Homo Sapiens
KSIEVPQAK

SEQ ID NO: 63673 - protein, 9 aa, Homo Sapiens
DYYIKCFDT

SEQ ID NO: 63674 - protein, 9 aa, Homo Sapiens
DEERLGEDK

SEQ ID NO: 63675 - protein, 9 aa, Homo Sapiens
SNPQASCPL

SEQ ID NO: 63676 - protein, 9 aa, Homo Sapiens
THSKPLYET

SEQ ID NO: 63677 - protein, 9 aa, Homo Sapiens
NAGQLKNGD

SEQ ID NO: 63678 - protein, 9 aa, Homo Sapiens
HMCVYSYIH

SEQ ID NO: 63679 - protein, 9 aa, Homo Sapiens
PRMRGFIYQ

SEQ ID NO: 63680 - protein, 9 aa, Homo Sapiens
FVQIFLSVI

SEQ ID NO: 63681 - protein, 9 aa, Homo Sapiens
MLSASPRMR

SEQ ID NO: 63682 - protein, 9 aa, Homo Sapiens
DYQPKYFLS

SEQ ID NO: 63683 - protein, 9 aa, Homo Sapiens
VLGWYMVKS

SEQ ID NO: 63684 - protein, 9 aa, Homo Sapiens
KKFDTVQAS

SEQ ID NO: 63685 - protein, 9 aa, Homo Sapiens
PATSLPMSL

SEQ ID NO: 63686 - protein, 9 aa, Homo Sapiens
PHYQNKENC

SEQ ID NO: 63687 - protein, 9 aa, Homo Sapiens
ELNNSDSGF

SEQ ID NO: 63688 - protein, 9 aa, Homo Sapiens
KAVRRGGAD

SEQ ID NO: 63689 - protein, 9 aa, Homo Sapiens
SQKPNEVSS

SEQ ID NO: 63690 - protein, 9 aa, Homo Sapiens
TEKVDQVKG

SEQ ID NO: 63691 - protein, 9 aa, Homo Sapiens
EEEKWAAES

SEQ ID NO: 63692 - protein, 9 aa, Homo Sapiens
GEFCLPYPI

SEQ ID NO: 63693 - protein, 9 aa, Homo Sapiens
QTLNQVLVL

SEQ ID NO: 63694 - protein, 9 aa, Homo Sapiens
GDLLVFGGA

SEQ ID NO: 63695 - protein, 9 aa, Homo Sapiens
YHLILLTSL

SEQ ID NO: 63696 - protein, 9 aa, Homo Sapiens
VLLGRLTGV

SEQ ID NO: 63697 - protein, 9 aa, Homo Sapiens
RGFIYQGKI

SEQ ID NO: 63698 - protein, 9 aa, Homo Sapiens
EKSLHIPMY

SEQ ID NO: 63699 - protein, 9 aa, Homo Sapiens
VDQVKGTAE

SEQ ID NO: 63700 - protein, 9 aa, Homo Sapiens
FFKLHTFEE

SEQ ID NO: 63701 - protein, 9 aa, Homo Sapiens
PCTVGDAFA

SEQ ID NO: 63702 - protein, 9 aa, Homo Sapiens
LICGNFKGI

SEQ ID NO: 63703 - protein, 9 aa, Homo Sapiens
ALHLACASD

SEQ ID NO: 63704 - protein, 9 aa, Homo Sapiens
YLALLQVAP

SEQ ID NO: 63705 - protein, 9 aa, Homo Sapiens
NRSQKPNEV

SEQ ID NO: 63706 - protein, 9 aa, Homo Sapiens
VKAMINAGQ

SEQ ID NO: 63707 - protein, 9 aa, Homo Sapiens
QAAGKIFKI

SEQ ID NO: 63708 - protein, 9 aa, Homo Sapiens
KYSKVPSAL

SEQ ID NO: 63709 - protein, 9 aa, Homo Sapiens
KLYARMSEV

SEQ ID NO: 63710 - protein, 9 aa, Homo Sapiens
YKLQTYDES

SEQ ID NO: 63711 - protein, 9 aa, Homo Sapiens
QGKGPCPRR

SEQ ID NO: 63712 - protein, 9 aa, Homo Sapiens
LEDSTMCVV

SEQ ID NO: 63713 - protein, 9 aa, Homo Sapiens
EGSSFAYIP

SEQ ID NO: 63714 - protein, 9 aa, Homo Sapiens
GHAVLIVKG

SEQ ID NO: 63715 - protein, 9 aa, Homo Sapiens
HYQNKENCA

SEQ ID NO: 63716 - protein, 9 aa, Homo Sapiens
TYDESSLPL

SEQ ID NO: 63717 - protein, 9 aa, Homo Sapiens
IKIKFDKYK

SEQ ID NO: 63718 - protein, 9 aa, Homo Sapiens
LHLACASDH

SEQ ID NO: 63719 - protein, 9 aa, Homo Sapiens
EGDLKAPKV

SEQ ID NO: 63720 - protein, 9 aa, Homo Sapiens
LMDNGENEL

SEQ ID NO: 63721 - protein, 9 aa, Homo Sapiens
RGLGSPWIY

SEQ ID NO: 63722 - protein, 9 aa, Homo Sapiens
NVNFFKLHT

SEQ ID NO: 63723 - protein, 9 aa, Homo Sapiens
RASWKNYLE

SEQ ID NO: 63724 - protein, 9 aa, Homo Sapiens
EIRDGNEVR

SEQ ID NO: 63725 - protein, 9 aa, Homo Sapiens
RKDYQPKYF

SEQ ID NO: 63726 - protein, 9 aa, Homo Sapiens
AFKRGQRLY

SEQ ID NO: 63727 - protein, 9 aa, Homo Sapiens
TQFMTQTLN

SEQ ID NO: 63728 - protein, 9 aa, Homo Sapiens
PSSHHPRAT

SEQ ID NO: 63729 - protein, 9 aa, Homo Sapiens
VDKEKDEVN

SEQ ID NO: 63730 - protein, 9 aa, Homo Sapiens
HIEVTFDID

SEQ ID NO: 63731 - protein, 9 aa, Homo Sapiens
EIVSFDYSP

SEQ ID NO: 63732 - protein, 9 aa, Homo Sapiens
YDESSLPLP

SEQ ID NO: 63733 - protein, 9 aa, Homo Sapiens
APKVDVKGP

SEQ ID NO: 63734 - protein, 9 aa, Homo Sapiens
LSCLFWEFL

SEQ ID NO: 63735 - protein, 9 aa, Homo Sapiens
KAMINAGQL

SEQ ID NO: 63736 - protein, 9 aa, Homo Sapiens
FEPTEEECE

SEQ ID NO: 63737 - protein, 9 aa, Homo Sapiens
EFCLPYPIE

SEQ ID NO: 63738 - protein, 9 aa, Homo Sapiens
KVIQQIVDK

SEQ ID NO: 63739 - protein, 9 aa, Homo Sapiens
LYARMSEVL

SEQ ID NO: 63740 - protein, 9 aa, Homo Sapiens
SNAIISWAQ

SEQ ID NO: 63741 - protein, 9 aa, Homo Sapiens
TKSYNEIKI

SEQ ID NO: 63742 - protein, 9 aa, Homo Sapiens
THTIIPTKI

SEQ ID NO: 63743 - protein, 9 aa, Homo Sapiens
YLWQAARCI

SEQ ID NO: 63744 - protein, 9 aa, Homo Sapiens
KNLQEALKD

SEQ ID NO: 63745 - protein, 9 aa, Homo Sapiens
GILELTMET

SEQ ID NO: 63746 - protein, 9 aa, Homo Sapiens
YPPNFPICL

SEQ ID NO: 63747 - protein, 9 aa, Homo Sapiens
TATLKEKKE

SEQ ID NO: 63748 - protein, 9 aa, Homo Sapiens
AARCIPQAL

SEQ ID NO: 63749 - protein, 9 aa, Homo Sapiens
LSGLNSGPG

SEQ ID NO: 63750 - protein, 9 aa, Homo Sapiens
GEYTPGTFV

SEQ ID NO: 63751 - protein, 9 aa, Homo Sapiens
QKKTNDLRY

SEQ ID NO: 63752 - protein, 9 aa, Homo Sapiens
RNHRMFSLG

SEQ ID NO: 63753 - protein, 9 aa, Homo Sapiens
YIVNIMAIV

SEQ ID NO: 63754 - protein, 9 aa, Homo Sapiens
KEEVNVEGL

SEQ ID NO: 63755 - protein, 9 aa, Homo Sapiens
SCLFWEFLT

SEQ ID NO: 63756 - protein, 9 aa, Homo Sapiens
GITCKKFDT

SEQ ID NO: 63757 - protein, 9 aa, Homo Sapiens
GVIKSAFYP

SEQ ID NO: 63758 - protein, 9 aa, Homo Sapiens
QFFFHCNWR

SEQ ID NO: 63759 - protein, 9 aa, Homo Sapiens
NYFEHSNYV

SEQ ID NO: 63760 - protein, 9 aa, Homo Sapiens
DLKAPKVDV

SEQ ID NO: 63761 - protein, 9 aa, Homo Sapiens
SADPPPAVW

SEQ ID NO: 63762 - protein, 9 aa, Homo Sapiens
ALADYYIKC

SEQ ID NO: 63763 - protein, 9 aa, Homo Sapiens
PQGKGPCPR

SEQ ID NO: 63764 - protein, 9 aa, Homo Sapiens
LQSSWLPNF

SEQ ID NO: 63765 - protein, 9 aa, Homo Sapiens
QPKYFLSIP

SEQ ID NO: 63766 - protein, 9 aa, Homo Sapiens
RCIPQALTL

SEQ ID NO: 63767 - protein, 9 aa, Homo Sapiens
EKEKIKKTN

SEQ ID NO: 63768 - protein, 9 aa, Homo Sapiens
GTQKSQRTE

SEQ ID NO: 63769 - protein, 9 aa, Homo Sapiens
MAWVKFYGN

SEQ ID NO: 63770 - protein, 9 aa, Homo Sapiens
HQKESDPTE

SEQ ID NO: 63771 - protein, 9 aa, Homo Sapiens
APLRASWKN

SEQ ID NO: 63772 - protein, 9 aa, Homo Sapiens
DRLYFLMEY

SEQ ID NO: 63773 - protein, 9 aa, Homo Sapiens
LNGAELEIS

SEQ ID NO: 63774 - protein, 9 aa, Homo Sapiens
LPCTVGDAF

SEQ ID NO: 63775 - protein, 9 aa, Homo Sapiens
LTEELLALQ

SEQ ID NO: 63776 - protein, 9 aa, Homo Sapiens
SLEDSTMCV

SEQ ID NO: 63777 - protein, 9 aa, Homo Sapiens
HHRVKSPEL

SEQ ID NO: 63778 - protein, 9 aa, Homo Sapiens
SPNTKQASP

SEQ ID NO: 63779 - protein, 9 aa, Homo Sapiens
DAFACLTCA

SEQ ID NO: 63780 - protein, 9 aa, Homo Sapiens
KNICWGTHS

SEQ ID NO: 63781 - protein, 9 aa, Homo Sapiens
SKTQFMTQT

SEQ ID NO: 63782 - protein, 9 aa, Homo Sapiens
QTMDRLYFL

SEQ ID NO: 63783 - protein, 9 aa, Homo Sapiens
GFFTVFTGV

SEQ ID NO: 63784 - protein, 9 aa, Homo Sapiens
ILSCLFWEF

SEQ ID NO: 63785 - protein, 9 aa, Homo Sapiens
VGDAFACLT

SEQ ID NO: 63786 - protein, 9 aa, Homo Sapiens
VPHIEVTFD

SEQ ID NO: 63787 - protein, 9 aa, Homo Sapiens
PPADRSCLK

SEQ ID NO: 63788 - protein, 9 aa, Homo Sapiens
ISTGPDAMS

SEQ ID NO: 63789 - protein, 9 aa, Homo Sapiens
IQKGNNNGK

SEQ ID NO: 63790 - protein, 9 aa, Homo Sapiens
MTVLLGRLT

SEQ ID NO: 63791 - protein, 9 aa, Homo Sapiens
SPSPARRMR

SEQ ID NO: 63792 - protein, 9 aa, Homo Sapiens
RLTEELLAL

SEQ ID NO: 63793 - protein, 9 aa, Homo Sapiens
RLDSIVIKQ

SEQ ID NO: 63794 - protein, 9 aa, Homo Sapiens
KIQSSLPEG

SEQ ID NO: 63795 - protein, 9 aa, Homo Sapiens
VGKCRSADI

SEQ ID NO: 63796 - protein, 9 aa, Homo Sapiens
HSNYVYLVL

SEQ ID NO: 63797 - protein, 9 aa, Homo Sapiens
PADRSCLKH

SEQ ID NO: 63798 - protein, 9 aa, Homo Sapiens
TCKKFDTVQ

SEQ ID NO: 63799 - protein, 9 aa, Homo Sapiens
GGVSPHCPG

SEQ ID NO: 63800 - protein, 9 aa, Homo Sapiens
EIINAIFEP

SEQ ID NO: 63801 - protein, 9 aa, Homo Sapiens
SFEEEFIHL

SEQ ID NO: 63802 - protein, 9 aa, Homo Sapiens
DEEEKWAAE

SEQ ID NO: 63803 - protein, 9 aa, Homo Sapiens
DPPPAVWVA

SEQ ID NO: 63804 - protein, 9 aa, Homo Sapiens
TMDRLYFLM

SEQ ID NO: 63805 - protein, 9 aa, Homo Sapiens
TDCGTIESG

SEQ ID NO: 63806 - protein, 9 aa, Homo Sapiens
HKLNTMKHL

SEQ ID NO: 63807 - protein, 9 aa, Homo Sapiens
KIFGPVAHP

SEQ ID NO: 63808 - protein, 9 aa, Homo Sapiens
DHVKVVTLL

SEQ ID NO: 63809 - protein, 9 aa, Homo Sapiens
STMCVVCSH

SEQ ID NO: 63810 - protein, 9 aa, Homo Sapiens
AFYPPNFPI

SEQ ID NO: 63811 - protein, 9 aa, Homo Sapiens
NLSPNTKQA

SEQ ID NO: 63812 - protein, 9 aa, Homo Sapiens
VLVWFPGDA

SEQ ID NO: 63813 - protein, 9 aa, Homo Sapiens
STFSPAPCP

SEQ ID NO: 63814 - protein, 9 aa, Homo Sapiens
CGNFKGIKI

SEQ ID NO: 63815 - protein, 9 aa, Homo Sapiens
PDNKHKNLY

SEQ ID NO: 63816 - protein, 9 aa, Homo Sapiens
KKIEPQGKG

SEQ ID NO: 63817 - protein, 9 aa, Homo Sapiens
KVDQVKGTA

SEQ ID NO: 63818 - protein, 9 aa, Homo Sapiens
VIIKYEKSL

SEQ ID NO: 63819 - protein, 9 aa, Homo Sapiens
VELLEVFGG

SEQ ID NO: 63820 - protein, 9 aa, Homo Sapiens
HRKALLHIF

SEQ ID NO: 63821 - protein, 9 aa, Homo Sapiens
DTHTIIPTK

SEQ ID NO: 63822 - protein, 9 aa, Homo Sapiens
ISPTEDGKH

SEQ ID NO: 63823 - protein, 9 aa, Homo Sapiens
FKLQSSWLP

SEQ ID NO: 63824 - protein, 9 aa, Homo Sapiens
PHIEVTFDI

SEQ ID NO: 63825 - protein, 9 aa, Homo Sapiens
YYTMSQPNA

SEQ ID NO: 63826 - protein, 9 aa, Homo Sapiens
TINSSPIKS

SEQ ID NO: 63827 - protein, 9 aa, Homo Sapiens
KCRSADIKV

SEQ ID NO: 63828 - protein, 9 aa, Homo Sapiens
ARCIPQALT

SEQ ID NO: 63829 - protein, 9 aa, Homo Sapiens
ILVIIKYEK

SEQ ID NO: 63830 - protein, 9 aa, Homo Sapiens
PNSTVGEFC

SEQ ID NO: 63831 - protein, 9 aa, Homo Sapiens
VLSPAGILE

SEQ ID NO: 63832 - protein, 9 aa, Homo Sapiens
SPMALMDNG

SEQ ID NO: 63833 - protein, 9 aa, Homo Sapiens
RGFAIDCAI

SEQ ID NO: 63834 - protein, 9 aa, Homo Sapiens
LACASDHVK

SEQ ID NO: 63835 - protein, 9 aa, Homo Sapiens
IISWAQKLK

SEQ ID NO: 63836 - protein, 9 aa, Homo Sapiens
SDSGFFTVF

SEQ ID NO: 63837 - protein, 9 aa, Homo Sapiens
YGFVKAMIN

SEQ ID NO: 63838 - protein, 9 aa, Homo Sapiens
QAARCIPQA

SEQ ID NO: 63839 - protein, 9 aa, Homo Sapiens
SIEVPQAKA

SEQ ID NO: 63840 - protein, 9 aa, Homo Sapiens
LNVSLESII

SEQ ID NO: 63841 - protein, 9 aa, Homo Sapiens
KEKIKKTNN

SEQ ID NO: 63842 - protein, 9 aa, Homo Sapiens
YMNIQQKED

SEQ ID NO: 63843 - protein, 9 aa, Homo Sapiens
PVQRGLGSP

SEQ ID NO: 63844 - protein, 9 aa, Homo Sapiens
KTTDLKQQS

SEQ ID NO: 63845 - protein, 9 aa, Homo Sapiens
MNLRGLAVA

SEQ ID NO: 63846 - protein, 9 aa, Homo Sapiens
AFACLTCAP

SEQ ID NO: 63847 - protein, 9 aa, Homo Sapiens
WTHGITCKK

SEQ ID NO: 63848 - protein, 9 aa, Homo Sapiens
IVIKQGRLI

SEQ ID NO: 63849 - protein, 9 aa, Homo Sapiens
NMFYIVNIM

SEQ ID NO: 63850 - protein, 9 aa, Homo Sapiens
LEGDLKAPK

SEQ ID NO: 63851 - protein, 9 aa, Homo Sapiens
LKAQVDKEK

SEQ ID NO: 63852 - protein, 9 aa, Homo Sapiens
DSIVIKQGR

SEQ ID NO: 63853 - protein, 9 aa, Homo Sapiens
PKYFLSIPI

SEQ ID NO: 63854 - protein, 9 aa, Homo Sapiens
ILNKEEVNV

SEQ ID NO: 63855 - protein, 9 aa, Homo Sapiens
FYPPNFPIC

SEQ ID NO: 63856 - protein, 9 aa, Homo Sapiens
LFWEFLTLC

SEQ ID NO: 63857 - protein, 9 aa, Homo Sapiens
YVTPVNQNV

SEQ ID NO: 63858 - protein, 9 aa, Homo Sapiens
CQKISPDGG

SEQ ID NO: 63859 - protein, 9 aa, Homo Sapiens
LSKQMPSQP

SEQ ID NO: 63860 - protein, 9 aa, Homo Sapiens
DKPSVLSGL

SEQ ID NO: 63861 - protein, 9 aa, Homo Sapiens
AMINAGQLK

SEQ ID NO: 63862 - protein, 9 aa, Homo Sapiens
ILEKFISLE

SEQ ID NO: 63863 - protein, 9 aa, Homo Sapiens
TGEIVSFDY

SEQ ID NO: 63864 - protein, 9 aa, Homo Sapiens
VIQQIVDKS

SEQ ID NO: 63865 - protein, 9 aa, Homo Sapiens
LWQAARCIP

SEQ ID NO: 63866 - protein, 9 aa, Homo Sapiens
DWCFSTPKN

SEQ ID NO: 63867 - protein, 9 aa, Homo Sapiens
IINAIFEPT

SEQ ID NO: 63868 - protein, 9 aa, Homo Sapiens
ELLALQMEC

SEQ ID NO: 63869 - protein, 9 aa, Homo Sapiens
HLVLDRIRK

SEQ ID NO: 63870 - protein, 9 aa, Homo Sapiens
NKENCAPLY

SEQ ID NO: 63871 - protein, 9 aa, Homo Sapiens
TWKKIEPQG

SEQ ID NO: 63872 - protein, 9 aa, Homo Sapiens
LNKEEVNVE

SEQ ID NO: 63873 - protein, 9 aa, Homo Sapiens
PSLSKQMPS

SEQ ID NO: 63874 - protein, 9 aa, Homo Sapiens
FDRFLGHAQ

SEQ ID NO: 63875 - protein, 9 aa, Homo Sapiens
RGLAVARDD

SEQ ID NO: 63876 - protein, 9 aa, Homo Sapiens
PWIYLWQAA

SEQ ID NO: 63877 - protein, 9 aa, Homo Sapiens
LVLKKRTEE

SEQ ID NO: 63878 - protein, 9 aa, Homo Sapiens
IVSFDYSPL

SEQ ID NO: 63879 - protein, 9 aa, Homo Sapiens
QRTSKLYAR

SEQ ID NO: 63880 - protein, 9 aa, Homo Sapiens
PTVLVVLLL

SEQ ID NO: 63881 - protein, 9 aa, Homo Sapiens
MSGTQKSQR

SEQ ID NO: 63882 - protein, 9 aa, Homo Sapiens
FIHMSGTQK

SEQ ID NO: 63883 - protein, 9 aa, Homo Sapiens
SPWIYLWQA

SEQ ID NO: 63884 - protein, 9 aa, Homo Sapiens
LMNLRGLAV

SEQ ID NO: 63885 - protein, 9 aa, Homo Sapiens
FKRGGVSPH

SEQ ID NO: 63886 - protein, 9 aa, Homo Sapiens
LQVRCLGPR

SEQ ID NO: 63887 - protein, 9 aa, Homo Sapiens
RMFSLGNNG

SEQ ID NO: 63888 - protein, 9 aa, Homo Sapiens
KLKAGECVE

SEQ ID NO: 63889 - protein, 9 aa, Homo Sapiens
FGGSLHSSL

SEQ ID NO: 63890 - protein, 9 aa, Homo Sapiens
PKLEGDLKA

SEQ ID NO: 63891 - protein, 9 aa, Homo Sapiens
TFHPDPSQV

SEQ ID NO: 63892 - protein, 9 aa, Homo Sapiens
EILNKEEVN

SEQ ID NO: 63893 - protein, 9 aa, Homo Sapiens
FKIFGPVAH

SEQ ID NO: 63894 - protein, 9 aa, Homo Sapiens
LLHYLFLAC

SEQ ID NO: 63895 - protein, 9 aa, Homo Sapiens
EALKDTEKK

SEQ ID NO: 63896 - protein, 9 aa, Homo Sapiens
VNVEGLHIN

SEQ ID NO: 63897 - protein, 9 aa, Homo Sapiens
TSKLYARMS

SEQ ID NO: 63898 - protein, 9 aa, Homo Sapiens
LVNSQVDFQ

SEQ ID NO: 63899 - protein, 9 aa, Homo Sapiens
KHQKESDPT

SEQ ID NO: 63900 - protein, 9 aa, Homo Sapiens
LEISTGPDA

SEQ ID NO: 63901 - protein, 9 aa, Homo Sapiens
LTASGFPWV

SEQ ID NO: 63902 - protein, 9 aa, Homo Sapiens
IGTDCGTIE

SEQ ID NO: 63903 - protein, 9 aa, Homo Sapiens
QVELLEVFG

SEQ ID NO: 63904 - protein, 9 aa, Homo Sapiens
HYSQQFLQQ

SEQ ID NO: 63905 - protein, 9 aa, Homo Sapiens
VALFKLQSS

SEQ ID NO: 63906 - protein, 9 aa, Homo Sapiens
EDVDDMASL

SEQ ID NO: 63907 - protein, 9 aa, Homo Sapiens
DRSCLKHPS

SEQ ID NO: 63908 - protein, 9 aa, Homo Sapiens
TVLVVLLLD

SEQ ID NO: 63909 - protein, 9 aa, Homo Sapiens
EGEYTPGTF

SEQ ID NO: 63910 - protein, 9 aa, Homo Sapiens
YQNKENCAP

SEQ ID NO: 63911 - protein, 9 aa, Homo Sapiens
EPSRTREAP

SEQ ID NO: 63912 - protein, 9 aa, Homo Sapiens
GTHSKPLYE

SEQ ID NO: 63913 - protein, 9 aa, Homo Sapiens
RVKSPELYE

SEQ ID NO: 63914 - protein, 9 aa, Homo Sapiens
DPATSLPMS

SEQ ID NO: 63915 - protein, 9 aa, Homo Sapiens
IRKFVKEVK

SEQ ID NO: 63916 - protein, 9 aa, Homo Sapiens
ICWGTHSKP

SEQ ID NO: 63917 - protein, 9 aa, Homo Sapiens
TEELLALQM

SEQ ID NO: 63918 - protein, 9 aa, Homo Sapiens
KLQSSWLPN

SEQ ID NO: 63919 - protein, 9 aa, Homo Sapiens
HRKNFVLPQ

SEQ ID NO: 63920 - protein, 9 aa, Homo Sapiens
LQRTSKLYA

SEQ ID NO: 63921 - protein, 9 aa, Homo Sapiens
KTNSNAIIS

SEQ ID NO: 63922 - protein, 9 aa, Homo Sapiens
VMEKQKKNV

SEQ ID NO: 63923 - protein, 9 aa, Homo Sapiens
DTPPSVIIS

SEQ ID NO: 63924 - protein, 9 aa, Homo Sapiens
FYGNLVAIL

SEQ ID NO: 63925 - protein, 9 aa, Homo Sapiens
ALPQPSHSN

SEQ ID NO: 63926 - protein, 9 aa, Homo Sapiens
LLALQMECA

SEQ ID NO: 63927 - protein, 9 aa, Homo Sapiens
ERLGEDKYY

SEQ ID NO: 63928 - protein, 9 aa, Homo Sapiens
LPMSLASLT

SEQ ID NO: 63929 - protein, 9 aa, Homo Sapiens
PFKGWMDIM

SEQ ID NO: 63930 - protein, 9 aa, Homo Sapiens
YSKVPSALA

SEQ ID NO: 63931 - protein, 9 aa, Homo Sapiens
LPHRKNFVL

SEQ ID NO: 63932 - protein, 9 aa, Homo Sapiens
LESIIANLC

SEQ ID NO: 63933 - protein, 9 aa, Homo Sapiens
IKKTNNRLN

SEQ ID NO: 63934 - protein, 9 aa, Homo Sapiens
GGSLHSSLY

SEQ ID NO: 63935 - protein, 9 aa, Homo Sapiens
EASVLQKNG

SEQ ID NO: 63936 - protein, 9 aa, Homo Sapiens
DIKVIMVTG

SEQ ID NO: 63937 - protein, 9 aa, Homo Sapiens
IFEPTEEEC

SEQ ID NO: 63938 - protein, 9 aa, Homo Sapiens
STPKNTWDD

SEQ ID NO: 63939 - protein, 9 aa, Homo Sapiens
VKEVKCRLL

SEQ ID NO: 63940 - protein, 9 aa, Homo Sapiens
QLCHSQELP

SEQ ID NO: 63941 - protein, 9 aa, Homo Sapiens
FVTKSYNEI

SEQ ID NO: 63942 - protein, 9 aa, Homo Sapiens
FLVSRFIHM

SEQ ID NO: 63943 - protein, 9 aa, Homo Sapiens
ADPPPAVWV

SEQ ID NO: 63944 - protein, 9 aa, Homo Sapiens
LRLQRIRQS

SEQ ID NO: 63945 - protein, 9 aa, Homo Sapiens
TMSQPNASV

SEQ ID NO: 63946 - protein, 9 aa, Homo Sapiens
HKKWEGHAV

SEQ ID NO: 63947 - protein, 9 aa, Homo Sapiens
NASPHYQNK

SEQ ID NO: 63948 - protein, 9 aa, Homo Sapiens
VIKQGRLID

SEQ ID NO: 63949 - protein, 9 aa, Homo Sapiens
NIMAIVLLS

SEQ ID NO: 63950 - protein, 9 aa, Homo Sapiens
LQQLCHSQE

SEQ ID NO: 63951 - protein, 9 aa, Homo Sapiens
QPSHSNPQA

SEQ ID NO: 63952 - protein, 9 aa, Homo Sapiens
YFLMEYVNG

SEQ ID NO: 63953 - protein, 9 aa, Homo Sapiens
SPNLSPNTK

SEQ ID NO: 63954 - protein, 9 aa, Homo Sapiens
RNAQNPSSH

SEQ ID NO: 63955 - protein, 9 aa, Homo Sapiens
SKNQNKSGG

SEQ ID NO: 63956 - protein, 9 aa, Homo Sapiens
SSLYHLILL

SEQ ID NO: 63957 - protein, 9 aa, Homo Sapiens
ECVEDITNK

SEQ ID NO: 63958 - protein, 9 aa, Homo Sapiens
YTMSQPNAS

SEQ ID NO: 63959 - protein, 9 aa, Homo Sapiens
VLSGLNSGP

SEQ ID NO: 63960 - protein, 9 aa, Homo Sapiens
CLGPRFSKA

SEQ ID NO: 63961 - protein, 9 aa, Homo Sapiens
YSQQFLQQL

SEQ ID NO: 63962 - protein, 9 aa, Homo Sapiens
NTWDDSWQP

SEQ ID NO: 63963 - protein, 9 aa, Homo Sapiens
KKTNNRLNS

SEQ ID NO: 63964 - protein, 9 aa, Homo Sapiens
FHPDPSQVE

SEQ ID NO: 63965 - protein, 9 aa, Homo Sapiens
SIVIKQGRL

SEQ ID NO: 63966 - protein, 9 aa, Homo Sapiens
VEYFKRGGV

SEQ ID NO: 63967 - protein, 9 aa, Homo Sapiens
HRMFSLGNN

SEQ ID NO: 63968 - protein, 9 aa, Homo Sapiens
RYSGNAGDE

SEQ ID NO: 63969 - protein, 9 aa, Homo Sapiens
GVMLVCITA

SEQ ID NO: 63970 - protein, 9 aa, Homo Sapiens
NPQASCPLP

SEQ ID NO: 63971 - protein, 9 aa, Homo Sapiens
IYICIHMCV

SEQ ID NO: 63972 - protein, 9 aa, Homo Sapiens
ICQKISPDG

SEQ ID NO: 63973 - protein, 9 aa, Homo Sapiens
AIISWAQKL

SEQ ID NO: 63974 - protein, 9 aa, Homo Sapiens
FEHSNYVYL

SEQ ID NO: 63975 - protein, 9 aa, Homo Sapiens
PHRKNFVLP

SEQ ID NO: 63976 - protein, 9 aa, Homo Sapiens
SPAGILELT

SEQ ID NO: 63977 - protein, 9 aa, Homo Sapiens
EVRVTSWDG

SEQ ID NO: 63978 - protein, 9 aa, Homo Sapiens
RFEIINAIF

SEQ ID NO: 63979 - protein, 9 aa, Homo Sapiens
LRASWKNYL

SEQ ID NO: 63980 - protein, 9 aa, Homo Sapiens
GDAFACLTC

SEQ ID NO: 63981 - protein, 9 aa, Homo Sapiens
LALQMECAE

SEQ ID NO: 63982 - protein, 9 aa, Homo Sapiens
ADYYIKCFD

SEQ ID NO: 63983 - protein, 9 aa, Homo Sapiens
QNKENCAPL

SEQ ID NO: 63984 - protein, 9 aa, Homo Sapiens
QYLEDENGV

SEQ ID NO: 63985 - protein, 9 aa, Homo Sapiens
REAPPGTLH

SEQ ID NO: 63986 - protein, 9 aa, Homo Sapiens
PHWYKLQTY

SEQ ID NO: 63987 - protein, 9 aa, Homo Sapiens
KKRVNPPAD

SEQ ID NO: 63988 - protein, 9 aa, Homo Sapiens
NVEGLHING

SEQ ID NO: 63989 - protein, 9 aa, Homo Sapiens
WVKFYGNLV

SEQ ID NO: 63990 - protein, 9 aa, Homo Sapiens
QNPSSHHPR

SEQ ID NO: 63991 - protein, 9 aa, Homo Sapiens
TERKDPATS

SEQ ID NO: 63992 - protein, 9 aa, Homo Sapiens
NMSKTQFMT

SEQ ID NO: 63993 - protein, 9 aa, Homo Sapiens
NGKTTDLKQ

SEQ ID NO: 63994 - protein, 9 aa, Homo Sapiens
GSGDTHTII

SEQ ID NO: 63995 - protein, 9 aa, Homo Sapiens
EYTPGTFVQ

SEQ ID NO: 63996 - protein, 9 aa, Homo Sapiens
AVGKCRSAD

SEQ ID NO: 63997 - protein, 9 aa, Homo Sapiens
GKTNSNAII

SEQ ID NO: 63998 - protein, 9 aa, Homo Sapiens
LLEDLQKKT

SEQ ID NO: 63999 - protein, 9 aa, Homo Sapiens
GNEVRVTSW

SEQ ID NO: 64000 - protein, 9 aa, Homo Sapiens
NSQVDFQAM

SEQ ID NO: 64001 - protein, 9 aa, Homo Sapiens
FLEKIQSSL

SEQ ID NO: 64002 - protein, 9 aa, Homo Sapiens
MHPTNEEDV

SEQ ID NO: 64003 - protein, 9 aa, Homo Sapiens
IYLWQAARC

SEQ ID NO: 64004 - protein, 9 aa, Homo Sapiens
LVIIKYEKS

SEQ ID NO: 64005 - protein, 9 aa, Homo Sapiens
HCNWRNHRM

SEQ ID NO: 64006 - protein, 9 aa, Homo Sapiens
KNVEGEVEM

SEQ ID NO: 64007 - protein, 9 aa, Homo Sapiens
AKALVNSQV

SEQ ID NO: 64008 - protein, 9 aa, Homo Sapiens
KGNNNGKTT

SEQ ID NO: 64009 - protein, 9 aa, Homo Sapiens
NGKVIQQIV

SEQ ID NO: 64010 - protein, 9 aa, Homo Sapiens
IFLEKIQSS

SEQ ID NO: 64011 - protein, 9 aa, Homo Sapiens
AQNPSSHHP

SEQ ID NO: 64012 - protein, 9 aa, Homo Sapiens
EKIKKTNNR

SEQ ID NO: 64013 - protein, 9 aa, Homo Sapiens
PSAVSRDKY

SEQ ID NO: 64014 - protein, 9 aa, Homo Sapiens
CFSTPKNTW

SEQ ID NO: 64015 - protein, 9 aa, Homo Sapiens
LASLTASGF

SEQ ID NO: 64016 - protein, 9 aa, Homo Sapiens
SLHSSLYHL

SEQ ID NO: 64017 - protein, 9 aa, Homo Sapiens
IQQIVDKSG

SEQ ID NO: 64018 - protein, 9 aa, Homo Sapiens
CLQVRCLGP

SEQ ID NO: 64019 - protein, 9 aa, Homo Sapiens
SYKAVRRGG

SEQ ID NO: 64020 - protein, 9 aa, Homo Sapiens
FSYKAVRRG

SEQ ID NO: 64021 - protein, 9 aa, Homo Sapiens
HLACASDHV

SEQ ID NO: 64022 - protein, 9 aa, Homo Sapiens
KQMPSQPLT

SEQ ID NO: 64023 - protein, 9 aa, Homo Sapiens
CKIQFFFHC

SEQ ID NO: 64024 - protein, 9 aa, Homo Sapiens
NQNKSGGLK

SEQ ID NO: 64025 - protein, 9 aa, Homo Sapiens
CLPHRKNFV

SEQ ID NO: 64026 - protein, 9 aa, Homo Sapiens
WRNHRMFSL

SEQ ID NO: 64027 - protein, 9 aa, Homo Sapiens
ASGFPWVLL

SEQ ID NO: 64028 - protein, 9 aa, Homo Sapiens
LSLEDSTMC

SEQ ID NO: 64029 - protein, 9 aa, Homo Sapiens
KNQNKSGGL

SEQ ID NO: 64030 - protein, 9 aa, Homo Sapiens
KTNDLRYIE

SEQ ID NO: 64031 - protein, 9 aa, Homo Sapiens
QVAPFKGWM

SEQ ID NO: 64032 - protein, 9 aa, Homo Sapiens
CKVQTNLKI

SEQ ID NO: 64033 - protein, 9 aa, Homo Sapiens
IKSAFYPPN

SEQ ID NO: 64034 - protein, 9 aa, Homo Sapiens
LEDLQKKTN

SEQ ID NO: 64035 - protein, 9 aa, Homo Sapiens
TANMFYIVN

SEQ ID NO: 64036 - protein, 9 aa, Homo Sapiens
IHRTLGFQK

SEQ ID NO: 64037 - protein, 9 aa, Homo Sapiens
SKLYARMSE

SEQ ID NO: 64038 - protein, 9 aa, Homo Sapiens
RLYFLMEYV

SEQ ID NO: 64039 - protein, 9 aa, Homo Sapiens
VRADSEQQN

SEQ ID NO: 64040 - protein, 9 aa, Homo Sapiens
KRGFAIDCA

SEQ ID NO: 64041 - protein, 9 aa, Homo Sapiens
AWVKFYGNL

SEQ ID NO: 64042 - protein, 9 aa, Homo Sapiens
FFHCNWRNH

SEQ ID NO: 64043 - protein, 9 aa, Homo Sapiens
LVAILEKFI

SEQ ID NO: 64044 - protein, 9 aa, Homo Sapiens
NYVTPVNQN

SEQ ID NO: 64045 - protein, 9 aa, Homo Sapiens
LLEVFGGSL

SEQ ID NO: 64046 - protein, 9 aa, Homo Sapiens
SLSKQMPSQ

SEQ ID NO: 64047 - protein, 9 aa, Homo Sapiens
SPRMRGFIY

SEQ ID NO: 64048 - protein, 9 aa, Homo Sapiens
QMPSQPLTD

SEQ ID NO: 64049 - protein, 9 aa, Homo Sapiens
TQKSQRTER

SEQ ID NO: 64050 - protein, 9 aa, Homo Sapiens
ERKDPATSL

SEQ ID NO: 64051 - protein, 9 aa, Homo Sapiens
LDLPSLSKQ

SEQ ID NO: 64052 - protein, 9 aa, Homo Sapiens
PPNSTVGEF

SEQ ID NO: 64053 - protein, 9 aa, Homo Sapiens
YFEHSNYVY

SEQ ID NO: 64054 - protein, 9 aa, Homo Sapiens
LKDNEYILC

SEQ ID NO: 64055 - protein, 9 aa, Homo Sapiens
DVTFHPDPS

SEQ ID NO: 64056 - protein, 9 aa, Homo Sapiens
KALVNSQVD

SEQ ID NO: 64057 - protein, 9 aa, Homo Sapiens
IPWKFECGS

SEQ ID NO: 64058 - protein, 9 aa, Homo Sapiens
VNPPADRSC

SEQ ID NO: 64059 - protein, 9 aa, Homo Sapiens
HGITCKKFD

SEQ ID NO: 64060 - protein, 9 aa, Homo Sapiens
KTNNRLNSR

SEQ ID NO: 64061 - protein, 9 aa, Homo Sapiens
PDKPSVLSG

SEQ ID NO: 64062 - protein, 9 aa, Homo Sapiens
KQKKNVEGE

SEQ ID NO: 64063 - protein, 9 aa, Homo Sapiens
QKKNVEGEV

SEQ ID NO: 64064 - protein, 9 aa, Homo Sapiens
NSKNQNKSG

SEQ ID NO: 64065 - protein, 9 aa, Homo Sapiens
QSSWLPNFY

SEQ ID NO: 64066 - protein, 9 aa, Homo Sapiens
YNYFEHSNY

SEQ ID NO: 64067 - protein, 9 aa, Homo Sapiens
EDLQKKTND

SEQ ID NO: 64068 - protein, 9 aa, Homo Sapiens
MFHIDFDRF

SEQ ID NO: 64069 - protein, 9 aa, Homo Sapiens
HDHNLQYLE

SEQ ID NO: 64070 - protein, 9 aa, Homo Sapiens
NFVLPQKSL

SEQ ID NO: 64071 - protein, 9 aa, Homo Sapiens
DEFRGLKKE

SEQ ID NO: 64072 - protein, 9 aa, Homo Sapiens
QGVLGWYMV

SEQ ID NO: 64073 - protein, 9 aa, Homo Sapiens
FSDTPPSVI

SEQ ID NO: 64074 - protein, 9 aa, Homo Sapiens
TNLHLEESS

SEQ ID NO: 64075 - protein, 9 aa, Homo Sapiens
IIKYEKSLH

SEQ ID NO: 64076 - protein, 9 aa, Homo Sapiens
KQGRLIDQQ

SEQ ID NO: 64077 - protein, 9 aa, Homo Sapiens
TSPMALMDN

SEQ ID NO: 64078 - protein, 9 aa, Homo Sapiens
LHTPSPSPA

SEQ ID NO: 64079 - protein, 9 aa, Homo Sapiens
SLTASGFPW

SEQ ID NO: 64080 - protein, 9 aa, Homo Sapiens
SPHYQNKEN

SEQ ID NO: 64081 - protein, 9 aa, Homo Sapiens
EDKYYQVVY

SEQ ID NO: 64082 - protein, 9 aa, Homo Sapiens
SAFYPPNFP

SEQ ID NO: 64083 - protein, 9 aa, Homo Sapiens
AIFEPTEEE

SEQ ID NO: 64084 - protein, 9 aa, Homo Sapiens
APRGVPHIE

SEQ ID NO: 64085 - protein, 9 aa, Homo Sapiens
VSFDYSPLI

SEQ ID NO: 64086 - protein, 9 aa, Homo Sapiens
IGKEIIHLV

SEQ ID NO: 64087 - protein, 9 aa, Homo Sapiens
GKVIQQIVD

SEQ ID NO: 64088 - protein, 9 aa, Homo Sapiens
VCFQGVLGW

SEQ ID NO: 64089 - protein, 9 aa, Homo Sapiens
TIIPTKIND

SEQ ID NO: 64090 - protein, 9 aa, Homo Sapiens
CKKFDTVQA

SEQ ID NO: 64091 - protein, 9 aa, Homo Sapiens
NNRLNSRIN

SEQ ID NO: 64092 - protein, 9 aa, Homo Sapiens
KRVNPPADR

SEQ ID NO: 64093 - protein, 9 aa, Homo Sapiens
CWGTHSKPL

SEQ ID NO: 64094 - protein, 9 aa, Homo Sapiens
ILNGAELEI

SEQ ID NO: 64095 - protein, 9 aa, Homo Sapiens
VIGTDCGTI

SEQ ID NO: 64096 - protein, 9 aa, Homo Sapiens
AVSRDKYSK

SEQ ID NO: 64097 - protein, 9 aa, Homo Sapiens
LLQVAPFKG

SEQ ID NO: 64098 - protein, 9 aa, Homo Sapiens
SRFIHMSGT

SEQ ID NO: 64099 - protein, 9 aa, Homo Sapiens
MEKQKKNVE

SEQ ID NO: 64100 - protein, 9 aa, Homo Sapiens
TELNTVNNY

SEQ ID NO: 64101 - protein, 9 aa, Homo Sapiens
TSLPMSLAS

SEQ ID NO: 64102 - protein, 9 aa, Homo Sapiens
LFDNPMLDK

SEQ ID NO: 64103 - protein, 9 aa, Homo Sapiens
YTPGTFVQI

SEQ ID NO: 64104 - protein, 9 aa, Homo Sapiens
GPRFSKAGC

SEQ ID NO: 64105 - protein, 9 aa, Homo Sapiens
TVLLGRLTG

SEQ ID NO: 64106 - protein, 9 aa, Homo Sapiens
GSSFAYIPW

SEQ ID NO: 64107 - protein, 9 aa, Homo Sapiens
PSPSPARRM

SEQ ID NO: 64108 - protein, 9 aa, Homo Sapiens
NEVRVTSWD

SEQ ID NO: 64109 - protein, 9 aa, Homo Sapiens
HTDEKPYDC

SEQ ID NO: 64110 - protein, 9 aa, Homo Sapiens
SHHPRATFL

SEQ ID NO: 64111 - protein, 9 aa, Homo Sapiens
PSVIISWQP

SEQ ID NO: 64112 - protein, 9 aa, Homo Sapiens
AGVIKSAFY

SEQ ID NO: 64113 - protein, 9 aa, Homo Sapiens
TQTLNQVLV

SEQ ID NO: 64114 - protein, 9 aa, Homo Sapiens
PPYYTMSQP

SEQ ID NO: 64115 - protein, 9 aa, Homo Sapiens
DRVRSFEEE

SEQ ID NO: 64116 - protein, 9 aa, Homo Sapiens
GENSKNQNK

SEQ ID NO: 64117 - protein, 9 aa, Homo Sapiens
DGNEVRVTS

SEQ ID NO: 64118 - protein, 9 aa, Homo Sapiens
VKAFKRGQR

SEQ ID NO: 64119 - protein, 9 aa, Homo Sapiens
WQAARCIPQ

SEQ ID NO: 64120 - protein, 9 aa, Homo Sapiens
LGEDKYYQV

SEQ ID NO: 64121 - protein, 9 aa, Homo Sapiens
GTLHTPSPS

SEQ ID NO: 64122 - protein, 9 aa, Homo Sapiens
GFVKAMINA

SEQ ID NO: 64123 - protein, 9 aa, Homo Sapiens
VWFPGDAFK

SEQ ID NO: 64124 - protein, 9 aa, Homo Sapiens
VFNSSYAME

SEQ ID NO: 64125 - protein, 9 aa, Homo Sapiens
TLMNLRGLA

SEQ ID NO: 64126 - protein, 9 aa, Homo Sapiens
KNGKVIQQI

SEQ ID NO: 64127 - protein, 9 aa, Homo Sapiens
ISWAQKLKQ

SEQ ID NO: 64128 - protein, 9 aa, Homo Sapiens
EIKIKFDKY

SEQ ID NO: 64129 - protein, 9 aa, Homo Sapiens
NSSYAMEQE

SEQ ID NO: 64130 - protein, 9 aa, Homo Sapiens
RMRGFIYQG

SEQ ID NO: 64131 - protein, 9 aa, Homo Sapiens
VSRDKYSKV

SEQ ID NO: 64132 - protein, 9 aa, Homo Sapiens
KTINSSPIK

SEQ ID NO: 64133 - protein, 9 aa, Homo Sapiens
FACLTCAPD

SEQ ID NO: 64134 - protein, 9 aa, Homo Sapiens
NTVNNYFLL

SEQ ID NO: 64135 - protein, 9 aa, Homo Sapiens
IHLVLDRIR

SEQ ID NO: 64136 - protein, 9 aa, Homo Sapiens
SFHKLNTMK

SEQ ID NO: 64137 - protein, 9 aa, Homo Sapiens
ERPRPQDPH

SEQ ID NO: 64138 - protein, 9 aa, Homo Sapiens
STVGEFCLP

SEQ ID NO: 64139 - protein, 9 aa, Homo Sapiens
SQVDFQAMW

SEQ ID NO: 64140 - protein, 9 aa, Homo Sapiens
HPDPSQVEL

SEQ ID NO: 64141 - protein, 9 aa, Homo Sapiens
ALFKLQSSW

SEQ ID NO: 64142 - protein, 9 aa, Homo Sapiens
DKFRQKLDE

SEQ ID NO: 64143 - protein, 9 aa, Homo Sapiens
DLPSLSKQM

SEQ ID NO: 64144 - protein, 9 aa, Homo Sapiens
SGENSKNQN

SEQ ID NO: 64145 - protein, 9 aa, Homo Sapiens
LPQPSHSNP

SEQ ID NO: 64146 - protein, 9 aa, Homo Sapiens
GEDKYYQVV

SEQ ID NO: 64147 - protein, 9 aa, Homo Sapiens
LQKKTNDLR

SEQ ID NO: 64148 - protein, 9 aa, Homo Sapiens
NLVAILEKF

SEQ ID NO: 64149 - protein, 9 aa, Homo Sapiens
FCLPYPIEH

SEQ ID NO: 64150 - protein, 9 aa, Homo Sapiens
EEDVDDMAS

SEQ ID NO: 64151 - protein, 9 aa, Homo Sapiens
LNNSDSGFF

SEQ ID NO: 64152 - protein, 9 aa, Homo Sapiens
HLILLTSLL

SEQ ID NO: 64153 - protein, 9 aa, Homo Sapiens
AILEKFISL

SEQ ID NO: 64154 - protein, 9 aa, Homo Sapiens
GNNNGKTTD

SEQ ID NO: 64155 - protein, 9 aa, Homo Sapiens
RTSKLYARM

SEQ ID NO: 64156 - protein, 9 aa, Homo Sapiens
DFDRFLGHA

SEQ ID NO: 64157 - protein, 9 aa, Homo Sapiens
KTIDNVNFF

SEQ ID NO: 64158 - protein, 9 aa, Homo Sapiens
PSQVELLEV

SEQ ID NO: 64159 - protein, 9 aa, Homo Sapiens
TFVQIFLSV

SEQ ID NO: 64160 - protein, 9 aa, Homo Sapiens
EKFISLEVC

SEQ ID NO: 64161 - protein, 9 aa, Homo Sapiens
LLVFGGATL

SEQ ID NO: 64162 - protein, 9 aa, Homo Sapiens
FHCNWRNHR

SEQ ID NO: 64163 - protein, 9 aa, Homo Sapiens
SEYPLEKTI

SEQ ID NO: 64164 - protein, 9 aa, Homo Sapiens
LGPRFSKAG

SEQ ID NO: 64165 - protein, 9 aa, Homo Sapiens
IKYEKSLHI

SEQ ID NO: 64166 - protein, 9 aa, Homo Sapiens
SFKVNTELN

SEQ ID NO: 64167 - protein, 9 aa, Homo Sapiens
FLMEYVNGG

SEQ ID NO: 64168 - protein, 9 aa, Homo Sapiens
VKDSLEECK

SEQ ID NO: 64169 - protein, 9 aa, Homo Sapiens
PGTFVQIFL

SEQ ID NO: 64170 - protein, 9 aa, Homo Sapiens
EECKVQTNL

SEQ ID NO: 64171 - protein, 9 aa, Homo Sapiens
ATSLPMSLA

SEQ ID NO: 64172 - protein, 9 aa, Homo Sapiens
APCPEMPGT

SEQ ID NO: 64173 - protein, 9 aa, Homo Sapiens
SECKIQFFF

SEQ ID NO: 64174 - protein, 9 aa, Homo Sapiens
LDSIVIKQG

SEQ ID NO: 64175 - protein, 9 aa, Homo Sapiens
VALADYYIK

SEQ ID NO: 64176 - protein, 9 aa, Homo Sapiens
PTNEEDVDD

SEQ ID NO: 64177 - protein, 9 aa, Homo Sapiens
GTDCGTIES

SEQ ID NO: 64178 - protein, 9 aa, Homo Sapiens
SKQMPSQPL

SEQ ID NO: 64179 - protein, 9 aa, Homo Sapiens
APFKGWMDI

SEQ ID NO: 64180 - protein, 9 aa, Homo Sapiens
NGENELTGS

SEQ ID NO: 64181 - protein, 9 aa, Homo Sapiens
PKNTWDDSW

SEQ ID NO: 64182 - protein, 9 aa, Homo Sapiens
KNGHKRKHF

SEQ ID NO: 64183 - protein, 9 aa, Homo Sapiens
MLDKELRAM

SEQ ID NO: 64184 - protein, 9 aa, Homo Sapiens
IIAGLLHYL

SEQ ID NO: 64185 - protein, 9 aa, Homo Sapiens
LDNEVKAFK

SEQ ID NO: 64186 - protein, 9 aa, Homo Sapiens
ASPHYQNKE

SEQ ID NO: 64187 - protein, 9 aa, Homo Sapiens
QQKITEKVD

SEQ ID NO: 64188 - protein, 9 aa, Homo Sapiens
ANMFYIVNI

SEQ ID NO: 64189 - protein, 9 aa, Homo Sapiens
SQVELLEVF

SEQ ID NO: 64190 - protein, 9 aa, Homo Sapiens
PSVLSGLNS

SEQ ID NO: 64191 - protein, 9 aa, Homo Sapiens
EKQKKNVEG

SEQ ID NO: 64192 - protein, 9 aa, Homo Sapiens
RKFVKEVKC

SEQ ID NO: 64193 - protein, 9 aa, Homo Sapiens
ASPRMRGFI

SEQ ID NO: 64194 - protein, 9 aa, Homo Sapiens
GAELEISTG

SEQ ID NO: 64195 - protein, 9 aa, Homo Sapiens
NSTVGEFCL

SEQ ID NO: 64196 - protein, 9 aa, Homo Sapiens
ILPNVIYRL

SEQ ID NO: 64197 - protein, 9 aa, Homo Sapiens
CFQGVLGWY

SEQ ID NO: 64198 - protein, 9 aa, Homo Sapiens
MFYIVNIMA

SEQ ID NO: 64199 - protein, 9 aa, Homo Sapiens
NVSLESIIA

SEQ ID NO: 64200 - protein, 9 aa, Homo Sapiens
YRNAQNPSS

SEQ ID NO: 64201 - protein, 9 aa, Homo Sapiens
VNTELNTVN

SEQ ID NO: 64202 - protein, 9 aa, Homo Sapiens
VWVATTKST

SEQ ID NO: 64203 - protein, 9 aa, Homo Sapiens
DHNLQYLED

SEQ ID NO: 64204 - protein, 9 aa, Homo Sapiens
CITALIGCL

SEQ ID NO: 64205 - protein, 9 aa, Homo Sapiens
GNLVAILEK

SEQ ID NO: 64206 - protein, 9 aa, Homo Sapiens
DNGENELTG

SEQ ID NO: 64207 - protein, 9 aa, Homo Sapiens
QRGLGSPWI

SEQ ID NO: 64208 - protein, 9 aa, Homo Sapiens
INSSPIKSE

SEQ ID NO: 64209 - protein, 9 aa, Homo Sapiens
NAIISWAQK

SEQ ID NO: 64210 - protein, 9 aa, Homo Sapiens
DQLQRTSKL

SEQ ID NO: 64211 - protein, 9 aa, Homo Sapiens
KDEVNEGEL

SEQ ID NO: 64212 - protein, 9 aa, Homo Sapiens
PMLDKELRA

SEQ ID NO: 64213 - protein, 9 aa, Homo Sapiens
NTELNTVNN

SEQ ID NO: 64214 - protein, 9 aa, Homo Sapiens
SDHVKVVTL

SEQ ID NO: 64215 - protein, 9 aa, Homo Sapiens
VTFHPDPSQ

SEQ ID NO: 64216 - protein, 9 aa, Homo Sapiens
LVCFQGVLG

SEQ ID NO: 64217 - protein, 9 aa, Homo Sapiens
TLKDNEYIL

SEQ ID NO: 64218 - protein, 9 aa, Homo Sapiens
SIIANLCAC

SEQ ID NO: 64219 - protein, 9 aa, Homo Sapiens
RQAAGKIFK

SEQ ID NO: 64220 - protein, 9 aa, Homo Sapiens
QVLVLKKRT

SEQ ID NO: 64221 - protein, 9 aa, Homo Sapiens
QTNLHLEES

SEQ ID NO: 64222 - protein, 9 aa, Homo Sapiens
INAIFEPTE

SEQ ID NO: 64223 - protein, 9 aa, Homo Sapiens
GSLHSSLYH

SEQ ID NO: 64224 - protein, 9 aa, Homo Sapiens
DFHHRVKSP

SEQ ID NO: 64225 - protein, 9 aa, Homo Sapiens
SWLPNFYTH

SEQ ID NO: 64226 - protein, 9 aa, Homo Sapiens
KYYQVVYYY

SEQ ID NO: 64227 - protein, 9 aa, Homo Sapiens
DVDDMASLT

SEQ ID NO: 64228 - protein, 9 aa, Homo Sapiens
EGPDKPSVL

SEQ ID NO: 64229 - protein, 9 aa, Homo Sapiens
MNIQQKEDI

SEQ ID NO: 64230 - protein, 9 aa, Homo Sapiens
NKSGGLKSS

SEQ ID NO: 64231 - protein, 9 aa, Homo Sapiens
AMHPTNEED

SEQ ID NO: 64232 - protein, 9 aa, Homo Sapiens
KEEMNRSQK

SEQ ID NO: 64233 - protein, 9 aa, Homo Sapiens
GVFNSSYAM

SEQ ID NO: 64234 - protein, 9 aa, Homo Sapiens
LYINIVAYD

SEQ ID NO: 64235 - protein, 9 aa, Homo Sapiens
NEEDVDDMA

SEQ ID NO: 64236 - protein, 9 aa, Homo Sapiens
RVRSFEEEF

SEQ ID NO: 64237 - protein, 9 aa, Homo Sapiens
SGDTHTIIP

SEQ ID NO: 64238 - protein, 9 aa, Homo Sapiens
TMPTVLVVL

SEQ ID NO: 64239 - protein, 9 aa, Homo Sapiens
PRFSKAGCW

SEQ ID NO: 64240 - protein, 9 aa, Homo Sapiens
QQFLQQLCH

SEQ ID NO: 64241 - protein, 9 aa, Homo Sapiens
IFRKVQKSI

SEQ ID NO: 64242 - protein, 9 aa, Homo Sapiens
NVIYRLNIP

SEQ ID NO: 64243 - protein, 9 aa, Homo Sapiens
FLLMTVLLG

SEQ ID NO: 64244 - protein, 9 aa, Homo Sapiens
NFKGIKIKP

SEQ ID NO: 64245 - protein, 9 aa, Homo Sapiens
LFKLQSSWL

SEQ ID NO: 64246 - protein, 9 aa, Homo Sapiens
KIQFFFHCN

SEQ ID NO: 64247 - protein, 9 aa, Homo Sapiens
QRTLMNLRG

SEQ ID NO: 64248 - protein, 9 aa, Homo Sapiens
EEVNVEGLH

SEQ ID NO: 64249 - protein, 9 aa, Homo Sapiens
TFAEIFLEK

SEQ ID NO: 64250 - protein, 9 aa, Homo Sapiens
LYNYFEHSN

SEQ ID NO: 64251 - protein, 9 aa, Homo Sapiens
KLDEALRES

SEQ ID NO: 64252 - protein, 9 aa, Homo Sapiens
MSKTQFMTQ

SEQ ID NO: 64253 - protein, 9 aa, Homo Sapiens
RSFEEEFIH

SEQ ID NO: 64254 - protein, 9 aa, Homo Sapiens
IIANLCACL

SEQ ID NO: 64255 - protein, 9 aa, Homo Sapiens
LEESSEDKP

SEQ ID NO: 64256 - protein, 9 aa, Homo Sapiens
FVKAMINAG

SEQ ID NO: 64257 - protein, 9 aa, Homo Sapiens
KNFVLPQKS

SEQ ID NO: 64258 - protein, 9 aa, Homo Sapiens
IHMCVYSYI

SEQ ID NO: 64259 - protein, 9 aa, Homo Sapiens
SASPRMRGF

SEQ ID NO: 64260 - protein, 9 aa, Homo Sapiens
PNTKQASPL

SEQ ID NO: 64261 - protein, 9 aa, Homo Sapiens
LLCSKDVTF

SEQ ID NO: 64262 - protein, 9 aa, Homo Sapiens
QLQRTSKLY

SEQ ID NO: 64263 - protein, 9 aa, Homo Sapiens
EQQNQEYQR

SEQ ID NO: 64264 - protein, 9 aa, Homo Sapiens
IKQGRLIDQ

SEQ ID NO: 64265 - protein, 9 aa, Homo Sapiens
FAYIPWKFE

SEQ ID NO: 64266 - protein, 9 aa, Homo Sapiens
CIHMCVYSY

SEQ ID NO: 64267 - protein, 9 aa, Homo Sapiens
WKNYLEGTD

SEQ ID NO: 64268 - protein, 9 aa, Homo Sapiens
SGTQKSQRT

SEQ ID NO: 64269 - protein, 9 aa, Homo Sapiens
KEKKTQTFL

SEQ ID NO: 64270 - protein, 9 aa, Homo Sapiens
FHHRVKSPE

SEQ ID NO: 64271 - protein, 9 aa, Homo Sapiens
QQIVDKSGV

SEQ ID NO: 64272 - protein, 9 aa, Homo Sapiens
YFILPNVIY

SEQ ID NO: 64273 - protein, 9 aa, Homo Sapiens
KKHKKWEGH

SEQ ID NO: 64274 - protein, 9 aa, Homo Sapiens
SEQQNQEYQ

SEQ ID NO: 64275 - protein, 9 aa, Homo Sapiens
ADRSCLKHP

SEQ ID NO: 64276 - protein, 9 aa, Homo Sapiens
PWVLLCSKD

SEQ ID NO: 64277 - protein, 9 aa, Homo Sapiens
AIIAGLLHY

SEQ ID NO: 64278 - protein, 9 aa, Homo Sapiens
GLVCFQGVL

SEQ ID NO: 64279 - protein, 9 aa, Homo Sapiens
EKDEVNEGE

SEQ ID NO: 64280 - protein, 9 aa, Homo Sapiens
WKKIEPQGK

SEQ ID NO: 64281 - protein, 9 aa, Homo Sapiens
PYYTMSQPN

SEQ ID NO: 64282 - protein, 9 aa, Homo Sapiens
YGNLVAILE

SEQ ID NO: 64283 - protein, 9 aa, Homo Sapiens
RTERKDPAT

SEQ ID NO: 64284 - protein, 9 aa, Homo Sapiens
EISTGPDAM

SEQ ID NO: 64285 - protein, 9 aa, Homo Sapiens
SGFPWVLLC

SEQ ID NO: 64286 - protein, 9 aa, Homo Sapiens
RKNFVLPQK

SEQ ID NO: 64287 - protein, 9 aa, Homo Sapiens
QKLDEALRE

SEQ ID NO: 64288 - protein, 9 aa, Homo Sapiens
FPWVLLCSK

SEQ ID NO: 64289 - protein, 9 aa, Homo Sapiens
RKDPATSLP

SEQ ID NO: 64290 - protein, 9 aa, Homo Sapiens
GDAFKTGSA

SEQ ID NO: 64291 - protein, 9 aa, Homo Sapiens
NAGDEFRGL

SEQ ID NO: 64292 - protein, 9 aa, Homo Sapiens
LDEALRESQ

SEQ ID NO: 64293 - protein, 9 aa, Homo Sapiens
KLVGDLLVF

SEQ ID NO: 64294 - protein, 9 aa, Homo Sapiens
CASDHVKVV

SEQ ID NO: 64295 - protein, 9 aa, Homo Sapiens
EIFLEKIQS

SEQ ID NO: 64296 - protein, 9 aa, Homo Sapiens
KIEPQGKGP

SEQ ID NO: 64297 - protein, 9 aa, Homo Sapiens
LNICQKISP

SEQ ID NO: 64298 - protein, 9 aa, Homo Sapiens
TPGTFVQIF

SEQ ID NO: 64299 - protein, 9 aa, Homo Sapiens
QRIRQSEDE

SEQ ID NO: 64300 - protein, 9 aa, Homo Sapiens
SKDVTFHPD

SEQ ID NO: 64301 - protein, 9 aa, Homo Sapiens
INAGQLKNG

SEQ ID NO: 64302 - protein, 9 aa, Homo Sapiens
SADIKVIMV

SEQ ID NO: 64303 - protein, 9 aa, Homo Sapiens
NAQNPSSHH

SEQ ID NO: 64304 - protein, 9 aa, Homo Sapiens
YDHADFHHR

SEQ ID NO: 64305 - protein, 9 aa, Homo Sapiens
ICGNFKGIK

SEQ ID NO: 64306 - protein, 9 aa, Homo Sapiens
MDNGENELT

SEQ ID NO: 64307 - protein, 9 aa, Homo Sapiens
SRTREAPPG

SEQ ID NO: 64308 - protein, 9 aa, Homo Sapiens
SGVFNSSYA

SEQ ID NO: 64309 - protein, 9 aa, Homo Sapiens
PSRTREAPP

SEQ ID NO: 64310 - protein, 9 aa, Homo Sapiens
QKNGHKRKH

SEQ ID NO: 64311 - protein, 9 aa, Homo Sapiens
MSLASLTAS

SEQ ID NO: 64312 - protein, 9 aa, Homo Sapiens
QEALKDTEK

SEQ ID NO: 64313 - protein, 9 aa, Homo Sapiens
QQNQEYQRL

SEQ ID NO: 64314 - protein, 9 aa, Homo Sapiens
PDRVRSFEE

SEQ ID NO: 64315 - protein, 9 aa, Homo Sapiens
FRQKLDEAL

SEQ ID NO: 64316 - protein, 9 aa, Homo Sapiens
DVRADSEQQ

SEQ ID NO: 64317 - protein, 9 aa, Homo Sapiens
YTIGKEIIH

SEQ ID NO: 64318 - protein, 9 aa, Homo Sapiens
VLPQKSLSP

SEQ ID NO: 64319 - protein, 9 aa, Homo Sapiens
GFPWVLLCS

SEQ ID NO: 64320 - protein, 9 aa, Homo Sapiens
LQKNGHKRK

SEQ ID NO: 64321 - protein, 9 aa, Homo Sapiens
KDPATSLPM

SEQ ID NO: 64322 - protein, 9 aa, Homo Sapiens
KISPDGGKI

SEQ ID NO: 64323 - protein, 9 aa, Homo Sapiens
NQVLVLKKR

SEQ ID NO: 64324 - protein, 9 aa, Homo Sapiens
QIVDKSGVV

SEQ ID NO: 64325 - protein, 9 aa, Homo Sapiens
FVLPQKSLS

SEQ ID NO: 64326 - protein, 9 aa, Homo Sapiens
PAPCPEMPG

SEQ ID NO: 64327 - protein, 9 aa, Homo Sapiens
GSPWIYLWQ

SEQ ID NO: 64328 - protein, 9 aa, Homo Sapiens
DSGFFTVFT

SEQ ID NO: 64329 - protein, 9 aa, Homo Sapiens
DENMSKTQF

SEQ ID NO: 64330 - protein, 9 aa, Homo Sapiens
VLFLVSRFI

SEQ ID NO: 64331 - protein, 9 aa, Homo Sapiens
VAILEKFIS

SEQ ID NO: 64332 - protein, 9 aa, Homo Sapiens
TNDLRYIEM

SEQ ID NO: 64333 - protein, 9 aa, Homo Sapiens
ELEISTGPD

SEQ ID NO: 64334 - protein, 9 aa, Homo Sapiens
SLESIIANL

SEQ ID NO: 64335 - protein, 9 aa, Homo Sapiens
EVFGGSLHS

SEQ ID NO: 64336 - protein, 9 aa, Homo Sapiens
LKDTEKKLE

SEQ ID NO: 64337 - protein, 9 aa, Homo Sapiens
DNVNFFKLH

SEQ ID NO: 64338 - protein, 9 aa, Homo Sapiens
AELEISTGP

SEQ ID NO: 64339 - protein, 9 aa, Homo Sapiens
KHKNLYINI

SEQ ID NO: 64340 - protein, 9 aa, Homo Sapiens
WEGHAVLIV

SEQ ID NO: 64341 - protein, 9 aa, Homo Sapiens
KEKKEKKTQ

SEQ ID NO: 64342 - protein, 9 aa, Homo Sapiens
HPTNEEDVD

SEQ ID NO: 64343 - protein, 9 aa, Homo Sapiens
LEECKVQTN

SEQ ID NO: 64344 - protein, 9 aa, Homo Sapiens
KSLHIPMYI

SEQ ID NO: 64345 - protein, 9 aa, Homo Sapiens
LSPNTKQAS

SEQ ID NO: 64346 - protein, 9 aa, Homo Sapiens
KVNTELNTV

SEQ ID NO: 64347 - protein, 9 aa, Homo Sapiens
KKRKDYQPK

SEQ ID NO: 64348 - protein, 9 aa, Homo Sapiens
SSSGVFNSS

SEQ ID NO: 64349 - protein, 9 aa, Homo Sapiens
KVQTNLKIW

SEQ ID NO: 64350 - protein, 9 aa, Homo Sapiens
HNLQYLEDE

SEQ ID NO: 64351 - protein, 9 aa, Homo Sapiens
VNSQVDFQA

SEQ ID NO: 64352 - protein, 9 aa, Homo Sapiens
VQKSIEVPQ

SEQ ID NO: 64353 - protein, 9 aa, Homo Sapiens
PLFDNPMLD

SEQ ID NO: 64354 - protein, 9 aa, Homo Sapiens
DEALRESQG

SEQ ID NO: 64355 - protein, 9 aa, Homo Sapiens
LEVFGGSLH

SEQ ID NO: 64356 - protein, 9 aa, Homo Sapiens
SRDKYSKVP

SEQ ID NO: 64357 - protein, 9 aa, Homo Sapiens
KYEKSLHIP

SEQ ID NO: 64358 - protein, 9 aa, Homo Sapiens
FWEFLTLCN

SEQ ID NO: 64359 - protein, 9 aa, Homo Sapiens
PCPEMPGTV

SEQ ID NO: 64360 - protein, 9 aa, Homo Sapiens
KLQTYDESS

SEQ ID NO: 64361 - protein, 9 aa, Homo Sapiens
SKRGFAIDC

SEQ ID NO: 64362 - protein, 9 aa, Homo Sapiens
EELLALQME

SEQ ID NO: 64363 - protein, 9 aa, Homo Sapiens
FTWKKIEPQ

SEQ ID NO: 64364 - protein, 9 aa, Homo Sapiens
CLFWEFLTL

SEQ ID NO: 64365 - protein, 9 aa, Homo Sapiens
LLNICQKIS

SEQ ID NO: 64366 - protein, 9 aa, Homo Sapiens
FMTQTLNQV

SEQ ID NO: 64367 - protein, 9 aa, Homo Sapiens
ILELTMETQ

SEQ ID NO: 64368 - protein, 9 aa, Homo Sapiens
AEIFLEKIQ

SEQ ID NO: 64369 - protein, 9 aa, Homo Sapiens
TIDNVNFFK

SEQ ID NO: 64370 - protein, 9 aa, Homo Sapiens
LIHRTLGFQ

SEQ ID NO: 64371 - protein, 9 aa, Homo Sapiens
VLVLKKRTE

SEQ ID NO: 64372 - protein, 9 aa, Homo Sapiens
GEIVSFDYS

SEQ ID NO: 64373 - protein, 9 aa, Homo Sapiens
KRTEEQICV

SEQ ID NO: 64374 - protein, 9 aa, Homo Sapiens
LSYMNIQQK

SEQ ID NO: 64375 - protein, 9 aa, Homo Sapiens
RCLGPRFSK

SEQ ID NO: 64376 - protein, 9 aa, Homo Sapiens
EYPLEKTIN

SEQ ID NO: 64377 - protein, 9 aa, Homo Sapiens
NTMKHLLLL

SEQ ID NO: 64378 - protein, 9 aa, Homo Sapiens
VLKKRTEEQ

SEQ ID NO: 64379 - protein, 9 aa, Homo Sapiens
CVEDITNKF

SEQ ID NO: 64380 - protein, 9 aa, Homo Sapiens
SGFFTVFTG

SEQ ID NO: 64381 - protein, 9 aa, Homo Sapiens
RNYVTPVNQ

SEQ ID NO: 64382 - protein, 9 aa, Homo Sapiens
PPGTLHTPS

SEQ ID NO: 64383 - protein, 9 aa, Homo Sapiens
NFFKLHTFE

SEQ ID NO: 64384 - protein, 9 aa, Homo Sapiens
NICQKISPD

SEQ ID NO: 64385 - protein, 9 aa, Homo Sapiens
MINAGQLKN

SEQ ID NO: 64386 - protein, 9 aa, Homo Sapiens
EDSTMCVVC

SEQ ID NO: 64387 - protein, 9 aa, Homo Sapiens
KNLYINIVA

SEQ ID NO: 64388 - protein, 9 aa, Homo Sapiens
KDSLEECKV

SEQ ID NO: 64389 - protein, 9 aa, Homo Sapiens
TIGKEIIHL

SEQ ID NO: 64390 - protein, 9 aa, Homo Sapiens
FLVALADYY

SEQ ID NO: 64391 - protein, 9 aa, Homo Sapiens
HWYKLQTYD

SEQ ID NO: 64392 - protein, 9 aa, Homo Sapiens
KEIIHLVLD

SEQ ID NO: 64393 - protein, 9 aa, Homo Sapiens
CGLVCFQGV

SEQ ID NO: 64394 - protein, 9 aa, Homo Sapiens
NPPADRSCL

SEQ ID NO: 64395 - protein, 9 aa, Homo Sapiens
HKNLYINIV

SEQ ID NO: 64396 - protein, 9 aa, Homo Sapiens
TASGFPWVL

SEQ ID NO: 64397 - protein, 9 aa, Homo Sapiens
WIYLWQAAR

SEQ ID NO: 64398 - protein, 9 aa, Homo Sapiens
PTDALSYMN

SEQ ID NO: 64399 - protein, 9 aa, Homo Sapiens
AVWVATTKS

SEQ ID NO: 64400 - protein, 9 aa, Homo Sapiens
LHLEESSED

SEQ ID NO: 64401 - protein, 9 aa, Homo Sapiens
AIDCAILSC

SEQ ID NO: 64402 - protein, 9 aa, Homo Sapiens
SVLSGLNSG

SEQ ID NO: 64403 - protein, 9 aa, Homo Sapiens
KKTNDLRYI

SEQ ID NO: 64404 - protein, 9 aa, Homo Sapiens
GVLGWYMVK

SEQ ID NO: 64405 - protein, 9 aa, Homo Sapiens
PGTLHTPSP

SEQ ID NO: 64406 - protein, 9 aa, Homo Sapiens
TPTGEIVSF

SEQ ID NO: 64407 - protein, 9 aa, Homo Sapiens
PQDPHRKAL

SEQ ID NO: 64408 - protein, 9 aa, Homo Sapiens
RYFILPNVI

SEQ ID NO: 64409 - protein, 9 aa, Homo Sapiens
ASDHVKVVT

SEQ ID NO: 64410 - protein, 9 aa, Homo Sapiens
HIDFDRFLG

SEQ ID NO: 64411 - protein, 9 aa, Homo Sapiens
GNFKGIKIK

SEQ ID NO: 64412 - protein, 9 aa, Homo Sapiens
HMFHIDFDR

SEQ ID NO: 64413 - protein, 9 aa, Homo Sapiens
KFYGNLVAI

SEQ ID NO: 64414 - protein, 9 aa, Homo Sapiens
IHMSGTQKS

SEQ ID NO: 64415 - protein, 9 aa, Homo Sapiens
LRLDSIVIK

SEQ ID NO: 64416 - protein, 9 aa, Homo Sapiens
ECKIQFFFH

SEQ ID NO: 64417 - protein, 9 aa, Homo Sapiens
GPDKPSVLS

SEQ ID NO: 64418 - protein, 9 aa, Homo Sapiens
PVLVWFPGD

SEQ ID NO: 64419 - protein, 9 aa, Homo Sapiens
SSGVFNSSY

SEQ ID NO: 64420 - protein, 9 aa, Homo Sapiens
KIFKIFGPV

SEQ ID NO: 64421 - protein, 9 aa, Homo Sapiens
QTYDESSLP

SEQ ID NO: 64422 - protein, 9 aa, Homo Sapiens
QKSQRTERK

SEQ ID NO: 64423 - protein, 9 aa, Homo Sapiens
ALKDTEKKL

SEQ ID NO: 64424 - protein, 9 aa, Homo Sapiens
KRGGVSPHC

SEQ ID NO: 64425 - protein, 9 aa, Homo Sapiens
ESIIANLCA

SEQ ID NO: 64426 - protein, 9 aa, Homo Sapiens
PNKEEMNRS

SEQ ID NO: 64427 - protein, 9 aa, Homo Sapiens
PRGVPHIEV

SEQ ID NO: 64428 - protein, 9 aa, Homo Sapiens
EDGKHQKES

SEQ ID NO: 64429 - protein, 9 aa, Homo Sapiens
ELNTVNNYF

SEQ ID NO: 64430 - protein, 9 aa, Homo Sapiens
EKKEKKTQT

SEQ ID NO: 64431 - protein, 9 aa, Homo Sapiens
KNYLEGTDI

SEQ ID NO: 64432 - protein, 9 aa, Homo Sapiens
SSHHPRATF

SEQ ID NO: 64433 - protein, 9 aa, Homo Sapiens
FSPAPCPEM

SEQ ID NO: 64434 - protein, 9 aa, Homo Sapiens
PTGEIVSFD

SEQ ID NO: 64435 - protein, 9 aa, Homo Sapiens
DLLVFGGAT

SEQ ID NO: 64436 - protein, 9 aa, Homo Sapiens
ICIHMCVYS

SEQ ID NO: 64437 - protein, 9 aa, Homo Sapiens
EVEYFKRGG

SEQ ID NO: 64438 - protein, 9 aa, Homo Sapiens
RDGNEVRVT

SEQ ID NO: 64439 - protein, 9 aa, Homo Sapiens
NLRGLAVAR

SEQ ID NO: 64440 - protein, 9 aa, Homo Sapiens
EAPPGTLHT

SEQ ID NO: 64441 - protein, 9 aa, Homo Sapiens
YFKRGGVSP

SEQ ID NO: 64442 - protein, 9 aa, Homo Sapiens
VNIMAIVLL

SEQ ID NO: 64443 - protein, 9 aa, Homo Sapiens
RPQDPHRKA

SEQ ID NO: 64444 - protein, 9 aa, Homo Sapiens
EDENGVGYV

SEQ ID NO: 64445 - protein, 9 aa, Homo Sapiens
PPAVWVATT

SEQ ID NO: 64446 - protein, 9 aa, Homo Sapiens
CPEMPGTVE

SEQ ID NO: 64447 - protein, 9 aa, Homo Sapiens
SLEECKVQT

SEQ ID NO: 64448 - protein, 9 aa, Homo Sapiens
ALVNSQVDF

SEQ ID NO: 64449 - protein, 9 aa, Homo Sapiens
GLGLIIHHR

SEQ ID NO: 64450 - protein, 9 aa, Homo Sapiens
KLNTMKHLL

SEQ ID NO: 64451 - protein, 9 aa, Homo Sapiens
FQGVLGWYM

SEQ ID NO: 64452 - protein, 9 aa, Homo Sapiens
LSASPRMRG

SEQ ID NO: 64453 - protein, 9 aa, Homo Sapiens
ITEKVDQVK

SEQ ID NO: 64454 - protein, 9 aa, Homo Sapiens
EFRGLKKED

SEQ ID NO: 64455 - protein, 9 aa, Homo Sapiens
RFIHMSGTQ

SEQ ID NO: 64456 - protein, 9 aa, Homo Sapiens
PNVIYRLNI

SEQ ID NO: 64457 - protein, 9 aa, Homo Sapiens
PSPFLLMTV

SEQ ID NO: 64458 - protein, 9 aa, Homo Sapiens
APPGTLHTP

SEQ ID NO: 64459 - protein, 9 aa, Homo Sapiens
AGILELTME

SEQ ID NO: 64460 - protein, 9 aa, Homo Sapiens
KITEKVDQV

SEQ ID NO: 64461 - protein, 9 aa, Homo Sapiens
NKHKNLYIN

SEQ ID NO: 64462 - protein, 9 aa, Homo Sapiens
WFPGDAFKT

SEQ ID NO: 64463 - protein, 9 aa, Homo Sapiens
MFSLGNNGI

SEQ ID NO: 64464 - protein, 9 aa, Homo Sapiens
LAPLFDNPM

SEQ ID NO: 64465 - protein, 9 aa, Homo Sapiens
NSKRGFAID

SEQ ID NO: 64466 - protein, 9 aa, Homo Sapiens
VAPFKGWMD

SEQ ID NO: 64467 - protein, 9 aa, Homo Sapiens
LYHLILLTS

SEQ ID NO: 64468 - protein, 9 aa, Homo Sapiens
NLQEALKDT

SEQ ID NO: 64469 - protein, 9 aa, Homo Sapiens
IPPPYYTMS

SEQ ID NO: 64470 - protein, 9 aa, Homo Sapiens
RADSEQQNQ

SEQ ID NO: 64471 - protein, 9 aa, Homo Sapiens
LGSPWIYLW

SEQ ID NO: 64472 - protein, 9 aa, Homo Sapiens
QDPHRKALL

SEQ ID NO: 64473 - protein, 9 aa, Homo Sapiens
TFSPAPCPE

SEQ ID NO: 64474 - protein, 9 aa, Homo Sapiens
GNAGDEFRG

SEQ ID NO: 64475 - protein, 9 aa, Homo Sapiens
GKTTDLKQQ

SEQ ID NO: 64476 - protein, 9 aa, Homo Sapiens
ENMSKTQFM

SEQ ID NO: 64477 - protein, 9 aa, Homo Sapiens
QVRCLGPRF

SEQ ID NO: 64478 - protein, 9 aa, Homo Sapiens
DKEKDEVNE

SEQ ID NO: 64479 - protein, 9 aa, Homo Sapiens
RIRQSEDEE

SEQ ID NO: 64480 - protein, 9 aa, Homo Sapiens
LQTYDESSL

SEQ ID NO: 64481 - protein, 9 aa, Homo Sapiens
DSTMCVVCS

SEQ ID NO: 64482 - protein, 9 aa, Homo Sapiens
TTPFSYKAV

SEQ ID NO: 64483 - protein, 9 aa, Homo Sapiens
PAGILELTM

SEQ ID NO: 64484 - protein, 9 aa, Homo Sapiens
KGIKIKPGS

SEQ ID NO: 64485 - protein, 9 aa, Homo Sapiens
DSEQQNQEY

SEQ ID NO: 64486 - protein, 9 aa, Homo Sapiens
AQVDKEKDE

SEQ ID NO: 64487 - protein, 9 aa, Homo Sapiens
RGVPHIEVT

SEQ ID NO: 64488 - protein, 9 aa, Homo Sapiens
DKYYQVVYY

SEQ ID NO: 64489 - protein, 9 aa, Homo Sapiens
VLLCSKDVT

SEQ ID NO: 64490 - protein, 9 aa, Homo Sapiens
DAFKTGSAS

SEQ ID NO: 64491 - protein, 9 aa, Homo Sapiens
HIYICIHMC

SEQ ID NO: 64492 - protein, 9 aa, Homo Sapiens
LWTHGITCK

SEQ ID NO: 64493 - protein, 9 aa, Homo Sapiens
FPGDAFKTG

SEQ ID NO: 64494 - protein, 9 aa, Homo Sapiens
SSFAYIPWK

SEQ ID NO: 64495 - protein, 9 aa, Homo Sapiens
KKWEGHAVL

SEQ ID NO: 64496 - protein, 9 aa, Homo Sapiens
FLQQLCHSQ

SEQ ID NO: 64497 - protein, 9 aa, Homo Sapiens
YNEIKIKFD

SEQ ID NO: 64498 - protein, 9 aa, Homo Sapiens
DLQKKTNDL

SEQ ID NO: 64499 - protein, 9 aa, Homo Sapiens
ALSYMNIQQ

SEQ ID NO: 64500 - protein, 9 aa, Homo Sapiens
RKNICWGTH

SEQ ID NO: 64501 - protein, 9 aa, Homo Sapiens
IAGLLHYLF

SEQ ID NO: 64502 - protein, 9 aa, Homo Sapiens
KHKKWEGHA

SEQ ID NO: 64503 - protein, 9 aa, Homo Sapiens
LQVAPFKGW

SEQ ID NO: 64504 - protein, 9 aa, Homo Sapiens
CTVGDAFAC

SEQ ID NO: 64505 - protein, 9 aa, Homo Sapiens
ADSEQQNQE

SEQ ID NO: 64506 - protein, 9 aa, Homo Sapiens
LVGDLLVFG

SEQ ID NO: 64507 - protein, 9 aa, Homo Sapiens
VRSFEEEFI

SEQ ID NO: 64508 - protein, 9 aa, Homo Sapiens
KSAFYPPNF

SEQ ID NO: 64509 - protein, 9 aa, Homo Sapiens
TNNRLNSRI

SEQ ID NO: 64510 - protein, 9 aa, Homo Sapiens
IPDRVRSFE

SEQ ID NO: 64511 - protein, 9 aa, Homo Sapiens
KPSVLSGLN

SEQ ID NO: 64512 - protein, 9 aa, Homo Sapiens
SWSFHKLNT

SEQ ID NO: 64513 - protein, 9 aa, Homo Sapiens
ASVLQKNGH

SEQ ID NO: 64514 - protein, 9 aa, Homo Sapiens
MRGFIYQGK

SEQ ID NO: 64515 - protein, 9 aa, Homo Sapiens
IEVPQAKAQ

SEQ ID NO: 64516 - protein, 9 aa, Homo Sapiens
RTREAPPGT

SEQ ID NO: 64517 - protein, 9 aa, Homo Sapiens
GVPHIEVTF

SEQ ID NO: 64518 - protein, 9 aa, Homo Sapiens
RVLSPAGIL

SEQ ID NO: 64519 - protein, 9 aa, Homo Sapiens
GKIFKIFGP

SEQ ID NO: 64520 - protein, 9 aa, Homo Sapiens
LGAVIGTDC

SEQ ID NO: 64521 - protein, 9 aa, Homo Sapiens
PPSVIISWQ

SEQ ID NO: 64522 - protein, 9 aa, Homo Sapiens
NYLEGTDIL

SEQ ID NO: 64523 - protein, 9 aa, Homo Sapiens
KYFLSIPIT

SEQ ID NO: 64524 - protein, 9 aa, Homo Sapiens
YLEDENGVG

SEQ ID NO: 64525 - protein, 9 aa, Homo Sapiens
LIIHHRGQK

SEQ ID NO: 64526 - protein, 9 aa, Homo Sapiens
ALMDNGENE

SEQ ID NO: 64527 - protein, 9 aa, Homo Sapiens
EVNVEGLHI

SEQ ID NO: 64528 - protein, 9 aa, Homo Sapiens
NLYINIVAY

SEQ ID NO: 64529 - protein, 9 aa, Homo Sapiens
GDVRADSEQ

SEQ ID NO: 64530 - protein, 9 aa, Homo Sapiens
LPSLSKQMP

SEQ ID NO: 64531 - protein, 9 aa, Homo Sapiens
PMSLASLTA

SEQ ID NO: 64532 - protein, 9 aa, Homo Sapiens
ATLKDNEYI

SEQ ID NO: 64533 - protein, 9 aa, Homo Sapiens
KAFKRGQRL

SEQ ID NO: 64534 - protein, 9 aa, Homo Sapiens
VVLLLDQRE

SEQ ID NO: 64535 - protein, 9 aa, Homo Sapiens
PFLLMTVLL

SEQ ID NO: 64536 - protein, 9 aa, Homo Sapiens
GTFVQIFLS

SEQ ID NO: 64537 - protein, 9 aa, Homo Sapiens
LEKFISLEV

SEQ ID NO: 64538 - protein, 9 aa, Homo Sapiens
VRRGGADTY

SEQ ID NO: 64539 - protein, 9 aa, Homo Sapiens
LQEALKDTE

SEQ ID NO: 64540 - protein, 9 aa, Homo Sapiens
VEDITNKFK

SEQ ID NO: 64541 - protein, 9 aa, Homo Sapiens
MPTVLVVLL

SEQ ID NO: 64542 - protein, 9 aa, Homo Sapiens
NLHLEESSE

SEQ ID NO: 64543 - protein, 9 aa, Homo Sapiens
LNTMKHLLL

SEQ ID NO: 64544 - protein, 9 aa, Homo Sapiens
RLIHRTLGF

SEQ ID NO: 64545 - protein, 9 aa, Homo Sapiens
GAVIGTDCG

SEQ ID NO: 64546 - protein, 9 aa, Homo Sapiens
PDPSQVELL

SEQ ID NO: 64547 - protein, 9 aa, Homo Sapiens
ADIKVIMVT

SEQ ID NO: 64548 - protein, 9 aa, Homo Sapiens
GECVEDITN

SEQ ID NO: 64549 - protein, 9 aa, Homo Sapiens
ISPDGGKIP

SEQ ID NO: 64550 - protein, 9 aa, Homo Sapiens
LMEYVNGGD

SEQ ID NO: 64551 - protein, 9 aa, Homo Sapiens
FGGATLYGI

SEQ ID NO: 64552 - protein, 9 aa, Homo Sapiens
LSPNLSPNT

SEQ ID NO: 64553 - protein, 9 aa, Homo Sapiens
YYIKCFDTV

SEQ ID NO: 64554 - protein, 9 aa, Homo Sapiens
CYLRLQRIR

SEQ ID NO: 64555 - protein, 9 aa, Homo Sapiens
ATLKEKKEK

SEQ ID NO: 64556 - protein, 9 aa, Homo Sapiens
KAQVDKEKD

SEQ ID NO: 64557 - protein, 9 aa, Homo Sapiens
LVALADYYI

SEQ ID NO: 64558 - protein, 9 aa, Homo Sapiens
HRTLGFQKL

SEQ ID NO: 64559 - protein, 9 aa, Homo Sapiens
VKFYGNLVA

SEQ ID NO: 64560 - protein, 9 aa, Homo Sapiens
MTQTLNQVL

SEQ ID NO: 64561 - protein, 9 aa, Homo Sapiens
PLRASWKNY

SEQ ID NO: 64562 - protein, 9 aa, Homo Sapiens
FRYFILPNV

SEQ ID NO: 64563 - protein, 9 aa, Homo Sapiens
KSQRTERKD

SEQ ID NO: 64564 - protein, 9 aa, Homo Sapiens
RLGEDKYYQ

SEQ ID NO: 64565 - protein, 9 aa, Homo Sapiens
ISRLTEELL

SEQ ID NO: 64566 - protein, 9 aa, Homo Sapiens
TLKEKKEKK

SEQ ID NO: 64567 - protein, 9 aa, Homo Sapiens
LQYLEDENG

SEQ ID NO: 64568 - protein, 9 aa, Homo Sapiens
PPAPRGVPH

SEQ ID NO: 64569 - protein, 9 aa, Homo Sapiens
AQNIRKFVK

SEQ ID NO: 64570 - protein, 9 aa, Homo Sapiens
EFRYFILPN

SEQ ID NO: 64571 - protein, 9 aa, Homo Sapiens
SYMNIQQKE

SEQ ID NO: 64572 - protein, 9 aa, Homo Sapiens
PEEIRDGNE

SEQ ID NO: 64573 - protein, 9 aa, Homo Sapiens
ADFHHRVKS

SEQ ID NO: 64574 - protein, 9 aa, Homo Sapiens
FTTMPTVLV

SEQ ID NO: 64575 - protein, 9 aa, Homo Sapiens
NICWGTHSK

SEQ ID NO: 64576 - protein, 9 aa, Homo Sapiens
FKRGQRLYE

SEQ ID NO: 64577 - protein, 9 aa, Homo Sapiens
QKGNNNGKT

SEQ ID NO: 64578 - protein, 9 aa, Homo Sapiens
NKEEMNRSQ

SEQ ID NO: 64579 - protein, 9 aa, Homo Sapiens
FKVNTELNT

SEQ ID NO: 64580 - protein, 9 aa, Homo Sapiens
PRPQDPHRK

SEQ ID NO: 64581 - protein, 9 aa, Homo Sapiens
RPRPQDPHR

SEQ ID NO: 64582 - protein, 9 aa, Homo Sapiens
SSWLPNFYT

SEQ ID NO: 64583 - protein, 9 aa, Homo Sapiens
TREAPPGTL

SEQ ID NO: 64584 - protein, 9 aa, Homo Sapiens
VQRTLMNLR

SEQ ID NO: 64585 - protein, 9 aa, Homo Sapiens
EPQGKGPCP

SEQ ID NO: 64586 - protein, 9 aa, Homo Sapiens
AGECVEDIT

SEQ ID NO: 64587 - protein, 9 aa, Homo Sapiens
NNNGKTTDL

SEQ ID NO: 64588 - protein, 9 aa, Homo Sapiens
HSSLYHLIL

SEQ ID NO: 64589 - protein, 9 aa, Homo Sapiens
NTKQASPLI

SEQ ID NO: 64590 - protein, 9 aa, Homo Sapiens
HMSGTQKSQ

SEQ ID NO: 64591 - protein, 9 aa, Homo Sapiens
GLGSPWIYL

SEQ ID NO: 64592 - protein, 9 aa, Homo Sapiens
PELFSDTPP

SEQ ID NO: 64593 - protein, 9 aa, Homo Sapiens
MGVMLVCIT

SEQ ID NO: 64594 - protein, 9 aa, Homo Sapiens
THGITCKKF

SEQ ID NO: 64595 - protein, 9 aa, Homo Sapiens
SPFLLMTVL

SEQ ID NO: 64596 - protein, 9 aa, Homo Sapiens
AAGKIFKIF

SEQ ID NO: 64597 - protein, 9 aa, Homo Sapiens
GFAIDCAIL

SEQ ID NO: 64598 - protein, 9 aa, Homo Sapiens
REVEYFKRG

SEQ ID NO: 64599 - protein, 9 aa, Homo Sapiens
LNTVNNYFL

SEQ ID NO: 64600 - protein, 9 aa, Homo Sapiens
DEKPYDCKE

SEQ ID NO: 64601 - protein, 9 aa, Homo Sapiens
ITALIGCLF

SEQ ID NO: 64602 - protein, 9 aa, Homo Sapiens
SQRTERKDP

SEQ ID NO: 64603 - protein, 9 aa, Homo Sapiens
SLPMSLASL

SEQ ID NO: 64604 - protein, 9 aa, Homo Sapiens
ELFSDTPPS

SEQ ID NO: 64605 - protein, 9 aa, Homo Sapiens
IEPQGKGPC

SEQ ID NO: 64606 - protein, 9 aa, Homo Sapiens
DNPMLDKEL

SEQ ID NO: 64607 - protein, 9 aa, Homo Sapiens
NNGKTTDLK

SEQ ID NO: 64608 - protein, 9 aa, Homo Sapiens
TLHTPSPSP

SEQ ID NO: 64609 - protein, 9 aa, Homo Sapiens
KDVTFHPDP

SEQ ID NO: 64610 - protein, 9 aa, Homo Sapiens
HADFHHRVK

SEQ ID NO: 64611 - protein, 9 aa, Homo Sapiens
SDTPPSVII

SEQ ID NO: 64612 - protein, 9 aa, Homo Sapiens
LELYNYFEH

SEQ ID NO: 64613 - protein, 9 aa, Homo Sapiens
PQPSHSNPQ

SEQ ID NO: 64614 - protein, 9 aa, Homo Sapiens
AQQKITEKV

SEQ ID NO: 64615 - protein, 9 aa, Homo Sapiens
HCILSCLFW

SEQ ID NO: 64616 - protein, 9 aa, Homo Sapiens
MDRLYFLME

SEQ ID NO: 64617 - protein, 9 aa, Homo Sapiens
GIKIKPGSM

SEQ ID NO: 64618 - protein, 9 aa, Homo Sapiens
NSDSGFFTV

SEQ ID NO: 64619 - protein, 9 aa, Homo Sapiens
VLQKNGHKR

SEQ ID NO: 64620 - protein, 9 aa, Homo Sapiens
NEIPDRVRS

SEQ ID NO: 64621 - protein, 9 aa, Homo Sapiens
LCSKDVTFH

SEQ ID NO: 64622 - protein, 9 aa, Homo Sapiens
IRQSEDEES

SEQ ID NO: 64623 - protein, 9 aa, Homo Sapiens
DCGTIESGL

SEQ ID NO: 64624 - protein, 9 aa, Homo Sapiens
VSLESIIAN

SEQ ID NO: 64625 - protein, 9 aa, Homo Sapiens
TPKNTWDDS

SEQ ID NO: 64626 - protein, 9 aa, Homo Sapiens
TPFSYKAVR

SEQ ID NO: 64627 - protein, 9 aa, Homo Sapiens
RVNPPADRS

SEQ ID NO: 64628 - protein, 9 aa, Homo Sapiens
ENSKNQNKS

SEQ ID NO: 64629 - protein, 9 aa, Homo Sapiens
LGSGDTHTI

SEQ ID NO: 64630 - protein, 9 aa, Homo Sapiens
TTPTGEIVS

SEQ ID NO: 64631 - protein, 9 aa, Homo Sapiens
IVNIMAIVL

SEQ ID NO: 64632 - protein, 9 aa, Homo Sapiens
TLSPNLSPN

SEQ ID NO: 64633 - protein, 9 aa, Homo Sapiens
QKISPDGGK

SEQ ID NO: 64634 - protein, 9 aa, Homo Sapiens
VCITALIGC

SEQ ID NO: 64635 - protein, 9 aa, Homo Sapiens
PGDAFKTGS

SEQ ID NO: 64636 - protein, 9 aa, Homo Sapiens
QEASVLQKN

SEQ ID NO: 64637 - protein, 9 aa, Homo Sapiens
DLSLEDSTM

SEQ ID NO: 64638 - protein, 9 aa, Homo Sapiens
KVQKSIEVP

SEQ ID NO: 64639 - protein, 9 aa, Homo Sapiens
AYIPWKFEC

SEQ ID NO: 64640 - protein, 9 aa, Homo Sapiens
HHRGQKGPR

SEQ ID NO: 64641 - protein, 9 aa, Homo Sapiens
SGNAGDEFR

SEQ ID NO: 64642 - protein, 9 aa, Homo Sapiens
LMTVLLGRL

SEQ ID NO: 64643 - protein, 9 aa, Homo Sapiens
PNLSPNTKQ

SEQ ID NO: 64644 - protein, 9 aa, Homo Sapiens
NKNLQEALK

SEQ ID NO: 64645 - protein, 9 aa, Homo Sapiens
HTPSPSPAR

SEQ ID NO: 64646 - protein, 9 aa, Homo Sapiens
KKRTEEQIC

SEQ ID NO: 64647 - protein, 9 aa, Homo Sapiens
VLVVLLLDQ

SEQ ID NO: 64648 - protein, 9 aa, Homo Sapiens
CNWRNHRMF

SEQ ID NO: 64649 - protein, 9 aa, Homo Sapiens
TEDGKHQKE

SEQ ID NO: 64650 - protein, 9 aa, Homo Sapiens
EIPDRVRSF

SEQ ID NO: 64651 - protein, 9 aa, Homo Sapiens
LPNVIYRLN

SEQ ID NO: 64652 - protein, 9 aa, Homo Sapiens
RDKYSKVPS

SEQ ID NO: 64653 - protein, 9 aa, Homo Sapiens
VGEFCLPYP

SEQ ID NO: 64654 - protein, 9 aa, Homo Sapiens
LALLQVAPF

SEQ ID NO: 64655 - protein, 9 aa, Homo Sapiens
NEIKIKFDK

SEQ ID NO: 64656 - protein, 9 aa, Homo Sapiens
LKKRTEEQI

SEQ ID NO: 64657 - protein, 9 aa, Homo Sapiens
YPLEKTINS

SEQ ID NO: 64658 - protein, 9 aa, Homo Sapiens
SVLQKNGHK

SEQ ID NO: 64659 - protein, 9 aa, Homo Sapiens
VFGGSLHSS

SEQ ID NO: 64660 - protein, 9 aa, Homo Sapiens
LEKTINSSP

SEQ ID NO: 64661 - protein, 9 aa, Homo Sapiens
IKLKAGECV

SEQ ID NO: 64662 - protein, 9 aa, Homo Sapiens
SRLTEELLA

SEQ ID NO: 64663 - protein, 9 aa, Homo Sapiens
ELLEVFGGS

SEQ ID NO: 64664 - protein, 9 aa, Homo Sapiens
WCFSTPKNT

SEQ ID NO: 64665 - protein, 9 aa, Homo Sapiens
PSHSNPQAS

SEQ ID NO: 64666 - protein, 9 aa, Homo Sapiens
DSLEECKVQ

SEQ ID NO: 64667 - protein, 9 aa, Homo Sapiens
QKSIEVPQA

SEQ ID NO: 64668 - protein, 9 aa, Homo Sapiens
QFMTQTLNQ

SEQ ID NO: 64669 - protein, 9 aa, Homo Sapiens
RSADPPPAV

SEQ ID NO: 64670 - protein, 9 aa, Homo Sapiens
KFVKEVKCR

SEQ ID NO: 64671 - protein, 9 aa, Homo Sapiens
TDEKPYDCK

SEQ ID NO: 64672 - protein, 9 aa, Homo Sapiens
CLLNICQKI

SEQ ID NO: 64673 - protein, 9 aa, Homo Sapiens
TVGDAFACL

SEQ ID NO: 64674 - protein, 9 aa, Homo Sapiens
FHIDFDRFL

SEQ ID NO: 64675 - protein, 9 aa, Homo Sapiens
LGLGLIIHH

SEQ ID NO: 64676 - protein, 9 aa, Homo Sapiens
TTMPTVLVV

SEQ ID NO: 64677 - protein, 9 aa, Homo Sapiens
RLQRIRQSE

SEQ ID NO: 64678 - protein, 9 aa, Homo Sapiens
QIAKALVNS

SEQ ID NO: 64679 - protein, 9 aa, Homo Sapiens
KDYQPKYFL

SEQ ID NO: 64680 - protein, 9 aa, Homo Sapiens
QRTERKDPA

SEQ ID NO: 64681 - protein, 9 aa, Homo Sapiens
TPSPSPARR

SEQ ID NO: 64682 - protein, 9 aa, Homo Sapiens
PPVQRGLGS

SEQ ID NO: 64683 - protein, 9 aa, Homo Sapiens
DNEVKAFKR

SEQ ID NO: 64684 - protein, 9 aa, Homo Sapiens
AGKIFKIFG

SEQ ID NO: 64685 - protein, 9 aa, Homo Sapiens
RQKLDEALR

SEQ ID NO: 64686 - protein, 9 aa, Homo Sapiens
LVCITALIG

SEQ ID NO: 64687 - protein, 9 aa, Homo Sapiens
YQPKYFLSI

SEQ ID NO: 64688 - protein, 9 aa, Homo Sapiens
GKCRSADIK

SEQ ID NO: 64689 - protein, 9 aa, Homo Sapiens
EYFKRGGVS

SEQ ID NO: 64690 - protein, 9 aa, Homo Sapiens
NSNAIISWA

SEQ ID NO: 64691 - protein, 9 aa, Homo Sapiens
VSWSFHKLN

SEQ ID NO: 64692 - protein, 9 aa, Homo Sapiens
SSSSSGVFN

SEQ ID NO: 64693 - protein, 9 aa, Homo Sapiens
YSGNAGDEF

SEQ ID NO: 64694 - protein, 9 aa, Homo Sapiens
GNSKRGFAI

SEQ ID NO: 64695 - protein, 9 aa, Homo Sapiens
YICIHMCVY

SEQ ID NO: 64696 - protein, 9 aa, Homo Sapiens
FDNPMLDKE

SEQ ID NO: 64697 - protein, 9 aa, Homo Sapiens
KWEGHAVLI

SEQ ID NO: 64698 - protein, 9 aa, Homo Sapiens
LILLTSLLS

SEQ ID NO: 64699 - protein, 9 aa, Homo Sapiens
FKLHTFEEV

SEQ ID NO: 64700 - protein, 9 aa, Homo Sapiens
GKNGKVIQQ

SEQ ID NO: 64701 - protein, 9 aa, Homo Sapiens
VTKSYNEIK

SEQ ID NO: 64702 - protein, 9 aa, Homo Sapiens
SLYHLILLT

SEQ ID NO: 64703 - protein, 9 aa, Homo Sapiens
YEKSLHIPM

SEQ ID NO: 64704 - protein, 9 aa, Homo Sapiens
HPDNKHKNL

SEQ ID NO: 64705 - protein, 9 aa, Homo Sapiens
LVVLLLDQR

SEQ ID NO: 64706 - protein, 9 aa, Homo Sapiens
HSNPQASCP

SEQ ID NO: 64707 - protein, 9 aa, Homo Sapiens
WEFLTLCNI

SEQ ID NO: 64708 - protein, 9 aa, Homo Sapiens
KLEGDLKAP

SEQ ID NO: 64709 - protein, 9 aa, Homo Sapiens
EEMNRSQKP

SEQ ID NO: 64710 - protein, 9 aa, Homo Sapiens
VMLVCITAL

SEQ ID NO: 64711 - protein, 9 aa, Homo Sapiens
TDLSLEDST

SEQ ID NO: 64712 - protein, 9 aa, Homo Sapiens
SSSSGVFNS

SEQ ID NO: 64713 - protein, 9 aa, Homo Sapiens
FLGLGLIIH

SEQ ID NO: 64714 - protein, 9 aa, Homo Sapiens
FHKLNTMKH

SEQ ID NO: 64715 - protein, 9 aa, Homo Sapiens
TLNQVLVLK

SEQ ID NO: 64716 - protein, 9 aa, Homo Sapiens
MCVYSYIHM

SEQ ID NO: 64717 - protein, 9 aa, Homo Sapiens
EMNRSQKPN

SEQ ID NO: 64718 - protein, 9 aa, Homo Sapiens
YIPWKFECG

SEQ ID NO: 64719 - protein, 9 aa, Homo Sapiens
EHSNYVYLV

SEQ ID NO: 64720 - protein, 9 aa, Homo Sapiens
DGKHQKESD

SEQ ID NO: 64721 - protein, 9 aa, Homo Sapiens
IAKALVNSQ

SEQ ID NO: 64722 - protein, 9 aa, Homo Sapiens
PPPAVWVAT

SEQ ID NO: 64723 - protein, 9 aa, Homo Sapiens
ALLQVAPFK

SEQ ID NO: 64724 - protein, 9 aa, Homo Sapiens
KFISLEVCY

SEQ ID NO: 64725 - protein, 9 aa, Homo Sapiens
GDEEEKWAA

SEQ ID NO: 64726 - protein, 9 aa, Homo Sapiens
DNKHKNLYI

SEQ ID NO: 64727 - protein, 9 aa, Homo Sapiens
YIKCFDTVT

SEQ ID NO: 64728 - protein, 9 aa, Homo Sapiens
TMCVVCSHH

SEQ ID NO: 64729 - protein, 9 aa, Homo Sapiens
QQLCHSQEL

SEQ ID NO: 64730 - protein, 9 aa, Homo Sapiens
NPSSHHPRA

SEQ ID NO: 64731 - protein, 9 aa, Homo Sapiens
LHSSLYHLI

SEQ ID NO: 64732 - protein, 9 aa, Homo Sapiens
NGAELEIST

SEQ ID NO: 64733 - protein, 9 aa, Homo Sapiens
NAIFEPTEE

SEQ ID NO: 64734 - protein, 9 aa, Homo Sapiens
IIHLVLDRI

SEQ ID NO: 64735 - protein, 9 aa, Homo Sapiens
ACASDHVKV

SEQ ID NO: 64736 - protein, 9 aa, Homo Sapiens
SHSNPQASC

SEQ ID NO: 64737 - protein, 9 aa, Homo Sapiens
SWKNYLEGT

SEQ ID NO: 64738 - protein, 9 aa, Homo Sapiens
KFRQKLDEA

SEQ ID NO: 64739 - protein, 9 aa, Homo Sapiens
LLMTVLLGR

SEQ ID NO: 64740 - protein, 9 aa, Homo Sapiens
NHRMFSLGN

SEQ ID NO: 64741 - protein, 9 aa, Homo Sapiens
MSQPNASVH

SEQ ID NO: 64742 - protein, 9 aa, Homo Sapiens
VRCLGPRFS

SEQ ID NO: 64743 - protein, 9 aa, Homo Sapiens
NIRKFVKEV

SEQ ID NO: 64744 - protein, 9 aa, Homo Sapiens
FISLEVCYH

SEQ ID NO: 64745 - protein, 9 aa, Homo Sapiens
NGHKRKHFL

SEQ ID NO: 64746 - protein, 9 aa, Homo Sapiens
GDLKAPKVD

SEQ ID NO: 64747 - protein, 9 aa, Homo Sapiens
IRDGNEVRV

SEQ ID NO: 64748 - protein, 9 aa, Homo Sapiens
FYIVNIMAI

SEQ ID NO: 64749 - protein, 9 aa, Homo Sapiens
SQQFLQQLC

SEQ ID NO: 64750 - protein, 9 aa, Homo Sapiens
IDNVNFFKL

SEQ ID NO: 64751 - protein, 9 aa, Homo Sapiens
PMALMDNGE

SEQ ID NO: 64752 - protein, 9 aa, Homo Sapiens
KSYNEIKIK

SEQ ID NO: 64753 - protein, 9 aa, Homo Sapiens
IHHRGQKGP

SEQ ID NO: 64754 - protein, 9 aa, Homo Sapiens
FFTVFTGVQ

SEQ ID NO: 64755 - protein, 9 aa, Homo Sapiens
RQSEDEESI

SEQ ID NO: 64756 - protein, 9 aa, Homo Sapiens
MNRSQKPNE

SEQ ID NO: 64757 - protein, 9 aa, Homo Sapiens
DKYSKVPSA

SEQ ID NO: 64758 - protein, 9 aa, Homo Sapiens
LVSRFIHMS

SEQ ID NO: 64759 - protein, 9 aa, Homo Sapiens
RSQKPNEVS

SEQ ID NO: 64760 - protein, 9 aa, Homo Sapiens
KDTEKKLEE

SEQ ID NO: 64761 - protein, 9 aa, Homo Sapiens
NEVKAFKRG

SEQ ID NO: 64762 - protein, 9 aa, Homo Sapiens
CRSADIKVI

SEQ ID NO: 64763 - protein, 9 aa, Homo Sapiens
LVWFPGDAF

SEQ ID NO: 64764 - protein, 9 aa, Homo Sapiens
TDALSYMNI

SEQ ID NO: 64765 - protein, 9 aa, Homo Sapiens
EEKWAAESC

SEQ ID NO: 64766 - protein, 9 aa, Homo Sapiens
KSTFSPAPC

SEQ ID NO: 64767 - protein, 9 aa, Homo Sapiens
FFFHCNWRN

SEQ ID NO: 64768 - protein, 9 aa, Homo Sapiens
MLVCITALI

SEQ ID NO: 64769 - protein, 9 aa, Homo Sapiens
WYKLQTYDE

SEQ ID NO: 64770 - protein, 9 aa, Homo Sapiens
QFLQQLCHS

SEQ ID NO: 64771 - protein, 9 aa, Homo Sapiens
RGGVSPHCP

SEQ ID NO: 64772 - protein, 9 aa, Homo Sapiens
APLFDNPML

SEQ ID NO: 64773 - protein, 9 aa, Homo Sapiens
LEKIQSSLP

SEQ ID NO: 64774 - protein, 9 aa, Homo Sapiens
PGNSKRGFA

SEQ ID NO: 64775 - protein, 9 aa, Homo Sapiens
IIPTKINDG

SEQ ID NO: 64776 - protein, 9 aa, Homo Sapiens
FILPNVIYR

SEQ ID NO: 64777 - protein, 9 aa, Homo Sapiens
AVRRGGADT

SEQ ID NO: 64778 - protein, 9 aa, Homo Sapiens
PPPYYTMSQ

SEQ ID NO: 64779 - protein, 9 aa, Homo Sapiens
WSFHKLNTM

SEQ ID NO: 64780 - protein, 9 aa, Homo Sapiens
AGLLHYLFL

SEQ ID NO: 64781 - protein, 9 aa, Homo Sapiens
EKKTQTFLL

SEQ ID NO: 64782 - protein, 9 aa, Homo Sapiens
SPTEDGKHQ

SEQ ID NO: 64783 - protein, 9 aa, Homo Sapiens
YDKFRQKLD

SEQ ID NO: 64784 - protein, 9 aa, Homo Sapiens
LYFLMEYVN

SEQ ID NO: 64785 - protein, 9 aa, Homo Sapiens
NWRNHRMFS

SEQ ID NO: 64786 - protein, 9 aa, Homo Sapiens
KRGQRLYEK

SEQ ID NO: 64787 - protein, 9 aa, Homo Sapiens
VQRGLGSPW

SEQ ID NO: 64788 - protein, 9 aa, Homo Sapiens
YLRLQRIRQ

SEQ ID NO: 64789 - protein, 9 aa, Homo Sapiens
ECKVQTNLK

SEQ ID NO: 64790 - protein, 9 aa, Homo Sapiens
FRKVQKSIE

SEQ ID NO: 64791 - protein, 9 aa, Homo Sapiens
KTQFMTQTL

SEQ ID NO: 64792 - protein, 9 aa, Homo Sapiens
KKEKKTQTF

SEQ ID NO: 64793 - protein, 9 aa, Homo Sapiens
LRGLAVARD

SEQ ID NO: 64794 - protein, 9 aa, Homo Sapiens
KIKKTNNRL

SEQ ID NO: 64795 - protein, 9 aa, Homo Sapiens
EEIRDGNEV

SEQ ID NO: 64796 - protein, 9 aa, Homo Sapiens
PFSYKAVRR

SEQ ID NO: 64797 - protein, 9 aa, Homo Sapiens
IHIYICIHM

SEQ ID NO: 64798 - protein, 9 aa, Homo Sapiens
DPHRKALLH

SEQ ID NO: 64799 - protein, 9 aa, Homo Sapiens
LVFGGATLY

SEQ ID NO: 64800 - protein, 9 aa, Homo Sapiens
HAVLIVKGK

SEQ ID NO: 64801 - protein, 9 aa, Homo Sapiens
VSRFIHMSG

SEQ ID NO: 64802 - protein, 9 aa, Homo Sapiens
LKAPKVDVK

SEQ ID NO: 64803 - protein, 9 aa, Homo Sapiens
KAPKVDVKG

SEQ ID NO: 64804 - protein, 9 aa, Homo Sapiens
QKITEKVDQ

SEQ ID NO: 64805 - protein, 9 aa, Homo Sapiens
PAPRGVPHI

SEQ ID NO: 64806 - protein, 9 aa, Homo Sapiens
CILSCLFWE

SEQ ID NO: 64807 - protein, 9 aa, Homo Sapiens
NLQYLEDEN

SEQ ID NO: 64808 - protein, 9 aa, Homo Sapiens
NIQQKEDIT

SEQ ID NO: 64809 - protein, 9 aa, Homo Sapiens
VLGAVIGTD

SEQ ID NO: 64810 - protein, 9 aa, Homo Sapiens
ELYNYFEHS

SEQ ID NO: 64811 - protein, 9 aa, Homo Sapiens
HLEESSEDK

SEQ ID NO: 64812 - protein, 9 aa, Homo Sapiens
GDEFRGLKK

SEQ ID NO: 64813 - protein, 9 aa, Homo Sapiens
PTEDGKHQK

SEQ ID NO: 64814 - protein, 9 aa, Homo Sapiens
CAIIAGLLH

SEQ ID NO: 64815 - protein, 9 aa, Homo Sapiens
SFDYSPLIT

SEQ ID NO: 64816 - protein, 9 aa, Homo Sapiens
IFKIFGPVA

SEQ ID NO: 64817 - protein, 9 aa, Homo Sapiens
PHRKALLHI

SEQ ID NO: 64818 - protein, 9 aa, Homo Sapiens
KEKDEVNEG

SEQ ID NO: 64819 - protein, 9 aa, Homo Sapiens
GLLHYLFLA

SEQ ID NO: 64820 - protein, 9 aa, Homo Sapiens
FVKEVKCRL

SEQ ID NO: 64821 - protein, 9 aa, Homo Sapiens
HTIIPTKIN

SEQ ID NO: 64822 - protein, 9 aa, Homo Sapiens
LFSDTPPSV

SEQ ID NO: 64823 - protein, 9 aa, Homo Sapiens
VGDLLVFGG

SEQ ID NO: 64824 - protein, 9 aa, Homo Sapiens
EKIQSSLPE

SEQ ID NO: 64825 - protein, 9 aa, Homo Sapiens
SIPPPYYTM

SEQ ID NO: 64826 - protein, 9 aa, Homo Sapiens
KEVKCRLLL

SEQ ID NO: 64827 - protein, 9 aa, Homo Sapiens
AVMEKQKKN

SEQ ID NO: 64828 - protein, 9 aa, Homo Sapiens
GLIIHHRGQ

SEQ ID NO: 64829 - protein, 9 aa, Homo Sapiens
WVLLCSKDV

SEQ ID NO: 64830 - protein, 9 aa, Homo Sapiens
LSPAGILEL

SEQ ID NO: 64831 - protein, 9 aa, Homo Sapiens
FEIINAIFE

SEQ ID NO: 64832 - protein, 9 aa, Homo Sapiens
IKIKPGSMG

SEQ ID NO: 64833 - protein, 9 aa, Homo Sapiens
KRVLSPAGI

SEQ ID NO: 64834 - protein, 9 aa, Homo Sapiens
DRFLGHAQM

SEQ ID NO: 64835 - protein, 9 aa, Homo Sapiens
TNEEDVDDM

SEQ ID NO: 64836 - protein, 9 aa, Homo Sapiens
ASWKNYLEG

SEQ ID NO: 64837 - protein, 9 aa, Homo Sapiens
GKHQKESDP

SEQ ID NO: 64838 - protein, 9 aa, Homo Sapiens
EVKAFKRGQ

SEQ ID NO: 64839 - protein, 9 aa, Homo Sapiens
LEDENGVGY

SEQ ID NO: 64840 - protein, 9 aa, Homo Sapiens
LFLVSRFIH

SEQ ID NO: 64841 - protein, 9 aa, Homo Sapiens
FSTPKNTWD

SEQ ID NO: 64842 - protein, 9 aa, Homo Sapiens
IIHHRGQKG

SEQ ID NO: 64843 - protein, 9 aa, Homo Sapiens
TVGEFCLPY

SEQ ID NO: 64844 - protein, 9 aa, Homo Sapiens
AGDEFRGLK

SEQ ID NO: 64845 - protein, 9 aa, Homo Sapiens
AVIGTDCGT

SEQ ID NO: 64846 - protein, 9 aa, Homo Sapiens
KRKDYQPKY

SEQ ID NO: 64847 - protein, 9 aa, Homo Sapiens
EKVDQVKGT

SEQ ID NO: 64848 - protein, 9 aa, Homo Sapiens
RTLMNLRGL

SEQ ID NO: 64849 - protein, 9 aa, Homo Sapiens
HSKPLYETI

SEQ ID NO: 64850 - protein, 9 aa, Homo Sapiens
CSKDVTFHP

SEQ ID NO: 64851 - protein, 9 aa, Homo Sapiens
SPAPCPEMP

SEQ ID NO: 64852 - protein, 9 aa, Homo Sapiens
FAIDCAILS

SEQ ID NO: 64853 - protein, 9 aa, Homo Sapiens
PLEKTINSS

SEQ ID NO: 64854 - protein, 9 aa, Homo Sapiens
PWKFECGSV

SEQ ID NO: 64855 - protein, 9 aa, Homo Sapiens
QNIRKFVKE

SEQ ID NO: 64856 - protein, 9 aa, Homo Sapiens
FKGIKIKPG

SEQ ID NO: 64857 - protein, 9 aa, Homo Sapiens
WGTHSKPLY

SEQ ID NO: 64858 - protein, 9 aa, Homo Sapiens
IMGVMLVCI

SEQ ID NO: 64859 - protein, 9 aa, Homo Sapiens
KNTWDDSWQ

SEQ ID NO: 64860 - protein, 9 aa, Homo Sapiens
EKTINSSPI

SEQ ID NO: 64861 - protein, 9 aa, Homo Sapiens
QNKSGGLKS

SEQ ID NO: 64862 - protein, 9 aa, Homo Sapiens
NKEEVNVEG

SEQ ID NO: 64863 - protein, 9 aa, Homo Sapiens
IDFDRFLGH

SEQ ID NO: 64864 - protein, 9 aa, Homo Sapiens
SLNVSLESI

SEQ ID NO: 64865 - protein, 9 aa, Homo Sapiens
EERLGEDKY

SEQ ID NO: 64866 - protein, 9 aa, Homo Sapiens
LGLIIHHRG

SEQ ID NO: 64867 - protein, 9 aa, Homo Sapiens
GGRPDPEKD

SEQ ID NO: 64868 - protein, 9 aa, Homo Sapiens
WYALDQLSP

SEQ ID NO: 64869 - protein, 9 aa, Homo Sapiens
CRKEVWQLK

SEQ ID NO: 64870 - protein, 9 aa, Homo Sapiens
KTLDTQEEE

SEQ ID NO: 64871 - protein, 9 aa, Homo Sapiens
QGMRILELT

SEQ ID NO: 64872 - protein, 9 aa, Homo Sapiens
GPGLRSHCY

SEQ ID NO: 64873 - protein, 9 aa, Homo Sapiens
PGGTLQGPA

SEQ ID NO: 64874 - protein, 9 aa, Homo Sapiens
ARSLGPPGH

SEQ ID NO: 64875 - protein, 9 aa, Homo Sapiens
VYVKRYEGN

SEQ ID NO: 64876 - protein, 9 aa, Homo Sapiens
QRPSPLSDS

SEQ ID NO: 64877 - protein, 9 aa, Homo Sapiens
HLHFQEEKQ

SEQ ID NO: 64878 - protein, 9 aa, Homo Sapiens
CELCKEGDV

SEQ ID NO: 64879 - protein, 9 aa, Homo Sapiens
AALQRVHLS

SEQ ID NO: 64880 - protein, 9 aa, Homo Sapiens
ADGNLCRRT

SEQ ID NO: 64881 - protein, 9 aa, Homo Sapiens
RLTHRLRLA

SEQ ID NO: 64882 - protein, 9 aa, Homo Sapiens
RATFIKDWS

SEQ ID NO: 64883 - protein, 9 aa, Homo Sapiens
TVRAMAIYK

SEQ ID NO: 64884 - protein, 9 aa, Homo Sapiens
CGGHEELSG

SEQ ID NO: 64885 - protein, 9 aa, Homo Sapiens
TASGPSELL

SEQ ID NO: 64886 - protein, 9 aa, Homo Sapiens
PYQMKEKSI

SEQ ID NO: 64887 - protein, 9 aa, Homo Sapiens
EPNAVFAKE

SEQ ID NO: 64888 - protein, 9 aa, Homo Sapiens
AGALTVPAA

SEQ ID NO: 64889 - protein, 9 aa, Homo Sapiens
PGDREGPHE

SEQ ID NO: 64890 - protein, 9 aa, Homo Sapiens
PAPRTPQAR

SEQ ID NO: 64891 - protein, 9 aa, Homo Sapiens
VLNSYWMQS

SEQ ID NO: 64892 - protein, 9 aa, Homo Sapiens
NDHRVFAGE

SEQ ID NO: 64893 - protein, 9 aa, Homo Sapiens
HSPTGPSCP

SEQ ID NO: 64894 - protein, 9 aa, Homo Sapiens
PCTSAFWLS

SEQ ID NO: 64895 - protein, 9 aa, Homo Sapiens
RTIKLWDIR

SEQ ID NO: 64896 - protein, 9 aa, Homo Sapiens
PQIPDAGAL

SEQ ID NO: 64897 - protein, 9 aa, Homo Sapiens
TDGNHRYRG

SEQ ID NO: 64898 - protein, 9 aa, Homo Sapiens
RAAGSLTKY

SEQ ID NO: 64899 - protein, 9 aa, Homo Sapiens
FYVDAISSR

SEQ ID NO: 64900 - protein, 9 aa, Homo Sapiens
TVQYSDLGL

SEQ ID NO: 64901 - protein, 9 aa, Homo Sapiens
SKTLDTQEE

SEQ ID NO: 64902 - protein, 9 aa, Homo Sapiens
TCECSANAL

SEQ ID NO: 64903 - protein, 9 aa, Homo Sapiens
CCFHSPTGP

SEQ ID NO: 64904 - protein, 9 aa, Homo Sapiens
QCRKEVWQL

SEQ ID NO: 64905 - protein, 9 aa, Homo Sapiens
AFIAAQGSF

SEQ ID NO: 64906 - protein, 9 aa, Homo Sapiens
IGGRPDPEK

SEQ ID NO: 64907 - protein, 9 aa, Homo Sapiens
DDLIQHQGM

SEQ ID NO: 64908 - protein, 9 aa, Homo Sapiens
TLQGPAMLI

SEQ ID NO: 64909 - protein, 9 aa, Homo Sapiens
DTVVARLED

SEQ ID NO: 64910 - protein, 9 aa, Homo Sapiens
LSDSYPCTL

SEQ ID NO: 64911 - protein, 9 aa, Homo Sapiens
IPDAGALTV

SEQ ID NO: 64912 - protein, 9 aa, Homo Sapiens
TLGTVIAGD

SEQ ID NO: 64913 - protein, 9 aa, Homo Sapiens
PVESPPSYQ

SEQ ID NO: 64914 - protein, 9 aa, Homo Sapiens
AVRATVTHP

SEQ ID NO: 64915 - protein, 9 aa, Homo Sapiens
IHSASVKAG

SEQ ID NO: 64916 - protein, 9 aa, Homo Sapiens
SSKTLDTQE

SEQ ID NO: 64917 - protein, 9 aa, Homo Sapiens
EPYQMKEKS

SEQ ID NO: 64918 - protein, 9 aa, Homo Sapiens
LQRVHLSCG

SEQ ID NO: 64919 - protein, 9 aa, Homo Sapiens
TSAFWLSSG

SEQ ID NO: 64920 - protein, 9 aa, Homo Sapiens
VRLLPGLGV

SEQ ID NO: 64921 - protein, 9 aa, Homo Sapiens
LQVPRSNHL

SEQ ID NO: 64922 - protein, 9 aa, Homo Sapiens
FIAAQGSFD

SEQ ID NO: 64923 - protein, 9 aa, Homo Sapiens
QVPRSNHLH

SEQ ID NO: 64924 - protein, 9 aa, Homo Sapiens
IKRLNKGLQ

SEQ ID NO: 64925 - protein, 9 aa, Homo Sapiens
NLCRRTSTH

SEQ ID NO: 64926 - protein, 9 aa, Homo Sapiens
LNLKGQACR

SEQ ID NO: 64927 - protein, 9 aa, Homo Sapiens
LYGHTSTVC

SEQ ID NO: 64928 - protein, 9 aa, Homo Sapiens
GISCTSTRD

SEQ ID NO: 64929 - protein, 9 aa, Homo Sapiens
ENDHRVFAG

SEQ ID NO: 64930 - protein, 9 aa, Homo Sapiens
WLSSGSTST

SEQ ID NO: 64931 - protein, 9 aa, Homo Sapiens
GLGVYLSLY

SEQ ID NO: 64932 - protein, 9 aa, Homo Sapiens
SAPCTSAFW

SEQ ID NO: 64933 - protein, 9 aa, Homo Sapiens
GSITEYLPP

SEQ ID NO: 64934 - protein, 9 aa, Homo Sapiens
PPSSSSRHC

SEQ ID NO: 64935 - protein, 9 aa, Homo Sapiens
YLRVHTGEK

SEQ ID NO: 64936 - protein, 9 aa, Homo Sapiens
LGLLYIRLS

SEQ ID NO: 64937 - protein, 9 aa, Homo Sapiens
LLLLPLATL

SEQ ID NO: 64938 - protein, 9 aa, Homo Sapiens
DFLHDSTVN

SEQ ID NO: 64939 - protein, 9 aa, Homo Sapiens
SDSYPCTLR

SEQ ID NO: 64940 - protein, 9 aa, Homo Sapiens
QEETTNELR

SEQ ID NO: 64941 - protein, 9 aa, Homo Sapiens
APTVRPPRL

SEQ ID NO: 64942 - protein, 9 aa, Homo Sapiens
HRLTHRLRL

SEQ ID NO: 64943 - protein, 9 aa, Homo Sapiens
RVHLSCGGH

SEQ ID NO: 64944 - protein, 9 aa, Homo Sapiens
QSPVIEFWE

SEQ ID NO: 64945 - protein, 9 aa, Homo Sapiens
ANALTASGP

SEQ ID NO: 64946 - protein, 9 aa, Homo Sapiens
SSCQHRLSS

SEQ ID NO: 64947 - protein, 9 aa, Homo Sapiens
DQEGNRQHS

SEQ ID NO: 64948 - protein, 9 aa, Homo Sapiens
VIAGDTSGD

SEQ ID NO: 64949 - protein, 9 aa, Homo Sapiens
VCCMHLHEK

SEQ ID NO: 64950 - protein, 9 aa, Homo Sapiens
ITEYLPPEV

SEQ ID NO: 64951 - protein, 9 aa, Homo Sapiens
KENKTEPWK

SEQ ID NO: 64952 - protein, 9 aa, Homo Sapiens
AGRKPRAAL

SEQ ID NO: 64953 - protein, 9 aa, Homo Sapiens
IRQARQRRQ

SEQ ID NO: 64954 - protein, 9 aa, Homo Sapiens
CRRTSTHPE

SEQ ID NO: 64955 - protein, 9 aa, Homo Sapiens
SAPTVRPPR

SEQ ID NO: 64956 - protein, 9 aa, Homo Sapiens
VDAISSRHV

SEQ ID NO: 64957 - protein, 9 aa, Homo Sapiens
MKEKSILRC

SEQ ID NO: 64958 - protein, 9 aa, Homo Sapiens
FCETKDVFQ

SEQ ID NO: 64959 - protein, 9 aa, Homo Sapiens
CKRRRTSSK

SEQ ID NO: 64960 - protein, 9 aa, Homo Sapiens
QHSSLIDID

SEQ ID NO: 64961 - protein, 9 aa, Homo Sapiens
IFCETKDVF

SEQ ID NO: 64962 - protein, 9 aa, Homo Sapiens
MYRPVVSTD

SEQ ID NO: 64963 - protein, 9 aa, Homo Sapiens
SHCYRAALE

SEQ ID NO: 64964 - protein, 9 aa, Homo Sapiens
QFYVDAISS

SEQ ID NO: 64965 - protein, 9 aa, Homo Sapiens
PGACSDTSA

SEQ ID NO: 64966 - protein, 9 aa, Homo Sapiens
QRSALTSYL

SEQ ID NO: 64967 - protein, 9 aa, Homo Sapiens
QHQGMRILE

SEQ ID NO: 64968 - protein, 9 aa, Homo Sapiens
MLQEMQRQN

SEQ ID NO: 64969 - protein, 9 aa, Homo Sapiens
SQFLSCPGP

SEQ ID NO: 64970 - protein, 9 aa, Homo Sapiens
YASENDHRV

SEQ ID NO: 64971 - protein, 9 aa, Homo Sapiens
GRRRAREVV

SEQ ID NO: 64972 - protein, 9 aa, Homo Sapiens
QEMQRQNEQ

SEQ ID NO: 64973 - protein, 9 aa, Homo Sapiens
GVVTFLQSE

SEQ ID NO: 64974 - protein, 9 aa, Homo Sapiens
ILLVGRRRA

SEQ ID NO: 64975 - protein, 9 aa, Homo Sapiens
VGRRRAREV

SEQ ID NO: 64976 - protein, 9 aa, Homo Sapiens
KEVWQLKEL

SEQ ID NO: 64977 - protein, 9 aa, Homo Sapiens
LDQEGNRQH

SEQ ID NO: 64978 - protein, 9 aa, Homo Sapiens
NKGLQDALN

SEQ ID NO: 64979 - protein, 9 aa, Homo Sapiens
EEPYQMKEK

SEQ ID NO: 64980 - protein, 9 aa, Homo Sapiens
AGSITEYLP

SEQ ID NO: 64981 - protein, 9 aa, Homo Sapiens
PAAGPAQGP

SEQ ID NO: 64982 - protein, 9 aa, Homo Sapiens
RSSGHCDPD

SEQ ID NO: 64983 - protein, 9 aa, Homo Sapiens
GSECSKNRT

SEQ ID NO: 64984 - protein, 9 aa, Homo Sapiens
DSTPPPGTV

SEQ ID NO: 64985 - protein, 9 aa, Homo Sapiens
QGPAMLIPE

SEQ ID NO: 64986 - protein, 9 aa, Homo Sapiens
GVQPLGSRQ

SEQ ID NO: 64987 - protein, 9 aa, Homo Sapiens
GSGGPVQAP

SEQ ID NO: 64988 - protein, 9 aa, Homo Sapiens
QVEYALRKL

SEQ ID NO: 64989 - protein, 9 aa, Homo Sapiens
YALDQLSPD

SEQ ID NO: 64990 - protein, 9 aa, Homo Sapiens
CDPDVATML

SEQ ID NO: 64991 - protein, 9 aa, Homo Sapiens
QKENKIPKE

SEQ ID NO: 64992 - protein, 9 aa, Homo Sapiens
MEIFCETKD

SEQ ID NO: 64993 - protein, 9 aa, Homo Sapiens
PRTPQAREV

SEQ ID NO: 64994 - protein, 9 aa, Homo Sapiens
QDDLIQHQG

SEQ ID NO: 64995 - protein, 9 aa, Homo Sapiens
TSTCEFVTT

SEQ ID NO: 64996 - protein, 9 aa, Homo Sapiens
RRPVTVPPG

SEQ ID NO: 64997 - protein, 9 aa, Homo Sapiens
LSPDVQHKA

SEQ ID NO: 64998 - protein, 9 aa, Homo Sapiens
SPTGPSCPA

SEQ ID NO: 64999 - protein, 9 aa, Homo Sapiens
QKTSSCQHR

SEQ ID NO: 65000 - protein, 9 aa, Homo Sapiens
LERSSGHCD

SEQ ID NO: 65001 - protein, 9 aa, Homo Sapiens
EVPGVFSRS

SEQ ID NO: 65002 - protein, 9 aa, Homo Sapiens
FLQVPRSNH

SEQ ID NO: 65003 - protein, 9 aa, Homo Sapiens
QRRQKRKEY

SEQ ID NO: 65004 - protein, 9 aa, Homo Sapiens
DHRVFAGEL

SEQ ID NO: 65005 - protein, 9 aa, Homo Sapiens
MAIGGRPDP

SEQ ID NO: 65006 - protein, 9 aa, Homo Sapiens
SAFIAAQGS

SEQ ID NO: 65007 - protein, 9 aa, Homo Sapiens
GSNGSECSK

SEQ ID NO: 65008 - protein, 9 aa, Homo Sapiens
FDEHIGQLC

SEQ ID NO: 65009 - protein, 9 aa, Homo Sapiens
LCRRTSTHP

SEQ ID NO: 65010 - protein, 9 aa, Homo Sapiens
IQHQGMRIL

SEQ ID NO: 65011 - protein, 9 aa, Homo Sapiens
QHRLSSRGE

SEQ ID NO: 65012 - protein, 9 aa, Homo Sapiens
APAGRISGL

SEQ ID NO: 65013 - protein, 9 aa, Homo Sapiens
TVRPPRLPC

SEQ ID NO: 65014 - protein, 9 aa, Homo Sapiens
QAREVSAPC

SEQ ID NO: 65015 - protein, 9 aa, Homo Sapiens
LPMYRPVVS

SEQ ID NO: 65016 - protein, 9 aa, Homo Sapiens
RADFQYRQR

SEQ ID NO: 65017 - protein, 9 aa, Homo Sapiens
FIDLVYVKR

SEQ ID NO: 65018 - protein, 9 aa, Homo Sapiens
TQEEEDDTI

SEQ ID NO: 65019 - protein, 9 aa, Homo Sapiens
REGPHERGP

SEQ ID NO: 65020 - protein, 9 aa, Homo Sapiens
HPQGKDAPR

SEQ ID NO: 65021 - protein, 9 aa, Homo Sapiens
PYAYGMLDR

SEQ ID NO: 65022 - protein, 9 aa, Homo Sapiens
CTSAFWLSS

SEQ ID NO: 65023 - protein, 9 aa, Homo Sapiens
QEEEDDTIH

SEQ ID NO: 65024 - protein, 9 aa, Homo Sapiens
VNLLSIVMI

SEQ ID NO: 65025 - protein, 9 aa, Homo Sapiens
NTSTCEFVT

SEQ ID NO: 65026 - protein, 9 aa, Homo Sapiens
GPVQAPLPV

SEQ ID NO: 65027 - protein, 9 aa, Homo Sapiens
GSPYAYGML

SEQ ID NO: 65028 - protein, 9 aa, Homo Sapiens
PVTVPPGIR

SEQ ID NO: 65029 - protein, 9 aa, Homo Sapiens
TVRELAPRG

SEQ ID NO: 65030 - protein, 9 aa, Homo Sapiens
PSPLSDSYP

SEQ ID NO: 65031 - protein, 9 aa, Homo Sapiens
LVYVKRYEG

SEQ ID NO: 65032 - protein, 9 aa, Homo Sapiens
SSQFLSCPG

SEQ ID NO: 65033 - protein, 9 aa, Homo Sapiens
LRLARSLGP

SEQ ID NO: 65034 - protein, 9 aa, Homo Sapiens
LAPAGRISG

SEQ ID NO: 65035 - protein, 9 aa, Homo Sapiens
GGTLQGPAM

SEQ ID NO: 65036 - protein, 9 aa, Homo Sapiens
KMLQEMQRQ

SEQ ID NO: 65037 - protein, 9 aa, Homo Sapiens
QYRQRELDT

SEQ ID NO: 65038 - protein, 9 aa, Homo Sapiens
SCPAPRTPQ

SEQ ID NO: 65039 - protein, 9 aa, Homo Sapiens
LSCGGHEEL

SEQ ID NO: 65040 - protein, 9 aa, Homo Sapiens
LLLPLATLF

SEQ ID NO: 65041 - protein, 9 aa, Homo Sapiens
RQHSSLIDI

SEQ ID NO: 65042 - protein, 9 aa, Homo Sapiens
FHSPTGPSC

SEQ ID NO: 65043 - protein, 9 aa, Homo Sapiens
VWQLKELWD

SEQ ID NO: 65044 - protein, 9 aa, Homo Sapiens
CEIKRLNKG

SEQ ID NO: 65045 - protein, 9 aa, Homo Sapiens
VQAPLPVLS

SEQ ID NO: 65046 - protein, 9 aa, Homo Sapiens
LRSHCYRAA

SEQ ID NO: 65047 - protein, 9 aa, Homo Sapiens
TCEFVTTLN

SEQ ID NO: 65048 - protein, 9 aa, Homo Sapiens
DFIDLVYVK

SEQ ID NO: 65049 - protein, 9 aa, Homo Sapiens
SCQHRLSSR

SEQ ID NO: 65050 - protein, 9 aa, Homo Sapiens
LDKAENRGK

SEQ ID NO: 65051 - protein, 9 aa, Homo Sapiens
VIPCSGEGA

SEQ ID NO: 65052 - protein, 9 aa, Homo Sapiens
LDEDTVVAR

SEQ ID NO: 65053 - protein, 9 aa, Homo Sapiens
SENDHRVFA

SEQ ID NO: 65054 - protein, 9 aa, Homo Sapiens
ESPPSYQSV

SEQ ID NO: 65055 - protein, 9 aa, Homo Sapiens
MYQKTLGTV

SEQ ID NO: 65056 - protein, 9 aa, Homo Sapiens
IDSLQAFSL

SEQ ID NO: 65057 - protein, 9 aa, Homo Sapiens
YVADGNLCR

SEQ ID NO: 65058 - protein, 9 aa, Homo Sapiens
QPHGVPGDR

SEQ ID NO: 65059 - protein, 9 aa, Homo Sapiens
STPPPGTVR

SEQ ID NO: 65060 - protein, 9 aa, Homo Sapiens
RTRMMEIFC

SEQ ID NO: 65061 - protein, 9 aa, Homo Sapiens
SEQKENKIP

SEQ ID NO: 65062 - protein, 9 aa, Homo Sapiens
TGETMESFV

SEQ ID NO: 65063 - protein, 9 aa, Homo Sapiens
YVKRYEGNM

SEQ ID NO: 65064 - protein, 9 aa, Homo Sapiens
CRVCDQRHL

SEQ ID NO: 65065 - protein, 9 aa, Homo Sapiens
PAGRISGLC

SEQ ID NO: 65066 - protein, 9 aa, Homo Sapiens
QAVRATVTH

SEQ ID NO: 65067 - protein, 9 aa, Homo Sapiens
STVCCMHLH

SEQ ID NO: 65068 - protein, 9 aa, Homo Sapiens
QLCTDWQKA

SEQ ID NO: 65069 - protein, 9 aa, Homo Sapiens
ALDQLSPDV

SEQ ID NO: 65070 - protein, 9 aa, Homo Sapiens
EIFCETKDV

SEQ ID NO: 65071 - protein, 9 aa, Homo Sapiens
EHIGQLCTD

SEQ ID NO: 65072 - protein, 9 aa, Homo Sapiens
PQLLCWPLH

SEQ ID NO: 65073 - protein, 9 aa, Homo Sapiens
LEEIEILLR

SEQ ID NO: 65074 - protein, 9 aa, Homo Sapiens
KDWSNKMPD

SEQ ID NO: 65075 - protein, 9 aa, Homo Sapiens
PSCPAPRTP

SEQ ID NO: 65076 - protein, 9 aa, Homo Sapiens
VKAGRKPRA

SEQ ID NO: 65077 - protein, 9 aa, Homo Sapiens
TLDTQEEED

SEQ ID NO: 65078 - protein, 9 aa, Homo Sapiens
LIQHQGMRI

SEQ ID NO: 65079 - protein, 9 aa, Homo Sapiens
LSKKFEKIN

SEQ ID NO: 65080 - protein, 9 aa, Homo Sapiens
KNSPALTGN

SEQ ID NO: 65081 - protein, 9 aa, Homo Sapiens
RKEVWQLKE

SEQ ID NO: 65082 - protein, 9 aa, Homo Sapiens
MLDRGYRYD

SEQ ID NO: 65083 - protein, 9 aa, Homo Sapiens
SSGSTSTCE

SEQ ID NO: 65084 - protein, 9 aa, Homo Sapiens
LVDLFNNQY

SEQ ID NO: 65085 - protein, 9 aa, Homo Sapiens
SSSRHCKRR

SEQ ID NO: 65086 - protein, 9 aa, Homo Sapiens
ATRGISLDS

SEQ ID NO: 65087 - protein, 9 aa, Homo Sapiens
QIPDAGALT

SEQ ID NO: 65088 - protein, 9 aa, Homo Sapiens
VHHFLCDIP

SEQ ID NO: 65089 - protein, 9 aa, Homo Sapiens
RLARSLGPP

SEQ ID NO: 65090 - protein, 9 aa, Homo Sapiens
KINEGRMPG

SEQ ID NO: 65091 - protein, 9 aa, Homo Sapiens
QPQLLCWPL

SEQ ID NO: 65092 - protein, 9 aa, Homo Sapiens
ANSAFIAAQ

SEQ ID NO: 65093 - protein, 9 aa, Homo Sapiens
CVGHPQGKD

SEQ ID NO: 65094 - protein, 9 aa, Homo Sapiens
RAMTPLQVH

SEQ ID NO: 65095 - protein, 9 aa, Homo Sapiens
EFVTTLNGH

SEQ ID NO: 65096 - protein, 9 aa, Homo Sapiens
SQRPSPLSD

SEQ ID NO: 65097 - protein, 9 aa, Homo Sapiens
RRSQAVRAT

SEQ ID NO: 65098 - protein, 9 aa, Homo Sapiens
LRQCRKEVW

SEQ ID NO: 65099 - protein, 9 aa, Homo Sapiens
AEETPRYSN

SEQ ID NO: 65100 - protein, 9 aa, Homo Sapiens
QAPAPAAGP

SEQ ID NO: 65101 - protein, 9 aa, Homo Sapiens
HIGQLCTDW

SEQ ID NO: 65102 - protein, 9 aa, Homo Sapiens
FQYRQRELD

SEQ ID NO: 65103 - protein, 9 aa, Homo Sapiens
LDTQEEEDD

SEQ ID NO: 65104 - protein, 9 aa, Homo Sapiens
LAPRGVVTF

SEQ ID NO: 65105 - protein, 9 aa, Homo Sapiens
DPDVATMLN

SEQ ID NO: 65106 - protein, 9 aa, Homo Sapiens
WPLHRLTHR

SEQ ID NO: 65107 - protein, 9 aa, Homo Sapiens
GHPQGKDAP

SEQ ID NO: 65108 - protein, 9 aa, Homo Sapiens
DEEEDFLHD

SEQ ID NO: 65109 - protein, 9 aa, Homo Sapiens
AAEETPRYS

SEQ ID NO: 65110 - protein, 9 aa, Homo Sapiens
SGVQGPAVW

SEQ ID NO: 65111 - protein, 9 aa, Homo Sapiens
RKPRAALQR

SEQ ID NO: 65112 - protein, 9 aa, Homo Sapiens
ELAPRGVVT

SEQ ID NO: 65113 - protein, 9 aa, Homo Sapiens
PGHCCTGAC

SEQ ID NO: 65114 - protein, 9 aa, Homo Sapiens
GTVIAGDTS

SEQ ID NO: 65115 - protein, 9 aa, Homo Sapiens
GLLGSGLPL

SEQ ID NO: 65116 - protein, 9 aa, Homo Sapiens
KSNEVHHFL

SEQ ID NO: 65117 - protein, 9 aa, Homo Sapiens
PTVRPPRLP

SEQ ID NO: 65118 - protein, 9 aa, Homo Sapiens
PRSNHLHFQ

SEQ ID NO: 65119 - protein, 9 aa, Homo Sapiens
EGNRQHSSL

SEQ ID NO: 65120 - protein, 9 aa, Homo Sapiens
SGPSELLLL

SEQ ID NO: 65121 - protein, 9 aa, Homo Sapiens
TTNELRVNL

SEQ ID NO: 65122 - protein, 9 aa, Homo Sapiens
LLPGLGVYL

SEQ ID NO: 65123 - protein, 9 aa, Homo Sapiens
LGSRQRETG

SEQ ID NO: 65124 - protein, 9 aa, Homo Sapiens
RSGLVNLLS

SEQ ID NO: 65125 - protein, 9 aa, Homo Sapiens
KGLQDALNI

SEQ ID NO: 65126 - protein, 9 aa, Homo Sapiens
QEEGSGGPV

SEQ ID NO: 65127 - protein, 9 aa, Homo Sapiens
APCTSAFWL

SEQ ID NO: 65128 - protein, 9 aa, Homo Sapiens
TPRYSNYNT

SEQ ID NO: 65129 - protein, 9 aa, Homo Sapiens
REEVPGVFS

SEQ ID NO: 65130 - protein, 9 aa, Homo Sapiens
ERADFQYRQ

SEQ ID NO: 65131 - protein, 9 aa, Homo Sapiens
LLVGRRRAR

SEQ ID NO: 65132 - protein, 9 aa, Homo Sapiens
RELAPRGVV

SEQ ID NO: 65133 - protein, 9 aa, Homo Sapiens
NSQRATFIK

SEQ ID NO: 65134 - protein, 9 aa, Homo Sapiens
RGVVTFLQS

SEQ ID NO: 65135 - protein, 9 aa, Homo Sapiens
QGSFDGSSS

SEQ ID NO: 65136 - protein, 9 aa, Homo Sapiens
GLPLSLCRR

SEQ ID NO: 65137 - protein, 9 aa, Homo Sapiens
QRQNEQMME

SEQ ID NO: 65138 - protein, 9 aa, Homo Sapiens
RTNFRLWSP

SEQ ID NO: 65139 - protein, 9 aa, Homo Sapiens
NSYWMQSHS

SEQ ID NO: 65140 - protein, 9 aa, Homo Sapiens
LGTVIAGDT

SEQ ID NO: 65141 - protein, 9 aa, Homo Sapiens
IKDWSNKMP

SEQ ID NO: 65142 - protein, 9 aa, Homo Sapiens
RSWRRSQAV

SEQ ID NO: 65143 - protein, 9 aa, Homo Sapiens
LIHSASVKA

SEQ ID NO: 65144 - protein, 9 aa, Homo Sapiens
HLHVAEPNA

SEQ ID NO: 65145 - protein, 9 aa, Homo Sapiens
KRLNKGLQD

SEQ ID NO: 65146 - protein, 9 aa, Homo Sapiens
EETTNELRV

SEQ ID NO: 65147 - protein, 9 aa, Homo Sapiens
VARLEDQCT

SEQ ID NO: 65148 - protein, 9 aa, Homo Sapiens
QLDELLTKH

SEQ ID NO: 65149 - protein, 9 aa, Homo Sapiens
EYLPPEVPA

SEQ ID NO: 65150 - protein, 9 aa, Homo Sapiens
TPKLITDSY

SEQ ID NO: 65151 - protein, 9 aa, Homo Sapiens
GFVCELCKE

SEQ ID NO: 65152 - protein, 9 aa, Homo Sapiens
RVFAGELEV

SEQ ID NO: 65153 - protein, 9 aa, Homo Sapiens
VSVRLLPGL

SEQ ID NO: 65154 - protein, 9 aa, Homo Sapiens
SALTSYLRV

SEQ ID NO: 65155 - protein, 9 aa, Homo Sapiens
LGPPGHCCT

SEQ ID NO: 65156 - protein, 9 aa, Homo Sapiens
GHCDPDVAT

SEQ ID NO: 65157 - protein, 9 aa, Homo Sapiens
DLGLLYIRL

SEQ ID NO: 65158 - protein, 9 aa, Homo Sapiens
IILVDLFNN

SEQ ID NO: 65159 - protein, 9 aa, Homo Sapiens
MAKNSPALT

SEQ ID NO: 65160 - protein, 9 aa, Homo Sapiens
AIGGRPDPE

SEQ ID NO: 65161 - protein, 9 aa, Homo Sapiens
SKKFEKINE

SEQ ID NO: 65162 - protein, 9 aa, Homo Sapiens
KTSSCQHRL

SEQ ID NO: 65163 - protein, 9 aa, Homo Sapiens
ASGPSELLL

SEQ ID NO: 65164 - protein, 9 aa, Homo Sapiens
FLHDSTVNP

SEQ ID NO: 65165 - protein, 9 aa, Homo Sapiens
VQGPAVWGL

SEQ ID NO: 65166 - protein, 9 aa, Homo Sapiens
VKRYEGNMN

SEQ ID NO: 65167 - protein, 9 aa, Homo Sapiens
EEGSGGPVQ

SEQ ID NO: 65168 - protein, 9 aa, Homo Sapiens
LHVAEPNAV

SEQ ID NO: 65169 - protein, 9 aa, Homo Sapiens
LSSGSTSTC

SEQ ID NO: 65170 - protein, 9 aa, Homo Sapiens
STATRGISL

SEQ ID NO: 65171 - protein, 9 aa, Homo Sapiens
AAGSLTKYS

SEQ ID NO: 65172 - protein, 9 aa, Homo Sapiens
FHPQGSLPM

SEQ ID NO: 65173 - protein, 9 aa, Homo Sapiens
VSAPCTSAF

SEQ ID NO: 65174 - protein, 9 aa, Homo Sapiens
SQPSQNQGL

SEQ ID NO: 65175 - protein, 9 aa, Homo Sapiens
ALRKLMSLI

SEQ ID NO: 65176 - protein, 9 aa, Homo Sapiens
GSSQFLSCP

SEQ ID NO: 65177 - protein, 9 aa, Homo Sapiens
RMMEIFCET

SEQ ID NO: 65178 - protein, 9 aa, Homo Sapiens
VRELAPRGV

SEQ ID NO: 65179 - protein, 9 aa, Homo Sapiens
LTHRLRLAR

SEQ ID NO: 65180 - protein, 9 aa, Homo Sapiens
DTQEEEDDT

SEQ ID NO: 65181 - protein, 9 aa, Homo Sapiens
AIRGIATDE

SEQ ID NO: 65182 - protein, 9 aa, Homo Sapiens
NRGKLEKLQ

SEQ ID NO: 65183 - protein, 9 aa, Homo Sapiens
PPGTVRAMA

SEQ ID NO: 65184 - protein, 9 aa, Homo Sapiens
LTASGPSEL

SEQ ID NO: 65185 - protein, 9 aa, Homo Sapiens
SGAGISCTS

SEQ ID NO: 65186 - protein, 9 aa, Homo Sapiens
LQEMQRQNE

SEQ ID NO: 65187 - protein, 9 aa, Homo Sapiens
ETPRYSNYN

SEQ ID NO: 65188 - protein, 9 aa, Homo Sapiens
AISSRHVSA

SEQ ID NO: 65189 - protein, 9 aa, Homo Sapiens
LISNSKDRT

SEQ ID NO: 65190 - protein, 9 aa, Homo Sapiens
RGISLDSEL

SEQ ID NO: 65191 - protein, 9 aa, Homo Sapiens
PFQSHMSQA

SEQ ID NO: 65192 - protein, 9 aa, Homo Sapiens
QEIEKENKT

SEQ ID NO: 65193 - protein, 9 aa, Homo Sapiens
CFHSPTGPS

SEQ ID NO: 65194 - protein, 9 aa, Homo Sapiens
HFLCDIPAV

SEQ ID NO: 65195 - protein, 9 aa, Homo Sapiens
QQPQLLCWP

SEQ ID NO: 65196 - protein, 9 aa, Homo Sapiens
YVRRHTAGG

SEQ ID NO: 65197 - protein, 9 aa, Homo Sapiens
RAALQRVHL

SEQ ID NO: 65198 - protein, 9 aa, Homo Sapiens
KLITDSYSM

SEQ ID NO: 65199 - protein, 9 aa, Homo Sapiens
FRLWSPFQS

SEQ ID NO: 65200 - protein, 9 aa, Homo Sapiens
RPSPLSDSY

SEQ ID NO: 65201 - protein, 9 aa, Homo Sapiens
GMRILELTP

SEQ ID NO: 65202 - protein, 9 aa, Homo Sapiens
TYVRRHTAG

SEQ ID NO: 65203 - protein, 9 aa, Homo Sapiens
PLDKAENRG

SEQ ID NO: 65204 - protein, 9 aa, Homo Sapiens
WQLKELWDT

SEQ ID NO: 65205 - protein, 9 aa, Homo Sapiens
CETKDVFQL

SEQ ID NO: 65206 - protein, 9 aa, Homo Sapiens
YLISNSKDR

SEQ ID NO: 65207 - protein, 9 aa, Homo Sapiens
LARSLGPPG

SEQ ID NO: 65208 - protein, 9 aa, Homo Sapiens
WSPFQSHMS

SEQ ID NO: 65209 - protein, 9 aa, Homo Sapiens
ARQRRQKRK

SEQ ID NO: 65210 - protein, 9 aa, Homo Sapiens
DEDTVVARL

SEQ ID NO: 65211 - protein, 9 aa, Homo Sapiens
FLSCPGPAS

SEQ ID NO: 65212 - protein, 9 aa, Homo Sapiens
RGIATDEKM

SEQ ID NO: 65213 - protein, 9 aa, Homo Sapiens
PKEEPYQMK

SEQ ID NO: 65214 - protein, 9 aa, Homo Sapiens
DIQCADRLG

SEQ ID NO: 65215 - protein, 9 aa, Homo Sapiens
EKINEGRMP

SEQ ID NO: 65216 - protein, 9 aa, Homo Sapiens
EDTVVARLE

SEQ ID NO: 65217 - protein, 9 aa, Homo Sapiens
KHRMTWDPA

SEQ ID NO: 65218 - protein, 9 aa, Homo Sapiens
PLATLFPMY

SEQ ID NO: 65219 - protein, 9 aa, Homo Sapiens
TSTVCCMHL

SEQ ID NO: 65220 - protein, 9 aa, Homo Sapiens
EQKENKIPK

SEQ ID NO: 65221 - protein, 9 aa, Homo Sapiens
SYLRVHTGE

SEQ ID NO: 65222 - protein, 9 aa, Homo Sapiens
IGQLCTDWQ

SEQ ID NO: 65223 - protein, 9 aa, Homo Sapiens
HRLSSRGEP

SEQ ID NO: 65224 - protein, 9 aa, Homo Sapiens
GRPDPEKDP

SEQ ID NO: 65225 - protein, 9 aa, Homo Sapiens
RQRETGQGP

SEQ ID NO: 65226 - protein, 9 aa, Homo Sapiens
SGHCDPDVA

SEQ ID NO: 65227 - protein, 9 aa, Homo Sapiens
YALRKLMSL

SEQ ID NO: 65228 - protein, 9 aa, Homo Sapiens
CDQLADRQS

SEQ ID NO: 65229 - protein, 9 aa, Homo Sapiens
HLKGLPVES

SEQ ID NO: 65230 - protein, 9 aa, Homo Sapiens
VVTVQYSDL

SEQ ID NO: 65231 - protein, 9 aa, Homo Sapiens
PPRLPCGGN

SEQ ID NO: 65232 - protein, 9 aa, Homo Sapiens
ADFQYRQRE

SEQ ID NO: 65233 - protein, 9 aa, Homo Sapiens
QEGNRQHSS

SEQ ID NO: 65234 - protein, 9 aa, Homo Sapiens
ADRLGHDAT

SEQ ID NO: 65235 - protein, 9 aa, Homo Sapiens
NQYFEDNVT

SEQ ID NO: 65236 - protein, 9 aa, Homo Sapiens
TRMMEIFCE

SEQ ID NO: 65237 - protein, 9 aa, Homo Sapiens
SSSSRHCKR

SEQ ID NO: 65238 - protein, 9 aa, Homo Sapiens
GMLDRGYRY

SEQ ID NO: 65239 - protein, 9 aa, Homo Sapiens
PDAGALTVP

SEQ ID NO: 65240 - protein, 9 aa, Homo Sapiens
DGNHRYRGF

SEQ ID NO: 65241 - protein, 9 aa, Homo Sapiens
NSKDRTIKL

SEQ ID NO: 65242 - protein, 9 aa, Homo Sapiens
GNLCRRTST

SEQ ID NO: 65243 - protein, 9 aa, Homo Sapiens
EEDFLHDST

SEQ ID NO: 65244 - protein, 9 aa, Homo Sapiens
QRVHLSCGG

SEQ ID NO: 65245 - protein, 9 aa, Homo Sapiens
LTSYLRVHT

SEQ ID NO: 65246 - protein, 9 aa, Homo Sapiens
STEQRGRRR

SEQ ID NO: 65247 - protein, 9 aa, Homo Sapiens
GIATDEKML

SEQ ID NO: 65248 - protein, 9 aa, Homo Sapiens
AEPNAVFAK

SEQ ID NO: 65249 - protein, 9 aa, Homo Sapiens
DSYPCTLRQ

SEQ ID NO: 65250 - protein, 9 aa, Homo Sapiens
ELSGGPRQQ

SEQ ID NO: 65251 - protein, 9 aa, Homo Sapiens
TRILLVGRR

SEQ ID NO: 65252 - protein, 9 aa, Homo Sapiens
PPGHCCTGA

SEQ ID NO: 65253 - protein, 9 aa, Homo Sapiens
EIKRLNKGL

SEQ ID NO: 65254 - protein, 9 aa, Homo Sapiens
RQRELDTIE

SEQ ID NO: 65255 - protein, 9 aa, Homo Sapiens
RPVTVPPGI

SEQ ID NO: 65256 - protein, 9 aa, Homo Sapiens
NGSECSKNR

SEQ ID NO: 65257 - protein, 9 aa, Homo Sapiens
TVPPGIRPQ

SEQ ID NO: 65258 - protein, 9 aa, Homo Sapiens
SGGPRQQPQ

SEQ ID NO: 65259 - protein, 9 aa, Homo Sapiens
GLRSHCYRA

SEQ ID NO: 65260 - protein, 9 aa, Homo Sapiens
LHDSTVNPS

SEQ ID NO: 65261 - protein, 9 aa, Homo Sapiens
CQHRLSSRG

SEQ ID NO: 65262 - protein, 9 aa, Homo Sapiens
LDLRSGLVN

SEQ ID NO: 65263 - protein, 9 aa, Homo Sapiens
PAAAEETPR

SEQ ID NO: 65264 - protein, 9 aa, Homo Sapiens
AYGMLDRGY

SEQ ID NO: 65265 - protein, 9 aa, Homo Sapiens
LLGSGLPLS

SEQ ID NO: 65266 - protein, 9 aa, Homo Sapiens
QYSDLGLLY

SEQ ID NO: 65267 - protein, 9 aa, Homo Sapiens
LLPLATLFP

SEQ ID NO: 65268 - protein, 9 aa, Homo Sapiens
LAGSITEYL

SEQ ID NO: 65269 - protein, 9 aa, Homo Sapiens
HRLRLARSL

SEQ ID NO: 65270 - protein, 9 aa, Homo Sapiens
GTVRAMAIY

SEQ ID NO: 65271 - protein, 9 aa, Homo Sapiens
GTYVRRHTA

SEQ ID NO: 65272 - protein, 9 aa, Homo Sapiens
QRGRRRQVQ

SEQ ID NO: 65273 - protein, 9 aa, Homo Sapiens
LSCPGPASS

SEQ ID NO: 65274 - protein, 9 aa, Homo Sapiens
NKIPKEKTV

SEQ ID NO: 65275 - protein, 9 aa, Homo Sapiens
GPRQQPQLL

SEQ ID NO: 65276 - protein, 9 aa, Homo Sapiens
HCKRRRTSS

SEQ ID NO: 65277 - protein, 9 aa, Homo Sapiens
SELLLLPLA

SEQ ID NO: 65278 - protein, 9 aa, Homo Sapiens
CWPLHRLTH

SEQ ID NO: 65279 - protein, 9 aa, Homo Sapiens
GACSDTSAH

SEQ ID NO: 65280 - protein, 9 aa, Homo Sapiens
LRMMRAMTP

SEQ ID NO: 65281 - protein, 9 aa, Homo Sapiens
WMQSHSHSG

SEQ ID NO: 65282 - protein, 9 aa, Homo Sapiens
EELSGGPRQ

SEQ ID NO: 65283 - protein, 9 aa, Homo Sapiens
HTSTVCCMH

SEQ ID NO: 65284 - protein, 9 aa, Homo Sapiens
VTDGNHRYR

SEQ ID NO: 65285 - protein, 9 aa, Homo Sapiens
DGNLCRRTS

SEQ ID NO: 65286 - protein, 9 aa, Homo Sapiens
YAYGMLDRG

SEQ ID NO: 65287 - protein, 9 aa, Homo Sapiens
LQGPAMLIP

SEQ ID NO: 65288 - protein, 9 aa, Homo Sapiens
KGQACRVCD

SEQ ID NO: 65289 - protein, 9 aa, Homo Sapiens
LNKGLQDAL

SEQ ID NO: 65290 - protein, 9 aa, Homo Sapiens
YGMLDRGYR

SEQ ID NO: 65291 - protein, 9 aa, Homo Sapiens
FFSITGETM

SEQ ID NO: 65292 - protein, 9 aa, Homo Sapiens
AMAIGGRPD

SEQ ID NO: 65293 - protein, 9 aa, Homo Sapiens
SNGSECSKN

SEQ ID NO: 65294 - protein, 9 aa, Homo Sapiens
RRHTAGGGP

SEQ ID NO: 65295 - protein, 9 aa, Homo Sapiens
SNSKDRTIK

SEQ ID NO: 65296 - protein, 9 aa, Homo Sapiens
YLPPEVPAR

SEQ ID NO: 65297 - protein, 9 aa, Homo Sapiens
RPPRLPCGG

SEQ ID NO: 65298 - protein, 9 aa, Homo Sapiens
TNFRLWSPF

SEQ ID NO: 65299 - protein, 9 aa, Homo Sapiens
PKEKTVQHQ

SEQ ID NO: 65300 - protein, 9 aa, Homo Sapiens
LRKLMSLIQ

SEQ ID NO: 65301 - protein, 9 aa, Homo Sapiens
TATRGISLD

SEQ ID NO: 65302 - protein, 9 aa, Homo Sapiens
KDAPRLPPT

SEQ ID NO: 65303 - protein, 9 aa, Homo Sapiens
VESPPSYQS

SEQ ID NO: 65304 - protein, 9 aa, Homo Sapiens
PAPAAGPAQ

SEQ ID NO: 65305 - protein, 9 aa, Homo Sapiens
LTKYSNRYY

SEQ ID NO: 65306 - protein, 9 aa, Homo Sapiens
SQRATFIKD

SEQ ID NO: 65307 - protein, 9 aa, Homo Sapiens
QTRILLVGR

SEQ ID NO: 65308 - protein, 9 aa, Homo Sapiens
STSTCECSA

SEQ ID NO: 65309 - protein, 9 aa, Homo Sapiens
TSTCECSAN

SEQ ID NO: 65310 - protein, 9 aa, Homo Sapiens
SITGETMES

SEQ ID NO: 65311 - protein, 9 aa, Homo Sapiens
TPPPGTVRA

SEQ ID NO: 65312 - protein, 9 aa, Homo Sapiens
PMYRPVVST

SEQ ID NO: 65313 - protein, 9 aa, Homo Sapiens
VIKSTATRG

SEQ ID NO: 65314 - protein, 9 aa, Homo Sapiens
GLPVESPPS

SEQ ID NO: 65315 - protein, 9 aa, Homo Sapiens
PLEEIEILL

SEQ ID NO: 65316 - protein, 9 aa, Homo Sapiens
DELLTKHRM

SEQ ID NO: 65317 - protein, 9 aa, Homo Sapiens
SAFWLSSGS

SEQ ID NO: 65318 - protein, 9 aa, Homo Sapiens
KYSNRYYSN

SEQ ID NO: 65319 - protein, 9 aa, Homo Sapiens
AFDEHIGQL

SEQ ID NO: 65320 - protein, 9 aa, Homo Sapiens
LLLNSCPGA

SEQ ID NO: 65321 - protein, 9 aa, Homo Sapiens
DQLADRQSP

SEQ ID NO: 65322 - protein, 9 aa, Homo Sapiens
SLPMYRPVV

SEQ ID NO: 65323 - protein, 9 aa, Homo Sapiens
PRGVVTFLQ

SEQ ID NO: 65324 - protein, 9 aa, Homo Sapiens
ELCKEGDVL

SEQ ID NO: 65325 - protein, 9 aa, Homo Sapiens
RHTAGGGPG

SEQ ID NO: 65326 - protein, 9 aa, Homo Sapiens
AGISCTSTR

SEQ ID NO: 65327 - protein, 9 aa, Homo Sapiens
TVIAGDTSG

SEQ ID NO: 65328 - protein, 9 aa, Homo Sapiens
GRKPRAALQ

SEQ ID NO: 65329 - protein, 9 aa, Homo Sapiens
KTLGTVIAG

SEQ ID NO: 65330 - protein, 9 aa, Homo Sapiens
HGVPGDREG

SEQ ID NO: 65331 - protein, 9 aa, Homo Sapiens
YQKTLGTVI

SEQ ID NO: 65332 - protein, 9 aa, Homo Sapiens
SWRRSQAVR

SEQ ID NO: 65333 - protein, 9 aa, Homo Sapiens
GGPVQAPLP

SEQ ID NO: 65334 - protein, 9 aa, Homo Sapiens
GPSCPAPRT

SEQ ID NO: 65335 - protein, 9 aa, Homo Sapiens
NSCPGACSD

SEQ ID NO: 65336 - protein, 9 aa, Homo Sapiens
WRRSQAVRA

SEQ ID NO: 65337 - protein, 9 aa, Homo Sapiens
RQARQRRQK

SEQ ID NO: 65338 - protein, 9 aa, Homo Sapiens
IPCSGEGAI

SEQ ID NO: 65339 - protein, 9 aa, Homo Sapiens
RGPGGTLQG

SEQ ID NO: 65340 - protein, 9 aa, Homo Sapiens
NRQHSSLID

SEQ ID NO: 65341 - protein, 9 aa, Homo Sapiens
RPDPEKDPS

SEQ ID NO: 65342 - protein, 9 aa, Homo Sapiens
TQRSALTSY

SEQ ID NO: 65343 - protein, 9 aa, Homo Sapiens
QGKDAPRLP

SEQ ID NO: 65344 - protein, 9 aa, Homo Sapiens
RRQKRKEYC

SEQ ID NO: 65345 - protein, 9 aa, Homo Sapiens
DLRSGLVNL

SEQ ID NO: 65346 - protein, 9 aa, Homo Sapiens
VPGVFSRSV

SEQ ID NO: 65347 - protein, 9 aa, Homo Sapiens
ELLTKHRMT

SEQ ID NO: 65348 - protein, 9 aa, Homo Sapiens
DSLQAFSLD

SEQ ID NO: 65349 - protein, 9 aa, Homo Sapiens
TKHRMTWDP

SEQ ID NO: 65350 - protein, 9 aa, Homo Sapiens
ADRQSPVIE

SEQ ID NO: 65351 - protein, 9 aa, Homo Sapiens
REVSAPCTS

SEQ ID NO: 65352 - protein, 9 aa, Homo Sapiens
KEEPYQMKE

SEQ ID NO: 65353 - protein, 9 aa, Homo Sapiens
SYWMQSHSH

SEQ ID NO: 65354 - protein, 9 aa, Homo Sapiens
GHCCTGACW

SEQ ID NO: 65355 - protein, 9 aa, Homo Sapiens
KPRAALQRV

SEQ ID NO: 65356 - protein, 9 aa, Homo Sapiens
NSAFIAAQG

SEQ ID NO: 65357 - protein, 9 aa, Homo Sapiens
VPGDREGPH

SEQ ID NO: 65358 - protein, 9 aa, Homo Sapiens
IDKSKRDPL

SEQ ID NO: 65359 - protein, 9 aa, Homo Sapiens
LSSASTGHA

SEQ ID NO: 65360 - protein, 9 aa, Homo Sapiens
DLFNNQYFE

SEQ ID NO: 65361 - protein, 9 aa, Homo Sapiens
DNIKSSQPS

SEQ ID NO: 65362 - protein, 9 aa, Homo Sapiens
LVNLLSIVM

SEQ ID NO: 65363 - protein, 9 aa, Homo Sapiens
LMFVKLVIP

SEQ ID NO: 65364 - protein, 9 aa, Homo Sapiens
FIKDWSNKM

SEQ ID NO: 65365 - protein, 9 aa, Homo Sapiens
AREVSAPCT

SEQ ID NO: 65366 - protein, 9 aa, Homo Sapiens
LPLATLFPM

SEQ ID NO: 65367 - protein, 9 aa, Homo Sapiens
GAGISCTST

SEQ ID NO: 65368 - protein, 9 aa, Homo Sapiens
ATDEKMLIS

SEQ ID NO: 65369 - protein, 9 aa, Homo Sapiens
AGSLTKYSN

SEQ ID NO: 65370 - protein, 9 aa, Homo Sapiens
YGHTSTVCC

SEQ ID NO: 65371 - protein, 9 aa, Homo Sapiens
ETTNELRVN

SEQ ID NO: 65372 - protein, 9 aa, Homo Sapiens
KDIQCADRL

SEQ ID NO: 65373 - protein, 9 aa, Homo Sapiens
LGVYLSLYT

SEQ ID NO: 65374 - protein, 9 aa, Homo Sapiens
LREEVPGVF

SEQ ID NO: 65375 - protein, 9 aa, Homo Sapiens
VDLFNNQYF

SEQ ID NO: 65376 - protein, 9 aa, Homo Sapiens
CCMHLHEKR

SEQ ID NO: 65377 - protein, 9 aa, Homo Sapiens
QAFSLDCRC

SEQ ID NO: 65378 - protein, 9 aa, Homo Sapiens
LGSGLPLSL

SEQ ID NO: 65379 - protein, 9 aa, Homo Sapiens
KLVIPCSGE

SEQ ID NO: 65380 - protein, 9 aa, Homo Sapiens
RVCDQRHLN

SEQ ID NO: 65381 - protein, 9 aa, Homo Sapiens
IRQEIEKEN

SEQ ID NO: 65382 - protein, 9 aa, Homo Sapiens
RLSKKFEKI

SEQ ID NO: 65383 - protein, 9 aa, Homo Sapiens
RLWSPFQSH

SEQ ID NO: 65384 - protein, 9 aa, Homo Sapiens
YDLRMMRAM

SEQ ID NO: 65385 - protein, 9 aa, Homo Sapiens
LCDIPAVMV

SEQ ID NO: 65386 - protein, 9 aa, Homo Sapiens
HDSTVNPSK

SEQ ID NO: 65387 - protein, 9 aa, Homo Sapiens
LCWPLHRLT

SEQ ID NO: 65388 - protein, 9 aa, Homo Sapiens
LQAFSLDCR

SEQ ID NO: 65389 - protein, 9 aa, Homo Sapiens
EQEETTNEL

SEQ ID NO: 65390 - protein, 9 aa, Homo Sapiens
PVQAPLPVL

SEQ ID NO: 65391 - protein, 9 aa, Homo Sapiens
PRQQPQLLC

SEQ ID NO: 65392 - protein, 9 aa, Homo Sapiens
DQLSPDVQH

SEQ ID NO: 65393 - protein, 9 aa, Homo Sapiens
RQQPQLLCW

SEQ ID NO: 65394 - protein, 9 aa, Homo Sapiens
LHRLTHRLR

SEQ ID NO: 65395 - protein, 9 aa, Homo Sapiens
RLHFVTDGN

SEQ ID NO: 65396 - protein, 9 aa, Homo Sapiens
KDRTIKLWD

SEQ ID NO: 65397 - protein, 9 aa, Homo Sapiens
ITGETMESF

SEQ ID NO: 65398 - protein, 9 aa, Homo Sapiens
LNSYWMQSH

SEQ ID NO: 65399 - protein, 9 aa, Homo Sapiens
EKENKTEPW

SEQ ID NO: 65400 - protein, 9 aa, Homo Sapiens
ALTASGPSE

SEQ ID NO: 65401 - protein, 9 aa, Homo Sapiens
MMEIFCETK

SEQ ID NO: 65402 - protein, 9 aa, Homo Sapiens
KEQEETTNE

SEQ ID NO: 65403 - protein, 9 aa, Homo Sapiens
KSSQPSQNQ

SEQ ID NO: 65404 - protein, 9 aa, Homo Sapiens
HTAGGGPGQ

SEQ ID NO: 65405 - protein, 9 aa, Homo Sapiens
DAPRLPPTL

SEQ ID NO: 65406 - protein, 9 aa, Homo Sapiens
ELLLLPLAT

SEQ ID NO: 65407 - protein, 9 aa, Homo Sapiens
SLSSASTGH

SEQ ID NO: 65408 - protein, 9 aa, Homo Sapiens
QLLCWPLHR

SEQ ID NO: 65409 - protein, 9 aa, Homo Sapiens
EIEKENKTE

SEQ ID NO: 65410 - protein, 9 aa, Homo Sapiens
KIPKEKTVQ

SEQ ID NO: 65411 - protein, 9 aa, Homo Sapiens
LNSCPGACS

SEQ ID NO: 65412 - protein, 9 aa, Homo Sapiens
RALIHSASV

SEQ ID NO: 65413 - protein, 9 aa, Homo Sapiens
VPPGIRPQS

SEQ ID NO: 65414 - protein, 9 aa, Homo Sapiens
DEAMAIGGR

SEQ ID NO: 65415 - protein, 9 aa, Homo Sapiens
SANALTASG

SEQ ID NO: 65416 - protein, 9 aa, Homo Sapiens
LATLFPMYT

SEQ ID NO: 65417 - protein, 9 aa, Homo Sapiens
EVHHFLCDI

SEQ ID NO: 65418 - protein, 9 aa, Homo Sapiens
GSLPMYRPV

SEQ ID NO: 65419 - protein, 9 aa, Homo Sapiens
MTPLQVHVD

SEQ ID NO: 65420 - protein, 9 aa, Homo Sapiens
LITDSYSMD

SEQ ID NO: 65421 - protein, 9 aa, Homo Sapiens
RSALTSYLR

SEQ ID NO: 65422 - protein, 9 aa, Homo Sapiens
LWSPFQSHM

SEQ ID NO: 65423 - protein, 9 aa, Homo Sapiens
AFWLSSGST

SEQ ID NO: 65424 - protein, 9 aa, Homo Sapiens
SITEYLPPE

SEQ ID NO: 65425 - protein, 9 aa, Homo Sapiens
KAIRGIATD

SEQ ID NO: 65426 - protein, 9 aa, Homo Sapiens
ITDSYSMDV

SEQ ID NO: 65427 - protein, 9 aa, Homo Sapiens
RLNKGLQDA

SEQ ID NO: 65428 - protein, 9 aa, Homo Sapiens
GETMESFVK

SEQ ID NO: 65429 - protein, 9 aa, Homo Sapiens
FWLSSGSTS

SEQ ID NO: 65430 - protein, 9 aa, Homo Sapiens
ETMESFVKS

SEQ ID NO: 65431 - protein, 9 aa, Homo Sapiens
CVKAGRKPR

SEQ ID NO: 65432 - protein, 9 aa, Homo Sapiens
ATFIKDWSN

SEQ ID NO: 65433 - protein, 9 aa, Homo Sapiens
SNHLHFQEE

SEQ ID NO: 65434 - protein, 9 aa, Homo Sapiens
TSTRDLYAT

SEQ ID NO: 65435 - protein, 9 aa, Homo Sapiens
RGRRRQVQA

SEQ ID NO: 65436 - protein, 9 aa, Homo Sapiens
GGPRQQPQL

SEQ ID NO: 65437 - protein, 9 aa, Homo Sapiens
VTVQYSDLG

SEQ ID NO: 65438 - protein, 9 aa, Homo Sapiens
DLIQHQGMR

SEQ ID NO: 65439 - protein, 9 aa, Homo Sapiens
VRRHTAGGG

SEQ ID NO: 65440 - protein, 9 aa, Homo Sapiens
RGTYVRRHT

SEQ ID NO: 65441 - protein, 9 aa, Homo Sapiens
SGGPVQAPL

SEQ ID NO: 65442 - protein, 9 aa, Homo Sapiens
KNKEKNRYV

SEQ ID NO: 65443 - protein, 9 aa, Homo Sapiens
RVLNSYWMQ

SEQ ID NO: 65444 - protein, 9 aa, Homo Sapiens
HRVFAGELE

SEQ ID NO: 65445 - protein, 9 aa, Homo Sapiens
PSELLLLPL

SEQ ID NO: 65446 - protein, 9 aa, Homo Sapiens
ISSRHVSAY

SEQ ID NO: 65447 - protein, 9 aa, Homo Sapiens
RILLVGRRR

SEQ ID NO: 65448 - protein, 9 aa, Homo Sapiens
VLCCFHSPT

SEQ ID NO: 65449 - protein, 9 aa, Homo Sapiens
CECSANALT

SEQ ID NO: 65450 - protein, 9 aa, Homo Sapiens
KEKSILRCS

SEQ ID NO: 65451 - protein, 9 aa, Homo Sapiens
GKLEKLQAQ

SEQ ID NO: 65452 - protein, 9 aa, Homo Sapiens
EDFLHDSTV

SEQ ID NO: 65453 - protein, 9 aa, Homo Sapiens
GPSELLLLP

SEQ ID NO: 65454 - protein, 9 aa, Homo Sapiens
RSQAVRATV

SEQ ID NO: 65455 - protein, 9 aa, Homo Sapiens
RSHCYRAAL

SEQ ID NO: 65456 - protein, 9 aa, Homo Sapiens
DLSTEQRGR

SEQ ID NO: 65457 - protein, 9 aa, Homo Sapiens
STCEFVTTL

SEQ ID NO: 65458 - protein, 9 aa, Homo Sapiens
LCCFHSPTG

SEQ ID NO: 65459 - protein, 9 aa, Homo Sapiens
GAFDEHIGQ

SEQ ID NO: 65460 - protein, 9 aa, Homo Sapiens
YWMQSHSHS

SEQ ID NO: 65461 - protein, 9 aa, Homo Sapiens
MQSHSHSGG

SEQ ID NO: 65462 - protein, 9 aa, Homo Sapiens
LGKDIQCAD

SEQ ID NO: 65463 - protein, 9 aa, Homo Sapiens
EAMAIGGRP

SEQ ID NO: 65464 - protein, 9 aa, Homo Sapiens
PGLRSHCYR

SEQ ID NO: 65465 - protein, 9 aa, Homo Sapiens
IKSTATRGI

SEQ ID NO: 65466 - protein, 9 aa, Homo Sapiens
HHFLCDIPA

SEQ ID NO: 65467 - protein, 9 aa, Homo Sapiens
EQRGRRRQV

SEQ ID NO: 65468 - protein, 9 aa, Homo Sapiens
PPGIRPQSI

SEQ ID NO: 65469 - protein, 9 aa, Homo Sapiens
GLMFVKLVI

SEQ ID NO: 65470 - protein, 9 aa, Homo Sapiens
GLDLRSGLV

SEQ ID NO: 65471 - protein, 9 aa, Homo Sapiens
VADGNLCRR

SEQ ID NO: 65472 - protein, 9 aa, Homo Sapiens
PRAALQRVH

SEQ ID NO: 65473 - protein, 9 aa, Homo Sapiens
SQAVRATVT

SEQ ID NO: 65474 - protein, 9 aa, Homo Sapiens
LHFVTDGNH

SEQ ID NO: 65475 - protein, 9 aa, Homo Sapiens
TTLNGHKRG

SEQ ID NO: 65476 - protein, 9 aa, Homo Sapiens
FHLHVAEPN

SEQ ID NO: 65477 - protein, 9 aa, Homo Sapiens
LKGLPVESP

SEQ ID NO: 65478 - protein, 9 aa, Homo Sapiens
VEYALRKLM

SEQ ID NO: 65479 - protein, 9 aa, Homo Sapiens
TVVARLEDQ

SEQ ID NO: 65480 - protein, 9 aa, Homo Sapiens
MRAMTPLQV

SEQ ID NO: 65481 - protein, 9 aa, Homo Sapiens
LSGAGISCT

SEQ ID NO: 65482 - protein, 9 aa, Homo Sapiens
FNNQYFEDN

SEQ ID NO: 65483 - protein, 9 aa, Homo Sapiens
GGSSQFLSC

SEQ ID NO: 65484 - protein, 9 aa, Homo Sapiens
PSQNQGLGR

SEQ ID NO: 65485 - protein, 9 aa, Homo Sapiens
GKDIQCADR

SEQ ID NO: 65486 - protein, 9 aa, Homo Sapiens
TRGISLDSE

SEQ ID NO: 65487 - protein, 9 aa, Homo Sapiens
SGLPLSLCR

SEQ ID NO: 65488 - protein, 9 aa, Homo Sapiens
GSLTKYSNR

SEQ ID NO: 65489 - protein, 9 aa, Homo Sapiens
TFMFVLCCF

SEQ ID NO: 65490 - protein, 9 aa, Homo Sapiens
CKEGDVLFP

SEQ ID NO: 65491 - protein, 9 aa, Homo Sapiens
ECSANALTA

SEQ ID NO: 65492 - protein, 9 aa, Homo Sapiens
DPLEEIEIL

SEQ ID NO: 65493 - protein, 9 aa, Homo Sapiens
KAENRGKLE

SEQ ID NO: 65494 - protein, 9 aa, Homo Sapiens
GLQDALNIK

SEQ ID NO: 65495 - protein, 9 aa, Homo Sapiens
VQPLGSRQR

SEQ ID NO: 65496 - protein, 9 aa, Homo Sapiens
PLGSRQRET

SEQ ID NO: 65497 - protein, 9 aa, Homo Sapiens
DKSKRDPLE

SEQ ID NO: 65498 - protein, 9 aa, Homo Sapiens
VKLVIPCSG

SEQ ID NO: 65499 - protein, 9 aa, Homo Sapiens
TNGSNGSEC

SEQ ID NO: 65500 - protein, 9 aa, Homo Sapiens
ACSDTSAHD

SEQ ID NO: 65501 - protein, 9 aa, Homo Sapiens
QKAGPGLRS

SEQ ID NO: 65502 - protein, 9 aa, Homo Sapiens
SECSKNRTV

SEQ ID NO: 65503 - protein, 9 aa, Homo Sapiens
CDQSGVQGP

SEQ ID NO: 65504 - protein, 9 aa, Homo Sapiens
EAASKEKNK

SEQ ID NO: 65505 - protein, 9 aa, Homo Sapiens
QRETGQGPG

SEQ ID NO: 65506 - protein, 9 aa, Homo Sapiens
GTLQGPAML

SEQ ID NO: 65507 - protein, 9 aa, Homo Sapiens
NFRLWSPFQ

SEQ ID NO: 65508 - protein, 9 aa, Homo Sapiens
NEVHHFLCD

SEQ ID NO: 65509 - protein, 9 aa, Homo Sapiens
RRGPGGTLQ

SEQ ID NO: 65510 - protein, 9 aa, Homo Sapiens
ALQRVHLSC

SEQ ID NO: 65511 - protein, 9 aa, Homo Sapiens
HSASVKAGE

SEQ ID NO: 65512 - protein, 9 aa, Homo Sapiens
RLLPGLGVY

SEQ ID NO: 65513 - protein, 9 aa, Homo Sapiens
APRGVVTFL

SEQ ID NO: 65514 - protein, 9 aa, Homo Sapiens
LTKHRMTWD

SEQ ID NO: 65515 - protein, 9 aa, Homo Sapiens
GSGLPLSLC

SEQ ID NO: 65516 - protein, 9 aa, Homo Sapiens
TCDQLADRQ

SEQ ID NO: 65517 - protein, 9 aa, Homo Sapiens
KSTATRGIS

SEQ ID NO: 65518 - protein, 9 aa, Homo Sapiens
RKLMSLIQK

SEQ ID NO: 65519 - protein, 9 aa, Homo Sapiens
RQKRKEYCM

SEQ ID NO: 65520 - protein, 9 aa, Homo Sapiens
QLADRQSPV

SEQ ID NO: 65521 - protein, 9 aa, Homo Sapiens
IPKEKTVQH

SEQ ID NO: 65522 - protein, 9 aa, Homo Sapiens
ALIHSASVK

SEQ ID NO: 65523 - protein, 9 aa, Homo Sapiens
ECSKNRTVS

SEQ ID NO: 65524 - protein, 9 aa, Homo Sapiens
LADRQSPVI

SEQ ID NO: 65525 - protein, 9 aa, Homo Sapiens
SCGGHEELS

SEQ ID NO: 65526 - protein, 9 aa, Homo Sapiens
ILVDLFNNQ

SEQ ID NO: 65527 - protein, 9 aa, Homo Sapiens
CLKEQEETT

SEQ ID NO: 65528 - protein, 9 aa, Homo Sapiens
ENKIPKEKT

SEQ ID NO: 65529 - protein, 9 aa, Homo Sapiens
VRATVTHPR

SEQ ID NO: 65530 - protein, 9 aa, Homo Sapiens
RMMRAMTPL

SEQ ID NO: 65531 - protein, 9 aa, Homo Sapiens
FEKINEGRM

SEQ ID NO: 65532 - protein, 9 aa, Homo Sapiens
GPPGHCCTG

SEQ ID NO: 65533 - protein, 9 aa, Homo Sapiens
SPPSYQSVI

SEQ ID NO: 65534 - protein, 9 aa, Homo Sapiens
CEAASKEKN

SEQ ID NO: 65535 - protein, 9 aa, Homo Sapiens
TEYLPPEVP

SEQ ID NO: 65536 - protein, 9 aa, Homo Sapiens
STFMFVLCC

SEQ ID NO: 65537 - protein, 9 aa, Homo Sapiens
QSHSHSGGS

SEQ ID NO: 65538 - protein, 9 aa, Homo Sapiens
GNHRYRGFS

SEQ ID NO: 65539 - protein, 9 aa, Homo Sapiens
GLVNLLSIV

SEQ ID NO: 65540 - protein, 9 aa, Homo Sapiens
AENRGKLEK

SEQ ID NO: 65541 - protein, 9 aa, Homo Sapiens
QARQRRQKR

SEQ ID NO: 65542 - protein, 9 aa, Homo Sapiens
KSKRDPLEE

SEQ ID NO: 65543 - protein, 9 aa, Homo Sapiens
GVPGDREGP

SEQ ID NO: 65544 - protein, 9 aa, Homo Sapiens
YQMKEKSIL

SEQ ID NO: 65545 - protein, 9 aa, Homo Sapiens
KEKNKEKNR

SEQ ID NO: 65546 - protein, 9 aa, Homo Sapiens
IAAQGSFDG

SEQ ID NO: 65547 - protein, 9 aa, Homo Sapiens
KGLPVESPP

SEQ ID NO: 65548 - protein, 9 aa, Homo Sapiens
KKLAPAGRI

SEQ ID NO: 65549 - protein, 9 aa, Homo Sapiens
QPLGSRQRE

SEQ ID NO: 65550 - protein, 9 aa, Homo Sapiens
VQYSDLGLL

SEQ ID NO: 65551 - protein, 9 aa, Homo Sapiens
GGGSSQFLS

SEQ ID NO: 65552 - protein, 9 aa, Homo Sapiens
QCADRLGHD

SEQ ID NO: 65553 - protein, 9 aa, Homo Sapiens
PNAVFAKEQ

SEQ ID NO: 65554 - protein, 9 aa, Homo Sapiens
QPSQNQGLG

SEQ ID NO: 65555 - protein, 9 aa, Homo Sapiens
VCELCKEGD

SEQ ID NO: 65556 - protein, 9 aa, Homo Sapiens
WIDSLQAFS

SEQ ID NO: 65557 - protein, 9 aa, Homo Sapiens
EEEDFLHDS

SEQ ID NO: 65558 - protein, 9 aa, Homo Sapiens
TQLDELLTK

SEQ ID NO: 65559 - protein, 9 aa, Homo Sapiens
SGSPYAYGM

SEQ ID NO: 65560 - protein, 9 aa, Homo Sapiens
QKRKEYCMY

SEQ ID NO: 65561 - protein, 9 aa, Homo Sapiens
NALTASGPS

SEQ ID NO: 65562 - protein, 9 aa, Homo Sapiens
SKEKNKEKN

SEQ ID NO: 65563 - protein, 9 aa, Homo Sapiens
PKLITDSYS

SEQ ID NO: 65564 - protein, 9 aa, Homo Sapiens
AGRISGLCF

SEQ ID NO: 65565 - protein, 9 aa, Homo Sapiens
VDNIKSSQP

SEQ ID NO: 65566 - protein, 9 aa, Homo Sapiens
SVKAGESVL

SEQ ID NO: 65567 - protein, 9 aa, Homo Sapiens
RLRLARSLG

SEQ ID NO: 65568 - protein, 9 aa, Homo Sapiens
LKGQACRVC

SEQ ID NO: 65569 - protein, 9 aa, Homo Sapiens
LLCWPLHRL

SEQ ID NO: 65570 - protein, 9 aa, Homo Sapiens
KFFSITGET

SEQ ID NO: 65571 - protein, 9 aa, Homo Sapiens
NSLKKLAPA

SEQ ID NO: 65572 - protein, 9 aa, Homo Sapiens
QFLSCPGPA

SEQ ID NO: 65573 - protein, 9 aa, Homo Sapiens
YSNRYYSNE

SEQ ID NO: 65574 - protein, 9 aa, Homo Sapiens
RRRAREVVI

SEQ ID NO: 65575 - protein, 9 aa, Homo Sapiens
RYSNYNTLP

SEQ ID NO: 65576 - protein, 9 aa, Homo Sapiens
LPGLGVYLS

SEQ ID NO: 65577 - protein, 9 aa, Homo Sapiens
EDEEEDFLH

SEQ ID NO: 65578 - protein, 9 aa, Homo Sapiens
PLSDSYPCT

SEQ ID NO: 65579 - protein, 9 aa, Homo Sapiens
LPLSLCRRT

SEQ ID NO: 65580 - protein, 9 aa, Homo Sapiens
NNQYFEDNV

SEQ ID NO: 65581 - protein, 9 aa, Homo Sapiens
SASVKAGES

SEQ ID NO: 65582 - protein, 9 aa, Homo Sapiens
LVGRRRARE

SEQ ID NO: 65583 - protein, 9 aa, Homo Sapiens
GQACRVCDQ

SEQ ID NO: 65584 - protein, 9 aa, Homo Sapiens
ASKEKNKEK

SEQ ID NO: 65585 - protein, 9 aa, Homo Sapiens
NLKGQACRV

SEQ ID NO: 65586 - protein, 9 aa, Homo Sapiens
NAVFAKEQP

SEQ ID NO: 65587 - protein, 9 aa, Homo Sapiens
SGLVNLLSI

SEQ ID NO: 65588 - protein, 9 aa, Homo Sapiens
PLHRLTHRL

SEQ ID NO: 65589 - protein, 9 aa, Homo Sapiens
TSYLRVHTG

SEQ ID NO: 65590 - protein, 9 aa, Homo Sapiens
QLSPDVQHK

SEQ ID NO: 65591 - protein, 9 aa, Homo Sapiens
SPFQSHMSQ

SEQ ID NO: 65592 - protein, 9 aa, Homo Sapiens
LSLCRRTWR

SEQ ID NO: 65593 - protein, 9 aa, Homo Sapiens
LPVESPPSY

SEQ ID NO: 65594 - protein, 9 aa, Homo Sapiens
ALAGSITEY

SEQ ID NO: 65595 - protein, 9 aa, Homo Sapiens
DQSGVQGPA

SEQ ID NO: 65596 - protein, 9 aa, Homo Sapiens
HPQGSLPMY

SEQ ID NO: 65597 - protein, 9 aa, Homo Sapiens
PGLGVYLSL

SEQ ID NO: 65598 - protein, 9 aa, Homo Sapiens
KAGRKPRAA

SEQ ID NO: 65599 - protein, 9 aa, Homo Sapiens
SQVEYALRK

SEQ ID NO: 65600 - protein, 9 aa, Homo Sapiens
FVKLVIPCS

SEQ ID NO: 65601 - protein, 9 aa, Homo Sapiens
LRSGLVNLL

SEQ ID NO: 65602 - protein, 9 aa, Homo Sapiens
KKFEKINEG

SEQ ID NO: 65603 - protein, 9 aa, Homo Sapiens
VAEPNAVFA

SEQ ID NO: 65604 - protein, 9 aa, Homo Sapiens
DAGALTVPA

SEQ ID NO: 65605 - protein, 9 aa, Homo Sapiens
SPLSDSYPC

SEQ ID NO: 65606 - protein, 9 aa, Homo Sapiens
RQSPVIEFW

SEQ ID NO: 65607 - protein, 9 aa, Homo Sapiens
QSGVQGPAV

SEQ ID NO: 65608 - protein, 9 aa, Homo Sapiens
CPGACSDTS

SEQ ID NO: 65609 - protein, 9 aa, Homo Sapiens
LAQAPAPAA

SEQ ID NO: 65610 - protein, 9 aa, Homo Sapiens
QMKEKSILR

SEQ ID NO: 65611 - protein, 9 aa, Homo Sapiens
GPGGTLQGP

SEQ ID NO: 65612 - protein, 9 aa, Homo Sapiens
FSITGETME

SEQ ID NO: 65613 - protein, 9 aa, Homo Sapiens
KAGPGLRSH

SEQ ID NO: 65614 - protein, 9 aa, Homo Sapiens
DRTIKLWDI

SEQ ID NO: 65615 - protein, 9 aa, Homo Sapiens
QGSLPMYRP

SEQ ID NO: 65616 - protein, 9 aa, Homo Sapiens
LLDQEGNRQ

SEQ ID NO: 65617 - protein, 9 aa, Homo Sapiens
IQCADRLGH

SEQ ID NO: 65618 - protein, 9 aa, Homo Sapiens
TSSCQHRLS

SEQ ID NO: 65619 - protein, 9 aa, Homo Sapiens
GSSKTLDTQ

SEQ ID NO: 65620 - protein, 9 aa, Homo Sapiens
AAGPAQGPL

SEQ ID NO: 65621 - protein, 9 aa, Homo Sapiens
LVIPCSGEG

SEQ ID NO: 65622 - protein, 9 aa, Homo Sapiens
ERSSGHCDP

SEQ ID NO: 65623 - protein, 9 aa, Homo Sapiens
SNEVHHFLC

SEQ ID NO: 65624 - protein, 9 aa, Homo Sapiens
SPDVQHKAN

SEQ ID NO: 65625 - protein, 9 aa, Homo Sapiens
SSQPSQNQG

SEQ ID NO: 65626 - protein, 9 aa, Homo Sapiens
SKDRTIKLW

SEQ ID NO: 65627 - protein, 9 aa, Homo Sapiens
CADRLGHDA

SEQ ID NO: 65628 - protein, 9 aa, Homo Sapiens
PGTVRAMAI

SEQ ID NO: 65629 - protein, 9 aa, Homo Sapiens
KGFVCELCK

SEQ ID NO: 65630 - protein, 9 aa, Homo Sapiens
IDLVYVKRY

SEQ ID NO: 65631 - protein, 9 aa, Homo Sapiens
LFNNQYFED

SEQ ID NO: 65632 - protein, 9 aa, Homo Sapiens
HLSCGGHEE

SEQ ID NO: 65633 - protein, 9 aa, Homo Sapiens
APAAGPAQG

SEQ ID NO: 65634 - protein, 9 aa, Homo Sapiens
MLDEDTVVA

SEQ ID NO: 65635 - protein, 9 aa, Homo Sapiens
AQGSFDGSS

SEQ ID NO: 65636 - protein, 9 aa, Homo Sapiens
PRYSNYNTL

SEQ ID NO: 65637 - protein, 9 aa, Homo Sapiens
DRQSPVIEF

SEQ ID NO: 65638 - protein, 9 aa, Homo Sapiens
IEKENKTEP

SEQ ID NO: 65639 - protein, 9 aa, Homo Sapiens
TFIKDWSNK

SEQ ID NO: 65640 - protein, 9 aa, Homo Sapiens
QWYALDQLS

SEQ ID NO: 65641 - protein, 9 aa, Homo Sapiens
TPQAREVSA

SEQ ID NO: 65642 - protein, 9 aa, Homo Sapiens
PDLSTEQRG

SEQ ID NO: 65643 - protein, 9 aa, Homo Sapiens
EYALRKLMS

SEQ ID NO: 65644 - protein, 9 aa, Homo Sapiens
SCPGACSDT

SEQ ID NO: 65645 - protein, 9 aa, Homo Sapiens
FVLCCFHSP

SEQ ID NO: 65646 - protein, 9 aa, Homo Sapiens
DEHIGQLCT

SEQ ID NO: 65647 - protein, 9 aa, Homo Sapiens
ACRVCDQRH

SEQ ID NO: 65648 - protein, 9 aa, Homo Sapiens
SCTSTRDLY

SEQ ID NO: 65649 - protein, 9 aa, Homo Sapiens
SVRLLPGLG

SEQ ID NO: 65650 - protein, 9 aa, Homo Sapiens
LLTKHRMTW

SEQ ID NO: 65651 - protein, 9 aa, Homo Sapiens
PLSLCRRTW

SEQ ID NO: 65652 - protein, 9 aa, Homo Sapiens
ENKTEPWKE

SEQ ID NO: 65653 - protein, 9 aa, Homo Sapiens
RHCKRRRTS

SEQ ID NO: 65654 - protein, 9 aa, Homo Sapiens
VFAGELEVL

SEQ ID NO: 65655 - protein, 9 aa, Homo Sapiens
RQRRQKRKE

SEQ ID NO: 65656 - protein, 9 aa, Homo Sapiens
NHLHFQEEK

SEQ ID NO: 65657 - protein, 9 aa, Homo Sapiens
TERADFQYR

SEQ ID NO: 65658 - protein, 9 aa, Homo Sapiens
DLVYVKRYE

SEQ ID NO: 65659 - protein, 9 aa, Homo Sapiens
YRALIHSAS

SEQ ID NO: 65660 - protein, 9 aa, Homo Sapiens
IKSSQPSQN

SEQ ID NO: 65661 - protein, 9 aa, Homo Sapiens
APRTPQARE

SEQ ID NO: 65662 - protein, 9 aa, Homo Sapiens
AAQGSFDGS

SEQ ID NO: 65663 - protein, 9 aa, Homo Sapiens
DLRMMRAMT

SEQ ID NO: 65664 - protein, 9 aa, Homo Sapiens
SRHCKRRRT

SEQ ID NO: 65665 - protein, 9 aa, Homo Sapiens
TVCCMHLHE

SEQ ID NO: 65666 - protein, 9 aa, Homo Sapiens
SLGPPGHCC

SEQ ID NO: 65667 - protein, 9 aa, Homo Sapiens
IATDEKMLI

SEQ ID NO: 65668 - protein, 9 aa, Homo Sapiens
SLQAFSLDC

SEQ ID NO: 65669 - protein, 9 aa, Homo Sapiens
AAAEETPRY

SEQ ID NO: 65670 - protein, 9 aa, Homo Sapiens
HQGMRILEL

SEQ ID NO: 65671 - protein, 9 aa, Homo Sapiens
RICDQSGVQ

SEQ ID NO: 65672 - protein, 9 aa, Homo Sapiens
LKKLAPAGR

SEQ ID NO: 65673 - protein, 9 aa, Homo Sapiens
FVCELCKEG

SEQ ID NO: 65674 - protein, 9 aa, Homo Sapiens
RSNHLHFQE

SEQ ID NO: 65675 - protein, 9 aa, Homo Sapiens
EETPRYSNY

SEQ ID NO: 65676 - protein, 9 aa, Homo Sapiens
NKTEPWKEK

SEQ ID NO: 65677 - protein, 9 aa, Homo Sapiens
LDQLSPDVQ

SEQ ID NO: 65678 - protein, 9 aa, Homo Sapiens
TGPSCPAPR

SEQ ID NO: 65679 - protein, 9 aa, Homo Sapiens
ASVKAGESV

SEQ ID NO: 65680 - protein, 9 aa, Homo Sapiens
QGPAVWGLR

SEQ ID NO: 65681 - protein, 9 aa, Homo Sapiens
SSGHCDPDV

SEQ ID NO: 65682 - protein, 9 aa, Homo Sapiens
PTGPSCPAP

SEQ ID NO: 65683 - protein, 9 aa, Homo Sapiens
MQRQNEQMM

SEQ ID NO: 65684 - protein, 9 aa, Homo Sapiens
FVTTLNGHK

SEQ ID NO: 65685 - protein, 9 aa, Homo Sapiens
ISCTSTRDL

SEQ ID NO: 65686 - protein, 9 aa, Homo Sapiens
GISLDSELH

SEQ ID NO: 65687 - protein, 9 aa, Homo Sapiens
STCECSANA

SEQ ID NO: 65688 - protein, 9 aa, Homo Sapiens
GHEELSGGP

SEQ ID NO: 65689 - protein, 9 aa, Homo Sapiens
ASENDHRVF

SEQ ID NO: 65690 - protein, 9 aa, Homo Sapiens
HCDPDVATM

SEQ ID NO: 65691 - protein, 9 aa, Homo Sapiens
FVTDGNHRY

SEQ ID NO: 65692 - protein, 9 aa, Homo Sapiens
LRLHFVTDG

SEQ ID NO: 65693 - protein, 9 aa, Homo Sapiens
RTPQAREVS

SEQ ID NO: 65694 - protein, 9 aa, Homo Sapiens
ISNSKDRTI

SEQ ID NO: 65695 - protein, 9 aa, Homo Sapiens
RGKLEKLQA

SEQ ID NO: 65696 - protein, 9 aa, Homo Sapiens
TKYSNRYYS

SEQ ID NO: 65697 - protein, 9 aa, Homo Sapiens
CEFVTTLNG

SEQ ID NO: 65698 - protein, 9 aa, Homo Sapiens
MFVKLVIPC

SEQ ID NO: 65699 - protein, 9 aa, Homo Sapiens
SSRHVSAYG

SEQ ID NO: 65700 - protein, 9 aa, Homo Sapiens
THRLRLARS

SEQ ID NO: 65701 - protein, 9 aa, Homo Sapiens
ALTVPAAVE

SEQ ID NO: 65702 - protein, 9 aa, Homo Sapiens
VPRSNHLHF

SEQ ID NO: 65703 - protein, 9 aa, Homo Sapiens
TCEAASKEK

SEQ ID NO: 65704 - protein, 9 aa, Homo Sapiens
QKTLGTVIA

SEQ ID NO: 65705 - protein, 9 aa, Homo Sapiens
GQLCTDWQK

SEQ ID NO: 65706 - protein, 9 aa, Homo Sapiens
DKAENRGKL

SEQ ID NO: 65707 - protein, 9 aa, Homo Sapiens
DAISSRHVS

SEQ ID NO: 65708 - protein, 9 aa, Homo Sapiens
GRRRQVQAD

SEQ ID NO: 65709 - protein, 9 aa, Homo Sapiens
LSGGPRQQP

SEQ ID NO: 65710 - protein, 9 aa, Homo Sapiens
LSTEQRGRR

SEQ ID NO: 65711 - protein, 9 aa, Homo Sapiens
QACRVCDQR

SEQ ID NO: 65712 - protein, 9 aa, Homo Sapiens
GKDAPRLPP

SEQ ID NO: 65713 - protein, 9 aa, Homo Sapiens
FLCDIPAVM

SEQ ID NO: 65714 - protein, 9 aa, Homo Sapiens
CQKTSSCQH

SEQ ID NO: 65715 - protein, 9 aa, Homo Sapiens
RQCRKEVWQ

SEQ ID NO: 65716 - protein, 9 aa, Homo Sapiens
RRTSTHPES

SEQ ID NO: 65717 - protein, 9 aa, Homo Sapiens
PPPGTVRAM

SEQ ID NO: 65718 - protein, 9 aa, Homo Sapiens
RGGGSSQFL

SEQ ID NO: 65719 - protein, 9 aa, Homo Sapiens
LDELLTKHR

SEQ ID NO: 65720 - protein, 9 aa, Homo Sapiens
LKEQEETTN

SEQ ID NO: 65721 - protein, 9 aa, Homo Sapiens
IRGIATDEK

SEQ ID NO: 65722 - protein, 9 aa, Homo Sapiens
VRLSKKFEK

SEQ ID NO: 65723 - protein, 9 aa, Homo Sapiens
LTVPAAVEV

SEQ ID NO: 65724 - protein, 9 aa, Homo Sapiens
GALTVPAAV

SEQ ID NO: 65725 - protein, 9 aa, Homo Sapiens
QRATFIKDW

SEQ ID NO: 65726 - protein, 9 aa, Homo Sapiens
TEQRGRRRQ

SEQ ID NO: 65727 - protein, 9 aa, Homo Sapiens
EMQRQNEQM

SEQ ID NO: 65728 - protein, 9 aa, Homo Sapiens
PSSSSRHCK

SEQ ID NO: 65729 - protein, 9 aa, Homo Sapiens
KRDPLEEIE

SEQ ID NO: 65730 - protein, 9 aa, Homo Sapiens
VTTLNGHKR

SEQ ID NO: 65731 - protein, 9 aa, Homo Sapiens
AGPGLRSHC

SEQ ID NO: 65732 - protein, 9 aa, Homo Sapiens
RDPLEEIEI

SEQ ID NO: 65733 - protein, 9 aa, Homo Sapiens
SKRDPLEEI

SEQ ID NO: 65734 - protein, 9 aa, Homo Sapiens
TNELRVNLS

SEQ ID NO: 65735 - protein, 9 aa, Homo Sapiens
SLTKYSNRY

SEQ ID NO: 65736 - protein, 9 aa, Homo Sapiens
EVWQLKELW

SEQ ID NO: 65737 - protein, 9 aa, Homo Sapiens
RSLGPPGHC

SEQ ID NO: 65738 - protein, 9 aa, Homo Sapiens
VGHPQGKDA

SEQ ID NO: 65739 - protein, 9 aa, Homo Sapiens
FMFVLCCFH

SEQ ID NO: 65740 - protein, 9 aa, Homo Sapiens
SSRHCKRRR

SEQ ID NO: 65741 - protein, 9 aa, Homo Sapiens
GGHEELSGG

SEQ ID NO: 65742 - protein, 9 aa, Homo Sapiens
PGIRPQSIY

SEQ ID NO: 65743 - protein, 9 aa, Homo Sapiens
MMRAMTPLQ

SEQ ID NO: 65744 - protein, 9 aa, Homo Sapiens
PQGKDAPRL

SEQ ID NO: 65745 - protein, 9 aa, Homo Sapiens
ACVKAGRKP

SEQ ID NO: 65746 - protein, 9 aa, Homo Sapiens
GVQGPAVWG

SEQ ID NO: 65747 - protein, 9 aa, Homo Sapiens
LSTFMFVLC

SEQ ID NO: 65748 - protein, 9 aa, Homo Sapiens
KLAPAGRIS

SEQ ID NO: 65749 - protein, 9 aa, Homo Sapiens
ENRGKLEKL

SEQ ID NO: 65750 - protein, 9 aa, Homo Sapiens
EGSGGPVQA

SEQ ID NO: 65751 - protein, 9 aa, Homo Sapiens
YRQRELDTI

SEQ ID NO: 65752 - protein, 9 aa, Homo Sapiens
PQAREVSAP

SEQ ID NO: 65753 - protein, 9 aa, Homo Sapiens
SLKKLAPAG

SEQ ID NO: 65754 - protein, 9 aa, Homo Sapiens
GRGTYVRRH

SEQ ID NO: 65755 - protein, 9 aa, Homo Sapiens
GNRQHSSLI

SEQ ID NO: 65756 - protein, 9 aa, Homo Sapiens
GSRQRETGQ

SEQ ID NO: 65757 - protein, 9 aa, Homo Sapiens
APAPAAGPA

SEQ ID NO: 65758 - protein, 9 aa, Homo Sapiens
ILGKDIQCA

SEQ ID NO: 65759 - protein, 9 aa, Homo Sapiens
RQNEQMMEQ

SEQ ID NO: 65760 - protein, 9 aa, Homo Sapiens
SPYAYGMLD

SEQ ID NO: 65761 - protein, 9 aa, Homo Sapiens
LCKEGDVLF

SEQ ID NO: 65762 - protein, 9 aa, Homo Sapiens
LLNSCPGAC

SEQ ID NO: 65763 - protein, 9 aa, Homo Sapiens
AMTPLQVHV

SEQ ID NO: 65764 - protein, 9 aa, Homo Sapiens
AQAPAPAAG

SEQ ID NO: 65765 - protein, 9 aa, Homo Sapiens
NGSNGSECS

SEQ ID NO: 65766 - protein, 9 aa, Homo Sapiens
CTSTRDLYA

SEQ ID NO: 65767 - protein, 9 aa, Homo Sapiens
CSKNRTVSG

SEQ ID NO: 65768 - protein, 9 aa, Homo Sapiens
ALTSYLRVH

SEQ ID NO: 65769 - protein, 9 aa, Homo Sapiens
GHTSTVCCM

SEQ ID NO: 65770 - protein, 9 aa, Homo Sapiens
SDLGLLYIR

SEQ ID NO: 65771 - protein, 9 aa, Homo Sapiens
SRQRETGQG

SEQ ID NO: 65772 - protein, 9 aa, Homo Sapiens
VHLSCGGHE

SEQ ID NO: 65773 - protein, 9 aa, Homo Sapiens
YVDAISSRH

SEQ ID NO: 65774 - protein, 9 aa, Homo Sapiens
RDFIDLVYV

SEQ ID NO: 65775 - protein, 9 aa, Homo Sapiens
DFQYRQREL

SEQ ID NO: 65776 - protein, 9 aa, Homo Sapiens
DREGPHERG

SEQ ID NO: 65777 - protein, 9 aa, Homo Sapiens
SGSTSTCEC

SEQ ID NO: 65778 - protein, 9 aa, Homo Sapiens
AGPAQGPLP

SEQ ID NO: 65779 - protein, 9 aa, Homo Sapiens
LKFFSITGE

SEQ ID NO: 65780 - protein, 9 aa, Homo Sapiens
RQEIEKENK

SEQ ID NO: 65781 - protein, 9 aa, Homo Sapiens
VTVPPGIRP

SEQ ID NO: 65782 - protein, 9 aa, Homo Sapiens
VVARLEDQC

SEQ ID NO: 65783 - protein, 9 aa, Homo Sapiens
KENKIPKEK

SEQ ID NO: 65784 - protein, 9 aa, Homo Sapiens
HVAEPNAVF

SEQ ID NO: 65785 - protein, 9 aa, Homo Sapiens
CPAPRTPQA

SEQ ID NO: 65786 - protein, 9 aa, Homo Sapiens
HFVTDGNHR

SEQ ID NO: 65787 - protein, 9 aa, Homo Sapiens
EVSAPCTSA

SEQ ID NO: 65788 - protein, 9 aa, Homo Sapiens
GSTSTCECS

SEQ ID NO: 65789 - protein, 9 aa, Homo Sapiens
ICDQSGVQG

SEQ ID NO: 65790 - protein, 9 aa, Homo Sapiens
EKNKEKNRY

SEQ ID NO: 65791 - protein, 9 aa, Homo Sapiens
YSDLGLLYI

SEQ ID NO: 65792 - protein, 9 aa, Homo Sapiens
PHGVPGDRE

SEQ ID NO: 65793 - protein, 9 aa, Homo Sapiens
AKNSPALTG

SEQ ID NO: 65794 - protein, 9 aa, Homo Sapiens
PQGSLPMYR

SEQ ID NO: 65795 - protein, 9 aa, Homo Sapiens
LRRPVTVPP

SEQ ID NO: 65796 - protein, 9 aa, Homo Sapiens
KFEKINEGR

SEQ ID NO: 65797 - protein, 9 aa, Homo Sapiens
EEVPGVFSR

SEQ ID NO: 65798 - protein, 9 aa, Homo Sapiens
NIKSSQPSQ

SEQ ID NO: 65799 - protein, 9 aa, Homo Sapiens
HEELSGGPR

SEQ ID NO: 65800 - protein, 9 aa, Homo Sapiens
GDREGPHER

SEQ ID NO: 65801 - protein, 9 aa, Homo Sapiens
CSANALTAS

SEQ ID NO: 65802 - protein, 9 aa, Homo Sapiens
AASKEKNKE

SEQ ID NO: 65803 - protein, 9 aa, Homo Sapiens
LQFYVDAIS

SEQ ID NO: 65804 - protein, 9 aa, Homo Sapiens
KEGDVLFPF

SEQ ID NO: 65805 - protein, 9 aa, Homo Sapiens
VRPPRLPCG

SEQ ID NO: 65806 - protein, 9 aa, Homo Sapiens
QKAIRGIAT

SEQ ID NO: 65807 - protein, 9 aa, Homo Sapiens
QNEQMMEQK

SEQ ID NO: 65808 - protein, 9 aa, Homo Sapiens
IQKAIRGIA

SEQ ID NO: 65809 - protein, 9 aa, Homo Sapiens
MFVLCCFHS

SEQ ID NO: 65810 - protein, 9 aa, Homo Sapiens
SVNQQGKIE

SEQ ID NO: 65811 - protein, 9 aa, Homo Sapiens
SIITTKMYA

SEQ ID NO: 65812 - protein, 9 aa, Homo Sapiens
SANEFPCLP

SEQ ID NO: 65813 - protein, 9 aa, Homo Sapiens
DRCQDASEL

SEQ ID NO: 65814 - protein, 9 aa, Homo Sapiens
GSGRAPARW

SEQ ID NO: 65815 - protein, 9 aa, Homo Sapiens
PRRSYPMHR

SEQ ID NO: 65816 - protein, 9 aa, Homo Sapiens
AERGNQEPF

SEQ ID NO: 65817 - protein, 9 aa, Homo Sapiens
SLISFQYGD

SEQ ID NO: 65818 - protein, 9 aa, Homo Sapiens
ADKPFSIHP

SEQ ID NO: 65819 - protein, 9 aa, Homo Sapiens
SPDLPKASA

SEQ ID NO: 65820 - protein, 9 aa, Homo Sapiens
LRCYGHEGS

SEQ ID NO: 65821 - protein, 9 aa, Homo Sapiens
ALGSVYERD

SEQ ID NO: 65822 - protein, 9 aa, Homo Sapiens
VCHLQNYHQ

SEQ ID NO: 65823 - protein, 9 aa, Homo Sapiens
VDTPNLDAT

SEQ ID NO: 65824 - protein, 9 aa, Homo Sapiens
PSPGAWPYR

SEQ ID NO: 65825 - protein, 9 aa, Homo Sapiens
DARGKVEFQ

SEQ ID NO: 65826 - protein, 9 aa, Homo Sapiens
VLSRSQNGP

SEQ ID NO: 65827 - protein, 9 aa, Homo Sapiens
LEFQGSAIP

SEQ ID NO: 65828 - protein, 9 aa, Homo Sapiens
PCLPALGGS

SEQ ID NO: 65829 - protein, 9 aa, Homo Sapiens
ETLRFISSK

SEQ ID NO: 65830 - protein, 9 aa, Homo Sapiens
LQIYTISPN

SEQ ID NO: 65831 - protein, 9 aa, Homo Sapiens
PGPSGEWGL

SEQ ID NO: 65832 - protein, 9 aa, Homo Sapiens
DPNAPGDIA

SEQ ID NO: 65833 - protein, 9 aa, Homo Sapiens
KETLRFISS

SEQ ID NO: 65834 - protein, 9 aa, Homo Sapiens
PGPSRRRYR

SEQ ID NO: 65835 - protein, 9 aa, Homo Sapiens
RTAPNPQRP

SEQ ID NO: 65836 - protein, 9 aa, Homo Sapiens
TLPTSSHSS

SEQ ID NO: 65837 - protein, 9 aa, Homo Sapiens
GMAALGSVY

SEQ ID NO: 65838 - protein, 9 aa, Homo Sapiens
SPSPPGGAT

SEQ ID NO: 65839 - protein, 9 aa, Homo Sapiens
LKLNQCRLG

SEQ ID NO: 65840 - protein, 9 aa, Homo Sapiens
GGIGTFILA

SEQ ID NO: 65841 - protein, 9 aa, Homo Sapiens
PLNAAHFCP

SEQ ID NO: 65842 - protein, 9 aa, Homo Sapiens
LAVQILSPE

SEQ ID NO: 65843 - protein, 9 aa, Homo Sapiens
AHVCEPSTC

SEQ ID NO: 65844 - protein, 9 aa, Homo Sapiens
AHFCPCNNC

SEQ ID NO: 65845 - protein, 9 aa, Homo Sapiens
LQNYHQKSC

SEQ ID NO: 65846 - protein, 9 aa, Homo Sapiens
GRAPARWGL

SEQ ID NO: 65847 - protein, 9 aa, Homo Sapiens
NTVSPTVKA

SEQ ID NO: 65848 - protein, 9 aa, Homo Sapiens
MRSHTGKEL

SEQ ID NO: 65849 - protein, 9 aa, Homo Sapiens
IIAKGECLP

SEQ ID NO: 65850 - protein, 9 aa, Homo Sapiens
QQGKIELSS

SEQ ID NO: 65851 - protein, 9 aa, Homo Sapiens
YANDKKIQS

SEQ ID NO: 65852 - protein, 9 aa, Homo Sapiens
SSPSPPGGA

SEQ ID NO: 65853 - protein, 9 aa, Homo Sapiens
AAHFCPCNN

SEQ ID NO: 65854 - protein, 9 aa, Homo Sapiens
ILKHWTGGC

SEQ ID NO: 65855 - protein, 9 aa, Homo Sapiens
RSDGDKEDE

SEQ ID NO: 65856 - protein, 9 aa, Homo Sapiens
TMTYKMHFR

SEQ ID NO: 65857 - protein, 9 aa, Homo Sapiens
ARYMQKIRF

SEQ ID NO: 65858 - protein, 9 aa, Homo Sapiens
YQARSDGDK

SEQ ID NO: 65859 - protein, 9 aa, Homo Sapiens
HFLEFQGSA

SEQ ID NO: 65860 - protein, 9 aa, Homo Sapiens
SDAPQVKEN

SEQ ID NO: 65861 - protein, 9 aa, Homo Sapiens
RAPARWGLP

SEQ ID NO: 65862 - protein, 9 aa, Homo Sapiens
GQRRSFAER

SEQ ID NO: 65863 - protein, 9 aa, Homo Sapiens
WDVVTCLAH

SEQ ID NO: 65864 - protein, 9 aa, Homo Sapiens
KADKPFSIH

SEQ ID NO: 65865 - protein, 9 aa, Homo Sapiens
VQILSPEEK

SEQ ID NO: 65866 - protein, 9 aa, Homo Sapiens
QIYTISPNF

SEQ ID NO: 65867 - protein, 9 aa, Homo Sapiens
QEVRDPFQM

SEQ ID NO: 65868 - protein, 9 aa, Homo Sapiens
PIDCFHLQP

SEQ ID NO: 65869 - protein, 9 aa, Homo Sapiens
NQCRLGEPM

SEQ ID NO: 65870 - protein, 9 aa, Homo Sapiens
AAHHHHAAP

SEQ ID NO: 65871 - protein, 9 aa, Homo Sapiens
PTMTYKMHF

SEQ ID NO: 65872 - protein, 9 aa, Homo Sapiens
VNGDENAFG

SEQ ID NO: 65873 - protein, 9 aa, Homo Sapiens
EFQGSAIPQ

SEQ ID NO: 65874 - protein, 9 aa, Homo Sapiens
GMMARENKV

SEQ ID NO: 65875 - protein, 9 aa, Homo Sapiens
TDPNKWIPK

SEQ ID NO: 65876 - protein, 9 aa, Homo Sapiens
SSPKSSETA

SEQ ID NO: 65877 - protein, 9 aa, Homo Sapiens
KMGGFHWMH

SEQ ID NO: 65878 - protein, 9 aa, Homo Sapiens
SDGDKEDEL

SEQ ID NO: 65879 - protein, 9 aa, Homo Sapiens
SNRLAHVCE

SEQ ID NO: 65880 - protein, 9 aa, Homo Sapiens
QKLGVLSRS

SEQ ID NO: 65881 - protein, 9 aa, Homo Sapiens
SAPLGDEVT

SEQ ID NO: 65882 - protein, 9 aa, Homo Sapiens
FSIHPQGIR

SEQ ID NO: 65883 - protein, 9 aa, Homo Sapiens
LNAAHFCPC

SEQ ID NO: 65884 - protein, 9 aa, Homo Sapiens
SGEWGLAGP

SEQ ID NO: 65885 - protein, 9 aa, Homo Sapiens
MPQLPAAVP

SEQ ID NO: 65886 - protein, 9 aa, Homo Sapiens
ASFTAARSD

SEQ ID NO: 65887 - protein, 9 aa, Homo Sapiens
VVTCLAHSE

SEQ ID NO: 65888 - protein, 9 aa, Homo Sapiens
LAHVCEPST

SEQ ID NO: 65889 - protein, 9 aa, Homo Sapiens
PGPRGSGRA

SEQ ID NO: 65890 - protein, 9 aa, Homo Sapiens
HPLNAAHFC

SEQ ID NO: 65891 - protein, 9 aa, Homo Sapiens
PAAVPQQGL

SEQ ID NO: 65892 - protein, 9 aa, Homo Sapiens
DQRGQRRSF

SEQ ID NO: 65893 - protein, 9 aa, Homo Sapiens
EKEEEEAGE

SEQ ID NO: 65894 - protein, 9 aa, Homo Sapiens
EKSVLGGHD

SEQ ID NO: 65895 - protein, 9 aa, Homo Sapiens
AYGIAMSGG

SEQ ID NO: 65896 - protein, 9 aa, Homo Sapiens
RASDNSFTN

SEQ ID NO: 65897 - protein, 9 aa, Homo Sapiens
SYPMHRLIQ

SEQ ID NO: 65898 - protein, 9 aa, Homo Sapiens
LVGEAEGEE

SEQ ID NO: 65899 - protein, 9 aa, Homo Sapiens
TCLAHSESY

SEQ ID NO: 65900 - protein, 9 aa, Homo Sapiens
LPKDNSIYV

SEQ ID NO: 65901 - protein, 9 aa, Homo Sapiens
GPAASFTAA

SEQ ID NO: 65902 - protein, 9 aa, Homo Sapiens
GEWGLAGPP

SEQ ID NO: 65903 - protein, 9 aa, Homo Sapiens
QRGQRRSFA

SEQ ID NO: 65904 - protein, 9 aa, Homo Sapiens
PKASACPPG

SEQ ID NO: 65905 - protein, 9 aa, Homo Sapiens
SVYERDIWK

SEQ ID NO: 65906 - protein, 9 aa, Homo Sapiens
KELNARYMQ

SEQ ID NO: 65907 - protein, 9 aa, Homo Sapiens
SPRREPDPN

SEQ ID NO: 65908 - protein, 9 aa, Homo Sapiens
GSVYERDIW

SEQ ID NO: 65909 - protein, 9 aa, Homo Sapiens
PGHPCLPAL

SEQ ID NO: 65910 - protein, 9 aa, Homo Sapiens
SRRRYRKET

SEQ ID NO: 65911 - protein, 9 aa, Homo Sapiens
SQKLGVLSR

SEQ ID NO: 65912 - protein, 9 aa, Homo Sapiens
KSNRLAHVC

SEQ ID NO: 65913 - protein, 9 aa, Homo Sapiens
PDPNAPGDI

SEQ ID NO: 65914 - protein, 9 aa, Homo Sapiens
WVFPSSPKS

SEQ ID NO: 65915 - protein, 9 aa, Homo Sapiens
SPVSSTLPT

SEQ ID NO: 65916 - protein, 9 aa, Homo Sapiens
PKDNSIYVL

SEQ ID NO: 65917 - protein, 9 aa, Homo Sapiens
ARSDGDKED

SEQ ID NO: 65918 - protein, 9 aa, Homo Sapiens
QEPFLQALG

SEQ ID NO: 65919 - protein, 9 aa, Homo Sapiens
DPKTPLLQG

SEQ ID NO: 65920 - protein, 9 aa, Homo Sapiens
QARLSCLPK

SEQ ID NO: 65921 - protein, 9 aa, Homo Sapiens
AKPCKAVSL

SEQ ID NO: 65922 - protein, 9 aa, Homo Sapiens
TGMMARENK

SEQ ID NO: 65923 - protein, 9 aa, Homo Sapiens
EQLLCEASI

SEQ ID NO: 65924 - protein, 9 aa, Homo Sapiens
KKSANEFPC

SEQ ID NO: 65925 - protein, 9 aa, Homo Sapiens
LNTVSPTVK

SEQ ID NO: 65926 - protein, 9 aa, Homo Sapiens
CFHLQPLMF

SEQ ID NO: 65927 - protein, 9 aa, Homo Sapiens
PNLDATARD

SEQ ID NO: 65928 - protein, 9 aa, Homo Sapiens
APGPSRRRY

SEQ ID NO: 65929 - protein, 9 aa, Homo Sapiens
HVCEPSTCV

SEQ ID NO: 65930 - protein, 9 aa, Homo Sapiens
MLLPSSSPK

SEQ ID NO: 65931 - protein, 9 aa, Homo Sapiens
DTKLRPTMT

SEQ ID NO: 65932 - protein, 9 aa, Homo Sapiens
DKPFSIHPQ

SEQ ID NO: 65933 - protein, 9 aa, Homo Sapiens
RCYGHEGSG

SEQ ID NO: 65934 - protein, 9 aa, Homo Sapiens
SSKLPDKTV

SEQ ID NO: 65935 - protein, 9 aa, Homo Sapiens
RGQRRSFAE

SEQ ID NO: 65936 - protein, 9 aa, Homo Sapiens
ERLEGSLIS

SEQ ID NO: 65937 - protein, 9 aa, Homo Sapiens
CNCAVASHV

SEQ ID NO: 65938 - protein, 9 aa, Homo Sapiens
GYCSAPLGD

SEQ ID NO: 65939 - protein, 9 aa, Homo Sapiens
QDASELQRD

SEQ ID NO: 65940 - protein, 9 aa, Homo Sapiens
GDLCNCAVA

SEQ ID NO: 65941 - protein, 9 aa, Homo Sapiens
GLSIELLAV

SEQ ID NO: 65942 - protein, 9 aa, Homo Sapiens
KTPLLQGIA

SEQ ID NO: 65943 - protein, 9 aa, Homo Sapiens
PGGFRGGRG

SEQ ID NO: 65944 - protein, 9 aa, Homo Sapiens
ANCRDFLES

SEQ ID NO: 65945 - protein, 9 aa, Homo Sapiens
RTYSANCRD

SEQ ID NO: 65946 - protein, 9 aa, Homo Sapiens
VKENPSTVG

SEQ ID NO: 65947 - protein, 9 aa, Homo Sapiens
GGFHWMHRD

SEQ ID NO: 65948 - protein, 9 aa, Homo Sapiens
KWDRNGRTL

SEQ ID NO: 65949 - protein, 9 aa, Homo Sapiens
RYMQKIRFP

SEQ ID NO: 65950 - protein, 9 aa, Homo Sapiens
NQQGKIELS

SEQ ID NO: 65951 - protein, 9 aa, Homo Sapiens
WVLTGVLVY

SEQ ID NO: 65952 - protein, 9 aa, Homo Sapiens
HGSTTKAIR

SEQ ID NO: 65953 - protein, 9 aa, Homo Sapiens
YQMPQLPAA

SEQ ID NO: 65954 - protein, 9 aa, Homo Sapiens
VCKESVNQQ

SEQ ID NO: 65955 - protein, 9 aa, Homo Sapiens
PHKTVKKSA

SEQ ID NO: 65956 - protein, 9 aa, Homo Sapiens
DTPNLDATA

SEQ ID NO: 65957 - protein, 9 aa, Homo Sapiens
DPTDPNKWI

SEQ ID NO: 65958 - protein, 9 aa, Homo Sapiens
PQVKENPST

SEQ ID NO: 65959 - protein, 9 aa, Homo Sapiens
PTSSHSSSA

SEQ ID NO: 65960 - protein, 9 aa, Homo Sapiens
SRSQNGPPK

SEQ ID NO: 65961 - protein, 9 aa, Homo Sapiens
NQSTPKLLS

SEQ ID NO: 65962 - protein, 9 aa, Homo Sapiens
ADQDARGKV

SEQ ID NO: 65963 - protein, 9 aa, Homo Sapiens
SANCRDFLE

SEQ ID NO: 65964 - protein, 9 aa, Homo Sapiens
HFCPCNNCN

SEQ ID NO: 65965 - protein, 9 aa, Homo Sapiens
RSYPMHRLI

SEQ ID NO: 65966 - protein, 9 aa, Homo Sapiens
LLAVERGNR

SEQ ID NO: 65967 - protein, 9 aa, Homo Sapiens
AHSESYIGG

SEQ ID NO: 65968 - protein, 9 aa, Homo Sapiens
GSTTKAIRT

SEQ ID NO: 65969 - protein, 9 aa, Homo Sapiens
TELSHGSTT

SEQ ID NO: 65970 - protein, 9 aa, Homo Sapiens
DRNGRTLDL

SEQ ID NO: 65971 - protein, 9 aa, Homo Sapiens
GEKSYVCDT

SEQ ID NO: 65972 - protein, 9 aa, Homo Sapiens
SPEEKIKVK

SEQ ID NO: 65973 - protein, 9 aa, Homo Sapiens
FPSSPKSSE

SEQ ID NO: 65974 - protein, 9 aa, Homo Sapiens
GSSPDLPKA

SEQ ID NO: 65975 - protein, 9 aa, Homo Sapiens
AKGECLPYF

SEQ ID NO: 65976 - protein, 9 aa, Homo Sapiens
QMPQLPAAV

SEQ ID NO: 65977 - protein, 9 aa, Homo Sapiens
TVSDAPQVK

SEQ ID NO: 65978 - protein, 9 aa, Homo Sapiens
TFFFFFFFC

SEQ ID NO: 65979 - protein, 9 aa, Homo Sapiens
GDGLSIELL

SEQ ID NO: 65980 - protein, 9 aa, Homo Sapiens
NLDATARDG

SEQ ID NO: 65981 - protein, 9 aa, Homo Sapiens
HHAAPHHHH

SEQ ID NO: 65982 - protein, 9 aa, Homo Sapiens
LCNCAVASH

SEQ ID NO: 65983 - protein, 9 aa, Homo Sapiens
RLEGSLISF

SEQ ID NO: 65984 - protein, 9 aa, Homo Sapiens
PSLDLHQEM

SEQ ID NO: 65985 - protein, 9 aa, Homo Sapiens
TVKKSANEF

SEQ ID NO: 65986 - protein, 9 aa, Homo Sapiens
VKKSANEFP

SEQ ID NO: 65987 - protein, 9 aa, Homo Sapiens
GLVGEAEGE

SEQ ID NO: 65988 - protein, 9 aa, Homo Sapiens
LPAAVPQQG

SEQ ID NO: 65989 - protein, 9 aa, Homo Sapiens
ELQGHTLCS

SEQ ID NO: 65990 - protein, 9 aa, Homo Sapiens
PPGPPGSTA

SEQ ID NO: 65991 - protein, 9 aa, Homo Sapiens
LLCEASILK

SEQ ID NO: 65992 - protein, 9 aa, Homo Sapiens
LRGRSSPGG

SEQ ID NO: 65993 - protein, 9 aa, Homo Sapiens
AFGAERGNQ

SEQ ID NO: 65994 - protein, 9 aa, Homo Sapiens
LSPEEKIKV

SEQ ID NO: 65995 - protein, 9 aa, Homo Sapiens
RSHTGKELD

SEQ ID NO: 65996 - protein, 9 aa, Homo Sapiens
IQTGMMARE

SEQ ID NO: 65997 - protein, 9 aa, Homo Sapiens
APHHHHHHH

SEQ ID NO: 65998 - protein, 9 aa, Homo Sapiens
TALPGSKGD

SEQ ID NO: 65999 - protein, 9 aa, Homo Sapiens
ISVMVSHSN

SEQ ID NO: 66000 - protein, 9 aa, Homo Sapiens
WTGGCPFRE

SEQ ID NO: 66001 - protein, 9 aa, Homo Sapiens
LNARYMQKI

SEQ ID NO: 66002 - protein, 9 aa, Homo Sapiens
VSDAPQVKE

SEQ ID NO: 66003 - protein, 9 aa, Homo Sapiens
TQTQEVEKL

SEQ ID NO: 66004 - protein, 9 aa, Homo Sapiens
GDVAFPRRS

SEQ ID NO: 66005 - protein, 9 aa, Homo Sapiens
QILSPEEKI

SEQ ID NO: 66006 - protein, 9 aa, Homo Sapiens
ELQRDPRAG

SEQ ID NO: 66007 - protein, 9 aa, Homo Sapiens
PKTPLLQGI

SEQ ID NO: 66008 - protein, 9 aa, Homo Sapiens
SILCIWVLT

SEQ ID NO: 66009 - protein, 9 aa, Homo Sapiens
YGHEGSGPP

SEQ ID NO: 66010 - protein, 9 aa, Homo Sapiens
MAALGSVYE

SEQ ID NO: 66011 - protein, 9 aa, Homo Sapiens
YSLWNKELK

SEQ ID NO: 66012 - protein, 9 aa, Homo Sapiens
TADQDARGK

SEQ ID NO: 66013 - protein, 9 aa, Homo Sapiens
DVAFPRRSY

SEQ ID NO: 66014 - protein, 9 aa, Homo Sapiens
TRRTAPNPQ

SEQ ID NO: 66015 - protein, 9 aa, Homo Sapiens
EVEKLVRAG

SEQ ID NO: 66016 - protein, 9 aa, Homo Sapiens
SLKLNQCRL

SEQ ID NO: 66017 - protein, 9 aa, Homo Sapiens
NSLQIYTIS

SEQ ID NO: 66018 - protein, 9 aa, Homo Sapiens
PLIYSLWNK

SEQ ID NO: 66019 - protein, 9 aa, Homo Sapiens
LSHGSTTKA

SEQ ID NO: 66020 - protein, 9 aa, Homo Sapiens
ASELQRDPR

SEQ ID NO: 66021 - protein, 9 aa, Homo Sapiens
DPFQMKLFV

SEQ ID NO: 66022 - protein, 9 aa, Homo Sapiens
QDARGKVEF

SEQ ID NO: 66023 - protein, 9 aa, Homo Sapiens
TVASTYKSQ

SEQ ID NO: 66024 - protein, 9 aa, Homo Sapiens
RRTAPNPQR

SEQ ID NO: 66025 - protein, 9 aa, Homo Sapiens
FSLKLNQCR

SEQ ID NO: 66026 - protein, 9 aa, Homo Sapiens
LEGSLISFQ

SEQ ID NO: 66027 - protein, 9 aa, Homo Sapiens
AELQGHTLC

SEQ ID NO: 66028 - protein, 9 aa, Homo Sapiens
KLGVLSRSQ

SEQ ID NO: 66029 - protein, 9 aa, Homo Sapiens
RGPAASFTA

SEQ ID NO: 66030 - protein, 9 aa, Homo Sapiens
WNKELKDAL

SEQ ID NO: 66031 - protein, 9 aa, Homo Sapiens
RDFLESKGC

SEQ ID NO: 66032 - protein, 9 aa, Homo Sapiens
AREERENNL

SEQ ID NO: 66033 - protein, 9 aa, Homo Sapiens
LRFISSKLP

SEQ ID NO: 66034 - protein, 9 aa, Homo Sapiens
PFSIHPQGI

SEQ ID NO: 66035 - protein, 9 aa, Homo Sapiens
RCQDASELQ

SEQ ID NO: 66036 - protein, 9 aa, Homo Sapiens
TQEVEKLVR

SEQ ID NO: 66037 - protein, 9 aa, Homo Sapiens
RENKVADWL

SEQ ID NO: 66038 - protein, 9 aa, Homo Sapiens
IWVLTGVLV

SEQ ID NO: 66039 - protein, 9 aa, Homo Sapiens
ARENKVADW

SEQ ID NO: 66040 - protein, 9 aa, Homo Sapiens
KNKADKPFS

SEQ ID NO: 66041 - protein, 9 aa, Homo Sapiens
LDATARDGV

SEQ ID NO: 66042 - protein, 9 aa, Homo Sapiens
SQAAVEQEE

SEQ ID NO: 66043 - protein, 9 aa, Homo Sapiens
VRRHTGEKS

SEQ ID NO: 66044 - protein, 9 aa, Homo Sapiens
DGDKEDELV

SEQ ID NO: 66045 - protein, 9 aa, Homo Sapiens
AHHHHAAPH

SEQ ID NO: 66046 - protein, 9 aa, Homo Sapiens
TGGCPFREG

SEQ ID NO: 66047 - protein, 9 aa, Homo Sapiens
GIQTGMMAR

SEQ ID NO: 66048 - protein, 9 aa, Homo Sapiens
CLPALGGSP

SEQ ID NO: 66049 - protein, 9 aa, Homo Sapiens
AASFTAARS

SEQ ID NO: 66050 - protein, 9 aa, Homo Sapiens
GEAEGEEEE

SEQ ID NO: 66051 - protein, 9 aa, Homo Sapiens
MYANDKKIQ

SEQ ID NO: 66052 - protein, 9 aa, Homo Sapiens
QEVEKLVRA

SEQ ID NO: 66053 - protein, 9 aa, Homo Sapiens
SEEGNLLNT

SEQ ID NO: 66054 - protein, 9 aa, Homo Sapiens
QSPRREPDP

SEQ ID NO: 66055 - protein, 9 aa, Homo Sapiens
MLSLSPAKE

SEQ ID NO: 66056 - protein, 9 aa, Homo Sapiens
TPNLDATAR

SEQ ID NO: 66057 - protein, 9 aa, Homo Sapiens
VPPSKRRRE

SEQ ID NO: 66058 - protein, 9 aa, Homo Sapiens
IAKGECLPY

SEQ ID NO: 66059 - protein, 9 aa, Homo Sapiens
IDCFHLQPL

SEQ ID NO: 66060 - protein, 9 aa, Homo Sapiens
SYARHFLEF

SEQ ID NO: 66061 - protein, 9 aa, Homo Sapiens
PSQSAELQG

SEQ ID NO: 66062 - protein, 9 aa, Homo Sapiens
KLVRAGLRN

SEQ ID NO: 66063 - protein, 9 aa, Homo Sapiens
KPSQSAELQ

SEQ ID NO: 66064 - protein, 9 aa, Homo Sapiens
KSQYEEALR

SEQ ID NO: 66065 - protein, 9 aa, Homo Sapiens
LQRDPRAGS

SEQ ID NO: 66066 - protein, 9 aa, Homo Sapiens
LCIWVLTGV

SEQ ID NO: 66067 - protein, 9 aa, Homo Sapiens
TTKAIRTTA

SEQ ID NO: 66068 - protein, 9 aa, Homo Sapiens
ICTVNGDEN

SEQ ID NO: 66069 - protein, 9 aa, Homo Sapiens
ELSHGSTTK

SEQ ID NO: 66070 - protein, 9 aa, Homo Sapiens
ILCIWVLTG

SEQ ID NO: 66071 - protein, 9 aa, Homo Sapiens
DQDARGKVE

SEQ ID NO: 66072 - protein, 9 aa, Homo Sapiens
LSLSPAKEP

SEQ ID NO: 66073 - protein, 9 aa, Homo Sapiens
EDVNQSTPK

SEQ ID NO: 66074 - protein, 9 aa, Homo Sapiens
ERTYSANCR

SEQ ID NO: 66075 - protein, 9 aa, Homo Sapiens
PAASFTAAR

SEQ ID NO: 66076 - protein, 9 aa, Homo Sapiens
RDPFQMKLF

SEQ ID NO: 66077 - protein, 9 aa, Homo Sapiens
MEGWCQQMA

SEQ ID NO: 66078 - protein, 9 aa, Homo Sapiens
GPRGSGRAP

SEQ ID NO: 66079 - protein, 9 aa, Homo Sapiens
DASELQRDP

SEQ ID NO: 66080 - protein, 9 aa, Homo Sapiens
LFGFTREIQ

SEQ ID NO: 66081 - protein, 9 aa, Homo Sapiens
DLPKASACP

SEQ ID NO: 66082 - protein, 9 aa, Homo Sapiens
SLQIYTISP

SEQ ID NO: 66083 - protein, 9 aa, Homo Sapiens
HDQLRVRVT

SEQ ID NO: 66084 - protein, 9 aa, Homo Sapiens
LNQCRLGEP

SEQ ID NO: 66085 - protein, 9 aa, Homo Sapiens
AVQILSPEE

SEQ ID NO: 66086 - protein, 9 aa, Homo Sapiens
SQYEEALRE

SEQ ID NO: 66087 - protein, 9 aa, Homo Sapiens
LSIELLAVE

SEQ ID NO: 66088 - protein, 9 aa, Homo Sapiens
STYKSQYEE

SEQ ID NO: 66089 - protein, 9 aa, Homo Sapiens
ILKYVQEDS

SEQ ID NO: 66090 - protein, 9 aa, Homo Sapiens
QRRSFAERY

SEQ ID NO: 66091 - protein, 9 aa, Homo Sapiens
APLGDEVTK

SEQ ID NO: 66092 - protein, 9 aa, Homo Sapiens
GPPGSTALP

SEQ ID NO: 66093 - protein, 9 aa, Homo Sapiens
QYEEALREE

SEQ ID NO: 66094 - protein, 9 aa, Homo Sapiens
SNLTGKLTG

SEQ ID NO: 66095 - protein, 9 aa, Homo Sapiens
NKWIPKDSV

SEQ ID NO: 66096 - protein, 9 aa, Homo Sapiens
LKHWTGGCP

SEQ ID NO: 66097 - protein, 9 aa, Homo Sapiens
GFTREIQDH

SEQ ID NO: 66098 - protein, 9 aa, Homo Sapiens
PYQMPQLPA

SEQ ID NO: 66099 - protein, 9 aa, Homo Sapiens
VGEAEGEEE

SEQ ID NO: 66100 - protein, 9 aa, Homo Sapiens
FCPCNNCNS

SEQ ID NO: 66101 - protein, 9 aa, Homo Sapiens
ECDPTDPNK

SEQ ID NO: 66102 - protein, 9 aa, Homo Sapiens
SGGGIGTFI

SEQ ID NO: 66103 - protein, 9 aa, Homo Sapiens
QRPGHPCLP

SEQ ID NO: 66104 - protein, 9 aa, Homo Sapiens
VMVSHSNGT

SEQ ID NO: 66105 - protein, 9 aa, Homo Sapiens
GISVMVSHS

SEQ ID NO: 66106 - protein, 9 aa, Homo Sapiens
SPCQQAGCV

SEQ ID NO: 66107 - protein, 9 aa, Homo Sapiens
QKIRFPIPT

SEQ ID NO: 66108 - protein, 9 aa, Homo Sapiens
GLSNMRSHT

SEQ ID NO: 66109 - protein, 9 aa, Homo Sapiens
APNPQRPGH

SEQ ID NO: 66110 - protein, 9 aa, Homo Sapiens
GSPGPRGSG

SEQ ID NO: 66111 - protein, 9 aa, Homo Sapiens
KEEEEAGES

SEQ ID NO: 66112 - protein, 9 aa, Homo Sapiens
LGDLCNCAV

SEQ ID NO: 66113 - protein, 9 aa, Homo Sapiens
QLLRDPKTP

SEQ ID NO: 66114 - protein, 9 aa, Homo Sapiens
SSPCQQAGC

SEQ ID NO: 66115 - protein, 9 aa, Homo Sapiens
PSPPGGATG

SEQ ID NO: 66116 - protein, 9 aa, Homo Sapiens
TKLRPTMTY

SEQ ID NO: 66117 - protein, 9 aa, Homo Sapiens
RMLLPSSSP

SEQ ID NO: 66118 - protein, 9 aa, Homo Sapiens
GSLISFQYG

SEQ ID NO: 66119 - protein, 9 aa, Homo Sapiens
NCAVASHVA

SEQ ID NO: 66120 - protein, 9 aa, Homo Sapiens
GPSGEWGLA

SEQ ID NO: 66121 - protein, 9 aa, Homo Sapiens
KSANEFPCL

SEQ ID NO: 66122 - protein, 9 aa, Homo Sapiens
QGGWTDAGS

SEQ ID NO: 66123 - protein, 9 aa, Homo Sapiens
FYLFGFTRE

SEQ ID NO: 66124 - protein, 9 aa, Homo Sapiens
MMARENKVA

SEQ ID NO: 66125 - protein, 9 aa, Homo Sapiens
MQKIRFPIP

SEQ ID NO: 66126 - protein, 9 aa, Homo Sapiens
HQEMPQQED

SEQ ID NO: 66127 - protein, 9 aa, Homo Sapiens
ERGNQEPFL

SEQ ID NO: 66128 - protein, 9 aa, Homo Sapiens
FLEFQGSAI

SEQ ID NO: 66129 - protein, 9 aa, Homo Sapiens
GSGPPAPAP

SEQ ID NO: 66130 - protein, 9 aa, Homo Sapiens
VASTYKSQY

SEQ ID NO: 66131 - protein, 9 aa, Homo Sapiens
NGDENAFGT

SEQ ID NO: 66132 - protein, 9 aa, Homo Sapiens
PRREPDPNA

SEQ ID NO: 66133 - protein, 9 aa, Homo Sapiens
LPPSSPSPP

SEQ ID NO: 66134 - protein, 9 aa, Homo Sapiens
GSTALPGSK

SEQ ID NO: 66135 - protein, 9 aa, Homo Sapiens
CKESVNQQG

SEQ ID NO: 66136 - protein, 9 aa, Homo Sapiens
CRDFLESKG

SEQ ID NO: 66137 - protein, 9 aa, Homo Sapiens
LRPTMTYKM

SEQ ID NO: 66138 - protein, 9 aa, Homo Sapiens
GHEGSGPPA

SEQ ID NO: 66139 - protein, 9 aa, Homo Sapiens
DGLSIELLA

SEQ ID NO: 66140 - protein, 9 aa, Homo Sapiens
PICTVNGDE

SEQ ID NO: 66141 - protein, 9 aa, Homo Sapiens
RLAHVCEPS

SEQ ID NO: 66142 - protein, 9 aa, Homo Sapiens
VCEPSTCVY

SEQ ID NO: 66143 - protein, 9 aa, Homo Sapiens
NQEPFLQAL

SEQ ID NO: 66144 - protein, 9 aa, Homo Sapiens
LPKASACPP

SEQ ID NO: 66145 - protein, 9 aa, Homo Sapiens
PPGGATGPC

SEQ ID NO: 66146 - protein, 9 aa, Homo Sapiens
RREPDPNAP

SEQ ID NO: 66147 - protein, 9 aa, Homo Sapiens
KHWTGGCPF

SEQ ID NO: 66148 - protein, 9 aa, Homo Sapiens
QSAELQGHT

SEQ ID NO: 66149 - protein, 9 aa, Homo Sapiens
QEMPQQEDQ

SEQ ID NO: 66150 - protein, 9 aa, Homo Sapiens
DAPQVKENP

SEQ ID NO: 66151 - protein, 9 aa, Homo Sapiens
TGISVMVSH

SEQ ID NO: 66152 - protein, 9 aa, Homo Sapiens
FNGLSNMRS

SEQ ID NO: 66153 - protein, 9 aa, Homo Sapiens
DEEKEEEEK

SEQ ID NO: 66154 - protein, 9 aa, Homo Sapiens
ISTFFFFFF

SEQ ID NO: 66155 - protein, 9 aa, Homo Sapiens
PALGGSPGP

SEQ ID NO: 66156 - protein, 9 aa, Homo Sapiens
APQVKENPS

SEQ ID NO: 66157 - protein, 9 aa, Homo Sapiens
KHQGGWTDA

SEQ ID NO: 66158 - protein, 9 aa, Homo Sapiens
ELLAVERGN

SEQ ID NO: 66159 - protein, 9 aa, Homo Sapiens
ALGGSPGPR

SEQ ID NO: 66160 - protein, 9 aa, Homo Sapiens
QARSDGDKE

SEQ ID NO: 66161 - protein, 9 aa, Homo Sapiens
FLRGRSSPG

SEQ ID NO: 66162 - protein, 9 aa, Homo Sapiens
QPGPSGEWG

SEQ ID NO: 66163 - protein, 9 aa, Homo Sapiens
FLAVQILSP

SEQ ID NO: 66164 - protein, 9 aa, Homo Sapiens
SPGPRGSGR

SEQ ID NO: 66165 - protein, 9 aa, Homo Sapiens
PKPPGLGTE

SEQ ID NO: 66166 - protein, 9 aa, Homo Sapiens
GGWTDAGSG

SEQ ID NO: 66167 - protein, 9 aa, Homo Sapiens
RPTMTYKMH

SEQ ID NO: 66168 - protein, 9 aa, Homo Sapiens
NQTHYIIAK

SEQ ID NO: 66169 - protein, 9 aa, Homo Sapiens
LSILCIWVL

SEQ ID NO: 66170 - protein, 9 aa, Homo Sapiens
GDEVTKSVY

SEQ ID NO: 66171 - protein, 9 aa, Homo Sapiens
SGPPAPAPR

SEQ ID NO: 66172 - protein, 9 aa, Homo Sapiens
AGSGGGGGY

SEQ ID NO: 66173 - protein, 9 aa, Homo Sapiens
SQSAELQGH

SEQ ID NO: 66174 - protein, 9 aa, Homo Sapiens
SPGGFRGGR

SEQ ID NO: 66175 - protein, 9 aa, Homo Sapiens
LVPPSKRRR

SEQ ID NO: 66176 - protein, 9 aa, Homo Sapiens
AAVPQQGLR

SEQ ID NO: 66177 - protein, 9 aa, Homo Sapiens
CAVASHVAP

SEQ ID NO: 66178 - protein, 9 aa, Homo Sapiens
STLPTSSHS

SEQ ID NO: 66179 - protein, 9 aa, Homo Sapiens
SPAKEPMAK

SEQ ID NO: 66180 - protein, 9 aa, Homo Sapiens
HHHHAAPHH

SEQ ID NO: 66181 - protein, 9 aa, Homo Sapiens
CRKWDRNGR

SEQ ID NO: 66182 - protein, 9 aa, Homo Sapiens
RSSPGGFRG

SEQ ID NO: 66183 - protein, 9 aa, Homo Sapiens
RGRSSPGGF

SEQ ID NO: 66184 - protein, 9 aa, Homo Sapiens
HSNGTVSPS

SEQ ID NO: 66185 - protein, 9 aa, Homo Sapiens
HKTVKKSAN

SEQ ID NO: 66186 - protein, 9 aa, Homo Sapiens
WMHRDVQDP

SEQ ID NO: 66187 - protein, 9 aa, Homo Sapiens
LDLHQEMPQ

SEQ ID NO: 66188 - protein, 9 aa, Homo Sapiens
IFSLKLNQC

SEQ ID NO: 66189 - protein, 9 aa, Homo Sapiens
QVKENPSTV

SEQ ID NO: 66190 - protein, 9 aa, Homo Sapiens
LIYSLWNKE

SEQ ID NO: 66191 - protein, 9 aa, Homo Sapiens
RNGRTLDLE

SEQ ID NO: 66192 - protein, 9 aa, Homo Sapiens
EGWCQQMAR

SEQ ID NO: 66193 - protein, 9 aa, Homo Sapiens
KWIPKDSVG

SEQ ID NO: 66194 - protein, 9 aa, Homo Sapiens
LPSCNNRHF

SEQ ID NO: 66195 - protein, 9 aa, Homo Sapiens
FFFFFFFCL

SEQ ID NO: 66196 - protein, 9 aa, Homo Sapiens
SPKSSETAF

SEQ ID NO: 66197 - protein, 9 aa, Homo Sapiens
GGHDQLRVR

SEQ ID NO: 66198 - protein, 9 aa, Homo Sapiens
GLGAKPCKA

SEQ ID NO: 66199 - protein, 9 aa, Homo Sapiens
STALPGSKG

SEQ ID NO: 66200 - protein, 9 aa, Homo Sapiens
SHGSTTKAI

SEQ ID NO: 66201 - protein, 9 aa, Homo Sapiens
CTVNGDENA

SEQ ID NO: 66202 - protein, 9 aa, Homo Sapiens
GHPCLPALG

SEQ ID NO: 66203 - protein, 9 aa, Homo Sapiens
IYTISPNFH

SEQ ID NO: 66204 - protein, 9 aa, Homo Sapiens
LTGVLVYLA

SEQ ID NO: 66205 - protein, 9 aa, Homo Sapiens
TSNLTGKLT

SEQ ID NO: 66206 - protein, 9 aa, Homo Sapiens
EEGNLLNTV

SEQ ID NO: 66207 - protein, 9 aa, Homo Sapiens
KPFSIHPQG

SEQ ID NO: 66208 - protein, 9 aa, Homo Sapiens
ISFQYGDLQ

SEQ ID NO: 66209 - protein, 9 aa, Homo Sapiens
LAPGPSRRR

SEQ ID NO: 66210 - protein, 9 aa, Homo Sapiens
VYERDIWKA

SEQ ID NO: 66211 - protein, 9 aa, Homo Sapiens
GVLSRSQNG

SEQ ID NO: 66212 - protein, 9 aa, Homo Sapiens
DAGSGGGGG

SEQ ID NO: 66213 - protein, 9 aa, Homo Sapiens
EPDPNAPGD

SEQ ID NO: 66214 - protein, 9 aa, Homo Sapiens
RGNQEPFLQ

SEQ ID NO: 66215 - protein, 9 aa, Homo Sapiens
FISSKLPDK

SEQ ID NO: 66216 - protein, 9 aa, Homo Sapiens
FGAERGNQE

SEQ ID NO: 66217 - protein, 9 aa, Homo Sapiens
SSPDLPKAS

SEQ ID NO: 66218 - protein, 9 aa, Homo Sapiens
CQDASELQR

SEQ ID NO: 66219 - protein, 9 aa, Homo Sapiens
GCVPVCCKT

SEQ ID NO: 66220 - protein, 9 aa, Homo Sapiens
SHSNGTVSP

SEQ ID NO: 66221 - protein, 9 aa, Homo Sapiens
KEDELVGSN

SEQ ID NO: 66222 - protein, 9 aa, Homo Sapiens
KMLSLSPAK

SEQ ID NO: 66223 - protein, 9 aa, Homo Sapiens
WGLAGPPGR

SEQ ID NO: 66224 - protein, 9 aa, Homo Sapiens
VQARLSCLP

SEQ ID NO: 66225 - protein, 9 aa, Homo Sapiens
IYSLWNKEL

SEQ ID NO: 66226 - protein, 9 aa, Homo Sapiens
LSPAKEPMA

SEQ ID NO: 66227 - protein, 9 aa, Homo Sapiens
VGTNSLQIY

SEQ ID NO: 66228 - protein, 9 aa, Homo Sapiens
KMYANDKKI

SEQ ID NO: 66229 - protein, 9 aa, Homo Sapiens
GLQNPIDCF

SEQ ID NO: 66230 - protein, 9 aa, Homo Sapiens
VLTGVLVYL

SEQ ID NO: 66231 - protein, 9 aa, Homo Sapiens
FGFTREIQD

SEQ ID NO: 66232 - protein, 9 aa, Homo Sapiens
NARYMQKIR

SEQ ID NO: 66233 - protein, 9 aa, Homo Sapiens
PKLLSENCD

SEQ ID NO: 66234 - protein, 9 aa, Homo Sapiens
PGSTALPGS

SEQ ID NO: 66235 - protein, 9 aa, Homo Sapiens
PSCNNRHFW

SEQ ID NO: 66236 - protein, 9 aa, Homo Sapiens
AALGSVYER

SEQ ID NO: 66237 - protein, 9 aa, Homo Sapiens
ESVNQQGKI

SEQ ID NO: 66238 - protein, 9 aa, Homo Sapiens
RTLDLEEFL

SEQ ID NO: 66239 - protein, 9 aa, Homo Sapiens
ISSKLPDKT

SEQ ID NO: 66240 - protein, 9 aa, Homo Sapiens
SELQRDPRA

SEQ ID NO: 66241 - protein, 9 aa, Homo Sapiens
RHFLEFQGS

SEQ ID NO: 66242 - protein, 9 aa, Homo Sapiens
HPCLPALGG

SEQ ID NO: 66243 - protein, 9 aa, Homo Sapiens
WPYRASDNS

SEQ ID NO: 66244 - protein, 9 aa, Homo Sapiens
GKLTGLLPF

SEQ ID NO: 66245 - protein, 9 aa, Homo Sapiens
SLWNKELKD

SEQ ID NO: 66246 - protein, 9 aa, Homo Sapiens
PSSSPKPPG

SEQ ID NO: 66247 - protein, 9 aa, Homo Sapiens
GWCQQMARE

SEQ ID NO: 66248 - protein, 9 aa, Homo Sapiens
IAMSGGGIG

SEQ ID NO: 66249 - protein, 9 aa, Homo Sapiens
RPGHPCLPA

SEQ ID NO: 66250 - protein, 9 aa, Homo Sapiens
LSQAAVEQE

SEQ ID NO: 66251 - protein, 9 aa, Homo Sapiens
ELNARYMQK

SEQ ID NO: 66252 - protein, 9 aa, Homo Sapiens
KLNQCRLGE

SEQ ID NO: 66253 - protein, 9 aa, Homo Sapiens
SSTLPTSSH

SEQ ID NO: 66254 - protein, 9 aa, Homo Sapiens
PNQTHYIIA

SEQ ID NO: 66255 - protein, 9 aa, Homo Sapiens
DKEDELVGS

SEQ ID NO: 66256 - protein, 9 aa, Homo Sapiens
QQMAREERE

SEQ ID NO: 66257 - protein, 9 aa, Homo Sapiens
QSTPKLLSE

SEQ ID NO: 66258 - protein, 9 aa, Homo Sapiens
MHRDVQDPF

SEQ ID NO: 66259 - protein, 9 aa, Homo Sapiens
VSISTFFFF

SEQ ID NO: 66260 - protein, 9 aa, Homo Sapiens
STPKLLSEN

SEQ ID NO: 66261 - protein, 9 aa, Homo Sapiens
TKMYANDKK

SEQ ID NO: 66262 - protein, 9 aa, Homo Sapiens
QTGMMAREN

SEQ ID NO: 66263 - protein, 9 aa, Homo Sapiens
PCQQAGCVP

SEQ ID NO: 66264 - protein, 9 aa, Homo Sapiens
LGGHDQLRV

SEQ ID NO: 66265 - protein, 9 aa, Homo Sapiens
VFPSSPKSS

SEQ ID NO: 66266 - protein, 9 aa, Homo Sapiens
GFHWMHRDV

SEQ ID NO: 66267 - protein, 9 aa, Homo Sapiens
AWPYRASDN

SEQ ID NO: 66268 - protein, 9 aa, Homo Sapiens
DPNKWIPKD

SEQ ID NO: 66269 - protein, 9 aa, Homo Sapiens
LGSVYERDI

SEQ ID NO: 66270 - protein, 9 aa, Homo Sapiens
KESVNQQGK

SEQ ID NO: 66271 - protein, 9 aa, Homo Sapiens
LQNPIDCFH

SEQ ID NO: 66272 - protein, 9 aa, Homo Sapiens
HKMLSLSPA

SEQ ID NO: 66273 - protein, 9 aa, Homo Sapiens
CKAVSLSVT

SEQ ID NO: 66274 - protein, 9 aa, Homo Sapiens
SSPKPPGLG

SEQ ID NO: 66275 - protein, 9 aa, Homo Sapiens
RWGLPPSSP

SEQ ID NO: 66276 - protein, 9 aa, Homo Sapiens
PGPPGSTAL

SEQ ID NO: 66277 - protein, 9 aa, Homo Sapiens
NAAHFCPCN

SEQ ID NO: 66278 - protein, 9 aa, Homo Sapiens
PARWGLPPS

SEQ ID NO: 66279 - protein, 9 aa, Homo Sapiens
CEASILKYV

SEQ ID NO: 66280 - protein, 9 aa, Homo Sapiens
SPGAWPYRA

SEQ ID NO: 66281 - protein, 9 aa, Homo Sapiens
EKSYVCDTC

SEQ ID NO: 66282 - protein, 9 aa, Homo Sapiens
HQKSCSSHV

SEQ ID NO: 66283 - protein, 9 aa, Homo Sapiens
TGKLTGLLP

SEQ ID NO: 66284 - protein, 9 aa, Homo Sapiens
MSGGGIGTF

SEQ ID NO: 66285 - protein, 9 aa, Homo Sapiens
STFFFFFFF

SEQ ID NO: 66286 - protein, 9 aa, Homo Sapiens
ARLSCLPKD

SEQ ID NO: 66287 - protein, 9 aa, Homo Sapiens
DLHQEMPQQ

SEQ ID NO: 66288 - protein, 9 aa, Homo Sapiens
QNPIDCFHL

SEQ ID NO: 66289 - protein, 9 aa, Homo Sapiens
GAKPCKAVS

SEQ ID NO: 66290 - protein, 9 aa, Homo Sapiens
GDENAFGTL

SEQ ID NO: 66291 - protein, 9 aa, Homo Sapiens
PDLPKASAC

SEQ ID NO: 66292 - protein, 9 aa, Homo Sapiens
MTYKMHFRN

SEQ ID NO: 66293 - protein, 9 aa, Homo Sapiens
DNGLGAKPC

SEQ ID NO: 66294 - protein, 9 aa, Homo Sapiens
CLAHSESYI

SEQ ID NO: 66295 - protein, 9 aa, Homo Sapiens
LGAKPCKAV

SEQ ID NO: 66296 - protein, 9 aa, Homo Sapiens
NLLNTVSPT

SEQ ID NO: 66297 - protein, 9 aa, Homo Sapiens
LGDEVTKSV

SEQ ID NO: 66298 - protein, 9 aa, Homo Sapiens
NGRTLDLEE

SEQ ID NO: 66299 - protein, 9 aa, Homo Sapiens
HLQNYHQKS

SEQ ID NO: 66300 - protein, 9 aa, Homo Sapiens
LLNTVSPTV

SEQ ID NO: 66301 - protein, 9 aa, Homo Sapiens
VSSTLPTSS

SEQ ID NO: 66302 - protein, 9 aa, Homo Sapiens
AFPRRSYPM

SEQ ID NO: 66303 - protein, 9 aa, Homo Sapiens
EKLVRAGLR

SEQ ID NO: 66304 - protein, 9 aa, Homo Sapiens
EKPSQSAEL

SEQ ID NO: 66305 - protein, 9 aa, Homo Sapiens
GGCPFREGV

SEQ ID NO: 66306 - protein, 9 aa, Homo Sapiens
HEGSGPPAP

SEQ ID NO: 66307 - protein, 9 aa, Homo Sapiens
DNSWVFPSS

SEQ ID NO: 66308 - protein, 9 aa, Homo Sapiens
VNTSNLTGK

SEQ ID NO: 66309 - protein, 9 aa, Homo Sapiens
TNSLQIYTI

SEQ ID NO: 66310 - protein, 9 aa, Homo Sapiens
ATRRTAPNP

SEQ ID NO: 66311 - protein, 9 aa, Homo Sapiens
TMHKMLSLS

SEQ ID NO: 66312 - protein, 9 aa, Homo Sapiens
SLDLHQEMP

SEQ ID NO: 66313 - protein, 9 aa, Homo Sapiens
RFLRGRSSP

SEQ ID NO: 66314 - protein, 9 aa, Homo Sapiens
DATARDGVK

SEQ ID NO: 66315 - protein, 9 aa, Homo Sapiens
TTKMYANDK

SEQ ID NO: 66316 - protein, 9 aa, Homo Sapiens
CRLGEPMLV

SEQ ID NO: 66317 - protein, 9 aa, Homo Sapiens
MAREERENN

SEQ ID NO: 66318 - protein, 9 aa, Homo Sapiens
KSYVCDTCG

SEQ ID NO: 66319 - protein, 9 aa, Homo Sapiens
CLPSCNNRH

SEQ ID NO: 66320 - protein, 9 aa, Homo Sapiens
LQGHTLCSR

SEQ ID NO: 66321 - protein, 9 aa, Homo Sapiens
GGSPGPRGS

SEQ ID NO: 66322 - protein, 9 aa, Homo Sapiens
PSSPKSSET

SEQ ID NO: 66323 - protein, 9 aa, Homo Sapiens
RFYLFGFTR

SEQ ID NO: 66324 - protein, 9 aa, Homo Sapiens
GHDQLRVRV

SEQ ID NO: 66325 - protein, 9 aa, Homo Sapiens
YSQEVRDPF

SEQ ID NO: 66326 - protein, 9 aa, Homo Sapiens
PVSSTLPTS

SEQ ID NO: 66327 - protein, 9 aa, Homo Sapiens
WTDAGSGGG

SEQ ID NO: 66328 - protein, 9 aa, Homo Sapiens
NPLIYSLWN

SEQ ID NO: 66329 - protein, 9 aa, Homo Sapiens
LTGKLTGLL

SEQ ID NO: 66330 - protein, 9 aa, Homo Sapiens
NIPICTVNG

SEQ ID NO: 66331 - protein, 9 aa, Homo Sapiens
SWVFPSSPK

SEQ ID NO: 66332 - protein, 9 aa, Homo Sapiens
GDKEDELVG

SEQ ID NO: 66333 - protein, 9 aa, Homo Sapiens
LISFQYGDL

SEQ ID NO: 66334 - protein, 9 aa, Homo Sapiens
NSWVFPSSP

SEQ ID NO: 66335 - protein, 9 aa, Homo Sapiens
EERLEGSLI

SEQ ID NO: 66336 - protein, 9 aa, Homo Sapiens
NYHQKSCSS

SEQ ID NO: 66337 - protein, 9 aa, Homo Sapiens
QAGCVPVCC

SEQ ID NO: 66338 - protein, 9 aa, Homo Sapiens
CDPTDPNKW

SEQ ID NO: 66339 - protein, 9 aa, Homo Sapiens
VKILKHWTG

SEQ ID NO: 66340 - protein, 9 aa, Homo Sapiens
LNPLIYSLW

SEQ ID NO: 66341 - protein, 9 aa, Homo Sapiens
LCEASILKY

SEQ ID NO: 66342 - protein, 9 aa, Homo Sapiens
DCFHLQPLM

SEQ ID NO: 66343 - protein, 9 aa, Homo Sapiens
TAPNPQRPG

SEQ ID NO: 66344 - protein, 9 aa, Homo Sapiens
GVCKESVNQ

SEQ ID NO: 66345 - protein, 9 aa, Homo Sapiens
LRDPKTPLL

SEQ ID NO: 66346 - protein, 9 aa, Homo Sapiens
PNPQRPGHP

SEQ ID NO: 66347 - protein, 9 aa, Homo Sapiens
KLRPTMTYK

SEQ ID NO: 66348 - protein, 9 aa, Homo Sapiens
YLGDLCNCA

SEQ ID NO: 66349 - protein, 9 aa, Homo Sapiens
YKSQYEEAL

SEQ ID NO: 66350 - protein, 9 aa, Homo Sapiens
MEKSVLGGH

SEQ ID NO: 66351 - protein, 9 aa, Homo Sapiens
QPEKEEEEA

SEQ ID NO: 66352 - protein, 9 aa, Homo Sapiens
RRSYPMHRL

SEQ ID NO: 66353 - protein, 9 aa, Homo Sapiens
GQPGPSGEW

SEQ ID NO: 66354 - protein, 9 aa, Homo Sapiens
SYVCDTCGK

SEQ ID NO: 66355 - protein, 9 aa, Homo Sapiens
CSAPLGDEV

SEQ ID NO: 66356 - protein, 9 aa, Homo Sapiens
ARWGLPPSS

SEQ ID NO: 66357 - protein, 9 aa, Homo Sapiens
STTKAIRTT

SEQ ID NO: 66358 - protein, 9 aa, Homo Sapiens
CHLQNYHQK

SEQ ID NO: 66359 - protein, 9 aa, Homo Sapiens
RGKVEFQEG

SEQ ID NO: 66360 - protein, 9 aa, Homo Sapiens
RLSCLPKDN

SEQ ID NO: 66361 - protein, 9 aa, Homo Sapiens
VEKLVRAGL

SEQ ID NO: 66362 - protein, 9 aa, Homo Sapiens
LDQRGQRRS

SEQ ID NO: 66363 - protein, 9 aa, Homo Sapiens
EGSGPPAPA

SEQ ID NO: 66364 - protein, 9 aa, Homo Sapiens
SPHKTVKKS

SEQ ID NO: 66365 - protein, 9 aa, Homo Sapiens
GAWPYRASD

SEQ ID NO: 66366 - protein, 9 aa, Homo Sapiens
GNQEPFLQA

SEQ ID NO: 66367 - protein, 9 aa, Homo Sapiens
LWNKELKDA

SEQ ID NO: 66368 - protein, 9 aa, Homo Sapiens
GGGIGTFIL

SEQ ID NO: 66369 - protein, 9 aa, Homo Sapiens
LGSSPDLPK

SEQ ID NO: 66370 - protein, 9 aa, Homo Sapiens
NPQRPGHPC

SEQ ID NO: 66371 - protein, 9 aa, Homo Sapiens
YMQKIRFPI

SEQ ID NO: 66372 - protein, 9 aa, Homo Sapiens
GTNSLQIYT

SEQ ID NO: 66373 - protein, 9 aa, Homo Sapiens
SPKPPGLGT

SEQ ID NO: 66374 - protein, 9 aa, Homo Sapiens
ASTYKSQYE

SEQ ID NO: 66375 - protein, 9 aa, Homo Sapiens
SLSPAKEPM

SEQ ID NO: 66376 - protein, 9 aa, Homo Sapiens
KILKHWTGG

SEQ ID NO: 66377 - protein, 9 aa, Homo Sapiens
SQEVRDPFQ

SEQ ID NO: 66378 - protein, 9 aa, Homo Sapiens
MSYARHFLE

SEQ ID NO: 66379 - protein, 9 aa, Homo Sapiens
IELLAVERG

SEQ ID NO: 66380 - protein, 9 aa, Homo Sapiens
VTCLAHSES

SEQ ID NO: 66381 - protein, 9 aa, Homo Sapiens
ATQTQEVEK

SEQ ID NO: 66382 - protein, 9 aa, Homo Sapiens
LPALGGSPG

SEQ ID NO: 66383 - protein, 9 aa, Homo Sapiens
FRFYLFGFT

SEQ ID NO: 66384 - protein, 9 aa, Homo Sapiens
VAFPRRSYP

SEQ ID NO: 66385 - protein, 9 aa, Homo Sapiens
AGCVPVCCK

SEQ ID NO: 66386 - protein, 9 aa, Homo Sapiens
ASILKYVQE

SEQ ID NO: 66387 - protein, 9 aa, Homo Sapiens
IITTKMYAN

SEQ ID NO: 66388 - protein, 9 aa, Homo Sapiens
PSRRRYRKE

SEQ ID NO: 66389 - protein, 9 aa, Homo Sapiens
TSSPCQQAG

SEQ ID NO: 66390 - protein, 9 aa, Homo Sapiens
KASACPPGL

SEQ ID NO: 66391 - protein, 9 aa, Homo Sapiens
KSVLGGHDQ

SEQ ID NO: 66392 - protein, 9 aa, Homo Sapiens
HWTGGCPFR

SEQ ID NO: 66393 - protein, 9 aa, Homo Sapiens
VLVSISTFF

SEQ ID NO: 66394 - protein, 9 aa, Homo Sapiens
PCKAVSLSV

SEQ ID NO: 66395 - protein, 9 aa, Homo Sapiens
LAHSESYIG

SEQ ID NO: 66396 - protein, 9 aa, Homo Sapiens
QCRLGEPML

SEQ ID NO: 66397 - protein, 9 aa, Homo Sapiens
FKNKADKPF

SEQ ID NO: 66398 - protein, 9 aa, Homo Sapiens
RRHTGEKSY

SEQ ID NO: 66399 - protein, 9 aa, Homo Sapiens
GKVEFQEGV

SEQ ID NO: 66400 - protein, 9 aa, Homo Sapiens
ALSQAAVEQ

SEQ ID NO: 66401 - protein, 9 aa, Homo Sapiens
KPCKAVSLS

SEQ ID NO: 66402 - protein, 9 aa, Homo Sapiens
GLTRGPAAS

SEQ ID NO: 66403 - protein, 9 aa, Homo Sapiens
RDPKTPLLQ

SEQ ID NO: 66404 - protein, 9 aa, Homo Sapiens
VNQQGKIEL

SEQ ID NO: 66405 - protein, 9 aa, Homo Sapiens
CLPKDNSIY

SEQ ID NO: 66406 - protein, 9 aa, Homo Sapiens
FTREIQDHA

SEQ ID NO: 66407 - protein, 9 aa, Homo Sapiens
TSSHSSSAS

SEQ ID NO: 66408 - protein, 9 aa, Homo Sapiens
NCRDFLESK

SEQ ID NO: 66409 - protein, 9 aa, Homo Sapiens
TGEKSYVCD

SEQ ID NO: 66410 - protein, 9 aa, Homo Sapiens
ATARDGVKA

SEQ ID NO: 66411 - protein, 9 aa, Homo Sapiens
NGLGAKPCK

SEQ ID NO: 66412 - protein, 9 aa, Homo Sapiens
EWGLAGPPG

SEQ ID NO: 66413 - protein, 9 aa, Homo Sapiens
EMPQQEDQK

SEQ ID NO: 66414 - protein, 9 aa, Homo Sapiens
PRGSGRAPA

SEQ ID NO: 66415 - protein, 9 aa, Homo Sapiens
NTSNLTGKL

SEQ ID NO: 66416 - protein, 9 aa, Homo Sapiens
PNKWIPKDS

SEQ ID NO: 66417 - protein, 9 aa, Homo Sapiens
VFNGLSNMR

SEQ ID NO: 66418 - protein, 9 aa, Homo Sapiens
FHWMHRDVQ

SEQ ID NO: 66419 - protein, 9 aa, Homo Sapiens
TDAGSGGGG

SEQ ID NO: 66420 - protein, 9 aa, Homo Sapiens
LPSSSPKPP

SEQ ID NO: 66421 - protein, 9 aa, Homo Sapiens
FWQLLRDPK

SEQ ID NO: 66422 - protein, 9 aa, Homo Sapiens
YLFGFTREI

SEQ ID NO: 66423 - protein, 9 aa, Homo Sapiens
LFRFYLFGF

SEQ ID NO: 66424 - protein, 9 aa, Homo Sapiens
FPRRSYPMH

SEQ ID NO: 66425 - protein, 9 aa, Homo Sapiens
LGVLSRSQN

SEQ ID NO: 66426 - protein, 9 aa, Homo Sapiens
PTDPNKWIP

SEQ ID NO: 66427 - protein, 9 aa, Homo Sapiens
PQLPAAVPQ

SEQ ID NO: 66428 - protein, 9 aa, Homo Sapiens
SFTAARSDA

SEQ ID NO: 66429 - protein, 9 aa, Homo Sapiens
MVSHSNGTV

SEQ ID NO: 66430 - protein, 9 aa, Homo Sapiens
LLRDPKTPL

SEQ ID NO: 66431 - protein, 9 aa, Homo Sapiens
PFQMKLFVD

SEQ ID NO: 66432 - protein, 9 aa, Homo Sapiens
RFISSKLPD

SEQ ID NO: 66433 - protein, 9 aa, Homo Sapiens
KVEFQEGVE

SEQ ID NO: 66434 - protein, 9 aa, Homo Sapiens
LGLQNPIDC

SEQ ID NO: 66435 - protein, 9 aa, Homo Sapiens
EASILKYVQ

SEQ ID NO: 66436 - protein, 9 aa, Homo Sapiens
KEEEEKEEE

SEQ ID NO: 66437 - protein, 9 aa, Homo Sapiens
HQGGWTDAG

SEQ ID NO: 66438 - protein, 9 aa, Homo Sapiens
PSGEWGLAG

SEQ ID NO: 66439 - protein, 9 aa, Homo Sapiens
RNLAPGPSR

SEQ ID NO: 66440 - protein, 9 aa, Homo Sapiens
TARDGVKAR

SEQ ID NO: 66441 - protein, 9 aa, Homo Sapiens
SISTFFFFF

SEQ ID NO: 66442 - protein, 9 aa, Homo Sapiens
WQLLRDPKT

SEQ ID NO: 66443 - protein, 9 aa, Homo Sapiens
RHTGEKSYV

SEQ ID NO: 66444 - protein, 9 aa, Homo Sapiens
LHQEMPQQE

SEQ ID NO: 66445 - protein, 9 aa, Homo Sapiens
NLAPGPSRR

SEQ ID NO: 66446 - protein, 9 aa, Homo Sapiens
SGRAPARWG

SEQ ID NO: 66447 - protein, 9 aa, Homo Sapiens
YRASDNSFT

SEQ ID NO: 66448 - protein, 9 aa, Homo Sapiens
PPGSTALPG

SEQ ID NO: 66449 - protein, 9 aa, Homo Sapiens
PATRRTAPN

SEQ ID NO: 66450 - protein, 9 aa, Homo Sapiens
AGLVGEAEG

SEQ ID NO: 66451 - protein, 9 aa, Homo Sapiens
LSCLPKDNS

SEQ ID NO: 66452 - protein, 9 aa, Homo Sapiens
RKWDRNGRT

SEQ ID NO: 66453 - protein, 9 aa, Homo Sapiens
TRGPAASFT

SEQ ID NO: 66454 - protein, 9 aa, Homo Sapiens
QQAGCVPVC

SEQ ID NO: 66455 - protein, 9 aa, Homo Sapiens
PSSPSPPGG

SEQ ID NO: 66456 - protein, 9 aa, Homo Sapiens
WDRNGRTLD

SEQ ID NO: 66457 - protein, 9 aa, Homo Sapiens
RGSGRAPAR

SEQ ID NO: 66458 - protein, 9 aa, Homo Sapiens
QTHYIIAKG

SEQ ID NO: 66459 - protein, 9 aa, Homo Sapiens
KLTGLLPFK

SEQ ID NO: 66460 - protein, 9 aa, Homo Sapiens
MHKMLSLSP

SEQ ID NO: 66461 - protein, 9 aa, Homo Sapiens
SCLPKDNSI

SEQ ID NO: 66462 - protein, 9 aa, Homo Sapiens
GRTLDLEEF

SEQ ID NO: 66463 - protein, 9 aa, Homo Sapiens
GWTDAGSGG

SEQ ID NO: 66464 - protein, 9 aa, Homo Sapiens
LVSISTFFF

SEQ ID NO: 66465 - protein, 9 aa, Homo Sapiens
CPCNNCNSK

SEQ ID NO: 66466 - protein, 9 aa, Homo Sapiens
IVCHLQNYH

SEQ ID NO: 66467 - protein, 9 aa, Homo Sapiens
THYIIAKGE

SEQ ID NO: 66468 - protein, 9 aa, Homo Sapiens
TVNGDENAF

SEQ ID NO: 66469 - protein, 9 aa, Homo Sapiens
PEEKIKVKS

SEQ ID NO: 66470 - protein, 9 aa, Homo Sapiens
SSPGGFRGG

SEQ ID NO: 66471 - protein, 9 aa, Homo Sapiens
KTVKKSANE

SEQ ID NO: 66472 - protein, 9 aa, Homo Sapiens
ILSPEEKIK

SEQ ID NO: 66473 - protein, 9 aa, Homo Sapiens
DLDQRGQRR

SEQ ID NO: 66474 - protein, 9 aa, Homo Sapiens
APARWGLPP

SEQ ID NO: 66475 - protein, 9 aa, Homo Sapiens
LPTSSHSSS

SEQ ID NO: 66476 - protein, 9 aa, Homo Sapiens
SNMRSHTGK

SEQ ID NO: 66477 - protein, 9 aa, Homo Sapiens
SCLPSCNNR

SEQ ID NO: 66478 - protein, 9 aa, Homo Sapiens
QLPAAVPQQ

SEQ ID NO: 66479 - protein, 9 aa, Homo Sapiens
LSIITTKMY

SEQ ID NO: 66480 - protein, 9 aa, Homo Sapiens
ISDLDQRGQ

SEQ ID NO: 66481 - protein, 9 aa, Homo Sapiens
DLCNCAVAS

SEQ ID NO: 66482 - protein, 9 aa, Homo Sapiens
VLGGHDQLR

SEQ ID NO: 66483 - protein, 9 aa, Homo Sapiens
HYIIAKGEC

SEQ ID NO: 66484 - protein, 9 aa, Homo Sapiens
SIELLAVER

SEQ ID NO: 66485 - protein, 9 aa, Homo Sapiens
HRDVQDPFA

SEQ ID NO: 66486 - protein, 9 aa, Homo Sapiens
NMRSHTGKE

SEQ ID NO: 66487 - protein, 9 aa, Homo Sapiens
QTQEVEKLV

SEQ ID NO: 66488 - protein, 9 aa, Homo Sapiens
GNLLNTVSP

SEQ ID NO: 66489 - protein, 9 aa, Homo Sapiens
EVRDPFQMK

SEQ ID NO: 66490 - protein, 9 aa, Homo Sapiens
PEKEEEEAG

SEQ ID NO: 66491 - protein, 9 aa, Homo Sapiens
HWMHRDVQD

SEQ ID NO: 66492 - protein, 9 aa, Homo Sapiens
CEPSTCVYA

SEQ ID NO: 66493 - protein, 9 aa, Homo Sapiens
YSANCRDFL

SEQ ID NO: 66494 - protein, 9 aa, Homo Sapiens
HAAPHHHHH

SEQ ID NO: 66495 - protein, 9 aa, Homo Sapiens
GLPPSSPSP

SEQ ID NO: 66496 - protein, 9 aa, Homo Sapiens
FYSQEVRDP

SEQ ID NO: 66497 - protein, 9 aa, Homo Sapiens
NRLAHVCEP

SEQ ID NO: 66498 - protein, 9 aa, Homo Sapiens
YCSAPLGDE

SEQ ID NO: 66499 - protein, 9 aa, Homo Sapiens
CYGHEGSGP

SEQ ID NO: 66500 - protein, 9 aa, Homo Sapiens
ARGKVEFQE

SEQ ID NO: 66501 - protein, 9 aa, Homo Sapiens
GRSSPGGFR

SEQ ID NO: 66502 - protein, 9 aa, Homo Sapiens
LTRGPAASF

SEQ ID NO: 66503 - protein, 9 aa, Homo Sapiens
NPIDCFHLQ

SEQ ID NO: 66504 - protein, 9 aa, Homo Sapiens
PYRASDNSF

SEQ ID NO: 66505 - protein, 9 aa, Homo Sapiens
ITTKMYAND

SEQ ID NO: 66506 - protein, 9 aa, Homo Sapiens
NGLSNMRSH

SEQ ID NO: 66507 - protein, 9 aa, Homo Sapiens
EGSLISFQY

SEQ ID NO: 66508 - protein, 9 aa, Homo Sapiens
GIAMSGGGI

SEQ ID NO: 66509 - protein, 9 aa, Homo Sapiens
LSRSQNGPP

SEQ ID NO: 66510 - protein, 9 aa, Homo Sapiens
YARHFLEFQ

SEQ ID NO: 66511 - protein, 9 aa, Homo Sapiens
GPSRRRYRK

SEQ ID NO: 66512 - protein, 9 aa, Homo Sapiens
ARHFLEFQG

SEQ ID NO: 66513 - protein, 9 aa, Homo Sapiens
LGGSPGPRG

SEQ ID NO: 66514 - protein, 9 aa, Homo Sapiens
NLTGKLTGL

SEQ ID NO: 66515 - protein, 9 aa, Homo Sapiens
QMAREEREN

SEQ ID NO: 66516 - protein, 9 aa, Homo Sapiens
TYKSQYEEA

SEQ ID NO: 66517 - protein, 9 aa, Homo Sapiens
PRNLAPGPS

SEQ ID NO: 66518 - protein, 9 aa, Homo Sapiens
YHQKSCSSH

SEQ ID NO: 66519 - protein, 9 aa, Homo Sapiens
PPSSPSPPG

SEQ ID NO: 66520 - protein, 9 aa, Homo Sapiens
SSSPKPPGL

SEQ ID NO: 66521 - protein, 9 aa, Homo Sapiens
QLLCEASIL

SEQ ID NO: 66522 - protein, 9 aa, Homo Sapiens
IPICTVNGD

SEQ ID NO: 66523 - protein, 9 aa, Homo Sapiens
CIWVLTGVL

SEQ ID NO: 66524 - protein, 9 aa, Homo Sapiens
GDTKLRPTM

SEQ ID NO: 66525 - protein, 9 aa, Homo Sapiens
AGMAALGSV

SEQ ID NO: 66526 - protein, 9 aa, Homo Sapiens
LLPSSSPKP

SEQ ID NO: 66527 - protein, 9 aa, Homo Sapiens
SPPGGATGP

SEQ ID NO: 66528 - protein, 9 aa, Homo Sapiens
CQQMAREER

SEQ ID NO: 66529 - protein, 9 aa, Homo Sapiens
SVLGGHDQL

SEQ ID NO: 66530 - protein, 9 aa, Homo Sapiens
LSNMRSHTG

SEQ ID NO: 66531 - protein, 9 aa, Homo Sapiens
DVVTCLAHS

SEQ ID NO: 66532 - protein, 9 aa, Homo Sapiens
LTELSHGST

SEQ ID NO: 66533 - protein, 9 aa, Homo Sapiens
SCNICGKKI

SEQ ID NO: 66534 - protein, 9 aa, Homo Sapiens
TSEEGNLLN

SEQ ID NO: 66535 - protein, 9 aa, Homo Sapiens
NKADKPFSI

SEQ ID NO: 66536 - protein, 9 aa, Homo Sapiens
AMSGGGIGT

SEQ ID NO: 66537 - protein, 9 aa, Homo Sapiens
HHHAAPHHH

SEQ ID NO: 66538 - protein, 9 aa, Homo Sapiens
VRDPFQMKL

SEQ ID NO: 66539 - protein, 9 aa, Homo Sapiens
VSHSNGTVS

SEQ ID NO: 66540 - protein, 9 aa, Homo Sapiens
GAERGNQEP

SEQ ID NO: 66541 - protein, 9 aa, Homo Sapiens
SKLPDKTVE

SEQ ID NO: 66542 - protein, 9 aa, Homo Sapiens
PQRPGHPCL

SEQ ID NO: 66543 - protein, 9 aa, Homo Sapiens
RVLVSISTF

SEQ ID NO: 66544 - protein, 9 aa, Homo Sapiens
MARENKVAD

SEQ ID NO: 66545 - protein, 9 aa, Homo Sapiens
LGYCSAPLG

SEQ ID NO: 66546 - protein, 9 aa, Homo Sapiens
DVNQSTPKL

SEQ ID NO: 66547 - protein, 9 aa, Homo Sapiens
REPDPNAPG

SEQ ID NO: 66548 - protein, 9 aa, Homo Sapiens
SVMVSHSNG

SEQ ID NO: 66549 - protein, 9 aa, Homo Sapiens
TLRFISSKL

SEQ ID NO: 66550 - protein, 9 aa, Homo Sapiens
VNQSTPKLL

SEQ ID NO: 66551 - protein, 9 aa, Homo Sapiens
WCQQMAREE

SEQ ID NO: 66552 - protein, 9 aa, Homo Sapiens
PGAWPYRAS

SEQ ID NO: 66553 - protein, 9 aa, Homo Sapiens
SAELQGHTL

SEQ ID NO: 66554 - protein, 9 aa, Homo Sapiens
MPQQEDQKK

SEQ ID NO: 66555 - protein, 9 aa, Homo Sapiens
TYSANCRDF

SEQ ID NO: 66556 - protein, 9 aa, Homo Sapiens
RSQNGPPKS

SEQ ID NO: 66557 - protein, 9 aa, Homo Sapiens
YGIAMSGGG

SEQ ID NO: 66558 - protein, 9 aa, Homo Sapiens
SDLDQRGQR

SEQ ID NO: 66559 - protein, 9 aa, Homo Sapiens
KLLSENCDS

SEQ ID NO: 66560 - protein, 9 aa, Homo Sapiens
YIIAKGECL

SEQ ID NO: 66561 - protein, 9 aa, Homo Sapiens
MGGFHWMHR

SEQ ID NO: 66562 - protein, 9 aa, Homo Sapiens
PLGDEVTKS

SEQ ID NO: 66563 - protein, 9 aa, Homo Sapiens
TQSPRREPD

SEQ ID NO: 66564 - protein, 9 aa, Homo Sapiens
DVGTNSLQI

SEQ ID NO: 66565 - protein, 9 aa, Homo Sapiens
QNYHQKSCS

SEQ ID NO: 66566 - protein, 9 aa, Homo Sapiens
GTVSDAPQV

SEQ ID NO: 66567 - protein, 9 aa, Homo Sapiens
LAVERGNRT

SEQ ID NO: 66568 - protein, 9 aa, Homo Sapiens
WGLPPSSPS

SEQ ID NO: 66569 - protein, 9 aa, Homo Sapiens
CQQAGCVPV

SEQ ID NO: 66570 - protein, 9 aa, Homo Sapiens
TPKLLSENC

SEQ ID NO: 66571 - protein, 9 aa, Homo Sapiens
SILKYVQED

SEQ ID NO: 66572 - protein, 9 aa, Homo Sapiens
EGNLLNTVS

SEQ ID NO: 66573 - protein, 9 aa, Homo Sapiens
CYLGDLCNC

SEQ ID NO: 66574 - protein, 9 aa, Homo Sapiens
HSESYIGGN

SEQ ID NO: 66575 - protein, 9 aa, Homo Sapiens
QAAVEQEEE

SEQ ID NO: 66576 - protein, 9 aa, Homo Sapiens
QFDTATLLC

SEQ ID NO: 66577 - protein, 9 aa, Homo Sapiens
AHVLLLISF

SEQ ID NO: 66578 - protein, 9 aa, Homo Sapiens
ELTIQNTTV

SEQ ID NO: 66579 - protein, 9 aa, Homo Sapiens
PYLDNWPNF

SEQ ID NO: 66580 - protein, 9 aa, Homo Sapiens
FSACQKLQK

SEQ ID NO: 66581 - protein, 9 aa, Homo Sapiens
ENMGKRMNH

SEQ ID NO: 66582 - protein, 9 aa, Homo Sapiens
LWKKFKRYF

SEQ ID NO: 66583 - protein, 9 aa, Homo Sapiens
AEESQHDSG

SEQ ID NO: 66584 - protein, 9 aa, Homo Sapiens
PQAMMTHLH

SEQ ID NO: 66585 - protein, 9 aa, Homo Sapiens
RPHWRLGPT

SEQ ID NO: 66586 - protein, 9 aa, Homo Sapiens
DLCDERERR

SEQ ID NO: 66587 - protein, 9 aa, Homo Sapiens
RMVSDRWLS

SEQ ID NO: 66588 - protein, 9 aa, Homo Sapiens
DGGCDQGLD

SEQ ID NO: 66589 - protein, 9 aa, Homo Sapiens
PKSETGTHV

SEQ ID NO: 66590 - protein, 9 aa, Homo Sapiens
DLDLRLVGP

SEQ ID NO: 66591 - protein, 9 aa, Homo Sapiens
RTPMYMSDS

SEQ ID NO: 66592 - protein, 9 aa, Homo Sapiens
TVIPDQYCF

SEQ ID NO: 66593 - protein, 9 aa, Homo Sapiens
LSNGMIIFF

SEQ ID NO: 66594 - protein, 9 aa, Homo Sapiens
VASSSHVPI

SEQ ID NO: 66595 - protein, 9 aa, Homo Sapiens
HCIDDLSNG

SEQ ID NO: 66596 - protein, 9 aa, Homo Sapiens
AQHLKAQSR

SEQ ID NO: 66597 - protein, 9 aa, Homo Sapiens
LSFVDEIIS

SEQ ID NO: 66598 - protein, 9 aa, Homo Sapiens
MVAEPGATV

SEQ ID NO: 66599 - protein, 9 aa, Homo Sapiens
LGVSVASSS

SEQ ID NO: 66600 - protein, 9 aa, Homo Sapiens
LSQEVALLK

SEQ ID NO: 66601 - protein, 9 aa, Homo Sapiens
GQMQNNNLD

SEQ ID NO: 66602 - protein, 9 aa, Homo Sapiens
DEIISGAKS

SEQ ID NO: 66603 - protein, 9 aa, Homo Sapiens
CCNCCQDLA

SEQ ID NO: 66604 - protein, 9 aa, Homo Sapiens
EQKRNDEAV

SEQ ID NO: 66605 - protein, 9 aa, Homo Sapiens
RTVIPDQYC

SEQ ID NO: 66606 - protein, 9 aa, Homo Sapiens
YLPAFEPFL

SEQ ID NO: 66607 - protein, 9 aa, Homo Sapiens
KEQTMSDCE

SEQ ID NO: 66608 - protein, 9 aa, Homo Sapiens
LDNWPNFNR

SEQ ID NO: 66609 - protein, 9 aa, Homo Sapiens
LDTLSQEVA

SEQ ID NO: 66610 - protein, 9 aa, Homo Sapiens
GDRETTIWG

SEQ ID NO: 66611 - protein, 9 aa, Homo Sapiens
YTSSNIRPS

SEQ ID NO: 66612 - protein, 9 aa, Homo Sapiens
PPKFPELPE

SEQ ID NO: 66613 - protein, 9 aa, Homo Sapiens
REHRAAHLG

SEQ ID NO: 66614 - protein, 9 aa, Homo Sapiens
FLRLLVIKG

SEQ ID NO: 66615 - protein, 9 aa, Homo Sapiens
RTALESLKQ

SEQ ID NO: 66616 - protein, 9 aa, Homo Sapiens
RDFLCISLV

SEQ ID NO: 66617 - protein, 9 aa, Homo Sapiens
INVERQEWK

SEQ ID NO: 66618 - protein, 9 aa, Homo Sapiens
TGKKLYKCE

SEQ ID NO: 66619 - protein, 9 aa, Homo Sapiens
CALPNHPGV

SEQ ID NO: 66620 - protein, 9 aa, Homo Sapiens
QPAYQVTLS

SEQ ID NO: 66621 - protein, 9 aa, Homo Sapiens
QFYINVERQ

SEQ ID NO: 66622 - protein, 9 aa, Homo Sapiens
IKRALQSEQ

SEQ ID NO: 66623 - protein, 9 aa, Homo Sapiens
MKTIWSTML

SEQ ID NO: 66624 - protein, 9 aa, Homo Sapiens
SKLETTHTT

SEQ ID NO: 66625 - protein, 9 aa, Homo Sapiens
RERPQAMMT

SEQ ID NO: 66626 - protein, 9 aa, Homo Sapiens
GIKRALQSE

SEQ ID NO: 66627 - protein, 9 aa, Homo Sapiens
TLRPDQLHI

SEQ ID NO: 66628 - protein, 9 aa, Homo Sapiens
DIQTGASGS

SEQ ID NO: 66629 - protein, 9 aa, Homo Sapiens
KAENLMYLK

SEQ ID NO: 66630 - protein, 9 aa, Homo Sapiens
GRVPPPPHA

SEQ ID NO: 66631 - protein, 9 aa, Homo Sapiens
EPDKQRSEL

SEQ ID NO: 66632 - protein, 9 aa, Homo Sapiens
DAGDPNSAN

SEQ ID NO: 66633 - protein, 9 aa, Homo Sapiens
QTVVQWSDF

SEQ ID NO: 66634 - protein, 9 aa, Homo Sapiens
KDIQTGASG

SEQ ID NO: 66635 - protein, 9 aa, Homo Sapiens
RKKKRCQRD

SEQ ID NO: 66636 - protein, 9 aa, Homo Sapiens
AEWGEEETK

SEQ ID NO: 66637 - protein, 9 aa, Homo Sapiens
AAYESVLFH

SEQ ID NO: 66638 - protein, 9 aa, Homo Sapiens
ILLMSLPSR

SEQ ID NO: 66639 - protein, 9 aa, Homo Sapiens
ELREHRAAH

SEQ ID NO: 66640 - protein, 9 aa, Homo Sapiens
NGQSGHSAG

SEQ ID NO: 66641 - protein, 9 aa, Homo Sapiens
KCHPSLGNA

SEQ ID NO: 66642 - protein, 9 aa, Homo Sapiens
SSLRESYQP

SEQ ID NO: 66643 - protein, 9 aa, Homo Sapiens
TVVQWSDFR

SEQ ID NO: 66644 - protein, 9 aa, Homo Sapiens
FRVSSVPKM

SEQ ID NO: 66645 - protein, 9 aa, Homo Sapiens
GHSAGGPGF

SEQ ID NO: 66646 - protein, 9 aa, Homo Sapiens
QRDGMCCPS

SEQ ID NO: 66647 - protein, 9 aa, Homo Sapiens
CNNTDAFAD

SEQ ID NO: 66648 - protein, 9 aa, Homo Sapiens
QSCSSKNSD

SEQ ID NO: 66649 - protein, 9 aa, Homo Sapiens
LQLLSSEVT

SEQ ID NO: 66650 - protein, 9 aa, Homo Sapiens
CFQHTNYGN

SEQ ID NO: 66651 - protein, 9 aa, Homo Sapiens
DQLHIFNTL

SEQ ID NO: 66652 - protein, 9 aa, Homo Sapiens
DSWSQEMDL

SEQ ID NO: 66653 - protein, 9 aa, Homo Sapiens
VCAADGRGP

SEQ ID NO: 66654 - protein, 9 aa, Homo Sapiens
FFRVSSVPK

SEQ ID NO: 66655 - protein, 9 aa, Homo Sapiens
NGAVFLNGK

SEQ ID NO: 66656 - protein, 9 aa, Homo Sapiens
IFSAARQNY

SEQ ID NO: 66657 - protein, 9 aa, Homo Sapiens
ESEQKRNDE

SEQ ID NO: 66658 - protein, 9 aa, Homo Sapiens
RTGATTSSF

SEQ ID NO: 66659 - protein, 9 aa, Homo Sapiens
EATKKSCDQ

SEQ ID NO: 66660 - protein, 9 aa, Homo Sapiens
PSLGNAMAA

SEQ ID NO: 66661 - protein, 9 aa, Homo Sapiens
GIRAWPSTP

SEQ ID NO: 66662 - protein, 9 aa, Homo Sapiens
FYFLFSLGT

SEQ ID NO: 66663 - protein, 9 aa, Homo Sapiens
GASLGIKRA

SEQ ID NO: 66664 - protein, 9 aa, Homo Sapiens
GNDKGNQQE

SEQ ID NO: 66665 - protein, 9 aa, Homo Sapiens
VSVASSSHV

SEQ ID NO: 66666 - protein, 9 aa, Homo Sapiens
KAGNLYTGK

SEQ ID NO: 66667 - protein, 9 aa, Homo Sapiens
QTMSDCEAG

SEQ ID NO: 66668 - protein, 9 aa, Homo Sapiens
PLLPVACIN

SEQ ID NO: 66669 - protein, 9 aa, Homo Sapiens
LRLLVIKGE

SEQ ID NO: 66670 - protein, 9 aa, Homo Sapiens
DRSESPQRS

SEQ ID NO: 66671 - protein, 9 aa, Homo Sapiens
RETTIWGKA

SEQ ID NO: 66672 - protein, 9 aa, Homo Sapiens
PAYQVTLSG

SEQ ID NO: 66673 - protein, 9 aa, Homo Sapiens
NTDAFADWC

SEQ ID NO: 66674 - protein, 9 aa, Homo Sapiens
LSKERERPQ

SEQ ID NO: 66675 - protein, 9 aa, Homo Sapiens
RDARSGPPM

SEQ ID NO: 66676 - protein, 9 aa, Homo Sapiens
LIFDHLAQL

SEQ ID NO: 66677 - protein, 9 aa, Homo Sapiens
VIRKLTCLC

SEQ ID NO: 66678 - protein, 9 aa, Homo Sapiens
HWRLGPTGK

SEQ ID NO: 66679 - protein, 9 aa, Homo Sapiens
WKKFKRYFL

SEQ ID NO: 66680 - protein, 9 aa, Homo Sapiens
KGSGAGCGP

SEQ ID NO: 66681 - protein, 9 aa, Homo Sapiens
WRDPGRREL

SEQ ID NO: 66682 - protein, 9 aa, Homo Sapiens
SFGSPSKQR

SEQ ID NO: 66683 - protein, 9 aa, Homo Sapiens
LLSIADWMV

SEQ ID NO: 66684 - protein, 9 aa, Homo Sapiens
SIADWMVHW

SEQ ID NO: 66685 - protein, 9 aa, Homo Sapiens
SKGSGAGCG

SEQ ID NO: 66686 - protein, 9 aa, Homo Sapiens
TSLGQMQNN

SEQ ID NO: 66687 - protein, 9 aa, Homo Sapiens
GLDCCNCCQ

SEQ ID NO: 66688 - protein, 9 aa, Homo Sapiens
SGHSAGGPG

SEQ ID NO: 66689 - protein, 9 aa, Homo Sapiens
NNTDAFADW

SEQ ID NO: 66690 - protein, 9 aa, Homo Sapiens
EEAEWGEEE

SEQ ID NO: 66691 - protein, 9 aa, Homo Sapiens
VMSQKQRNR

SEQ ID NO: 66692 - protein, 9 aa, Homo Sapiens
CSLTQTVVQ

SEQ ID NO: 66693 - protein, 9 aa, Homo Sapiens
STGPTPGSS

SEQ ID NO: 66694 - protein, 9 aa, Homo Sapiens
IGTQIVSER

SEQ ID NO: 66695 - protein, 9 aa, Homo Sapiens
QWENMGKRM

SEQ ID NO: 66696 - protein, 9 aa, Homo Sapiens
AARQNYPLT

SEQ ID NO: 66697 - protein, 9 aa, Homo Sapiens
LPHAFQATF

SEQ ID NO: 66698 - protein, 9 aa, Homo Sapiens
LWEMAAEKR

SEQ ID NO: 66699 - protein, 9 aa, Homo Sapiens
EAEWGEEET

SEQ ID NO: 66700 - protein, 9 aa, Homo Sapiens
KRVEPPPKF

SEQ ID NO: 66701 - protein, 9 aa, Homo Sapiens
ELLCSPLIN

SEQ ID NO: 66702 - protein, 9 aa, Homo Sapiens
KIEAAYESV

SEQ ID NO: 66703 - protein, 9 aa, Homo Sapiens
RKQPLPQED

SEQ ID NO: 66704 - protein, 9 aa, Homo Sapiens
SRVQMNFLQ

SEQ ID NO: 66705 - protein, 9 aa, Homo Sapiens
PSRQCSWDR

SEQ ID NO: 66706 - protein, 9 aa, Homo Sapiens
VLVFVTSGG

SEQ ID NO: 66707 - protein, 9 aa, Homo Sapiens
FHCIDDLSN

SEQ ID NO: 66708 - protein, 9 aa, Homo Sapiens
DQGLDPIPL

SEQ ID NO: 66709 - protein, 9 aa, Homo Sapiens
SMEGHKGAQ

SEQ ID NO: 66710 - protein, 9 aa, Homo Sapiens
WVAPDPATG

SEQ ID NO: 66711 - protein, 9 aa, Homo Sapiens
WASVDVLCC

SEQ ID NO: 66712 - protein, 9 aa, Homo Sapiens
QNTTVHSLL

SEQ ID NO: 66713 - protein, 9 aa, Homo Sapiens
PKTLQKQQN

SEQ ID NO: 66714 - protein, 9 aa, Homo Sapiens
FADWCEIFG

SEQ ID NO: 66715 - protein, 9 aa, Homo Sapiens
VCHHYCLNS

SEQ ID NO: 66716 - protein, 9 aa, Homo Sapiens
IAPLLPVAC

SEQ ID NO: 66717 - protein, 9 aa, Homo Sapiens
LPSRVHLKQ

SEQ ID NO: 66718 - protein, 9 aa, Homo Sapiens
ALSEKELLH

SEQ ID NO: 66719 - protein, 9 aa, Homo Sapiens
DPGRRELPT

SEQ ID NO: 66720 - protein, 9 aa, Homo Sapiens
SFAVLVAHV

SEQ ID NO: 66721 - protein, 9 aa, Homo Sapiens
PNISLHLLH

SEQ ID NO: 66722 - protein, 9 aa, Homo Sapiens
VTLSGQEPI

SEQ ID NO: 66723 - protein, 9 aa, Homo Sapiens
VWKQFGRLP

SEQ ID NO: 66724 - protein, 9 aa, Homo Sapiens
PSRVHLKQK

SEQ ID NO: 66725 - protein, 9 aa, Homo Sapiens
HKRTHIKYT

SEQ ID NO: 66726 - protein, 9 aa, Homo Sapiens
IEAAYESVL

SEQ ID NO: 66727 - protein, 9 aa, Homo Sapiens
PTPGSSGGT

SEQ ID NO: 66728 - protein, 9 aa, Homo Sapiens
SSKNSDGKQ

SEQ ID NO: 66729 - protein, 9 aa, Homo Sapiens
GCALPNHPG

SEQ ID NO: 66730 - protein, 9 aa, Homo Sapiens
EIMVTFKAS

SEQ ID NO: 66731 - protein, 9 aa, Homo Sapiens
QNPLLMWVA

SEQ ID NO: 66732 - protein, 9 aa, Homo Sapiens
GSSGGTKMP

SEQ ID NO: 66733 - protein, 9 aa, Homo Sapiens
KMKGKEERR

SEQ ID NO: 66734 - protein, 9 aa, Homo Sapiens
ILNDIRKAG

SEQ ID NO: 66735 - protein, 9 aa, Homo Sapiens
EHRKCACPS

SEQ ID NO: 66736 - protein, 9 aa, Homo Sapiens
RALQSEQAT

SEQ ID NO: 66737 - protein, 9 aa, Homo Sapiens
VECDGCTID

SEQ ID NO: 66738 - protein, 9 aa, Homo Sapiens
SPMILRFLH

SEQ ID NO: 66739 - protein, 9 aa, Homo Sapiens
ATVCAARRL

SEQ ID NO: 66740 - protein, 9 aa, Homo Sapiens
MTEVVRRYP

SEQ ID NO: 66741 - protein, 9 aa, Homo Sapiens
LPNHPGVYT

SEQ ID NO: 66742 - protein, 9 aa, Homo Sapiens
TFGIRAWPS

SEQ ID NO: 66743 - protein, 9 aa, Homo Sapiens
DCEAGALRC

SEQ ID NO: 66744 - protein, 9 aa, Homo Sapiens
VKCAGSVAL

SEQ ID NO: 66745 - protein, 9 aa, Homo Sapiens
IYNVEQLRY

SEQ ID NO: 66746 - protein, 9 aa, Homo Sapiens
LETTHTTSP

SEQ ID NO: 66747 - protein, 9 aa, Homo Sapiens
APEKIEECS

SEQ ID NO: 66748 - protein, 9 aa, Homo Sapiens
CSWDRSESP

SEQ ID NO: 66749 - protein, 9 aa, Homo Sapiens
RRQISSLRE

SEQ ID NO: 66750 - protein, 9 aa, Homo Sapiens
QFGRLPEFY

SEQ ID NO: 66751 - protein, 9 aa, Homo Sapiens
STMNPGQLC

SEQ ID NO: 66752 - protein, 9 aa, Homo Sapiens
KKIYNVEQL

SEQ ID NO: 66753 - protein, 9 aa, Homo Sapiens
KLCNNTDAF

SEQ ID NO: 66754 - protein, 9 aa, Homo Sapiens
NFLQLLSSE

SEQ ID NO: 66755 - protein, 9 aa, Homo Sapiens
MHQIIHTGE

SEQ ID NO: 66756 - protein, 9 aa, Homo Sapiens
SKSSVPLSS

SEQ ID NO: 66757 - protein, 9 aa, Homo Sapiens
LNLSAIKER

SEQ ID NO: 66758 - protein, 9 aa, Homo Sapiens
ETTHTTSPL

SEQ ID NO: 66759 - protein, 9 aa, Homo Sapiens
IVECDGCTI

SEQ ID NO: 66760 - protein, 9 aa, Homo Sapiens
CDIAPLLPV

SEQ ID NO: 66761 - protein, 9 aa, Homo Sapiens
FHLVFHCID

SEQ ID NO: 66762 - protein, 9 aa, Homo Sapiens
TSKGSGAGC

SEQ ID NO: 66763 - protein, 9 aa, Homo Sapiens
FDRDLTEFG

SEQ ID NO: 66764 - protein, 9 aa, Homo Sapiens
ERRQISSLR

SEQ ID NO: 66765 - protein, 9 aa, Homo Sapiens
TSSNIRPSP

SEQ ID NO: 66766 - protein, 9 aa, Homo Sapiens
SSVPKMILL

SEQ ID NO: 66767 - protein, 9 aa, Homo Sapiens
TTSSFPAQA

SEQ ID NO: 66768 - protein, 9 aa, Homo Sapiens
TKKSCDQLA

SEQ ID NO: 66769 - protein, 9 aa, Homo Sapiens
ERQEWKLDT

SEQ ID NO: 66770 - protein, 9 aa, Homo Sapiens
DKNCVMSQK

SEQ ID NO: 66771 - protein, 9 aa, Homo Sapiens
MKGKEERRV

SEQ ID NO: 66772 - protein, 9 aa, Homo Sapiens
THYRAQVEV

SEQ ID NO: 66773 - protein, 9 aa, Homo Sapiens
GPTPGSSGG

SEQ ID NO: 66774 - protein, 9 aa, Homo Sapiens
DIAPLLPVA

SEQ ID NO: 66775 - protein, 9 aa, Homo Sapiens
HYRAQVEVR

SEQ ID NO: 66776 - protein, 9 aa, Homo Sapiens
CHINECHSR

SEQ ID NO: 66777 - protein, 9 aa, Homo Sapiens
GHVIRKLTC

SEQ ID NO: 66778 - protein, 9 aa, Homo Sapiens
EPKTLQKQQ

SEQ ID NO: 66779 - protein, 9 aa, Homo Sapiens
DPKSETGTH

SEQ ID NO: 66780 - protein, 9 aa, Homo Sapiens
WGEEETKSP

SEQ ID NO: 66781 - protein, 9 aa, Homo Sapiens
EIVECDGCT

SEQ ID NO: 66782 - protein, 9 aa, Homo Sapiens
LMSLPSRVH

SEQ ID NO: 66783 - protein, 9 aa, Homo Sapiens
QIVSERLVA

SEQ ID NO: 66784 - protein, 9 aa, Homo Sapiens
TVVAKVVAD

SEQ ID NO: 66785 - protein, 9 aa, Homo Sapiens
YLNLSAIKE

SEQ ID NO: 66786 - protein, 9 aa, Homo Sapiens
IVSERLVAL

SEQ ID NO: 66787 - protein, 9 aa, Homo Sapiens
DNWPNFNRS

SEQ ID NO: 66788 - protein, 9 aa, Homo Sapiens
FGTLYAENQ

SEQ ID NO: 66789 - protein, 9 aa, Homo Sapiens
PPLPLPPRL

SEQ ID NO: 66790 - protein, 9 aa, Homo Sapiens
GTQIVSERL

SEQ ID NO: 66791 - protein, 9 aa, Homo Sapiens
SNQEVLVFV

SEQ ID NO: 66792 - protein, 9 aa, Homo Sapiens
CHPSLGNAM

SEQ ID NO: 66793 - protein, 9 aa, Homo Sapiens
SSVPLSSRV

SEQ ID NO: 66794 - protein, 9 aa, Homo Sapiens
PGSSGGTKM

SEQ ID NO: 66795 - protein, 9 aa, Homo Sapiens
ENFAYVQMK

SEQ ID NO: 66796 - protein, 9 aa, Homo Sapiens
PLPLPPRLL

SEQ ID NO: 66797 - protein, 9 aa, Homo Sapiens
KRMNHHLQY

SEQ ID NO: 66798 - protein, 9 aa, Homo Sapiens
GTHYRAQVE

SEQ ID NO: 66799 - protein, 9 aa, Homo Sapiens
SREWGGRCE

SEQ ID NO: 66800 - protein, 9 aa, Homo Sapiens
CQDLAHRSG

SEQ ID NO: 66801 - protein, 9 aa, Homo Sapiens
LGIKRALQS

SEQ ID NO: 66802 - protein, 9 aa, Homo Sapiens
DWPMPPLPL

SEQ ID NO: 66803 - protein, 9 aa, Homo Sapiens
LCVKPDVSA

SEQ ID NO: 66804 - protein, 9 aa, Homo Sapiens
VDTFQSGKQ

SEQ ID NO: 66805 - protein, 9 aa, Homo Sapiens
IRAWPSTPF

SEQ ID NO: 66806 - protein, 9 aa, Homo Sapiens
GYILDPHTV

SEQ ID NO: 66807 - protein, 9 aa, Homo Sapiens
MLEKVLTFL

SEQ ID NO: 66808 - protein, 9 aa, Homo Sapiens
LEEVQQRLL

SEQ ID NO: 66809 - protein, 9 aa, Homo Sapiens
WARDARSGP

SEQ ID NO: 66810 - protein, 9 aa, Homo Sapiens
VRRYPHHER

SEQ ID NO: 66811 - protein, 9 aa, Homo Sapiens
LLMWVAPDP

SEQ ID NO: 66812 - protein, 9 aa, Homo Sapiens
GLDIHSPMI

SEQ ID NO: 66813 - protein, 9 aa, Homo Sapiens
RKCACPSRE

SEQ ID NO: 66814 - protein, 9 aa, Homo Sapiens
LLVKSMEKT

SEQ ID NO: 66815 - protein, 9 aa, Homo Sapiens
DGSTCTMTE

SEQ ID NO: 66816 - protein, 9 aa, Homo Sapiens
QKLLYLNLS

SEQ ID NO: 66817 - protein, 9 aa, Homo Sapiens
SRVPNISLH

SEQ ID NO: 66818 - protein, 9 aa, Homo Sapiens
ERERPQAMM

SEQ ID NO: 66819 - protein, 9 aa, Homo Sapiens
DPIPLLANL

SEQ ID NO: 66820 - protein, 9 aa, Homo Sapiens
YFLFSLGTT

SEQ ID NO: 66821 - protein, 9 aa, Homo Sapiens
SLTQTVVQW

SEQ ID NO: 66822 - protein, 9 aa, Homo Sapiens
YTVWKQFGR

SEQ ID NO: 66823 - protein, 9 aa, Homo Sapiens
SREDAGDPN

SEQ ID NO: 66824 - protein, 9 aa, Homo Sapiens
SQEVALLKE

SEQ ID NO: 66825 - protein, 9 aa, Homo Sapiens
SEKELLHLK

SEQ ID NO: 66826 - protein, 9 aa, Homo Sapiens
QMNFLQLLS

SEQ ID NO: 66827 - protein, 9 aa, Homo Sapiens
TVSREDAGD

SEQ ID NO: 66828 - protein, 9 aa, Homo Sapiens
SETGTHVGV

SEQ ID NO: 66829 - protein, 9 aa, Homo Sapiens
NVERQEWKL

SEQ ID NO: 66830 - protein, 9 aa, Homo Sapiens
SGSGEMVCT

SEQ ID NO: 66831 - protein, 9 aa, Homo Sapiens
GSVCAADGR

SEQ ID NO: 66832 - protein, 9 aa, Homo Sapiens
DKQRSELPR

SEQ ID NO: 66833 - protein, 9 aa, Homo Sapiens
CIDDLSNGM

SEQ ID NO: 66834 - protein, 9 aa, Homo Sapiens
LKDVTAYML

SEQ ID NO: 66835 - protein, 9 aa, Homo Sapiens
HRAAHLGKK

SEQ ID NO: 66836 - protein, 9 aa, Homo Sapiens
KFPELPEKP

SEQ ID NO: 66837 - protein, 9 aa, Homo Sapiens
PFIPYLDNW

SEQ ID NO: 66838 - protein, 9 aa, Homo Sapiens
THTTSPLPE

SEQ ID NO: 66839 - protein, 9 aa, Homo Sapiens
VHSLLVAWR

SEQ ID NO: 66840 - protein, 9 aa, Homo Sapiens
FEATKKSCD

SEQ ID NO: 66841 - protein, 9 aa, Homo Sapiens
EVLVFVTSG

SEQ ID NO: 66842 - protein, 9 aa, Homo Sapiens
AFPSSEHRK

SEQ ID NO: 66843 - protein, 9 aa, Homo Sapiens
VQMKTIWST

SEQ ID NO: 66844 - protein, 9 aa, Homo Sapiens
GRRELPTFH

SEQ ID NO: 66845 - protein, 9 aa, Homo Sapiens
KGISGKRPG

SEQ ID NO: 66846 - protein, 9 aa, Homo Sapiens
MNHHLQYNG

SEQ ID NO: 66847 - protein, 9 aa, Homo Sapiens
PEKIEECSQ

SEQ ID NO: 66848 - protein, 9 aa, Homo Sapiens
AFAVLTRCR

SEQ ID NO: 66849 - protein, 9 aa, Homo Sapiens
CQRDGMCCP

SEQ ID NO: 66850 - protein, 9 aa, Homo Sapiens
KAQSRDFLC

SEQ ID NO: 66851 - protein, 9 aa, Homo Sapiens
MWVAPDPAT

SEQ ID NO: 66852 - protein, 9 aa, Homo Sapiens
GLDAPLFGV

SEQ ID NO: 66853 - protein, 9 aa, Homo Sapiens
SVHFDRDLT

SEQ ID NO: 66854 - protein, 9 aa, Homo Sapiens
SSAIFSAAR

SEQ ID NO: 66855 - protein, 9 aa, Homo Sapiens
HTGKKLYKC

SEQ ID NO: 66856 - protein, 9 aa, Homo Sapiens
SEGRELVIP

SEQ ID NO: 66857 - protein, 9 aa, Homo Sapiens
RSGPPMASG

SEQ ID NO: 66858 - protein, 9 aa, Homo Sapiens
ECHSRKLSG

SEQ ID NO: 66859 - protein, 9 aa, Homo Sapiens
SGQEPIVKK

SEQ ID NO: 66860 - protein, 9 aa, Homo Sapiens
FSEVKPLIF

SEQ ID NO: 66861 - protein, 9 aa, Homo Sapiens
RERRQISSL

SEQ ID NO: 66862 - protein, 9 aa, Homo Sapiens
VQKQEAMQR

SEQ ID NO: 66863 - protein, 9 aa, Homo Sapiens
LTRCRVVQS

SEQ ID NO: 66864 - protein, 9 aa, Homo Sapiens
WVKQLWSHN

SEQ ID NO: 66865 - protein, 9 aa, Homo Sapiens
LGLGLACVL

SEQ ID NO: 66866 - protein, 9 aa, Homo Sapiens
AKLHVSLTR

SEQ ID NO: 66867 - protein, 9 aa, Homo Sapiens
RRAARPHWR

SEQ ID NO: 66868 - protein, 9 aa, Homo Sapiens
LYAENQDVA

SEQ ID NO: 66869 - protein, 9 aa, Homo Sapiens
DRDLTEFGT

SEQ ID NO: 66870 - protein, 9 aa, Homo Sapiens
GCGPWIKNM

SEQ ID NO: 66871 - protein, 9 aa, Homo Sapiens
SEPYTSSNI

SEQ ID NO: 66872 - protein, 9 aa, Homo Sapiens
DIRKAGNLY

SEQ ID NO: 66873 - protein, 9 aa, Homo Sapiens
WPMPPLPLP

SEQ ID NO: 66874 - protein, 9 aa, Homo Sapiens
SMLDLCDER

SEQ ID NO: 66875 - protein, 9 aa, Homo Sapiens
QLSMHQIIH

SEQ ID NO: 66876 - protein, 9 aa, Homo Sapiens
CHSRKLSGC

SEQ ID NO: 66877 - protein, 9 aa, Homo Sapiens
PPMASGYGR

SEQ ID NO: 66878 - protein, 9 aa, Homo Sapiens
GGCDQGLDP

SEQ ID NO: 66879 - protein, 9 aa, Homo Sapiens
EKIEECSQF

SEQ ID NO: 66880 - protein, 9 aa, Homo Sapiens
QCSWDRSES

SEQ ID NO: 66881 - protein, 9 aa, Homo Sapiens
LAHQTEPKT

SEQ ID NO: 66882 - protein, 9 aa, Homo Sapiens
GVGLDVERW

SEQ ID NO: 66883 - protein, 9 aa, Homo Sapiens
MGKRMNHHL

SEQ ID NO: 66884 - protein, 9 aa, Homo Sapiens
HFDRDLTEF

SEQ ID NO: 66885 - protein, 9 aa, Homo Sapiens
EWGEEETKS

SEQ ID NO: 66886 - protein, 9 aa, Homo Sapiens
WPNFNRSVD

SEQ ID NO: 66887 - protein, 9 aa, Homo Sapiens
LSEKELLHL

SEQ ID NO: 66888 - protein, 9 aa, Homo Sapiens
SENEAEWEE

SEQ ID NO: 66889 - protein, 9 aa, Homo Sapiens
FSAARQNYP

SEQ ID NO: 66890 - protein, 9 aa, Homo Sapiens
VHFDRDLTE

SEQ ID NO: 66891 - protein, 9 aa, Homo Sapiens
LRLVGPHSP

SEQ ID NO: 66892 - protein, 9 aa, Homo Sapiens
AEPGATVCA

SEQ ID NO: 66893 - protein, 9 aa, Homo Sapiens
DLTEFGTQG

SEQ ID NO: 66894 - protein, 9 aa, Homo Sapiens
IQNTTVHSL

SEQ ID NO: 66895 - protein, 9 aa, Homo Sapiens
REDAGDPNS

SEQ ID NO: 66896 - protein, 9 aa, Homo Sapiens
EPPPKFPEL

SEQ ID NO: 66897 - protein, 9 aa, Homo Sapiens
LRFGTLYAE

SEQ ID NO: 66898 - protein, 9 aa, Homo Sapiens
RRDSWLDIQ

SEQ ID NO: 66899 - protein, 9 aa, Homo Sapiens
ISSLRESYQ

SEQ ID NO: 66900 - protein, 9 aa, Homo Sapiens
CSQSCSSKN

SEQ ID NO: 66901 - protein, 9 aa, Homo Sapiens
TLSGQEPIV

SEQ ID NO: 66902 - protein, 9 aa, Homo Sapiens
RVEPPPKFP

SEQ ID NO: 66903 - protein, 9 aa, Homo Sapiens
RDLTEFGTQ

SEQ ID NO: 66904 - protein, 9 aa, Homo Sapiens
RVPNISLHL

SEQ ID NO: 66905 - protein, 9 aa, Homo Sapiens
NPKNSLKQL

SEQ ID NO: 66906 - protein, 9 aa, Homo Sapiens
VPLKKIYNV

SEQ ID NO: 66907 - protein, 9 aa, Homo Sapiens
VAEPGATVC

SEQ ID NO: 66908 - protein, 9 aa, Homo Sapiens
TRCRVVQSS

SEQ ID NO: 66909 - protein, 9 aa, Homo Sapiens
QLAHQTEPK

SEQ ID NO: 66910 - protein, 9 aa, Homo Sapiens
ASGSGEMVC

SEQ ID NO: 66911 - protein, 9 aa, Homo Sapiens
QGVGLDVER

SEQ ID NO: 66912 - protein, 9 aa, Homo Sapiens
HDSGIESLR

SEQ ID NO: 66913 - protein, 9 aa, Homo Sapiens
NGNDKGNQQ

SEQ ID NO: 66914 - protein, 9 aa, Homo Sapiens
CSPLINKCI

SEQ ID NO: 66915 - protein, 9 aa, Homo Sapiens
WLSMEGHKG

SEQ ID NO: 66916 - protein, 9 aa, Homo Sapiens
RKGISGKRP

SEQ ID NO: 66917 - protein, 9 aa, Homo Sapiens
MVSDRWLSC

SEQ ID NO: 66918 - protein, 9 aa, Homo Sapiens
PMILRFLHR

SEQ ID NO: 66919 - protein, 9 aa, Homo Sapiens
QSRDFLCIS

SEQ ID NO: 66920 - protein, 9 aa, Homo Sapiens
QTGASGSGE

SEQ ID NO: 66921 - protein, 9 aa, Homo Sapiens
ENLMYLKQI

SEQ ID NO: 66922 - protein, 9 aa, Homo Sapiens
KKGHVIRKL

SEQ ID NO: 66923 - protein, 9 aa, Homo Sapiens
GPHSPCYGR

SEQ ID NO: 66924 - protein, 9 aa, Homo Sapiens
IFDHLAQLF

SEQ ID NO: 66925 - protein, 9 aa, Homo Sapiens
LGALIAVNP

SEQ ID NO: 66926 - protein, 9 aa, Homo Sapiens
LGLAPSAAL

SEQ ID NO: 66927 - protein, 9 aa, Homo Sapiens
ISLHLLHEP

SEQ ID NO: 66928 - protein, 9 aa, Homo Sapiens
DSTGPTPGS

SEQ ID NO: 66929 - protein, 9 aa, Homo Sapiens
KGKEERRVT

SEQ ID NO: 66930 - protein, 9 aa, Homo Sapiens
CGPWIKNME

SEQ ID NO: 66931 - protein, 9 aa, Homo Sapiens
CRVVQSSLG

SEQ ID NO: 66932 - protein, 9 aa, Homo Sapiens
LKIEAAYES

SEQ ID NO: 66933 - protein, 9 aa, Homo Sapiens
GKEQTMSDC

SEQ ID NO: 66934 - protein, 9 aa, Homo Sapiens
NDIRKAGNL

SEQ ID NO: 66935 - protein, 9 aa, Homo Sapiens
RVHLKQKSR

SEQ ID NO: 66936 - protein, 9 aa, Homo Sapiens
LDLRLVGPH

SEQ ID NO: 66937 - protein, 9 aa, Homo Sapiens
GAGCGPWIK

SEQ ID NO: 66938 - protein, 9 aa, Homo Sapiens
DCCNCCQDL

SEQ ID NO: 66939 - protein, 9 aa, Homo Sapiens
QEAMQRATV

SEQ ID NO: 66940 - protein, 9 aa, Homo Sapiens
SAGGPGFTS

SEQ ID NO: 66941 - protein, 9 aa, Homo Sapiens
KTTSLGQMQ

SEQ ID NO: 66942 - protein, 9 aa, Homo Sapiens
NCCQDLAHR

SEQ ID NO: 66943 - protein, 9 aa, Homo Sapiens
CLNSESCTI

SEQ ID NO: 66944 - protein, 9 aa, Homo Sapiens
KRNDEAVKG

SEQ ID NO: 66945 - protein, 9 aa, Homo Sapiens
LMVAEPGAT

SEQ ID NO: 66946 - protein, 9 aa, Homo Sapiens
TVVTSEPYT

SEQ ID NO: 66947 - protein, 9 aa, Homo Sapiens
KRCQRDGMC

SEQ ID NO: 66948 - protein, 9 aa, Homo Sapiens
KRLKAENLM

SEQ ID NO: 66949 - protein, 9 aa, Homo Sapiens
NDKGNQQEK

SEQ ID NO: 66950 - protein, 9 aa, Homo Sapiens
PLIFDHLAQ

SEQ ID NO: 66951 - protein, 9 aa, Homo Sapiens
EAMQRATVE

SEQ ID NO: 66952 - protein, 9 aa, Homo Sapiens
AGGPGFTSR

SEQ ID NO: 66953 - protein, 9 aa, Homo Sapiens
QEPSKSSVP

SEQ ID NO: 66954 - protein, 9 aa, Homo Sapiens
ASSSHVPIQ

SEQ ID NO: 66955 - protein, 9 aa, Homo Sapiens
SCSSKNSDG

SEQ ID NO: 66956 - protein, 9 aa, Homo Sapiens
LAQWGQQLE

SEQ ID NO: 66957 - protein, 9 aa, Homo Sapiens
KKRCQRDGM

SEQ ID NO: 66958 - protein, 9 aa, Homo Sapiens
AQVEVRLPR

SEQ ID NO: 66959 - protein, 9 aa, Homo Sapiens
VVAKVVADR

SEQ ID NO: 66960 - protein, 9 aa, Homo Sapiens
VAPDPATGQ

SEQ ID NO: 66961 - protein, 9 aa, Homo Sapiens
LSMEGHKGA

SEQ ID NO: 66962 - protein, 9 aa, Homo Sapiens
DFLRLLVIK

SEQ ID NO: 66963 - protein, 9 aa, Homo Sapiens
GPPMASGYG

SEQ ID NO: 66964 - protein, 9 aa, Homo Sapiens
YCFQHTNYG

SEQ ID NO: 66965 - protein, 9 aa, Homo Sapiens
KQPLPQEDP

SEQ ID NO: 66966 - protein, 9 aa, Homo Sapiens
NPLFYGFLW

SEQ ID NO: 66967 - protein, 9 aa, Homo Sapiens
LTYRKQPLP

SEQ ID NO: 66968 - protein, 9 aa, Homo Sapiens
RQISSLRES

SEQ ID NO: 66969 - protein, 9 aa, Homo Sapiens
QKLRCYSGS

SEQ ID NO: 66970 - protein, 9 aa, Homo Sapiens
VEPPPKFPE

SEQ ID NO: 66971 - protein, 9 aa, Homo Sapiens
NDEAVKGLR

SEQ ID NO: 66972 - protein, 9 aa, Homo Sapiens
TCTMTEWIT

SEQ ID NO: 66973 - protein, 9 aa, Homo Sapiens
EVNSEHMDA

SEQ ID NO: 66974 - protein, 9 aa, Homo Sapiens
VDEIISGAK

SEQ ID NO: 66975 - protein, 9 aa, Homo Sapiens
RESYQPLAG

SEQ ID NO: 66976 - protein, 9 aa, Homo Sapiens
KWWRDPGRR

SEQ ID NO: 66977 - protein, 9 aa, Homo Sapiens
LYLNLSAIK

SEQ ID NO: 66978 - protein, 9 aa, Homo Sapiens
KELLHLKAD

SEQ ID NO: 66979 - protein, 9 aa, Homo Sapiens
TTLLPHAFQ

SEQ ID NO: 66980 - protein, 9 aa, Homo Sapiens
VRTVIPDQY

SEQ ID NO: 66981 - protein, 9 aa, Homo Sapiens
ARQNYPLTS

SEQ ID NO: 66982 - protein, 9 aa, Homo Sapiens
KGCALPNHP

SEQ ID NO: 66983 - protein, 9 aa, Homo Sapiens
ETSFQLDWL

SEQ ID NO: 66984 - protein, 9 aa, Homo Sapiens
NKKEIMVTF

SEQ ID NO: 66985 - protein, 9 aa, Homo Sapiens
VVQWSDFRS

SEQ ID NO: 66986 - protein, 9 aa, Homo Sapiens
GFLWKKFKR

SEQ ID NO: 66987 - protein, 9 aa, Homo Sapiens
SEHMDAYCR

SEQ ID NO: 66988 - protein, 9 aa, Homo Sapiens
LPLPPRLLQ

SEQ ID NO: 66989 - protein, 9 aa, Homo Sapiens
MTEWITWSP

SEQ ID NO: 66990 - protein, 9 aa, Homo Sapiens
MAAEKRIFG

SEQ ID NO: 66991 - protein, 9 aa, Homo Sapiens
IQAEISASA

SEQ ID NO: 66992 - protein, 9 aa, Homo Sapiens
PAQAPSAAA

SEQ ID NO: 66993 - protein, 9 aa, Homo Sapiens
GLRFGTLYA

SEQ ID NO: 66994 - protein, 9 aa, Homo Sapiens
QWGQQLEWP

SEQ ID NO: 66995 - protein, 9 aa, Homo Sapiens
SKNSDGKQT

SEQ ID NO: 66996 - protein, 9 aa, Homo Sapiens
MPPLPLPPR

SEQ ID NO: 66997 - protein, 9 aa, Homo Sapiens
PMYMSDSND

SEQ ID NO: 66998 - protein, 9 aa, Homo Sapiens
SQFDTATLL

SEQ ID NO: 66999 - protein, 9 aa, Homo Sapiens
YSSGPGPFY

SEQ ID NO: 67000 - protein, 9 aa, Homo Sapiens
YDKARPNIP

SEQ ID NO: 67001 - protein, 9 aa, Homo Sapiens
HMTEVVRRY

SEQ ID NO: 67002 - protein, 9 aa, Homo Sapiens
KPDVSAPGL

SEQ ID NO: 67003 - protein, 9 aa, Homo Sapiens
LRRDSWLDI

SEQ ID NO: 67004 - protein, 9 aa, Homo Sapiens
PHSPCYGRL

SEQ ID NO: 67005 - protein, 9 aa, Homo Sapiens
VSQFDTATL

SEQ ID NO: 67006 - protein, 9 aa, Homo Sapiens
AARPHWRLG

SEQ ID NO: 67007 - protein, 9 aa, Homo Sapiens
HVLLLISFR

SEQ ID NO: 67008 - protein, 9 aa, Homo Sapiens
QVEVRLPRD

SEQ ID NO: 67009 - protein, 9 aa, Homo Sapiens
SGPPMASGY

SEQ ID NO: 67010 - protein, 9 aa, Homo Sapiens
PVACINTHL

SEQ ID NO: 67011 - protein, 9 aa, Homo Sapiens
ECDGCTIDW

SEQ ID NO: 67012 - protein, 9 aa, Homo Sapiens
MEKTILPVQ

SEQ ID NO: 67013 - protein, 9 aa, Homo Sapiens
VFLNGKEMT

SEQ ID NO: 67014 - protein, 9 aa, Homo Sapiens
QNNNLDELN

SEQ ID NO: 67015 - protein, 9 aa, Homo Sapiens
EDAGDPNSA

SEQ ID NO: 67016 - protein, 9 aa, Homo Sapiens
TEVVRRYPH

SEQ ID NO: 67017 - protein, 9 aa, Homo Sapiens
TIWGKATPA

SEQ ID NO: 67018 - protein, 9 aa, Homo Sapiens
FLFSLGTTE

SEQ ID NO: 67019 - protein, 9 aa, Homo Sapiens
SKERERPQA

SEQ ID NO: 67020 - protein, 9 aa, Homo Sapiens
WSQEMDLKP

SEQ ID NO: 67021 - protein, 9 aa, Homo Sapiens
VFCNIWASV

SEQ ID NO: 67022 - protein, 9 aa, Homo Sapiens
HSRKLSGCS

SEQ ID NO: 67023 - protein, 9 aa, Homo Sapiens
KIYNVEQLR

SEQ ID NO: 67024 - protein, 9 aa, Homo Sapiens
TILPVQLKL

SEQ ID NO: 67025 - protein, 9 aa, Homo Sapiens
LDPHTVVAK

SEQ ID NO: 67026 - protein, 9 aa, Homo Sapiens
LALLQGVGL

SEQ ID NO: 67027 - protein, 9 aa, Homo Sapiens
PKFPELPEK

SEQ ID NO: 67028 - protein, 9 aa, Homo Sapiens
YMSDSNDTI

SEQ ID NO: 67029 - protein, 9 aa, Homo Sapiens
VKSMEKTIL

SEQ ID NO: 67030 - protein, 9 aa, Homo Sapiens
RVQMNFLQL

SEQ ID NO: 67031 - protein, 9 aa, Homo Sapiens
LDCCNCCQD

SEQ ID NO: 67032 - protein, 9 aa, Homo Sapiens
KCACPSREW

SEQ ID NO: 67033 - protein, 9 aa, Homo Sapiens
FLWKKFKRY

SEQ ID NO: 67034 - protein, 9 aa, Homo Sapiens
QFYFLFSLG

SEQ ID NO: 67035 - protein, 9 aa, Homo Sapiens
PMPPLPLPP

SEQ ID NO: 67036 - protein, 9 aa, Homo Sapiens
EGKCHPSLG

SEQ ID NO: 67037 - protein, 9 aa, Homo Sapiens
EAAYESVLF

SEQ ID NO: 67038 - protein, 9 aa, Homo Sapiens
ALAQWGQQL

SEQ ID NO: 67039 - protein, 9 aa, Homo Sapiens
PGTHYRAQV

SEQ ID NO: 67040 - protein, 9 aa, Homo Sapiens
DARSGPPMA

SEQ ID NO: 67041 - protein, 9 aa, Homo Sapiens
YGKRLKAEN

SEQ ID NO: 67042 - protein, 9 aa, Homo Sapiens
IDTQEQLRT

SEQ ID NO: 67043 - protein, 9 aa, Homo Sapiens
EEEEAEWGE

SEQ ID NO: 67044 - protein, 9 aa, Homo Sapiens
FLQLLSSEV

SEQ ID NO: 67045 - protein, 9 aa, Homo Sapiens
GSGAGCGPW

SEQ ID NO: 67046 - protein, 9 aa, Homo Sapiens
GLGLGLACV

SEQ ID NO: 67047 - protein, 9 aa, Homo Sapiens
PYDKARPNI

SEQ ID NO: 67048 - protein, 9 aa, Homo Sapiens
HPSLGNAMA

SEQ ID NO: 67049 - protein, 9 aa, Homo Sapiens
TYLPAFEPF

SEQ ID NO: 67050 - protein, 9 aa, Homo Sapiens
INNGNDKGN

SEQ ID NO: 67051 - protein, 9 aa, Homo Sapiens
SCLQKLLYL

SEQ ID NO: 67052 - protein, 9 aa, Homo Sapiens
IRKAGNLYT

SEQ ID NO: 67053 - protein, 9 aa, Homo Sapiens
SLDALWEMA

SEQ ID NO: 67054 - protein, 9 aa, Homo Sapiens
TVHSLLVAW

SEQ ID NO: 67055 - protein, 9 aa, Homo Sapiens
MLDLCDERE

SEQ ID NO: 67056 - protein, 9 aa, Homo Sapiens
PGLQPRLQG

SEQ ID NO: 67057 - protein, 9 aa, Homo Sapiens
FYGFLWKKF

SEQ ID NO: 67058 - protein, 9 aa, Homo Sapiens
SSFPAQAPS

SEQ ID NO: 67059 - protein, 9 aa, Homo Sapiens
HSAYTTLLP

SEQ ID NO: 67060 - protein, 9 aa, Homo Sapiens
RLALLQGVG

SEQ ID NO: 67061 - protein, 9 aa, Homo Sapiens
SAPGLQPRL

SEQ ID NO: 67062 - protein, 9 aa, Homo Sapiens
GISGKRPGA

SEQ ID NO: 67063 - protein, 9 aa, Homo Sapiens
QYFIRMVSD

SEQ ID NO: 67064 - protein, 9 aa, Homo Sapiens
CPALPPPPP

SEQ ID NO: 67065 - protein, 9 aa, Homo Sapiens
SAIFSAARQ

SEQ ID NO: 67066 - protein, 9 aa, Homo Sapiens
NQLSMHQII

SEQ ID NO: 67067 - protein, 9 aa, Homo Sapiens
WDRSESPQR

SEQ ID NO: 67068 - protein, 9 aa, Homo Sapiens
PSREWGGRC

SEQ ID NO: 67069 - protein, 9 aa, Homo Sapiens
TDSTGPTPG

SEQ ID NO: 67070 - protein, 9 aa, Homo Sapiens
IIHTGKKLY

SEQ ID NO: 67071 - protein, 9 aa, Homo Sapiens
CACPSREWG

SEQ ID NO: 67072 - protein, 9 aa, Homo Sapiens
FPELPEKPA

SEQ ID NO: 67073 - protein, 9 aa, Homo Sapiens
STNGAVFLN

SEQ ID NO: 67074 - protein, 9 aa, Homo Sapiens
EIIHTGKKL

SEQ ID NO: 67075 - protein, 9 aa, Homo Sapiens
GKEERRVTE

SEQ ID NO: 67076 - protein, 9 aa, Homo Sapiens
FIRMVSDRW

SEQ ID NO: 67077 - protein, 9 aa, Homo Sapiens
QHLKAQSRD

SEQ ID NO: 67078 - protein, 9 aa, Homo Sapiens
RTISEPDKQ

SEQ ID NO: 67079 - protein, 9 aa, Homo Sapiens
SSCSQSCSS

SEQ ID NO: 67080 - protein, 9 aa, Homo Sapiens
VPPPPHAVI

SEQ ID NO: 67081 - protein, 9 aa, Homo Sapiens
RLDTLSQEV

SEQ ID NO: 67082 - protein, 9 aa, Homo Sapiens
VSAPGLQPR

SEQ ID NO: 67083 - protein, 9 aa, Homo Sapiens
TVLSFVDEI

SEQ ID NO: 67084 - protein, 9 aa, Homo Sapiens
QPLPQEDPD

SEQ ID NO: 67085 - protein, 9 aa, Homo Sapiens
NPLLMWVAP

SEQ ID NO: 67086 - protein, 9 aa, Homo Sapiens
YRKQPLPQE

SEQ ID NO: 67087 - protein, 9 aa, Homo Sapiens
KKSCDQLAL

SEQ ID NO: 67088 - protein, 9 aa, Homo Sapiens
TTAKLHVSL

SEQ ID NO: 67089 - protein, 9 aa, Homo Sapiens
SCSLTQTVV

SEQ ID NO: 67090 - protein, 9 aa, Homo Sapiens
PNHPGVYTS

SEQ ID NO: 67091 - protein, 9 aa, Homo Sapiens
MVDLMFPLL

SEQ ID NO: 67092 - protein, 9 aa, Homo Sapiens
RSESPQRSS

SEQ ID NO: 67093 - protein, 9 aa, Homo Sapiens
EEVQQRLLQ

SEQ ID NO: 67094 - protein, 9 aa, Homo Sapiens
ASVDVLCCT

SEQ ID NO: 67095 - protein, 9 aa, Homo Sapiens
TNYGNPADH

SEQ ID NO: 67096 - protein, 9 aa, Homo Sapiens
LSGQEPIVK

SEQ ID NO: 67097 - protein, 9 aa, Homo Sapiens
LFSLGTTEC

SEQ ID NO: 67098 - protein, 9 aa, Homo Sapiens
ARLALLQGV

SEQ ID NO: 67099 - protein, 9 aa, Homo Sapiens
DVRTVIPDQ

SEQ ID NO: 67100 - protein, 9 aa, Homo Sapiens
KQFGRLPEF

SEQ ID NO: 67101 - protein, 9 aa, Homo Sapiens
SQFTYKFAE

SEQ ID NO: 67102 - protein, 9 aa, Homo Sapiens
SEHRKCACP

SEQ ID NO: 67103 - protein, 9 aa, Homo Sapiens
VLTQALAQW

SEQ ID NO: 67104 - protein, 9 aa, Homo Sapiens
RQNYPLTSN

SEQ ID NO: 67105 - protein, 9 aa, Homo Sapiens
TFQSGKQFD

SEQ ID NO: 67106 - protein, 9 aa, Homo Sapiens
TPMYMSDSN

SEQ ID NO: 67107 - protein, 9 aa, Homo Sapiens
RNDEAVKGL

SEQ ID NO: 67108 - protein, 9 aa, Homo Sapiens
SDCEAGALR

SEQ ID NO: 67109 - protein, 9 aa, Homo Sapiens
RLLVIKGEH

SEQ ID NO: 67110 - protein, 9 aa, Homo Sapiens
TTVHSLLVA

SEQ ID NO: 67111 - protein, 9 aa, Homo Sapiens
GALIAVNPK

SEQ ID NO: 67112 - protein, 9 aa, Homo Sapiens
LVFHCIDDL

SEQ ID NO: 67113 - protein, 9 aa, Homo Sapiens
KIEECSQFT

SEQ ID NO: 67114 - protein, 9 aa, Homo Sapiens
FGRLPEFYN

SEQ ID NO: 67115 - protein, 9 aa, Homo Sapiens
DTQEQLRTA

SEQ ID NO: 67116 - protein, 9 aa, Homo Sapiens
ERERRQISS

SEQ ID NO: 67117 - protein, 9 aa, Homo Sapiens
VDPDSWSQE

SEQ ID NO: 67118 - protein, 9 aa, Homo Sapiens
CPGTHYRAQ

SEQ ID NO: 67119 - protein, 9 aa, Homo Sapiens
HVVSQFDTA

SEQ ID NO: 67120 - protein, 9 aa, Homo Sapiens
WSHNVPHTS

SEQ ID NO: 67121 - protein, 9 aa, Homo Sapiens
FYINVERQE

SEQ ID NO: 67122 - protein, 9 aa, Homo Sapiens
IRKLTCLCI

SEQ ID NO: 67123 - protein, 9 aa, Homo Sapiens
GKGCALPNH

SEQ ID NO: 67124 - protein, 9 aa, Homo Sapiens
RPDQLHIFN

SEQ ID NO: 67125 - protein, 9 aa, Homo Sapiens
QMKTIWSTM

SEQ ID NO: 67126 - protein, 9 aa, Homo Sapiens
LMWVAPDPA

SEQ ID NO: 67127 - protein, 9 aa, Homo Sapiens
TKKGHVIRK

SEQ ID NO: 67128 - protein, 9 aa, Homo Sapiens
SFEATKKSC

SEQ ID NO: 67129 - protein, 9 aa, Homo Sapiens
ADMRGVGLC

SEQ ID NO: 67130 - protein, 9 aa, Homo Sapiens
KLLYLNLSA

SEQ ID NO: 67131 - protein, 9 aa, Homo Sapiens
FQHTNYGNP

SEQ ID NO: 67132 - protein, 9 aa, Homo Sapiens
LEDLPSFSA

SEQ ID NO: 67133 - protein, 9 aa, Homo Sapiens
FLQFYFLFS

SEQ ID NO: 67134 - protein, 9 aa, Homo Sapiens
FAYVQMKTI

SEQ ID NO: 67135 - protein, 9 aa, Homo Sapiens
EQTMSDCEA

SEQ ID NO: 67136 - protein, 9 aa, Homo Sapiens
QEWKLDTLC

SEQ ID NO: 67137 - protein, 9 aa, Homo Sapiens
LLCSPLINK

SEQ ID NO: 67138 - protein, 9 aa, Homo Sapiens
AYQVTLSGQ

SEQ ID NO: 67139 - protein, 9 aa, Homo Sapiens
LNRGLKKKK

SEQ ID NO: 67140 - protein, 9 aa, Homo Sapiens
IHTGKKLYK

SEQ ID NO: 67141 - protein, 9 aa, Homo Sapiens
DTATLLCYL

SEQ ID NO: 67142 - protein, 9 aa, Homo Sapiens
LINKCIEAI

SEQ ID NO: 67143 - protein, 9 aa, Homo Sapiens
QGLDPIPLL

SEQ ID NO: 67144 - protein, 9 aa, Homo Sapiens
AEWEETTSP

SEQ ID NO: 67145 - protein, 9 aa, Homo Sapiens
HGRVPPPPH

SEQ ID NO: 67146 - protein, 9 aa, Homo Sapiens
AADGRGPGA

SEQ ID NO: 67147 - protein, 9 aa, Homo Sapiens
HHVVSQFDT

SEQ ID NO: 67148 - protein, 9 aa, Homo Sapiens
TGPTPGSSG

SEQ ID NO: 67149 - protein, 9 aa, Homo Sapiens
NCHFGPYDK

SEQ ID NO: 67150 - protein, 9 aa, Homo Sapiens
GKCHPSLGN

SEQ ID NO: 67151 - protein, 9 aa, Homo Sapiens
QKMKGKEER

SEQ ID NO: 67152 - protein, 9 aa, Homo Sapiens
EAQEVLYVI

SEQ ID NO: 67153 - protein, 9 aa, Homo Sapiens
RDKNCVMSQ

SEQ ID NO: 67154 - protein, 9 aa, Homo Sapiens
SFVDEIISG

SEQ ID NO: 67155 - protein, 9 aa, Homo Sapiens
PLLMWVAPD

SEQ ID NO: 67156 - protein, 9 aa, Homo Sapiens
RGLKKKKQY

SEQ ID NO: 67157 - protein, 9 aa, Homo Sapiens
VSREDAGDP

SEQ ID NO: 67158 - protein, 9 aa, Homo Sapiens
QKQRNRCQY

SEQ ID NO: 67159 - protein, 9 aa, Homo Sapiens
CSSKNSDGK

SEQ ID NO: 67160 - protein, 9 aa, Homo Sapiens
QTEPKTLQK

SEQ ID NO: 67161 - protein, 9 aa, Homo Sapiens
TATLLCYLY

SEQ ID NO: 67162 - protein, 9 aa, Homo Sapiens
CDQGLDPIP

SEQ ID NO: 67163 - protein, 9 aa, Homo Sapiens
LDVRTVIPD

SEQ ID NO: 67164 - protein, 9 aa, Homo Sapiens
YMLEKVLTF

SEQ ID NO: 67165 - protein, 9 aa, Homo Sapiens
QEVLVFVTS

SEQ ID NO: 67166 - protein, 9 aa, Homo Sapiens
QVTLSGQEP

SEQ ID NO: 67167 - protein, 9 aa, Homo Sapiens
KSCDQLALG

SEQ ID NO: 67168 - protein, 9 aa, Homo Sapiens
VSERLVALL

SEQ ID NO: 67169 - protein, 9 aa, Homo Sapiens
RPQAMMTHL

SEQ ID NO: 67170 - protein, 9 aa, Homo Sapiens
SYSYSYSSG

SEQ ID NO: 67171 - protein, 9 aa, Homo Sapiens
IALSEKELL

SEQ ID NO: 67172 - protein, 9 aa, Homo Sapiens
EMIGTQIVS

SEQ ID NO: 67173 - protein, 9 aa, Homo Sapiens
VERQEWKLD

SEQ ID NO: 67174 - protein, 9 aa, Homo Sapiens
KRPGAGEGP

SEQ ID NO: 67175 - protein, 9 aa, Homo Sapiens
APGGGGGGV

SEQ ID NO: 67176 - protein, 9 aa, Homo Sapiens
IHMSEGREL

SEQ ID NO: 67177 - protein, 9 aa, Homo Sapiens
AENQDVATA

SEQ ID NO: 67178 - protein, 9 aa, Homo Sapiens
NWPNFNRSV

SEQ ID NO: 67179 - protein, 9 aa, Homo Sapiens
YYVCHHYCL

SEQ ID NO: 67180 - protein, 9 aa, Homo Sapiens
SWSQEMDLK

SEQ ID NO: 67181 - protein, 9 aa, Homo Sapiens
HSPMILRFL

SEQ ID NO: 67182 - protein, 9 aa, Homo Sapiens
KGHVIRKLT

SEQ ID NO: 67183 - protein, 9 aa, Homo Sapiens
QLDWLQAEP

SEQ ID NO: 67184 - protein, 9 aa, Homo Sapiens
HLGKKGRGK

SEQ ID NO: 67185 - protein, 9 aa, Homo Sapiens
EHMDAYCRK

SEQ ID NO: 67186 - protein, 9 aa, Homo Sapiens
DPHTVVAKV

SEQ ID NO: 67187 - protein, 9 aa, Homo Sapiens
SQNPLLMWV

SEQ ID NO: 67188 - protein, 9 aa, Homo Sapiens
VGLDVERWL

SEQ ID NO: 67189 - protein, 9 aa, Homo Sapiens
SRLDTLSQE

SEQ ID NO: 67190 - protein, 9 aa, Homo Sapiens
RGPGAGAPA

SEQ ID NO: 67191 - protein, 9 aa, Homo Sapiens
RVPPPPHAV

SEQ ID NO: 67192 - protein, 9 aa, Homo Sapiens
HYCLNSESC

SEQ ID NO: 67193 - protein, 9 aa, Homo Sapiens
QEMDLKPDA

SEQ ID NO: 67194 - protein, 9 aa, Homo Sapiens
ATKKSCDQL

SEQ ID NO: 67195 - protein, 9 aa, Homo Sapiens
VSEVKDTVH

SEQ ID NO: 67196 - protein, 9 aa, Homo Sapiens
LLPVACINT

SEQ ID NO: 67197 - protein, 9 aa, Homo Sapiens
FPSSEHRKC

SEQ ID NO: 67198 - protein, 9 aa, Homo Sapiens
LVCRIQKLR

SEQ ID NO: 67199 - protein, 9 aa, Homo Sapiens
AVFLNGKEM

SEQ ID NO: 67200 - protein, 9 aa, Homo Sapiens
GCHINECHS

SEQ ID NO: 67201 - protein, 9 aa, Homo Sapiens
TQIVSERLV

SEQ ID NO: 67202 - protein, 9 aa, Homo Sapiens
EEEAEWGEE

SEQ ID NO: 67203 - protein, 9 aa, Homo Sapiens
EIISGAKSP

SEQ ID NO: 67204 - protein, 9 aa, Homo Sapiens
AAEKRIFGA

SEQ ID NO: 67205 - protein, 9 aa, Homo Sapiens
LRRAARPHW

SEQ ID NO: 67206 - protein, 9 aa, Homo Sapiens
HQTEPKTLQ

SEQ ID NO: 67207 - protein, 9 aa, Homo Sapiens
KRTHIKYTT

SEQ ID NO: 67208 - protein, 9 aa, Homo Sapiens
HVGVVQYSH

SEQ ID NO: 67209 - protein, 9 aa, Homo Sapiens
LNDIRKAGN

SEQ ID NO: 67210 - protein, 9 aa, Homo Sapiens
LKAENLMYL

SEQ ID NO: 67211 - protein, 9 aa, Homo Sapiens
EKTILPVQL

SEQ ID NO: 67212 - protein, 9 aa, Homo Sapiens
NMTFGIRAW

SEQ ID NO: 67213 - protein, 9 aa, Homo Sapiens
VLTRCRVVQ

SEQ ID NO: 67214 - protein, 9 aa, Homo Sapiens
LFYGFLWKK

SEQ ID NO: 67215 - protein, 9 aa, Homo Sapiens
SCSQSCSSK

SEQ ID NO: 67216 - protein, 9 aa, Homo Sapiens
DSFEATKKS

SEQ ID NO: 67217 - protein, 9 aa, Homo Sapiens
DTLSQEVAL

SEQ ID NO: 67218 - protein, 9 aa, Homo Sapiens
TVCAARRLF

SEQ ID NO: 67219 - protein, 9 aa, Homo Sapiens
NRTPMYMSD

SEQ ID NO: 67220 - protein, 9 aa, Homo Sapiens
EMAAEKRIF

SEQ ID NO: 67221 - protein, 9 aa, Homo Sapiens
PEVKCAGSV

SEQ ID NO: 67222 - protein, 9 aa, Homo Sapiens
CVKPDVSAP

SEQ ID NO: 67223 - protein, 9 aa, Homo Sapiens
SLPSRVHLK

SEQ ID NO: 67224 - protein, 9 aa, Homo Sapiens
EGDRETTIW

SEQ ID NO: 67225 - protein, 9 aa, Homo Sapiens
LDALWEMAA

SEQ ID NO: 67226 - protein, 9 aa, Homo Sapiens
SSEHRKCAC

SEQ ID NO: 67227 - protein, 9 aa, Homo Sapiens
GLACVLART

SEQ ID NO: 67228 - protein, 9 aa, Homo Sapiens
AAHLGKKGR

SEQ ID NO: 67229 - protein, 9 aa, Homo Sapiens
LACVLARTQ

SEQ ID NO: 67230 - protein, 9 aa, Homo Sapiens
WENMGKRMN

SEQ ID NO: 67231 - protein, 9 aa, Homo Sapiens
CAADGRGPG

SEQ ID NO: 67232 - protein, 9 aa, Homo Sapiens
ARPHWRLGP

SEQ ID NO: 67233 - protein, 9 aa, Homo Sapiens
RSYSYSYSS

SEQ ID NO: 67234 - protein, 9 aa, Homo Sapiens
VVSQFDTAT

SEQ ID NO: 67235 - protein, 9 aa, Homo Sapiens
NTTVHSLLV

SEQ ID NO: 67236 - protein, 9 aa, Homo Sapiens
LKWWRDPGR

SEQ ID NO: 67237 - protein, 9 aa, Homo Sapiens
VQMNFLQLL

SEQ ID NO: 67238 - protein, 9 aa, Homo Sapiens
PSSEHRKCA

SEQ ID NO: 67239 - protein, 9 aa, Homo Sapiens
TEPKTLQKQ

SEQ ID NO: 67240 - protein, 9 aa, Homo Sapiens
SCDQLALGV

SEQ ID NO: 67241 - protein, 9 aa, Homo Sapiens
KRALQSEQA

SEQ ID NO: 67242 - protein, 9 aa, Homo Sapiens
RGVGLCPAL

SEQ ID NO: 67243 - protein, 9 aa, Homo Sapiens
SAYTTLLPH

SEQ ID NO: 67244 - protein, 9 aa, Homo Sapiens
SVDVLCCTA

SEQ ID NO: 67245 - protein, 9 aa, Homo Sapiens
RVLTYRKQP

SEQ ID NO: 67246 - protein, 9 aa, Homo Sapiens
VKPDVSAPG

SEQ ID NO: 67247 - protein, 9 aa, Homo Sapiens
WGKATPAEE

SEQ ID NO: 67248 - protein, 9 aa, Homo Sapiens
HFGCPVGST

SEQ ID NO: 67249 - protein, 9 aa, Homo Sapiens
LIAVNPKNS

SEQ ID NO: 67250 - protein, 9 aa, Homo Sapiens
YRAQVEVRL

SEQ ID NO: 67251 - protein, 9 aa, Homo Sapiens
SWLDIQAEI

SEQ ID NO: 67252 - protein, 9 aa, Homo Sapiens
GTLYAENQD

SEQ ID NO: 67253 - protein, 9 aa, Homo Sapiens
WPSTPFFDL

SEQ ID NO: 67254 - protein, 9 aa, Homo Sapiens
LDWPMPPLP

SEQ ID NO: 67255 - protein, 9 aa, Homo Sapiens
RRKKKRCQR

SEQ ID NO: 67256 - protein, 9 aa, Homo Sapiens
DQYCFQHTN

SEQ ID NO: 67257 - protein, 9 aa, Homo Sapiens
IPYLDNWPN

SEQ ID NO: 67258 - protein, 9 aa, Homo Sapiens
TLSQEVALL

SEQ ID NO: 67259 - protein, 9 aa, Homo Sapiens
RMNHHLQYN

SEQ ID NO: 67260 - protein, 9 aa, Homo Sapiens
ALWEMAAEK

SEQ ID NO: 67261 - protein, 9 aa, Homo Sapiens
LVIKGEHMT

SEQ ID NO: 67262 - protein, 9 aa, Homo Sapiens
SRVHLKQKS

SEQ ID NO: 67263 - protein, 9 aa, Homo Sapiens
VQKMKGKEE

SEQ ID NO: 67264 - protein, 9 aa, Homo Sapiens
ETTIWGKAT

SEQ ID NO: 67265 - protein, 9 aa, Homo Sapiens
RLKAENLMY

SEQ ID NO: 67266 - protein, 9 aa, Homo Sapiens
NISLHLLHE

SEQ ID NO: 67267 - protein, 9 aa, Homo Sapiens
ASLGIKRAL

SEQ ID NO: 67268 - protein, 9 aa, Homo Sapiens
APSAALVSL

SEQ ID NO: 67269 - protein, 9 aa, Homo Sapiens
TAKLHVSLT

SEQ ID NO: 67270 - protein, 9 aa, Homo Sapiens
ISKRLRRRW

SEQ ID NO: 67271 - protein, 9 aa, Homo Sapiens
KPLIFDHLA

SEQ ID NO: 67272 - protein, 9 aa, Homo Sapiens
DGRGPGAGA

SEQ ID NO: 67273 - protein, 9 aa, Homo Sapiens
SFQLDWLQA

SEQ ID NO: 67274 - protein, 9 aa, Homo Sapiens
VGSTMNPGQ

SEQ ID NO: 67275 - protein, 9 aa, Homo Sapiens
PLFYGFLWK

SEQ ID NO: 67276 - protein, 9 aa, Homo Sapiens
RRYPHHERC

SEQ ID NO: 67277 - protein, 9 aa, Homo Sapiens
LRRRWQLLQ

SEQ ID NO: 67278 - protein, 9 aa, Homo Sapiens
EDSYKVTTA

SEQ ID NO: 67279 - protein, 9 aa, Homo Sapiens
KSETGTHVG

SEQ ID NO: 67280 - protein, 9 aa, Homo Sapiens
SYSYSSGPG

SEQ ID NO: 67281 - protein, 9 aa, Homo Sapiens
CNIWASVDV

SEQ ID NO: 67282 - protein, 9 aa, Homo Sapiens
PTVSREDAG

SEQ ID NO: 67283 - protein, 9 aa, Homo Sapiens
PPHAVIPLK

SEQ ID NO: 67284 - protein, 9 aa, Homo Sapiens
SLGQMQNNN

SEQ ID NO: 67285 - protein, 9 aa, Homo Sapiens
ELALINNGN

SEQ ID NO: 67286 - protein, 9 aa, Homo Sapiens
LRCYSGSHS

SEQ ID NO: 67287 - protein, 9 aa, Homo Sapiens
GKRLKAENL

SEQ ID NO: 67288 - protein, 9 aa, Homo Sapiens
SWVKQLWSH

SEQ ID NO: 67289 - protein, 9 aa, Homo Sapiens
ETVLSFVDE

SEQ ID NO: 67290 - protein, 9 aa, Homo Sapiens
PAFEPFLYD

SEQ ID NO: 67291 - protein, 9 aa, Homo Sapiens
EPGATVCAA

SEQ ID NO: 67292 - protein, 9 aa, Homo Sapiens
HPGVYTSVA

SEQ ID NO: 67293 - protein, 9 aa, Homo Sapiens
LTEFGTQGG

SEQ ID NO: 67294 - protein, 9 aa, Homo Sapiens
ALVSLSSVS

SEQ ID NO: 67295 - protein, 9 aa, Homo Sapiens
ALPNHPGVY

SEQ ID NO: 67296 - protein, 9 aa, Homo Sapiens
QHDSGIESL

SEQ ID NO: 67297 - protein, 9 aa, Homo Sapiens
AERLKIEAA

SEQ ID NO: 67298 - protein, 9 aa, Homo Sapiens
SGAGCGPWI

SEQ ID NO: 67299 - protein, 9 aa, Homo Sapiens
SGPGPFYNK

SEQ ID NO: 67300 - protein, 9 aa, Homo Sapiens
EGPEIVECD

SEQ ID NO: 67301 - protein, 9 aa, Homo Sapiens
PQYFIRMVS

SEQ ID NO: 67302 - protein, 9 aa, Homo Sapiens
RAAHLGKKG

SEQ ID NO: 67303 - protein, 9 aa, Homo Sapiens
VVPLKKIYN

SEQ ID NO: 67304 - protein, 9 aa, Homo Sapiens
SQSCSSKNS

SEQ ID NO: 67305 - protein, 9 aa, Homo Sapiens
EGHKGAQLP

SEQ ID NO: 67306 - protein, 9 aa, Homo Sapiens
DERERRQIS

SEQ ID NO: 67307 - protein, 9 aa, Homo Sapiens
LHVTRTGAT

SEQ ID NO: 67308 - protein, 9 aa, Homo Sapiens
KNCVMSQKQ

SEQ ID NO: 67309 - protein, 9 aa, Homo Sapiens
DTFQSGKQF

SEQ ID NO: 67310 - protein, 9 aa, Homo Sapiens
HVIRKLTCL

SEQ ID NO: 67311 - protein, 9 aa, Homo Sapiens
VLVAHVLLL

SEQ ID NO: 67312 - protein, 9 aa, Homo Sapiens
GLGLAPSAA

SEQ ID NO: 67313 - protein, 9 aa, Homo Sapiens
LINNGNDKG

SEQ ID NO: 67314 - protein, 9 aa, Homo Sapiens
NECHSRKLS

SEQ ID NO: 67315 - protein, 9 aa, Homo Sapiens
AVNPKNSLK

SEQ ID NO: 67316 - protein, 9 aa, Homo Sapiens
KSSVPLSSR

SEQ ID NO: 67317 - protein, 9 aa, Homo Sapiens
DIHSPMILR

SEQ ID NO: 67318 - protein, 9 aa, Homo Sapiens
FQSGKQFDA

SEQ ID NO: 67319 - protein, 9 aa, Homo Sapiens
VPNISLHLL

SEQ ID NO: 67320 - protein, 9 aa, Homo Sapiens
QLSKERERP

SEQ ID NO: 67321 - protein, 9 aa, Homo Sapiens
AYMLEKVLT

SEQ ID NO: 67322 - protein, 9 aa, Homo Sapiens
LPVACINTH

SEQ ID NO: 67323 - protein, 9 aa, Homo Sapiens
CPSREWGGR

SEQ ID NO: 67324 - protein, 9 aa, Homo Sapiens
ESVNKKEIM

SEQ ID NO: 67325 - protein, 9 aa, Homo Sapiens
PDVSAPGLQ

SEQ ID NO: 67326 - protein, 9 aa, Homo Sapiens
VNKKEIMVT

SEQ ID NO: 67327 - protein, 9 aa, Homo Sapiens
SYSSGPGPF

SEQ ID NO: 67328 - protein, 9 aa, Homo Sapiens
TGATTSSFP

SEQ ID NO: 67329 - protein, 9 aa, Homo Sapiens
KQEAMQRAT

SEQ ID NO: 67330 - protein, 9 aa, Homo Sapiens
MQNNNLDEL

SEQ ID NO: 67331 - protein, 9 aa, Homo Sapiens
NFAYVQMKT

SEQ ID NO: 67332 - protein, 9 aa, Homo Sapiens
LDLCDERER

SEQ ID NO: 67333 - protein, 9 aa, Homo Sapiens
TTSLGQMQN

SEQ ID NO: 67334 - protein, 9 aa, Homo Sapiens
ERPQAMMTH

SEQ ID NO: 67335 - protein, 9 aa, Homo Sapiens
TPGSSGGTK

SEQ ID NO: 67336 - protein, 9 aa, Homo Sapiens
TRTGATTSS

SEQ ID NO: 67337 - protein, 9 aa, Homo Sapiens
ATTSSFPAQ

SEQ ID NO: 67338 - protein, 9 aa, Homo Sapiens
ILLSIADWM

SEQ ID NO: 67339 - protein, 9 aa, Homo Sapiens
LGQMQNNNL

SEQ ID NO: 67340 - protein, 9 aa, Homo Sapiens
DWLQAEPRC

SEQ ID NO: 67341 - protein, 9 aa, Homo Sapiens
GGPGFTSRT

SEQ ID NO: 67342 - protein, 9 aa, Homo Sapiens
LKSRLDTLS

SEQ ID NO: 67343 - protein, 9 aa, Homo Sapiens
TSFQLDWLQ

SEQ ID NO: 67344 - protein, 9 aa, Homo Sapiens
TMNPGQLCE

SEQ ID NO: 67345 - protein, 9 aa, Homo Sapiens
HLKAQSRDF

SEQ ID NO: 67346 - protein, 9 aa, Homo Sapiens
MIGTQIVSE

SEQ ID NO: 67347 - protein, 9 aa, Homo Sapiens
TISEPDKQR

SEQ ID NO: 67348 - protein, 9 aa, Homo Sapiens
SPLINKCIE

SEQ ID NO: 67349 - protein, 9 aa, Homo Sapiens
CSQFTYKFA

SEQ ID NO: 67350 - protein, 9 aa, Homo Sapiens
ETGTHVGVV

SEQ ID NO: 67351 - protein, 9 aa, Homo Sapiens
PGGGGGGVP

SEQ ID NO: 67352 - protein, 9 aa, Homo Sapiens
LALINNGND

SEQ ID NO: 67353 - protein, 9 aa, Homo Sapiens
EETSFQLDW

SEQ ID NO: 67354 - protein, 9 aa, Homo Sapiens
SERLVALLE

SEQ ID NO: 67355 - protein, 9 aa, Homo Sapiens
EVKPLIFDH

SEQ ID NO: 67356 - protein, 9 aa, Homo Sapiens
GCDQGLDPI

SEQ ID NO: 67357 - protein, 9 aa, Homo Sapiens
HRKCACPSR

SEQ ID NO: 67358 - protein, 9 aa, Homo Sapiens
LCDERERRQ

SEQ ID NO: 67359 - protein, 9 aa, Homo Sapiens
SVPKMILLS

SEQ ID NO: 67360 - protein, 9 aa, Homo Sapiens
KESVNKKEI

SEQ ID NO: 67361 - protein, 9 aa, Homo Sapiens
IQTGASGSG

SEQ ID NO: 67362 - protein, 9 aa, Homo Sapiens
GLAPSAALV

SEQ ID NO: 67363 - protein, 9 aa, Homo Sapiens
VCRIQKLRC

SEQ ID NO: 67364 - protein, 9 aa, Homo Sapiens
EIIHMSEGR

SEQ ID NO: 67365 - protein, 9 aa, Homo Sapiens
VSSVPKMIL

SEQ ID NO: 67366 - protein, 9 aa, Homo Sapiens
PEIVECDGC

SEQ ID NO: 67367 - protein, 9 aa, Homo Sapiens
AYTTLLPHA

SEQ ID NO: 67368 - protein, 9 aa, Homo Sapiens
AGNLYTGKE

SEQ ID NO: 67369 - protein, 9 aa, Homo Sapiens
CRRKKKRCQ

SEQ ID NO: 67370 - protein, 9 aa, Homo Sapiens
AMQRATVER

SEQ ID NO: 67371 - protein, 9 aa, Homo Sapiens
EDLPSFSAC

SEQ ID NO: 67372 - protein, 9 aa, Homo Sapiens
IKGEHMTEE

SEQ ID NO: 67373 - protein, 9 aa, Homo Sapiens
VFVTSGGRM

SEQ ID NO: 67374 - protein, 9 aa, Homo Sapiens
AYVQMKTIW

SEQ ID NO: 67375 - protein, 9 aa, Homo Sapiens
RLVGPHSPC

SEQ ID NO: 67376 - protein, 9 aa, Homo Sapiens
PPQYFIRMV

SEQ ID NO: 67377 - protein, 9 aa, Homo Sapiens
LSFAVLVAH

SEQ ID NO: 67378 - protein, 9 aa, Homo Sapiens
AIFFRVSSV

SEQ ID NO: 67379 - protein, 9 aa, Homo Sapiens
SFPAQAPSA

SEQ ID NO: 67380 - protein, 9 aa, Homo Sapiens
MSQKQRNRC

SEQ ID NO: 67381 - protein, 9 aa, Homo Sapiens
SEPDKQRSE

SEQ ID NO: 67382 - protein, 9 aa, Homo Sapiens
SGKRPGAGE

SEQ ID NO: 67383 - protein, 9 aa, Homo Sapiens
WGQQLEWPE

SEQ ID NO: 67384 - protein, 9 aa, Homo Sapiens
SAALVSLSS

SEQ ID NO: 67385 - protein, 9 aa, Homo Sapiens
NVEQLRYQA

SEQ ID NO: 67386 - protein, 9 aa, Homo Sapiens
YSYSYSSGP

SEQ ID NO: 67387 - protein, 9 aa, Homo Sapiens
FQLDWLQAE

SEQ ID NO: 67388 - protein, 9 aa, Homo Sapiens
EAEESQHDS

SEQ ID NO: 67389 - protein, 9 aa, Homo Sapiens
INKCIEAIR

SEQ ID NO: 67390 - protein, 9 aa, Homo Sapiens
ISTNGAVFL

SEQ ID NO: 67391 - protein, 9 aa, Homo Sapiens
REWGGRCEF

SEQ ID NO: 67392 - protein, 9 aa, Homo Sapiens
FLTLRPDQL

SEQ ID NO: 67393 - protein, 9 aa, Homo Sapiens
FLKWWRDPG

SEQ ID NO: 67394 - protein, 9 aa, Homo Sapiens
PSKLETTHT

SEQ ID NO: 67395 - protein, 9 aa, Homo Sapiens
EECSQFTYK

SEQ ID NO: 67396 - protein, 9 aa, Homo Sapiens
CTMTEWITW

SEQ ID NO: 67397 - protein, 9 aa, Homo Sapiens
VDLMFPLLL

SEQ ID NO: 67398 - protein, 9 aa, Homo Sapiens
LGLGLGLAC

SEQ ID NO: 67399 - protein, 9 aa, Homo Sapiens
VKQLWSHNV

SEQ ID NO: 67400 - protein, 9 aa, Homo Sapiens
LSIADWMVH

SEQ ID NO: 67401 - protein, 9 aa, Homo Sapiens
TYRKQPLPQ

SEQ ID NO: 67402 - protein, 9 aa, Homo Sapiens
AYESVLFHQ

SEQ ID NO: 67403 - protein, 9 aa, Homo Sapiens
VIKGEHMTE

SEQ ID NO: 67404 - protein, 9 aa, Homo Sapiens
RGCHINECH

SEQ ID NO: 67405 - protein, 9 aa, Homo Sapiens
GVSVASSSH

SEQ ID NO: 67406 - protein, 9 aa, Homo Sapiens
RRRWQLLQD

SEQ ID NO: 67407 - protein, 9 aa, Homo Sapiens
NGKEQTMSD

SEQ ID NO: 67408 - protein, 9 aa, Homo Sapiens
GATTSSFPA

SEQ ID NO: 67409 - protein, 9 aa, Homo Sapiens
HFGPYDKAR

SEQ ID NO: 67410 - protein, 9 aa, Homo Sapiens
FELLCSPLI

SEQ ID NO: 67411 - protein, 9 aa, Homo Sapiens
IPEIIHMSE

SEQ ID NO: 67412 - protein, 9 aa, Homo Sapiens
SAARQNYPL

SEQ ID NO: 67413 - protein, 9 aa, Homo Sapiens
GATVCAARR

SEQ ID NO: 67414 - protein, 9 aa, Homo Sapiens
QLWSHNVPH

SEQ ID NO: 67415 - protein, 9 aa, Homo Sapiens
QMQNNNLDE

SEQ ID NO: 67416 - protein, 9 aa, Homo Sapiens
DLSNGMIIF

SEQ ID NO: 67417 - protein, 9 aa, Homo Sapiens
KLRCYSGSH

SEQ ID NO: 67418 - protein, 9 aa, Homo Sapiens
HMSEGRELV

SEQ ID NO: 67419 - protein, 9 aa, Homo Sapiens
ISRVPNISL

SEQ ID NO: 67420 - protein, 9 aa, Homo Sapiens
LQGVGLDVE

SEQ ID NO: 67421 - protein, 9 aa, Homo Sapiens
FIPYLDNWP

SEQ ID NO: 67422 - protein, 9 aa, Homo Sapiens
EVKCAGSVA

SEQ ID NO: 67423 - protein, 9 aa, Homo Sapiens
GSTMNPGQL

SEQ ID NO: 67424 - protein, 9 aa, Homo Sapiens
LREGKCHPS

SEQ ID NO: 67425 - protein, 9 aa, Homo Sapiens
IFVDTFQSG

SEQ ID NO: 67426 - protein, 9 aa, Homo Sapiens
AFEPFLYDA

SEQ ID NO: 67427 - protein, 9 aa, Homo Sapiens
VQQRLLQLQ

SEQ ID NO: 67428 - protein, 9 aa, Homo Sapiens
RLKIEAAYE

SEQ ID NO: 67429 - protein, 9 aa, Homo Sapiens
GLDPIPLLA

SEQ ID NO: 67430 - protein, 9 aa, Homo Sapiens
RFGTLYAEN

SEQ ID NO: 67431 - protein, 9 aa, Homo Sapiens
LHLLHEPPA

SEQ ID NO: 67432 - protein, 9 aa, Homo Sapiens
SFEGPEIVE

SEQ ID NO: 67433 - protein, 9 aa, Homo Sapiens
QLLSSEVTQ

SEQ ID NO: 67434 - protein, 9 aa, Homo Sapiens
KKKRCQRDG

SEQ ID NO: 67435 - protein, 9 aa, Homo Sapiens
EVQQRLLQL

SEQ ID NO: 67436 - protein, 9 aa, Homo Sapiens
YSYSSGPGP

SEQ ID NO: 67437 - protein, 9 aa, Homo Sapiens
LWSHNVPHT

SEQ ID NO: 67438 - protein, 9 aa, Homo Sapiens
MYMSDSNDT

SEQ ID NO: 67439 - protein, 9 aa, Homo Sapiens
GRSENEAEW

SEQ ID NO: 67440 - protein, 9 aa, Homo Sapiens
TVWKQFGRL

SEQ ID NO: 67441 - protein, 9 aa, Homo Sapiens
PHAVIPLKR

SEQ ID NO: 67442 - protein, 9 aa, Homo Sapiens
TAYMLEKVL

SEQ ID NO: 67443 - protein, 9 aa, Homo Sapiens
DAFADWCEI

SEQ ID NO: 67444 - protein, 9 aa, Homo Sapiens
EISKRLRRR

SEQ ID NO: 67445 - protein, 9 aa, Homo Sapiens
RAARPHWRL

SEQ ID NO: 67446 - protein, 9 aa, Homo Sapiens
LPPQYFIRM

SEQ ID NO: 67447 - protein, 9 aa, Homo Sapiens
LPAFEPFLY

SEQ ID NO: 67448 - protein, 9 aa, Homo Sapiens
FGPYDKARP

SEQ ID NO: 67449 - protein, 9 aa, Homo Sapiens
RVSSVPKMI

SEQ ID NO: 67450 - protein, 9 aa, Homo Sapiens
VAHVLLLIS

SEQ ID NO: 67451 - protein, 9 aa, Homo Sapiens
NHPGVYTSV

SEQ ID NO: 67452 - protein, 9 aa, Homo Sapiens
IHSPMILRF

SEQ ID NO: 67453 - protein, 9 aa, Homo Sapiens
WEMAAEKRI

SEQ ID NO: 67454 - protein, 9 aa, Homo Sapiens
TLYAENQDV

SEQ ID NO: 67455 - protein, 9 aa, Homo Sapiens
PLPQEDPDV

SEQ ID NO: 67456 - protein, 9 aa, Homo Sapiens
EVHPEVKCA

SEQ ID NO: 67457 - protein, 9 aa, Homo Sapiens
PLDWPMPPL

SEQ ID NO: 67458 - protein, 9 aa, Homo Sapiens
AGCGPWIKN

SEQ ID NO: 67459 - protein, 9 aa, Homo Sapiens
ARDARSGPP

SEQ ID NO: 67460 - protein, 9 aa, Homo Sapiens
SVPLSSRVM

SEQ ID NO: 67461 - protein, 9 aa, Homo Sapiens
ACQKLQKID

SEQ ID NO: 67462 - protein, 9 aa, Homo Sapiens
KQLWSHNVP

SEQ ID NO: 67463 - protein, 9 aa, Homo Sapiens
IEECSQFTY

SEQ ID NO: 67464 - protein, 9 aa, Homo Sapiens
LNSESCTIG

SEQ ID NO: 67465 - protein, 9 aa, Homo Sapiens
EDGSTCTMT

SEQ ID NO: 67466 - protein, 9 aa, Homo Sapiens
VLTYRKQPL

SEQ ID NO: 67467 - protein, 9 aa, Homo Sapiens
IWGKATPAE

SEQ ID NO: 67468 - protein, 9 aa, Homo Sapiens
EAVQKMKGK

SEQ ID NO: 67469 - protein, 9 aa, Homo Sapiens
MSDCEAGAL

SEQ ID NO: 67470 - protein, 9 aa, Homo Sapiens
YTTLLPHAF

SEQ ID NO: 67471 - protein, 9 aa, Homo Sapiens
TDAFADWCE

SEQ ID NO: 67472 - protein, 9 aa, Homo Sapiens
DEVNSEHMD

SEQ ID NO: 67473 - protein, 9 aa, Homo Sapiens
AQSRDFLCI

SEQ ID NO: 67474 - protein, 9 aa, Homo Sapiens
WEETTSPEC

SEQ ID NO: 67475 - protein, 9 aa, Homo Sapiens
YLDNWPNFN

SEQ ID NO: 67476 - protein, 9 aa, Homo Sapiens
HHYCLNSES

SEQ ID NO: 67477 - protein, 9 aa, Homo Sapiens
IPDQYCFQH

SEQ ID NO: 67478 - protein, 9 aa, Homo Sapiens
HTNYGNPAD

SEQ ID NO: 67479 - protein, 9 aa, Homo Sapiens
THKRTHIKY

SEQ ID NO: 67480 - protein, 9 aa, Homo Sapiens
RLPEFYNIP

SEQ ID NO: 67481 - protein, 9 aa, Homo Sapiens
DMRGVGLCP

SEQ ID NO: 67482 - protein, 9 aa, Homo Sapiens
RCRVVQSSL

SEQ ID NO: 67483 - protein, 9 aa, Homo Sapiens
TGTHVGVVQ

SEQ ID NO: 67484 - protein, 9 aa, Homo Sapiens
KSMEKTILP

SEQ ID NO: 67485 - protein, 9 aa, Homo Sapiens
QEQLRTALE

SEQ ID NO: 67486 - protein, 9 aa, Homo Sapiens
SEVKDTVHK

SEQ ID NO: 67487 - protein, 9 aa, Homo Sapiens
AQAPSAAAL

SEQ ID NO: 67488 - protein, 9 aa, Homo Sapiens
TGASGSGEM

SEQ ID NO: 67489 - protein, 9 aa, Homo Sapiens
NEAEWEETT

SEQ ID NO: 67490 - protein, 9 aa, Homo Sapiens
SVQKQEAMQ

SEQ ID NO: 67491 - protein, 9 aa, Homo Sapiens
PHAFQATFG

SEQ ID NO: 67492 - protein, 9 aa, Homo Sapiens
DLPSFSACQ

SEQ ID NO: 67493 - protein, 9 aa, Homo Sapiens
SEQKRNDEA

SEQ ID NO: 67494 - protein, 9 aa, Homo Sapiens
TSSFPAQAP

SEQ ID NO: 67495 - protein, 9 aa, Homo Sapiens
CLQKLLYLN

SEQ ID NO: 67496 - protein, 9 aa, Homo Sapiens
QKCTYLPAF

SEQ ID NO: 67497 - protein, 9 aa, Homo Sapiens
CRIQKLRCY

SEQ ID NO: 67498 - protein, 9 aa, Homo Sapiens
TSEPYTSSN

SEQ ID NO: 67499 - protein, 9 aa, Homo Sapiens
KSNQEVLVF

SEQ ID NO: 67500 - protein, 9 aa, Homo Sapiens
SQKQRNRCQ

SEQ ID NO: 67501 - protein, 9 aa, Homo Sapiens
TALESLKQH

SEQ ID NO: 67502 - protein, 9 aa, Homo Sapiens
TMTEWITWS

SEQ ID NO: 67503 - protein, 9 aa, Homo Sapiens
VPKMILLSG

SEQ ID NO: 67504 - protein, 9 aa, Homo Sapiens
LVAHVLLLI

SEQ ID NO: 67505 - protein, 9 aa, Homo Sapiens
DKARPNIPV

SEQ ID NO: 67506 - protein, 9 aa, Homo Sapiens
ILDPHTVVA

SEQ ID NO: 67507 - protein, 9 aa, Homo Sapiens
GLCPALPPP

SEQ ID NO: 67508 - protein, 9 aa, Homo Sapiens
FCLGVSVAS

SEQ ID NO: 67509 - protein, 9 aa, Homo Sapiens
WSLLEEVQQ

SEQ ID NO: 67510 - protein, 9 aa, Homo Sapiens
FDTATLLCY

SEQ ID NO: 67511 - protein, 9 aa, Homo Sapiens
LTQALAQWG

SEQ ID NO: 67512 - protein, 9 aa, Homo Sapiens
SVASSSHVP

SEQ ID NO: 67513 - protein, 9 aa, Homo Sapiens
GKRMNHHLQ

SEQ ID NO: 67514 - protein, 9 aa, Homo Sapiens
QKQEAMQRA

SEQ ID NO: 67515 - protein, 9 aa, Homo Sapiens
QSGKQFDAL

SEQ ID NO: 67516 - protein, 9 aa, Homo Sapiens
LCSPLINKC

SEQ ID NO: 67517 - protein, 9 aa, Homo Sapiens
LVGPHSPCY

SEQ ID NO: 67518 - protein, 9 aa, Homo Sapiens
LDIQAEISA

SEQ ID NO: 67519 - protein, 9 aa, Homo Sapiens
LKAQSRDFL

SEQ ID NO: 67520 - protein, 9 aa, Homo Sapiens
KEGLDIHSP

SEQ ID NO: 67521 - protein, 9 aa, Homo Sapiens
LCPALPPPP

SEQ ID NO: 67522 - protein, 9 aa, Homo Sapiens
APGLQPRLQ

SEQ ID NO: 67523 - protein, 9 aa, Homo Sapiens
HTTSPLPER

SEQ ID NO: 67524 - protein, 9 aa, Homo Sapiens
VGPHSPCYG

SEQ ID NO: 67525 - protein, 9 aa, Homo Sapiens
GRGPGAGAP

SEQ ID NO: 67526 - protein, 9 aa, Homo Sapiens
SMEKTILPV

SEQ ID NO: 67527 - protein, 9 aa, Homo Sapiens
AHLGKKGRG

SEQ ID NO: 67528 - protein, 9 aa, Homo Sapiens
VVTSEPYTS

SEQ ID NO: 67529 - protein, 9 aa, Homo Sapiens
LIALSEKEL

SEQ ID NO: 67530 - protein, 9 aa, Homo Sapiens
PYTSSNIRP

SEQ ID NO: 67531 - protein, 9 aa, Homo Sapiens
RPGAGEGPG

SEQ ID NO: 67532 - protein, 9 aa, Homo Sapiens
EAEWEETTS

SEQ ID NO: 67533 - protein, 9 aa, Homo Sapiens
PHTVVAKVV

SEQ ID NO: 67534 - protein, 9 aa, Homo Sapiens
ISEPDKQRS

SEQ ID NO: 67535 - protein, 9 aa, Homo Sapiens
QRATVEREM

SEQ ID NO: 67536 - protein, 9 aa, Homo Sapiens
LKKIYNVEQ

SEQ ID NO: 67537 - protein, 9 aa, Homo Sapiens
GAVFLNGKE

SEQ ID NO: 67538 - protein, 9 aa, Homo Sapiens
PDSWSQEMD

SEQ ID NO: 67539 - protein, 9 aa, Homo Sapiens
EGLDIHSPM

SEQ ID NO: 67540 - protein, 9 aa, Homo Sapiens
MSEGRELVI

SEQ ID NO: 67541 - protein, 9 aa, Homo Sapiens
SLHLLHEPP

SEQ ID NO: 67542 - protein, 9 aa, Homo Sapiens
GEEEEAEWG

SEQ ID NO: 67543 - protein, 9 aa, Homo Sapiens
TQEQLRTAL

SEQ ID NO: 67544 - protein, 9 aa, Homo Sapiens
SRDFLCISL

SEQ ID NO: 67545 - protein, 9 aa, Homo Sapiens
LLQGVGLDV

SEQ ID NO: 67546 - protein, 9 aa, Homo Sapiens
LVDPDSWSQ

SEQ ID NO: 67547 - protein, 9 aa, Homo Sapiens
TEFGTQGGV

SEQ ID NO: 67548 - protein, 9 aa, Homo Sapiens
LTIQNTTVH

SEQ ID NO: 67549 - protein, 9 aa, Homo Sapiens
TMSDCEAGA

SEQ ID NO: 67550 - protein, 9 aa, Homo Sapiens
SGKQFDALE

SEQ ID NO: 67551 - protein, 9 aa, Homo Sapiens
LVFVTSGGR

SEQ ID NO: 67552 - protein, 9 aa, Homo Sapiens
PSFSACQKL

SEQ ID NO: 67553 - protein, 9 aa, Homo Sapiens
PLINKCIEA

SEQ ID NO: 67554 - protein, 9 aa, Homo Sapiens
AGSVALTAL

SEQ ID NO: 67555 - protein, 9 aa, Homo Sapiens
THVGVVQYS

SEQ ID NO: 67556 - protein, 9 aa, Homo Sapiens
GTHVGVVQY

SEQ ID NO: 67557 - protein, 9 aa, Homo Sapiens
YILDPHTVV

SEQ ID NO: 67558 - protein, 9 aa, Homo Sapiens
INECHSRKL

SEQ ID NO: 67559 - protein, 9 aa, Homo Sapiens
DLMFPLLLL

SEQ ID NO: 67560 - protein, 9 aa, Homo Sapiens
IWASVDVLC

SEQ ID NO: 67561 - protein, 9 aa, Homo Sapiens
YVCHHYCLN

SEQ ID NO: 67562 - protein, 9 aa, Homo Sapiens
HLVFHCIDD

SEQ ID NO: 67563 - protein, 9 aa, Homo Sapiens
AENLMYLKQ

SEQ ID NO: 67564 - protein, 9 aa, Homo Sapiens
ERLKIEAAY

SEQ ID NO: 67565 - protein, 9 aa, Homo Sapiens
KRLRRRWQL

SEQ ID NO: 67566 - protein, 9 aa, Homo Sapiens
WWRDPGRRE

SEQ ID NO: 67567 - protein, 9 aa, Homo Sapiens
RNQLSMHQI

SEQ ID NO: 67568 - protein, 9 aa, Homo Sapiens
YDSWVKQLW

SEQ ID NO: 67569 - protein, 9 aa, Homo Sapiens
WKQFGRLPE

SEQ ID NO: 67570 - protein, 9 aa, Homo Sapiens
YINVERQEW

SEQ ID NO: 67571 - protein, 9 aa, Homo Sapiens
QVLILLSIA

SEQ ID NO: 67572 - protein, 9 aa, Homo Sapiens
RYGKRLKAE

SEQ ID NO: 67573 - protein, 9 aa, Homo Sapiens
LDWLQAEPR

SEQ ID NO: 67574 - protein, 9 aa, Homo Sapiens
CHHYCLNSE

SEQ ID NO: 67575 - protein, 9 aa, Homo Sapiens
HAVIPLKRP

SEQ ID NO: 67576 - protein, 9 aa, Homo Sapiens
KEIMVTFKA

SEQ ID NO: 67577 - protein, 9 aa, Homo Sapiens
VLSFVDEII

SEQ ID NO: 67578 - protein, 9 aa, Homo Sapiens
ACPSREWGG

SEQ ID NO: 67579 - protein, 9 aa, Homo Sapiens
WLDIQAEIS

SEQ ID NO: 67580 - protein, 9 aa, Homo Sapiens
RRKGISGKR

SEQ ID NO: 67581 - protein, 9 aa, Homo Sapiens
FGCPVGSTM

SEQ ID NO: 67582 - protein, 9 aa, Homo Sapiens
IIHMSEGRE

SEQ ID NO: 67583 - protein, 9 aa, Homo Sapiens
YLIALSEKE

SEQ ID NO: 67584 - protein, 9 aa, Homo Sapiens
LPSFSACQK

SEQ ID NO: 67585 - protein, 9 aa, Homo Sapiens
VESEQKRND

SEQ ID NO: 67586 - protein, 9 aa, Homo Sapiens
DLRLVGPHS

SEQ ID NO: 67587 - protein, 9 aa, Homo Sapiens
LEKVLTFLR

SEQ ID NO: 67588 - protein, 9 aa, Homo Sapiens
LLMSLPSRV

SEQ ID NO: 67589 - protein, 9 aa, Homo Sapiens
HKGAQLPRI

SEQ ID NO: 67590 - protein, 9 aa, Homo Sapiens
FLNGKEMTN

SEQ ID NO: 67591 - protein, 9 aa, Homo Sapiens
MNFLQLLSS

SEQ ID NO: 67592 - protein, 9 aa, Homo Sapiens
GPEIVECDG

SEQ ID NO: 67593 - protein, 9 aa, Homo Sapiens
PDQYCFQHT

SEQ ID NO: 67594 - protein, 9 aa, Homo Sapiens
QHTNYGNPA

SEQ ID NO: 67595 - protein, 9 aa, Homo Sapiens
ANRTPMYMS

SEQ ID NO: 67596 - protein, 9 aa, Homo Sapiens
IQKLRCYSG

SEQ ID NO: 67597 - protein, 9 aa, Homo Sapiens
DSYKVTTAK

SEQ ID NO: 67598 - protein, 9 aa, Homo Sapiens
PKNSLKQLT

SEQ ID NO: 67599 - protein, 9 aa, Homo Sapiens
FEPFLYDAP

SEQ ID NO: 67600 - protein, 9 aa, Homo Sapiens
LCNNTDAFA

SEQ ID NO: 67601 - protein, 9 aa, Homo Sapiens
SKRLRRRWQ

SEQ ID NO: 67602 - protein, 9 aa, Homo Sapiens
KLETTHTTS

SEQ ID NO: 67603 - protein, 9 aa, Homo Sapiens
GPYDKARPN

SEQ ID NO: 67604 - protein, 9 aa, Homo Sapiens
GVGLCPALP

SEQ ID NO: 67605 - protein, 9 aa, Homo Sapiens
PGATVCAAR

SEQ ID NO: 67606 - protein, 9 aa, Homo Sapiens
LQKLLYLNL

SEQ ID NO: 67607 - protein, 9 aa, Homo Sapiens
GPTVSREDA

SEQ ID NO: 67608 - protein, 9 aa, Homo Sapiens
KCAGSVALT

SEQ ID NO: 67609 - protein, 9 aa, Homo Sapiens
LAPSAALVS

SEQ ID NO: 67610 - protein, 9 aa, Homo Sapiens
NQEVLVFVT

SEQ ID NO: 67611 - protein, 9 aa, Homo Sapiens
NMGKRMNHH

SEQ ID NO: 67612 - protein, 9 aa, Homo Sapiens
EVVRRYPHH

SEQ ID NO: 67613 - protein, 9 aa, Homo Sapiens
EKELLHLKA

SEQ ID NO: 67614 - protein, 9 aa, Homo Sapiens
GKQFDALEV

SEQ ID NO: 67615 - protein, 9 aa, Homo Sapiens
RKAGNLYTG

SEQ ID NO: 67616 - protein, 9 aa, Homo Sapiens
NIWASVDVL

SEQ ID NO: 67617 - protein, 9 aa, Homo Sapiens
WLQAEPRCV

SEQ ID NO: 67618 - protein, 9 aa, Homo Sapiens
TTHTTSPLP

SEQ ID NO: 67619 - protein, 9 aa, Homo Sapiens
YNVEQLRYQ

SEQ ID NO: 67620 - protein, 9 aa, Homo Sapiens
PSAALVSLS

SEQ ID NO: 67621 - protein, 9 aa, Homo Sapiens
KERERPQAM

SEQ ID NO: 67622 - protein, 9 aa, Homo Sapiens
YQVTLSGQE

SEQ ID NO: 67623 - protein, 9 aa, Homo Sapiens
SYKVTTAKL

SEQ ID NO: 67624 - protein, 9 aa, Homo Sapiens
VNSEHMDAY

SEQ ID NO: 67625 - protein, 9 aa, Homo Sapiens
HMDAYCRKE

SEQ ID NO: 67626 - protein, 9 aa, Homo Sapiens
LILLSIADW

SEQ ID NO: 67627 - protein, 9 aa, Homo Sapiens
KSRLDTLSQ

SEQ ID NO: 67628 - protein, 9 aa, Homo Sapiens
YRTKKGHVI

SEQ ID NO: 67629 - protein, 9 aa, Homo Sapiens
AHQTEPKTL

SEQ ID NO: 67630 - protein, 9 aa, Homo Sapiens
LVKSMEKTI

SEQ ID NO: 67631 - protein, 9 aa, Homo Sapiens
QYCFQHTNY

SEQ ID NO: 67632 - protein, 9 aa, Homo Sapiens
EPSKSSVPL

SEQ ID NO: 67633 - protein, 9 aa, Homo Sapiens
SLRESYQPL

SEQ ID NO: 67634 - protein, 9 aa, Homo Sapiens
EESQHDSGI

SEQ ID NO: 67635 - protein, 9 aa, Homo Sapiens
WKDIQTGAS

SEQ ID NO: 67636 - protein, 9 aa, Homo Sapiens
AALVSLSSV

SEQ ID NO: 67637 - protein, 9 aa, Homo Sapiens
GENFAYVQM

SEQ ID NO: 67638 - protein, 9 aa, Homo Sapiens
LDPIPLLAN

SEQ ID NO: 67639 - protein, 9 aa, Homo Sapiens
VTAYMLEKV

SEQ ID NO: 67640 - protein, 9 aa, Homo Sapiens
MTFGIRAWP

SEQ ID NO: 67641 - protein, 9 aa, Homo Sapiens
LLEEVQQRL

SEQ ID NO: 67642 - protein, 9 aa, Homo Sapiens
LTLRPDQLH

SEQ ID NO: 67643 - protein, 9 aa, Homo Sapiens
TQTVVQWSD

SEQ ID NO: 67644 - protein, 9 aa, Homo Sapiens
SQLAHQTEP

SEQ ID NO: 67645 - protein, 9 aa, Homo Sapiens
VGLCPALPP

SEQ ID NO: 67646 - protein, 9 aa, Homo Sapiens
ENEAEWEET

SEQ ID NO: 67647 - protein, 9 aa, Homo Sapiens
QDLAHRSGL

SEQ ID NO: 67648 - protein, 9 aa, Homo Sapiens
AGDPNSANP

SEQ ID NO: 67649 - protein, 9 aa, Homo Sapiens
SFSEVKPLI

SEQ ID NO: 67650 - protein, 9 aa, Homo Sapiens
DSWLDIQAE

SEQ ID NO: 67651 - protein, 9 aa, Homo Sapiens
RAWPSTPFF

SEQ ID NO: 67652 - protein, 9 aa, Homo Sapiens
KCTYLPAFE

SEQ ID NO: 67653 - protein, 9 aa, Homo Sapiens
TIQNTTVHS

SEQ ID NO: 67654 - protein, 9 aa, Homo Sapiens
RVFCNIWAS

SEQ ID NO: 67655 - protein, 9 aa, Homo Sapiens
LQFYFLFSL

SEQ ID NO: 67656 - protein, 9 aa, Homo Sapiens
SACQKLQKI

SEQ ID NO: 67657 - protein, 9 aa, Homo Sapiens
AWPSTPFFD

SEQ ID NO: 67658 - protein, 9 aa, Homo Sapiens
CHFGPYDKA

SEQ ID NO: 67659 - protein, 9 aa, Homo Sapiens
QISSLRESY

SEQ ID NO: 67660 - protein, 9 aa, Homo Sapiens
PKESVNKKE

SEQ ID NO: 67661 - protein, 9 aa, Homo Sapiens
RSENEAEWE

SEQ ID NO: 67662 - protein, 9 aa, Homo Sapiens
HWLSMEGHK

SEQ ID NO: 67663 - protein, 9 aa, Homo Sapiens
EHRAAHLGK

SEQ ID NO: 67664 - protein, 9 aa, Homo Sapiens
KTILPVQLK

SEQ ID NO: 67665 - protein, 9 aa, Homo Sapiens
NAEISKRLR

SEQ ID NO: 67666 - protein, 9 aa, Homo Sapiens
NNGNDKGNQ

SEQ ID NO: 67667 - protein, 9 aa, Homo Sapiens
GCPVGSTMN

SEQ ID NO: 67668 - protein, 9 aa, Homo Sapiens
RDPGRRELP

SEQ ID NO: 67669 - protein, 9 aa, Homo Sapiens
LTQTVVQWS

SEQ ID NO: 67670 - protein, 9 aa, Homo Sapiens
ALIAVNPKN

SEQ ID NO: 67671 - protein, 9 aa, Homo Sapiens
LREHRAAHL

SEQ ID NO: 67672 - protein, 9 aa, Homo Sapiens
YFIRMVSDR

SEQ ID NO: 67673 - protein, 9 aa, Homo Sapiens
IFFRVSSVP

SEQ ID NO: 67674 - protein, 9 aa, Homo Sapiens
PSKSSVPLS

SEQ ID NO: 67675 - protein, 9 aa, Homo Sapiens
DALWEMAAE

SEQ ID NO: 67676 - protein, 9 aa, Homo Sapiens
PDKQRSELP

SEQ ID NO: 67677 - protein, 9 aa, Homo Sapiens
LRTALESLK

SEQ ID NO: 67678 - protein, 9 aa, Homo Sapiens
CLGVSVASS

SEQ ID NO: 67679 - protein, 9 aa, Homo Sapiens
AVLVAHVLL

SEQ ID NO: 67680 - protein, 9 aa, Homo Sapiens
PEIIHMSEG

SEQ ID NO: 67681 - protein, 9 aa, Homo Sapiens
CTYLPAFEP

SEQ ID NO: 67682 - protein, 9 aa, Homo Sapiens
SSSHVPIQK

SEQ ID NO: 67683 - protein, 9 aa, Homo Sapiens
LNGKEMTNQ

SEQ ID NO: 67684 - protein, 9 aa, Homo Sapiens
SFHLVFHCI

SEQ ID NO: 67685 - protein, 9 aa, Homo Sapiens
ISGKRPGAG

SEQ ID NO: 67686 - protein, 9 aa, Homo Sapiens
FVDEIISGA

SEQ ID NO: 67687 - protein, 9 aa, Homo Sapiens
GNLYTGKEL

SEQ ID NO: 67688 - protein, 9 aa, Homo Sapiens
RQEWKLDTL

SEQ ID NO: 67689 - protein, 9 aa, Homo Sapiens
SQEMDLKPD

SEQ ID NO: 67690 - protein, 9 aa, Homo Sapiens
VHPEVKCAG

SEQ ID NO: 67691 - protein, 9 aa, Homo Sapiens
LGLACVLAR

SEQ ID NO: 67692 - protein, 9 aa, Homo Sapiens
TDEVNSEHM

SEQ ID NO: 67693 - protein, 9 aa, Homo Sapiens
FCNIWASVD

SEQ ID NO: 67694 - protein, 9 aa, Homo Sapiens
FAVLTRCRV

SEQ ID NO: 67695 - protein, 9 aa, Homo Sapiens
DRETTIWGK

SEQ ID NO: 67696 - protein, 9 aa, Homo Sapiens
FPAQAPSAA

SEQ ID NO: 67697 - protein, 9 aa, Homo Sapiens
VTRTGATTS

SEQ ID NO: 67698 - protein, 9 aa, Homo Sapiens
TRNQLSMHQ

SEQ ID NO: 67699 - protein, 9 aa, Homo Sapiens
FCDIAPLLP

SEQ ID NO: 67700 - protein, 9 aa, Homo Sapiens
RCQRDGMCC

SEQ ID NO: 67701 - protein, 9 aa, Homo Sapiens
FGIRAWPST

SEQ ID NO: 67702 - protein, 9 aa, Homo Sapiens
CVMSQKQRN

SEQ ID NO: 67703 - protein, 9 aa, Homo Sapiens
VNPKNSLKQ

SEQ ID NO: 67704 - protein, 9 aa, Homo Sapiens
SLGIKRALQ

SEQ ID NO: 67705 - protein, 9 aa, Homo Sapiens
GSTCTMTEW

SEQ ID NO: 67706 - protein, 9 aa, Homo Sapiens
HPEVKCAGS

SEQ ID NO: 67707 - protein, 9 aa, Homo Sapiens
YCLNSESCT

SEQ ID NO: 67708 - protein, 9 aa, Homo Sapiens
PVGSTMNPG

SEQ ID NO: 67709 - protein, 9 aa, Homo Sapiens
RCYSGSHSQ

SEQ ID NO: 67710 - protein, 9 aa, Homo Sapiens
TQALAQWGQ

SEQ ID NO: 67711 - protein, 9 aa, Homo Sapiens
EQLRTALES

SEQ ID NO: 67712 - protein, 9 aa, Homo Sapiens
SRQCSWDRS

SEQ ID NO: 67713 - protein, 9 aa, Homo Sapiens
YVQMKTIWS

SEQ ID NO: 67714 - protein, 9 aa, Homo Sapiens
CPVGSTMNP

SEQ ID NO: 67715 - protein, 9 aa, Homo Sapiens
MRGVGLCPA

SEQ ID NO: 67716 - protein, 9 aa, Homo Sapiens
DVSAPGLQP

SEQ ID NO: 67717 - protein, 9 aa, Homo Sapiens
GLQPRLQGL

SEQ ID NO: 67718 - protein, 9 aa, Homo Sapiens
AIFSAARQN

SEQ ID NO: 67719 - protein, 9 aa, Homo Sapiens
EWEETTSPE

SEQ ID NO: 67720 - protein, 9 aa, Homo Sapiens
GASGSGEMV

SEQ ID NO: 67721 - protein, 9 aa, Homo Sapiens
TEWITWSPC

SEQ ID NO: 67722 - protein, 9 aa, Homo Sapiens
YPHHERCSD

SEQ ID NO: 67723 - protein, 9 aa, Homo Sapiens
FAVLVAHVL

SEQ ID NO: 67724 - protein, 9 aa, Homo Sapiens
KVTTAKLHV

SEQ ID NO: 67725 - protein, 9 aa, Homo Sapiens
PPPHAVIPL

SEQ ID NO: 67726 - protein, 9 aa, Homo Sapiens
LLVIKGEHM

SEQ ID NO: 67727 - protein, 9 aa, Homo Sapiens
RVVQSSLGS

SEQ ID NO: 67728 - protein, 9 aa, Homo Sapiens
VVRRYPHHE

SEQ ID NO: 67729 - protein, 9 aa, Homo Sapiens
CDERERRQI

SEQ ID NO: 67730 - protein, 9 aa, Homo Sapiens
HLREGKCHP

SEQ ID NO: 67731 - protein, 9 aa, Homo Sapiens
MQRATVERE

SEQ ID NO: 67732 - protein, 9 aa, Homo Sapiens
VPLSSRVME

SEQ ID NO: 67733 - protein, 9 aa, Homo Sapiens
REGKCHPSL

SEQ ID NO: 67734 - protein, 9 aa, Homo Sapiens
RTKKGHVIR

SEQ ID NO: 67735 - protein, 9 aa, Homo Sapiens
GGEEEEAEW

SEQ ID NO: 67736 - protein, 9 aa, Homo Sapiens
NRGLKKKKQ

SEQ ID NO: 67737 - protein, 9 aa, Homo Sapiens
IDDLSNGMI

SEQ ID NO: 67738 - protein, 9 aa, Homo Sapiens
FPSKLETTH

SEQ ID NO: 67739 - protein, 9 aa, Homo Sapiens
SVNKKEIMV

SEQ ID NO: 67740 - protein, 9 aa, Homo Sapiens
DVTAYMLEK

SEQ ID NO: 67741 - protein, 9 aa, Homo Sapiens
SQHDSGIES

SEQ ID NO: 67742 - protein, 9 aa, Homo Sapiens
MSDSNDTIS

SEQ ID NO: 67743 - protein, 9 aa, Homo Sapiens
VLILLSIAD

SEQ ID NO: 67744 - protein, 9 aa, Homo Sapiens
HTVVAKVVA

SEQ ID NO: 67745 - protein, 9 aa, Homo Sapiens
RQCSWDRSE

SEQ ID NO: 67746 - protein, 9 aa, Homo Sapiens
CNCCQDLAH

SEQ ID NO: 67747 - protein, 9 aa, Homo Sapiens
LEAVQKMKG

SEQ ID NO: 67748 - protein, 9 aa, Homo Sapiens
RDSWLDIQA

SEQ ID NO: 67749 - protein, 9 aa, Homo Sapiens
KKEIMVTFK

SEQ ID NO: 67750 - protein, 9 aa, Homo Sapiens
VFHCIDDLS

SEQ ID NO: 67751 - protein, 9 aa, Homo Sapiens
APLLPVACI

SEQ ID NO: 67752 - protein, 9 aa, Homo Sapiens
DDLSNGMII

SEQ ID NO: 67753 - protein, 9 aa, Homo Sapiens
LLQVLILLS

SEQ ID NO: 67754 - protein, 9 aa, Homo Sapiens
AFADWCEIF

SEQ ID NO: 67755 - protein, 9 aa, Homo Sapiens
ESQHDSGIE

SEQ ID NO: 67756 - protein, 9 aa, Homo Sapiens
HVTRTGATT

SEQ ID NO: 67757 - protein, 9 aa, Homo Sapiens
KDVTAYMLE

SEQ ID NO: 67758 - protein, 9 aa, Homo Sapiens
PGASLGIKR

SEQ ID NO: 67759 - protein, 9 aa, Homo Sapiens
MQEPSKSSV

SEQ ID NO: 67760 - protein, 9 aa, Homo Sapiens
STDEVNSEH

SEQ ID NO: 67761 - protein, 9 aa, Homo Sapiens
CFLQFYFLF

SEQ ID NO: 67762 - protein, 9 aa, Homo Sapiens
ALINNGNDK

SEQ ID NO: 67763 - protein, 9 aa, Homo Sapiens
PLKKIYNVE

SEQ ID NO: 67764 - protein, 9 aa, Homo Sapiens
STCTMTEWI

SEQ ID NO: 67765 - protein, 9 aa, Homo Sapiens
SEVKPLIFD

SEQ ID NO: 67766 - protein, 9 aa, Homo Sapiens
GRLPEFYNI

SEQ ID NO: 67767 - protein, 9 aa, Homo Sapiens
SFSACQKLQ

SEQ ID NO: 67768 - protein, 9 aa, Homo Sapiens
LRESYQPLA

SEQ ID NO: 67769 - protein, 9 aa, Homo Sapiens
LQVLILLSI

SEQ ID NO: 67770 - protein, 9 aa, Homo Sapiens
NYLIALSEK

SEQ ID NO: 67771 - protein, 9 aa, Homo Sapiens
RAQVEVRLP

SEQ ID NO: 67772 - protein, 9 aa, Homo Sapiens
YAENQDVAT

SEQ ID NO: 67773 - protein, 9 aa, Homo Sapiens
SRTISEPDK

SEQ ID NO: 67774 - protein, 8 aa, Homo Sapiens
SEKTRQNK

SEQ ID NO: 67775 - protein, 9 aa, Homo Sapiens
ADGRGPGAG

SEQ ID NO: 67776 - protein, 9 aa, Homo Sapiens
AEISKRLRR

SEQ ID NO: 67777 - protein, 9 aa, Homo Sapiens
SWDRSESPQ

SEQ ID NO: 67778 - protein, 9 aa, Homo Sapiens
LLPHAFQAT

SEQ ID NO: 67779 - protein, 9 aa, Homo Sapiens
GWSLLEEVQ

SEQ ID NO: 67780 - protein, 9 aa, Homo Sapiens
VIPDQYCFQ

SEQ ID NO: 67781 - protein, 9 aa, Homo Sapiens
RYPHHERCS

SEQ ID NO: 67782 - protein, 9 aa, Homo Sapiens
ESCSLTQTV

SEQ ID NO: 67783 - protein, 9 aa, Homo Sapiens
DEAEESQHD

SEQ ID NO: 67784 - protein, 9 aa, Homo Sapiens
YKVTTAKLH

SEQ ID NO: 67785 - protein, 9 aa, Homo Sapiens
EHWLSMEGH

SEQ ID NO: 67786 - protein, 9 aa, Homo Sapiens
EIPEIIHMS

SEQ ID NO: 67787 - protein, 9 aa, Homo Sapiens
LDIHSPMIL

SEQ ID NO: 67788 - protein, 9 aa, Homo Sapiens
SDSNDTISN

SEQ ID NO: 67789 - protein, 9 aa, Homo Sapiens
ARSGPPMAS

SEQ ID NO: 67790 - protein, 9 aa, Homo Sapiens
PDQLHIFNT

SEQ ID NO: 67791 - protein, 9 aa, Homo Sapiens
FGSPSKQRK

SEQ ID NO: 67792 - protein, 9 aa, Homo Sapiens
AQEVLYVIG

SEQ ID NO: 67793 - protein, 9 aa, Homo Sapiens
TTIWGKATP

SEQ ID NO: 67794 - protein, 9 aa, Homo Sapiens
VTSEPYTSS

SEQ ID NO: 67795 - protein, 9 aa, Homo Sapiens
NSEHMDAYC

SEQ ID NO: 67796 - protein, 9 aa, Homo Sapiens
RLRRRWQLL

SEQ ID NO: 67797 - protein, 9 aa, Homo Sapiens
DPDSWSQEM

SEQ ID NO: 67798 - protein, 9 aa, Homo Sapiens
PGRRELPTF

SEQ ID NO: 67799 - protein, 9 aa, Homo Sapiens
RIQKLRCYS

SEQ ID NO: 67800 - protein, 9 aa, Homo Sapiens
GHKGAQLPR

SEQ ID NO: 67801 - protein, 9 aa, Homo Sapiens
SLLEEVQQR

SEQ ID NO: 67802 - protein, 9 aa, Homo Sapiens
DSWVKQLWS

SEQ ID NO: 67803 - protein, 9 aa, Homo Sapiens
SKSNQEVLV

SEQ ID NO: 67804 - protein, 9 aa, Homo Sapiens
IAVNPKNSL

SEQ ID NO: 67805 - protein, 9 aa, Homo Sapiens
WRLGPTGKE

SEQ ID NO: 67806 - protein, 9 aa, Homo Sapiens
PPPKFPELP

SEQ ID NO: 67807 - protein, 9 aa, Homo Sapiens
SVCAADGRG

SEQ ID NO: 67808 - protein, 9 aa, Homo Sapiens
CCQDLAHRS

SEQ ID NO: 67809 - protein, 9 aa, Homo Sapiens
MSLPSRVHL

SEQ ID NO: 67810 - protein, 9 aa, Homo Sapiens
PPPPHAVIP

SEQ ID NO: 67811 - protein, 9 aa, Homo Sapiens
HINECHSRK

SEQ ID NO: 67812 - protein, 9 aa, Homo Sapiens
HSAGGPGFT

SEQ ID NO: 67813 - protein, 9 aa, Homo Sapiens
YGFLWKKFK

SEQ ID NO: 67814 - protein, 9 aa, Homo Sapiens
QSGHSAGGP

SEQ ID NO: 67815 - protein, 9 aa, Homo Sapiens
GQSGHSAGG

SEQ ID NO: 67816 - protein, 9 aa, Homo Sapiens
PHWRLGPTG

SEQ ID NO: 67817 - protein, 9 aa, Homo Sapiens
CAGSVALTA

SEQ ID NO: 67818 - protein, 9 aa, Homo Sapiens
ALLQGVGLD

SEQ ID NO: 67819 - protein, 9 aa, Homo Sapiens
FEGPEIVEC

SEQ ID NO: 67820 - protein, 9 aa, Homo Sapiens
AQWGQQLEW

SEQ ID NO: 67821 - protein, 9 aa, Homo Sapiens
GCFLQFYFL

SEQ ID NO: 67822 - protein, 9 aa, Homo Sapiens
QALAQWGQQ

SEQ ID NO: 67823 - protein, 9 aa, Homo Sapiens
GLGLACVLA

SEQ ID NO: 67824 - protein, 9 aa, Homo Sapiens
QLRTALESL

SEQ ID NO: 67825 - protein, 9 aa, Homo Sapiens
FLLGLGLGL

SEQ ID NO: 67826 - protein, 9 aa, Homo Sapiens
VKPLIFDHL

SEQ ID NO: 67827 - protein, 9 aa, Homo Sapiens
TLLPHAFQA

SEQ ID NO: 67828 - protein, 9 aa, Homo Sapiens
NCVMSQKQR

SEQ ID NO: 67829 - protein, 9 aa, Homo Sapiens
IRMVSDRWL

SEQ ID NO: 67830 - protein, 9 aa, Homo Sapiens
DEAVKGLRK

SEQ ID NO: 67831 - protein, 9 aa, Homo Sapiens
ECSQFTYKF

SEQ ID NO: 67832 - protein, 9 aa, Homo Sapiens
FVDTFQSGK

SEQ ID NO: 67833 - protein, 9 aa, Homo Sapiens
MEGHKGAQL

SEQ ID NO: 67834 - protein, 9 aa, Homo Sapiens
AVQKMKGKE

SEQ ID NO: 67835 - protein, 9 aa, Homo Sapiens
DIQAEISAS

SEQ ID NO: 67836 - protein, 9 aa, Homo Sapiens
LRPDQLHIF

SEQ ID NO: 67837 - protein, 9 aa, Homo Sapiens
EPYTSSNIR

SEQ ID NO: 67838 - protein, 9 aa, Homo Sapiens
TNGAVFLNG

SEQ ID NO: 67839 - protein, 9 aa, Homo Sapiens
AVLTRCRVV

SEQ ID NO: 67840 - protein, 9 aa, Homo Sapiens
PDEAEESQH

SEQ ID NO: 67841 - protein, 9 aa, Homo Sapiens
EDFLRLLVI

SEQ ID NO: 67842 - protein, 9 aa, Homo Sapiens
GKRPGAGEG

SEQ ID NO: 67843 - protein, 9 aa, Homo Sapiens
LLYLNLSAI

SEQ ID NO: 67844 - protein, 9 aa, Homo Sapiens
SSGPGPFYN

SEQ ID NO: 67845 - protein, 9 aa, Homo Sapiens
QKRNDEAVK

SEQ ID NO: 67846 - protein, 9 aa, Homo Sapiens
KQRSELPRE

SEQ ID NO: 67847 - protein, 9 aa, Homo Sapiens
VTTAKLHVS

SEQ ID NO: 67848 - protein, 9 aa, Homo Sapiens
ALTRRICIP

SEQ ID NO: 67849 - protein, 9 aa, Homo Sapiens
LALQQTVEA

SEQ ID NO: 67850 - protein, 9 aa, Homo Sapiens
TPSEEKKVE

SEQ ID NO: 67851 - protein, 9 aa, Homo Sapiens
GRPPMQLLM

SEQ ID NO: 67852 - protein, 9 aa, Homo Sapiens
LTRRICIPT

SEQ ID NO: 67853 - protein, 9 aa, Homo Sapiens
RGQQYGVLA

SEQ ID NO: 67854 - protein, 9 aa, Homo Sapiens
PRVPVFDDP

SEQ ID NO: 67855 - protein, 9 aa, Homo Sapiens
AIPRLRPLQ

SEQ ID NO: 67856 - protein, 9 aa, Homo Sapiens
NGSLPSLHC

SEQ ID NO: 67857 - protein, 9 aa, Homo Sapiens
QFNIQLCDG

SEQ ID NO: 67858 - protein, 9 aa, Homo Sapiens
HRPPRHMGN

SEQ ID NO: 67859 - protein, 9 aa, Homo Sapiens
GSYHPGVFC

SEQ ID NO: 67860 - protein, 9 aa, Homo Sapiens
YHPGVFCGD

SEQ ID NO: 67861 - protein, 9 aa, Homo Sapiens
EHKRHRDRL

SEQ ID NO: 67862 - protein, 9 aa, Homo Sapiens
LPSLHCSSW

SEQ ID NO: 67863 - protein, 9 aa, Homo Sapiens
GNKAMEPMD

SEQ ID NO: 67864 - protein, 9 aa, Homo Sapiens
WGGRLDPAG

SEQ ID NO: 67865 - protein, 9 aa, Homo Sapiens
GSLFEVQWQ

SEQ ID NO: 67866 - protein, 9 aa, Homo Sapiens
TFFQFNIQL

SEQ ID NO: 67867 - protein, 9 aa, Homo Sapiens
ELALQQTVE

SEQ ID NO: 67868 - protein, 9 aa, Homo Sapiens
GDPKNDSCI

SEQ ID NO: 67869 - protein, 9 aa, Homo Sapiens
TYAAVKHSR

SEQ ID NO: 67870 - protein, 9 aa, Homo Sapiens
KRSREHKRH

SEQ ID NO: 67871 - protein, 9 aa, Homo Sapiens
EHELALQQT

SEQ ID NO: 67872 - protein, 9 aa, Homo Sapiens
QAVTYAAVK

SEQ ID NO: 67873 - protein, 9 aa, Homo Sapiens
SLHCSSWYT

SEQ ID NO: 67874 - protein, 9 aa, Homo Sapiens
DNIKTPAKR

SEQ ID NO: 67875 - protein, 9 aa, Homo Sapiens
IISRLVALI

SEQ ID NO: 67876 - protein, 9 aa, Homo Sapiens
KRLRGPLPP

SEQ ID NO: 67877 - protein, 9 aa, Homo Sapiens
DPQAVTYAA

SEQ ID NO: 67878 - protein, 9 aa, Homo Sapiens
LTPPSPLKD

SEQ ID NO: 67879 - protein, 9 aa, Homo Sapiens
TVLTPPSPL

SEQ ID NO: 67880 - protein, 9 aa, Homo Sapiens
CIFALAVLL

SEQ ID NO: 67881 - protein, 9 aa, Homo Sapiens
RQQPGPRVP

SEQ ID NO: 67882 - protein, 9 aa, Homo Sapiens
KKVEGDAAT

SEQ ID NO: 67883 - protein, 9 aa, Homo Sapiens
PMDSPLMSA

SEQ ID NO: 67884 - protein, 9 aa, Homo Sapiens
PQAVTYAAV

SEQ ID NO: 67885 - protein, 9 aa, Homo Sapiens
YSTYSKLQR

SEQ ID NO: 67886 - protein, 9 aa, Homo Sapiens
STDYSTYSK

SEQ ID NO: 67887 - protein, 9 aa, Homo Sapiens
RRICIPTSC

SEQ ID NO: 67888 - protein, 9 aa, Homo Sapiens
DMHRPPRHM

SEQ ID NO: 67889 - protein, 9 aa, Homo Sapiens
TVQEAMKVS

SEQ ID NO: 67890 - protein, 9 aa, Homo Sapiens
LMSAIPRLR

SEQ ID NO: 67891 - protein, 9 aa, Homo Sapiens
MHRPPRHMG

SEQ ID NO: 67892 - protein, 9 aa, Homo Sapiens
YSKLQRSRA

SEQ ID NO: 67893 - protein, 9 aa, Homo Sapiens
VLTPPSPLK

SEQ ID NO: 67894 - protein, 9 aa, Homo Sapiens
ASVTQAGVQ

SEQ ID NO: 67895 - protein, 9 aa, Homo Sapiens
YAAVKHSRP

SEQ ID NO: 67896 - protein, 9 aa, Homo Sapiens
QLLMDSLPL

SEQ ID NO: 67897 - protein, 9 aa, Homo Sapiens
RLVALIFGT

SEQ ID NO: 67898 - protein, 9 aa, Homo Sapiens
KVEGDAATE

SEQ ID NO: 67899 - protein, 9 aa, Homo Sapiens
DKTDKRILT

SEQ ID NO: 67900 - protein, 9 aa, Homo Sapiens
HKRHRDRLR

SEQ ID NO: 67901 - protein, 9 aa, Homo Sapiens
PAKRLRGPL

SEQ ID NO: 67902 - protein, 9 aa, Homo Sapiens
RYLGSLQPL

SEQ ID NO: 67903 - protein, 9 aa, Homo Sapiens
IEDIVHDGR

SEQ ID NO: 67904 - protein, 9 aa, Homo Sapiens
GQQYGVLAV

SEQ ID NO: 67905 - protein, 9 aa, Homo Sapiens
HLTVQEAMK

SEQ ID NO: 67906 - protein, 9 aa, Homo Sapiens
CGQPGSQVP

SEQ ID NO: 67907 - protein, 9 aa, Homo Sapiens
CSSWYTDEP

SEQ ID NO: 67908 - protein, 9 aa, Homo Sapiens
RPPRHMGNK

SEQ ID NO: 67909 - protein, 9 aa, Homo Sapiens
QLIEDIVHD

SEQ ID NO: 67910 - protein, 9 aa, Homo Sapiens
GVFCGDKWS

SEQ ID NO: 67911 - protein, 9 aa, Homo Sapiens
EQTWGLLEP

SEQ ID NO: 67912 - protein, 9 aa, Homo Sapiens
KTDKRILTF

SEQ ID NO: 67913 - protein, 9 aa, Homo Sapiens
RLDPAGSWT

SEQ ID NO: 67914 - protein, 9 aa, Homo Sapiens
ISRLVALIF

SEQ ID NO: 67915 - protein, 9 aa, Homo Sapiens
QRSRATVLT

SEQ ID NO: 67916 - protein, 9 aa, Homo Sapiens
PLMSAIPRL

SEQ ID NO: 67917 - protein, 9 aa, Homo Sapiens
IKTPAKRLR

SEQ ID NO: 67918 - protein, 9 aa, Homo Sapiens
WCTPSKKRG

SEQ ID NO: 67919 - protein, 9 aa, Homo Sapiens
VNTWFSMGQ

SEQ ID NO: 67920 - protein, 9 aa, Homo Sapiens
MDSPLMSAI

SEQ ID NO: 67921 - protein, 9 aa, Homo Sapiens
HPGVFCGDK

SEQ ID NO: 67922 - protein, 9 aa, Homo Sapiens
SCIFALAVL

SEQ ID NO: 67923 - protein, 9 aa, Homo Sapiens
FQFNIQLCD

SEQ ID NO: 67924 - protein, 9 aa, Homo Sapiens
TPSKKRGLA

SEQ ID NO: 67925 - protein, 9 aa, Homo Sapiens
EEKKVEGDA

SEQ ID NO: 67926 - protein, 9 aa, Homo Sapiens
PGPRVPVFD

SEQ ID NO: 67927 - protein, 9 aa, Homo Sapiens
RHRDRLRLH

SEQ ID NO: 67928 - protein, 9 aa, Homo Sapiens
DIVHDGRLY

SEQ ID NO: 67929 - protein, 9 aa, Homo Sapiens
AMEPMDSPL

SEQ ID NO: 67930 - protein, 9 aa, Homo Sapiens
AAVKHSRPR

SEQ ID NO: 67931 - protein, 9 aa, Homo Sapiens
FVNTWFSMG

SEQ ID NO: 67932 - protein, 9 aa, Homo Sapiens
CTPSKKRGL

SEQ ID NO: 67933 - protein, 9 aa, Homo Sapiens
AMKVSAHLK

SEQ ID NO: 67934 - protein, 9 aa, Homo Sapiens
TQAGVQWRY

SEQ ID NO: 67935 - protein, 9 aa, Homo Sapiens
STYSKLQRS

SEQ ID NO: 67936 - protein, 9 aa, Homo Sapiens
FFQFNIQLC

SEQ ID NO: 67937 - protein, 9 aa, Homo Sapiens
KGDPKNDSC

SEQ ID NO: 67938 - protein, 9 aa, Homo Sapiens
AVTYAAVKH

SEQ ID NO: 67939 - protein, 9 aa, Homo Sapiens
QTLCSFFFF

SEQ ID NO: 67940 - protein, 9 aa, Homo Sapiens
QPGPRVPVF

SEQ ID NO: 67941 - protein, 9 aa, Homo Sapiens
SKLQRSRAT

SEQ ID NO: 67942 - protein, 9 aa, Homo Sapiens
REHKRHRDR

SEQ ID NO: 67943 - protein, 9 aa, Homo Sapiens
EDFDWCTPS

SEQ ID NO: 67944 - protein, 9 aa, Homo Sapiens
PRHMGNKAM

SEQ ID NO: 67945 - protein, 9 aa, Homo Sapiens
QTWGLLEPE

SEQ ID NO: 67946 - protein, 9 aa, Homo Sapiens
PLKDMHRPP

SEQ ID NO: 67947 - protein, 9 aa, Homo Sapiens
KVSAHLKLQ

SEQ ID NO: 67948 - protein, 9 aa, Homo Sapiens
RHMGNKAME

SEQ ID NO: 67949 - protein, 9 aa, Homo Sapiens
TRRICIPTS

SEQ ID NO: 67950 - protein, 9 aa, Homo Sapiens
IPRLRPLQP

SEQ ID NO: 67951 - protein, 9 aa, Homo Sapiens
PGVFCGDKW

SEQ ID NO: 67952 - protein, 9 aa, Homo Sapiens
EGSLFEVQW

SEQ ID NO: 67953 - protein, 9 aa, Homo Sapiens
LVALIFGTL

SEQ ID NO: 67954 - protein, 9 aa, Homo Sapiens
HMGNKAMEP

SEQ ID NO: 67955 - protein, 9 aa, Homo Sapiens
GQPGSQVPD

SEQ ID NO: 67956 - protein, 9 aa, Homo Sapiens
VLRGQQYGV

SEQ ID NO: 67957 - protein, 9 aa, Homo Sapiens
MEPMDSPLM

SEQ ID NO: 67958 - protein, 9 aa, Homo Sapiens
RPEQTWGLL

SEQ ID NO: 67959 - protein, 9 aa, Homo Sapiens
TWFSMGQET

SEQ ID NO: 67960 - protein, 9 aa, Homo Sapiens
FFETESASV

SEQ ID NO: 67961 - protein, 9 aa, Homo Sapiens
VALIFGTLY

SEQ ID NO: 67962 - protein, 9 aa, Homo Sapiens
LDPAGSWTC

SEQ ID NO: 67963 - protein, 9 aa, Homo Sapiens
DDKTDKRIL

SEQ ID NO: 67964 - protein, 9 aa, Homo Sapiens
SFFFFETES

SEQ ID NO: 67965 - protein, 9 aa, Homo Sapiens
DPAGSWTCG

SEQ ID NO: 67966 - protein, 9 aa, Homo Sapiens
FNIQLCDGV

SEQ ID NO: 67967 - protein, 9 aa, Homo Sapiens
GPRVPVFDD

SEQ ID NO: 67968 - protein, 9 aa, Homo Sapiens
AEAFVNTWF

SEQ ID NO: 67969 - protein, 9 aa, Homo Sapiens
TESASVTQA

SEQ ID NO: 67970 - protein, 9 aa, Homo Sapiens
TCGQPGSQV

SEQ ID NO: 67971 - protein, 9 aa, Homo Sapiens
EPMDSPLMS

SEQ ID NO: 67972 - protein, 9 aa, Homo Sapiens
KLQRSRATV

SEQ ID NO: 67973 - protein, 9 aa, Homo Sapiens
DYSTYSKLQ

SEQ ID NO: 67974 - protein, 9 aa, Homo Sapiens
QQYGVLAVL

SEQ ID NO: 67975 - protein, 9 aa, Homo Sapiens
TDYSTYSKL

SEQ ID NO: 67976 - protein, 9 aa, Homo Sapiens
LQPMGRPPM

SEQ ID NO: 67977 - protein, 9 aa, Homo Sapiens
TPAKRLRGP

SEQ ID NO: 67978 - protein, 9 aa, Homo Sapiens
PRLRPLQPM

SEQ ID NO: 67979 - protein, 9 aa, Homo Sapiens
VEGDAATEQ

SEQ ID NO: 67980 - protein, 9 aa, Homo Sapiens
DPKNDSCIF

SEQ ID NO: 67981 - protein, 9 aa, Homo Sapiens
WGLLEPERT

SEQ ID NO: 67982 - protein, 9 aa, Homo Sapiens
SKKRGLAPI

SEQ ID NO: 67983 - protein, 9 aa, Homo Sapiens
EAFVNTWFS

SEQ ID NO: 67984 - protein, 9 aa, Homo Sapiens
QEAMKVSAH

SEQ ID NO: 67985 - protein, 9 aa, Homo Sapiens
KTPAKRLRG

SEQ ID NO: 67986 - protein, 9 aa, Homo Sapiens
VQWQLAQLE

SEQ ID NO: 67987 - protein, 9 aa, Homo Sapiens
KRILTFICK

SEQ ID NO: 67988 - protein, 9 aa, Homo Sapiens
PSLHCSSWY

SEQ ID NO: 67989 - protein, 9 aa, Homo Sapiens
WTCGQPGSQ

SEQ ID NO: 67990 - protein, 9 aa, Homo Sapiens
SRLVALIFG

SEQ ID NO: 67991 - protein, 9 aa, Homo Sapiens
KNDSCIFAL

SEQ ID NO: 67992 - protein, 9 aa, Homo Sapiens
RILTFICKD

SEQ ID NO: 67993 - protein, 9 aa, Homo Sapiens
RSREHKRHR

SEQ ID NO: 67994 - protein, 9 aa, Homo Sapiens
PSKKRGLAP

SEQ ID NO: 67995 - protein, 9 aa, Homo Sapiens
TWGLLEPER

SEQ ID NO: 67996 - protein, 9 aa, Homo Sapiens
SRATVLTPP

SEQ ID NO: 67997 - protein, 9 aa, Homo Sapiens
DSCIFALAV

SEQ ID NO: 67998 - protein, 9 aa, Homo Sapiens
KLLDTFFQF

SEQ ID NO: 67999 - protein, 9 aa, Homo Sapiens
QQLIEDIVH

SEQ ID NO: 68000 - protein, 9 aa, Homo Sapiens
GSLPSLHCS

SEQ ID NO: 68001 - protein, 9 aa, Homo Sapiens
SLFEVQWQL

SEQ ID NO: 68002 - protein, 9 aa, Homo Sapiens
HCSSWYTDE

SEQ ID NO: 68003 - protein, 9 aa, Homo Sapiens
MGNKAMEPM

SEQ ID NO: 68004 - protein, 9 aa, Homo Sapiens
PPRHMGNKA

SEQ ID NO: 68005 - protein, 9 aa, Homo Sapiens
QQTVEAGVN

SEQ ID NO: 68006 - protein, 9 aa, Homo Sapiens
EDIVHDGRL

SEQ ID NO: 68007 - protein, 9 aa, Homo Sapiens
PEQTWGLLE

SEQ ID NO: 68008 - protein, 9 aa, Homo Sapiens
TLCSFFFFE

SEQ ID NO: 68009 - protein, 9 aa, Homo Sapiens
SEEEEEEMA

SEQ ID NO: 68010 - protein, 9 aa, Homo Sapiens
LKDMHRPPR

SEQ ID NO: 68011 - protein, 9 aa, Homo Sapiens
LTFICKDSE

SEQ ID NO: 68012 - protein, 9 aa, Homo Sapiens
FDWCTPSKK

SEQ ID NO: 68013 - protein, 9 aa, Homo Sapiens
FETESASVT

SEQ ID NO: 68014 - protein, 9 aa, Homo Sapiens
AALTRRICI

SEQ ID NO: 68015 - protein, 9 aa, Homo Sapiens
WFSMGQETV

SEQ ID NO: 68016 - protein, 9 aa, Homo Sapiens
TDKRILTFI

SEQ ID NO: 68017 - protein, 9 aa, Homo Sapiens
SYHPGVFCG

SEQ ID NO: 68018 - protein, 9 aa, Homo Sapiens
ILTFICKDS

SEQ ID NO: 68019 - protein, 9 aa, Homo Sapiens
NTWFSMGQE

SEQ ID NO: 68020 - protein, 9 aa, Homo Sapiens
CIPTSCWLP

SEQ ID NO: 68021 - protein, 9 aa, Homo Sapiens
GGRLDPAGS

SEQ ID NO: 68022 - protein, 9 aa, Homo Sapiens
QWQLAQLEA

SEQ ID NO: 68023 - protein, 9 aa, Homo Sapiens
PPSPLKDMH

SEQ ID NO: 68024 - protein, 9 aa, Homo Sapiens
RATVLTPPS

SEQ ID NO: 68025 - protein, 9 aa, Homo Sapiens
VQEAMKVSA

SEQ ID NO: 68026 - protein, 9 aa, Homo Sapiens
SASVTQAGV

SEQ ID NO: 68027 - protein, 9 aa, Homo Sapiens
SWIISRLVA

SEQ ID NO: 68028 - protein, 9 aa, Homo Sapiens
PMQLLMDSL

SEQ ID NO: 68029 - protein, 9 aa, Homo Sapiens
QYGVLAVLL

SEQ ID NO: 68030 - protein, 9 aa, Homo Sapiens
KAMEPMDSP

SEQ ID NO: 68031 - protein, 9 aa, Homo Sapiens
WIISRLVAL

SEQ ID NO: 68032 - protein, 9 aa, Homo Sapiens
LLDTFFQFN

SEQ ID NO: 68033 - protein, 9 aa, Homo Sapiens
VHDGRLYAS

SEQ ID NO: 68034 - protein, 9 aa, Homo Sapiens
PLQPMGRPP

SEQ ID NO: 68035 - protein, 9 aa, Homo Sapiens
MSAIPRLRP

SEQ ID NO: 68036 - protein, 9 aa, Homo Sapiens
GRLDPAGSW

SEQ ID NO: 68037 - protein, 9 aa, Homo Sapiens
CSFFFFETE

SEQ ID NO: 68038 - protein, 9 aa, Homo Sapiens
DFDWCTPSK

SEQ ID NO: 68039 - protein, 9 aa, Homo Sapiens
PPMQLLMDS

SEQ ID NO: 68040 - protein, 9 aa, Homo Sapiens
FSMGQETVE

SEQ ID NO: 68041 - protein, 9 aa, Homo Sapiens
LRGQQYGVL

SEQ ID NO: 68042 - protein, 9 aa, Homo Sapiens
YLGSLQPLP

SEQ ID NO: 68043 - protein, 9 aa, Homo Sapiens
RPLQPMGRP

SEQ ID NO: 68044 - protein, 9 aa, Homo Sapiens
DKRILTFIC

SEQ ID NO: 68045 - protein, 9 aa, Homo Sapiens
PAGSWTCGQ

SEQ ID NO: 68046 - protein, 9 aa, Homo Sapiens
EKKVEGDAA

SEQ ID NO: 68047 - protein, 9 aa, Homo Sapiens
QSLRPEQTW

SEQ ID NO: 68048 - protein, 9 aa, Homo Sapiens
LRPEQTWGL

SEQ ID NO: 68049 - protein, 9 aa, Homo Sapiens
DTFFQFNIQ

SEQ ID NO: 68050 - protein, 9 aa, Homo Sapiens
LQRSRATVL

SEQ ID NO: 68051 - protein, 9 aa, Homo Sapiens
LCSFFFFET

SEQ ID NO: 68052 - protein, 9 aa, Homo Sapiens
IVHDGRLYA

SEQ ID NO: 68053 - protein, 9 aa, Homo Sapiens
SREHKRHRD

SEQ ID NO: 68054 - protein, 9 aa, Homo Sapiens
LIEDIVHDG

SEQ ID NO: 68055 - protein, 9 aa, Homo Sapiens
AVKHSRPRR

SEQ ID NO: 68056 - protein, 9 aa, Homo Sapiens
TYSKLQRSR

SEQ ID NO: 68057 - protein, 9 aa, Homo Sapiens
ALIFGTLYP

SEQ ID NO: 68058 - protein, 9 aa, Homo Sapiens
SLRPEQTWG

SEQ ID NO: 68059 - protein, 9 aa, Homo Sapiens
EAMKVSAHL

SEQ ID NO: 68060 - protein, 9 aa, Homo Sapiens
LDTFFQFNI

SEQ ID NO: 68061 - protein, 9 aa, Homo Sapiens
RLRPLQPMG

SEQ ID NO: 68062 - protein, 9 aa, Homo Sapiens
IPTSCWLPL

SEQ ID NO: 68063 - protein, 9 aa, Homo Sapiens
PKNDSCIFA

SEQ ID NO: 68064 - protein, 9 aa, Homo Sapiens
ETPSEEKKV

SEQ ID NO: 68065 - protein, 9 aa, Homo Sapiens
PSEEKKVEG

SEQ ID NO: 68066 - protein, 9 aa, Homo Sapiens
LTVQEAMKV

SEQ ID NO: 68067 - protein, 9 aa, Homo Sapiens
QQPGPRVPV

SEQ ID NO: 68068 - protein, 9 aa, Homo Sapiens
RPPMQLLMD

SEQ ID NO: 68069 - protein, 9 aa, Homo Sapiens
DDNIKTPAK

SEQ ID NO: 68070 - protein, 9 aa, Homo Sapiens
AKRLRGPLP

SEQ ID NO: 68071 - protein, 9 aa, Homo Sapiens
PSPLKDMHR

SEQ ID NO: 68072 - protein, 9 aa, Homo Sapiens
DSEEEEEEM

SEQ ID NO: 68073 - protein, 9 aa, Homo Sapiens
KRHRDRLRL

SEQ ID NO: 68074 - protein, 9 aa, Homo Sapiens
NYEHELALQ

SEQ ID NO: 68075 - protein, 9 aa, Homo Sapiens
ATVLTPPSP

SEQ ID NO: 68076 - protein, 9 aa, Homo Sapiens
AFVNTWFSM

SEQ ID NO: 68077 - protein, 9 aa, Homo Sapiens
RICIPTSCW

SEQ ID NO: 68078 - protein, 9 aa, Homo Sapiens
SPLKDMHRP

SEQ ID NO: 68079 - protein, 9 aa, Homo Sapiens
FFFETESAS

SEQ ID NO: 68080 - protein, 9 aa, Homo Sapiens
AGSWTCGQP

SEQ ID NO: 68081 - protein, 9 aa, Homo Sapiens
ICIPTSCWL

SEQ ID NO: 68082 - protein, 9 aa, Homo Sapiens
QPMGRPPMQ

SEQ ID NO: 68083 - protein, 9 aa, Homo Sapiens
ETESASVTQ

SEQ ID NO: 68084 - protein, 9 aa, Homo Sapiens
FEVQWQLAQ

SEQ ID NO: 68085 - protein, 9 aa, Homo Sapiens
SLPSLHCSS

SEQ ID NO: 68086 - protein, 9 aa, Homo Sapiens
SAIPRLRPL

SEQ ID NO: 68087 - protein, 9 aa, Homo Sapiens
EVQWQLAQL

SEQ ID NO: 68088 - protein, 9 aa, Homo Sapiens
NDSCIFALA

SEQ ID NO: 68089 - protein, 9 aa, Homo Sapiens
WQLAQLEAR

SEQ ID NO: 68090 - protein, 9 aa, Homo Sapiens
GSWTCGQPG

SEQ ID NO: 68091 - protein, 9 aa, Homo Sapiens
FFFFETESA

SEQ ID NO: 68092 - protein, 9 aa, Homo Sapiens
MGRPPMQLL

SEQ ID NO: 68093 - protein, 9 aa, Homo Sapiens
NIKTPAKRL

SEQ ID NO: 68094 - protein, 9 aa, Homo Sapiens
VTYAAVKHS

SEQ ID NO: 68095 - protein, 9 aa, Homo Sapiens
LQQTVEAGV

SEQ ID NO: 68096 - protein, 9 aa, Homo Sapiens
HELALQQTV

SEQ ID NO: 68097 - protein, 9 aa, Homo Sapiens
SWTCGQPGS

SEQ ID NO: 68098 - protein, 9 aa, Homo Sapiens
KDMHRPPRH

SEQ ID NO: 68099 - protein, 9 aa, Homo Sapiens
SPLMSAIPR

SEQ ID NO: 68100 - protein, 9 aa, Homo Sapiens
SEEKKVEGD

SEQ ID NO: 68101 - protein, 9 aa, Homo Sapiens
QPGSQVPDL

SEQ ID NO: 68102 - protein, 9 aa, Homo Sapiens
ESASVTQAG

SEQ ID NO: 68103 - protein, 9 aa, Homo Sapiens
VFCGDKWSC

SEQ ID NO: 68104 - protein, 9 aa, Homo Sapiens
PMGRPPMQL

SEQ ID NO: 68105 - protein, 9 aa, Homo Sapiens
PGSQVPDLQ

SEQ ID NO: 68106 - protein, 9 aa, Homo Sapiens
HDGRLYASE

SEQ ID NO: 68107 - protein, 9 aa, Homo Sapiens
LHCSSWYTD

SEQ ID NO: 68108 - protein, 9 aa, Homo Sapiens
DWCTPSKKR

SEQ ID NO: 68109 - protein, 9 aa, Homo Sapiens
LRPLQPMGR

SEQ ID NO: 68110 - protein, 9 aa, Homo Sapiens
HRDRLRLHQ

SEQ ID NO: 68111 - protein, 9 aa, Homo Sapiens
RSRATVLTP

SEQ ID NO: 68112 - protein, 9 aa, Homo Sapiens
DSPLMSAIP

SEQ ID NO: 68113 - protein, 9 aa, Homo Sapiens
NKAMEPMDS

SEQ ID NO: 68114 - protein, 9 aa, Homo Sapiens
TPPSPLKDM

SEQ ID NO: 68115 - protein, 9 aa, Homo Sapiens
LFEVQWQLA

SEQ ID NO: 68116 - protein, 9 aa, Homo Sapiens
MKVSAHLKL

SEQ ID NO: 68117 - protein, 9 aa, Homo Sapiens
SRQQPGPRV

SEQ ID NO: 68118 - protein, 9 aa, Homo Sapiens
ALQQTVEAG

SEQ ID NO: 68119 - protein, 9 aa, Homo Sapiens
YEHELALQQ

SEQ ID NO: 68120 - protein, 9 aa, Homo Sapiens
MQLLMDSLP

SEQ ID NO: 68121 - protein, 9 aa, Homo Sapiens
THWNIAKSM

SEQ ID NO: 68122 - protein, 9 aa, Homo Sapiens
LHSLFWSVF

SEQ ID NO: 68123 - protein, 9 aa, Homo Sapiens
KAFARSSHL

SEQ ID NO: 68124 - protein, 9 aa, Homo Sapiens
CKEAINVLS

SEQ ID NO: 68125 - protein, 9 aa, Homo Sapiens
LVLKKPMAK

SEQ ID NO: 68126 - protein, 9 aa, Homo Sapiens
TKIMHSLHL

SEQ ID NO: 68127 - protein, 9 aa, Homo Sapiens
HTDAGMFGV

SEQ ID NO: 68128 - protein, 9 aa, Homo Sapiens
SKKSRLFSS

SEQ ID NO: 68129 - protein, 9 aa, Homo Sapiens
GPSCTYSTL

SEQ ID NO: 68130 - protein, 9 aa, Homo Sapiens
DTYRQIRID

SEQ ID NO: 68131 - protein, 9 aa, Homo Sapiens
LCRRSRASS

SEQ ID NO: 68132 - protein, 9 aa, Homo Sapiens
ATMDDMLCT

SEQ ID NO: 68133 - protein, 9 aa, Homo Sapiens
KAEEEEVAA

SEQ ID NO: 68134 - protein, 9 aa, Homo Sapiens
YYVSHLYGP

SEQ ID NO: 68135 - protein, 9 aa, Homo Sapiens
DPSSFLSHQ

SEQ ID NO: 68136 - protein, 9 aa, Homo Sapiens
FYFTHTDAG

SEQ ID NO: 68137 - protein, 9 aa, Homo Sapiens
PHFLIQIPH

SEQ ID NO: 68138 - protein, 9 aa, Homo Sapiens
MAEYQEHWF

SEQ ID NO: 68139 - protein, 9 aa, Homo Sapiens
CGRITLAKE

SEQ ID NO: 68140 - protein, 9 aa, Homo Sapiens
GPKPGGMAA

SEQ ID NO: 68141 - protein, 9 aa, Homo Sapiens
LPCSPDEYL

SEQ ID NO: 68142 - protein, 9 aa, Homo Sapiens
NFRWQNGAA

SEQ ID NO: 68143 - protein, 9 aa, Homo Sapiens
KHLRETQAQ

SEQ ID NO: 68144 - protein, 9 aa, Homo Sapiens
FLIQIPHSE

SEQ ID NO: 68145 - protein, 9 aa, Homo Sapiens
PSSFLSHQL

SEQ ID NO: 68146 - protein, 9 aa, Homo Sapiens
HSLHLQRST

SEQ ID NO: 68147 - protein, 9 aa, Homo Sapiens
PKPGGMAAD

SEQ ID NO: 68148 - protein, 9 aa, Homo Sapiens
DGDPHFLIQ

SEQ ID NO: 68149 - protein, 9 aa, Homo Sapiens
TMDDMLCTR

SEQ ID NO: 68150 - protein, 9 aa, Homo Sapiens
WSACTSSTC

SEQ ID NO: 68151 - protein, 9 aa, Homo Sapiens
VCLPCSPDE

SEQ ID NO: 68152 - protein, 9 aa, Homo Sapiens
IRHMAEYQE

SEQ ID NO: 68153 - protein, 9 aa, Homo Sapiens
GNCGRNGLV

SEQ ID NO: 68154 - protein, 9 aa, Homo Sapiens
GPGASCGGS

SEQ ID NO: 68155 - protein, 9 aa, Homo Sapiens
GKIKESYHN

SEQ ID NO: 68156 - protein, 9 aa, Homo Sapiens
YLNSCYWDH

SEQ ID NO: 68157 - protein, 9 aa, Homo Sapiens
EAINVLSHL

SEQ ID NO: 68158 - protein, 9 aa, Homo Sapiens
CVNKEELVL

SEQ ID NO: 68159 - protein, 9 aa, Homo Sapiens
LPQHGDRPE

SEQ ID NO: 68160 - protein, 9 aa, Homo Sapiens
HGDRPEPLS

SEQ ID NO: 68161 - protein, 9 aa, Homo Sapiens
CTSSTCDKG

SEQ ID NO: 68162 - protein, 9 aa, Homo Sapiens
CRKTIRHMA

SEQ ID NO: 68163 - protein, 9 aa, Homo Sapiens
YNCKEAINV

SEQ ID NO: 68164 - protein, 9 aa, Homo Sapiens
HNGRIFANT

SEQ ID NO: 68165 - protein, 9 aa, Homo Sapiens
PGPGGPKPG

SEQ ID NO: 68166 - protein, 9 aa, Homo Sapiens
PEAPANAHL

SEQ ID NO: 68167 - protein, 9 aa, Homo Sapiens
SLSSYSPAS

SEQ ID NO: 68168 - protein, 9 aa, Homo Sapiens
DNHSYYVSH

SEQ ID NO: 68169 - protein, 9 aa, Homo Sapiens
VSHLYGPSE

SEQ ID NO: 68170 - protein, 9 aa, Homo Sapiens
DMLKNGRID

SEQ ID NO: 68171 - protein, 9 aa, Homo Sapiens
AEESPGDPA

SEQ ID NO: 68172 - protein, 9 aa, Homo Sapiens
RSRASSVGR

SEQ ID NO: 68173 - protein, 9 aa, Homo Sapiens
VDKHLRETQ

SEQ ID NO: 68174 - protein, 9 aa, Homo Sapiens
FSTLFETLH

SEQ ID NO: 68175 - protein, 9 aa, Homo Sapiens
KDETYLLFT

SEQ ID NO: 68176 - protein, 9 aa, Homo Sapiens
LIQIPHSEE

SEQ ID NO: 68177 - protein, 9 aa, Homo Sapiens
QEWLSTLPP

SEQ ID NO: 68178 - protein, 9 aa, Homo Sapiens
SRSSLSSYS

SEQ ID NO: 68179 - protein, 9 aa, Homo Sapiens
KEEEPKAEE

SEQ ID NO: 68180 - protein, 9 aa, Homo Sapiens
KESYHNGRI

SEQ ID NO: 68181 - protein, 9 aa, Homo Sapiens
MLCTRSSTL

SEQ ID NO: 68182 - protein, 9 aa, Homo Sapiens
EILPEAPAN

SEQ ID NO: 68183 - protein, 9 aa, Homo Sapiens
IRIDIPRTN

SEQ ID NO: 68184 - protein, 9 aa, Homo Sapiens
KLSHISLLE

SEQ ID NO: 68185 - protein, 9 aa, Homo Sapiens
CTYSTLQMY

SEQ ID NO: 68186 - protein, 9 aa, Homo Sapiens
TATMDDMLC

SEQ ID NO: 68187 - protein, 9 aa, Homo Sapiens
WEDSPERGH

SEQ ID NO: 68188 - protein, 9 aa, Homo Sapiens
EEKEEEPKA

SEQ ID NO: 68189 - protein, 9 aa, Homo Sapiens
VLPWFLNHP

SEQ ID NO: 68190 - protein, 9 aa, Homo Sapiens
PLPQHGDRP

SEQ ID NO: 68191 - protein, 9 aa, Homo Sapiens
LLTLNFTIT

SEQ ID NO: 68192 - protein, 9 aa, Homo Sapiens
ANVRFVTHW

SEQ ID NO: 68193 - protein, 9 aa, Homo Sapiens
ELTVLVLPW

SEQ ID NO: 68194 - protein, 9 aa, Homo Sapiens
TVLVLPWFL

SEQ ID NO: 68195 - protein, 9 aa, Homo Sapiens
TQCMSLCMC

SEQ ID NO: 68196 - protein, 9 aa, Homo Sapiens
LPWFLNHPS

SEQ ID NO: 68197 - protein, 9 aa, Homo Sapiens
VLKKPMAKC

SEQ ID NO: 68198 - protein, 9 aa, Homo Sapiens
SAELTVLVL

SEQ ID NO: 68199 - protein, 9 aa, Homo Sapiens
VNKEELVLK

SEQ ID NO: 68200 - protein, 9 aa, Homo Sapiens
TDAGMFGVF

SEQ ID NO: 68201 - protein, 9 aa, Homo Sapiens
YFTHTDAGM

SEQ ID NO: 68202 - protein, 9 aa, Homo Sapiens
CRRSRASSV

SEQ ID NO: 68203 - protein, 9 aa, Homo Sapiens
ESYHNGRIF

SEQ ID NO: 68204 - protein, 9 aa, Homo Sapiens
LTRQLDMLK

SEQ ID NO: 68205 - protein, 9 aa, Homo Sapiens
EPKAEEEEV

SEQ ID NO: 68206 - protein, 9 aa, Homo Sapiens
IKESYHNGR

SEQ ID NO: 68207 - protein, 9 aa, Homo Sapiens
PLLVLLTLN

SEQ ID NO: 68208 - protein, 9 aa, Homo Sapiens
PATASPRPL

SEQ ID NO: 68209 - protein, 9 aa, Homo Sapiens
SACTSSTCD

SEQ ID NO: 68210 - protein, 9 aa, Homo Sapiens
SNFRWQNGA

SEQ ID NO: 68211 - protein, 9 aa, Homo Sapiens
GHPHERARS

SEQ ID NO: 68212 - protein, 9 aa, Homo Sapiens
RLFSSSSND

SEQ ID NO: 68213 - protein, 9 aa, Homo Sapiens
PERGHPHER

SEQ ID NO: 68214 - protein, 9 aa, Homo Sapiens
IMHSLHLQR

SEQ ID NO: 68215 - protein, 9 aa, Homo Sapiens
LTYLNSCYW

SEQ ID NO: 68216 - protein, 9 aa, Homo Sapiens
FRSNFRWQN

SEQ ID NO: 68217 - protein, 9 aa, Homo Sapiens
SYHNGRIFA

SEQ ID NO: 68218 - protein, 9 aa, Homo Sapiens
KRCNQGSKD

SEQ ID NO: 68219 - protein, 9 aa, Homo Sapiens
NSTKIMHSL

SEQ ID NO: 68220 - protein, 9 aa, Homo Sapiens
HPHERARSR

SEQ ID NO: 68221 - protein, 9 aa, Homo Sapiens
CTDLYKSYQ

SEQ ID NO: 68222 - protein, 9 aa, Homo Sapiens
YCRKTIRHM

SEQ ID NO: 68223 - protein, 9 aa, Homo Sapiens
LVLPWFLNH

SEQ ID NO: 68224 - protein, 9 aa, Homo Sapiens
AEEKEEEPK

SEQ ID NO: 68225 - protein, 9 aa, Homo Sapiens
CIHKDETYL

SEQ ID NO: 68226 - protein, 9 aa, Homo Sapiens
HISLLELVE

SEQ ID NO: 68227 - protein, 9 aa, Homo Sapiens
PGDPATASP

SEQ ID NO: 68228 - protein, 9 aa, Homo Sapiens
TPEVKRCNQ

SEQ ID NO: 68229 - protein, 9 aa, Homo Sapiens
HQDTYRQIR

SEQ ID NO: 68230 - protein, 9 aa, Homo Sapiens
LCGNCGRNG

SEQ ID NO: 68231 - protein, 9 aa, Homo Sapiens
PKAEEEEVA

SEQ ID NO: 68232 - protein, 9 aa, Homo Sapiens
HSYYVSHLY

SEQ ID NO: 68233 - protein, 9 aa, Homo Sapiens
IRPLPQHGD

SEQ ID NO: 68234 - protein, 9 aa, Homo Sapiens
PSCTYSTLQ

SEQ ID NO: 68235 - protein, 9 aa, Homo Sapiens
FETLHSLFW

SEQ ID NO: 68236 - protein, 9 aa, Homo Sapiens
AINVLSHLP

SEQ ID NO: 68237 - protein, 9 aa, Homo Sapiens
LCMCYSASI

SEQ ID NO: 68238 - protein, 9 aa, Homo Sapiens
VTPEVKRCN

SEQ ID NO: 68239 - protein, 9 aa, Homo Sapiens
RIMVCGRIT

SEQ ID NO: 68240 - protein, 9 aa, Homo Sapiens
SSRSSLSSY

SEQ ID NO: 68241 - protein, 9 aa, Homo Sapiens
LTLNFTITN

SEQ ID NO: 68242 - protein, 9 aa, Homo Sapiens
STLQMYLDT

SEQ ID NO: 68243 - protein, 9 aa, Homo Sapiens
EEPKAEEEE

SEQ ID NO: 68244 - protein, 9 aa, Homo Sapiens
SYSPASLYH

SEQ ID NO: 68245 - protein, 9 aa, Homo Sapiens
QAPLQPEDD

SEQ ID NO: 68246 - protein, 9 aa, Homo Sapiens
VEELTRQLD

SEQ ID NO: 68247 - protein, 9 aa, Homo Sapiens
ASSVGRCSM

SEQ ID NO: 68248 - protein, 9 aa, Homo Sapiens
CTRSSTLTE

SEQ ID NO: 68249 - protein, 9 aa, Homo Sapiens
KSYQCECTS

SEQ ID NO: 68250 - protein, 9 aa, Homo Sapiens
QDTYRQIRI

SEQ ID NO: 68251 - protein, 9 aa, Homo Sapiens
AASPLLVLL

SEQ ID NO: 68252 - protein, 9 aa, Homo Sapiens
HQLPFLSTL

SEQ ID NO: 68253 - protein, 9 aa, Homo Sapiens
ELVLKKPMA

SEQ ID NO: 68254 - protein, 9 aa, Homo Sapiens
NYFFYFTHT

SEQ ID NO: 68255 - protein, 9 aa, Homo Sapiens
YQCECTSGW

SEQ ID NO: 68256 - protein, 9 aa, Homo Sapiens
KANVRFVTH

SEQ ID NO: 68257 - protein, 9 aa, Homo Sapiens
GFRSNFRWQ

SEQ ID NO: 68258 - protein, 9 aa, Homo Sapiens
DETYLLFTD

SEQ ID NO: 68259 - protein, 9 aa, Homo Sapiens
RWQNGAALT

SEQ ID NO: 68260 - protein, 9 aa, Homo Sapiens
IHKDETYLL

SEQ ID NO: 68261 - protein, 9 aa, Homo Sapiens
GDPSSFLSH

SEQ ID NO: 68262 - protein, 9 aa, Homo Sapiens
PASSQAPLQ

SEQ ID NO: 68263 - protein, 9 aa, Homo Sapiens
THTDAGMFG

SEQ ID NO: 68264 - protein, 9 aa, Homo Sapiens
QCECTSGWT

SEQ ID NO: 68265 - protein, 9 aa, Homo Sapiens
PQEWLSTLP

SEQ ID NO: 68266 - protein, 9 aa, Homo Sapiens
MDDMLCTRS

SEQ ID NO: 68267 - protein, 9 aa, Homo Sapiens
DLGAPQEWL

SEQ ID NO: 68268 - protein, 9 aa, Homo Sapiens
ELTRQLDML

SEQ ID NO: 68269 - protein, 9 aa, Homo Sapiens
LFSSSSNDS

SEQ ID NO: 68270 - protein, 9 aa, Homo Sapiens
KEELVLKKP

SEQ ID NO: 68271 - protein, 9 aa, Homo Sapiens
QAVDKHLRE

SEQ ID NO: 68272 - protein, 9 aa, Homo Sapiens
QCMSLCMCY

SEQ ID NO: 68273 - protein, 9 aa, Homo Sapiens
LDMLKNGRI

SEQ ID NO: 68274 - protein, 9 aa, Homo Sapiens
INVLSHLPS

SEQ ID NO: 68275 - protein, 9 aa, Homo Sapiens
DDMLCTRSS

SEQ ID NO: 68276 - protein, 9 aa, Homo Sapiens
SLCQAVDKH

SEQ ID NO: 68277 - protein, 9 aa, Homo Sapiens
KPGGMAADG

SEQ ID NO: 68278 - protein, 9 aa, Homo Sapiens
GKAFARSSH

SEQ ID NO: 68279 - protein, 9 aa, Homo Sapiens
LASKKSRLF

SEQ ID NO: 68280 - protein, 9 aa, Homo Sapiens
RQIRIDIPR

SEQ ID NO: 68281 - protein, 9 aa, Homo Sapiens
LQLTYLNSC

SEQ ID NO: 68282 - protein, 9 aa, Homo Sapiens
TRQLDMLKN

SEQ ID NO: 68283 - protein, 9 aa, Homo Sapiens
MVCGRITLA

SEQ ID NO: 68284 - protein, 9 aa, Homo Sapiens
FRWQNGAAL

SEQ ID NO: 68285 - protein, 9 aa, Homo Sapiens
DALDLGAPQ

SEQ ID NO: 68286 - protein, 9 aa, Homo Sapiens
SHLYGPSEP

SEQ ID NO: 68287 - protein, 9 aa, Homo Sapiens
GDPATASPR

SEQ ID NO: 68288 - protein, 9 aa, Homo Sapiens
LTQCMSLCM

SEQ ID NO: 68289 - protein, 9 aa, Homo Sapiens
EELVLKKPM

SEQ ID NO: 68290 - protein, 9 aa, Homo Sapiens
GRNGLVKDL

SEQ ID NO: 68291 - protein, 9 aa, Homo Sapiens
LVLLTLNFT

SEQ ID NO: 68292 - protein, 9 aa, Homo Sapiens
YRQIRIDIP

SEQ ID NO: 68293 - protein, 9 aa, Homo Sapiens
DPHFLIQIP

SEQ ID NO: 68294 - protein, 9 aa, Homo Sapiens
NWSPWSACT

SEQ ID NO: 68295 - protein, 9 aa, Homo Sapiens
SGKIKESYH

SEQ ID NO: 68296 - protein, 9 aa, Homo Sapiens
NCKEAINVL

SEQ ID NO: 68297 - protein, 9 aa, Homo Sapiens
DSVCLPCSP

SEQ ID NO: 68298 - protein, 9 aa, Homo Sapiens
LDLGAPQEW

SEQ ID NO: 68299 - protein, 9 aa, Homo Sapiens
HLSEHTRTH

SEQ ID NO: 68300 - protein, 9 aa, Homo Sapiens
SSQAPLQPE

SEQ ID NO: 68301 - protein, 9 aa, Homo Sapiens
CSPDEYLDS

SEQ ID NO: 68302 - protein, 9 aa, Homo Sapiens
LSHISLLEL

SEQ ID NO: 68303 - protein, 9 aa, Homo Sapiens
SGSHHHEAA

SEQ ID NO: 68304 - protein, 9 aa, Homo Sapiens
DSPERGHPH

SEQ ID NO: 68305 - protein, 9 aa, Homo Sapiens
PGGPKPGGM

SEQ ID NO: 68306 - protein, 9 aa, Homo Sapiens
MVLQAAVAP

SEQ ID NO: 68307 - protein, 9 aa, Homo Sapiens
SDSVCLPCS

SEQ ID NO: 68308 - protein, 9 aa, Homo Sapiens
NSCYWDHKE

SEQ ID NO: 68309 - protein, 9 aa, Homo Sapiens
MHSLHLQRS

SEQ ID NO: 68310 - protein, 9 aa, Homo Sapiens
NVLSHLPSH

SEQ ID NO: 68311 - protein, 9 aa, Homo Sapiens
PSKLSHISL

SEQ ID NO: 68312 - protein, 9 aa, Homo Sapiens
LGAPQEWLS

SEQ ID NO: 68313 - protein, 9 aa, Homo Sapiens
STLFETLHS

SEQ ID NO: 68314 - protein, 9 aa, Homo Sapiens
LQAAVAPNR

SEQ ID NO: 68315 - protein, 9 aa, Homo Sapiens
VLSHLPSHH

SEQ ID NO: 68316 - protein, 9 aa, Homo Sapiens
CQAVDKHLR

SEQ ID NO: 68317 - protein, 9 aa, Homo Sapiens
YSTLQMYLD

SEQ ID NO: 68318 - protein, 9 aa, Homo Sapiens
SFLSHQLPF

SEQ ID NO: 68319 - protein, 9 aa, Homo Sapiens
SPERGHPHE

SEQ ID NO: 68320 - protein, 9 aa, Homo Sapiens
LSSYSPASL

SEQ ID NO: 68321 - protein, 9 aa, Homo Sapiens
SSLSSYSPA

SEQ ID NO: 68322 - protein, 9 aa, Homo Sapiens
SPWSACTSS

SEQ ID NO: 68323 - protein, 9 aa, Homo Sapiens
NVRFVTHWN

SEQ ID NO: 68324 - protein, 9 aa, Homo Sapiens
DLYKSYQCE

SEQ ID NO: 68325 - protein, 9 aa, Homo Sapiens
PGEPEILPE

SEQ ID NO: 68326 - protein, 9 aa, Homo Sapiens
LQPEDDILY

SEQ ID NO: 68327 - protein, 9 aa, Homo Sapiens
LSHQLPFLS

SEQ ID NO: 68328 - protein, 9 aa, Homo Sapiens
SLLELVESL

SEQ ID NO: 68329 - protein, 9 aa, Homo Sapiens
TIRHMAEYQ

SEQ ID NO: 68330 - protein, 9 aa, Homo Sapiens
RFVTHWNIA

SEQ ID NO: 68331 - protein, 9 aa, Homo Sapiens
MCYSASIGG

SEQ ID NO: 68332 - protein, 9 aa, Homo Sapiens
APLQPEDDI

SEQ ID NO: 68333 - protein, 9 aa, Homo Sapiens
SHHHEAASW

SEQ ID NO: 68334 - protein, 9 aa, Homo Sapiens
VKRCNQGSK

SEQ ID NO: 68335 - protein, 9 aa, Homo Sapiens
AVDKHLRET

SEQ ID NO: 68336 - protein, 9 aa, Homo Sapiens
SYQCECTSG

SEQ ID NO: 68337 - protein, 9 aa, Homo Sapiens
KVTPEVKRC

SEQ ID NO: 68338 - protein, 9 aa, Homo Sapiens
YKSYQCECT

SEQ ID NO: 68339 - protein, 9 aa, Homo Sapiens
VDGDPHFLI

SEQ ID NO: 68340 - protein, 9 aa, Homo Sapiens
NNSTKIMHS

SEQ ID NO: 68341 - protein, 9 aa, Homo Sapiens
TYLNSCYWD

SEQ ID NO: 68342 - protein, 9 aa, Homo Sapiens
LYKSYQCEC

SEQ ID NO: 68343 - protein, 9 aa, Homo Sapiens
CNQGSKDLN

SEQ ID NO: 68344 - protein, 9 aa, Homo Sapiens
RITLAKEVF

SEQ ID NO: 68345 - protein, 9 aa, Homo Sapiens
FARSSHLSE

SEQ ID NO: 68346 - protein, 9 aa, Homo Sapiens
EAPANAHLK

SEQ ID NO: 68347 - protein, 9 aa, Homo Sapiens
WQNGAALTS

SEQ ID NO: 68348 - protein, 9 aa, Homo Sapiens
GEPEILPEA

SEQ ID NO: 68349 - protein, 9 aa, Homo Sapiens
GLVKDLKTH

SEQ ID NO: 68350 - protein, 9 aa, Homo Sapiens
NKEELVLKK

SEQ ID NO: 68351 - protein, 9 aa, Homo Sapiens
LPEAPANAH

SEQ ID NO: 68352 - protein, 9 aa, Homo Sapiens
VLQAAVAPN

SEQ ID NO: 68353 - protein, 9 aa, Homo Sapiens
QIRIDIPRT

SEQ ID NO: 68354 - protein, 9 aa, Homo Sapiens
GRITLAKEV

SEQ ID NO: 68355 - protein, 9 aa, Homo Sapiens
SCTYSTLQM

SEQ ID NO: 68356 - protein, 9 aa, Homo Sapiens
ASKKSRLFS

SEQ ID NO: 68357 - protein, 9 aa, Homo Sapiens
CLPCSPDEY

SEQ ID NO: 68358 - protein, 9 aa, Homo Sapiens
HKDETYLLF

SEQ ID NO: 68359 - protein, 9 aa, Homo Sapiens
AELTVLVLP

SEQ ID NO: 68360 - protein, 9 aa, Homo Sapiens
LCTRSSTLT

SEQ ID NO: 68361 - protein, 9 aa, Homo Sapiens
PCSPDEYLD

SEQ ID NO: 68362 - protein, 9 aa, Homo Sapiens
HLYGPSEPH

SEQ ID NO: 68363 - protein, 9 aa, Homo Sapiens
PCVNKEELV

SEQ ID NO: 68364 - protein, 9 aa, Homo Sapiens
RSSLSSYSP

SEQ ID NO: 68365 - protein, 9 aa, Homo Sapiens
LQMYLDTEL

SEQ ID NO: 68366 - protein, 9 aa, Homo Sapiens
CGRNGLVKD

SEQ ID NO: 68367 - protein, 9 aa, Homo Sapiens
RSSHLSEHT

SEQ ID NO: 68368 - protein, 9 aa, Homo Sapiens
YHNGRIFAN

SEQ ID NO: 68369 - protein, 9 aa, Homo Sapiens
EESPGDPAT

SEQ ID NO: 68370 - protein, 9 aa, Homo Sapiens
NGLVKDLKT

SEQ ID NO: 68371 - protein, 9 aa, Homo Sapiens
FFYFTHTDA

SEQ ID NO: 68372 - protein, 9 aa, Homo Sapiens
PEILPEAPA

SEQ ID NO: 68373 - protein, 9 aa, Homo Sapiens
GSHHHEAAS

SEQ ID NO: 68374 - protein, 9 aa, Homo Sapiens
NHSYYVSHL

SEQ ID NO: 68375 - protein, 9 aa, Homo Sapiens
LCQAVDKHL

SEQ ID NO: 68376 - protein, 9 aa, Homo Sapiens
VCIHKDETY

SEQ ID NO: 68377 - protein, 9 aa, Homo Sapiens
QHGDRPEPL

SEQ ID NO: 68378 - protein, 9 aa, Homo Sapiens
HSLFWSVFG

SEQ ID NO: 68379 - protein, 9 aa, Homo Sapiens
SPGDPATAS

SEQ ID NO: 68380 - protein, 9 aa, Homo Sapiens
YFFYFTHTD

SEQ ID NO: 68381 - protein, 9 aa, Homo Sapiens
ITLAKEVFG

SEQ ID NO: 68382 - protein, 9 aa, Homo Sapiens
VLVLPWFLN

SEQ ID NO: 68383 - protein, 9 aa, Homo Sapiens
YIRPLPQHG

SEQ ID NO: 68384 - protein, 9 aa, Homo Sapiens
PLRGPGASC

SEQ ID NO: 68385 - protein, 9 aa, Homo Sapiens
SLCMCYSAS

SEQ ID NO: 68386 - protein, 9 aa, Homo Sapiens
SHLSEHTRT

SEQ ID NO: 68387 - protein, 9 aa, Homo Sapiens
SVCLPCSPD

SEQ ID NO: 68388 - protein, 9 aa, Homo Sapiens
ISLLELVES

SEQ ID NO: 68389 - protein, 9 aa, Homo Sapiens
SKLSHISLL

SEQ ID NO: 68390 - protein, 9 aa, Homo Sapiens
ASPLLVLLT

SEQ ID NO: 68391 - protein, 9 aa, Homo Sapiens
SCGGSPVKA

SEQ ID NO: 68392 - protein, 9 aa, Homo Sapiens
CMCYSASIG

SEQ ID NO: 68393 - protein, 9 aa, Homo Sapiens
QLDMLKNGR

SEQ ID NO: 68394 - protein, 9 aa, Homo Sapiens
TSSTCDKGK

SEQ ID NO: 68395 - protein, 9 aa, Homo Sapiens
HHHEAASWA

SEQ ID NO: 68396 - protein, 9 aa, Homo Sapiens
YVSHLYGPS

SEQ ID NO: 68397 - protein, 9 aa, Homo Sapiens
YLLFTDQHN

SEQ ID NO: 68398 - protein, 9 aa, Homo Sapiens
RNGLVKDLK

SEQ ID NO: 68399 - protein, 9 aa, Homo Sapiens
GDPHFLIQI

SEQ ID NO: 68400 - protein, 9 aa, Homo Sapiens
KEAINVLSH

SEQ ID NO: 68401 - protein, 9 aa, Homo Sapiens
FVTHWNIAK

SEQ ID NO: 68402 - protein, 9 aa, Homo Sapiens
GAPQEWLST

SEQ ID NO: 68403 - protein, 9 aa, Homo Sapiens
VRFVTHWNI

SEQ ID NO: 68404 - protein, 9 aa, Homo Sapiens
ALDLGAPQE

SEQ ID NO: 68405 - protein, 9 aa, Homo Sapiens
SVDGDPHFL

SEQ ID NO: 68406 - protein, 9 aa, Homo Sapiens
HMAEYQEHW

SEQ ID NO: 68407 - protein, 9 aa, Homo Sapiens
TLAKEVFGD

SEQ ID NO: 68408 - protein, 9 aa, Homo Sapiens
ETYLLFTDQ

SEQ ID NO: 68409 - protein, 9 aa, Homo Sapiens
GGPKPGGMA

SEQ ID NO: 68410 - protein, 9 aa, Homo Sapiens
VCGRITLAK

SEQ ID NO: 68411 - protein, 9 aa, Homo Sapiens
LFETLHSLF

SEQ ID NO: 68412 - protein, 9 aa, Homo Sapiens
ESPGDPATA

SEQ ID NO: 68413 - protein, 9 aa, Homo Sapiens
LLVLLTLNF

SEQ ID NO: 68414 - protein, 9 aa, Homo Sapiens
VTHWNIAKS

SEQ ID NO: 68415 - protein, 9 aa, Homo Sapiens
TLHSLFWSV

SEQ ID NO: 68416 - protein, 9 aa, Homo Sapiens
PWSACTSST

SEQ ID NO: 68417 - protein, 9 aa, Homo Sapiens
RRSRASSVG

SEQ ID NO: 68418 - protein, 9 aa, Homo Sapiens
SPDEYLDSW

SEQ ID NO: 68419 - protein, 9 aa, Homo Sapiens
KIMHSLHLQ

SEQ ID NO: 68420 - protein, 9 aa, Homo Sapiens
SHQLPFLST

SEQ ID NO: 68421 - protein, 9 aa, Homo Sapiens
IMVCGRITL

SEQ ID NO: 68422 - protein, 9 aa, Homo Sapiens
TLFETLHSL

SEQ ID NO: 68423 - protein, 9 aa, Homo Sapiens
KSRLFSSSS

SEQ ID NO: 68424 - protein, 9 aa, Homo Sapiens
CMSLCMCYS

SEQ ID NO: 68425 - protein, 9 aa, Homo Sapiens
EVKRCNQGS

SEQ ID NO: 68426 - protein, 9 aa, Homo Sapiens
EEEPKAEEE

SEQ ID NO: 68427 - protein, 9 aa, Homo Sapiens
SRASSVGRC

SEQ ID NO: 68428 - protein, 9 aa, Homo Sapiens
ATASPRPLF

SEQ ID NO: 68429 - protein, 9 aa, Homo Sapiens
EELTRQLDM

SEQ ID NO: 68430 - protein, 9 aa, Homo Sapiens
SSHLSEHTR

SEQ ID NO: 68431 - protein, 9 aa, Homo Sapiens
VLLTLNFTI

SEQ ID NO: 68432 - protein, 9 aa, Homo Sapiens
RPLPQHGDR

SEQ ID NO: 68433 - protein, 9 aa, Homo Sapiens
KIKESYHNG

SEQ ID NO: 68434 - protein, 9 aa, Homo Sapiens
HFLIQIPHS

SEQ ID NO: 68435 - protein, 9 aa, Homo Sapiens
PEVKRCNQG

SEQ ID NO: 68436 - protein, 9 aa, Homo Sapiens
RHMAEYQEH

SEQ ID NO: 68437 - protein, 9 aa, Homo Sapiens
PNNSTKIMH

SEQ ID NO: 68438 - protein, 9 aa, Homo Sapiens
SQAPLQPED

SEQ ID NO: 68439 - protein, 9 aa, Homo Sapiens
TYSTLQMYL

SEQ ID NO: 68440 - protein, 9 aa, Homo Sapiens
SSVGRCSMP

SEQ ID NO: 68441 - protein, 9 aa, Homo Sapiens
TYRQIRIDI

SEQ ID NO: 68442 - protein, 9 aa, Homo Sapiens
NCGRNGLVK

SEQ ID NO: 68443 - protein, 9 aa, Homo Sapiens
RIDIPRTNP

SEQ ID NO: 68444 - protein, 9 aa, Homo Sapiens
ERGHPHERA

SEQ ID NO: 68445 - protein, 9 aa, Homo Sapiens
LTVLVLPWF

SEQ ID NO: 68446 - protein, 9 aa, Homo Sapiens
RQLDMLKNG

SEQ ID NO: 68447 - protein, 9 aa, Homo Sapiens
WSPWSACTS

SEQ ID NO: 68448 - protein, 9 aa, Homo Sapiens
DPATASPRP

SEQ ID NO: 68449 - protein, 9 aa, Homo Sapiens
TLQMYLDTE

SEQ ID NO: 68450 - protein, 9 aa, Homo Sapiens
KKSRLFSSS

SEQ ID NO: 68451 - protein, 9 aa, Homo Sapiens
RKTIRHMAE

SEQ ID NO: 68452 - protein, 9 aa, Homo Sapiens
LRGPGASCG

SEQ ID NO: 68453 - protein, 9 aa, Homo Sapiens
RGPGASCGG

SEQ ID NO: 68454 - protein, 9 aa, Homo Sapiens
QSLCQAVDK

SEQ ID NO: 68455 - protein, 9 aa, Homo Sapiens
DKANVRFVT

SEQ ID NO: 68456 - protein, 9 aa, Homo Sapiens
RSNFRWQNG

SEQ ID NO: 68457 - protein, 9 aa, Homo Sapiens
SHISLLELV

SEQ ID NO: 68458 - protein, 9 aa, Homo Sapiens
QPEDDILYQ

SEQ ID NO: 68459 - protein, 9 aa, Homo Sapiens
SSYSPASLY

SEQ ID NO: 68460 - protein, 9 aa, Homo Sapiens
CGNCGRNGL

SEQ ID NO: 68461 - protein, 9 aa, Homo Sapiens
YSPASLYHS

SEQ ID NO: 68462 - protein, 9 aa, Homo Sapiens
LLQLTYLNS

SEQ ID NO: 68463 - protein, 9 aa, Homo Sapiens
MSLCMCYSA

SEQ ID NO: 68464 - protein, 9 aa, Homo Sapiens
CGGSPVKAS

SEQ ID NO: 68465 - protein, 9 aa, Homo Sapiens
ASSQAPLQP

SEQ ID NO: 68466 - protein, 9 aa, Homo Sapiens
LLLQLTYLN

SEQ ID NO: 68467 - protein, 9 aa, Homo Sapiens
ASCGGSPVK

SEQ ID NO: 68468 - protein, 9 aa, Homo Sapiens
EYIRPLPQH

SEQ ID NO: 68469 - protein, 9 aa, Homo Sapiens
GPGGPKPGG

SEQ ID NO: 68470 - protein, 9 aa, Homo Sapiens
QLTYLNSCY

SEQ ID NO: 68471 - protein, 9 aa, Homo Sapiens
PGASCGGSP

SEQ ID NO: 68472 - protein, 9 aa, Homo Sapiens
GASCGGSPV

SEQ ID NO: 68473 - protein, 9 aa, Homo Sapiens
SSFLSHQLP

SEQ ID NO: 68474 - protein, 9 aa, Homo Sapiens
EDSPERGHP

SEQ ID NO: 68475 - protein, 9 aa, Homo Sapiens
LNSCYWDHK

SEQ ID NO: 68476 - protein, 9 aa, Homo Sapiens
QTPGPGGPK

SEQ ID NO: 68477 - protein, 9 aa, Homo Sapiens
RLCRRSRAS

SEQ ID NO: 68478 - protein, 9 aa, Homo Sapiens
ACTSSTCDK

SEQ ID NO: 68479 - protein, 9 aa, Homo Sapiens
LLELVESLD

SEQ ID NO: 68480 - protein, 9 aa, Homo Sapiens
EKEEEPKAE

SEQ ID NO: 68481 - protein, 9 aa, Homo Sapiens
DKHLRETQA

SEQ ID NO: 68482 - protein, 9 aa, Homo Sapiens
RASSVGRCS

SEQ ID NO: 68483 - protein, 9 aa, Homo Sapiens
EPEILPEAP

SEQ ID NO: 68484 - protein, 9 aa, Homo Sapiens
FLSHQLPFL

SEQ ID NO: 68485 - protein, 9 aa, Homo Sapiens
PGFRSNFRW

SEQ ID NO: 68486 - protein, 9 aa, Homo Sapiens
RGHPHERAR

SEQ ID NO: 68487 - protein, 9 aa, Homo Sapiens
ARSSHLSEH

SEQ ID NO: 68488 - protein, 9 aa, Homo Sapiens
PQHGDRPEP

SEQ ID NO: 68489 - protein, 9 aa, Homo Sapiens
TPGPGGPKP

SEQ ID NO: 68490 - protein, 9 aa, Homo Sapiens
ETLHSLFWS

SEQ ID NO: 68491 - protein, 9 aa, Homo Sapiens
FTHTDAGMF

SEQ ID NO: 68492 - protein, 9 aa, Homo Sapiens
AFARSSHLS

SEQ ID NO: 68493 - protein, 9 aa, Homo Sapiens
DMLCTRSST

SEQ ID NO: 68494 - protein, 9 aa, Homo Sapiens
TDLYKSYQC

SEQ ID NO: 68495 - protein, 9 aa, Homo Sapiens
PLQPEDDIL

SEQ ID NO: 68496 - protein, 9 aa, Homo Sapiens
TYLLFTDQH

SEQ ID NO: 68497 - protein, 9 aa, Homo Sapiens
SYYVSHLYG

SEQ ID NO: 68498 - protein, 9 aa, Homo Sapiens
ILPEAPANA

SEQ ID NO: 68499 - protein, 9 aa, Homo Sapiens
FSSSSNDSG

SEQ ID NO: 68500 - protein, 9 aa, Homo Sapiens
SPLLVLLTL

SEQ ID NO: 68501 - protein, 9 aa, Homo Sapiens
APQEWLSTL

SEQ ID NO: 68502 - protein, 9 aa, Homo Sapiens
RCNQGSKDL

SEQ ID NO: 68503 - protein, 9 aa, Homo Sapiens
STKIMHSLH

SEQ ID NO: 68504 - protein, 9 aa, Homo Sapiens
KTIRHMAEY

SEQ ID NO: 68505 - protein, 9 aa, Homo Sapiens
GYCVFWLLT

SEQ ID NO: 68506 - protein, 9 aa, Homo Sapiens
GHTLGESLM

SEQ ID NO: 68507 - protein, 9 aa, Homo Sapiens
GIHSGDKPY

SEQ ID NO: 68508 - protein, 9 aa, Homo Sapiens
ITDRCFPSY

SEQ ID NO: 68509 - protein, 9 aa, Homo Sapiens
QGHTLGESL

SEQ ID NO: 68510 - protein, 9 aa, Homo Sapiens
HRGIHSGDK

SEQ ID NO: 68511 - protein, 9 aa, Homo Sapiens
GADQLAFSP

SEQ ID NO: 68512 - protein, 9 aa, Homo Sapiens
EGQLDHVKL

SEQ ID NO: 68513 - protein, 9 aa, Homo Sapiens
SHRKENSKS

SEQ ID NO: 68514 - protein, 9 aa, Homo Sapiens
QLAFSPPHP

SEQ ID NO: 68515 - protein, 9 aa, Homo Sapiens
ADQLAFSPP

SEQ ID NO: 68516 - protein, 9 aa, Homo Sapiens
AFSPPHPNY

SEQ ID NO: 68517 - protein, 9 aa, Homo Sapiens
TLGESLMCA

SEQ ID NO: 68518 - protein, 9 aa, Homo Sapiens
IEKLTPGML

SEQ ID NO: 68519 - protein, 9 aa, Homo Sapiens
DRYGAICNP

SEQ ID NO: 68520 - protein, 9 aa, Homo Sapiens
MCAGNVGEA

SEQ ID NO: 68521 - protein, 9 aa, Homo Sapiens
LEKTVVLRV

SEQ ID NO: 68522 - protein, 9 aa, Homo Sapiens
WQFLLKLLS

SEQ ID NO: 68523 - protein, 9 aa, Homo Sapiens
HRKENSKSE

SEQ ID NO: 68524 - protein, 9 aa, Homo Sapiens
DCSPRERQG

SEQ ID NO: 68525 - protein, 9 aa, Homo Sapiens
GYNLAGDKE

SEQ ID NO: 68526 - protein, 9 aa, Homo Sapiens
LRGLQSLHY

SEQ ID NO: 68527 - protein, 9 aa, Homo Sapiens
LMRKAHTEG

SEQ ID NO: 68528 - protein, 9 aa, Homo Sapiens
KTVVLRVPV

SEQ ID NO: 68529 - protein, 9 aa, Homo Sapiens
RKENSKSEK

SEQ ID NO: 68530 - protein, 9 aa, Homo Sapiens
RYGAICNPL

SEQ ID NO: 68531 - protein, 9 aa, Homo Sapiens
SPKPKRWRV

SEQ ID NO: 68532 - protein, 9 aa, Homo Sapiens
EPRVHLRSG

SEQ ID NO: 68533 - protein, 9 aa, Homo Sapiens
ESLMCAGNV

SEQ ID NO: 68534 - protein, 9 aa, Homo Sapiens
LCRLLGLEV

SEQ ID NO: 68535 - protein, 9 aa, Homo Sapiens
GITDRCFPS

SEQ ID NO: 68536 - protein, 9 aa, Homo Sapiens
LSTSIKYSQ

SEQ ID NO: 68537 - protein, 9 aa, Homo Sapiens
SVLIKNQGH

SEQ ID NO: 68538 - protein, 9 aa, Homo Sapiens
LMAYDRYGA

SEQ ID NO: 68539 - protein, 9 aa, Homo Sapiens
LWQFLLKLL

SEQ ID NO: 68540 - protein, 9 aa, Homo Sapiens
TVVLRVPVP

SEQ ID NO: 68541 - protein, 9 aa, Homo Sapiens
YDRYGAICN

SEQ ID NO: 68542 - protein, 9 aa, Homo Sapiens
EHHVRLCKP

SEQ ID NO: 68543 - protein, 9 aa, Homo Sapiens
CALLPEDIR

SEQ ID NO: 68544 - protein, 9 aa, Homo Sapiens
EEPRVHLRS

SEQ ID NO: 68545 - protein, 9 aa, Homo Sapiens
SKEYIVYDE

SEQ ID NO: 68546 - protein, 9 aa, Homo Sapiens
HSGDKPYKC

SEQ ID NO: 68547 - protein, 9 aa, Homo Sapiens
RERQGDYQM

SEQ ID NO: 68548 - protein, 9 aa, Homo Sapiens
SGDKPYKCD

SEQ ID NO: 68549 - protein, 9 aa, Homo Sapiens
YCVFWLLTP

SEQ ID NO: 68550 - protein, 9 aa, Homo Sapiens
HDTAISGPF

SEQ ID NO: 68551 - protein, 9 aa, Homo Sapiens
LPEDIRFLA

SEQ ID NO: 68552 - protein, 9 aa, Homo Sapiens
EKTVVLRVP

SEQ ID NO: 68553 - protein, 9 aa, Homo Sapiens
KENSKSEKR

SEQ ID NO: 68554 - protein, 9 aa, Homo Sapiens
HTLGESLMC

SEQ ID NO: 68555 - protein, 9 aa, Homo Sapiens
IKNQGHTLG

SEQ ID NO: 68556 - protein, 9 aa, Homo Sapiens
LLRNRYPAW

SEQ ID NO: 68557 - protein, 9 aa, Homo Sapiens
MAYDRYGAI

SEQ ID NO: 68558 - protein, 9 aa, Homo Sapiens
WLCCATPAH

SEQ ID NO: 68559 - protein, 9 aa, Homo Sapiens
NSKSEKRMY

SEQ ID NO: 68560 - protein, 9 aa, Homo Sapiens
SHRGIHSGD

SEQ ID NO: 68561 - protein, 9 aa, Homo Sapiens
MLRGLQSLH

SEQ ID NO: 68562 - protein, 9 aa, Homo Sapiens
QLWQFLLKL

SEQ ID NO: 68563 - protein, 9 aa, Homo Sapiens
KEYIVYDED

SEQ ID NO: 68564 - protein, 9 aa, Homo Sapiens
TNLKEHHVR

SEQ ID NO: 68565 - protein, 9 aa, Homo Sapiens
LIKNQGHTL

SEQ ID NO: 68566 - protein, 9 aa, Homo Sapiens
NSTNLKEHH

SEQ ID NO: 68567 - protein, 9 aa, Homo Sapiens
TDQEKMEKR

SEQ ID NO: 68568 - protein, 9 aa, Homo Sapiens
SLMCAGNVG

SEQ ID NO: 68569 - protein, 9 aa, Homo Sapiens
VHLRSGAQV

SEQ ID NO: 68570 - protein, 9 aa, Homo Sapiens
LLKLLSDSS

SEQ ID NO: 68571 - protein, 9 aa, Homo Sapiens
FLLKLLSDS

SEQ ID NO: 68572 - protein, 9 aa, Homo Sapiens
YGAICNPLR

SEQ ID NO: 68573 - protein, 9 aa, Homo Sapiens
ENSKSEKRM

SEQ ID NO: 68574 - protein, 9 aa, Homo Sapiens
LTPGMLRGL

SEQ ID NO: 68575 - protein, 9 aa, Homo Sapiens
ATPAHALQC

SEQ ID NO: 68576 - protein, 9 aa, Homo Sapiens
EYIVYDEDV

SEQ ID NO: 68577 - protein, 9 aa, Homo Sapiens
DTEGQLDHV

SEQ ID NO: 68578 - protein, 9 aa, Homo Sapiens
SPNSTNLKE

SEQ ID NO: 68579 - protein, 9 aa, Homo Sapiens
IKYSQPGET

SEQ ID NO: 68580 - protein, 9 aa, Homo Sapiens
SIKYSQPGE

SEQ ID NO: 68581 - protein, 9 aa, Homo Sapiens
CSPRERQGD

SEQ ID NO: 68582 - protein, 9 aa, Homo Sapiens
TYRCNKGYN

SEQ ID NO: 68583 - protein, 9 aa, Homo Sapiens
LTPLPMAVS

SEQ ID NO: 68584 - protein, 9 aa, Homo Sapiens
WAEEPRVHL

SEQ ID NO: 68585 - protein, 9 aa, Homo Sapiens
YSQPGETDG

SEQ ID NO: 68586 - protein, 9 aa, Homo Sapiens
RHSKEYIVY

SEQ ID NO: 68587 - protein, 9 aa, Homo Sapiens
TSIKYSQPG

SEQ ID NO: 68588 - protein, 9 aa, Homo Sapiens
IRFLARSPH

SEQ ID NO: 68589 - protein, 9 aa, Homo Sapiens
SCGITDRCF

SEQ ID NO: 68590 - protein, 9 aa, Homo Sapiens
KYSQPGETD

SEQ ID NO: 68591 - protein, 9 aa, Homo Sapiens
TAISGPFHY

SEQ ID NO: 68592 - protein, 9 aa, Homo Sapiens
FCALLPEDI

SEQ ID NO: 68593 - protein, 9 aa, Homo Sapiens
VIKIDLLRN

SEQ ID NO: 68594 - protein, 9 aa, Homo Sapiens
CAGNVGEAL

SEQ ID NO: 68595 - protein, 9 aa, Homo Sapiens
AACPVGCPI

SEQ ID NO: 68596 - protein, 9 aa, Homo Sapiens
YDEDVESRD

SEQ ID NO: 68597 - protein, 9 aa, Homo Sapiens
YIVYDEDVE

SEQ ID NO: 68598 - protein, 9 aa, Homo Sapiens
TPLPMAVSS

SEQ ID NO: 68599 - protein, 9 aa, Homo Sapiens
ESVIKIDLL

SEQ ID NO: 68600 - protein, 9 aa, Homo Sapiens
PGMLRGLQS

SEQ ID NO: 68601 - protein, 9 aa, Homo Sapiens
LALWLCCAT

SEQ ID NO: 68602 - protein, 9 aa, Homo Sapiens
ACPAACPVG

SEQ ID NO: 68603 - protein, 9 aa, Homo Sapiens
RKAHTEGVT

SEQ ID NO: 68604 - protein, 9 aa, Homo Sapiens
TPGMLRGLQ

SEQ ID NO: 68605 - protein, 9 aa, Homo Sapiens
PRERQGDYQ

SEQ ID NO: 68606 - protein, 9 aa, Homo Sapiens
LGLEVTDFS

SEQ ID NO: 68607 - protein, 9 aa, Homo Sapiens
DQLAFSPPH

SEQ ID NO: 68608 - protein, 9 aa, Homo Sapiens
DLLRNRYPA

SEQ ID NO: 68609 - protein, 9 aa, Homo Sapiens
FLEKTVVLR

SEQ ID NO: 68610 - protein, 9 aa, Homo Sapiens
LYTLMRKAH

SEQ ID NO: 68611 - protein, 9 aa, Homo Sapiens
KSEKRMYSK

SEQ ID NO: 68612 - protein, 9 aa, Homo Sapiens
AGNVGEALR

SEQ ID NO: 68613 - protein, 9 aa, Homo Sapiens
CPAACPVGC

SEQ ID NO: 68614 - protein, 9 aa, Homo Sapiens
PYLYTLMRK

SEQ ID NO: 68615 - protein, 9 aa, Homo Sapiens
MCSARACPA

SEQ ID NO: 68616 - protein, 9 aa, Homo Sapiens
GAICNPLRY

SEQ ID NO: 68617 - protein, 9 aa, Homo Sapiens
ALLPEDIRF

SEQ ID NO: 68618 - protein, 9 aa, Homo Sapiens
LLPEDIRFL

SEQ ID NO: 68619 - protein, 9 aa, Homo Sapiens
HSFLEKTVV

SEQ ID NO: 68620 - protein, 9 aa, Homo Sapiens
GLMAYDRYG

SEQ ID NO: 68621 - protein, 9 aa, Homo Sapiens
KNQGHTLGE

SEQ ID NO: 68622 - protein, 9 aa, Homo Sapiens
ERQGDYQMK

SEQ ID NO: 68623 - protein, 9 aa, Homo Sapiens
KLCRLLGLE

SEQ ID NO: 68624 - protein, 9 aa, Homo Sapiens
FSPPHPNYT

SEQ ID NO: 68625 - protein, 9 aa, Homo Sapiens
FWLLTPLPM

SEQ ID NO: 68626 - protein, 9 aa, Homo Sapiens
RLLGLEVTD

SEQ ID NO: 68627 - protein, 9 aa, Homo Sapiens
QGDYQMKKL

SEQ ID NO: 68628 - protein, 9 aa, Homo Sapiens
KLTPGMLRG

SEQ ID NO: 68629 - protein, 9 aa, Homo Sapiens
GMLRGLQSL

SEQ ID NO: 68630 - protein, 9 aa, Homo Sapiens
YRCNKGYNL

SEQ ID NO: 68631 - protein, 9 aa, Homo Sapiens
IDLLRNRYP

SEQ ID NO: 68632 - protein, 9 aa, Homo Sapiens
IKIDLLRNR

SEQ ID NO: 68633 - protein, 9 aa, Homo Sapiens
KEHHVRLCK

SEQ ID NO: 68634 - protein, 9 aa, Homo Sapiens
EVTDFSRAL

SEQ ID NO: 68635 - protein, 9 aa, Homo Sapiens
LKEHHVRLC

SEQ ID NO: 68636 - protein, 9 aa, Homo Sapiens
LAFSPPHPN

SEQ ID NO: 68637 - protein, 9 aa, Homo Sapiens
LGESLMCAG

SEQ ID NO: 68638 - protein, 9 aa, Homo Sapiens
EQSPKPKRW

SEQ ID NO: 68639 - protein, 9 aa, Homo Sapiens
RVHLRSGAQ

SEQ ID NO: 68640 - protein, 9 aa, Homo Sapiens
CRLLGLEVT

SEQ ID NO: 68641 - protein, 9 aa, Homo Sapiens
SKSEKRMYS

SEQ ID NO: 68642 - protein, 9 aa, Homo Sapiens
SQPGETDGT

SEQ ID NO: 68643 - protein, 9 aa, Homo Sapiens
CSARACPAA

SEQ ID NO: 68644 - protein, 9 aa, Homo Sapiens
TDRCFPSYC

SEQ ID NO: 68645 - protein, 9 aa, Homo Sapiens
NKGYNLAGD

SEQ ID NO: 68646 - protein, 9 aa, Homo Sapiens
EDTEGQLDH

SEQ ID NO: 68647 - protein, 9 aa, Homo Sapiens
WLLTPLPMA

SEQ ID NO: 68648 - protein, 9 aa, Homo Sapiens
SGPFHYAPY

SEQ ID NO: 68649 - protein, 9 aa, Homo Sapiens
TPAHALQCR

SEQ ID NO: 68650 - protein, 9 aa, Homo Sapiens
AISGPFHYA

SEQ ID NO: 68651 - protein, 9 aa, Homo Sapiens
IHSGDKPYK

SEQ ID NO: 68652 - protein, 9 aa, Homo Sapiens
GESLMCAGN

SEQ ID NO: 68653 - protein, 9 aa, Homo Sapiens
EDIRFLARS

SEQ ID NO: 68654 - protein, 9 aa, Homo Sapiens
PFHYAPYHR

SEQ ID NO: 68655 - protein, 9 aa, Homo Sapiens
IQLWQFLLK

SEQ ID NO: 68656 - protein, 9 aa, Homo Sapiens
LLTPLPMAV

SEQ ID NO: 68657 - protein, 9 aa, Homo Sapiens
ALWLCCATP

SEQ ID NO: 68658 - protein, 9 aa, Homo Sapiens
SFLEKTVVL

SEQ ID NO: 68659 - protein, 9 aa, Homo Sapiens
MSVLIKNQG

SEQ ID NO: 68660 - protein, 9 aa, Homo Sapiens
LCCATPAHA

SEQ ID NO: 68661 - protein, 9 aa, Homo Sapiens
STSIKYSQP

SEQ ID NO: 68662 - protein, 9 aa, Homo Sapiens
KLLSDSSNS

SEQ ID NO: 68663 - protein, 9 aa, Homo Sapiens
LRNRYPAWE

SEQ ID NO: 68664 - protein, 9 aa, Homo Sapiens
SPRERQGDY

SEQ ID NO: 68665 - protein, 9 aa, Homo Sapiens
LWLCCATPA

SEQ ID NO: 68666 - protein, 9 aa, Homo Sapiens
RQGDYQMKK

SEQ ID NO: 68667 - protein, 9 aa, Homo Sapiens
YHSFLEKTV

SEQ ID NO: 68668 - protein, 9 aa, Homo Sapiens
ADRKQKTDQ

SEQ ID NO: 68669 - protein, 9 aa, Homo Sapiens
GQLDHVKLF

SEQ ID NO: 68670 - protein, 9 aa, Homo Sapiens
FHYAPYHRS

SEQ ID NO: 68671 - protein, 9 aa, Homo Sapiens
NLAGDKESS

SEQ ID NO: 68672 - protein, 9 aa, Homo Sapiens
STNLKEHHV

SEQ ID NO: 68673 - protein, 9 aa, Homo Sapiens
NLKEHHVRL

SEQ ID NO: 68674 - protein, 9 aa, Homo Sapiens
QEKMEKRTA

SEQ ID NO: 68675 - protein, 9 aa, Homo Sapiens
GDYQMKKLR

SEQ ID NO: 68676 - protein, 9 aa, Homo Sapiens
KTDQEKMEK

SEQ ID NO: 68677 - protein, 9 aa, Homo Sapiens
SARACPAAC

SEQ ID NO: 68678 - protein, 9 aa, Homo Sapiens
KQKTDQEKM

SEQ ID NO: 68679 - protein, 9 aa, Homo Sapiens
PNSTNLKEH

SEQ ID NO: 68680 - protein, 9 aa, Homo Sapiens
HSKEYIVYD

SEQ ID NO: 68681 - protein, 9 aa, Homo Sapiens
RCFPSYCEH

SEQ ID NO: 68682 - protein, 9 aa, Homo Sapiens
YTLMRKAHT

SEQ ID NO: 68683 - protein, 9 aa, Homo Sapiens
QKTDQEKME

SEQ ID NO: 68684 - protein, 9 aa, Homo Sapiens
GEALRGSQT

SEQ ID NO: 68685 - protein, 9 aa, Homo Sapiens
CATPAHALQ

SEQ ID NO: 68686 - protein, 9 aa, Homo Sapiens
TEGQLDHVK

SEQ ID NO: 68687 - protein, 9 aa, Homo Sapiens
SPPHPNYTW

SEQ ID NO: 68688 - protein, 9 aa, Homo Sapiens
ISGPFHYAP

SEQ ID NO: 68689 - protein, 9 aa, Homo Sapiens
CCATPAHAL

SEQ ID NO: 68690 - protein, 9 aa, Homo Sapiens
FPSYCEHGG

SEQ ID NO: 68691 - protein, 9 aa, Homo Sapiens
LEVTDFSRA

SEQ ID NO: 68692 - protein, 9 aa, Homo Sapiens
VYDEDVESR

SEQ ID NO: 68693 - protein, 9 aa, Homo Sapiens
RACPAACPV

SEQ ID NO: 68694 - protein, 9 aa, Homo Sapiens
DIRFLARSP

SEQ ID NO: 68695 - protein, 9 aa, Homo Sapiens
DTAISGPFH

SEQ ID NO: 68696 - protein, 9 aa, Homo Sapiens
LKLLSDSSN

SEQ ID NO: 68697 - protein, 9 aa, Homo Sapiens
PEDIRFLAR

SEQ ID NO: 68698 - protein, 9 aa, Homo Sapiens
IVYDEDVES

SEQ ID NO: 68699 - protein, 9 aa, Homo Sapiens
SSHRKENSK

SEQ ID NO: 68700 - protein, 9 aa, Homo Sapiens
SMSVLIKNQ

SEQ ID NO: 68701 - protein, 9 aa, Homo Sapiens
TLMRKAHTE

SEQ ID NO: 68702 - protein, 9 aa, Homo Sapiens
RKQKTDQEK

SEQ ID NO: 68703 - protein, 9 aa, Homo Sapiens
GNVGEALRG

SEQ ID NO: 68704 - protein, 9 aa, Homo Sapiens
YNLAGDKES

SEQ ID NO: 68705 - protein, 9 aa, Homo Sapiens
QLDHVKLFM

SEQ ID NO: 68706 - protein, 9 aa, Homo Sapiens
EKLTPGMLR

SEQ ID NO: 68707 - protein, 9 aa, Homo Sapiens
PRVHLRSGA

SEQ ID NO: 68708 - protein, 9 aa, Homo Sapiens
RCNKGYNLA

SEQ ID NO: 68709 - protein, 9 aa, Homo Sapiens
MRKAHTEGV

SEQ ID NO: 68710 - protein, 9 aa, Homo Sapiens
LPYLYTLMR

SEQ ID NO: 68711 - protein, 9 aa, Homo Sapiens
VFWLLTPLP

SEQ ID NO: 68712 - protein, 9 aa, Homo Sapiens
YLYTLMRKA

SEQ ID NO: 68713 - protein, 9 aa, Homo Sapiens
CNKGYNLAG

SEQ ID NO: 68714 - protein, 9 aa, Homo Sapiens
IEDTEGQLD

SEQ ID NO: 68715 - protein, 9 aa, Homo Sapiens
CVFWLLTPL

SEQ ID NO: 68716 - protein, 9 aa, Homo Sapiens
DRCFPSYCE

SEQ ID NO: 68717 - protein, 9 aa, Homo Sapiens
KGYNLAGDK

SEQ ID NO: 68718 - protein, 9 aa, Homo Sapiens
KIDLLRNRY

SEQ ID NO: 68719 - protein, 9 aa, Homo Sapiens
LLGLEVTDF

SEQ ID NO: 68720 - protein, 9 aa, Homo Sapiens
LDHVKLFMQ

SEQ ID NO: 68721 - protein, 9 aa, Homo Sapiens
DRKQKTDQE

SEQ ID NO: 68722 - protein, 9 aa, Homo Sapiens
QSPKPKRWR

SEQ ID NO: 68723 - protein, 9 aa, Homo Sapiens
GPFHYAPYH

SEQ ID NO: 68724 - protein, 9 aa, Homo Sapiens
QPGETDGTR

SEQ ID NO: 68725 - protein, 9 aa, Homo Sapiens
LMCAGNVGE

SEQ ID NO: 68726 - protein, 9 aa, Homo Sapiens
SWAEEPRVH

SEQ ID NO: 68727 - protein, 9 aa, Homo Sapiens
HLRSGAQVG

SEQ ID NO: 68728 - protein, 9 aa, Homo Sapiens
EGADQLAFS

SEQ ID NO: 68729 - protein, 9 aa, Homo Sapiens
DQEKMEKRT

SEQ ID NO: 68730 - protein, 9 aa, Homo Sapiens
QFLLKLLSD

SEQ ID NO: 68731 - protein, 9 aa, Homo Sapiens
GLEVTDFSR

SEQ ID NO: 68732 - protein, 9 aa, Homo Sapiens
VVLRVPVPP

SEQ ID NO: 68733 - protein, 9 aa, Homo Sapiens
ARACPAACP

SEQ ID NO: 68734 - protein, 9 aa, Homo Sapiens
DHVKLFMQD

SEQ ID NO: 68735 - protein, 9 aa, Homo Sapiens
VGEALRGSQ

SEQ ID NO: 68736 - protein, 9 aa, Homo Sapiens
RGIHSGDKP

SEQ ID NO: 68737 - protein, 9 aa, Homo Sapiens
AYDRYGAIC

SEQ ID NO: 68738 - protein, 9 aa, Homo Sapiens
NVGEALRGS

SEQ ID NO: 68739 - protein, 9 aa, Homo Sapiens
AEEPRVHLR

SEQ ID NO: 68740 - protein, 9 aa, Homo Sapiens
SVIKIDLLR

SEQ ID NO: 68741 - protein, 9 aa, Homo Sapiens
VLIKNQGHT

SEQ ID NO: 68742 - protein, 9 aa, Homo Sapiens
NQGHTLGES

SEQ ID NO: 68743 - protein, 9 aa, Homo Sapiens
CGITDRCFP

SEQ ID NO: 68744 - protein, 9 aa, Homo Sapiens
PAACPVGCP

SEQ ID NO: 68745 - protein, 9 aa, Homo Sapiens
CFPSYCEHG

SEQ ID NO: 68746 - protein, 9 aa, Homo Sapiens
TLRQCYGAS

SEQ ID NO: 68747 - protein, 9 aa, Homo Sapiens
AADELTKME

SEQ ID NO: 68748 - protein, 9 aa, Homo Sapiens
NDSPSVGGD

SEQ ID NO: 68749 - protein, 9 aa, Homo Sapiens
AICVMKSFL

SEQ ID NO: 68750 - protein, 9 aa, Homo Sapiens
PDPQWKISI

SEQ ID NO: 68751 - protein, 9 aa, Homo Sapiens
LMDWQVIPK

SEQ ID NO: 68752 - protein, 9 aa, Homo Sapiens
AACPSAVRG

SEQ ID NO: 68753 - protein, 9 aa, Homo Sapiens
QEKSSLLAE

SEQ ID NO: 68754 - protein, 9 aa, Homo Sapiens
ESHAKARVM

SEQ ID NO: 68755 - protein, 9 aa, Homo Sapiens
CSFQNQIAA

SEQ ID NO: 68756 - protein, 9 aa, Homo Sapiens
AKARVMPPE

SEQ ID NO: 68757 - protein, 9 aa, Homo Sapiens
VFRGFYSAH

SEQ ID NO: 68758 - protein, 9 aa, Homo Sapiens
KKTNDLRYI

SEQ ID NO: 68759 - protein, 9 aa, Homo Sapiens
ESGSISLVT

SEQ ID NO: 68760 - protein, 9 aa, Homo Sapiens
SRSLSPPYK

SEQ ID NO: 68761 - protein, 9 aa, Homo Sapiens
SLLRARQLA

SEQ ID NO: 68762 - protein, 9 aa, Homo Sapiens
FLIFRRWKS

SEQ ID NO: 68763 - protein, 9 aa, Homo Sapiens
GQTVQKIAC

SEQ ID NO: 68764 - protein, 9 aa, Homo Sapiens
CKCSDTKWE

SEQ ID NO: 68765 - protein, 9 aa, Homo Sapiens
YVSLHVSLN

SEQ ID NO: 68766 - protein, 9 aa, Homo Sapiens
VYSLITSCN

SEQ ID NO: 68767 - protein, 9 aa, Homo Sapiens
RAICVMKSF

SEQ ID NO: 68768 - protein, 9 aa, Homo Sapiens
YTAYKNYYY

SEQ ID NO: 68769 - protein, 9 aa, Homo Sapiens
LKGPPSSRE

SEQ ID NO: 68770 - protein, 9 aa, Homo Sapiens
ELDCTSGKK

SEQ ID NO: 68771 - protein, 9 aa, Homo Sapiens
SVLHTLRQC

SEQ ID NO: 68772 - protein, 9 aa, Homo Sapiens
PELQNPESL

SEQ ID NO: 68773 - protein, 9 aa, Homo Sapiens
ILTECIPFS

SEQ ID NO: 68774 - protein, 9 aa, Homo Sapiens
ARHTGAMHL

SEQ ID NO: 68775 - protein, 9 aa, Homo Sapiens
LEVLCSFQN

SEQ ID NO: 68776 - protein, 9 aa, Homo Sapiens
GYVVERRYI

SEQ ID NO: 68777 - protein, 9 aa, Homo Sapiens
MESSLKQQQ

SEQ ID NO: 68778 - protein, 9 aa, Homo Sapiens
SGMYRRLFK

SEQ ID NO: 68779 - protein, 9 aa, Homo Sapiens
DCTSGKKQA

SEQ ID NO: 68780 - protein, 9 aa, Homo Sapiens
RVHVLENSS

SEQ ID NO: 68781 - protein, 9 aa, Homo Sapiens
GLGMFKLFH

SEQ ID NO: 68782 - protein, 9 aa, Homo Sapiens
LEWMNNVMN

SEQ ID NO: 68783 - protein, 9 aa, Homo Sapiens
LSFKAADEL

SEQ ID NO: 68784 - protein, 9 aa, Homo Sapiens
FGGSLHSSL

SEQ ID NO: 68785 - protein, 9 aa, Homo Sapiens
VEALTTSQD

SEQ ID NO: 68786 - protein, 9 aa, Homo Sapiens
DICVASEIM

SEQ ID NO: 68787 - protein, 9 aa, Homo Sapiens
YYYSEPGRN

SEQ ID NO: 68788 - protein, 9 aa, Homo Sapiens
EEKIGEQEE

SEQ ID NO: 68789 - protein, 9 aa, Homo Sapiens
TTSRGRRKC

SEQ ID NO: 68790 - protein, 9 aa, Homo Sapiens
GFQSRQFAA

SEQ ID NO: 68791 - protein, 9 aa, Homo Sapiens
WRPGSCTNI

SEQ ID NO: 68792 - protein, 9 aa, Homo Sapiens
EFSKHLKEE

SEQ ID NO: 68793 - protein, 9 aa, Homo Sapiens
STVNVIAPA

SEQ ID NO: 68794 - protein, 9 aa, Homo Sapiens
QVVEALTTS

SEQ ID NO: 68795 - protein, 9 aa, Homo Sapiens
GESLLRARQ

SEQ ID NO: 68796 - protein, 9 aa, Homo Sapiens
CRAIDIVYS

SEQ ID NO: 68797 - protein, 9 aa, Homo Sapiens
VLSSLELLR

SEQ ID NO: 68798 - protein, 9 aa, Homo Sapiens
ASLTASGFP

SEQ ID NO: 68799 - protein, 9 aa, Homo Sapiens
YKRWRRSSC

SEQ ID NO: 68800 - protein, 9 aa, Homo Sapiens
IEIKAIDEN

SEQ ID NO: 68801 - protein, 9 aa, Homo Sapiens
VASGGKMTL

SEQ ID NO: 68802 - protein, 9 aa, Homo Sapiens
VKDLQEEVS

SEQ ID NO: 68803 - protein, 9 aa, Homo Sapiens
ASGGKMTLR

SEQ ID NO: 68804 - protein, 9 aa, Homo Sapiens
WDPEAHKLT

SEQ ID NO: 68805 - protein, 9 aa, Homo Sapiens
MHLNHLSSR

SEQ ID NO: 68806 - protein, 9 aa, Homo Sapiens
VETLGCCNL

SEQ ID NO: 68807 - protein, 9 aa, Homo Sapiens
EQPSRSEFS

SEQ ID NO: 68808 - protein, 9 aa, Homo Sapiens
YHLILLTSL

SEQ ID NO: 68809 - protein, 9 aa, Homo Sapiens
WKVRLRHDN

SEQ ID NO: 68810 - protein, 9 aa, Homo Sapiens
TRIFCHPSF

SEQ ID NO: 68811 - protein, 9 aa, Homo Sapiens
WIGDDLRDL

SEQ ID NO: 68812 - protein, 9 aa, Homo Sapiens
IFLHLKRSV

SEQ ID NO: 68813 - protein, 9 aa, Homo Sapiens
KARVMPPEG

SEQ ID NO: 68814 - protein, 9 aa, Homo Sapiens
VYFVAVRAI

SEQ ID NO: 68815 - protein, 9 aa, Homo Sapiens
TKEVALCEE

SEQ ID NO: 68816 - protein, 9 aa, Homo Sapiens
EFFDETRQL

SEQ ID NO: 68817 - protein, 9 aa, Homo Sapiens
KMLSLTHLF

SEQ ID NO: 68818 - protein, 9 aa, Homo Sapiens
QVMDLPWTS

SEQ ID NO: 68819 - protein, 9 aa, Homo Sapiens
FMIGNIMAK

SEQ ID NO: 68820 - protein, 9 aa, Homo Sapiens
FVFVSTPTL

SEQ ID NO: 68821 - protein, 9 aa, Homo Sapiens
GDDLRDLLC

SEQ ID NO: 68822 - protein, 9 aa, Homo Sapiens
KEVALCEEN

SEQ ID NO: 68823 - protein, 9 aa, Homo Sapiens
VLCWDPEAH

SEQ ID NO: 68824 - protein, 9 aa, Homo Sapiens
GEPFDRIME

SEQ ID NO: 68825 - protein, 9 aa, Homo Sapiens
WPTPWRRFW

SEQ ID NO: 68826 - protein, 9 aa, Homo Sapiens
LSYGAIGAI

SEQ ID NO: 68827 - protein, 9 aa, Homo Sapiens
TRTAQFDIC

SEQ ID NO: 68828 - protein, 9 aa, Homo Sapiens
RRYIKRKTW

SEQ ID NO: 68829 - protein, 9 aa, Homo Sapiens
WGTVCDDAL

SEQ ID NO: 68830 - protein, 9 aa, Homo Sapiens
SFMIGNIMA

SEQ ID NO: 68831 - protein, 9 aa, Homo Sapiens
VFVFGVADV

SEQ ID NO: 68832 - protein, 9 aa, Homo Sapiens
RPGSCTNIT

SEQ ID NO: 68833 - protein, 9 aa, Homo Sapiens
CCNLICSDK

SEQ ID NO: 68834 - protein, 9 aa, Homo Sapiens
FDETRQLCD

SEQ ID NO: 68835 - protein, 9 aa, Homo Sapiens
KAALHPSHT

SEQ ID NO: 68836 - protein, 9 aa, Homo Sapiens
LNSNAVTGL

SEQ ID NO: 68837 - protein, 9 aa, Homo Sapiens
NYYYSEPGR

SEQ ID NO: 68838 - protein, 9 aa, Homo Sapiens
IGNIMAKMA

SEQ ID NO: 68839 - protein, 9 aa, Homo Sapiens
VAALQQEKS

SEQ ID NO: 68840 - protein, 9 aa, Homo Sapiens
SLASLTASG

SEQ ID NO: 68841 - protein, 9 aa, Homo Sapiens
GDVLTNDSP

SEQ ID NO: 68842 - protein, 9 aa, Homo Sapiens
WRRFWKRVR

SEQ ID NO: 68843 - protein, 9 aa, Homo Sapiens
KVPDIIVIP

SEQ ID NO: 68844 - protein, 9 aa, Homo Sapiens
DEPIFTQPL

SEQ ID NO: 68845 - protein, 9 aa, Homo Sapiens
HPKTDTTVS

SEQ ID NO: 68846 - protein, 9 aa, Homo Sapiens
TTSCSIPWC

SEQ ID NO: 68847 - protein, 9 aa, Homo Sapiens
VNVIAPAHH

SEQ ID NO: 68848 - protein, 9 aa, Homo Sapiens
FKPLRVPPD

SEQ ID NO: 68849 - protein, 9 aa, Homo Sapiens
VVASGGKMT

SEQ ID NO: 68850 - protein, 9 aa, Homo Sapiens
MELVTGGEP

SEQ ID NO: 68851 - protein, 9 aa, Homo Sapiens
VVFRGFYSA

SEQ ID NO: 68852 - protein, 9 aa, Homo Sapiens
GAFCEGQTV

SEQ ID NO: 68853 - protein, 9 aa, Homo Sapiens
EYTTFYSRP

SEQ ID NO: 68854 - protein, 9 aa, Homo Sapiens
DETRQLCDL

SEQ ID NO: 68855 - protein, 9 aa, Homo Sapiens
RLRVHVLEN

SEQ ID NO: 68856 - protein, 9 aa, Homo Sapiens
GLWRPGSCT

SEQ ID NO: 68857 - protein, 9 aa, Homo Sapiens
QKKTNDLRY

SEQ ID NO: 68858 - protein, 9 aa, Homo Sapiens
KESREKCST

SEQ ID NO: 68859 - protein, 9 aa, Homo Sapiens
LDCTSGKKQ

SEQ ID NO: 68860 - protein, 9 aa, Homo Sapiens
SLSPPYKRW

SEQ ID NO: 68861 - protein, 9 aa, Homo Sapiens
TGRKRTVKD

SEQ ID NO: 68862 - protein, 9 aa, Homo Sapiens
CMAFELATV

SEQ ID NO: 68863 - protein, 9 aa, Homo Sapiens
RPGSPPGWA

SEQ ID NO: 68864 - protein, 9 aa, Homo Sapiens
EDEGFQSRQ

SEQ ID NO: 68865 - protein, 9 aa, Homo Sapiens
IYDLHKKTS

SEQ ID NO: 68866 - protein, 9 aa, Homo Sapiens
NHQARVTTR

SEQ ID NO: 68867 - protein, 9 aa, Homo Sapiens
LFKPLRVPP

SEQ ID NO: 68868 - protein, 9 aa, Homo Sapiens
GTQKSQRTE

SEQ ID NO: 68869 - protein, 9 aa, Homo Sapiens
HTGAMHLNH

SEQ ID NO: 68870 - protein, 9 aa, Homo Sapiens
GEICTKSLT

SEQ ID NO: 68871 - protein, 9 aa, Homo Sapiens
SNPVYRIQH

SEQ ID NO: 68872 - protein, 9 aa, Homo Sapiens
QSIPSTVNV

SEQ ID NO: 68873 - protein, 9 aa, Homo Sapiens
LRHDNTGKA

SEQ ID NO: 68874 - protein, 9 aa, Homo Sapiens
GGKQFYAGI

SEQ ID NO: 68875 - protein, 9 aa, Homo Sapiens
SYGAIGAIV

SEQ ID NO: 68876 - protein, 9 aa, Homo Sapiens
TAQFDICVA

SEQ ID NO: 68877 - protein, 9 aa, Homo Sapiens
SKDVTFHPD

SEQ ID NO: 68878 - protein, 9 aa, Homo Sapiens
LIRLTAWCC

SEQ ID NO: 68879 - protein, 9 aa, Homo Sapiens
SYVKALEYV

SEQ ID NO: 68880 - protein, 9 aa, Homo Sapiens
HMSGTQKSQ

SEQ ID NO: 68881 - protein, 9 aa, Homo Sapiens
SNAVTGLRE

SEQ ID NO: 68882 - protein, 9 aa, Homo Sapiens
CDDALDLRA

SEQ ID NO: 68883 - protein, 9 aa, Homo Sapiens
IQLHLSHPI

SEQ ID NO: 68884 - protein, 9 aa, Homo Sapiens
SSSATSTLG

SEQ ID NO: 68885 - protein, 9 aa, Homo Sapiens
LWKVRLRHD

SEQ ID NO: 68886 - protein, 9 aa, Homo Sapiens
LCHNCAVEC

SEQ ID NO: 68887 - protein, 9 aa, Homo Sapiens
LLRPWAKEN

SEQ ID NO: 68888 - protein, 9 aa, Homo Sapiens
YLTDENEVV

SEQ ID NO: 68889 - protein, 9 aa, Homo Sapiens
AVRAICVMK

SEQ ID NO: 68890 - protein, 9 aa, Homo Sapiens
QLMALPITR

SEQ ID NO: 68891 - protein, 9 aa, Homo Sapiens
FSVFVFGVA

SEQ ID NO: 68892 - protein, 9 aa, Homo Sapiens
ETLGCCNLI

SEQ ID NO: 68893 - protein, 9 aa, Homo Sapiens
MDWQVIPKK

SEQ ID NO: 68894 - protein, 9 aa, Homo Sapiens
QFDICVASE

SEQ ID NO: 68895 - protein, 9 aa, Homo Sapiens
VMKSFLIFR

SEQ ID NO: 68896 - protein, 9 aa, Homo Sapiens
SFPQEYFLF

SEQ ID NO: 68897 - protein, 9 aa, Homo Sapiens
EEFFDETRQ

SEQ ID NO: 68898 - protein, 9 aa, Homo Sapiens
VLHTLRQCY

SEQ ID NO: 68899 - protein, 9 aa, Homo Sapiens
ERYRDKDSD

SEQ ID NO: 68900 - protein, 9 aa, Homo Sapiens
GEINFYYLS

SEQ ID NO: 68901 - protein, 9 aa, Homo Sapiens
HSSLYHLIL

SEQ ID NO: 68902 - protein, 9 aa, Homo Sapiens
LQFVFVSTP

SEQ ID NO: 68903 - protein, 9 aa, Homo Sapiens
ATCHLQQVM

SEQ ID NO: 68904 - protein, 9 aa, Homo Sapiens
AIDIVYSLI

SEQ ID NO: 68905 - protein, 9 aa, Homo Sapiens
DENEVVFRG

SEQ ID NO: 68906 - protein, 9 aa, Homo Sapiens
PCILTECIP

SEQ ID NO: 68907 - protein, 9 aa, Homo Sapiens
SLVALQQPL

SEQ ID NO: 68908 - protein, 9 aa, Homo Sapiens
EKIGEQEEK

SEQ ID NO: 68909 - protein, 9 aa, Homo Sapiens
VPDIIVIPR

SEQ ID NO: 68910 - protein, 9 aa, Homo Sapiens
TSYVKALEY

SEQ ID NO: 68911 - protein, 9 aa, Homo Sapiens
SEQVVEALT

SEQ ID NO: 68912 - protein, 9 aa, Homo Sapiens
RYWVLQFVF

SEQ ID NO: 68913 - protein, 9 aa, Homo Sapiens
TSSSATSTL

SEQ ID NO: 68914 - protein, 9 aa, Homo Sapiens
TFYSRPGST

SEQ ID NO: 68915 - protein, 9 aa, Homo Sapiens
MALPITRPG

SEQ ID NO: 68916 - protein, 9 aa, Homo Sapiens
RQCYGASLL

SEQ ID NO: 68917 - protein, 9 aa, Homo Sapiens
LCWDPEAHK

SEQ ID NO: 68918 - protein, 9 aa, Homo Sapiens
YWVLQFVFV

SEQ ID NO: 68919 - protein, 9 aa, Homo Sapiens
PESLSAVFR

SEQ ID NO: 68920 - protein, 9 aa, Homo Sapiens
CHNCAVECN

SEQ ID NO: 68921 - protein, 9 aa, Homo Sapiens
PYKRWRRSS

SEQ ID NO: 68922 - protein, 9 aa, Homo Sapiens
GVFKEKVSS

SEQ ID NO: 68923 - protein, 9 aa, Homo Sapiens
LSSACGSYF

SEQ ID NO: 68924 - protein, 9 aa, Homo Sapiens
TNIHDKLSK

SEQ ID NO: 68925 - protein, 9 aa, Homo Sapiens
VELLEVFGG

SEQ ID NO: 68926 - protein, 9 aa, Homo Sapiens
SVKSVILVM

SEQ ID NO: 68927 - protein, 9 aa, Homo Sapiens
RGQAICIDK

SEQ ID NO: 68928 - protein, 9 aa, Homo Sapiens
PCQRTWKRT

SEQ ID NO: 68929 - protein, 9 aa, Homo Sapiens
ASLVALQQP

SEQ ID NO: 68930 - protein, 9 aa, Homo Sapiens
GSCTNITMG

SEQ ID NO: 68931 - protein, 9 aa, Homo Sapiens
MGTDWIGDD

SEQ ID NO: 68932 - protein, 9 aa, Homo Sapiens
TSFPQEYFL

SEQ ID NO: 68933 - protein, 9 aa, Homo Sapiens
ARVMPPEGY

SEQ ID NO: 68934 - protein, 9 aa, Homo Sapiens
LGLGMFKLF

SEQ ID NO: 68935 - protein, 9 aa, Homo Sapiens
VGLGLGMFK

SEQ ID NO: 68936 - protein, 9 aa, Homo Sapiens
IVELSSTDS

SEQ ID NO: 68937 - protein, 9 aa, Homo Sapiens
EKRNLEVLC

SEQ ID NO: 68938 - protein, 9 aa, Homo Sapiens
QLCKDINNY

SEQ ID NO: 68939 - protein, 9 aa, Homo Sapiens
PLQIQLHLS

SEQ ID NO: 68940 - protein, 9 aa, Homo Sapiens
RHTGAMHLN

SEQ ID NO: 68941 - protein, 9 aa, Homo Sapiens
KNHISSMNT

SEQ ID NO: 68942 - protein, 9 aa, Homo Sapiens
CHWNGKKML

SEQ ID NO: 68943 - protein, 9 aa, Homo Sapiens
KKQANGQFI

SEQ ID NO: 68944 - protein, 9 aa, Homo Sapiens
EWLQVLGCG

SEQ ID NO: 68945 - protein, 9 aa, Homo Sapiens
KFCRAIDIV

SEQ ID NO: 68946 - protein, 9 aa, Homo Sapiens
EGFQSRQFA

SEQ ID NO: 68947 - protein, 9 aa, Homo Sapiens
TERTPVTLH

SEQ ID NO: 68948 - protein, 9 aa, Homo Sapiens
PVYRIQHKI

SEQ ID NO: 68949 - protein, 9 aa, Homo Sapiens
LGCCNLICS

SEQ ID NO: 68950 - protein, 9 aa, Homo Sapiens
TADGSANHQ

SEQ ID NO: 68951 - protein, 9 aa, Homo Sapiens
YRRLFKPLR

SEQ ID NO: 68952 - protein, 9 aa, Homo Sapiens
GAIVGHEFT

SEQ ID NO: 68953 - protein, 9 aa, Homo Sapiens
QARVTTRMG

SEQ ID NO: 68954 - protein, 9 aa, Homo Sapiens
PDIIVIPRS

SEQ ID NO: 68955 - protein, 9 aa, Homo Sapiens
ESVLVGYVN

SEQ ID NO: 68956 - protein, 9 aa, Homo Sapiens
EPFDRIMER

SEQ ID NO: 68957 - protein, 9 aa, Homo Sapiens
NCAVECNFG

SEQ ID NO: 68958 - protein, 9 aa, Homo Sapiens
IKRRDKTRI

SEQ ID NO: 68959 - protein, 9 aa, Homo Sapiens
RNLEVLCSF

SEQ ID NO: 68960 - protein, 9 aa, Homo Sapiens
LSSLELLRE

SEQ ID NO: 68961 - protein, 9 aa, Homo Sapiens
SVLVGYVNY

SEQ ID NO: 68962 - protein, 9 aa, Homo Sapiens
GQAICIDKK

SEQ ID NO: 68963 - protein, 9 aa, Homo Sapiens
TGEINFYYL

SEQ ID NO: 68964 - protein, 9 aa, Homo Sapiens
RTVKDLQEE

SEQ ID NO: 68965 - protein, 9 aa, Homo Sapiens
LSPSGESLL

SEQ ID NO: 68966 - protein, 9 aa, Homo Sapiens
ETSYVKALE

SEQ ID NO: 68967 - protein, 9 aa, Homo Sapiens
ITPGVFKEK

SEQ ID NO: 68968 - protein, 9 aa, Homo Sapiens
SGLMDWQVI

SEQ ID NO: 68969 - protein, 9 aa, Homo Sapiens
GLSSQHPKT

SEQ ID NO: 68970 - protein, 9 aa, Homo Sapiens
SEEQILQLA

SEQ ID NO: 68971 - protein, 9 aa, Homo Sapiens
SVNEVLEWM

SEQ ID NO: 68972 - protein, 9 aa, Homo Sapiens
QVELLEVFG

SEQ ID NO: 68973 - protein, 9 aa, Homo Sapiens
ANHQARVTT

SEQ ID NO: 68974 - protein, 9 aa, Homo Sapiens
CNLICSDKT

SEQ ID NO: 68975 - protein, 9 aa, Homo Sapiens
KSFLIFRRW

SEQ ID NO: 68976 - protein, 9 aa, Homo Sapiens
YFVAVRAIC

SEQ ID NO: 68977 - protein, 9 aa, Homo Sapiens
CSIPWCHLC

SEQ ID NO: 68978 - protein, 9 aa, Homo Sapiens
YGWVKRGSK

SEQ ID NO: 68979 - protein, 9 aa, Homo Sapiens
MLSLTHLFL

SEQ ID NO: 68980 - protein, 9 aa, Homo Sapiens
FYSRPGSTE

SEQ ID NO: 68981 - protein, 9 aa, Homo Sapiens
GDLWKVRLR

SEQ ID NO: 68982 - protein, 9 aa, Homo Sapiens
ELVTGGEPF

SEQ ID NO: 68983 - protein, 9 aa, Homo Sapiens
LGCRQYVSL

SEQ ID NO: 68984 - protein, 9 aa, Homo Sapiens
LGEKVPDII

SEQ ID NO: 68985 - protein, 9 aa, Homo Sapiens
SATSTLGSP

SEQ ID NO: 68986 - protein, 9 aa, Homo Sapiens
SGPCILTEC

SEQ ID NO: 68987 - protein, 9 aa, Homo Sapiens
FGVADVDYN

SEQ ID NO: 68988 - protein, 9 aa, Homo Sapiens
AMHILTQPF

SEQ ID NO: 68989 - protein, 9 aa, Homo Sapiens
VIRPYTAVT

SEQ ID NO: 68990 - protein, 9 aa, Homo Sapiens
IRERYRDKD

SEQ ID NO: 68991 - protein, 9 aa, Homo Sapiens
MSGTQKSQR

SEQ ID NO: 68992 - protein, 9 aa, Homo Sapiens
FIHMSGTQK

SEQ ID NO: 68993 - protein, 9 aa, Homo Sapiens
EWYIRGQAI

SEQ ID NO: 68994 - protein, 9 aa, Homo Sapiens
LLEVFGGSL

SEQ ID NO: 68995 - protein, 9 aa, Homo Sapiens
LCKDINNYY

SEQ ID NO: 68996 - protein, 9 aa, Homo Sapiens
PSTVNVIAP

SEQ ID NO: 68997 - protein, 9 aa, Homo Sapiens
GSANHQARV

SEQ ID NO: 68998 - protein, 9 aa, Homo Sapiens
SEEPHTNIH

SEQ ID NO: 68999 - protein, 9 aa, Homo Sapiens
ITTSCSIPW

SEQ ID NO: 69000 - protein, 9 aa, Homo Sapiens
TSEVSGSGS

SEQ ID NO: 69001 - protein, 9 aa, Homo Sapiens
TDLNSNAVT

SEQ ID NO: 69002 - protein, 9 aa, Homo Sapiens
ALDLRAAGV

SEQ ID NO: 69003 - protein, 9 aa, Homo Sapiens
QNPESLSAV

SEQ ID NO: 69004 - protein, 9 aa, Homo Sapiens
TPGVFKEKV

SEQ ID NO: 69005 - protein, 9 aa, Homo Sapiens
MSPWPTPWR

SEQ ID NO: 69006 - protein, 9 aa, Homo Sapiens
FVYTVKYVL

SEQ ID NO: 69007 - protein, 9 aa, Homo Sapiens
GPCILTECI

SEQ ID NO: 69008 - protein, 9 aa, Homo Sapiens
GEKVPDIIV

SEQ ID NO: 69009 - protein, 9 aa, Homo Sapiens
EKCEDYKEG

SEQ ID NO: 69010 - protein, 9 aa, Homo Sapiens
IIVIPRSQE

SEQ ID NO: 69011 - protein, 9 aa, Homo Sapiens
KMESSLKQQ

SEQ ID NO: 69012 - protein, 9 aa, Homo Sapiens
PITRPGSPP

SEQ ID NO: 69013 - protein, 9 aa, Homo Sapiens
LCSFQNQIA

SEQ ID NO: 69014 - protein, 9 aa, Homo Sapiens
EALTTSQDG

SEQ ID NO: 69015 - protein, 9 aa, Homo Sapiens
FDICVASEI

SEQ ID NO: 69016 - protein, 9 aa, Homo Sapiens
VLVNGNVVT

SEQ ID NO: 69017 - protein, 9 aa, Homo Sapiens
AALHPSHTD

SEQ ID NO: 69018 - protein, 9 aa, Homo Sapiens
LWRPGSCTN

SEQ ID NO: 69019 - protein, 9 aa, Homo Sapiens
GMSPWPTPW

SEQ ID NO: 69020 - protein, 9 aa, Homo Sapiens
DPATSLPMS

SEQ ID NO: 69021 - protein, 9 aa, Homo Sapiens
LEQRKRSDK

SEQ ID NO: 69022 - protein, 9 aa, Homo Sapiens
AHQKTLVTR

SEQ ID NO: 69023 - protein, 9 aa, Homo Sapiens
VRLRHDNTG

SEQ ID NO: 69024 - protein, 9 aa, Homo Sapiens
CRQYVSLHV

SEQ ID NO: 69025 - protein, 9 aa, Homo Sapiens
NEVLEWMNN

SEQ ID NO: 69026 - protein, 9 aa, Homo Sapiens
LVIRPYTAV

SEQ ID NO: 69027 - protein, 9 aa, Homo Sapiens
LESGSISLV

SEQ ID NO: 69028 - protein, 9 aa, Homo Sapiens
VGYVNYGNF

SEQ ID NO: 69029 - protein, 9 aa, Homo Sapiens
DMQVAALQQ

SEQ ID NO: 69030 - protein, 9 aa, Homo Sapiens
FMITPGVFK

SEQ ID NO: 69031 - protein, 9 aa, Homo Sapiens
SLKQQQLCD

SEQ ID NO: 69032 - protein, 9 aa, Homo Sapiens
EIKAIDENG

SEQ ID NO: 69033 - protein, 9 aa, Homo Sapiens
IPSTVNVIA

SEQ ID NO: 69034 - protein, 9 aa, Homo Sapiens
MSPLDQSGL

SEQ ID NO: 69035 - protein, 9 aa, Homo Sapiens
DALDLRAAG

SEQ ID NO: 69036 - protein, 9 aa, Homo Sapiens
GGSLHSSLY

SEQ ID NO: 69037 - protein, 9 aa, Homo Sapiens
ALQQEKSSL

SEQ ID NO: 69038 - protein, 9 aa, Homo Sapiens
LTAWCCILG

SEQ ID NO: 69039 - protein, 9 aa, Homo Sapiens
PDTHLKGPP

SEQ ID NO: 69040 - protein, 9 aa, Homo Sapiens
AMHLNHLSS

SEQ ID NO: 69041 - protein, 9 aa, Homo Sapiens
FQSRQFAAL

SEQ ID NO: 69042 - protein, 9 aa, Homo Sapiens
IKAIDENGH

SEQ ID NO: 69043 - protein, 9 aa, Homo Sapiens
SPLDQSGLG

SEQ ID NO: 69044 - protein, 9 aa, Homo Sapiens
SPSVGGDME

SEQ ID NO: 69045 - protein, 9 aa, Homo Sapiens
VLYEDEGFQ

SEQ ID NO: 69046 - protein, 9 aa, Homo Sapiens
GAIGAIVGH

SEQ ID NO: 69047 - protein, 9 aa, Homo Sapiens
EICTKSLTD

SEQ ID NO: 69048 - protein, 9 aa, Homo Sapiens
CILTECIPF

SEQ ID NO: 69049 - protein, 9 aa, Homo Sapiens
KKEKCEDYK

SEQ ID NO: 69050 - protein, 9 aa, Homo Sapiens
VIVGFAAFV

SEQ ID NO: 69051 - protein, 9 aa, Homo Sapiens
RLTSEVSGS

SEQ ID NO: 69052 - protein, 9 aa, Homo Sapiens
SQVELLEVF

SEQ ID NO: 69053 - protein, 9 aa, Homo Sapiens
VLLCSKDVT

SEQ ID NO: 69054 - protein, 9 aa, Homo Sapiens
PEVYFVAVR

SEQ ID NO: 69055 - protein, 9 aa, Homo Sapiens
ATSTLGSPE

SEQ ID NO: 69056 - protein, 9 aa, Homo Sapiens
SPLQIQLHL

SEQ ID NO: 69057 - protein, 9 aa, Homo Sapiens
ITRPGSPPG

SEQ ID NO: 69058 - protein, 9 aa, Homo Sapiens
FHPDPSQVE

SEQ ID NO: 69059 - protein, 9 aa, Homo Sapiens
GPCQRTWKR

SEQ ID NO: 69060 - protein, 9 aa, Homo Sapiens
TAMKCRNPG

SEQ ID NO: 69061 - protein, 9 aa, Homo Sapiens
YRDKDSDLA

SEQ ID NO: 69062 - protein, 9 aa, Homo Sapiens
NLGIEIKAI

SEQ ID NO: 69063 - protein, 9 aa, Homo Sapiens
KMTLRCGSQ

SEQ ID NO: 69064 - protein, 9 aa, Homo Sapiens
GARLTSEVS

SEQ ID NO: 69065 - protein, 9 aa, Homo Sapiens
LQNPESLSA

SEQ ID NO: 69066 - protein, 9 aa, Homo Sapiens
VECNFGQKE

SEQ ID NO: 69067 - protein, 9 aa, Homo Sapiens
ADGSANHQA

SEQ ID NO: 69068 - protein, 9 aa, Homo Sapiens
ASYKHTTSR

SEQ ID NO: 69069 - protein, 9 aa, Homo Sapiens
EKCSTAVDI

SEQ ID NO: 69070 - protein, 9 aa, Homo Sapiens
LDLRAAGVL

SEQ ID NO: 69071 - protein, 9 aa, Homo Sapiens
ILGEKVPDI

SEQ ID NO: 69072 - protein, 9 aa, Homo Sapiens
QVLGCGVME

SEQ ID NO: 69073 - protein, 9 aa, Homo Sapiens
LLMAALYQV

SEQ ID NO: 69074 - protein, 9 aa, Homo Sapiens
KTRIFCHPS

SEQ ID NO: 69075 - protein, 9 aa, Homo Sapiens
CGSYFYMAP

SEQ ID NO: 69076 - protein, 9 aa, Homo Sapiens
KDILIRLTA

SEQ ID NO: 69077 - protein, 9 aa, Homo Sapiens
SVFVFGVAD

SEQ ID NO: 69078 - protein, 9 aa, Homo Sapiens
KEKCEDYKE

SEQ ID NO: 69079 - protein, 9 aa, Homo Sapiens
HPITTSCSI

SEQ ID NO: 69080 - protein, 9 aa, Homo Sapiens
ACPSAVRGM

SEQ ID NO: 69081 - protein, 9 aa, Homo Sapiens
SRCKCSDTK

SEQ ID NO: 69082 - protein, 9 aa, Homo Sapiens
RRDKTRIFC

SEQ ID NO: 69083 - protein, 9 aa, Homo Sapiens
IITLVLVNG

SEQ ID NO: 69084 - protein, 9 aa, Homo Sapiens
YTTFYSRPG

SEQ ID NO: 69085 - protein, 9 aa, Homo Sapiens
NLEVLCSFQ

SEQ ID NO: 69086 - protein, 9 aa, Homo Sapiens
CRNPGCPFT

SEQ ID NO: 69087 - protein, 9 aa, Homo Sapiens
RWKSHSPLQ

SEQ ID NO: 69088 - protein, 9 aa, Homo Sapiens
LAETSYVKA

SEQ ID NO: 69089 - protein, 9 aa, Homo Sapiens
FKLFHLQKE

SEQ ID NO: 69090 - protein, 9 aa, Homo Sapiens
YLEQPSRSE

SEQ ID NO: 69091 - protein, 9 aa, Homo Sapiens
SKYGWVKRG

SEQ ID NO: 69092 - protein, 9 aa, Homo Sapiens
SGFSVFVFG

SEQ ID NO: 69093 - protein, 9 aa, Homo Sapiens
CNFGQKEKP

SEQ ID NO: 69094 - protein, 9 aa, Homo Sapiens
ERTPVTLHL

SEQ ID NO: 69095 - protein, 9 aa, Homo Sapiens
WATKEVALC

SEQ ID NO: 69096 - protein, 9 aa, Homo Sapiens
DKDSDLALG

SEQ ID NO: 69097 - protein, 9 aa, Homo Sapiens
LYEDEGFQS

SEQ ID NO: 69098 - protein, 9 aa, Homo Sapiens
GSYFYMAPE

SEQ ID NO: 69099 - protein, 9 aa, Homo Sapiens
IDSFMIGNI

SEQ ID NO: 69100 - protein, 9 aa, Homo Sapiens
LTSEVSGSG

SEQ ID NO: 69101 - protein, 9 aa, Homo Sapiens
SHPITTSCS

SEQ ID NO: 69102 - protein, 9 aa, Homo Sapiens
AETSYVKAL

SEQ ID NO: 69103 - protein, 9 aa, Homo Sapiens
LDSGPCILT

SEQ ID NO: 69104 - protein, 9 aa, Homo Sapiens
ETSISSVIC

SEQ ID NO: 69105 - protein, 9 aa, Homo Sapiens
TLGCCNLIC

SEQ ID NO: 69106 - protein, 9 aa, Homo Sapiens
SYTAYKNYY

SEQ ID NO: 69107 - protein, 9 aa, Homo Sapiens
YYLAERSIE

SEQ ID NO: 69108 - protein, 9 aa, Homo Sapiens
LASLTASGF

SEQ ID NO: 69109 - protein, 9 aa, Homo Sapiens
LQQVMDLPW

SEQ ID NO: 69110 - protein, 9 aa, Homo Sapiens
SLHSSLYHL

SEQ ID NO: 69111 - protein, 9 aa, Homo Sapiens
EVLEWMNNV

SEQ ID NO: 69112 - protein, 9 aa, Homo Sapiens
GEWYIRGQA

SEQ ID NO: 69113 - protein, 9 aa, Homo Sapiens
QPSRSEFSK

SEQ ID NO: 69114 - protein, 9 aa, Homo Sapiens
QSRQFAALV

SEQ ID NO: 69115 - protein, 9 aa, Homo Sapiens
HPSHTDPVT

SEQ ID NO: 69116 - protein, 9 aa, Homo Sapiens
EPHTNIHDK

SEQ ID NO: 69117 - protein, 9 aa, Homo Sapiens
ASGFPWVLL

SEQ ID NO: 69118 - protein, 9 aa, Homo Sapiens
HGEWLQVLG

SEQ ID NO: 69119 - protein, 9 aa, Homo Sapiens
IFRRWKSHS

SEQ ID NO: 69120 - protein, 9 aa, Homo Sapiens
KTNDLRYIE

SEQ ID NO: 69121 - protein, 9 aa, Homo Sapiens
HLQQVMDLP

SEQ ID NO: 69122 - protein, 9 aa, Homo Sapiens
NPGCPFTLN

SEQ ID NO: 69123 - protein, 9 aa, Homo Sapiens
AARHTGAMH

SEQ ID NO: 69124 - protein, 9 aa, Homo Sapiens
LQVLGCGVM

SEQ ID NO: 69125 - protein, 9 aa, Homo Sapiens
LVGDLMSPL

SEQ ID NO: 69126 - protein, 9 aa, Homo Sapiens
SSQHPKTDT

SEQ ID NO: 69127 - protein, 9 aa, Homo Sapiens
YYSEPGRNN

SEQ ID NO: 69128 - protein, 9 aa, Homo Sapiens
DSGPCILTE

SEQ ID NO: 69129 - protein, 9 aa, Homo Sapiens
IVYSLITSC

SEQ ID NO: 69130 - protein, 9 aa, Homo Sapiens
SSLELLREQ

SEQ ID NO: 69131 - protein, 9 aa, Homo Sapiens
LEQPSRSEF

SEQ ID NO: 69132 - protein, 9 aa, Homo Sapiens
LSHPITTSC

SEQ ID NO: 69133 - protein, 9 aa, Homo Sapiens
LSEEQILQL

SEQ ID NO: 69134 - protein, 9 aa, Homo Sapiens
ESSLKQQQL

SEQ ID NO: 69135 - protein, 9 aa, Homo Sapiens
ICVMKSFLI

SEQ ID NO: 69136 - protein, 9 aa, Homo Sapiens
TVNVIAPAH

SEQ ID NO: 69137 - protein, 9 aa, Homo Sapiens
TAVTSDEDQ

SEQ ID NO: 69138 - protein, 9 aa, Homo Sapiens
TQKSQRTER

SEQ ID NO: 69139 - protein, 9 aa, Homo Sapiens
ERKDPATSL

SEQ ID NO: 69140 - protein, 9 aa, Homo Sapiens
RTGEINFYY

SEQ ID NO: 69141 - protein, 9 aa, Homo Sapiens
RTERKDPAT

SEQ ID NO: 69142 - protein, 9 aa, Homo Sapiens
ELLEVFGGS

SEQ ID NO: 69143 - protein, 9 aa, Homo Sapiens
AKENMYHAL

SEQ ID NO: 69144 - protein, 9 aa, Homo Sapiens
LICSDKTGT

SEQ ID NO: 69145 - protein, 9 aa, Homo Sapiens
DVTFHPDPS

SEQ ID NO: 69146 - protein, 9 aa, Homo Sapiens
EQEEKIGEQ

SEQ ID NO: 69147 - protein, 9 aa, Homo Sapiens
ATVDYLFEP

SEQ ID NO: 69148 - protein, 9 aa, Homo Sapiens
WNGKKMLSL

SEQ ID NO: 69149 - protein, 9 aa, Homo Sapiens
EVLCSFQNQ

SEQ ID NO: 69150 - protein, 9 aa, Homo Sapiens
RCGFLESGS

SEQ ID NO: 69151 - protein, 9 aa, Homo Sapiens
RQLCDLRLF

SEQ ID NO: 69152 - protein, 9 aa, Homo Sapiens
VIPKKKDKV

SEQ ID NO: 69153 - protein, 9 aa, Homo Sapiens
PFDRIMERG

SEQ ID NO: 69154 - protein, 9 aa, Homo Sapiens
SGKKQANGQ

SEQ ID NO: 69155 - protein, 9 aa, Homo Sapiens
ISNPVYRIQ

SEQ ID NO: 69156 - protein, 9 aa, Homo Sapiens
HNEMDEPIF

SEQ ID NO: 69157 - protein, 9 aa, Homo Sapiens
GVWDMGGKQ

SEQ ID NO: 69158 - protein, 9 aa, Homo Sapiens
PSAVRGMSP

SEQ ID NO: 69159 - protein, 9 aa, Homo Sapiens
ENEVVFRGF

SEQ ID NO: 69160 - protein, 9 aa, Homo Sapiens
AIVGHEFTH

SEQ ID NO: 69161 - protein, 9 aa, Homo Sapiens
IRLTAWCCI

SEQ ID NO: 69162 - protein, 9 aa, Homo Sapiens
ISLEQRKRS

SEQ ID NO: 69163 - protein, 9 aa, Homo Sapiens
VELSSTDSS

SEQ ID NO: 69164 - protein, 9 aa, Homo Sapiens
ALHPSHTDP

SEQ ID NO: 69165 - protein, 9 aa, Homo Sapiens
YFYMAPEVW

SEQ ID NO: 69166 - protein, 9 aa, Homo Sapiens
SLTASGFPW

SEQ ID NO: 69167 - protein, 9 aa, Homo Sapiens
YGAIGAIVG

SEQ ID NO: 69168 - protein, 9 aa, Homo Sapiens
KLFHLQKEL

SEQ ID NO: 69169 - protein, 9 aa, Homo Sapiens
TFHPDPSQV

SEQ ID NO: 69170 - protein, 9 aa, Homo Sapiens
LQIQLHLSH

SEQ ID NO: 69171 - protein, 9 aa, Homo Sapiens
GKKMLSLTH

SEQ ID NO: 69172 - protein, 9 aa, Homo Sapiens
RPWAKENMY

SEQ ID NO: 69173 - protein, 9 aa, Homo Sapiens
GYVNYGNFE

SEQ ID NO: 69174 - protein, 8 aa, Homo Sapiens
TLRCGSQK

SEQ ID NO: 69175 - protein, 9 aa, Homo Sapiens
HLSHPITTS

SEQ ID NO: 69176 - protein, 9 aa, Homo Sapiens
FLESGSISL

SEQ ID NO: 69177 - protein, 9 aa, Homo Sapiens
REKCSTAVD

SEQ ID NO: 69178 - protein, 9 aa, Homo Sapiens
NMYHALGYS

SEQ ID NO: 69179 - protein, 9 aa, Homo Sapiens
PWPTPWRRF

SEQ ID NO: 69180 - protein, 9 aa, Homo Sapiens
KRSDKNSSF

SEQ ID NO: 69181 - protein, 9 aa, Homo Sapiens
RYIKRKTWV

SEQ ID NO: 69182 - protein, 9 aa, Homo Sapiens
VAVRAICVM

SEQ ID NO: 69183 - protein, 9 aa, Homo Sapiens
SACGSYFYM

SEQ ID NO: 69184 - protein, 9 aa, Homo Sapiens
YIITLVLVN

SEQ ID NO: 69185 - protein, 9 aa, Homo Sapiens
PPSSREGTL

SEQ ID NO: 69186 - protein, 9 aa, Homo Sapiens
VLTNDSPSV

SEQ ID NO: 69187 - protein, 9 aa, Homo Sapiens
RDKDSDLAL

SEQ ID NO: 69188 - protein, 9 aa, Homo Sapiens
FELATVDYL

SEQ ID NO: 69189 - protein, 9 aa, Homo Sapiens
VISVTVHAS

SEQ ID NO: 69190 - protein, 9 aa, Homo Sapiens
HTNIHDKLS

SEQ ID NO: 69191 - protein, 9 aa, Homo Sapiens
EQILQLAVR

SEQ ID NO: 69192 - protein, 9 aa, Homo Sapiens
TNDSPSVGG

SEQ ID NO: 69193 - protein, 9 aa, Homo Sapiens
PLSVGVAHV

SEQ ID NO: 69194 - protein, 9 aa, Homo Sapiens
NNGARLTSE

SEQ ID NO: 69195 - protein, 9 aa, Homo Sapiens
GMFKLFHLQ

SEQ ID NO: 69196 - protein, 9 aa, Homo Sapiens
FFDETRQLC

SEQ ID NO: 69197 - protein, 9 aa, Homo Sapiens
MQEQEEKIG

SEQ ID NO: 69198 - protein, 9 aa, Homo Sapiens
RNPGCPFTL

SEQ ID NO: 69199 - protein, 9 aa, Homo Sapiens
TPWRRFWKR

SEQ ID NO: 69200 - protein, 9 aa, Homo Sapiens
TTAMKCRNP

SEQ ID NO: 69201 - protein, 9 aa, Homo Sapiens
AQPLSVGVA

SEQ ID NO: 69202 - protein, 9 aa, Homo Sapiens
DPEAHKLTE

SEQ ID NO: 69203 - protein, 9 aa, Homo Sapiens
PTPWRRFWK

SEQ ID NO: 69204 - protein, 9 aa, Homo Sapiens
ESLLRARQL

SEQ ID NO: 69205 - protein, 9 aa, Homo Sapiens
TDPVTVTGH

SEQ ID NO: 69206 - protein, 9 aa, Homo Sapiens
AQPNRTMHA

SEQ ID NO: 69207 - protein, 9 aa, Homo Sapiens
LGELGAQPN

SEQ ID NO: 69208 - protein, 9 aa, Homo Sapiens
SLSEEQILQ

SEQ ID NO: 69209 - protein, 9 aa, Homo Sapiens
ASTERTPVT

SEQ ID NO: 69210 - protein, 9 aa, Homo Sapiens
SPVVASGGK

SEQ ID NO: 69211 - protein, 9 aa, Homo Sapiens
AVTSDEDQG

SEQ ID NO: 69212 - protein, 9 aa, Homo Sapiens
CYGASLLHT

SEQ ID NO: 69213 - protein, 9 aa, Homo Sapiens
DVLTNDSPS

SEQ ID NO: 69214 - protein, 9 aa, Homo Sapiens
PGAAACPSA

SEQ ID NO: 69215 - protein, 9 aa, Homo Sapiens
PQWKISIQQ

SEQ ID NO: 69216 - protein, 9 aa, Homo Sapiens
ELSSTDSSL

SEQ ID NO: 69217 - protein, 9 aa, Homo Sapiens
MDLPWTSVS

SEQ ID NO: 69218 - protein, 9 aa, Homo Sapiens
HTLRQCYGA

SEQ ID NO: 69219 - protein, 9 aa, Homo Sapiens
HPGPCQRTW

SEQ ID NO: 69220 - protein, 9 aa, Homo Sapiens
FKAADELTK

SEQ ID NO: 69221 - protein, 9 aa, Homo Sapiens
YFPINNTSF

SEQ ID NO: 69222 - protein, 9 aa, Homo Sapiens
SLSYGAIGA

SEQ ID NO: 69223 - protein, 9 aa, Homo Sapiens
ETRQLCDLR

SEQ ID NO: 69224 - protein, 9 aa, Homo Sapiens
KNYYYSEPG

SEQ ID NO: 69225 - protein, 9 aa, Homo Sapiens
TVQKIACTT

SEQ ID NO: 69226 - protein, 9 aa, Homo Sapiens
KENMYHALG

SEQ ID NO: 69227 - protein, 9 aa, Homo Sapiens
HPDPSQVEL

SEQ ID NO: 69228 - protein, 9 aa, Homo Sapiens
IRYWVLQFV

SEQ ID NO: 69229 - protein, 9 aa, Homo Sapiens
SFKAADELT

SEQ ID NO: 69230 - protein, 9 aa, Homo Sapiens
HSPLQIQLH

SEQ ID NO: 69231 - protein, 9 aa, Homo Sapiens
GPGAAACPS

SEQ ID NO: 69232 - protein, 9 aa, Homo Sapiens
DPQWKISIQ

SEQ ID NO: 69233 - protein, 9 aa, Homo Sapiens
HLILLTSLL

SEQ ID NO: 69234 - protein, 9 aa, Homo Sapiens
FPQEYFLFQ

SEQ ID NO: 69235 - protein, 9 aa, Homo Sapiens
RYRDKDSDL

SEQ ID NO: 69236 - protein, 9 aa, Homo Sapiens
QTFRKMESS

SEQ ID NO: 69237 - protein, 9 aa, Homo Sapiens
AAFVYTVKY

SEQ ID NO: 69238 - protein, 9 aa, Homo Sapiens
LPDPQWKIS

SEQ ID NO: 69239 - protein, 9 aa, Homo Sapiens
LTQPFYFLF

SEQ ID NO: 69240 - protein, 9 aa, Homo Sapiens
VVERRYIKR

SEQ ID NO: 69241 - protein, 9 aa, Homo Sapiens
ARLTSEVSG

SEQ ID NO: 69242 - protein, 9 aa, Homo Sapiens
QEQEEKIGE

SEQ ID NO: 69243 - protein, 9 aa, Homo Sapiens
MFKLFHLQK

SEQ ID NO: 69244 - protein, 9 aa, Homo Sapiens
CVASEIMAV

SEQ ID NO: 69245 - protein, 9 aa, Homo Sapiens
CHLQQVMDL

SEQ ID NO: 69246 - protein, 9 aa, Homo Sapiens
EEPHTNIHD

SEQ ID NO: 69247 - protein, 9 aa, Homo Sapiens
VCDDALDLR

SEQ ID NO: 69248 - protein, 9 aa, Homo Sapiens
ATSLPMSLA

SEQ ID NO: 69249 - protein, 9 aa, Homo Sapiens
HISSMNTTP

SEQ ID NO: 69250 - protein, 9 aa, Homo Sapiens
IALSKYGWV

SEQ ID NO: 69251 - protein, 9 aa, Homo Sapiens
LTECIPFSI

SEQ ID NO: 69252 - protein, 9 aa, Homo Sapiens
VVEALTTSQ

SEQ ID NO: 69253 - protein, 9 aa, Homo Sapiens
KSVNEVLEW

SEQ ID NO: 69254 - protein, 9 aa, Homo Sapiens
GPPSSREGT

SEQ ID NO: 69255 - protein, 9 aa, Homo Sapiens
INNYYLAER

SEQ ID NO: 69256 - protein, 9 aa, Homo Sapiens
YKNYYYSEP

SEQ ID NO: 69257 - protein, 9 aa, Homo Sapiens
SQRTERKDP

SEQ ID NO: 69258 - protein, 9 aa, Homo Sapiens
GEWLQVLGC

SEQ ID NO: 69259 - protein, 9 aa, Homo Sapiens
DIVYSLITS

SEQ ID NO: 69260 - protein, 9 aa, Homo Sapiens
SSATSTLGS

SEQ ID NO: 69261 - protein, 9 aa, Homo Sapiens
AICIDKKDE

SEQ ID NO: 69262 - protein, 9 aa, Homo Sapiens
NRTMHAGPG

SEQ ID NO: 69263 - protein, 9 aa, Homo Sapiens
IRPYTAVTS

SEQ ID NO: 69264 - protein, 9 aa, Homo Sapiens
HILTQPFYF

SEQ ID NO: 69265 - protein, 9 aa, Homo Sapiens
VFGGSLHSS

SEQ ID NO: 69266 - protein, 9 aa, Homo Sapiens
TVCDDALDL

SEQ ID NO: 69267 - protein, 9 aa, Homo Sapiens
EGQTVQKIA

SEQ ID NO: 69268 - protein, 9 aa, Homo Sapiens
IGEQEEKMQ

SEQ ID NO: 69269 - protein, 9 aa, Homo Sapiens
RMGTDWIGD

SEQ ID NO: 69270 - protein, 9 aa, Homo Sapiens
NPESLSAVF

SEQ ID NO: 69271 - protein, 9 aa, Homo Sapiens
PNRTMHAGP

SEQ ID NO: 69272 - protein, 9 aa, Homo Sapiens
SPEVYFVAV

SEQ ID NO: 69273 - protein, 9 aa, Homo Sapiens
SLTHLFLVF

SEQ ID NO: 69274 - protein, 9 aa, Homo Sapiens
SHTDPVTVT

SEQ ID NO: 69275 - protein, 9 aa, Homo Sapiens
SSLKQQQLC

SEQ ID NO: 69276 - protein, 9 aa, Homo Sapiens
KRRDKTRIF

SEQ ID NO: 69277 - protein, 9 aa, Homo Sapiens
AGPGAAACP

SEQ ID NO: 69278 - protein, 9 aa, Homo Sapiens
WKISIQQKT

SEQ ID NO: 69279 - protein, 9 aa, Homo Sapiens
GTDWIGDDL

SEQ ID NO: 69280 - protein, 9 aa, Homo Sapiens
TDWIGDDLR

SEQ ID NO: 69281 - protein, 9 aa, Homo Sapiens
LHSSLYHLI

SEQ ID NO: 69282 - protein, 9 aa, Homo Sapiens
PHTNIHDKL

SEQ ID NO: 69283 - protein, 9 aa, Homo Sapiens
VLCSFQNQI

SEQ ID NO: 69284 - protein, 9 aa, Homo Sapiens
KIGEQEEKM

SEQ ID NO: 69285 - protein, 9 aa, Homo Sapiens
ALPITRPGS

SEQ ID NO: 69286 - protein, 9 aa, Homo Sapiens
PITTSCSIP

SEQ ID NO: 69287 - protein, 9 aa, Homo Sapiens
HKLTEECVL

SEQ ID NO: 69288 - protein, 9 aa, Homo Sapiens
CSKDVTFHP

SEQ ID NO: 69289 - protein, 9 aa, Homo Sapiens
GAMHLNHLS

SEQ ID NO: 69290 - protein, 9 aa, Homo Sapiens
VTFHPDPSQ

SEQ ID NO: 69291 - protein, 9 aa, Homo Sapiens
CFHNIGEIC

SEQ ID NO: 69292 - protein, 9 aa, Homo Sapiens
PKTDTTVSG

SEQ ID NO: 69293 - protein, 9 aa, Homo Sapiens
FTIRCGFLE

SEQ ID NO: 69294 - protein, 9 aa, Homo Sapiens
NSNAVTGLR

SEQ ID NO: 69295 - protein, 9 aa, Homo Sapiens
GSLHSSLYH

SEQ ID NO: 69296 - protein, 9 aa, Homo Sapiens
YTDLNSNAV

SEQ ID NO: 69297 - protein, 9 aa, Homo Sapiens
QIQLHLSHP

SEQ ID NO: 69298 - protein, 9 aa, Homo Sapiens
KGPPSSREG

SEQ ID NO: 69299 - protein, 9 aa, Homo Sapiens
FAAFVYTVK

SEQ ID NO: 69300 - protein, 9 aa, Homo Sapiens
KIYDLHKKT

SEQ ID NO: 69301 - protein, 9 aa, Homo Sapiens
TDENEVVFR

SEQ ID NO: 69302 - protein, 9 aa, Homo Sapiens
LSTSSSATS

SEQ ID NO: 69303 - protein, 9 aa, Homo Sapiens
RGRLRVHVL

SEQ ID NO: 69304 - protein, 9 aa, Homo Sapiens
EKKEKCEDY

SEQ ID NO: 69305 - protein, 9 aa, Homo Sapiens
QFVFVSTPT

SEQ ID NO: 69306 - protein, 9 aa, Homo Sapiens
GIEIKAIDE

SEQ ID NO: 69307 - protein, 9 aa, Homo Sapiens
IGYVVERRY

SEQ ID NO: 69308 - protein, 9 aa, Homo Sapiens
QLCDLRLFQ

SEQ ID NO: 69309 - protein, 9 aa, Homo Sapiens
PEYTTFYSR

SEQ ID NO: 69310 - protein, 9 aa, Homo Sapiens
FLGCRQYVS

SEQ ID NO: 69311 - protein, 9 aa, Homo Sapiens
SANHQARVT

SEQ ID NO: 69312 - protein, 9 aa, Homo Sapiens
PEAHKLTEE

SEQ ID NO: 69313 - protein, 9 aa, Homo Sapiens
CAVECNFGQ

SEQ ID NO: 69314 - protein, 9 aa, Homo Sapiens
KISNPVYRI

SEQ ID NO: 69315 - protein, 9 aa, Homo Sapiens
QGLDTTPNP

SEQ ID NO: 69316 - protein, 9 aa, Homo Sapiens
NAARHTGAM

SEQ ID NO: 69317 - protein, 9 aa, Homo Sapiens
VHASLVALQ

SEQ ID NO: 69318 - protein, 9 aa, Homo Sapiens
KAEKKEKCE

SEQ ID NO: 69319 - protein, 9 aa, Homo Sapiens
HAKARVMPP

SEQ ID NO: 69320 - protein, 9 aa, Homo Sapiens
HAGPGAAAC

SEQ ID NO: 69321 - protein, 9 aa, Homo Sapiens
RKMESSLKQ

SEQ ID NO: 69322 - protein, 9 aa, Homo Sapiens
IPKKKDKVA

SEQ ID NO: 69323 - protein, 9 aa, Homo Sapiens
HNIGEICTK

SEQ ID NO: 69324 - protein, 9 aa, Homo Sapiens
RLRHDNTGK

SEQ ID NO: 69325 - protein, 9 aa, Homo Sapiens
SPWPTPWRR

SEQ ID NO: 69326 - protein, 9 aa, Homo Sapiens
YYIITLVLV

SEQ ID NO: 69327 - protein, 9 aa, Homo Sapiens
IIRERYRDK

SEQ ID NO: 69328 - protein, 9 aa, Homo Sapiens
ENMYHALGY

SEQ ID NO: 69329 - protein, 9 aa, Homo Sapiens
MHAGPGAAA

SEQ ID NO: 69330 - protein, 9 aa, Homo Sapiens
LTNDSPSVG

SEQ ID NO: 69331 - protein, 9 aa, Homo Sapiens
CKDINNYYL

SEQ ID NO: 69332 - protein, 9 aa, Homo Sapiens
LLCSKDVTF

SEQ ID NO: 69333 - protein, 9 aa, Homo Sapiens
PNQGVWDMG

SEQ ID NO: 69334 - protein, 9 aa, Homo Sapiens
AIGAIVGHE

SEQ ID NO: 69335 - protein, 9 aa, Homo Sapiens
LATVDYLFE

SEQ ID NO: 69336 - protein, 9 aa, Homo Sapiens
SGTQKSQRT

SEQ ID NO: 69337 - protein, 9 aa, Homo Sapiens
NLSTSSSAT

SEQ ID NO: 69338 - protein, 9 aa, Homo Sapiens
ILQLAVRWL

SEQ ID NO: 69339 - protein, 9 aa, Homo Sapiens
AVECNFGQK

SEQ ID NO: 69340 - protein, 9 aa, Homo Sapiens
SHSPLQIQL

SEQ ID NO: 69341 - protein, 9 aa, Homo Sapiens
TPVTLHLDG

SEQ ID NO: 69342 - protein, 9 aa, Homo Sapiens
YIALSKYGW

SEQ ID NO: 69343 - protein, 9 aa, Homo Sapiens
RRFWKRVRS

SEQ ID NO: 69344 - protein, 9 aa, Homo Sapiens
NEMDEPIFT

SEQ ID NO: 69345 - protein, 9 aa, Homo Sapiens
DDALDLRAA

SEQ ID NO: 69346 - protein, 9 aa, Homo Sapiens
ITLVLVNGN

SEQ ID NO: 69347 - protein, 9 aa, Homo Sapiens
VHVLENSSR

SEQ ID NO: 69348 - protein, 9 aa, Homo Sapiens
ISSMNTTPL

SEQ ID NO: 69349 - protein, 9 aa, Homo Sapiens
SSMNTTPLP

SEQ ID NO: 69350 - protein, 9 aa, Homo Sapiens
AASTERTPV

SEQ ID NO: 69351 - protein, 9 aa, Homo Sapiens
LVLVNGNVV

SEQ ID NO: 69352 - protein, 9 aa, Homo Sapiens
GCRQYVSLH

SEQ ID NO: 69353 - protein, 9 aa, Homo Sapiens
GMYRRLFKP

SEQ ID NO: 69354 - protein, 9 aa, Homo Sapiens
DLWKVRLRH

SEQ ID NO: 69355 - protein, 9 aa, Homo Sapiens
SDTKWEPMC

SEQ ID NO: 69356 - protein, 9 aa, Homo Sapiens
LRPWAKENM

SEQ ID NO: 69357 - protein, 9 aa, Homo Sapiens
SPSGESLLR

SEQ ID NO: 69358 - protein, 9 aa, Homo Sapiens
LPMSLASLT

SEQ ID NO: 69359 - protein, 9 aa, Homo Sapiens
AVRGMSPWP

SEQ ID NO: 69360 - protein, 9 aa, Homo Sapiens
KYTDLNSNA

SEQ ID NO: 69361 - protein, 9 aa, Homo Sapiens
FPWVLLCSK

SEQ ID NO: 69362 - protein, 9 aa, Homo Sapiens
RKDPATSLP

SEQ ID NO: 69363 - protein, 9 aa, Homo Sapiens
YVKALEYVI

SEQ ID NO: 69364 - protein, 9 aa, Homo Sapiens
VLQFVFVST

SEQ ID NO: 69365 - protein, 9 aa, Homo Sapiens
RCKCSDTKW

SEQ ID NO: 69366 - protein, 9 aa, Homo Sapiens
HASLVALQQ

SEQ ID NO: 69367 - protein, 9 aa, Homo Sapiens
NNYYLAERS

SEQ ID NO: 69368 - protein, 9 aa, Homo Sapiens
TCHWNGKKM

SEQ ID NO: 69369 - protein, 9 aa, Homo Sapiens
EKVPDIIVI

SEQ ID NO: 69370 - protein, 9 aa, Homo Sapiens
ELGAQPNRT

SEQ ID NO: 69371 - protein, 9 aa, Homo Sapiens
AYKNYYYSE

SEQ ID NO: 69372 - protein, 9 aa, Homo Sapiens
HLKRSVKSV

SEQ ID NO: 69373 - protein, 9 aa, Homo Sapiens
RRMGTDWIG

SEQ ID NO: 69374 - protein, 9 aa, Homo Sapiens
PHPGPCQRT

SEQ ID NO: 69375 - protein, 9 aa, Homo Sapiens
SIPSTVNVI

SEQ ID NO: 69376 - protein, 9 aa, Homo Sapiens
AFCEGQTVQ

SEQ ID NO: 69377 - protein, 9 aa, Homo Sapiens
MSLASLTAS

SEQ ID NO: 69378 - protein, 9 aa, Homo Sapiens
KCSTAVDIS

SEQ ID NO: 69379 - protein, 9 aa, Homo Sapiens
MPHPGPCQR

SEQ ID NO: 69380 - protein, 9 aa, Homo Sapiens
VLVLLMAAL

SEQ ID NO: 69381 - protein, 9 aa, Homo Sapiens
MPDTHLKGP

SEQ ID NO: 69382 - protein, 9 aa, Homo Sapiens
YEDEGFQSR

SEQ ID NO: 69383 - protein, 9 aa, Homo Sapiens
GFPWVLLCS

SEQ ID NO: 69384 - protein, 9 aa, Homo Sapiens
QVAALQQEK

SEQ ID NO: 69385 - protein, 9 aa, Homo Sapiens
SGGKMTLRC

SEQ ID NO: 69386 - protein, 9 aa, Homo Sapiens
VFGVADVDY

SEQ ID NO: 69387 - protein, 9 aa, Homo Sapiens
WYIRGQAIC

SEQ ID NO: 69388 - protein, 9 aa, Homo Sapiens
RKRSDKNSS

SEQ ID NO: 69389 - protein, 9 aa, Homo Sapiens
KKMLSLTHL

SEQ ID NO: 69390 - protein, 9 aa, Homo Sapiens
MMQEQEEKI

SEQ ID NO: 69391 - protein, 9 aa, Homo Sapiens
IDIVYSLIT

SEQ ID NO: 69392 - protein, 9 aa, Homo Sapiens
VLFLVSRFI

SEQ ID NO: 69393 - protein, 9 aa, Homo Sapiens
TNDLRYIEM

SEQ ID NO: 69394 - protein, 9 aa, Homo Sapiens
VYTVKYVLR

SEQ ID NO: 69395 - protein, 9 aa, Homo Sapiens
EEQILQLAV

SEQ ID NO: 69396 - protein, 9 aa, Homo Sapiens
KTSCNLDEQ

SEQ ID NO: 69397 - protein, 9 aa, Homo Sapiens
CGFLESGSI

SEQ ID NO: 69398 - protein, 9 aa, Homo Sapiens
LYYIITLVL

SEQ ID NO: 69399 - protein, 9 aa, Homo Sapiens
PGPCQRTWK

SEQ ID NO: 69400 - protein, 9 aa, Homo Sapiens
LHKKTSCNL

SEQ ID NO: 69401 - protein, 9 aa, Homo Sapiens
GWVKRGSKV

SEQ ID NO: 69402 - protein, 9 aa, Homo Sapiens
MGGKQFYAG

SEQ ID NO: 69403 - protein, 9 aa, Homo Sapiens
NSRCKCSDT

SEQ ID NO: 69404 - protein, 9 aa, Homo Sapiens
LEVFGGSLH

SEQ ID NO: 69405 - protein, 9 aa, Homo Sapiens
GRKRTVKDL

SEQ ID NO: 69406 - protein, 9 aa, Homo Sapiens
RLTAWCCIL

SEQ ID NO: 69407 - protein, 9 aa, Homo Sapiens
PQGLDTTPN

SEQ ID NO: 69408 - protein, 9 aa, Homo Sapiens
CVMKSFLIF

SEQ ID NO: 69409 - protein, 9 aa, Homo Sapiens
PWVLLCSKD

SEQ ID NO: 69410 - protein, 9 aa, Homo Sapiens
VPSEQVVEA

SEQ ID NO: 69411 - protein, 9 aa, Homo Sapiens
DTKWEPMCG

SEQ ID NO: 69412 - protein, 9 aa, Homo Sapiens
FVAVRAICV

SEQ ID NO: 69413 - protein, 9 aa, Homo Sapiens
RSVKSVILV

SEQ ID NO: 69414 - protein, 9 aa, Homo Sapiens
QLHLSHPIT

SEQ ID NO: 69415 - protein, 9 aa, Homo Sapiens
FRRWKSHSP

SEQ ID NO: 69416 - protein, 9 aa, Homo Sapiens
QRKRSDKNS

SEQ ID NO: 69417 - protein, 9 aa, Homo Sapiens
PNNGARLTS

SEQ ID NO: 69418 - protein, 9 aa, Homo Sapiens
SHAKARVMP

SEQ ID NO: 69419 - protein, 9 aa, Homo Sapiens
AFVYTVKYV

SEQ ID NO: 69420 - protein, 9 aa, Homo Sapiens
FLHLKRSVK

SEQ ID NO: 69421 - protein, 9 aa, Homo Sapiens
DLQKKTNDL

SEQ ID NO: 69422 - protein, 9 aa, Homo Sapiens
TQPFYFLFF

SEQ ID NO: 69423 - protein, 9 aa, Homo Sapiens
KPLRVPPDL

SEQ ID NO: 69424 - protein, 9 aa, Homo Sapiens
TSCSIPWCH

SEQ ID NO: 69425 - protein, 9 aa, Homo Sapiens
GHNEMDEPI

SEQ ID NO: 69426 - protein, 9 aa, Homo Sapiens
LQKKTNDLR

SEQ ID NO: 69427 - protein, 9 aa, Homo Sapiens
LCSKDVTFH

SEQ ID NO: 69428 - protein, 9 aa, Homo Sapiens
ICVASEIMA

SEQ ID NO: 69429 - protein, 9 aa, Homo Sapiens
NNTSFPQEY

SEQ ID NO: 69430 - protein, 9 aa, Homo Sapiens
KDINNYYLA

SEQ ID NO: 69431 - protein, 9 aa, Homo Sapiens
KCEDYKEGG

SEQ ID NO: 69432 - protein, 9 aa, Homo Sapiens
SSACGSYFY

SEQ ID NO: 69433 - protein, 9 aa, Homo Sapiens
RPYTAVTSD

SEQ ID NO: 69434 - protein, 9 aa, Homo Sapiens
AMKCRNPGC

SEQ ID NO: 69435 - protein, 9 aa, Homo Sapiens
VRAICVMKS

SEQ ID NO: 69436 - protein, 9 aa, Homo Sapiens
ICTKSLTDA

SEQ ID NO: 69437 - protein, 9 aa, Homo Sapiens
TSTLGSPEN

SEQ ID NO: 69438 - protein, 9 aa, Homo Sapiens
CSDTKWEPM

SEQ ID NO: 69439 - protein, 9 aa, Homo Sapiens
PSRSEFSKH

SEQ ID NO: 69440 - protein, 9 aa, Homo Sapiens
RSEFSKHLK

SEQ ID NO: 69441 - protein, 9 aa, Homo Sapiens
GFLESGSIS

SEQ ID NO: 69442 - protein, 9 aa, Homo Sapiens
FLVSRFIHM

SEQ ID NO: 69443 - protein, 9 aa, Homo Sapiens
RTAQFDICV

SEQ ID NO: 69444 - protein, 9 aa, Homo Sapiens
LRVHVLENS

SEQ ID NO: 69445 - protein, 9 aa, Homo Sapiens
TFRKMESSL

SEQ ID NO: 69446 - protein, 9 aa, Homo Sapiens
TRPGSPPGW

SEQ ID NO: 69447 - protein, 9 aa, Homo Sapiens
HNCAVECNF

SEQ ID NO: 69448 - protein, 9 aa, Homo Sapiens
SGTGRKRTV

SEQ ID NO: 69449 - protein, 9 aa, Homo Sapiens
IHMSGTQKS

SEQ ID NO: 69450 - protein, 9 aa, Homo Sapiens
MNTTPLPRP

SEQ ID NO: 69451 - protein, 9 aa, Homo Sapiens
YVVERRYIK

SEQ ID NO: 69452 - protein, 9 aa, Homo Sapiens
FCEGQTVQK

SEQ ID NO: 69453 - protein, 9 aa, Homo Sapiens
WDMGGKQFY

SEQ ID NO: 69454 - protein, 9 aa, Homo Sapiens
QKSQRTERK

SEQ ID NO: 69455 - protein, 9 aa, Homo Sapiens
YIKRKTWVL

SEQ ID NO: 69456 - protein, 9 aa, Homo Sapiens
YRIQHKIVT

SEQ ID NO: 69457 - protein, 9 aa, Homo Sapiens
TSLSEEQIL

SEQ ID NO: 69458 - protein, 9 aa, Homo Sapiens
PIFTQPLMY

SEQ ID NO: 69459 - protein, 9 aa, Homo Sapiens
QVIPKKKDK

SEQ ID NO: 69460 - protein, 9 aa, Homo Sapiens
TISLEQRKR

SEQ ID NO: 69461 - protein, 9 aa, Homo Sapiens
GKMTLRCGS

SEQ ID NO: 69462 - protein, 9 aa, Homo Sapiens
RLFKPLRVP

SEQ ID NO: 69463 - protein, 9 aa, Homo Sapiens
QGVWDMGGK

SEQ ID NO: 69464 - protein, 9 aa, Homo Sapiens
GFSVFVFGV

SEQ ID NO: 69465 - protein, 9 aa, Homo Sapiens
KCSDTKWEP

SEQ ID NO: 69466 - protein, 9 aa, Homo Sapiens
RVMPPEGYD

SEQ ID NO: 69467 - protein, 9 aa, Homo Sapiens
ETTAMKCRN

SEQ ID NO: 69468 - protein, 9 aa, Homo Sapiens
QWKISIQQK

SEQ ID NO: 69469 - protein, 9 aa, Homo Sapiens
ALEYVIKVS

SEQ ID NO: 69470 - protein, 9 aa, Homo Sapiens
ERRYIKRKT

SEQ ID NO: 69471 - protein, 9 aa, Homo Sapiens
SLVIRPYTA

SEQ ID NO: 69472 - protein, 9 aa, Homo Sapiens
TAVDISENL

SEQ ID NO: 69473 - protein, 9 aa, Homo Sapiens
DLHKKTSCN

SEQ ID NO: 69474 - protein, 9 aa, Homo Sapiens
QPNRTMHAG

SEQ ID NO: 69475 - protein, 9 aa, Homo Sapiens
DLPDPQWKI

SEQ ID NO: 69476 - protein, 9 aa, Homo Sapiens
RKRTVKDLQ

SEQ ID NO: 69477 - protein, 9 aa, Homo Sapiens
LATAQPLSV

SEQ ID NO: 69478 - protein, 9 aa, Homo Sapiens
QHPKTDTTV

SEQ ID NO: 69479 - protein, 9 aa, Homo Sapiens
SREKCSTAV

SEQ ID NO: 69480 - protein, 9 aa, Homo Sapiens
LTDENEVVF

SEQ ID NO: 69481 - protein, 9 aa, Homo Sapiens
CTSGKKQAN

SEQ ID NO: 69482 - protein, 9 aa, Homo Sapiens
SSLYHLILL

SEQ ID NO: 69483 - protein, 9 aa, Homo Sapiens
EVALCEENM

SEQ ID NO: 69484 - protein, 9 aa, Homo Sapiens
NYYLAERSI

SEQ ID NO: 69485 - protein, 9 aa, Homo Sapiens
LRQCYGASL

SEQ ID NO: 69486 - protein, 9 aa, Homo Sapiens
TAYKNYYYS

SEQ ID NO: 69487 - protein, 9 aa, Homo Sapiens
TGGEPFDRI

SEQ ID NO: 69488 - protein, 9 aa, Homo Sapiens
DWIGDDLRD

SEQ ID NO: 69489 - protein, 9 aa, Homo Sapiens
LQLAVRWLE

SEQ ID NO: 69490 - protein, 9 aa, Homo Sapiens
SQHPKTDTT

SEQ ID NO: 69491 - protein, 9 aa, Homo Sapiens
SLEQRKRSD

SEQ ID NO: 69492 - protein, 9 aa, Homo Sapiens
CPSAVRGMS

SEQ ID NO: 69493 - protein, 9 aa, Homo Sapiens
WQVIPKKKD

SEQ ID NO: 69494 - protein, 9 aa, Homo Sapiens
WVKRGSKVS

SEQ ID NO: 69495 - protein, 9 aa, Homo Sapiens
FHNIGEICT

SEQ ID NO: 69496 - protein, 9 aa, Homo Sapiens
NIMAKMARP

SEQ ID NO: 69497 - protein, 9 aa, Homo Sapiens
DEGFQSRQF

SEQ ID NO: 69498 - protein, 9 aa, Homo Sapiens
LSSQHPKTD

SEQ ID NO: 69499 - protein, 9 aa, Homo Sapiens
LHLKRSVKS

SEQ ID NO: 69500 - protein, 9 aa, Homo Sapiens
VWDMGGKQF

SEQ ID NO: 69501 - protein, 9 aa, Homo Sapiens
GPEYTTFYS

SEQ ID NO: 69502 - protein, 9 aa, Homo Sapiens
HKKTSCNLD

SEQ ID NO: 69503 - protein, 9 aa, Homo Sapiens
WLQVLGCGV

SEQ ID NO: 69504 - protein, 9 aa, Homo Sapiens
SEFSKHLKE

SEQ ID NO: 69505 - protein, 9 aa, Homo Sapiens
MPPEGYDVV

SEQ ID NO: 69506 - protein, 9 aa, Homo Sapiens
TLVLVNGNV

SEQ ID NO: 69507 - protein, 9 aa, Homo Sapiens
LQQEKSSLL

SEQ ID NO: 69508 - protein, 9 aa, Homo Sapiens
KTDTTVSGD

SEQ ID NO: 69509 - protein, 9 aa, Homo Sapiens
INNTSFPQE

SEQ ID NO: 69510 - protein, 9 aa, Homo Sapiens
MIGNIMAKM

SEQ ID NO: 69511 - protein, 9 aa, Homo Sapiens
LSVGVAHVV

SEQ ID NO: 69512 - protein, 9 aa, Homo Sapiens
YFMITPGVF

SEQ ID NO: 69513 - protein, 9 aa, Homo Sapiens
TSLPMSLAS

SEQ ID NO: 69514 - protein, 9 aa, Homo Sapiens
SCTNITMGV

SEQ ID NO: 69515 - protein, 9 aa, Homo Sapiens
PGVFKEKVS

SEQ ID NO: 69516 - protein, 9 aa, Homo Sapiens
SSTDSSLLL

SEQ ID NO: 69517 - protein, 9 aa, Homo Sapiens
TAQPLSVGV

SEQ ID NO: 69518 - protein, 9 aa, Homo Sapiens
PWAKENMYH

SEQ ID NO: 69519 - protein, 9 aa, Homo Sapiens
LMSPLDQSG

SEQ ID NO: 69520 - protein, 9 aa, Homo Sapiens
WVLQFVFVS

SEQ ID NO: 69521 - protein, 9 aa, Homo Sapiens
VIDSFMIGN

SEQ ID NO: 69522 - protein, 9 aa, Homo Sapiens
RERYRDKDS

SEQ ID NO: 69523 - protein, 9 aa, Homo Sapiens
RHDNTGKAP

SEQ ID NO: 69524 - protein, 9 aa, Homo Sapiens
STDSSLLLK

SEQ ID NO: 69525 - protein, 9 aa, Homo Sapiens
LILLTSLLS

SEQ ID NO: 69526 - protein, 9 aa, Homo Sapiens
HLKGPPSSR

SEQ ID NO: 69527 - protein, 9 aa, Homo Sapiens
NIVELSSTD

SEQ ID NO: 69528 - protein, 9 aa, Homo Sapiens
MITPGVFKE

SEQ ID NO: 69529 - protein, 9 aa, Homo Sapiens
NSGLWRPGS

SEQ ID NO: 69530 - protein, 9 aa, Homo Sapiens
FPINNTSFP

SEQ ID NO: 69531 - protein, 9 aa, Homo Sapiens
TASGFPWVL

SEQ ID NO: 69532 - protein, 9 aa, Homo Sapiens
TVKDLQEEV

SEQ ID NO: 69533 - protein, 9 aa, Homo Sapiens
LMAALYQVL

SEQ ID NO: 69534 - protein, 9 aa, Homo Sapiens
EPIFTQPLM

SEQ ID NO: 69535 - protein, 9 aa, Homo Sapiens
STAVDISEN

SEQ ID NO: 69536 - protein, 9 aa, Homo Sapiens
HDKLSKKNS

SEQ ID NO: 69537 - protein, 9 aa, Homo Sapiens
GDLMSPLDQ

SEQ ID NO: 69538 - protein, 9 aa, Homo Sapiens
MQVAALQQE

SEQ ID NO: 69539 - protein, 9 aa, Homo Sapiens
EVVFRGFYS

SEQ ID NO: 69540 - protein, 9 aa, Homo Sapiens
DKTRIFCHP

SEQ ID NO: 69541 - protein, 9 aa, Homo Sapiens
TDTTVSGDT

SEQ ID NO: 69542 - protein, 9 aa, Homo Sapiens
LVLLMAALY

SEQ ID NO: 69543 - protein, 9 aa, Homo Sapiens
KRTVKDLQE

SEQ ID NO: 69544 - protein, 9 aa, Homo Sapiens
VLLMAALYQ

SEQ ID NO: 69545 - protein, 9 aa, Homo Sapiens
VLVGYVNYG

SEQ ID NO: 69546 - protein, 9 aa, Homo Sapiens
GNIMAKMAR

SEQ ID NO: 69547 - protein, 9 aa, Homo Sapiens
CSTAVDISE

SEQ ID NO: 69548 - protein, 9 aa, Homo Sapiens
PLDQSGLGA

SEQ ID NO: 69549 - protein, 9 aa, Homo Sapiens
KSHSPLQIQ

SEQ ID NO: 69550 - protein, 9 aa, Homo Sapiens
SGLWRPGSC

SEQ ID NO: 69551 - protein, 9 aa, Homo Sapiens
GAAACPSAV

SEQ ID NO: 69552 - protein, 9 aa, Homo Sapiens
TVDYLFEPH

SEQ ID NO: 69553 - protein, 9 aa, Homo Sapiens
RQYVSLHVS

SEQ ID NO: 69554 - protein, 9 aa, Homo Sapiens
CEGQTVQKI

SEQ ID NO: 69555 - protein, 9 aa, Homo Sapiens
GCCNLICSD

SEQ ID NO: 69556 - protein, 9 aa, Homo Sapiens
HQKTLVTRT

SEQ ID NO: 69557 - protein, 9 aa, Homo Sapiens
ILTQPFYFL

SEQ ID NO: 69558 - protein, 9 aa, Homo Sapiens
NPVYRIQHK

SEQ ID NO: 69559 - protein, 9 aa, Homo Sapiens
SGESLLRAR

SEQ ID NO: 69560 - protein, 9 aa, Homo Sapiens
LSSTDSSLL

SEQ ID NO: 69561 - protein, 9 aa, Homo Sapiens
PDPSQVELL

SEQ ID NO: 69562 - protein, 9 aa, Homo Sapiens
TMHAGPGAA

SEQ ID NO: 69563 - protein, 9 aa, Homo Sapiens
NIGEICTKS

SEQ ID NO: 69564 - protein, 9 aa, Homo Sapiens
IGDDLRDLL

SEQ ID NO: 69565 - protein, 9 aa, Homo Sapiens
GLDTTPNPH

SEQ ID NO: 69566 - protein, 9 aa, Homo Sapiens
PVVASGGKM

SEQ ID NO: 69567 - protein, 9 aa, Homo Sapiens
PATSLPMSL

SEQ ID NO: 69568 - protein, 9 aa, Homo Sapiens
IQHKIVTSL

SEQ ID NO: 69569 - protein, 9 aa, Homo Sapiens
EDLQKKTND

SEQ ID NO: 69570 - protein, 9 aa, Homo Sapiens
KSQRTERKD

SEQ ID NO: 69571 - protein, 9 aa, Homo Sapiens
VLENSSRAL

SEQ ID NO: 69572 - protein, 9 aa, Homo Sapiens
TIRCGFLES

SEQ ID NO: 69573 - protein, 9 aa, Homo Sapiens
MVSVLVLLM

SEQ ID NO: 69574 - protein, 9 aa, Homo Sapiens
VGFAAFVYT

SEQ ID NO: 69575 - protein, 9 aa, Homo Sapiens
QTVQKIACT

SEQ ID NO: 69576 - protein, 9 aa, Homo Sapiens
INFHGEWLQ

SEQ ID NO: 69577 - protein, 9 aa, Homo Sapiens
TRQLCDLRL

SEQ ID NO: 69578 - protein, 9 aa, Homo Sapiens
AVTGLRESE

SEQ ID NO: 69579 - protein, 9 aa, Homo Sapiens
LIFRRWKSH

SEQ ID NO: 69580 - protein, 9 aa, Homo Sapiens
LYHLILLTS

SEQ ID NO: 69581 - protein, 9 aa, Homo Sapiens
LGPEYTTFY

SEQ ID NO: 69582 - protein, 9 aa, Homo Sapiens
DSPEVYFVA

SEQ ID NO: 69583 - protein, 9 aa, Homo Sapiens
NIHDKLSKK

SEQ ID NO: 69584 - protein, 9 aa, Homo Sapiens
SYFYMAPEV

SEQ ID NO: 69585 - protein, 9 aa, Homo Sapiens
PWRRFWKRV

SEQ ID NO: 69586 - protein, 9 aa, Homo Sapiens
YVNYGNFEI

SEQ ID NO: 69587 - protein, 9 aa, Homo Sapiens
TCFHNIGEI

SEQ ID NO: 69588 - protein, 9 aa, Homo Sapiens
AQFDICVAS

SEQ ID NO: 69589 - protein, 9 aa, Homo Sapiens
IRCGFLESG

SEQ ID NO: 69590 - protein, 9 aa, Homo Sapiens
SLSPSGESL

SEQ ID NO: 69591 - protein, 9 aa, Homo Sapiens
EKSVNEVLE

SEQ ID NO: 69592 - protein, 9 aa, Homo Sapiens
KVRLRHDNT

SEQ ID NO: 69593 - protein, 9 aa, Homo Sapiens
YKHTTSRGR

SEQ ID NO: 69594 - protein, 9 aa, Homo Sapiens
APNNGARLT

SEQ ID NO: 69595 - protein, 9 aa, Homo Sapiens
RSDKNSSFR

SEQ ID NO: 69596 - protein, 9 aa, Homo Sapiens
DGSANHQAR

SEQ ID NO: 69597 - protein, 9 aa, Homo Sapiens
VFKEKVSSL

SEQ ID NO: 69598 - protein, 9 aa, Homo Sapiens
ESLSAVFRD

SEQ ID NO: 69599 - protein, 9 aa, Homo Sapiens
NEVVFRGFY

SEQ ID NO: 69600 - protein, 9 aa, Homo Sapiens
DPSQVELLE

SEQ ID NO: 69601 - protein, 9 aa, Homo Sapiens
ADELTKMED

SEQ ID NO: 69602 - protein, 9 aa, Homo Sapiens
LVNGNVVTK

SEQ ID NO: 69603 - protein, 9 aa, Homo Sapiens
NLICSDKTG

SEQ ID NO: 69604 - protein, 9 aa, Homo Sapiens
VKALEYVIK

SEQ ID NO: 69605 - protein, 9 aa, Homo Sapiens
PSHTDPVTV

SEQ ID NO: 69606 - protein, 9 aa, Homo Sapiens
DLMSPLDQS

SEQ ID NO: 69607 - protein, 9 aa, Homo Sapiens
VGDLMSPLD

SEQ ID NO: 69608 - protein, 9 aa, Homo Sapiens
YIRGQAICI

SEQ ID NO: 69609 - protein, 9 aa, Homo Sapiens
RIFCHPSFR

SEQ ID NO: 69610 - protein, 9 aa, Homo Sapiens
LHLSHPITT

SEQ ID NO: 69611 - protein, 9 aa, Homo Sapiens
SVGVAHVVR

SEQ ID NO: 69612 - protein, 9 aa, Homo Sapiens
SLPMSLASL

SEQ ID NO: 69613 - protein, 9 aa, Homo Sapiens
QELDCTSGK

SEQ ID NO: 69614 - protein, 9 aa, Homo Sapiens
TERKDPATS

SEQ ID NO: 69615 - protein, 9 aa, Homo Sapiens
SMNTTPLPR

SEQ ID NO: 69616 - protein, 9 aa, Homo Sapiens
KDVTFHPDP

SEQ ID NO: 69617 - protein, 9 aa, Homo Sapiens
KDSPEVYFV

SEQ ID NO: 69618 - protein, 9 aa, Homo Sapiens
GFAAFVYTV

SEQ ID NO: 69619 - protein, 9 aa, Homo Sapiens
IDENGHDLA

SEQ ID NO: 69620 - protein, 9 aa, Homo Sapiens
MKSFLIFRR

SEQ ID NO: 69621 - protein, 9 aa, Homo Sapiens
GGKMTLRCG

SEQ ID NO: 69622 - protein, 9 aa, Homo Sapiens
LKRSVKSVI

SEQ ID NO: 69623 - protein, 9 aa, Homo Sapiens
EVYFVAVRA

SEQ ID NO: 69624 - protein, 9 aa, Homo Sapiens
CNSRCKCSD

SEQ ID NO: 69625 - protein, 9 aa, Homo Sapiens
VMPPEGYDV

SEQ ID NO: 69626 - protein, 9 aa, Homo Sapiens
GGEPFDRIM

SEQ ID NO: 69627 - protein, 9 aa, Homo Sapiens
VERRYIKRK

SEQ ID NO: 69628 - protein, 9 aa, Homo Sapiens
DIIVIPRSQ

SEQ ID NO: 69629 - protein, 9 aa, Homo Sapiens
TTFYSRPGS

SEQ ID NO: 69630 - protein, 9 aa, Homo Sapiens
ATAQPLSVG

SEQ ID NO: 69631 - protein, 9 aa, Homo Sapiens
IGAIVGHEF

SEQ ID NO: 69632 - protein, 9 aa, Homo Sapiens
LFLGCRQYV

SEQ ID NO: 69633 - protein, 9 aa, Homo Sapiens
NFHGEWLQV

SEQ ID NO: 69634 - protein, 9 aa, Homo Sapiens
CWDPEAHKL

SEQ ID NO: 69635 - protein, 9 aa, Homo Sapiens
LSPPYKRWR

SEQ ID NO: 69636 - protein, 9 aa, Homo Sapiens
CQRTWKRTA

SEQ ID NO: 69637 - protein, 9 aa, Homo Sapiens
KHTTSRGRR

SEQ ID NO: 69638 - protein, 9 aa, Homo Sapiens
ISVTVHASL

SEQ ID NO: 69639 - protein, 9 aa, Homo Sapiens
NQGVWDMGG

SEQ ID NO: 69640 - protein, 9 aa, Homo Sapiens
QQVMDLPWT

SEQ ID NO: 69641 - protein, 9 aa, Homo Sapiens
KDSDLALGM

SEQ ID NO: 69642 - protein, 9 aa, Homo Sapiens
STSSSATST

SEQ ID NO: 69643 - protein, 9 aa, Homo Sapiens
IRGQAICID

SEQ ID NO: 69644 - protein, 9 aa, Homo Sapiens
YSRPGSTET

SEQ ID NO: 69645 - protein, 9 aa, Homo Sapiens
GAQPNRTMH

SEQ ID NO: 69646 - protein, 9 aa, Homo Sapiens
TKDILIRLT

SEQ ID NO: 69647 - protein, 9 aa, Homo Sapiens
KAADELTKM

SEQ ID NO: 69648 - protein, 9 aa, Homo Sapiens
PGSCTNITM

SEQ ID NO: 69649 - protein, 9 aa, Homo Sapiens
HWNGKKMLS

SEQ ID NO: 69650 - protein, 9 aa, Homo Sapiens
SRSEFSKHL

SEQ ID NO: 69651 - protein, 9 aa, Homo Sapiens
LIFLHLKRS

SEQ ID NO: 69652 - protein, 9 aa, Homo Sapiens
DAHQKTLVT

SEQ ID NO: 69653 - protein, 9 aa, Homo Sapiens
SGFPWVLLC

SEQ ID NO: 69654 - protein, 9 aa, Homo Sapiens
SVLVLLMAA

SEQ ID NO: 69655 - protein, 9 aa, Homo Sapiens
EINFYYLSP

SEQ ID NO: 69656 - protein, 9 aa, Homo Sapiens
MVLSSLELL

SEQ ID NO: 69657 - protein, 9 aa, Homo Sapiens
QAICIDKKD

SEQ ID NO: 69658 - protein, 9 aa, Homo Sapiens
KRSVKSVIL

SEQ ID NO: 69659 - protein, 9 aa, Homo Sapiens
KYGWVKRGS

SEQ ID NO: 69660 - protein, 9 aa, Homo Sapiens
MHILTQPFY

SEQ ID NO: 69661 - protein, 9 aa, Homo Sapiens
GTGRKRTVK

SEQ ID NO: 69662 - protein, 9 aa, Homo Sapiens
SYKHTTSRG

SEQ ID NO: 69663 - protein, 9 aa, Homo Sapiens
RDKTRIFCH

SEQ ID NO: 69664 - protein, 9 aa, Homo Sapiens
LMALPITRP

SEQ ID NO: 69665 - protein, 9 aa, Homo Sapiens
QPLSVGVAH

SEQ ID NO: 69666 - protein, 9 aa, Homo Sapiens
EQRKRSDKN

SEQ ID NO: 69667 - protein, 9 aa, Homo Sapiens
THLKGPPSS

SEQ ID NO: 69668 - protein, 9 aa, Homo Sapiens
SRGRLRVHV

SEQ ID NO: 69669 - protein, 9 aa, Homo Sapiens
IVGFAAFVY

SEQ ID NO: 69670 - protein, 9 aa, Homo Sapiens
LVGYVNYGN

SEQ ID NO: 69671 - protein, 9 aa, Homo Sapiens
CEDYKEGGS

SEQ ID NO: 69672 - protein, 9 aa, Homo Sapiens
VRGMSPWPT

SEQ ID NO: 69673 - protein, 9 aa, Homo Sapiens
LHPSHTDPV

SEQ ID NO: 69674 - protein, 9 aa, Homo Sapiens
RSRSLSPPY

SEQ ID NO: 69675 - protein, 9 aa, Homo Sapiens
QRTERKDPA

SEQ ID NO: 69676 - protein, 9 aa, Homo Sapiens
EQVVEALTT

SEQ ID NO: 69677 - protein, 9 aa, Homo Sapiens
ATKEVALCE

SEQ ID NO: 69678 - protein, 9 aa, Homo Sapiens
VSVLVLLMA

SEQ ID NO: 69679 - protein, 9 aa, Homo Sapiens
NGARLTSEV

SEQ ID NO: 69680 - protein, 9 aa, Homo Sapiens
DELSFKAAD

SEQ ID NO: 69681 - protein, 9 aa, Homo Sapiens
LTASGFPWV

SEQ ID NO: 69682 - protein, 9 aa, Homo Sapiens
DMGGKQFYA

SEQ ID NO: 69683 - protein, 9 aa, Homo Sapiens
MDEPIFTQP

SEQ ID NO: 69684 - protein, 9 aa, Homo Sapiens
SLSAVFRDF

SEQ ID NO: 69685 - protein, 9 aa, Homo Sapiens
FVFGVADVD

SEQ ID NO: 69686 - protein, 9 aa, Homo Sapiens
TDSSLLLKD

SEQ ID NO: 69687 - protein, 9 aa, Homo Sapiens
GGAFCEGQT

SEQ ID NO: 69688 - protein, 9 aa, Homo Sapiens
DINNYYLAE

SEQ ID NO: 69689 - protein, 9 aa, Homo Sapiens
VEKSVNEVL

SEQ ID NO: 69690 - protein, 9 aa, Homo Sapiens
KAIDENGHD

SEQ ID NO: 69691 - protein, 9 aa, Homo Sapiens
GRLRVHVLE

SEQ ID NO: 69692 - protein, 9 aa, Homo Sapiens
DWQVIPKKK

SEQ ID NO: 69693 - protein, 9 aa, Homo Sapiens
ESREKCSTA

SEQ ID NO: 69694 - protein, 9 aa, Homo Sapiens
LGAQPNRTM

SEQ ID NO: 69695 - protein, 9 aa, Homo Sapiens
SLYHLILLT

SEQ ID NO: 69696 - protein, 9 aa, Homo Sapiens
GLMDWQVIP

SEQ ID NO: 69697 - protein, 9 aa, Homo Sapiens
KCRNPGCPF

SEQ ID NO: 69698 - protein, 9 aa, Homo Sapiens
EVFGGSLHS

SEQ ID NO: 69699 - protein, 9 aa, Homo Sapiens
PSEQVVEAL

SEQ ID NO: 69700 - protein, 9 aa, Homo Sapiens
NVIAPAHHS

SEQ ID NO: 69701 - protein, 9 aa, Homo Sapiens
VSLHVSLNF

SEQ ID NO: 69702 - protein, 9 aa, Homo Sapiens
WLSSACGSY

SEQ ID NO: 69703 - protein, 9 aa, Homo Sapiens
LGMFKLFHL

SEQ ID NO: 69704 - protein, 9 aa, Homo Sapiens
LLRARQLAL

SEQ ID NO: 69705 - protein, 9 aa, Homo Sapiens
LLEDLQKKT

SEQ ID NO: 69706 - protein, 9 aa, Homo Sapiens
TLATAQPLS

SEQ ID NO: 69707 - protein, 9 aa, Homo Sapiens
SPPYKRWRR

SEQ ID NO: 69708 - protein, 9 aa, Homo Sapiens
GELGAQPNR

SEQ ID NO: 69709 - protein, 9 aa, Homo Sapiens
NGKKMLSLT

SEQ ID NO: 69710 - protein, 9 aa, Homo Sapiens
LGIEIKAID

SEQ ID NO: 69711 - protein, 9 aa, Homo Sapiens
NTSFPQEYF

SEQ ID NO: 69712 - protein, 9 aa, Homo Sapiens
VNYGNFEIL

SEQ ID NO: 69713 - protein, 9 aa, Homo Sapiens
TPELQNPES

SEQ ID NO: 69714 - protein, 9 aa, Homo Sapiens
FCRAIDIVY

SEQ ID NO: 69715 - protein, 9 aa, Homo Sapiens
ELSFKAADE

SEQ ID NO: 69716 - protein, 9 aa, Homo Sapiens
EKAEKKEKC

SEQ ID NO: 69717 - protein, 9 aa, Homo Sapiens
NAVTGLRES

SEQ ID NO: 69718 - protein, 9 aa, Homo Sapiens
ISIQQKTDL

SEQ ID NO: 69719 - protein, 9 aa, Homo Sapiens
LSLTHLFLV

SEQ ID NO: 69720 - protein, 9 aa, Homo Sapiens
RTPVTLHLD

SEQ ID NO: 69721 - protein, 9 aa, Homo Sapiens
RAIDIVYSL

SEQ ID NO: 69722 - protein, 9 aa, Homo Sapiens
QYVSLHVSL

SEQ ID NO: 69723 - protein, 9 aa, Homo Sapiens
ALSKYGWVK

SEQ ID NO: 69724 - protein, 9 aa, Homo Sapiens
HTDPVTVTG

SEQ ID NO: 69725 - protein, 9 aa, Homo Sapiens
IGEICTKSL

SEQ ID NO: 69726 - protein, 9 aa, Homo Sapiens
AALQQEKSS

SEQ ID NO: 69727 - protein, 9 aa, Homo Sapiens
DLNSNAVTG

SEQ ID NO: 69728 - protein, 9 aa, Homo Sapiens
NHISSMNTT

SEQ ID NO: 69729 - protein, 9 aa, Homo Sapiens
KDPATSLPM

SEQ ID NO: 69730 - protein, 9 aa, Homo Sapiens
GFQWATKEV

SEQ ID NO: 69731 - protein, 9 aa, Homo Sapiens
RIQHKIVTS

SEQ ID NO: 69732 - protein, 9 aa, Homo Sapiens
SAVRGMSPW

SEQ ID NO: 69733 - protein, 9 aa, Homo Sapiens
DSFMIGNIM

SEQ ID NO: 69734 - protein, 9 aa, Homo Sapiens
PPYKRWRRS

SEQ ID NO: 69735 - protein, 9 aa, Homo Sapiens
ILIRLTAWC

SEQ ID NO: 69736 - protein, 9 aa, Homo Sapiens
WKSHSPLQI

SEQ ID NO: 69737 - protein, 9 aa, Homo Sapiens
VMDLPWTSV

SEQ ID NO: 69738 - protein, 9 aa, Homo Sapiens
MWKNHISSM

SEQ ID NO: 69739 - protein, 9 aa, Homo Sapiens
LMVSVLVLL

SEQ ID NO: 69740 - protein, 9 aa, Homo Sapiens
AQSIPSTVN

SEQ ID NO: 69741 - protein, 9 aa, Homo Sapiens
DSPSVGGDM

SEQ ID NO: 69742 - protein, 9 aa, Homo Sapiens
SCSIPWCHL

SEQ ID NO: 69743 - protein, 9 aa, Homo Sapiens
KALEYVIKV

SEQ ID NO: 69744 - protein, 9 aa, Homo Sapiens
LVSRFIHMS

SEQ ID NO: 69745 - protein, 9 aa, Homo Sapiens
IHDKLSKKN

SEQ ID NO: 69746 - protein, 9 aa, Homo Sapiens
VYRIQHKIV

SEQ ID NO: 69747 - protein, 9 aa, Homo Sapiens
KRNLEVLCS

SEQ ID NO: 69748 - protein, 9 aa, Homo Sapiens
HDELSFKAA

SEQ ID NO: 69749 - protein, 9 aa, Homo Sapiens
WKNHISSMN

SEQ ID NO: 69750 - protein, 9 aa, Homo Sapiens
RRLFKPLRV

SEQ ID NO: 69751 - protein, 9 aa, Homo Sapiens
FTAASTERT

SEQ ID NO: 69752 - protein, 9 aa, Homo Sapiens
TCHLQQVMD

SEQ ID NO: 69753 - protein, 9 aa, Homo Sapiens
AEKKEKCED

SEQ ID NO: 69754 - protein, 9 aa, Homo Sapiens
RTKDILIRL

SEQ ID NO: 69755 - protein, 9 aa, Homo Sapiens
TSGKKQANG

SEQ ID NO: 69756 - protein, 9 aa, Homo Sapiens
YDLHKKTSC

SEQ ID NO: 69757 - protein, 9 aa, Homo Sapiens
PSGESLLRA

SEQ ID NO: 69758 - protein, 9 aa, Homo Sapiens
LLDSGPCIL

SEQ ID NO: 69759 - protein, 9 aa, Homo Sapiens
YTAVTSDED

SEQ ID NO: 69760 - protein, 9 aa, Homo Sapiens
VTGGEPFDR

SEQ ID NO: 69761 - protein, 9 aa, Homo Sapiens
ECNFGQKEK

SEQ ID NO: 69762 - protein, 9 aa, Homo Sapiens
RRWKSHSPL

SEQ ID NO: 69763 - protein, 9 aa, Homo Sapiens
KKTSCNLDE

SEQ ID NO: 69764 - protein, 9 aa, Homo Sapiens
DILIRLTAW

SEQ ID NO: 69765 - protein, 9 aa, Homo Sapiens
QQEKSSLLA

SEQ ID NO: 69766 - protein, 9 aa, Homo Sapiens
RFIHMSGTQ

SEQ ID NO: 69767 - protein, 9 aa, Homo Sapiens
AIDENGHDL

SEQ ID NO: 69768 - protein, 9 aa, Homo Sapiens
SFLIFRRWK

SEQ ID NO: 69769 - protein, 9 aa, Homo Sapiens
GLGLGMFKL

SEQ ID NO: 69770 - protein, 9 aa, Homo Sapiens
VSRFIHMSG

SEQ ID NO: 69771 - protein, 9 aa, Homo Sapiens
RSLSPPYKR

SEQ ID NO: 69772 - protein, 9 aa, Homo Sapiens
RTMHAGPGA

SEQ ID NO: 69773 - protein, 9 aa, Homo Sapiens
LDQSGLGAE

SEQ ID NO: 69774 - protein, 9 aa, Homo Sapiens
HTTSRGRRK

SEQ ID NO: 69775 - protein, 9 aa, Homo Sapiens
PSVGGDMES

SEQ ID NO: 69776 - protein, 9 aa, Homo Sapiens
TSCNLDEQQ

SEQ ID NO: 69777 - protein, 9 aa, Homo Sapiens
TGAMHLNHL

SEQ ID NO: 69778 - protein, 9 aa, Homo Sapiens
QEEKIGEQE

SEQ ID NO: 69779 - protein, 9 aa, Homo Sapiens
ELQNPESLS

SEQ ID NO: 69780 - protein, 9 aa, Homo Sapiens
EAHKLTEEC

SEQ ID NO: 69781 - protein, 9 aa, Homo Sapiens
PINNTSFPQ

SEQ ID NO: 69782 - protein, 9 aa, Homo Sapiens
LPITRPGSP

SEQ ID NO: 69783 - protein, 9 aa, Homo Sapiens
FQWATKEVA

SEQ ID NO: 69784 - protein, 9 aa, Homo Sapiens
QILQLAVRW

SEQ ID NO: 69785 - protein, 9 aa, Homo Sapiens
PSQVELLEV

SEQ ID NO: 69786 - protein, 9 aa, Homo Sapiens
LSKYGWVKR

SEQ ID NO: 69787 - protein, 9 aa, Homo Sapiens
MKCRNPGCP

SEQ ID NO: 69788 - protein, 9 aa, Homo Sapiens
PYTAVTSDE

SEQ ID NO: 69789 - protein, 9 aa, Homo Sapiens
LVTGGEPFD

SEQ ID NO: 69790 - protein, 9 aa, Homo Sapiens
DTHLKGPPS

SEQ ID NO: 69791 - protein, 9 aa, Homo Sapiens
STERTPVTL

SEQ ID NO: 69792 - protein, 9 aa, Homo Sapiens
GTVCDDALD

SEQ ID NO: 69793 - protein, 9 aa, Homo Sapiens
IFCHPSFRE

SEQ ID NO: 69794 - protein, 9 aa, Homo Sapiens
ELATVDYLF

SEQ ID NO: 69795 - protein, 9 aa, Homo Sapiens
MAFELATVD

SEQ ID NO: 69796 - protein, 9 aa, Homo Sapiens
PMSLASLTA

SEQ ID NO: 69797 - protein, 9 aa, Homo Sapiens
KISIQQKTD

SEQ ID NO: 69798 - protein, 9 aa, Homo Sapiens
FHGEWLQVL

SEQ ID NO: 69799 - protein, 9 aa, Homo Sapiens
IFTQPLMYK

SEQ ID NO: 69800 - protein, 9 aa, Homo Sapiens
ENIVELSST

SEQ ID NO: 69801 - protein, 9 aa, Homo Sapiens
WVLLCSKDV

SEQ ID NO: 69802 - protein, 9 aa, Homo Sapiens
VNEVLEWMN

SEQ ID NO: 69803 - protein, 9 aa, Homo Sapiens
VLEWMNNVM

SEQ ID NO: 69804 - protein, 9 aa, Homo Sapiens
ACGSYFYMA

SEQ ID NO: 69805 - protein, 9 aa, Homo Sapiens
GKKQANGQF

SEQ ID NO: 69806 - protein, 9 aa, Homo Sapiens
FYFMITPGV

SEQ ID NO: 69807 - protein, 9 aa, Homo Sapiens
HQARVTTRM

SEQ ID NO: 69808 - protein, 9 aa, Homo Sapiens
VALCEENMR

SEQ ID NO: 69809 - protein, 9 aa, Homo Sapiens
TAASTERTP

SEQ ID NO: 69810 - protein, 9 aa, Homo Sapiens
AAACPSAVR

SEQ ID NO: 69811 - protein, 9 aa, Homo Sapiens
LFLVSRFIH

SEQ ID NO: 69812 - protein, 9 aa, Homo Sapiens
RGMSPWPTP

SEQ ID NO: 69813 - protein, 9 aa, Homo Sapiens
QWATKEVAL

SEQ ID NO: 69814 - protein, 9 aa, Homo Sapiens
LHTLRQCYG

SEQ ID NO: 69815 - protein, 9 aa, Homo Sapiens
EMDEPIFTQ

SEQ ID NO: 69816 - protein, 9 aa, Homo Sapiens
NYGNFEILS

SEQ ID NO: 69817 - protein, 9 aa, Homo Sapiens
MYRRLFKPL

SEQ ID NO: 69818 - protein, 9 aa, Homo Sapiens
WAKENMYHA

SEQ ID NO: 69819 - protein, 9 aa, Homo Sapiens
AHKLTEECV

SEQ ID NO: 69820 - protein, 9 aa, Homo Sapiens
QSGFSVFVF

SEQ ID NO: 69821 - protein, 9 aa, Homo Sapiens
VFVSTPTLV

SEQ ID NO: 69822 - protein, 9 aa, Homo Sapiens
FRKMESSLK

SEQ ID NO: 69823 - protein, 9 aa, Homo Sapiens
LEDLQKKTN

SEQ ID NO: 69824 - protein, 9 aa, Homo Sapiens
VDYLFEPHS

SEQ ID NO: 69825 - protein, 9 aa, Homo Sapiens
AFELATVDY

SEQ ID NO: 69826 - protein, 9 aa, Homo Sapiens
HVLENSSRA

SEQ ID NO: 69827 - protein, 9 aa, Homo Sapiens
QCYGASLLH

SEQ ID NO: 69828 - protein, 9 aa, Homo Sapiens
SRFIHMSGT

SEQ ID NO: 69829 - protein, 9 aa, Homo Sapiens
IAMVIVYFV

SEQ ID NO: 69830 - protein, 9 aa, Homo Sapiens
ALGNVIFAL

SEQ ID NO: 69831 - protein, 9 aa, Homo Sapiens
QYVQIRILK

SEQ ID NO: 69832 - protein, 9 aa, Homo Sapiens
EGPCCKKEV

SEQ ID NO: 69833 - protein, 9 aa, Homo Sapiens
QVFEGFTTG

SEQ ID NO: 69834 - protein, 9 aa, Homo Sapiens
TCCDYVNSY

SEQ ID NO: 69835 - protein, 9 aa, Homo Sapiens
NREWYNRIL

SEQ ID NO: 69836 - protein, 9 aa, Homo Sapiens
SEQERMGLP

SEQ ID NO: 69837 - protein, 9 aa, Homo Sapiens
KQGPPQDEE

SEQ ID NO: 69838 - protein, 9 aa, Homo Sapiens
VKEQEAFEC

SEQ ID NO: 69839 - protein, 9 aa, Homo Sapiens
AVAEAAAAA

SEQ ID NO: 69840 - protein, 9 aa, Homo Sapiens
WEQYKFPAV

SEQ ID NO: 69841 - protein, 9 aa, Homo Sapiens
ETKECKSEE

SEQ ID NO: 69842 - protein, 9 aa, Homo Sapiens
EERPEKIPH

SEQ ID NO: 69843 - protein, 9 aa, Homo Sapiens
GRKPGGRGG

SEQ ID NO: 69844 - protein, 9 aa, Homo Sapiens
LIGYYLYRK

SEQ ID NO: 69845 - protein, 9 aa, Homo Sapiens
EFEETCRVF

SEQ ID NO: 69846 - protein, 9 aa, Homo Sapiens
QVSTKEGEK

SEQ ID NO: 69847 - protein, 9 aa, Homo Sapiens
GQYFQPVVP

SEQ ID NO: 69848 - protein, 9 aa, Homo Sapiens
TTLTARTSS

SEQ ID NO: 69849 - protein, 9 aa, Homo Sapiens
LLELTAYDI

SEQ ID NO: 69850 - protein, 9 aa, Homo Sapiens
AVITRSSNV

SEQ ID NO: 69851 - protein, 9 aa, Homo Sapiens
YWEQYKFPA

SEQ ID NO: 69852 - protein, 9 aa, Homo Sapiens
WLDKWMLTK

SEQ ID NO: 69853 - protein, 9 aa, Homo Sapiens
ERMGLPRDM

SEQ ID NO: 69854 - protein, 9 aa, Homo Sapiens
RLRHIDGLE

SEQ ID NO: 69855 - protein, 9 aa, Homo Sapiens
QTTCCPSCG

SEQ ID NO: 69856 - protein, 9 aa, Homo Sapiens
VLLHRARSG

SEQ ID NO: 69857 - protein, 9 aa, Homo Sapiens
LNSIQGVYR

SEQ ID NO: 69858 - protein, 9 aa, Homo Sapiens
ALNSIQGVY

SEQ ID NO: 69859 - protein, 9 aa, Homo Sapiens
LGLIGYYLY

SEQ ID NO: 69860 - protein, 9 aa, Homo Sapiens
AALSLIVYI

SEQ ID NO: 69861 - protein, 9 aa, Homo Sapiens
MNPIIYSYH

SEQ ID NO: 69862 - protein, 9 aa, Homo Sapiens
DGLEESFRI

SEQ ID NO: 69863 - protein, 9 aa, Homo Sapiens
VFHYKRPTD

SEQ ID NO: 69864 - protein, 9 aa, Homo Sapiens
YSYHDKEMS

SEQ ID NO: 69865 - protein, 9 aa, Homo Sapiens
RGEQQEHGN

SEQ ID NO: 69866 - protein, 9 aa, Homo Sapiens
LTTLTARTS

SEQ ID NO: 69867 - protein, 9 aa, Homo Sapiens
DGQYFQPVV

SEQ ID NO: 69868 - protein, 9 aa, Homo Sapiens
DGKQGPPQD

SEQ ID NO: 69869 - protein, 9 aa, Homo Sapiens
RDPLSKITE

SEQ ID NO: 69870 - protein, 9 aa, Homo Sapiens
IDGLEESFR

SEQ ID NO: 69871 - protein, 9 aa, Homo Sapiens
HLTVKCTYS

SEQ ID NO: 69872 - protein, 9 aa, Homo Sapiens
GRSCVGKTT

SEQ ID NO: 69873 - protein, 9 aa, Homo Sapiens
TCCPSCGVS

SEQ ID NO: 69874 - protein, 9 aa, Homo Sapiens
CMQASSCNC

SEQ ID NO: 69875 - protein, 9 aa, Homo Sapiens
PGTRVRAMT

SEQ ID NO: 69876 - protein, 9 aa, Homo Sapiens
SLCLIFYYS

SEQ ID NO: 69877 - protein, 9 aa, Homo Sapiens
ELDKIKGVF

SEQ ID NO: 69878 - protein, 9 aa, Homo Sapiens
TGVPTRCPP

SEQ ID NO: 69879 - protein, 9 aa, Homo Sapiens
IIAPFSSKQ

SEQ ID NO: 69880 - protein, 9 aa, Homo Sapiens
CDSRYSDIK

SEQ ID NO: 69881 - protein, 9 aa, Homo Sapiens
YNRILNDKS

SEQ ID NO: 69882 - protein, 9 aa, Homo Sapiens
FSYEEIAMA

SEQ ID NO: 69883 - protein, 9 aa, Homo Sapiens
RLTPGPGPE

SEQ ID NO: 69884 - protein, 9 aa, Homo Sapiens
RDNQAIELL

SEQ ID NO: 69885 - protein, 9 aa, Homo Sapiens
ALRHETLKK

SEQ ID NO: 69886 - protein, 9 aa, Homo Sapiens
NVAEGNHLT

SEQ ID NO: 69887 - protein, 9 aa, Homo Sapiens
VLTELDKIK

SEQ ID NO: 69888 - protein, 9 aa, Homo Sapiens
MDKSNKSTK

SEQ ID NO: 69889 - protein, 9 aa, Homo Sapiens
VPIKTIWST

SEQ ID NO: 69890 - protein, 9 aa, Homo Sapiens
PTDHMFVFF

SEQ ID NO: 69891 - protein, 9 aa, Homo Sapiens
ETCRVFATK

SEQ ID NO: 69892 - protein, 9 aa, Homo Sapiens
IISLCLIFY

SEQ ID NO: 69893 - protein, 9 aa, Homo Sapiens
GTCCDYVNS

SEQ ID NO: 69894 - protein, 9 aa, Homo Sapiens
ESRAAREKQ

SEQ ID NO: 69895 - protein, 9 aa, Homo Sapiens
YLKFVLLHR

SEQ ID NO: 69896 - protein, 9 aa, Homo Sapiens
EVSHKSEIS

SEQ ID NO: 69897 - protein, 9 aa, Homo Sapiens
GYVHIVEAI

SEQ ID NO: 69898 - protein, 9 aa, Homo Sapiens
LKNEDTKSG

SEQ ID NO: 69899 - protein, 9 aa, Homo Sapiens
NYDIAARKC

SEQ ID NO: 69900 - protein, 9 aa, Homo Sapiens
TQTLNKVVC

SEQ ID NO: 69901 - protein, 9 aa, Homo Sapiens
SLAITGGST

SEQ ID NO: 69902 - protein, 9 aa, Homo Sapiens
RGNYDIAAR

SEQ ID NO: 69903 - protein, 9 aa, Homo Sapiens
PLGKKRSLA

SEQ ID NO: 69904 - protein, 9 aa, Homo Sapiens
SLGDKIAMV

SEQ ID NO: 69905 - protein, 9 aa, Homo Sapiens
ASIISLCLI

SEQ ID NO: 69906 - protein, 9 aa, Homo Sapiens
IQGVYRKAV

SEQ ID NO: 69907 - protein, 9 aa, Homo Sapiens
IPHLKLLVE

SEQ ID NO: 69908 - protein, 9 aa, Homo Sapiens
KQVFEGFTT

SEQ ID NO: 69909 - protein, 9 aa, Homo Sapiens
LAISKGYVH

SEQ ID NO: 69910 - protein, 9 aa, Homo Sapiens
QLASDERYC

SEQ ID NO: 69911 - protein, 9 aa, Homo Sapiens
NTLMQDVKP

SEQ ID NO: 69912 - protein, 9 aa, Homo Sapiens
IYLKFVLLH

SEQ ID NO: 69913 - protein, 9 aa, Homo Sapiens
SYEEIAMAT

SEQ ID NO: 69914 - protein, 9 aa, Homo Sapiens
LLFQLGRDA

SEQ ID NO: 69915 - protein, 9 aa, Homo Sapiens
IKANPVPNG

SEQ ID NO: 69916 - protein, 9 aa, Homo Sapiens
AMVIVYFVA

SEQ ID NO: 69917 - protein, 9 aa, Homo Sapiens
WEAYQIFLD

SEQ ID NO: 69918 - protein, 9 aa, Homo Sapiens
SGGKEAGIA

SEQ ID NO: 69919 - protein, 9 aa, Homo Sapiens
HVDAESLTT

SEQ ID NO: 69920 - protein, 9 aa, Homo Sapiens
LNDVRCSST

SEQ ID NO: 69921 - protein, 9 aa, Homo Sapiens
ALLGLIGYY

SEQ ID NO: 69922 - protein, 9 aa, Homo Sapiens
RHIDGLEES

SEQ ID NO: 69923 - protein, 9 aa, Homo Sapiens
MASRSTNTS

SEQ ID NO: 69924 - protein, 9 aa, Homo Sapiens
ILKIIVIGD

SEQ ID NO: 69925 - protein, 9 aa, Homo Sapiens
KRSIQDIKA

SEQ ID NO: 69926 - protein, 9 aa, Homo Sapiens
EHLNDVRCS

SEQ ID NO: 69927 - protein, 9 aa, Homo Sapiens
IDPLKTTPI

SEQ ID NO: 69928 - protein, 9 aa, Homo Sapiens
GKTTESTQC

SEQ ID NO: 69929 - protein, 9 aa, Homo Sapiens
HKSEISNAP

SEQ ID NO: 69930 - protein, 9 aa, Homo Sapiens
QSSEPSNGA

SEQ ID NO: 69931 - protein, 9 aa, Homo Sapiens
SEISNAPDG

SEQ ID NO: 69932 - protein, 9 aa, Homo Sapiens
HLNDVRCSS

SEQ ID NO: 69933 - protein, 9 aa, Homo Sapiens
CIPKTHKRG

SEQ ID NO: 69934 - protein, 9 aa, Homo Sapiens
CVGKTTEST

SEQ ID NO: 69935 - protein, 9 aa, Homo Sapiens
HLKLLVEKK

SEQ ID NO: 69936 - protein, 9 aa, Homo Sapiens
MLTKKQFGL

SEQ ID NO: 69937 - protein, 9 aa, Homo Sapiens
SKITEQEKD

SEQ ID NO: 69938 - protein, 9 aa, Homo Sapiens
LLNYMSDVE

SEQ ID NO: 69939 - protein, 9 aa, Homo Sapiens
VQGSHNRSL

SEQ ID NO: 69940 - protein, 9 aa, Homo Sapiens
TTCCPSCGV

SEQ ID NO: 69941 - protein, 9 aa, Homo Sapiens
DNHCMQASS

SEQ ID NO: 69942 - protein, 9 aa, Homo Sapiens
VNVAEGNHL

SEQ ID NO: 69943 - protein, 9 aa, Homo Sapiens
FPAVITRSS

SEQ ID NO: 69944 - protein, 9 aa, Homo Sapiens
YWGVKEQEA

SEQ ID NO: 69945 - protein, 9 aa, Homo Sapiens
ADAFMGVQS

SEQ ID NO: 69946 - protein, 9 aa, Homo Sapiens
ETTYTVLKN

SEQ ID NO: 69947 - protein, 9 aa, Homo Sapiens
FAALSLIVY

SEQ ID NO: 69948 - protein, 9 aa, Homo Sapiens
NSIQGVYRK

SEQ ID NO: 69949 - protein, 9 aa, Homo Sapiens
LRHETLKKT

SEQ ID NO: 69950 - protein, 9 aa, Homo Sapiens
GKQGPPQDE

SEQ ID NO: 69951 - protein, 9 aa, Homo Sapiens
GLIGYYLYR

SEQ ID NO: 69952 - protein, 9 aa, Homo Sapiens
ALSGPPPGG

SEQ ID NO: 69953 - protein, 9 aa, Homo Sapiens
QDKFLSSLE

SEQ ID NO: 69954 - protein, 9 aa, Homo Sapiens
ECPGPPGLP

SEQ ID NO: 69955 - protein, 9 aa, Homo Sapiens
LEPASSPMA

SEQ ID NO: 69956 - protein, 9 aa, Homo Sapiens
HACTQKFSY

SEQ ID NO: 69957 - protein, 9 aa, Homo Sapiens
GLHWALYSI

SEQ ID NO: 69958 - protein, 9 aa, Homo Sapiens
ADREDKVEP

SEQ ID NO: 69959 - protein, 9 aa, Homo Sapiens
QQKDASVSD

SEQ ID NO: 69960 - protein, 9 aa, Homo Sapiens
IKALKYAIS

SEQ ID NO: 69961 - protein, 9 aa, Homo Sapiens
MNGRKPGGR

SEQ ID NO: 69962 - protein, 9 aa, Homo Sapiens
FIYAWPKAL

SEQ ID NO: 69963 - protein, 9 aa, Homo Sapiens
PGPECPGPP

SEQ ID NO: 69964 - protein, 9 aa, Homo Sapiens
KDASVSDID

SEQ ID NO: 69965 - protein, 9 aa, Homo Sapiens
PLLELTAYD

SEQ ID NO: 69966 - protein, 9 aa, Homo Sapiens
DKSNKSTKS

SEQ ID NO: 69967 - protein, 9 aa, Homo Sapiens
YLLWHPEAM

SEQ ID NO: 69968 - protein, 9 aa, Homo Sapiens
LGKKRSLAI

SEQ ID NO: 69969 - protein, 9 aa, Homo Sapiens
FAYVPIKTI

SEQ ID NO: 69970 - protein, 9 aa, Homo Sapiens
VHIVEAILN

SEQ ID NO: 69971 - protein, 9 aa, Homo Sapiens
EWYNRILND

SEQ ID NO: 69972 - protein, 9 aa, Homo Sapiens
IPALSLDTF

SEQ ID NO: 69973 - protein, 9 aa, Homo Sapiens
AISKGYVHI

SEQ ID NO: 69974 - protein, 9 aa, Homo Sapiens
TPLGKKRSL

SEQ ID NO: 69975 - protein, 9 aa, Homo Sapiens
SPMASRSTN

SEQ ID NO: 69976 - protein, 9 aa, Homo Sapiens
IFALVDGKS

SEQ ID NO: 69977 - protein, 9 aa, Homo Sapiens
SDERYCKDI

SEQ ID NO: 69978 - protein, 9 aa, Homo Sapiens
QYKFPAVIT

SEQ ID NO: 69979 - protein, 9 aa, Homo Sapiens
NRVATLLNY

SEQ ID NO: 69980 - protein, 9 aa, Homo Sapiens
AFRSQDKFL

SEQ ID NO: 69981 - protein, 9 aa, Homo Sapiens
SQDKFLSSL

SEQ ID NO: 69982 - protein, 9 aa, Homo Sapiens
NPEFEETCR

SEQ ID NO: 69983 - protein, 9 aa, Homo Sapiens
SIFIYAWPK

SEQ ID NO: 69984 - protein, 9 aa, Homo Sapiens
ECKSEEELH

SEQ ID NO: 69985 - protein, 9 aa, Homo Sapiens
TLNKVVCTL

SEQ ID NO: 69986 - protein, 9 aa, Homo Sapiens
PALSGPPPG

SEQ ID NO: 69987 - protein, 9 aa, Homo Sapiens
DPLKTTPII

SEQ ID NO: 69988 - protein, 9 aa, Homo Sapiens
FFASIISLC

SEQ ID NO: 69989 - protein, 9 aa, Homo Sapiens
QSFNLKRAQ

SEQ ID NO: 69990 - protein, 9 aa, Homo Sapiens
FALVDGKST

SEQ ID NO: 69991 - protein, 9 aa, Homo Sapiens
ECIPKTHKR

SEQ ID NO: 69992 - protein, 9 aa, Homo Sapiens
GTASGGKEA

SEQ ID NO: 69993 - protein, 9 aa, Homo Sapiens
YVQIRILKI

SEQ ID NO: 69994 - protein, 9 aa, Homo Sapiens
AMTIYKQSQ

SEQ ID NO: 69995 - protein, 9 aa, Homo Sapiens
KIYLKFVLL

SEQ ID NO: 69996 - protein, 9 aa, Homo Sapiens
AECIPKTHK

SEQ ID NO: 69997 - protein, 9 aa, Homo Sapiens
IGQTQTLNK

SEQ ID NO: 69998 - protein, 9 aa, Homo Sapiens
SLIVYIFTK

SEQ ID NO: 69999 - protein, 9 aa, Homo Sapiens
LTAYDIFER

SEQ ID NO: 70000 - protein, 9 aa, Homo Sapiens
LWHPEAMAA

SEQ ID NO: 70001 - protein, 9 aa, Homo Sapiens
LGNVIFALV

SEQ ID NO: 70002 - protein, 9 aa, Homo Sapiens
AREKQSFNL

SEQ ID NO: 70003 - protein, 9 aa, Homo Sapiens
DKVEPGCHH

SEQ ID NO: 70004 - protein, 9 aa, Homo Sapiens
PSYGRQGSG

SEQ ID NO: 70005 - protein, 9 aa, Homo Sapiens
TLKKTNARP

SEQ ID NO: 70006 - protein, 9 aa, Homo Sapiens
GSHNRSLSL

SEQ ID NO: 70007 - protein, 9 aa, Homo Sapiens
LADIKARLG

SEQ ID NO: 70008 - protein, 9 aa, Homo Sapiens
CNPHYASQT

SEQ ID NO: 70009 - protein, 9 aa, Homo Sapiens
DERYCKDIN

SEQ ID NO: 70010 - protein, 9 aa, Homo Sapiens
AYDIFERDL

SEQ ID NO: 70011 - protein, 9 aa, Homo Sapiens
ENFAYVPIK

SEQ ID NO: 70012 - protein, 9 aa, Homo Sapiens
HMFVFFPEE

SEQ ID NO: 70013 - protein, 9 aa, Homo Sapiens
GTGNRVATL

SEQ ID NO: 70014 - protein, 9 aa, Homo Sapiens
DHMFVFFPE

SEQ ID NO: 70015 - protein, 9 aa, Homo Sapiens
ASSLKTVIP

SEQ ID NO: 70016 - protein, 9 aa, Homo Sapiens
CKSEEELHR

SEQ ID NO: 70017 - protein, 9 aa, Homo Sapiens
DPTDHMFVF

SEQ ID NO: 70018 - protein, 9 aa, Homo Sapiens
CCDYVNSYT

SEQ ID NO: 70019 - protein, 9 aa, Homo Sapiens
FASIISLCL

SEQ ID NO: 70020 - protein, 9 aa, Homo Sapiens
WSFDECNPH

SEQ ID NO: 70021 - protein, 9 aa, Homo Sapiens
GTGVPTRCP

SEQ ID NO: 70022 - protein, 9 aa, Homo Sapiens
QKFSYEEIA

SEQ ID NO: 70023 - protein, 9 aa, Homo Sapiens
SIQGVYRKA

SEQ ID NO: 70024 - protein, 9 aa, Homo Sapiens
SRAAREKQS

SEQ ID NO: 70025 - protein, 9 aa, Homo Sapiens
MANSMNGRK

SEQ ID NO: 70026 - protein, 9 aa, Homo Sapiens
IGYYLYRKA

SEQ ID NO: 70027 - protein, 9 aa, Homo Sapiens
TAGKHYVYR

SEQ ID NO: 70028 - protein, 9 aa, Homo Sapiens
VPTRCPPAT

SEQ ID NO: 70029 - protein, 9 aa, Homo Sapiens
FLIEHLNDV

SEQ ID NO: 70030 - protein, 9 aa, Homo Sapiens
NNPEFEETC

SEQ ID NO: 70031 - protein, 9 aa, Homo Sapiens
CPSCGVSSC

SEQ ID NO: 70032 - protein, 9 aa, Homo Sapiens
NDDPTDHMF

SEQ ID NO: 70033 - protein, 9 aa, Homo Sapiens
AAVAEAAAA

SEQ ID NO: 70034 - protein, 9 aa, Homo Sapiens
ASVSDIDGI

SEQ ID NO: 70035 - protein, 9 aa, Homo Sapiens
PHLKLLVEK

SEQ ID NO: 70036 - protein, 9 aa, Homo Sapiens
SLDTFSPVR

SEQ ID NO: 70037 - protein, 9 aa, Homo Sapiens
RSLAITGGS

SEQ ID NO: 70038 - protein, 9 aa, Homo Sapiens
FEETCRVFA

SEQ ID NO: 70039 - protein, 9 aa, Homo Sapiens
TASGGKEAG

SEQ ID NO: 70040 - protein, 9 aa, Homo Sapiens
DNQAIELLF

SEQ ID NO: 70041 - protein, 9 aa, Homo Sapiens
EERDGQYFQ

SEQ ID NO: 70042 - protein, 9 aa, Homo Sapiens
LCCQTTCCP

SEQ ID NO: 70043 - protein, 9 aa, Homo Sapiens
GGRSCVGKT

SEQ ID NO: 70044 - protein, 9 aa, Homo Sapiens
EADREDKVE

SEQ ID NO: 70045 - protein, 9 aa, Homo Sapiens
DKFLSSLES

SEQ ID NO: 70046 - protein, 9 aa, Homo Sapiens
VLTSQHWLV

SEQ ID NO: 70047 - protein, 9 aa, Homo Sapiens
AGTASGGKE

SEQ ID NO: 70048 - protein, 9 aa, Homo Sapiens
PLSKITEQE

SEQ ID NO: 70049 - protein, 9 aa, Homo Sapiens
EDGKQGPPQ

SEQ ID NO: 70050 - protein, 9 aa, Homo Sapiens
IIHKTAGKH

SEQ ID NO: 70051 - protein, 9 aa, Homo Sapiens
PASSPMASR

SEQ ID NO: 70052 - protein, 9 aa, Homo Sapiens
LKFVLLHRA

SEQ ID NO: 70053 - protein, 9 aa, Homo Sapiens
PYEGPCCKK

SEQ ID NO: 70054 - protein, 9 aa, Homo Sapiens
IEHLNDVRC

SEQ ID NO: 70055 - protein, 9 aa, Homo Sapiens
TQKFSYEEI

SEQ ID NO: 70056 - protein, 9 aa, Homo Sapiens
LKTTPIIAP

SEQ ID NO: 70057 - protein, 9 aa, Homo Sapiens
LSLDTFSPV

SEQ ID NO: 70058 - protein, 9 aa, Homo Sapiens
PQEEEDGKQ

SEQ ID NO: 70059 - protein, 9 aa, Homo Sapiens
LCLIFYYSK

SEQ ID NO: 70060 - protein, 9 aa, Homo Sapiens
LVLTSQHWL

SEQ ID NO: 70061 - protein, 9 aa, Homo Sapiens
VQIRILKII

SEQ ID NO: 70062 - protein, 9 aa, Homo Sapiens
IIYSYHDKE

SEQ ID NO: 70063 - protein, 9 aa, Homo Sapiens
WMLTKKQFG

SEQ ID NO: 70064 - protein, 9 aa, Homo Sapiens
LSLIVYIFT

SEQ ID NO: 70065 - protein, 9 aa, Homo Sapiens
VNTEASSLK

SEQ ID NO: 70066 - protein, 9 aa, Homo Sapiens
CKNGGTCCD

SEQ ID NO: 70067 - protein, 9 aa, Homo Sapiens
KTPLGKKRS

SEQ ID NO: 70068 - protein, 9 aa, Homo Sapiens
MGLPRDMLE

SEQ ID NO: 70069 - protein, 9 aa, Homo Sapiens
TALNSIQGV

SEQ ID NO: 70070 - protein, 9 aa, Homo Sapiens
LTDSLADIK

SEQ ID NO: 70071 - protein, 9 aa, Homo Sapiens
TLLNYMSDV

SEQ ID NO: 70072 - protein, 9 aa, Homo Sapiens
WPKALSAFD

SEQ ID NO: 70073 - protein, 9 aa, Homo Sapiens
CCKKEVSAV

SEQ ID NO: 70074 - protein, 9 aa, Homo Sapiens
WGVKEQEAF

SEQ ID NO: 70075 - protein, 9 aa, Homo Sapiens
SFDECNPHY

SEQ ID NO: 70076 - protein, 9 aa, Homo Sapiens
CLIFYYSKK

SEQ ID NO: 70077 - protein, 9 aa, Homo Sapiens
KEAGIASGG

SEQ ID NO: 70078 - protein, 9 aa, Homo Sapiens
HCMQASSCN

SEQ ID NO: 70079 - protein, 9 aa, Homo Sapiens
AAEAAAVAE

SEQ ID NO: 70080 - protein, 9 aa, Homo Sapiens
IGENFAYVP

SEQ ID NO: 70081 - protein, 9 aa, Homo Sapiens
FVLLHRARS

SEQ ID NO: 70082 - protein, 9 aa, Homo Sapiens
TCRVFATKM

SEQ ID NO: 70083 - protein, 9 aa, Homo Sapiens
GGTCCDYVN

SEQ ID NO: 70084 - protein, 9 aa, Homo Sapiens
TLTARTSSS

SEQ ID NO: 70085 - protein, 9 aa, Homo Sapiens
PAPRGEQQE

SEQ ID NO: 70086 - protein, 9 aa, Homo Sapiens
TDHMFVFFP

SEQ ID NO: 70087 - protein, 9 aa, Homo Sapiens
SCVGKTTES

SEQ ID NO: 70088 - protein, 9 aa, Homo Sapiens
YDIFERDLK

SEQ ID NO: 70089 - protein, 9 aa, Homo Sapiens
AFMGVQSGH

SEQ ID NO: 70090 - protein, 9 aa, Homo Sapiens
RLVLTSQHW

SEQ ID NO: 70091 - protein, 9 aa, Homo Sapiens
VAEAAAAAA

SEQ ID NO: 70092 - protein, 9 aa, Homo Sapiens
NQAIELLFQ

SEQ ID NO: 70093 - protein, 9 aa, Homo Sapiens
TKECKSEEE

SEQ ID NO: 70094 - protein, 9 aa, Homo Sapiens
IPKTHKRGS

SEQ ID NO: 70095 - protein, 9 aa, Homo Sapiens
DAFMGVQSG

SEQ ID NO: 70096 - protein, 9 aa, Homo Sapiens
RMGLPRDML

SEQ ID NO: 70097 - protein, 9 aa, Homo Sapiens
SGPPPGGAE

SEQ ID NO: 70098 - protein, 9 aa, Homo Sapiens
QGSGSGRSS

SEQ ID NO: 70099 - protein, 9 aa, Homo Sapiens
IQDIKALKY

SEQ ID NO: 70100 - protein, 9 aa, Homo Sapiens
FLFLIEHLN

SEQ ID NO: 70101 - protein, 9 aa, Homo Sapiens
GKHYVYRFV

SEQ ID NO: 70102 - protein, 9 aa, Homo Sapiens
TVLKRKVYC

SEQ ID NO: 70103 - protein, 9 aa, Homo Sapiens
GPGPECPGP

SEQ ID NO: 70104 - protein, 9 aa, Homo Sapiens
NRSLSLGDK

SEQ ID NO: 70105 - protein, 9 aa, Homo Sapiens
QSPSYGRQG

SEQ ID NO: 70106 - protein, 9 aa, Homo Sapiens
PSTPALSGP

SEQ ID NO: 70107 - protein, 9 aa, Homo Sapiens
IGFIKVGYN

SEQ ID NO: 70108 - protein, 9 aa, Homo Sapiens
TRVRAMTIY

SEQ ID NO: 70109 - protein, 9 aa, Homo Sapiens
ERDGQYFQP

SEQ ID NO: 70110 - protein, 9 aa, Homo Sapiens
YFAALSLIV

SEQ ID NO: 70111 - protein, 9 aa, Homo Sapiens
ERLVLTSQH

SEQ ID NO: 70112 - protein, 9 aa, Homo Sapiens
QKDASVSDI

SEQ ID NO: 70113 - protein, 9 aa, Homo Sapiens
INHLVERGN

SEQ ID NO: 70114 - protein, 9 aa, Homo Sapiens
HIVEAILNH

SEQ ID NO: 70115 - protein, 9 aa, Homo Sapiens
IKVGYNKLF

SEQ ID NO: 70116 - protein, 9 aa, Homo Sapiens
HAFRSQDKF

SEQ ID NO: 70117 - protein, 9 aa, Homo Sapiens
LKRKVYCSN

SEQ ID NO: 70118 - protein, 9 aa, Homo Sapiens
PIIAPFSSK

SEQ ID NO: 70119 - protein, 9 aa, Homo Sapiens
ASGGKEAGI

SEQ ID NO: 70120 - protein, 9 aa, Homo Sapiens
ELLFQLGRD

SEQ ID NO: 70121 - protein, 9 aa, Homo Sapiens
HKRGSKEPS

SEQ ID NO: 70122 - protein, 9 aa, Homo Sapiens
NPHYASQTT

SEQ ID NO: 70123 - protein, 9 aa, Homo Sapiens
STKEGEKLA

SEQ ID NO: 70124 - protein, 9 aa, Homo Sapiens
ERPEKIPHL

SEQ ID NO: 70125 - protein, 9 aa, Homo Sapiens
GGTGVPTRC

SEQ ID NO: 70126 - protein, 9 aa, Homo Sapiens
KTTESTQCE

SEQ ID NO: 70127 - protein, 9 aa, Homo Sapiens
RQRHIIYRV

SEQ ID NO: 70128 - protein, 9 aa, Homo Sapiens
KQSFNLKRA

SEQ ID NO: 70129 - protein, 9 aa, Homo Sapiens
LNKVVCTLV

SEQ ID NO: 70130 - protein, 9 aa, Homo Sapiens
AVWEAYQIF

SEQ ID NO: 70131 - protein, 9 aa, Homo Sapiens
DIKALKYAI

SEQ ID NO: 70132 - protein, 9 aa, Homo Sapiens
NRQRHIIYR

SEQ ID NO: 70133 - protein, 9 aa, Homo Sapiens
ATALRHETL

SEQ ID NO: 70134 - protein, 9 aa, Homo Sapiens
EISNAPDGA

SEQ ID NO: 70135 - protein, 9 aa, Homo Sapiens
LDKWMLTKK

SEQ ID NO: 70136 - protein, 9 aa, Homo Sapiens
EADAFMGVQ

SEQ ID NO: 70137 - protein, 9 aa, Homo Sapiens
ADIKARLGR

SEQ ID NO: 70138 - protein, 9 aa, Homo Sapiens
EENTLMQDV

SEQ ID NO: 70139 - protein, 9 aa, Homo Sapiens
IKPSTEGEV

SEQ ID NO: 70140 - protein, 9 aa, Homo Sapiens
DDPTDHMFV

SEQ ID NO: 70141 - protein, 9 aa, Homo Sapiens
YLYRKANRP

SEQ ID NO: 70142 - protein, 9 aa, Homo Sapiens
SSLKTVIPT

SEQ ID NO: 70143 - protein, 9 aa, Homo Sapiens
SHNRSLSLG

SEQ ID NO: 70144 - protein, 9 aa, Homo Sapiens
EGNHLTVKC

SEQ ID NO: 70145 - protein, 9 aa, Homo Sapiens
GYYLYRKAN

SEQ ID NO: 70146 - protein, 9 aa, Homo Sapiens
QHWLVLVPF

SEQ ID NO: 70147 - protein, 9 aa, Homo Sapiens
MTIYKQSQH

SEQ ID NO: 70148 - protein, 9 aa, Homo Sapiens
SRQVSTKEG

SEQ ID NO: 70149 - protein, 9 aa, Homo Sapiens
IQKHGRGMD

SEQ ID NO: 70150 - protein, 9 aa, Homo Sapiens
SDIKPSTEG

SEQ ID NO: 70151 - protein, 9 aa, Homo Sapiens
EGFTTGLLK

SEQ ID NO: 70152 - protein, 9 aa, Homo Sapiens
QSGHMKEGT

SEQ ID NO: 70153 - protein, 9 aa, Homo Sapiens
TKKQFGLLS

SEQ ID NO: 70154 - protein, 9 aa, Homo Sapiens
IFIYAWPKA

SEQ ID NO: 70155 - protein, 9 aa, Homo Sapiens
QKHGRGMDK

SEQ ID NO: 70156 - protein, 9 aa, Homo Sapiens
QGSHNRSLS

SEQ ID NO: 70157 - protein, 9 aa, Homo Sapiens
IELLFQLGR

SEQ ID NO: 70158 - protein, 9 aa, Homo Sapiens
QIFLDRIPD

SEQ ID NO: 70159 - protein, 9 aa, Homo Sapiens
VGKTTESTQ

SEQ ID NO: 70160 - protein, 9 aa, Homo Sapiens
LGDKIAMVI

SEQ ID NO: 70161 - protein, 9 aa, Homo Sapiens
DIFERDLKK

SEQ ID NO: 70162 - protein, 9 aa, Homo Sapiens
SQHWLVLVP

SEQ ID NO: 70163 - protein, 9 aa, Homo Sapiens
RPQEEEDGK

SEQ ID NO: 70164 - protein, 9 aa, Homo Sapiens
IKRSIQDIK

SEQ ID NO: 70165 - protein, 9 aa, Homo Sapiens
PSLGDKIAM

SEQ ID NO: 70166 - protein, 9 aa, Homo Sapiens
RGMDKSNKS

SEQ ID NO: 70167 - protein, 9 aa, Homo Sapiens
PTRCPPATA

SEQ ID NO: 70168 - protein, 9 aa, Homo Sapiens
DHSRQVSTK

SEQ ID NO: 70169 - protein, 9 aa, Homo Sapiens
YEGPCCKKE

SEQ ID NO: 70170 - protein, 9 aa, Homo Sapiens
STPALSGPP

SEQ ID NO: 70171 - protein, 9 aa, Homo Sapiens
VLCGLHWAL

SEQ ID NO: 70172 - protein, 9 aa, Homo Sapiens
EQERMGLPR

SEQ ID NO: 70173 - protein, 9 aa, Homo Sapiens
QRHIIYRVT

SEQ ID NO: 70174 - protein, 9 aa, Homo Sapiens
RCPPATATS

SEQ ID NO: 70175 - protein, 9 aa, Homo Sapiens
LTKKQFGLL

SEQ ID NO: 70176 - protein, 9 aa, Homo Sapiens
PLKTTPIIA

SEQ ID NO: 70177 - protein, 9 aa, Homo Sapiens
HNDDPTDHM

SEQ ID NO: 70178 - protein, 9 aa, Homo Sapiens
EDKVEPGCH

SEQ ID NO: 70179 - protein, 9 aa, Homo Sapiens
QQEHGNPGP

SEQ ID NO: 70180 - protein, 9 aa, Homo Sapiens
PGPGPECPG

SEQ ID NO: 70181 - protein, 9 aa, Homo Sapiens
GNRVATLLN

SEQ ID NO: 70182 - protein, 9 aa, Homo Sapiens
NHCMQASSC

SEQ ID NO: 70183 - protein, 9 aa, Homo Sapiens
QIRILKIIV

SEQ ID NO: 70184 - protein, 9 aa, Homo Sapiens
ASIFIYAWP

SEQ ID NO: 70185 - protein, 9 aa, Homo Sapiens
PIIYSYHDK

SEQ ID NO: 70186 - protein, 9 aa, Homo Sapiens
YAWPKALSA

SEQ ID NO: 70187 - protein, 9 aa, Homo Sapiens
KHYVYRFVC

SEQ ID NO: 70188 - protein, 9 aa, Homo Sapiens
LDKIKGVFE

SEQ ID NO: 70189 - protein, 9 aa, Homo Sapiens
RSCVGKTTE

SEQ ID NO: 70190 - protein, 9 aa, Homo Sapiens
TNKQVFEGF

SEQ ID NO: 70191 - protein, 9 aa, Homo Sapiens
RGNREWYNR

SEQ ID NO: 70192 - protein, 9 aa, Homo Sapiens
GENFAYVPI

SEQ ID NO: 70193 - protein, 9 aa, Homo Sapiens
SPYEGPCCK

SEQ ID NO: 70194 - protein, 9 aa, Homo Sapiens
NSMNGRKPG

SEQ ID NO: 70195 - protein, 9 aa, Homo Sapiens
GGKEAGIAS

SEQ ID NO: 70196 - protein, 9 aa, Homo Sapiens
KRKVYCSNE

SEQ ID NO: 70197 - protein, 9 aa, Homo Sapiens
RHIIYRVTS

SEQ ID NO: 70198 - protein, 9 aa, Homo Sapiens
PGFQLASDE

SEQ ID NO: 70199 - protein, 9 aa, Homo Sapiens
QTLNKVVCT

SEQ ID NO: 70200 - protein, 9 aa, Homo Sapiens
GYNKLFVLD

SEQ ID NO: 70201 - protein, 9 aa, Homo Sapiens
AAAAEAAAV

SEQ ID NO: 70202 - protein, 9 aa, Homo Sapiens
REDKVEPGC

SEQ ID NO: 70203 - protein, 9 aa, Homo Sapiens
ITALNSIQG

SEQ ID NO: 70204 - protein, 9 aa, Homo Sapiens
WAMYYLLWH

SEQ ID NO: 70205 - protein, 9 aa, Homo Sapiens
MQDVKPFRI

SEQ ID NO: 70206 - protein, 9 aa, Homo Sapiens
IKGVFERPS

SEQ ID NO: 70207 - protein, 9 aa, Homo Sapiens
VSHKSEISN

SEQ ID NO: 70208 - protein, 9 aa, Homo Sapiens
TELDKIKGV

SEQ ID NO: 70209 - protein, 9 aa, Homo Sapiens
NSSEQERMG

SEQ ID NO: 70210 - protein, 9 aa, Homo Sapiens
SYQFYWGVK

SEQ ID NO: 70211 - protein, 9 aa, Homo Sapiens
LIEHLNDVR

SEQ ID NO: 70212 - protein, 9 aa, Homo Sapiens
ECNPHYASQ

SEQ ID NO: 70213 - protein, 9 aa, Homo Sapiens
RAAREKQSF

SEQ ID NO: 70214 - protein, 9 aa, Homo Sapiens
PRGEQQEHG

SEQ ID NO: 70215 - protein, 9 aa, Homo Sapiens
TVLKNEDTK

SEQ ID NO: 70216 - protein, 9 aa, Homo Sapiens
SKGYVHIVE

SEQ ID NO: 70217 - protein, 9 aa, Homo Sapiens
KVYCSNEKM

SEQ ID NO: 70218 - protein, 9 aa, Homo Sapiens
PCKNGGTCC

SEQ ID NO: 70219 - protein, 9 aa, Homo Sapiens
AGTVFHYKR

SEQ ID NO: 70220 - protein, 9 aa, Homo Sapiens
GPCCKKEVS

SEQ ID NO: 70221 - protein, 9 aa, Homo Sapiens
TRCPPATAT

SEQ ID NO: 70222 - protein, 9 aa, Homo Sapiens
EETKECKSE

SEQ ID NO: 70223 - protein, 9 aa, Homo Sapiens
QFYWGVKEQ

SEQ ID NO: 70224 - protein, 9 aa, Homo Sapiens
FMGVQSGHM

SEQ ID NO: 70225 - protein, 9 aa, Homo Sapiens
IRILKIIVI

SEQ ID NO: 70226 - protein, 9 aa, Homo Sapiens
ERYCKDINE

SEQ ID NO: 70227 - protein, 9 aa, Homo Sapiens
CDYVNSYTC

SEQ ID NO: 70228 - protein, 9 aa, Homo Sapiens
TPGPGPECP

SEQ ID NO: 70229 - protein, 9 aa, Homo Sapiens
DAESLTTLT

SEQ ID NO: 70230 - protein, 9 aa, Homo Sapiens
QEAVWEAYQ

SEQ ID NO: 70231 - protein, 9 aa, Homo Sapiens
RSQDKFLSS

SEQ ID NO: 70232 - protein, 9 aa, Homo Sapiens
ISTRDPLSK

SEQ ID NO: 70233 - protein, 9 aa, Homo Sapiens
TVNTEASSL

SEQ ID NO: 70234 - protein, 9 aa, Homo Sapiens
WIKANPVPN

SEQ ID NO: 70235 - protein, 9 aa, Homo Sapiens
GFQLASDER

SEQ ID NO: 70236 - protein, 9 aa, Homo Sapiens
NTEASSLKT

SEQ ID NO: 70237 - protein, 9 aa, Homo Sapiens
RDGQYFQPV

SEQ ID NO: 70238 - protein, 9 aa, Homo Sapiens
AAAEAAAVA

SEQ ID NO: 70239 - protein, 9 aa, Homo Sapiens
ISLCLIFYY

SEQ ID NO: 70240 - protein, 9 aa, Homo Sapiens
EEEDGKQGP

SEQ ID NO: 70241 - protein, 9 aa, Homo Sapiens
DKIKGVFER

SEQ ID NO: 70242 - protein, 9 aa, Homo Sapiens
KWMLTKKQF

SEQ ID NO: 70243 - protein, 9 aa, Homo Sapiens
IYAWPKALS

SEQ ID NO: 70244 - protein, 9 aa, Homo Sapiens
VQSGHMKEG

SEQ ID NO: 70245 - protein, 9 aa, Homo Sapiens
VAEGNHLTV

SEQ ID NO: 70246 - protein, 9 aa, Homo Sapiens
KFVLLHRAR

SEQ ID NO: 70247 - protein, 9 aa, Homo Sapiens
DLSVQGSHN

SEQ ID NO: 70248 - protein, 9 aa, Homo Sapiens
APRGEQQEH

SEQ ID NO: 70249 - protein, 9 aa, Homo Sapiens
GMDKSNKST

SEQ ID NO: 70250 - protein, 9 aa, Homo Sapiens
NKLFVLDDR

SEQ ID NO: 70251 - protein, 9 aa, Homo Sapiens
YCSNEKMRR

SEQ ID NO: 70252 - protein, 9 aa, Homo Sapiens
LFSDNHCMQ

SEQ ID NO: 70253 - protein, 9 aa, Homo Sapiens
RLEPASSPM

SEQ ID NO: 70254 - protein, 9 aa, Homo Sapiens
CGLHWALYS

SEQ ID NO: 70255 - protein, 9 aa, Homo Sapiens
CRVFATKMA

SEQ ID NO: 70256 - protein, 9 aa, Homo Sapiens
TKEGEKLAT

SEQ ID NO: 70257 - protein, 9 aa, Homo Sapiens
GKKRSLAIT

SEQ ID NO: 70258 - protein, 9 aa, Homo Sapiens
GNHLTVKCT

SEQ ID NO: 70259 - protein, 9 aa, Homo Sapiens
KTTPIIAPF

SEQ ID NO: 70260 - protein, 9 aa, Homo Sapiens
SVSDIDGID

SEQ ID NO: 70261 - protein, 9 aa, Homo Sapiens
GRGMDKSNK

SEQ ID NO: 70262 - protein, 9 aa, Homo Sapiens
QPVVPLPDL

SEQ ID NO: 70263 - protein, 9 aa, Homo Sapiens
LSKITEQEK

SEQ ID NO: 70264 - protein, 9 aa, Homo Sapiens
KKQFGLLSL

SEQ ID NO: 70265 - protein, 9 aa, Homo Sapiens
AYQIFLDRI

SEQ ID NO: 70266 - protein, 9 aa, Homo Sapiens
QDVKPFRIL

SEQ ID NO: 70267 - protein, 9 aa, Homo Sapiens
TYTVLKNED

SEQ ID NO: 70268 - protein, 9 aa, Homo Sapiens
EKQSFNLKR

SEQ ID NO: 70269 - protein, 9 aa, Homo Sapiens
VYCSNEKMR

SEQ ID NO: 70270 - protein, 9 aa, Homo Sapiens
AWPKALSAF

SEQ ID NO: 70271 - protein, 9 aa, Homo Sapiens
ESLTTLTAR

SEQ ID NO: 70272 - protein, 9 aa, Homo Sapiens
SSPMASRST

SEQ ID NO: 70273 - protein, 9 aa, Homo Sapiens
EQQEHGNPG

SEQ ID NO: 70274 - protein, 9 aa, Homo Sapiens
SNAPDGAGS

SEQ ID NO: 70275 - protein, 9 aa, Homo Sapiens
KNGGTCCDY

SEQ ID NO: 70276 - protein, 9 aa, Homo Sapiens
FLFSDNHCM

SEQ ID NO: 70277 - protein, 9 aa, Homo Sapiens
SSEPSNGAK

SEQ ID NO: 70278 - protein, 9 aa, Homo Sapiens
VPNGHSRWG

SEQ ID NO: 70279 - protein, 9 aa, Homo Sapiens
FTTGLLKVS

SEQ ID NO: 70280 - protein, 9 aa, Homo Sapiens
TTPIIAPFS

SEQ ID NO: 70281 - protein, 9 aa, Homo Sapiens
TIYKQSQHM

SEQ ID NO: 70282 - protein, 9 aa, Homo Sapiens
KGYVHIVEA

SEQ ID NO: 70283 - protein, 9 aa, Homo Sapiens
LVVLCGLHW

SEQ ID NO: 70284 - protein, 9 aa, Homo Sapiens
VIFALVDGK

SEQ ID NO: 70285 - protein, 9 aa, Homo Sapiens
THKRGSKEP

SEQ ID NO: 70286 - protein, 9 aa, Homo Sapiens
METTYTVLK

SEQ ID NO: 70287 - protein, 9 aa, Homo Sapiens
FEGFTTGLL

SEQ ID NO: 70288 - protein, 9 aa, Homo Sapiens
NFAYVPIKT

SEQ ID NO: 70289 - protein, 9 aa, Homo Sapiens
GVQSGHMKE

SEQ ID NO: 70290 - protein, 9 aa, Homo Sapiens
LMQDVKPFR

SEQ ID NO: 70291 - protein, 9 aa, Homo Sapiens
SFWSFDECN

SEQ ID NO: 70292 - protein, 9 aa, Homo Sapiens
LSGPPPGGA

SEQ ID NO: 70293 - protein, 9 aa, Homo Sapiens
KRGNREWYN

SEQ ID NO: 70294 - protein, 9 aa, Homo Sapiens
CFLFLIEHL

SEQ ID NO: 70295 - protein, 9 aa, Homo Sapiens
GQSPSYGRQ

SEQ ID NO: 70296 - protein, 9 aa, Homo Sapiens
GHVDAESLT

SEQ ID NO: 70297 - protein, 9 aa, Homo Sapiens
CCPSCGVSS

SEQ ID NO: 70298 - protein, 9 aa, Homo Sapiens
HKTAGKHYV

SEQ ID NO: 70299 - protein, 9 aa, Homo Sapiens
LIVYIFTKL

SEQ ID NO: 70300 - protein, 9 aa, Homo Sapiens
DIKPSTEGE

SEQ ID NO: 70301 - protein, 9 aa, Homo Sapiens
PALSLDTFS

SEQ ID NO: 70302 - protein, 9 aa, Homo Sapiens
PEEADREDK

SEQ ID NO: 70303 - protein, 9 aa, Homo Sapiens
VKPFRILIS

SEQ ID NO: 70304 - protein, 9 aa, Homo Sapiens
LLVVLCGLH

SEQ ID NO: 70305 - protein, 9 aa, Homo Sapiens
DREDKVEPG

SEQ ID NO: 70306 - protein, 9 aa, Homo Sapiens
IKARLGRMV

SEQ ID NO: 70307 - protein, 9 aa, Homo Sapiens
FYWGVKEQE

SEQ ID NO: 70308 - protein, 9 aa, Homo Sapiens
SATALRHET

SEQ ID NO: 70309 - protein, 9 aa, Homo Sapiens
TPALSGPPP

SEQ ID NO: 70310 - protein, 9 aa, Homo Sapiens
VGYNKLFVL

SEQ ID NO: 70311 - protein, 9 aa, Homo Sapiens
TVFHYKRPT

SEQ ID NO: 70312 - protein, 9 aa, Homo Sapiens
KVEPGCHHI

SEQ ID NO: 70313 - protein, 9 aa, Homo Sapiens
PNGHSRWGT

SEQ ID NO: 70314 - protein, 9 aa, Homo Sapiens
AHNDDPTDH

SEQ ID NO: 70315 - protein, 9 aa, Homo Sapiens
AYVPIKTIW

SEQ ID NO: 70316 - protein, 9 aa, Homo Sapiens
NKQVFEGFT

SEQ ID NO: 70317 - protein, 9 aa, Homo Sapiens
TPIIAPFSS

SEQ ID NO: 70318 - protein, 9 aa, Homo Sapiens
GQTQTLNKV

SEQ ID NO: 70319 - protein, 9 aa, Homo Sapiens
LTSQHWLVL

SEQ ID NO: 70320 - protein, 9 aa, Homo Sapiens
TDSLADIKA

SEQ ID NO: 70321 - protein, 9 aa, Homo Sapiens
ALTDSLADI

SEQ ID NO: 70322 - protein, 9 aa, Homo Sapiens
LVERGNYDI

SEQ ID NO: 70323 - protein, 9 aa, Homo Sapiens
LIGQTQTLN

SEQ ID NO: 70324 - protein, 9 aa, Homo Sapiens
EAYQIFLDR

SEQ ID NO: 70325 - protein, 9 aa, Homo Sapiens
GKEAGIASG

SEQ ID NO: 70326 - protein, 9 aa, Homo Sapiens
VLKRKVYCS

SEQ ID NO: 70327 - protein, 9 aa, Homo Sapiens
TALRHETLK

SEQ ID NO: 70328 - protein, 9 aa, Homo Sapiens
QEHGNPGPH

SEQ ID NO: 70329 - protein, 9 aa, Homo Sapiens
SYHDKEMSA

SEQ ID NO: 70330 - protein, 9 aa, Homo Sapiens
ASSPMASRS

SEQ ID NO: 70331 - protein, 9 aa, Homo Sapiens
RHETLKKTN

SEQ ID NO: 70332 - protein, 9 aa, Homo Sapiens
VWEAYQIFL

SEQ ID NO: 70333 - protein, 9 aa, Homo Sapiens
LASDERYCK

SEQ ID NO: 70334 - protein, 9 aa, Homo Sapiens
GNRQRHIIY

SEQ ID NO: 70335 - protein, 9 aa, Homo Sapiens
RPEKIPHLK

SEQ ID NO: 70336 - protein, 9 aa, Homo Sapiens
GFTTGLLKV

SEQ ID NO: 70337 - protein, 9 aa, Homo Sapiens
MYYLLWHPE

SEQ ID NO: 70338 - protein, 9 aa, Homo Sapiens
KFLSSLESY

SEQ ID NO: 70339 - protein, 9 aa, Homo Sapiens
FQPVVPLPD

SEQ ID NO: 70340 - protein, 9 aa, Homo Sapiens
LELTAYDIF

SEQ ID NO: 70341 - protein, 9 aa, Homo Sapiens
LCGLHWALY

SEQ ID NO: 70342 - protein, 9 aa, Homo Sapiens
VAGTVFHYK

SEQ ID NO: 70343 - protein, 9 aa, Homo Sapiens
QDIKALKYA

SEQ ID NO: 70344 - protein, 9 aa, Homo Sapiens
VATLLNYMS

SEQ ID NO: 70345 - protein, 9 aa, Homo Sapiens
QYFQPVVPL

SEQ ID NO: 70346 - protein, 9 aa, Homo Sapiens
PECPGPPGL

SEQ ID NO: 70347 - protein, 9 aa, Homo Sapiens
LKTVIPTQT

SEQ ID NO: 70348 - protein, 9 aa, Homo Sapiens
VYIFTKLSV

SEQ ID NO: 70349 - protein, 9 aa, Homo Sapiens
SHKSEISNA

SEQ ID NO: 70350 - protein, 9 aa, Homo Sapiens
EPASSPMAS

SEQ ID NO: 70351 - protein, 9 aa, Homo Sapiens
PMASRSTNT

SEQ ID NO: 70352 - protein, 9 aa, Homo Sapiens
NVIFALVDG

SEQ ID NO: 70353 - protein, 9 aa, Homo Sapiens
ANSMNGRKP

SEQ ID NO: 70354 - protein, 9 aa, Homo Sapiens
REWYNRILN

SEQ ID NO: 70355 - protein, 9 aa, Homo Sapiens
HNRSLSLGD

SEQ ID NO: 70356 - protein, 9 aa, Homo Sapiens
RKPGGRGGN

SEQ ID NO: 70357 - protein, 9 aa, Homo Sapiens
KSEISNAPD

SEQ ID NO: 70358 - protein, 9 aa, Homo Sapiens
IYSYHDKEM

SEQ ID NO: 70359 - protein, 9 aa, Homo Sapiens
HDKEMSATF

SEQ ID NO: 70360 - protein, 9 aa, Homo Sapiens
YIKRSIQDI

SEQ ID NO: 70361 - protein, 9 aa, Homo Sapiens
DTFSPVRKP

SEQ ID NO: 70362 - protein, 9 aa, Homo Sapiens
AAREKQSFN

SEQ ID NO: 70363 - protein, 9 aa, Homo Sapiens
FWSFDECNP

SEQ ID NO: 70364 - protein, 9 aa, Homo Sapiens
ALSLIVYIF

SEQ ID NO: 70365 - protein, 9 aa, Homo Sapiens
KRGSKEPST

SEQ ID NO: 70366 - protein, 9 aa, Homo Sapiens
HIDGLEESF

SEQ ID NO: 70367 - protein, 9 aa, Homo Sapiens
PIKTIWSTM

SEQ ID NO: 70368 - protein, 9 aa, Homo Sapiens
KERLVLTSQ

SEQ ID NO: 70369 - protein, 9 aa, Homo Sapiens
RQVSTKEGE

SEQ ID NO: 70370 - protein, 9 aa, Homo Sapiens
AEAAAVAEA

SEQ ID NO: 70371 - protein, 9 aa, Homo Sapiens
GITALNSIQ

SEQ ID NO: 70372 - protein, 9 aa, Homo Sapiens
SIISLCLIF

SEQ ID NO: 70373 - protein, 9 aa, Homo Sapiens
ILIGQTQTL

SEQ ID NO: 70374 - protein, 9 aa, Homo Sapiens
RQGSGSGRS

SEQ ID NO: 70375 - protein, 9 aa, Homo Sapiens
GDKIAMVIV

SEQ ID NO: 70376 - protein, 9 aa, Homo Sapiens
GGGRSCVGK

SEQ ID NO: 70377 - protein, 9 aa, Homo Sapiens
FFQGNRQRH

SEQ ID NO: 70378 - protein, 9 aa, Homo Sapiens
DQYVQIRIL

SEQ ID NO: 70379 - protein, 9 aa, Homo Sapiens
NPIIYSYHD

SEQ ID NO: 70380 - protein, 9 aa, Homo Sapiens
SLADIKARL

SEQ ID NO: 70381 - protein, 9 aa, Homo Sapiens
FSDNHCMQA

SEQ ID NO: 70382 - protein, 9 aa, Homo Sapiens
NGRKPGGRG

SEQ ID NO: 70383 - protein, 9 aa, Homo Sapiens
PKTHKRGSK

SEQ ID NO: 70384 - protein, 9 aa, Homo Sapiens
GNVIFALVD

SEQ ID NO: 70385 - protein, 9 aa, Homo Sapiens
QAIELLFQL

SEQ ID NO: 70386 - protein, 9 aa, Homo Sapiens
YTVLKNEDT

SEQ ID NO: 70387 - protein, 9 aa, Homo Sapiens
CTQKFSYEE

SEQ ID NO: 70388 - protein, 9 aa, Homo Sapiens
SMNGRKPGG

SEQ ID NO: 70389 - protein, 9 aa, Homo Sapiens
GTRVRAMTI

SEQ ID NO: 70390 - protein, 9 aa, Homo Sapiens
THAFRSQDK

SEQ ID NO: 70391 - protein, 9 aa, Homo Sapiens
YFQPVVPLP

SEQ ID NO: 70392 - protein, 9 aa, Homo Sapiens
LTARTSSSR

SEQ ID NO: 70393 - protein, 9 aa, Homo Sapiens
NRILNDKSP

SEQ ID NO: 70394 - protein, 9 aa, Homo Sapiens
AIELLFQLG

SEQ ID NO: 70395 - protein, 9 aa, Homo Sapiens
ELTAYDIFE

SEQ ID NO: 70396 - protein, 9 aa, Homo Sapiens
KFSYEEIAM

SEQ ID NO: 70397 - protein, 9 aa, Homo Sapiens
RSIQDIKAL

SEQ ID NO: 70398 - protein, 9 aa, Homo Sapiens
TGNRVATLL

SEQ ID NO: 70399 - protein, 9 aa, Homo Sapiens
CPPATATSP

SEQ ID NO: 70400 - protein, 9 aa, Homo Sapiens
GPECPGPPG

SEQ ID NO: 70401 - protein, 9 aa, Homo Sapiens
EEADREDKV

SEQ ID NO: 70402 - protein, 9 aa, Homo Sapiens
IHKTAGKHY

SEQ ID NO: 70403 - protein, 9 aa, Homo Sapiens
VVLCGLHWA

SEQ ID NO: 70404 - protein, 9 aa, Homo Sapiens
ALSLDTFSP

SEQ ID NO: 70405 - protein, 9 aa, Homo Sapiens
YQFYWGVKE

SEQ ID NO: 70406 - protein, 9 aa, Homo Sapiens
AASIFIYAW

SEQ ID NO: 70407 - protein, 9 aa, Homo Sapiens
RQSSEPSNG

SEQ ID NO: 70408 - protein, 9 aa, Homo Sapiens
QVNVAEGNH

SEQ ID NO: 70409 - protein, 9 aa, Homo Sapiens
LRLRHIDGL

SEQ ID NO: 70410 - protein, 9 aa, Homo Sapiens
ENTLMQDVK

SEQ ID NO: 70411 - protein, 9 aa, Homo Sapiens
LLWHPEAMA

SEQ ID NO: 70412 - protein, 9 aa, Homo Sapiens
MGVQSGHMK

SEQ ID NO: 70413 - protein, 9 aa, Homo Sapiens
DKWMLTKKQ

SEQ ID NO: 70414 - protein, 9 aa, Homo Sapiens
GVKEQEAFE

SEQ ID NO: 70415 - protein, 9 aa, Homo Sapiens
TAYDIFERD

SEQ ID NO: 70416 - protein, 9 aa, Homo Sapiens
RAMTIYKQS

SEQ ID NO: 70417 - protein, 9 aa, Homo Sapiens
LTPGPGPEC

SEQ ID NO: 70418 - protein, 9 aa, Homo Sapiens
EASSLKTVI

SEQ ID NO: 70419 - protein, 9 aa, Homo Sapiens
ETLKKTNAR

SEQ ID NO: 70420 - protein, 9 aa, Homo Sapiens
DASVSDIDG

SEQ ID NO: 70421 - protein, 9 aa, Homo Sapiens
LSVQGSHNR

SEQ ID NO: 70422 - protein, 9 aa, Homo Sapiens
GNREWYNRI

SEQ ID NO: 70423 - protein, 9 aa, Homo Sapiens
PVPNGHSRW

SEQ ID NO: 70424 - protein, 9 aa, Homo Sapiens
YKFPAVITR

SEQ ID NO: 70425 - protein, 9 aa, Homo Sapiens
RILKIIVIG

SEQ ID NO: 70426 - protein, 9 aa, Homo Sapiens
KEQEAFECL

SEQ ID NO: 70427 - protein, 9 aa, Homo Sapiens
DSLADIKAR

SEQ ID NO: 70428 - protein, 9 aa, Homo Sapiens
PPPGGAESV

SEQ ID NO: 70429 - protein, 9 aa, Homo Sapiens
TARTSSSRP

SEQ ID NO: 70430 - protein, 9 aa, Homo Sapiens
VMEETKECK

SEQ ID NO: 70431 - protein, 9 aa, Homo Sapiens
EQQKDASVS

SEQ ID NO: 70432 - protein, 9 aa, Homo Sapiens
TRDPLSKIT

SEQ ID NO: 70433 - protein, 9 aa, Homo Sapiens
EKIPHLKLL

SEQ ID NO: 70434 - protein, 9 aa, Homo Sapiens
HIIYRVTSQ

SEQ ID NO: 70435 - protein, 9 aa, Homo Sapiens
AMYYLLWHP

SEQ ID NO: 70436 - protein, 9 aa, Homo Sapiens
ERGNYDIAA

SEQ ID NO: 70437 - protein, 9 aa, Homo Sapiens
FWAMYYLLW

SEQ ID NO: 70438 - protein, 9 aa, Homo Sapiens
QGVYRKAVV

SEQ ID NO: 70439 - protein, 9 aa, Homo Sapiens
GFIKVGYNK

SEQ ID NO: 70440 - protein, 9 aa, Homo Sapiens
RVATLLNYM

SEQ ID NO: 70441 - protein, 9 aa, Homo Sapiens
KHGRGMDKS

SEQ ID NO: 70442 - protein, 9 aa, Homo Sapiens
EQYKFPAVI

SEQ ID NO: 70443 - protein, 9 aa, Homo Sapiens
GTVFHYKRP

SEQ ID NO: 70444 - protein, 9 aa, Homo Sapiens
FQGNRQRHI

SEQ ID NO: 70445 - protein, 9 aa, Homo Sapiens
LLGLIGYYL

SEQ ID NO: 70446 - protein, 9 aa, Homo Sapiens
YQIFLDRIP

SEQ ID NO: 70447 - protein, 9 aa, Homo Sapiens
EETCRVFAT

SEQ ID NO: 70448 - protein, 9 aa, Homo Sapiens
AESLTTLTA

SEQ ID NO: 70449 - protein, 9 aa, Homo Sapiens
RYSDIKPST

SEQ ID NO: 70450 - protein, 9 aa, Homo Sapiens
NSPYEGPCC

SEQ ID NO: 70451 - protein, 9 aa, Homo Sapiens
YHDKEMSAT

SEQ ID NO: 70452 - protein, 9 aa, Homo Sapiens
DVKPFRILI

SEQ ID NO: 70453 - protein, 9 aa, Homo Sapiens
VLKNEDTKS

SEQ ID NO: 70454 - protein, 9 aa, Homo Sapiens
HETLKKTNA

SEQ ID NO: 70455 - protein, 9 aa, Homo Sapiens
SPSYGRQGS

SEQ ID NO: 70456 - protein, 9 aa, Homo Sapiens
NHLVERGNY

SEQ ID NO: 70457 - protein, 9 aa, Homo Sapiens
VFEGFTTGL

SEQ ID NO: 70458 - protein, 9 aa, Homo Sapiens
DKIAMVIVY

SEQ ID NO: 70459 - protein, 9 aa, Homo Sapiens
WHPEAMAAV

SEQ ID NO: 70460 - protein, 9 aa, Homo Sapiens
KFDVAGTVF

SEQ ID NO: 70461 - protein, 9 aa, Homo Sapiens
SLKTVIPTQ

SEQ ID NO: 70462 - protein, 9 aa, Homo Sapiens
CQTTCCPSC

SEQ ID NO: 70463 - protein, 9 aa, Homo Sapiens
MVIVYFVAL

SEQ ID NO: 70464 - protein, 9 aa, Homo Sapiens
YVHIVEAIL

SEQ ID NO: 70465 - protein, 9 aa, Homo Sapiens
LKIIVIGDS

SEQ ID NO: 70466 - protein, 9 aa, Homo Sapiens
NGHSRWGTF

SEQ ID NO: 70467 - protein, 9 aa, Homo Sapiens
LDTFSPVRK

SEQ ID NO: 70468 - protein, 9 aa, Homo Sapiens
LTELDKIKG

SEQ ID NO: 70469 - protein, 9 aa, Homo Sapiens
NHLTVKCTY

SEQ ID NO: 70470 - protein, 9 aa, Homo Sapiens
AEGNHLTVK

SEQ ID NO: 70471 - protein, 9 aa, Homo Sapiens
PEKIPHLKL

SEQ ID NO: 70472 - protein, 9 aa, Homo Sapiens
YEEIAMATV

SEQ ID NO: 70473 - protein, 9 aa, Homo Sapiens
KGVFERPSD

SEQ ID NO: 70474 - protein, 9 aa, Homo Sapiens
KVGYNKLFV

SEQ ID NO: 70475 - protein, 9 aa, Homo Sapiens
KIKGVFERP

SEQ ID NO: 70476 - protein, 9 aa, Homo Sapiens
MQASSCNCF

SEQ ID NO: 70477 - protein, 9 aa, Homo Sapiens
KRSLAITGG

SEQ ID NO: 70478 - protein, 9 aa, Homo Sapiens
QTQTLNKVV

SEQ ID NO: 70479 - protein, 9 aa, Homo Sapiens
ASDERYCKD

SEQ ID NO: 70480 - protein, 9 aa, Homo Sapiens
SPAPRGEQQ

SEQ ID NO: 70481 - protein, 9 aa, Homo Sapiens
VDAESLTTL

SEQ ID NO: 70482 - protein, 9 aa, Homo Sapiens
NGGTCCDYV

SEQ ID NO: 70483 - protein, 9 aa, Homo Sapiens
PAVITRSSN

SEQ ID NO: 70484 - protein, 9 aa, Homo Sapiens
LSALGNVIF

SEQ ID NO: 70485 - protein, 9 aa, Homo Sapiens
VRAMTIYKQ

SEQ ID NO: 70486 - protein, 9 aa, Homo Sapiens
KANPVPNGH

SEQ ID NO: 70487 - protein, 9 aa, Homo Sapiens
HYVYRFVCD

SEQ ID NO: 70488 - protein, 9 aa, Homo Sapiens
DVAGTVFHY

SEQ ID NO: 70489 - protein, 9 aa, Homo Sapiens
YNKLFVLDD

SEQ ID NO: 70490 - protein, 9 aa, Homo Sapiens
SYGRQGSGS

SEQ ID NO: 70491 - protein, 9 aa, Homo Sapiens
KFPAVITRS

SEQ ID NO: 70492 - protein, 9 aa, Homo Sapiens
CSNEKMRRG

SEQ ID NO: 70493 - protein, 9 aa, Homo Sapiens
TLMQDVKPF

SEQ ID NO: 70494 - protein, 9 aa, Homo Sapiens
SDNHCMQAS

SEQ ID NO: 70495 - protein, 9 aa, Homo Sapiens
HGRGMDKSN

SEQ ID NO: 70496 - protein, 9 aa, Homo Sapiens
KTAGKHYVY

SEQ ID NO: 70497 - protein, 9 aa, Homo Sapiens
PCCKKEVSA

SEQ ID NO: 70498 - protein, 9 aa, Homo Sapiens
KIAMVIVYF

SEQ ID NO: 70499 - protein, 9 aa, Homo Sapiens
RVRAMTIYK

SEQ ID NO: 70500 - protein, 9 aa, Homo Sapiens
FDVAGTVFH

SEQ ID NO: 70501 - protein, 9 aa, Homo Sapiens
ISKGYVHIV

SEQ ID NO: 70502 - protein, 9 aa, Homo Sapiens
GNYDIAARK

SEQ ID NO: 70503 - protein, 9 aa, Homo Sapiens
EVMEETKEC

SEQ ID NO: 70504 - protein, 9 aa, Homo Sapiens
FRSQDKFLS

SEQ ID NO: 70505 - protein, 9 aa, Homo Sapiens
GRQGSGSGR

SEQ ID NO: 70506 - protein, 9 aa, Homo Sapiens
SLTTLTART

SEQ ID NO: 70507 - protein, 9 aa, Homo Sapiens
HLVERGNYD

SEQ ID NO: 70508 - protein, 9 aa, Homo Sapiens
STRDPLSKI

SEQ ID NO: 70509 - protein, 9 aa, Homo Sapiens
WYNRILNDK

SEQ ID NO: 70510 - protein, 9 aa, Homo Sapiens
KTHKRGSKE

SEQ ID NO: 70511 - protein, 9 aa, Homo Sapiens
RKVYCSNEK

SEQ ID NO: 70512 - protein, 9 aa, Homo Sapiens
DIKARLGRM

SEQ ID NO: 70513 - protein, 9 aa, Homo Sapiens
DPLSKITEQ

SEQ ID NO: 70514 - protein, 9 aa, Homo Sapiens
PEFEETCRV

SEQ ID NO: 70515 - protein, 9 aa, Homo Sapiens
KECKSEEEL

SEQ ID NO: 70516 - protein, 9 aa, Homo Sapiens
HWALYSIFD

SEQ ID NO: 70517 - protein, 9 aa, Homo Sapiens
SEPSNGAKL

SEQ ID NO: 70518 - protein, 9 aa, Homo Sapiens
KIPHLKLLV

SEQ ID NO: 70519 - protein, 9 aa, Homo Sapiens
TEASSLKTV

SEQ ID NO: 70520 - protein, 9 aa, Homo Sapiens
GPPPGGAES

SEQ ID NO: 70521 - protein, 9 aa, Homo Sapiens
LRHIDGLEE

SEQ ID NO: 70522 - protein, 9 aa, Homo Sapiens
RKFDVAGTV

SEQ ID NO: 70523 - protein, 9 aa, Homo Sapiens
SDIDGIDIE

SEQ ID NO: 70524 - protein, 9 aa, Homo Sapiens
YYLYRKANR

SEQ ID NO: 70525 - protein, 9 aa, Homo Sapiens
ATLLNYMSD

SEQ ID NO: 70526 - protein, 9 aa, Homo Sapiens
VSTKEGEKL

SEQ ID NO: 70527 - protein, 9 aa, Homo Sapiens
KPGGRGGNP

SEQ ID NO: 70528 - protein, 9 aa, Homo Sapiens
TFSPVRKPP

SEQ ID NO: 70529 - protein, 9 aa, Homo Sapiens
YSDIKPSTE

SEQ ID NO: 70530 - protein, 9 aa, Homo Sapiens
EAAAVAEAA

SEQ ID NO: 70531 - protein, 9 aa, Homo Sapiens
REKQSFNLK

SEQ ID NO: 70532 - protein, 9 aa, Homo Sapiens
EAGTASGGK

SEQ ID NO: 70533 - protein, 9 aa, Homo Sapiens
IVYIFTKLS

SEQ ID NO: 70534 - protein, 9 aa, Homo Sapiens
AGKHYVYRF

SEQ ID NO: 70535 - protein, 9 aa, Homo Sapiens
FIKVGYNKL

SEQ ID NO: 70536 - protein, 9 aa, Homo Sapiens
SSEQERMGL

SEQ ID NO: 70537 - protein, 9 aa, Homo Sapiens
EAVWEAYQI

SEQ ID NO: 70538 - protein, 9 aa, Homo Sapiens
AAAVAEAAA

SEQ ID NO: 70539 - protein, 9 aa, Homo Sapiens
SALGNVIFA

SEQ ID NO: 70540 - protein, 9 aa, Homo Sapiens
CCQTTCCPS

SEQ ID NO: 70541 - protein, 9 aa, Homo Sapiens
TNSPYEGPC

SEQ ID NO: 70542 - protein, 9 aa, Homo Sapiens
GEQQEHGNP

SEQ ID NO: 70543 - protein, 9 aa, Homo Sapiens
TNSSEQERM

SEQ ID NO: 70544 - protein, 9 aa, Homo Sapiens
KPSTEGEVI

SEQ ID NO: 70545 - protein, 9 aa, Homo Sapiens
EEDGKQGPP

SEQ ID NO: 70546 - protein, 9 aa, Homo Sapiens
LFLIEHLND

SEQ ID NO: 70547 - protein, 9 aa, Homo Sapiens
GVPTRCPPA

SEQ ID NO: 70548 - protein, 9 aa, Homo Sapiens
PRDNQAIEL

SEQ ID NO: 70549 - protein, 9 aa, Homo Sapiens
NPVPNGHSR

SEQ ID NO: 70550 - protein, 9 aa, Homo Sapiens
YYLLWHPEA

SEQ ID NO: 70551 - protein, 9 aa, Homo Sapiens
SRYSDIKPS

SEQ ID NO: 70552 - protein, 9 aa, Homo Sapiens
VRQSSEPSN

SEQ ID NO: 70553 - protein, 9 aa, Homo Sapiens
MEETKECKS

SEQ ID NO: 70554 - protein, 9 aa, Homo Sapiens
VSDIDGIDI

SEQ ID NO: 70555 - protein, 9 aa, Homo Sapiens
QEEEDGKQG

SEQ ID NO: 70556 - protein, 9 aa, Homo Sapiens
QGNRQRHII

SEQ ID NO: 70557 - protein, 9 aa, Homo Sapiens
FSPVRKPPN

SEQ ID NO: 70558 - protein, 9 aa, Homo Sapiens
YVPIKTIWS

SEQ ID NO: 70559 - protein, 9 aa, Homo Sapiens
ANPVPNGHS

SEQ ID NO: 70560 - protein, 9 aa, Homo Sapiens
TSQHWLVLV

SEQ ID NO: 70561 - protein, 9 aa, Homo Sapiens
LHWALYSIF

SEQ ID NO: 70562 - protein, 9 aa, Homo Sapiens
SIQDIKALK

SEQ ID NO: 70563 - protein, 9 aa, Homo Sapiens
KKRSLAITG

SEQ ID NO: 70564 - protein, 9 aa, Homo Sapiens
FQLASDERY

SEQ ID NO: 70565 - protein, 9 aa, Homo Sapiens
DECNPHYAS

SEQ ID NO: 70566 - protein, 9 aa, Homo Sapiens
DSRYSDIKP

SEQ ID NO: 70567 - protein, 9 aa, Homo Sapiens
SVQGSHNRS

SEQ ID NO: 70568 - protein, 9 aa, Homo Sapiens
KITEQEKDF

SEQ ID NO: 70569 - protein, 9 aa, Homo Sapiens
LLHRARSGL

SEQ ID NO: 70570 - protein, 9 aa, Homo Sapiens
ACTQKFSYE

SEQ ID NO: 70571 - protein, 9 aa, Homo Sapiens
VERGNYDIA

SEQ ID NO: 70572 - protein, 9 aa, Homo Sapiens
FDECNPHYA

SEQ ID NO: 70573 - protein, 9 aa, Homo Sapiens
KEGEKLATE

SEQ ID NO: 70574 - protein, 9 aa, Homo Sapiens
HSRQVSTKE

SEQ ID NO: 70575 - protein, 9 aa, Homo Sapiens
LHRARSGLK

SEQ ID NO: 70576 - protein, 9 aa, Homo Sapiens
ISNAPDGAG

SEQ ID NO: 70577 - protein, 9 aa, Homo Sapiens
QERMGLPRD

SEQ ID NO: 70578 - protein, 9 aa, Homo Sapiens
TTYTVLKNE

SEQ ID NO: 70579 - protein, 9 aa, Homo Sapiens
GLTQKYQEL

SEQ ID NO: 70580 - protein, 9 aa, Homo Sapiens
CRLLQRYNE

SEQ ID NO: 70581 - protein, 9 aa, Homo Sapiens
NGKCYYCRE

SEQ ID NO: 70582 - protein, 9 aa, Homo Sapiens
AVNLIECHP

SEQ ID NO: 70583 - protein, 9 aa, Homo Sapiens
NTCFNGKCY

SEQ ID NO: 70584 - protein, 9 aa, Homo Sapiens
IWKSLIVHE

SEQ ID NO: 70585 - protein, 9 aa, Homo Sapiens
KRRGHLSEK

SEQ ID NO: 70586 - protein, 9 aa, Homo Sapiens
NSAKLDEAN

SEQ ID NO: 70587 - protein, 9 aa, Homo Sapiens
LHTTLALPP

SEQ ID NO: 70588 - protein, 9 aa, Homo Sapiens
TIENELNQT

SEQ ID NO: 70589 - protein, 9 aa, Homo Sapiens
GIKMAAIRG

SEQ ID NO: 70590 - protein, 9 aa, Homo Sapiens
KHFHSHLGV

SEQ ID NO: 70591 - protein, 9 aa, Homo Sapiens
EFPNNYPSG

SEQ ID NO: 70592 - protein, 9 aa, Homo Sapiens
ALKSNYNRG

SEQ ID NO: 70593 - protein, 9 aa, Homo Sapiens
TTLALPPPQ

SEQ ID NO: 70594 - protein, 9 aa, Homo Sapiens
QIMHRFIPD

SEQ ID NO: 70595 - protein, 9 aa, Homo Sapiens
SGSQTTSAG

SEQ ID NO: 70596 - protein, 9 aa, Homo Sapiens
FNGKCYYCR

SEQ ID NO: 70597 - protein, 9 aa, Homo Sapiens
GKDVEFPNN

SEQ ID NO: 70598 - protein, 9 aa, Homo Sapiens
LSTEQWLWY

SEQ ID NO: 70599 - protein, 9 aa, Homo Sapiens
SCSTNTSEV

SEQ ID NO: 70600 - protein, 9 aa, Homo Sapiens
TNTSEVPRW

SEQ ID NO: 70601 - protein, 9 aa, Homo Sapiens
KSNYNRGNI

SEQ ID NO: 70602 - protein, 9 aa, Homo Sapiens
DRAEERRCR

SEQ ID NO: 70603 - protein, 9 aa, Homo Sapiens
SGLSVVTSG

SEQ ID NO: 70604 - protein, 9 aa, Homo Sapiens
EKSCKSKEC

SEQ ID NO: 70605 - protein, 9 aa, Homo Sapiens
ARAILLGHS

SEQ ID NO: 70606 - protein, 9 aa, Homo Sapiens
IHTRGAPSV

SEQ ID NO: 70607 - protein, 9 aa, Homo Sapiens
GLAIILCIK

SEQ ID NO: 70608 - protein, 9 aa, Homo Sapiens
ILCIKTMFH

SEQ ID NO: 70609 - protein, 9 aa, Homo Sapiens
LTSLPFDCP

SEQ ID NO: 70610 - protein, 9 aa, Homo Sapiens
FPNNYPSGC

SEQ ID NO: 70611 - protein, 9 aa, Homo Sapiens
SKDTHIDAK

SEQ ID NO: 70612 - protein, 9 aa, Homo Sapiens
LLGHSCQWT

SEQ ID NO: 70613 - protein, 9 aa, Homo Sapiens
HSHLGVIES

SEQ ID NO: 70614 - protein, 9 aa, Homo Sapiens
KPSENINTP

SEQ ID NO: 70615 - protein, 9 aa, Homo Sapiens
KPAVNLIEC

SEQ ID NO: 70616 - protein, 9 aa, Homo Sapiens
LVIGQTRLE

SEQ ID NO: 70617 - protein, 9 aa, Homo Sapiens
TGEKSYVCT

SEQ ID NO: 70618 - protein, 9 aa, Homo Sapiens
CFNGKCYYC

SEQ ID NO: 70619 - protein, 9 aa, Homo Sapiens
WHMKIEELC

SEQ ID NO: 70620 - protein, 9 aa, Homo Sapiens
LCIKTMFHP

SEQ ID NO: 70621 - protein, 9 aa, Homo Sapiens
HRFIPDLLF

SEQ ID NO: 70622 - protein, 9 aa, Homo Sapiens
DTIENELNQ

SEQ ID NO: 70623 - protein, 9 aa, Homo Sapiens
KIKQIMHRF

SEQ ID NO: 70624 - protein, 9 aa, Homo Sapiens
IEEDDSGLS

SEQ ID NO: 70625 - protein, 9 aa, Homo Sapiens
EPHTHRTAK

SEQ ID NO: 70626 - protein, 9 aa, Homo Sapiens
RAEERRCRL

SEQ ID NO: 70627 - protein, 9 aa, Homo Sapiens
PNNYPSGCL

SEQ ID NO: 70628 - protein, 9 aa, Homo Sapiens
NTSEVPRWP

SEQ ID NO: 70629 - protein, 9 aa, Homo Sapiens
FVKHFHSHL

SEQ ID NO: 70630 - protein, 9 aa, Homo Sapiens
KSYVCTECG

SEQ ID NO: 70631 - protein, 9 aa, Homo Sapiens
SKEPKMQII

SEQ ID NO: 70632 - protein, 9 aa, Homo Sapiens
RFIPDLLFA

SEQ ID NO: 70633 - protein, 9 aa, Homo Sapiens
AVIEEMCNI

SEQ ID NO: 70634 - protein, 9 aa, Homo Sapiens
LSRFISWFP

SEQ ID NO: 70635 - protein, 9 aa, Homo Sapiens
DHLKKAVAV

SEQ ID NO: 70636 - protein, 9 aa, Homo Sapiens
GSQTTSAGT

SEQ ID NO: 70637 - protein, 9 aa, Homo Sapiens
ISMYKSFFI

SEQ ID NO: 70638 - protein, 9 aa, Homo Sapiens
IDAKELNKK

SEQ ID NO: 70639 - protein, 9 aa, Homo Sapiens
YITEKSCKS

SEQ ID NO: 70640 - protein, 9 aa, Homo Sapiens
YKIKQIMHR

SEQ ID NO: 70641 - protein, 9 aa, Homo Sapiens
FDQIFNPQG

SEQ ID NO: 70642 - protein, 9 aa, Homo Sapiens
AVNSKDTHI

SEQ ID NO: 70643 - protein, 9 aa, Homo Sapiens
DDSGLSVVT

SEQ ID NO: 70644 - protein, 9 aa, Homo Sapiens
VIEEMCNIL

SEQ ID NO: 70645 - protein, 9 aa, Homo Sapiens
SSGSQTTSA

SEQ ID NO: 70646 - protein, 9 aa, Homo Sapiens
AFIWKSLIV

SEQ ID NO: 70647 - protein, 9 aa, Homo Sapiens
PHTHRTAKA

SEQ ID NO: 70648 - protein, 9 aa, Homo Sapiens
EDDSGLSVV

SEQ ID NO: 70649 - protein, 9 aa, Homo Sapiens
KDVEFPNNY

SEQ ID NO: 70650 - protein, 9 aa, Homo Sapiens
THLINSAKL

SEQ ID NO: 70651 - protein, 9 aa, Homo Sapiens
ILVIGQTRL

SEQ ID NO: 70652 - protein, 9 aa, Homo Sapiens
IKMAAIRGE

SEQ ID NO: 70653 - protein, 9 aa, Homo Sapiens
IGQTRLEAT

SEQ ID NO: 70654 - protein, 9 aa, Homo Sapiens
SSKEPKMQI

SEQ ID NO: 70655 - protein, 9 aa, Homo Sapiens
LDTLKAGLT

SEQ ID NO: 70656 - protein, 9 aa, Homo Sapiens
LAIILCIKT

SEQ ID NO: 70657 - protein, 9 aa, Homo Sapiens
CKSKECEKT

SEQ ID NO: 70658 - protein, 9 aa, Homo Sapiens
THRTAKAQS

SEQ ID NO: 70659 - protein, 9 aa, Homo Sapiens
SLHTTLALP

SEQ ID NO: 70660 - protein, 9 aa, Homo Sapiens
LKKAVAVIE

SEQ ID NO: 70661 - protein, 9 aa, Homo Sapiens
RRCRLLQRY

SEQ ID NO: 70662 - protein, 9 aa, Homo Sapiens
STEQWLWYL

SEQ ID NO: 70663 - protein, 9 aa, Homo Sapiens
TLKAGLTQK

SEQ ID NO: 70664 - protein, 9 aa, Homo Sapiens
HRTAKAQSD

SEQ ID NO: 70665 - protein, 9 aa, Homo Sapiens
QKDTIENEL

SEQ ID NO: 70666 - protein, 9 aa, Homo Sapiens
AEERRCRLL

SEQ ID NO: 70667 - protein, 9 aa, Homo Sapiens
IEELCLQEL

SEQ ID NO: 70668 - protein, 9 aa, Homo Sapiens
KNETCCAAT

SEQ ID NO: 70669 - protein, 9 aa, Homo Sapiens
AVAVIEEMC

SEQ ID NO: 70670 - protein, 9 aa, Homo Sapiens
WLWYLFVGV

SEQ ID NO: 70671 - protein, 9 aa, Homo Sapiens
TEQWLWYLF

SEQ ID NO: 70672 - protein, 9 aa, Homo Sapiens
TGSSKEPKM

SEQ ID NO: 70673 - protein, 9 aa, Homo Sapiens
EERRCRLLQ

SEQ ID NO: 70674 - protein, 9 aa, Homo Sapiens
KAFIWKSLI

SEQ ID NO: 70675 - protein, 9 aa, Homo Sapiens
TSSSFISYC

SEQ ID NO: 70676 - protein, 9 aa, Homo Sapiens
DCPQALAVP

SEQ ID NO: 70677 - protein, 9 aa, Homo Sapiens
EQLARAILL

SEQ ID NO: 70678 - protein, 9 aa, Homo Sapiens
MVKNETCCA

SEQ ID NO: 70679 - protein, 9 aa, Homo Sapiens
WYLFVGVGE

SEQ ID NO: 70680 - protein, 9 aa, Homo Sapiens
PLSRFISWF

SEQ ID NO: 70681 - protein, 9 aa, Homo Sapiens
LIECHPYLT

SEQ ID NO: 70682 - protein, 9 aa, Homo Sapiens
LKSNYNRGN

SEQ ID NO: 70683 - protein, 9 aa, Homo Sapiens
PRWRKRMSI

SEQ ID NO: 70684 - protein, 9 aa, Homo Sapiens
QNQGIKMAA

SEQ ID NO: 70685 - protein, 9 aa, Homo Sapiens
RRGHLSEKP

SEQ ID NO: 70686 - protein, 9 aa, Homo Sapiens
YQFDQIFNP

SEQ ID NO: 70687 - protein, 9 aa, Homo Sapiens
FISWFPYDG

SEQ ID NO: 70688 - protein, 9 aa, Homo Sapiens
SKECEKTFH

SEQ ID NO: 70689 - protein, 9 aa, Homo Sapiens
FIWKSLIVH

SEQ ID NO: 70690 - protein, 9 aa, Homo Sapiens
TSGLAIILC

SEQ ID NO: 70691 - protein, 9 aa, Homo Sapiens
EPASSGSQT

SEQ ID NO: 70692 - protein, 9 aa, Homo Sapiens
SITLKSNKN

SEQ ID NO: 70693 - protein, 9 aa, Homo Sapiens
YLFVGVGEL

SEQ ID NO: 70694 - protein, 9 aa, Homo Sapiens
VEFPNNYPS

SEQ ID NO: 70695 - protein, 9 aa, Homo Sapiens
HLINSAKLD

SEQ ID NO: 70696 - protein, 9 aa, Homo Sapiens
RTAKAQSDL

SEQ ID NO: 70697 - protein, 9 aa, Homo Sapiens
IHTGEKSYV

SEQ ID NO: 70698 - protein, 9 aa, Homo Sapiens
LCALKSNYN

SEQ ID NO: 70699 - protein, 9 aa, Homo Sapiens
AILLGHSCQ

SEQ ID NO: 70700 - protein, 9 aa, Homo Sapiens
LKYKPAVNL

SEQ ID NO: 70701 - protein, 9 aa, Homo Sapiens
RMTSSSFIS

SEQ ID NO: 70702 - protein, 9 aa, Homo Sapiens
VNSKDTHID

SEQ ID NO: 70703 - protein, 9 aa, Homo Sapiens
DSGLSVVTS

SEQ ID NO: 70704 - protein, 9 aa, Homo Sapiens
KQIMHRFIP

SEQ ID NO: 70705 - protein, 9 aa, Homo Sapiens
RPLSRFISW

SEQ ID NO: 70706 - protein, 9 aa, Homo Sapiens
QLARAILLG

SEQ ID NO: 70707 - protein, 9 aa, Homo Sapiens
KKVYQFDQI

SEQ ID NO: 70708 - protein, 9 aa, Homo Sapiens
CSTNTSEVP

SEQ ID NO: 70709 - protein, 9 aa, Homo Sapiens
EQWLWYLFV

SEQ ID NO: 70710 - protein, 9 aa, Homo Sapiens
ITLKSNKNR

SEQ ID NO: 70711 - protein, 9 aa, Homo Sapiens
MLLLTVVIS

SEQ ID NO: 70712 - protein, 9 aa, Homo Sapiens
LARAILLGH

SEQ ID NO: 70713 - protein, 9 aa, Homo Sapiens
KKAVAVIEE

SEQ ID NO: 70714 - protein, 9 aa, Homo Sapiens
NNYPSGCLL

SEQ ID NO: 70715 - protein, 9 aa, Homo Sapiens
HFHSHLGVI

SEQ ID NO: 70716 - protein, 9 aa, Homo Sapiens
NLIECHPYL

SEQ ID NO: 70717 - protein, 9 aa, Homo Sapiens
SSSFISYCT

SEQ ID NO: 70718 - protein, 9 aa, Homo Sapiens
KIEELCLQE

SEQ ID NO: 70719 - protein, 9 aa, Homo Sapiens
KAQSDLLSQ

SEQ ID NO: 70720 - protein, 9 aa, Homo Sapiens
KSCKSKECE

SEQ ID NO: 70721 - protein, 9 aa, Homo Sapiens
GHLSEKPSE

SEQ ID NO: 70722 - protein, 9 aa, Homo Sapiens
MKIEELCLQ

SEQ ID NO: 70723 - protein, 9 aa, Homo Sapiens
SEKPSENIN

SEQ ID NO: 70724 - protein, 9 aa, Homo Sapiens
MTSSSFISY

SEQ ID NO: 70725 - protein, 9 aa, Homo Sapiens
VNLIECHPY

SEQ ID NO: 70726 - protein, 9 aa, Homo Sapiens
KAGLTQKYQ

SEQ ID NO: 70727 - protein, 9 aa, Homo Sapiens
LDRAEERRC

SEQ ID NO: 70728 - protein, 9 aa, Homo Sapiens
IENELNQTS

SEQ ID NO: 70729 - protein, 9 aa, Homo Sapiens
TCFNGKCYY

SEQ ID NO: 70730 - protein, 9 aa, Homo Sapiens
KMLLLTVVI

SEQ ID NO: 70731 - protein, 9 aa, Homo Sapiens
SSLHTTLAL

SEQ ID NO: 70732 - protein, 9 aa, Homo Sapiens
GIEFVKHFH

SEQ ID NO: 70733 - protein, 9 aa, Homo Sapiens
HIDAKELNK

SEQ ID NO: 70734 - protein, 9 aa, Homo Sapiens
SCKSKECEK

SEQ ID NO: 70735 - protein, 9 aa, Homo Sapiens
NNTCFNGKC

SEQ ID NO: 70736 - protein, 9 aa, Homo Sapiens
CIKTMFHPS

SEQ ID NO: 70737 - protein, 9 aa, Homo Sapiens
GNNTCFNGK

SEQ ID NO: 70738 - protein, 9 aa, Homo Sapiens
VKHFHSHLG

SEQ ID NO: 70739 - protein, 9 aa, Homo Sapiens
PKMQIICRR

SEQ ID NO: 70740 - protein, 9 aa, Homo Sapiens
ELCLQELKL

SEQ ID NO: 70741 - protein, 9 aa, Homo Sapiens
ETQNQGIKM

SEQ ID NO: 70742 - protein, 9 aa, Homo Sapiens
VKNETCCAA

SEQ ID NO: 70743 - protein, 9 aa, Homo Sapiens
SSFISYCTP

SEQ ID NO: 70744 - protein, 9 aa, Homo Sapiens
SLIVHERTH

SEQ ID NO: 70745 - protein, 9 aa, Homo Sapiens
YKPAVNLIE

SEQ ID NO: 70746 - protein, 9 aa, Homo Sapiens
ISWFPYDGS

SEQ ID NO: 70747 - protein, 9 aa, Homo Sapiens
LSEKPSENI

SEQ ID NO: 70748 - protein, 9 aa, Homo Sapiens
AQKDTIENE

SEQ ID NO: 70749 - protein, 9 aa, Homo Sapiens
RKRMSITLK

SEQ ID NO: 70750 - protein, 9 aa, Homo Sapiens
PAVNLIECH

SEQ ID NO: 70751 - protein, 9 aa, Homo Sapiens
KSLIVHERT

SEQ ID NO: 70752 - protein, 9 aa, Homo Sapiens
SRFISWFPY

SEQ ID NO: 70753 - protein, 9 aa, Homo Sapiens
WRKRMSITL

SEQ ID NO: 70754 - protein, 9 aa, Homo Sapiens
KAVAVIEEM

SEQ ID NO: 70755 - protein, 9 aa, Homo Sapiens
SFISYCTPG

SEQ ID NO: 70756 - protein, 9 aa, Homo Sapiens
EPKMQIICR

SEQ ID NO: 70757 - protein, 9 aa, Homo Sapiens
PQALAVPKP

SEQ ID NO: 70758 - protein, 9 aa, Homo Sapiens
EKSYVCTEC

SEQ ID NO: 70759 - protein, 9 aa, Homo Sapiens
KDTHIDAKE

SEQ ID NO: 70760 - protein, 9 aa, Homo Sapiens
RTGSSKEPK

SEQ ID NO: 70761 - protein, 9 aa, Homo Sapiens
HTTLALPPP

SEQ ID NO: 70762 - protein, 9 aa, Homo Sapiens
RGHLSEKPS

SEQ ID NO: 70763 - protein, 9 aa, Homo Sapiens
IMHRFIPDL

SEQ ID NO: 70764 - protein, 9 aa, Homo Sapiens
QGIKMAAIR

SEQ ID NO: 70765 - protein, 9 aa, Homo Sapiens
IFNPQGSVE

SEQ ID NO: 70766 - protein, 9 aa, Homo Sapiens
CPQALAVPK

SEQ ID NO: 70767 - protein, 9 aa, Homo Sapiens
DVEFPNNYP

SEQ ID NO: 70768 - protein, 9 aa, Homo Sapiens
TRPLSRFIS

SEQ ID NO: 70769 - protein, 9 aa, Homo Sapiens
KDTIENELN

SEQ ID NO: 70770 - protein, 9 aa, Homo Sapiens
ETCCAATPS

SEQ ID NO: 70771 - protein, 9 aa, Homo Sapiens
FISYCTPGL

SEQ ID NO: 70772 - protein, 9 aa, Homo Sapiens
FHSHLGVIE

SEQ ID NO: 70773 - protein, 9 aa, Homo Sapiens
EFVKHFHSH

SEQ ID NO: 70774 - protein, 9 aa, Homo Sapiens
LWYLFVGVG

SEQ ID NO: 70775 - protein, 9 aa, Homo Sapiens
QDILVIGQT

SEQ ID NO: 70776 - protein, 9 aa, Homo Sapiens
HTHRTAKAQ

SEQ ID NO: 70777 - protein, 9 aa, Homo Sapiens
VGNNTCFNG

SEQ ID NO: 70778 - protein, 9 aa, Homo Sapiens
GSSLHTTLA

SEQ ID NO: 70779 - protein, 9 aa, Homo Sapiens
CALKSNYNR

SEQ ID NO: 70780 - protein, 9 aa, Homo Sapiens
EGMVKNETC

SEQ ID NO: 70781 - protein, 9 aa, Homo Sapiens
INSAKLDEA

SEQ ID NO: 70782 - protein, 9 aa, Homo Sapiens
RIHTRGAPS

SEQ ID NO: 70783 - protein, 9 aa, Homo Sapiens
MSITLKSNK

SEQ ID NO: 70784 - protein, 9 aa, Homo Sapiens
QTTSAGTAT

SEQ ID NO: 70785 - protein, 9 aa, Homo Sapiens
THIDAKELN

SEQ ID NO: 70786 - protein, 9 aa, Homo Sapiens
EKPSENINT

SEQ ID NO: 70787 - protein, 9 aa, Homo Sapiens
TVGNNTCFN

SEQ ID NO: 70788 - protein, 9 aa, Homo Sapiens
RMSITLKSN

SEQ ID NO: 70789 - protein, 9 aa, Homo Sapiens
TCCAATPSA

SEQ ID NO: 70790 - protein, 9 aa, Homo Sapiens
KSKECEKTF

SEQ ID NO: 70791 - protein, 9 aa, Homo Sapiens
AIILCIKTM

SEQ ID NO: 70792 - protein, 9 aa, Homo Sapiens
SWFPYDGSK

SEQ ID NO: 70793 - protein, 9 aa, Homo Sapiens
TEKSCKSKE

SEQ ID NO: 70794 - protein, 9 aa, Homo Sapiens
NQGIKMAAI

SEQ ID NO: 70795 - protein, 9 aa, Homo Sapiens
NYPSGCLLG

SEQ ID NO: 70796 - protein, 9 aa, Homo Sapiens
KMQIICRRR

SEQ ID NO: 70797 - protein, 9 aa, Homo Sapiens
KVYQFDQIF

SEQ ID NO: 70798 - protein, 9 aa, Homo Sapiens
CCAATPSAM

SEQ ID NO: 70799 - protein, 9 aa, Homo Sapiens
SYVCTECGR

SEQ ID NO: 70800 - protein, 9 aa, Homo Sapiens
SLPFDCPQA

SEQ ID NO: 70801 - protein, 9 aa, Homo Sapiens
QFDQIFNPQ

SEQ ID NO: 70802 - protein, 9 aa, Homo Sapiens
DTLKAGLTQ

SEQ ID NO: 70803 - protein, 9 aa, Homo Sapiens
SGLAIILCI

SEQ ID NO: 70804 - protein, 9 aa, Homo Sapiens
SQTTSAGTA

SEQ ID NO: 70805 - protein, 9 aa, Homo Sapiens
SAKLDEANL

SEQ ID NO: 70806 - protein, 9 aa, Homo Sapiens
GTTHLINSA

SEQ ID NO: 70807 - protein, 9 aa, Homo Sapiens
LLCALKSNY

SEQ ID NO: 70808 - protein, 9 aa, Homo Sapiens
CLQELKLNR

SEQ ID NO: 70809 - protein, 9 aa, Homo Sapiens
AGLTQKYQE

SEQ ID NO: 70810 - protein, 9 aa, Homo Sapiens
SQDILVIGQ

SEQ ID NO: 70811 - protein, 9 aa, Homo Sapiens
LSVVTSGCL

SEQ ID NO: 70812 - protein, 9 aa, Homo Sapiens
RFISWFPYD

SEQ ID NO: 70813 - protein, 9 aa, Homo Sapiens
VAVIEEMCN

SEQ ID NO: 70814 - protein, 9 aa, Homo Sapiens
TAKAQSDLL

SEQ ID NO: 70815 - protein, 9 aa, Homo Sapiens
GMVKNETCC

SEQ ID NO: 70816 - protein, 9 aa, Homo Sapiens
TVVISMYKS

SEQ ID NO: 70817 - protein, 9 aa, Homo Sapiens
NETCCAATP

SEQ ID NO: 70818 - protein, 9 aa, Homo Sapiens
PFDCPQALA

SEQ ID NO: 70819 - protein, 9 aa, Homo Sapiens
KRMSITLKS

SEQ ID NO: 70820 - protein, 9 aa, Homo Sapiens
HGTTHLINS

SEQ ID NO: 70821 - protein, 9 aa, Homo Sapiens
ERRCRLLQR

SEQ ID NO: 70822 - protein, 9 aa, Homo Sapiens
CLLCALKSN

SEQ ID NO: 70823 - protein, 9 aa, Homo Sapiens
GSSKEPKMQ

SEQ ID NO: 70824 - protein, 9 aa, Homo Sapiens
EGSSLHTTL

SEQ ID NO: 70825 - protein, 9 aa, Homo Sapiens
QWLWYLFVG

SEQ ID NO: 70826 - protein, 9 aa, Homo Sapiens
RCRLLQRYN

SEQ ID NO: 70827 - protein, 9 aa, Homo Sapiens
AEGSSLHTT

SEQ ID NO: 70828 - protein, 9 aa, Homo Sapiens
VYQFDQIFN

SEQ ID NO: 70829 - protein, 9 aa, Homo Sapiens
EDVCSCSTN

SEQ ID NO: 70830 - protein, 9 aa, Homo Sapiens
RAILLGHSC

SEQ ID NO: 70831 - protein, 9 aa, Homo Sapiens
TSLPFDCPQ

SEQ ID NO: 70832 - protein, 9 aa, Homo Sapiens
TTHLINSAK

SEQ ID NO: 70833 - protein, 9 aa, Homo Sapiens
VSAQKDTIE

SEQ ID NO: 70834 - protein, 9 aa, Homo Sapiens
ILLGHSCQW

SEQ ID NO: 70835 - protein, 9 aa, Homo Sapiens
LLLTVVISM

SEQ ID NO: 70836 - protein, 9 aa, Homo Sapiens
MRMTSSSFI

SEQ ID NO: 70837 - protein, 9 aa, Homo Sapiens
KMAAIRGEV

SEQ ID NO: 70838 - protein, 9 aa, Homo Sapiens
DILVIGQTR

SEQ ID NO: 70839 - protein, 9 aa, Homo Sapiens
LINSAKLDE

SEQ ID NO: 70840 - protein, 9 aa, Homo Sapiens
QIFNPQGSV

SEQ ID NO: 70841 - protein, 9 aa, Homo Sapiens
RWRKRMSIT

SEQ ID NO: 70842 - protein, 9 aa, Homo Sapiens
FDCPQALAV

SEQ ID NO: 70843 - protein, 9 aa, Homo Sapiens
VVISMYKSF

SEQ ID NO: 70844 - protein, 9 aa, Homo Sapiens
PQLDTLKAG

SEQ ID NO: 70845 - protein, 9 aa, Homo Sapiens
WKSLIVHER

SEQ ID NO: 70846 - protein, 9 aa, Homo Sapiens
MAAIRGEVT

SEQ ID NO: 70847 - protein, 9 aa, Homo Sapiens
LVSAQKDTI

SEQ ID NO: 70848 - protein, 9 aa, Homo Sapiens
GEKSYVCTE

SEQ ID NO: 70849 - protein, 9 aa, Homo Sapiens
LCLQELKLN

SEQ ID NO: 70850 - protein, 9 aa, Homo Sapiens
MHRFIPDLL

SEQ ID NO: 70851 - protein, 9 aa, Homo Sapiens
SEPASSGSQ

SEQ ID NO: 70852 - protein, 9 aa, Homo Sapiens
DVCSCSTNT

SEQ ID NO: 70853 - protein, 9 aa, Homo Sapiens
IEFVKHFHS

SEQ ID NO: 70854 - protein, 9 aa, Homo Sapiens
ISYCTPGLC

SEQ ID NO: 70855 - protein, 9 aa, Homo Sapiens
VIGQTRLEA

SEQ ID NO: 70856 - protein, 9 aa, Homo Sapiens
KYKPAVNLI

SEQ ID NO: 70857 - protein, 9 aa, Homo Sapiens
IILCIKTMF

SEQ ID NO: 70858 - protein, 9 aa, Homo Sapiens
KCLLCALKS

SEQ ID NO: 70859 - protein, 9 aa, Homo Sapiens
DTHIDAKEL

SEQ ID NO: 70860 - protein, 9 aa, Homo Sapiens
QLDTLKAGL

SEQ ID NO: 70861 - protein, 9 aa, Homo Sapiens
ITEKSCKSK

SEQ ID NO: 70862 - protein, 9 aa, Homo Sapiens
AKAQSDLLS

SEQ ID NO: 70863 - protein, 9 aa, Homo Sapiens
ASSGSQTTS

SEQ ID NO: 70864 - protein, 9 aa, Homo Sapiens
SVVTSGCLG

SEQ ID NO: 70865 - protein, 9 aa, Homo Sapiens
SNYNRGNIP

SEQ ID NO: 70866 - protein, 9 aa, Homo Sapiens
EEDDSGLSV

SEQ ID NO: 70867 - protein, 9 aa, Homo Sapiens
LLTVVISMY

SEQ ID NO: 70868 - protein, 9 aa, Homo Sapiens
EELCLQELK

SEQ ID NO: 70869 - protein, 9 aa, Homo Sapiens
GLSVVTSGC

SEQ ID NO: 70870 - protein, 9 aa, Homo Sapiens
MRIHTRGAP

SEQ ID NO: 70871 - protein, 9 aa, Homo Sapiens
PASSGSQTT

SEQ ID NO: 70872 - protein, 9 aa, Homo Sapiens
GQTRLEATI

SEQ ID NO: 70873 - protein, 9 aa, Homo Sapiens
VISMYKSFF

SEQ ID NO: 70874 - protein, 9 aa, Homo Sapiens
DQIFNPQGS

SEQ ID NO: 70875 - protein, 9 aa, Homo Sapiens
PSQDILVIG

SEQ ID NO: 70876 - protein, 9 aa, Homo Sapiens
HLKKAVAVI

SEQ ID NO: 70877 - protein, 9 aa, Homo Sapiens
IKQIMHRFI

SEQ ID NO: 70878 - protein, 9 aa, Homo Sapiens
HLSEKPSEN

SEQ ID NO: 70879 - protein, 9 aa, Homo Sapiens
STNTSEVPR

SEQ ID NO: 70880 - protein, 9 aa, Homo Sapiens
LEQLARAIL

SEQ ID NO: 70881 - protein, 9 aa, Homo Sapiens
TLALPPPQP

SEQ ID NO: 70882 - protein, 9 aa, Homo Sapiens
LTVVISMYK

SEQ ID NO: 70883 - protein, 9 aa, Homo Sapiens
VCSCSTNTS

SEQ ID NO: 70884 - protein, 9 aa, Homo Sapiens
TQNQGIKMA

SEQ ID NO: 70885 - protein, 9 aa, Homo Sapiens
HMKIEELCL

SEQ ID NO: 70886 - protein, 9 aa, Homo Sapiens
LKAGLTQKY

SEQ ID NO: 70887 - protein, 9 aa, Homo Sapiens
SAQKDTIEN

SEQ ID NO: 70888 - protein, 9 aa, Homo Sapiens
LPFDCPQAL

SEQ ID NO: 70889 - protein, 9 aa, Homo Sapiens
NSKDTHIDA

SEQ ID NO: 70890 - protein, 9 aa, Homo Sapiens
KEPKMQIIC

SEQ ID NO: 70891 - protein, 9 aa, Homo Sapiens
CSCSTNTSE

SEQ ID NO: 70892 - protein, 9 aa, Homo Sapiens
FAYYRVGKY

SEQ ID NO: 70893 - protein, 9 aa, Homo Sapiens
CQPRCQWRE

SEQ ID NO: 70894 - protein, 9 aa, Homo Sapiens
GEETASPML

SEQ ID NO: 70895 - protein, 9 aa, Homo Sapiens
HGATHTVRL

SEQ ID NO: 70896 - protein, 9 aa, Homo Sapiens
LLCFNMDRS

SEQ ID NO: 70897 - protein, 9 aa, Homo Sapiens
GLTGSLSAR

SEQ ID NO: 70898 - protein, 9 aa, Homo Sapiens
ALVSTEKML

SEQ ID NO: 70899 - protein, 9 aa, Homo Sapiens
FNMDRSRKV

SEQ ID NO: 70900 - protein, 9 aa, Homo Sapiens
AAHAHWKSK

SEQ ID NO: 70901 - protein, 9 aa, Homo Sapiens
NNGGCHPNS

SEQ ID NO: 70902 - protein, 9 aa, Homo Sapiens
QIRAQTAAG

SEQ ID NO: 70903 - protein, 9 aa, Homo Sapiens
PADFSHDEC

SEQ ID NO: 70904 - protein, 9 aa, Homo Sapiens
LLVSLLLKE

SEQ ID NO: 70905 - protein, 9 aa, Homo Sapiens
NGGCHPNSI

SEQ ID NO: 70906 - protein, 9 aa, Homo Sapiens
IRAQTAAGY

SEQ ID NO: 70907 - protein, 9 aa, Homo Sapiens
SNTGERVQT

SEQ ID NO: 70908 - protein, 9 aa, Homo Sapiens
PDSFGIWAK

SEQ ID NO: 70909 - protein, 9 aa, Homo Sapiens
GCHPNSICT

SEQ ID NO: 70910 - protein, 9 aa, Homo Sapiens
KALANHNNL

SEQ ID NO: 70911 - protein, 9 aa, Homo Sapiens
LPADFSHDE

SEQ ID NO: 70912 - protein, 9 aa, Homo Sapiens
NSLVAYMNN

SEQ ID NO: 70913 - protein, 9 aa, Homo Sapiens
GKYVKALEC

SEQ ID NO: 70914 - protein, 9 aa, Homo Sapiens
PLNSGAHPS

SEQ ID NO: 70915 - protein, 9 aa, Homo Sapiens
GYHRIVHQR

SEQ ID NO: 70916 - protein, 9 aa, Homo Sapiens
SEEQSESEE

SEQ ID NO: 70917 - protein, 9 aa, Homo Sapiens
PTQYFLHQQ

SEQ ID NO: 70918 - protein, 9 aa, Homo Sapiens
AIASLPADF

SEQ ID NO: 70919 - protein, 9 aa, Homo Sapiens
PKAIVFSYG

SEQ ID NO: 70920 - protein, 9 aa, Homo Sapiens
ENTSAGHYV

SEQ ID NO: 70921 - protein, 9 aa, Homo Sapiens
CQWREWFDE

SEQ ID NO: 70922 - protein, 9 aa, Homo Sapiens
NGALKVQPP

SEQ ID NO: 70923 - protein, 9 aa, Homo Sapiens
PETGLQSPG

SEQ ID NO: 70924 - protein, 9 aa, Homo Sapiens
YVFQIRAQT

SEQ ID NO: 70925 - protein, 9 aa, Homo Sapiens
IWAKKTKEQ

SEQ ID NO: 70926 - protein, 9 aa, Homo Sapiens
PKNKGIKSS

SEQ ID NO: 70927 - protein, 9 aa, Homo Sapiens
ASAPEAKVQ

SEQ ID NO: 70928 - protein, 9 aa, Homo Sapiens
AWLWNERFW

SEQ ID NO: 70929 - protein, 9 aa, Homo Sapiens
ELPELQSSE

SEQ ID NO: 70930 - protein, 9 aa, Homo Sapiens
FAAHAHWKS

SEQ ID NO: 70931 - protein, 9 aa, Homo Sapiens
HSSLLLDSY

SEQ ID NO: 70932 - protein, 9 aa, Homo Sapiens
QAAAQIQSR

SEQ ID NO: 70933 - protein, 9 aa, Homo Sapiens
SKHSVVWNA

SEQ ID NO: 70934 - protein, 9 aa, Homo Sapiens
VHQRMQHSP

SEQ ID NO: 70935 - protein, 9 aa, Homo Sapiens
EQSESEEES

SEQ ID NO: 70936 - protein, 9 aa, Homo Sapiens
AYMNNSRSS

SEQ ID NO: 70937 - protein, 9 aa, Homo Sapiens
ADLHHNKLL

SEQ ID NO: 70938 - protein, 9 aa, Homo Sapiens
LIKNTCLPK

SEQ ID NO: 70939 - protein, 9 aa, Homo Sapiens
IISSYAFTT

SEQ ID NO: 70940 - protein, 9 aa, Homo Sapiens
KTKFIDRLN

SEQ ID NO: 70941 - protein, 9 aa, Homo Sapiens
LGRGELFKA

SEQ ID NO: 70942 - protein, 9 aa, Homo Sapiens
AADISVIAI

SEQ ID NO: 70943 - protein, 9 aa, Homo Sapiens
SKTKFIDRL

SEQ ID NO: 70944 - protein, 9 aa, Homo Sapiens
SLVAYMNNS

SEQ ID NO: 70945 - protein, 9 aa, Homo Sapiens
CVLLRAPKL

SEQ ID NO: 70946 - protein, 9 aa, Homo Sapiens
GHYVRENCK

SEQ ID NO: 70947 - protein, 9 aa, Homo Sapiens
YTRQKPYNC

SEQ ID NO: 70948 - protein, 9 aa, Homo Sapiens
LDLPQKQGK

SEQ ID NO: 70949 - protein, 9 aa, Homo Sapiens
AHWKSKEWP

SEQ ID NO: 70950 - protein, 9 aa, Homo Sapiens
RASMGLEEN

SEQ ID NO: 70951 - protein, 9 aa, Homo Sapiens
VQSPERSRT

SEQ ID NO: 70952 - protein, 9 aa, Homo Sapiens
HLECLQWLK

SEQ ID NO: 70953 - protein, 9 aa, Homo Sapiens
AWTMVLSAY

SEQ ID NO: 70954 - protein, 9 aa, Homo Sapiens
DASSAPSQG

SEQ ID NO: 70955 - protein, 9 aa, Homo Sapiens
RCQWREWFD

SEQ ID NO: 70956 - protein, 9 aa, Homo Sapiens
APDASAPEA

SEQ ID NO: 70957 - protein, 9 aa, Homo Sapiens
VRQCGPETG

SEQ ID NO: 70958 - protein, 9 aa, Homo Sapiens
TFNPDWWMP

SEQ ID NO: 70959 - protein, 9 aa, Homo Sapiens
HKAPKNKGI

SEQ ID NO: 70960 - protein, 9 aa, Homo Sapiens
GKPLDQFLW

SEQ ID NO: 70961 - protein, 9 aa, Homo Sapiens
GYAGKFGVE

SEQ ID NO: 70962 - protein, 9 aa, Homo Sapiens
HRIVHQRMQ

SEQ ID NO: 70963 - protein, 9 aa, Homo Sapiens
AMEALVSTE

SEQ ID NO: 70964 - protein, 9 aa, Homo Sapiens
PTVNQFPTQ

SEQ ID NO: 70965 - protein, 9 aa, Homo Sapiens
LTKHRKIYT

SEQ ID NO: 70966 - protein, 9 aa, Homo Sapiens
PEVIRASMG

SEQ ID NO: 70967 - protein, 9 aa, Homo Sapiens
LNSGAHPSV

SEQ ID NO: 70968 - protein, 9 aa, Homo Sapiens
VGKYHIQAC

SEQ ID NO: 70969 - protein, 9 aa, Homo Sapiens
YAGKFGVEQ

SEQ ID NO: 70970 - protein, 9 aa, Homo Sapiens
AAFSKTKFI

SEQ ID NO: 70971 - protein, 9 aa, Homo Sapiens
KKTEEKEKL

SEQ ID NO: 70972 - protein, 9 aa, Homo Sapiens
KEDEGEETA

SEQ ID NO: 70973 - protein, 9 aa, Homo Sapiens
RILPDPDDS

SEQ ID NO: 70974 - protein, 9 aa, Homo Sapiens
GAAFSKTKF

SEQ ID NO: 70975 - protein, 9 aa, Homo Sapiens
EGSCPQVNV

SEQ ID NO: 70976 - protein, 9 aa, Homo Sapiens
VFQIRAQTA

SEQ ID NO: 70977 - protein, 9 aa, Homo Sapiens
WVINWEGMI

SEQ ID NO: 70978 - protein, 9 aa, Homo Sapiens
NDGNNGGCH

SEQ ID NO: 70979 - protein, 9 aa, Homo Sapiens
WDENTSAGH

SEQ ID NO: 70980 - protein, 9 aa, Homo Sapiens
SFGIWAKKT

SEQ ID NO: 70981 - protein, 9 aa, Homo Sapiens
VIPFNCFSK

SEQ ID NO: 70982 - protein, 9 aa, Homo Sapiens
KAFIDTAQH

SEQ ID NO: 70983 - protein, 9 aa, Homo Sapiens
SGHDTTSNR

SEQ ID NO: 70984 - protein, 9 aa, Homo Sapiens
TCLPKDDPQ

SEQ ID NO: 70985 - protein, 9 aa, Homo Sapiens
NDARHGGWT

SEQ ID NO: 70986 - protein, 9 aa, Homo Sapiens
HNNLVVKVK

SEQ ID NO: 70987 - protein, 9 aa, Homo Sapiens
MHCTFNPDW

SEQ ID NO: 70988 - protein, 9 aa, Homo Sapiens
DARHGGWTT

SEQ ID NO: 70989 - protein, 9 aa, Homo Sapiens
HRKIYTRQK

SEQ ID NO: 70990 - protein, 9 aa, Homo Sapiens
LLLKEKQDG

SEQ ID NO: 70991 - protein, 9 aa, Homo Sapiens
MAGILAWLW

SEQ ID NO: 70992 - protein, 9 aa, Homo Sapiens
MKQMNDARH

SEQ ID NO: 70993 - protein, 9 aa, Homo Sapiens
SMLQEYCKY

SEQ ID NO: 70994 - protein, 9 aa, Homo Sapiens
KVQPPRNQD

SEQ ID NO: 70995 - protein, 9 aa, Homo Sapiens
TGPSKHSVV

SEQ ID NO: 70996 - protein, 9 aa, Homo Sapiens
LLPVANPPK

SEQ ID NO: 70997 - protein, 9 aa, Homo Sapiens
CCVLLRAPK

SEQ ID NO: 70998 - protein, 9 aa, Homo Sapiens
LKVQPPRNQ

SEQ ID NO: 70999 - protein, 9 aa, Homo Sapiens
AFYWVINWE

SEQ ID NO: 71000 - protein, 9 aa, Homo Sapiens
ESESEEQSE

SEQ ID NO: 71001 - protein, 9 aa, Homo Sapiens
GALKVQPPR

SEQ ID NO: 71002 - protein, 9 aa, Homo Sapiens
ECPAGAYYE

SEQ ID NO: 71003 - protein, 9 aa, Homo Sapiens
FPTQYFLHQ

SEQ ID NO: 71004 - protein, 9 aa, Homo Sapiens
LNGALKVQP

SEQ ID NO: 71005 - protein, 9 aa, Homo Sapiens
GVQSPERSR

SEQ ID NO: 71006 - protein, 9 aa, Homo Sapiens
VAYMNNSRS

SEQ ID NO: 71007 - protein, 9 aa, Homo Sapiens
GIWAKKTKE

SEQ ID NO: 71008 - protein, 9 aa, Homo Sapiens
QEYCKYLQQ

SEQ ID NO: 71009 - protein, 9 aa, Homo Sapiens
QMNDARHGG

SEQ ID NO: 71010 - protein, 9 aa, Homo Sapiens
ELFKAFIDT

SEQ ID NO: 71011 - protein, 9 aa, Homo Sapiens
KNTCLPKDD

SEQ ID NO: 71012 - protein, 9 aa, Homo Sapiens
KAPKNKGIK

SEQ ID NO: 71013 - protein, 9 aa, Homo Sapiens
LWNERFWLP

SEQ ID NO: 71014 - protein, 9 aa, Homo Sapiens
DSSKSPVGS

SEQ ID NO: 71015 - protein, 9 aa, Homo Sapiens
VFLPLNSGA

SEQ ID NO: 71016 - protein, 9 aa, Homo Sapiens
PDPDDSSKS

SEQ ID NO: 71017 - protein, 9 aa, Homo Sapiens
AAQIQSRVI

SEQ ID NO: 71018 - protein, 9 aa, Homo Sapiens
IVHQRMQHS

SEQ ID NO: 71019 - protein, 9 aa, Homo Sapiens
NCFSKWKPS

SEQ ID NO: 71020 - protein, 9 aa, Homo Sapiens
SPERSRTLH

SEQ ID NO: 71021 - protein, 9 aa, Homo Sapiens
RRRSRLKEL

SEQ ID NO: 71022 - protein, 9 aa, Homo Sapiens
TMVLSAYWH

SEQ ID NO: 71023 - protein, 9 aa, Homo Sapiens
TCCVLLRAP

SEQ ID NO: 71024 - protein, 9 aa, Homo Sapiens
EFIRMHCTF

SEQ ID NO: 71025 - protein, 9 aa, Homo Sapiens
IQACTTTPC

SEQ ID NO: 71026 - protein, 9 aa, Homo Sapiens
KNKGIKSSI

SEQ ID NO: 71027 - protein, 9 aa, Homo Sapiens
NNLVVKVKV

SEQ ID NO: 71028 - protein, 9 aa, Homo Sapiens
LVSLLLKEK

SEQ ID NO: 71029 - protein, 9 aa, Homo Sapiens
IRASMGLEE

SEQ ID NO: 71030 - protein, 9 aa, Homo Sapiens
VSLLLKEKQ

SEQ ID NO: 71031 - protein, 9 aa, Homo Sapiens
ELPEVIRAS

SEQ ID NO: 71032 - protein, 9 aa, Homo Sapiens
RPNYHLECL

SEQ ID NO: 71033 - protein, 9 aa, Homo Sapiens
VQTVALERH

SEQ ID NO: 71034 - protein, 9 aa, Homo Sapiens
SLLLKEKQD

SEQ ID NO: 71035 - protein, 9 aa, Homo Sapiens
EDSGHDTTS

SEQ ID NO: 71036 - protein, 9 aa, Homo Sapiens
LAWLWNERF

SEQ ID NO: 71037 - protein, 9 aa, Homo Sapiens
LSARGSHMD

SEQ ID NO: 71038 - protein, 9 aa, Homo Sapiens
FNPDWWMPS

SEQ ID NO: 71039 - protein, 9 aa, Homo Sapiens
RKIYTRQKP

SEQ ID NO: 71040 - protein, 9 aa, Homo Sapiens
GPSKHSVVW

SEQ ID NO: 71041 - protein, 9 aa, Homo Sapiens
KHRKIYTRQ

SEQ ID NO: 71042 - protein, 9 aa, Homo Sapiens
LFKAFIDTA

SEQ ID NO: 71043 - protein, 9 aa, Homo Sapiens
NVNFPQLGL

SEQ ID NO: 71044 - protein, 9 aa, Homo Sapiens
DGNNGGCHP

SEQ ID NO: 71045 - protein, 9 aa, Homo Sapiens
LPVANPPKA

SEQ ID NO: 71046 - protein, 9 aa, Homo Sapiens
DASAPEAKV

SEQ ID NO: 71047 - protein, 9 aa, Homo Sapiens
YMNNSRSSS

SEQ ID NO: 71048 - protein, 9 aa, Homo Sapiens
SAWTMVLSA

SEQ ID NO: 71049 - protein, 9 aa, Homo Sapiens
EGEETASPM

SEQ ID NO: 71050 - protein, 9 aa, Homo Sapiens
DLPQKQGKP

SEQ ID NO: 71051 - protein, 9 aa, Homo Sapiens
SLFFRTCCV

SEQ ID NO: 71052 - protein, 9 aa, Homo Sapiens
KQGKPLDQF

SEQ ID NO: 71053 - protein, 9 aa, Homo Sapiens
GERVQTVAL

SEQ ID NO: 71054 - protein, 9 aa, Homo Sapiens
STIISSYAF

SEQ ID NO: 71055 - protein, 9 aa, Homo Sapiens
IKALANHNN

SEQ ID NO: 71056 - protein, 9 aa, Homo Sapiens
WTMVLSAYW

SEQ ID NO: 71057 - protein, 9 aa, Homo Sapiens
HIQACTTTP

SEQ ID NO: 71058 - protein, 9 aa, Homo Sapiens
NPDSFGIWA

SEQ ID NO: 71059 - protein, 9 aa, Homo Sapiens
LTGSLSARG

SEQ ID NO: 71060 - protein, 9 aa, Homo Sapiens
RKKTEEKEK

SEQ ID NO: 71061 - protein, 9 aa, Homo Sapiens
TGSLSARGS

SEQ ID NO: 71062 - protein, 9 aa, Homo Sapiens
IYTRQKPYN

SEQ ID NO: 71063 - protein, 9 aa, Homo Sapiens
ENSNTGERV

SEQ ID NO: 71064 - protein, 9 aa, Homo Sapiens
RMHCTFNPD

SEQ ID NO: 71065 - protein, 9 aa, Homo Sapiens
MDAFYWVIN

SEQ ID NO: 71066 - protein, 9 aa, Homo Sapiens
PSAIASLPA

SEQ ID NO: 71067 - protein, 9 aa, Homo Sapiens
EEKEKLLKL

SEQ ID NO: 71068 - protein, 9 aa, Homo Sapiens
MSSALPGLP

SEQ ID NO: 71069 - protein, 9 aa, Homo Sapiens
KASMLQEYC

SEQ ID NO: 71070 - protein, 9 aa, Homo Sapiens
VGKYVKALE

SEQ ID NO: 71071 - protein, 9 aa, Homo Sapiens
THTVRLQLL

SEQ ID NO: 71072 - protein, 9 aa, Homo Sapiens
DEGEETASP

SEQ ID NO: 71073 - protein, 9 aa, Homo Sapiens
DTPLLVSLL

SEQ ID NO: 71074 - protein, 9 aa, Homo Sapiens
ASLPADFSH

SEQ ID NO: 71075 - protein, 9 aa, Homo Sapiens
APKNKGIKS

SEQ ID NO: 71076 - protein, 9 aa, Homo Sapiens
LQEYCKYLQ

SEQ ID NO: 71077 - protein, 9 aa, Homo Sapiens
TTSNRDSYS

SEQ ID NO: 71078 - protein, 9 aa, Homo Sapiens
SARGSHMDR

SEQ ID NO: 71079 - protein, 9 aa, Homo Sapiens
ILPDPDDSS

SEQ ID NO: 71080 - protein, 9 aa, Homo Sapiens
AGILAWLWN

SEQ ID NO: 71081 - protein, 9 aa, Homo Sapiens
GRLQALCMS

SEQ ID NO: 71082 - protein, 9 aa, Homo Sapiens
ERSRTLHFR

SEQ ID NO: 71083 - protein, 9 aa, Homo Sapiens
DDSSKSPVG

SEQ ID NO: 71084 - protein, 9 aa, Homo Sapiens
EVIRASMGL

SEQ ID NO: 71085 - protein, 9 aa, Homo Sapiens
YCKYLQQAF

SEQ ID NO: 71086 - protein, 9 aa, Homo Sapiens
GNNGGCHPN

SEQ ID NO: 71087 - protein, 9 aa, Homo Sapiens
KELPELQSS

SEQ ID NO: 71088 - protein, 9 aa, Homo Sapiens
CTFNPDWWM

SEQ ID NO: 71089 - protein, 9 aa, Homo Sapiens
TEEKEKLLK

SEQ ID NO: 71090 - protein, 9 aa, Homo Sapiens
RVIPFNCFS

SEQ ID NO: 71091 - protein, 9 aa, Homo Sapiens
LHHNKLLEH

SEQ ID NO: 71092 - protein, 9 aa, Homo Sapiens
RHGGWTTKM

SEQ ID NO: 71093 - protein, 9 aa, Homo Sapiens
ILKHSSLLL

SEQ ID NO: 71094 - protein, 9 aa, Homo Sapiens
LCFNMDRSR

SEQ ID NO: 71095 - protein, 9 aa, Homo Sapiens
DPDDSSKSP

SEQ ID NO: 71096 - protein, 9 aa, Homo Sapiens
IASLPADFS

SEQ ID NO: 71097 - protein, 9 aa, Homo Sapiens
TLTKHRKIY

SEQ ID NO: 71098 - protein, 9 aa, Homo Sapiens
AAPTVNQFP

SEQ ID NO: 71099 - protein, 9 aa, Homo Sapiens
KTLEKSLGP

SEQ ID NO: 71100 - protein, 9 aa, Homo Sapiens
KIYTRQKPY

SEQ ID NO: 71101 - protein, 9 aa, Homo Sapiens
IRMHCTFNP

SEQ ID NO: 71102 - protein, 9 aa, Homo Sapiens
REWFDEDYP

SEQ ID NO: 71103 - protein, 9 aa, Homo Sapiens
EEQSESEEE

SEQ ID NO: 71104 - protein, 9 aa, Homo Sapiens
HCTFNPDWW

SEQ ID NO: 71105 - protein, 9 aa, Homo Sapiens
YHLECLQWL

SEQ ID NO: 71106 - protein, 9 aa, Homo Sapiens
ALANHNNLV

SEQ ID NO: 71107 - protein, 9 aa, Homo Sapiens
IAIYFLVVM

SEQ ID NO: 71108 - protein, 9 aa, Homo Sapiens
VQPPRNQDP

SEQ ID NO: 71109 - protein, 9 aa, Homo Sapiens
GKEDEGEET

SEQ ID NO: 71110 - protein, 9 aa, Homo Sapiens
FYWVINWEG

SEQ ID NO: 71111 - protein, 9 aa, Homo Sapiens
RHFVFLPLN

SEQ ID NO: 71112 - protein, 9 aa, Homo Sapiens
FMKQMNDAR

SEQ ID NO: 71113 - protein, 9 aa, Homo Sapiens
ARHGGWTTK

SEQ ID NO: 71114 - protein, 9 aa, Homo Sapiens
SVKSTIISS

SEQ ID NO: 71115 - protein, 9 aa, Homo Sapiens
FLPLNSGAH

SEQ ID NO: 71116 - protein, 9 aa, Homo Sapiens
NQFPTQYFL

SEQ ID NO: 71117 - protein, 9 aa, Homo Sapiens
RGSHMDRIG

SEQ ID NO: 71118 - protein, 9 aa, Homo Sapiens
LLGRGELFK

SEQ ID NO: 71119 - protein, 9 aa, Homo Sapiens
QALCMSSAL

SEQ ID NO: 71120 - protein, 9 aa, Homo Sapiens
KHSSLLLDS

SEQ ID NO: 71121 - protein, 9 aa, Homo Sapiens
PKASHGYAG

SEQ ID NO: 71122 - protein, 9 aa, Homo Sapiens
DAFYWVINW

SEQ ID NO: 71123 - protein, 9 aa, Homo Sapiens
VNQFPTQYF

SEQ ID NO: 71124 - protein, 9 aa, Homo Sapiens
SLSARGSHM

SEQ ID NO: 71125 - protein, 9 aa, Homo Sapiens
DTTSNRDSY

SEQ ID NO: 71126 - protein, 9 aa, Homo Sapiens
SCPQVNVNF

SEQ ID NO: 71127 - protein, 9 aa, Homo Sapiens
MLQEYCKYL

SEQ ID NO: 71128 - protein, 9 aa, Homo Sapiens
TTAPDASAP

SEQ ID NO: 71129 - protein, 9 aa, Homo Sapiens
ARGSHMDRI

SEQ ID NO: 71130 - protein, 9 aa, Homo Sapiens
QSESEEESE

SEQ ID NO: 71131 - protein, 9 aa, Homo Sapiens
IRKKTEEKE

SEQ ID NO: 71132 - protein, 9 aa, Homo Sapiens
EYCKYLQQA

SEQ ID NO: 71133 - protein, 9 aa, Homo Sapiens
SAGHYVREN

SEQ ID NO: 71134 - protein, 9 aa, Homo Sapiens
QKQGKPLDQ

SEQ ID NO: 71135 - protein, 9 aa, Homo Sapiens
GADTPLLVS

SEQ ID NO: 71136 - protein, 9 aa, Homo Sapiens
RVQTVALER

SEQ ID NO: 71137 - protein, 9 aa, Homo Sapiens
QVNVNFPQL

SEQ ID NO: 71138 - protein, 9 aa, Homo Sapiens
HPNSICTNT

SEQ ID NO: 71139 - protein, 9 aa, Homo Sapiens
HQRMQHSPD

SEQ ID NO: 71140 - protein, 9 aa, Homo Sapiens
ATHTVRLQL

SEQ ID NO: 71141 - protein, 9 aa, Homo Sapiens
SLIKNTCLP

SEQ ID NO: 71142 - protein, 9 aa, Homo Sapiens
ESEEQSESE

SEQ ID NO: 71143 - protein, 9 aa, Homo Sapiens
EECPAGAYY

SEQ ID NO: 71144 - protein, 9 aa, Homo Sapiens
SVIAIYFLV

SEQ ID NO: 71145 - protein, 9 aa, Homo Sapiens
ADISVIAIY

SEQ ID NO: 71146 - protein, 9 aa, Homo Sapiens
LPELQSSER

SEQ ID NO: 71147 - protein, 9 aa, Homo Sapiens
KYHIQACTT

SEQ ID NO: 71148 - protein, 9 aa, Homo Sapiens
SGYHRIVHQ

SEQ ID NO: 71149 - protein, 9 aa, Homo Sapiens
HDTTSNRDS

SEQ ID NO: 71150 - protein, 9 aa, Homo Sapiens
PLLVSLLLK

SEQ ID NO: 71151 - protein, 9 aa, Homo Sapiens
PNSLVAYMN

SEQ ID NO: 71152 - protein, 9 aa, Homo Sapiens
KFIDRLNKH

SEQ ID NO: 71153 - protein, 9 aa, Homo Sapiens
EESTTGFNK

SEQ ID NO: 71154 - protein, 9 aa, Homo Sapiens
VKSTIISSY

SEQ ID NO: 71155 - protein, 9 aa, Homo Sapiens
MNDARHGGW

SEQ ID NO: 71156 - protein, 9 aa, Homo Sapiens
NTGERVQTV

SEQ ID NO: 71157 - protein, 9 aa, Homo Sapiens
LKHSSLLLD

SEQ ID NO: 71158 - protein, 9 aa, Homo Sapiens
QFAYYRVGK

SEQ ID NO: 71159 - protein, 9 aa, Homo Sapiens
HTVRLQLLS

SEQ ID NO: 71160 - protein, 9 aa, Homo Sapiens
QWREWFDED

SEQ ID NO: 71161 - protein, 9 aa, Homo Sapiens
LRSAWTMVL

SEQ ID NO: 71162 - protein, 9 aa, Homo Sapiens
KEKLLKLLQ

SEQ ID NO: 71163 - protein, 9 aa, Homo Sapiens
ACTTTPCML

SEQ ID NO: 71164 - protein, 9 aa, Homo Sapiens
LVSTEKMLQ

SEQ ID NO: 71165 - protein, 9 aa, Homo Sapiens
DENTSAGHY

SEQ ID NO: 71166 - protein, 9 aa, Homo Sapiens
IQSRVIPFN

SEQ ID NO: 71167 - protein, 9 aa, Homo Sapiens
LPLNSGAHP

SEQ ID NO: 71168 - protein, 9 aa, Homo Sapiens
QSPERSRTL

SEQ ID NO: 71169 - protein, 9 aa, Homo Sapiens
DVLLCFNMD

SEQ ID NO: 71170 - protein, 9 aa, Homo Sapiens
PRLVPGKTL

SEQ ID NO: 71171 - protein, 9 aa, Homo Sapiens
APSQGSHFC

SEQ ID NO: 71172 - protein, 9 aa, Homo Sapiens
SLHKAPKNK

SEQ ID NO: 71173 - protein, 9 aa, Homo Sapiens
YHRIVHQRM

SEQ ID NO: 71174 - protein, 9 aa, Homo Sapiens
RAQTAAGYG

SEQ ID NO: 71175 - protein, 9 aa, Homo Sapiens
PSQGSHFCL

SEQ ID NO: 71176 - protein, 9 aa, Homo Sapiens
QCGPETGLQ

SEQ ID NO: 71177 - protein, 9 aa, Homo Sapiens
FQIRAQTAA

SEQ ID NO: 71178 - protein, 9 aa, Homo Sapiens
ISVIAIYFL

SEQ ID NO: 71179 - protein, 9 aa, Homo Sapiens
SRLKELPEL

SEQ ID NO: 71180 - protein, 9 aa, Homo Sapiens
FSHDECIVY

SEQ ID NO: 71181 - protein, 9 aa, Homo Sapiens
ILAWLWNER

SEQ ID NO: 71182 - protein, 9 aa, Homo Sapiens
REERPNYHL

SEQ ID NO: 71183 - protein, 9 aa, Homo Sapiens
LPDPDDSSK

SEQ ID NO: 71184 - protein, 9 aa, Homo Sapiens
KQMNDARHG

SEQ ID NO: 71185 - protein, 9 aa, Homo Sapiens
EAMEALVST

SEQ ID NO: 71186 - protein, 9 aa, Homo Sapiens
VILKHSSLL

SEQ ID NO: 71187 - protein, 9 aa, Homo Sapiens
CKYLQQAFE

SEQ ID NO: 71188 - protein, 9 aa, Homo Sapiens
WREWFDEDY

SEQ ID NO: 71189 - protein, 9 aa, Homo Sapiens
FIDRLNKHG

SEQ ID NO: 71190 - protein, 9 aa, Homo Sapiens
PSKHSVVWN

SEQ ID NO: 71191 - protein, 9 aa, Homo Sapiens
VINWEGMIS

SEQ ID NO: 71192 - protein, 9 aa, Homo Sapiens
SHGYAGKFG

SEQ ID NO: 71193 - protein, 9 aa, Homo Sapiens
HREERPNYH

SEQ ID NO: 71194 - protein, 9 aa, Homo Sapiens
KYVKALECA

SEQ ID NO: 71195 - protein, 9 aa, Homo Sapiens
LHKAPKNKG

SEQ ID NO: 71196 - protein, 9 aa, Homo Sapiens
GGCHPNSIC

SEQ ID NO: 71197 - protein, 9 aa, Homo Sapiens
HAHWKSKEW

SEQ ID NO: 71198 - protein, 9 aa, Homo Sapiens
GKTLEKSLG

SEQ ID NO: 71199 - protein, 9 aa, Homo Sapiens
MEALVSTEK

SEQ ID NO: 71200 - protein, 9 aa, Homo Sapiens
VLSAYWHGL

SEQ ID NO: 71201 - protein, 9 aa, Homo Sapiens
KSKEWPEFV

SEQ ID NO: 71202 - protein, 9 aa, Homo Sapiens
WAKKTKEQL

SEQ ID NO: 71203 - protein, 9 aa, Homo Sapiens
GPKASHGYA

SEQ ID NO: 71204 - protein, 9 aa, Homo Sapiens
CHPNSICTN

SEQ ID NO: 71205 - protein, 9 aa, Homo Sapiens
VNPDSFGIW

SEQ ID NO: 71206 - protein, 9 aa, Homo Sapiens
HSVVWNAMI

SEQ ID NO: 71207 - protein, 9 aa, Homo Sapiens
QGKPLDQFL

SEQ ID NO: 71208 - protein, 9 aa, Homo Sapiens
TIISSYAFT

SEQ ID NO: 71209 - protein, 9 aa, Homo Sapiens
FIRMHCTFN

SEQ ID NO: 71210 - protein, 9 aa, Homo Sapiens
AYYRVGKYV

SEQ ID NO: 71211 - protein, 9 aa, Homo Sapiens
PIRKKTEEK

SEQ ID NO: 71212 - protein, 9 aa, Homo Sapiens
LLEHGEYKE

SEQ ID NO: 71213 - protein, 9 aa, Homo Sapiens
SHDECIVYQ

SEQ ID NO: 71214 - protein, 9 aa, Homo Sapiens
TGFNKSRLG

SEQ ID NO: 71215 - protein, 9 aa, Homo Sapiens
FNCFSKWKP

SEQ ID NO: 71216 - protein, 9 aa, Homo Sapiens
DSLHKAPKN

SEQ ID NO: 71217 - protein, 9 aa, Homo Sapiens
KWKPSAIAS

SEQ ID NO: 71218 - protein, 9 aa, Homo Sapiens
LLDSYTEYC

SEQ ID NO: 71219 - protein, 9 aa, Homo Sapiens
QGADTPLLV

SEQ ID NO: 71220 - protein, 9 aa, Homo Sapiens
RSAWTMVLS

SEQ ID NO: 71221 - protein, 9 aa, Homo Sapiens
VPGKTLEKS

SEQ ID NO: 71222 - protein, 9 aa, Homo Sapiens
LPKDDPQVM

SEQ ID NO: 71223 - protein, 9 aa, Homo Sapiens
FVFLPLNSG

SEQ ID NO: 71224 - protein, 9 aa, Homo Sapiens
TKHRKIYTR

SEQ ID NO: 71225 - protein, 9 aa, Homo Sapiens
GFNKSRLGT

SEQ ID NO: 71226 - protein, 9 aa, Homo Sapiens
PQKQGKPLD

SEQ ID NO: 71227 - protein, 9 aa, Homo Sapiens
SKEWPEFVR

SEQ ID NO: 71228 - protein, 9 aa, Homo Sapiens
DLHHNKLLE

SEQ ID NO: 71229 - protein, 9 aa, Homo Sapiens
RLVPGKTLE

SEQ ID NO: 71230 - protein, 9 aa, Homo Sapiens
TKFIDRLNK

SEQ ID NO: 71231 - protein, 9 aa, Homo Sapiens
GSCPQVNVN

SEQ ID NO: 71232 - protein, 9 aa, Homo Sapiens
EADLHHNKL

SEQ ID NO: 71233 - protein, 9 aa, Homo Sapiens
QEDSGHDTT

SEQ ID NO: 71234 - protein, 9 aa, Homo Sapiens
RDASSAPSQ

SEQ ID NO: 71235 - protein, 9 aa, Homo Sapiens
FSKWKPSAI

SEQ ID NO: 71236 - protein, 9 aa, Homo Sapiens
QLNGALKVQ

SEQ ID NO: 71237 - protein, 9 aa, Homo Sapiens
LQALCMSSA

SEQ ID NO: 71238 - protein, 9 aa, Homo Sapiens
PQVNVNFPQ

SEQ ID NO: 71239 - protein, 9 aa, Homo Sapiens
FRTCCVLLR

SEQ ID NO: 71240 - protein, 9 aa, Homo Sapiens
LVAYMNNSR

SEQ ID NO: 71241 - protein, 9 aa, Homo Sapiens
QIQSRVIPF

SEQ ID NO: 71242 - protein, 9 aa, Homo Sapiens
PGKTLEKSL

SEQ ID NO: 71243 - protein, 9 aa, Homo Sapiens
CFNMDRSRK

SEQ ID NO: 71244 - protein, 9 aa, Homo Sapiens
GSLSARGSH

SEQ ID NO: 71245 - protein, 9 aa, Homo Sapiens
YRVGKYVKA

SEQ ID NO: 71246 - protein, 9 aa, Homo Sapiens
LEECPAGAY

SEQ ID NO: 71247 - protein, 9 aa, Homo Sapiens
EESESEEQS

SEQ ID NO: 71248 - protein, 9 aa, Homo Sapiens
HFVFLPLNS

SEQ ID NO: 71249 - protein, 9 aa, Homo Sapiens
SSYAFTTVS

SEQ ID NO: 71250 - protein, 9 aa, Homo Sapiens
RTCCVLLRA

SEQ ID NO: 71251 - protein, 9 aa, Homo Sapiens
KDVLLCFNM

SEQ ID NO: 71252 - protein, 9 aa, Homo Sapiens
DFSHDECIV

SEQ ID NO: 71253 - protein, 9 aa, Homo Sapiens
CFSKWKPSA

SEQ ID NO: 71254 - protein, 9 aa, Homo Sapiens
VVWNAMIHP

SEQ ID NO: 71255 - protein, 9 aa, Homo Sapiens
TRGHGATHT

SEQ ID NO: 71256 - protein, 9 aa, Homo Sapiens
RVGKYVKAL

SEQ ID NO: 71257 - protein, 9 aa, Homo Sapiens
SKWKPSAIA

SEQ ID NO: 71258 - protein, 9 aa, Homo Sapiens
QPRCQWREW

SEQ ID NO: 71259 - protein, 9 aa, Homo Sapiens
RGELFKAFI

SEQ ID NO: 71260 - protein, 9 aa, Homo Sapiens
EALVSTEKM

SEQ ID NO: 71261 - protein, 9 aa, Homo Sapiens
AFSKTKFID

SEQ ID NO: 71262 - protein, 9 aa, Homo Sapiens
NKSRLGTKD

SEQ ID NO: 71263 - protein, 9 aa, Homo Sapiens
VWNAMIHPL

SEQ ID NO: 71264 - protein, 9 aa, Homo Sapiens
CPQVNVNFP

SEQ ID NO: 71265 - protein, 9 aa, Homo Sapiens
VNFPQLGLC

SEQ ID NO: 71266 - protein, 9 aa, Homo Sapiens
RSRLKELPE

SEQ ID NO: 71267 - protein, 9 aa, Homo Sapiens
CGPETGLQS

SEQ ID NO: 71268 - protein, 9 aa, Homo Sapiens
ERVQTVALE

SEQ ID NO: 71269 - protein, 9 aa, Homo Sapiens
DSGHDTTSN

SEQ ID NO: 71270 - protein, 9 aa, Homo Sapiens
PVVRQCGPE

SEQ ID NO: 71271 - protein, 9 aa, Homo Sapiens
KLLEHGEYK

SEQ ID NO: 71272 - protein, 9 aa, Homo Sapiens
AQTAAGYGT

SEQ ID NO: 71273 - protein, 9 aa, Homo Sapiens
ETASPMLQI

SEQ ID NO: 71274 - protein, 9 aa, Homo Sapiens
RLKELPELQ

SEQ ID NO: 71275 - protein, 9 aa, Homo Sapiens
RGHGATHTV

SEQ ID NO: 71276 - protein, 9 aa, Homo Sapiens
EERPNYHLE

SEQ ID NO: 71277 - protein, 9 aa, Homo Sapiens
SRVIPFNCF

SEQ ID NO: 71278 - protein, 9 aa, Homo Sapiens
TGQGADTPL

SEQ ID NO: 71279 - protein, 9 aa, Homo Sapiens
YHIQACTTT

SEQ ID NO: 71280 - protein, 9 aa, Homo Sapiens
AGHYVRENC

SEQ ID NO: 71281 - protein, 9 aa, Homo Sapiens
PFNCFSKWK

SEQ ID NO: 71282 - protein, 9 aa, Homo Sapiens
VNVNFPQLG

SEQ ID NO: 71283 - protein, 9 aa, Homo Sapiens
EDEGEETAS

SEQ ID NO: 71284 - protein, 9 aa, Homo Sapiens
CPAGAYYEK

SEQ ID NO: 71285 - protein, 9 aa, Homo Sapiens
EKEKLLKLL

SEQ ID NO: 71286 - protein, 9 aa, Homo Sapiens
MNNSRSSSA

SEQ ID NO: 71287 - protein, 9 aa, Homo Sapiens
LLLDSYTEY

SEQ ID NO: 71288 - protein, 9 aa, Homo Sapiens
DISVIAIYF

SEQ ID NO: 71289 - protein, 9 aa, Homo Sapiens
FGIWAKKTK

SEQ ID NO: 71290 - protein, 9 aa, Homo Sapiens
NHNNLVVKV

SEQ ID NO: 71291 - protein, 9 aa, Homo Sapiens
GAYYEKETK

SEQ ID NO: 71292 - protein, 9 aa, Homo Sapiens
TGERVQTVA

SEQ ID NO: 71293 - protein, 9 aa, Homo Sapiens
TAPDASAPE

SEQ ID NO: 71294 - protein, 9 aa, Homo Sapiens
ESTTGFNKS

SEQ ID NO: 71295 - protein, 9 aa, Homo Sapiens
VLLCFNMDR

SEQ ID NO: 71296 - protein, 9 aa, Homo Sapiens
WKSKEWPEF

SEQ ID NO: 71297 - protein, 9 aa, Homo Sapiens
AQIQSRVIP

SEQ ID NO: 71298 - protein, 9 aa, Homo Sapiens
GATHTVRLQ

SEQ ID NO: 71299 - protein, 9 aa, Homo Sapiens
CLEECPAGA

SEQ ID NO: 71300 - protein, 9 aa, Homo Sapiens
HNKLLEHGE

SEQ ID NO: 71301 - protein, 9 aa, Homo Sapiens
YYRVGKYVK

SEQ ID NO: 71302 - protein, 9 aa, Homo Sapiens
MVLSAYWHG

SEQ ID NO: 71303 - protein, 9 aa, Homo Sapiens
IYVFQIRAQ

SEQ ID NO: 71304 - protein, 9 aa, Homo Sapiens
NSLFFRTCC

SEQ ID NO: 71305 - protein, 9 aa, Homo Sapiens
LANHNNLVV

SEQ ID NO: 71306 - protein, 9 aa, Homo Sapiens
ADTPLLVSL

SEQ ID NO: 71307 - protein, 9 aa, Homo Sapiens
NYHLECLQW

SEQ ID NO: 71308 - protein, 9 aa, Homo Sapiens
RLQALCMSS

SEQ ID NO: 71309 - protein, 9 aa, Homo Sapiens
NKGIKSSIG

SEQ ID NO: 71310 - protein, 9 aa, Homo Sapiens
RRSRLKELP

SEQ ID NO: 71311 - protein, 9 aa, Homo Sapiens
WSLIKNTCL

SEQ ID NO: 71312 - protein, 9 aa, Homo Sapiens
ASMGLEENT

SEQ ID NO: 71313 - protein, 9 aa, Homo Sapiens
SAPEAKVQE

SEQ ID NO: 71314 - protein, 9 aa, Homo Sapiens
VANPPKAIV

SEQ ID NO: 71315 - protein, 9 aa, Homo Sapiens
ASMLQEYCK

SEQ ID NO: 71316 - protein, 9 aa, Homo Sapiens
SAIASLPAD

SEQ ID NO: 71317 - protein, 9 aa, Homo Sapiens
AYYEKETKE

SEQ ID NO: 71318 - protein, 9 aa, Homo Sapiens
QTAAGYGTN

SEQ ID NO: 71319 - protein, 9 aa, Homo Sapiens
VSRDASSAP

SEQ ID NO: 71320 - protein, 9 aa, Homo Sapiens
LVPGKTLEK

SEQ ID NO: 71321 - protein, 9 aa, Homo Sapiens
CLPKDDPQV

SEQ ID NO: 71322 - protein, 9 aa, Homo Sapiens
PVGKYHIQA

SEQ ID NO: 71323 - protein, 9 aa, Homo Sapiens
NSNTGERVQ

SEQ ID NO: 71324 - protein, 9 aa, Homo Sapiens
NWEAMEALV

SEQ ID NO: 71325 - protein, 9 aa, Homo Sapiens
FFRTCCVLL

SEQ ID NO: 71326 - protein, 9 aa, Homo Sapiens
TCQPRCQWR

SEQ ID NO: 71327 - protein, 9 aa, Homo Sapiens
PERSRTLHF

SEQ ID NO: 71328 - protein, 9 aa, Homo Sapiens
WLWNERFWL

SEQ ID NO: 71329 - protein, 9 aa, Homo Sapiens
LFFRTCCVL

SEQ ID NO: 71330 - protein, 9 aa, Homo Sapiens
ASHGYAGKF

SEQ ID NO: 71331 - protein, 9 aa, Homo Sapiens
NSGAHPSVP

SEQ ID NO: 71332 - protein, 9 aa, Homo Sapiens
SRDASSAPS

SEQ ID NO: 71333 - protein, 9 aa, Homo Sapiens
YWVINWEGM

SEQ ID NO: 71334 - protein, 9 aa, Homo Sapiens
LPQKQGKPL

SEQ ID NO: 71335 - protein, 9 aa, Homo Sapiens
SSLLLDSYT

SEQ ID NO: 71336 - protein, 9 aa, Homo Sapiens
HHNKLLEHG

SEQ ID NO: 71337 - protein, 9 aa, Homo Sapiens
AIYFLVVMA

SEQ ID NO: 71338 - protein, 9 aa, Homo Sapiens
KHSVVWNAM

SEQ ID NO: 71339 - protein, 9 aa, Homo Sapiens
VVRQCGPET

SEQ ID NO: 71340 - protein, 9 aa, Homo Sapiens
VLRSAWTMV

SEQ ID NO: 71341 - protein, 9 aa, Homo Sapiens
TPLLVSLLL

SEQ ID NO: 71342 - protein, 9 aa, Homo Sapiens
GHGATHTVR

SEQ ID NO: 71343 - protein, 9 aa, Homo Sapiens
REESTTGFN

SEQ ID NO: 71344 - protein, 9 aa, Homo Sapiens
TASPMLQIQ

SEQ ID NO: 71345 - protein, 9 aa, Homo Sapiens
TVNQFPTQY

SEQ ID NO: 71346 - protein, 9 aa, Homo Sapiens
KTEEKEKLL

SEQ ID NO: 71347 - protein, 9 aa, Homo Sapiens
QACTTTPCM

SEQ ID NO: 71348 - protein, 9 aa, Homo Sapiens
HYVRENCKP

SEQ ID NO: 71349 - protein, 9 aa, Homo Sapiens
DSFGIWAKK

SEQ ID NO: 71350 - protein, 9 aa, Homo Sapiens
KPLDQFLWR

SEQ ID NO: 71351 - protein, 9 aa, Homo Sapiens
SVVWNAMIH

SEQ ID NO: 71352 - protein, 9 aa, Homo Sapiens
FKAFIDTAQ

SEQ ID NO: 71353 - protein, 9 aa, Homo Sapiens
SAPSQGSHF

SEQ ID NO: 71354 - protein, 9 aa, Homo Sapiens
SYAFTTVSC

SEQ ID NO: 71355 - protein, 9 aa, Homo Sapiens
PDDSSKSPV

SEQ ID NO: 71356 - protein, 9 aa, Homo Sapiens
SSKSPVGSP

SEQ ID NO: 71357 - protein, 9 aa, Homo Sapiens
GRGELFKAF

SEQ ID NO: 71358 - protein, 9 aa, Homo Sapiens
QPRLVPGKT

SEQ ID NO: 71359 - protein, 9 aa, Homo Sapiens
FSKTKFIDR

SEQ ID NO: 71360 - protein, 9 aa, Homo Sapiens
QPPRNQDPA

SEQ ID NO: 71361 - protein, 9 aa, Homo Sapiens
IPFNCFSKW

SEQ ID NO: 71362 - protein, 9 aa, Homo Sapiens
LCMSSALPG

SEQ ID NO: 71363 - protein, 9 aa, Homo Sapiens
TSNRDSYSD

SEQ ID NO: 71364 - protein, 9 aa, Homo Sapiens
NWEGMISVS

SEQ ID NO: 71365 - protein, 9 aa, Homo Sapiens
GILAWLWNE

SEQ ID NO: 71366 - protein, 9 aa, Homo Sapiens
VFKDVLLCF

SEQ ID NO: 71367 - protein, 9 aa, Homo Sapiens
PNYHLECLQ

SEQ ID NO: 71368 - protein, 9 aa, Homo Sapiens
GQPRLVPGK

SEQ ID NO: 71369 - protein, 9 aa, Homo Sapiens
SLLLDSYTE

SEQ ID NO: 71370 - protein, 9 aa, Homo Sapiens
ERPNYHLEC

SEQ ID NO: 71371 - protein, 9 aa, Homo Sapiens
STTGFNKSR

SEQ ID NO: 71372 - protein, 9 aa, Homo Sapiens
PDASAPEAK

SEQ ID NO: 71373 - protein, 9 aa, Homo Sapiens
TSAGHYVRE

SEQ ID NO: 71374 - protein, 9 aa, Homo Sapiens
CMSSALPGL

SEQ ID NO: 71375 - protein, 9 aa, Homo Sapiens
LTRGHGATH

SEQ ID NO: 71376 - protein, 9 aa, Homo Sapiens
VIAIYFLVV

SEQ ID NO: 71377 - protein, 9 aa, Homo Sapiens
LKELPELQS

SEQ ID NO: 71378 - protein, 9 aa, Homo Sapiens
GEESESEEQ

SEQ ID NO: 71379 - protein, 9 aa, Homo Sapiens
QSRVIPFNC

SEQ ID NO: 71380 - protein, 9 aa, Homo Sapiens
SMGLEENTG

SEQ ID NO: 71381 - protein, 9 aa, Homo Sapiens
ITTAPDASA

SEQ ID NO: 71382 - protein, 9 aa, Homo Sapiens
PPKAIVFSY

SEQ ID NO: 71383 - protein, 9 aa, Homo Sapiens
ANHNNLVVK

SEQ ID NO: 71384 - protein, 9 aa, Homo Sapiens
INWEGMISV

SEQ ID NO: 71385 - protein, 9 aa, Homo Sapiens
KASHGYAGK

SEQ ID NO: 71386 - protein, 9 aa, Homo Sapiens
ALCMSSALP

SEQ ID NO: 71387 - protein, 9 aa, Homo Sapiens
LPEVIRASM

SEQ ID NO: 71388 - protein, 9 aa, Homo Sapiens
NPPKAIVFS

SEQ ID NO: 71389 - protein, 9 aa, Homo Sapiens
NAADISVIA

SEQ ID NO: 71390 - protein, 9 aa, Homo Sapiens
PRCQWREWF

SEQ ID NO: 71391 - protein, 9 aa, Homo Sapiens
NLVVKVKVL

SEQ ID NO: 71392 - protein, 9 aa, Homo Sapiens
ISSYAFTTV

SEQ ID NO: 71393 - protein, 9 aa, Homo Sapiens
HGYAGKFGV

SEQ ID NO: 71394 - protein, 9 aa, Homo Sapiens
KPSAIASLP

SEQ ID NO: 71395 - protein, 9 aa, Homo Sapiens
SPNSLVAYM

SEQ ID NO: 71396 - protein, 9 aa, Homo Sapiens
PAGAYYEKE

SEQ ID NO: 71397 - protein, 9 aa, Homo Sapiens
KAIVFSYGH

SEQ ID NO: 71398 - protein, 9 aa, Homo Sapiens
FKDVLLCFN

SEQ ID NO: 71399 - protein, 9 aa, Homo Sapiens
RIVHQRMQH

SEQ ID NO: 71400 - protein, 9 aa, Homo Sapiens
GPETGLQSP

SEQ ID NO: 71401 - protein, 9 aa, Homo Sapiens
NKLLEHGEY

SEQ ID NO: 71402 - protein, 9 aa, Homo Sapiens
GHDTTSNRD

SEQ ID NO: 71403 - protein, 9 aa, Homo Sapiens
WEAMEALVS

SEQ ID NO: 71404 - protein, 9 aa, Homo Sapiens
IKNTCLPKD

SEQ ID NO: 71405 - protein, 9 aa, Homo Sapiens
VIRASMGLE

SEQ ID NO: 71406 - protein, 9 aa, Homo Sapiens
APEAKVQEE

SEQ ID NO: 71407 - protein, 9 aa, Homo Sapiens
HWKSKEWPE

SEQ ID NO: 71408 - protein, 9 aa, Homo Sapiens
ALKVQPPRN

SEQ ID NO: 71409 - protein, 9 aa, Homo Sapiens
TTGFNKSRL

SEQ ID NO: 71410 - protein, 9 aa, Homo Sapiens
SLPADFSHD

SEQ ID NO: 71411 - protein, 9 aa, Homo Sapiens
NTCLPKDDP

SEQ ID NO: 71412 - protein, 9 aa, Homo Sapiens
QFPTQYFLH

SEQ ID NO: 71413 - protein, 9 aa, Homo Sapiens
LGRLQALCM

SEQ ID NO: 71414 - protein, 9 aa, Homo Sapiens
KSTIISSYA

SEQ ID NO: 71415 - protein, 9 aa, Homo Sapiens
ADFSHDECI

SEQ ID NO: 71416 - protein, 9 aa, Homo Sapiens
EETASPMLQ

SEQ ID NO: 71417 - protein, 9 aa, Homo Sapiens
PVANPPKAI

SEQ ID NO: 71418 - protein, 9 aa, Homo Sapiens
GELFKAFID

SEQ ID NO: 71419 - protein, 9 aa, Homo Sapiens
WKPSAIASL

SEQ ID NO: 71420 - protein, 9 aa, Homo Sapiens
ASSAPSQGS

SEQ ID NO: 71421 - protein, 9 aa, Homo Sapiens
AAAQIQSRV

SEQ ID NO: 71422 - protein, 9 aa, Homo Sapiens
VSTEKMLQD

SEQ ID NO: 71423 - protein, 9 aa, Homo Sapiens
GKYHIQACT

SEQ ID NO: 71424 - protein, 9 aa, Homo Sapiens
SSAPSQGSH

SEQ ID NO: 71425 - protein, 9 aa, Homo Sapiens
LSGYHRIVH

SEQ ID NO: 71426 - protein, 9 aa, Homo Sapiens
APTVNQFPT

SEQ ID NO: 71427 - protein, 9 aa, Homo Sapiens
NTSAGHYVR

SEQ ID NO: 71428 - protein, 9 aa, Homo Sapiens
RQCGPETGL

SEQ ID NO: 71429 - protein, 9 aa, Homo Sapiens
ANPPKAIVF

SEQ ID NO: 71430 - protein, 9 aa, Homo Sapiens
AGAYYEKET

SEQ ID NO: 71431 - protein, 9 aa, Homo Sapiens
FNKSRLGTK

SEQ ID NO: 71432 - protein, 9 aa, Homo Sapiens
SESEEQSES

SEQ ID NO: 71433 - protein, 9 aa, Homo Sapiens
ETGLQSPGT

SEQ ID NO: 71434 - protein, 9 aa, Homo Sapiens
GQGADTPLL

SEQ ID NO: 71435 - protein, 9 aa, Homo Sapiens
AHAHWKSKE

SEQ ID NO: 71436 - protein, 9 aa, Homo Sapiens
AGKFGVEQD

SEQ ID NO: 71437 - protein, 9 aa, Homo Sapiens
DTGDKSIYG

SEQ ID NO: 71438 - protein, 9 aa, Homo Sapiens
QLVFYNAVA

SEQ ID NO: 71439 - protein, 9 aa, Homo Sapiens
VDERRYRNV

SEQ ID NO: 71440 - protein, 9 aa, Homo Sapiens
KENVCLLRD

SEQ ID NO: 71441 - protein, 9 aa, Homo Sapiens
SAFAQAAAA

SEQ ID NO: 71442 - protein, 9 aa, Homo Sapiens
YMCDEVVAP

SEQ ID NO: 71443 - protein, 9 aa, Homo Sapiens
EPPTTTAAG

SEQ ID NO: 71444 - protein, 9 aa, Homo Sapiens
VCFLLPPRA

SEQ ID NO: 71445 - protein, 9 aa, Homo Sapiens
EGQTEEPEA

SEQ ID NO: 71446 - protein, 9 aa, Homo Sapiens
NLKDDFEVF

SEQ ID NO: 71447 - protein, 9 aa, Homo Sapiens
NDHFYRGKA

SEQ ID NO: 71448 - protein, 9 aa, Homo Sapiens
VEISLYDES

SEQ ID NO: 71449 - protein, 9 aa, Homo Sapiens
NTLIIKVCG

SEQ ID NO: 71450 - protein, 9 aa, Homo Sapiens
SAIWSIKMG

SEQ ID NO: 71451 - protein, 9 aa, Homo Sapiens
DCRSTAGQW

SEQ ID NO: 71452 - protein, 9 aa, Homo Sapiens
VCPHPSRDQ

SEQ ID NO: 71453 - protein, 9 aa, Homo Sapiens
TGYEYHVLS

SEQ ID NO: 71454 - protein, 9 aa, Homo Sapiens
LKGIPGSTV

SEQ ID NO: 71455 - protein, 9 aa, Homo Sapiens
RPTRENNVK

SEQ ID NO: 71456 - protein, 9 aa, Homo Sapiens
GFITLFVAS

SEQ ID NO: 71457 - protein, 9 aa, Homo Sapiens
HPRCVSIPG

SEQ ID NO: 71458 - protein, 9 aa, Homo Sapiens
HDVSLANWM

SEQ ID NO: 71459 - protein, 9 aa, Homo Sapiens
VQDLLTGIE

SEQ ID NO: 71460 - protein, 9 aa, Homo Sapiens
RWLTYFMAL

SEQ ID NO: 71461 - protein, 9 aa, Homo Sapiens
GSAIWSIKM

SEQ ID NO: 71462 - protein, 9 aa, Homo Sapiens
QDLLTGIEK

SEQ ID NO: 71463 - protein, 9 aa, Homo Sapiens
YIHTHTFYV

SEQ ID NO: 71464 - protein, 9 aa, Homo Sapiens
DKENVCLLR

SEQ ID NO: 71465 - protein, 9 aa, Homo Sapiens
YTGYEYHVL

SEQ ID NO: 71466 - protein, 9 aa, Homo Sapiens
WFAGKQVMS

SEQ ID NO: 71467 - protein, 9 aa, Homo Sapiens
DKVLPLEAE

SEQ ID NO: 71468 - protein, 9 aa, Homo Sapiens
IHSKKTEAL

SEQ ID NO: 71469 - protein, 9 aa, Homo Sapiens
IKMGRGSGF

SEQ ID NO: 71470 - protein, 9 aa, Homo Sapiens
TQDKVLPLE

SEQ ID NO: 71471 - protein, 9 aa, Homo Sapiens
YQTFLEVAE

SEQ ID NO: 71472 - protein, 9 aa, Homo Sapiens
GTQNLSGPG

SEQ ID NO: 71473 - protein, 9 aa, Homo Sapiens
QPLDPGEGS

SEQ ID NO: 71474 - protein, 9 aa, Homo Sapiens
SSCMGGMNQ

SEQ ID NO: 71475 - protein, 9 aa, Homo Sapiens
LTPRVYSTE

SEQ ID NO: 71476 - protein, 9 aa, Homo Sapiens
FVVNRKIFG

SEQ ID NO: 71477 - protein, 9 aa, Homo Sapiens
STRIVGAKE

SEQ ID NO: 71478 - protein, 9 aa, Homo Sapiens
SGKVACLDT

SEQ ID NO: 71479 - protein, 9 aa, Homo Sapiens
RWFAGKQVM

SEQ ID NO: 71480 - protein, 9 aa, Homo Sapiens
MIIQFGFIT

SEQ ID NO: 71481 - protein, 9 aa, Homo Sapiens
GDPPVTVIS

SEQ ID NO: 71482 - protein, 9 aa, Homo Sapiens
QQSFWNNKG

SEQ ID NO: 71483 - protein, 9 aa, Homo Sapiens
GGTQNLSGP

SEQ ID NO: 71484 - protein, 9 aa, Homo Sapiens
TQLVQQSFW

SEQ ID NO: 71485 - protein, 9 aa, Homo Sapiens
ISPQITRCE

SEQ ID NO: 71486 - protein, 9 aa, Homo Sapiens
YTFKNLPVE

SEQ ID NO: 71487 - protein, 9 aa, Homo Sapiens
LEVAESSGT

SEQ ID NO: 71488 - protein, 9 aa, Homo Sapiens
TMFQNDFEN

SEQ ID NO: 71489 - protein, 9 aa, Homo Sapiens
ENACQAKSE

SEQ ID NO: 71490 - protein, 9 aa, Homo Sapiens
LLTGIEKLV

SEQ ID NO: 71491 - protein, 9 aa, Homo Sapiens
LVCPHPSRD

SEQ ID NO: 71492 - protein, 9 aa, Homo Sapiens
LLQKFRDQD

SEQ ID NO: 71493 - protein, 9 aa, Homo Sapiens
TRVLLQKFR

SEQ ID NO: 71494 - protein, 9 aa, Homo Sapiens
RKIFGEIGL

SEQ ID NO: 71495 - protein, 9 aa, Homo Sapiens
IQFGFITLF

SEQ ID NO: 71496 - protein, 9 aa, Homo Sapiens
TPSISPQIT

SEQ ID NO: 71497 - protein, 9 aa, Homo Sapiens
LDISSSNAI

SEQ ID NO: 71498 - protein, 9 aa, Homo Sapiens
KGRQRKPQP

SEQ ID NO: 71499 - protein, 9 aa, Homo Sapiens
LTICCCCCW

SEQ ID NO: 71500 - protein, 9 aa, Homo Sapiens
GSVGVRDQQ

SEQ ID NO: 71501 - protein, 9 aa, Homo Sapiens
LDLTRVLLQ

SEQ ID NO: 71502 - protein, 9 aa, Homo Sapiens
LVQQSFWNN

SEQ ID NO: 71503 - protein, 9 aa, Homo Sapiens
MCDEVVAPN

SEQ ID NO: 71504 - protein, 9 aa, Homo Sapiens
CRSTAGQWD

SEQ ID NO: 71505 - protein, 9 aa, Homo Sapiens
DGWVRSVSF

SEQ ID NO: 71506 - protein, 9 aa, Homo Sapiens
PSISPQITR

SEQ ID NO: 71507 - protein, 9 aa, Homo Sapiens
SFWNNKGHR

SEQ ID NO: 71508 - protein, 9 aa, Homo Sapiens
IIKVCGCDV

SEQ ID NO: 71509 - protein, 9 aa, Homo Sapiens
TSPFSVYVS

SEQ ID NO: 71510 - protein, 9 aa, Homo Sapiens
ASVSGKVAC

SEQ ID NO: 71511 - protein, 9 aa, Homo Sapiens
IKVMVQDLL

SEQ ID NO: 71512 - protein, 9 aa, Homo Sapiens
DTPSISPQI

SEQ ID NO: 71513 - protein, 9 aa, Homo Sapiens
LTQTQDKVL

SEQ ID NO: 71514 - protein, 9 aa, Homo Sapiens
WLTYFMALK

SEQ ID NO: 71515 - protein, 9 aa, Homo Sapiens
LASVSGKVA

SEQ ID NO: 71516 - protein, 9 aa, Homo Sapiens
RLSQSSLTI

SEQ ID NO: 71517 - protein, 9 aa, Homo Sapiens
LRDEEERDQ

SEQ ID NO: 71518 - protein, 9 aa, Homo Sapiens
LTSAFAQAA

SEQ ID NO: 71519 - protein, 9 aa, Homo Sapiens
VMSVASVGG

SEQ ID NO: 71520 - protein, 9 aa, Homo Sapiens
SQQQQQQHR

SEQ ID NO: 71521 - protein, 9 aa, Homo Sapiens
DERRYRNVF

SEQ ID NO: 71522 - protein, 9 aa, Homo Sapiens
IYIYTHIYI

SEQ ID NO: 71523 - protein, 9 aa, Homo Sapiens
DEEERDQVR

SEQ ID NO: 71524 - protein, 9 aa, Homo Sapiens
HFCAWVYDY

SEQ ID NO: 71525 - protein, 9 aa, Homo Sapiens
DSPQGHGIS

SEQ ID NO: 71526 - protein, 9 aa, Homo Sapiens
FAGGANDGW

SEQ ID NO: 71527 - protein, 9 aa, Homo Sapiens
HPNDTGDKS

SEQ ID NO: 71528 - protein, 9 aa, Homo Sapiens
QNDFENACQ

SEQ ID NO: 71529 - protein, 9 aa, Homo Sapiens
ASLVCPHPS

SEQ ID NO: 71530 - protein, 9 aa, Homo Sapiens
HLWAEPPNK

SEQ ID NO: 71531 - protein, 9 aa, Homo Sapiens
MSSTNTLII

SEQ ID NO: 71532 - protein, 9 aa, Homo Sapiens
RAVYVHSES

SEQ ID NO: 71533 - protein, 9 aa, Homo Sapiens
LAHLTSAFA

SEQ ID NO: 71534 - protein, 9 aa, Homo Sapiens
ANDGWVRSV

SEQ ID NO: 71535 - protein, 9 aa, Homo Sapiens
WCPHPRCVS

SEQ ID NO: 71536 - protein, 9 aa, Homo Sapiens
PMSSTNTLI

SEQ ID NO: 71537 - protein, 9 aa, Homo Sapiens
AESSGTVSV

SEQ ID NO: 71538 - protein, 9 aa, Homo Sapiens
QLVQQSFWN

SEQ ID NO: 71539 - protein, 9 aa, Homo Sapiens
DQQDCRSTA

SEQ ID NO: 71540 - protein, 9 aa, Homo Sapiens
LIAGSVCFL

SEQ ID NO: 71541 - protein, 9 aa, Homo Sapiens
IIHSKKTEA

SEQ ID NO: 71542 - protein, 9 aa, Homo Sapiens
LQHPFFSHL

SEQ ID NO: 71543 - protein, 9 aa, Homo Sapiens
DLLTGIEKL

SEQ ID NO: 71544 - protein, 9 aa, Homo Sapiens
RTLQNDNSS

SEQ ID NO: 71545 - protein, 9 aa, Homo Sapiens
AIWSIKMGR

SEQ ID NO: 71546 - protein, 9 aa, Homo Sapiens
TPRVYSTEN

SEQ ID NO: 71547 - protein, 9 aa, Homo Sapiens
GRQRKPQPL

SEQ ID NO: 71548 - protein, 9 aa, Homo Sapiens
GVRDQQDCR

SEQ ID NO: 71549 - protein, 9 aa, Homo Sapiens
QSFWNNKGH

SEQ ID NO: 71550 - protein, 9 aa, Homo Sapiens
RKPQPLDPG

SEQ ID NO: 71551 - protein, 9 aa, Homo Sapiens
QDSPQGHGI

SEQ ID NO: 71552 - protein, 9 aa, Homo Sapiens
KRSSHRLSQ

SEQ ID NO: 71553 - protein, 9 aa, Homo Sapiens
KQVMSVASV

SEQ ID NO: 71554 - protein, 9 aa, Homo Sapiens
ARTLQNDNS

SEQ ID NO: 71555 - protein, 9 aa, Homo Sapiens
NLVEISLYD

SEQ ID NO: 71556 - protein, 9 aa, Homo Sapiens
SHASLVCPH

SEQ ID NO: 71557 - protein, 9 aa, Homo Sapiens
TQNLSGPGG

SEQ ID NO: 71558 - protein, 9 aa, Homo Sapiens
HRLSQSSLT

SEQ ID NO: 71559 - protein, 9 aa, Homo Sapiens
QQRQNQRRF

SEQ ID NO: 71560 - protein, 9 aa, Homo Sapiens
FDYSEFKGD

SEQ ID NO: 71561 - protein, 9 aa, Homo Sapiens
AHYRTSPFS

SEQ ID NO: 71562 - protein, 9 aa, Homo Sapiens
EKGRQRKPQ

SEQ ID NO: 71563 - protein, 9 aa, Homo Sapiens
HGISRFQFC

SEQ ID NO: 71564 - protein, 9 aa, Homo Sapiens
ISRFQFCGR

SEQ ID NO: 71565 - protein, 9 aa, Homo Sapiens
WMEAAGVPG

SEQ ID NO: 71566 - protein, 9 aa, Homo Sapiens
MVQDLLTGI

SEQ ID NO: 71567 - protein, 9 aa, Homo Sapiens
GISRFQFCG

SEQ ID NO: 71568 - protein, 9 aa, Homo Sapiens
QTEEPEAEE

SEQ ID NO: 71569 - protein, 9 aa, Homo Sapiens
PQGQLVFYN

SEQ ID NO: 71570 - protein, 9 aa, Homo Sapiens
PFFSHLWAE

SEQ ID NO: 71571 - protein, 9 aa, Homo Sapiens
TLIIKVCGC

SEQ ID NO: 71572 - protein, 9 aa, Homo Sapiens
FSLDPLYRE

SEQ ID NO: 71573 - protein, 9 aa, Homo Sapiens
NFGYTFKNL

SEQ ID NO: 71574 - protein, 9 aa, Homo Sapiens
VCLLRDESI

SEQ ID NO: 71575 - protein, 9 aa, Homo Sapiens
PNDTGDKSI

SEQ ID NO: 71576 - protein, 9 aa, Homo Sapiens
RSMSLRVHS

SEQ ID NO: 71577 - protein, 9 aa, Homo Sapiens
TVKMGPSGR

SEQ ID NO: 71578 - protein, 9 aa, Homo Sapiens
WFSLDPLYR

SEQ ID NO: 71579 - protein, 9 aa, Homo Sapiens
VGVRDQQDC

SEQ ID NO: 71580 - protein, 9 aa, Homo Sapiens
SSHRLSQSS

SEQ ID NO: 71581 - protein, 9 aa, Homo Sapiens
PVQFSSSAI

SEQ ID NO: 71582 - protein, 9 aa, Homo Sapiens
QVMSVASVG

SEQ ID NO: 71583 - protein, 9 aa, Homo Sapiens
VFPANASCC

SEQ ID NO: 71584 - protein, 9 aa, Homo Sapiens
AVFPANASC

SEQ ID NO: 71585 - protein, 9 aa, Homo Sapiens
DIIHSKKTE

SEQ ID NO: 71586 - protein, 9 aa, Homo Sapiens
RAHMRTGRP

SEQ ID NO: 71587 - protein, 9 aa, Homo Sapiens
LGAYEQAAC

SEQ ID NO: 71588 - protein, 9 aa, Homo Sapiens
FGFITLFVA

SEQ ID NO: 71589 - protein, 9 aa, Homo Sapiens
MALKSNGSV

SEQ ID NO: 71590 - protein, 9 aa, Homo Sapiens
TVISLVETV

SEQ ID NO: 71591 - protein, 9 aa, Homo Sapiens
ISSRPTREN

SEQ ID NO: 71592 - protein, 9 aa, Homo Sapiens
FAGKQVMSV

SEQ ID NO: 71593 - protein, 9 aa, Homo Sapiens
DQVRSSVRA

SEQ ID NO: 71594 - protein, 9 aa, Homo Sapiens
ENVCLLRDE

SEQ ID NO: 71595 - protein, 9 aa, Homo Sapiens
LRRRKAVLP

SEQ ID NO: 71596 - protein, 9 aa, Homo Sapiens
IWSIKMGRG

SEQ ID NO: 71597 - protein, 9 aa, Homo Sapiens
LRDESIQKG

SEQ ID NO: 71598 - protein, 9 aa, Homo Sapiens
LPNLRAHMR

SEQ ID NO: 71599 - protein, 9 aa, Homo Sapiens
KTCYEGNDH

SEQ ID NO: 71600 - protein, 9 aa, Homo Sapiens
PRLFQELRD

SEQ ID NO: 71601 - protein, 9 aa, Homo Sapiens
VLRIPNIQY

SEQ ID NO: 71602 - protein, 9 aa, Homo Sapiens
SSTNTLIIK

SEQ ID NO: 71603 - protein, 9 aa, Homo Sapiens
YFMALKSNG

SEQ ID NO: 71604 - protein, 9 aa, Homo Sapiens
CYEGNDHFY

SEQ ID NO: 71605 - protein, 9 aa, Homo Sapiens
TFLEVAESS

SEQ ID NO: 71606 - protein, 9 aa, Homo Sapiens
RDQVRSSVR

SEQ ID NO: 71607 - protein, 9 aa, Homo Sapiens
LDPVQFSSS

SEQ ID NO: 71608 - protein, 9 aa, Homo Sapiens
VPQGQLVFY

SEQ ID NO: 71609 - protein, 9 aa, Homo Sapiens
IRFCCCRPT

SEQ ID NO: 71610 - protein, 9 aa, Homo Sapiens
KNLPVEGSE

SEQ ID NO: 71611 - protein, 9 aa, Homo Sapiens
SHRLSQSSL

SEQ ID NO: 71612 - protein, 9 aa, Homo Sapiens
LISSRPTRE

SEQ ID NO: 71613 - protein, 9 aa, Homo Sapiens
PNLRAHMRT

SEQ ID NO: 71614 - protein, 9 aa, Homo Sapiens
VTVISLVET

SEQ ID NO: 71615 - protein, 9 aa, Homo Sapiens
NVFEDSVRI

SEQ ID NO: 71616 - protein, 9 aa, Homo Sapiens
GHGISRFQF

SEQ ID NO: 71617 - protein, 9 aa, Homo Sapiens
VQQSFWNNK

SEQ ID NO: 71618 - protein, 9 aa, Homo Sapiens
MGRGSGFPG

SEQ ID NO: 71619 - protein, 9 aa, Homo Sapiens
EERDQVRSS

SEQ ID NO: 71620 - protein, 9 aa, Homo Sapiens
SCMGGMNQR

SEQ ID NO: 71621 - protein, 9 aa, Homo Sapiens
ITLFVASFP

SEQ ID NO: 71622 - protein, 9 aa, Homo Sapiens
PRCVSIPGH

SEQ ID NO: 71623 - protein, 9 aa, Homo Sapiens
QTQDKVLPL

SEQ ID NO: 71624 - protein, 9 aa, Homo Sapiens
FQQRQNQRR

SEQ ID NO: 71625 - protein, 9 aa, Homo Sapiens
RSSHRLSQS

SEQ ID NO: 71626 - protein, 9 aa, Homo Sapiens
RNVFEDSVR

SEQ ID NO: 71627 - protein, 9 aa, Homo Sapiens
TKRAARHFK

SEQ ID NO: 71628 - protein, 9 aa, Homo Sapiens
TYIRDKIIP

SEQ ID NO: 71629 - protein, 9 aa, Homo Sapiens
IVLRIPNIQ

SEQ ID NO: 71630 - protein, 9 aa, Homo Sapiens
LANWMEAAG

SEQ ID NO: 71631 - protein, 9 aa, Homo Sapiens
VYVHSESSQ

SEQ ID NO: 71632 - protein, 9 aa, Homo Sapiens
TYFMALKSN

SEQ ID NO: 71633 - protein, 9 aa, Homo Sapiens
SKRSSHRLS

SEQ ID NO: 71634 - protein, 9 aa, Homo Sapiens
THPNDTGDK

SEQ ID NO: 71635 - protein, 9 aa, Homo Sapiens
KDDFEVFFF

SEQ ID NO: 71636 - protein, 9 aa, Homo Sapiens
ARHFKEESK

SEQ ID NO: 71637 - protein, 9 aa, Homo Sapiens
FITLFVASF

SEQ ID NO: 71638 - protein, 9 aa, Homo Sapiens
KVLPLEAEP

SEQ ID NO: 71639 - protein, 9 aa, Homo Sapiens
APYSLLDPV

SEQ ID NO: 71640 - protein, 9 aa, Homo Sapiens
KAVLPQTRY

SEQ ID NO: 71641 - protein, 9 aa, Homo Sapiens
ALKSNGSVF

SEQ ID NO: 71642 - protein, 9 aa, Homo Sapiens
DAPLLTPRV

SEQ ID NO: 71643 - protein, 9 aa, Homo Sapiens
NDQDSAISR

SEQ ID NO: 71644 - protein, 9 aa, Homo Sapiens
GAYEQAACY

SEQ ID NO: 71645 - protein, 9 aa, Homo Sapiens
ACLDTCGDL

SEQ ID NO: 71646 - protein, 9 aa, Homo Sapiens
VVDERRYRN

SEQ ID NO: 71647 - protein, 9 aa, Homo Sapiens
YLYMCDEVV

SEQ ID NO: 71648 - protein, 9 aa, Homo Sapiens
PHPRCVSIP

SEQ ID NO: 71649 - protein, 9 aa, Homo Sapiens
ISLYDESPK

SEQ ID NO: 71650 - protein, 9 aa, Homo Sapiens
TEALQSATP

SEQ ID NO: 71651 - protein, 9 aa, Homo Sapiens
ICCCCCWAP

SEQ ID NO: 71652 - protein, 9 aa, Homo Sapiens
SLVCPHPSR

SEQ ID NO: 71653 - protein, 9 aa, Homo Sapiens
VISLVETVP

SEQ ID NO: 71654 - protein, 9 aa, Homo Sapiens
TTTAAGATE

SEQ ID NO: 71655 - protein, 9 aa, Homo Sapiens
ESVSLDISS

SEQ ID NO: 71656 - protein, 9 aa, Homo Sapiens
PTRENNVKT

SEQ ID NO: 71657 - protein, 9 aa, Homo Sapiens
NACQAKSEA

SEQ ID NO: 71658 - protein, 9 aa, Homo Sapiens
SEEHEGQTE

SEQ ID NO: 71659 - protein, 9 aa, Homo Sapiens
DVSLANWME

SEQ ID NO: 71660 - protein, 9 aa, Homo Sapiens
RDEEERDQV

SEQ ID NO: 71661 - protein, 9 aa, Homo Sapiens
HMLIAGSVC

SEQ ID NO: 71662 - protein, 9 aa, Homo Sapiens
TFKNLPVEG

SEQ ID NO: 71663 - protein, 9 aa, Homo Sapiens
WKEPGSGGT

SEQ ID NO: 71664 - protein, 9 aa, Homo Sapiens
KVMVQDLLT

SEQ ID NO: 71665 - protein, 9 aa, Homo Sapiens
NVCLLRDES

SEQ ID NO: 71666 - protein, 9 aa, Homo Sapiens
EESDAPLLT

SEQ ID NO: 71667 - protein, 9 aa, Homo Sapiens
RTSPFSVYV

SEQ ID NO: 71668 - protein, 9 aa, Homo Sapiens
KEIFFDYSE

SEQ ID NO: 71669 - protein, 9 aa, Homo Sapiens
QFGFITLFV

SEQ ID NO: 71670 - protein, 9 aa, Homo Sapiens
YDESPKNPQ

SEQ ID NO: 71671 - protein, 9 aa, Homo Sapiens
GYEYHVLSP

SEQ ID NO: 71672 - protein, 9 aa, Homo Sapiens
NDTGDKSIY

SEQ ID NO: 71673 - protein, 9 aa, Homo Sapiens
AVYVHSESS

SEQ ID NO: 71674 - protein, 9 aa, Homo Sapiens
LYMCDEVVA

SEQ ID NO: 71675 - protein, 9 aa, Homo Sapiens
RALRAVYVH

SEQ ID NO: 71676 - protein, 9 aa, Homo Sapiens
FMALKSNGS

SEQ ID NO: 71677 - protein, 9 aa, Homo Sapiens
ASEEHEGQT

SEQ ID NO: 71678 - protein, 9 aa, Homo Sapiens
HIYIHTHTF

SEQ ID NO: 71679 - protein, 9 aa, Homo Sapiens
CPHPSRDQK

SEQ ID NO: 71680 - protein, 9 aa, Homo Sapiens
LWFSLDPLY

SEQ ID NO: 71681 - protein, 9 aa, Homo Sapiens
SLYDESPKN

SEQ ID NO: 71682 - protein, 9 aa, Homo Sapiens
CLLRDESIQ

SEQ ID NO: 71683 - protein, 9 aa, Homo Sapiens
SVSLDISSS

SEQ ID NO: 71684 - protein, 9 aa, Homo Sapiens
QYTGYEYHV

SEQ ID NO: 71685 - protein, 9 aa, Homo Sapiens
RNDQDSAIS

SEQ ID NO: 71686 - protein, 9 aa, Homo Sapiens
PVTVISLVE

SEQ ID NO: 71687 - protein, 9 aa, Homo Sapiens
TLQNDNSSR

SEQ ID NO: 71688 - protein, 9 aa, Homo Sapiens
LLDPVQFSS

SEQ ID NO: 71689 - protein, 9 aa, Homo Sapiens
QRQNQRRFS

SEQ ID NO: 71690 - protein, 9 aa, Homo Sapiens
DFTHPNDTG

SEQ ID NO: 71691 - protein, 9 aa, Homo Sapiens
IPNIQYVNR

SEQ ID NO: 71692 - protein, 9 aa, Homo Sapiens
AGKQVMSVA

SEQ ID NO: 71693 - protein, 9 aa, Homo Sapiens
RGQYTGYEY

SEQ ID NO: 71694 - protein, 9 aa, Homo Sapiens
CCCRPTEPP

SEQ ID NO: 71695 - protein, 9 aa, Homo Sapiens
RVHSLQHSG

SEQ ID NO: 71696 - protein, 9 aa, Homo Sapiens
LESVSLDIS

SEQ ID NO: 71697 - protein, 9 aa, Homo Sapiens
GVQFQQRQN

SEQ ID NO: 71698 - protein, 9 aa, Homo Sapiens
GSEPPTTTA

SEQ ID NO: 71699 - protein, 9 aa, Homo Sapiens
NHFCAWVYD

SEQ ID NO: 71700 - protein, 9 aa, Homo Sapiens
ERDQVRSSV

SEQ ID NO: 71701 - protein, 9 aa, Homo Sapiens
NARTLQNDN

SEQ ID NO: 71702 - protein, 9 aa, Homo Sapiens
PGVQFQQRQ

SEQ ID NO: 71703 - protein, 9 aa, Homo Sapiens
YVHSESSQG

SEQ ID NO: 71704 - protein, 9 aa, Homo Sapiens
MGGMNQRPI

SEQ ID NO: 71705 - protein, 9 aa, Homo Sapiens
IYTHIYIHT

SEQ ID NO: 71706 - protein, 9 aa, Homo Sapiens
GDFTHPNDT

SEQ ID NO: 71707 - protein, 9 aa, Homo Sapiens
SVCFLLPPR

SEQ ID NO: 71708 - protein, 9 aa, Homo Sapiens
FGYTFKNLP

SEQ ID NO: 71709 - protein, 9 aa, Homo Sapiens
ENNVKTFLK

SEQ ID NO: 71710 - protein, 9 aa, Homo Sapiens
FFDYSEFKG

SEQ ID NO: 71711 - protein, 9 aa, Homo Sapiens
SDAPLLTPR

SEQ ID NO: 71712 - protein, 9 aa, Homo Sapiens
VQFQQRQNQ

SEQ ID NO: 71713 - protein, 9 aa, Homo Sapiens
DYSEFKGDL

SEQ ID NO: 71714 - protein, 9 aa, Homo Sapiens
EVVAPNVSL

SEQ ID NO: 71715 - protein, 9 aa, Homo Sapiens
LPTYIRDKI

SEQ ID NO: 71716 - protein, 9 aa, Homo Sapiens
AISRTTEKD

SEQ ID NO: 71717 - protein, 9 aa, Homo Sapiens
DPVQFSSSA

SEQ ID NO: 71718 - protein, 9 aa, Homo Sapiens
FFFTIGITW

SEQ ID NO: 71719 - protein, 9 aa, Homo Sapiens
KMGRGSGFP

SEQ ID NO: 71720 - protein, 9 aa, Homo Sapiens
SIKMGRGSG

SEQ ID NO: 71721 - protein, 9 aa, Homo Sapiens
LQKFRDQDL

SEQ ID NO: 71722 - protein, 9 aa, Homo Sapiens
RENNVKTFL

SEQ ID NO: 71723 - protein, 9 aa, Homo Sapiens
SPQGHGISR

SEQ ID NO: 71724 - protein, 9 aa, Homo Sapiens
PPRLFQELR

SEQ ID NO: 71725 - protein, 9 aa, Homo Sapiens
HPFFSHLWA

SEQ ID NO: 71726 - protein, 9 aa, Homo Sapiens
YTHIYIHTH

SEQ ID NO: 71727 - protein, 9 aa, Homo Sapiens
LYDESPKNP

SEQ ID NO: 71728 - protein, 9 aa, Homo Sapiens
DQDSAISRT

SEQ ID NO: 71729 - protein, 9 aa, Homo Sapiens
ESDAPLLTP

SEQ ID NO: 71730 - protein, 9 aa, Homo Sapiens
LKDDFEVFF

SEQ ID NO: 71731 - protein, 9 aa, Homo Sapiens
KNLVEISLY

SEQ ID NO: 71732 - protein, 9 aa, Homo Sapiens
SFVVNRKIF

SEQ ID NO: 71733 - protein, 9 aa, Homo Sapiens
EMIIQFGFI

SEQ ID NO: 71734 - protein, 9 aa, Homo Sapiens
LRAVYVHSE

SEQ ID NO: 71735 - protein, 9 aa, Homo Sapiens
LGSVGVRDQ

SEQ ID NO: 71736 - protein, 9 aa, Homo Sapiens
IFFDYSEFK

SEQ ID NO: 71737 - protein, 9 aa, Homo Sapiens
AVALWFSLD

SEQ ID NO: 71738 - protein, 9 aa, Homo Sapiens
HYRTSPFSV

SEQ ID NO: 71739 - protein, 9 aa, Homo Sapiens
VAESSGTVS

SEQ ID NO: 71740 - protein, 9 aa, Homo Sapiens
LLRRRKAVL

SEQ ID NO: 71741 - protein, 9 aa, Homo Sapiens
RKAVLPQTR

SEQ ID NO: 71742 - protein, 9 aa, Homo Sapiens
VSLDISSSN

SEQ ID NO: 71743 - protein, 9 aa, Homo Sapiens
ISSSNAIDL

SEQ ID NO: 71744 - protein, 9 aa, Homo Sapiens
QGHGISRFQ

SEQ ID NO: 71745 - protein, 9 aa, Homo Sapiens
GKQVMSVAS

SEQ ID NO: 71746 - protein, 9 aa, Homo Sapiens
NWMEAAGVP

SEQ ID NO: 71747 - protein, 9 aa, Homo Sapiens
TRENNVKTF

SEQ ID NO: 71748 - protein, 9 aa, Homo Sapiens
SLGSVGVRD

SEQ ID NO: 71749 - protein, 9 aa, Homo Sapiens
SKTCYEGND

SEQ ID NO: 71750 - protein, 9 aa, Homo Sapiens
SCCSWTLRN

SEQ ID NO: 71751 - protein, 9 aa, Homo Sapiens
GQLVFYNAV

SEQ ID NO: 71752 - protein, 9 aa, Homo Sapiens
EVAESSGTV

SEQ ID NO: 71753 - protein, 9 aa, Homo Sapiens
SPGVQFQQR

SEQ ID NO: 71754 - protein, 9 aa, Homo Sapiens
CCSWTLRNP

SEQ ID NO: 71755 - protein, 9 aa, Homo Sapiens
SRTTEKDKS

SEQ ID NO: 71756 - protein, 9 aa, Homo Sapiens
YPRLPTYIR

SEQ ID NO: 71757 - protein, 9 aa, Homo Sapiens
VKMGPSGRA

SEQ ID NO: 71758 - protein, 9 aa, Homo Sapiens
GWVRSVSFS

SEQ ID NO: 71759 - protein, 9 aa, Homo Sapiens
TAAGATEEE

SEQ ID NO: 71760 - protein, 9 aa, Homo Sapiens
ERRYRNVFE

SEQ ID NO: 71761 - protein, 9 aa, Homo Sapiens
AARHFKEES

SEQ ID NO: 71762 - protein, 9 aa, Homo Sapiens
KRSMSLRVH

SEQ ID NO: 71763 - protein, 9 aa, Homo Sapiens
GSGGTQNLS

SEQ ID NO: 71764 - protein, 9 aa, Homo Sapiens
TNTLIIKVC

SEQ ID NO: 71765 - protein, 9 aa, Homo Sapiens
ANWMEAAGV

SEQ ID NO: 71766 - protein, 9 aa, Homo Sapiens
PANASCCSW

SEQ ID NO: 71767 - protein, 9 aa, Homo Sapiens
PTYIRDKII

SEQ ID NO: 71768 - protein, 9 aa, Homo Sapiens
TCYEGNDHF

SEQ ID NO: 71769 - protein, 9 aa, Homo Sapiens
FSHLWAEPP

SEQ ID NO: 71770 - protein, 9 aa, Homo Sapiens
ALQHPFFSH

SEQ ID NO: 71771 - protein, 9 aa, Homo Sapiens
GGMNQRPIL

SEQ ID NO: 71772 - protein, 9 aa, Homo Sapiens
FLEVAESSG

SEQ ID NO: 71773 - protein, 9 aa, Homo Sapiens
KTEALQSAT

SEQ ID NO: 71774 - protein, 9 aa, Homo Sapiens
NLPVEGSEE

SEQ ID NO: 71775 - protein, 9 aa, Homo Sapiens
QDKVLPLEA

SEQ ID NO: 71776 - protein, 9 aa, Homo Sapiens
TQLLRRRKA

SEQ ID NO: 71777 - protein, 9 aa, Homo Sapiens
DLTRVLLQK

SEQ ID NO: 71778 - protein, 9 aa, Homo Sapiens
RQRKPQPLD

SEQ ID NO: 71779 - protein, 9 aa, Homo Sapiens
GQYTGYEYH

SEQ ID NO: 71780 - protein, 9 aa, Homo Sapiens
IYIHTHTFY

SEQ ID NO: 71781 - protein, 9 aa, Homo Sapiens
FFTIGITWI

SEQ ID NO: 71782 - protein, 9 aa, Homo Sapiens
NQRPILTII

SEQ ID NO: 71783 - protein, 9 aa, Homo Sapiens
PLTQTQDKV

SEQ ID NO: 71784 - protein, 9 aa, Homo Sapiens
PFSVYVSAD

SEQ ID NO: 71785 - protein, 9 aa, Homo Sapiens
EIFFDYSEF

SEQ ID NO: 71786 - protein, 9 aa, Homo Sapiens
VLPLEAEPP

SEQ ID NO: 71787 - protein, 9 aa, Homo Sapiens
ALWFSLDPL

SEQ ID NO: 71788 - protein, 9 aa, Homo Sapiens
LTRVLLQKF

SEQ ID NO: 71789 - protein, 9 aa, Homo Sapiens
HLTSAFAQA

SEQ ID NO: 71790 - protein, 9 aa, Homo Sapiens
NASCCSWTL

SEQ ID NO: 71791 - protein, 9 aa, Homo Sapiens
YSLLDPVQF

SEQ ID NO: 71792 - protein, 9 aa, Homo Sapiens
VFFFTIGIT

SEQ ID NO: 71793 - protein, 9 aa, Homo Sapiens
DFENACQAK

SEQ ID NO: 71794 - protein, 9 aa, Homo Sapiens
DDFEVFFFT

SEQ ID NO: 71795 - protein, 9 aa, Homo Sapiens
ALRAVYVHS

SEQ ID NO: 71796 - protein, 9 aa, Homo Sapiens
CSKRSSHRL

SEQ ID NO: 71797 - protein, 9 aa, Homo Sapiens
RLPTYIRDK

SEQ ID NO: 71798 - protein, 9 aa, Homo Sapiens
EISLYDESP

SEQ ID NO: 71799 - protein, 9 aa, Homo Sapiens
KEPGSGGTQ

SEQ ID NO: 71800 - protein, 9 aa, Homo Sapiens
PLLTPRVYS

SEQ ID NO: 71801 - protein, 9 aa, Homo Sapiens
LRIPNIQYV

SEQ ID NO: 71802 - protein, 9 aa, Homo Sapiens
MSVASVGGN

SEQ ID NO: 71803 - protein, 9 aa, Homo Sapiens
HASLVCPHP

SEQ ID NO: 71804 - protein, 9 aa, Homo Sapiens
GNHFCAWVY

SEQ ID NO: 71805 - protein, 9 aa, Homo Sapiens
RIVLRIPNI

SEQ ID NO: 71806 - protein, 9 aa, Homo Sapiens
SLRVHSLQH

SEQ ID NO: 71807 - protein, 9 aa, Homo Sapiens
FAQAAAASL

SEQ ID NO: 71808 - protein, 9 aa, Homo Sapiens
QQDCRSTAG

SEQ ID NO: 71809 - protein, 9 aa, Homo Sapiens
YIYTHIYIH

SEQ ID NO: 71810 - protein, 9 aa, Homo Sapiens
RLFQELRDL

SEQ ID NO: 71811 - protein, 9 aa, Homo Sapiens
DEVVAPNVS

SEQ ID NO: 71812 - protein, 9 aa, Homo Sapiens
CFLLPPRAK

SEQ ID NO: 71813 - protein, 9 aa, Homo Sapiens
EPGSGGTQN

SEQ ID NO: 71814 - protein, 9 aa, Homo Sapiens
KIFGEIGLL

SEQ ID NO: 71815 - protein, 9 aa, Homo Sapiens
PPVTVISLV

SEQ ID NO: 71816 - protein, 9 aa, Homo Sapiens
MLAHLTSAF

SEQ ID NO: 71817 - protein, 9 aa, Homo Sapiens
GANDGWVRS

SEQ ID NO: 71818 - protein, 9 aa, Homo Sapiens
PGSGGTQNL

SEQ ID NO: 71819 - protein, 9 aa, Homo Sapiens
LSQQQQQQH

SEQ ID NO: 71820 - protein, 9 aa, Homo Sapiens
ISRTTEKDK

SEQ ID NO: 71821 - protein, 9 aa, Homo Sapiens
AFAQAAAAS

SEQ ID NO: 71822 - protein, 9 aa, Homo Sapiens
LRVHSLQHS

SEQ ID NO: 71823 - protein, 9 aa, Homo Sapiens
SYPRLPTYI

SEQ ID NO: 71824 - protein, 9 aa, Homo Sapiens
GSVCFLLPP

SEQ ID NO: 71825 - protein, 9 aa, Homo Sapiens
TQTQDKVLP

SEQ ID NO: 71826 - protein, 9 aa, Homo Sapiens
PRLPTYIRD

SEQ ID NO: 71827 - protein, 9 aa, Homo Sapiens
CDEVVAPNV

SEQ ID NO: 71828 - protein, 9 aa, Homo Sapiens
CNLKDDFEV

SEQ ID NO: 71829 - protein, 9 aa, Homo Sapiens
RPTEPPGSK

SEQ ID NO: 71830 - protein, 9 aa, Homo Sapiens
VKEIFFDYS

SEQ ID NO: 71831 - protein, 9 aa, Homo Sapiens
FKNLPVEGS

SEQ ID NO: 71832 - protein, 9 aa, Homo Sapiens
GKVACLDTC

SEQ ID NO: 71833 - protein, 9 aa, Homo Sapiens
RCVSIPGHC

SEQ ID NO: 71834 - protein, 9 aa, Homo Sapiens
IQYVNRPFP

SEQ ID NO: 71835 - protein, 9 aa, Homo Sapiens
RDLQKDLAV

SEQ ID NO: 71836 - protein, 9 aa, Homo Sapiens
FKRSMSLRV

SEQ ID NO: 71837 - protein, 9 aa, Homo Sapiens
CYPFSAGLP

SEQ ID NO: 71838 - protein, 9 aa, Homo Sapiens
VACLDTCGD

SEQ ID NO: 71839 - protein, 9 aa, Homo Sapiens
EHEGQTEEP

SEQ ID NO: 71840 - protein, 9 aa, Homo Sapiens
ESSGTVSVI

SEQ ID NO: 71841 - protein, 9 aa, Homo Sapiens
QTFLEVAES

SEQ ID NO: 71842 - protein, 9 aa, Homo Sapiens
EEERDQVRS

SEQ ID NO: 71843 - protein, 9 aa, Homo Sapiens
FQELRDLQK

SEQ ID NO: 71844 - protein, 9 aa, Homo Sapiens
SYYLYMCDE

SEQ ID NO: 71845 - protein, 9 aa, Homo Sapiens
KRAARHFKE

SEQ ID NO: 71846 - protein, 9 aa, Homo Sapiens
DISSSNAID

SEQ ID NO: 71847 - protein, 9 aa, Homo Sapiens
DHFYRGKAS

SEQ ID NO: 71848 - protein, 9 aa, Homo Sapiens
PDTPSISPQ

SEQ ID NO: 71849 - protein, 9 aa, Homo Sapiens
TTAAGATEE

SEQ ID NO: 71850 - protein, 9 aa, Homo Sapiens
SHDVSLANW

SEQ ID NO: 71851 - protein, 9 aa, Homo Sapiens
GNDHFYRGK

SEQ ID NO: 71852 - protein, 9 aa, Homo Sapiens
IFGEIGLLD

SEQ ID NO: 71853 - protein, 9 aa, Homo Sapiens
VHSESSQGG

SEQ ID NO: 71854 - protein, 9 aa, Homo Sapiens
FCCCRPTEP

SEQ ID NO: 71855 - protein, 9 aa, Homo Sapiens
FENACQAKS

SEQ ID NO: 71856 - protein, 9 aa, Homo Sapiens
LRDLQKDLA

SEQ ID NO: 71857 - protein, 9 aa, Homo Sapiens
TICCCCCWA

SEQ ID NO: 71858 - protein, 9 aa, Homo Sapiens
TSSHASLVC

SEQ ID NO: 71859 - protein, 9 aa, Homo Sapiens
VVNRKIFGE

SEQ ID NO: 71860 - protein, 9 aa, Homo Sapiens
SSHASLVCP

SEQ ID NO: 71861 - protein, 9 aa, Homo Sapiens
RYRNVFEDS

SEQ ID NO: 71862 - protein, 9 aa, Homo Sapiens
YYLYMCDEV

SEQ ID NO: 71863 - protein, 9 aa, Homo Sapiens
AYEQAACYP

SEQ ID NO: 71864 - protein, 9 aa, Homo Sapiens
DFEVFFFTI

SEQ ID NO: 71865 - protein, 9 aa, Homo Sapiens
RRKAVLPQT

SEQ ID NO: 71866 - protein, 9 aa, Homo Sapiens
FDIGNHFCA

SEQ ID NO: 71867 - protein, 9 aa, Homo Sapiens
GSYPRLPTY

SEQ ID NO: 71868 - protein, 9 aa, Homo Sapiens
SSRPTRENN

SEQ ID NO: 71869 - protein, 9 aa, Homo Sapiens
VMVQDLLTG

SEQ ID NO: 71870 - protein, 9 aa, Homo Sapiens
MLIAGSVCF

SEQ ID NO: 71871 - protein, 9 aa, Homo Sapiens
SEPPTTTAA

SEQ ID NO: 71872 - protein, 9 aa, Homo Sapiens
CMGGMNQRP

SEQ ID NO: 71873 - protein, 9 aa, Homo Sapiens
HFKEESKDL

SEQ ID NO: 71874 - protein, 9 aa, Homo Sapiens
QRPILTIIT

SEQ ID NO: 71875 - protein, 9 aa, Homo Sapiens
QDSAISRTT

SEQ ID NO: 71876 - protein, 9 aa, Homo Sapiens
PYSLLDPVQ

SEQ ID NO: 71877 - protein, 9 aa, Homo Sapiens
RAARHFKEE

SEQ ID NO: 71878 - protein, 9 aa, Homo Sapiens
FTHPNDTGD

SEQ ID NO: 71879 - protein, 9 aa, Homo Sapiens
SLDISSSNA

SEQ ID NO: 71880 - protein, 9 aa, Homo Sapiens
RRYRNVFED

SEQ ID NO: 71881 - protein, 9 aa, Homo Sapiens
RRRKAVLPQ

SEQ ID NO: 71882 - protein, 9 aa, Homo Sapiens
SIKVMVQDL

SEQ ID NO: 71883 - protein, 9 aa, Homo Sapiens
QLLRRRKAV

SEQ ID NO: 71884 - protein, 9 aa, Homo Sapiens
YEGNDHFYR

SEQ ID NO: 71885 - protein, 9 aa, Homo Sapiens
HMRTGRPPD

SEQ ID NO: 71886 - protein, 9 aa, Homo Sapiens
KGIPGSTVK

SEQ ID NO: 71887 - protein, 9 aa, Homo Sapiens
LLRDESIQK

SEQ ID NO: 71888 - protein, 9 aa, Homo Sapiens
EVFFFTIGI

SEQ ID NO: 71889 - protein, 9 aa, Homo Sapiens
YEYHVLSPK

SEQ ID NO: 71890 - protein, 9 aa, Homo Sapiens
NNFGYTFKN

SEQ ID NO: 71891 - protein, 9 aa, Homo Sapiens
LVEISLYDE

SEQ ID NO: 71892 - protein, 9 aa, Homo Sapiens
LTYFMALKS

SEQ ID NO: 71893 - protein, 9 aa, Homo Sapiens
FFSHLWAEP

SEQ ID NO: 71894 - protein, 9 aa, Homo Sapiens
EGSEPPTTT

SEQ ID NO: 71895 - protein, 9 aa, Homo Sapiens
SAISRTTEK

SEQ ID NO: 71896 - protein, 9 aa, Homo Sapiens
QGQLVFYNA

SEQ ID NO: 71897 - protein, 9 aa, Homo Sapiens
AACYPFSAG

SEQ ID NO: 71898 - protein, 9 aa, Homo Sapiens
HSESSQGGA

SEQ ID NO: 71899 - protein, 9 aa, Homo Sapiens
SLDPLYREL

SEQ ID NO: 71900 - protein, 9 aa, Homo Sapiens
KVACLDTCG

SEQ ID NO: 71901 - protein, 9 aa, Homo Sapiens
SHLWAEPPN

SEQ ID NO: 71902 - protein, 9 aa, Homo Sapiens
YIRDKIIPP

SEQ ID NO: 71903 - protein, 9 aa, Homo Sapiens
SMSLRVHSL

SEQ ID NO: 71904 - protein, 9 aa, Homo Sapiens
TEPPGSKIP

SEQ ID NO: 71905 - protein, 9 aa, Homo Sapiens
VRDQQDCRS

SEQ ID NO: 71906 - protein, 9 aa, Homo Sapiens
LKSNGSVFV

SEQ ID NO: 71907 - protein, 9 aa, Homo Sapiens
SSLGSVGVR

SEQ ID NO: 71908 - protein, 9 aa, Homo Sapiens
SVGVRDQQD

SEQ ID NO: 71909 - protein, 9 aa, Homo Sapiens
FCAWVYDYT

SEQ ID NO: 71910 - protein, 9 aa, Homo Sapiens
VQFSSSAIQ

SEQ ID NO: 71911 - protein, 9 aa, Homo Sapiens
RIPNIQYVN

SEQ ID NO: 71912 - protein, 9 aa, Homo Sapiens
ISLVETVPN

SEQ ID NO: 71913 - protein, 9 aa, Homo Sapiens
IHTHTFYVS

SEQ ID NO: 71914 - protein, 9 aa, Homo Sapiens
SLANWMEAA

SEQ ID NO: 71915 - protein, 9 aa, Homo Sapiens
DVVKEIFFD

SEQ ID NO: 71916 - protein, 9 aa, Homo Sapiens
QDCRSTAGQ

SEQ ID NO: 71917 - protein, 9 aa, Homo Sapiens
MTQLLRRRK

SEQ ID NO: 71918 - protein, 9 aa, Homo Sapiens
FQNDFENAC

SEQ ID NO: 71919 - protein, 9 aa, Homo Sapiens
AHMRTGRPP

SEQ ID NO: 71920 - protein, 9 aa, Homo Sapiens
STVKMGPSG

SEQ ID NO: 71921 - protein, 9 aa, Homo Sapiens
SLLDPVQFS

SEQ ID NO: 71922 - protein, 9 aa, Homo Sapiens
SSSNAIDLV

SEQ ID NO: 71923 - protein, 9 aa, Homo Sapiens
CVSIPGHCC

SEQ ID NO: 71924 - protein, 9 aa, Homo Sapiens
FRGQYTGYE

SEQ ID NO: 71925 - protein, 9 aa, Homo Sapiens
YEQAACYPF

SEQ ID NO: 71926 - protein, 9 aa, Homo Sapiens
AGGANDGWV

SEQ ID NO: 71927 - protein, 9 aa, Homo Sapiens
LSPGVQFQQ

SEQ ID NO: 71928 - protein, 9 aa, Homo Sapiens
DSAISRTTE

SEQ ID NO: 71929 - protein, 9 aa, Homo Sapiens
VVKEIFFDY

SEQ ID NO: 71930 - protein, 9 aa, Homo Sapiens
YRNVFEDSV

SEQ ID NO: 71931 - protein, 9 aa, Homo Sapiens
CCRPTEPPG

SEQ ID NO: 71932 - protein, 9 aa, Homo Sapiens
AGDPPVTVI

SEQ ID NO: 71933 - protein, 9 aa, Homo Sapiens
PQGHGISRF

SEQ ID NO: 71934 - protein, 9 aa, Homo Sapiens
MNQRPILTI

SEQ ID NO: 71935 - protein, 9 aa, Homo Sapiens
FEVFFFTIG

SEQ ID NO: 71936 - protein, 9 aa, Homo Sapiens
MRTGRPPDP

SEQ ID NO: 71937 - protein, 9 aa, Homo Sapiens
SPFSVYVSA

SEQ ID NO: 71938 - protein, 9 aa, Homo Sapiens
NDGWVRSVS

SEQ ID NO: 71939 - protein, 9 aa, Homo Sapiens
PNIQYVNRP

SEQ ID NO: 71940 - protein, 9 aa, Homo Sapiens
VNRKIFGEI

SEQ ID NO: 71941 - protein, 9 aa, Homo Sapiens
LRAHMRTGR

SEQ ID NO: 71942 - protein, 9 aa, Homo Sapiens
NRKIFGEIG

SEQ ID NO: 71943 - protein, 9 aa, Homo Sapiens
RHFKEESKD

SEQ ID NO: 71944 - protein, 9 aa, Homo Sapiens
GSTVKMGPS

SEQ ID NO: 71945 - protein, 9 aa, Homo Sapiens
IFAGGANDG

SEQ ID NO: 71946 - protein, 9 aa, Homo Sapiens
QRKPQPLDP

SEQ ID NO: 71947 - protein, 9 aa, Homo Sapiens
IAGSVCFLL

SEQ ID NO: 71948 - protein, 9 aa, Homo Sapiens
SGGTQNLSG

SEQ ID NO: 71949 - protein, 9 aa, Homo Sapiens
RVLLQKFRD

SEQ ID NO: 71950 - protein, 9 aa, Homo Sapiens
HSKKTEALQ

SEQ ID NO: 71951 - protein, 9 aa, Homo Sapiens
CSFVVNRKI

SEQ ID NO: 71952 - protein, 9 aa, Homo Sapiens
DIGNHFCAW

SEQ ID NO: 71953 - protein, 9 aa, Homo Sapiens
IGNHFCAWV

SEQ ID NO: 71954 - protein, 9 aa, Homo Sapiens
RFCCCRPTE

SEQ ID NO: 71955 - protein, 9 aa, Homo Sapiens
QAACYPFSA

SEQ ID NO: 71956 - protein, 9 aa, Homo Sapiens
STNTLIIKV

SEQ ID NO: 71957 - protein, 9 aa, Homo Sapiens
PPDTPSISP

SEQ ID NO: 71958 - protein, 9 aa, Homo Sapiens
APLLTPRVY

SEQ ID NO: 71959 - protein, 9 aa, Homo Sapiens
GGANDGWVR

SEQ ID NO: 71960 - protein, 9 aa, Homo Sapiens
VLLQKFRDQ

SEQ ID NO: 71961 - protein, 9 aa, Homo Sapiens
ELRDLQKDL

SEQ ID NO: 71962 - protein, 9 aa, Homo Sapiens
FKEESKDLA

SEQ ID NO: 71963 - protein, 9 aa, Homo Sapiens
SPPDTPSIS

SEQ ID NO: 71964 - protein, 9 aa, Homo Sapiens
EEHEGQTEE

SEQ ID NO: 71965 - protein, 9 aa, Homo Sapiens
TFRGQYTGY

SEQ ID NO: 71966 - protein, 9 aa, Homo Sapiens
LLTPRVYST

SEQ ID NO: 71967 - protein, 9 aa, Homo Sapiens
MSPPDTPSI

SEQ ID NO: 71968 - protein, 9 aa, Homo Sapiens
NDFENACQA

SEQ ID NO: 71969 - protein, 9 aa, Homo Sapiens
KKTEALQSA

SEQ ID NO: 71970 - protein, 9 aa, Homo Sapiens
QELRDLQKD

SEQ ID NO: 71971 - protein, 9 aa, Homo Sapiens
RDESIQKGQ

SEQ ID NO: 71972 - protein, 9 aa, Homo Sapiens
VSGKVACLD

SEQ ID NO: 71973 - protein, 9 aa, Homo Sapiens
WSIKMGRGS

SEQ ID NO: 71974 - protein, 9 aa, Homo Sapiens
NLRAHMRTG

SEQ ID NO: 71975 - protein, 9 aa, Homo Sapiens
FPANASCCS

SEQ ID NO: 71976 - protein, 9 aa, Homo Sapiens
ACYPFSAGL

SEQ ID NO: 71977 - protein, 9 aa, Homo Sapiens
HEGQTEEPE

SEQ ID NO: 71978 - protein, 9 aa, Homo Sapiens
PTEPPGSKI

SEQ ID NO: 71979 - protein, 9 aa, Homo Sapiens
ALRDEEERD

SEQ ID NO: 71980 - protein, 9 aa, Homo Sapiens
DPPVTVISL

SEQ ID NO: 71981 - protein, 9 aa, Homo Sapiens
LQNDNSSRF

SEQ ID NO: 71982 - protein, 9 aa, Homo Sapiens
DEVPQGQLV

SEQ ID NO: 71983 - protein, 9 aa, Homo Sapiens
MFQNDFENA

SEQ ID NO: 71984 - protein, 9 aa, Homo Sapiens
AGSVCFLLP

SEQ ID NO: 71985 - protein, 9 aa, Homo Sapiens
LWCPHPRCV

SEQ ID NO: 71986 - protein, 9 aa, Homo Sapiens
SVSGKVACL

SEQ ID NO: 71987 - protein, 9 aa, Homo Sapiens
VALWFSLDP

SEQ ID NO: 71988 - protein, 9 aa, Homo Sapiens
AWVYDYTHE

SEQ ID NO: 71989 - protein, 9 aa, Homo Sapiens
EVPQGQLVF

SEQ ID NO: 71990 - protein, 9 aa, Homo Sapiens
GQTEEPEAE

SEQ ID NO: 71991 - protein, 9 aa, Homo Sapiens
LIIKVCGCD

SEQ ID NO: 71992 - protein, 9 aa, Homo Sapiens
EALQSATPV

SEQ ID NO: 71993 - protein, 9 aa, Homo Sapiens
DITQLVQQS

SEQ ID NO: 71994 - protein, 9 aa, Homo Sapiens
CPHPRCVSI

SEQ ID NO: 71995 - protein, 9 aa, Homo Sapiens
PTTTAAGAT

SEQ ID NO: 71996 - protein, 9 aa, Homo Sapiens
MSLRVHSLQ

SEQ ID NO: 71997 - protein, 9 aa, Homo Sapiens
SRPTRENNV

SEQ ID NO: 71998 - protein, 9 aa, Homo Sapiens
NIQYVNRPF

SEQ ID NO: 71999 - protein, 9 aa, Homo Sapiens
SFKRSMSLR

SEQ ID NO: 72000 - protein, 9 aa, Homo Sapiens
GMNQRPILT

SEQ ID NO: 72001 - protein, 9 aa, Homo Sapiens
RCAVALWFS

SEQ ID NO: 72002 - protein, 9 aa, Homo Sapiens
EGNDHFYRG

SEQ ID NO: 72003 - protein, 9 aa, Homo Sapiens
GIPGSTVKM

SEQ ID NO: 72004 - protein, 9 aa, Homo Sapiens
SISPQITRC

SEQ ID NO: 72005 - protein, 9 aa, Homo Sapiens
KEESKDLAG

SEQ ID NO: 72006 - protein, 9 aa, Homo Sapiens
IPGSTVKMG

SEQ ID NO: 72007 - protein, 9 aa, Homo Sapiens
LFQELRDLQ

SEQ ID NO: 72008 - protein, 9 aa, Homo Sapiens
PGSTVKMGP

SEQ ID NO: 72009 - protein, 9 aa, Homo Sapiens
AHLTSAFAQ

SEQ ID NO: 72010 - protein, 9 aa, Homo Sapiens
ASCCSWTLR

SEQ ID NO: 72011 - protein, 9 aa, Homo Sapiens
IIQFGFITL

SEQ ID NO: 72012 - protein, 9 aa, Homo Sapiens
QKFRDQDLP

SEQ ID NO: 72013 - protein, 9 aa, Homo Sapiens
PLPNLRAHM

SEQ ID NO: 72014 - protein, 9 aa, Homo Sapiens
RDQQDCRST

SEQ ID NO: 72015 - protein, 9 aa, Homo Sapiens
KPQPLDPGE

SEQ ID NO: 72016 - protein, 9 aa, Homo Sapiens
LVFYNAVAI

SEQ ID NO: 72017 - protein, 9 aa, Homo Sapiens
QNDNSSRFG

SEQ ID NO: 72018 - protein, 9 aa, Homo Sapiens
ITQLVQQSF

SEQ ID NO: 72019 - protein, 9 aa, Homo Sapiens
QFQQRQNQR

SEQ ID NO: 72020 - protein, 9 aa, Homo Sapiens
CRPTEPPGS

SEQ ID NO: 72021 - protein, 9 aa, Homo Sapiens
FGNARTLQN

SEQ ID NO: 72022 - protein, 9 aa, Homo Sapiens
VFYNAVAIP

SEQ ID NO: 72023 - protein, 9 aa, Homo Sapiens
CAVALWFSL

SEQ ID NO: 72024 - protein, 9 aa, Homo Sapiens
EQAACYPFS

SEQ ID NO: 72025 - protein, 9 aa, Homo Sapiens
RLWCPHPRC

SEQ ID NO: 72026 - protein, 9 aa, Homo Sapiens
THIYIHTHT

SEQ ID NO: 72027 - protein, 9 aa, Homo Sapiens
PQPLDPGEG

SEQ ID NO: 72028 - protein, 9 aa, Homo Sapiens
GYTFKNLPV

SEQ ID NO: 72029 - protein, 9 aa, Homo Sapiens
YASEEHEGQ

SEQ ID NO: 72030 - protein, 9 aa, Homo Sapiens
QHPFFSHLW

SEQ ID NO: 72031 - protein, 9 aa, Homo Sapiens
AFGNARTLQ

SEQ ID NO: 72032 - protein, 9 aa, Homo Sapiens
GGDFTHPND

SEQ ID NO: 72033 - protein, 9 aa, Homo Sapiens
YRTSPFSVY

SEQ ID NO: 72034 - protein, 9 aa, Homo Sapiens
TSAFAQAAA

SEQ ID NO: 72035 - protein, 9 aa, Homo Sapiens
ANASCCSWT

SEQ ID NO: 72036 - protein, 9 aa, Homo Sapiens
VSLANWMEA

SEQ ID NO: 72037 - protein, 9 aa, Homo Sapiens
PPTTTAAGA

SEQ ID NO: 72038 - protein, 9 aa, Homo Sapiens
SKKTEALQS

SEQ ID NO: 72039 - protein, 9 aa, Homo Sapiens
GNARTLQND

SEQ ID NO: 72040 - protein, 9 aa, Homo Sapiens
CAWVYDYTH

SEQ ID NO: 72041 - protein, 9 aa, Homo Sapiens
DVEAENLLL

SEQ ID NO: 72042 - protein, 9 aa, Homo Sapiens
YGPTITSCQ

SEQ ID NO: 72043 - protein, 9 aa, Homo Sapiens
GRLLRHRPG

SEQ ID NO: 72044 - protein, 9 aa, Homo Sapiens
LYQVSTHDS

SEQ ID NO: 72045 - protein, 9 aa, Homo Sapiens
AIWYDWRQQ

SEQ ID NO: 72046 - protein, 9 aa, Homo Sapiens
GQINPNCGY

SEQ ID NO: 72047 - protein, 9 aa, Homo Sapiens
AGLLQSLLG

SEQ ID NO: 72048 - protein, 9 aa, Homo Sapiens
CLVLHKFES

SEQ ID NO: 72049 - protein, 9 aa, Homo Sapiens
RAEGGLWPL

SEQ ID NO: 72050 - protein, 9 aa, Homo Sapiens
ATDTGRDGS

SEQ ID NO: 72051 - protein, 9 aa, Homo Sapiens
ISDLQPKPN

SEQ ID NO: 72052 - protein, 9 aa, Homo Sapiens
SRHSSMSPV

SEQ ID NO: 72053 - protein, 9 aa, Homo Sapiens
KPPKVGEEG

SEQ ID NO: 72054 - protein, 9 aa, Homo Sapiens
SLGRIVEFM

SEQ ID NO: 72055 - protein, 9 aa, Homo Sapiens
SSRRGAIMC

SEQ ID NO: 72056 - protein, 9 aa, Homo Sapiens
LSRDREAGR

SEQ ID NO: 72057 - protein, 9 aa, Homo Sapiens
ARGLHIPKV

SEQ ID NO: 72058 - protein, 9 aa, Homo Sapiens
MLRNLSSLD

SEQ ID NO: 72059 - protein, 9 aa, Homo Sapiens
REIAQEFKT

SEQ ID NO: 72060 - protein, 9 aa, Homo Sapiens
TSHTSSRRG

SEQ ID NO: 72061 - protein, 9 aa, Homo Sapiens
EPEVLQDSQ

SEQ ID NO: 72062 - protein, 9 aa, Homo Sapiens
REQQLGRAA

SEQ ID NO: 72063 - protein, 9 aa, Homo Sapiens
SVALVSFSS

SEQ ID NO: 72064 - protein, 9 aa, Homo Sapiens
KKYVKVLVH

SEQ ID NO: 72065 - protein, 9 aa, Homo Sapiens
YSLETLHAA

SEQ ID NO: 72066 - protein, 9 aa, Homo Sapiens
RHWAGAEPG

SEQ ID NO: 72067 - protein, 9 aa, Homo Sapiens
LENSNSGET

SEQ ID NO: 72068 - protein, 9 aa, Homo Sapiens
TDTGRDGSG

SEQ ID NO: 72069 - protein, 9 aa, Homo Sapiens
TSPATAAGL

SEQ ID NO: 72070 - protein, 9 aa, Homo Sapiens
DVAHLLQVP

SEQ ID NO: 72071 - protein, 9 aa, Homo Sapiens
WYDWRQQHQ

SEQ ID NO: 72072 - protein, 9 aa, Homo Sapiens
SSRSRHSSM

SEQ ID NO: 72073 - protein, 9 aa, Homo Sapiens
VLHCLNISV

SEQ ID NO: 72074 - protein, 9 aa, Homo Sapiens
DQLYGPTIT

SEQ ID NO: 72075 - protein, 9 aa, Homo Sapiens
PGSLGRIVE

SEQ ID NO: 72076 - protein, 9 aa, Homo Sapiens
GYPAGRSST

SEQ ID NO: 72077 - protein, 9 aa, Homo Sapiens
GKIPILSYW

SEQ ID NO: 72078 - protein, 9 aa, Homo Sapiens
VKVLVHDVA

SEQ ID NO: 72079 - protein, 9 aa, Homo Sapiens
QQAWERKGE

SEQ ID NO: 72080 - protein, 9 aa, Homo Sapiens
SLRSDPPKT

SEQ ID NO: 72081 - protein, 9 aa, Homo Sapiens
TATDTGRDG

SEQ ID NO: 72082 - protein, 9 aa, Homo Sapiens
LKFTVPTGA

SEQ ID NO: 72083 - protein, 9 aa, Homo Sapiens
VQLNLIKGM

SEQ ID NO: 72084 - protein, 9 aa, Homo Sapiens
PQDAGQRYG

SEQ ID NO: 72085 - protein, 9 aa, Homo Sapiens
GSQCSCQGR

SEQ ID NO: 72086 - protein, 9 aa, Homo Sapiens
GLWPLGANS

SEQ ID NO: 72087 - protein, 9 aa, Homo Sapiens
MFNSSCMGG

SEQ ID NO: 72088 - protein, 9 aa, Homo Sapiens
FHPNITDVE

SEQ ID NO: 72089 - protein, 9 aa, Homo Sapiens
MNDARHGGW

SEQ ID NO: 72090 - protein, 9 aa, Homo Sapiens
TQGRLWNKT

SEQ ID NO: 72091 - protein, 9 aa, Homo Sapiens
ETLHAAVCR

SEQ ID NO: 72092 - protein, 9 aa, Homo Sapiens
PNITDVEAE

SEQ ID NO: 72093 - protein, 9 aa, Homo Sapiens
RDGSGARHR

SEQ ID NO: 72094 - protein, 9 aa, Homo Sapiens
HKFESYNDE

SEQ ID NO: 72095 - protein, 9 aa, Homo Sapiens
EDVAHLLQV

SEQ ID NO: 72096 - protein, 9 aa, Homo Sapiens
ETALRVTEL

SEQ ID NO: 72097 - protein, 9 aa, Homo Sapiens
SLSRDREAG

SEQ ID NO: 72098 - protein, 9 aa, Homo Sapiens
RRTSSLRSD

SEQ ID NO: 72099 - protein, 9 aa, Homo Sapiens
LSLKSQKPK

SEQ ID NO: 72100 - protein, 9 aa, Homo Sapiens
LGRLLRHRP

SEQ ID NO: 72101 - protein, 9 aa, Homo Sapiens
VRSPCPGGE

SEQ ID NO: 72102 - protein, 9 aa, Homo Sapiens
VELALSMIK

SEQ ID NO: 72103 - protein, 9 aa, Homo Sapiens
GDTNSLSMF

SEQ ID NO: 72104 - protein, 9 aa, Homo Sapiens
YSCLKPPKV

SEQ ID NO: 72105 - protein, 9 aa, Homo Sapiens
PTTCPSPVT

SEQ ID NO: 72106 - protein, 9 aa, Homo Sapiens
RSPCPGGET

SEQ ID NO: 72107 - protein, 9 aa, Homo Sapiens
SSMSPVRLP

SEQ ID NO: 72108 - protein, 9 aa, Homo Sapiens
PSPMKDAGD

SEQ ID NO: 72109 - protein, 9 aa, Homo Sapiens
MRSVTHANA

SEQ ID NO: 72110 - protein, 9 aa, Homo Sapiens
EGNAMSPDF

SEQ ID NO: 72111 - protein, 9 aa, Homo Sapiens
QINPNCGYQ

SEQ ID NO: 72112 - protein, 9 aa, Homo Sapiens
FNMSFNPAE

SEQ ID NO: 72113 - protein, 9 aa, Homo Sapiens
MSSLRFFAI

SEQ ID NO: 72114 - protein, 9 aa, Homo Sapiens
WERKGELVR

SEQ ID NO: 72115 - protein, 9 aa, Homo Sapiens
GVIHLTMLR

SEQ ID NO: 72116 - protein, 9 aa, Homo Sapiens
LGLAWAHSP

SEQ ID NO: 72117 - protein, 9 aa, Homo Sapiens
LQDSQDRCY

SEQ ID NO: 72118 - protein, 9 aa, Homo Sapiens
KINVKVGVN

SEQ ID NO: 72119 - protein, 9 aa, Homo Sapiens
NTTSHTSSR

SEQ ID NO: 72120 - protein, 9 aa, Homo Sapiens
TTPGSLGRI

SEQ ID NO: 72121 - protein, 9 aa, Homo Sapiens
GRLWNKTSE

SEQ ID NO: 72122 - protein, 9 aa, Homo Sapiens
SMFYAITLL

SEQ ID NO: 72123 - protein, 9 aa, Homo Sapiens
RKGELVRSP

SEQ ID NO: 72124 - protein, 9 aa, Homo Sapiens
ALTEGKSYI

SEQ ID NO: 72125 - protein, 9 aa, Homo Sapiens
LRVTELNTK

SEQ ID NO: 72126 - protein, 9 aa, Homo Sapiens
RQQHQPDTF

SEQ ID NO: 72127 - protein, 9 aa, Homo Sapiens
FIKVFPIFL

SEQ ID NO: 72128 - protein, 9 aa, Homo Sapiens
QVSTHDSAH

SEQ ID NO: 72129 - protein, 9 aa, Homo Sapiens
QGRLWNKTS

SEQ ID NO: 72130 - protein, 9 aa, Homo Sapiens
SQCSCQGRA

SEQ ID NO: 72131 - protein, 9 aa, Homo Sapiens
GNTQKCRII

SEQ ID NO: 72132 - protein, 9 aa, Homo Sapiens
FPKVLHCLN

SEQ ID NO: 72133 - protein, 9 aa, Homo Sapiens
ILLGRLLRH

SEQ ID NO: 72134 - protein, 9 aa, Homo Sapiens
DVLCVHEAT

SEQ ID NO: 72135 - protein, 9 aa, Homo Sapiens
GGLWPLGAN

SEQ ID NO: 72136 - protein, 9 aa, Homo Sapiens
QKCRIIDYS

SEQ ID NO: 72137 - protein, 9 aa, Homo Sapiens
HLTMLRNLS

SEQ ID NO: 72138 - protein, 9 aa, Homo Sapiens
YYWHKLERR

SEQ ID NO: 72139 - protein, 9 aa, Homo Sapiens
FPIFLLVVL

SEQ ID NO: 72140 - protein, 9 aa, Homo Sapiens
KDLGLCPKR

SEQ ID NO: 72141 - protein, 9 aa, Homo Sapiens
RRHWAGAEP

SEQ ID NO: 72142 - protein, 9 aa, Homo Sapiens
SYGDTNSLS

SEQ ID NO: 72143 - protein, 9 aa, Homo Sapiens
RHSSMSPVR

SEQ ID NO: 72144 - protein, 9 aa, Homo Sapiens
AKKQDLEEI

SEQ ID NO: 72145 - protein, 9 aa, Homo Sapiens
LHKFESYND

SEQ ID NO: 72146 - protein, 9 aa, Homo Sapiens
ERPVSIDGY

SEQ ID NO: 72147 - protein, 9 aa, Homo Sapiens
LLGLAWAHS

SEQ ID NO: 72148 - protein, 9 aa, Homo Sapiens
RLVEDVAHL

SEQ ID NO: 72149 - protein, 9 aa, Homo Sapiens
QQHQPDTFQ

SEQ ID NO: 72150 - protein, 9 aa, Homo Sapiens
EGGLWPLGA

SEQ ID NO: 72151 - protein, 9 aa, Homo Sapiens
RLTAKKQDL

SEQ ID NO: 72152 - protein, 9 aa, Homo Sapiens
PVSIDGYLV

SEQ ID NO: 72153 - protein, 9 aa, Homo Sapiens
TDASFLSGV

SEQ ID NO: 72154 - protein, 9 aa, Homo Sapiens
DARHGGWTT

SEQ ID NO: 72155 - protein, 9 aa, Homo Sapiens
TGRDGSGAR

SEQ ID NO: 72156 - protein, 9 aa, Homo Sapiens
SNSGETRTI

SEQ ID NO: 72157 - protein, 9 aa, Homo Sapiens
RWFHPNITD

SEQ ID NO: 72158 - protein, 9 aa, Homo Sapiens
MKQMNDARH

SEQ ID NO: 72159 - protein, 9 aa, Homo Sapiens
NALLCGSQC

SEQ ID NO: 72160 - protein, 9 aa, Homo Sapiens
FLSGVSASL

SEQ ID NO: 72161 - protein, 9 aa, Homo Sapiens
INDNPTTCP

SEQ ID NO: 72162 - protein, 9 aa, Homo Sapiens
PNSPKKLYL

SEQ ID NO: 72163 - protein, 9 aa, Homo Sapiens
LKPPKVGEE

SEQ ID NO: 72164 - protein, 9 aa, Homo Sapiens
WAHSPSALR

SEQ ID NO: 72165 - protein, 9 aa, Homo Sapiens
GTTPGSLGR

SEQ ID NO: 72166 - protein, 9 aa, Homo Sapiens
GGQINPNCG

SEQ ID NO: 72167 - protein, 9 aa, Homo Sapiens
QYLECLVLH

SEQ ID NO: 72168 - protein, 9 aa, Homo Sapiens
IENAFQALT

SEQ ID NO: 72169 - protein, 9 aa, Homo Sapiens
HDSAHGRTG

SEQ ID NO: 72170 - protein, 9 aa, Homo Sapiens
RPVSIDGYL

SEQ ID NO: 72171 - protein, 9 aa, Homo Sapiens
CVHEATKFA

SEQ ID NO: 72172 - protein, 9 aa, Homo Sapiens
NDNPTTCPS

SEQ ID NO: 72173 - protein, 9 aa, Homo Sapiens
ALLCGSQCS

SEQ ID NO: 72174 - protein, 9 aa, Homo Sapiens
RELGYPAGR

SEQ ID NO: 72175 - protein, 9 aa, Homo Sapiens
KVLHCLNIS

SEQ ID NO: 72176 - protein, 9 aa, Homo Sapiens
AMSALRSMR

SEQ ID NO: 72177 - protein, 9 aa, Homo Sapiens
CNHKVELAL

SEQ ID NO: 72178 - protein, 9 aa, Homo Sapiens
HVGNQNTTS

SEQ ID NO: 72179 - protein, 9 aa, Homo Sapiens
MSPVRLPLN

SEQ ID NO: 72180 - protein, 9 aa, Homo Sapiens
QMNDARHGG

SEQ ID NO: 72181 - protein, 9 aa, Homo Sapiens
RNLTAPSPM

SEQ ID NO: 72182 - protein, 9 aa, Homo Sapiens
ADILADRKL

SEQ ID NO: 72183 - protein, 9 aa, Homo Sapiens
RPWRRHWAG

SEQ ID NO: 72184 - protein, 9 aa, Homo Sapiens
NQNTTSHTS

SEQ ID NO: 72185 - protein, 9 aa, Homo Sapiens
MLFKKAQEL

SEQ ID NO: 72186 - protein, 9 aa, Homo Sapiens
AFKPGNTQK

SEQ ID NO: 72187 - protein, 9 aa, Homo Sapiens
LGTQGRLWN

SEQ ID NO: 72188 - protein, 9 aa, Homo Sapiens
PTITSCQQA

SEQ ID NO: 72189 - protein, 9 aa, Homo Sapiens
TTMRSVTHA

SEQ ID NO: 72190 - protein, 9 aa, Homo Sapiens
YDWRQQHQP

SEQ ID NO: 72191 - protein, 9 aa, Homo Sapiens
ENSNSGETR

SEQ ID NO: 72192 - protein, 9 aa, Homo Sapiens
TDVEAENLL

SEQ ID NO: 72193 - protein, 9 aa, Homo Sapiens
PWRRHWAGA

SEQ ID NO: 72194 - protein, 9 aa, Homo Sapiens
DLEEICHDL

SEQ ID NO: 72195 - protein, 9 aa, Homo Sapiens
NTQKCRIID

SEQ ID NO: 72196 - protein, 9 aa, Homo Sapiens
QLYGPTITS

SEQ ID NO: 72197 - protein, 9 aa, Homo Sapiens
WAQLKNLFL

SEQ ID NO: 72198 - protein, 9 aa, Homo Sapiens
TLHLTTGEY

SEQ ID NO: 72199 - protein, 9 aa, Homo Sapiens
INPNCGYQY

SEQ ID NO: 72200 - protein, 9 aa, Homo Sapiens
IAQEFKTDL

SEQ ID NO: 72201 - protein, 9 aa, Homo Sapiens
DNPTTCPSP

SEQ ID NO: 72202 - protein, 9 aa, Homo Sapiens
RRLVEDVAH

SEQ ID NO: 72203 - protein, 9 aa, Homo Sapiens
IWYDWRQQH

SEQ ID NO: 72204 - protein, 9 aa, Homo Sapiens
VKQQVSTGK

SEQ ID NO: 72205 - protein, 9 aa, Homo Sapiens
FNPAENAVL

SEQ ID NO: 72206 - protein, 9 aa, Homo Sapiens
HLNLGQDMS

SEQ ID NO: 72207 - protein, 9 aa, Homo Sapiens
HRSREQQLG

SEQ ID NO: 72208 - protein, 9 aa, Homo Sapiens
GTNLMVTVA

SEQ ID NO: 72209 - protein, 9 aa, Homo Sapiens
LCGSQCSCQ

SEQ ID NO: 72210 - protein, 9 aa, Homo Sapiens
SKINVKVGV

SEQ ID NO: 72211 - protein, 9 aa, Homo Sapiens
QFIKVFPIF

SEQ ID NO: 72212 - protein, 9 aa, Homo Sapiens
AQEFKTDLR

SEQ ID NO: 72213 - protein, 9 aa, Homo Sapiens
ENAFQALTE

SEQ ID NO: 72214 - protein, 9 aa, Homo Sapiens
QGNIFAMSA

SEQ ID NO: 72215 - protein, 9 aa, Homo Sapiens
CPKRTLRLV

SEQ ID NO: 72216 - protein, 9 aa, Homo Sapiens
VFWVFGTNL

SEQ ID NO: 72217 - protein, 9 aa, Homo Sapiens
TGETALRVT

SEQ ID NO: 72218 - protein, 9 aa, Homo Sapiens
LDESYGDTN

SEQ ID NO: 72219 - protein, 9 aa, Homo Sapiens
KQMNDARHG

SEQ ID NO: 72220 - protein, 9 aa, Homo Sapiens
STHDSAHGR

SEQ ID NO: 72221 - protein, 9 aa, Homo Sapiens
YVKVLVHDV

SEQ ID NO: 72222 - protein, 9 aa, Homo Sapiens
LMVTVAKSF

SEQ ID NO: 72223 - protein, 9 aa, Homo Sapiens
LGLCPKRTL

SEQ ID NO: 72224 - protein, 9 aa, Homo Sapiens
RSDPPKTRR

SEQ ID NO: 72225 - protein, 9 aa, Homo Sapiens
LGRAARSYH

SEQ ID NO: 72226 - protein, 9 aa, Homo Sapiens
LWPLGANSQ

SEQ ID NO: 72227 - protein, 9 aa, Homo Sapiens
GPTITSCQQ

SEQ ID NO: 72228 - protein, 9 aa, Homo Sapiens
APPLSSDTY

SEQ ID NO: 72229 - protein, 9 aa, Homo Sapiens
SEAVTLKFT

SEQ ID NO: 72230 - protein, 9 aa, Homo Sapiens
DRKLFLSNG

SEQ ID NO: 72231 - protein, 9 aa, Homo Sapiens
WLSATTMRS

SEQ ID NO: 72232 - protein, 9 aa, Homo Sapiens
LNLGQDMSS

SEQ ID NO: 72233 - protein, 9 aa, Homo Sapiens
PCPGGETGQ

SEQ ID NO: 72234 - protein, 9 aa, Homo Sapiens
NIFAMSALR

SEQ ID NO: 72235 - protein, 9 aa, Homo Sapiens
IFAMSALRS

SEQ ID NO: 72236 - protein, 9 aa, Homo Sapiens
VLVHDVAYR

SEQ ID NO: 72237 - protein, 9 aa, Homo Sapiens
LCVHEATKF

SEQ ID NO: 72238 - protein, 9 aa, Homo Sapiens
VFNMSFNPA

SEQ ID NO: 72239 - protein, 9 aa, Homo Sapiens
LSSDTYTNR

SEQ ID NO: 72240 - protein, 9 aa, Homo Sapiens
PWLSATTMR

SEQ ID NO: 72241 - protein, 9 aa, Homo Sapiens
CGSQCSCQG

SEQ ID NO: 72242 - protein, 9 aa, Homo Sapiens
SCLKPPKVG

SEQ ID NO: 72243 - protein, 9 aa, Homo Sapiens
HEATKFAAN

SEQ ID NO: 72244 - protein, 9 aa, Homo Sapiens
EFKTDLRFQ

SEQ ID NO: 72245 - protein, 9 aa, Homo Sapiens
QHGCNHKVE

SEQ ID NO: 72246 - protein, 9 aa, Homo Sapiens
GTQGRLWNK

SEQ ID NO: 72247 - protein, 9 aa, Homo Sapiens
KHVGNQNTT

SEQ ID NO: 72248 - protein, 9 aa, Homo Sapiens
IKDLGLCPK

SEQ ID NO: 72249 - protein, 9 aa, Homo Sapiens
DMSSLRFFA

SEQ ID NO: 72250 - protein, 9 aa, Homo Sapiens
SLLGLAWAH

SEQ ID NO: 72251 - protein, 9 aa, Homo Sapiens
TPGSLGRIV

SEQ ID NO: 72252 - protein, 9 aa, Homo Sapiens
HLLQVPSSA

SEQ ID NO: 72253 - protein, 9 aa, Homo Sapiens
EQQLGRAAR

SEQ ID NO: 72254 - protein, 9 aa, Homo Sapiens
KPNSPKKLY

SEQ ID NO: 72255 - protein, 9 aa, Homo Sapiens
PKVGEEGHE

SEQ ID NO: 72256 - protein, 9 aa, Homo Sapiens
SSLRSDPPK

SEQ ID NO: 72257 - protein, 9 aa, Homo Sapiens
WQQAWERKG

SEQ ID NO: 72258 - protein, 9 aa, Homo Sapiens
YLECLVLHK

SEQ ID NO: 72259 - protein, 9 aa, Homo Sapiens
TYTNRHPAV

SEQ ID NO: 72260 - protein, 9 aa, Homo Sapiens
QGEVVRELM

SEQ ID NO: 72261 - protein, 9 aa, Homo Sapiens
RELMKDTDS

SEQ ID NO: 72262 - protein, 9 aa, Homo Sapiens
PLTPLWTSP

SEQ ID NO: 72263 - protein, 9 aa, Homo Sapiens
CVSKRPDVL

SEQ ID NO: 72264 - protein, 9 aa, Homo Sapiens
CLNVFSQFY

SEQ ID NO: 72265 - protein, 9 aa, Homo Sapiens
WTSPATAAG

SEQ ID NO: 72266 - protein, 9 aa, Homo Sapiens
GRAGLLQSL

SEQ ID NO: 72267 - protein, 9 aa, Homo Sapiens
GMLFKKAQE

SEQ ID NO: 72268 - protein, 9 aa, Homo Sapiens
WTLPQDAGQ

SEQ ID NO: 72269 - protein, 9 aa, Homo Sapiens
RGLHIPKVQ

SEQ ID NO: 72270 - protein, 9 aa, Homo Sapiens
RRGAIMCWL

SEQ ID NO: 72271 - protein, 9 aa, Homo Sapiens
IKVFPIFLL

SEQ ID NO: 72272 - protein, 9 aa, Homo Sapiens
HWAGAEPGR

SEQ ID NO: 72273 - protein, 9 aa, Homo Sapiens
LQPKPNSPK

SEQ ID NO: 72274 - protein, 9 aa, Homo Sapiens
VTLKFTVPT

SEQ ID NO: 72275 - protein, 9 aa, Homo Sapiens
AARLYSLET

SEQ ID NO: 72276 - protein, 9 aa, Homo Sapiens
NAMSPDFIP

SEQ ID NO: 72277 - protein, 9 aa, Homo Sapiens
RLVREIAQE

SEQ ID NO: 72278 - protein, 9 aa, Homo Sapiens
MPWLSATTM

SEQ ID NO: 72279 - protein, 9 aa, Homo Sapiens
IEGNAMSPD

SEQ ID NO: 72280 - protein, 9 aa, Homo Sapiens
AAVCRRSCP

SEQ ID NO: 72281 - protein, 9 aa, Homo Sapiens
SRSRHSSMS

SEQ ID NO: 72282 - protein, 9 aa, Homo Sapiens
GCNHKVELA

SEQ ID NO: 72283 - protein, 9 aa, Homo Sapiens
SMKHVGNQN

SEQ ID NO: 72284 - protein, 9 aa, Homo Sapiens
NMSFNPAEN

SEQ ID NO: 72285 - protein, 9 aa, Homo Sapiens
QVTGKIPIL

SEQ ID NO: 72286 - protein, 9 aa, Homo Sapiens
HSPSALRPW

SEQ ID NO: 72287 - protein, 9 aa, Homo Sapiens
APSPMKDAG

SEQ ID NO: 72288 - protein, 9 aa, Homo Sapiens
KFRSLSRDR

SEQ ID NO: 72289 - protein, 9 aa, Homo Sapiens
NPTTCPSPV

SEQ ID NO: 72290 - protein, 9 aa, Homo Sapiens
QNTTSHTSS

SEQ ID NO: 72291 - protein, 9 aa, Homo Sapiens
QDAGQRYGS

SEQ ID NO: 72292 - protein, 9 aa, Homo Sapiens
VKDINDNPT

SEQ ID NO: 72293 - protein, 9 aa, Homo Sapiens
LSATTMRSV

SEQ ID NO: 72294 - protein, 9 aa, Homo Sapiens
VKQVTGKIP

SEQ ID NO: 72295 - protein, 9 aa, Homo Sapiens
QVHFPKVLH

SEQ ID NO: 72296 - protein, 9 aa, Homo Sapiens
VLCVHEATK

SEQ ID NO: 72297 - protein, 9 aa, Homo Sapiens
AEGGLWPLG

SEQ ID NO: 72298 - protein, 9 aa, Homo Sapiens
LRSDPPKTR

SEQ ID NO: 72299 - protein, 9 aa, Homo Sapiens
DQGEVVREL

SEQ ID NO: 72300 - protein, 9 aa, Homo Sapiens
NITDVEAEN

SEQ ID NO: 72301 - protein, 9 aa, Homo Sapiens
RSREQQLGR

SEQ ID NO: 72302 - protein, 9 aa, Homo Sapiens
QEDGPAARL

SEQ ID NO: 72303 - protein, 9 aa, Homo Sapiens
NYMFNSSCM

SEQ ID NO: 72304 - protein, 9 aa, Homo Sapiens
LVRSPCPGG

SEQ ID NO: 72305 - protein, 9 aa, Homo Sapiens
GMDVLCVHE

SEQ ID NO: 72306 - protein, 9 aa, Homo Sapiens
LLCGSQCSC

SEQ ID NO: 72307 - protein, 9 aa, Homo Sapiens
RAGLLQSLL

SEQ ID NO: 72308 - protein, 9 aa, Homo Sapiens
EVWTLPQDA

SEQ ID NO: 72309 - protein, 9 aa, Homo Sapiens
QLGSMFYAI

SEQ ID NO: 72310 - protein, 9 aa, Homo Sapiens
IRELGYPAG

SEQ ID NO: 72311 - protein, 9 aa, Homo Sapiens
LETLHAAVC

SEQ ID NO: 72312 - protein, 9 aa, Homo Sapiens
YNYMFNSSC

SEQ ID NO: 72313 - protein, 9 aa, Homo Sapiens
GSMFYAITL

SEQ ID NO: 72314 - protein, 9 aa, Homo Sapiens
PGRLVCLNV

SEQ ID NO: 72315 - protein, 9 aa, Homo Sapiens
KGELVRSPC

SEQ ID NO: 72316 - protein, 9 aa, Homo Sapiens
WHKLERRDI

SEQ ID NO: 72317 - protein, 9 aa, Homo Sapiens
SALRPWRRH

SEQ ID NO: 72318 - protein, 9 aa, Homo Sapiens
ITGETALRV

SEQ ID NO: 72319 - protein, 9 aa, Homo Sapiens
TLHAAVCRR

SEQ ID NO: 72320 - protein, 9 aa, Homo Sapiens
YWHKLERRD

SEQ ID NO: 72321 - protein, 9 aa, Homo Sapiens
LTAPSPMKD

SEQ ID NO: 72322 - protein, 9 aa, Homo Sapiens
VVRELMKDT

SEQ ID NO: 72323 - protein, 9 aa, Homo Sapiens
NCGYQYKRL

SEQ ID NO: 72324 - protein, 9 aa, Homo Sapiens
MVKQVTGKI

SEQ ID NO: 72325 - protein, 9 aa, Homo Sapiens
GNQNTTSHT

SEQ ID NO: 72326 - protein, 9 aa, Homo Sapiens
FMKQMNDAR

SEQ ID NO: 72327 - protein, 9 aa, Homo Sapiens
TQGNIFAMS

SEQ ID NO: 72328 - protein, 9 aa, Homo Sapiens
ARHGGWTTK

SEQ ID NO: 72329 - protein, 9 aa, Homo Sapiens
WRQQHQPDT

SEQ ID NO: 72330 - protein, 9 aa, Homo Sapiens
MVREDSVKC

SEQ ID NO: 72331 - protein, 9 aa, Homo Sapiens
PLSSDTYTN

SEQ ID NO: 72332 - protein, 9 aa, Homo Sapiens
VAHLLQVPS

SEQ ID NO: 72333 - protein, 9 aa, Homo Sapiens
GLLQSLLGL

SEQ ID NO: 72334 - protein, 9 aa, Homo Sapiens
FRSLSRDRE

SEQ ID NO: 72335 - protein, 9 aa, Homo Sapiens
EAFKPGNTQ

SEQ ID NO: 72336 - protein, 9 aa, Homo Sapiens
LRAEGGLWP

SEQ ID NO: 72337 - protein, 9 aa, Homo Sapiens
VVIEGNAMS

SEQ ID NO: 72338 - protein, 9 aa, Homo Sapiens
QCSCQGRAG

SEQ ID NO: 72339 - protein, 9 aa, Homo Sapiens
KQLGSMFYA

SEQ ID NO: 72340 - protein, 9 aa, Homo Sapiens
KVFPIFLLV

SEQ ID NO: 72341 - protein, 9 aa, Homo Sapiens
MDVLCVHEA

SEQ ID NO: 72342 - protein, 9 aa, Homo Sapiens
VHDVAYRQE

SEQ ID NO: 72343 - protein, 9 aa, Homo Sapiens
VKGEKQLGS

SEQ ID NO: 72344 - protein, 9 aa, Homo Sapiens
DWQQAWERK

SEQ ID NO: 72345 - protein, 9 aa, Homo Sapiens
KGMLFKKAQ

SEQ ID NO: 72346 - protein, 9 aa, Homo Sapiens
VWTLPQDAG

SEQ ID NO: 72347 - protein, 9 aa, Homo Sapiens
VYSVALVSF

SEQ ID NO: 72348 - protein, 9 aa, Homo Sapiens
HKVELALSM

SEQ ID NO: 72349 - protein, 9 aa, Homo Sapiens
AHLLQVPSS

SEQ ID NO: 72350 - protein, 9 aa, Homo Sapiens
SLGTQGRLW

SEQ ID NO: 72351 - protein, 9 aa, Homo Sapiens
LGQDMSSLR

SEQ ID NO: 72352 - protein, 9 aa, Homo Sapiens
FWVFGTNLM

SEQ ID NO: 72353 - protein, 9 aa, Homo Sapiens
ARLYSLETL

SEQ ID NO: 72354 - protein, 9 aa, Homo Sapiens
SRNLTAPSP

SEQ ID NO: 72355 - protein, 9 aa, Homo Sapiens
VEDVAHLLQ

SEQ ID NO: 72356 - protein, 9 aa, Homo Sapiens
PSALRPWRR

SEQ ID NO: 72357 - protein, 9 aa, Homo Sapiens
KIPILSYWP

SEQ ID NO: 72358 - protein, 9 aa, Homo Sapiens
IIAPGRLVC

SEQ ID NO: 72359 - protein, 9 aa, Homo Sapiens
SFNPAENAV

SEQ ID NO: 72360 - protein, 9 aa, Homo Sapiens
QLENSNSGE

SEQ ID NO: 72361 - protein, 9 aa, Homo Sapiens
TSSRRGAIM

SEQ ID NO: 72362 - protein, 9 aa, Homo Sapiens
LSWTVYSVA

SEQ ID NO: 72363 - protein, 9 aa, Homo Sapiens
SDTYTNRHP

SEQ ID NO: 72364 - protein, 9 aa, Homo Sapiens
GEKQLGSMF

SEQ ID NO: 72365 - protein, 9 aa, Homo Sapiens
VLHKFESYN

SEQ ID NO: 72366 - protein, 9 aa, Homo Sapiens
SKGVIHLTM

SEQ ID NO: 72367 - protein, 9 aa, Homo Sapiens
GGETGQEDG

SEQ ID NO: 72368 - protein, 9 aa, Homo Sapiens
TIHYNYMFN

SEQ ID NO: 72369 - protein, 9 aa, Homo Sapiens
FGTNLMVTV

SEQ ID NO: 72370 - protein, 9 aa, Homo Sapiens
TTSHTSSRR

SEQ ID NO: 72371 - protein, 9 aa, Homo Sapiens
SHTSSRRGA

SEQ ID NO: 72372 - protein, 9 aa, Homo Sapiens
MKHVGNQNT

SEQ ID NO: 72373 - protein, 9 aa, Homo Sapiens
WNKTSEGMD

SEQ ID NO: 72374 - protein, 9 aa, Homo Sapiens
TMLRNLSSL

SEQ ID NO: 72375 - protein, 9 aa, Homo Sapiens
QDLEEICHD

SEQ ID NO: 72376 - protein, 9 aa, Homo Sapiens
ADRKLFLSN

SEQ ID NO: 72377 - protein, 9 aa, Homo Sapiens
TVYSVALVS

SEQ ID NO: 72378 - protein, 9 aa, Homo Sapiens
GTATDTGRD

SEQ ID NO: 72379 - protein, 9 aa, Homo Sapiens
HCLNISVLS

SEQ ID NO: 72380 - protein, 9 aa, Homo Sapiens
ELMKDTDSI

SEQ ID NO: 72381 - protein, 9 aa, Homo Sapiens
VNSKGTLKV

SEQ ID NO: 72382 - protein, 9 aa, Homo Sapiens
SRDREAGRR

SEQ ID NO: 72383 - protein, 9 aa, Homo Sapiens
LHIPKVQHV

SEQ ID NO: 72384 - protein, 9 aa, Homo Sapiens
AWERKGELV

SEQ ID NO: 72385 - protein, 9 aa, Homo Sapiens
LTMLRNLSS

SEQ ID NO: 72386 - protein, 9 aa, Homo Sapiens
GPLTPLWTS

SEQ ID NO: 72387 - protein, 9 aa, Homo Sapiens
ETLHLTTGE

SEQ ID NO: 72388 - protein, 9 aa, Homo Sapiens
EVVRELMKD

SEQ ID NO: 72389 - protein, 9 aa, Homo Sapiens
LECLVLHKF

SEQ ID NO: 72390 - protein, 9 aa, Homo Sapiens
LADRKLFLS

SEQ ID NO: 72391 - protein, 9 aa, Homo Sapiens
HVKQQVSTG

SEQ ID NO: 72392 - protein, 9 aa, Homo Sapiens
PVFNMSFNP

SEQ ID NO: 72393 - protein, 9 aa, Homo Sapiens
GSLGRIVEF

SEQ ID NO: 72394 - protein, 9 aa, Homo Sapiens
QQLGRAARS

SEQ ID NO: 72395 - protein, 9 aa, Homo Sapiens
LTEGKSYIT

SEQ ID NO: 72396 - protein, 9 aa, Homo Sapiens
MSALRSMRF

SEQ ID NO: 72397 - protein, 9 aa, Homo Sapiens
YPAGRSSTC

SEQ ID NO: 72398 - protein, 9 aa, Homo Sapiens
VREIAQEFK

SEQ ID NO: 72399 - protein, 9 aa, Homo Sapiens
AARGLHIPK

SEQ ID NO: 72400 - protein, 9 aa, Homo Sapiens
LGSMFYAIT

SEQ ID NO: 72401 - protein, 9 aa, Homo Sapiens
TGKIPILSY

SEQ ID NO: 72402 - protein, 9 aa, Homo Sapiens
NVKVGVNSK

SEQ ID NO: 72403 - protein, 9 aa, Homo Sapiens
LYSLETLHA

SEQ ID NO: 72404 - protein, 9 aa, Homo Sapiens
HPNITDVEA

SEQ ID NO: 72405 - protein, 9 aa, Homo Sapiens
VHFPKVLHC

SEQ ID NO: 72406 - protein, 9 aa, Homo Sapiens
CSCQGRAGL

SEQ ID NO: 72407 - protein, 9 aa, Homo Sapiens
RVTELNTKE

SEQ ID NO: 72408 - protein, 9 aa, Homo Sapiens
ELGYPAGRS

SEQ ID NO: 72409 - protein, 9 aa, Homo Sapiens
GQEDGPAAR

SEQ ID NO: 72410 - protein, 9 aa, Homo Sapiens
IKGMLFKKA

SEQ ID NO: 72411 - protein, 9 aa, Homo Sapiens
TAPSPMKDA

SEQ ID NO: 72412 - protein, 9 aa, Homo Sapiens
NSPKKLYLT

SEQ ID NO: 72413 - protein, 9 aa, Homo Sapiens
YTDETLHLT

SEQ ID NO: 72414 - protein, 9 aa, Homo Sapiens
LNLIKGMLF

SEQ ID NO: 72415 - protein, 9 aa, Homo Sapiens
ILADRKLFL

SEQ ID NO: 72416 - protein, 9 aa, Homo Sapiens
HLPHILLGR

SEQ ID NO: 72417 - protein, 9 aa, Homo Sapiens
REAGRRQHA

SEQ ID NO: 72418 - protein, 9 aa, Homo Sapiens
RSRHSSMSP

SEQ ID NO: 72419 - protein, 9 aa, Homo Sapiens
PPHGERPVS

SEQ ID NO: 72420 - protein, 9 aa, Homo Sapiens
ALRPWRRHW

SEQ ID NO: 72421 - protein, 9 aa, Homo Sapiens
FAMSALRSM

SEQ ID NO: 72422 - protein, 9 aa, Homo Sapiens
PNCGYQYKR

SEQ ID NO: 72423 - protein, 9 aa, Homo Sapiens
CLKPPKVGE

SEQ ID NO: 72424 - protein, 9 aa, Homo Sapiens
SDPPKTRRT

SEQ ID NO: 72425 - protein, 9 aa, Homo Sapiens
GHLNLGQDM

SEQ ID NO: 72426 - protein, 9 aa, Homo Sapiens
VSTHDSAHG

SEQ ID NO: 72427 - protein, 9 aa, Homo Sapiens
SPSALRPWR

SEQ ID NO: 72428 - protein, 9 aa, Homo Sapiens
GERPVSIDG

SEQ ID NO: 72429 - protein, 9 aa, Homo Sapiens
YSVALVSFS

SEQ ID NO: 72430 - protein, 9 aa, Homo Sapiens
DINDNPTTC

SEQ ID NO: 72431 - protein, 9 aa, Homo Sapiens
VSASLLERR

SEQ ID NO: 72432 - protein, 9 aa, Homo Sapiens
QAWERKGEL

SEQ ID NO: 72433 - protein, 9 aa, Homo Sapiens
VSIDGYLVE

SEQ ID NO: 72434 - protein, 9 aa, Homo Sapiens
PDVLSLKSQ

SEQ ID NO: 72435 - protein, 9 aa, Homo Sapiens
VTGKIPILS

SEQ ID NO: 72436 - protein, 9 aa, Homo Sapiens
LPQDAGQRY

SEQ ID NO: 72437 - protein, 9 aa, Homo Sapiens
FNSSCMGGM

SEQ ID NO: 72438 - protein, 9 aa, Homo Sapiens
DAGQRYGSH

SEQ ID NO: 72439 - protein, 9 aa, Homo Sapiens
TSSLRSDPP

SEQ ID NO: 72440 - protein, 9 aa, Homo Sapiens
LAWAHSPSA

SEQ ID NO: 72441 - protein, 9 aa, Homo Sapiens
VKVGVNSKG

SEQ ID NO: 72442 - protein, 9 aa, Homo Sapiens
TPLWTSPAT

SEQ ID NO: 72443 - protein, 9 aa, Homo Sapiens
YQVSTHDSA

SEQ ID NO: 72444 - protein, 9 aa, Homo Sapiens
LTPLWTSPA

SEQ ID NO: 72445 - protein, 9 aa, Homo Sapiens
HGCNHKVEL

SEQ ID NO: 72446 - protein, 9 aa, Homo Sapiens
QQVSTGKRS

SEQ ID NO: 72447 - protein, 9 aa, Homo Sapiens
PGNTQKCRI

SEQ ID NO: 72448 - protein, 9 aa, Homo Sapiens
VIHLTMLRN

SEQ ID NO: 72449 - protein, 9 aa, Homo Sapiens
KFPVFNMSF

SEQ ID NO: 72450 - protein, 9 aa, Homo Sapiens
VHLLQLENS

SEQ ID NO: 72451 - protein, 9 aa, Homo Sapiens
RSLSRDREA

SEQ ID NO: 72452 - protein, 9 aa, Homo Sapiens
KVLVHDVAY

SEQ ID NO: 72453 - protein, 9 aa, Homo Sapiens
KSPGTTPGS

SEQ ID NO: 72454 - protein, 9 aa, Homo Sapiens
LGYPAGRSS

SEQ ID NO: 72455 - protein, 9 aa, Homo Sapiens
TQKCRIIDY

SEQ ID NO: 72456 - protein, 9 aa, Homo Sapiens
KLFLSNGKL

SEQ ID NO: 72457 - protein, 9 aa, Homo Sapiens
SIDGYLVEK

SEQ ID NO: 72458 - protein, 9 aa, Homo Sapiens
KGVIHLTML

SEQ ID NO: 72459 - protein, 9 aa, Homo Sapiens
VGNQNTTSH

SEQ ID NO: 72460 - protein, 9 aa, Homo Sapiens
LLGRLLRHR

SEQ ID NO: 72461 - protein, 9 aa, Homo Sapiens
NAFQALTEG

SEQ ID NO: 72462 - protein, 9 aa, Homo Sapiens
TPPPPGKPQ

SEQ ID NO: 72463 - protein, 9 aa, Homo Sapiens
KLERRDIVP

SEQ ID NO: 72464 - protein, 9 aa, Homo Sapiens
NSNSGETRT

SEQ ID NO: 72465 - protein, 9 aa, Homo Sapiens
LLQSLLGLA

SEQ ID NO: 72466 - protein, 9 aa, Homo Sapiens
ARLTAKKQD

SEQ ID NO: 72467 - protein, 9 aa, Homo Sapiens
YTNRHPAVP

SEQ ID NO: 72468 - protein, 9 aa, Homo Sapiens
PPLSSDTYT

SEQ ID NO: 72469 - protein, 9 aa, Homo Sapiens
VHEATKFAA

SEQ ID NO: 72470 - protein, 9 aa, Homo Sapiens
FQALTEGKS

SEQ ID NO: 72471 - protein, 9 aa, Homo Sapiens
CSRNLTAPS

SEQ ID NO: 72472 - protein, 9 aa, Homo Sapiens
HTSSRRGAI

SEQ ID NO: 72473 - protein, 9 aa, Homo Sapiens
SREQQLGRA

SEQ ID NO: 72474 - protein, 9 aa, Homo Sapiens
VRELMKDTD

SEQ ID NO: 72475 - protein, 9 aa, Homo Sapiens
HSSMSPVRL

SEQ ID NO: 72476 - protein, 9 aa, Homo Sapiens
VEVVIEGNA

SEQ ID NO: 72477 - protein, 9 aa, Homo Sapiens
RSEAVTLKF

SEQ ID NO: 72478 - protein, 9 aa, Homo Sapiens
RLVCLNVFS

SEQ ID NO: 72479 - protein, 9 aa, Homo Sapiens
SRRGAIMCW

SEQ ID NO: 72480 - protein, 9 aa, Homo Sapiens
TTIHYNYMF

SEQ ID NO: 72481 - protein, 9 aa, Homo Sapiens
TGQEDGPAA

SEQ ID NO: 72482 - protein, 9 aa, Homo Sapiens
PGGQINPNC

SEQ ID NO: 72483 - protein, 9 aa, Homo Sapiens
VYTDETLHL

SEQ ID NO: 72484 - protein, 9 aa, Homo Sapiens
GLHIPKVQH

SEQ ID NO: 72485 - protein, 9 aa, Homo Sapiens
NSLSMFVRT

SEQ ID NO: 72486 - protein, 9 aa, Homo Sapiens
NLMVTVAKS

SEQ ID NO: 72487 - protein, 9 aa, Homo Sapiens
QRSEAVTLK

SEQ ID NO: 72488 - protein, 9 aa, Homo Sapiens
QALTEGKSY

SEQ ID NO: 72489 - protein, 9 aa, Homo Sapiens
AWAHSPSAL

SEQ ID NO: 72490 - protein, 9 aa, Homo Sapiens
RYLSWTVYS

SEQ ID NO: 72491 - protein, 9 aa, Homo Sapiens
TMRSVTHAN

SEQ ID NO: 72492 - protein, 9 aa, Homo Sapiens
LPHILLGRL

SEQ ID NO: 72493 - protein, 9 aa, Homo Sapiens
NDARHGGWT

SEQ ID NO: 72494 - protein, 9 aa, Homo Sapiens
KRPDVLSLK

SEQ ID NO: 72495 - protein, 9 aa, Homo Sapiens
KFTVPTGAR

SEQ ID NO: 72496 - protein, 9 aa, Homo Sapiens
LHVKQQVST

SEQ ID NO: 72497 - protein, 9 aa, Homo Sapiens
LYGPTITSC

SEQ ID NO: 72498 - protein, 9 aa, Homo Sapiens
NHKVELALS

SEQ ID NO: 72499 - protein, 9 aa, Homo Sapiens
TEGKSYITK

SEQ ID NO: 72500 - protein, 9 aa, Homo Sapiens
DASFLSGVS

SEQ ID NO: 72501 - protein, 9 aa, Homo Sapiens
QGRAGLLQS

SEQ ID NO: 72502 - protein, 9 aa, Homo Sapiens
EKQLGSMFY

SEQ ID NO: 72503 - protein, 9 aa, Homo Sapiens
GNIFAMSAL

SEQ ID NO: 72504 - protein, 9 aa, Homo Sapiens
TDVAARGLH

SEQ ID NO: 72505 - protein, 9 aa, Homo Sapiens
TNLMVTVAK

SEQ ID NO: 72506 - protein, 9 aa, Homo Sapiens
QLGRAARSY

SEQ ID NO: 72507 - protein, 9 aa, Homo Sapiens
KYVKVLVHD

SEQ ID NO: 72508 - protein, 9 aa, Homo Sapiens
IQFIKVFPI

SEQ ID NO: 72509 - protein, 9 aa, Homo Sapiens
LRPWRRHWA

SEQ ID NO: 72510 - protein, 9 aa, Homo Sapiens
THDSAHGRT

SEQ ID NO: 72511 - protein, 9 aa, Homo Sapiens
WFHPNITDV

SEQ ID NO: 72512 - protein, 9 aa, Homo Sapiens
WVFGTNLMV

SEQ ID NO: 72513 - protein, 9 aa, Homo Sapiens
ASFLSGVSA

SEQ ID NO: 72514 - protein, 9 aa, Homo Sapiens
LVHDVAYRQ

SEQ ID NO: 72515 - protein, 9 aa, Homo Sapiens
HLLQLENSN

SEQ ID NO: 72516 - protein, 9 aa, Homo Sapiens
GVNSKGTLK

SEQ ID NO: 72517 - protein, 9 aa, Homo Sapiens
QDMSSLRFF

SEQ ID NO: 72518 - protein, 9 aa, Homo Sapiens
FPVFNMSFN

SEQ ID NO: 72519 - protein, 9 aa, Homo Sapiens
IAPGRLVCL

SEQ ID NO: 72520 - protein, 9 aa, Homo Sapiens
KPGNTQKCR

SEQ ID NO: 72521 - protein, 9 aa, Homo Sapiens
ERKGELVRS

SEQ ID NO: 72522 - protein, 9 aa, Homo Sapiens
KQDLEEICH

SEQ ID NO: 72523 - protein, 9 aa, Homo Sapiens
HYNYMFNSS

SEQ ID NO: 72524 - protein, 9 aa, Homo Sapiens
SATTMRSVT

SEQ ID NO: 72525 - protein, 9 aa, Homo Sapiens
GTQGNIFAM

SEQ ID NO: 72526 - protein, 9 aa, Homo Sapiens
LLQLENSNS

SEQ ID NO: 72527 - protein, 9 aa, Homo Sapiens
GLCPKRTLR

SEQ ID NO: 72528 - protein, 9 aa, Homo Sapiens
KDINDNPTT

SEQ ID NO: 72529 - protein, 9 aa, Homo Sapiens
AVCRRSCPV

SEQ ID NO: 72530 - protein, 9 aa, Homo Sapiens
HGERPVSID

SEQ ID NO: 72531 - protein, 9 aa, Homo Sapiens
FDQLYGPTI

SEQ ID NO: 72532 - protein, 9 aa, Homo Sapiens
HAAVCRRSC

SEQ ID NO: 72533 - protein, 9 aa, Homo Sapiens
LTAKKQDLE

SEQ ID NO: 72534 - protein, 9 aa, Homo Sapiens
HLTTGEYKS

SEQ ID NO: 72535 - protein, 9 aa, Homo Sapiens
LVEDVAHLL

SEQ ID NO: 72536 - protein, 9 aa, Homo Sapiens
KKQDLEEIC

SEQ ID NO: 72537 - protein, 9 aa, Homo Sapiens
DLGLCPKRT

SEQ ID NO: 72538 - protein, 9 aa, Homo Sapiens
PAARLYSLE

SEQ ID NO: 72539 - protein, 9 aa, Homo Sapiens
NPNCGYQYK

SEQ ID NO: 72540 - protein, 9 aa, Homo Sapiens
ERFDQLYGP

SEQ ID NO: 72541 - protein, 9 aa, Homo Sapiens
QLNLIKGML

SEQ ID NO: 72542 - protein, 9 aa, Homo Sapiens
LMKDTDSIN

SEQ ID NO: 72543 - protein, 9 aa, Homo Sapiens
RLYSLETLH

SEQ ID NO: 72544 - protein, 9 aa, Homo Sapiens
PHGERPVSI

SEQ ID NO: 72545 - protein, 9 aa, Homo Sapiens
AVTLKFTVP

SEQ ID NO: 72546 - protein, 9 aa, Homo Sapiens
CGYQYKRLE

SEQ ID NO: 72547 - protein, 9 aa, Homo Sapiens
DPPKTRRTS

SEQ ID NO: 72548 - protein, 9 aa, Homo Sapiens
GNAMSPDFI

SEQ ID NO: 72549 - protein, 9 aa, Homo Sapiens
DVAARGLHI

SEQ ID NO: 72550 - protein, 9 aa, Homo Sapiens
GELVRSPCP

SEQ ID NO: 72551 - protein, 9 aa, Homo Sapiens
PHILLGRLL

SEQ ID NO: 72552 - protein, 9 aa, Homo Sapiens
SCQGRAGLL

SEQ ID NO: 72553 - protein, 9 aa, Homo Sapiens
KQVTGKIPI

SEQ ID NO: 72554 - protein, 9 aa, Homo Sapiens
DTGRDGSGA

SEQ ID NO: 72555 - protein, 9 aa, Homo Sapiens
KQQVSTGKR

SEQ ID NO: 72556 - protein, 9 aa, Homo Sapiens
PGGETGQED

SEQ ID NO: 72557 - protein, 9 aa, Homo Sapiens
ELVRSPCPG

SEQ ID NO: 72558 - protein, 9 aa, Homo Sapiens
NLIKGMLFK

SEQ ID NO: 72559 - protein, 9 aa, Homo Sapiens
SPGTTPGSL

SEQ ID NO: 72560 - protein, 9 aa, Homo Sapiens
RKLFLSNGK

SEQ ID NO: 72561 - protein, 9 aa, Homo Sapiens
LFLSNGKLK

SEQ ID NO: 72562 - protein, 9 aa, Homo Sapiens
IHLTMLRNL

SEQ ID NO: 72563 - protein, 9 aa, Homo Sapiens
DREAGRRQH

SEQ ID NO: 72564 - protein, 9 aa, Homo Sapiens
LHCLNISVL

SEQ ID NO: 72565 - protein, 9 aa, Homo Sapiens
SPCPGGETG

SEQ ID NO: 72566 - protein, 9 aa, Homo Sapiens
LSGVSASLL

SEQ ID NO: 72567 - protein, 9 aa, Homo Sapiens
DGSGARHRP

SEQ ID NO: 72568 - protein, 9 aa, Homo Sapiens
DWRQQHQPD

SEQ ID NO: 72569 - protein, 9 aa, Homo Sapiens
DGMDVLCVH

SEQ ID NO: 72570 - protein, 9 aa, Homo Sapiens
KVELALSMI

SEQ ID NO: 72571 - protein, 9 aa, Homo Sapiens
GRDGSGARH

SEQ ID NO: 72572 - protein, 9 aa, Homo Sapiens
STGKRSQAC

SEQ ID NO: 72573 - protein, 9 aa, Homo Sapiens
VFGTNLMVT

SEQ ID NO: 72574 - protein, 9 aa, Homo Sapiens
LWTSPATAA

SEQ ID NO: 72575 - protein, 9 aa, Homo Sapiens
SPMKDAGDM

SEQ ID NO: 72576 - protein, 9 aa, Homo Sapiens
RLLRHRPGE

SEQ ID NO: 72577 - protein, 9 aa, Homo Sapiens
LQSLLGLAW

SEQ ID NO: 72578 - protein, 9 aa, Homo Sapiens
LERRDIVPV

SEQ ID NO: 72579 - protein, 9 aa, Homo Sapiens
SLETLHAAV

SEQ ID NO: 72580 - protein, 9 aa, Homo Sapiens
EAVTLKFTV

SEQ ID NO: 72581 - protein, 9 aa, Homo Sapiens
EDGPAARLY

SEQ ID NO: 72582 - protein, 9 aa, Homo Sapiens
GLAWAHSPS

SEQ ID NO: 72583 - protein, 9 aa, Homo Sapiens
TALRVTELN

SEQ ID NO: 72584 - protein, 9 aa, Homo Sapiens
GETALRVTE

SEQ ID NO: 72585 - protein, 9 aa, Homo Sapiens
LIKGMLFKK

SEQ ID NO: 72586 - protein, 9 aa, Homo Sapiens
YGDTNSLSM

SEQ ID NO: 72587 - protein, 9 aa, Homo Sapiens
VAIWYDWRQ

SEQ ID NO: 72588 - protein, 9 aa, Homo Sapiens
DVLSLKSQK

SEQ ID NO: 72589 - protein, 9 aa, Homo Sapiens
SLIKDLGLC

SEQ ID NO: 72590 - protein, 9 aa, Homo Sapiens
DGPAARLYS

SEQ ID NO: 72591 - protein, 9 aa, Homo Sapiens
NLTAPSPMK

SEQ ID NO: 72592 - protein, 9 aa, Homo Sapiens
FVEVVIEGN

SEQ ID NO: 72593 - protein, 9 aa, Homo Sapiens
HILLGRLLR

SEQ ID NO: 72594 - protein, 9 aa, Homo Sapiens
EVVIEGNAM

SEQ ID NO: 72595 - protein, 9 aa, Homo Sapiens
VGEEGHEGC

SEQ ID NO: 72596 - protein, 9 aa, Homo Sapiens
PGTTPGSLG

SEQ ID NO: 72597 - protein, 9 aa, Homo Sapiens
ERRDIVPVK

SEQ ID NO: 72598 - protein, 9 aa, Homo Sapiens
VAARGLHIP

SEQ ID NO: 72599 - protein, 9 aa, Homo Sapiens
LVLHKFESY

SEQ ID NO: 72600 - protein, 9 aa, Homo Sapiens
LTTGEYKST

SEQ ID NO: 72601 - protein, 9 aa, Homo Sapiens
QVSTGKRSQ

SEQ ID NO: 72602 - protein, 9 aa, Homo Sapiens
WRRHWAGAE

SEQ ID NO: 72603 - protein, 9 aa, Homo Sapiens
DLQPKPNSP

SEQ ID NO: 72604 - protein, 9 aa, Homo Sapiens
ESYGDTNSL

SEQ ID NO: 72605 - protein, 9 aa, Homo Sapiens
PLWTSPATA

SEQ ID NO: 72606 - protein, 9 aa, Homo Sapiens
TNSLSMFVR

SEQ ID NO: 72607 - protein, 9 aa, Homo Sapiens
TLPQDAGQR

SEQ ID NO: 72608 - protein, 9 aa, Homo Sapiens
MSFNPAENA

SEQ ID NO: 72609 - protein, 9 aa, Homo Sapiens
WTVYSVALV

SEQ ID NO: 72610 - protein, 9 aa, Homo Sapiens
TAKKQDLEE

SEQ ID NO: 72611 - protein, 9 aa, Homo Sapiens
RRDIVPVKE

SEQ ID NO: 72612 - protein, 9 aa, Homo Sapiens
PKPNSPKKL

SEQ ID NO: 72613 - protein, 9 aa, Homo Sapiens
YLSWTVYSV

SEQ ID NO: 72614 - protein, 9 aa, Homo Sapiens
LIKDLGLCP

SEQ ID NO: 72615 - protein, 9 aa, Homo Sapiens
HKLERRDIV

SEQ ID NO: 72616 - protein, 9 aa, Homo Sapiens
RDREAGRRQ

SEQ ID NO: 72617 - protein, 9 aa, Homo Sapiens
LCPKRTLRL

SEQ ID NO: 72618 - protein, 9 aa, Homo Sapiens
VSTGKRSQA

SEQ ID NO: 72619 - protein, 9 aa, Homo Sapiens
SWTVYSVAL

SEQ ID NO: 72620 - protein, 9 aa, Homo Sapiens
QKKYVKVLV

SEQ ID NO: 72621 - protein, 9 aa, Homo Sapiens
RLWNKTSEG

SEQ ID NO: 72622 - protein, 9 aa, Homo Sapiens
VREDSVKCL

SEQ ID NO: 72623 - protein, 9 aa, Homo Sapiens
APGRLVCLN

SEQ ID NO: 72624 - protein, 9 aa, Homo Sapiens
GEVVRELMK

SEQ ID NO: 72625 - protein, 9 aa, Homo Sapiens
EIAQEFKTD

SEQ ID NO: 72626 - protein, 9 aa, Homo Sapiens
GETGQEDGP

SEQ ID NO: 72627 - protein, 9 aa, Homo Sapiens
KVGEEGHEG

SEQ ID NO: 72628 - protein, 9 aa, Homo Sapiens
TEVWTLPQD

SEQ ID NO: 72629 - protein, 9 aa, Homo Sapiens
DESYGDTNS

SEQ ID NO: 72630 - protein, 9 aa, Homo Sapiens
ALRVTELNT

SEQ ID NO: 72631 - protein, 9 aa, Homo Sapiens
YESIRELGY

SEQ ID NO: 72632 - protein, 9 aa, Homo Sapiens
EVLQDSQDR

SEQ ID NO: 72633 - protein, 9 aa, Homo Sapiens
VCLNVFSQF

SEQ ID NO: 72634 - protein, 9 aa, Homo Sapiens
GRLVCLNVF

SEQ ID NO: 72635 - protein, 9 aa, Homo Sapiens
RHGGWTTKM

SEQ ID NO: 72636 - protein, 9 aa, Homo Sapiens
GRAARSYHK

SEQ ID NO: 72637 - protein, 9 aa, Homo Sapiens
GVSASLLER

SEQ ID NO: 72638 - protein, 9 aa, Homo Sapiens
SFLSGVSAS

SEQ ID NO: 72639 - protein, 9 aa, Homo Sapiens
AHSPSALRP

SEQ ID NO: 72640 - protein, 9 aa, Homo Sapiens
VSKRPDVLS

SEQ ID NO: 72641 - protein, 9 aa, Homo Sapiens
IPILSYWPY

SEQ ID NO: 72642 - protein, 9 aa, Homo Sapiens
LVREIAQEF

SEQ ID NO: 72643 - protein, 9 aa, Homo Sapiens
INVKVGVNS

SEQ ID NO: 72644 - protein, 9 aa, Homo Sapiens
VLSLKSQKP

SEQ ID NO: 72645 - protein, 9 aa, Homo Sapiens
ESIRELGYP

SEQ ID NO: 72646 - protein, 9 aa, Homo Sapiens
PKVLHCLNI

SEQ ID NO: 72647 - protein, 9 aa, Homo Sapiens
HFPKVLHCL

SEQ ID NO: 72648 - protein, 9 aa, Homo Sapiens
SIRELGYPA

SEQ ID NO: 72649 - protein, 9 aa, Homo Sapiens
VFPIFLLVV

SEQ ID NO: 72650 - protein, 9 aa, Homo Sapiens
YMFNSSCMG

SEQ ID NO: 72651 - protein, 9 aa, Homo Sapiens
DILADRKLF

SEQ ID NO: 72652 - protein, 9 aa, Homo Sapiens
TTCPSPVTV

SEQ ID NO: 72653 - protein, 9 aa, Homo Sapiens
QEFKTDLRF

SEQ ID NO: 72654 - protein, 9 aa, Homo Sapiens
LQLENSNSG

SEQ ID NO: 72655 - protein, 9 aa, Homo Sapiens
AFQALTEGK

SEQ ID NO: 72656 - protein, 9 aa, Homo Sapiens
PEVLQDSQD

SEQ ID NO: 72657 - protein, 9 aa, Homo Sapiens
LWNKTSEGM

SEQ ID NO: 72658 - protein, 9 aa, Homo Sapiens
VYYWHKLER

SEQ ID NO: 72659 - protein, 9 aa, Homo Sapiens
TLKFTVPTG

SEQ ID NO: 72660 - protein, 9 aa, Homo Sapiens
DTNSLSMFV

SEQ ID NO: 72661 - protein, 9 aa, Homo Sapiens
KVGVNSKGT

SEQ ID NO: 72662 - protein, 9 aa, Homo Sapiens
ITDVEAENL

SEQ ID NO: 72663 - protein, 9 aa, Homo Sapiens
CQGRAGLLQ

SEQ ID NO: 72664 - protein, 9 aa, Homo Sapiens
VLQDSQDRC

SEQ ID NO: 72665 - protein, 9 aa, Homo Sapiens
RFDQLYGPT

SEQ ID NO: 72666 - protein, 9 aa, Homo Sapiens
ECLVLHKFE

SEQ ID NO: 72667 - protein, 9 aa, Homo Sapiens
TGKRSQACH

SEQ ID NO: 72668 - protein, 9 aa, Homo Sapiens
SSDTYTNRH

SEQ ID NO: 72669 - protein, 9 aa, Homo Sapiens
IHYNYMFNS

SEQ ID NO: 72670 - protein, 9 aa, Homo Sapiens
SLYQVSTHD

SEQ ID NO: 72671 - protein, 9 aa, Homo Sapiens
QPKPNSPKK

SEQ ID NO: 72672 - protein, 9 aa, Homo Sapiens
NLGQDMSSL

SEQ ID NO: 72673 - protein, 9 aa, Homo Sapiens
KGEKQLGSM

SEQ ID NO: 72674 - protein, 9 aa, Homo Sapiens
TDETLHLTT

SEQ ID NO: 72675 - protein, 9 aa, Homo Sapiens
ATTMRSVTH

SEQ ID NO: 72676 - protein, 9 aa, Homo Sapiens
SKRPDVLSL

SEQ ID NO: 72677 - protein, 9 aa, Homo Sapiens
VIEGNAMSP

SEQ ID NO: 72678 - protein, 9 aa, Homo Sapiens
QSLLGLAWA

SEQ ID NO: 72679 - protein, 9 aa, Homo Sapiens
SGVSASLLE

SEQ ID NO: 72680 - protein, 9 aa, Homo Sapiens
GPAARLYSL

SEQ ID NO: 72681 - protein, 9 aa, Homo Sapiens
LHLTTGEYK

SEQ ID NO: 72682 - protein, 9 aa, Homo Sapiens
VGVNSKGTL

SEQ ID NO: 72683 - protein, 9 aa, Homo Sapiens
SMSPVRLPL

SEQ ID NO: 72684 - protein, 9 aa, Homo Sapiens
RTSSLRSDP

SEQ ID NO: 72685 - protein, 9 aa, Homo Sapiens
DTYTNRHPA

SEQ ID NO: 72686 - protein, 9 aa, Homo Sapiens
LVCLNVFSQ

SEQ ID NO: 72687 - protein, 9 aa, Homo Sapiens
GQDMSSLRF

SEQ ID NO: 72688 - protein, 9 aa, Homo Sapiens
HIPKVQHVI

SEQ ID NO: 72689 - protein, 9 aa, Homo Sapiens
FKPGNTQKC

SEQ ID NO: 72690 - protein, 9 aa, Homo Sapiens
CPGGETGQE

SEQ ID NO: 72691 - protein, 9 aa, Homo Sapiens
DETLHLTTG

SEQ ID NO: 72692 - protein, 9 aa, Homo Sapiens
SPATAAGLK

SEQ ID NO: 72693 - protein, 9 aa, Homo Sapiens
VTELNTKEF

SEQ ID NO: 72694 - protein, 9 aa, Homo Sapiens
PQHGCNHKV

SEQ ID NO: 72695 - protein, 9 aa, Homo Sapiens
PPKVGEEGH

SEQ ID NO: 72696 - protein, 9 aa, Homo Sapiens
RPDVLSLKS

SEQ ID NO: 72697 - protein, 9 aa, Homo Sapiens
ETGQEDGPA

SEQ ID NO: 72698 - protein, 9 aa, Homo Sapiens
SDLQPKPNS

SEQ ID NO: 72699 - protein, 9 aa, Homo Sapiens
LHAAVCRRS

SEQ ID NO: 72700 - protein, 9 aa, Homo Sapiens
KKFIYIHCV

SEQ ID NO: 72701 - protein, 9 aa, Homo Sapiens
KRGKYIKTW

SEQ ID NO: 72702 - protein, 9 aa, Homo Sapiens
SFFFFETES

SEQ ID NO: 72703 - protein, 9 aa, Homo Sapiens
KSEKGLNSQ

SEQ ID NO: 72704 - protein, 9 aa, Homo Sapiens
GLNSQSSKH

SEQ ID NO: 72705 - protein, 9 aa, Homo Sapiens
KVTSGVRSG

SEQ ID NO: 72706 - protein, 9 aa, Homo Sapiens
PPEIPAGLP

SEQ ID NO: 72707 - protein, 9 aa, Homo Sapiens
KQMCSLKER

SEQ ID NO: 72708 - protein, 9 aa, Homo Sapiens
TASGYSTIY

SEQ ID NO: 72709 - protein, 9 aa, Homo Sapiens
FRTQYNRRR

SEQ ID NO: 72710 - protein, 9 aa, Homo Sapiens
IFKIKKKKF

SEQ ID NO: 72711 - protein, 9 aa, Homo Sapiens
KKKFIYIHC

SEQ ID NO: 72712 - protein, 9 aa, Homo Sapiens
QMCSLKERV

SEQ ID NO: 72713 - protein, 9 aa, Homo Sapiens
ETWGFEQNN

SEQ ID NO: 72714 - protein, 9 aa, Homo Sapiens
LNSQSSKHI

SEQ ID NO: 72715 - protein, 9 aa, Homo Sapiens
LLKHAQHKA

SEQ ID NO: 72716 - protein, 9 aa, Homo Sapiens
SCGIKSCRV

SEQ ID NO: 72717 - protein, 9 aa, Homo Sapiens
ASRSKLLYK

SEQ ID NO: 72718 - protein, 9 aa, Homo Sapiens
STIYDSETL

SEQ ID NO: 72719 - protein, 9 aa, Homo Sapiens
RGKYIKTWR

SEQ ID NO: 72720 - protein, 9 aa, Homo Sapiens
SEKGLNSQS

SEQ ID NO: 72721 - protein, 9 aa, Homo Sapiens
CEKKKLLIH

SEQ ID NO: 72722 - protein, 9 aa, Homo Sapiens
KKKILLNLS

SEQ ID NO: 72723 - protein, 9 aa, Homo Sapiens
RRNTFNGTP

SEQ ID NO: 72724 - protein, 9 aa, Homo Sapiens
SWHLLYQLL

SEQ ID NO: 72725 - protein, 9 aa, Homo Sapiens
RPAGLLPHI

SEQ ID NO: 72726 - protein, 9 aa, Homo Sapiens
LLPHISGLE

SEQ ID NO: 72727 - protein, 9 aa, Homo Sapiens
FRVPPEIPA

SEQ ID NO: 72728 - protein, 9 aa, Homo Sapiens
QDIPFPVQC

SEQ ID NO: 72729 - protein, 9 aa, Homo Sapiens
SGYSTIYDS

SEQ ID NO: 72730 - protein, 9 aa, Homo Sapiens
LFDSWHLLY

SEQ ID NO: 72731 - protein, 9 aa, Homo Sapiens
LYKLQTYLP

SEQ ID NO: 72732 - protein, 9 aa, Homo Sapiens
SKTLIKNLS

SEQ ID NO: 72733 - protein, 9 aa, Homo Sapiens
GASQISSKT

SEQ ID NO: 72734 - protein, 9 aa, Homo Sapiens
KEGKLLKHA

SEQ ID NO: 72735 - protein, 9 aa, Homo Sapiens
TFNGTPYWM

SEQ ID NO: 72736 - protein, 9 aa, Homo Sapiens
CGIKSCRVA

SEQ ID NO: 72737 - protein, 9 aa, Homo Sapiens
TPGGLRLRL

SEQ ID NO: 72738 - protein, 9 aa, Homo Sapiens
IHCVDRGLL

SEQ ID NO: 72739 - protein, 9 aa, Homo Sapiens
PEEKKKILL

SEQ ID NO: 72740 - protein, 9 aa, Homo Sapiens
KLLIHLPPS

SEQ ID NO: 72741 - protein, 9 aa, Homo Sapiens
TQYNRRRSQ

SEQ ID NO: 72742 - protein, 9 aa, Homo Sapiens
ASGYSTIYD

SEQ ID NO: 72743 - protein, 9 aa, Homo Sapiens
PVQCSECTK

SEQ ID NO: 72744 - protein, 9 aa, Homo Sapiens
YNRRRSQLL

SEQ ID NO: 72745 - protein, 9 aa, Homo Sapiens
KKILLNLSC

SEQ ID NO: 72746 - protein, 9 aa, Homo Sapiens
FIYIHCVDR

SEQ ID NO: 72747 - protein, 9 aa, Homo Sapiens
DKEKQMCSL

SEQ ID NO: 72748 - protein, 9 aa, Homo Sapiens
ASVTQAGVQ

SEQ ID NO: 72749 - protein, 9 aa, Homo Sapiens
ILSSLSFRK

SEQ ID NO: 72750 - protein, 9 aa, Homo Sapiens
ESDMATDSI

SEQ ID NO: 72751 - protein, 9 aa, Homo Sapiens
KFIYIHCVD

SEQ ID NO: 72752 - protein, 9 aa, Homo Sapiens
EKKKLLIHL

SEQ ID NO: 72753 - protein, 9 aa, Homo Sapiens
RYLGSLQPL

SEQ ID NO: 72754 - protein, 9 aa, Homo Sapiens
NQYEASYNQ

SEQ ID NO: 72755 - protein, 9 aa, Homo Sapiens
SKLLYKLQT

SEQ ID NO: 72756 - protein, 9 aa, Homo Sapiens
EESDMATDS

SEQ ID NO: 72757 - protein, 9 aa, Homo Sapiens
IRTEGKESS

SEQ ID NO: 72758 - protein, 9 aa, Homo Sapiens
NWQDIPFPV

SEQ ID NO: 72759 - protein, 9 aa, Homo Sapiens
GRRNTFNGT

SEQ ID NO: 72760 - protein, 9 aa, Homo Sapiens
HKRGKYIKT

SEQ ID NO: 72761 - protein, 9 aa, Homo Sapiens
DSLPEESDM

SEQ ID NO: 72762 - protein, 9 aa, Homo Sapiens
KEKQMCSLK

SEQ ID NO: 72763 - protein, 9 aa, Homo Sapiens
NSQSSKHIL

SEQ ID NO: 72764 - protein, 9 aa, Homo Sapiens
SDMATDSIP

SEQ ID NO: 72765 - protein, 9 aa, Homo Sapiens
IEVILPVLC

SEQ ID NO: 72766 - protein, 9 aa, Homo Sapiens
HVIEVILPV

SEQ ID NO: 72767 - protein, 9 aa, Homo Sapiens
YIHCVDRGL

SEQ ID NO: 72768 - protein, 9 aa, Homo Sapiens
EGKLLKHAQ

SEQ ID NO: 72769 - protein, 9 aa, Homo Sapiens
WQDIPFPVQ

SEQ ID NO: 72770 - protein, 9 aa, Homo Sapiens
LLFPETWGF

SEQ ID NO: 72771 - protein, 9 aa, Homo Sapiens
LKQQNQYEA

SEQ ID NO: 72772 - protein, 9 aa, Homo Sapiens
LLIHLPPSH

SEQ ID NO: 72773 - protein, 9 aa, Homo Sapiens
LKSEKGLNS

SEQ ID NO: 72774 - protein, 9 aa, Homo Sapiens
GLLFPETWG

SEQ ID NO: 72775 - protein, 9 aa, Homo Sapiens
PEESDMATD

SEQ ID NO: 72776 - protein, 9 aa, Homo Sapiens
RGLLFPETW

SEQ ID NO: 72777 - protein, 9 aa, Homo Sapiens
EEKKKILLN

SEQ ID NO: 72778 - protein, 9 aa, Homo Sapiens
GIKSCRVAA

SEQ ID NO: 72779 - protein, 9 aa, Homo Sapiens
VILPVLCNY

SEQ ID NO: 72780 - protein, 9 aa, Homo Sapiens
RSPGQVTPG

SEQ ID NO: 72781 - protein, 9 aa, Homo Sapiens
VLVTLFDSW

SEQ ID NO: 72782 - protein, 9 aa, Homo Sapiens
MKEGKLLKH

SEQ ID NO: 72783 - protein, 9 aa, Homo Sapiens
TVLGLFRVP

SEQ ID NO: 72784 - protein, 9 aa, Homo Sapiens
KTLIKNLSN

SEQ ID NO: 72785 - protein, 9 aa, Homo Sapiens
KILLNLSCQ

SEQ ID NO: 72786 - protein, 9 aa, Homo Sapiens
FKIKKKKFI

SEQ ID NO: 72787 - protein, 9 aa, Homo Sapiens
EGWLHKRGK

SEQ ID NO: 72788 - protein, 9 aa, Homo Sapiens
CPSSSSSVS

SEQ ID NO: 72789 - protein, 9 aa, Homo Sapiens
YKLQTYLPP

SEQ ID NO: 72790 - protein, 9 aa, Homo Sapiens
TSGVRSGCP

SEQ ID NO: 72791 - protein, 9 aa, Homo Sapiens
QTLCSFFFF

SEQ ID NO: 72792 - protein, 9 aa, Homo Sapiens
DSWHLLYQL

SEQ ID NO: 72793 - protein, 9 aa, Homo Sapiens
NNTWRQYNE

SEQ ID NO: 72794 - protein, 9 aa, Homo Sapiens
LRDKEKQMC

SEQ ID NO: 72795 - protein, 9 aa, Homo Sapiens
NTWRQYNET

SEQ ID NO: 72796 - protein, 9 aa, Homo Sapiens
ISGLEAGAV

SEQ ID NO: 72797 - protein, 9 aa, Homo Sapiens
SIFKIKKKK

SEQ ID NO: 72798 - protein, 9 aa, Homo Sapiens
KKLLIHLPP

SEQ ID NO: 72799 - protein, 9 aa, Homo Sapiens
VLQECEKKK

SEQ ID NO: 72800 - protein, 9 aa, Homo Sapiens
AKVTSGVRS

SEQ ID NO: 72801 - protein, 9 aa, Homo Sapiens
QNQYEASYN

SEQ ID NO: 72802 - protein, 9 aa, Homo Sapiens
FQPPPPPPA

SEQ ID NO: 72803 - protein, 9 aa, Homo Sapiens
HCVDRGLLF

SEQ ID NO: 72804 - protein, 9 aa, Homo Sapiens
PQFRTQYNR

SEQ ID NO: 72805 - protein, 9 aa, Homo Sapiens
TLKQQNQYE

SEQ ID NO: 72806 - protein, 9 aa, Homo Sapiens
SPGQVTPGG

SEQ ID NO: 72807 - protein, 9 aa, Homo Sapiens
KQQNQYEAS

SEQ ID NO: 72808 - protein, 9 aa, Homo Sapiens
MATDSIPRE

SEQ ID NO: 72809 - protein, 9 aa, Homo Sapiens
SFRKLMLGH

SEQ ID NO: 72810 - protein, 9 aa, Homo Sapiens
FFETESASV

SEQ ID NO: 72811 - protein, 9 aa, Homo Sapiens
LVTLFDSWH

SEQ ID NO: 72812 - protein, 9 aa, Homo Sapiens
VLCNYLSYW

SEQ ID NO: 72813 - protein, 9 aa, Homo Sapiens
QVTPGGLRL

SEQ ID NO: 72814 - protein, 9 aa, Homo Sapiens
VGRRNTFNG

SEQ ID NO: 72815 - protein, 9 aa, Homo Sapiens
DMATDSIPR

SEQ ID NO: 72816 - protein, 9 aa, Homo Sapiens
YEASYNQSF

SEQ ID NO: 72817 - protein, 9 aa, Homo Sapiens
PHISGLEAG

SEQ ID NO: 72818 - protein, 9 aa, Homo Sapiens
YSTIYDSET

SEQ ID NO: 72819 - protein, 9 aa, Homo Sapiens
QECEKKKLL

SEQ ID NO: 72820 - protein, 9 aa, Homo Sapiens
HRRIRTEGK

SEQ ID NO: 72821 - protein, 9 aa, Homo Sapiens
SRHRRIRTE

SEQ ID NO: 72822 - protein, 9 aa, Homo Sapiens
LPPSHWDRK

SEQ ID NO: 72823 - protein, 9 aa, Homo Sapiens
RCPSSSSSV

SEQ ID NO: 72824 - protein, 9 aa, Homo Sapiens
TWRQYNETS

SEQ ID NO: 72825 - protein, 9 aa, Homo Sapiens
PFPVQCSEC

SEQ ID NO: 72826 - protein, 9 aa, Homo Sapiens
GQVTPGGLR

SEQ ID NO: 72827 - protein, 9 aa, Homo Sapiens
KGLNSQSSK

SEQ ID NO: 72828 - protein, 9 aa, Homo Sapiens
KYIKTWRPR

SEQ ID NO: 72829 - protein, 9 aa, Homo Sapiens
VLGLFRVPP

SEQ ID NO: 72830 - protein, 9 aa, Homo Sapiens
LGLFRVPPE

SEQ ID NO: 72831 - protein, 9 aa, Homo Sapiens
LPHISGLEA

SEQ ID NO: 72832 - protein, 9 aa, Homo Sapiens
GGLRLRLPR

SEQ ID NO: 72833 - protein, 9 aa, Homo Sapiens
RTQYNRRRS

SEQ ID NO: 72834 - protein, 9 aa, Homo Sapiens
PQFSSTVLK

SEQ ID NO: 72835 - protein, 9 aa, Homo Sapiens
QRRSRHRRI

SEQ ID NO: 72836 - protein, 9 aa, Homo Sapiens
SGASQISSK

SEQ ID NO: 72837 - protein, 9 aa, Homo Sapiens
GLFRVPPEI

SEQ ID NO: 72838 - protein, 9 aa, Homo Sapiens
LHKRGKYIK

SEQ ID NO: 72839 - protein, 9 aa, Homo Sapiens
FNGTPYWMA

SEQ ID NO: 72840 - protein, 9 aa, Homo Sapiens
VTPGGLRLR

SEQ ID NO: 72841 - protein, 9 aa, Homo Sapiens
SLSFRKLML

SEQ ID NO: 72842 - protein, 9 aa, Homo Sapiens
QYNRRRSQL

SEQ ID NO: 72843 - protein, 9 aa, Homo Sapiens
EKGLNSQSS

SEQ ID NO: 72844 - protein, 9 aa, Homo Sapiens
FDSWHLLYQ

SEQ ID NO: 72845 - protein, 9 aa, Homo Sapiens
TASRSKLLY

SEQ ID NO: 72846 - protein, 9 aa, Homo Sapiens
RSRHRRIRT

SEQ ID NO: 72847 - protein, 9 aa, Homo Sapiens
FPVQCSECT

SEQ ID NO: 72848 - protein, 9 aa, Homo Sapiens
RVPPEIPAG

SEQ ID NO: 72849 - protein, 9 aa, Homo Sapiens
ISSKTLIKN

SEQ ID NO: 72850 - protein, 9 aa, Homo Sapiens
RDKEKQMCS

SEQ ID NO: 72851 - protein, 9 aa, Homo Sapiens
SSLSFRKLM

SEQ ID NO: 72852 - protein, 9 aa, Homo Sapiens
KLLKHAQHK

SEQ ID NO: 72853 - protein, 9 aa, Homo Sapiens
PVLCNYLSY

SEQ ID NO: 72854 - protein, 9 aa, Homo Sapiens
TWGFEQNNT

SEQ ID NO: 72855 - protein, 9 aa, Homo Sapiens
PETWGFEQN

SEQ ID NO: 72856 - protein, 9 aa, Homo Sapiens
TLCSFFFFE

SEQ ID NO: 72857 - protein, 9 aa, Homo Sapiens
HTASGYSTI

SEQ ID NO: 72858 - protein, 9 aa, Homo Sapiens
FPETWGFEQ

SEQ ID NO: 72859 - protein, 9 aa, Homo Sapiens
PGGLRLRLP

SEQ ID NO: 72860 - protein, 9 aa, Homo Sapiens
GKLLKHAQH

SEQ ID NO: 72861 - protein, 9 aa, Homo Sapiens
FETESASVT

SEQ ID NO: 72862 - protein, 9 aa, Homo Sapiens
LFPETWGFE

SEQ ID NO: 72863 - protein, 9 aa, Homo Sapiens
NRRRSQLLR

SEQ ID NO: 72864 - protein, 9 aa, Homo Sapiens
GYSTIYDSE

SEQ ID NO: 72865 - protein, 9 aa, Homo Sapiens
HLPPSHWDR

SEQ ID NO: 72866 - protein, 9 aa, Homo Sapiens
PPSHWDRKC

SEQ ID NO: 72867 - protein, 9 aa, Homo Sapiens
DIPFPVQCS

SEQ ID NO: 72868 - protein, 9 aa, Homo Sapiens
SSKTLIKNL

SEQ ID NO: 72869 - protein, 9 aa, Homo Sapiens
VDPEEKKKI

SEQ ID NO: 72870 - protein, 9 aa, Homo Sapiens
LLYKLQTYL

SEQ ID NO: 72871 - protein, 9 aa, Homo Sapiens
EVILPVLCN

SEQ ID NO: 72872 - protein, 9 aa, Homo Sapiens
WLHKRGKYI

SEQ ID NO: 72873 - protein, 9 aa, Homo Sapiens
QYEASYNQS

SEQ ID NO: 72874 - protein, 9 aa, Homo Sapiens
DPEEKKKIL

SEQ ID NO: 72875 - protein, 9 aa, Homo Sapiens
RSKLLYKLQ

SEQ ID NO: 72876 - protein, 9 aa, Homo Sapiens
GFEQNNTWR

SEQ ID NO: 72877 - protein, 9 aa, Homo Sapiens
LLNLSCQSC

SEQ ID NO: 72878 - protein, 9 aa, Homo Sapiens
PHTASGYST

SEQ ID NO: 72879 - protein, 9 aa, Homo Sapiens
VPPEIPAGL

SEQ ID NO: 72880 - protein, 9 aa, Homo Sapiens
RIRTEGKES

SEQ ID NO: 72881 - protein, 9 aa, Homo Sapiens
NLSCQSCTF

SEQ ID NO: 72882 - protein, 9 aa, Homo Sapiens
SASVTQAGV

SEQ ID NO: 72883 - protein, 9 aa, Homo Sapiens
SQISSKTLI

SEQ ID NO: 72884 - protein, 9 aa, Homo Sapiens
WHLLYQLLW

SEQ ID NO: 72885 - protein, 9 aa, Homo Sapiens
FLKSEKGLN

SEQ ID NO: 72886 - protein, 9 aa, Homo Sapiens
TVGRRNTFN

SEQ ID NO: 72887 - protein, 9 aa, Homo Sapiens
GVRSGCPGH

SEQ ID NO: 72888 - protein, 9 aa, Homo Sapiens
KKKKFIYIH

SEQ ID NO: 72889 - protein, 9 aa, Homo Sapiens
ECEKKKLLI

SEQ ID NO: 72890 - protein, 9 aa, Homo Sapiens
PSHWDRKCQ

SEQ ID NO: 72891 - protein, 9 aa, Homo Sapiens
AGLLPHISG

SEQ ID NO: 72892 - protein, 9 aa, Homo Sapiens
CSFFFFETE

SEQ ID NO: 72893 - protein, 9 aa, Homo Sapiens
KKKLLIHLP

SEQ ID NO: 72894 - protein, 9 aa, Homo Sapiens
DRKCQTTPR

SEQ ID NO: 72895 - protein, 9 aa, Homo Sapiens
GLLPHISGL

SEQ ID NO: 72896 - protein, 9 aa, Homo Sapiens
YLGSLQPLP

SEQ ID NO: 72897 - protein, 9 aa, Homo Sapiens
SGCPGHCSS

SEQ ID NO: 72898 - protein, 9 aa, Homo Sapiens
HAQHKAIPA

SEQ ID NO: 72899 - protein, 9 aa, Homo Sapiens
PSSSSSVSC

SEQ ID NO: 72900 - protein, 9 aa, Homo Sapiens
EKQMCSLKE

SEQ ID NO: 72901 - protein, 9 aa, Homo Sapiens
VRILSSLSF

SEQ ID NO: 72902 - protein, 9 aa, Homo Sapiens
LCSFFFFET

SEQ ID NO: 72903 - protein, 9 aa, Homo Sapiens
ILPVLCNYL

SEQ ID NO: 72904 - protein, 9 aa, Homo Sapiens
VTLFDSWHL

SEQ ID NO: 72905 - protein, 9 aa, Homo Sapiens
TQAGVQWRY

SEQ ID NO: 72906 - protein, 9 aa, Homo Sapiens
ASQISSKTL

SEQ ID NO: 72907 - protein, 9 aa, Homo Sapiens
EQNNTWRQY

SEQ ID NO: 72908 - protein, 9 aa, Homo Sapiens
GKYIKTWRP

SEQ ID NO: 72909 - protein, 9 aa, Homo Sapiens
NGTPYWMAP

SEQ ID NO: 72910 - protein, 9 aa, Homo Sapiens
RRSRHRRIR

SEQ ID NO: 72911 - protein, 9 aa, Homo Sapiens
RRIRTEGKE

SEQ ID NO: 72912 - protein, 9 aa, Homo Sapiens
CVDRGLLFP

SEQ ID NO: 72913 - protein, 9 aa, Homo Sapiens
GWLHKRGKY

SEQ ID NO: 72914 - protein, 9 aa, Homo Sapiens
LPVLCNYLS

SEQ ID NO: 72915 - protein, 9 aa, Homo Sapiens
PAGLLPHIS

SEQ ID NO: 72916 - protein, 9 aa, Homo Sapiens
FRKLMLGHN

SEQ ID NO: 72917 - protein, 9 aa, Homo Sapiens
RSGCPGHCS

SEQ ID NO: 72918 - protein, 9 aa, Homo Sapiens
HWDRKCQTT

SEQ ID NO: 72919 - protein, 9 aa, Homo Sapiens
KLLYKLQTY

SEQ ID NO: 72920 - protein, 9 aa, Homo Sapiens
LPEESDMAT

SEQ ID NO: 72921 - protein, 9 aa, Homo Sapiens
VRSGCPGHC

SEQ ID NO: 72922 - protein, 9 aa, Homo Sapiens
EKKKILLNL

SEQ ID NO: 72923 - protein, 9 aa, Homo Sapiens
IPFPVQCSE

SEQ ID NO: 72924 - protein, 9 aa, Homo Sapiens
SRSKLLYKL

SEQ ID NO: 72925 - protein, 9 aa, Homo Sapiens
WDRKCQTTP

SEQ ID NO: 72926 - protein, 9 aa, Homo Sapiens
LNLSCQSCT

SEQ ID NO: 72927 - protein, 9 aa, Homo Sapiens
VTSGVRSGC

SEQ ID NO: 72928 - protein, 9 aa, Homo Sapiens
IKKKKFIYI

SEQ ID NO: 72929 - protein, 9 aa, Homo Sapiens
VIEVILPVL

SEQ ID NO: 72930 - protein, 9 aa, Homo Sapiens
ILLNLSCQS

SEQ ID NO: 72931 - protein, 9 aa, Homo Sapiens
SHWDRKCQT

SEQ ID NO: 72932 - protein, 9 aa, Homo Sapiens
NTFNGTPYW

SEQ ID NO: 72933 - protein, 9 aa, Homo Sapiens
QNNTWRQYN

SEQ ID NO: 72934 - protein, 9 aa, Homo Sapiens
FFFETESAS

SEQ ID NO: 72935 - protein, 9 aa, Homo Sapiens
LSSLSFRKL

SEQ ID NO: 72936 - protein, 9 aa, Homo Sapiens
HISGLEAGA

SEQ ID NO: 72937 - protein, 9 aa, Homo Sapiens
TESASVTQA

SEQ ID NO: 72938 - protein, 9 aa, Homo Sapiens
RILSSLSFR

SEQ ID NO: 72939 - protein, 9 aa, Homo Sapiens
ETESASVTQ

SEQ ID NO: 72940 - protein, 9 aa, Homo Sapiens
LFRVPPEIP

SEQ ID NO: 72941 - protein, 9 aa, Homo Sapiens
IYIHCVDRG

SEQ ID NO: 72942 - protein, 9 aa, Homo Sapiens
SPHTASGYS

SEQ ID NO: 72943 - protein, 9 aa, Homo Sapiens
PGQVTPGGL

SEQ ID NO: 72944 - protein, 9 aa, Homo Sapiens
LQECEKKKL

SEQ ID NO: 72945 - protein, 9 aa, Homo Sapiens
VDRGLLFPE

SEQ ID NO: 72946 - protein, 9 aa, Homo Sapiens
RHRRIRTEG

SEQ ID NO: 72947 - protein, 9 aa, Homo Sapiens
KIKKKKFIY

SEQ ID NO: 72948 - protein, 9 aa, Homo Sapiens
QISSKTLIK

SEQ ID NO: 72949 - protein, 9 aa, Homo Sapiens
FFFFETESA

SEQ ID NO: 72950 - protein, 9 aa, Homo Sapiens
QQNQYEASY

SEQ ID NO: 72951 - protein, 9 aa, Homo Sapiens
LKHAQHKAI

SEQ ID NO: 72952 - protein, 9 aa, Homo Sapiens
WGFEQNNTW

SEQ ID NO: 72953 - protein, 9 aa, Homo Sapiens
MCSLKERVK

SEQ ID NO: 72954 - protein, 9 aa, Homo Sapiens
DRGLLFPET

SEQ ID NO: 72955 - protein, 9 aa, Homo Sapiens
CSLKERVKS

SEQ ID NO: 72956 - protein, 9 aa, Homo Sapiens
FEQNNTWRQ

SEQ ID NO: 72957 - protein, 9 aa, Homo Sapiens
RNTFNGTPY

SEQ ID NO: 72958 - protein, 9 aa, Homo Sapiens
ESASVTQAG

SEQ ID NO: 72959 - protein, 9 aa, Homo Sapiens
KHAQHKAIP

SEQ ID NO: 72960 - protein, 9 aa, Homo Sapiens
QFRTQYNRR

SEQ ID NO: 72961 - protein, 9 aa, Homo Sapiens
FPQFRTQYN

SEQ ID NO: 72962 - protein, 9 aa, Homo Sapiens
SGVRSGCPG

SEQ ID NO: 72963 - protein, 9 aa, Homo Sapiens
WRQYNETSF

SEQ ID NO: 72964 - protein, 9 aa, Homo Sapiens
LIHLPPSHW

SEQ ID NO: 72965 - protein, 9 aa, Homo Sapiens
EASYNQSFS

SEQ ID NO: 72966 - protein, 9 aa, Homo Sapiens
HYTEGAELT

SEQ ID NO: 72967 - protein, 9 aa, Homo Sapiens
RQYNETSFL

SEQ ID NO: 72968 - protein, 9 aa, Homo Sapiens
TLFDSWHLL

SEQ ID NO: 72969 - protein, 9 aa, Homo Sapiens
LSFRKLMLG

SEQ ID NO: 72970 - protein, 9 aa, Homo Sapiens
SLPEESDMA

SEQ ID NO: 72971 - protein, 9 aa, Homo Sapiens
IHLPPSHWD

SEQ ID NO: 72972 - protein, 9 aa, Homo Sapiens
LNWQDIPFP

SEQ ID NO: 72973 - protein, 9 aa, Homo Sapiens
VTLGVENRK

SEQ ID NO: 72974 - protein, 9 aa, Homo Sapiens
VHRAAVRLR

SEQ ID NO: 72975 - protein, 9 aa, Homo Sapiens
AKDGGLVTS

SEQ ID NO: 72976 - protein, 9 aa, Homo Sapiens
CLIVENLSS

SEQ ID NO: 72977 - protein, 9 aa, Homo Sapiens
REELKLKAQ

SEQ ID NO: 72978 - protein, 9 aa, Homo Sapiens
ECTDLLAQD

SEQ ID NO: 72979 - protein, 9 aa, Homo Sapiens
NHIRLPVVK

SEQ ID NO: 72980 - protein, 9 aa, Homo Sapiens
EDSKIDHYM

SEQ ID NO: 72981 - protein, 9 aa, Homo Sapiens
VNYHASDVL

SEQ ID NO: 72982 - protein, 9 aa, Homo Sapiens
PDEKSIMTN

SEQ ID NO: 72983 - protein, 9 aa, Homo Sapiens
PRSLRIYEC

SEQ ID NO: 72984 - protein, 9 aa, Homo Sapiens
STKMKPQVK

SEQ ID NO: 72985 - protein, 9 aa, Homo Sapiens
KKKTNKQQQ

SEQ ID NO: 72986 - protein, 9 aa, Homo Sapiens
ENHIRLPVV

SEQ ID NO: 72987 - protein, 9 aa, Homo Sapiens
SSWQAKRVN

SEQ ID NO: 72988 - protein, 9 aa, Homo Sapiens
LDANRTVLD

SEQ ID NO: 72989 - protein, 9 aa, Homo Sapiens
DTIVHRAAV

SEQ ID NO: 72990 - protein, 9 aa, Homo Sapiens
MEDTFIVCL

SEQ ID NO: 72991 - protein, 9 aa, Homo Sapiens
RIYECHVGI

SEQ ID NO: 72992 - protein, 9 aa, Homo Sapiens
AVDFVNYHA

SEQ ID NO: 72993 - protein, 9 aa, Homo Sapiens
RMNILTFKK

SEQ ID NO: 72994 - protein, 9 aa, Homo Sapiens
TKRPAFTWS

SEQ ID NO: 72995 - protein, 9 aa, Homo Sapiens
TKMKPQVKP

SEQ ID NO: 72996 - protein, 9 aa, Homo Sapiens
AFTWSIVQS

SEQ ID NO: 72997 - protein, 9 aa, Homo Sapiens
FTWSIVQSE

SEQ ID NO: 72998 - protein, 9 aa, Homo Sapiens
NVSELAAEQ

SEQ ID NO: 72999 - protein, 9 aa, Homo Sapiens
DVGEVTLGV

SEQ ID NO: 73000 - protein, 9 aa, Homo Sapiens
MSGKEIKKN

SEQ ID NO: 73001 - protein, 9 aa, Homo Sapiens
SKTKTKNKH

SEQ ID NO: 73002 - protein, 9 aa, Homo Sapiens
VRTENCLIV

SEQ ID NO: 73003 - protein, 9 aa, Homo Sapiens
KKVFERMNI

SEQ ID NO: 73004 - protein, 9 aa, Homo Sapiens
CSVERCAVY

SEQ ID NO: 73005 - protein, 9 aa, Homo Sapiens
TSREAGAEK

SEQ ID NO: 73006 - protein, 9 aa, Homo Sapiens
VAANQSHAR

SEQ ID NO: 73007 - protein, 9 aa, Homo Sapiens
SQQELGGQG

SEQ ID NO: 73008 - protein, 9 aa, Homo Sapiens
ETSREAGAE

SEQ ID NO: 73009 - protein, 9 aa, Homo Sapiens
DHYMLEYRR

SEQ ID NO: 73010 - protein, 9 aa, Homo Sapiens
AAVAANQSH

SEQ ID NO: 73011 - protein, 9 aa, Homo Sapiens
ASKTKTKNK

SEQ ID NO: 73012 - protein, 9 aa, Homo Sapiens
LSLQVSMQG

SEQ ID NO: 73013 - protein, 9 aa, Homo Sapiens
QDRSLDMTV

SEQ ID NO: 73014 - protein, 9 aa, Homo Sapiens
HYMLEYRRT

SEQ ID NO: 73015 - protein, 9 aa, Homo Sapiens
SVERCAVYS

SEQ ID NO: 73016 - protein, 9 aa, Homo Sapiens
NCLIVENLS

SEQ ID NO: 73017 - protein, 9 aa, Homo Sapiens
MQGSKPDKN

SEQ ID NO: 73018 - protein, 9 aa, Homo Sapiens
RREELKLKA

SEQ ID NO: 73019 - protein, 9 aa, Homo Sapiens
MTVKEPSNE

SEQ ID NO: 73020 - protein, 9 aa, Homo Sapiens
EPITHFPEV

SEQ ID NO: 73021 - protein, 9 aa, Homo Sapiens
NRTVLDKFS

SEQ ID NO: 73022 - protein, 9 aa, Homo Sapiens
WQAKRVNVS

SEQ ID NO: 73023 - protein, 9 aa, Homo Sapiens
PDDSKVPSS

SEQ ID NO: 73024 - protein, 9 aa, Homo Sapiens
QICKECTDL

SEQ ID NO: 73025 - protein, 9 aa, Homo Sapiens
GGKIQEKLL

SEQ ID NO: 73026 - protein, 9 aa, Homo Sapiens
QSFALSSDE

SEQ ID NO: 73027 - protein, 9 aa, Homo Sapiens
EENPDDSKV

SEQ ID NO: 73028 - protein, 9 aa, Homo Sapiens
RTENCLIVE

SEQ ID NO: 73029 - protein, 9 aa, Homo Sapiens
TQLSLQVSM

SEQ ID NO: 73030 - protein, 9 aa, Homo Sapiens
DIQEDGKLY

SEQ ID NO: 73031 - protein, 9 aa, Homo Sapiens
GKEIKKNKH

SEQ ID NO: 73032 - protein, 9 aa, Homo Sapiens
VWESQQELG

SEQ ID NO: 73033 - protein, 9 aa, Homo Sapiens
YNAKDTIVH

SEQ ID NO: 73034 - protein, 9 aa, Homo Sapiens
DYLGPSQPG

SEQ ID NO: 73035 - protein, 9 aa, Homo Sapiens
CHVGISSHE

SEQ ID NO: 73036 - protein, 9 aa, Homo Sapiens
EGRWYHIYE

SEQ ID NO: 73037 - protein, 9 aa, Homo Sapiens
FALYQQLVQ

SEQ ID NO: 73038 - protein, 9 aa, Homo Sapiens
VQLLDANRT

SEQ ID NO: 73039 - protein, 9 aa, Homo Sapiens
ENPDDSKVP

SEQ ID NO: 73040 - protein, 9 aa, Homo Sapiens
YMLEYRRTN

SEQ ID NO: 73041 - protein, 9 aa, Homo Sapiens
DTGSCDIQE

SEQ ID NO: 73042 - protein, 9 aa, Homo Sapiens
EEAEKRREE

SEQ ID NO: 73043 - protein, 9 aa, Homo Sapiens
SCDIQEDGK

SEQ ID NO: 73044 - protein, 9 aa, Homo Sapiens
EKRREELKL

SEQ ID NO: 73045 - protein, 9 aa, Homo Sapiens
QEPCSVERC

SEQ ID NO: 73046 - protein, 9 aa, Homo Sapiens
DLAGQDLTD

SEQ ID NO: 73047 - protein, 9 aa, Homo Sapiens
LEGRWYHIY

SEQ ID NO: 73048 - protein, 9 aa, Homo Sapiens
ICKECTDLL

SEQ ID NO: 73049 - protein, 9 aa, Homo Sapiens
ETSAEAWAA

SEQ ID NO: 73050 - protein, 9 aa, Homo Sapiens
VDFVNYHAS

SEQ ID NO: 73051 - protein, 9 aa, Homo Sapiens
SSTKMKPQV

SEQ ID NO: 73052 - protein, 9 aa, Homo Sapiens
KPLEGRWYH

SEQ ID NO: 73053 - protein, 9 aa, Homo Sapiens
FVNYHASDV

SEQ ID NO: 73054 - protein, 9 aa, Homo Sapiens
HDNHTHSDI

SEQ ID NO: 73055 - protein, 9 aa, Homo Sapiens
PATKRPAFT

SEQ ID NO: 73056 - protein, 9 aa, Homo Sapiens
EDPTYDYLG

SEQ ID NO: 73057 - protein, 9 aa, Homo Sapiens
IKKNKHLFG

SEQ ID NO: 73058 - protein, 9 aa, Homo Sapiens
LSQSFALSS

SEQ ID NO: 73059 - protein, 9 aa, Homo Sapiens
AEKRREELK

SEQ ID NO: 73060 - protein, 9 aa, Homo Sapiens
NELSSTVEP

SEQ ID NO: 73061 - protein, 9 aa, Homo Sapiens
DDVQILVEM

SEQ ID NO: 73062 - protein, 9 aa, Homo Sapiens
IMTNVAQFL

SEQ ID NO: 73063 - protein, 9 aa, Homo Sapiens
SWQAKRVNV

SEQ ID NO: 73064 - protein, 9 aa, Homo Sapiens
KTQAVDFVN

SEQ ID NO: 73065 - protein, 9 aa, Homo Sapiens
ECHVGISSH

SEQ ID NO: 73066 - protein, 9 aa, Homo Sapiens
VLTPDDVQI

SEQ ID NO: 73067 - protein, 9 aa, Homo Sapiens
LPVVKVVVL

SEQ ID NO: 73068 - protein, 9 aa, Homo Sapiens
EELKLKAQE

SEQ ID NO: 73069 - protein, 9 aa, Homo Sapiens
QQLVQGNAV

SEQ ID NO: 73070 - protein, 9 aa, Homo Sapiens
SIMTNVAQF

SEQ ID NO: 73071 - protein, 9 aa, Homo Sapiens
AKDTIVHRA

SEQ ID NO: 73072 - protein, 9 aa, Homo Sapiens
TFIVCLNKV

SEQ ID NO: 73073 - protein, 9 aa, Homo Sapiens
TGSCDIQED

SEQ ID NO: 73074 - protein, 9 aa, Homo Sapiens
TYDYLGPSQ

SEQ ID NO: 73075 - protein, 9 aa, Homo Sapiens
LDMTVKEPS

SEQ ID NO: 73076 - protein, 9 aa, Homo Sapiens
AGVVGGKIQ

SEQ ID NO: 73077 - protein, 9 aa, Homo Sapiens
ATKQICKEC

SEQ ID NO: 73078 - protein, 9 aa, Homo Sapiens
LLDANRTVL

SEQ ID NO: 73079 - protein, 9 aa, Homo Sapiens
VAAGVVGGK

SEQ ID NO: 73080 - protein, 9 aa, Homo Sapiens
KVFERMNIL

SEQ ID NO: 73081 - protein, 9 aa, Homo Sapiens
SLWALETSR

SEQ ID NO: 73082 - protein, 9 aa, Homo Sapiens
QILVEMEDE

SEQ ID NO: 73083 - protein, 9 aa, Homo Sapiens
AWAAVLAQS

SEQ ID NO: 73084 - protein, 9 aa, Homo Sapiens
KTPGLSQSF

SEQ ID NO: 73085 - protein, 9 aa, Homo Sapiens
KRVNVSELA

SEQ ID NO: 73086 - protein, 9 aa, Homo Sapiens
HQNTMEDTF

SEQ ID NO: 73087 - protein, 9 aa, Homo Sapiens
QLSLQVSMQ

SEQ ID NO: 73088 - protein, 9 aa, Homo Sapiens
AKRVNVSEL

SEQ ID NO: 73089 - protein, 9 aa, Homo Sapiens
PAFTWSIVQ

SEQ ID NO: 73090 - protein, 9 aa, Homo Sapiens
PPVRTENCL

SEQ ID NO: 73091 - protein, 9 aa, Homo Sapiens
TKTKNKHFV

SEQ ID NO: 73092 - protein, 9 aa, Homo Sapiens
DFAKDGGLV

SEQ ID NO: 73093 - protein, 9 aa, Homo Sapiens
FALSSDEIL

SEQ ID NO: 73094 - protein, 9 aa, Homo Sapiens
KVPSSSGIN

SEQ ID NO: 73095 - protein, 9 aa, Homo Sapiens
LVQLLDANR

SEQ ID NO: 73096 - protein, 9 aa, Homo Sapiens
KIDHYMLEY

SEQ ID NO: 73097 - protein, 9 aa, Homo Sapiens
LAALHDNHT

SEQ ID NO: 73098 - protein, 9 aa, Homo Sapiens
QDLTDYLMK

SEQ ID NO: 73099 - protein, 9 aa, Homo Sapiens
VKPLEGRWY

SEQ ID NO: 73100 - protein, 9 aa, Homo Sapiens
GLSQSFALS

SEQ ID NO: 73101 - protein, 9 aa, Homo Sapiens
IVHRAAVRL

SEQ ID NO: 73102 - protein, 9 aa, Homo Sapiens
RLPVVKVVV

SEQ ID NO: 73103 - protein, 9 aa, Homo Sapiens
QDFAKDGGL

SEQ ID NO: 73104 - protein, 9 aa, Homo Sapiens
RSLRIYECH

SEQ ID NO: 73105 - protein, 9 aa, Homo Sapiens
HIRLPVVKV

SEQ ID NO: 73106 - protein, 9 aa, Homo Sapiens
EVTLGVENR

SEQ ID NO: 73107 - protein, 9 aa, Homo Sapiens
KPQVKPSSL

SEQ ID NO: 73108 - protein, 9 aa, Homo Sapiens
PITHFPEVT

SEQ ID NO: 73109 - protein, 9 aa, Homo Sapiens
MNILTFKKS

SEQ ID NO: 73110 - protein, 9 aa, Homo Sapiens
ALETSREAG

SEQ ID NO: 73111 - protein, 9 aa, Homo Sapiens
SKVPSSSGI

SEQ ID NO: 73112 - protein, 9 aa, Homo Sapiens
TMEDTFIVC

SEQ ID NO: 73113 - protein, 9 aa, Homo Sapiens
PDDVQILVE

SEQ ID NO: 73114 - protein, 9 aa, Homo Sapiens
KECTDLLAQ

SEQ ID NO: 73115 - protein, 9 aa, Homo Sapiens
VEPITHFPE

SEQ ID NO: 73116 - protein, 9 aa, Homo Sapiens
LSSTVEPIT

SEQ ID NO: 73117 - protein, 9 aa, Homo Sapiens
NKHLFGLRI

SEQ ID NO: 73118 - protein, 9 aa, Homo Sapiens
SLRIYECHV

SEQ ID NO: 73119 - protein, 9 aa, Homo Sapiens
LAGQDLTDY

SEQ ID NO: 73120 - protein, 9 aa, Homo Sapiens
RPAFTWSIV

SEQ ID NO: 73121 - protein, 9 aa, Homo Sapiens
TKQICKECT

SEQ ID NO: 73122 - protein, 9 aa, Homo Sapiens
NQSHARRGA

SEQ ID NO: 73123 - protein, 9 aa, Homo Sapiens
KMKPQVKPS

SEQ ID NO: 73124 - protein, 9 aa, Homo Sapiens
IYECHVGIS

SEQ ID NO: 73125 - protein, 9 aa, Homo Sapiens
TIVHRAAVR

SEQ ID NO: 73126 - protein, 9 aa, Homo Sapiens
QLLDANRTV

SEQ ID NO: 73127 - protein, 9 aa, Homo Sapiens
LSLAALHDN

SEQ ID NO: 73128 - protein, 9 aa, Homo Sapiens
RTVLDKFSA

SEQ ID NO: 73129 - protein, 9 aa, Homo Sapiens
CAVYSSPLY

SEQ ID NO: 73130 - protein, 9 aa, Homo Sapiens
FAKDGGLVT

SEQ ID NO: 73131 - protein, 9 aa, Homo Sapiens
DVLTPDDVQ

SEQ ID NO: 73132 - protein, 9 aa, Homo Sapiens
LLSLAALHD

SEQ ID NO: 73133 - protein, 9 aa, Homo Sapiens
KYNAKDTIV

SEQ ID NO: 73134 - protein, 9 aa, Homo Sapiens
SALKKKTNK

SEQ ID NO: 73135 - protein, 9 aa, Homo Sapiens
ERCAVYSSP

SEQ ID NO: 73136 - protein, 9 aa, Homo Sapiens
ILTFKKSKD

SEQ ID NO: 73137 - protein, 9 aa, Homo Sapiens
ATKRPAFTW

SEQ ID NO: 73138 - protein, 9 aa, Homo Sapiens
PVRTENCLI

SEQ ID NO: 73139 - protein, 9 aa, Homo Sapiens
MVWESQQEL

SEQ ID NO: 73140 - protein, 9 aa, Homo Sapiens
VFERMNILT

SEQ ID NO: 73141 - protein, 9 aa, Homo Sapiens
SKIDHYMLE

SEQ ID NO: 73142 - protein, 9 aa, Homo Sapiens
CKECTDLLA

SEQ ID NO: 73143 - protein, 9 aa, Homo Sapiens
TLGVENRKK

SEQ ID NO: 73144 - protein, 9 aa, Homo Sapiens
SFALSSDEI

SEQ ID NO: 73145 - protein, 9 aa, Homo Sapiens
CTDLLAQDR

SEQ ID NO: 73146 - protein, 9 aa, Homo Sapiens
PQVKPSSLM

SEQ ID NO: 73147 - protein, 9 aa, Homo Sapiens
ALYQQLVQG

SEQ ID NO: 73148 - protein, 9 aa, Homo Sapiens
SHARRGASR

SEQ ID NO: 73149 - protein, 9 aa, Homo Sapiens
ENCLIVENL

SEQ ID NO: 73150 - protein, 9 aa, Homo Sapiens
VGEVTLGVE

SEQ ID NO: 73151 - protein, 9 aa, Homo Sapiens
GLSLWALET

SEQ ID NO: 73152 - protein, 9 aa, Homo Sapiens
LYQQLVQGN

SEQ ID NO: 73153 - protein, 9 aa, Homo Sapiens
QDTGSCDIQ

SEQ ID NO: 73154 - protein, 9 aa, Homo Sapiens
WALETSREA

SEQ ID NO: 73155 - protein, 9 aa, Homo Sapiens
EPCSVERCA

SEQ ID NO: 73156 - protein, 9 aa, Homo Sapiens
WAAVLAQSK

SEQ ID NO: 73157 - protein, 9 aa, Homo Sapiens
NILTFKKSK

SEQ ID NO: 73158 - protein, 9 aa, Homo Sapiens
LGPSQPGPG

SEQ ID NO: 73159 - protein, 9 aa, Homo Sapiens
KIQEKLLSA

SEQ ID NO: 73160 - protein, 9 aa, Homo Sapiens
LVTSQESGQ

SEQ ID NO: 73161 - protein, 9 aa, Homo Sapiens
KRPAFTWSI

SEQ ID NO: 73162 - protein, 9 aa, Homo Sapiens
SIENHIRLP

SEQ ID NO: 73163 - protein, 9 aa, Homo Sapiens
LRIYECHVG

SEQ ID NO: 73164 - protein, 9 aa, Homo Sapiens
MLEYRRTNF

SEQ ID NO: 73165 - protein, 9 aa, Homo Sapiens
GRWYHIYEN

SEQ ID NO: 73166 - protein, 9 aa, Homo Sapiens
SSTVEPITH

SEQ ID NO: 73167 - protein, 9 aa, Homo Sapiens
YLGPSQPGP

SEQ ID NO: 73168 - protein, 9 aa, Homo Sapiens
PVETSAEAW

SEQ ID NO: 73169 - protein, 9 aa, Homo Sapiens
EIKKNKHLF

SEQ ID NO: 73170 - protein, 9 aa, Homo Sapiens
NVAQFLQYS

SEQ ID NO: 73171 - protein, 9 aa, Homo Sapiens
HARRGASRW

SEQ ID NO: 73172 - protein, 9 aa, Homo Sapiens
VENRKKLQK

SEQ ID NO: 73173 - protein, 9 aa, Homo Sapiens
AVAANQSHA

SEQ ID NO: 73174 - protein, 9 aa, Homo Sapiens
SGKEIKKNK

SEQ ID NO: 73175 - protein, 9 aa, Homo Sapiens
VVGGKIQEK

SEQ ID NO: 73176 - protein, 9 aa, Homo Sapiens
VKPSSLMNP

SEQ ID NO: 73177 - protein, 9 aa, Homo Sapiens
TVEPITHFP

SEQ ID NO: 73178 - protein, 9 aa, Homo Sapiens
STVEPITHF

SEQ ID NO: 73179 - protein, 9 aa, Homo Sapiens
NPDDSKVPS

SEQ ID NO: 73180 - protein, 9 aa, Homo Sapiens
TENCLIVEN

SEQ ID NO: 73181 - protein, 9 aa, Homo Sapiens
DEKSIMTNV

SEQ ID NO: 73182 - protein, 9 aa, Homo Sapiens
SQDRSLDMT

SEQ ID NO: 73183 - protein, 9 aa, Homo Sapiens
DSKVPSSSG

SEQ ID NO: 73184 - protein, 9 aa, Homo Sapiens
LETSREAGA

SEQ ID NO: 73185 - protein, 9 aa, Homo Sapiens
KTKNKHFVC

SEQ ID NO: 73186 - protein, 9 aa, Homo Sapiens
GEVTLGVEN

SEQ ID NO: 73187 - protein, 9 aa, Homo Sapiens
AEAWAAVLA

SEQ ID NO: 73188 - protein, 9 aa, Homo Sapiens
SLDMTVKEP

SEQ ID NO: 73189 - protein, 9 aa, Homo Sapiens
QAKRVNVSE

SEQ ID NO: 73190 - protein, 9 aa, Homo Sapiens
RLDLAGQDL

SEQ ID NO: 73191 - protein, 9 aa, Homo Sapiens
WESQQELGG

SEQ ID NO: 73192 - protein, 9 aa, Homo Sapiens
ELSSTVEPI

SEQ ID NO: 73193 - protein, 9 aa, Homo Sapiens
APPVRTENC

SEQ ID NO: 73194 - protein, 9 aa, Homo Sapiens
KEIKKNKHL

SEQ ID NO: 73195 - protein, 9 aa, Homo Sapiens
QFALYQQLV

SEQ ID NO: 73196 - protein, 9 aa, Homo Sapiens
LVQGNAVGG

SEQ ID NO: 73197 - protein, 9 aa, Homo Sapiens
LKKKTNKQQ

SEQ ID NO: 73198 - protein, 9 aa, Homo Sapiens
QAVDFVNYH

SEQ ID NO: 73199 - protein, 9 aa, Homo Sapiens
EAEKRREEL

SEQ ID NO: 73200 - protein, 9 aa, Homo Sapiens
ANQSHARRG

SEQ ID NO: 73201 - protein, 9 aa, Homo Sapiens
KDTIVHRAA

SEQ ID NO: 73202 - protein, 9 aa, Homo Sapiens
VSMQGSKPD

SEQ ID NO: 73203 - protein, 9 aa, Homo Sapiens
ELKLKAQES

SEQ ID NO: 73204 - protein, 9 aa, Homo Sapiens
RVNVSELAA

SEQ ID NO: 73205 - protein, 9 aa, Homo Sapiens
DGGLVTSQE

SEQ ID NO: 73206 - protein, 9 aa, Homo Sapiens
QELGGQGPR

SEQ ID NO: 73207 - protein, 9 aa, Homo Sapiens
EKSIMTNVA

SEQ ID NO: 73208 - protein, 9 aa, Homo Sapiens
LQVSMQGSK

SEQ ID NO: 73209 - protein, 9 aa, Homo Sapiens
GLVTSQESG

SEQ ID NO: 73210 - protein, 9 aa, Homo Sapiens
QQELGGQGP

SEQ ID NO: 73211 - protein, 9 aa, Homo Sapiens
QVKPSSLMN

SEQ ID NO: 73212 - protein, 9 aa, Homo Sapiens
YQQLVQGNA

SEQ ID NO: 73213 - protein, 9 aa, Homo Sapiens
PLEGRWYHI

SEQ ID NO: 73214 - protein, 9 aa, Homo Sapiens
AGQDLTDYL

SEQ ID NO: 73215 - protein, 9 aa, Homo Sapiens
DPTYDYLGP

SEQ ID NO: 73216 - protein, 9 aa, Homo Sapiens
KSIMTNVAQ

SEQ ID NO: 73217 - protein, 9 aa, Homo Sapiens
GQDLTDYLM

SEQ ID NO: 73218 - protein, 9 aa, Homo Sapiens
VETSAEAWA

SEQ ID NO: 73219 - protein, 9 aa, Homo Sapiens
TSALKKKTN

SEQ ID NO: 73220 - protein, 9 aa, Homo Sapiens
ALKKKTNKQ

SEQ ID NO: 73221 - protein, 9 aa, Homo Sapiens
PCSVERCAV

SEQ ID NO: 73222 - protein, 9 aa, Homo Sapiens
AEENPDDSK

SEQ ID NO: 73223 - protein, 9 aa, Homo Sapiens
PGLSQSFAL

SEQ ID NO: 73224 - protein, 9 aa, Homo Sapiens
GKIQEKLLS

SEQ ID NO: 73225 - protein, 9 aa, Homo Sapiens
YECHVGISS

SEQ ID NO: 73226 - protein, 9 aa, Homo Sapiens
DVQILVEME

SEQ ID NO: 73227 - protein, 9 aa, Homo Sapiens
TSAEAWAAV

SEQ ID NO: 73228 - protein, 9 aa, Homo Sapiens
ASQDRSLDM

SEQ ID NO: 73229 - protein, 9 aa, Homo Sapiens
SAEAWAAVL

SEQ ID NO: 73230 - protein, 9 aa, Homo Sapiens
MKPQVKPSS

SEQ ID NO: 73231 - protein, 9 aa, Homo Sapiens
SQDTGSCDI

SEQ ID NO: 73232 - protein, 9 aa, Homo Sapiens
SLQVSMQGS

SEQ ID NO: 73233 - protein, 9 aa, Homo Sapiens
VERCAVYSS

SEQ ID NO: 73234 - protein, 9 aa, Homo Sapiens
ESQQELGGQ

SEQ ID NO: 73235 - protein, 9 aa, Homo Sapiens
LSLWALETS

SEQ ID NO: 73236 - protein, 9 aa, Homo Sapiens
RCAVYSSPL

SEQ ID NO: 73237 - protein, 9 aa, Homo Sapiens
DRSLDMTVK

SEQ ID NO: 73238 - protein, 9 aa, Homo Sapiens
TPDDVQILV

SEQ ID NO: 73239 - protein, 9 aa, Homo Sapiens
FERMNILTF

SEQ ID NO: 73240 - protein, 9 aa, Homo Sapiens
LKTQAVDFV

SEQ ID NO: 73241 - protein, 9 aa, Homo Sapiens
EAWAAVLAQ

SEQ ID NO: 73242 - protein, 9 aa, Homo Sapiens
LHDNHTHSD

SEQ ID NO: 73243 - protein, 9 aa, Homo Sapiens
CDIQEDGKL

SEQ ID NO: 73244 - protein, 9 aa, Homo Sapiens
PPATKRPAF

SEQ ID NO: 73245 - protein, 9 aa, Homo Sapiens
KRREELKLK

SEQ ID NO: 73246 - protein, 9 aa, Homo Sapiens
SASKTKTKN

SEQ ID NO: 73247 - protein, 9 aa, Homo Sapiens
DSKIDHYML

SEQ ID NO: 73248 - protein, 9 aa, Homo Sapiens
TNVAQFLQY

SEQ ID NO: 73249 - protein, 9 aa, Homo Sapiens
SMQGSKPDK

SEQ ID NO: 73250 - protein, 9 aa, Homo Sapiens
GVVGGKIQE

SEQ ID NO: 73251 - protein, 9 aa, Homo Sapiens
YDYLGPSQP

SEQ ID NO: 73252 - protein, 9 aa, Homo Sapiens
VQILVEMED

SEQ ID NO: 73253 - protein, 9 aa, Homo Sapiens
SSQDTGSCD

SEQ ID NO: 73254 - protein, 9 aa, Homo Sapiens
KTKTKNKHF

SEQ ID NO: 73255 - protein, 9 aa, Homo Sapiens
DDSKVPSSS

SEQ ID NO: 73256 - protein, 9 aa, Homo Sapiens
LTPDDVQIL

SEQ ID NO: 73257 - protein, 9 aa, Homo Sapiens
TQAVDFVNY

SEQ ID NO: 73258 - protein, 9 aa, Homo Sapiens
GSCDIQEDG

SEQ ID NO: 73259 - protein, 9 aa, Homo Sapiens
MRLDLAGQD

SEQ ID NO: 73260 - protein, 9 aa, Homo Sapiens
LWALETSRE

SEQ ID NO: 73261 - protein, 9 aa, Homo Sapiens
KDGGLVTSQ

SEQ ID NO: 73262 - protein, 9 aa, Homo Sapiens
QNTMEDTFI

SEQ ID NO: 73263 - protein, 9 aa, Homo Sapiens
EDTFIVCLN

SEQ ID NO: 73264 - protein, 9 aa, Homo Sapiens
PTYDYLGPS

SEQ ID NO: 73265 - protein, 9 aa, Homo Sapiens
DANRTVLDK

SEQ ID NO: 73266 - protein, 9 aa, Homo Sapiens
QVSMQGSKP

SEQ ID NO: 73267 - protein, 9 aa, Homo Sapiens
TPGLSQSFA

SEQ ID NO: 73268 - protein, 9 aa, Homo Sapiens
TKNKHFVCQ

SEQ ID NO: 73269 - protein, 9 aa, Homo Sapiens
AALHDNHTH

SEQ ID NO: 73270 - protein, 9 aa, Homo Sapiens
SQSFALSSD

SEQ ID NO: 73271 - protein, 9 aa, Homo Sapiens
ELGGQGPRR

SEQ ID NO: 73272 - protein, 9 aa, Homo Sapiens
DTFIVCLNK

SEQ ID NO: 73273 - protein, 9 aa, Homo Sapiens
VTSALKKKT

SEQ ID NO: 73274 - protein, 9 aa, Homo Sapiens
IRLPVVKVV

SEQ ID NO: 73275 - protein, 9 aa, Homo Sapiens
IDHYMLEYR

SEQ ID NO: 73276 - protein, 9 aa, Homo Sapiens
PVVKVVVLG

SEQ ID NO: 73277 - protein, 9 aa, Homo Sapiens
IENHIRLPV

SEQ ID NO: 73278 - protein, 9 aa, Homo Sapiens
GVENRKKLQ

SEQ ID NO: 73279 - protein, 9 aa, Homo Sapiens
VGGKIQEKL

SEQ ID NO: 73280 - protein, 9 aa, Homo Sapiens
KNKHLFGLR

SEQ ID NO: 73281 - protein, 9 aa, Homo Sapiens
EVKPLEGRW

SEQ ID NO: 73282 - protein, 9 aa, Homo Sapiens
SLAALHDNH

SEQ ID NO: 73283 - protein, 9 aa, Homo Sapiens
NTMEDTFIV

SEQ ID NO: 73284 - protein, 9 aa, Homo Sapiens
NAKDTIVHR

SEQ ID NO: 73285 - protein, 9 aa, Homo Sapiens
LSSASTGDS

SEQ ID NO: 73286 - protein, 9 aa, Homo Sapiens
LGVENRKKL

SEQ ID NO: 73287 - protein, 9 aa, Homo Sapiens
ERMNILTFK

SEQ ID NO: 73288 - protein, 9 aa, Homo Sapiens
DMTVKEPSN

SEQ ID NO: 73289 - protein, 9 aa, Homo Sapiens
KQICKECTD

SEQ ID NO: 73290 - protein, 9 aa, Homo Sapiens
RWYHIYENG

SEQ ID NO: 73291 - protein, 9 aa, Homo Sapiens
VNVSELAAE

SEQ ID NO: 73292 - protein, 9 aa, Homo Sapiens
GGLVTSQES

SEQ ID NO: 73293 - protein, 9 aa, Homo Sapiens
LGGQGPRRQ

SEQ ID NO: 73294 - protein, 9 aa, Homo Sapiens
VQGNAVGGS

SEQ ID NO: 73295 - protein, 9 aa, Homo Sapiens
NKHFVCQKV

SEQ ID NO: 73296 - protein, 9 aa, Homo Sapiens
QHQNTMEDT

SEQ ID NO: 73297 - protein, 9 aa, Homo Sapiens
DFVNYHASD

SEQ ID NO: 73298 - protein, 9 aa, Homo Sapiens
QSHARRGAS

SEQ ID NO: 73299 - protein, 9 aa, Homo Sapiens
QLVQGNAVG

SEQ ID NO: 73300 - protein, 9 aa, Homo Sapiens
ANRTVLDKF

SEQ ID NO: 73301 - protein, 9 aa, Homo Sapiens
LDLAGQDLT

SEQ ID NO: 73302 - protein, 9 aa, Homo Sapiens
EEDPTYDYL

SEQ ID NO: 73303 - protein, 9 aa, Homo Sapiens
IMRLDLAGQ

SEQ ID NO: 73304 - protein, 9 aa, Homo Sapiens
ALHDNHTHS

SEQ ID NO: 73305 - protein, 9 aa, Homo Sapiens
AANQSHARR

SEQ ID NO: 73306 - protein, 9 aa, Homo Sapiens
RSLDMTVKE

SEQ ID NO: 73307 - protein, 9 aa, Homo Sapiens
AAGVVGGKI

SEQ ID NO: 73308 - protein, 9 aa, Homo Sapiens
KVTSALKKK

SEQ ID NO: 73309 - protein, 9 aa, Homo Sapiens
FLLSLAALH

SEQ ID NO: 73310 - protein, 9 aa, Homo Sapiens
MTNVAQFLQ

SEQ ID NO: 73311 - protein, 9 aa, Homo Sapiens
KKNKHLFGL

SEQ ID NO: 73312 - protein, 9 aa, Homo Sapiens
KNKHFVCQK

SEQ ID NO: 73313 - protein, 9 aa, Homo Sapiens
WYHIYENGT

SEQ ID NO: 73314 - protein, 9 aa, Homo Sapiens
EFGGNLTLH

SEQ ID NO: 73315 - protein, 9 aa, Homo Sapiens
ILRQEVALF

SEQ ID NO: 73316 - protein, 9 aa, Homo Sapiens
SVFGRVSRL

SEQ ID NO: 73317 - protein, 9 aa, Homo Sapiens
GKYQVLLEL

SEQ ID NO: 73318 - protein, 9 aa, Homo Sapiens
DPVLFEPVY

SEQ ID NO: 73319 - protein, 9 aa, Homo Sapiens
AEKSSGFQT

SEQ ID NO: 73320 - protein, 9 aa, Homo Sapiens
EAKQDGIGE

SEQ ID NO: 73321 - protein, 9 aa, Homo Sapiens
RKGNEKEIQ

SEQ ID NO: 73322 - protein, 9 aa, Homo Sapiens
EDTILTKSD

SEQ ID NO: 73323 - protein, 9 aa, Homo Sapiens
QRICLKRAE

SEQ ID NO: 73324 - protein, 9 aa, Homo Sapiens
EPRKPVEKA

SEQ ID NO: 73325 - protein, 9 aa, Homo Sapiens
EMLFFRNAI

SEQ ID NO: 73326 - protein, 9 aa, Homo Sapiens
ERVQGLKQQ

SEQ ID NO: 73327 - protein, 9 aa, Homo Sapiens
HRKIHTGKK

SEQ ID NO: 73328 - protein, 9 aa, Homo Sapiens
GLIVLQQLN

SEQ ID NO: 73329 - protein, 9 aa, Homo Sapiens
EFFVDKHSA

SEQ ID NO: 73330 - protein, 9 aa, Homo Sapiens
TVSGEASPP

SEQ ID NO: 73331 - protein, 9 aa, Homo Sapiens
FAIFRTFGH

SEQ ID NO: 73332 - protein, 9 aa, Homo Sapiens
AIISYVLTS

SEQ ID NO: 73333 - protein, 9 aa, Homo Sapiens
PCSQTSFLS

SEQ ID NO: 73334 - protein, 9 aa, Homo Sapiens
VHMRTAYKY

SEQ ID NO: 73335 - protein, 9 aa, Homo Sapiens
QEFLANARA

SEQ ID NO: 73336 - protein, 9 aa, Homo Sapiens
YSAFYLGHL

SEQ ID NO: 73337 - protein, 9 aa, Homo Sapiens
DNEQVGSES

SEQ ID NO: 73338 - protein, 9 aa, Homo Sapiens
RICIIFIWI

SEQ ID NO: 73339 - protein, 9 aa, Homo Sapiens
DCQVSSFRV

SEQ ID NO: 73340 - protein, 9 aa, Homo Sapiens
HLHVSTRTR

SEQ ID NO: 73341 - protein, 9 aa, Homo Sapiens
KAVFVGRPM

SEQ ID NO: 73342 - protein, 9 aa, Homo Sapiens
VTGGANNFA

SEQ ID NO: 73343 - protein, 9 aa, Homo Sapiens
NMYNALCKT

SEQ ID NO: 73344 - protein, 9 aa, Homo Sapiens
HYKIKVWNY

SEQ ID NO: 73345 - protein, 9 aa, Homo Sapiens
TFGPLRCQK

SEQ ID NO: 73346 - protein, 9 aa, Homo Sapiens
GPWVTVTSA

SEQ ID NO: 73347 - protein, 9 aa, Homo Sapiens
CDAGFMLSA

SEQ ID NO: 73348 - protein, 9 aa, Homo Sapiens
VYFYYKEKD

SEQ ID NO: 73349 - protein, 9 aa, Homo Sapiens
RRPGASVHD

SEQ ID NO: 73350 - protein, 9 aa, Homo Sapiens
VCSNTDEDN

SEQ ID NO: 73351 - protein, 9 aa, Homo Sapiens
RLREVVSEN

SEQ ID NO: 73352 - protein, 9 aa, Homo Sapiens
LQQGGLRAA

SEQ ID NO: 73353 - protein, 9 aa, Homo Sapiens
KSATVPDQE

SEQ ID NO: 73354 - protein, 9 aa, Homo Sapiens
IQLAQGMEY

SEQ ID NO: 73355 - protein, 9 aa, Homo Sapiens
LDAGSGKPP

SEQ ID NO: 73356 - protein, 9 aa, Homo Sapiens
EKLKEKIMD

SEQ ID NO: 73357 - protein, 9 aa, Homo Sapiens
DLIWGLAGF

SEQ ID NO: 73358 - protein, 9 aa, Homo Sapiens
LCLIDERIH

SEQ ID NO: 73359 - protein, 9 aa, Homo Sapiens
YDFNSNAFP

SEQ ID NO: 73360 - protein, 9 aa, Homo Sapiens
NNFGSVARM

SEQ ID NO: 73361 - protein, 9 aa, Homo Sapiens
PKIFENPRR

SEQ ID NO: 73362 - protein, 9 aa, Homo Sapiens
AVKDKLPQS

SEQ ID NO: 73363 - protein, 9 aa, Homo Sapiens
QANPDLDSD

SEQ ID NO: 73364 - protein, 9 aa, Homo Sapiens
ANVCYDVLS

SEQ ID NO: 73365 - protein, 9 aa, Homo Sapiens
IKKQGSLDL

SEQ ID NO: 73366 - protein, 9 aa, Homo Sapiens
LARERGSLD

SEQ ID NO: 73367 - protein, 9 aa, Homo Sapiens
APCMGPNYG

SEQ ID NO: 73368 - protein, 9 aa, Homo Sapiens
YQPTNKGKY

SEQ ID NO: 73369 - protein, 9 aa, Homo Sapiens
QLSKGKNVT

SEQ ID NO: 73370 - protein, 9 aa, Homo Sapiens
IGQIVFSLA

SEQ ID NO: 73371 - protein, 9 aa, Homo Sapiens
PGNHILHCP

SEQ ID NO: 73372 - protein, 9 aa, Homo Sapiens
SPEVSEMLE

SEQ ID NO: 73373 - protein, 9 aa, Homo Sapiens
NQPCIPGIK

SEQ ID NO: 73374 - protein, 9 aa, Homo Sapiens
ADTQLMLAV

SEQ ID NO: 73375 - protein, 9 aa, Homo Sapiens
KANSKVAQW

SEQ ID NO: 73376 - protein, 9 aa, Homo Sapiens
YMWPFEKPN

SEQ ID NO: 73377 - protein, 9 aa, Homo Sapiens
SELQYDMKK

SEQ ID NO: 73378 - protein, 9 aa, Homo Sapiens
VMVYKFYFH

SEQ ID NO: 73379 - protein, 9 aa, Homo Sapiens
TASKVTAAA

SEQ ID NO: 73380 - protein, 9 aa, Homo Sapiens
HYYKEEASD

SEQ ID NO: 73381 - protein, 9 aa, Homo Sapiens
AKFEISLPV

SEQ ID NO: 73382 - protein, 9 aa, Homo Sapiens
LSKANSKVA

SEQ ID NO: 73383 - protein, 9 aa, Homo Sapiens
GVPTIQSDI

SEQ ID NO: 73384 - protein, 9 aa, Homo Sapiens
MLSADRCVP

SEQ ID NO: 73385 - protein, 9 aa, Homo Sapiens
LHAGNRQAC

SEQ ID NO: 73386 - protein, 9 aa, Homo Sapiens
VASLFYANT

SEQ ID NO: 73387 - protein, 9 aa, Homo Sapiens
FQVQLQQYR

SEQ ID NO: 73388 - protein, 9 aa, Homo Sapiens
MDKPMFTQP

SEQ ID NO: 73389 - protein, 9 aa, Homo Sapiens
FPMKWSPPE

SEQ ID NO: 73390 - protein, 9 aa, Homo Sapiens
TLRIIYNQV

SEQ ID NO: 73391 - protein, 9 aa, Homo Sapiens
YNVQAPPPS

SEQ ID NO: 73392 - protein, 9 aa, Homo Sapiens
IMEFGGNLT

SEQ ID NO: 73393 - protein, 9 aa, Homo Sapiens
SFRHCIIKT

SEQ ID NO: 73394 - protein, 9 aa, Homo Sapiens
PVMLPSYDK

SEQ ID NO: 73395 - protein, 9 aa, Homo Sapiens
LHVLLPQSP

SEQ ID NO: 73396 - protein, 9 aa, Homo Sapiens
NIEIVIKMF

SEQ ID NO: 73397 - protein, 9 aa, Homo Sapiens
GGGGGEAAA

SEQ ID NO: 73398 - protein, 9 aa, Homo Sapiens
TLSFLPTCG

SEQ ID NO: 73399 - protein, 9 aa, Homo Sapiens
NFSEDVLCK

SEQ ID NO: 73400 - protein, 9 aa, Homo Sapiens
NSKVAQWRT

SEQ ID NO: 73401 - protein, 9 aa, Homo Sapiens
VALWDLINL

SEQ ID NO: 73402 - protein, 9 aa, Homo Sapiens
TLMRLCWAS

SEQ ID NO: 73403 - protein, 9 aa, Homo Sapiens
IKSPSQDKM

SEQ ID NO: 73404 - protein, 9 aa, Homo Sapiens
QPWPQAWDD

SEQ ID NO: 73405 - protein, 9 aa, Homo Sapiens
AEEYGAGTY

SEQ ID NO: 73406 - protein, 9 aa, Homo Sapiens
SGKPPMDYH

SEQ ID NO: 73407 - protein, 9 aa, Homo Sapiens
GKLRDRLQG

SEQ ID NO: 73408 - protein, 9 aa, Homo Sapiens
EETNDNIEI

SEQ ID NO: 73409 - protein, 9 aa, Homo Sapiens
LWRGPGNHI

SEQ ID NO: 73410 - protein, 9 aa, Homo Sapiens
KRKAPPPPM

SEQ ID NO: 73411 - protein, 9 aa, Homo Sapiens
SLNKYTKTV

SEQ ID NO: 73412 - protein, 9 aa, Homo Sapiens
ESENNSLYL

SEQ ID NO: 73413 - protein, 9 aa, Homo Sapiens
LRFWVNVMK

SEQ ID NO: 73414 - protein, 9 aa, Homo Sapiens
HRVLSCESS

SEQ ID NO: 73415 - protein, 9 aa, Homo Sapiens
GARQLHVLL

SEQ ID NO: 73416 - protein, 9 aa, Homo Sapiens
AEKMEKMEQ

SEQ ID NO: 73417 - protein, 9 aa, Homo Sapiens
KGVLLDYLV

SEQ ID NO: 73418 - protein, 9 aa, Homo Sapiens
KAQEEGYFE

SEQ ID NO: 73419 - protein, 9 aa, Homo Sapiens
ELCAELGRA

SEQ ID NO: 73420 - protein, 9 aa, Homo Sapiens
CVHMVISEL

SEQ ID NO: 73421 - protein, 9 aa, Homo Sapiens
CITVPLLRE

SEQ ID NO: 73422 - protein, 9 aa, Homo Sapiens
IGFQREWHK

SEQ ID NO: 73423 - protein, 9 aa, Homo Sapiens
AVVVVVDIG

SEQ ID NO: 73424 - protein, 9 aa, Homo Sapiens
FSEDVLCKF

SEQ ID NO: 73425 - protein, 9 aa, Homo Sapiens
ENQARFYFQ

SEQ ID NO: 73426 - protein, 9 aa, Homo Sapiens
LPKEEEGIT

SEQ ID NO: 73427 - protein, 9 aa, Homo Sapiens
AKLTPNYDK

SEQ ID NO: 73428 - protein, 9 aa, Homo Sapiens
WPLYMWPFE

SEQ ID NO: 73429 - protein, 9 aa, Homo Sapiens
TKEESEHEV

SEQ ID NO: 73430 - protein, 9 aa, Homo Sapiens
LTQRICLKR

SEQ ID NO: 73431 - protein, 9 aa, Homo Sapiens
PLELQEITF

SEQ ID NO: 73432 - protein, 9 aa, Homo Sapiens
LPSVQHPNE

SEQ ID NO: 73433 - protein, 9 aa, Homo Sapiens
SRSHSRGRK

SEQ ID NO: 73434 - protein, 9 aa, Homo Sapiens
YSVSCGIQL

SEQ ID NO: 73435 - protein, 9 aa, Homo Sapiens
PDRQEEAPP

SEQ ID NO: 73436 - protein, 9 aa, Homo Sapiens
HCPGARHIY

SEQ ID NO: 73437 - protein, 9 aa, Homo Sapiens
EMDILFHSS

SEQ ID NO: 73438 - protein, 9 aa, Homo Sapiens
AIEENLQPW

SEQ ID NO: 73439 - protein, 9 aa, Homo Sapiens
KQGSLDLAL

SEQ ID NO: 73440 - protein, 9 aa, Homo Sapiens
KDTMSGRPW

SEQ ID NO: 73441 - protein, 9 aa, Homo Sapiens
VENKSWKKI

SEQ ID NO: 73442 - protein, 9 aa, Homo Sapiens
SENQARFYF

SEQ ID NO: 73443 - protein, 9 aa, Homo Sapiens
SGCEARRNE

SEQ ID NO: 73444 - protein, 9 aa, Homo Sapiens
MAFDALVTL

SEQ ID NO: 73445 - protein, 9 aa, Homo Sapiens
SMASNYTSR

SEQ ID NO: 73446 - protein, 9 aa, Homo Sapiens
GVKFLCQGL

SEQ ID NO: 73447 - protein, 9 aa, Homo Sapiens
YDEGLPKEE

SEQ ID NO: 73448 - protein, 9 aa, Homo Sapiens
NAVSCQEDT

SEQ ID NO: 73449 - protein, 9 aa, Homo Sapiens
PQFEAFAGW

SEQ ID NO: 73450 - protein, 9 aa, Homo Sapiens
SSIKYSNSM

SEQ ID NO: 73451 - protein, 9 aa, Homo Sapiens
AQKTGLSPS

SEQ ID NO: 73452 - protein, 9 aa, Homo Sapiens
GSLATPDQS

SEQ ID NO: 73453 - protein, 9 aa, Homo Sapiens
NVLQKNSKR

SEQ ID NO: 73454 - protein, 9 aa, Homo Sapiens
GGPWVTVTS

SEQ ID NO: 73455 - protein, 9 aa, Homo Sapiens
LSFLPTCGH

SEQ ID NO: 73456 - protein, 9 aa, Homo Sapiens
IQPQLPNGC

SEQ ID NO: 73457 - protein, 9 aa, Homo Sapiens
NAIISYVLT

SEQ ID NO: 73458 - protein, 9 aa, Homo Sapiens
VDKHSAVWV

SEQ ID NO: 73459 - protein, 9 aa, Homo Sapiens
MATVWDEAK

SEQ ID NO: 73460 - protein, 9 aa, Homo Sapiens
SCCAPVYCR

SEQ ID NO: 73461 - protein, 9 aa, Homo Sapiens
IQGELVKSN

SEQ ID NO: 73462 - protein, 9 aa, Homo Sapiens
PPMLDLLKS

SEQ ID NO: 73463 - protein, 9 aa, Homo Sapiens
VFSLAAVFL

SEQ ID NO: 73464 - protein, 9 aa, Homo Sapiens
PNKVDKEYK

SEQ ID NO: 73465 - protein, 9 aa, Homo Sapiens
DFSTAIVDS

SEQ ID NO: 73466 - protein, 9 aa, Homo Sapiens
KTGLSPSPS

SEQ ID NO: 73467 - protein, 9 aa, Homo Sapiens
SKREATNVK

SEQ ID NO: 73468 - protein, 9 aa, Homo Sapiens
SCGELMKSK

SEQ ID NO: 73469 - protein, 9 aa, Homo Sapiens
PEEELDFFL

SEQ ID NO: 73470 - protein, 9 aa, Homo Sapiens
FCRVLKNRA

SEQ ID NO: 73471 - protein, 9 aa, Homo Sapiens
PKKQPDDSR

SEQ ID NO: 73472 - protein, 9 aa, Homo Sapiens
GSEVLLSPK

SEQ ID NO: 73473 - protein, 9 aa, Homo Sapiens
LCEELGCRH

SEQ ID NO: 73474 - protein, 9 aa, Homo Sapiens
SYQPTNKGK

SEQ ID NO: 73475 - protein, 9 aa, Homo Sapiens
AVGLIEKDT

SEQ ID NO: 73476 - protein, 9 aa, Homo Sapiens
TPLPEEVNR

SEQ ID NO: 73477 - protein, 9 aa, Homo Sapiens
TFPSVAPLE

SEQ ID NO: 73478 - protein, 9 aa, Homo Sapiens
PNSHLHVST

SEQ ID NO: 73479 - protein, 9 aa, Homo Sapiens
CGQSSCCAP

SEQ ID NO: 73480 - protein, 9 aa, Homo Sapiens
IREIDLSVN

SEQ ID NO: 73481 - protein, 9 aa, Homo Sapiens
RLRQENKNL

SEQ ID NO: 73482 - protein, 9 aa, Homo Sapiens
ELVKSNCGA

SEQ ID NO: 73483 - protein, 9 aa, Homo Sapiens
VWDEAKQDG

SEQ ID NO: 73484 - protein, 9 aa, Homo Sapiens
ETFNEDNSD

SEQ ID NO: 73485 - protein, 9 aa, Homo Sapiens
SRGRKGLRP

SEQ ID NO: 73486 - protein, 9 aa, Homo Sapiens
GVQSPERSR

SEQ ID NO: 73487 - protein, 9 aa, Homo Sapiens
ALLGLSISK

SEQ ID NO: 73488 - protein, 9 aa, Homo Sapiens
LNKYTKTVF

SEQ ID NO: 73489 - protein, 9 aa, Homo Sapiens
IKVCSLTGQ

SEQ ID NO: 73490 - protein, 9 aa, Homo Sapiens
GGGGKARGG

SEQ ID NO: 73491 - protein, 9 aa, Homo Sapiens
QSDIPAPRI

SEQ ID NO: 73492 - protein, 9 aa, Homo Sapiens
RLEQEFLAN

SEQ ID NO: 73493 - protein, 9 aa, Homo Sapiens
VLQKNSKRY

SEQ ID NO: 73494 - protein, 9 aa, Homo Sapiens
GKLSPWKGK

SEQ ID NO: 73495 - protein, 9 aa, Homo Sapiens
IPAHYVYLQ

SEQ ID NO: 73496 - protein, 9 aa, Homo Sapiens
DSSDPQGLE

SEQ ID NO: 73497 - protein, 9 aa, Homo Sapiens
HIQGELVKS

SEQ ID NO: 73498 - protein, 9 aa, Homo Sapiens
DDNEERLRA

SEQ ID NO: 73499 - protein, 9 aa, Homo Sapiens
GARGKLSPW

SEQ ID NO: 73500 - protein, 9 aa, Homo Sapiens
KRVEVSEDL

SEQ ID NO: 73501 - protein, 9 aa, Homo Sapiens
AVPPNKVDK

SEQ ID NO: 73502 - protein, 9 aa, Homo Sapiens
YYKEKDDDD

SEQ ID NO: 73503 - protein, 9 aa, Homo Sapiens
EQFCFKFCI

SEQ ID NO: 73504 - protein, 9 aa, Homo Sapiens
RGFGLALTL

SEQ ID NO: 73505 - protein, 9 aa, Homo Sapiens
IWENEFSFE

SEQ ID NO: 73506 - protein, 9 aa, Homo Sapiens
EDLWRGPGN

SEQ ID NO: 73507 - protein, 9 aa, Homo Sapiens
MSPTQLSDV

SEQ ID NO: 73508 - protein, 9 aa, Homo Sapiens
AAVAPYGYT

SEQ ID NO: 73509 - protein, 9 aa, Homo Sapiens
CNKVVDTCL

SEQ ID NO: 73510 - protein, 9 aa, Homo Sapiens
DPRYPRSSM

SEQ ID NO: 73511 - protein, 9 aa, Homo Sapiens
EYFIIQYQD

SEQ ID NO: 73512 - protein, 9 aa, Homo Sapiens
DAGSGKPPM

SEQ ID NO: 73513 - protein, 9 aa, Homo Sapiens
DYDFNSNAF

SEQ ID NO: 73514 - protein, 9 aa, Homo Sapiens
SQHLVHVVV

SEQ ID NO: 73515 - protein, 9 aa, Homo Sapiens
FLRLFNVTP

SEQ ID NO: 73516 - protein, 9 aa, Homo Sapiens
SDPQGLEAA

SEQ ID NO: 73517 - protein, 9 aa, Homo Sapiens
AGSYQVKFQ

SEQ ID NO: 73518 - protein, 9 aa, Homo Sapiens
RDYNVQAPP

SEQ ID NO: 73519 - protein, 9 aa, Homo Sapiens
DDLEKVCNK

SEQ ID NO: 73520 - protein, 9 aa, Homo Sapiens
PLLDCVRTA

SEQ ID NO: 73521 - protein, 9 aa, Homo Sapiens
KQDGIGEEV

SEQ ID NO: 73522 - protein, 9 aa, Homo Sapiens
TLLRHWRSH

SEQ ID NO: 73523 - protein, 9 aa, Homo Sapiens
SLPVANDSY

SEQ ID NO: 73524 - protein, 9 aa, Homo Sapiens
DAKELERRA

SEQ ID NO: 73525 - protein, 9 aa, Homo Sapiens
MPPYGSLQG

SEQ ID NO: 73526 - protein, 9 aa, Homo Sapiens
SRCHAATLA

SEQ ID NO: 73527 - protein, 9 aa, Homo Sapiens
KQASATMVY

SEQ ID NO: 73528 - protein, 9 aa, Homo Sapiens
QRFGPPISR

SEQ ID NO: 73529 - protein, 9 aa, Homo Sapiens
KLWSNKLIT

SEQ ID NO: 73530 - protein, 9 aa, Homo Sapiens
YPKPKVQWT

SEQ ID NO: 73531 - protein, 9 aa, Homo Sapiens
SKANSKVAQ

SEQ ID NO: 73532 - protein, 9 aa, Homo Sapiens
HKGMPLEKV

SEQ ID NO: 73533 - protein, 9 aa, Homo Sapiens
GELFHRIVE

SEQ ID NO: 73534 - protein, 9 aa, Homo Sapiens
GGGKARGGT

SEQ ID NO: 73535 - protein, 9 aa, Homo Sapiens
TVSFKSLKH

SEQ ID NO: 73536 - protein, 9 aa, Homo Sapiens
APSFLLGVG

SEQ ID NO: 73537 - protein, 9 aa, Homo Sapiens
SYKKFCRVL

SEQ ID NO: 73538 - protein, 9 aa, Homo Sapiens
QRALPILNV

SEQ ID NO: 73539 - protein, 9 aa, Homo Sapiens
GKCQLLRRA

SEQ ID NO: 73540 - protein, 9 aa, Homo Sapiens
VVSTASKVT

SEQ ID NO: 73541 - protein, 9 aa, Homo Sapiens
GGDHYKIKV

SEQ ID NO: 73542 - protein, 9 aa, Homo Sapiens
RQEVALFDK

SEQ ID NO: 73543 - protein, 9 aa, Homo Sapiens
YLLLHYTAH

SEQ ID NO: 73544 - protein, 9 aa, Homo Sapiens
DALVTLCEE

SEQ ID NO: 73545 - protein, 9 aa, Homo Sapiens
EKVERLVAQ

SEQ ID NO: 73546 - protein, 9 aa, Homo Sapiens
STYFQTIND

SEQ ID NO: 73547 - protein, 9 aa, Homo Sapiens
HINSSDAEE

SEQ ID NO: 73548 - protein, 9 aa, Homo Sapiens
RVFLSFRHC

SEQ ID NO: 73549 - protein, 9 aa, Homo Sapiens
GLALPPTHS

SEQ ID NO: 73550 - protein, 9 aa, Homo Sapiens
QPCIPGIKP

SEQ ID NO: 73551 - protein, 9 aa, Homo Sapiens
DKPEFFIDM

SEQ ID NO: 73552 - protein, 9 aa, Homo Sapiens
LMRLCWASE

SEQ ID NO: 73553 - protein, 9 aa, Homo Sapiens
FFCAYKSHF

SEQ ID NO: 73554 - protein, 9 aa, Homo Sapiens
LAPPPPEID

SEQ ID NO: 73555 - protein, 9 aa, Homo Sapiens
LQYDMKKYQ

SEQ ID NO: 73556 - protein, 9 aa, Homo Sapiens
FQTQSAPGP

SEQ ID NO: 73557 - protein, 9 aa, Homo Sapiens
TFNEDNSDI

SEQ ID NO: 73558 - protein, 9 aa, Homo Sapiens
SQVESASKQ

SEQ ID NO: 73559 - protein, 9 aa, Homo Sapiens
SEKSVHSFQ

SEQ ID NO: 73560 - protein, 9 aa, Homo Sapiens
APDRQEEAP

SEQ ID NO: 73561 - protein, 9 aa, Homo Sapiens
RLGKPLILK

SEQ ID NO: 73562 - protein, 9 aa, Homo Sapiens
CRVLKNRAW

SEQ ID NO: 73563 - protein, 9 aa, Homo Sapiens
VSENHGDHL

SEQ ID NO: 73564 - protein, 9 aa, Homo Sapiens
QLYKQASAT

SEQ ID NO: 73565 - protein, 9 aa, Homo Sapiens
SWQVDDCPD

SEQ ID NO: 73566 - protein, 9 aa, Homo Sapiens
LSLMKDCFQ

SEQ ID NO: 73567 - protein, 9 aa, Homo Sapiens
LAAREDRLQ

SEQ ID NO: 73568 - protein, 9 aa, Homo Sapiens
LREVVSENH

SEQ ID NO: 73569 - protein, 9 aa, Homo Sapiens
AIKAGLELL

SEQ ID NO: 73570 - protein, 9 aa, Homo Sapiens
SSPEVSEML

SEQ ID NO: 73571 - protein, 9 aa, Homo Sapiens
FLLGVGGRA

SEQ ID NO: 73572 - protein, 9 aa, Homo Sapiens
ELFYETEAR

SEQ ID NO: 73573 - protein, 9 aa, Homo Sapiens
ESLRLQLLE

SEQ ID NO: 73574 - protein, 9 aa, Homo Sapiens
DGDWEKENE

SEQ ID NO: 73575 - protein, 9 aa, Homo Sapiens
RRYQKSTKL

SEQ ID NO: 73576 - protein, 9 aa, Homo Sapiens
NAIPPMLDL

SEQ ID NO: 73577 - protein, 9 aa, Homo Sapiens
QDEGTKAEP

SEQ ID NO: 73578 - protein, 9 aa, Homo Sapiens
SEGSWAEQA

SEQ ID NO: 73579 - protein, 9 aa, Homo Sapiens
KDKTQKVQM

SEQ ID NO: 73580 - protein, 9 aa, Homo Sapiens
HQTWRFGAA

SEQ ID NO: 73581 - protein, 9 aa, Homo Sapiens
KNLARRLES

SEQ ID NO: 73582 - protein, 9 aa, Homo Sapiens
KEESEHEVS

SEQ ID NO: 73583 - protein, 9 aa, Homo Sapiens
KENEATGEL

SEQ ID NO: 73584 - protein, 9 aa, Homo Sapiens
ELADVLVRL

SEQ ID NO: 73585 - protein, 9 aa, Homo Sapiens
SEGSYPCSH

SEQ ID NO: 73586 - protein, 9 aa, Homo Sapiens
KDIIVINVD

SEQ ID NO: 73587 - protein, 9 aa, Homo Sapiens
INAVSCQED

SEQ ID NO: 73588 - protein, 9 aa, Homo Sapiens
VSKAQEAAQ

SEQ ID NO: 73589 - protein, 9 aa, Homo Sapiens
WENAKMNFN

SEQ ID NO: 73590 - protein, 9 aa, Homo Sapiens
EEKEEEAAT

SEQ ID NO: 73591 - protein, 9 aa, Homo Sapiens
HCIIKTYKM

SEQ ID NO: 73592 - protein, 9 aa, Homo Sapiens
PSVAPLELQ

SEQ ID NO: 73593 - protein, 9 aa, Homo Sapiens
LDANMYNAL

SEQ ID NO: 73594 - protein, 9 aa, Homo Sapiens
RKAPPPPMS

SEQ ID NO: 73595 - protein, 9 aa, Homo Sapiens
CRLRICIIF

SEQ ID NO: 73596 - protein, 9 aa, Homo Sapiens
SHLHVSTRT

SEQ ID NO: 73597 - protein, 9 aa, Homo Sapiens
ADYSAFGTH

SEQ ID NO: 73598 - protein, 9 aa, Homo Sapiens
LCQGLRYPE

SEQ ID NO: 73599 - protein, 9 aa, Homo Sapiens
FGAKFPMKW

SEQ ID NO: 73600 - protein, 9 aa, Homo Sapiens
FQKAKAQEE

SEQ ID NO: 73601 - protein, 9 aa, Homo Sapiens
YLGSCGKFL

SEQ ID NO: 73602 - protein, 9 aa, Homo Sapiens
EHINSSDAE

SEQ ID NO: 73603 - protein, 9 aa, Homo Sapiens
SKAAVQVLD

SEQ ID NO: 73604 - protein, 9 aa, Homo Sapiens
EAQVDNSKQ

SEQ ID NO: 73605 - protein, 9 aa, Homo Sapiens
WGAAGCTFG

SEQ ID NO: 73606 - protein, 9 aa, Homo Sapiens
AAARFYQLD

SEQ ID NO: 73607 - protein, 9 aa, Homo Sapiens
NISDLERHC

SEQ ID NO: 73608 - protein, 9 aa, Homo Sapiens
STDAEKIQC

SEQ ID NO: 73609 - protein, 9 aa, Homo Sapiens
QGGPWVTVT

SEQ ID NO: 73610 - protein, 9 aa, Homo Sapiens
GFQREWHKF

SEQ ID NO: 73611 - protein, 9 aa, Homo Sapiens
EDHDLWNRV

SEQ ID NO: 73612 - protein, 9 aa, Homo Sapiens
FQDFRPFVS

SEQ ID NO: 73613 - protein, 9 aa, Homo Sapiens
LRAPDMDQL

SEQ ID NO: 73614 - protein, 9 aa, Homo Sapiens
RIIYNQVGR

SEQ ID NO: 73615 - protein, 9 aa, Homo Sapiens
LMVQQPGMM

SEQ ID NO: 73616 - protein, 9 aa, Homo Sapiens
MERLCVDYG

SEQ ID NO: 73617 - protein, 9 aa, Homo Sapiens
SVLPHGYVP

SEQ ID NO: 73618 - protein, 9 aa, Homo Sapiens
KQRLEAYSE

SEQ ID NO: 73619 - protein, 9 aa, Homo Sapiens
GSGKPPMDY

SEQ ID NO: 73620 - protein, 9 aa, Homo Sapiens
GNHILHCPG

SEQ ID NO: 73621 - protein, 9 aa, Homo Sapiens
GERVQGLKQ

SEQ ID NO: 73622 - protein, 9 aa, Homo Sapiens
GYCWCVNRD

SEQ ID NO: 73623 - protein, 9 aa, Homo Sapiens
HILHCPGAR

SEQ ID NO: 73624 - protein, 9 aa, Homo Sapiens
DSNDDEDEE

SEQ ID NO: 73625 - protein, 9 aa, Homo Sapiens
TPNYDKSEV

SEQ ID NO: 73626 - protein, 9 aa, Homo Sapiens
KRKGNEKEI

SEQ ID NO: 73627 - protein, 9 aa, Homo Sapiens
HYSLSGRNF

SEQ ID NO: 73628 - protein, 9 aa, Homo Sapiens
HYLIVAVVV

SEQ ID NO: 73629 - protein, 9 aa, Homo Sapiens
RSSSPEVSE

SEQ ID NO: 73630 - protein, 9 aa, Homo Sapiens
SRELLHEKG

SEQ ID NO: 73631 - protein, 9 aa, Homo Sapiens
SPLIIHQKI

SEQ ID NO: 73632 - protein, 9 aa, Homo Sapiens
FRPFVSSSP

SEQ ID NO: 73633 - protein, 9 aa, Homo Sapiens
LGKEQHCKL

SEQ ID NO: 73634 - protein, 9 aa, Homo Sapiens
KQLASELQY

SEQ ID NO: 73635 - protein, 9 aa, Homo Sapiens
LSPEQTEHW

SEQ ID NO: 73636 - protein, 9 aa, Homo Sapiens
WDEAKQDGI

SEQ ID NO: 73637 - protein, 9 aa, Homo Sapiens
AKMNFNNVG

SEQ ID NO: 73638 - protein, 9 aa, Homo Sapiens
DEGTKAEPG

SEQ ID NO: 73639 - protein, 9 aa, Homo Sapiens
LSYIDPNAF

SEQ ID NO: 73640 - protein, 9 aa, Homo Sapiens
TCFQAGDQE

SEQ ID NO: 73641 - protein, 9 aa, Homo Sapiens
LSSAPPGEE

SEQ ID NO: 73642 - protein, 9 aa, Homo Sapiens
RAEAASQLA

SEQ ID NO: 73643 - protein, 9 aa, Homo Sapiens
SPPGTRRPG

SEQ ID NO: 73644 - protein, 9 aa, Homo Sapiens
NRDGREVEG

SEQ ID NO: 73645 - protein, 9 aa, Homo Sapiens
TLKPLSENQ

SEQ ID NO: 73646 - protein, 9 aa, Homo Sapiens
MTCFQAGDQ

SEQ ID NO: 73647 - protein, 9 aa, Homo Sapiens
KKQRLEAYS

SEQ ID NO: 73648 - protein, 9 aa, Homo Sapiens
KSVHSFQLK

SEQ ID NO: 73649 - protein, 9 aa, Homo Sapiens
PQGLELFQN

SEQ ID NO: 73650 - protein, 9 aa, Homo Sapiens
TIYGLHALQ

SEQ ID NO: 73651 - protein, 9 aa, Homo Sapiens
LVQQFQVQL

SEQ ID NO: 73652 - protein, 9 aa, Homo Sapiens
AYSVSCGIQ

SEQ ID NO: 73653 - protein, 9 aa, Homo Sapiens
ITSSTVSKL

SEQ ID NO: 73654 - protein, 9 aa, Homo Sapiens
VTQLNPKEE

SEQ ID NO: 73655 - protein, 9 aa, Homo Sapiens
FQNINFAEE

SEQ ID NO: 73656 - protein, 9 aa, Homo Sapiens
CSQTSFLSP

SEQ ID NO: 73657 - protein, 9 aa, Homo Sapiens
ITNNFGSVA

SEQ ID NO: 73658 - protein, 9 aa, Homo Sapiens
EKREDTTPY

SEQ ID NO: 73659 - protein, 9 aa, Homo Sapiens
TSKRKKTKE

SEQ ID NO: 73660 - protein, 9 aa, Homo Sapiens
LDYDFNSNA

SEQ ID NO: 73661 - protein, 9 aa, Homo Sapiens
TQLMLAVGL

SEQ ID NO: 73662 - protein, 9 aa, Homo Sapiens
GAPVRLRCN

SEQ ID NO: 73663 - protein, 9 aa, Homo Sapiens
ISKAAVQVL

SEQ ID NO: 73664 - protein, 9 aa, Homo Sapiens
ALFDKTRTG

SEQ ID NO: 73665 - protein, 9 aa, Homo Sapiens
TDWNLHSIK

SEQ ID NO: 73666 - protein, 9 aa, Homo Sapiens
CKHVPFLVM

SEQ ID NO: 73667 - protein, 9 aa, Homo Sapiens
SHCGHGQST

SEQ ID NO: 73668 - protein, 9 aa, Homo Sapiens
LRSYPGEAR

SEQ ID NO: 73669 - protein, 9 aa, Homo Sapiens
QREWHKFLL

SEQ ID NO: 73670 - protein, 9 aa, Homo Sapiens
TYLPCIITV

SEQ ID NO: 73671 - protein, 9 aa, Homo Sapiens
RSSMWELTA

SEQ ID NO: 73672 - protein, 9 aa, Homo Sapiens
VADTQLMLA

SEQ ID NO: 73673 - protein, 9 aa, Homo Sapiens
RLRCSFRQR

SEQ ID NO: 73674 - protein, 9 aa, Homo Sapiens
LPCFEPYKF

SEQ ID NO: 73675 - protein, 9 aa, Homo Sapiens
DVLFVYKNT

SEQ ID NO: 73676 - protein, 9 aa, Homo Sapiens
EVSEDLWRG

SEQ ID NO: 73677 - protein, 9 aa, Homo Sapiens
DVDDNEERL

SEQ ID NO: 73678 - protein, 9 aa, Homo Sapiens
QRLEAYSER

SEQ ID NO: 73679 - protein, 9 aa, Homo Sapiens
SPYQYHSVH

SEQ ID NO: 73680 - protein, 9 aa, Homo Sapiens
DCPDSCCEP

SEQ ID NO: 73681 - protein, 9 aa, Homo Sapiens
NKDMDIKTI

SEQ ID NO: 73682 - protein, 9 aa, Homo Sapiens
SAGKDTMSG

SEQ ID NO: 73683 - protein, 9 aa, Homo Sapiens
INYDFPNNR

SEQ ID NO: 73684 - protein, 9 aa, Homo Sapiens
HRFQNINFA

SEQ ID NO: 73685 - protein, 9 aa, Homo Sapiens
SCESSLKMH

SEQ ID NO: 73686 - protein, 9 aa, Homo Sapiens
SSGFQTQSA

SEQ ID NO: 73687 - protein, 9 aa, Homo Sapiens
STSEGSYPC

SEQ ID NO: 73688 - protein, 9 aa, Homo Sapiens
GFQKKGPVS

SEQ ID NO: 73689 - protein, 9 aa, Homo Sapiens
KGKNVTVEM

SEQ ID NO: 73690 - protein, 9 aa, Homo Sapiens
SENHGDHLV

SEQ ID NO: 73691 - protein, 9 aa, Homo Sapiens
QEAAQENAS

SEQ ID NO: 73692 - protein, 9 aa, Homo Sapiens
PRTLSPYQY

SEQ ID NO: 73693 - protein, 9 aa, Homo Sapiens
ATPLPVTSF

SEQ ID NO: 73694 - protein, 9 aa, Homo Sapiens
EKRRAIFDV

SEQ ID NO: 73695 - protein, 9 aa, Homo Sapiens
GKPPMDYHE

SEQ ID NO: 73696 - protein, 9 aa, Homo Sapiens
LFVYKNTNS

SEQ ID NO: 73697 - protein, 9 aa, Homo Sapiens
RPMVWGLAF

SEQ ID NO: 73698 - protein, 9 aa, Homo Sapiens
VHYYKEEAS

SEQ ID NO: 73699 - protein, 9 aa, Homo Sapiens
DFNSNAFPH

SEQ ID NO: 73700 - protein, 9 aa, Homo Sapiens
MLSTYFQTI

SEQ ID NO: 73701 - protein, 9 aa, Homo Sapiens
KVCNKVVDT

SEQ ID NO: 73702 - protein, 9 aa, Homo Sapiens
LVTITNNFG

SEQ ID NO: 73703 - protein, 9 aa, Homo Sapiens
TTWVSFFFN

SEQ ID NO: 73704 - protein, 9 aa, Homo Sapiens
MLAAREDRL

SEQ ID NO: 73705 - protein, 9 aa, Homo Sapiens
VTGGELFHR

SEQ ID NO: 73706 - protein, 9 aa, Homo Sapiens
PEFTIPQGK

SEQ ID NO: 73707 - protein, 9 aa, Homo Sapiens
LSEMDILFH

SEQ ID NO: 73708 - protein, 9 aa, Homo Sapiens
RELLHEKGP

SEQ ID NO: 73709 - protein, 9 aa, Homo Sapiens
EPLPVWGAA

SEQ ID NO: 73710 - protein, 9 aa, Homo Sapiens
YAKTTKMKV

SEQ ID NO: 73711 - protein, 9 aa, Homo Sapiens
SQIWNLNPV

SEQ ID NO: 73712 - protein, 9 aa, Homo Sapiens
KKQGSLDLA

SEQ ID NO: 73713 - protein, 9 aa, Homo Sapiens
TENNISDLE

SEQ ID NO: 73714 - protein, 9 aa, Homo Sapiens
FNAGTFTEE

SEQ ID NO: 73715 - protein, 9 aa, Homo Sapiens
VRVRSSMWE

SEQ ID NO: 73716 - protein, 9 aa, Homo Sapiens
GGEDHDLWN

SEQ ID NO: 73717 - protein, 9 aa, Homo Sapiens
QEKMMRRQQ

SEQ ID NO: 73718 - protein, 9 aa, Homo Sapiens
TIPQGKYQV

SEQ ID NO: 73719 - protein, 9 aa, Homo Sapiens
TAEEYGAGT

SEQ ID NO: 73720 - protein, 9 aa, Homo Sapiens
KSQERLMSY

SEQ ID NO: 73721 - protein, 9 aa, Homo Sapiens
SGFQTQSAP

SEQ ID NO: 73722 - protein, 9 aa, Homo Sapiens
QGFQKKGPV

SEQ ID NO: 73723 - protein, 9 aa, Homo Sapiens
KLVSPSDHR

SEQ ID NO: 73724 - protein, 9 aa, Homo Sapiens
SFNGCFVKV

SEQ ID NO: 73725 - protein, 9 aa, Homo Sapiens
VAVMVYKFY

SEQ ID NO: 73726 - protein, 9 aa, Homo Sapiens
EKPNYTEIR

SEQ ID NO: 73727 - protein, 9 aa, Homo Sapiens
SEELHPKHY

SEQ ID NO: 73728 - protein, 9 aa, Homo Sapiens
TRISKAAVQ

SEQ ID NO: 73729 - protein, 9 aa, Homo Sapiens
RNKVCLEKQ

SEQ ID NO: 73730 - protein, 9 aa, Homo Sapiens
TLYDNEQVG

SEQ ID NO: 73731 - protein, 9 aa, Homo Sapiens
HYTVQPETG

SEQ ID NO: 73732 - protein, 9 aa, Homo Sapiens
AALQQKKTC

SEQ ID NO: 73733 - protein, 9 aa, Homo Sapiens
QGLEAAKEA

SEQ ID NO: 73734 - protein, 9 aa, Homo Sapiens
TSQSRGLSR

SEQ ID NO: 73735 - protein, 9 aa, Homo Sapiens
EAECVEANS

SEQ ID NO: 73736 - protein, 9 aa, Homo Sapiens
DIIVINVDL

SEQ ID NO: 73737 - protein, 9 aa, Homo Sapiens
PSGDETIDE

SEQ ID NO: 73738 - protein, 9 aa, Homo Sapiens
ELKNYKQPV

SEQ ID NO: 73739 - protein, 9 aa, Homo Sapiens
WGQDGNEKM

SEQ ID NO: 73740 - protein, 9 aa, Homo Sapiens
KEEAAHHSH

SEQ ID NO: 73741 - protein, 9 aa, Homo Sapiens
LRDRLQGEH

SEQ ID NO: 73742 - protein, 9 aa, Homo Sapiens
ERTSQSRGL

SEQ ID NO: 73743 - protein, 9 aa, Homo Sapiens
YPPHYLAAR

SEQ ID NO: 73744 - protein, 9 aa, Homo Sapiens
EPYKFTPRA

SEQ ID NO: 73745 - protein, 9 aa, Homo Sapiens
LIGQIVFSL

SEQ ID NO: 73746 - protein, 9 aa, Homo Sapiens
FTLEGEILE

SEQ ID NO: 73747 - protein, 9 aa, Homo Sapiens
RLCWASELS

SEQ ID NO: 73748 - protein, 9 aa, Homo Sapiens
DEHEDEDEA

SEQ ID NO: 73749 - protein, 9 aa, Homo Sapiens
IIYNQVGRP

SEQ ID NO: 73750 - protein, 9 aa, Homo Sapiens
SKVAQWRTK

SEQ ID NO: 73751 - protein, 9 aa, Homo Sapiens
LQAVLLLAF

SEQ ID NO: 73752 - protein, 9 aa, Homo Sapiens
PQPPAPSRL

SEQ ID NO: 73753 - protein, 9 aa, Homo Sapiens
EEAGGTQLE

SEQ ID NO: 73754 - protein, 9 aa, Homo Sapiens
AEEHINSSD

SEQ ID NO: 73755 - protein, 9 aa, Homo Sapiens
FTIPQGKYQ

SEQ ID NO: 73756 - protein, 9 aa, Homo Sapiens
SDVLGLMVQ

SEQ ID NO: 73757 - protein, 9 aa, Homo Sapiens
FLPTCGHTS

SEQ ID NO: 73758 - protein, 9 aa, Homo Sapiens
FRYLQDIIV

SEQ ID NO: 73759 - protein, 9 aa, Homo Sapiens
VAVVVVVDI

SEQ ID NO: 73760 - protein, 9 aa, Homo Sapiens
RLAPGGPAA

SEQ ID NO: 73761 - protein, 9 aa, Homo Sapiens
PLSAADTKP

SEQ ID NO: 73762 - protein, 9 aa, Homo Sapiens
PDLASQGLG

SEQ ID NO: 73763 - protein, 9 aa, Homo Sapiens
VEKAVANFF

SEQ ID NO: 73764 - protein, 9 aa, Homo Sapiens
RPGASVHDR

SEQ ID NO: 73765 - protein, 9 aa, Homo Sapiens
DVLGLMVQQ

SEQ ID NO: 73766 - protein, 9 aa, Homo Sapiens
PAHYVYLQA

SEQ ID NO: 73767 - protein, 9 aa, Homo Sapiens
AKELERRAQ

SEQ ID NO: 73768 - protein, 9 aa, Homo Sapiens
LKPLSENQA

SEQ ID NO: 73769 - protein, 9 aa, Homo Sapiens
NNVGNGFLS

SEQ ID NO: 73770 - protein, 9 aa, Homo Sapiens
AYNSRLQLE

SEQ ID NO: 73771 - protein, 9 aa, Homo Sapiens
REAECVEAN

SEQ ID NO: 73772 - protein, 9 aa, Homo Sapiens
NKNLARRLE

SEQ ID NO: 73773 - protein, 9 aa, Homo Sapiens
LAEKSSGFQ

SEQ ID NO: 73774 - protein, 9 aa, Homo Sapiens
QLPNGCKAP

SEQ ID NO: 73775 - protein, 9 aa, Homo Sapiens
GVILLIRID

SEQ ID NO: 73776 - protein, 9 aa, Homo Sapiens
LQQKKTCGQ

SEQ ID NO: 73777 - protein, 9 aa, Homo Sapiens
LTPNYDKSE

SEQ ID NO: 73778 - protein, 9 aa, Homo Sapiens
RRLGEAWAR

SEQ ID NO: 73779 - protein, 9 aa, Homo Sapiens
PSAQKTGLS

SEQ ID NO: 73780 - protein, 9 aa, Homo Sapiens
GQFVGDGTF

SEQ ID NO: 73781 - protein, 9 aa, Homo Sapiens
ICLKRAEAG

SEQ ID NO: 73782 - protein, 9 aa, Homo Sapiens
CIIFIWIYS

SEQ ID NO: 73783 - protein, 9 aa, Homo Sapiens
ATAAVAAAA

SEQ ID NO: 73784 - protein, 9 aa, Homo Sapiens
RGGPGSAGR

SEQ ID NO: 73785 - protein, 9 aa, Homo Sapiens
DRLQEYTEQ

SEQ ID NO: 73786 - protein, 9 aa, Homo Sapiens
VFVAGWGIS

SEQ ID NO: 73787 - protein, 9 aa, Homo Sapiens
IVINVDLQS

SEQ ID NO: 73788 - protein, 9 aa, Homo Sapiens
EIDVTTYYS

SEQ ID NO: 73789 - protein, 9 aa, Homo Sapiens
TKAARRLGN

SEQ ID NO: 73790 - protein, 9 aa, Homo Sapiens
RVLSCESSL

SEQ ID NO: 73791 - protein, 9 aa, Homo Sapiens
HPWKLVSFG

SEQ ID NO: 73792 - protein, 9 aa, Homo Sapiens
VLSPVSHLR

SEQ ID NO: 73793 - protein, 9 aa, Homo Sapiens
HSHCGHGQS

SEQ ID NO: 73794 - protein, 9 aa, Homo Sapiens
SLPCFEPYK

SEQ ID NO: 73795 - protein, 9 aa, Homo Sapiens
LGESPATTT

SEQ ID NO: 73796 - protein, 9 aa, Homo Sapiens
INFAEEVYT

SEQ ID NO: 73797 - protein, 9 aa, Homo Sapiens
FFNLHILVC

SEQ ID NO: 73798 - protein, 9 aa, Homo Sapiens
SVQHPNEQK

SEQ ID NO: 73799 - protein, 9 aa, Homo Sapiens
IANFTKAAF

SEQ ID NO: 73800 - protein, 9 aa, Homo Sapiens
DNTEMQSHA

SEQ ID NO: 73801 - protein, 9 aa, Homo Sapiens
GEASPPRSS

SEQ ID NO: 73802 - protein, 9 aa, Homo Sapiens
LENMASWGN

SEQ ID NO: 73803 - protein, 9 aa, Homo Sapiens
DKRRLNDLV

SEQ ID NO: 73804 - protein, 9 aa, Homo Sapiens
RLQLLERFK

SEQ ID NO: 73805 - protein, 9 aa, Homo Sapiens
EKEEEAATS

SEQ ID NO: 73806 - protein, 9 aa, Homo Sapiens
CHRVLSCES

SEQ ID NO: 73807 - protein, 9 aa, Homo Sapiens
QELNAIPPM

SEQ ID NO: 73808 - protein, 9 aa, Homo Sapiens
EDGKSPEDP

SEQ ID NO: 73809 - protein, 9 aa, Homo Sapiens
LCQANPDLD

SEQ ID NO: 73810 - protein, 9 aa, Homo Sapiens
LMKDCFQYG

SEQ ID NO: 73811 - protein, 9 aa, Homo Sapiens
AFTYSIDSV

SEQ ID NO: 73812 - protein, 9 aa, Homo Sapiens
GMGRFISRK

SEQ ID NO: 73813 - protein, 9 aa, Homo Sapiens
AEEAGGTQL

SEQ ID NO: 73814 - protein, 9 aa, Homo Sapiens
RIKNVENKS

SEQ ID NO: 73815 - protein, 9 aa, Homo Sapiens
AEQATAGRD

SEQ ID NO: 73816 - protein, 9 aa, Homo Sapiens
DFGGNIKSV

SEQ ID NO: 73817 - protein, 9 aa, Homo Sapiens
NEKMGGITQ

SEQ ID NO: 73818 - protein, 9 aa, Homo Sapiens
DGDYILKLP

SEQ ID NO: 73819 - protein, 9 aa, Homo Sapiens
KVSQNHKGC

SEQ ID NO: 73820 - protein, 9 aa, Homo Sapiens
RDKRRLNDL

SEQ ID NO: 73821 - protein, 9 aa, Homo Sapiens
SGSKMRPAR

SEQ ID NO: 73822 - protein, 9 aa, Homo Sapiens
KEYKNPHTV

SEQ ID NO: 73823 - protein, 9 aa, Homo Sapiens
AKSATVPDQ

SEQ ID NO: 73824 - protein, 9 aa, Homo Sapiens
INVAGRNDK

SEQ ID NO: 73825 - protein, 9 aa, Homo Sapiens
LHPWKLVSF

SEQ ID NO: 73826 - protein, 9 aa, Homo Sapiens
QRLRCSFRQ

SEQ ID NO: 73827 - protein, 9 aa, Homo Sapiens
SSKFFCAYK

SEQ ID NO: 73828 - protein, 9 aa, Homo Sapiens
VSGEASPPR

SEQ ID NO: 73829 - protein, 9 aa, Homo Sapiens
TGKKACKCN

SEQ ID NO: 73830 - protein, 9 aa, Homo Sapiens
SSLNSDNLH

SEQ ID NO: 73831 - protein, 9 aa, Homo Sapiens
KDEKEEEDQ

SEQ ID NO: 73832 - protein, 9 aa, Homo Sapiens
KTTFPSSPE

SEQ ID NO: 73833 - protein, 9 aa, Homo Sapiens
VFLSFRHCI

SEQ ID NO: 73834 - protein, 9 aa, Homo Sapiens
EDVQVEEDD

SEQ ID NO: 73835 - protein, 9 aa, Homo Sapiens
NPGPLSKPP

SEQ ID NO: 73836 - protein, 9 aa, Homo Sapiens
DLASQGLGP

SEQ ID NO: 73837 - protein, 9 aa, Homo Sapiens
NKGMGRFIS

SEQ ID NO: 73838 - protein, 9 aa, Homo Sapiens
SYDKAVSGG

SEQ ID NO: 73839 - protein, 9 aa, Homo Sapiens
PGVLFPKKQ

SEQ ID NO: 73840 - protein, 9 aa, Homo Sapiens
LHLSSEGAA

SEQ ID NO: 73841 - protein, 9 aa, Homo Sapiens
DRLQGEHSQ

SEQ ID NO: 73842 - protein, 9 aa, Homo Sapiens
GDCGGPLVC

SEQ ID NO: 73843 - protein, 9 aa, Homo Sapiens
SQKSSGNCS

SEQ ID NO: 73844 - protein, 9 aa, Homo Sapiens
RHWRSHQGE

SEQ ID NO: 73845 - protein, 9 aa, Homo Sapiens
RQVQKELAD

SEQ ID NO: 73846 - protein, 9 aa, Homo Sapiens
SAEEDAEAQ

SEQ ID NO: 73847 - protein, 9 aa, Homo Sapiens
LSFRHCIIK

SEQ ID NO: 73848 - protein, 9 aa, Homo Sapiens
DENDNSPKI

SEQ ID NO: 73849 - protein, 9 aa, Homo Sapiens
MAALQQKKT

SEQ ID NO: 73850 - protein, 9 aa, Homo Sapiens
KFTPRAGGF

SEQ ID NO: 73851 - protein, 9 aa, Homo Sapiens
GCVGCATKE

SEQ ID NO: 73852 - protein, 9 aa, Homo Sapiens
DLLNDNIRR

SEQ ID NO: 73853 - protein, 9 aa, Homo Sapiens
ALAPNPQFE

SEQ ID NO: 73854 - protein, 9 aa, Homo Sapiens
LVSPSDHRN

SEQ ID NO: 73855 - protein, 9 aa, Homo Sapiens
RFLVDFGAQ

SEQ ID NO: 73856 - protein, 9 aa, Homo Sapiens
NVENKSWKK

SEQ ID NO: 73857 - protein, 9 aa, Homo Sapiens
RTFGHHHPI

SEQ ID NO: 73858 - protein, 9 aa, Homo Sapiens
LSPYQYHSV

SEQ ID NO: 73859 - protein, 9 aa, Homo Sapiens
AYAKTTKMK

SEQ ID NO: 73860 - protein, 9 aa, Homo Sapiens
VLSQLGSAK

SEQ ID NO: 73861 - protein, 9 aa, Homo Sapiens
ISSYKKFCR

SEQ ID NO: 73862 - protein, 9 aa, Homo Sapiens
TAQGEIACG

SEQ ID NO: 73863 - protein, 9 aa, Homo Sapiens
PRTLFAPAL

SEQ ID NO: 73864 - protein, 9 aa, Homo Sapiens
LLHLDYDFN

SEQ ID NO: 73865 - protein, 9 aa, Homo Sapiens
PDGLFLDAN

SEQ ID NO: 73866 - protein, 9 aa, Homo Sapiens
VMKNPQFVF

SEQ ID NO: 73867 - protein, 9 aa, Homo Sapiens
DQGVCTQLL

SEQ ID NO: 73868 - protein, 9 aa, Homo Sapiens
FSAVKDKLP

SEQ ID NO: 73869 - protein, 9 aa, Homo Sapiens
KSTKLLIRK

SEQ ID NO: 73870 - protein, 9 aa, Homo Sapiens
PPSVFGRVS

SEQ ID NO: 73871 - protein, 9 aa, Homo Sapiens
DLEQFCFKF

SEQ ID NO: 73872 - protein, 9 aa, Homo Sapiens
VTTGLVGTS

SEQ ID NO: 73873 - protein, 9 aa, Homo Sapiens
NLGVILLIR

SEQ ID NO: 73874 - protein, 9 aa, Homo Sapiens
CRDLARERG

SEQ ID NO: 73875 - protein, 9 aa, Homo Sapiens
DCFQYGTPE

SEQ ID NO: 73876 - protein, 9 aa, Homo Sapiens
NYYENVLQK

SEQ ID NO: 73877 - protein, 9 aa, Homo Sapiens
STKLLIRKL

SEQ ID NO: 73878 - protein, 9 aa, Homo Sapiens
CYDVLSPVS

SEQ ID NO: 73879 - protein, 9 aa, Homo Sapiens
AIFDVRRTF

SEQ ID NO: 73880 - protein, 9 aa, Homo Sapiens
GVDKRDRKN

SEQ ID NO: 73881 - protein, 9 aa, Homo Sapiens
HSMASNYTS

SEQ ID NO: 73882 - protein, 9 aa, Homo Sapiens
DQAIKAGLE

SEQ ID NO: 73883 - protein, 9 aa, Homo Sapiens
QKKGPVSGL

SEQ ID NO: 73884 - protein, 9 aa, Homo Sapiens
VKKELEMQI

SEQ ID NO: 73885 - protein, 9 aa, Homo Sapiens
VLQIVTNRN

SEQ ID NO: 73886 - protein, 9 aa, Homo Sapiens
QPVEDQGVC

SEQ ID NO: 73887 - protein, 9 aa, Homo Sapiens
HVQLSSAPP

SEQ ID NO: 73888 - protein, 9 aa, Homo Sapiens
TTAFTRSSQ

SEQ ID NO: 73889 - protein, 9 aa, Homo Sapiens
GTQLEPLKP

SEQ ID NO: 73890 - protein, 9 aa, Homo Sapiens
IKAKGVLLD

SEQ ID NO: 73891 - protein, 9 aa, Homo Sapiens
VSGGDHYKI

SEQ ID NO: 73892 - protein, 9 aa, Homo Sapiens
KRAEAGPLG

SEQ ID NO: 73893 - protein, 9 aa, Homo Sapiens
ALQQGGLRA

SEQ ID NO: 73894 - protein, 9 aa, Homo Sapiens
RIKKDEKEE

SEQ ID NO: 73895 - protein, 9 aa, Homo Sapiens
VAVHSSEEL

SEQ ID NO: 73896 - protein, 9 aa, Homo Sapiens
VLIGQIVFS

SEQ ID NO: 73897 - protein, 9 aa, Homo Sapiens
YDFPNNREL

SEQ ID NO: 73898 - protein, 9 aa, Homo Sapiens
IEALSEMDI

SEQ ID NO: 73899 - protein, 9 aa, Homo Sapiens
LLDCVRTAD

SEQ ID NO: 73900 - protein, 9 aa, Homo Sapiens
MRKLWSNKL

SEQ ID NO: 73901 - protein, 9 aa, Homo Sapiens
GEALGSICY

SEQ ID NO: 73902 - protein, 9 aa, Homo Sapiens
VSQNHKGCV

SEQ ID NO: 73903 - protein, 9 aa, Homo Sapiens
RQDARIIVE

SEQ ID NO: 73904 - protein, 9 aa, Homo Sapiens
TKAEPGAGR

SEQ ID NO: 73905 - protein, 9 aa, Homo Sapiens
AAKGCSNAH

SEQ ID NO: 73906 - protein, 9 aa, Homo Sapiens
TFGHHHPIR

SEQ ID NO: 73907 - protein, 9 aa, Homo Sapiens
PCIITVILS

SEQ ID NO: 73908 - protein, 9 aa, Homo Sapiens
HSIKRADKT

SEQ ID NO: 73909 - protein, 9 aa, Homo Sapiens
SQSKAKDKP

SEQ ID NO: 73910 - protein, 9 aa, Homo Sapiens
NAKMNFNNV

SEQ ID NO: 73911 - protein, 9 aa, Homo Sapiens
LVTLCEELG

SEQ ID NO: 73912 - protein, 9 aa, Homo Sapiens
TIDEKLGLS

SEQ ID NO: 73913 - protein, 9 aa, Homo Sapiens
SSDHRTVLK

SEQ ID NO: 73914 - protein, 9 aa, Homo Sapiens
QLDILDTFG

SEQ ID NO: 73915 - protein, 9 aa, Homo Sapiens
GGWSSAEEH

SEQ ID NO: 73916 - protein, 9 aa, Homo Sapiens
SEKEPLPVW

SEQ ID NO: 73917 - protein, 9 aa, Homo Sapiens
LTQITRLDG

SEQ ID NO: 73918 - protein, 9 aa, Homo Sapiens
SCVSYATFD

SEQ ID NO: 73919 - protein, 9 aa, Homo Sapiens
VESASKQLD

SEQ ID NO: 73920 - protein, 9 aa, Homo Sapiens
EKVCNKVVD

SEQ ID NO: 73921 - protein, 9 aa, Homo Sapiens
CMGPNYGVQ

SEQ ID NO: 73922 - protein, 9 aa, Homo Sapiens
KQMKNLKLL

SEQ ID NO: 73923 - protein, 9 aa, Homo Sapiens
LLQTESDAK

SEQ ID NO: 73924 - protein, 9 aa, Homo Sapiens
LQGERVQGL

SEQ ID NO: 73925 - protein, 9 aa, Homo Sapiens
QLASELQYD

SEQ ID NO: 73926 - protein, 9 aa, Homo Sapiens
FWEQRLRCS

SEQ ID NO: 73927 - protein, 9 aa, Homo Sapiens
RHRKIHTGK

SEQ ID NO: 73928 - protein, 9 aa, Homo Sapiens
APGLPELCA

SEQ ID NO: 73929 - protein, 9 aa, Homo Sapiens
SASKQLDRV

SEQ ID NO: 73930 - protein, 9 aa, Homo Sapiens
KPLILKRVK

SEQ ID NO: 73931 - protein, 9 aa, Homo Sapiens
WMKSPAFPG

SEQ ID NO: 73932 - protein, 9 aa, Homo Sapiens
EGSYPCSHP

SEQ ID NO: 73933 - protein, 9 aa, Homo Sapiens
PISMTMPPY

SEQ ID NO: 73934 - protein, 9 aa, Homo Sapiens
RAINVAGRN

SEQ ID NO: 73935 - protein, 9 aa, Homo Sapiens
SLNSDNLHA

SEQ ID NO: 73936 - protein, 9 aa, Homo Sapiens
TWVRVRSSM

SEQ ID NO: 73937 - protein, 9 aa, Homo Sapiens
RRGIKVCSL

SEQ ID NO: 73938 - protein, 9 aa, Homo Sapiens
LPDSNDDED

SEQ ID NO: 73939 - protein, 9 aa, Homo Sapiens
RKRAQVDKV

SEQ ID NO: 73940 - protein, 9 aa, Homo Sapiens
KIEALSEMD

SEQ ID NO: 73941 - protein, 9 aa, Homo Sapiens
REVVSENHG

SEQ ID NO: 73942 - protein, 9 aa, Homo Sapiens
PGTRRPGAS

SEQ ID NO: 73943 - protein, 9 aa, Homo Sapiens
LQKELPSVQ

SEQ ID NO: 73944 - protein, 9 aa, Homo Sapiens
NPKIFENPR

SEQ ID NO: 73945 - protein, 9 aa, Homo Sapiens
GTENNISDL

SEQ ID NO: 73946 - protein, 9 aa, Homo Sapiens
LGLMVQQPG

SEQ ID NO: 73947 - protein, 9 aa, Homo Sapiens
KDEKREDTT

SEQ ID NO: 73948 - protein, 9 aa, Homo Sapiens
TIDLLNDNI

SEQ ID NO: 73949 - protein, 9 aa, Homo Sapiens
IEETNDNIE

SEQ ID NO: 73950 - protein, 9 aa, Homo Sapiens
LEATSDRSE

SEQ ID NO: 73951 - protein, 9 aa, Homo Sapiens
NINFAEEVY

SEQ ID NO: 73952 - protein, 9 aa, Homo Sapiens
GVNRIISVR

SEQ ID NO: 73953 - protein, 9 aa, Homo Sapiens
TVTSAVPPS

SEQ ID NO: 73954 - protein, 9 aa, Homo Sapiens
NKYTKTVFI

SEQ ID NO: 73955 - protein, 9 aa, Homo Sapiens
PCIPGIKPT

SEQ ID NO: 73956 - protein, 9 aa, Homo Sapiens
FQLSKGKNV

SEQ ID NO: 73957 - protein, 9 aa, Homo Sapiens
SYTAEEYGA

SEQ ID NO: 73958 - protein, 9 aa, Homo Sapiens
DLANHGLIV

SEQ ID NO: 73959 - protein, 9 aa, Homo Sapiens
GGPGGLGCK

SEQ ID NO: 73960 - protein, 9 aa, Homo Sapiens
GKLLFNLIS

SEQ ID NO: 73961 - protein, 9 aa, Homo Sapiens
DLTPLLCFQ

SEQ ID NO: 73962 - protein, 9 aa, Homo Sapiens
DHRNPKNNV

SEQ ID NO: 73963 - protein, 9 aa, Homo Sapiens
TTYINHVVF

SEQ ID NO: 73964 - protein, 9 aa, Homo Sapiens
CFEPYKFTP

SEQ ID NO: 73965 - protein, 9 aa, Homo Sapiens
QNTSAPYQL

SEQ ID NO: 73966 - protein, 9 aa, Homo Sapiens
AGTFTEEQK

SEQ ID NO: 73967 - protein, 9 aa, Homo Sapiens
QGDCGGPLV

SEQ ID NO: 73968 - protein, 9 aa, Homo Sapiens
PTLKPLSEN

SEQ ID NO: 73969 - protein, 9 aa, Homo Sapiens
EERIFLAVA

SEQ ID NO: 73970 - protein, 9 aa, Homo Sapiens
ACESENNSL

SEQ ID NO: 73971 - protein, 9 aa, Homo Sapiens
NMASWGNIN

SEQ ID NO: 73972 - protein, 9 aa, Homo Sapiens
KEEEAATSS

SEQ ID NO: 73973 - protein, 9 aa, Homo Sapiens
LLRIKKQGS

SEQ ID NO: 73974 - protein, 9 aa, Homo Sapiens
KGNEKEIQR

SEQ ID NO: 73975 - protein, 9 aa, Homo Sapiens
CCFRDYNVQ

SEQ ID NO: 73976 - protein, 9 aa, Homo Sapiens
GQYSECRDL

SEQ ID NO: 73977 - protein, 9 aa, Homo Sapiens
VACIKAKGV

SEQ ID NO: 73978 - protein, 9 aa, Homo Sapiens
PLSENQARF

SEQ ID NO: 73979 - protein, 9 aa, Homo Sapiens
QQKKTCGQR

SEQ ID NO: 73980 - protein, 9 aa, Homo Sapiens
CSNTDEDNG

SEQ ID NO: 73981 - protein, 9 aa, Homo Sapiens
LSVSDGEEG

SEQ ID NO: 73982 - protein, 9 aa, Homo Sapiens
ALWDLINLK

SEQ ID NO: 73983 - protein, 9 aa, Homo Sapiens
SELEEEKEE

SEQ ID NO: 73984 - protein, 9 aa, Homo Sapiens
VGRPMVWGL

SEQ ID NO: 73985 - protein, 9 aa, Homo Sapiens
FMERKRAQV

SEQ ID NO: 73986 - protein, 9 aa, Homo Sapiens
AAPPAAPPL

SEQ ID NO: 73987 - protein, 9 aa, Homo Sapiens
KEKLKEKIM

SEQ ID NO: 73988 - protein, 9 aa, Homo Sapiens
SNSSSSTSE

SEQ ID NO: 73989 - protein, 9 aa, Homo Sapiens
ERQLQFYTK

SEQ ID NO: 73990 - protein, 9 aa, Homo Sapiens
KECWFPKAT

SEQ ID NO: 73991 - protein, 9 aa, Homo Sapiens
INLKLKLHS

SEQ ID NO: 73992 - protein, 9 aa, Homo Sapiens
ISRKAFPEH

SEQ ID NO: 73993 - protein, 9 aa, Homo Sapiens
YYKEEASDV

SEQ ID NO: 73994 - protein, 9 aa, Homo Sapiens
YPGEARRKA

SEQ ID NO: 73995 - protein, 9 aa, Homo Sapiens
VRLLRIKKQ

SEQ ID NO: 73996 - protein, 9 aa, Homo Sapiens
KRSRDKRRL

SEQ ID NO: 73997 - protein, 9 aa, Homo Sapiens
TDKWMENLR

SEQ ID NO: 73998 - protein, 9 aa, Homo Sapiens
EVIQLAQGM

SEQ ID NO: 73999 - protein, 9 aa, Homo Sapiens
EHRFQNINF

SEQ ID NO: 74000 - protein, 9 aa, Homo Sapiens
FEKFHIDPL

SEQ ID NO: 74001 - protein, 9 aa, Homo Sapiens
ASRPRLHPW

SEQ ID NO: 74002 - protein, 9 aa, Homo Sapiens
RLQLERANM

SEQ ID NO: 74003 - protein, 9 aa, Homo Sapiens
LWQRFHLTL

SEQ ID NO: 74004 - protein, 9 aa, Homo Sapiens
QVDDCPDSC

SEQ ID NO: 74005 - protein, 9 aa, Homo Sapiens
KVERLVAQK

SEQ ID NO: 74006 - protein, 9 aa, Homo Sapiens
RDNNGYSNP

SEQ ID NO: 74007 - protein, 9 aa, Homo Sapiens
SKDEKREDT

SEQ ID NO: 74008 - protein, 9 aa, Homo Sapiens
PSQDKMLPT

SEQ ID NO: 74009 - protein, 9 aa, Homo Sapiens
VQLSSAPPG

SEQ ID NO: 74010 - protein, 9 aa, Homo Sapiens
QLLHLDYDF

SEQ ID NO: 74011 - protein, 9 aa, Homo Sapiens
WVRVRSSMW

SEQ ID NO: 74012 - protein, 9 aa, Homo Sapiens
SVIWENEFS

SEQ ID NO: 74013 - protein, 9 aa, Homo Sapiens
VGERGWGAL

SEQ ID NO: 74014 - protein, 9 aa, Homo Sapiens
HLKQRRRSR

SEQ ID NO: 74015 - protein, 9 aa, Homo Sapiens
RAERRAPSF

SEQ ID NO: 74016 - protein, 9 aa, Homo Sapiens
RAPDRQEEA

SEQ ID NO: 74017 - protein, 9 aa, Homo Sapiens
AEHRFQNIN

SEQ ID NO: 74018 - protein, 9 aa, Homo Sapiens
QDFRPFVSS

SEQ ID NO: 74019 - protein, 9 aa, Homo Sapiens
TKERLFHKL

SEQ ID NO: 74020 - protein, 9 aa, Homo Sapiens
PELRPHVQP

SEQ ID NO: 74021 - protein, 9 aa, Homo Sapiens
MLGSCVSYA

SEQ ID NO: 74022 - protein, 9 aa, Homo Sapiens
TKNSNWESC

SEQ ID NO: 74023 - protein, 9 aa, Homo Sapiens
AIVDSRRFN

SEQ ID NO: 74024 - protein, 9 aa, Homo Sapiens
CPFSSKFFC

SEQ ID NO: 74025 - protein, 9 aa, Homo Sapiens
MWLEAHDSD

SEQ ID NO: 74026 - protein, 9 aa, Homo Sapiens
SAMRKLWSN

SEQ ID NO: 74027 - protein, 9 aa, Homo Sapiens
DLEKVCNKV

SEQ ID NO: 74028 - protein, 9 aa, Homo Sapiens
KQCMENQDC

SEQ ID NO: 74029 - protein, 9 aa, Homo Sapiens
RVEVSEDLW

SEQ ID NO: 74030 - protein, 9 aa, Homo Sapiens
SLIINYDFP

SEQ ID NO: 74031 - protein, 9 aa, Homo Sapiens
HLALLGLSI

SEQ ID NO: 74032 - protein, 9 aa, Homo Sapiens
PVSCLISAG

SEQ ID NO: 74033 - protein, 9 aa, Homo Sapiens
SRPRLHPWK

SEQ ID NO: 74034 - protein, 9 aa, Homo Sapiens
ENLQPWPQA

SEQ ID NO: 74035 - protein, 9 aa, Homo Sapiens
VMLPSYDKA

SEQ ID NO: 74036 - protein, 9 aa, Homo Sapiens
QCMENQDCD

SEQ ID NO: 74037 - protein, 9 aa, Homo Sapiens
QKNSKRYQA

SEQ ID NO: 74038 - protein, 9 aa, Homo Sapiens
ALPPTHSPT

SEQ ID NO: 74039 - protein, 9 aa, Homo Sapiens
EDNSDIGRA

SEQ ID NO: 74040 - protein, 9 aa, Homo Sapiens
ANTLFTYTR

SEQ ID NO: 74041 - protein, 9 aa, Homo Sapiens
SCNSASETD

SEQ ID NO: 74042 - protein, 9 aa, Homo Sapiens
NCMKTEENK

SEQ ID NO: 74043 - protein, 9 aa, Homo Sapiens
RYDAEDLEQ

SEQ ID NO: 74044 - protein, 9 aa, Homo Sapiens
GAAISEETL

SEQ ID NO: 74045 - protein, 9 aa, Homo Sapiens
ELRPHVQPR

SEQ ID NO: 74046 - protein, 9 aa, Homo Sapiens
CFQAGDQEG

SEQ ID NO: 74047 - protein, 9 aa, Homo Sapiens
YKEKDDDDT

SEQ ID NO: 74048 - protein, 9 aa, Homo Sapiens
VDNTEMQSH

SEQ ID NO: 74049 - protein, 9 aa, Homo Sapiens
LEEHYLIVA

SEQ ID NO: 74050 - protein, 9 aa, Homo Sapiens
PEPRKPVEK

SEQ ID NO: 74051 - protein, 9 aa, Homo Sapiens
ESSTLLRHW

SEQ ID NO: 74052 - protein, 9 aa, Homo Sapiens
CATKERLFH

SEQ ID NO: 74053 - protein, 9 aa, Homo Sapiens
HLCKKQRLE

SEQ ID NO: 74054 - protein, 9 aa, Homo Sapiens
EEHINSSDA

SEQ ID NO: 74055 - protein, 9 aa, Homo Sapiens
EKFKRKGNE

SEQ ID NO: 74056 - protein, 9 aa, Homo Sapiens
PTPVVSTAS

SEQ ID NO: 74057 - protein, 9 aa, Homo Sapiens
VCLEKQMKN

SEQ ID NO: 74058 - protein, 9 aa, Homo Sapiens
KSGSKMRPA

SEQ ID NO: 74059 - protein, 9 aa, Homo Sapiens
AISSIASSQ

SEQ ID NO: 74060 - protein, 9 aa, Homo Sapiens
LFHRIVEKG

SEQ ID NO: 74061 - protein, 9 aa, Homo Sapiens
NRKVRKAYL

SEQ ID NO: 74062 - protein, 9 aa, Homo Sapiens
SQLGSAKNR

SEQ ID NO: 74063 - protein, 9 aa, Homo Sapiens
EAHDSDLGQ

SEQ ID NO: 74064 - protein, 9 aa, Homo Sapiens
TRTVPCSQT

SEQ ID NO: 74065 - protein, 9 aa, Homo Sapiens
SVPHSIIHG

SEQ ID NO: 74066 - protein, 9 aa, Homo Sapiens
GPSAGKDTM

SEQ ID NO: 74067 - protein, 9 aa, Homo Sapiens
FYTKAARRL

SEQ ID NO: 74068 - protein, 9 aa, Homo Sapiens
IKEKLAENI

SEQ ID NO: 74069 - protein, 9 aa, Homo Sapiens
RNQTIDLLN

SEQ ID NO: 74070 - protein, 9 aa, Homo Sapiens
EKMMRRQQE

SEQ ID NO: 74071 - protein, 9 aa, Homo Sapiens
NHGKPVGDL

SEQ ID NO: 74072 - protein, 9 aa, Homo Sapiens
GIYVWSNIS

SEQ ID NO: 74073 - protein, 9 aa, Homo Sapiens
MERKRAQVD

SEQ ID NO: 74074 - protein, 9 aa, Homo Sapiens
ASELSDLHL

SEQ ID NO: 74075 - protein, 9 aa, Homo Sapiens
QVQKELADV

SEQ ID NO: 74076 - protein, 9 aa, Homo Sapiens
CNSASETDK

SEQ ID NO: 74077 - protein, 9 aa, Homo Sapiens
PVEDQGVCT

SEQ ID NO: 74078 - protein, 9 aa, Homo Sapiens
GTRRPGASV

SEQ ID NO: 74079 - protein, 9 aa, Homo Sapiens
VFQIEERIF

SEQ ID NO: 74080 - protein, 9 aa, Homo Sapiens
CFIETFKQC

SEQ ID NO: 74081 - protein, 9 aa, Homo Sapiens
EIVIKMFQN

SEQ ID NO: 74082 - protein, 9 aa, Homo Sapiens
TFSSENLSV

SEQ ID NO: 74083 - protein, 9 aa, Homo Sapiens
HTGKKACKC

SEQ ID NO: 74084 - protein, 9 aa, Homo Sapiens
RALGCGRAE

SEQ ID NO: 74085 - protein, 9 aa, Homo Sapiens
DWEVFQIEE

SEQ ID NO: 74086 - protein, 9 aa, Homo Sapiens
VTITNNFGS

SEQ ID NO: 74087 - protein, 9 aa, Homo Sapiens
FRTFGHHHP

SEQ ID NO: 74088 - protein, 9 aa, Homo Sapiens
SVSCGIQLI

SEQ ID NO: 74089 - protein, 9 aa, Homo Sapiens
RNEYRTEFT

SEQ ID NO: 74090 - protein, 9 aa, Homo Sapiens
SLLMERLCV

SEQ ID NO: 74091 - protein, 9 aa, Homo Sapiens
IDDTDVDDN

SEQ ID NO: 74092 - protein, 9 aa, Homo Sapiens
AHYGYERHR

SEQ ID NO: 74093 - protein, 9 aa, Homo Sapiens
WDLINLKLK

SEQ ID NO: 74094 - protein, 9 aa, Homo Sapiens
KAWALERLL

SEQ ID NO: 74095 - protein, 9 aa, Homo Sapiens
KDSCQGDCG

SEQ ID NO: 74096 - protein, 9 aa, Homo Sapiens
TPLLCFQAT

SEQ ID NO: 74097 - protein, 9 aa, Homo Sapiens
HVDHLGIYV

SEQ ID NO: 74098 - protein, 9 aa, Homo Sapiens
IIMEFGGNL

SEQ ID NO: 74099 - protein, 9 aa, Homo Sapiens
PFSSKFFCA

SEQ ID NO: 74100 - protein, 9 aa, Homo Sapiens
DEDEHEDED

SEQ ID NO: 74101 - protein, 9 aa, Homo Sapiens
FEISLPVAN

SEQ ID NO: 74102 - protein, 9 aa, Homo Sapiens
AAAAISSIA

SEQ ID NO: 74103 - protein, 9 aa, Homo Sapiens
EELHPKHYP

SEQ ID NO: 74104 - protein, 9 aa, Homo Sapiens
SNRKVRKAY

SEQ ID NO: 74105 - protein, 9 aa, Homo Sapiens
AQEAAQENA

SEQ ID NO: 74106 - protein, 9 aa, Homo Sapiens
LVAMCQVTS

SEQ ID NO: 74107 - protein, 9 aa, Homo Sapiens
VELFYETEA

SEQ ID NO: 74108 - protein, 9 aa, Homo Sapiens
LSKGKNVTV

SEQ ID NO: 74109 - protein, 9 aa, Homo Sapiens
VSSPVSCLI

SEQ ID NO: 74110 - protein, 9 aa, Homo Sapiens
CIITVILSQ

SEQ ID NO: 74111 - protein, 9 aa, Homo Sapiens
VRFLVDFGA

SEQ ID NO: 74112 - protein, 9 aa, Homo Sapiens
LPTQDEGTK

SEQ ID NO: 74113 - protein, 9 aa, Homo Sapiens
GDHYKIKVW

SEQ ID NO: 74114 - protein, 9 aa, Homo Sapiens
YINHVVFVA

SEQ ID NO: 74115 - protein, 9 aa, Homo Sapiens
QDSDTVKLQ

SEQ ID NO: 74116 - protein, 9 aa, Homo Sapiens
KRADKTSGR

SEQ ID NO: 74117 - protein, 9 aa, Homo Sapiens
YSNPFVKVY

SEQ ID NO: 74118 - protein, 9 aa, Homo Sapiens
KNDQERQET

SEQ ID NO: 74119 - protein, 9 aa, Homo Sapiens
ASVSQHLVH

SEQ ID NO: 74120 - protein, 9 aa, Homo Sapiens
GKDRKYFHY

SEQ ID NO: 74121 - protein, 9 aa, Homo Sapiens
SLSFNGCFV

SEQ ID NO: 74122 - protein, 9 aa, Homo Sapiens
LFNLISQVG

SEQ ID NO: 74123 - protein, 9 aa, Homo Sapiens
TAAVAAAAP

SEQ ID NO: 74124 - protein, 9 aa, Homo Sapiens
VQVEEDDKV

SEQ ID NO: 74125 - protein, 9 aa, Homo Sapiens
VPAQKKIDE

SEQ ID NO: 74126 - protein, 9 aa, Homo Sapiens
TVWDEAKQD

SEQ ID NO: 74127 - protein, 9 aa, Homo Sapiens
NEDNSDIGR

SEQ ID NO: 74128 - protein, 9 aa, Homo Sapiens
ENKSWKKIR

SEQ ID NO: 74129 - protein, 9 aa, Homo Sapiens
YFQTINDLL

SEQ ID NO: 74130 - protein, 9 aa, Homo Sapiens
CVEANSGRL

SEQ ID NO: 74131 - protein, 9 aa, Homo Sapiens
SQDKMLPTY

SEQ ID NO: 74132 - protein, 9 aa, Homo Sapiens
NVPSPKSPL

SEQ ID NO: 74133 - protein, 9 aa, Homo Sapiens
KKDKTQKVQ

SEQ ID NO: 74134 - protein, 9 aa, Homo Sapiens
FLKDEDWND

SEQ ID NO: 74135 - protein, 9 aa, Homo Sapiens
AHNSGEDSH

SEQ ID NO: 74136 - protein, 9 aa, Homo Sapiens
LHQTWRFGA

SEQ ID NO: 74137 - protein, 9 aa, Homo Sapiens
PFVSSSPLD

SEQ ID NO: 74138 - protein, 9 aa, Homo Sapiens
KVSGLNEGL

SEQ ID NO: 74139 - protein, 9 aa, Homo Sapiens
LVAQKSYEH

SEQ ID NO: 74140 - protein, 9 aa, Homo Sapiens
MELKNYKQP

SEQ ID NO: 74141 - protein, 9 aa, Homo Sapiens
YTKAARRLG

SEQ ID NO: 74142 - protein, 9 aa, Homo Sapiens
KTLLLHGGA

SEQ ID NO: 74143 - protein, 9 aa, Homo Sapiens
PKIIITSLS

SEQ ID NO: 74144 - protein, 9 aa, Homo Sapiens
PGARHIYGT

SEQ ID NO: 74145 - protein, 9 aa, Homo Sapiens
QLGSAKNRP

SEQ ID NO: 74146 - protein, 9 aa, Homo Sapiens
REQIDRGSF

SEQ ID NO: 74147 - protein, 9 aa, Homo Sapiens
FIETFKQCM

SEQ ID NO: 74148 - protein, 9 aa, Homo Sapiens
RKYFHYNSD

SEQ ID NO: 74149 - protein, 9 aa, Homo Sapiens
FLRNAIISY

SEQ ID NO: 74150 - protein, 9 aa, Homo Sapiens
KASDVLGLM

SEQ ID NO: 74151 - protein, 9 aa, Homo Sapiens
SNPFVKVYL

SEQ ID NO: 74152 - protein, 9 aa, Homo Sapiens
TTTATATAT

SEQ ID NO: 74153 - protein, 9 aa, Homo Sapiens
GLGCKPSQV

SEQ ID NO: 74154 - protein, 9 aa, Homo Sapiens
VDDNEERLR

SEQ ID NO: 74155 - protein, 9 aa, Homo Sapiens
ADLTPLLCF

SEQ ID NO: 74156 - protein, 9 aa, Homo Sapiens
DMLRVASSS

SEQ ID NO: 74157 - protein, 9 aa, Homo Sapiens
VGDGTFNTI

SEQ ID NO: 74158 - protein, 9 aa, Homo Sapiens
PLRCQKAWA

SEQ ID NO: 74159 - protein, 9 aa, Homo Sapiens
PGESKTTFP

SEQ ID NO: 74160 - protein, 9 aa, Homo Sapiens
RYPRSSMED

SEQ ID NO: 74161 - protein, 9 aa, Homo Sapiens
PFRDLPLGK

SEQ ID NO: 74162 - protein, 9 aa, Homo Sapiens
KAEPGAGRA

SEQ ID NO: 74163 - protein, 9 aa, Homo Sapiens
YSAFGTHTL

SEQ ID NO: 74164 - protein, 9 aa, Homo Sapiens
SLGAYSVSC

SEQ ID NO: 74165 - protein, 9 aa, Homo Sapiens
SLGLWMKSP

SEQ ID NO: 74166 - protein, 9 aa, Homo Sapiens
CESSLKMHY

SEQ ID NO: 74167 - protein, 9 aa, Homo Sapiens
CTPLSKDET

SEQ ID NO: 74168 - protein, 9 aa, Homo Sapiens
FQMALELMR

SEQ ID NO: 74169 - protein, 9 aa, Homo Sapiens
QAQKLLTQI

SEQ ID NO: 74170 - protein, 9 aa, Homo Sapiens
EEDDKVQKS

SEQ ID NO: 74171 - protein, 9 aa, Homo Sapiens
FFVDKHSAV

SEQ ID NO: 74172 - protein, 9 aa, Homo Sapiens
PMLDLLKSE

SEQ ID NO: 74173 - protein, 9 aa, Homo Sapiens
SKQLDRVAA

SEQ ID NO: 74174 - protein, 9 aa, Homo Sapiens
LAQGMEYLL

SEQ ID NO: 74175 - protein, 9 aa, Homo Sapiens
TNVKNDQER

SEQ ID NO: 74176 - protein, 9 aa, Homo Sapiens
EFELQREIK

SEQ ID NO: 74177 - protein, 9 aa, Homo Sapiens
ELQDNLCQM

SEQ ID NO: 74178 - protein, 9 aa, Homo Sapiens
RDGFTLEGE

SEQ ID NO: 74179 - protein, 9 aa, Homo Sapiens
SPWKGKSKT

SEQ ID NO: 74180 - protein, 9 aa, Homo Sapiens
PFQLSKGKN

SEQ ID NO: 74181 - protein, 9 aa, Homo Sapiens
TKPLRHQAF

SEQ ID NO: 74182 - protein, 9 aa, Homo Sapiens
KNRPEQSLP

SEQ ID NO: 74183 - protein, 9 aa, Homo Sapiens
QPRPLPSFC

SEQ ID NO: 74184 - protein, 9 aa, Homo Sapiens
LLTQITRLD

SEQ ID NO: 74185 - protein, 9 aa, Homo Sapiens
RFISRKAFP

SEQ ID NO: 74186 - protein, 9 aa, Homo Sapiens
VAAAAPGPS

SEQ ID NO: 74187 - protein, 9 aa, Homo Sapiens
TIQSDIPAP

SEQ ID NO: 74188 - protein, 9 aa, Homo Sapiens
PPHLERIKE

SEQ ID NO: 74189 - protein, 9 aa, Homo Sapiens
FPSVAPLEL

SEQ ID NO: 74190 - protein, 9 aa, Homo Sapiens
LGFCSSLDP

SEQ ID NO: 74191 - protein, 9 aa, Homo Sapiens
GAYSVSCGI

SEQ ID NO: 74192 - protein, 9 aa, Homo Sapiens
VLSKANSKV

SEQ ID NO: 74193 - protein, 9 aa, Homo Sapiens
FNYYENVLQ

SEQ ID NO: 74194 - protein, 9 aa, Homo Sapiens
DNPKIFENP

SEQ ID NO: 74195 - protein, 9 aa, Homo Sapiens
VKNDQERQE

SEQ ID NO: 74196 - protein, 9 aa, Homo Sapiens
DIIVWPPLW

SEQ ID NO: 74197 - protein, 9 aa, Homo Sapiens
RGIKVCSLT

SEQ ID NO: 74198 - protein, 9 aa, Homo Sapiens
ENKNLARRL

SEQ ID NO: 74199 - protein, 9 aa, Homo Sapiens
ELEEEKEEE

SEQ ID NO: 74200 - protein, 9 aa, Homo Sapiens
NLHSIKRAD

SEQ ID NO: 74201 - protein, 9 aa, Homo Sapiens
EDEGPGAKS

SEQ ID NO: 74202 - protein, 9 aa, Homo Sapiens
FRNQTIDLL

SEQ ID NO: 74203 - protein, 9 aa, Homo Sapiens
QKELPSVQH

SEQ ID NO: 74204 - protein, 9 aa, Homo Sapiens
LIKSPSQDK

SEQ ID NO: 74205 - protein, 9 aa, Homo Sapiens
ATVWDEAKQ

SEQ ID NO: 74206 - protein, 9 aa, Homo Sapiens
AFDHTVSLA

SEQ ID NO: 74207 - protein, 9 aa, Homo Sapiens
AGFMLSADR

SEQ ID NO: 74208 - protein, 9 aa, Homo Sapiens
DKVQKSSAP

SEQ ID NO: 74209 - protein, 9 aa, Homo Sapiens
FLAKFEISL

SEQ ID NO: 74210 - protein, 9 aa, Homo Sapiens
SEDVLCKFD

SEQ ID NO: 74211 - protein, 9 aa, Homo Sapiens
HALQQGGLR

SEQ ID NO: 74212 - protein, 9 aa, Homo Sapiens
GLEVISPTK

SEQ ID NO: 74213 - protein, 9 aa, Homo Sapiens
GSEGKLLFN

SEQ ID NO: 74214 - protein, 9 aa, Homo Sapiens
FGHHHPIRT

SEQ ID NO: 74215 - protein, 9 aa, Homo Sapiens
VSVTQLNPK

SEQ ID NO: 74216 - protein, 9 aa, Homo Sapiens
HMRTAYKYV

SEQ ID NO: 74217 - protein, 9 aa, Homo Sapiens
DRIKKDEKE

SEQ ID NO: 74218 - protein, 9 aa, Homo Sapiens
TISELEEEK

SEQ ID NO: 74219 - protein, 9 aa, Homo Sapiens
GFCSSLDPC

SEQ ID NO: 74220 - protein, 9 aa, Homo Sapiens
GHESLRLQL

SEQ ID NO: 74221 - protein, 9 aa, Homo Sapiens
CYIAEVLIT

SEQ ID NO: 74222 - protein, 9 aa, Homo Sapiens
YNQVGRPFL

SEQ ID NO: 74223 - protein, 9 aa, Homo Sapiens
EKSSGFQTQ

SEQ ID NO: 74224 - protein, 9 aa, Homo Sapiens
KVCSLTGQV

SEQ ID NO: 74225 - protein, 9 aa, Homo Sapiens
LGIYVWSNI

SEQ ID NO: 74226 - protein, 9 aa, Homo Sapiens
TSEKSVHSF

SEQ ID NO: 74227 - protein, 9 aa, Homo Sapiens
FHYNSDFHI

SEQ ID NO: 74228 - protein, 9 aa, Homo Sapiens
WGNINVILV

SEQ ID NO: 74229 - protein, 9 aa, Homo Sapiens
TYFQTINDL

SEQ ID NO: 74230 - protein, 9 aa, Homo Sapiens
LIVLQQLNA

SEQ ID NO: 74231 - protein, 9 aa, Homo Sapiens
DTTPYQLVK

SEQ ID NO: 74232 - protein, 9 aa, Homo Sapiens
LQLLERFKS

SEQ ID NO: 74233 - protein, 9 aa, Homo Sapiens
TQMKVSGLN

SEQ ID NO: 74234 - protein, 9 aa, Homo Sapiens
RRNEYRTEF

SEQ ID NO: 74235 - protein, 9 aa, Homo Sapiens
NPQFEAFAG

SEQ ID NO: 74236 - protein, 9 aa, Homo Sapiens
TDHQGQCLP

SEQ ID NO: 74237 - protein, 9 aa, Homo Sapiens
KQPDDSRDE

SEQ ID NO: 74238 - protein, 9 aa, Homo Sapiens
GSSCGQSSC

SEQ ID NO: 74239 - protein, 9 aa, Homo Sapiens
VEVSEDLWR

SEQ ID NO: 74240 - protein, 9 aa, Homo Sapiens
HVQFDFLIK

SEQ ID NO: 74241 - protein, 9 aa, Homo Sapiens
DGLFLDANM

SEQ ID NO: 74242 - protein, 9 aa, Homo Sapiens
ARRNEYRTE

SEQ ID NO: 74243 - protein, 9 aa, Homo Sapiens
DVTEDGKSP

SEQ ID NO: 74244 - protein, 9 aa, Homo Sapiens
LRCNHGKPV

SEQ ID NO: 74245 - protein, 9 aa, Homo Sapiens
WENEFSFED

SEQ ID NO: 74246 - protein, 9 aa, Homo Sapiens
TIILIVEIE

SEQ ID NO: 74247 - protein, 9 aa, Homo Sapiens
VDSRRFNYV

SEQ ID NO: 74248 - protein, 9 aa, Homo Sapiens
NFGHLALLG

SEQ ID NO: 74249 - protein, 9 aa, Homo Sapiens
IVTNRNDVQ

SEQ ID NO: 74250 - protein, 9 aa, Homo Sapiens
TAFTRSSQK

SEQ ID NO: 74251 - protein, 9 aa, Homo Sapiens
VCRALGCGR

SEQ ID NO: 74252 - protein, 9 aa, Homo Sapiens
QSKAKDKPE

SEQ ID NO: 74253 - protein, 9 aa, Homo Sapiens
IMWLEAHDS

SEQ ID NO: 74254 - protein, 9 aa, Homo Sapiens
LEKQMKNLK

SEQ ID NO: 74255 - protein, 9 aa, Homo Sapiens
DEGPGAKSA

SEQ ID NO: 74256 - protein, 9 aa, Homo Sapiens
SGEDSHLKQ

SEQ ID NO: 74257 - protein, 9 aa, Homo Sapiens
GRIKNVENK

SEQ ID NO: 74258 - protein, 9 aa, Homo Sapiens
DGNEKMGGI

SEQ ID NO: 74259 - protein, 9 aa, Homo Sapiens
QGLELFQNT

SEQ ID NO: 74260 - protein, 9 aa, Homo Sapiens
FVDKHSAVW

SEQ ID NO: 74261 - protein, 9 aa, Homo Sapiens
LFFQKAKAQ

SEQ ID NO: 74262 - protein, 9 aa, Homo Sapiens
HYVYLQAFV

SEQ ID NO: 74263 - protein, 9 aa, Homo Sapiens
FGLALTLQP

SEQ ID NO: 74264 - protein, 9 aa, Homo Sapiens
YQYHSVHGV

SEQ ID NO: 74265 - protein, 9 aa, Homo Sapiens
AFTRSSQKS

SEQ ID NO: 74266 - protein, 9 aa, Homo Sapiens
FDNKDMDIK

SEQ ID NO: 74267 - protein, 9 aa, Homo Sapiens
ATNVKNDQE

SEQ ID NO: 74268 - protein, 9 aa, Homo Sapiens
FTKAAFTYS

SEQ ID NO: 74269 - protein, 9 aa, Homo Sapiens
VDFGAQVSV

SEQ ID NO: 74270 - protein, 9 aa, Homo Sapiens
FSWGAKGQR

SEQ ID NO: 74271 - protein, 9 aa, Homo Sapiens
VPTDQAIKA

SEQ ID NO: 74272 - protein, 9 aa, Homo Sapiens
GEDHDLWNR

SEQ ID NO: 74273 - protein, 9 aa, Homo Sapiens
LVKSNCGAS

SEQ ID NO: 74274 - protein, 9 aa, Homo Sapiens
QEEGYFEAF

SEQ ID NO: 74275 - protein, 9 aa, Homo Sapiens
FFRNAIEGK

SEQ ID NO: 74276 - protein, 9 aa, Homo Sapiens
KNAFMLLMG

SEQ ID NO: 74277 - protein, 9 aa, Homo Sapiens
PLGESPATT

SEQ ID NO: 74278 - protein, 9 aa, Homo Sapiens
QSAFQRALP

SEQ ID NO: 74279 - protein, 9 aa, Homo Sapiens
NLHAGNRQA

SEQ ID NO: 74280 - protein, 9 aa, Homo Sapiens
AKDKPEFFI

SEQ ID NO: 74281 - protein, 9 aa, Homo Sapiens
ERLVAQKSY

SEQ ID NO: 74282 - protein, 9 aa, Homo Sapiens
DDEEEDEKI

SEQ ID NO: 74283 - protein, 9 aa, Homo Sapiens
EAAAVAPYG

SEQ ID NO: 74284 - protein, 9 aa, Homo Sapiens
AAAPNPGPL

SEQ ID NO: 74285 - protein, 9 aa, Homo Sapiens
AQDSTDAEK

SEQ ID NO: 74286 - protein, 9 aa, Homo Sapiens
LSKERAERK

SEQ ID NO: 74287 - protein, 9 aa, Homo Sapiens
RKPVEKAVA

SEQ ID NO: 74288 - protein, 9 aa, Homo Sapiens
FKQCMENQD

SEQ ID NO: 74289 - protein, 9 aa, Homo Sapiens
NVMKNPQFV

SEQ ID NO: 74290 - protein, 9 aa, Homo Sapiens
DFGAQVSVV

SEQ ID NO: 74291 - protein, 9 aa, Homo Sapiens
VALFDKTRT

SEQ ID NO: 74292 - protein, 9 aa, Homo Sapiens
NQARFYFQD

SEQ ID NO: 74293 - protein, 9 aa, Homo Sapiens
MLLMGNIVR

SEQ ID NO: 74294 - protein, 9 aa, Homo Sapiens
RLQYLLLHY

SEQ ID NO: 74295 - protein, 9 aa, Homo Sapiens
LLHQTWRFG

SEQ ID NO: 74296 - protein, 9 aa, Homo Sapiens
YLQDIIVWP

SEQ ID NO: 74297 - protein, 9 aa, Homo Sapiens
NGYSNPFVK

SEQ ID NO: 74298 - protein, 9 aa, Homo Sapiens
TQSAFQRAL

SEQ ID NO: 74299 - protein, 9 aa, Homo Sapiens
AALLGGGGK

SEQ ID NO: 74300 - protein, 9 aa, Homo Sapiens
NKQALPLSE

SEQ ID NO: 74301 - protein, 9 aa, Homo Sapiens
VMFRGLWQR

SEQ ID NO: 74302 - protein, 9 aa, Homo Sapiens
AGSGKPPMD

SEQ ID NO: 74303 - protein, 9 aa, Homo Sapiens
KLLIRKLPF

SEQ ID NO: 74304 - protein, 9 aa, Homo Sapiens
KRRAIFDVR

SEQ ID NO: 74305 - protein, 9 aa, Homo Sapiens
FILVMLRSY

SEQ ID NO: 74306 - protein, 9 aa, Homo Sapiens
PSYDKAVSG

SEQ ID NO: 74307 - protein, 9 aa, Homo Sapiens
TNRNDVQGY

SEQ ID NO: 74308 - protein, 9 aa, Homo Sapiens
RFSAVKDKL

SEQ ID NO: 74309 - protein, 9 aa, Homo Sapiens
RGRKGLRPP

SEQ ID NO: 74310 - protein, 9 aa, Homo Sapiens
VDENDNSPK

SEQ ID NO: 74311 - protein, 9 aa, Homo Sapiens
SFLPTCGHT

SEQ ID NO: 74312 - protein, 9 aa, Homo Sapiens
GLQKLGAHT

SEQ ID NO: 74313 - protein, 9 aa, Homo Sapiens
MQRFGPPIS

SEQ ID NO: 74314 - protein, 9 aa, Homo Sapiens
TQDEGTKAE

SEQ ID NO: 74315 - protein, 9 aa, Homo Sapiens
ECHSSADSA

SEQ ID NO: 74316 - protein, 9 aa, Homo Sapiens
VEANSGRLA

SEQ ID NO: 74317 - protein, 9 aa, Homo Sapiens
QEKVERLVA

SEQ ID NO: 74318 - protein, 9 aa, Homo Sapiens
QKSSGNCSK

SEQ ID NO: 74319 - protein, 9 aa, Homo Sapiens
SPERSRTLH

SEQ ID NO: 74320 - protein, 9 aa, Homo Sapiens
FLSFRHCII

SEQ ID NO: 74321 - protein, 9 aa, Homo Sapiens
SIVTTGLVG

SEQ ID NO: 74322 - protein, 9 aa, Homo Sapiens
RDFAIFRTF

SEQ ID NO: 74323 - protein, 9 aa, Homo Sapiens
ISSIASSQA

SEQ ID NO: 74324 - protein, 9 aa, Homo Sapiens
VPVRFLVDF

SEQ ID NO: 74325 - protein, 9 aa, Homo Sapiens
TSEGSWAEQ

SEQ ID NO: 74326 - protein, 9 aa, Homo Sapiens
RPFVSSSPL

SEQ ID NO: 74327 - protein, 9 aa, Homo Sapiens
YDAEDLEQF

SEQ ID NO: 74328 - protein, 9 aa, Homo Sapiens
AAPNPGPLS

SEQ ID NO: 74329 - protein, 9 aa, Homo Sapiens
PLIIHQKIH

SEQ ID NO: 74330 - protein, 9 aa, Homo Sapiens
DEAKQDGIG

SEQ ID NO: 74331 - protein, 9 aa, Homo Sapiens
ESCASKPVS

SEQ ID NO: 74332 - protein, 9 aa, Homo Sapiens
VQAPPPSSP

SEQ ID NO: 74333 - protein, 9 aa, Homo Sapiens
LPLGKEQHC

SEQ ID NO: 74334 - protein, 9 aa, Homo Sapiens
VPPNKVDKE

SEQ ID NO: 74335 - protein, 9 aa, Homo Sapiens
KAVSGGLSA

SEQ ID NO: 74336 - protein, 9 aa, Homo Sapiens
RQLQFYTKA

SEQ ID NO: 74337 - protein, 9 aa, Homo Sapiens
QDVLFVYKN

SEQ ID NO: 74338 - protein, 9 aa, Homo Sapiens
QTINDLLSS

SEQ ID NO: 74339 - protein, 9 aa, Homo Sapiens
PFVYFYYKE

SEQ ID NO: 74340 - protein, 9 aa, Homo Sapiens
SKTLLLHGG

SEQ ID NO: 74341 - protein, 9 aa, Homo Sapiens
LRIIYNQVG

SEQ ID NO: 74342 - protein, 9 aa, Homo Sapiens
PEQTEHWGG

SEQ ID NO: 74343 - protein, 9 aa, Homo Sapiens
PFEKPNYTE

SEQ ID NO: 74344 - protein, 9 aa, Homo Sapiens
FGGNLTLHQ

SEQ ID NO: 74345 - protein, 9 aa, Homo Sapiens
LFFRNAIEG

SEQ ID NO: 74346 - protein, 9 aa, Homo Sapiens
CGHGQSTQR

SEQ ID NO: 74347 - protein, 9 aa, Homo Sapiens
NLSVSDGEE

SEQ ID NO: 74348 - protein, 9 aa, Homo Sapiens
TYINHVVFV

SEQ ID NO: 74349 - protein, 9 aa, Homo Sapiens
SLSGRNFEK

SEQ ID NO: 74350 - protein, 9 aa, Homo Sapiens
NNISDLERH

SEQ ID NO: 74351 - protein, 9 aa, Homo Sapiens
EAMLSTYFQ

SEQ ID NO: 74352 - protein, 9 aa, Homo Sapiens
CMKTEENKS

SEQ ID NO: 74353 - protein, 9 aa, Homo Sapiens
EHEDEDEAG

SEQ ID NO: 74354 - protein, 9 aa, Homo Sapiens
ELQYDMKKY

SEQ ID NO: 74355 - protein, 9 aa, Homo Sapiens
QFLAKFEIS

SEQ ID NO: 74356 - protein, 9 aa, Homo Sapiens
PPRSSGNDA

SEQ ID NO: 74357 - protein, 9 aa, Homo Sapiens
LHALQQGGL

SEQ ID NO: 74358 - protein, 9 aa, Homo Sapiens
HAGNRQACP

SEQ ID NO: 74359 - protein, 9 aa, Homo Sapiens
IRHSLSFNG

SEQ ID NO: 74360 - protein, 9 aa, Homo Sapiens
YRKVSKAQE

SEQ ID NO: 74361 - protein, 9 aa, Homo Sapiens
GVLFPKKQP

SEQ ID NO: 74362 - protein, 9 aa, Homo Sapiens
SSCGQSSCC

SEQ ID NO: 74363 - protein, 9 aa, Homo Sapiens
HRIVEKGYY

SEQ ID NO: 74364 - protein, 9 aa, Homo Sapiens
QLRGAFDHT

SEQ ID NO: 74365 - protein, 9 aa, Homo Sapiens
ESASKQLDR

SEQ ID NO: 74366 - protein, 9 aa, Homo Sapiens
TMPPYGSLQ

SEQ ID NO: 74367 - protein, 9 aa, Homo Sapiens
ALGSICYIA

SEQ ID NO: 74368 - protein, 9 aa, Homo Sapiens
RKVRKAYLQ

SEQ ID NO: 74369 - protein, 9 aa, Homo Sapiens
SSEKSSSTS

SEQ ID NO: 74370 - protein, 9 aa, Homo Sapiens
NFGSVARMC

SEQ ID NO: 74371 - protein, 9 aa, Homo Sapiens
TSCGELMKS

SEQ ID NO: 74372 - protein, 9 aa, Homo Sapiens
NFAEEVYTR

SEQ ID NO: 74373 - protein, 9 aa, Homo Sapiens
IYHQRIHTA

SEQ ID NO: 74374 - protein, 9 aa, Homo Sapiens
WTDHQGQCL

SEQ ID NO: 74375 - protein, 9 aa, Homo Sapiens
LALNTVDML

SEQ ID NO: 74376 - protein, 9 aa, Homo Sapiens
GKARGGTVP

SEQ ID NO: 74377 - protein, 9 aa, Homo Sapiens
KNEFHKHVQ

SEQ ID NO: 74378 - protein, 9 aa, Homo Sapiens
FSCNSASET

SEQ ID NO: 74379 - protein, 9 aa, Homo Sapiens
RISSYKKFC

SEQ ID NO: 74380 - protein, 9 aa, Homo Sapiens
KRKKTKEES

SEQ ID NO: 74381 - protein, 9 aa, Homo Sapiens
QQFQVQLQQ

SEQ ID NO: 74382 - protein, 9 aa, Homo Sapiens
CPGARHIYG

SEQ ID NO: 74383 - protein, 9 aa, Homo Sapiens
SDLGQSGQV

SEQ ID NO: 74384 - protein, 9 aa, Homo Sapiens
PECHSSADS

SEQ ID NO: 74385 - protein, 9 aa, Homo Sapiens
RSHSRGRKG

SEQ ID NO: 74386 - protein, 9 aa, Homo Sapiens
AREDRLQEY

SEQ ID NO: 74387 - protein, 9 aa, Homo Sapiens
TTGHSHCGH

SEQ ID NO: 74388 - protein, 9 aa, Homo Sapiens
VISPTKFEV

SEQ ID NO: 74389 - protein, 9 aa, Homo Sapiens
QEDTILTKS

SEQ ID NO: 74390 - protein, 9 aa, Homo Sapiens
DNKDMDIKT

SEQ ID NO: 74391 - protein, 9 aa, Homo Sapiens
FIHIKWICS

SEQ ID NO: 74392 - protein, 9 aa, Homo Sapiens
LENFGHLAL

SEQ ID NO: 74393 - protein, 9 aa, Homo Sapiens
GKEQHCKLL

SEQ ID NO: 74394 - protein, 9 aa, Homo Sapiens
LQPWPQAWD

SEQ ID NO: 74395 - protein, 9 aa, Homo Sapiens
RLSYIDPNA

SEQ ID NO: 74396 - protein, 9 aa, Homo Sapiens
KIIITSLSD

SEQ ID NO: 74397 - protein, 9 aa, Homo Sapiens
LNGLALPPT

SEQ ID NO: 74398 - protein, 9 aa, Homo Sapiens
HYNSDFHIP

SEQ ID NO: 74399 - protein, 9 aa, Homo Sapiens
YDKAVSGGL

SEQ ID NO: 74400 - protein, 9 aa, Homo Sapiens
AFQRALPIL

SEQ ID NO: 74401 - protein, 9 aa, Homo Sapiens
LGCGRAEAA

SEQ ID NO: 74402 - protein, 9 aa, Homo Sapiens
KSPFQLSKG

SEQ ID NO: 74403 - protein, 9 aa, Homo Sapiens
EGPGAKSAT

SEQ ID NO: 74404 - protein, 9 aa, Homo Sapiens
SEKSSSTSA

SEQ ID NO: 74405 - protein, 9 aa, Homo Sapiens
SPVSCLISA

SEQ ID NO: 74406 - protein, 9 aa, Homo Sapiens
LIASVSQHL

SEQ ID NO: 74407 - protein, 9 aa, Homo Sapiens
VKFQMALEL

SEQ ID NO: 74408 - protein, 9 aa, Homo Sapiens
EITGPMMPH

SEQ ID NO: 74409 - protein, 9 aa, Homo Sapiens
SPNSHLHVS

SEQ ID NO: 74410 - protein, 9 aa, Homo Sapiens
TDFGGNIKS

SEQ ID NO: 74411 - protein, 9 aa, Homo Sapiens
GGGGEAAAV

SEQ ID NO: 74412 - protein, 9 aa, Homo Sapiens
KAGLELLKV

SEQ ID NO: 74413 - protein, 9 aa, Homo Sapiens
HSLSFNGCF

SEQ ID NO: 74414 - protein, 9 aa, Homo Sapiens
DVLSPVSHL

SEQ ID NO: 74415 - protein, 9 aa, Homo Sapiens
SVSVTQLNP

SEQ ID NO: 74416 - protein, 9 aa, Homo Sapiens
NNCLILRAP

SEQ ID NO: 74417 - protein, 9 aa, Homo Sapiens
RKLWSNKLI

SEQ ID NO: 74418 - protein, 9 aa, Homo Sapiens
ARLKDIIVI

SEQ ID NO: 74419 - protein, 9 aa, Homo Sapiens
SQLYKQASA

SEQ ID NO: 74420 - protein, 9 aa, Homo Sapiens
TLSPYQYHS

SEQ ID NO: 74421 - protein, 9 aa, Homo Sapiens
NGCFVKVAR

SEQ ID NO: 74422 - protein, 9 aa, Homo Sapiens
VLEEQTAFN

SEQ ID NO: 74423 - protein, 9 aa, Homo Sapiens
RCNHGKPVG

SEQ ID NO: 74424 - protein, 9 aa, Homo Sapiens
MKSPAFPGE

SEQ ID NO: 74425 - protein, 9 aa, Homo Sapiens
ILKLPKSNQ

SEQ ID NO: 74426 - protein, 9 aa, Homo Sapiens
VAGRNDKNF

SEQ ID NO: 74427 - protein, 9 aa, Homo Sapiens
KFEVVLYLN

SEQ ID NO: 74428 - protein, 9 aa, Homo Sapiens
IRLGKPLIL

SEQ ID NO: 74429 - protein, 9 aa, Homo Sapiens
WEQRLRCSF

SEQ ID NO: 74430 - protein, 9 aa, Homo Sapiens
ISLPVANDS

SEQ ID NO: 74431 - protein, 9 aa, Homo Sapiens
ANPDLDSDK

SEQ ID NO: 74432 - protein, 9 aa, Homo Sapiens
ESDAKELER

SEQ ID NO: 74433 - protein, 9 aa, Homo Sapiens
GQIVFSLAA

SEQ ID NO: 74434 - protein, 9 aa, Homo Sapiens
GRVATAAVA

SEQ ID NO: 74435 - protein, 9 aa, Homo Sapiens
VQKELADVL

SEQ ID NO: 74436 - protein, 9 aa, Homo Sapiens
LLRHWRSHQ

SEQ ID NO: 74437 - protein, 9 aa, Homo Sapiens
TLEGEILEI

SEQ ID NO: 74438 - protein, 9 aa, Homo Sapiens
LSMKFLKKG

SEQ ID NO: 74439 - protein, 9 aa, Homo Sapiens
SKMRPARAK

SEQ ID NO: 74440 - protein, 9 aa, Homo Sapiens
SDAKELERR

SEQ ID NO: 74441 - protein, 9 aa, Homo Sapiens
FVSGGDHYK

SEQ ID NO: 74442 - protein, 9 aa, Homo Sapiens
NFTKAAFTY

SEQ ID NO: 74443 - protein, 9 aa, Homo Sapiens
VPCSQTSFL

SEQ ID NO: 74444 - protein, 9 aa, Homo Sapiens
LADVLVRLH

SEQ ID NO: 74445 - protein, 9 aa, Homo Sapiens
EQATAGRDD

SEQ ID NO: 74446 - protein, 9 aa, Homo Sapiens
LSPVSHLRF

SEQ ID NO: 74447 - protein, 9 aa, Homo Sapiens
LPTCGHTSQ

SEQ ID NO: 74448 - protein, 9 aa, Homo Sapiens
IVLQQLNAQ

SEQ ID NO: 74449 - protein, 9 aa, Homo Sapiens
HKEKLKEKI

SEQ ID NO: 74450 - protein, 9 aa, Homo Sapiens
ENHGDHLVL

SEQ ID NO: 74451 - protein, 9 aa, Homo Sapiens
KIFENPRRS

SEQ ID NO: 74452 - protein, 9 aa, Homo Sapiens
QGVCTQLLA

SEQ ID NO: 74453 - protein, 9 aa, Homo Sapiens
ERLCVDYGK

SEQ ID NO: 74454 - protein, 9 aa, Homo Sapiens
KGAKLTPNY

SEQ ID NO: 74455 - protein, 9 aa, Homo Sapiens
RQQEKMMRR

SEQ ID NO: 74456 - protein, 9 aa, Homo Sapiens
EENLQPWPQ

SEQ ID NO: 74457 - protein, 9 aa, Homo Sapiens
DKRDRKNSI

SEQ ID NO: 74458 - protein, 9 aa, Homo Sapiens
EDRLQEYTE

SEQ ID NO: 74459 - protein, 9 aa, Homo Sapiens
APVRLRCNH

SEQ ID NO: 74460 - protein, 9 aa, Homo Sapiens
KPMFTQPLM

SEQ ID NO: 74461 - protein, 9 aa, Homo Sapiens
SLRLQLLER

SEQ ID NO: 74462 - protein, 9 aa, Homo Sapiens
GQDGNEKMG

SEQ ID NO: 74463 - protein, 9 aa, Homo Sapiens
RGKLSPWKG

SEQ ID NO: 74464 - protein, 9 aa, Homo Sapiens
TTLKSSEKS

SEQ ID NO: 74465 - protein, 9 aa, Homo Sapiens
DNLHAGNRQ

SEQ ID NO: 74466 - protein, 9 aa, Homo Sapiens
EEEEDEDEH

SEQ ID NO: 74467 - protein, 9 aa, Homo Sapiens
LMGNIVRVV

SEQ ID NO: 74468 - protein, 9 aa, Homo Sapiens
QAVLLLAFQ

SEQ ID NO: 74469 - protein, 9 aa, Homo Sapiens
FSSKFFCAY

SEQ ID NO: 74470 - protein, 9 aa, Homo Sapiens
PAKPLEATS

SEQ ID NO: 74471 - protein, 9 aa, Homo Sapiens
SASQIWNLN

SEQ ID NO: 74472 - protein, 9 aa, Homo Sapiens
TMQRFGPPI

SEQ ID NO: 74473 - protein, 9 aa, Homo Sapiens
GAWRGFGLA

SEQ ID NO: 74474 - protein, 9 aa, Homo Sapiens
IASVSQHLV

SEQ ID NO: 74475 - protein, 9 aa, Homo Sapiens
DHRTVLKSS

SEQ ID NO: 74476 - protein, 9 aa, Homo Sapiens
QFQVQLQQY

SEQ ID NO: 74477 - protein, 9 aa, Homo Sapiens
MKGFTVSFK

SEQ ID NO: 74478 - protein, 9 aa, Homo Sapiens
VKSPFQLSK

SEQ ID NO: 74479 - protein, 9 aa, Homo Sapiens
AEAQVDNSK

SEQ ID NO: 74480 - protein, 9 aa, Homo Sapiens
FVGDGTFNT

SEQ ID NO: 74481 - protein, 9 aa, Homo Sapiens
GRRGIKVCS

SEQ ID NO: 74482 - protein, 9 aa, Homo Sapiens
SMKEMVILF

SEQ ID NO: 74483 - protein, 9 aa, Homo Sapiens
FLCQGLRYP

SEQ ID NO: 74484 - protein, 9 aa, Homo Sapiens
HTPVTISAN

SEQ ID NO: 74485 - protein, 9 aa, Homo Sapiens
YIEKFKRKG

SEQ ID NO: 74486 - protein, 9 aa, Homo Sapiens
MFRGLWQRF

SEQ ID NO: 74487 - protein, 9 aa, Homo Sapiens
NQIGFQREW

SEQ ID NO: 74488 - protein, 9 aa, Homo Sapiens
NEMDKPMFT

SEQ ID NO: 74489 - protein, 9 aa, Homo Sapiens
FDVRRTFCL

SEQ ID NO: 74490 - protein, 9 aa, Homo Sapiens
LRCSFRQRD

SEQ ID NO: 74491 - protein, 9 aa, Homo Sapiens
PKPKVQWTD

SEQ ID NO: 74492 - protein, 9 aa, Homo Sapiens
ADVLVRLHN

SEQ ID NO: 74493 - protein, 9 aa, Homo Sapiens
PMSPTQLSD

SEQ ID NO: 74494 - protein, 9 aa, Homo Sapiens
CESENNSLY

SEQ ID NO: 74495 - protein, 9 aa, Homo Sapiens
RDRKNSIQQ

SEQ ID NO: 74496 - protein, 9 aa, Homo Sapiens
LIAVTFISI

SEQ ID NO: 74497 - protein, 9 aa, Homo Sapiens
ASDVLGLMV

SEQ ID NO: 74498 - protein, 9 aa, Homo Sapiens
YYLLHQTWR

SEQ ID NO: 74499 - protein, 9 aa, Homo Sapiens
LQAFVQPGV

SEQ ID NO: 74500 - protein, 9 aa, Homo Sapiens
QFDGDYILK

SEQ ID NO: 74501 - protein, 9 aa, Homo Sapiens
GCFVKVARS

SEQ ID NO: 74502 - protein, 9 aa, Homo Sapiens
NPFVKVYLL

SEQ ID NO: 74503 - protein, 9 aa, Homo Sapiens
LFRRLEQEF

SEQ ID NO: 74504 - protein, 9 aa, Homo Sapiens
YENVLQKNS

SEQ ID NO: 74505 - protein, 9 aa, Homo Sapiens
PSWPECHSS

SEQ ID NO: 74506 - protein, 9 aa, Homo Sapiens
QKAKAQEEG

SEQ ID NO: 74507 - protein, 9 aa, Homo Sapiens
LRHWRSHQG

SEQ ID NO: 74508 - protein, 9 aa, Homo Sapiens
GDYILKLPK

SEQ ID NO: 74509 - protein, 9 aa, Homo Sapiens
TFTEEQKCT

SEQ ID NO: 74510 - protein, 9 aa, Homo Sapiens
AKGQRPGFG

SEQ ID NO: 74511 - protein, 9 aa, Homo Sapiens
SGLVASPVL

SEQ ID NO: 74512 - protein, 9 aa, Homo Sapiens
DKESRSVIW

SEQ ID NO: 74513 - protein, 9 aa, Homo Sapiens
LVDFGAQVS

SEQ ID NO: 74514 - protein, 9 aa, Homo Sapiens
HRSSSPEVS

SEQ ID NO: 74515 - protein, 9 aa, Homo Sapiens
HRYIEHYTV

SEQ ID NO: 74516 - protein, 9 aa, Homo Sapiens
GSCVSYATF

SEQ ID NO: 74517 - protein, 9 aa, Homo Sapiens
KPLRHQAFL

SEQ ID NO: 74518 - protein, 9 aa, Homo Sapiens
IACESENNS

SEQ ID NO: 74519 - protein, 9 aa, Homo Sapiens
SGDETIDEK

SEQ ID NO: 74520 - protein, 9 aa, Homo Sapiens
RSRDKRRLN

SEQ ID NO: 74521 - protein, 9 aa, Homo Sapiens
MGRFISRKA

SEQ ID NO: 74522 - protein, 9 aa, Homo Sapiens
GGTQLEPLK

SEQ ID NO: 74523 - protein, 9 aa, Homo Sapiens
GPGAKSATV

SEQ ID NO: 74524 - protein, 9 aa, Homo Sapiens
AQEEGYFEA

SEQ ID NO: 74525 - protein, 9 aa, Homo Sapiens
GIPAHYVYL

SEQ ID NO: 74526 - protein, 9 aa, Homo Sapiens
ATMVYGLFM

SEQ ID NO: 74527 - protein, 9 aa, Homo Sapiens
EKKDKTQKV

SEQ ID NO: 74528 - protein, 9 aa, Homo Sapiens
SQFDGDYIL

SEQ ID NO: 74529 - protein, 9 aa, Homo Sapiens
PPPMSPTQL

SEQ ID NO: 74530 - protein, 9 aa, Homo Sapiens
GHSHCGHGQ

SEQ ID NO: 74531 - protein, 9 aa, Homo Sapiens
SKFFCAYKS

SEQ ID NO: 74532 - protein, 9 aa, Homo Sapiens
KVCLEKQMK

SEQ ID NO: 74533 - protein, 9 aa, Homo Sapiens
RSSQKSSGN

SEQ ID NO: 74534 - protein, 9 aa, Homo Sapiens
LSVSVTQLN

SEQ ID NO: 74535 - protein, 9 aa, Homo Sapiens
IFDVRRTFC

SEQ ID NO: 74536 - protein, 9 aa, Homo Sapiens
SEGKLLFNL

SEQ ID NO: 74537 - protein, 9 aa, Homo Sapiens
EGTKAEPGA

SEQ ID NO: 74538 - protein, 9 aa, Homo Sapiens
RHIYGTENN

SEQ ID NO: 74539 - protein, 9 aa, Homo Sapiens
GLENMASWG

SEQ ID NO: 74540 - protein, 9 aa, Homo Sapiens
DKMLPTYLK

SEQ ID NO: 74541 - protein, 9 aa, Homo Sapiens
ERRAPSFLL

SEQ ID NO: 74542 - protein, 9 aa, Homo Sapiens
DLPLGKEQH

SEQ ID NO: 74543 - protein, 9 aa, Homo Sapiens
CEARRNEYR

SEQ ID NO: 74544 - protein, 9 aa, Homo Sapiens
DFRPFVSSS

SEQ ID NO: 74545 - protein, 9 aa, Homo Sapiens
FNNVGNGFL

SEQ ID NO: 74546 - protein, 9 aa, Homo Sapiens
VWGAAGCTF

SEQ ID NO: 74547 - protein, 9 aa, Homo Sapiens
RGRGRGQGR

SEQ ID NO: 74548 - protein, 9 aa, Homo Sapiens
SSSPEVSEM

SEQ ID NO: 74549 - protein, 9 aa, Homo Sapiens
SPTKFEVVL

SEQ ID NO: 74550 - protein, 9 aa, Homo Sapiens
GKPLILKRV

SEQ ID NO: 74551 - protein, 9 aa, Homo Sapiens
KTKEESEHE

SEQ ID NO: 74552 - protein, 9 aa, Homo Sapiens
SGRAERDCQ

SEQ ID NO: 74553 - protein, 9 aa, Homo Sapiens
DYILKLPKS

SEQ ID NO: 74554 - protein, 9 aa, Homo Sapiens
LKRAEAGPL

SEQ ID NO: 74555 - protein, 9 aa, Homo Sapiens
LPELCAELG

SEQ ID NO: 74556 - protein, 9 aa, Homo Sapiens
LQREIKRLQ

SEQ ID NO: 74557 - protein, 9 aa, Homo Sapiens
FMLSADRCV

SEQ ID NO: 74558 - protein, 9 aa, Homo Sapiens
GLHALQQGG

SEQ ID NO: 74559 - protein, 9 aa, Homo Sapiens
WNLNPVFGG

SEQ ID NO: 74560 - protein, 9 aa, Homo Sapiens
FISRKAFPE

SEQ ID NO: 74561 - protein, 9 aa, Homo Sapiens
VSVVAVMVY

SEQ ID NO: 74562 - protein, 9 aa, Homo Sapiens
TSRCHAATL

SEQ ID NO: 74563 - protein, 9 aa, Homo Sapiens
LTRLCLVLR

SEQ ID NO: 74564 - protein, 9 aa, Homo Sapiens
DFDELQDNL

SEQ ID NO: 74565 - protein, 9 aa, Homo Sapiens
CRALGCGRA

SEQ ID NO: 74566 - protein, 9 aa, Homo Sapiens
DDNPKIFEN

SEQ ID NO: 74567 - protein, 9 aa, Homo Sapiens
KFTLRIIYN

SEQ ID NO: 74568 - protein, 9 aa, Homo Sapiens
AAGSYQVKF

SEQ ID NO: 74569 - protein, 9 aa, Homo Sapiens
FLDANMYNA

SEQ ID NO: 74570 - protein, 9 aa, Homo Sapiens
RYQKSTKLL

SEQ ID NO: 74571 - protein, 9 aa, Homo Sapiens
LFYANTLFT

SEQ ID NO: 74572 - protein, 9 aa, Homo Sapiens
VCTEVIQLA

SEQ ID NO: 74573 - protein, 9 aa, Homo Sapiens
GCNKQALPL

SEQ ID NO: 74574 - protein, 9 aa, Homo Sapiens
ALREKAVTV

SEQ ID NO: 74575 - protein, 9 aa, Homo Sapiens
FSTAIVDSR

SEQ ID NO: 74576 - protein, 9 aa, Homo Sapiens
RCQKAWALE

SEQ ID NO: 74577 - protein, 9 aa, Homo Sapiens
PAASRPRLH

SEQ ID NO: 74578 - protein, 9 aa, Homo Sapiens
SSYKKFCRV

SEQ ID NO: 74579 - protein, 9 aa, Homo Sapiens
ESTGHATPL

SEQ ID NO: 74580 - protein, 9 aa, Homo Sapiens
DTMSGRPWP

SEQ ID NO: 74581 - protein, 9 aa, Homo Sapiens
QNHKGCVLP

SEQ ID NO: 74582 - protein, 9 aa, Homo Sapiens
WVSFFFNLH

SEQ ID NO: 74583 - protein, 9 aa, Homo Sapiens
SVAPLELQE

SEQ ID NO: 74584 - protein, 9 aa, Homo Sapiens
LSTYFQTIN

SEQ ID NO: 74585 - protein, 9 aa, Homo Sapiens
SSAEEHINS

SEQ ID NO: 74586 - protein, 9 aa, Homo Sapiens
IKYSNSMKE

SEQ ID NO: 74587 - protein, 9 aa, Homo Sapiens
IRYSVREQI

SEQ ID NO: 74588 - protein, 9 aa, Homo Sapiens
LLERFKSSA

SEQ ID NO: 74589 - protein, 9 aa, Homo Sapiens
LQDIIVWPP

SEQ ID NO: 74590 - protein, 9 aa, Homo Sapiens
LEAHDSDLG

SEQ ID NO: 74591 - protein, 9 aa, Homo Sapiens
GILALLDKE

SEQ ID NO: 74592 - protein, 9 aa, Homo Sapiens
FEECITVPL

SEQ ID NO: 74593 - protein, 9 aa, Homo Sapiens
IYGLHALQQ

SEQ ID NO: 74594 - protein, 9 aa, Homo Sapiens
AVAAAAPGP

SEQ ID NO: 74595 - protein, 9 aa, Homo Sapiens
YSLSGRNFE

SEQ ID NO: 74596 - protein, 9 aa, Homo Sapiens
PDTDFGGNI

SEQ ID NO: 74597 - protein, 9 aa, Homo Sapiens
MRRMDPVLF

SEQ ID NO: 74598 - protein, 9 aa, Homo Sapiens
QVDNSKQLI

SEQ ID NO: 74599 - protein, 9 aa, Homo Sapiens
GGGEAAAVA

SEQ ID NO: 74600 - protein, 9 aa, Homo Sapiens
DYNVQAPPP

SEQ ID NO: 74601 - protein, 9 aa, Homo Sapiens
LHVSTRTRG

SEQ ID NO: 74602 - protein, 9 aa, Homo Sapiens
HRNPKNNVV

SEQ ID NO: 74603 - protein, 9 aa, Homo Sapiens
VLSCESSLK

SEQ ID NO: 74604 - protein, 9 aa, Homo Sapiens
VRFSAVKDK

SEQ ID NO: 74605 - protein, 9 aa, Homo Sapiens
SHALEFELQ

SEQ ID NO: 74606 - protein, 9 aa, Homo Sapiens
FTRNSSSVL

SEQ ID NO: 74607 - protein, 9 aa, Homo Sapiens
CMENQDCDE

SEQ ID NO: 74608 - protein, 9 aa, Homo Sapiens
KFPMKWSPP

SEQ ID NO: 74609 - protein, 9 aa, Homo Sapiens
AQKLLTQIT

SEQ ID NO: 74610 - protein, 9 aa, Homo Sapiens
ESPATTTAT

SEQ ID NO: 74611 - protein, 9 aa, Homo Sapiens
ERKAERALQ

SEQ ID NO: 74612 - protein, 9 aa, Homo Sapiens
SESDSAITS

SEQ ID NO: 74613 - protein, 9 aa, Homo Sapiens
CQGLRYPEC

SEQ ID NO: 74614 - protein, 9 aa, Homo Sapiens
VPEEELDFF

SEQ ID NO: 74615 - protein, 9 aa, Homo Sapiens
TTPYQLVKK

SEQ ID NO: 74616 - protein, 9 aa, Homo Sapiens
TLTRLCWAS

SEQ ID NO: 74617 - protein, 9 aa, Homo Sapiens
HCGHGQSTQ

SEQ ID NO: 74618 - protein, 9 aa, Homo Sapiens
RFWVNVMKN

SEQ ID NO: 74619 - protein, 9 aa, Homo Sapiens
NFNNVGNGF

SEQ ID NO: 74620 - protein, 9 aa, Homo Sapiens
TGYCWCVNR

SEQ ID NO: 74621 - protein, 9 aa, Homo Sapiens
ATSKPMSFY

SEQ ID NO: 74622 - protein, 9 aa, Homo Sapiens
RMDPVLFEP

SEQ ID NO: 74623 - protein, 9 aa, Homo Sapiens
GADYPGKCQ

SEQ ID NO: 74624 - protein, 9 aa, Homo Sapiens
QTIDLLNDN

SEQ ID NO: 74625 - protein, 9 aa, Homo Sapiens
DFMERKRAQ

SEQ ID NO: 74626 - protein, 9 aa, Homo Sapiens
LALPPTHSP

SEQ ID NO: 74627 - protein, 9 aa, Homo Sapiens
LGTSGLVAS

SEQ ID NO: 74628 - protein, 9 aa, Homo Sapiens
KLQVDQELS

SEQ ID NO: 74629 - protein, 9 aa, Homo Sapiens
EDYDEGLPK

SEQ ID NO: 74630 - protein, 9 aa, Homo Sapiens
QTQSSAPCM

SEQ ID NO: 74631 - protein, 9 aa, Homo Sapiens
RLKDIIVIN

SEQ ID NO: 74632 - protein, 9 aa, Homo Sapiens
TTATATATT

SEQ ID NO: 74633 - protein, 9 aa, Homo Sapiens
KMRPARAKF

SEQ ID NO: 74634 - protein, 9 aa, Homo Sapiens
HGSEMLFFR

SEQ ID NO: 74635 - protein, 9 aa, Homo Sapiens
LLCFQATDP

SEQ ID NO: 74636 - protein, 9 aa, Homo Sapiens
RLMSYSDES

SEQ ID NO: 74637 - protein, 9 aa, Homo Sapiens
QKFRYLQDI

SEQ ID NO: 74638 - protein, 9 aa, Homo Sapiens
PDSCCEPPC

SEQ ID NO: 74639 - protein, 9 aa, Homo Sapiens
CGRRGIKVC

SEQ ID NO: 74640 - protein, 9 aa, Homo Sapiens
VSCGIQLIR

SEQ ID NO: 74641 - protein, 9 aa, Homo Sapiens
FQKKGPVSG

SEQ ID NO: 74642 - protein, 9 aa, Homo Sapiens
KTLSTLLHL

SEQ ID NO: 74643 - protein, 9 aa, Homo Sapiens
PEVSEMLEY

SEQ ID NO: 74644 - protein, 9 aa, Homo Sapiens
IKRADKTSG

SEQ ID NO: 74645 - protein, 9 aa, Homo Sapiens
YVYLQAFVQ

SEQ ID NO: 74646 - protein, 9 aa, Homo Sapiens
PKYLGSCGK

SEQ ID NO: 74647 - protein, 9 aa, Homo Sapiens
SPTPIAPLA

SEQ ID NO: 74648 - protein, 9 aa, Homo Sapiens
HMVISELIS

SEQ ID NO: 74649 - protein, 9 aa, Homo Sapiens
VVSENHGDH

SEQ ID NO: 74650 - protein, 9 aa, Homo Sapiens
AQKKIDEAK

SEQ ID NO: 74651 - protein, 9 aa, Homo Sapiens
GLPKEEEGI

SEQ ID NO: 74652 - protein, 9 aa, Homo Sapiens
AAVAAAAPG

SEQ ID NO: 74653 - protein, 9 aa, Homo Sapiens
EDTTPYQLV

SEQ ID NO: 74654 - protein, 9 aa, Homo Sapiens
LMERLCVDY

SEQ ID NO: 74655 - protein, 9 aa, Homo Sapiens
PKEFFVDKH

SEQ ID NO: 74656 - protein, 9 aa, Homo Sapiens
CETFNEDNS

SEQ ID NO: 74657 - protein, 9 aa, Homo Sapiens
CLPAKPLEA

SEQ ID NO: 74658 - protein, 9 aa, Homo Sapiens
SETDKWMEN

SEQ ID NO: 74659 - protein, 9 aa, Homo Sapiens
LFQNTSAPY

SEQ ID NO: 74660 - protein, 9 aa, Homo Sapiens
GNLTLHQVI

SEQ ID NO: 74661 - protein, 9 aa, Homo Sapiens
ISELEEEKE

SEQ ID NO: 74662 - protein, 9 aa, Homo Sapiens
WCVNRDGRE

SEQ ID NO: 74663 - protein, 9 aa, Homo Sapiens
LFVSGGDHY

SEQ ID NO: 74664 - protein, 9 aa, Homo Sapiens
SDHRTVLKS

SEQ ID NO: 74665 - protein, 9 aa, Homo Sapiens
VTSAVPPSE

SEQ ID NO: 74666 - protein, 9 aa, Homo Sapiens
GQGRGALAR

SEQ ID NO: 74667 - protein, 9 aa, Homo Sapiens
LPSYDKAVS

SEQ ID NO: 74668 - protein, 9 aa, Homo Sapiens
SRDKRRLND

SEQ ID NO: 74669 - protein, 9 aa, Homo Sapiens
RVQGLKQQK

SEQ ID NO: 74670 - protein, 9 aa, Homo Sapiens
TLVTITNNF

SEQ ID NO: 74671 - protein, 9 aa, Homo Sapiens
SAFGTHTLI

SEQ ID NO: 74672 - protein, 9 aa, Homo Sapiens
IFENPRRSP

SEQ ID NO: 74673 - protein, 9 aa, Homo Sapiens
KRAQVDKVC

SEQ ID NO: 74674 - protein, 9 aa, Homo Sapiens
KVSKAQEAA

SEQ ID NO: 74675 - protein, 9 aa, Homo Sapiens
SVREQIDRG

SEQ ID NO: 74676 - protein, 9 aa, Homo Sapiens
SSPVSCLIS

SEQ ID NO: 74677 - protein, 9 aa, Homo Sapiens
VSEMLEYDR

SEQ ID NO: 74678 - protein, 9 aa, Homo Sapiens
APSWPECHS

SEQ ID NO: 74679 - protein, 9 aa, Homo Sapiens
KKACKCNEC

SEQ ID NO: 74680 - protein, 9 aa, Homo Sapiens
PCMGPNYGV

SEQ ID NO: 74681 - protein, 9 aa, Homo Sapiens
ERHRDYSRS

SEQ ID NO: 74682 - protein, 9 aa, Homo Sapiens
VSFKSLKHF

SEQ ID NO: 74683 - protein, 9 aa, Homo Sapiens
MRLCWASEL

SEQ ID NO: 74684 - protein, 9 aa, Homo Sapiens
EDEDEHEDE

SEQ ID NO: 74685 - protein, 9 aa, Homo Sapiens
APSRLAPGG

SEQ ID NO: 74686 - protein, 9 aa, Homo Sapiens
VMLRSYPGE

SEQ ID NO: 74687 - protein, 9 aa, Homo Sapiens
GKSPEDPSG

SEQ ID NO: 74688 - protein, 9 aa, Homo Sapiens
REFWEQRLR

SEQ ID NO: 74689 - protein, 9 aa, Homo Sapiens
PRAYAKTTK

SEQ ID NO: 74690 - protein, 9 aa, Homo Sapiens
ADWEVFQIE

SEQ ID NO: 74691 - protein, 9 aa, Homo Sapiens
QPPAPSRLA

SEQ ID NO: 74692 - protein, 9 aa, Homo Sapiens
KKRLRQENK

SEQ ID NO: 74693 - protein, 9 aa, Homo Sapiens
TFNTIESHP

SEQ ID NO: 74694 - protein, 9 aa, Homo Sapiens
YTSRCHAAT

SEQ ID NO: 74695 - protein, 9 aa, Homo Sapiens
ISPTKFEVV

SEQ ID NO: 74696 - protein, 9 aa, Homo Sapiens
KMEKMEQER

SEQ ID NO: 74697 - protein, 9 aa, Homo Sapiens
SVTQLNPKE

SEQ ID NO: 74698 - protein, 9 aa, Homo Sapiens
PTPIAPLAR

SEQ ID NO: 74699 - protein, 9 aa, Homo Sapiens
PSGCNKQAL

SEQ ID NO: 74700 - protein, 9 aa, Homo Sapiens
SMKFLKKGE

SEQ ID NO: 74701 - protein, 9 aa, Homo Sapiens
SEISNRTMI

SEQ ID NO: 74702 - protein, 9 aa, Homo Sapiens
DFAIFRTFG

SEQ ID NO: 74703 - protein, 9 aa, Homo Sapiens
NVCYDVLSP

SEQ ID NO: 74704 - protein, 9 aa, Homo Sapiens
PKVQWTDHQ

SEQ ID NO: 74705 - protein, 9 aa, Homo Sapiens
EDEHEDEDE

SEQ ID NO: 74706 - protein, 9 aa, Homo Sapiens
AKPLEATSD

SEQ ID NO: 74707 - protein, 9 aa, Homo Sapiens
AKRKSGSKM

SEQ ID NO: 74708 - protein, 9 aa, Homo Sapiens
ALLGGGGKA

SEQ ID NO: 74709 - protein, 9 aa, Homo Sapiens
EYIEKFKRK

SEQ ID NO: 74710 - protein, 9 aa, Homo Sapiens
LAPGGPAAS

SEQ ID NO: 74711 - protein, 9 aa, Homo Sapiens
PAAPPLSAA

SEQ ID NO: 74712 - protein, 9 aa, Homo Sapiens
QGERVQGLK

SEQ ID NO: 74713 - protein, 9 aa, Homo Sapiens
VDKRDRKNS

SEQ ID NO: 74714 - protein, 9 aa, Homo Sapiens
CHLCSDLIW

SEQ ID NO: 74715 - protein, 9 aa, Homo Sapiens
PRLHPWKLV

SEQ ID NO: 74716 - protein, 9 aa, Homo Sapiens
NWESCASKP

SEQ ID NO: 74717 - protein, 9 aa, Homo Sapiens
MLPSYDKAV

SEQ ID NO: 74718 - protein, 9 aa, Homo Sapiens
CFRDYNVQA

SEQ ID NO: 74719 - protein, 9 aa, Homo Sapiens
QLEPLKPLK

SEQ ID NO: 74720 - protein, 9 aa, Homo Sapiens
QERLMSYSD

SEQ ID NO: 74721 - protein, 9 aa, Homo Sapiens
VISVTGGAN

SEQ ID NO: 74722 - protein, 9 aa, Homo Sapiens
PRSSGNDAP

SEQ ID NO: 74723 - protein, 9 aa, Homo Sapiens
GNLGVILLI

SEQ ID NO: 74724 - protein, 9 aa, Homo Sapiens
LIWGLAGFL

SEQ ID NO: 74725 - protein, 9 aa, Homo Sapiens
ILDTFGNHP

SEQ ID NO: 74726 - protein, 9 aa, Homo Sapiens
PPAAPPLSA

SEQ ID NO: 74727 - protein, 9 aa, Homo Sapiens
SAPCMGPNY

SEQ ID NO: 74728 - protein, 9 aa, Homo Sapiens
KDRKYFHYN

SEQ ID NO: 74729 - protein, 9 aa, Homo Sapiens
DEKIDRTDP

SEQ ID NO: 74730 - protein, 9 aa, Homo Sapiens
GTRISKAAV

SEQ ID NO: 74731 - protein, 9 aa, Homo Sapiens
PGAKSATVP

SEQ ID NO: 74732 - protein, 9 aa, Homo Sapiens
GILEKGSLA

SEQ ID NO: 74733 - protein, 9 aa, Homo Sapiens
CVGCATKER

SEQ ID NO: 74734 - protein, 9 aa, Homo Sapiens
RRQQEKMMR

SEQ ID NO: 74735 - protein, 9 aa, Homo Sapiens
PRYPRSSME

SEQ ID NO: 74736 - protein, 9 aa, Homo Sapiens
ILGTSGLVA

SEQ ID NO: 74737 - protein, 9 aa, Homo Sapiens
SSFGAKFPM

SEQ ID NO: 74738 - protein, 9 aa, Homo Sapiens
YKKFCRVLK

SEQ ID NO: 74739 - protein, 9 aa, Homo Sapiens
FTRSSQKSS

SEQ ID NO: 74740 - protein, 9 aa, Homo Sapiens
AGGTQLEPL

SEQ ID NO: 74741 - protein, 9 aa, Homo Sapiens
FDALVTLCE

SEQ ID NO: 74742 - protein, 9 aa, Homo Sapiens
FQTINDLLS

SEQ ID NO: 74743 - protein, 9 aa, Homo Sapiens
IIQYQDSLR

SEQ ID NO: 74744 - protein, 9 aa, Homo Sapiens
CQEDTILTK

SEQ ID NO: 74745 - protein, 9 aa, Homo Sapiens
QVKFQMALE

SEQ ID NO: 74746 - protein, 9 aa, Homo Sapiens
LQFYTKAAR

SEQ ID NO: 74747 - protein, 9 aa, Homo Sapiens
ASNYTSRCH

SEQ ID NO: 74748 - protein, 9 aa, Homo Sapiens
ELNAIPPML

SEQ ID NO: 74749 - protein, 9 aa, Homo Sapiens
ARGKLSPWK

SEQ ID NO: 74750 - protein, 9 aa, Homo Sapiens
VQCIRLGKP

SEQ ID NO: 74751 - protein, 9 aa, Homo Sapiens
PPPEIDVTT

SEQ ID NO: 74752 - protein, 9 aa, Homo Sapiens
GRNFEKFHI

SEQ ID NO: 74753 - protein, 9 aa, Homo Sapiens
FTDSIKEEA

SEQ ID NO: 74754 - protein, 9 aa, Homo Sapiens
RKVSKAQEA

SEQ ID NO: 74755 - protein, 9 aa, Homo Sapiens
WGALTRGTL

SEQ ID NO: 74756 - protein, 9 aa, Homo Sapiens
LPVWGAAGC

SEQ ID NO: 74757 - protein, 9 aa, Homo Sapiens
TQSSAPCMG

SEQ ID NO: 74758 - protein, 9 aa, Homo Sapiens
FGAQVSVVH

SEQ ID NO: 74759 - protein, 9 aa, Homo Sapiens
RIKEKLAEN

SEQ ID NO: 74760 - protein, 9 aa, Homo Sapiens
VLLSPKVTC

SEQ ID NO: 74761 - protein, 9 aa, Homo Sapiens
CTQLLAPSG

SEQ ID NO: 74762 - protein, 9 aa, Homo Sapiens
LLPQSPPTD

SEQ ID NO: 74763 - protein, 9 aa, Homo Sapiens
CKFDEWTFI

SEQ ID NO: 74764 - protein, 9 aa, Homo Sapiens
FSSENLSVS

SEQ ID NO: 74765 - protein, 9 aa, Homo Sapiens
AEKPYKCND

SEQ ID NO: 74766 - protein, 9 aa, Homo Sapiens
ASWGNINVI

SEQ ID NO: 74767 - protein, 9 aa, Homo Sapiens
KGSLATPDQ

SEQ ID NO: 74768 - protein, 9 aa, Homo Sapiens
NLHILVCTF

SEQ ID NO: 74769 - protein, 9 aa, Homo Sapiens
RYSVREQID

SEQ ID NO: 74770 - protein, 9 aa, Homo Sapiens
PLGKEQHCK

SEQ ID NO: 74771 - protein, 9 aa, Homo Sapiens
QGSLDLALE

SEQ ID NO: 74772 - protein, 9 aa, Homo Sapiens
SIKEEAAHH

SEQ ID NO: 74773 - protein, 9 aa, Homo Sapiens
YYENVLQKN

SEQ ID NO: 74774 - protein, 9 aa, Homo Sapiens
RDCQVSSFR

SEQ ID NO: 74775 - protein, 9 aa, Homo Sapiens
RLSASQIWN

SEQ ID NO: 74776 - protein, 9 aa, Homo Sapiens
EVVSENHGD

SEQ ID NO: 74777 - protein, 9 aa, Homo Sapiens
LAPNPQFEA

SEQ ID NO: 74778 - protein, 9 aa, Homo Sapiens
ALEFELQRE

SEQ ID NO: 74779 - protein, 9 aa, Homo Sapiens
NEATGELGV

SEQ ID NO: 74780 - protein, 9 aa, Homo Sapiens
PSLGLWMKS

SEQ ID NO: 74781 - protein, 9 aa, Homo Sapiens
SVHSFQLKG

SEQ ID NO: 74782 - protein, 9 aa, Homo Sapiens
SDGADYPGK

SEQ ID NO: 74783 - protein, 9 aa, Homo Sapiens
TRRPGASVH

SEQ ID NO: 74784 - protein, 9 aa, Homo Sapiens
CKKQRLEAY

SEQ ID NO: 74785 - protein, 9 aa, Homo Sapiens
KRMLETAYK

SEQ ID NO: 74786 - protein, 9 aa, Homo Sapiens
EARRNEYRT

SEQ ID NO: 74787 - protein, 9 aa, Homo Sapiens
TGHSHCGHG

SEQ ID NO: 74788 - protein, 9 aa, Homo Sapiens
MNFNNVGNG

SEQ ID NO: 74789 - protein, 9 aa, Homo Sapiens
LFLDANMYN

SEQ ID NO: 74790 - protein, 9 aa, Homo Sapiens
SRGFIHIKW

SEQ ID NO: 74791 - protein, 9 aa, Homo Sapiens
VQEKVERLV

SEQ ID NO: 74792 - protein, 9 aa, Homo Sapiens
YDVLSPVSH

SEQ ID NO: 74793 - protein, 9 aa, Homo Sapiens
HSFQLKGFP

SEQ ID NO: 74794 - protein, 9 aa, Homo Sapiens
TPVVSTASK

SEQ ID NO: 74795 - protein, 9 aa, Homo Sapiens
YIACESENN

SEQ ID NO: 74796 - protein, 9 aa, Homo Sapiens
LKEKIMDQY

SEQ ID NO: 74797 - protein, 9 aa, Homo Sapiens
SECRDLARE

SEQ ID NO: 74798 - protein, 9 aa, Homo Sapiens
PGKCQLLRR

SEQ ID NO: 74799 - protein, 9 aa, Homo Sapiens
GRVPEEELD

SEQ ID NO: 74800 - protein, 9 aa, Homo Sapiens
FNLHILVCT

SEQ ID NO: 74801 - protein, 9 aa, Homo Sapiens
RGILEKGSL

SEQ ID NO: 74802 - protein, 9 aa, Homo Sapiens
IIVELFYET

SEQ ID NO: 74803 - protein, 9 aa, Homo Sapiens
KVRKAYLQF

SEQ ID NO: 74804 - protein, 9 aa, Homo Sapiens
QKELADVLV

SEQ ID NO: 74805 - protein, 9 aa, Homo Sapiens
GCQCDAGFM

SEQ ID NO: 74806 - protein, 9 aa, Homo Sapiens
VDMLRVASS

SEQ ID NO: 74807 - protein, 9 aa, Homo Sapiens
GSNRKVRKA

SEQ ID NO: 74808 - protein, 9 aa, Homo Sapiens
FHKHVQFDF

SEQ ID NO: 74809 - protein, 9 aa, Homo Sapiens
VVSVVAVMV

SEQ ID NO: 74810 - protein, 9 aa, Homo Sapiens
EVALFDKTR

SEQ ID NO: 74811 - protein, 9 aa, Homo Sapiens
KSPSQDKML

SEQ ID NO: 74812 - protein, 9 aa, Homo Sapiens
VERLVAQKS

SEQ ID NO: 74813 - protein, 9 aa, Homo Sapiens
LGLWMKSPA

SEQ ID NO: 74814 - protein, 9 aa, Homo Sapiens
QTSFLSPER

SEQ ID NO: 74815 - protein, 9 aa, Homo Sapiens
PGLPELCAE

SEQ ID NO: 74816 - protein, 9 aa, Homo Sapiens
PSVQHPNEQ

SEQ ID NO: 74817 - protein, 9 aa, Homo Sapiens
ELEVDNTEM

SEQ ID NO: 74818 - protein, 9 aa, Homo Sapiens
REATNVKND

SEQ ID NO: 74819 - protein, 9 aa, Homo Sapiens
CGIQLIRED

SEQ ID NO: 74820 - protein, 9 aa, Homo Sapiens
PVRFLVDFG

SEQ ID NO: 74821 - protein, 9 aa, Homo Sapiens
PHVQLSSAP

SEQ ID NO: 74822 - protein, 9 aa, Homo Sapiens
ICHRVLSCE

SEQ ID NO: 74823 - protein, 9 aa, Homo Sapiens
QSPSAQKTG

SEQ ID NO: 74824 - protein, 9 aa, Homo Sapiens
QLRLDVKKE

SEQ ID NO: 74825 - protein, 9 aa, Homo Sapiens
TLFAPALAA

SEQ ID NO: 74826 - protein, 9 aa, Homo Sapiens
NKERTSQSR

SEQ ID NO: 74827 - protein, 9 aa, Homo Sapiens
ISYVLTSRS

SEQ ID NO: 74828 - protein, 9 aa, Homo Sapiens
TFRNQTIDL

SEQ ID NO: 74829 - protein, 9 aa, Homo Sapiens
KKTKEESEH

SEQ ID NO: 74830 - protein, 9 aa, Homo Sapiens
CLEKQMKNL

SEQ ID NO: 74831 - protein, 9 aa, Homo Sapiens
LRICIIFIW

SEQ ID NO: 74832 - protein, 9 aa, Homo Sapiens
SWGNINVIL

SEQ ID NO: 74833 - protein, 9 aa, Homo Sapiens
AVLLLAFQE

SEQ ID NO: 74834 - protein, 9 aa, Homo Sapiens
VLQQLNAQR

SEQ ID NO: 74835 - protein, 9 aa, Homo Sapiens
RAIFDVRRT

SEQ ID NO: 74836 - protein, 9 aa, Homo Sapiens
RHRDYSRSF

SEQ ID NO: 74837 - protein, 9 aa, Homo Sapiens
AQRAAARFY

SEQ ID NO: 74838 - protein, 9 aa, Homo Sapiens
KPPMDYHED

SEQ ID NO: 74839 - protein, 9 aa, Homo Sapiens
DDTDVDDNE

SEQ ID NO: 74840 - protein, 9 aa, Homo Sapiens
VNRIISVRS

SEQ ID NO: 74841 - protein, 9 aa, Homo Sapiens
GRKGLRPPW

SEQ ID NO: 74842 - protein, 9 aa, Homo Sapiens
LCVDYGKKS

SEQ ID NO: 74843 - protein, 9 aa, Homo Sapiens
PFLRNAIIS

SEQ ID NO: 74844 - protein, 9 aa, Homo Sapiens
KFMTQSAFQ

SEQ ID NO: 74845 - protein, 9 aa, Homo Sapiens
DYYLLHQTW

SEQ ID NO: 74846 - protein, 9 aa, Homo Sapiens
ILEKGSLAT

SEQ ID NO: 74847 - protein, 9 aa, Homo Sapiens
NARLRPSRW

SEQ ID NO: 74848 - protein, 9 aa, Homo Sapiens
ASLFYANTL

SEQ ID NO: 74849 - protein, 9 aa, Homo Sapiens
KELPSVQHP

SEQ ID NO: 74850 - protein, 9 aa, Homo Sapiens
TSGLVASPV

SEQ ID NO: 74851 - protein, 9 aa, Homo Sapiens
SEMLFFRNA

SEQ ID NO: 74852 - protein, 9 aa, Homo Sapiens
GRGQGRGAL

SEQ ID NO: 74853 - protein, 9 aa, Homo Sapiens
PYQYHSVHG

SEQ ID NO: 74854 - protein, 9 aa, Homo Sapiens
PRKPVEKAV

SEQ ID NO: 74855 - protein, 9 aa, Homo Sapiens
YIDPNAFFR

SEQ ID NO: 74856 - protein, 9 aa, Homo Sapiens
SAHYGYERH

SEQ ID NO: 74857 - protein, 9 aa, Homo Sapiens
LGVILLIRI

SEQ ID NO: 74858 - protein, 9 aa, Homo Sapiens
LSENQARFY

SEQ ID NO: 74859 - protein, 9 aa, Homo Sapiens
SAEEHINSS

SEQ ID NO: 74860 - protein, 9 aa, Homo Sapiens
IFIWIYSCL

SEQ ID NO: 74861 - protein, 9 aa, Homo Sapiens
TNDNIEIVI

SEQ ID NO: 74862 - protein, 9 aa, Homo Sapiens
DYRLPDSND

SEQ ID NO: 74863 - protein, 9 aa, Homo Sapiens
VHELEVDNT

SEQ ID NO: 74864 - protein, 9 aa, Homo Sapiens
GVCTQLLAP

SEQ ID NO: 74865 - protein, 9 aa, Homo Sapiens
SAFYLGHLR

SEQ ID NO: 74866 - protein, 9 aa, Homo Sapiens
SGKRREMTC

SEQ ID NO: 74867 - protein, 9 aa, Homo Sapiens
QEKKDKTQK

SEQ ID NO: 74868 - protein, 9 aa, Homo Sapiens
TQRICLKRA

SEQ ID NO: 74869 - protein, 9 aa, Homo Sapiens
IEHYTVQPE

SEQ ID NO: 74870 - protein, 9 aa, Homo Sapiens
YQDSLRIQA

SEQ ID NO: 74871 - protein, 9 aa, Homo Sapiens
QAEGRVPEE

SEQ ID NO: 74872 - protein, 9 aa, Homo Sapiens
HLDYDFNSN

SEQ ID NO: 74873 - protein, 9 aa, Homo Sapiens
QIRYSVREQ

SEQ ID NO: 74874 - protein, 9 aa, Homo Sapiens
IVDSRRFNY

SEQ ID NO: 74875 - protein, 9 aa, Homo Sapiens
LRDGFTLEG

SEQ ID NO: 74876 - protein, 9 aa, Homo Sapiens
RIIVELFYE

SEQ ID NO: 74877 - protein, 9 aa, Homo Sapiens
PMKWSPPEV

SEQ ID NO: 74878 - protein, 9 aa, Homo Sapiens
LLGGGGKAR

SEQ ID NO: 74879 - protein, 9 aa, Homo Sapiens
LEFELQREI

SEQ ID NO: 74880 - protein, 9 aa, Homo Sapiens
SRLQLERAN

SEQ ID NO: 74881 - protein, 9 aa, Homo Sapiens
MRRQQEKMM

SEQ ID NO: 74882 - protein, 9 aa, Homo Sapiens
DALREKAVT

SEQ ID NO: 74883 - protein, 9 aa, Homo Sapiens
WRGPGNHIL

SEQ ID NO: 74884 - protein, 9 aa, Homo Sapiens
RNSSSVLPH

SEQ ID NO: 74885 - protein, 9 aa, Homo Sapiens
ILRAPDMDQ

SEQ ID NO: 74886 - protein, 9 aa, Homo Sapiens
KLKEKIMDQ

SEQ ID NO: 74887 - protein, 9 aa, Homo Sapiens
KREDTTPYQ

SEQ ID NO: 74888 - protein, 9 aa, Homo Sapiens
RLRCNHGKP

SEQ ID NO: 74889 - protein, 9 aa, Homo Sapiens
AERDCQVSS

SEQ ID NO: 74890 - protein, 9 aa, Homo Sapiens
VVLYSLNKY

SEQ ID NO: 74891 - protein, 9 aa, Homo Sapiens
WIHKGMPLE

SEQ ID NO: 74892 - protein, 9 aa, Homo Sapiens
LGSAKNRPE

SEQ ID NO: 74893 - protein, 9 aa, Homo Sapiens
SMPSGDETI

SEQ ID NO: 74894 - protein, 9 aa, Homo Sapiens
CVNRDGREV

SEQ ID NO: 74895 - protein, 9 aa, Homo Sapiens
LPQSPPTDL

SEQ ID NO: 74896 - protein, 9 aa, Homo Sapiens
VYKNTNSSN

SEQ ID NO: 74897 - protein, 9 aa, Homo Sapiens
DHLGIYVWS

SEQ ID NO: 74898 - protein, 9 aa, Homo Sapiens
VHSFQLKGF

SEQ ID NO: 74899 - protein, 9 aa, Homo Sapiens
RHLCKKQRL

SEQ ID NO: 74900 - protein, 9 aa, Homo Sapiens
GANNFALKP

SEQ ID NO: 74901 - protein, 9 aa, Homo Sapiens
LEKGSLATP

SEQ ID NO: 74902 - protein, 9 aa, Homo Sapiens
AFYLGHLRE

SEQ ID NO: 74903 - protein, 9 aa, Homo Sapiens
GDFFLRLFN

SEQ ID NO: 74904 - protein, 9 aa, Homo Sapiens
KDEDWNDFL

SEQ ID NO: 74905 - protein, 9 aa, Homo Sapiens
EALSEMDIL

SEQ ID NO: 74906 - protein, 9 aa, Homo Sapiens
LTVLGNLGV

SEQ ID NO: 74907 - protein, 9 aa, Homo Sapiens
KERAERKAE

SEQ ID NO: 74908 - protein, 9 aa, Homo Sapiens
VLCKFDEWT

SEQ ID NO: 74909 - protein, 9 aa, Homo Sapiens
PTIQSDIPA

SEQ ID NO: 74910 - protein, 9 aa, Homo Sapiens
DKLPQSPGL

SEQ ID NO: 74911 - protein, 9 aa, Homo Sapiens
PQGLEAAKE

SEQ ID NO: 74912 - protein, 9 aa, Homo Sapiens
HNSGEDSHL

SEQ ID NO: 74913 - protein, 9 aa, Homo Sapiens
VLGLMVQQP

SEQ ID NO: 74914 - protein, 9 aa, Homo Sapiens
PTNKGKYKV

SEQ ID NO: 74915 - protein, 9 aa, Homo Sapiens
KPMSFYPPH

SEQ ID NO: 74916 - protein, 9 aa, Homo Sapiens
DLWRGPGNH

SEQ ID NO: 74917 - protein, 9 aa, Homo Sapiens
YARRLGEAW

SEQ ID NO: 74918 - protein, 9 aa, Homo Sapiens
VASPVLPAA

SEQ ID NO: 74919 - protein, 9 aa, Homo Sapiens
KPVEKAVAN

SEQ ID NO: 74920 - protein, 9 aa, Homo Sapiens
SFFFNLHIL

SEQ ID NO: 74921 - protein, 9 aa, Homo Sapiens
CVDYGKKSK

SEQ ID NO: 74922 - protein, 9 aa, Homo Sapiens
ELGKLRDRL

SEQ ID NO: 74923 - protein, 9 aa, Homo Sapiens
EVSEMLEYD

SEQ ID NO: 74924 - protein, 9 aa, Homo Sapiens
QSSAPCMGP

SEQ ID NO: 74925 - protein, 9 aa, Homo Sapiens
GGAKAAKGC

SEQ ID NO: 74926 - protein, 9 aa, Homo Sapiens
HWRSHQGER

SEQ ID NO: 74927 - protein, 9 aa, Homo Sapiens
WEVFQIEER

SEQ ID NO: 74928 - protein, 9 aa, Homo Sapiens
SAQKTGLSP

SEQ ID NO: 74929 - protein, 9 aa, Homo Sapiens
NQTIDLLND

SEQ ID NO: 74930 - protein, 9 aa, Homo Sapiens
VWGQDGNEK

SEQ ID NO: 74931 - protein, 9 aa, Homo Sapiens
TVDKLESEV

SEQ ID NO: 74932 - protein, 9 aa, Homo Sapiens
QAIKAGLEL

SEQ ID NO: 74933 - protein, 9 aa, Homo Sapiens
ISVRSGREW

SEQ ID NO: 74934 - protein, 9 aa, Homo Sapiens
WPECHSSAD

SEQ ID NO: 74935 - protein, 9 aa, Homo Sapiens
ISEETLNDS

SEQ ID NO: 74936 - protein, 9 aa, Homo Sapiens
AITSSTVSK

SEQ ID NO: 74937 - protein, 9 aa, Homo Sapiens
YFLNLCLID

SEQ ID NO: 74938 - protein, 9 aa, Homo Sapiens
NKSWKKIRP

SEQ ID NO: 74939 - protein, 9 aa, Homo Sapiens
RKIHTGKKA

SEQ ID NO: 74940 - protein, 9 aa, Homo Sapiens
SIIHGYKRV

SEQ ID NO: 74941 - protein, 9 aa, Homo Sapiens
GWGGEDHDL

SEQ ID NO: 74942 - protein, 9 aa, Homo Sapiens
CWASELSDL

SEQ ID NO: 74943 - protein, 9 aa, Homo Sapiens
GSEMLFFRN

SEQ ID NO: 74944 - protein, 9 aa, Homo Sapiens
PGPLSKPPD

SEQ ID NO: 74945 - protein, 9 aa, Homo Sapiens
TGGELFHRI

SEQ ID NO: 74946 - protein, 9 aa, Homo Sapiens
NSRLQLERA

SEQ ID NO: 74947 - protein, 9 aa, Homo Sapiens
RIISVRSGR

SEQ ID NO: 74948 - protein, 9 aa, Homo Sapiens
LCKFDEWTF

SEQ ID NO: 74949 - protein, 9 aa, Homo Sapiens
KEEEDQDPP

SEQ ID NO: 74950 - protein, 9 aa, Homo Sapiens
VTLCEELGC

SEQ ID NO: 74951 - protein, 9 aa, Homo Sapiens
SIKYSNSMK

SEQ ID NO: 74952 - protein, 9 aa, Homo Sapiens
ILKQEKKDK

SEQ ID NO: 74953 - protein, 9 aa, Homo Sapiens
QDGNEKMGG

SEQ ID NO: 74954 - protein, 9 aa, Homo Sapiens
ASPPRSSGN

SEQ ID NO: 74955 - protein, 9 aa, Homo Sapiens
NVAGRNDKN

SEQ ID NO: 74956 - protein, 9 aa, Homo Sapiens
RDRLQGEHS

SEQ ID NO: 74957 - protein, 9 aa, Homo Sapiens
VSSESDSAI

SEQ ID NO: 74958 - protein, 9 aa, Homo Sapiens
CIRLGKPLI

SEQ ID NO: 74959 - protein, 9 aa, Homo Sapiens
PPTHSPTSH

SEQ ID NO: 74960 - protein, 9 aa, Homo Sapiens
ILIVEIELL

SEQ ID NO: 74961 - protein, 9 aa, Homo Sapiens
GQSSCCAPV

SEQ ID NO: 74962 - protein, 9 aa, Homo Sapiens
GYARRLGEA

SEQ ID NO: 74963 - protein, 9 aa, Homo Sapiens
GNFSEDVLC

SEQ ID NO: 74964 - protein, 9 aa, Homo Sapiens
RIQDVLFVY

SEQ ID NO: 74965 - protein, 9 aa, Homo Sapiens
AFLIRSFSV

SEQ ID NO: 74966 - protein, 9 aa, Homo Sapiens
ASKQLDRVA

SEQ ID NO: 74967 - protein, 9 aa, Homo Sapiens
LPEEVNRSQ

SEQ ID NO: 74968 - protein, 9 aa, Homo Sapiens
VLGNLGVIL

SEQ ID NO: 74969 - protein, 9 aa, Homo Sapiens
DCVRTADHH

SEQ ID NO: 74970 - protein, 9 aa, Homo Sapiens
RILVQQFQV

SEQ ID NO: 74971 - protein, 9 aa, Homo Sapiens
SFFNAGTFT

SEQ ID NO: 74972 - protein, 9 aa, Homo Sapiens
NSDNLHAGN

SEQ ID NO: 74973 - protein, 9 aa, Homo Sapiens
KKQPDDSRD

SEQ ID NO: 74974 - protein, 9 aa, Homo Sapiens
AAAAAISSI

SEQ ID NO: 74975 - protein, 9 aa, Homo Sapiens
ARIIVELFY

SEQ ID NO: 74976 - protein, 9 aa, Homo Sapiens
YQVKFQMAL

SEQ ID NO: 74977 - protein, 9 aa, Homo Sapiens
HLCSDLIWG

SEQ ID NO: 74978 - protein, 9 aa, Homo Sapiens
KGFTVSFKS

SEQ ID NO: 74979 - protein, 9 aa, Homo Sapiens
VFGPGTRIS

SEQ ID NO: 74980 - protein, 9 aa, Homo Sapiens
EMDKPMFTQ

SEQ ID NO: 74981 - protein, 9 aa, Homo Sapiens
MNCMKTEEN

SEQ ID NO: 74982 - protein, 9 aa, Homo Sapiens
SSMWELTAA

SEQ ID NO: 74983 - protein, 9 aa, Homo Sapiens
VLFVYKNTN

SEQ ID NO: 74984 - protein, 9 aa, Homo Sapiens
KNKERTSQS

SEQ ID NO: 74985 - protein, 9 aa, Homo Sapiens
RFSWGAKGQ

SEQ ID NO: 74986 - protein, 9 aa, Homo Sapiens
AEDLEQFCF

SEQ ID NO: 74987 - protein, 9 aa, Homo Sapiens
LQTESDAKE

SEQ ID NO: 74988 - protein, 9 aa, Homo Sapiens
GGGGGGEAA

SEQ ID NO: 74989 - protein, 9 aa, Homo Sapiens
TWVSFFFNL

SEQ ID NO: 74990 - protein, 9 aa, Homo Sapiens
APPPPMSPT

SEQ ID NO: 74991 - protein, 9 aa, Homo Sapiens
LQYLLLHYT

SEQ ID NO: 74992 - protein, 9 aa, Homo Sapiens
WQRFHLTLS

SEQ ID NO: 74993 - protein, 9 aa, Homo Sapiens
EEYGAGTYG

SEQ ID NO: 74994 - protein, 9 aa, Homo Sapiens
FVYFYYKEK

SEQ ID NO: 74995 - protein, 9 aa, Homo Sapiens
SCQEDTILT

SEQ ID NO: 74996 - protein, 9 aa, Homo Sapiens
THTLIKKKN

SEQ ID NO: 74997 - protein, 9 aa, Homo Sapiens
HEDEDEAGS

SEQ ID NO: 74998 - protein, 9 aa, Homo Sapiens
RAERDCQVS

SEQ ID NO: 74999 - protein, 9 aa, Homo Sapiens
FTEEQKCTY

SEQ ID NO: 75000 - protein, 9 aa, Homo Sapiens
LRLDVKKEL

SEQ ID NO: 75001 - protein, 9 aa, Homo Sapiens
AKAAKGCSN

SEQ ID NO: 75002 - protein, 9 aa, Homo Sapiens
ERHCQLAGD

SEQ ID NO: 75003 - protein, 9 aa, Homo Sapiens
LGGGGKARG

SEQ ID NO: 75004 - protein, 9 aa, Homo Sapiens
LFQKRMLET

SEQ ID NO: 75005 - protein, 9 aa, Homo Sapiens
ASQIWNLNP

SEQ ID NO: 75006 - protein, 9 aa, Homo Sapiens
KTSEKSVHS

SEQ ID NO: 75007 - protein, 9 aa, Homo Sapiens
AMRKLWSNK

SEQ ID NO: 75008 - protein, 9 aa, Homo Sapiens
MWELTAANL

SEQ ID NO: 75009 - protein, 9 aa, Homo Sapiens
VSPSDHRNP

SEQ ID NO: 75010 - protein, 9 aa, Homo Sapiens
PNPQFEAFA

SEQ ID NO: 75011 - protein, 9 aa, Homo Sapiens
CQKAWALER

SEQ ID NO: 75012 - protein, 9 aa, Homo Sapiens
SSESTGHAT

SEQ ID NO: 75013 - protein, 9 aa, Homo Sapiens
QTEHWGGQG

SEQ ID NO: 75014 - protein, 9 aa, Homo Sapiens
SLFYANTLF

SEQ ID NO: 75015 - protein, 9 aa, Homo Sapiens
FDGDYILKL

SEQ ID NO: 75016 - protein, 9 aa, Homo Sapiens
VSYATFDDD

SEQ ID NO: 75017 - protein, 9 aa, Homo Sapiens
AKRSRDKRR

SEQ ID NO: 75018 - protein, 9 aa, Homo Sapiens
DTTGHSHCG

SEQ ID NO: 75019 - protein, 9 aa, Homo Sapiens
TEFTDSIKE

SEQ ID NO: 75020 - protein, 9 aa, Homo Sapiens
LWMKSPAFP

SEQ ID NO: 75021 - protein, 9 aa, Homo Sapiens
KAPPPPMSP

SEQ ID NO: 75022 - protein, 9 aa, Homo Sapiens
AKFPMKWSP

SEQ ID NO: 75023 - protein, 9 aa, Homo Sapiens
QREIKRLQE

SEQ ID NO: 75024 - protein, 9 aa, Homo Sapiens
FKSLKHFDC

SEQ ID NO: 75025 - protein, 9 aa, Homo Sapiens
LMSYSDESR

SEQ ID NO: 75026 - protein, 9 aa, Homo Sapiens
LGAHTPVTI

SEQ ID NO: 75027 - protein, 9 aa, Homo Sapiens
LTSCGELMK

SEQ ID NO: 75028 - protein, 9 aa, Homo Sapiens
GKDTMSGRP

SEQ ID NO: 75029 - protein, 9 aa, Homo Sapiens
GGEAAAVAP

SEQ ID NO: 75030 - protein, 9 aa, Homo Sapiens
LKSSEKSSS

SEQ ID NO: 75031 - protein, 9 aa, Homo Sapiens
EFHKHVQFD

SEQ ID NO: 75032 - protein, 9 aa, Homo Sapiens
YGYARRLGE

SEQ ID NO: 75033 - protein, 9 aa, Homo Sapiens
RNGHNEMDK

SEQ ID NO: 75034 - protein, 9 aa, Homo Sapiens
FFLRLFNVT

SEQ ID NO: 75035 - protein, 9 aa, Homo Sapiens
VLLLAFQEA

SEQ ID NO: 75036 - protein, 9 aa, Homo Sapiens
GRAEAASQL

SEQ ID NO: 75037 - protein, 9 aa, Homo Sapiens
PPYGSLQGY

SEQ ID NO: 75038 - protein, 9 aa, Homo Sapiens
VLKSSKRSW

SEQ ID NO: 75039 - protein, 9 aa, Homo Sapiens
YKFTPRAGG

SEQ ID NO: 75040 - protein, 9 aa, Homo Sapiens
AHARLQYLL

SEQ ID NO: 75041 - protein, 9 aa, Homo Sapiens
LSSDHRTVL

SEQ ID NO: 75042 - protein, 9 aa, Homo Sapiens
FQNTSAPYQ

SEQ ID NO: 75043 - protein, 9 aa, Homo Sapiens
RHSLSFNGC

SEQ ID NO: 75044 - protein, 9 aa, Homo Sapiens
ITVILSQVS

SEQ ID NO: 75045 - protein, 9 aa, Homo Sapiens
EATNVKNDQ

SEQ ID NO: 75046 - protein, 9 aa, Homo Sapiens
ADYPGKCQL

SEQ ID NO: 75047 - protein, 9 aa, Homo Sapiens
ENLSVSDGE

SEQ ID NO: 75048 - protein, 9 aa, Homo Sapiens
PQGKYQVLL

SEQ ID NO: 75049 - protein, 9 aa, Homo Sapiens
RTSQSRGLS

SEQ ID NO: 75050 - protein, 9 aa, Homo Sapiens
VWSNISLYS

SEQ ID NO: 75051 - protein, 9 aa, Homo Sapiens
CTDLKVSQN

SEQ ID NO: 75052 - protein, 9 aa, Homo Sapiens
QFDFLIKGQ

SEQ ID NO: 75053 - protein, 9 aa, Homo Sapiens
SSQKSSGNC

SEQ ID NO: 75054 - protein, 9 aa, Homo Sapiens
CGVCSNTDE

SEQ ID NO: 75055 - protein, 9 aa, Homo Sapiens
NDNIEIVIK

SEQ ID NO: 75056 - protein, 9 aa, Homo Sapiens
STGYCWCVN

SEQ ID NO: 75057 - protein, 9 aa, Homo Sapiens
GDTTGHSHC

SEQ ID NO: 75058 - protein, 9 aa, Homo Sapiens
DSAITSSTV

SEQ ID NO: 75059 - protein, 9 aa, Homo Sapiens
VQGLKQQKA

SEQ ID NO: 75060 - protein, 9 aa, Homo Sapiens
MCQVTSTPD

SEQ ID NO: 75061 - protein, 9 aa, Homo Sapiens
NKVVDTCLY

SEQ ID NO: 75062 - protein, 9 aa, Homo Sapiens
KELERRAQE

SEQ ID NO: 75063 - protein, 9 aa, Homo Sapiens
KSSEKSSST

SEQ ID NO: 75064 - protein, 9 aa, Homo Sapiens
FPNNRELYI

SEQ ID NO: 75065 - protein, 9 aa, Homo Sapiens
RIKKQGSLD

SEQ ID NO: 75066 - protein, 9 aa, Homo Sapiens
DDKVQKSSA

SEQ ID NO: 75067 - protein, 9 aa, Homo Sapiens
DLKVSQNHK

SEQ ID NO: 75068 - protein, 9 aa, Homo Sapiens
QNINFAEEV

SEQ ID NO: 75069 - protein, 9 aa, Homo Sapiens
LRQEVALFD

SEQ ID NO: 75070 - protein, 9 aa, Homo Sapiens
ERAERKAER

SEQ ID NO: 75071 - protein, 9 aa, Homo Sapiens
PSEISNRTM

SEQ ID NO: 75072 - protein, 9 aa, Homo Sapiens
FQRALPILN

SEQ ID NO: 75073 - protein, 9 aa, Homo Sapiens
KELADVLVR

SEQ ID NO: 75074 - protein, 9 aa, Homo Sapiens
GELVKSNCG

SEQ ID NO: 75075 - protein, 9 aa, Homo Sapiens
RLLRIKKQG

SEQ ID NO: 75076 - protein, 9 aa, Homo Sapiens
HVAVHSSEE

SEQ ID NO: 75077 - protein, 9 aa, Homo Sapiens
PYGSLQGYQ

SEQ ID NO: 75078 - protein, 9 aa, Homo Sapiens
QCDAGFMLS

SEQ ID NO: 75079 - protein, 9 aa, Homo Sapiens
LNPKEEELS

SEQ ID NO: 75080 - protein, 9 aa, Homo Sapiens
QSSCCAPVY

SEQ ID NO: 75081 - protein, 9 aa, Homo Sapiens
LQSPSAQKT

SEQ ID NO: 75082 - protein, 9 aa, Homo Sapiens
DSDLGQSGQ

SEQ ID NO: 75083 - protein, 9 aa, Homo Sapiens
CRVHELEVD

SEQ ID NO: 75084 - protein, 9 aa, Homo Sapiens
FQEARYKAF

SEQ ID NO: 75085 - protein, 9 aa, Homo Sapiens
PSPKSPLRL

SEQ ID NO: 75086 - protein, 9 aa, Homo Sapiens
KVAQWRTKY

SEQ ID NO: 75087 - protein, 9 aa, Homo Sapiens
LSGRNFEKF

SEQ ID NO: 75088 - protein, 9 aa, Homo Sapiens
LHEKGPEVL

SEQ ID NO: 75089 - protein, 9 aa, Homo Sapiens
SAKNRPEQS

SEQ ID NO: 75090 - protein, 9 aa, Homo Sapiens
PGGPGGLGC

SEQ ID NO: 75091 - protein, 9 aa, Homo Sapiens
DDCPDSCCE

SEQ ID NO: 75092 - protein, 9 aa, Homo Sapiens
NHGLIVLQQ

SEQ ID NO: 75093 - protein, 9 aa, Homo Sapiens
LFEPVYDKK

SEQ ID NO: 75094 - protein, 9 aa, Homo Sapiens
VCNKVVDTC

SEQ ID NO: 75095 - protein, 9 aa, Homo Sapiens
LDFSTAIVD

SEQ ID NO: 75096 - protein, 9 aa, Homo Sapiens
NAFMLLMGN

SEQ ID NO: 75097 - protein, 9 aa, Homo Sapiens
GGNLTLHQV

SEQ ID NO: 75098 - protein, 9 aa, Homo Sapiens
LVQCIRLGK

SEQ ID NO: 75099 - protein, 9 aa, Homo Sapiens
DTDVDDNEE

SEQ ID NO: 75100 - protein, 9 aa, Homo Sapiens
FQVGAPMSP

SEQ ID NO: 75101 - protein, 9 aa, Homo Sapiens
VTVTSAVPP

SEQ ID NO: 75102 - protein, 9 aa, Homo Sapiens
LNEGLMYEY

SEQ ID NO: 75103 - protein, 9 aa, Homo Sapiens
PLEKVVMGI

SEQ ID NO: 75104 - protein, 9 aa, Homo Sapiens
RVHELEVDN

SEQ ID NO: 75105 - protein, 9 aa, Homo Sapiens
KRNARLRPS

SEQ ID NO: 75106 - protein, 9 aa, Homo Sapiens
SSENLSVSD

SEQ ID NO: 75107 - protein, 9 aa, Homo Sapiens
IRRYQKSTK

SEQ ID NO: 75108 - protein, 9 aa, Homo Sapiens
GVPRTLSPY

SEQ ID NO: 75109 - protein, 9 aa, Homo Sapiens
CGHTSQGSG

SEQ ID NO: 75110 - protein, 9 aa, Homo Sapiens
KMNFNNVGN

SEQ ID NO: 75111 - protein, 9 aa, Homo Sapiens
CFQATDPVN

SEQ ID NO: 75112 - protein, 9 aa, Homo Sapiens
HVQPRPLPS

SEQ ID NO: 75113 - protein, 9 aa, Homo Sapiens
HRQVQKELA

SEQ ID NO: 75114 - protein, 9 aa, Homo Sapiens
SELSDLHLL

SEQ ID NO: 75115 - protein, 9 aa, Homo Sapiens
IVFSLAAVF

SEQ ID NO: 75116 - protein, 9 aa, Homo Sapiens
LDILDTFGN

SEQ ID NO: 75117 - protein, 9 aa, Homo Sapiens
LDVKKELEM

SEQ ID NO: 75118 - protein, 9 aa, Homo Sapiens
MIFVIFLIA

SEQ ID NO: 75119 - protein, 9 aa, Homo Sapiens
PGSAGRAGF

SEQ ID NO: 75120 - protein, 9 aa, Homo Sapiens
SAGRAGFPR

SEQ ID NO: 75121 - protein, 9 aa, Homo Sapiens
DNSPKIIIT

SEQ ID NO: 75122 - protein, 9 aa, Homo Sapiens
CSLTGQVAE

SEQ ID NO: 75123 - protein, 9 aa, Homo Sapiens
YPRSSMEDD

SEQ ID NO: 75124 - protein, 9 aa, Homo Sapiens
MMPHSLHSL

SEQ ID NO: 75125 - protein, 9 aa, Homo Sapiens
RVPEEELDF

SEQ ID NO: 75126 - protein, 9 aa, Homo Sapiens
SCGKFLVST

SEQ ID NO: 75127 - protein, 9 aa, Homo Sapiens
TVDMLRVAS

SEQ ID NO: 75128 - protein, 9 aa, Homo Sapiens
PKEEEGITY

SEQ ID NO: 75129 - protein, 9 aa, Homo Sapiens
LWGPRAYAK

SEQ ID NO: 75130 - protein, 9 aa, Homo Sapiens
SSRGFIHIK

SEQ ID NO: 75131 - protein, 9 aa, Homo Sapiens
KAYLQFMVS

SEQ ID NO: 75132 - protein, 9 aa, Homo Sapiens
IKQNSGAAI

SEQ ID NO: 75133 - protein, 9 aa, Homo Sapiens
HALEFELQR

SEQ ID NO: 75134 - protein, 9 aa, Homo Sapiens
TAIVDSRRF

SEQ ID NO: 75135 - protein, 9 aa, Homo Sapiens
VAGQLTRLC

SEQ ID NO: 75136 - protein, 9 aa, Homo Sapiens
DNEERLRAP

SEQ ID NO: 75137 - protein, 9 aa, Homo Sapiens
WVNVMKNPQ

SEQ ID NO: 75138 - protein, 9 aa, Homo Sapiens
EQEFLANAR

SEQ ID NO: 75139 - protein, 9 aa, Homo Sapiens
EQIDRGSFV

SEQ ID NO: 75140 - protein, 9 aa, Homo Sapiens
IEKFKRKGN

SEQ ID NO: 75141 - protein, 9 aa, Homo Sapiens
RWVHMRTAY

SEQ ID NO: 75142 - protein, 9 aa, Homo Sapiens
LLHATPPDL

SEQ ID NO: 75143 - protein, 9 aa, Homo Sapiens
GCKPSQVLQ

SEQ ID NO: 75144 - protein, 9 aa, Homo Sapiens
ASKVTAAAM

SEQ ID NO: 75145 - protein, 9 aa, Homo Sapiens
VNRDGREVE

SEQ ID NO: 75146 - protein, 9 aa, Homo Sapiens
TYCNLTSCG

SEQ ID NO: 75147 - protein, 9 aa, Homo Sapiens
RVATAAVAA

SEQ ID NO: 75148 - protein, 9 aa, Homo Sapiens
LGSCVSYAT

SEQ ID NO: 75149 - protein, 9 aa, Homo Sapiens
RYIEHYTVQ

SEQ ID NO: 75150 - protein, 9 aa, Homo Sapiens
REDRLQEYT

SEQ ID NO: 75151 - protein, 9 aa, Homo Sapiens
VFVGRPMVW

SEQ ID NO: 75152 - protein, 9 aa, Homo Sapiens
MGNIVRVVV

SEQ ID NO: 75153 - protein, 9 aa, Homo Sapiens
VREQIDRGS

SEQ ID NO: 75154 - protein, 9 aa, Homo Sapiens
NSNWESCAS

SEQ ID NO: 75155 - protein, 9 aa, Homo Sapiens
PAPSRLAPG

SEQ ID NO: 75156 - protein, 9 aa, Homo Sapiens
VCYDVLSPV

SEQ ID NO: 75157 - protein, 9 aa, Homo Sapiens
DMRKSQERL

SEQ ID NO: 75158 - protein, 9 aa, Homo Sapiens
HIYGTENNI

SEQ ID NO: 75159 - protein, 9 aa, Homo Sapiens
ETQLRLDVK

SEQ ID NO: 75160 - protein, 9 aa, Homo Sapiens
FFFNLHILV

SEQ ID NO: 75161 - protein, 9 aa, Homo Sapiens
WAEQATAGR

SEQ ID NO: 75162 - protein, 9 aa, Homo Sapiens
RTVPCSQTS

SEQ ID NO: 75163 - protein, 9 aa, Homo Sapiens
GSWAEQATA

SEQ ID NO: 75164 - protein, 9 aa, Homo Sapiens
TPLSKDETA

SEQ ID NO: 75165 - protein, 9 aa, Homo Sapiens
LKNYKQPVV

SEQ ID NO: 75166 - protein, 9 aa, Homo Sapiens
TDSIKEEAA

SEQ ID NO: 75167 - protein, 9 aa, Homo Sapiens
RQENKNLAR

SEQ ID NO: 75168 - protein, 9 aa, Homo Sapiens
QQGGLRAAT

SEQ ID NO: 75169 - protein, 9 aa, Homo Sapiens
HQAFLIRSF

SEQ ID NO: 75170 - protein, 9 aa, Homo Sapiens
SSDPQGLEA

SEQ ID NO: 75171 - protein, 9 aa, Homo Sapiens
TFKQCMENQ

SEQ ID NO: 75172 - protein, 9 aa, Homo Sapiens
SSVLPHGYV

SEQ ID NO: 75173 - protein, 9 aa, Homo Sapiens
KKDCDLFQK

SEQ ID NO: 75174 - protein, 9 aa, Homo Sapiens
DEDWNDFLQ

SEQ ID NO: 75175 - protein, 9 aa, Homo Sapiens
GFFLGFCSS

SEQ ID NO: 75176 - protein, 9 aa, Homo Sapiens
YQKSTKLLI

SEQ ID NO: 75177 - protein, 9 aa, Homo Sapiens
DETAQGEIA

SEQ ID NO: 75178 - protein, 9 aa, Homo Sapiens
KKDEKEEED

SEQ ID NO: 75179 - protein, 9 aa, Homo Sapiens
TLLLHGGAK

SEQ ID NO: 75180 - protein, 9 aa, Homo Sapiens
GRAERDCQV

SEQ ID NO: 75181 - protein, 9 aa, Homo Sapiens
CQGDCGGPL

SEQ ID NO: 75182 - protein, 9 aa, Homo Sapiens
AISEETLND

SEQ ID NO: 75183 - protein, 9 aa, Homo Sapiens
KPKVQWTDH

SEQ ID NO: 75184 - protein, 9 aa, Homo Sapiens
SEDLWRGPG

SEQ ID NO: 75185 - protein, 9 aa, Homo Sapiens
QTLSFLPTC

SEQ ID NO: 75186 - protein, 9 aa, Homo Sapiens
EDVLCKFDE

SEQ ID NO: 75187 - protein, 9 aa, Homo Sapiens
FEPVYDKKS

SEQ ID NO: 75188 - protein, 9 aa, Homo Sapiens
SWPECHSSA

SEQ ID NO: 75189 - protein, 9 aa, Homo Sapiens
KFFCAYKSH

SEQ ID NO: 75190 - protein, 9 aa, Homo Sapiens
IHMNQIGFQ

SEQ ID NO: 75191 - protein, 9 aa, Homo Sapiens
ILALLDKEC

SEQ ID NO: 75192 - protein, 9 aa, Homo Sapiens
LEKVCNKVV

SEQ ID NO: 75193 - protein, 9 aa, Homo Sapiens
MVWGLAFQG

SEQ ID NO: 75194 - protein, 9 aa, Homo Sapiens
AEGRVPEEE

SEQ ID NO: 75195 - protein, 9 aa, Homo Sapiens
DLCHVVPAQ

SEQ ID NO: 75196 - protein, 9 aa, Homo Sapiens
LTLHQVIYG

SEQ ID NO: 75197 - protein, 9 aa, Homo Sapiens
RQLSMKFLK

SEQ ID NO: 75198 - protein, 9 aa, Homo Sapiens
YILKLPKSN

SEQ ID NO: 75199 - protein, 9 aa, Homo Sapiens
PPMSPTQLS

SEQ ID NO: 75200 - protein, 9 aa, Homo Sapiens
SASETDKWM

SEQ ID NO: 75201 - protein, 9 aa, Homo Sapiens
LEKVVMGIP

SEQ ID NO: 75202 - protein, 9 aa, Homo Sapiens
SQNHKGCVL

SEQ ID NO: 75203 - protein, 9 aa, Homo Sapiens
GKFLVSTST

SEQ ID NO: 75204 - protein, 9 aa, Homo Sapiens
AAREDRLQE

SEQ ID NO: 75205 - protein, 9 aa, Homo Sapiens
MLFFRNAIE

SEQ ID NO: 75206 - protein, 9 aa, Homo Sapiens
RGAFDHTVS

SEQ ID NO: 75207 - protein, 9 aa, Homo Sapiens
IDERIHTGV

SEQ ID NO: 75208 - protein, 9 aa, Homo Sapiens
IDLSVNRQI

SEQ ID NO: 75209 - protein, 9 aa, Homo Sapiens
VTEDGKSPE

SEQ ID NO: 75210 - protein, 9 aa, Homo Sapiens
APNPGPLSK

SEQ ID NO: 75211 - protein, 9 aa, Homo Sapiens
YGYERHRDY

SEQ ID NO: 75212 - protein, 9 aa, Homo Sapiens
FKRKGNEKE

SEQ ID NO: 75213 - protein, 9 aa, Homo Sapiens
SNDRWVHMR

SEQ ID NO: 75214 - protein, 9 aa, Homo Sapiens
KTTKMKVLE

SEQ ID NO: 75215 - protein, 9 aa, Homo Sapiens
MRKSQERLM

SEQ ID NO: 75216 - protein, 9 aa, Homo Sapiens
MLAVGLIEK

SEQ ID NO: 75217 - protein, 9 aa, Homo Sapiens
DLERHCQLA

SEQ ID NO: 75218 - protein, 9 aa, Homo Sapiens
DERIHTGVK

SEQ ID NO: 75219 - protein, 9 aa, Homo Sapiens
HNEMDKPMF

SEQ ID NO: 75220 - protein, 9 aa, Homo Sapiens
DYDEGLPKE

SEQ ID NO: 75221 - protein, 9 aa, Homo Sapiens
RGFIHIKWI

SEQ ID NO: 75222 - protein, 9 aa, Homo Sapiens
LEEQTAFNK

SEQ ID NO: 75223 - protein, 9 aa, Homo Sapiens
IWNLNPVFG

SEQ ID NO: 75224 - protein, 9 aa, Homo Sapiens
RHQAFLIRS

SEQ ID NO: 75225 - protein, 9 aa, Homo Sapiens
LSRELLHEK

SEQ ID NO: 75226 - protein, 9 aa, Homo Sapiens
CFQYGTPET

SEQ ID NO: 75227 - protein, 9 aa, Homo Sapiens
LAFQEARYK

SEQ ID NO: 75228 - protein, 9 aa, Homo Sapiens
PLALNTVDM

SEQ ID NO: 75229 - protein, 9 aa, Homo Sapiens
VCSLTGQVA

SEQ ID NO: 75230 - protein, 9 aa, Homo Sapiens
LNTVDMLRV

SEQ ID NO: 75231 - protein, 9 aa, Homo Sapiens
PHVAVHSSE

SEQ ID NO: 75232 - protein, 9 aa, Homo Sapiens
PPEIDVTTY

SEQ ID NO: 75233 - protein, 9 aa, Homo Sapiens
TVPCSQTSF

SEQ ID NO: 75234 - protein, 9 aa, Homo Sapiens
KGMPLEKVV

SEQ ID NO: 75235 - protein, 9 aa, Homo Sapiens
PVEKAVANF

SEQ ID NO: 75236 - protein, 9 aa, Homo Sapiens
EDQGVCTQL

SEQ ID NO: 75237 - protein, 9 aa, Homo Sapiens
NNGYSNPFV

SEQ ID NO: 75238 - protein, 9 aa, Homo Sapiens
TVLKSSKRS

SEQ ID NO: 75239 - protein, 9 aa, Homo Sapiens
MLRSYPGEA

SEQ ID NO: 75240 - protein, 9 aa, Homo Sapiens
IPPMLDLLK

SEQ ID NO: 75241 - protein, 9 aa, Homo Sapiens
KGCSNAHLH

SEQ ID NO: 75242 - protein, 9 aa, Homo Sapiens
MKCKHVPFL

SEQ ID NO: 75243 - protein, 9 aa, Homo Sapiens
LSPKVTCGP

SEQ ID NO: 75244 - protein, 9 aa, Homo Sapiens
ISDLERHCQ

SEQ ID NO: 75245 - protein, 9 aa, Homo Sapiens
SVTGGANNF

SEQ ID NO: 75246 - protein, 9 aa, Homo Sapiens
NSGAAISEE

SEQ ID NO: 75247 - protein, 9 aa, Homo Sapiens
RLHPWKLVS

SEQ ID NO: 75248 - protein, 9 aa, Homo Sapiens
KAEEAGGTQ

SEQ ID NO: 75249 - protein, 9 aa, Homo Sapiens
DRAPDRQEE

SEQ ID NO: 75250 - protein, 9 aa, Homo Sapiens
NCETFNEDN

SEQ ID NO: 75251 - protein, 9 aa, Homo Sapiens
QSDVTEDGK

SEQ ID NO: 75252 - protein, 9 aa, Homo Sapiens
GDGTFNTIE

SEQ ID NO: 75253 - protein, 9 aa, Homo Sapiens
TSSYTAEEY

SEQ ID NO: 75254 - protein, 9 aa, Homo Sapiens
LIDERIHTG

SEQ ID NO: 75255 - protein, 9 aa, Homo Sapiens
KDETAQGEI

SEQ ID NO: 75256 - protein, 9 aa, Homo Sapiens
PLVAMCQVT

SEQ ID NO: 75257 - protein, 9 aa, Homo Sapiens
NFEKFHIDP

SEQ ID NO: 75258 - protein, 9 aa, Homo Sapiens
NSHLHVSTR

SEQ ID NO: 75259 - protein, 9 aa, Homo Sapiens
GGPGSAGRA

SEQ ID NO: 75260 - protein, 9 aa, Homo Sapiens
KLRDRLQGE

SEQ ID NO: 75261 - protein, 9 aa, Homo Sapiens
YLIVAVVVV

SEQ ID NO: 75262 - protein, 9 aa, Homo Sapiens
EALGSICYI

SEQ ID NO: 75263 - protein, 9 aa, Homo Sapiens
VLPHGYVPS

SEQ ID NO: 75264 - protein, 9 aa, Homo Sapiens
KERTSQSRG

SEQ ID NO: 75265 - protein, 9 aa, Homo Sapiens
GAHTPVTIS

SEQ ID NO: 75266 - protein, 9 aa, Homo Sapiens
TPIAPLARA

SEQ ID NO: 75267 - protein, 9 aa, Homo Sapiens
KYLGSCGKF

SEQ ID NO: 75268 - protein, 9 aa, Homo Sapiens
FPKKQPDDS

SEQ ID NO: 75269 - protein, 9 aa, Homo Sapiens
SPKSPLRLI

SEQ ID NO: 75270 - protein, 9 aa, Homo Sapiens
NDRWVHMRT

SEQ ID NO: 75271 - protein, 9 aa, Homo Sapiens
DTVKLQVDQ

SEQ ID NO: 75272 - protein, 9 aa, Homo Sapiens
WKGKSKTLD

SEQ ID NO: 75273 - protein, 9 aa, Homo Sapiens
VKDKLPQSP

SEQ ID NO: 75274 - protein, 9 aa, Homo Sapiens
GCEARRNEY

SEQ ID NO: 75275 - protein, 9 aa, Homo Sapiens
SNSMKEMVI

SEQ ID NO: 75276 - protein, 9 aa, Homo Sapiens
VIWENEFSF

SEQ ID NO: 75277 - protein, 9 aa, Homo Sapiens
LDCVRTADH

SEQ ID NO: 75278 - protein, 9 aa, Homo Sapiens
TKLLIRKLP

SEQ ID NO: 75279 - protein, 9 aa, Homo Sapiens
NVKNDQERQ

SEQ ID NO: 75280 - protein, 9 aa, Homo Sapiens
CWCVNRDGR

SEQ ID NO: 75281 - protein, 9 aa, Homo Sapiens
SPKEFFVDK

SEQ ID NO: 75282 - protein, 9 aa, Homo Sapiens
ERKRAQVDK

SEQ ID NO: 75283 - protein, 9 aa, Homo Sapiens
VLFEPVYDK

SEQ ID NO: 75284 - protein, 9 aa, Homo Sapiens
IFRTFGHHH

SEQ ID NO: 75285 - protein, 9 aa, Homo Sapiens
GPLSKPPDL

SEQ ID NO: 75286 - protein, 9 aa, Homo Sapiens
ASATMVYGL

SEQ ID NO: 75287 - protein, 9 aa, Homo Sapiens
QIDRGSFVG

SEQ ID NO: 75288 - protein, 9 aa, Homo Sapiens
IQSDIPAPR

SEQ ID NO: 75289 - protein, 9 aa, Homo Sapiens
VQHPNEQKE

SEQ ID NO: 75290 - protein, 9 aa, Homo Sapiens
HIKWICSKP

SEQ ID NO: 75291 - protein, 9 aa, Homo Sapiens
EGKLLFNLI

SEQ ID NO: 75292 - protein, 9 aa, Homo Sapiens
EKIQCETVL

SEQ ID NO: 75293 - protein, 9 aa, Homo Sapiens
FFEECITVP

SEQ ID NO: 75294 - protein, 9 aa, Homo Sapiens
GLELFQNTS

SEQ ID NO: 75295 - protein, 9 aa, Homo Sapiens
NGDYIACES

SEQ ID NO: 75296 - protein, 9 aa, Homo Sapiens
LPPHLERIK

SEQ ID NO: 75297 - protein, 9 aa, Homo Sapiens
QFEAFAGWV

SEQ ID NO: 75298 - protein, 9 aa, Homo Sapiens
SEVLLSPKV

SEQ ID NO: 75299 - protein, 9 aa, Homo Sapiens
FLSPEQTEH

SEQ ID NO: 75300 - protein, 9 aa, Homo Sapiens
SAKVDFDEL

SEQ ID NO: 75301 - protein, 9 aa, Homo Sapiens
QLLERFKSS

SEQ ID NO: 75302 - protein, 9 aa, Homo Sapiens
SDSAITSST

SEQ ID NO: 75303 - protein, 9 aa, Homo Sapiens
GGANNFALK

SEQ ID NO: 75304 - protein, 9 aa, Homo Sapiens
SKTTFPSSP

SEQ ID NO: 75305 - protein, 9 aa, Homo Sapiens
TVLGNLGVI

SEQ ID NO: 75306 - protein, 9 aa, Homo Sapiens
ARQLHVLLP

SEQ ID NO: 75307 - protein, 9 aa, Homo Sapiens
PICGVPTIQ

SEQ ID NO: 75308 - protein, 9 aa, Homo Sapiens
GFTVSFKSL

SEQ ID NO: 75309 - protein, 9 aa, Homo Sapiens
LCSDLIWGL

SEQ ID NO: 75310 - protein, 9 aa, Homo Sapiens
SNGDYIACE

SEQ ID NO: 75311 - protein, 9 aa, Homo Sapiens
PSDHRNPKN

SEQ ID NO: 75312 - protein, 9 aa, Homo Sapiens
GPMMPHSLH

SEQ ID NO: 75313 - protein, 9 aa, Homo Sapiens
FIWIYSCLI

SEQ ID NO: 75314 - protein, 9 aa, Homo Sapiens
DPQGLEAAK

SEQ ID NO: 75315 - protein, 9 aa, Homo Sapiens
DGFFLGFCS

SEQ ID NO: 75316 - protein, 9 aa, Homo Sapiens
VPSLGLWMK

SEQ ID NO: 75317 - protein, 9 aa, Homo Sapiens
QVSSFRVKE

SEQ ID NO: 75318 - protein, 9 aa, Homo Sapiens
VSFFFNLHI

SEQ ID NO: 75319 - protein, 9 aa, Homo Sapiens
HSSEELHPK

SEQ ID NO: 75320 - protein, 9 aa, Homo Sapiens
LGSICYIAE

SEQ ID NO: 75321 - protein, 9 aa, Homo Sapiens
GHNEMDKPM

SEQ ID NO: 75322 - protein, 9 aa, Homo Sapiens
PMVWGLAFQ

SEQ ID NO: 75323 - protein, 9 aa, Homo Sapiens
PLRHQAFLI

SEQ ID NO: 75324 - protein, 9 aa, Homo Sapiens
STLLRHWRS

SEQ ID NO: 75325 - protein, 9 aa, Homo Sapiens
EFWEQRLRC

SEQ ID NO: 75326 - protein, 9 aa, Homo Sapiens
FQKRMLETA

SEQ ID NO: 75327 - protein, 9 aa, Homo Sapiens
AGRAGFPRE

SEQ ID NO: 75328 - protein, 9 aa, Homo Sapiens
SYPGEARRK

SEQ ID NO: 75329 - protein, 9 aa, Homo Sapiens
YSNSMKEMV

SEQ ID NO: 75330 - protein, 9 aa, Homo Sapiens
NKVCLEKQM

SEQ ID NO: 75331 - protein, 9 aa, Homo Sapiens
QYQDSLRIQ

SEQ ID NO: 75332 - protein, 9 aa, Homo Sapiens
CAYKSHFRN

SEQ ID NO: 75333 - protein, 9 aa, Homo Sapiens
SAPPGEEET

SEQ ID NO: 75334 - protein, 9 aa, Homo Sapiens
AGRVATAAV

SEQ ID NO: 75335 - protein, 9 aa, Homo Sapiens
PAFVHYYKE

SEQ ID NO: 75336 - protein, 9 aa, Homo Sapiens
AVFVGRPMV

SEQ ID NO: 75337 - protein, 9 aa, Homo Sapiens
GESPATTTA

SEQ ID NO: 75338 - protein, 9 aa, Homo Sapiens
DEKEEEDQD

SEQ ID NO: 75339 - protein, 9 aa, Homo Sapiens
ETNDNIEIV

SEQ ID NO: 75340 - protein, 9 aa, Homo Sapiens
EKGSLATPD

SEQ ID NO: 75341 - protein, 9 aa, Homo Sapiens
NCLILRAPD

SEQ ID NO: 75342 - protein, 9 aa, Homo Sapiens
QVSSPVSCL

SEQ ID NO: 75343 - protein, 9 aa, Homo Sapiens
SFKSLKHFD

SEQ ID NO: 75344 - protein, 9 aa, Homo Sapiens
ANMYNALCK

SEQ ID NO: 75345 - protein, 9 aa, Homo Sapiens
RHCIIKTYK

SEQ ID NO: 75346 - protein, 9 aa, Homo Sapiens
DSHLKQRRR

SEQ ID NO: 75347 - protein, 9 aa, Homo Sapiens
SAHARLQYL

SEQ ID NO: 75348 - protein, 9 aa, Homo Sapiens
VRSSMWELT

SEQ ID NO: 75349 - protein, 9 aa, Homo Sapiens
FVGRPMVWG

SEQ ID NO: 75350 - protein, 9 aa, Homo Sapiens
GFQTQSAPG

SEQ ID NO: 75351 - protein, 9 aa, Homo Sapiens
LGKPLILKR

SEQ ID NO: 75352 - protein, 9 aa, Homo Sapiens
DFFLRLFNV

SEQ ID NO: 75353 - protein, 9 aa, Homo Sapiens
GEAWARRSH

SEQ ID NO: 75354 - protein, 9 aa, Homo Sapiens
YLQAFVQPG

SEQ ID NO: 75355 - protein, 9 aa, Homo Sapiens
GLWMKSPAF

SEQ ID NO: 75356 - protein, 9 aa, Homo Sapiens
QLNPKEEEL

SEQ ID NO: 75357 - protein, 9 aa, Homo Sapiens
KCQLLRRAC

SEQ ID NO: 75358 - protein, 9 aa, Homo Sapiens
ENNISDLER

SEQ ID NO: 75359 - protein, 9 aa, Homo Sapiens
RNAIEGKSN

SEQ ID NO: 75360 - protein, 9 aa, Homo Sapiens
ADGDWEKEN

SEQ ID NO: 75361 - protein, 9 aa, Homo Sapiens
GVPTDQAIK

SEQ ID NO: 75362 - protein, 9 aa, Homo Sapiens
TRSSQKSSG

SEQ ID NO: 75363 - protein, 9 aa, Homo Sapiens
PERSRTLHF

SEQ ID NO: 75364 - protein, 9 aa, Homo Sapiens
FYLGHLREV

SEQ ID NO: 75365 - protein, 9 aa, Homo Sapiens
GPGNHILHC

SEQ ID NO: 75366 - protein, 9 aa, Homo Sapiens
GKKACKCNE

SEQ ID NO: 75367 - protein, 9 aa, Homo Sapiens
SGAAISEET

SEQ ID NO: 75368 - protein, 9 aa, Homo Sapiens
IKAGLELLK

SEQ ID NO: 75369 - protein, 9 aa, Homo Sapiens
KLTPNYDKS

SEQ ID NO: 75370 - protein, 9 aa, Homo Sapiens
TVQPETGAL

SEQ ID NO: 75371 - protein, 9 aa, Homo Sapiens
NKVDKEYKN

SEQ ID NO: 75372 - protein, 9 aa, Homo Sapiens
MDPVLFEPV

SEQ ID NO: 75373 - protein, 9 aa, Homo Sapiens
TKFEVVLYL

SEQ ID NO: 75374 - protein, 9 aa, Homo Sapiens
FQYGTPETL

SEQ ID NO: 75375 - protein, 9 aa, Homo Sapiens
SHSRGRKGL

SEQ ID NO: 75376 - protein, 9 aa, Homo Sapiens
DTPLPEEVN

SEQ ID NO: 75377 - protein, 9 aa, Homo Sapiens
HARLQYLLL

SEQ ID NO: 75378 - protein, 9 aa, Homo Sapiens
KQLDRVAAA

SEQ ID NO: 75379 - protein, 9 aa, Homo Sapiens
KTVALWDLI

SEQ ID NO: 75380 - protein, 9 aa, Homo Sapiens
NEQVGSESA

SEQ ID NO: 75381 - protein, 9 aa, Homo Sapiens
SNKLITDDK

SEQ ID NO: 75382 - protein, 9 aa, Homo Sapiens
LTRLCWASE

SEQ ID NO: 75383 - protein, 9 aa, Homo Sapiens
LCHVVPAQK

SEQ ID NO: 75384 - protein, 9 aa, Homo Sapiens
KAVTVDKLE

SEQ ID NO: 75385 - protein, 9 aa, Homo Sapiens
PSFLLGVGG

SEQ ID NO: 75386 - protein, 9 aa, Homo Sapiens
FFCGVCSNT

SEQ ID NO: 75387 - protein, 9 aa, Homo Sapiens
SKGKNVTVE

SEQ ID NO: 75388 - protein, 9 aa, Homo Sapiens
SDLERHCQL

SEQ ID NO: 75389 - protein, 9 aa, Homo Sapiens
EQVGSESAQ

SEQ ID NO: 75390 - protein, 9 aa, Homo Sapiens
SKRKKTKEE

SEQ ID NO: 75391 - protein, 9 aa, Homo Sapiens
DILDTFGNH

SEQ ID NO: 75392 - protein, 9 aa, Homo Sapiens
PATTTATAT

SEQ ID NO: 75393 - protein, 9 aa, Homo Sapiens
ESDSAITSS

SEQ ID NO: 75394 - protein, 9 aa, Homo Sapiens
TPGESKTTF

SEQ ID NO: 75395 - protein, 9 aa, Homo Sapiens
EDLEQFCFK

SEQ ID NO: 75396 - protein, 9 aa, Homo Sapiens
CDLFQKRML

SEQ ID NO: 75397 - protein, 9 aa, Homo Sapiens
PWKGKSKTL

SEQ ID NO: 75398 - protein, 9 aa, Homo Sapiens
LERIKEKLA

SEQ ID NO: 75399 - protein, 9 aa, Homo Sapiens
AQRQGFQKK

SEQ ID NO: 75400 - protein, 9 aa, Homo Sapiens
KAAFTYSID

SEQ ID NO: 75401 - protein, 9 aa, Homo Sapiens
TEHWGGQGS

SEQ ID NO: 75402 - protein, 9 aa, Homo Sapiens
LYKQASATM

SEQ ID NO: 75403 - protein, 9 aa, Homo Sapiens
LPLVAMCQV

SEQ ID NO: 75404 - protein, 9 aa, Homo Sapiens
TRPHVQLSS

SEQ ID NO: 75405 - protein, 9 aa, Homo Sapiens
VTFPSVAPL

SEQ ID NO: 75406 - protein, 9 aa, Homo Sapiens
QSPERSRTL

SEQ ID NO: 75407 - protein, 9 aa, Homo Sapiens
RYLQDIIVW

SEQ ID NO: 75408 - protein, 9 aa, Homo Sapiens
VHIQGELVK

SEQ ID NO: 75409 - protein, 9 aa, Homo Sapiens
INVDLQSIH

SEQ ID NO: 75410 - protein, 9 aa, Homo Sapiens
LKDIIVINV

SEQ ID NO: 75411 - protein, 9 aa, Homo Sapiens
IKSVLTWKH

SEQ ID NO: 75412 - protein, 9 aa, Homo Sapiens
EGSWAEQAT

SEQ ID NO: 75413 - protein, 9 aa, Homo Sapiens
NISPNSHLH

SEQ ID NO: 75414 - protein, 9 aa, Homo Sapiens
WPFEKPNYT

SEQ ID NO: 75415 - protein, 9 aa, Homo Sapiens
RTLFAPALA

SEQ ID NO: 75416 - protein, 9 aa, Homo Sapiens
QLRDGFTLE

SEQ ID NO: 75417 - protein, 9 aa, Homo Sapiens
GAKFPMKWS

SEQ ID NO: 75418 - protein, 9 aa, Homo Sapiens
KSNCGASPL

SEQ ID NO: 75419 - protein, 9 aa, Homo Sapiens
NHVVFVAGW

SEQ ID NO: 75420 - protein, 9 aa, Homo Sapiens
IEENLQPWP

SEQ ID NO: 75421 - protein, 9 aa, Homo Sapiens
FHRIVEKGY

SEQ ID NO: 75422 - protein, 9 aa, Homo Sapiens
ISNRTMIIY

SEQ ID NO: 75423 - protein, 9 aa, Homo Sapiens
SSCCAPVYC

SEQ ID NO: 75424 - protein, 9 aa, Homo Sapiens
HYGYERHRD

SEQ ID NO: 75425 - protein, 9 aa, Homo Sapiens
SRLSASQIW

SEQ ID NO: 75426 - protein, 9 aa, Homo Sapiens
STLLHLSSE

SEQ ID NO: 75427 - protein, 9 aa, Homo Sapiens
PYKFTPRAG

SEQ ID NO: 75428 - protein, 9 aa, Homo Sapiens
WEKENEATG

SEQ ID NO: 75429 - protein, 9 aa, Homo Sapiens
RHKEKLKEK

SEQ ID NO: 75430 - protein, 9 aa, Homo Sapiens
DPNAFFRLP

SEQ ID NO: 75431 - protein, 9 aa, Homo Sapiens
LGNLGVILL

SEQ ID NO: 75432 - protein, 9 aa, Homo Sapiens
FGSVARMCA

SEQ ID NO: 75433 - protein, 9 aa, Homo Sapiens
SMEDDFNYG

SEQ ID NO: 75434 - protein, 9 aa, Homo Sapiens
SFGAKFPMK

SEQ ID NO: 75435 - protein, 9 aa, Homo Sapiens
GSICYIAEV

SEQ ID NO: 75436 - protein, 9 aa, Homo Sapiens
CELPLVAMC

SEQ ID NO: 75437 - protein, 9 aa, Homo Sapiens
IKEEAAHHS

SEQ ID NO: 75438 - protein, 9 aa, Homo Sapiens
RKGLRPPWS

SEQ ID NO: 75439 - protein, 9 aa, Homo Sapiens
LEGEILEIS

SEQ ID NO: 75440 - protein, 9 aa, Homo Sapiens
SDLIWGLAG

SEQ ID NO: 75441 - protein, 9 aa, Homo Sapiens
NKLVSPSDH

SEQ ID NO: 75442 - protein, 9 aa, Homo Sapiens
PVWGAAGCT

SEQ ID NO: 75443 - protein, 9 aa, Homo Sapiens
APPLSAADT

SEQ ID NO: 75444 - protein, 9 aa, Homo Sapiens
QVQLQQYRQ

SEQ ID NO: 75445 - protein, 9 aa, Homo Sapiens
AEKIQCETV

SEQ ID NO: 75446 - protein, 9 aa, Homo Sapiens
DYIACESEN

SEQ ID NO: 75447 - protein, 9 aa, Homo Sapiens
FRILVQQFQ

SEQ ID NO: 75448 - protein, 9 aa, Homo Sapiens
FLKKGELAN

SEQ ID NO: 75449 - protein, 9 aa, Homo Sapiens
TDVDDNEER

SEQ ID NO: 75450 - protein, 9 aa, Homo Sapiens
RLCVDYGKK

SEQ ID NO: 75451 - protein, 9 aa, Homo Sapiens
LSFNGCFVK

SEQ ID NO: 75452 - protein, 9 aa, Homo Sapiens
EEDEDEHED

SEQ ID NO: 75453 - protein, 9 aa, Homo Sapiens
GKDSCQGDC

SEQ ID NO: 75454 - protein, 9 aa, Homo Sapiens
LGEAWARRS

SEQ ID NO: 75455 - protein, 9 aa, Homo Sapiens
MVQQPGMMD

SEQ ID NO: 75456 - protein, 9 aa, Homo Sapiens
PSRLAPGGP

SEQ ID NO: 75457 - protein, 9 aa, Homo Sapiens
PDSNDDEDE

SEQ ID NO: 75458 - protein, 9 aa, Homo Sapiens
QAIEENLQP

SEQ ID NO: 75459 - protein, 9 aa, Homo Sapiens
QLSMKFLKK

SEQ ID NO: 75460 - protein, 9 aa, Homo Sapiens
LLHLSSEGA

SEQ ID NO: 75461 - protein, 9 aa, Homo Sapiens
SSTLLRHWR

SEQ ID NO: 75462 - protein, 9 aa, Homo Sapiens
RSSMEDDFN

SEQ ID NO: 75463 - protein, 9 aa, Homo Sapiens
LRIKKQGSL

SEQ ID NO: 75464 - protein, 9 aa, Homo Sapiens
NRSQPLLIP

SEQ ID NO: 75465 - protein, 9 aa, Homo Sapiens
PCTDLKVSQ

SEQ ID NO: 75466 - protein, 9 aa, Homo Sapiens
LSASQIWNL

SEQ ID NO: 75467 - protein, 9 aa, Homo Sapiens
LLLHGGAKK

SEQ ID NO: 75468 - protein, 9 aa, Homo Sapiens
NSSSVLPHG

SEQ ID NO: 75469 - protein, 9 aa, Homo Sapiens
SSEELHPKH

SEQ ID NO: 75470 - protein, 9 aa, Homo Sapiens
VAQKSYEHM

SEQ ID NO: 75471 - protein, 9 aa, Homo Sapiens
EFTDSIKEE

SEQ ID NO: 75472 - protein, 9 aa, Homo Sapiens
PNPGPLSKP

SEQ ID NO: 75473 - protein, 9 aa, Homo Sapiens
AVMVYKFYF

SEQ ID NO: 75474 - protein, 9 aa, Homo Sapiens
QDYRLPDSN

SEQ ID NO: 75475 - protein, 9 aa, Homo Sapiens
PQLPNGCKA

SEQ ID NO: 75476 - protein, 9 aa, Homo Sapiens
NRIISVRSG

SEQ ID NO: 75477 - protein, 9 aa, Homo Sapiens
LILRAPDMD

SEQ ID NO: 75478 - protein, 9 aa, Homo Sapiens
VDFDELQDN

SEQ ID NO: 75479 - protein, 9 aa, Homo Sapiens
GCATKERLF

SEQ ID NO: 75480 - protein, 9 aa, Homo Sapiens
WSNKLITDD

SEQ ID NO: 75481 - protein, 9 aa, Homo Sapiens
KIQCETVLN

SEQ ID NO: 75482 - protein, 9 aa, Homo Sapiens
LRLQLLERF

SEQ ID NO: 75483 - protein, 9 aa, Homo Sapiens
SQSRGLSRL

SEQ ID NO: 75484 - protein, 9 aa, Homo Sapiens
ATKERLFHK

SEQ ID NO: 75485 - protein, 9 aa, Homo Sapiens
GDWEKENEA

SEQ ID NO: 75486 - protein, 9 aa, Homo Sapiens
VLYSLNKYT

SEQ ID NO: 75487 - protein, 9 aa, Homo Sapiens
SGCNKQALP

SEQ ID NO: 75488 - protein, 9 aa, Homo Sapiens
DAGFMLSAD

SEQ ID NO: 75489 - protein, 9 aa, Homo Sapiens
CKPSQVLQP

SEQ ID NO: 75490 - protein, 9 aa, Homo Sapiens
IDDNPKIFE

SEQ ID NO: 75491 - protein, 9 aa, Homo Sapiens
LASQGLGPS

SEQ ID NO: 75492 - protein, 9 aa, Homo Sapiens
DKQLASELQ

SEQ ID NO: 75493 - protein, 9 aa, Homo Sapiens
LRQENKNLA

SEQ ID NO: 75494 - protein, 9 aa, Homo Sapiens
FGGNIKSVL

SEQ ID NO: 75495 - protein, 9 aa, Homo Sapiens
SPSAQKTGL

SEQ ID NO: 75496 - protein, 9 aa, Homo Sapiens
TCGHTSQGS

SEQ ID NO: 75497 - protein, 9 aa, Homo Sapiens
DKDYSAFYL

SEQ ID NO: 75498 - protein, 9 aa, Homo Sapiens
QFCFKFCIN

SEQ ID NO: 75499 - protein, 9 aa, Homo Sapiens
CLAPPPPEI

SEQ ID NO: 75500 - protein, 9 aa, Homo Sapiens
NQVGRPFLW

SEQ ID NO: 75501 - protein, 9 aa, Homo Sapiens
SSAPPGEEE

SEQ ID NO: 75502 - protein, 9 aa, Homo Sapiens
PRLSYIDPN

SEQ ID NO: 75503 - protein, 9 aa, Homo Sapiens
KRKSGSKMR

SEQ ID NO: 75504 - protein, 9 aa, Homo Sapiens
AGKDTMSGR

SEQ ID NO: 75505 - protein, 9 aa, Homo Sapiens
KGQRPGFGY

SEQ ID NO: 75506 - protein, 9 aa, Homo Sapiens
NPLLDCVRT

SEQ ID NO: 75507 - protein, 9 aa, Homo Sapiens
VQSPERSRT

SEQ ID NO: 75508 - protein, 9 aa, Homo Sapiens
KPTPVVSTA

SEQ ID NO: 75509 - protein, 9 aa, Homo Sapiens
ELFHRIVEK

SEQ ID NO: 75510 - protein, 9 aa, Homo Sapiens
KMGGITQTP

SEQ ID NO: 75511 - protein, 9 aa, Homo Sapiens
AELGKLRDR

SEQ ID NO: 75512 - protein, 9 aa, Homo Sapiens
SPFQLSKGK

SEQ ID NO: 75513 - protein, 9 aa, Homo Sapiens
VVFVAGWGI

SEQ ID NO: 75514 - protein, 9 aa, Homo Sapiens
NNPRLSYID

SEQ ID NO: 75515 - protein, 9 aa, Homo Sapiens
MPSGDETID

SEQ ID NO: 75516 - protein, 9 aa, Homo Sapiens
KFLKKGELA

SEQ ID NO: 75517 - protein, 9 aa, Homo Sapiens
REDTTPYQL

SEQ ID NO: 75518 - protein, 9 aa, Homo Sapiens
RLDFSTAIV

SEQ ID NO: 75519 - protein, 9 aa, Homo Sapiens
TDLKVSQNH

SEQ ID NO: 75520 - protein, 9 aa, Homo Sapiens
LNAIPPMLD

SEQ ID NO: 75521 - protein, 9 aa, Homo Sapiens
LLAFQEARY

SEQ ID NO: 75522 - protein, 9 aa, Homo Sapiens
DEGLPKEEE

SEQ ID NO: 75523 - protein, 9 aa, Homo Sapiens
GGSNRKVRK

SEQ ID NO: 75524 - protein, 9 aa, Homo Sapiens
YSLNKYTKT

SEQ ID NO: 75525 - protein, 9 aa, Homo Sapiens
AASRPRLHP

SEQ ID NO: 75526 - protein, 9 aa, Homo Sapiens
NSASETDKW

SEQ ID NO: 75527 - protein, 9 aa, Homo Sapiens
AQGERNVPS

SEQ ID NO: 75528 - protein, 9 aa, Homo Sapiens
VSEDLWRGP

SEQ ID NO: 75529 - protein, 9 aa, Homo Sapiens
NSIQQLVPE

SEQ ID NO: 75530 - protein, 9 aa, Homo Sapiens
RGRGQGRGA

SEQ ID NO: 75531 - protein, 9 aa, Homo Sapiens
NTDEDNGNG

SEQ ID NO: 75532 - protein, 9 aa, Homo Sapiens
KRLREVVSE

SEQ ID NO: 75533 - protein, 9 aa, Homo Sapiens
LERHCQLAG

SEQ ID NO: 75534 - protein, 9 aa, Homo Sapiens
SFYPPHYLA

SEQ ID NO: 75535 - protein, 9 aa, Homo Sapiens
EHYTVQPET

SEQ ID NO: 75536 - protein, 9 aa, Homo Sapiens
GSAGRAGFP

SEQ ID NO: 75537 - protein, 9 aa, Homo Sapiens
VSLIINYDF

SEQ ID NO: 75538 - protein, 9 aa, Homo Sapiens
GSKMRPARA

SEQ ID NO: 75539 - protein, 9 aa, Homo Sapiens
DTILTKSDL

SEQ ID NO: 75540 - protein, 9 aa, Homo Sapiens
TDKDYSAFY

SEQ ID NO: 75541 - protein, 9 aa, Homo Sapiens
EEDEKIDRT

SEQ ID NO: 75542 - protein, 9 aa, Homo Sapiens
PVRLRCNHG

SEQ ID NO: 75543 - protein, 9 aa, Homo Sapiens
IISVRSGRE

SEQ ID NO: 75544 - protein, 9 aa, Homo Sapiens
LHLDYDFNS

SEQ ID NO: 75545 - protein, 9 aa, Homo Sapiens
FVAGWGISD

SEQ ID NO: 75546 - protein, 9 aa, Homo Sapiens
EGLPKEEEG

SEQ ID NO: 75547 - protein, 9 aa, Homo Sapiens
ELQREIKRL

SEQ ID NO: 75548 - protein, 9 aa, Homo Sapiens
QLQFYTKAA

SEQ ID NO: 75549 - protein, 9 aa, Homo Sapiens
IDLLNDNIR

SEQ ID NO: 75550 - protein, 9 aa, Homo Sapiens
ICGVPTIQS

SEQ ID NO: 75551 - protein, 9 aa, Homo Sapiens
ISPNSHLHV

SEQ ID NO: 75552 - protein, 9 aa, Homo Sapiens
LNTIILIVE

SEQ ID NO: 75553 - protein, 9 aa, Homo Sapiens
KMEQERIGR

SEQ ID NO: 75554 - protein, 9 aa, Homo Sapiens
VDKEYKNPH

SEQ ID NO: 75555 - protein, 9 aa, Homo Sapiens
LAPSGCNKQ

SEQ ID NO: 75556 - protein, 9 aa, Homo Sapiens
LINLKLKLH

SEQ ID NO: 75557 - protein, 9 aa, Homo Sapiens
LCKKQRLEA

SEQ ID NO: 75558 - protein, 9 aa, Homo Sapiens
KRDRKNSIQ

SEQ ID NO: 75559 - protein, 9 aa, Homo Sapiens
DCGGPLVCR

SEQ ID NO: 75560 - protein, 9 aa, Homo Sapiens
ASELQYDMK

SEQ ID NO: 75561 - protein, 9 aa, Homo Sapiens
KVAPSWPEC

SEQ ID NO: 75562 - protein, 9 aa, Homo Sapiens
KVQWTDHQG

SEQ ID NO: 75563 - protein, 9 aa, Homo Sapiens
KHVQFDFLI

SEQ ID NO: 75564 - protein, 9 aa, Homo Sapiens
HDSDLGQSG

SEQ ID NO: 75565 - protein, 9 aa, Homo Sapiens
CHSSADSAS

SEQ ID NO: 75566 - protein, 9 aa, Homo Sapiens
DKGAKLTPN

SEQ ID NO: 75567 - protein, 9 aa, Homo Sapiens
CNKQALPLS

SEQ ID NO: 75568 - protein, 9 aa, Homo Sapiens
VDHLGIYVW

SEQ ID NO: 75569 - protein, 9 aa, Homo Sapiens
YNSRLQLER

SEQ ID NO: 75570 - protein, 9 aa, Homo Sapiens
RLSRELLHE

SEQ ID NO: 75571 - protein, 9 aa, Homo Sapiens
HLERIKEKL

SEQ ID NO: 75572 - protein, 9 aa, Homo Sapiens
LSKDETAQG

SEQ ID NO: 75573 - protein, 9 aa, Homo Sapiens
KASDRAPDR

SEQ ID NO: 75574 - protein, 9 aa, Homo Sapiens
NHILHCPGA

SEQ ID NO: 75575 - protein, 9 aa, Homo Sapiens
ESNDRWVHM

SEQ ID NO: 75576 - protein, 9 aa, Homo Sapiens
RNVPSPKSP

SEQ ID NO: 75577 - protein, 9 aa, Homo Sapiens
NSGEDSHLK

SEQ ID NO: 75578 - protein, 9 aa, Homo Sapiens
NGCKAPRLV

SEQ ID NO: 75579 - protein, 9 aa, Homo Sapiens
VHSSEELHP

SEQ ID NO: 75580 - protein, 9 aa, Homo Sapiens
VIFLIAVTF

SEQ ID NO: 75581 - protein, 9 aa, Homo Sapiens
SSSPTPIAP

SEQ ID NO: 75582 - protein, 9 aa, Homo Sapiens
RLVAQKSYE

SEQ ID NO: 75583 - protein, 9 aa, Homo Sapiens
KQEKKDKTQ

SEQ ID NO: 75584 - protein, 9 aa, Homo Sapiens
NVQAPPPSS

SEQ ID NO: 75585 - protein, 9 aa, Homo Sapiens
AHYVYLQAF

SEQ ID NO: 75586 - protein, 9 aa, Homo Sapiens
MVTLYDNEQ

SEQ ID NO: 75587 - protein, 9 aa, Homo Sapiens
QWTDHQGQC

SEQ ID NO: 75588 - protein, 9 aa, Homo Sapiens
WESCASKPV

SEQ ID NO: 75589 - protein, 9 aa, Homo Sapiens
AKAQEEGYF

SEQ ID NO: 75590 - protein, 9 aa, Homo Sapiens
VQQFQVQLQ

SEQ ID NO: 75591 - protein, 9 aa, Homo Sapiens
VHMVISELI

SEQ ID NO: 75592 - protein, 9 aa, Homo Sapiens
CAAQRQGFQ

SEQ ID NO: 75593 - protein, 9 aa, Homo Sapiens
GRNDKNFHL

SEQ ID NO: 75594 - protein, 9 aa, Homo Sapiens
LCLVLRGTQ

SEQ ID NO: 75595 - protein, 9 aa, Homo Sapiens
GNIKSVLTW

SEQ ID NO: 75596 - protein, 9 aa, Homo Sapiens
GVCSNTDED

SEQ ID NO: 75597 - protein, 9 aa, Homo Sapiens
MLDLLKSEY

SEQ ID NO: 75598 - protein, 9 aa, Homo Sapiens
REMTCFQAG

SEQ ID NO: 75599 - protein, 9 aa, Homo Sapiens
AAQRQGFQK

SEQ ID NO: 75600 - protein, 9 aa, Homo Sapiens
EGRVPEEEL

SEQ ID NO: 75601 - protein, 9 aa, Homo Sapiens
QLDRVAAAR

SEQ ID NO: 75602 - protein, 9 aa, Homo Sapiens
KEKIMDQYK

SEQ ID NO: 75603 - protein, 9 aa, Homo Sapiens
TLSTLLHLS

SEQ ID NO: 75604 - protein, 9 aa, Homo Sapiens
QTQSAPGPV

SEQ ID NO: 75605 - protein, 9 aa, Homo Sapiens
QKRMLETAY

SEQ ID NO: 75606 - protein, 9 aa, Homo Sapiens
GFGLALTLQ

SEQ ID NO: 75607 - protein, 9 aa, Homo Sapiens
YFHYNSDFH

SEQ ID NO: 75608 - protein, 9 aa, Homo Sapiens
VAPLELQEI

SEQ ID NO: 75609 - protein, 9 aa, Homo Sapiens
KLLFLKDED

SEQ ID NO: 75610 - protein, 9 aa, Homo Sapiens
ELFQNTSAP

SEQ ID NO: 75611 - protein, 9 aa, Homo Sapiens
IQYQDSLRI

SEQ ID NO: 75612 - protein, 9 aa, Homo Sapiens
RQGFQKKGP

SEQ ID NO: 75613 - protein, 9 aa, Homo Sapiens
NSMKEMVIL

SEQ ID NO: 75614 - protein, 9 aa, Homo Sapiens
AILGTSGLV

SEQ ID NO: 75615 - protein, 9 aa, Homo Sapiens
QDKMLPTYL

SEQ ID NO: 75616 - protein, 9 aa, Homo Sapiens
GIKVCSLTG

SEQ ID NO: 75617 - protein, 9 aa, Homo Sapiens
YTVQPETGA

SEQ ID NO: 75618 - protein, 9 aa, Homo Sapiens
HRDYSRSFH

SEQ ID NO: 75619 - protein, 9 aa, Homo Sapiens
LLHEKGPEV

SEQ ID NO: 75620 - protein, 9 aa, Homo Sapiens
LCFQATDPV

SEQ ID NO: 75621 - protein, 9 aa, Homo Sapiens
GGSPPGTRR

SEQ ID NO: 75622 - protein, 9 aa, Homo Sapiens
FWVNVMKNP

SEQ ID NO: 75623 - protein, 9 aa, Homo Sapiens
WGGEDHDLW

SEQ ID NO: 75624 - protein, 9 aa, Homo Sapiens
RGQGRGALA

SEQ ID NO: 75625 - protein, 9 aa, Homo Sapiens
SPSQDKMLP

SEQ ID NO: 75626 - protein, 9 aa, Homo Sapiens
YNSDFHIPK

SEQ ID NO: 75627 - protein, 9 aa, Homo Sapiens
PKVTCGPPD

SEQ ID NO: 75628 - protein, 9 aa, Homo Sapiens
DAEKIQCET

SEQ ID NO: 75629 - protein, 9 aa, Homo Sapiens
EEDAEAQVD

SEQ ID NO: 75630 - protein, 9 aa, Homo Sapiens
SFQVGAPMS

SEQ ID NO: 75631 - protein, 9 aa, Homo Sapiens
RAPSFLLGV

SEQ ID NO: 75632 - protein, 9 aa, Homo Sapiens
DKECWFPKA

SEQ ID NO: 75633 - protein, 9 aa, Homo Sapiens
QTTLKSSEK

SEQ ID NO: 75634 - protein, 9 aa, Homo Sapiens
IYENNCLIL

SEQ ID NO: 75635 - protein, 9 aa, Homo Sapiens
AVTVDKLES

SEQ ID NO: 75636 - protein, 9 aa, Homo Sapiens
FVIFLIAVT

SEQ ID NO: 75637 - protein, 9 aa, Homo Sapiens
IPFLRNAII

SEQ ID NO: 75638 - protein, 9 aa, Homo Sapiens
PHLERIKEK

SEQ ID NO: 75639 - protein, 9 aa, Homo Sapiens
RAYAKTTKM

SEQ ID NO: 75640 - protein, 9 aa, Homo Sapiens
GLVASPVLP

SEQ ID NO: 75641 - protein, 9 aa, Homo Sapiens
AIFRTFGHH

SEQ ID NO: 75642 - protein, 9 aa, Homo Sapiens
PTDQAIKAG

SEQ ID NO: 75643 - protein, 9 aa, Homo Sapiens
KPLSENQAR

SEQ ID NO: 75644 - protein, 9 aa, Homo Sapiens
YWIHKGMPL

SEQ ID NO: 75645 - protein, 9 aa, Homo Sapiens
KAQEAAQEN

SEQ ID NO: 75646 - protein, 9 aa, Homo Sapiens
SVVAVMVYK

SEQ ID NO: 75647 - protein, 9 aa, Homo Sapiens
EDEKIDRTD

SEQ ID NO: 75648 - protein, 9 aa, Homo Sapiens
KIHTGKKAC

SEQ ID NO: 75649 - protein, 9 aa, Homo Sapiens
QKTGLSPSP

SEQ ID NO: 75650 - protein, 9 aa, Homo Sapiens
IITVILSQV

SEQ ID NO: 75651 - protein, 9 aa, Homo Sapiens
TEEQKCTYQ

SEQ ID NO: 75652 - protein, 9 aa, Homo Sapiens
DNSDIGRAG

SEQ ID NO: 75653 - protein, 9 aa, Homo Sapiens
KYQVLLELY

SEQ ID NO: 75654 - protein, 9 aa, Homo Sapiens
MKDCFQYGT

SEQ ID NO: 75655 - protein, 9 aa, Homo Sapiens
DSTDAEKIQ

SEQ ID NO: 75656 - protein, 9 aa, Homo Sapiens
DKLLFLKDE

SEQ ID NO: 75657 - protein, 9 aa, Homo Sapiens
EECITVPLL

SEQ ID NO: 75658 - protein, 9 aa, Homo Sapiens
ADKGAKLTP

SEQ ID NO: 75659 - protein, 9 aa, Homo Sapiens
QNSGAAISE

SEQ ID NO: 75660 - protein, 9 aa, Homo Sapiens
HVVPAQKKI

SEQ ID NO: 75661 - protein, 9 aa, Homo Sapiens
HATPPDLAS

SEQ ID NO: 75662 - protein, 9 aa, Homo Sapiens
KMMRRQQEG

SEQ ID NO: 75663 - protein, 9 aa, Homo Sapiens
EKQMKNLKL

SEQ ID NO: 75664 - protein, 9 aa, Homo Sapiens
IHTGKKACK

SEQ ID NO: 75665 - protein, 9 aa, Homo Sapiens
VQPETGALN

SEQ ID NO: 75666 - protein, 9 aa, Homo Sapiens
FRNAIEGKS

SEQ ID NO: 75667 - protein, 9 aa, Homo Sapiens
GAKGQRPGF

SEQ ID NO: 75668 - protein, 9 aa, Homo Sapiens
QDIIVWPPL

SEQ ID NO: 75669 - protein, 9 aa, Homo Sapiens
EQAEGRVPE

SEQ ID NO: 75670 - protein, 9 aa, Homo Sapiens
TRNSSSVLP

SEQ ID NO: 75671 - protein, 9 aa, Homo Sapiens
ARLQYLLLH

SEQ ID NO: 75672 - protein, 9 aa, Homo Sapiens
GPRAYAKTT

SEQ ID NO: 75673 - protein, 9 aa, Homo Sapiens
YIEHYTVQP

SEQ ID NO: 75674 - protein, 9 aa, Homo Sapiens
NKLITDDKR

SEQ ID NO: 75675 - protein, 9 aa, Homo Sapiens
VKFLCQGLR

SEQ ID NO: 75676 - protein, 9 aa, Homo Sapiens
NPRLSYIDP

SEQ ID NO: 75677 - protein, 9 aa, Homo Sapiens
DTQLMLAVG

SEQ ID NO: 75678 - protein, 9 aa, Homo Sapiens
FIIQYQDSL

SEQ ID NO: 75679 - protein, 9 aa, Homo Sapiens
GKIEALSEM

SEQ ID NO: 75680 - protein, 9 aa, Homo Sapiens
EKMGGITQT

SEQ ID NO: 75681 - protein, 9 aa, Homo Sapiens
EVFQIEERI

SEQ ID NO: 75682 - protein, 9 aa, Homo Sapiens
TEVIQLAQG

SEQ ID NO: 75683 - protein, 9 aa, Homo Sapiens
FEKPNYTEI

SEQ ID NO: 75684 - protein, 9 aa, Homo Sapiens
AAPPLSAAD

SEQ ID NO: 75685 - protein, 9 aa, Homo Sapiens
RNDKNFHLN

SEQ ID NO: 75686 - protein, 9 aa, Homo Sapiens
ESKTTFPSS

SEQ ID NO: 75687 - protein, 9 aa, Homo Sapiens
SLDAGSGKP

SEQ ID NO: 75688 - protein, 9 aa, Homo Sapiens
SKDETAQGE

SEQ ID NO: 75689 - protein, 9 aa, Homo Sapiens
NTVDMLRVA

SEQ ID NO: 75690 - protein, 9 aa, Homo Sapiens
TLLHLSSEG

SEQ ID NO: 75691 - protein, 9 aa, Homo Sapiens
EFTIPQGKY

SEQ ID NO: 75692 - protein, 9 aa, Homo Sapiens
DAEAQVDNS

SEQ ID NO: 75693 - protein, 9 aa, Homo Sapiens
SLMKDCFQY

SEQ ID NO: 75694 - protein, 9 aa, Homo Sapiens
EKMEQERIG

SEQ ID NO: 75695 - protein, 9 aa, Homo Sapiens
MTQSAFQRA

SEQ ID NO: 75696 - protein, 9 aa, Homo Sapiens
TVALWDLIN

SEQ ID NO: 75697 - protein, 9 aa, Homo Sapiens
LSKPPDLKK

SEQ ID NO: 75698 - protein, 9 aa, Homo Sapiens
GSKTLLLHG

SEQ ID NO: 75699 - protein, 9 aa, Homo Sapiens
DETIDEKLG

SEQ ID NO: 75700 - protein, 9 aa, Homo Sapiens
YLLHQTWRF

SEQ ID NO: 75701 - protein, 9 aa, Homo Sapiens
LQKLGAHTP

SEQ ID NO: 75702 - protein, 9 aa, Homo Sapiens
ARFYQLDVK

SEQ ID NO: 75703 - protein, 9 aa, Homo Sapiens
KMLGSCVSY

SEQ ID NO: 75704 - protein, 9 aa, Homo Sapiens
VKLQVDQEL

SEQ ID NO: 75705 - protein, 9 aa, Homo Sapiens
PLSKPPDLK

SEQ ID NO: 75706 - protein, 9 aa, Homo Sapiens
VIQLAQGME

SEQ ID NO: 75707 - protein, 9 aa, Homo Sapiens
ANSKVAQWR

SEQ ID NO: 75708 - protein, 9 aa, Homo Sapiens
CLILRAPDM

SEQ ID NO: 75709 - protein, 9 aa, Homo Sapiens
RQLHVLLPQ

SEQ ID NO: 75710 - protein, 9 aa, Homo Sapiens
RGWGALTRG

SEQ ID NO: 75711 - protein, 9 aa, Homo Sapiens
VDDCPDSCC

SEQ ID NO: 75712 - protein, 9 aa, Homo Sapiens
APNPQFEAF

SEQ ID NO: 75713 - protein, 9 aa, Homo Sapiens
VALAPNPQF

SEQ ID NO: 75714 - protein, 9 aa, Homo Sapiens
MEFGGNLTL

SEQ ID NO: 75715 - protein, 9 aa, Homo Sapiens
GEAAAVAPY

SEQ ID NO: 75716 - protein, 9 aa, Homo Sapiens
DGADYPGKC

SEQ ID NO: 75717 - protein, 9 aa, Homo Sapiens
VCTQLLAPS

SEQ ID NO: 75718 - protein, 9 aa, Homo Sapiens
GHLALLGLS

SEQ ID NO: 75719 - protein, 9 aa, Homo Sapiens
YGTSSYTAE

SEQ ID NO: 75720 - protein, 9 aa, Homo Sapiens
IKNVENKSW

SEQ ID NO: 75721 - protein, 9 aa, Homo Sapiens
FYQLDVKFR

SEQ ID NO: 75722 - protein, 9 aa, Homo Sapiens
QDSTDAEKI

SEQ ID NO: 75723 - protein, 9 aa, Homo Sapiens
TGPSAGKDT

SEQ ID NO: 75724 - protein, 9 aa, Homo Sapiens
ECRDLARER

SEQ ID NO: 75725 - protein, 9 aa, Homo Sapiens
DVALAPNPQ

SEQ ID NO: 75726 - protein, 9 aa, Homo Sapiens
LAKFEISLP

SEQ ID NO: 75727 - protein, 9 aa, Homo Sapiens
KEPLPVWGA

SEQ ID NO: 75728 - protein, 9 aa, Homo Sapiens
FLNTIILIV

SEQ ID NO: 75729 - protein, 9 aa, Homo Sapiens
DEEEDEKID

SEQ ID NO: 75730 - protein, 9 aa, Homo Sapiens
LGSCGKFLV

SEQ ID NO: 75731 - protein, 9 aa, Homo Sapiens
DCDLFQKRM

SEQ ID NO: 75732 - protein, 9 aa, Homo Sapiens
TQLRLDVKK

SEQ ID NO: 75733 - protein, 9 aa, Homo Sapiens
GLNEGLMYE

SEQ ID NO: 75734 - protein, 9 aa, Homo Sapiens
DHTVSLAVG

SEQ ID NO: 75735 - protein, 9 aa, Homo Sapiens
QGLKQQKAS

SEQ ID NO: 75736 - protein, 9 aa, Homo Sapiens
YRLPDSNDD

SEQ ID NO: 75737 - protein, 9 aa, Homo Sapiens
QEVALFDKT

SEQ ID NO: 75738 - protein, 9 aa, Homo Sapiens
PPPPMSPTQ

SEQ ID NO: 75739 - protein, 9 aa, Homo Sapiens
ICIIFIWIY

SEQ ID NO: 75740 - protein, 9 aa, Homo Sapiens
YPGKCQLLR

SEQ ID NO: 75741 - protein, 9 aa, Homo Sapiens
FLIRSFSVE

SEQ ID NO: 75742 - protein, 9 aa, Homo Sapiens
HLGIYVWSN

SEQ ID NO: 75743 - protein, 9 aa, Homo Sapiens
LQIVTNRND

SEQ ID NO: 75744 - protein, 9 aa, Homo Sapiens
QLFRRLEQE

SEQ ID NO: 75745 - protein, 9 aa, Homo Sapiens
EFFEECITV

SEQ ID NO: 75746 - protein, 9 aa, Homo Sapiens
SMTMPPYGS

SEQ ID NO: 75747 - protein, 9 aa, Homo Sapiens
SLATPDQSL

SEQ ID NO: 75748 - protein, 9 aa, Homo Sapiens
DELQDNLCQ

SEQ ID NO: 75749 - protein, 9 aa, Homo Sapiens
LQKNSKRYQ

SEQ ID NO: 75750 - protein, 9 aa, Homo Sapiens
RLIASVSQH

SEQ ID NO: 75751 - protein, 9 aa, Homo Sapiens
EDDEEEDEK

SEQ ID NO: 75752 - protein, 9 aa, Homo Sapiens
SAVKDKLPQ

SEQ ID NO: 75753 - protein, 9 aa, Homo Sapiens
GTSSYTAEE

SEQ ID NO: 75754 - protein, 9 aa, Homo Sapiens
EEVNRSQPL

SEQ ID NO: 75755 - protein, 9 aa, Homo Sapiens
HGYKRVLAL

SEQ ID NO: 75756 - protein, 9 aa, Homo Sapiens
VFLNTIILI

SEQ ID NO: 75757 - protein, 9 aa, Homo Sapiens
LPAKPLEAT

SEQ ID NO: 75758 - protein, 9 aa, Homo Sapiens
YFIIQYQDS

SEQ ID NO: 75759 - protein, 9 aa, Homo Sapiens
LLHGGAKKG

SEQ ID NO: 75760 - protein, 9 aa, Homo Sapiens
SGGDHYKIK

SEQ ID NO: 75761 - protein, 9 aa, Homo Sapiens
APLELQEIT

SEQ ID NO: 75762 - protein, 9 aa, Homo Sapiens
QGLRYPECK

SEQ ID NO: 75763 - protein, 9 aa, Homo Sapiens
PAGAWRGFG

SEQ ID NO: 75764 - protein, 9 aa, Homo Sapiens
DKTQKVQMK

SEQ ID NO: 75765 - protein, 9 aa, Homo Sapiens
RRMDPVLFE

SEQ ID NO: 75766 - protein, 9 aa, Homo Sapiens
PLFVSGGDH

SEQ ID NO: 75767 - protein, 9 aa, Homo Sapiens
TITNNFGSV

SEQ ID NO: 75768 - protein, 9 aa, Homo Sapiens
SDVTEDGKS

SEQ ID NO: 75769 - protein, 9 aa, Homo Sapiens
VVDGKRNAR

SEQ ID NO: 75770 - protein, 9 aa, Homo Sapiens
EQLRGAFDH

SEQ ID NO: 75771 - protein, 9 aa, Homo Sapiens
WGPRAYAKT

SEQ ID NO: 75772 - protein, 9 aa, Homo Sapiens
PVPSLGLWM

SEQ ID NO: 75773 - protein, 9 aa, Homo Sapiens
PLPVWGAAG

SEQ ID NO: 75774 - protein, 9 aa, Homo Sapiens
FCHLCSDLI

SEQ ID NO: 75775 - protein, 9 aa, Homo Sapiens
VDYYLLHQT

SEQ ID NO: 75776 - protein, 9 aa, Homo Sapiens
FQREWHKFL

SEQ ID NO: 75777 - protein, 9 aa, Homo Sapiens
RLCLVLRGT

SEQ ID NO: 75778 - protein, 9 aa, Homo Sapiens
DLINLKLKL

SEQ ID NO: 75779 - protein, 9 aa, Homo Sapiens
RLRICIIFI

SEQ ID NO: 75780 - protein, 9 aa, Homo Sapiens
MKEMVILFA

SEQ ID NO: 75781 - protein, 9 aa, Homo Sapiens
RGLWQRFHL

SEQ ID NO: 75782 - protein, 9 aa, Homo Sapiens
QVESASKQL

SEQ ID NO: 75783 - protein, 9 aa, Homo Sapiens
PEIDVTTYY

SEQ ID NO: 75784 - protein, 9 aa, Homo Sapiens
DGKRNARLR

SEQ ID NO: 75785 - protein, 9 aa, Homo Sapiens
LHATPPDLA

SEQ ID NO: 75786 - protein, 9 aa, Homo Sapiens
GAKLTPNYD

SEQ ID NO: 75787 - protein, 9 aa, Homo Sapiens
REPCLKCVH

SEQ ID NO: 75788 - protein, 9 aa, Homo Sapiens
FGPGTRISK

SEQ ID NO: 75789 - protein, 9 aa, Homo Sapiens
SICYIAEVL

SEQ ID NO: 75790 - protein, 9 aa, Homo Sapiens
VTVDKLESE

SEQ ID NO: 75791 - protein, 9 aa, Homo Sapiens
QRQGFQKKG

SEQ ID NO: 75792 - protein, 9 aa, Homo Sapiens
GGNIKSVLT

SEQ ID NO: 75793 - protein, 9 aa, Homo Sapiens
QLHVLLPQS

SEQ ID NO: 75794 - protein, 9 aa, Homo Sapiens
RPQGLELFQ

SEQ ID NO: 75795 - protein, 9 aa, Homo Sapiens
RAAARFYQL

SEQ ID NO: 75796 - protein, 9 aa, Homo Sapiens
RKSGSKMRP

SEQ ID NO: 75797 - protein, 9 aa, Homo Sapiens
SSAPCMGPN

SEQ ID NO: 75798 - protein, 9 aa, Homo Sapiens
VDRIKKDEK

SEQ ID NO: 75799 - protein, 9 aa, Homo Sapiens
LGAYSVSCG

SEQ ID NO: 75800 - protein, 9 aa, Homo Sapiens
MEKMEQERI

SEQ ID NO: 75801 - protein, 9 aa, Homo Sapiens
DHDLWNRVQ

SEQ ID NO: 75802 - protein, 9 aa, Homo Sapiens
QIEERIFLA

SEQ ID NO: 75803 - protein, 9 aa, Homo Sapiens
AGAWRGFGL

SEQ ID NO: 75804 - protein, 9 aa, Homo Sapiens
SWGAKGQRP

SEQ ID NO: 75805 - protein, 9 aa, Homo Sapiens
VSGLNEGLM

SEQ ID NO: 75806 - protein, 9 aa, Homo Sapiens
TNNFGSVAR

SEQ ID NO: 75807 - protein, 9 aa, Homo Sapiens
FMLLMGNIV

SEQ ID NO: 75808 - protein, 9 aa, Homo Sapiens
IYVWSNISL

SEQ ID NO: 75809 - protein, 9 aa, Homo Sapiens
AMCQVTSTP

SEQ ID NO: 75810 - protein, 9 aa, Homo Sapiens
YFYYKEKDD

SEQ ID NO: 75811 - protein, 9 aa, Homo Sapiens
NPKEEELSL

SEQ ID NO: 75812 - protein, 9 aa, Homo Sapiens
MVYKFYFHL

SEQ ID NO: 75813 - protein, 9 aa, Homo Sapiens
SSSVLPHGY

SEQ ID NO: 75814 - protein, 9 aa, Homo Sapiens
KFQMALELM

SEQ ID NO: 75815 - protein, 9 aa, Homo Sapiens
TVKLQVDQE

SEQ ID NO: 75816 - protein, 9 aa, Homo Sapiens
PIHSSSPTP

SEQ ID NO: 75817 - protein, 9 aa, Homo Sapiens
NTGVKFLCQ

SEQ ID NO: 75818 - protein, 9 aa, Homo Sapiens
FLVDFGAQV

SEQ ID NO: 75819 - protein, 9 aa, Homo Sapiens
QKLLTQITR

SEQ ID NO: 75820 - protein, 9 aa, Homo Sapiens
KNYKQPVVL

SEQ ID NO: 75821 - protein, 9 aa, Homo Sapiens
KKELEMQIS

SEQ ID NO: 75822 - protein, 9 aa, Homo Sapiens
GTKAEPGAG

SEQ ID NO: 75823 - protein, 9 aa, Homo Sapiens
YCLAPPPPE

SEQ ID NO: 75824 - protein, 9 aa, Homo Sapiens
FDHTVSLAV

SEQ ID NO: 75825 - protein, 9 aa, Homo Sapiens
IVELFYETE

SEQ ID NO: 75826 - protein, 9 aa, Homo Sapiens
TGLSPSPSP

SEQ ID NO: 75827 - protein, 9 aa, Homo Sapiens
FGPLRCQKA

SEQ ID NO: 75828 - protein, 9 aa, Homo Sapiens
RAQVDKVCR

SEQ ID NO: 75829 - protein, 9 aa, Homo Sapiens
RKNSIQQLV

SEQ ID NO: 75830 - protein, 9 aa, Homo Sapiens
AGRNDKNFH

SEQ ID NO: 75831 - protein, 9 aa, Homo Sapiens
DIKTIFRAV

SEQ ID NO: 75832 - protein, 9 aa, Homo Sapiens
FEPYKFTPR

SEQ ID NO: 75833 - protein, 9 aa, Homo Sapiens
KPLEATSDR

SEQ ID NO: 75834 - protein, 9 aa, Homo Sapiens
GPGGLGCKP

SEQ ID NO: 75835 - protein, 9 aa, Homo Sapiens
EQTEHWGGQ

SEQ ID NO: 75836 - protein, 9 aa, Homo Sapiens
RRAPSFLLG

SEQ ID NO: 75837 - protein, 9 aa, Homo Sapiens
QPQLPNGCK

SEQ ID NO: 75838 - protein, 9 aa, Homo Sapiens
CVRTADHHQ

SEQ ID NO: 75839 - protein, 9 aa, Homo Sapiens
TESDAKELE

SEQ ID NO: 75840 - protein, 9 aa, Homo Sapiens
QKSTKLLIR

SEQ ID NO: 75841 - protein, 9 aa, Homo Sapiens
NYTSRCHAA

SEQ ID NO: 75842 - protein, 9 aa, Homo Sapiens
SIKRADKTS

SEQ ID NO: 75843 - protein, 9 aa, Homo Sapiens
LKTLSTLLH

SEQ ID NO: 75844 - protein, 9 aa, Homo Sapiens
FQIEERIFL

SEQ ID NO: 75845 - protein, 9 aa, Homo Sapiens
AMLSTYFQT

SEQ ID NO: 75846 - protein, 9 aa, Homo Sapiens
DWNLHSIKR

SEQ ID NO: 75847 - protein, 9 aa, Homo Sapiens
AVHSSEELH

SEQ ID NO: 75848 - protein, 9 aa, Homo Sapiens
ILVMLRSYP

SEQ ID NO: 75849 - protein, 9 aa, Homo Sapiens
ETAQGEIAC

SEQ ID NO: 75850 - protein, 9 aa, Homo Sapiens
APPPPEIDV

SEQ ID NO: 75851 - protein, 9 aa, Homo Sapiens
QPDDSRDED

SEQ ID NO: 75852 - protein, 9 aa, Homo Sapiens
PLEATSDRS

SEQ ID NO: 75853 - protein, 9 aa, Homo Sapiens
CCAPVYCRR

SEQ ID NO: 75854 - protein, 9 aa, Homo Sapiens
SPSDSSDPQ

SEQ ID NO: 75855 - protein, 9 aa, Homo Sapiens
DKHSAVWVP

SEQ ID NO: 75856 - protein, 9 aa, Homo Sapiens
SDTVKLQVD

SEQ ID NO: 75857 - protein, 9 aa, Homo Sapiens
LELFQNTSA

SEQ ID NO: 75858 - protein, 9 aa, Homo Sapiens
SSESDSAIT

SEQ ID NO: 75859 - protein, 9 aa, Homo Sapiens
WRSHQGERP

SEQ ID NO: 75860 - protein, 9 aa, Homo Sapiens
TEDGKSPED

SEQ ID NO: 75861 - protein, 9 aa, Homo Sapiens
GNEKMGGIT

SEQ ID NO: 75862 - protein, 9 aa, Homo Sapiens
KKFCRVLKN

SEQ ID NO: 75863 - protein, 9 aa, Homo Sapiens
VNVMKNPQF

SEQ ID NO: 75864 - protein, 9 aa, Homo Sapiens
EKSSSTSAE

SEQ ID NO: 75865 - protein, 9 aa, Homo Sapiens
ERLMSYSDE

SEQ ID NO: 75866 - protein, 9 aa, Homo Sapiens
IEIVIKMFQ

SEQ ID NO: 75867 - protein, 9 aa, Homo Sapiens
LVASPVLPA

SEQ ID NO: 75868 - protein, 9 aa, Homo Sapiens
PRSSMEDDF

SEQ ID NO: 75869 - protein, 9 aa, Homo Sapiens
KRLRQENKN

SEQ ID NO: 75870 - protein, 9 aa, Homo Sapiens
QIGFQREWH

SEQ ID NO: 75871 - protein, 9 aa, Homo Sapiens
SSSTSEGSY

SEQ ID NO: 75872 - protein, 9 aa, Homo Sapiens
NQTQSSAPC

SEQ ID NO: 75873 - protein, 9 aa, Homo Sapiens
LKKGELANF

SEQ ID NO: 75874 - protein, 9 aa, Homo Sapiens
DSAHARLQY

SEQ ID NO: 75875 - protein, 9 aa, Homo Sapiens
LPCIITVIL

SEQ ID NO: 75876 - protein, 9 aa, Homo Sapiens
GDETIDEKL

SEQ ID NO: 75877 - protein, 9 aa, Homo Sapiens
ASVPHSIIH

SEQ ID NO: 75878 - protein, 9 aa, Homo Sapiens
HEPSEISNR

SEQ ID NO: 75879 - protein, 9 aa, Homo Sapiens
GWSSAEEHI

SEQ ID NO: 75880 - protein, 9 aa, Homo Sapiens
SSMEDDFNY

SEQ ID NO: 75881 - protein, 9 aa, Homo Sapiens
YHQRIHTAE

SEQ ID NO: 75882 - protein, 9 aa, Homo Sapiens
SCELPLVAM

SEQ ID NO: 75883 - protein, 9 aa, Homo Sapiens
EVDNTEMQS

SEQ ID NO: 75884 - protein, 9 aa, Homo Sapiens
SHLKQRRRS

SEQ ID NO: 75885 - protein, 9 aa, Homo Sapiens
KSSSTSAES

SEQ ID NO: 75886 - protein, 9 aa, Homo Sapiens
RLEAYSERS

SEQ ID NO: 75887 - protein, 9 aa, Homo Sapiens
SPDGFFLGF

SEQ ID NO: 75888 - protein, 9 aa, Homo Sapiens
KYFHYNSDF

SEQ ID NO: 75889 - protein, 9 aa, Homo Sapiens
IISYVLTSR

SEQ ID NO: 75890 - protein, 9 aa, Homo Sapiens
HKHVQFDFL

SEQ ID NO: 75891 - protein, 9 aa, Homo Sapiens
SRSVIWENE

SEQ ID NO: 75892 - protein, 9 aa, Homo Sapiens
SSYTAEEYG

SEQ ID NO: 75893 - protein, 9 aa, Homo Sapiens
FRGLWQRFH

SEQ ID NO: 75894 - protein, 9 aa, Homo Sapiens
DTFGNHPFP

SEQ ID NO: 75895 - protein, 9 aa, Homo Sapiens
QYLLLHYTA

SEQ ID NO: 75896 - protein, 9 aa, Homo Sapiens
SDSSDPQGL

SEQ ID NO: 75897 - protein, 9 aa, Homo Sapiens
YSECRDLAR

SEQ ID NO: 75898 - protein, 9 aa, Homo Sapiens
ALSEMDILF

SEQ ID NO: 75899 - protein, 9 aa, Homo Sapiens
YDNEQVGSE

SEQ ID NO: 75900 - protein, 9 aa, Homo Sapiens
AAPGLPELC

SEQ ID NO: 75901 - protein, 9 aa, Homo Sapiens
YNISPNSHL

SEQ ID NO: 75902 - protein, 9 aa, Homo Sapiens
IQTYLPCII

SEQ ID NO: 75903 - protein, 9 aa, Homo Sapiens
WLEAHDSDL

SEQ ID NO: 75904 - protein, 9 aa, Homo Sapiens
KQNSGAAIS

SEQ ID NO: 75905 - protein, 9 aa, Homo Sapiens
MSFYPPHYL

SEQ ID NO: 75906 - protein, 9 aa, Homo Sapiens
FRDYNVQAP

SEQ ID NO: 75907 - protein, 9 aa, Homo Sapiens
SFVMFRGLW

SEQ ID NO: 75908 - protein, 9 aa, Homo Sapiens
DARIIVELF

SEQ ID NO: 75909 - protein, 9 aa, Homo Sapiens
ANNFALKPR

SEQ ID NO: 75910 - protein, 9 aa, Homo Sapiens
GRAGFPREP

SEQ ID NO: 75911 - protein, 9 aa, Homo Sapiens
VQWTDHQGQ

SEQ ID NO: 75912 - protein, 9 aa, Homo Sapiens
IPFVYFYYK

SEQ ID NO: 75913 - protein, 9 aa, Homo Sapiens
AHDSDLGQS

SEQ ID NO: 75914 - protein, 9 aa, Homo Sapiens
LQVDQELSN

SEQ ID NO: 75915 - protein, 9 aa, Homo Sapiens
QQLFRRLEQ

SEQ ID NO: 75916 - protein, 9 aa, Homo Sapiens
GYERHRDYS

SEQ ID NO: 75917 - protein, 9 aa, Homo Sapiens
LTYCNLTSC

SEQ ID NO: 75918 - protein, 9 aa, Homo Sapiens
TSLLMERLC

SEQ ID NO: 75919 - protein, 9 aa, Homo Sapiens
VSCQEDTIL

SEQ ID NO: 75920 - protein, 9 aa, Homo Sapiens
SSPTPIAPL

SEQ ID NO: 75921 - protein, 9 aa, Homo Sapiens
AGLENMASW

SEQ ID NO: 75922 - protein, 9 aa, Homo Sapiens
KDCLPAKPL

SEQ ID NO: 75923 - protein, 9 aa, Homo Sapiens
MKWSPPEVF

SEQ ID NO: 75924 - protein, 9 aa, Homo Sapiens
AAAAAAISS

SEQ ID NO: 75925 - protein, 9 aa, Homo Sapiens
QVGAPMSPK

SEQ ID NO: 75926 - protein, 9 aa, Homo Sapiens
RPHVQPRPL

SEQ ID NO: 75927 - protein, 9 aa, Homo Sapiens
GWGALTRGT

SEQ ID NO: 75928 - protein, 9 aa, Homo Sapiens
PWVTVTSAV

SEQ ID NO: 75929 - protein, 9 aa, Homo Sapiens
RAELGKLRD

SEQ ID NO: 75930 - protein, 9 aa, Homo Sapiens
LELQEITFK

SEQ ID NO: 75931 - protein, 9 aa, Homo Sapiens
VSSSPLDQD

SEQ ID NO: 75932 - protein, 9 aa, Homo Sapiens
KESRSVIWE

SEQ ID NO: 75933 - protein, 9 aa, Homo Sapiens
KVDKEYKNP

SEQ ID NO: 75934 - protein, 9 aa, Homo Sapiens
MDGVNRIIS

SEQ ID NO: 75935 - protein, 9 aa, Homo Sapiens
ALSQLSFQV

SEQ ID NO: 75936 - protein, 9 aa, Homo Sapiens
FNSNAFPHP

SEQ ID NO: 75937 - protein, 9 aa, Homo Sapiens
EKEPLPVWG

SEQ ID NO: 75938 - protein, 9 aa, Homo Sapiens
HTVSLAVGF

SEQ ID NO: 75939 - protein, 9 aa, Homo Sapiens
CPDSCCEPP

SEQ ID NO: 75940 - protein, 9 aa, Homo Sapiens
VGSEGKLLF

SEQ ID NO: 75941 - protein, 9 aa, Homo Sapiens
PCFEPYKFT

SEQ ID NO: 75942 - protein, 9 aa, Homo Sapiens
MNQIGFQRE

SEQ ID NO: 75943 - protein, 9 aa, Homo Sapiens
PDGFFLGFC

SEQ ID NO: 75944 - protein, 9 aa, Homo Sapiens
HSIIHGYKR

SEQ ID NO: 75945 - protein, 9 aa, Homo Sapiens
SCGQSSCCA

SEQ ID NO: 75946 - protein, 9 aa, Homo Sapiens
PEKRRAIFD

SEQ ID NO: 75947 - protein, 9 aa, Homo Sapiens
IESNDRWVH

SEQ ID NO: 75948 - protein, 9 aa, Homo Sapiens
GQLTRLCLV

SEQ ID NO: 75949 - protein, 9 aa, Homo Sapiens
LRGAFDHTV

SEQ ID NO: 75950 - protein, 9 aa, Homo Sapiens
AKASDRAPD

SEQ ID NO: 75951 - protein, 9 aa, Homo Sapiens
KKGELANFR

SEQ ID NO: 75952 - protein, 9 aa, Homo Sapiens
NTIILIVEI

SEQ ID NO: 75953 - protein, 9 aa, Homo Sapiens
RVRSSMWEL

SEQ ID NO: 75954 - protein, 9 aa, Homo Sapiens
DRIQDVLFV

SEQ ID NO: 75955 - protein, 9 aa, Homo Sapiens
ERNVPSPKS

SEQ ID NO: 75956 - protein, 9 aa, Homo Sapiens
FDELQDNLC

SEQ ID NO: 75957 - protein, 9 aa, Homo Sapiens
FVSSSPLDQ

SEQ ID NO: 75958 - protein, 9 aa, Homo Sapiens
SNTDEDNGN

SEQ ID NO: 75959 - protein, 9 aa, Homo Sapiens
LIVAVVVVV

SEQ ID NO: 75960 - protein, 9 aa, Homo Sapiens
LLMGNIVRV

SEQ ID NO: 75961 - protein, 9 aa, Homo Sapiens
QAFLIRSFS

SEQ ID NO: 75962 - protein, 9 aa, Homo Sapiens
LSRFSWGAK

SEQ ID NO: 75963 - protein, 9 aa, Homo Sapiens
NEGLMYEYR

SEQ ID NO: 75964 - protein, 9 aa, Homo Sapiens
ALGCGRAEA

SEQ ID NO: 75965 - protein, 9 aa, Homo Sapiens
PRDNNGYSN

SEQ ID NO: 75966 - protein, 9 aa, Homo Sapiens
MLRGDFFLR

SEQ ID NO: 75967 - protein, 9 aa, Homo Sapiens
YGTENNISD

SEQ ID NO: 75968 - protein, 9 aa, Homo Sapiens
TGPMMPHSL

SEQ ID NO: 75969 - protein, 9 aa, Homo Sapiens
FFLGFCSSL

SEQ ID NO: 75970 - protein, 9 aa, Homo Sapiens
AINVAGRND

SEQ ID NO: 75971 - protein, 9 aa, Homo Sapiens
KEKLAENIH

SEQ ID NO: 75972 - protein, 9 aa, Homo Sapiens
QTWRFGAAA

SEQ ID NO: 75973 - protein, 9 aa, Homo Sapiens
LFAPALAAA

SEQ ID NO: 75974 - protein, 9 aa, Homo Sapiens
ARAEKMEKM

SEQ ID NO: 75975 - protein, 9 aa, Homo Sapiens
GNIVRVVVL

SEQ ID NO: 75976 - protein, 9 aa, Homo Sapiens
RTRTVPCSQ

SEQ ID NO: 75977 - protein, 9 aa, Homo Sapiens
TNKGKYKVL

SEQ ID NO: 75978 - protein, 9 aa, Homo Sapiens
VYLQAFVQP

SEQ ID NO: 75979 - protein, 9 aa, Homo Sapiens
IIHGYKRVL

SEQ ID NO: 75980 - protein, 9 aa, Homo Sapiens
PVVSTASKV

SEQ ID NO: 75981 - protein, 9 aa, Homo Sapiens
PTQDEGTKA

SEQ ID NO: 75982 - protein, 9 aa, Homo Sapiens
RNFEKFHID

SEQ ID NO: 75983 - protein, 9 aa, Homo Sapiens
RFYQLDVKF

SEQ ID NO: 75984 - protein, 9 aa, Homo Sapiens
SAITSSTVS

SEQ ID NO: 75985 - protein, 9 aa, Homo Sapiens
HSSSPTPIA

SEQ ID NO: 75986 - protein, 9 aa, Homo Sapiens
TTFPSSPEE

SEQ ID NO: 75987 - protein, 9 aa, Homo Sapiens
LRCQKAWAL

SEQ ID NO: 75988 - protein, 9 aa, Homo Sapiens
LVMLRSYPG

SEQ ID NO: 75989 - protein, 9 aa, Homo Sapiens
LADKGAKLT

SEQ ID NO: 75990 - protein, 9 aa, Homo Sapiens
VKSNCGASP

SEQ ID NO: 75991 - protein, 9 aa, Homo Sapiens
DLARERGSL

SEQ ID NO: 75992 - protein, 9 aa, Homo Sapiens
DLPEPRKPV

SEQ ID NO: 75993 - protein, 9 aa, Homo Sapiens
NNFALKPRM

SEQ ID NO: 75994 - protein, 9 aa, Homo Sapiens
KDYSAFYLG

SEQ ID NO: 75995 - protein, 9 aa, Homo Sapiens
PAQKKIDEA

SEQ ID NO: 75996 - protein, 9 aa, Homo Sapiens
QIWNLNPVF

SEQ ID NO: 75997 - protein, 9 aa, Homo Sapiens
VAMCQVTST

SEQ ID NO: 75998 - protein, 9 aa, Homo Sapiens
FNLISQVGR

SEQ ID NO: 75999 - protein, 9 aa, Homo Sapiens
LTPLLCFQA

SEQ ID NO: 76000 - protein, 9 aa, Homo Sapiens
EKAVTVDKL

SEQ ID NO: 76001 - protein, 9 aa, Homo Sapiens
KAAKGCSNA

SEQ ID NO: 76002 - protein, 9 aa, Homo Sapiens
GRGRGQGRG

SEQ ID NO: 76003 - protein, 9 aa, Homo Sapiens
QGELVKSNC

SEQ ID NO: 76004 - protein, 9 aa, Homo Sapiens
ELLHEKGPE

SEQ ID NO: 76005 - protein, 9 aa, Homo Sapiens
YENNCLILR

SEQ ID NO: 76006 - protein, 9 aa, Homo Sapiens
KARGGTVPG

SEQ ID NO: 76007 - protein, 9 aa, Homo Sapiens
ISVTGGANN

SEQ ID NO: 76008 - protein, 9 aa, Homo Sapiens
CQVSSFRVK

SEQ ID NO: 76009 - protein, 9 aa, Homo Sapiens
KLGAHTPVT

SEQ ID NO: 76010 - protein, 9 aa, Homo Sapiens
FGRVSRLAV

SEQ ID NO: 76011 - protein, 9 aa, Homo Sapiens
EAGGTQLEP

SEQ ID NO: 76012 - protein, 9 aa, Homo Sapiens
AAISEETLN

SEQ ID NO: 76013 - protein, 9 aa, Homo Sapiens
ALLDKECWF

SEQ ID NO: 76014 - protein, 9 aa, Homo Sapiens
ICYIAEVLI

SEQ ID NO: 76015 - protein, 9 aa, Homo Sapiens
AFVHYYKEE

SEQ ID NO: 76016 - protein, 9 aa, Homo Sapiens
PPLSAADTK

SEQ ID NO: 76017 - protein, 9 aa, Homo Sapiens
RICLKRAEA

SEQ ID NO: 76018 - protein, 9 aa, Homo Sapiens
FRDLPLGKE

SEQ ID NO: 76019 - protein, 9 aa, Homo Sapiens
CSDLIWGLA

SEQ ID NO: 76020 - protein, 9 aa, Homo Sapiens
AKNRPEQSL

SEQ ID NO: 76021 - protein, 9 aa, Homo Sapiens
LGCKPSQVL

SEQ ID NO: 76022 - protein, 9 aa, Homo Sapiens
YCNLTSCGE

SEQ ID NO: 76023 - protein, 9 aa, Homo Sapiens
APSGCNKQA

SEQ ID NO: 76024 - protein, 9 aa, Homo Sapiens
GKRREMTCF

SEQ ID NO: 76025 - protein, 9 aa, Homo Sapiens
EKEEEDQDP

SEQ ID NO: 76026 - protein, 9 aa, Homo Sapiens
VTNRNDVQG

SEQ ID NO: 76027 - protein, 9 aa, Homo Sapiens
RPLALNTVD

SEQ ID NO: 76028 - protein, 9 aa, Homo Sapiens
VLLPQSPPT

SEQ ID NO: 76029 - protein, 9 aa, Homo Sapiens
QGRGALARP

SEQ ID NO: 76030 - protein, 9 aa, Homo Sapiens
SNWESCASK

SEQ ID NO: 76031 - protein, 9 aa, Homo Sapiens
NDDEDEETA

SEQ ID NO: 76032 - protein, 9 aa, Homo Sapiens
YQLDILDTF

SEQ ID NO: 76033 - protein, 9 aa, Homo Sapiens
KAERALQVD

SEQ ID NO: 76034 - protein, 9 aa, Homo Sapiens
AGMLRGDFF

SEQ ID NO: 76035 - protein, 9 aa, Homo Sapiens
IYNQVGRPF

SEQ ID NO: 76036 - protein, 9 aa, Homo Sapiens
PSDSSDPQG

SEQ ID NO: 76037 - protein, 9 aa, Homo Sapiens
LPPTHSPTS

SEQ ID NO: 76038 - protein, 9 aa, Homo Sapiens
TSMPSGDET

SEQ ID NO: 76039 - protein, 9 aa, Homo Sapiens
NDKNFHLNV

SEQ ID NO: 76040 - protein, 9 aa, Homo Sapiens
GGGAKAAKG

SEQ ID NO: 76041 - protein, 9 aa, Homo Sapiens
GESKTTFPS

SEQ ID NO: 76042 - protein, 9 aa, Homo Sapiens
SALSQLSFQ

SEQ ID NO: 76043 - protein, 9 aa, Homo Sapiens
RSAKVDFDE

SEQ ID NO: 76044 - protein, 9 aa, Homo Sapiens
PPGTRRPGA

SEQ ID NO: 76045 - protein, 9 aa, Homo Sapiens
AGQLTRLCL

SEQ ID NO: 76046 - protein, 9 aa, Homo Sapiens
LAVGLIEKD

SEQ ID NO: 76047 - protein, 9 aa, Homo Sapiens
ECVEANSGR

SEQ ID NO: 76048 - protein, 9 aa, Homo Sapiens
STASKVTAA

SEQ ID NO: 76049 - protein, 9 aa, Homo Sapiens
IHIKWICSK

SEQ ID NO: 76050 - protein, 9 aa, Homo Sapiens
KVTCGPPDM

SEQ ID NO: 76051 - protein, 9 aa, Homo Sapiens
KNSIQQLVP

SEQ ID NO: 76052 - protein, 9 aa, Homo Sapiens
QVGSESAQG

SEQ ID NO: 76053 - protein, 9 aa, Homo Sapiens
LPHGYVPST

SEQ ID NO: 76054 - protein, 9 aa, Homo Sapiens
SATMVYGLF

SEQ ID NO: 76055 - protein, 9 aa, Homo Sapiens
FGNHPFPAM

SEQ ID NO: 76056 - protein, 9 aa, Homo Sapiens
KDCDLFQKR

SEQ ID NO: 76057 - protein, 9 aa, Homo Sapiens
VFGRVSRLA

SEQ ID NO: 76058 - protein, 9 aa, Homo Sapiens
LNSDNLHAG

SEQ ID NO: 76059 - protein, 9 aa, Homo Sapiens
QLAPSGCNK

SEQ ID NO: 76060 - protein, 9 aa, Homo Sapiens
FYANTLFTY

SEQ ID NO: 76061 - protein, 9 aa, Homo Sapiens
SKERAERKA

SEQ ID NO: 76062 - protein, 9 aa, Homo Sapiens
FLIAVTFIS

SEQ ID NO: 76063 - protein, 9 aa, Homo Sapiens
EVISPTKFE

SEQ ID NO: 76064 - protein, 9 aa, Homo Sapiens
CNHGKPVGD

SEQ ID NO: 76065 - protein, 9 aa, Homo Sapiens
LLGLSISKP

SEQ ID NO: 76066 - protein, 9 aa, Homo Sapiens
YSVREQIDR

SEQ ID NO: 76067 - protein, 9 aa, Homo Sapiens
FFQDFRPFV

SEQ ID NO: 76068 - protein, 9 aa, Homo Sapiens
IARAEKMEK

SEQ ID NO: 76069 - protein, 9 aa, Homo Sapiens
SPKIIITSL

SEQ ID NO: 76070 - protein, 9 aa, Homo Sapiens
KDKLPQSPG

SEQ ID NO: 76071 - protein, 9 aa, Homo Sapiens
KSSGFQTQS

SEQ ID NO: 76072 - protein, 9 aa, Homo Sapiens
EHWGGQGSS

SEQ ID NO: 76073 - protein, 9 aa, Homo Sapiens
IETFKQCME

SEQ ID NO: 76074 - protein, 9 aa, Homo Sapiens
KTQKVQMKF

SEQ ID NO: 76075 - protein, 9 aa, Homo Sapiens
SKAKDKPEF

SEQ ID NO: 76076 - protein, 9 aa, Homo Sapiens
ENFGHLALL

SEQ ID NO: 76077 - protein, 9 aa, Homo Sapiens
ARRLGEAWA

SEQ ID NO: 76078 - protein, 9 aa, Homo Sapiens
LEEEKEEEA

SEQ ID NO: 76079 - protein, 9 aa, Homo Sapiens
YVWSNISLY

SEQ ID NO: 76080 - protein, 9 aa, Homo Sapiens
GLMVQQPGM

SEQ ID NO: 76081 - protein, 9 aa, Homo Sapiens
IVAVVVVVD

SEQ ID NO: 76082 - protein, 9 aa, Homo Sapiens
LYSLNKYTK

SEQ ID NO: 76083 - protein, 9 aa, Homo Sapiens
LYDNEQVGS

SEQ ID NO: 76084 - protein, 9 aa, Homo Sapiens
QRAAARFYQ

SEQ ID NO: 76085 - protein, 9 aa, Homo Sapiens
HELEVDNTE

SEQ ID NO: 76086 - protein, 9 aa, Homo Sapiens
LVTGGELFH

SEQ ID NO: 76087 - protein, 9 aa, Homo Sapiens
FNEDNSDIG

SEQ ID NO: 76088 - protein, 9 aa, Homo Sapiens
SGEASPPRS

SEQ ID NO: 76089 - protein, 9 aa, Homo Sapiens
LFDKTRTGE

SEQ ID NO: 76090 - protein, 9 aa, Homo Sapiens
DRWVHMRTA

SEQ ID NO: 76091 - protein, 9 aa, Homo Sapiens
DSDTVKLQV

SEQ ID NO: 76092 - protein, 9 aa, Homo Sapiens
ATTTATATA

SEQ ID NO: 76093 - protein, 9 aa, Homo Sapiens
CGRAEAASQ

SEQ ID NO: 76094 - protein, 9 aa, Homo Sapiens
RNAIISYVL

SEQ ID NO: 76095 - protein, 9 aa, Homo Sapiens
GGKARGGTV

SEQ ID NO: 76096 - protein, 9 aa, Homo Sapiens
GYSNPFVKV

SEQ ID NO: 76097 - protein, 9 aa, Homo Sapiens
GGLGCKPSQ

SEQ ID NO: 76098 - protein, 9 aa, Homo Sapiens
FVMFRGLWQ

SEQ ID NO: 76099 - protein, 9 aa, Homo Sapiens
LKDEDWNDF

SEQ ID NO: 76100 - protein, 9 aa, Homo Sapiens
KFLCQGLRY

SEQ ID NO: 76101 - protein, 9 aa, Homo Sapiens
CLVLRGTQT

SEQ ID NO: 76102 - protein, 9 aa, Homo Sapiens
MKFLKKGEL

SEQ ID NO: 76103 - protein, 9 aa, Homo Sapiens
IDPNAFFRL

SEQ ID NO: 76104 - protein, 9 aa, Homo Sapiens
HEKGPEVLQ

SEQ ID NO: 76105 - protein, 9 aa, Homo Sapiens
CPELRPHVQ

SEQ ID NO: 76106 - protein, 9 aa, Homo Sapiens
KDKPEFFID

SEQ ID NO: 76107 - protein, 9 aa, Homo Sapiens
SCASKPVSG

SEQ ID NO: 76108 - protein, 9 aa, Homo Sapiens
GKRNARLRP

SEQ ID NO: 76109 - protein, 9 aa, Homo Sapiens
PSVVDGKRN

SEQ ID NO: 76110 - protein, 9 aa, Homo Sapiens
LNQPCIPGI

SEQ ID NO: 76111 - protein, 9 aa, Homo Sapiens
LNPLLDCVR

SEQ ID NO: 76112 - protein, 9 aa, Homo Sapiens
AECVEANSG

SEQ ID NO: 76113 - protein, 9 aa, Homo Sapiens
AAISSIASS

SEQ ID NO: 76114 - protein, 9 aa, Homo Sapiens
IGRIKNVEN

SEQ ID NO: 76115 - protein, 9 aa, Homo Sapiens
LRRHKEKLK

SEQ ID NO: 76116 - protein, 9 aa, Homo Sapiens
IADLTPLLC

SEQ ID NO: 76117 - protein, 9 aa, Homo Sapiens
DCLPAKPLE

SEQ ID NO: 76118 - protein, 9 aa, Homo Sapiens
SENLSVSDG

SEQ ID NO: 76119 - protein, 9 aa, Homo Sapiens
THSPTSHWD

SEQ ID NO: 76120 - protein, 9 aa, Homo Sapiens
DSIKEEAAH

SEQ ID NO: 76121 - protein, 9 aa, Homo Sapiens
LSQLGSAKN

SEQ ID NO: 76122 - protein, 9 aa, Homo Sapiens
KMLPTYLKD

SEQ ID NO: 76123 - protein, 9 aa, Homo Sapiens
NAGTFTEEQ

SEQ ID NO: 76124 - protein, 9 aa, Homo Sapiens
YGLHALQQG

SEQ ID NO: 76125 - protein, 9 aa, Homo Sapiens
VRKAYLQFM

SEQ ID NO: 76126 - protein, 9 aa, Homo Sapiens
VKLQGERVQ

SEQ ID NO: 76127 - protein, 9 aa, Homo Sapiens
ENNCLILRA

SEQ ID NO: 76128 - protein, 9 aa, Homo Sapiens
IWVACIKAK

SEQ ID NO: 76129 - protein, 9 aa, Homo Sapiens
DNNGYSNPF

SEQ ID NO: 76130 - protein, 9 aa, Homo Sapiens
AFGTHTLIK

SEQ ID NO: 76131 - protein, 9 aa, Homo Sapiens
EEMRRQQEK

SEQ ID NO: 76132 - protein, 9 aa, Homo Sapiens
HLVHVVVTQ

SEQ ID NO: 76133 - protein, 9 aa, Homo Sapiens
LRHQAFLIR

SEQ ID NO: 76134 - protein, 9 aa, Homo Sapiens
AARFYQLDV

SEQ ID NO: 76135 - protein, 9 aa, Homo Sapiens
ELPSVQHPN

SEQ ID NO: 76136 - protein, 9 aa, Homo Sapiens
PPPPEIDVT

SEQ ID NO: 76137 - protein, 9 aa, Homo Sapiens
MASWGNINV

SEQ ID NO: 76138 - protein, 9 aa, Homo Sapiens
SRKAFPEHL

SEQ ID NO: 76139 - protein, 9 aa, Homo Sapiens
SRFSWGAKG

SEQ ID NO: 76140 - protein, 9 aa, Homo Sapiens
DNIEIVIKM

SEQ ID NO: 76141 - protein, 9 aa, Homo Sapiens
NLTLHQVIY

SEQ ID NO: 76142 - protein, 9 aa, Homo Sapiens
QAAAAAAAI

SEQ ID NO: 76143 - protein, 9 aa, Homo Sapiens
LIDDTDVDD

SEQ ID NO: 76144 - protein, 9 aa, Homo Sapiens
FTLRIIYNQ

SEQ ID NO: 76145 - protein, 9 aa, Homo Sapiens
EPSEISNRT

SEQ ID NO: 76146 - protein, 9 aa, Homo Sapiens
ENVLQKNSK

SEQ ID NO: 76147 - protein, 9 aa, Homo Sapiens
DSCCEPPCC

SEQ ID NO: 76148 - protein, 9 aa, Homo Sapiens
TSKPMSFYP

SEQ ID NO: 76149 - protein, 9 aa, Homo Sapiens
ERSRTLHFR

SEQ ID NO: 76150 - protein, 9 aa, Homo Sapiens
TRLCWASEL

SEQ ID NO: 76151 - protein, 9 aa, Homo Sapiens
NHEPSEISN

SEQ ID NO: 76152 - protein, 9 aa, Homo Sapiens
SPKVTCGPP

SEQ ID NO: 76153 - protein, 9 aa, Homo Sapiens
ARHIYGTEN

SEQ ID NO: 76154 - protein, 9 aa, Homo Sapiens
EIDLSVNRQ

SEQ ID NO: 76155 - protein, 9 aa, Homo Sapiens
LCWASELSD

SEQ ID NO: 76156 - protein, 9 aa, Homo Sapiens
LSTLLHLSS

SEQ ID NO: 76157 - protein, 9 aa, Homo Sapiens
VPTIQSDIP

SEQ ID NO: 76158 - protein, 9 aa, Homo Sapiens
TFGNHPFPA

SEQ ID NO: 76159 - protein, 9 aa, Homo Sapiens
HTLIKKKNV

SEQ ID NO: 76160 - protein, 9 aa, Homo Sapiens
NLCLIDERI

SEQ ID NO: 76161 - protein, 9 aa, Homo Sapiens
FTYSIDSVS

SEQ ID NO: 76162 - protein, 9 aa, Homo Sapiens
PPPSVFGRV

SEQ ID NO: 76163 - protein, 9 aa, Homo Sapiens
AAFTYSIDS

SEQ ID NO: 76164 - protein, 9 aa, Homo Sapiens
IKKDEKEEE

SEQ ID NO: 76165 - protein, 9 aa, Homo Sapiens
SVSQHLVHV

SEQ ID NO: 76166 - protein, 9 aa, Homo Sapiens
GLPELCAEL

SEQ ID NO: 76167 - protein, 9 aa, Homo Sapiens
FENPRRSPT

SEQ ID NO: 76168 - protein, 9 aa, Homo Sapiens
VLFPKKQPD

SEQ ID NO: 76169 - protein, 9 aa, Homo Sapiens
KVVDTCLYK

SEQ ID NO: 76170 - protein, 9 aa, Homo Sapiens
ETIDEKLGL

SEQ ID NO: 76171 - protein, 9 aa, Homo Sapiens
RRHKEKLKE

SEQ ID NO: 76172 - protein, 9 aa, Homo Sapiens
KLQGERVQG

SEQ ID NO: 76173 - protein, 9 aa, Homo Sapiens
RPAGAWRGF

SEQ ID NO: 76174 - protein, 9 aa, Homo Sapiens
SMWELTAAN

SEQ ID NO: 76175 - protein, 9 aa, Homo Sapiens
LEQEFLANA

SEQ ID NO: 76176 - protein, 9 aa, Homo Sapiens
WRGFGLALT

SEQ ID NO: 76177 - protein, 9 aa, Homo Sapiens
QITRLDGDL

SEQ ID NO: 76178 - protein, 9 aa, Homo Sapiens
GAKAAKGCS

SEQ ID NO: 76179 - protein, 9 aa, Homo Sapiens
RTSKRKKTK

SEQ ID NO: 76180 - protein, 9 aa, Homo Sapiens
GAFDHTVSL

SEQ ID NO: 76181 - protein, 9 aa, Homo Sapiens
KLLTQITRL

SEQ ID NO: 76182 - protein, 9 aa, Homo Sapiens
REKAVTVDK

SEQ ID NO: 76183 - protein, 9 aa, Homo Sapiens
KMLAAREDR

SEQ ID NO: 76184 - protein, 9 aa, Homo Sapiens
HMNQIGFQR

SEQ ID NO: 76185 - protein, 9 aa, Homo Sapiens
KCVHMVISE

SEQ ID NO: 76186 - protein, 9 aa, Homo Sapiens
CGGPLVCRG

SEQ ID NO: 76187 - protein, 9 aa, Homo Sapiens
KDCFQYGTP

SEQ ID NO: 76188 - protein, 9 aa, Homo Sapiens
ERGWGALTR

SEQ ID NO: 76189 - protein, 9 aa, Homo Sapiens
SGLNEGLMY

SEQ ID NO: 76190 - protein, 9 aa, Homo Sapiens
QGERNVPSP

SEQ ID NO: 76191 - protein, 9 aa, Homo Sapiens
DYSAFYLGH

SEQ ID NO: 76192 - protein, 9 aa, Homo Sapiens
SNYTSRCHA

SEQ ID NO: 76193 - protein, 9 aa, Homo Sapiens
SPEQTEHWG

SEQ ID NO: 76194 - protein, 9 aa, Homo Sapiens
TMSGRPWPH

SEQ ID NO: 76195 - protein, 9 aa, Homo Sapiens
FNGCFVKVA

SEQ ID NO: 76196 - protein, 9 aa, Homo Sapiens
SKPMSFYPP

SEQ ID NO: 76197 - protein, 9 aa, Homo Sapiens
DYPGKCQLL

SEQ ID NO: 76198 - protein, 9 aa, Homo Sapiens
LDTFGNHPF

SEQ ID NO: 76199 - protein, 9 aa, Homo Sapiens
GSCGKFLVS

SEQ ID NO: 76200 - protein, 9 aa, Homo Sapiens
GPGSAGRAG

SEQ ID NO: 76201 - protein, 9 aa, Homo Sapiens
GAKSATVPD

SEQ ID NO: 76202 - protein, 9 aa, Homo Sapiens
SYIDPNAFF

SEQ ID NO: 76203 - protein, 9 aa, Homo Sapiens
QAPPPSSPS

SEQ ID NO: 76204 - protein, 9 aa, Homo Sapiens
QIVTNRNDV

SEQ ID NO: 76205 - protein, 9 aa, Homo Sapiens
DSCQGDCGG

SEQ ID NO: 76206 - protein, 9 aa, Homo Sapiens
FVHYYKEEA

SEQ ID NO: 76207 - protein, 9 aa, Homo Sapiens
VEEDDKVQK

SEQ ID NO: 76208 - protein, 9 aa, Homo Sapiens
SWAEQATAG

SEQ ID NO: 76209 - protein, 9 aa, Homo Sapiens
GMPLEKVVM

SEQ ID NO: 76210 - protein, 9 aa, Homo Sapiens
KPEFFIDML

SEQ ID NO: 76211 - protein, 9 aa, Homo Sapiens
LPEPRKPVE

SEQ ID NO: 76212 - protein, 9 aa, Homo Sapiens
STNHEPSEI

SEQ ID NO: 76213 - protein, 9 aa, Homo Sapiens
VNRSQPLLI

SEQ ID NO: 76214 - protein, 9 aa, Homo Sapiens
RAEKMEKME

SEQ ID NO: 76215 - protein, 9 aa, Homo Sapiens
SSSSTSEGS

SEQ ID NO: 76216 - protein, 9 aa, Homo Sapiens
PRLSRELLH

SEQ ID NO: 76217 - protein, 9 aa, Homo Sapiens
CGKFLVSTS

SEQ ID NO: 76218 - protein, 9 aa, Homo Sapiens
LRNAIISYV

SEQ ID NO: 76219 - protein, 9 aa, Homo Sapiens
QMKNLKLLS

SEQ ID NO: 76220 - protein, 9 aa, Homo Sapiens
PLRFWVNVM

SEQ ID NO: 76221 - protein, 9 aa, Homo Sapiens
MKVSGLNEG

SEQ ID NO: 76222 - protein, 9 aa, Homo Sapiens
AQVDNSKQL

SEQ ID NO: 76223 - protein, 9 aa, Homo Sapiens
FCAYKSHFR

SEQ ID NO: 76224 - protein, 9 aa, Homo Sapiens
QYDMKKYQE

SEQ ID NO: 76225 - protein, 9 aa, Homo Sapiens
QENKNLARR

SEQ ID NO: 76226 - protein, 9 aa, Homo Sapiens
VPSPKSPLR

SEQ ID NO: 76227 - protein, 9 aa, Homo Sapiens
CNLTSCGEL

SEQ ID NO: 76228 - protein, 9 aa, Homo Sapiens
AKGVLLDYL

SEQ ID NO: 76229 - protein, 9 aa, Homo Sapiens
PSVFGRVSR

SEQ ID NO: 76230 - protein, 9 aa, Homo Sapiens
DWEKENEAT

SEQ ID NO: 76231 - protein, 9 aa, Homo Sapiens
GTSGLVASP

SEQ ID NO: 76232 - protein, 9 aa, Homo Sapiens
QTYLPCIIT

SEQ ID NO: 76233 - protein, 9 aa, Homo Sapiens
AQVDKVCRH

SEQ ID NO: 76234 - protein, 9 aa, Homo Sapiens
QKKIDEAKD

SEQ ID NO: 76235 - protein, 9 aa, Homo Sapiens
IILIVEIEL

SEQ ID NO: 76236 - protein, 9 aa, Homo Sapiens
SFLLGVGGR

SEQ ID NO: 76237 - protein, 9 aa, Homo Sapiens
YTAEEYGAG

SEQ ID NO: 76238 - protein, 9 aa, Homo Sapiens
YRLCQANPD

SEQ ID NO: 76239 - protein, 9 aa, Homo Sapiens
GDYIACESE

SEQ ID NO: 76240 - protein, 9 aa, Homo Sapiens
RAERKAERA

SEQ ID NO: 76241 - protein, 9 aa, Homo Sapiens
MDIKTIFRA

SEQ ID NO: 76242 - protein, 9 aa, Homo Sapiens
NSPKIIITS

SEQ ID NO: 76243 - protein, 9 aa, Homo Sapiens
LLFNLISQV

SEQ ID NO: 76244 - protein, 9 aa, Homo Sapiens
LVVSVVAVM

SEQ ID NO: 76245 - protein, 9 aa, Homo Sapiens
TDQAIKAGL

SEQ ID NO: 76246 - protein, 9 aa, Homo Sapiens
QLTRLCLVL

SEQ ID NO: 76247 - protein, 9 aa, Homo Sapiens
INHVVFVAG

SEQ ID NO: 76248 - protein, 9 aa, Homo Sapiens
SPATTTATA

SEQ ID NO: 76249 - protein, 9 aa, Homo Sapiens
EKSVHSFQL

SEQ ID NO: 76250 - protein, 9 aa, Homo Sapiens
LGKLRDRLQ

SEQ ID NO: 76251 - protein, 9 aa, Homo Sapiens
LEQFCFKFC

SEQ ID NO: 76252 - protein, 9 aa, Homo Sapiens
LISAGLFCQ

SEQ ID NO: 76253 - protein, 9 aa, Homo Sapiens
ESRSVIWEN

SEQ ID NO: 76254 - protein, 9 aa, Homo Sapiens
FLGFCSSLD

SEQ ID NO: 76255 - protein, 9 aa, Homo Sapiens
ECITVPLLR

SEQ ID NO: 76256 - protein, 9 aa, Homo Sapiens
RRLEQEFLA

SEQ ID NO: 76257 - protein, 9 aa, Homo Sapiens
QHLVHVVVT

SEQ ID NO: 76258 - protein, 9 aa, Homo Sapiens
DLFQKRMLE

SEQ ID NO: 76259 - protein, 9 aa, Homo Sapiens
LEAYSERSP

SEQ ID NO: 76260 - protein, 9 aa, Homo Sapiens
LATPDQSLM

SEQ ID NO: 76261 - protein, 9 aa, Homo Sapiens
KERLFHKLF

SEQ ID NO: 76262 - protein, 9 aa, Homo Sapiens
SCQGDCGGP

SEQ ID NO: 76263 - protein, 9 aa, Homo Sapiens
YIAEVLITT

SEQ ID NO: 76264 - protein, 9 aa, Homo Sapiens
LKVSQNHKG

SEQ ID NO: 76265 - protein, 9 aa, Homo Sapiens
QDARIIVEL

SEQ ID NO: 76266 - protein, 9 aa, Homo Sapiens
ITRLDGDLG

SEQ ID NO: 76267 - protein, 9 aa, Homo Sapiens
SHRSSSPEV

SEQ ID NO: 76268 - protein, 9 aa, Homo Sapiens
HDLWNRVQN

SEQ ID NO: 76269 - protein, 9 aa, Homo Sapiens
RLCQANPDL

SEQ ID NO: 76270 - protein, 9 aa, Homo Sapiens
PTCGHTSQG

SEQ ID NO: 76271 - protein, 9 aa, Homo Sapiens
QPTNKGKYK

SEQ ID NO: 76272 - protein, 9 aa, Homo Sapiens
HKTSEKSVH

SEQ ID NO: 76273 - protein, 9 aa, Homo Sapiens
ILNPLLDCV

SEQ ID NO: 76274 - protein, 9 aa, Homo Sapiens
EKMEKMEQE

SEQ ID NO: 76275 - protein, 9 aa, Homo Sapiens
ENEATGELG

SEQ ID NO: 76276 - protein, 9 aa, Homo Sapiens
EISLPVAND

SEQ ID NO: 76277 - protein, 9 aa, Homo Sapiens
ISMTMPPYG

SEQ ID NO: 76278 - protein, 9 aa, Homo Sapiens
ASETDKWME

SEQ ID NO: 76279 - protein, 9 aa, Homo Sapiens
TLCEELGCR

SEQ ID NO: 76280 - protein, 9 aa, Homo Sapiens
SILRQEVAL

SEQ ID NO: 76281 - protein, 9 aa, Homo Sapiens
DKPMFTQPL

SEQ ID NO: 76282 - protein, 9 aa, Homo Sapiens
GARHIYGTE

SEQ ID NO: 76283 - protein, 9 aa, Homo Sapiens
FELQREIKR

SEQ ID NO: 76284 - protein, 9 aa, Homo Sapiens
RVDYYLLHQ

SEQ ID NO: 76285 - protein, 9 aa, Homo Sapiens
LMLAVGLIE

SEQ ID NO: 76286 - protein, 9 aa, Homo Sapiens
EDDKVQKSS

SEQ ID NO: 76287 - protein, 9 aa, Homo Sapiens
GFTLEGEIL

SEQ ID NO: 76288 - protein, 9 aa, Homo Sapiens
PNGCKAPRL

SEQ ID NO: 76289 - protein, 9 aa, Homo Sapiens
EEEDEKIDR

SEQ ID NO: 76290 - protein, 9 aa, Homo Sapiens
KFEISLPVA

SEQ ID NO: 76291 - protein, 9 aa, Homo Sapiens
LNLCLIDER

SEQ ID NO: 76292 - protein, 9 aa, Homo Sapiens
TRLCLVLRG

SEQ ID NO: 76293 - protein, 9 aa, Homo Sapiens
YSTFSSENL

SEQ ID NO: 76294 - protein, 9 aa, Homo Sapiens
AKQDGIGEE

SEQ ID NO: 76295 - protein, 9 aa, Homo Sapiens
IFLIAVTFI

SEQ ID NO: 76296 - protein, 9 aa, Homo Sapiens
HVVFVAGWG

SEQ ID NO: 76297 - protein, 9 aa, Homo Sapiens
WVHMRTAYK

SEQ ID NO: 76298 - protein, 9 aa, Homo Sapiens
LRGDFFLRL

SEQ ID NO: 76299 - protein, 9 aa, Homo Sapiens
VLKTLSTLL

SEQ ID NO: 76300 - protein, 9 aa, Homo Sapiens
LKLPKSNQY

SEQ ID NO: 76301 - protein, 9 aa, Homo Sapiens
PSAGKDTMS

SEQ ID NO: 76302 - protein, 9 aa, Homo Sapiens
LLMERLCVD

SEQ ID NO: 76303 - protein, 9 aa, Homo Sapiens
LVLIGQIVF

SEQ ID NO: 76304 - protein, 9 aa, Homo Sapiens
FGTHTLIKK

SEQ ID NO: 76305 - protein, 9 aa, Homo Sapiens
GMLRGDFFL

SEQ ID NO: 76306 - protein, 9 aa, Homo Sapiens
LEITGPMMP

SEQ ID NO: 76307 - protein, 9 aa, Homo Sapiens
PLSKDETAQ

SEQ ID NO: 76308 - protein, 9 aa, Homo Sapiens
KFLVSTSTR

SEQ ID NO: 76309 - protein, 9 aa, Homo Sapiens
KSPEDPSGT

SEQ ID NO: 76310 - protein, 9 aa, Homo Sapiens
RILNPLLDC

SEQ ID NO: 76311 - protein, 9 aa, Homo Sapiens
IVASLFYAN

SEQ ID NO: 76312 - protein, 9 aa, Homo Sapiens
FFNAGTFTE

SEQ ID NO: 76313 - protein, 9 aa, Homo Sapiens
IQDVLFVYK

SEQ ID NO: 76314 - protein, 9 aa, Homo Sapiens
VPRTLSPYQ

SEQ ID NO: 76315 - protein, 9 aa, Homo Sapiens
AEEDAEAQV

SEQ ID NO: 76316 - protein, 9 aa, Homo Sapiens
PSIVTTGLV

SEQ ID NO: 76317 - protein, 9 aa, Homo Sapiens
GSPPGTRRP

SEQ ID NO: 76318 - protein, 9 aa, Homo Sapiens
PPDLASQGL

SEQ ID NO: 76319 - protein, 9 aa, Homo Sapiens
VVAVMVYKF

SEQ ID NO: 76320 - protein, 9 aa, Homo Sapiens
VRLRCNHGK

SEQ ID NO: 76321 - protein, 9 aa, Homo Sapiens
ILHCPGARH

SEQ ID NO: 76322 - protein, 9 aa, Homo Sapiens
QVEEDDKVQ

SEQ ID NO: 76323 - protein, 9 aa, Homo Sapiens
GTFNTIESH

SEQ ID NO: 76324 - protein, 9 aa, Homo Sapiens
RGDFFLRLF

SEQ ID NO: 76325 - protein, 9 aa, Homo Sapiens
HESLRLQLL

SEQ ID NO: 76326 - protein, 9 aa, Homo Sapiens
QYSECRDLA

SEQ ID NO: 76327 - protein, 9 aa, Homo Sapiens
FVYKNTNSS

SEQ ID NO: 76328 - protein, 9 aa, Homo Sapiens
FYPPHYLAA

SEQ ID NO: 76329 - protein, 9 aa, Homo Sapiens
DKAVSGGLS

SEQ ID NO: 76330 - protein, 9 aa, Homo Sapiens
ITVPLLREH

SEQ ID NO: 76331 - protein, 9 aa, Homo Sapiens
IKTIFRAVG

SEQ ID NO: 76332 - protein, 9 aa, Homo Sapiens
EISNRTMII

SEQ ID NO: 76333 - protein, 9 aa, Homo Sapiens
TGGANNFAL

SEQ ID NO: 76334 - protein, 9 aa, Homo Sapiens
PELCAELGR

SEQ ID NO: 76335 - protein, 9 aa, Homo Sapiens
KNSNWESCA

SEQ ID NO: 76336 - protein, 9 aa, Homo Sapiens
VTLYDNEQV

SEQ ID NO: 76337 - protein, 9 aa, Homo Sapiens
GPLRCQKAW

SEQ ID NO: 76338 - protein, 9 aa, Homo Sapiens
WSSAEEHIN

SEQ ID NO: 76339 - protein, 9 aa, Homo Sapiens
KLSPWKGKS

SEQ ID NO: 76340 - protein, 9 aa, Homo Sapiens
RLPDSNDDE

SEQ ID NO: 76341 - protein, 9 aa, Homo Sapiens
ILVQQFQVQ

SEQ ID NO: 76342 - protein, 9 aa, Homo Sapiens
LKQEKKDKT

SEQ ID NO: 76343 - protein, 9 aa, Homo Sapiens
PTHSPTSHW

SEQ ID NO: 76344 - protein, 9 aa, Homo Sapiens
GEDSHLKQR

SEQ ID NO: 76345 - protein, 9 aa, Homo Sapiens
EVLLSPKVT

SEQ ID NO: 76346 - protein, 9 aa, Homo Sapiens
PVLFEPVYD

SEQ ID NO: 76347 - protein, 9 aa, Homo Sapiens
QASATMVYG

SEQ ID NO: 76348 - protein, 9 aa, Homo Sapiens
LWSNKLITD

SEQ ID NO: 76349 - protein, 9 aa, Homo Sapiens
PRPAFVHYY

SEQ ID NO: 76350 - protein, 9 aa, Homo Sapiens
SNDDEDEET

SEQ ID NO: 76351 - protein, 9 aa, Homo Sapiens
DTDFGGNIK

SEQ ID NO: 76352 - protein, 9 aa, Homo Sapiens
KMKGFTVSF

SEQ ID NO: 76353 - protein, 9 aa, Homo Sapiens
KHSAVWVPM

SEQ ID NO: 76354 - protein, 9 aa, Homo Sapiens
KGLRPPWSE

SEQ ID NO: 76355 - protein, 9 aa, Homo Sapiens
VAPSWPECH

SEQ ID NO: 76356 - protein, 9 aa, Homo Sapiens
TFPSSPEED

SEQ ID NO: 76357 - protein, 9 aa, Homo Sapiens
YANTLFTYT

SEQ ID NO: 76358 - protein, 9 aa, Homo Sapiens
CTEVIQLAQ

SEQ ID NO: 76359 - protein, 9 aa, Homo Sapiens
SVCTEVIQL

SEQ ID NO: 76360 - protein, 9 aa, Homo Sapiens
CIQPQLPNG

SEQ ID NO: 76361 - protein, 9 aa, Homo Sapiens
VPPPSVFGR

SEQ ID NO: 76362 - protein, 9 aa, Homo Sapiens
AIPPMLDLL

SEQ ID NO: 76363 - protein, 9 aa, Homo Sapiens
IVEIELLES

SEQ ID NO: 76364 - protein, 9 aa, Homo Sapiens
ILVLIGQIV

SEQ ID NO: 76365 - protein, 9 aa, Homo Sapiens
STEFTDSIK

SEQ ID NO: 76366 - protein, 9 aa, Homo Sapiens
QGKYQVLLE

SEQ ID NO: 76367 - protein, 9 aa, Homo Sapiens
RPHVQLSSA

SEQ ID NO: 76368 - protein, 9 aa, Homo Sapiens
SSTSEGSYP

SEQ ID NO: 76369 - protein, 9 aa, Homo Sapiens
FYYKEKDDD

SEQ ID NO: 76370 - protein, 9 aa, Homo Sapiens
GEDEGPGAK

SEQ ID NO: 76371 - protein, 9 aa, Homo Sapiens
QVDQELSNG

SEQ ID NO: 76372 - protein, 9 aa, Homo Sapiens
CASKPVSGW

SEQ ID NO: 76373 - protein, 9 aa, Homo Sapiens
CLKRAEAGP

SEQ ID NO: 76374 - protein, 9 aa, Homo Sapiens
ASDRAPDRQ

SEQ ID NO: 76375 - protein, 9 aa, Homo Sapiens
EDSHLKQRR

SEQ ID NO: 76376 - protein, 9 aa, Homo Sapiens
DVVLYSLNK

SEQ ID NO: 76377 - protein, 9 aa, Homo Sapiens
EQRLRCSFR

SEQ ID NO: 76378 - protein, 9 aa, Homo Sapiens
MTMPPYGSL

SEQ ID NO: 76379 - protein, 9 aa, Homo Sapiens
ATPPDLASQ

SEQ ID NO: 76380 - protein, 9 aa, Homo Sapiens
GRPMVWGLA

SEQ ID NO: 76381 - protein, 9 aa, Homo Sapiens
LANHGLIVL

SEQ ID NO: 76382 - protein, 9 aa, Homo Sapiens
DMDIKTIFR

SEQ ID NO: 76383 - protein, 9 aa, Homo Sapiens
KREATNVKN

SEQ ID NO: 76384 - protein, 9 aa, Homo Sapiens
IVTTGLVGT

SEQ ID NO: 76385 - protein, 9 aa, Homo Sapiens
NSSSSTSEG

SEQ ID NO: 76386 - protein, 9 aa, Homo Sapiens
RKKTKEESE

SEQ ID NO: 76387 - protein, 9 aa, Homo Sapiens
VQFDFLIKG

SEQ ID NO: 76388 - protein, 9 aa, Homo Sapiens
AKTTKMKVL

SEQ ID NO: 76389 - protein, 9 aa, Homo Sapiens
TVPPPSVFG

SEQ ID NO: 76390 - protein, 9 aa, Homo Sapiens
MPLEKVVMG

SEQ ID NO: 76391 - protein, 9 aa, Homo Sapiens
EPCLKCVHM

SEQ ID NO: 76392 - protein, 9 aa, Homo Sapiens
NRNDVQGYA

SEQ ID NO: 76393 - protein, 9 aa, Homo Sapiens
VMDGVNRII

SEQ ID NO: 76394 - protein, 9 aa, Homo Sapiens
QLSFQVGAP

SEQ ID NO: 76395 - protein, 9 aa, Homo Sapiens
GERGWGALT

SEQ ID NO: 76396 - protein, 9 aa, Homo Sapiens
RSYPGEARR

SEQ ID NO: 76397 - protein, 9 aa, Homo Sapiens
WGWGGEDHD

SEQ ID NO: 76398 - protein, 9 aa, Homo Sapiens
VVPAQKKID

SEQ ID NO: 76399 - protein, 9 aa, Homo Sapiens
ANFTKAAFT

SEQ ID NO: 76400 - protein, 9 aa, Homo Sapiens
SDRAPDRQE

SEQ ID NO: 76401 - protein, 9 aa, Homo Sapiens
AFDALVTLC

SEQ ID NO: 76402 - protein, 9 aa, Homo Sapiens
KFKRKGNEK

SEQ ID NO: 76403 - protein, 9 aa, Homo Sapiens
PLLCFQATD

SEQ ID NO: 76404 - protein, 9 aa, Homo Sapiens
RTVLKSSKR

SEQ ID NO: 76405 - protein, 9 aa, Homo Sapiens
NLQPWPQAW

SEQ ID NO: 76406 - protein, 9 aa, Homo Sapiens
DVKKELEMQ

SEQ ID NO: 76407 - protein, 9 aa, Homo Sapiens
PCLKCVHMV

SEQ ID NO: 76408 - protein, 9 aa, Homo Sapiens
SQLSFQVGA

SEQ ID NO: 76409 - protein, 9 aa, Homo Sapiens
KAKDKPEFF

SEQ ID NO: 76410 - protein, 9 aa, Homo Sapiens
LYMWPFEKP

SEQ ID NO: 76411 - protein, 9 aa, Homo Sapiens
TLKSSEKSS

SEQ ID NO: 76412 - protein, 9 aa, Homo Sapiens
CIIKTYKML

SEQ ID NO: 76413 - protein, 9 aa, Homo Sapiens
GERNVPSPK

SEQ ID NO: 76414 - protein, 9 aa, Homo Sapiens
CLIDERIHT

SEQ ID NO: 76415 - protein, 9 aa, Homo Sapiens
LLDKECWFP

SEQ ID NO: 76416 - protein, 9 aa, Homo Sapiens
ITGPMMPHS

SEQ ID NO: 76417 - protein, 9 aa, Homo Sapiens
DEKREDTTP

SEQ ID NO: 76418 - protein, 9 aa, Homo Sapiens
LKCVHMVIS

SEQ ID NO: 76419 - protein, 9 aa, Homo Sapiens
PEEVNRSQP

SEQ ID NO: 76420 - protein, 9 aa, Homo Sapiens
LPNGCKAPR

SEQ ID NO: 76421 - protein, 9 aa, Homo Sapiens
LIVEIELLE

SEQ ID NO: 76422 - protein, 9 aa, Homo Sapiens
MTVPPPSVF

SEQ ID NO: 76423 - protein, 9 aa, Homo Sapiens
VQPRPLPSF

SEQ ID NO: 76424 - protein, 9 aa, Homo Sapiens
NEFHKHVQF

SEQ ID NO: 76425 - protein, 9 aa, Homo Sapiens
QCIRLGKPL

SEQ ID NO: 76426 - protein, 9 aa, Homo Sapiens
KLPQSPGLI

SEQ ID NO: 76427 - protein, 9 aa, Homo Sapiens
NDVQGYAAK

SEQ ID NO: 76428 - protein, 9 aa, Homo Sapiens
EASPPRSSG

SEQ ID NO: 76429 - protein, 9 aa, Homo Sapiens
YKQASATMV

SEQ ID NO: 76430 - protein, 9 aa, Homo Sapiens
FCGVCSNTD

SEQ ID NO: 76431 - protein, 9 aa, Homo Sapiens
RNARLRPSR

SEQ ID NO: 76432 - protein, 9 aa, Homo Sapiens
SAFQRALPI

SEQ ID NO: 76433 - protein, 9 aa, Homo Sapiens
QQEKMMRRQ

SEQ ID NO: 76434 - protein, 9 aa, Homo Sapiens
MEDDFNYGS

SEQ ID NO: 76435 - protein, 9 aa, Homo Sapiens
CLISAGLFC

SEQ ID NO: 76436 - protein, 9 aa, Homo Sapiens
TTGLVGTSK

SEQ ID NO: 76437 - protein, 9 aa, Homo Sapiens
YLSSDHRTV

SEQ ID NO: 76438 - protein, 9 aa, Homo Sapiens
RISKAAVQV

SEQ ID NO: 76439 - protein, 9 aa, Homo Sapiens
QFVGDGTFN

SEQ ID NO: 76440 - protein, 9 aa, Homo Sapiens
AKGCSNAHL

SEQ ID NO: 76441 - protein, 9 aa, Homo Sapiens
VPLLREHLS

SEQ ID NO: 76442 - protein, 9 aa, Homo Sapiens
VEDQGVCTQ

SEQ ID NO: 76443 - protein, 9 aa, Homo Sapiens
ASLDAGSGK

SEQ ID NO: 76444 - protein, 9 aa, Homo Sapiens
CVSYATFDD

SEQ ID NO: 76445 - protein, 9 aa, Homo Sapiens
KAARRLGND

SEQ ID NO: 76446 - protein, 9 aa, Homo Sapiens
SYATFDDDL

SEQ ID NO: 76447 - protein, 9 aa, Homo Sapiens
LCAELGRAP

SEQ ID NO: 76448 - protein, 9 aa, Homo Sapiens
HRTVLKSSK

SEQ ID NO: 76449 - protein, 9 aa, Homo Sapiens
DRQEEAPPP

SEQ ID NO: 76450 - protein, 9 aa, Homo Sapiens
SPSDHRNPK

SEQ ID NO: 76451 - protein, 9 aa, Homo Sapiens
GLWQRFHLT

SEQ ID NO: 76452 - protein, 9 aa, Homo Sapiens
AHTPVTISA

SEQ ID NO: 76453 - protein, 9 aa, Homo Sapiens
KFCRVLKNR

SEQ ID NO: 76454 - protein, 9 aa, Homo Sapiens
QDSLRIQAQ

SEQ ID NO: 76455 - protein, 9 aa, Homo Sapiens
AKVDFDELQ

SEQ ID NO: 76456 - protein, 9 aa, Homo Sapiens
LHSIKRADK

SEQ ID NO: 76457 - protein, 9 aa, Homo Sapiens
NPDLDSDKD

SEQ ID NO: 76458 - protein, 9 aa, Homo Sapiens
FPSSPEEDV

SEQ ID NO: 76459 - protein, 9 aa, Homo Sapiens
AFQEARYKA

SEQ ID NO: 76460 - protein, 9 aa, Homo Sapiens
VATAAVAAA

SEQ ID NO: 76461 - protein, 9 aa, Homo Sapiens
KFRYLQDII

SEQ ID NO: 76462 - protein, 9 aa, Homo Sapiens
KVDFDELQD

SEQ ID NO: 76463 - protein, 9 aa, Homo Sapiens
FLYRLCQAN

SEQ ID NO: 76464 - protein, 9 aa, Homo Sapiens
QLAQGMEYL

SEQ ID NO: 76465 - protein, 9 aa, Homo Sapiens
LLNDNIRRG

SEQ ID NO: 76466 - protein, 9 aa, Homo Sapiens
DKEYKNPHT

SEQ ID NO: 76467 - protein, 9 aa, Homo Sapiens
NSDIGRAGH

SEQ ID NO: 76468 - protein, 9 aa, Homo Sapiens
KNVENKSWK

SEQ ID NO: 76469 - protein, 9 aa, Homo Sapiens
STAIVDSRR

SEQ ID NO: 76470 - protein, 9 aa, Homo Sapiens
TFFCGVCSN

SEQ ID NO: 76471 - protein, 9 aa, Homo Sapiens
RTLSPYQYH

SEQ ID NO: 76472 - protein, 9 aa, Homo Sapiens
GEGGSKTLL

SEQ ID NO: 76473 - protein, 9 aa, Homo Sapiens
KYSNSMKEM

SEQ ID NO: 76474 - protein, 9 aa, Homo Sapiens
CQGGPWVTV

SEQ ID NO: 76475 - protein, 9 aa, Homo Sapiens
AVSCQEDTI

SEQ ID NO: 76476 - protein, 9 aa, Homo Sapiens
VSTASKVTA

SEQ ID NO: 76477 - protein, 9 aa, Homo Sapiens
SCGIQLIRE

SEQ ID NO: 76478 - protein, 9 aa, Homo Sapiens
ENAKMNFNN

SEQ ID NO: 76479 - protein, 9 aa, Homo Sapiens
EHYLIVAVV

SEQ ID NO: 76480 - protein, 9 aa, Homo Sapiens
RKAYLQFMV

SEQ ID NO: 76481 - protein, 9 aa, Homo Sapiens
FGHLALLGL

SEQ ID NO: 76482 - protein, 9 aa, Homo Sapiens
LASELQYDM

SEQ ID NO: 76483 - protein, 9 aa, Homo Sapiens
IINYDFPNN

SEQ ID NO: 76484 - protein, 9 aa, Homo Sapiens
ANHGLIVLQ

SEQ ID NO: 76485 - protein, 9 aa, Homo Sapiens
SVVDGKRNA

SEQ ID NO: 76486 - protein, 9 aa, Homo Sapiens
ENDNSPKII

SEQ ID NO: 76487 - protein, 9 aa, Homo Sapiens
RVLSKANSK

SEQ ID NO: 76488 - protein, 9 aa, Homo Sapiens
VILLIRIDS

SEQ ID NO: 76489 - protein, 9 aa, Homo Sapiens
VDGKRNARL

SEQ ID NO: 76490 - protein, 9 aa, Homo Sapiens
PLQKELPSV

SEQ ID NO: 76491 - protein, 9 aa, Homo Sapiens
VGCATKERL

SEQ ID NO: 76492 - protein, 9 aa, Homo Sapiens
EMIFVIFLI

SEQ ID NO: 76493 - protein, 9 aa, Homo Sapiens
QMKVSGLNE

SEQ ID NO: 76494 - protein, 9 aa, Homo Sapiens
HVLLPQSPP

SEQ ID NO: 76495 - protein, 9 aa, Homo Sapiens
EMRRQQEKM

SEQ ID NO: 76496 - protein, 9 aa, Homo Sapiens
KEFFVDKHS

SEQ ID NO: 76497 - protein, 9 aa, Homo Sapiens
FFQKAKAQE

SEQ ID NO: 76498 - protein, 9 aa, Homo Sapiens
CQCDAGFML

SEQ ID NO: 76499 - protein, 9 aa, Homo Sapiens
TSEGSYPCS

SEQ ID NO: 76500 - protein, 9 aa, Homo Sapiens
RAYNSRLQL

SEQ ID NO: 76501 - protein, 9 aa, Homo Sapiens
YKEEASDVE

SEQ ID NO: 76502 - protein, 9 aa, Homo Sapiens
KDMDIKTIF

SEQ ID NO: 76503 - protein, 9 aa, Homo Sapiens
ERDCQVSSF

SEQ ID NO: 76504 - protein, 9 aa, Homo Sapiens
GRFISRKAF

SEQ ID NO: 76505 - protein, 9 aa, Homo Sapiens
RAGFPREPS

SEQ ID NO: 76506 - protein, 9 aa, Homo Sapiens
KEEEGITYY

SEQ ID NO: 76507 - protein, 9 aa, Homo Sapiens
AAAISSIAS

SEQ ID NO: 76508 - protein, 9 aa, Homo Sapiens
RSVIWENEF

SEQ ID NO: 76509 - protein, 9 aa, Homo Sapiens
SGLQKLGAH

SEQ ID NO: 76510 - protein, 9 aa, Homo Sapiens
CAELGRAPS

SEQ ID NO: 76511 - protein, 9 aa, Homo Sapiens
HSSRGFIHI

SEQ ID NO: 76512 - protein, 9 aa, Homo Sapiens
TGVKFLCQG

SEQ ID NO: 76513 - protein, 9 aa, Homo Sapiens
LWDLINLKL

SEQ ID NO: 76514 - protein, 9 aa, Homo Sapiens
HGLIVLQQL

SEQ ID NO: 76515 - protein, 9 aa, Homo Sapiens
LIINYDFPN

SEQ ID NO: 76516 - protein, 9 aa, Homo Sapiens
HSRGRKGLR

SEQ ID NO: 76517 - protein, 9 aa, Homo Sapiens
LFPKKQPDD

SEQ ID NO: 76518 - protein, 9 aa, Homo Sapiens
KQALPLSEK

SEQ ID NO: 76519 - protein, 9 aa, Homo Sapiens
DVLCKFDEW

SEQ ID NO: 76520 - protein, 9 aa, Homo Sapiens
LSFQVGAPM

SEQ ID NO: 76521 - protein, 9 aa, Homo Sapiens
PGGLGCKPS

SEQ ID NO: 76522 - protein, 9 aa, Homo Sapiens
RDLPLGKEQ

SEQ ID NO: 76523 - protein, 9 aa, Homo Sapiens
AFMLLMGNI

SEQ ID NO: 76524 - protein, 9 aa, Homo Sapiens
AAAVAPYGY

SEQ ID NO: 76525 - protein, 9 aa, Homo Sapiens
PMSFYPPHY

SEQ ID NO: 76526 - protein, 9 aa, Homo Sapiens
PAAPPAAPP

SEQ ID NO: 76527 - protein, 9 aa, Homo Sapiens
PPNKVDKEY

SEQ ID NO: 76528 - protein, 9 aa, Homo Sapiens
NIKSVLTWK

SEQ ID NO: 76529 - protein, 9 aa, Homo Sapiens
TAKRKSGSK

SEQ ID NO: 76530 - protein, 9 aa, Homo Sapiens
EQEEEEEET

SEQ ID NO: 76531 - protein, 9 aa, Homo Sapiens
TSQSKAKDK

SEQ ID NO: 76532 - protein, 9 aa, Homo Sapiens
LLFLKDEDW

SEQ ID NO: 76533 - protein, 9 aa, Homo Sapiens
HWGGQGSSV

SEQ ID NO: 76534 - protein, 9 aa, Homo Sapiens
ERIKEKLAE

SEQ ID NO: 76535 - protein, 9 aa, Homo Sapiens
RDLARERGS

SEQ ID NO: 76536 - protein, 9 aa, Homo Sapiens
DANMYNALC

SEQ ID NO: 76537 - protein, 9 aa, Homo Sapiens
KLLFNLISQ

SEQ ID NO: 76538 - protein, 9 aa, Homo Sapiens
QKAWALERL

SEQ ID NO: 76539 - protein, 9 aa, Homo Sapiens
QIVFSLAAV

SEQ ID NO: 76540 - protein, 9 aa, Homo Sapiens
DVQVEEDDK

SEQ ID NO: 76541 - protein, 9 aa, Homo Sapiens
CHVVPAQKK

SEQ ID NO: 76542 - protein, 9 aa, Homo Sapiens
IIVINVDLQ

SEQ ID NO: 76543 - protein, 9 aa, Homo Sapiens
CLKCVHMVI

SEQ ID NO: 76544 - protein, 9 aa, Homo Sapiens
IPQGKYQVL

SEQ ID NO: 76545 - protein, 9 aa, Homo Sapiens
KGMGRFISR

SEQ ID NO: 76546 - protein, 9 aa, Homo Sapiens
TDVVLYSLN

SEQ ID NO: 76547 - protein, 9 aa, Homo Sapiens
EDAEAQVDN

SEQ ID NO: 76548 - protein, 9 aa, Homo Sapiens
FQKFRYLQD

SEQ ID NO: 76549 - protein, 9 aa, Homo Sapiens
QVDKVCRHK

SEQ ID NO: 76550 - protein, 9 aa, Homo Sapiens
LLSPKVTCG

SEQ ID NO: 76551 - protein, 9 aa, Homo Sapiens
CIKAKGVLL

SEQ ID NO: 76552 - protein, 9 aa, Homo Sapiens
GTHTLIKKK

SEQ ID NO: 76553 - protein, 9 aa, Homo Sapiens
APPAAPPLS

SEQ ID NO: 76554 - protein, 9 aa, Homo Sapiens
DAEDLEQFC

SEQ ID NO: 76555 - protein, 9 aa, Homo Sapiens
WASELSDLH

SEQ ID NO: 76556 - protein, 9 aa, Homo Sapiens
LDKECWFPK

SEQ ID NO: 76557 - protein, 9 aa, Homo Sapiens
VHSSRGFIH

SEQ ID NO: 76558 - protein, 9 aa, Homo Sapiens
TQITRLDGD

SEQ ID NO: 76559 - protein, 9 aa, Homo Sapiens
EAAKRSRDK

SEQ ID NO: 76560 - protein, 9 aa, Homo Sapiens
GFIHIKWIC

SEQ ID NO: 76561 - protein, 9 aa, Homo Sapiens
RQLRDGFTL

SEQ ID NO: 76562 - protein, 9 aa, Homo Sapiens
EKENEATGE

SEQ ID NO: 76563 - protein, 9 aa, Homo Sapiens
LYRLCQANP

SEQ ID NO: 76564 - protein, 9 aa, Homo Sapiens
PLYMWPFEK

SEQ ID NO: 76565 - protein, 9 aa, Homo Sapiens
SYQVKFQMA

SEQ ID NO: 76566 - protein, 9 aa, Homo Sapiens
QKKTCGQRM

SEQ ID NO: 76567 - protein, 9 aa, Homo Sapiens
ACIKAKGVL

SEQ ID NO: 76568 - protein, 9 aa, Homo Sapiens
IFVIFLIAV

SEQ ID NO: 76569 - protein, 9 aa, Homo Sapiens
FCIQPQLPN

SEQ ID NO: 76570 - protein, 9 aa, Homo Sapiens
TKNKERTSQ

SEQ ID NO: 76571 - protein, 9 aa, Homo Sapiens
RLGEAWARR

SEQ ID NO: 76572 - protein, 9 aa, Homo Sapiens
FMTQSAFQR

SEQ ID NO: 76573 - protein, 9 aa, Homo Sapiens
YERHRDYSR

SEQ ID NO: 76574 - protein, 9 aa, Homo Sapiens
LSQLSFQVG

SEQ ID NO: 76575 - protein, 9 aa, Homo Sapiens
DGVNRIISV

SEQ ID NO: 76576 - protein, 9 aa, Homo Sapiens
GCGRAEAAS

SEQ ID NO: 76577 - protein, 9 aa, Homo Sapiens
NEYRTEFTT

SEQ ID NO: 76578 - protein, 9 aa, Homo Sapiens
EIDDNPKIF

SEQ ID NO: 76579 - protein, 9 aa, Homo Sapiens
FTVSFKSLK

SEQ ID NO: 76580 - protein, 9 aa, Homo Sapiens
AGKIEALSE

SEQ ID NO: 76581 - protein, 9 aa, Homo Sapiens
WNLHSIKRA

SEQ ID NO: 76582 - protein, 9 aa, Homo Sapiens
VSCLISAGL

SEQ ID NO: 76583 - protein, 9 aa, Homo Sapiens
SPPRSSGND

SEQ ID NO: 76584 - protein, 9 aa, Homo Sapiens
DHYKIKVWN

SEQ ID NO: 76585 - protein, 9 aa, Homo Sapiens
EEHYLIVAV

SEQ ID NO: 76586 - protein, 9 aa, Homo Sapiens
GLFLDANMY

SEQ ID NO: 76587 - protein, 9 aa, Homo Sapiens
IYGTENNIS

SEQ ID NO: 76588 - protein, 9 aa, Homo Sapiens
LALLGLSIS

SEQ ID NO: 76589 - protein, 9 aa, Homo Sapiens
GGELFHRIV

SEQ ID NO: 76590 - protein, 9 aa, Homo Sapiens
WVTVTSAVP

SEQ ID NO: 76591 - protein, 9 aa, Homo Sapiens
DGTFNTIES

SEQ ID NO: 76592 - protein, 9 aa, Homo Sapiens
SESTGHATP

SEQ ID NO: 76593 - protein, 9 aa, Homo Sapiens
SGRNFEKFH

SEQ ID NO: 76594 - protein, 9 aa, Homo Sapiens
KRREMTCFQ

SEQ ID NO: 76595 - protein, 9 aa, Homo Sapiens
DYSAFGTHT

SEQ ID NO: 76596 - protein, 9 aa, Homo Sapiens
FREFWEQRL

SEQ ID NO: 76597 - protein, 9 aa, Homo Sapiens
NTLFTYTRP

SEQ ID NO: 76598 - protein, 9 aa, Homo Sapiens
FRRLEQEFL

SEQ ID NO: 76599 - protein, 9 aa, Homo Sapiens
SLEITGPMM

SEQ ID NO: 76600 - protein, 9 aa, Homo Sapiens
NLTSCGELM

SEQ ID NO: 76601 - protein, 9 aa, Homo Sapiens
PGILALLDK

SEQ ID NO: 76602 - protein, 9 aa, Homo Sapiens
LREKAVTVD

SEQ ID NO: 76603 - protein, 9 aa, Homo Sapiens
PHSIIHGYK

SEQ ID NO: 76604 - protein, 9 aa, Homo Sapiens
DGKSPEDPS

SEQ ID NO: 76605 - protein, 9 aa, Homo Sapiens
EDWNDFLQQ

SEQ ID NO: 76606 - protein, 9 aa, Homo Sapiens
KEKDDDDTS

SEQ ID NO: 76607 - protein, 9 aa, Homo Sapiens
NGHNEMDKP

SEQ ID NO: 76608 - protein, 9 aa, Homo Sapiens
SCLISAGLF

SEQ ID NO: 76609 - protein, 9 aa, Homo Sapiens
YLGHLREVR

SEQ ID NO: 76610 - protein, 9 aa, Homo Sapiens
MASNYTSRC

SEQ ID NO: 76611 - protein, 9 aa, Homo Sapiens
IEMIFVIFL

SEQ ID NO: 76612 - protein, 9 aa, Homo Sapiens
LRPHVQPRP

SEQ ID NO: 76613 - protein, 9 aa, Homo Sapiens
FCSSLDPCL

SEQ ID NO: 76614 - protein, 9 aa, Homo Sapiens
AWRGFGLAL

SEQ ID NO: 76615 - protein, 9 aa, Homo Sapiens
VINVDLQSI

SEQ ID NO: 76616 - protein, 9 aa, Homo Sapiens
RGPGNHILH

SEQ ID NO: 76617 - protein, 9 aa, Homo Sapiens
KEQHCKLLP

SEQ ID NO: 76618 - protein, 9 aa, Homo Sapiens
EEQTAFNKI

SEQ ID NO: 76619 - protein, 9 aa, Homo Sapiens
TQLEPLKPL

SEQ ID NO: 76620 - protein, 9 aa, Homo Sapiens
MWPFEKPNY

SEQ ID NO: 76621 - protein, 9 aa, Homo Sapiens
TKAAFTYSI

SEQ ID NO: 76622 - protein, 9 aa, Homo Sapiens
EEEDEDEHE

SEQ ID NO: 76623 - protein, 9 aa, Homo Sapiens
GFDNKDMDI

SEQ ID NO: 76624 - protein, 9 aa, Homo Sapiens
FSLEITGPM

SEQ ID NO: 76625 - protein, 9 aa, Homo Sapiens
ALNTVDMLR

SEQ ID NO: 76626 - protein, 9 aa, Homo Sapiens
ETFKQCMEN

SEQ ID NO: 76627 - protein, 9 aa, Homo Sapiens
RKSQERLMS

SEQ ID NO: 76628 - protein, 9 aa, Homo Sapiens
EAWARRSHS

SEQ ID NO: 76629 - protein, 9 aa, Homo Sapiens
WVACIKAKG

SEQ ID NO: 76630 - protein, 9 aa, Homo Sapiens
QKLGAHTPV

SEQ ID NO: 76631 - protein, 9 aa, Homo Sapiens
GSAKNRPEQ

SEQ ID NO: 76632 - protein, 9 aa, Homo Sapiens
SSGCEARRN

SEQ ID NO: 76633 - protein, 9 aa, Homo Sapiens
LHCPGARHI

SEQ ID NO: 76634 - protein, 9 aa, Homo Sapiens
RNDVQGYAA

SEQ ID NO: 76635 - protein, 9 aa, Homo Sapiens
CGVPTIQSD

SEQ ID NO: 76636 - protein, 9 aa, Homo Sapiens
SDHRNPKNN

SEQ ID NO: 76637 - protein, 9 aa, Homo Sapiens
TVPLLREHL

SEQ ID NO: 76638 - protein, 9 aa, Homo Sapiens
QSRGLSRLF

SEQ ID NO: 76639 - protein, 9 aa, Homo Sapiens
QTESDAKEL

SEQ ID NO: 76640 - protein, 9 aa, Homo Sapiens
KGCVGCATK

SEQ ID NO: 76641 - protein, 9 aa, Homo Sapiens
KIDRTDPLQ

SEQ ID NO: 76642 - protein, 9 aa, Homo Sapiens
GGGGAKAAK

SEQ ID NO: 76643 - protein, 9 aa, Homo Sapiens
DRKNSIQQL

SEQ ID NO: 76644 - protein, 9 aa, Homo Sapiens
IEERIFLAV

SEQ ID NO: 76645 - protein, 9 aa, Homo Sapiens
LEVDNTEMQ

SEQ ID NO: 76646 - protein, 9 aa, Homo Sapiens
IIFIWIYSC

SEQ ID NO: 76647 - protein, 9 aa, Homo Sapiens
ETDKWMENL

SEQ ID NO: 76648 - protein, 9 aa, Homo Sapiens
GSYQVKFQM

SEQ ID NO: 76649 - protein, 9 aa, Homo Sapiens
AAKRSRDKR

SEQ ID NO: 76650 - protein, 9 aa, Homo Sapiens
LALLDKECW

SEQ ID NO: 76651 - protein, 9 aa, Homo Sapiens
TNHEPSEIS

SEQ ID NO: 76652 - protein, 9 aa, Homo Sapiens
RRAIFDVRR

SEQ ID NO: 76653 - protein, 9 aa, Homo Sapiens
NGLALPPTH

SEQ ID NO: 76654 - protein, 9 aa, Homo Sapiens
RREMTCFQA

SEQ ID NO: 76655 - protein, 9 aa, Homo Sapiens
EMTCFQAGD

SEQ ID NO: 76656 - protein, 9 aa, Homo Sapiens
QYGTPETLP

SEQ ID NO: 76657 - protein, 9 aa, Homo Sapiens
RLQEYTEQR

SEQ ID NO: 76658 - protein, 9 aa, Homo Sapiens
QVLEEQTAF

SEQ ID NO: 76659 - protein, 9 aa, Homo Sapiens
FAPALAAAA

SEQ ID NO: 76660 - protein, 9 aa, Homo Sapiens
RKAERALQV

SEQ ID NO: 76661 - protein, 9 aa, Homo Sapiens
PLPEEVNRS

SEQ ID NO: 76662 - protein, 9 aa, Homo Sapiens
QFYTKAARR

SEQ ID NO: 76663 - protein, 9 aa, Homo Sapiens
GGSKTLLLH

SEQ ID NO: 76664 - protein, 9 aa, Homo Sapiens
KAKAQEEGY

SEQ ID NO: 76665 - protein, 9 aa, Homo Sapiens
YGSLQGYQT

SEQ ID NO: 76666 - protein, 9 aa, Homo Sapiens
MKNPQFVFD

SEQ ID NO: 76667 - protein, 9 aa, Homo Sapiens
RFQNINFAE

SEQ ID NO: 76668 - protein, 9 aa, Homo Sapiens
TFCHLCSDL

SEQ ID NO: 76669 - protein, 9 aa, Homo Sapiens
AERRAPSFL

SEQ ID NO: 76670 - protein, 9 aa, Homo Sapiens
PMMPHSLHS

SEQ ID NO: 76671 - protein, 9 aa, Homo Sapiens
FNTIESHPK

SEQ ID NO: 76672 - protein, 9 aa, Homo Sapiens
NDNSPKIII

SEQ ID NO: 76673 - protein, 9 aa, Homo Sapiens
IHKGMPLEK

SEQ ID NO: 76674 - protein, 9 aa, Homo Sapiens
GTFTEEQKC

SEQ ID NO: 76675 - protein, 9 aa, Homo Sapiens
PHVQPRPLP

SEQ ID NO: 76676 - protein, 9 aa, Homo Sapiens
LLTQRICLK

SEQ ID NO: 76677 - protein, 9 aa, Homo Sapiens
EEELDFFLK

SEQ ID NO: 76678 - protein, 9 aa, Homo Sapiens
AERKAERAL

SEQ ID NO: 76679 - protein, 9 aa, Homo Sapiens
EKIDRTDPL

SEQ ID NO: 76680 - protein, 9 aa, Homo Sapiens
SEMDILFHS

SEQ ID NO: 76681 - protein, 9 aa, Homo Sapiens
QLSSAPPGE

SEQ ID NO: 76682 - protein, 9 aa, Homo Sapiens
GFMLSADRC

SEQ ID NO: 76683 - protein, 9 aa, Homo Sapiens
YATFDDDLP

SEQ ID NO: 76684 - protein, 9 aa, Homo Sapiens
LFLKDEDWN

SEQ ID NO: 76685 - protein, 9 aa, Homo Sapiens
RPRLHPWKL

SEQ ID NO: 76686 - protein, 9 aa, Homo Sapiens
YCWCVNRDG

SEQ ID NO: 76687 - protein, 9 aa, Homo Sapiens
GPGTRISKA

SEQ ID NO: 76688 - protein, 9 aa, Homo Sapiens
CGELMKSKY

SEQ ID NO: 76689 - protein, 9 aa, Homo Sapiens
REIDLSVNR

SEQ ID NO: 76690 - protein, 9 aa, Homo Sapiens
FWGWGGEDH

SEQ ID NO: 76691 - protein, 9 aa, Homo Sapiens
YLPCIITVI

SEQ ID NO: 76692 - protein, 9 aa, Homo Sapiens
DFPNNRELY

SEQ ID NO: 76693 - protein, 9 aa, Homo Sapiens
LSCESSLKM

SEQ ID NO: 76694 - protein, 9 aa, Homo Sapiens
PGTRISKAA

SEQ ID NO: 76695 - protein, 9 aa, Homo Sapiens
DGFTLEGEI

SEQ ID NO: 76696 - protein, 9 aa, Homo Sapiens
TPPDLASQG

SEQ ID NO: 76697 - protein, 9 aa, Homo Sapiens
EVNRSQPLL

SEQ ID NO: 76698 - protein, 9 aa, Homo Sapiens
CANVCYDVL

SEQ ID NO: 76699 - protein, 9 aa, Homo Sapiens
SQAIEENLQ

SEQ ID NO: 76700 - protein, 9 aa, Homo Sapiens
CQANPDLDS

SEQ ID NO: 76701 - protein, 9 aa, Homo Sapiens
ALVTLCEEL

SEQ ID NO: 76702 - protein, 9 aa, Homo Sapiens
EGGSKTLLL

SEQ ID NO: 76703 - protein, 9 aa, Homo Sapiens
TDAEKIQCE

SEQ ID NO: 76704 - protein, 9 aa, Homo Sapiens
PTKFEVVLY

SEQ ID NO: 76705 - protein, 9 aa, Homo Sapiens
NYDFPNNRE

SEQ ID NO: 76706 - protein, 9 aa, Homo Sapiens
ENMASWGNI

SEQ ID NO: 76707 - protein, 9 aa, Homo Sapiens
PPEKRRAIF

SEQ ID NO: 76708 - protein, 9 aa, Homo Sapiens
TQLNPKEEE

SEQ ID NO: 76709 - protein, 9 aa, Homo Sapiens
LTSEGSWAE

SEQ ID NO: 76710 - protein, 9 aa, Homo Sapiens
RLDVKKELE

SEQ ID NO: 76711 - protein, 9 aa, Homo Sapiens
DRKYFHYNS

SEQ ID NO: 76712 - protein, 9 aa, Homo Sapiens
KCKHVPFLV

SEQ ID NO: 76713 - protein, 9 aa, Homo Sapiens
PPIHSSSPT

SEQ ID NO: 76714 - protein, 9 aa, Homo Sapiens
IHGYKRVLA

SEQ ID NO: 76715 - protein, 9 aa, Homo Sapiens
RPAFVHYYK

SEQ ID NO: 76716 - protein, 9 aa, Homo Sapiens
IHSSSPTPI

SEQ ID NO: 76717 - protein, 9 aa, Homo Sapiens
LSPWKGKSK

SEQ ID NO: 76718 - protein, 9 aa, Homo Sapiens
SQERLMSYS

SEQ ID NO: 76719 - protein, 9 aa, Homo Sapiens
ELPLVAMCQ

SEQ ID NO: 76720 - protein, 9 aa, Homo Sapiens
SKAQEAAQE

SEQ ID NO: 76721 - protein, 9 aa, Homo Sapiens
WQVDDCPDS

SEQ ID NO: 76722 - protein, 9 aa, Homo Sapiens
DSLRIQAQF

SEQ ID NO: 76723 - protein, 9 aa, Homo Sapiens
VPHSIIHGY

SEQ ID NO: 76724 - protein, 9 aa, Homo Sapiens
CYRKVSKAQ

SEQ ID NO: 76725 - protein, 9 aa, Homo Sapiens
FLNLCLIDE

SEQ ID NO: 76726 - protein, 9 aa, Homo Sapiens
LLLAFQEAR

SEQ ID NO: 76727 - protein, 9 aa, Homo Sapiens
VSQHLVHVV

SEQ ID NO: 76728 - protein, 9 aa, Homo Sapiens
QLMLAVGLI

SEQ ID NO: 76729 - protein, 9 aa, Homo Sapiens
YQLDVKFRE

SEQ ID NO: 76730 - protein, 9 aa, Homo Sapiens
ESSLKMHYR

SEQ ID NO: 76731 - protein, 9 aa, Homo Sapiens
ALQQKKTCG

SEQ ID NO: 76732 - protein, 9 aa, Homo Sapiens
KAKGVLLDY

SEQ ID NO: 76733 - protein, 9 aa, Homo Sapiens
FRHCIIKTY

SEQ ID NO: 76734 - protein, 9 aa, Homo Sapiens
PPAPSRLAP

SEQ ID NO: 76735 - protein, 9 aa, Homo Sapiens
STFSSENLS

SEQ ID NO: 76736 - protein, 9 aa, Homo Sapiens
TSSESTGHA

SEQ ID NO: 76737 - protein, 9 aa, Homo Sapiens
SQTSFLSPE

SEQ ID NO: 76738 - protein, 9 aa, Homo Sapiens
SDNLHAGNR

SEQ ID NO: 76739 - protein, 9 aa, Homo Sapiens
LEVISPTKF

SEQ ID NO: 76740 - protein, 9 aa, Homo Sapiens
SRLAPGGPA

SEQ ID NO: 76741 - protein, 9 aa, Homo Sapiens
WGAKGQRPG

SEQ ID NO: 76742 - protein, 9 aa, Homo Sapiens
QEEVSAIIF

SEQ ID NO: 76743 - protein, 9 aa, Homo Sapiens
IIDGFIQMV

SEQ ID NO: 76744 - protein, 9 aa, Homo Sapiens
NIHAHAPPV

SEQ ID NO: 76745 - protein, 9 aa, Homo Sapiens
IGCKVPQDV

SEQ ID NO: 76746 - protein, 9 aa, Homo Sapiens
SFLRVAIPS

SEQ ID NO: 76747 - protein, 9 aa, Homo Sapiens
ANAAARPGV

SEQ ID NO: 76748 - protein, 9 aa, Homo Sapiens
VQGWFQNRR

SEQ ID NO: 76749 - protein, 9 aa, Homo Sapiens
RQQPANAAA

SEQ ID NO: 76750 - protein, 9 aa, Homo Sapiens
FKAEGSRFQ

SEQ ID NO: 76751 - protein, 9 aa, Homo Sapiens
NGRQQPANA

SEQ ID NO: 76752 - protein, 9 aa, Homo Sapiens
LRVAIPSML

SEQ ID NO: 76753 - protein, 9 aa, Homo Sapiens
PETIRDEKE

SEQ ID NO: 76754 - protein, 9 aa, Homo Sapiens
SHDLFGRKM

SEQ ID NO: 76755 - protein, 9 aa, Homo Sapiens
WWNASRCVG

SEQ ID NO: 76756 - protein, 9 aa, Homo Sapiens
HQGWVGNIL

SEQ ID NO: 76757 - protein, 9 aa, Homo Sapiens
NFKAEGSRF

SEQ ID NO: 76758 - protein, 9 aa, Homo Sapiens
DEKETGDHS

SEQ ID NO: 76759 - protein, 9 aa, Homo Sapiens
QDWASFLRV

SEQ ID NO: 76760 - protein, 9 aa, Homo Sapiens
ENAPEITLA

SEQ ID NO: 76761 - protein, 9 aa, Homo Sapiens
AICTQHPQG

SEQ ID NO: 76762 - protein, 9 aa, Homo Sapiens
GGAINEIVN

SEQ ID NO: 76763 - protein, 9 aa, Homo Sapiens
WVGNILQLG

SEQ ID NO: 76764 - protein, 9 aa, Homo Sapiens
VQMSVFHRE

SEQ ID NO: 76765 - protein, 9 aa, Homo Sapiens
GLDMRVVQG

SEQ ID NO: 76766 - protein, 9 aa, Homo Sapiens
AHAPPVQPI

SEQ ID NO: 76767 - protein, 9 aa, Homo Sapiens
QLYKTQWGG

SEQ ID NO: 76768 - protein, 9 aa, Homo Sapiens
PGEKINILK

SEQ ID NO: 76769 - protein, 9 aa, Homo Sapiens
ELETELQAE

SEQ ID NO: 76770 - protein, 9 aa, Homo Sapiens
KTQWGGAIN

SEQ ID NO: 76771 - protein, 9 aa, Homo Sapiens
VVQGWFQNR

SEQ ID NO: 76772 - protein, 9 aa, Homo Sapiens
TQHPQGYHL

SEQ ID NO: 76773 - protein, 9 aa, Homo Sapiens
DISDENENA

SEQ ID NO: 76774 - protein, 9 aa, Homo Sapiens
NCRYSHDLF

SEQ ID NO: 76775 - protein, 9 aa, Homo Sapiens
KELVGAVIN

SEQ ID NO: 76776 - protein, 9 aa, Homo Sapiens
GAVINPTEV

SEQ ID NO: 76777 - protein, 9 aa, Homo Sapiens
TFRHSMVVP

SEQ ID NO: 76778 - protein, 9 aa, Homo Sapiens
GWFQNRRAK

SEQ ID NO: 76779 - protein, 9 aa, Homo Sapiens
INPTEVFCS

SEQ ID NO: 76780 - protein, 9 aa, Homo Sapiens
ELKGIGCKV

SEQ ID NO: 76781 - protein, 9 aa, Homo Sapiens
MDLTAHQGW

SEQ ID NO: 76782 - protein, 9 aa, Homo Sapiens
HAHAPPVQP

SEQ ID NO: 76783 - protein, 9 aa, Homo Sapiens
KTIENLRAH

SEQ ID NO: 76784 - protein, 9 aa, Homo Sapiens
FTELKGIGC

SEQ ID NO: 76785 - protein, 9 aa, Homo Sapiens
GFLKVDRYH

SEQ ID NO: 76786 - protein, 9 aa, Homo Sapiens
ASQEVPQIT

SEQ ID NO: 76787 - protein, 9 aa, Homo Sapiens
AHQGWVGNI

SEQ ID NO: 76788 - protein, 9 aa, Homo Sapiens
AEGSRFQDC

SEQ ID NO: 76789 - protein, 9 aa, Homo Sapiens
SDENENAPE

SEQ ID NO: 76790 - protein, 9 aa, Homo Sapiens
VINPTEVFC

SEQ ID NO: 76791 - protein, 9 aa, Homo Sapiens
EVSAIIFQR

SEQ ID NO: 76792 - protein, 9 aa, Homo Sapiens
VDRYHNLCQ

SEQ ID NO: 76793 - protein, 9 aa, Homo Sapiens
VAIPSMLML

SEQ ID NO: 76794 - protein, 9 aa, Homo Sapiens
NSPGEKINI

SEQ ID NO: 76795 - protein, 9 aa, Homo Sapiens
RYSHDLFGR

SEQ ID NO: 76796 - protein, 9 aa, Homo Sapiens
ICTQHPQGY

SEQ ID NO: 76797 - protein, 9 aa, Homo Sapiens
HFAELETEL

SEQ ID NO: 76798 - protein, 9 aa, Homo Sapiens
SKSSTLTIH

SEQ ID NO: 76799 - protein, 9 aa, Homo Sapiens
AKHAWWNAS

SEQ ID NO: 76800 - protein, 9 aa, Homo Sapiens
SPGEKINIL

SEQ ID NO: 76801 - protein, 9 aa, Homo Sapiens
EERNHFAEL

SEQ ID NO: 76802 - protein, 9 aa, Homo Sapiens
HVNFKAEGS

SEQ ID NO: 76803 - protein, 9 aa, Homo Sapiens
FIQMVVVMN

SEQ ID NO: 76804 - protein, 9 aa, Homo Sapiens
KGIGCKVPQ

SEQ ID NO: 76805 - protein, 9 aa, Homo Sapiens
NQGFLKVDR

SEQ ID NO: 76806 - protein, 9 aa, Homo Sapiens
GAKHAWWNA

SEQ ID NO: 76807 - protein, 9 aa, Homo Sapiens
QQLYKTQWG

SEQ ID NO: 76808 - protein, 9 aa, Homo Sapiens
QWGGAINEI

SEQ ID NO: 76809 - protein, 9 aa, Homo Sapiens
RVAIPSMLM

SEQ ID NO: 76810 - protein, 9 aa, Homo Sapiens
ACWQWNPSE

SEQ ID NO: 76811 - protein, 9 aa, Homo Sapiens
PSERPSFAE

SEQ ID NO: 76812 - protein, 9 aa, Homo Sapiens
WNLNIHAHA

SEQ ID NO: 76813 - protein, 9 aa, Homo Sapiens
VPQITVVIS

SEQ ID NO: 76814 - protein, 9 aa, Homo Sapiens
ILKRSLLSI

SEQ ID NO: 76815 - protein, 9 aa, Homo Sapiens
QKELVGAVI

SEQ ID NO: 76816 - protein, 9 aa, Homo Sapiens
EGNHLVQSN

SEQ ID NO: 76817 - protein, 9 aa, Homo Sapiens
SAIIFQRAY

SEQ ID NO: 76818 - protein, 9 aa, Homo Sapiens
QPANAAARP

SEQ ID NO: 76819 - protein, 9 aa, Homo Sapiens
YKTQWGGAI

SEQ ID NO: 76820 - protein, 9 aa, Homo Sapiens
GIIDGFIQM

SEQ ID NO: 76821 - protein, 9 aa, Homo Sapiens
LTAHQGWVG

SEQ ID NO: 76822 - protein, 9 aa, Homo Sapiens
LYKTQWGGA

SEQ ID NO: 76823 - protein, 9 aa, Homo Sapiens
WAFGIIDGF

SEQ ID NO: 76824 - protein, 9 aa, Homo Sapiens
ETIRDEKET

SEQ ID NO: 76825 - protein, 9 aa, Homo Sapiens
MAICTQHPQ

SEQ ID NO: 76826 - protein, 9 aa, Homo Sapiens
IFQRAYRRY

SEQ ID NO: 76827 - protein, 9 aa, Homo Sapiens
CWQWNPSER

SEQ ID NO: 76828 - protein, 9 aa, Homo Sapiens
IRDEKETGD

SEQ ID NO: 76829 - protein, 9 aa, Homo Sapiens
AHIFANTVD

SEQ ID NO: 76830 - protein, 9 aa, Homo Sapiens
GHSMAICTQ

SEQ ID NO: 76831 - protein, 9 aa, Homo Sapiens
TQWGGAINE

SEQ ID NO: 76832 - protein, 9 aa, Homo Sapiens
DRNTFRHSM

SEQ ID NO: 76833 - protein, 9 aa, Homo Sapiens
QHPQGYHLW

SEQ ID NO: 76834 - protein, 9 aa, Homo Sapiens
HAWWNASRC

SEQ ID NO: 76835 - protein, 9 aa, Homo Sapiens
CGNIVVYHV

SEQ ID NO: 76836 - protein, 9 aa, Homo Sapiens
WNPSERPSF

SEQ ID NO: 76837 - protein, 9 aa, Homo Sapiens
NHLVQSNNR

SEQ ID NO: 76838 - protein, 9 aa, Homo Sapiens
NILKRSLLS

SEQ ID NO: 76839 - protein, 9 aa, Homo Sapiens
WQWNPSERP

SEQ ID NO: 76840 - protein, 9 aa, Homo Sapiens
QEVPQITVV

SEQ ID NO: 76841 - protein, 9 aa, Homo Sapiens
LDMRVVQGW

SEQ ID NO: 76842 - protein, 9 aa, Homo Sapiens
ELVGAVINP

SEQ ID NO: 76843 - protein, 9 aa, Homo Sapiens
HSMAICTQH

SEQ ID NO: 76844 - protein, 9 aa, Homo Sapiens
LNIHAHAPP

SEQ ID NO: 76845 - protein, 9 aa, Homo Sapiens
RNTFRHSMV

SEQ ID NO: 76846 - protein, 9 aa, Homo Sapiens
HIFANTVDS

SEQ ID NO: 76847 - protein, 9 aa, Homo Sapiens
EVPQITVVI

SEQ ID NO: 76848 - protein, 9 aa, Homo Sapiens
QITVVISSG

SEQ ID NO: 76849 - protein, 9 aa, Homo Sapiens
LLAAQGLWV

SEQ ID NO: 76850 - protein, 9 aa, Homo Sapiens
QGFLKVDRY

SEQ ID NO: 76851 - protein, 9 aa, Homo Sapiens
INILKRSLL

SEQ ID NO: 76852 - protein, 9 aa, Homo Sapiens
LNQGFLKVD

SEQ ID NO: 76853 - protein, 9 aa, Homo Sapiens
AIIFQRAYR

SEQ ID NO: 76854 - protein, 9 aa, Homo Sapiens
YHVNFKAEG

SEQ ID NO: 76855 - protein, 9 aa, Homo Sapiens
GRQQPANAA

SEQ ID NO: 76856 - protein, 9 aa, Homo Sapiens
FGRKMATEG

SEQ ID NO: 76857 - protein, 9 aa, Homo Sapiens
LVQSNNRSL

SEQ ID NO: 76858 - protein, 9 aa, Homo Sapiens
TRFTELKGI

SEQ ID NO: 76859 - protein, 9 aa, Homo Sapiens
KETGDHSMD

SEQ ID NO: 76860 - protein, 9 aa, Homo Sapiens
LKGIGCKVP

SEQ ID NO: 76861 - protein, 9 aa, Homo Sapiens
AWWNASRCV

SEQ ID NO: 76862 - protein, 9 aa, Homo Sapiens
QQPANAAAR

SEQ ID NO: 76863 - protein, 9 aa, Homo Sapiens
GEKINILKR

SEQ ID NO: 76864 - protein, 9 aa, Homo Sapiens
ERPSFAEIH

SEQ ID NO: 76865 - protein, 9 aa, Homo Sapiens
GPYHVNFKA

SEQ ID NO: 76866 - protein, 9 aa, Homo Sapiens
WASFLRVAI

SEQ ID NO: 76867 - protein, 9 aa, Homo Sapiens
YSHDLFGRK

SEQ ID NO: 76868 - protein, 9 aa, Homo Sapiens
TVVISSGPV

SEQ ID NO: 76869 - protein, 9 aa, Homo Sapiens
VGAVINPTE

SEQ ID NO: 76870 - protein, 9 aa, Homo Sapiens
SNNRSLIDD

SEQ ID NO: 76871 - protein, 9 aa, Homo Sapiens
IIFQRAYRR

SEQ ID NO: 76872 - protein, 9 aa, Homo Sapiens
DWASFLRVA

SEQ ID NO: 76873 - protein, 9 aa, Homo Sapiens
SQEVPQITV

SEQ ID NO: 76874 - protein, 9 aa, Homo Sapiens
IYGAKHAWW

SEQ ID NO: 76875 - protein, 9 aa, Homo Sapiens
KVDRYHNLC

SEQ ID NO: 76876 - protein, 9 aa, Homo Sapiens
NENAPEITL

SEQ ID NO: 76877 - protein, 9 aa, Homo Sapiens
FGIIDGFIQ

SEQ ID NO: 76878 - protein, 9 aa, Homo Sapiens
LWVQMSVFH

SEQ ID NO: 76879 - protein, 9 aa, Homo Sapiens
WGGAINEIV

SEQ ID NO: 76880 - protein, 9 aa, Homo Sapiens
SMVVPYEPP

SEQ ID NO: 76881 - protein, 9 aa, Homo Sapiens
KCGNIVVYH

SEQ ID NO: 76882 - protein, 9 aa, Homo Sapiens
TLTIHQRNH

SEQ ID NO: 76883 - protein, 9 aa, Homo Sapiens
FRHSMVVPY

SEQ ID NO: 76884 - protein, 9 aa, Homo Sapiens
KHAWWNASR

SEQ ID NO: 76885 - protein, 9 aa, Homo Sapiens
LRAHIFANT

SEQ ID NO: 76886 - protein, 9 aa, Homo Sapiens
GWVGNILQL

SEQ ID NO: 76887 - protein, 9 aa, Homo Sapiens
QGWVGNILQ

SEQ ID NO: 76888 - protein, 9 aa, Homo Sapiens
TIHQRNHTG

SEQ ID NO: 76889 - protein, 9 aa, Homo Sapiens
VQSNNRSLI

SEQ ID NO: 76890 - protein, 9 aa, Homo Sapiens
KAEGSRFQD

SEQ ID NO: 76891 - protein, 9 aa, Homo Sapiens
TIRDEKETG

SEQ ID NO: 76892 - protein, 9 aa, Homo Sapiens
QIDISDENE

SEQ ID NO: 76893 - protein, 9 aa, Homo Sapiens
NNRSLIDDK

SEQ ID NO: 76894 - protein, 9 aa, Homo Sapiens
RDEKETGDH

SEQ ID NO: 76895 - protein, 9 aa, Homo Sapiens
ASFLRVAIP

SEQ ID NO: 76896 - protein, 9 aa, Homo Sapiens
MRVVQGWFQ

SEQ ID NO: 76897 - protein, 9 aa, Homo Sapiens
FQRAYRRYL

SEQ ID NO: 76898 - protein, 9 aa, Homo Sapiens
GFIQMVVVM

SEQ ID NO: 76899 - protein, 9 aa, Homo Sapiens
NLRAHIFAN

SEQ ID NO: 76900 - protein, 9 aa, Homo Sapiens
RAHIFANTV

SEQ ID NO: 76901 - protein, 9 aa, Homo Sapiens
FNGRQQPAN

SEQ ID NO: 76902 - protein, 9 aa, Homo Sapiens
SMAICTQHP

SEQ ID NO: 76903 - protein, 9 aa, Homo Sapiens
FSKSSTLTI

SEQ ID NO: 76904 - protein, 9 aa, Homo Sapiens
QGWFQNRRA

SEQ ID NO: 76905 - protein, 9 aa, Homo Sapiens
TIENLRAHI

SEQ ID NO: 76906 - protein, 9 aa, Homo Sapiens
RFTELKGIG

SEQ ID NO: 76907 - protein, 9 aa, Homo Sapiens
QSNNRSLID

SEQ ID NO: 76908 - protein, 9 aa, Homo Sapiens
AVINPTEVF

SEQ ID NO: 76909 - protein, 9 aa, Homo Sapiens
LKVDRYHNL

SEQ ID NO: 76910 - protein, 9 aa, Homo Sapiens
NPSERPSFA

SEQ ID NO: 76911 - protein, 9 aa, Homo Sapiens
DLFGRKMAT

SEQ ID NO: 76912 - protein, 9 aa, Homo Sapiens
PYHVNFKAE

SEQ ID NO: 76913 - protein, 9 aa, Homo Sapiens
LFGRKMATE

SEQ ID NO: 76914 - protein, 9 aa, Homo Sapiens
NTFRHSMVV

SEQ ID NO: 76915 - protein, 9 aa, Homo Sapiens
LETELQAEL

SEQ ID NO: 76916 - protein, 9 aa, Homo Sapiens
DENENAPEI

SEQ ID NO: 76917 - protein, 9 aa, Homo Sapiens
RNHFAELET

SEQ ID NO: 76918 - protein, 9 aa, Homo Sapiens
LAAQGLWVQ

SEQ ID NO: 76919 - protein, 9 aa, Homo Sapiens
RHSMVVPYE

SEQ ID NO: 76920 - protein, 9 aa, Homo Sapiens
KSSTLTIHQ

SEQ ID NO: 76921 - protein, 9 aa, Homo Sapiens
WWNLNIHAH

SEQ ID NO: 76922 - protein, 9 aa, Homo Sapiens
LTIHQRNHT

SEQ ID NO: 76923 - protein, 9 aa, Homo Sapiens
DRYHNLCQK

SEQ ID NO: 76924 - protein, 9 aa, Homo Sapiens
NAAARPGVH

SEQ ID NO: 76925 - protein, 9 aa, Homo Sapiens
DMRVVQGWF

SEQ ID NO: 76926 - protein, 9 aa, Homo Sapiens
IVVYHVIVP

SEQ ID NO: 76927 - protein, 9 aa, Homo Sapiens
PQITVVISS

SEQ ID NO: 76928 - protein, 9 aa, Homo Sapiens
HLVQSNNRS

SEQ ID NO: 76929 - protein, 9 aa, Homo Sapiens
IDGFIQMVV

SEQ ID NO: 76930 - protein, 9 aa, Homo Sapiens
SSTLTIHQR

SEQ ID NO: 76931 - protein, 9 aa, Homo Sapiens
TELKGIGCK

SEQ ID NO: 76932 - protein, 9 aa, Homo Sapiens
DLTAHQGWV

SEQ ID NO: 76933 - protein, 9 aa, Homo Sapiens
ERNHFAELE

SEQ ID NO: 76934 - protein, 9 aa, Homo Sapiens
PANAAARPG

SEQ ID NO: 76935 - protein, 9 aa, Homo Sapiens
FLRVAIPSM

SEQ ID NO: 76936 - protein, 9 aa, Homo Sapiens
AAQGLWVQM

SEQ ID NO: 76937 - protein, 9 aa, Homo Sapiens
EKETGDHSM

SEQ ID NO: 76938 - protein, 9 aa, Homo Sapiens
EEVSAIIFQ

SEQ ID NO: 76939 - protein, 9 aa, Homo Sapiens
QGLWVQMSV

SEQ ID NO: 76940 - protein, 9 aa, Homo Sapiens
IDISDENEN

SEQ ID NO: 76941 - protein, 9 aa, Homo Sapiens
FAELETELQ

SEQ ID NO: 76942 - protein, 9 aa, Homo Sapiens
CRYSHDLFG

SEQ ID NO: 76943 - protein, 9 aa, Homo Sapiens
YGAKHAWWN

SEQ ID NO: 76944 - protein, 9 aa, Homo Sapiens
WVQMSVFHR

SEQ ID NO: 76945 - protein, 9 aa, Homo Sapiens
WNASRCVGR

SEQ ID NO: 76946 - protein, 9 aa, Homo Sapiens
GIGCKVPQD

SEQ ID NO: 76947 - protein, 9 aa, Homo Sapiens
STLTIHQRN

SEQ ID NO: 76948 - protein, 9 aa, Homo Sapiens
HDLFGRKMA

SEQ ID NO: 76949 - protein, 9 aa, Homo Sapiens
TAHQGWVGN

SEQ ID NO: 76950 - protein, 9 aa, Homo Sapiens
NIVVYHVIV

SEQ ID NO: 76951 - protein, 9 aa, Homo Sapiens
EKINILKRS

SEQ ID NO: 76952 - protein, 9 aa, Homo Sapiens
CTQHPQGYH

SEQ ID NO: 76953 - protein, 9 aa, Homo Sapiens
GNIVVYHVI

SEQ ID NO: 76954 - protein, 9 aa, Homo Sapiens
ISDENENAP

SEQ ID NO: 76955 - protein, 9 aa, Homo Sapiens
HSMVVPYEP

SEQ ID NO: 76956 - protein, 9 aa, Homo Sapiens
VSAIIFQRA

SEQ ID NO: 76957 - protein, 9 aa, Homo Sapiens
NLNIHAHAP

SEQ ID NO: 76958 - protein, 9 aa, Homo Sapiens
AFGIIDGFI

SEQ ID NO: 76959 - protein, 9 aa, Homo Sapiens
CLKCGNIVV

SEQ ID NO: 76960 - protein, 9 aa, Homo Sapiens
NHFAELETE

SEQ ID NO: 76961 - protein, 9 aa, Homo Sapiens
DGFIQMVVV

SEQ ID NO: 76962 - protein, 9 aa, Homo Sapiens
RVVQGWFQN

SEQ ID NO: 76963 - protein, 9 aa, Homo Sapiens
IENLRAHIF

SEQ ID NO: 76964 - protein, 9 aa, Homo Sapiens
AQGLWVQMS

SEQ ID NO: 76965 - protein, 9 aa, Homo Sapiens
GNHLVQSNN

SEQ ID NO: 76966 - protein, 9 aa, Homo Sapiens
ENLRAHIFA

SEQ ID NO: 76967 - protein, 9 aa, Homo Sapiens
VVYHVIVPC

SEQ ID NO: 76968 - protein, 9 aa, Homo Sapiens
ITVVISSGP

SEQ ID NO: 76969 - protein, 9 aa, Homo Sapiens
MVVPYEPPE

SEQ ID NO: 76970 - protein, 9 aa, Homo Sapiens
LVGAVINPT

SEQ ID NO: 76971 - protein, 9 aa, Homo Sapiens
VNFKAEGSR

SEQ ID NO: 76972 - protein, 9 aa, Homo Sapiens
SERPSFAEI

SEQ ID NO: 76973 - protein, 9 aa, Homo Sapiens
GLWVQMSVF

SEQ ID NO: 76974 - protein, 9 aa, Homo Sapiens
ENENAPEIT

SEQ ID NO: 76975 - protein, 9 aa, Homo Sapiens
NWWNLNIHA

SEQ ID NO: 76976 - protein, 9 aa, Homo Sapiens
AELETELQA

SEQ ID NO: 76977 - protein, 9 aa, Homo Sapiens
LKCGNIVVY

SEQ ID NO: 76978 - protein, 9 aa, Homo Sapiens
DPETIRDEK

SEQ ID NO: 76979 - protein, 9 aa, Homo Sapiens
KINILKRSL

SEQ ID NO: 76980 - protein, 9 aa, Homo Sapiens
QWNPSERPS

SEQ ID NO: 76981 - protein, 9 aa, Homo Sapiens
IHAHAPPVQ

SEQ ID NO: 76982 - protein, 9 aa, Homo Sapiens
VYHVIVPCS

SEQ ID NO: 76983 - protein, 9 aa, Homo Sapiens
FLKVDRYHN

SEQ ID NO: 76984 - protein, 9 aa, Homo Sapiens
YLLFAGTMM

SEQ ID NO: 76985 - protein, 9 aa, Homo Sapiens
NVTDMYGNT

SEQ ID NO: 76986 - protein, 9 aa, Homo Sapiens
GDSYGMQGG

SEQ ID NO: 76987 - protein, 9 aa, Homo Sapiens
TAGQMCCGL

SEQ ID NO: 76988 - protein, 9 aa, Homo Sapiens
AARASFAAQ

SEQ ID NO: 76989 - protein, 9 aa, Homo Sapiens
VTASAAQNT

SEQ ID NO: 76990 - protein, 9 aa, Homo Sapiens
EARAFVHKF

SEQ ID NO: 76991 - protein, 9 aa, Homo Sapiens
PWAWPWTWF

SEQ ID NO: 76992 - protein, 9 aa, Homo Sapiens
GHLTQLSGA

SEQ ID NO: 76993 - protein, 9 aa, Homo Sapiens
NTSLSGLSI

SEQ ID NO: 76994 - protein, 9 aa, Homo Sapiens
SCVGTRQLV

SEQ ID NO: 76995 - protein, 9 aa, Homo Sapiens
LCQEPEPTS

SEQ ID NO: 76996 - protein, 9 aa, Homo Sapiens
ANTMFQMEW

SEQ ID NO: 76997 - protein, 9 aa, Homo Sapiens
LKHLTEQKP

SEQ ID NO: 76998 - protein, 9 aa, Homo Sapiens
TLFQVDDVN

SEQ ID NO: 76999 - protein, 9 aa, Homo Sapiens
SGSQAGFCP

SEQ ID NO: 77000 - protein, 9 aa, Homo Sapiens
LLTQRGMGE

SEQ ID NO: 77001 - protein, 9 aa, Homo Sapiens
GNTSLSGLS

SEQ ID NO: 77002 - protein, 9 aa, Homo Sapiens
HSNQLDNDQ

SEQ ID NO: 77003 - protein, 9 aa, Homo Sapiens
ITRRRRAPL

SEQ ID NO: 77004 - protein, 9 aa, Homo Sapiens
AISASCAAS

SEQ ID NO: 77005 - protein, 9 aa, Homo Sapiens
HSVCYSGCF

SEQ ID NO: 77006 - protein, 9 aa, Homo Sapiens
YPYDEKQDE

SEQ ID NO: 77007 - protein, 9 aa, Homo Sapiens
VITTAVSLV

SEQ ID NO: 77008 - protein, 9 aa, Homo Sapiens
TNHRHKAAL

SEQ ID NO: 77009 - protein, 9 aa, Homo Sapiens
NDPNDGGAV

SEQ ID NO: 77010 - protein, 9 aa, Homo Sapiens
YGFYGDIKD

SEQ ID NO: 77011 - protein, 9 aa, Homo Sapiens
MHETHDGVH

SEQ ID NO: 77012 - protein, 9 aa, Homo Sapiens
PCRSPARGR

SEQ ID NO: 77013 - protein, 9 aa, Homo Sapiens
IPANMTAAV

SEQ ID NO: 77014 - protein, 9 aa, Homo Sapiens
TPLTTAQTS

SEQ ID NO: 77015 - protein, 9 aa, Homo Sapiens
PLTTAQTSG

SEQ ID NO: 77016 - protein, 9 aa, Homo Sapiens
REKIMYKAI

SEQ ID NO: 77017 - protein, 9 aa, Homo Sapiens
MMVSTTVGY

SEQ ID NO: 77018 - protein, 9 aa, Homo Sapiens
PPLSLSPPF

SEQ ID NO: 77019 - protein, 9 aa, Homo Sapiens
QKPDGLINE

SEQ ID NO: 77020 - protein, 9 aa, Homo Sapiens
REYFLCEID

SEQ ID NO: 77021 - protein, 9 aa, Homo Sapiens
FYGDIKDSE

SEQ ID NO: 77022 - protein, 9 aa, Homo Sapiens
KKALKDEKP

SEQ ID NO: 77023 - protein, 9 aa, Homo Sapiens
ISGDIKDCL

SEQ ID NO: 77024 - protein, 9 aa, Homo Sapiens
HYSNVCMEK

SEQ ID NO: 77025 - protein, 9 aa, Homo Sapiens
MVSTTVGYT

SEQ ID NO: 77026 - protein, 9 aa, Homo Sapiens
ARTVRKCWP

SEQ ID NO: 77027 - protein, 9 aa, Homo Sapiens
TGLPGTKGE

SEQ ID NO: 77028 - protein, 9 aa, Homo Sapiens
KNERTSVAR

SEQ ID NO: 77029 - protein, 9 aa, Homo Sapiens
NVCMEKSQK

SEQ ID NO: 77030 - protein, 9 aa, Homo Sapiens
LEDMRSNNI

SEQ ID NO: 77031 - protein, 9 aa, Homo Sapiens
KKSYRKFAL

SEQ ID NO: 77032 - protein, 9 aa, Homo Sapiens
RPYLTYKIG

SEQ ID NO: 77033 - protein, 9 aa, Homo Sapiens
HSYILTYQF

SEQ ID NO: 77034 - protein, 9 aa, Homo Sapiens
GSSPARTHQ

SEQ ID NO: 77035 - protein, 9 aa, Homo Sapiens
LDGNVCKAY

SEQ ID NO: 77036 - protein, 9 aa, Homo Sapiens
ISTSIFLFC

SEQ ID NO: 77037 - protein, 9 aa, Homo Sapiens
VHKFKVSYS

SEQ ID NO: 77038 - protein, 9 aa, Homo Sapiens
THQPAFLQP

SEQ ID NO: 77039 - protein, 9 aa, Homo Sapiens
SNQLDNDQS

SEQ ID NO: 77040 - protein, 9 aa, Homo Sapiens
EGQGLHRGH

SEQ ID NO: 77041 - protein, 9 aa, Homo Sapiens
RSASPWAWP

SEQ ID NO: 77042 - protein, 9 aa, Homo Sapiens
QMEWRGRRV

SEQ ID NO: 77043 - protein, 9 aa, Homo Sapiens
QPLSSAASR

SEQ ID NO: 77044 - protein, 9 aa, Homo Sapiens
ANMTAAVSL

SEQ ID NO: 77045 - protein, 9 aa, Homo Sapiens
LLNEGPEML

SEQ ID NO: 77046 - protein, 9 aa, Homo Sapiens
KHLTEQKPD

SEQ ID NO: 77047 - protein, 9 aa, Homo Sapiens
PGASLLQLQ

SEQ ID NO: 77048 - protein, 9 aa, Homo Sapiens
GSQAGFCPY

SEQ ID NO: 77049 - protein, 9 aa, Homo Sapiens
LSPPFFFFS

SEQ ID NO: 77050 - protein, 9 aa, Homo Sapiens
FVHKFKVSY

SEQ ID NO: 77051 - protein, 9 aa, Homo Sapiens
ATCSHYTQL

SEQ ID NO: 77052 - protein, 9 aa, Homo Sapiens
ACQGISLVT

SEQ ID NO: 77053 - protein, 9 aa, Homo Sapiens
ARAFVHKFK

SEQ ID NO: 77054 - protein, 9 aa, Homo Sapiens
TMFQMEWRG

SEQ ID NO: 77055 - protein, 9 aa, Homo Sapiens
HRHYGSTTW

SEQ ID NO: 77056 - protein, 9 aa, Homo Sapiens
VITLCFALI

SEQ ID NO: 77057 - protein, 9 aa, Homo Sapiens
AEDWATPLN

SEQ ID NO: 77058 - protein, 9 aa, Homo Sapiens
AVEARAFVH

SEQ ID NO: 77059 - protein, 9 aa, Homo Sapiens
NDRSLLPGL

SEQ ID NO: 77060 - protein, 9 aa, Homo Sapiens
HYGSTTWAT

SEQ ID NO: 77061 - protein, 9 aa, Homo Sapiens
ERPYLTYKI

SEQ ID NO: 77062 - protein, 9 aa, Homo Sapiens
SQAGFCPYS

SEQ ID NO: 77063 - protein, 9 aa, Homo Sapiens
GRELFDDPC

SEQ ID NO: 77064 - protein, 9 aa, Homo Sapiens
FREYFLCEI

SEQ ID NO: 77065 - protein, 9 aa, Homo Sapiens
GLSIHCPSA

SEQ ID NO: 77066 - protein, 9 aa, Homo Sapiens
CLKKKEDCL

SEQ ID NO: 77067 - protein, 9 aa, Homo Sapiens
QNQKGQQYP

SEQ ID NO: 77068 - protein, 9 aa, Homo Sapiens
RGRPDISEQ

SEQ ID NO: 77069 - protein, 9 aa, Homo Sapiens
KDCLKKKED

SEQ ID NO: 77070 - protein, 9 aa, Homo Sapiens
PVTCGNGTQ

SEQ ID NO: 77071 - protein, 9 aa, Homo Sapiens
SASPWAWPW

SEQ ID NO: 77072 - protein, 9 aa, Homo Sapiens
NVCKAYSWT

SEQ ID NO: 77073 - protein, 9 aa, Homo Sapiens
ALKDEKPEP

SEQ ID NO: 77074 - protein, 9 aa, Homo Sapiens
LRRFPRVKT

SEQ ID NO: 77075 - protein, 9 aa, Homo Sapiens
LGNTSLSGL

SEQ ID NO: 77076 - protein, 9 aa, Homo Sapiens
SNKEQLRDI

SEQ ID NO: 77077 - protein, 9 aa, Homo Sapiens
LKTACQGIS

SEQ ID NO: 77078 - protein, 9 aa, Homo Sapiens
ALEVITLCF

SEQ ID NO: 77079 - protein, 9 aa, Homo Sapiens
CAASRSASP

SEQ ID NO: 77080 - protein, 9 aa, Homo Sapiens
EDMRSNNIE

SEQ ID NO: 77081 - protein, 9 aa, Homo Sapiens
LSGAGFNSL

SEQ ID NO: 77082 - protein, 9 aa, Homo Sapiens
GYGFYGDIK

SEQ ID NO: 77083 - protein, 9 aa, Homo Sapiens
ASENETVKN

SEQ ID NO: 77084 - protein, 9 aa, Homo Sapiens
KGQQYPPPN

SEQ ID NO: 77085 - protein, 9 aa, Homo Sapiens
MALLQKINQ

SEQ ID NO: 77086 - protein, 9 aa, Homo Sapiens
RHYGSTTWA

SEQ ID NO: 77087 - protein, 9 aa, Homo Sapiens
EEVPTSIMY

SEQ ID NO: 77088 - protein, 9 aa, Homo Sapiens
DFREKIMYK

SEQ ID NO: 77089 - protein, 9 aa, Homo Sapiens
AQSRRTSIP

SEQ ID NO: 77090 - protein, 9 aa, Homo Sapiens
TISTSIFLF

SEQ ID NO: 77091 - protein, 9 aa, Homo Sapiens
SQGKVKSCS

SEQ ID NO: 77092 - protein, 9 aa, Homo Sapiens
GCFFYHEKE

SEQ ID NO: 77093 - protein, 9 aa, Homo Sapiens
FVDGRQPGT

SEQ ID NO: 77094 - protein, 9 aa, Homo Sapiens
MFQMEWRGR

SEQ ID NO: 77095 - protein, 9 aa, Homo Sapiens
KKLSENTDS

SEQ ID NO: 77096 - protein, 9 aa, Homo Sapiens
AQPLSSAAS

SEQ ID NO: 77097 - protein, 9 aa, Homo Sapiens
EQLISASLF

SEQ ID NO: 77098 - protein, 9 aa, Homo Sapiens
KSELCQEPE

SEQ ID NO: 77099 - protein, 9 aa, Homo Sapiens
KTACQGISL

SEQ ID NO: 77100 - protein, 9 aa, Homo Sapiens
RGRDCSRNS

SEQ ID NO: 77101 - protein, 9 aa, Homo Sapiens
VVTLEMDNY

SEQ ID NO: 77102 - protein, 9 aa, Homo Sapiens
RTSIPPIPA

SEQ ID NO: 77103 - protein, 9 aa, Homo Sapiens
GTTAGQMCC

SEQ ID NO: 77104 - protein, 9 aa, Homo Sapiens
ILFQKTVSA

SEQ ID NO: 77105 - protein, 9 aa, Homo Sapiens
RPDISEQLI

SEQ ID NO: 77106 - protein, 9 aa, Homo Sapiens
LPGLSCVQT

SEQ ID NO: 77107 - protein, 9 aa, Homo Sapiens
APPGASLLQ

SEQ ID NO: 77108 - protein, 9 aa, Homo Sapiens
PRMHIVEVT

SEQ ID NO: 77109 - protein, 9 aa, Homo Sapiens
QGGVEEVLK

SEQ ID NO: 77110 - protein, 9 aa, Homo Sapiens
QKHYSNVCM

SEQ ID NO: 77111 - protein, 9 aa, Homo Sapiens
SRRTSIPPI

SEQ ID NO: 77112 - protein, 9 aa, Homo Sapiens
SGIPQRLTA

SEQ ID NO: 77113 - protein, 9 aa, Homo Sapiens
YETLLNEGP

SEQ ID NO: 77114 - protein, 9 aa, Homo Sapiens
GLSCVQTAL

SEQ ID NO: 77115 - protein, 9 aa, Homo Sapiens
MVSGIKPLG

SEQ ID NO: 77116 - protein, 9 aa, Homo Sapiens
SHYTQLVWA

SEQ ID NO: 77117 - protein, 9 aa, Homo Sapiens
IHSNQLDND

SEQ ID NO: 77118 - protein, 9 aa, Homo Sapiens
GLTGLPGTK

SEQ ID NO: 77119 - protein, 9 aa, Homo Sapiens
HKYQPRMHI

SEQ ID NO: 77120 - protein, 9 aa, Homo Sapiens
ARNATCSHY

SEQ ID NO: 77121 - protein, 9 aa, Homo Sapiens
ELDKFLQDV

SEQ ID NO: 77122 - protein, 9 aa, Homo Sapiens
VSCVGTRQL

SEQ ID NO: 77123 - protein, 9 aa, Homo Sapiens
HTVVTASAA

SEQ ID NO: 77124 - protein, 9 aa, Homo Sapiens
SIPPIPANM

SEQ ID NO: 77125 - protein, 9 aa, Homo Sapiens
VETIQGFQC

SEQ ID NO: 77126 - protein, 9 aa, Homo Sapiens
LEESDLRRF

SEQ ID NO: 77127 - protein, 9 aa, Homo Sapiens
GSFGKVSYT

SEQ ID NO: 77128 - protein, 9 aa, Homo Sapiens
ESPTMFVDG

SEQ ID NO: 77129 - protein, 9 aa, Homo Sapiens
MFFGSNDGT

SEQ ID NO: 77130 - protein, 9 aa, Homo Sapiens
AAQSRRTSI

SEQ ID NO: 77131 - protein, 9 aa, Homo Sapiens
QKGQQYPPP

SEQ ID NO: 77132 - protein, 9 aa, Homo Sapiens
DHSVCYSGC

SEQ ID NO: 77133 - protein, 9 aa, Homo Sapiens
YLDGNVCKA

SEQ ID NO: 77134 - protein, 9 aa, Homo Sapiens
DGVHDMACD

SEQ ID NO: 77135 - protein, 9 aa, Homo Sapiens
NTFIDNVFA

SEQ ID NO: 77136 - protein, 9 aa, Homo Sapiens
AAVSLTRSP

SEQ ID NO: 77137 - protein, 9 aa, Homo Sapiens
SLGSEPPKT

SEQ ID NO: 77138 - protein, 9 aa, Homo Sapiens
SKSTVKRLL

SEQ ID NO: 77139 - protein, 9 aa, Homo Sapiens
VVTASAAQN

SEQ ID NO: 77140 - protein, 9 aa, Homo Sapiens
MIRPNGRVA

SEQ ID NO: 77141 - protein, 9 aa, Homo Sapiens
PVATVLTHM

SEQ ID NO: 77142 - protein, 9 aa, Homo Sapiens
AGPWSQCPV

SEQ ID NO: 77143 - protein, 9 aa, Homo Sapiens
PLSLSPPFF

SEQ ID NO: 77144 - protein, 9 aa, Homo Sapiens
LRTDALIND

SEQ ID NO: 77145 - protein, 9 aa, Homo Sapiens
KVSYTLFQV

SEQ ID NO: 77146 - protein, 9 aa, Homo Sapiens
LVLNKLRTD

SEQ ID NO: 77147 - protein, 9 aa, Homo Sapiens
KFALKYHPD

SEQ ID NO: 77148 - protein, 9 aa, Homo Sapiens
RQLVITTAV

SEQ ID NO: 77149 - protein, 9 aa, Homo Sapiens
CCEALEVIT

SEQ ID NO: 77150 - protein, 9 aa, Homo Sapiens
STPLTTAQT

SEQ ID NO: 77151 - protein, 9 aa, Homo Sapiens
TTAVSLVRA

SEQ ID NO: 77152 - protein, 9 aa, Homo Sapiens
EEKKALKDE

SEQ ID NO: 77153 - protein, 9 aa, Homo Sapiens
ARGRDCSRN

SEQ ID NO: 77154 - protein, 9 aa, Homo Sapiens
TWTKTSSVS

SEQ ID NO: 77155 - protein, 9 aa, Homo Sapiens
ASLLQLQQQ

SEQ ID NO: 77156 - protein, 9 aa, Homo Sapiens
HDGVHDMAC

SEQ ID NO: 77157 - protein, 9 aa, Homo Sapiens
EESDLRRFP

SEQ ID NO: 77158 - protein, 9 aa, Homo Sapiens
NHRHKAALK

SEQ ID NO: 77159 - protein, 9 aa, Homo Sapiens
TVKRLLLPR

SEQ ID NO: 77160 - protein, 9 aa, Homo Sapiens
ISRHIVLLF

SEQ ID NO: 77161 - protein, 9 aa, Homo Sapiens
PNVTDMYGN

SEQ ID NO: 77162 - protein, 9 aa, Homo Sapiens
TLLNEGPEM

SEQ ID NO: 77163 - protein, 9 aa, Homo Sapiens
QQGELMKAF

SEQ ID NO: 77164 - protein, 9 aa, Homo Sapiens
TPKSELCQE

SEQ ID NO: 77165 - protein, 9 aa, Homo Sapiens
LHTVVTASA

SEQ ID NO: 77166 - protein, 9 aa, Homo Sapiens
NPVATVLTH

SEQ ID NO: 77167 - protein, 9 aa, Homo Sapiens
SASCAASRS

SEQ ID NO: 77168 - protein, 9 aa, Homo Sapiens
NGSITHLMI

SEQ ID NO: 77169 - protein, 9 aa, Homo Sapiens
TVMFFGSND

SEQ ID NO: 77170 - protein, 9 aa, Homo Sapiens
HISMGYKTK

SEQ ID NO: 77171 - protein, 9 aa, Homo Sapiens
FNTFIDNVF

SEQ ID NO: 77172 - protein, 9 aa, Homo Sapiens
RPDIPCRAM

SEQ ID NO: 77173 - protein, 9 aa, Homo Sapiens
NTKIIVKLS

SEQ ID NO: 77174 - protein, 9 aa, Homo Sapiens
PDISEQLIS

SEQ ID NO: 77175 - protein, 9 aa, Homo Sapiens
PPGGSYKLA

SEQ ID NO: 77176 - protein, 9 aa, Homo Sapiens
CVCVISKCY

SEQ ID NO: 77177 - protein, 9 aa, Homo Sapiens
LEMDNYEPG

SEQ ID NO: 77178 - protein, 9 aa, Homo Sapiens
QLSGAGFNS

SEQ ID NO: 77179 - protein, 9 aa, Homo Sapiens
PLSSAASRV

SEQ ID NO: 77180 - protein, 9 aa, Homo Sapiens
VARTVRKCW

SEQ ID NO: 77181 - protein, 9 aa, Homo Sapiens
RDAADFMLK

SEQ ID NO: 77182 - protein, 9 aa, Homo Sapiens
RRDAADFML

SEQ ID NO: 77183 - protein, 9 aa, Homo Sapiens
IHSYILTYQ

SEQ ID NO: 77184 - protein, 9 aa, Homo Sapiens
NVERPYLTY

SEQ ID NO: 77185 - protein, 9 aa, Homo Sapiens
GGSYKLASP

SEQ ID NO: 77186 - protein, 9 aa, Homo Sapiens
RLKFSGIPQ

SEQ ID NO: 77187 - protein, 9 aa, Homo Sapiens
QKTVSAVAS

SEQ ID NO: 77188 - protein, 9 aa, Homo Sapiens
KSTVKRLLL

SEQ ID NO: 77189 - protein, 9 aa, Homo Sapiens
PDIPCRAMF

SEQ ID NO: 77190 - protein, 9 aa, Homo Sapiens
TSSLGSEPP

SEQ ID NO: 77191 - protein, 9 aa, Homo Sapiens
YFREYFLCE

SEQ ID NO: 77192 - protein, 9 aa, Homo Sapiens
YFLCEIDEA

SEQ ID NO: 77193 - protein, 9 aa, Homo Sapiens
HSRPPGGSY

SEQ ID NO: 77194 - protein, 9 aa, Homo Sapiens
QLVITTAVS

SEQ ID NO: 77195 - protein, 9 aa, Homo Sapiens
SYTLFQVDD

SEQ ID NO: 77196 - protein, 9 aa, Homo Sapiens
MTAAVSLTR

SEQ ID NO: 77197 - protein, 9 aa, Homo Sapiens
SAQIHSYIL

SEQ ID NO: 77198 - protein, 9 aa, Homo Sapiens
AASRSASPW

SEQ ID NO: 77199 - protein, 9 aa, Homo Sapiens
APPKGATPT

SEQ ID NO: 77200 - protein, 9 aa, Homo Sapiens
LCTNMLSNK

SEQ ID NO: 77201 - protein, 9 aa, Homo Sapiens
FIDNVFAFI

SEQ ID NO: 77202 - protein, 9 aa, Homo Sapiens
FPRVKTTPL

SEQ ID NO: 77203 - protein, 9 aa, Homo Sapiens
SPWAWPWTW

SEQ ID NO: 77204 - protein, 9 aa, Homo Sapiens
KKIHSNQLD

SEQ ID NO: 77205 - protein, 9 aa, Homo Sapiens
TTNHRHKAA

SEQ ID NO: 77206 - protein, 9 aa, Homo Sapiens
AGFCPYSID

SEQ ID NO: 77207 - protein, 9 aa, Homo Sapiens
LSENTDSLA

SEQ ID NO: 77208 - protein, 9 aa, Homo Sapiens
LNEGPEMLE

SEQ ID NO: 77209 - protein, 9 aa, Homo Sapiens
SITHLMIRP

SEQ ID NO: 77210 - protein, 9 aa, Homo Sapiens
LFCFPTIPL

SEQ ID NO: 77211 - protein, 9 aa, Homo Sapiens
TKTSSVSCV

SEQ ID NO: 77212 - protein, 9 aa, Homo Sapiens
KTKLYFQTN

SEQ ID NO: 77213 - protein, 9 aa, Homo Sapiens
QGELMKAFE

SEQ ID NO: 77214 - protein, 9 aa, Homo Sapiens
FLCEIDEAK

SEQ ID NO: 77215 - protein, 9 aa, Homo Sapiens
NRRSLSNSP

SEQ ID NO: 77216 - protein, 9 aa, Homo Sapiens
GSEPPKTRR

SEQ ID NO: 77217 - protein, 9 aa, Homo Sapiens
CVISKCYML

SEQ ID NO: 77218 - protein, 9 aa, Homo Sapiens
AIPTDGDSH

SEQ ID NO: 77219 - protein, 9 aa, Homo Sapiens
VGPPGLTGL

SEQ ID NO: 77220 - protein, 9 aa, Homo Sapiens
LGYETLLNE

SEQ ID NO: 77221 - protein, 9 aa, Homo Sapiens
ENTDSLAPG

SEQ ID NO: 77222 - protein, 9 aa, Homo Sapiens
AMSTPLTTA

SEQ ID NO: 77223 - protein, 9 aa, Homo Sapiens
TLCTNMLSN

SEQ ID NO: 77224 - protein, 9 aa, Homo Sapiens
ASCAASRSA

SEQ ID NO: 77225 - protein, 9 aa, Homo Sapiens
RAFVHKFKV

SEQ ID NO: 77226 - protein, 9 aa, Homo Sapiens
KFDTQYPYD

SEQ ID NO: 77227 - protein, 9 aa, Homo Sapiens
KSTFIEESP

SEQ ID NO: 77228 - protein, 9 aa, Homo Sapiens
PKSELCQEP

SEQ ID NO: 77229 - protein, 9 aa, Homo Sapiens
SENTDSLAP

SEQ ID NO: 77230 - protein, 9 aa, Homo Sapiens
EPYKVAKYT

SEQ ID NO: 77231 - protein, 9 aa, Homo Sapiens
KVKSCSCDP

SEQ ID NO: 77232 - protein, 9 aa, Homo Sapiens
IPCRAMFPS

SEQ ID NO: 77233 - protein, 9 aa, Homo Sapiens
TACQGISLV

SEQ ID NO: 77234 - protein, 9 aa, Homo Sapiens
LMIRPNGRV

SEQ ID NO: 77235 - protein, 9 aa, Homo Sapiens
TMFVDGRQP

SEQ ID NO: 77236 - protein, 9 aa, Homo Sapiens
GTRQLVITT

SEQ ID NO: 77237 - protein, 9 aa, Homo Sapiens
PKGATPTSP

SEQ ID NO: 77238 - protein, 9 aa, Homo Sapiens
TSVETIQGF

SEQ ID NO: 77239 - protein, 9 aa, Homo Sapiens
QCSLKTACQ

SEQ ID NO: 77240 - protein, 9 aa, Homo Sapiens
SDLRRFPRV

SEQ ID NO: 77241 - protein, 9 aa, Homo Sapiens
DNVFAFIIT

SEQ ID NO: 77242 - protein, 9 aa, Homo Sapiens
GTSVETIQG

SEQ ID NO: 77243 - protein, 9 aa, Homo Sapiens
TTAQTSGST

SEQ ID NO: 77244 - protein, 9 aa, Homo Sapiens
SRSASPWAW

SEQ ID NO: 77245 - protein, 9 aa, Homo Sapiens
SAVASLLKG

SEQ ID NO: 77246 - protein, 9 aa, Homo Sapiens
GLQKHYSNV

SEQ ID NO: 77247 - protein, 9 aa, Homo Sapiens
ELFDDPCYV

SEQ ID NO: 77248 - protein, 9 aa, Homo Sapiens
YKLASPMKP

SEQ ID NO: 77249 - protein, 9 aa, Homo Sapiens
SGAMSTPLT

SEQ ID NO: 77250 - protein, 9 aa, Homo Sapiens
SQCPVTCGN

SEQ ID NO: 77251 - protein, 9 aa, Homo Sapiens
CRAMFPSAA

SEQ ID NO: 77252 - protein, 9 aa, Homo Sapiens
ELCQEPEPT

SEQ ID NO: 77253 - protein, 9 aa, Homo Sapiens
TCSHYTQLV

SEQ ID NO: 77254 - protein, 9 aa, Homo Sapiens
KIMYKAIHC

SEQ ID NO: 77255 - protein, 9 aa, Homo Sapiens
EACEGCRKD

SEQ ID NO: 77256 - protein, 9 aa, Homo Sapiens
QMCCGLPGL

SEQ ID NO: 77257 - protein, 9 aa, Homo Sapiens
NVLRIQCLY

SEQ ID NO: 77258 - protein, 9 aa, Homo Sapiens
ETLLNEGPE

SEQ ID NO: 77259 - protein, 9 aa, Homo Sapiens
YLTYKIGWL

SEQ ID NO: 77260 - protein, 9 aa, Homo Sapiens
DSGSQAGFC

SEQ ID NO: 77261 - protein, 9 aa, Homo Sapiens
GAESPTMFV

SEQ ID NO: 77262 - protein, 9 aa, Homo Sapiens
LTHMVSMLA

SEQ ID NO: 77263 - protein, 9 aa, Homo Sapiens
LTQRGMGEA

SEQ ID NO: 77264 - protein, 9 aa, Homo Sapiens
QDHSVCYSG

SEQ ID NO: 77265 - protein, 9 aa, Homo Sapiens
QEPEPTSDT

SEQ ID NO: 77266 - protein, 9 aa, Homo Sapiens
TVNDFREKI

SEQ ID NO: 77267 - protein, 9 aa, Homo Sapiens
SLTRSPAIS

SEQ ID NO: 77268 - protein, 9 aa, Homo Sapiens
SFGKVSYTL

SEQ ID NO: 77269 - protein, 9 aa, Homo Sapiens
DAREKSTFI

SEQ ID NO: 77270 - protein, 9 aa, Homo Sapiens
LSSAASRVQ

SEQ ID NO: 77271 - protein, 9 aa, Homo Sapiens
GPHCANTKI

SEQ ID NO: 77272 - protein, 9 aa, Homo Sapiens
VLRIQCLYR

SEQ ID NO: 77273 - protein, 9 aa, Homo Sapiens
DRSLLPGLS

SEQ ID NO: 77274 - protein, 9 aa, Homo Sapiens
EGHLTQLSG

SEQ ID NO: 77275 - protein, 9 aa, Homo Sapiens
LTGLPGTKG

SEQ ID NO: 77276 - protein, 9 aa, Homo Sapiens
PILFQKTVS

SEQ ID NO: 77277 - protein, 9 aa, Homo Sapiens
RAARASFAA

SEQ ID NO: 77278 - protein, 9 aa, Homo Sapiens
LMVSGIKPL

SEQ ID NO: 77279 - protein, 9 aa, Homo Sapiens
QCPVTCGNG

SEQ ID NO: 77280 - protein, 9 aa, Homo Sapiens
VSLVRAARA

SEQ ID NO: 77281 - protein, 9 aa, Homo Sapiens
IKKSYRKFA

SEQ ID NO: 77282 - protein, 9 aa, Homo Sapiens
MFPSAACRR

SEQ ID NO: 77283 - protein, 9 aa, Homo Sapiens
SLLTQRGMG

SEQ ID NO: 77284 - protein, 9 aa, Homo Sapiens
STMDRDKVA

SEQ ID NO: 77285 - protein, 9 aa, Homo Sapiens
GFYGDIKDS

SEQ ID NO: 77286 - protein, 9 aa, Homo Sapiens
AGAESPTMF

SEQ ID NO: 77287 - protein, 9 aa, Homo Sapiens
REERKQQGE

SEQ ID NO: 77288 - protein, 9 aa, Homo Sapiens
SPARTHQPA

SEQ ID NO: 77289 - protein, 9 aa, Homo Sapiens
ISASCAASR

SEQ ID NO: 77290 - protein, 9 aa, Homo Sapiens
TVVTASAAQ

SEQ ID NO: 77291 - protein, 9 aa, Homo Sapiens
YKTKLYFQT

SEQ ID NO: 77292 - protein, 9 aa, Homo Sapiens
MQGGVEEVL

SEQ ID NO: 77293 - protein, 9 aa, Homo Sapiens
DKFLQDVRN

SEQ ID NO: 77294 - protein, 9 aa, Homo Sapiens
SYILTYQFP

SEQ ID NO: 77295 - protein, 9 aa, Homo Sapiens
DAADFMLKA

SEQ ID NO: 77296 - protein, 9 aa, Homo Sapiens
GNVCKAYSW

SEQ ID NO: 77297 - protein, 9 aa, Homo Sapiens
YDEKQDEFK

SEQ ID NO: 77298 - protein, 9 aa, Homo Sapiens
ACSQGKVKS

SEQ ID NO: 77299 - protein, 9 aa, Homo Sapiens
AREKSTFIE

SEQ ID NO: 77300 - protein, 9 aa, Homo Sapiens
RTVRKCWPN

SEQ ID NO: 77301 - protein, 9 aa, Homo Sapiens
DGNVCKAYS

SEQ ID NO: 77302 - protein, 9 aa, Homo Sapiens
QLISASLFL

SEQ ID NO: 77303 - protein, 9 aa, Homo Sapiens
GQGLHRGHT

SEQ ID NO: 77304 - protein, 9 aa, Homo Sapiens
MFSNLRKLV

SEQ ID NO: 77305 - protein, 9 aa, Homo Sapiens
AGQMCCGLP

SEQ ID NO: 77306 - protein, 9 aa, Homo Sapiens
ETHDGVHDM

SEQ ID NO: 77307 - protein, 9 aa, Homo Sapiens
ITLCFALIP

SEQ ID NO: 77308 - protein, 9 aa, Homo Sapiens
LNKLRTDAL

SEQ ID NO: 77309 - protein, 9 aa, Homo Sapiens
PTSIMYSEN

SEQ ID NO: 77310 - protein, 9 aa, Homo Sapiens
SNVCMEKSQ

SEQ ID NO: 77311 - protein, 9 aa, Homo Sapiens
LLPGLSCVQ

SEQ ID NO: 77312 - protein, 9 aa, Homo Sapiens
AESPTMFVD

SEQ ID NO: 77313 - protein, 9 aa, Homo Sapiens
EVITLCFAL

SEQ ID NO: 77314 - protein, 9 aa, Homo Sapiens
APLVANVGS

SEQ ID NO: 77315 - protein, 9 aa, Homo Sapiens
ITTDYYRGA

SEQ ID NO: 77316 - protein, 9 aa, Homo Sapiens
TPPSAQIHS

SEQ ID NO: 77317 - protein, 9 aa, Homo Sapiens
KYTNKGDAL

SEQ ID NO: 77318 - protein, 9 aa, Homo Sapiens
QVLAEDWAT

SEQ ID NO: 77319 - protein, 9 aa, Homo Sapiens
EDNDPNDGG

SEQ ID NO: 77320 - protein, 9 aa, Homo Sapiens
KFLQDVRNG

SEQ ID NO: 77321 - protein, 9 aa, Homo Sapiens
KVAIPTDGD

SEQ ID NO: 77322 - protein, 9 aa, Homo Sapiens
VLILLHTVV

SEQ ID NO: 77323 - protein, 9 aa, Homo Sapiens
QAQELAEAC

SEQ ID NO: 77324 - protein, 9 aa, Homo Sapiens
GQMCCGLPG

SEQ ID NO: 77325 - protein, 9 aa, Homo Sapiens
ARTHQPAFL

SEQ ID NO: 77326 - protein, 9 aa, Homo Sapiens
LCSVCEGQG

SEQ ID NO: 77327 - protein, 9 aa, Homo Sapiens
VNDFREKIM

SEQ ID NO: 77328 - protein, 9 aa, Homo Sapiens
HIVLLFSGF

SEQ ID NO: 77329 - protein, 9 aa, Homo Sapiens
RPPGGSYKL

SEQ ID NO: 77330 - protein, 9 aa, Homo Sapiens
SKNMFSNLR

SEQ ID NO: 77331 - protein, 9 aa, Homo Sapiens
CARNATCSH

SEQ ID NO: 77332 - protein, 9 aa, Homo Sapiens
GASLLQLQQ

SEQ ID NO: 77333 - protein, 9 aa, Homo Sapiens
RTSSLGSEP

SEQ ID NO: 77334 - protein, 9 aa, Homo Sapiens
RTDALINDI

SEQ ID NO: 77335 - protein, 9 aa, Homo Sapiens
DSWHIPYNE

SEQ ID NO: 77336 - protein, 9 aa, Homo Sapiens
HTTNHRHKA

SEQ ID NO: 77337 - protein, 9 aa, Homo Sapiens
HETHDGVHD

SEQ ID NO: 77338 - protein, 9 aa, Homo Sapiens
FSNLRKLVA

SEQ ID NO: 77339 - protein, 9 aa, Homo Sapiens
EFDDEDNDP

SEQ ID NO: 77340 - protein, 9 aa, Homo Sapiens
GYETLLNEG

SEQ ID NO: 77341 - protein, 9 aa, Homo Sapiens
CANTKIIVK

SEQ ID NO: 77342 - protein, 9 aa, Homo Sapiens
LRKLVASRD

SEQ ID NO: 77343 - protein, 9 aa, Homo Sapiens
SSVSCVGTR

SEQ ID NO: 77344 - protein, 9 aa, Homo Sapiens
FFFFSGMWY

SEQ ID NO: 77345 - protein, 9 aa, Homo Sapiens
TKIIVKLSD

SEQ ID NO: 77346 - protein, 9 aa, Homo Sapiens
GRPDISEQL

SEQ ID NO: 77347 - protein, 9 aa, Homo Sapiens
HVASENETV

SEQ ID NO: 77348 - protein, 9 aa, Homo Sapiens
WVQVLAEDW

SEQ ID NO: 77349 - protein, 9 aa, Homo Sapiens
DLCSVCEGQ

SEQ ID NO: 77350 - protein, 9 aa, Homo Sapiens
QVSANTMFQ

SEQ ID NO: 77351 - protein, 9 aa, Homo Sapiens
VAKYTNKGD

SEQ ID NO: 77352 - protein, 9 aa, Homo Sapiens
GKVSYTLFQ

SEQ ID NO: 77353 - protein, 9 aa, Homo Sapiens
AMFPSAACR

SEQ ID NO: 77354 - protein, 9 aa, Homo Sapiens
NTMFQMEWR

SEQ ID NO: 77355 - protein, 9 aa, Homo Sapiens
PAPPKGATP

SEQ ID NO: 77356 - protein, 9 aa, Homo Sapiens
IEDCKMMVS

SEQ ID NO: 77357 - protein, 9 aa, Homo Sapiens
QIHSYILTY

SEQ ID NO: 77358 - protein, 9 aa, Homo Sapiens
YRKFALKYH

SEQ ID NO: 77359 - protein, 9 aa, Homo Sapiens
PRLKFSGIP

SEQ ID NO: 77360 - protein, 9 aa, Homo Sapiens
PPSAQIHSY

SEQ ID NO: 77361 - protein, 9 aa, Homo Sapiens
SYLDGNVCK

SEQ ID NO: 77362 - protein, 9 aa, Homo Sapiens
CYSGCFFYH

SEQ ID NO: 77363 - protein, 9 aa, Homo Sapiens
RMHIVEVTE

SEQ ID NO: 77364 - protein, 9 aa, Homo Sapiens
ACEGCRKDL

SEQ ID NO: 77365 - protein, 9 aa, Homo Sapiens
KALKDEKPE

SEQ ID NO: 77366 - protein, 9 aa, Homo Sapiens
EKIMYKAIH

SEQ ID NO: 77367 - protein, 9 aa, Homo Sapiens
GFCPYSIDS

SEQ ID NO: 77368 - protein, 9 aa, Homo Sapiens
LISGDIKDC

SEQ ID NO: 77369 - protein, 9 aa, Homo Sapiens
SSPARTHQP

SEQ ID NO: 77370 - protein, 9 aa, Homo Sapiens
PHCANTKII

SEQ ID NO: 77371 - protein, 9 aa, Homo Sapiens
KCYMLAAMA

SEQ ID NO: 77372 - protein, 9 aa, Homo Sapiens
DWATPLNGF

SEQ ID NO: 77373 - protein, 9 aa, Homo Sapiens
QSRRTSIPP

SEQ ID NO: 77374 - protein, 9 aa, Homo Sapiens
YSGCFFYHE

SEQ ID NO: 77375 - protein, 9 aa, Homo Sapiens
CQGISLVTW

SEQ ID NO: 77376 - protein, 9 aa, Homo Sapiens
YRTITTDYY

SEQ ID NO: 77377 - protein, 9 aa, Homo Sapiens
LLFAGTMMV

SEQ ID NO: 77378 - protein, 9 aa, Homo Sapiens
QGLHRGHTK

SEQ ID NO: 77379 - protein, 9 aa, Homo Sapiens
RKFALKYHP

SEQ ID NO: 77380 - protein, 9 aa, Homo Sapiens
IKDCLKKKE

SEQ ID NO: 77381 - protein, 9 aa, Homo Sapiens
SLVTWTKTS

SEQ ID NO: 77382 - protein, 9 aa, Homo Sapiens
FQMEWRGRR

SEQ ID NO: 77383 - protein, 9 aa, Homo Sapiens
IDNVFAFII

SEQ ID NO: 77384 - protein, 9 aa, Homo Sapiens
PPFFFFSGM

SEQ ID NO: 77385 - protein, 9 aa, Homo Sapiens
RACSQGKVK

SEQ ID NO: 77386 - protein, 9 aa, Homo Sapiens
IGTSVETIQ

SEQ ID NO: 77387 - protein, 9 aa, Homo Sapiens
AFVHKFKVS

SEQ ID NO: 77388 - protein, 9 aa, Homo Sapiens
PGLTGLPGT

SEQ ID NO: 77389 - protein, 9 aa, Homo Sapiens
LVTWTKTSS

SEQ ID NO: 77390 - protein, 9 aa, Homo Sapiens
RSPAISASC

SEQ ID NO: 77391 - protein, 9 aa, Homo Sapiens
VKRLLLPRF

SEQ ID NO: 77392 - protein, 9 aa, Homo Sapiens
DSLAPGVSS

SEQ ID NO: 77393 - protein, 9 aa, Homo Sapiens
TTDYYRGAM

SEQ ID NO: 77394 - protein, 9 aa, Homo Sapiens
EERKQQGEL

SEQ ID NO: 77395 - protein, 9 aa, Homo Sapiens
DYYRGAMGF

SEQ ID NO: 77396 - protein, 9 aa, Homo Sapiens
GQQYPPPNL

SEQ ID NO: 77397 - protein, 9 aa, Homo Sapiens
LPSCNNRHF

SEQ ID NO: 77398 - protein, 9 aa, Homo Sapiens
MFVDGRQPG

SEQ ID NO: 77399 - protein, 9 aa, Homo Sapiens
DLRRFPRVK

SEQ ID NO: 77400 - protein, 9 aa, Homo Sapiens
SGDIKDCLK

SEQ ID NO: 77401 - protein, 9 aa, Homo Sapiens
TSSVSCVGT

SEQ ID NO: 77402 - protein, 9 aa, Homo Sapiens
FGKVSYTLF

SEQ ID NO: 77403 - protein, 9 aa, Homo Sapiens
AEACEGCRK

SEQ ID NO: 77404 - protein, 9 aa, Homo Sapiens
YTLFQVDDV

SEQ ID NO: 77405 - protein, 9 aa, Homo Sapiens
PGGSYKLAS

SEQ ID NO: 77406 - protein, 9 aa, Homo Sapiens
SMGYKTKLY

SEQ ID NO: 77407 - protein, 9 aa, Homo Sapiens
RAQPLSSAA

SEQ ID NO: 77408 - protein, 9 aa, Homo Sapiens
GLKHLTEQK

SEQ ID NO: 77409 - protein, 9 aa, Homo Sapiens
LSLLTQRGM

SEQ ID NO: 77410 - protein, 9 aa, Homo Sapiens
VLAEDWATP

SEQ ID NO: 77411 - protein, 9 aa, Homo Sapiens
PTPKSELCQ

SEQ ID NO: 77412 - protein, 9 aa, Homo Sapiens
GAMSTPLTT

SEQ ID NO: 77413 - protein, 9 aa, Homo Sapiens
TTAGQMCCG

SEQ ID NO: 77414 - protein, 9 aa, Homo Sapiens
ALELDKFLQ

SEQ ID NO: 77415 - protein, 9 aa, Homo Sapiens
GDIKDCLKK

SEQ ID NO: 77416 - protein, 9 aa, Homo Sapiens
VQLSLLTQR

SEQ ID NO: 77417 - protein, 9 aa, Homo Sapiens
RHKAALKLY

SEQ ID NO: 77418 - protein, 9 aa, Homo Sapiens
CPVTCGNGT

SEQ ID NO: 77419 - protein, 9 aa, Homo Sapiens
SGCFFYHEK

SEQ ID NO: 77420 - protein, 9 aa, Homo Sapiens
DDEDNDPND

SEQ ID NO: 77421 - protein, 9 aa, Homo Sapiens
FMLKASSVF

SEQ ID NO: 77422 - protein, 9 aa, Homo Sapiens
RAGPWSQCP

SEQ ID NO: 77423 - protein, 9 aa, Homo Sapiens
STVKRLLLP

SEQ ID NO: 77424 - protein, 9 aa, Homo Sapiens
MRIISRHIV

SEQ ID NO: 77425 - protein, 9 aa, Homo Sapiens
YKIGWLDSL

SEQ ID NO: 77426 - protein, 9 aa, Homo Sapiens
YGMQGGVEE

SEQ ID NO: 77427 - protein, 9 aa, Homo Sapiens
SLHKYQPRM

SEQ ID NO: 77428 - protein, 9 aa, Homo Sapiens
LVRAARASF

SEQ ID NO: 77429 - protein, 9 aa, Homo Sapiens
SELCQEPEP

SEQ ID NO: 77430 - protein, 9 aa, Homo Sapiens
ISYLDGNVC

SEQ ID NO: 77431 - protein, 9 aa, Homo Sapiens
RRTSSLGSE

SEQ ID NO: 77432 - protein, 9 aa, Homo Sapiens
DEFDDEDND

SEQ ID NO: 77433 - protein, 9 aa, Homo Sapiens
VSANTMFQM

SEQ ID NO: 77434 - protein, 9 aa, Homo Sapiens
ISEQLISAS

SEQ ID NO: 77435 - protein, 9 aa, Homo Sapiens
GISLVTWTK

SEQ ID NO: 77436 - protein, 9 aa, Homo Sapiens
TRRRRAPLV

SEQ ID NO: 77437 - protein, 9 aa, Homo Sapiens
NKEQLRDIS

SEQ ID NO: 77438 - protein, 9 aa, Homo Sapiens
RRAPLVANV

SEQ ID NO: 77439 - protein, 9 aa, Homo Sapiens
EKKALKDEK

SEQ ID NO: 77440 - protein, 9 aa, Homo Sapiens
LFDDPCYVN

SEQ ID NO: 77441 - protein, 9 aa, Homo Sapiens
QGFQCSPYP

SEQ ID NO: 77442 - protein, 9 aa, Homo Sapiens
IHVVTLEMD

SEQ ID NO: 77443 - protein, 9 aa, Homo Sapiens
MGYKTKLYF

SEQ ID NO: 77444 - protein, 9 aa, Homo Sapiens
SIFLFCFPT

SEQ ID NO: 77445 - protein, 9 aa, Homo Sapiens
ERYRTITTD

SEQ ID NO: 77446 - protein, 9 aa, Homo Sapiens
ISKCYMLAA

SEQ ID NO: 77447 - protein, 9 aa, Homo Sapiens
SLSPPFFFF

SEQ ID NO: 77448 - protein, 9 aa, Homo Sapiens
TAVSLVRAA

SEQ ID NO: 77449 - protein, 9 aa, Homo Sapiens
THMVSMLAV

SEQ ID NO: 77450 - protein, 9 aa, Homo Sapiens
SSLGSEPPK

SEQ ID NO: 77451 - protein, 9 aa, Homo Sapiens
SGPHCANTK

SEQ ID NO: 77452 - protein, 9 aa, Homo Sapiens
NKLRTDALI

SEQ ID NO: 77453 - protein, 9 aa, Homo Sapiens
IQGFQCSPY

SEQ ID NO: 77454 - protein, 9 aa, Homo Sapiens
GANPNVTDM

SEQ ID NO: 77455 - protein, 9 aa, Homo Sapiens
PFFFFSGMW

SEQ ID NO: 77456 - protein, 9 aa, Homo Sapiens
ADEFDDEDN

SEQ ID NO: 77457 - protein, 9 aa, Homo Sapiens
GIKPLGHPF

SEQ ID NO: 77458 - protein, 9 aa, Homo Sapiens
SEQLISASL

SEQ ID NO: 77459 - protein, 9 aa, Homo Sapiens
VCCEALEVI

SEQ ID NO: 77460 - protein, 9 aa, Homo Sapiens
DTQYPYDEK

SEQ ID NO: 77461 - protein, 9 aa, Homo Sapiens
DNDPNDGGA

SEQ ID NO: 77462 - protein, 9 aa, Homo Sapiens
LCEIDEAKK

SEQ ID NO: 77463 - protein, 9 aa, Homo Sapiens
VLNKLRTDA

SEQ ID NO: 77464 - protein, 9 aa, Homo Sapiens
RVIHVVTLE

SEQ ID NO: 77465 - protein, 9 aa, Homo Sapiens
QLSLLTQRG

SEQ ID NO: 77466 - protein, 9 aa, Homo Sapiens
PTMFVDGRQ

SEQ ID NO: 77467 - protein, 9 aa, Homo Sapiens
EALEVITLC

SEQ ID NO: 77468 - protein, 9 aa, Homo Sapiens
QPRMHIVEV

SEQ ID NO: 77469 - protein, 9 aa, Homo Sapiens
LGHPFSQMS

SEQ ID NO: 77470 - protein, 9 aa, Homo Sapiens
TITTDYYRG

SEQ ID NO: 77471 - protein, 9 aa, Homo Sapiens
KFSGIPQRL

SEQ ID NO: 77472 - protein, 9 aa, Homo Sapiens
VATVLTHMV

SEQ ID NO: 77473 - protein, 9 aa, Homo Sapiens
VISKCYMLA

SEQ ID NO: 77474 - protein, 9 aa, Homo Sapiens
RDCSRNSCL

SEQ ID NO: 77475 - protein, 9 aa, Homo Sapiens
KIIVKLSDG

SEQ ID NO: 77476 - protein, 9 aa, Homo Sapiens
PSCNNRHFW

SEQ ID NO: 77477 - protein, 9 aa, Homo Sapiens
TQRGMGEAV

SEQ ID NO: 77478 - protein, 9 aa, Homo Sapiens
LKDEKPEPK

SEQ ID NO: 77479 - protein, 9 aa, Homo Sapiens
AQIHSYILT

SEQ ID NO: 77480 - protein, 9 aa, Homo Sapiens
MRSNNIEDC

SEQ ID NO: 77481 - protein, 9 aa, Homo Sapiens
ASPWAWPWT

SEQ ID NO: 77482 - protein, 9 aa, Homo Sapiens
VTWTKTSSV

SEQ ID NO: 77483 - protein, 9 aa, Homo Sapiens
PKEEKKALK

SEQ ID NO: 77484 - protein, 9 aa, Homo Sapiens
THDGVHDMA

SEQ ID NO: 77485 - protein, 9 aa, Homo Sapiens
NEDLVERCS

SEQ ID NO: 77486 - protein, 9 aa, Homo Sapiens
PWSQCPVTC

SEQ ID NO: 77487 - protein, 9 aa, Homo Sapiens
DCPRLKFSG

SEQ ID NO: 77488 - protein, 9 aa, Homo Sapiens
SRPPGGSYK

SEQ ID NO: 77489 - protein, 9 aa, Homo Sapiens
PLVANVGSH

SEQ ID NO: 77490 - protein, 9 aa, Homo Sapiens
TDYYRGAMG

SEQ ID NO: 77491 - protein, 9 aa, Homo Sapiens
FQKTVSAVA

SEQ ID NO: 77492 - protein, 9 aa, Homo Sapiens
SLLQLQQQQ

SEQ ID NO: 77493 - protein, 9 aa, Homo Sapiens
KHYSNVCME

SEQ ID NO: 77494 - protein, 9 aa, Homo Sapiens
NQKGQQYPP

SEQ ID NO: 77495 - protein, 9 aa, Homo Sapiens
RKLVASRDG

SEQ ID NO: 77496 - protein, 9 aa, Homo Sapiens
NVQLSLLTQ

SEQ ID NO: 77497 - protein, 9 aa, Homo Sapiens
TVLTHMVSM

SEQ ID NO: 77498 - protein, 9 aa, Homo Sapiens
NDFREKIMY

SEQ ID NO: 77499 - protein, 9 aa, Homo Sapiens
FGSNDGTVL

SEQ ID NO: 77500 - protein, 9 aa, Homo Sapiens
SLLPGLSCV

SEQ ID NO: 77501 - protein, 9 aa, Homo Sapiens
PAISASCAA

SEQ ID NO: 77502 - protein, 9 aa, Homo Sapiens
VSGIKPLGH

SEQ ID NO: 77503 - protein, 9 aa, Homo Sapiens
SRAQPLSSA

SEQ ID NO: 77504 - protein, 9 aa, Homo Sapiens
VCYSGCFFY

SEQ ID NO: 77505 - protein, 9 aa, Homo Sapiens
HLTQLSGAG

SEQ ID NO: 77506 - protein, 9 aa, Homo Sapiens
FYPSRAQPL

SEQ ID NO: 77507 - protein, 9 aa, Homo Sapiens
ETIQGFQCS

SEQ ID NO: 77508 - protein, 9 aa, Homo Sapiens
HVVTLEMDN

SEQ ID NO: 77509 - protein, 9 aa, Homo Sapiens
ISLVTWTKT

SEQ ID NO: 77510 - protein, 9 aa, Homo Sapiens
WATYLALGV

SEQ ID NO: 77511 - protein, 9 aa, Homo Sapiens
CCGLPGLSS

SEQ ID NO: 77512 - protein, 9 aa, Homo Sapiens
HLMIRPNGR

SEQ ID NO: 77513 - protein, 9 aa, Homo Sapiens
AFNTFIDNV

SEQ ID NO: 77514 - protein, 9 aa, Homo Sapiens
TSLSGLSIH

SEQ ID NO: 77515 - protein, 9 aa, Homo Sapiens
KRLLLPRFC

SEQ ID NO: 77516 - protein, 9 aa, Homo Sapiens
NIEDCKMMQ

SEQ ID NO: 77517 - protein, 9 aa, Homo Sapiens
EDWATPLNG

SEQ ID NO: 77518 - protein, 9 aa, Homo Sapiens
SVSCVGTRQ

SEQ ID NO: 77519 - protein, 9 aa, Homo Sapiens
MCCGLPGLS

SEQ ID NO: 77520 - protein, 9 aa, Homo Sapiens
GELMKAFET

SEQ ID NO: 77521 - protein, 9 aa, Homo Sapiens
HKFKVSYSL

SEQ ID NO: 77522 - protein, 9 aa, Homo Sapiens
VSLTRSPAI

SEQ ID NO: 77523 - protein, 9 aa, Homo Sapiens
LTYKIGWLD

SEQ ID NO: 77524 - protein, 9 aa, Homo Sapiens
LVITTAVSL

SEQ ID NO: 77525 - protein, 9 aa, Homo Sapiens
CSHYTQLVW

SEQ ID NO: 77526 - protein, 9 aa, Homo Sapiens
TSVARTVRK

SEQ ID NO: 77527 - protein, 9 aa, Homo Sapiens
NMTAAVSLT

SEQ ID NO: 77528 - protein, 9 aa, Homo Sapiens
EQKPDGLIN

SEQ ID NO: 77529 - protein, 9 aa, Homo Sapiens
QYPYDEKQD

SEQ ID NO: 77530 - protein, 9 aa, Homo Sapiens
MDRDKVAIP

SEQ ID NO: 77531 - protein, 9 aa, Homo Sapiens
FAGTMMVST

SEQ ID NO: 77532 - protein, 9 aa, Homo Sapiens
PYFREYFLC

SEQ ID NO: 77533 - protein, 9 aa, Homo Sapiens
FDDPCYVNV

SEQ ID NO: 77534 - protein, 9 aa, Homo Sapiens
SIMYSENDI

SEQ ID NO: 77535 - protein, 9 aa, Homo Sapiens
SLAPGVSSF

SEQ ID NO: 77536 - protein, 9 aa, Homo Sapiens
YGSTTWATY

SEQ ID NO: 77537 - protein, 9 aa, Homo Sapiens
MSTPLTTAQ

SEQ ID NO: 77538 - protein, 9 aa, Homo Sapiens
QAGFCPYSI

SEQ ID NO: 77539 - protein, 9 aa, Homo Sapiens
SPAISASCA

SEQ ID NO: 77540 - protein, 9 aa, Homo Sapiens
SPARGRDCS

SEQ ID NO: 77541 - protein, 9 aa, Homo Sapiens
YQNQKGQQY

SEQ ID NO: 77542 - protein, 9 aa, Homo Sapiens
QRGMGEAVQ

SEQ ID NO: 77543 - protein, 9 aa, Homo Sapiens
NIEDCKMMV

SEQ ID NO: 77544 - protein, 9 aa, Homo Sapiens
TFIDNVFAF

SEQ ID NO: 77545 - protein, 9 aa, Homo Sapiens
LAEACEGCR

SEQ ID NO: 77546 - protein, 9 aa, Homo Sapiens
RIQCLYRKQ

SEQ ID NO: 77547 - protein, 9 aa, Homo Sapiens
NMFSNLRKL

SEQ ID NO: 77548 - protein, 9 aa, Homo Sapiens
KEEKKALKD

SEQ ID NO: 77549 - protein, 9 aa, Homo Sapiens
IISRHIVLL

SEQ ID NO: 77550 - protein, 9 aa, Homo Sapiens
LSGLSIHCP

SEQ ID NO: 77551 - protein, 9 aa, Homo Sapiens
ANTKIIVKL

SEQ ID NO: 77552 - protein, 9 aa, Homo Sapiens
RILEVNRRS

SEQ ID NO: 77553 - protein, 9 aa, Homo Sapiens
PPGASLLQL

SEQ ID NO: 77554 - protein, 9 aa, Homo Sapiens
TFIEESPLR

SEQ ID NO: 77555 - protein, 9 aa, Homo Sapiens
CGLPGLSSV

SEQ ID NO: 77556 - protein, 9 aa, Homo Sapiens
CPRLKFSGI

SEQ ID NO: 77557 - protein, 9 aa, Homo Sapiens
IMYKAIHCV

SEQ ID NO: 77558 - protein, 9 aa, Homo Sapiens
KGATPTSPV

SEQ ID NO: 77559 - protein, 9 aa, Homo Sapiens
AYEEVPTSI

SEQ ID NO: 77560 - protein, 9 aa, Homo Sapiens
VQLVLNKLR

SEQ ID NO: 77561 - protein, 9 aa, Homo Sapiens
FCPYSIDSE

SEQ ID NO: 77562 - protein, 9 aa, Homo Sapiens
RSPARGRDC

SEQ ID NO: 77563 - protein, 9 aa, Homo Sapiens
VQVLAEDWA

SEQ ID NO: 77564 - protein, 9 aa, Homo Sapiens
CPYSIDSEP

SEQ ID NO: 77565 - protein, 9 aa, Homo Sapiens
CVGTRQLVI

SEQ ID NO: 77566 - protein, 9 aa, Homo Sapiens
EVPTSIMYS

SEQ ID NO: 77567 - protein, 9 aa, Homo Sapiens
NPNVTDMYG

SEQ ID NO: 77568 - protein, 9 aa, Homo Sapiens
RRFPRVKTT

SEQ ID NO: 77569 - protein, 9 aa, Homo Sapiens
VRAARASFA

SEQ ID NO: 77570 - protein, 9 aa, Homo Sapiens
CYVNVQNLD

SEQ ID NO: 77571 - protein, 9 aa, Homo Sapiens
YNEDLVERC

SEQ ID NO: 77572 - protein, 9 aa, Homo Sapiens
VAIPTDGDS

SEQ ID NO: 77573 - protein, 9 aa, Homo Sapiens
AVSLVRAAR

SEQ ID NO: 77574 - protein, 9 aa, Homo Sapiens
WTKTSSVSC

SEQ ID NO: 77575 - protein, 9 aa, Homo Sapiens
DIKKSYRKF

SEQ ID NO: 77576 - protein, 9 aa, Homo Sapiens
HMVSMLAVI

SEQ ID NO: 77577 - protein, 9 aa, Homo Sapiens
VMFFGSNDG

SEQ ID NO: 77578 - protein, 9 aa, Homo Sapiens
CRSPARGRD

SEQ ID NO: 77579 - protein, 9 aa, Homo Sapiens
LILLHTVVT

SEQ ID NO: 77580 - protein, 9 aa, Homo Sapiens
LHTTNHRHK

SEQ ID NO: 77581 - protein, 9 aa, Homo Sapiens
LQKINQVLL

SEQ ID NO: 77582 - protein, 9 aa, Homo Sapiens
KAALKLYKH

SEQ ID NO: 77583 - protein, 9 aa, Homo Sapiens
MLSKSTVKR

SEQ ID NO: 77584 - protein, 9 aa, Homo Sapiens
GSITHLMIR

SEQ ID NO: 77585 - protein, 9 aa, Homo Sapiens
ILEVNRRSL

SEQ ID NO: 77586 - protein, 9 aa, Homo Sapiens
NATCSHYTQ

SEQ ID NO: 77587 - protein, 9 aa, Homo Sapiens
VIHVVTLEM

SEQ ID NO: 77588 - protein, 9 aa, Homo Sapiens
FCFPTIPLS

SEQ ID NO: 77589 - protein, 9 aa, Homo Sapiens
FDTQYPYDE

SEQ ID NO: 77590 - protein, 9 aa, Homo Sapiens
PCRAMFPSA

SEQ ID NO: 77591 - protein, 9 aa, Homo Sapiens
VCEGQGLHR

SEQ ID NO: 77592 - protein, 9 aa, Homo Sapiens
RASFAAQSR

SEQ ID NO: 77593 - protein, 9 aa, Homo Sapiens
EVNRRSLSN

SEQ ID NO: 77594 - protein, 9 aa, Homo Sapiens
WSQCPVTCG

SEQ ID NO: 77595 - protein, 9 aa, Homo Sapiens
KAFNTFIDN

SEQ ID NO: 77596 - protein, 9 aa, Homo Sapiens
HCANTKIIV

SEQ ID NO: 77597 - protein, 9 aa, Homo Sapiens
GPGSSPART

SEQ ID NO: 77598 - protein, 9 aa, Homo Sapiens
IPYNEDLVE

SEQ ID NO: 77599 - protein, 9 aa, Homo Sapiens
LTQLSGAGF

SEQ ID NO: 77600 - protein, 9 aa, Homo Sapiens
STSIFLFCF

SEQ ID NO: 77601 - protein, 9 aa, Homo Sapiens
LRIQCLYRK

SEQ ID NO: 77602 - protein, 9 aa, Homo Sapiens
QWVQVLAED

SEQ ID NO: 77603 - protein, 9 aa, Homo Sapiens
NVFAFIITM

SEQ ID NO: 77604 - protein, 9 aa, Homo Sapiens
FFCVCVISK

SEQ ID NO: 77605 - protein, 9 aa, Homo Sapiens
VERPYLTYK

SEQ ID NO: 77606 - protein, 9 aa, Homo Sapiens
THLMIRPNG

SEQ ID NO: 77607 - protein, 9 aa, Homo Sapiens
IPPIPANMT

SEQ ID NO: 77608 - protein, 9 aa, Homo Sapiens
SLVRAARAS

SEQ ID NO: 77609 - protein, 9 aa, Homo Sapiens
YRKQSSKHA

SEQ ID NO: 77610 - protein, 9 aa, Homo Sapiens
RAMFPSAAC

SEQ ID NO: 77611 - protein, 9 aa, Homo Sapiens
TVSAVASLL

SEQ ID NO: 77612 - protein, 9 aa, Homo Sapiens
DDPCYVNVQ

SEQ ID NO: 77613 - protein, 9 aa, Homo Sapiens
VCMEKSQKI

SEQ ID NO: 77614 - protein, 9 aa, Homo Sapiens
RIISRHIVL

SEQ ID NO: 77615 - protein, 9 aa, Homo Sapiens
PSRILEVNR

SEQ ID NO: 77616 - protein, 9 aa, Homo Sapiens
HDMACDTFI

SEQ ID NO: 77617 - protein, 9 aa, Homo Sapiens
VGTRQLVIT

SEQ ID NO: 77618 - protein, 9 aa, Homo Sapiens
GYKTKLYFQ

SEQ ID NO: 77619 - protein, 9 aa, Homo Sapiens
LAEDWATPL

SEQ ID NO: 77620 - protein, 9 aa, Homo Sapiens
CTNMLSNKE

SEQ ID NO: 77621 - protein, 9 aa, Homo Sapiens
STFIEESPL

SEQ ID NO: 77622 - protein, 9 aa, Homo Sapiens
QQYPPPNLA

SEQ ID NO: 77623 - protein, 9 aa, Homo Sapiens
DRDKVAIPT

SEQ ID NO: 77624 - protein, 9 aa, Homo Sapiens
LSIHCPSAA

SEQ ID NO: 77625 - protein, 9 aa, Homo Sapiens
VLTHMVSML

SEQ ID NO: 77626 - protein, 9 aa, Homo Sapiens
CLYRKQSSK

SEQ ID NO: 77627 - protein, 9 aa, Homo Sapiens
FGEPYKVAK

SEQ ID NO: 77628 - protein, 9 aa, Homo Sapiens
TSIMYSEND

SEQ ID NO: 77629 - protein, 9 aa, Homo Sapiens
NEGPEMLEK

SEQ ID NO: 77630 - protein, 9 aa, Homo Sapiens
TQYPYDEKQ

SEQ ID NO: 77631 - protein, 9 aa, Homo Sapiens
YEEVPTSIM

SEQ ID NO: 77632 - protein, 9 aa, Homo Sapiens
GPSRILEVN

SEQ ID NO: 77633 - protein, 9 aa, Homo Sapiens
SNITVMFFG

SEQ ID NO: 77634 - protein, 9 aa, Homo Sapiens
PANMTAAVS

SEQ ID NO: 77635 - protein, 9 aa, Homo Sapiens
QGKVKSCSC

SEQ ID NO: 77636 - protein, 9 aa, Homo Sapiens
GDIKDSEKK

SEQ ID NO: 77637 - protein, 9 aa, Homo Sapiens
SYKLASPMK

SEQ ID NO: 77638 - protein, 9 aa, Homo Sapiens
YSNVCMEKS

SEQ ID NO: 77639 - protein, 9 aa, Homo Sapiens
CEIDEAKKK

SEQ ID NO: 77640 - protein, 9 aa, Homo Sapiens
PCYVNVQNL

SEQ ID NO: 77641 - protein, 9 aa, Homo Sapiens
TRACSQGKV

SEQ ID NO: 77642 - protein, 9 aa, Homo Sapiens
PSRAQPLSS

SEQ ID NO: 77643 - protein, 9 aa, Homo Sapiens
FALKYHPDK

SEQ ID NO: 77644 - protein, 9 aa, Homo Sapiens
PSAQIHSYI

SEQ ID NO: 77645 - protein, 9 aa, Homo Sapiens
RKQQGELMK

SEQ ID NO: 77646 - protein, 9 aa, Homo Sapiens
TTWATYLAL

SEQ ID NO: 77647 - protein, 9 aa, Homo Sapiens
PARTHQPAF

SEQ ID NO: 77648 - protein, 9 aa, Homo Sapiens
LGSEPPKTR

SEQ ID NO: 77649 - protein, 9 aa, Homo Sapiens
MHIVEVTED

SEQ ID NO: 77650 - protein, 9 aa, Homo Sapiens
RHIVLLFSG

SEQ ID NO: 77651 - protein, 9 aa, Homo Sapiens
PARGRDCSR

SEQ ID NO: 77652 - protein, 9 aa, Homo Sapiens
VASENETVK

SEQ ID NO: 77653 - protein, 9 aa, Homo Sapiens
RTITTDYYR

SEQ ID NO: 77654 - protein, 9 aa, Homo Sapiens
SVCEGQGLH

SEQ ID NO: 77655 - protein, 9 aa, Homo Sapiens
PLGHPFSQM

SEQ ID NO: 77656 - protein, 9 aa, Homo Sapiens
TLEMDNYEP

SEQ ID NO: 77657 - protein, 9 aa, Homo Sapiens
KLSENTDSL

SEQ ID NO: 77658 - protein, 9 aa, Homo Sapiens
RDKVAIPTD

SEQ ID NO: 77659 - protein, 9 aa, Homo Sapiens
QCLYRKQSS

SEQ ID NO: 77660 - protein, 9 aa, Homo Sapiens
SANTMFQME

SEQ ID NO: 77661 - protein, 9 aa, Homo Sapiens
CLPSCNNRH

SEQ ID NO: 77662 - protein, 9 aa, Homo Sapiens
RNATCSHYT

SEQ ID NO: 77663 - protein, 9 aa, Homo Sapiens
CSQGKVKSC

SEQ ID NO: 77664 - protein, 9 aa, Homo Sapiens
GEPYKVAKY

SEQ ID NO: 77665 - protein, 9 aa, Homo Sapiens
PYNEDLVER

SEQ ID NO: 77666 - protein, 9 aa, Homo Sapiens
NNIEDCKMM

SEQ ID NO: 77667 - protein, 9 aa, Homo Sapiens
GIPQRLTAL

SEQ ID NO: 77668 - protein, 9 aa, Homo Sapiens
LLQLQQQQQ

SEQ ID NO: 77669 - protein, 9 aa, Homo Sapiens
GPPGLTGLP

SEQ ID NO: 77670 - protein, 9 aa, Homo Sapiens
TMMVSTTVG

SEQ ID NO: 77671 - protein, 9 aa, Homo Sapiens
ITHLMIRPN

SEQ ID NO: 77672 - protein, 9 aa, Homo Sapiens
ISMGYKTKL

SEQ ID NO: 77673 - protein, 9 aa, Homo Sapiens
FLQDVRNGI

SEQ ID NO: 77674 - protein, 9 aa, Homo Sapiens
KSYRKFALK

SEQ ID NO: 77675 - protein, 9 aa, Homo Sapiens
MLKASSVFK

SEQ ID NO: 77676 - protein, 9 aa, Homo Sapiens
FSGIPQRLT

SEQ ID NO: 77677 - protein, 9 aa, Homo Sapiens
ALLQKINQV

SEQ ID NO: 77678 - protein, 9 aa, Homo Sapiens
RTSVARTVR

SEQ ID NO: 77679 - protein, 9 aa, Homo Sapiens
QKINQVLLF

SEQ ID NO: 77680 - protein, 9 aa, Homo Sapiens
DCLKKKEDC

SEQ ID NO: 77681 - protein, 9 aa, Homo Sapiens
VLPAPPKGA

SEQ ID NO: 77682 - protein, 9 aa, Homo Sapiens
GRDCSRNSC

SEQ ID NO: 77683 - protein, 9 aa, Homo Sapiens
SKCYMLAAM

SEQ ID NO: 77684 - protein, 9 aa, Homo Sapiens
NNGSITHLM

SEQ ID NO: 77685 - protein, 9 aa, Homo Sapiens
SVLPAPPKG

SEQ ID NO: 77686 - protein, 9 aa, Homo Sapiens
GDSWHIPYN

SEQ ID NO: 77687 - protein, 9 aa, Homo Sapiens
ASRSASPWA

SEQ ID NO: 77688 - protein, 9 aa, Homo Sapiens
PPIPANMTA

SEQ ID NO: 77689 - protein, 9 aa, Homo Sapiens
LFAGTMMVS

SEQ ID NO: 77690 - protein, 9 aa, Homo Sapiens
WHIPYNEDL

SEQ ID NO: 77691 - protein, 9 aa, Homo Sapiens
GTMMVSTTV

SEQ ID NO: 77692 - protein, 9 aa, Homo Sapiens
SCAASRSAS

SEQ ID NO: 77693 - protein, 9 aa, Homo Sapiens
SVARTVRKC

SEQ ID NO: 77694 - protein, 9 aa, Homo Sapiens
VNRRSLSNS

SEQ ID NO: 77695 - protein, 9 aa, Homo Sapiens
LSLSPPFFF

SEQ ID NO: 77696 - protein, 9 aa, Homo Sapiens
TNMLSNKEQ

SEQ ID NO: 77697 - protein, 9 aa, Homo Sapiens
RSLLPGLSC

SEQ ID NO: 77698 - protein, 9 aa, Homo Sapiens
TMDRDKVAI

SEQ ID NO: 77699 - protein, 9 aa, Homo Sapiens
LQKHYSNVC

SEQ ID NO: 77700 - protein, 9 aa, Homo Sapiens
HIPYNEDLV

SEQ ID NO: 77701 - protein, 9 aa, Homo Sapiens
DISEQLISA

SEQ ID NO: 77702 - protein, 9 aa, Homo Sapiens
CQEPEPTSD

SEQ ID NO: 77703 - protein, 9 aa, Homo Sapiens
VTLEMDNYE

SEQ ID NO: 77704 - protein, 9 aa, Homo Sapiens
VSYTLFQVD

SEQ ID NO: 77705 - protein, 9 aa, Homo Sapiens
TWATYLALG

SEQ ID NO: 77706 - protein, 9 aa, Homo Sapiens
PSVLPAPPK

SEQ ID NO: 77707 - protein, 9 aa, Homo Sapiens
PGSSPARTH

SEQ ID NO: 77708 - protein, 9 aa, Homo Sapiens
CSVCEGQGL

SEQ ID NO: 77709 - protein, 9 aa, Homo Sapiens
VEARAFVHK

SEQ ID NO: 77710 - protein, 9 aa, Homo Sapiens
TSIFLFCFP

SEQ ID NO: 77711 - protein, 9 aa, Homo Sapiens
FLFCFPTIP

SEQ ID NO: 77712 - protein, 9 aa, Homo Sapiens
RYRTITTDY

SEQ ID NO: 77713 - protein, 9 aa, Homo Sapiens
KQQGELMKA

SEQ ID NO: 77714 - protein, 9 aa, Homo Sapiens
PPKGATPTS

SEQ ID NO: 77715 - protein, 9 aa, Homo Sapiens
GQCSLKTAC

SEQ ID NO: 77716 - protein, 9 aa, Homo Sapiens
PYLTYKIGW

SEQ ID NO: 77717 - protein, 9 aa, Homo Sapiens
TLGYETLLN

SEQ ID NO: 77718 - protein, 9 aa, Homo Sapiens
NLRKLVASR

SEQ ID NO: 77719 - protein, 9 aa, Homo Sapiens
DIKDSEKKR

SEQ ID NO: 77720 - protein, 9 aa, Homo Sapiens
RELFDDPCY

SEQ ID NO: 77721 - protein, 9 aa, Homo Sapiens
FFGSNDGTV

SEQ ID NO: 77722 - protein, 9 aa, Homo Sapiens
LHKYQPRMH

SEQ ID NO: 77723 - protein, 9 aa, Homo Sapiens
FAAQSRRTS

SEQ ID NO: 77724 - protein, 9 aa, Homo Sapiens
QYPPPNLAF

SEQ ID NO: 77725 - protein, 9 aa, Homo Sapiens
HRHKAALKL

SEQ ID NO: 77726 - protein, 9 aa, Homo Sapiens
LEVNRRSLS

SEQ ID NO: 77727 - protein, 9 aa, Homo Sapiens
VTDMYGNTA

SEQ ID NO: 77728 - protein, 9 aa, Homo Sapiens
AKYTNKGDA

SEQ ID NO: 77729 - protein, 9 aa, Homo Sapiens
SPTMFVDGR

SEQ ID NO: 77730 - protein, 9 aa, Homo Sapiens
TRSPAISAS

SEQ ID NO: 77731 - protein, 9 aa, Homo Sapiens
DIKDCLKKK

SEQ ID NO: 77732 - protein, 9 aa, Homo Sapiens
GPWSQCPVT

SEQ ID NO: 77733 - protein, 9 aa, Homo Sapiens
GRRDAADFM

SEQ ID NO: 77734 - protein, 9 aa, Homo Sapiens
LVANVGSHC

SEQ ID NO: 77735 - protein, 9 aa, Homo Sapiens
EKSTFIEES

SEQ ID NO: 77736 - protein, 9 aa, Homo Sapiens
HKAALKLYK

SEQ ID NO: 77737 - protein, 9 aa, Homo Sapiens
TYKIGWLDS

SEQ ID NO: 77738 - protein, 9 aa, Homo Sapiens
SYGMQGGVE

SEQ ID NO: 77739 - protein, 9 aa, Homo Sapiens
NITVMFFGS

SEQ ID NO: 77740 - protein, 9 aa, Homo Sapiens
ITRACSQGK

SEQ ID NO: 77741 - protein, 9 aa, Homo Sapiens
GVEEVLKTV

SEQ ID NO: 77742 - protein, 9 aa, Homo Sapiens
YGDIKDSEK

SEQ ID NO: 77743 - protein, 9 aa, Homo Sapiens
PIPANMTAA

SEQ ID NO: 77744 - protein, 9 aa, Homo Sapiens
KYQNQKGQQ

SEQ ID NO: 77745 - protein, 9 aa, Homo Sapiens
LNDRSLLPG

SEQ ID NO: 77746 - protein, 9 aa, Homo Sapiens
NERTSVART

SEQ ID NO: 77747 - protein, 9 aa, Homo Sapiens
ITVMFFGSN

SEQ ID NO: 77748 - protein, 9 aa, Homo Sapiens
RAPLVANVG

SEQ ID NO: 77749 - protein, 9 aa, Homo Sapiens
TDMYGNTAL

SEQ ID NO: 77750 - protein, 9 aa, Homo Sapiens
AGTMMVSTT

SEQ ID NO: 77751 - protein, 9 aa, Homo Sapiens
SNNIEDCKM

SEQ ID NO: 77752 - protein, 9 aa, Homo Sapiens
GKVKSCSCD

SEQ ID NO: 77753 - protein, 9 aa, Homo Sapiens
ESDLRRFPR

SEQ ID NO: 77754 - protein, 9 aa, Homo Sapiens
SRILEVNRR

SEQ ID NO: 77755 - protein, 9 aa, Homo Sapiens
GSYKLASPM

SEQ ID NO: 77756 - protein, 9 aa, Homo Sapiens
SGLSIHCPS

SEQ ID NO: 77757 - protein, 9 aa, Homo Sapiens
VCKAYSWTE

SEQ ID NO: 77758 - protein, 9 aa, Homo Sapiens
ILLHTVVTA

SEQ ID NO: 77759 - protein, 9 aa, Homo Sapiens
FIEESPLRI

SEQ ID NO: 77760 - protein, 9 aa, Homo Sapiens
IEDCKMMQV

SEQ ID NO: 77761 - protein, 9 aa, Homo Sapiens
TIQGFQCSP

SEQ ID NO: 77762 - protein, 9 aa, Homo Sapiens
CEALEVITL

SEQ ID NO: 77763 - protein, 9 aa, Homo Sapiens
LEVITLCFA

SEQ ID NO: 77764 - protein, 9 aa, Homo Sapiens
DEKQDEFKR

SEQ ID NO: 77765 - protein, 9 aa, Homo Sapiens
NTDSLAPGV

SEQ ID NO: 77766 - protein, 9 aa, Homo Sapiens
SCLPSCNNR

SEQ ID NO: 77767 - protein, 9 aa, Homo Sapiens
TKLYFQTNP

SEQ ID NO: 77768 - protein, 9 aa, Homo Sapiens
FREKIMYKA

SEQ ID NO: 77769 - protein, 9 aa, Homo Sapiens
VHDMACDTF

SEQ ID NO: 77770 - protein, 9 aa, Homo Sapiens
QLVLNKLRT

SEQ ID NO: 77771 - protein, 9 aa, Homo Sapiens
RFPRVKTTP

SEQ ID NO: 77772 - protein, 9 aa, Homo Sapiens
DSYGMQGGV

SEQ ID NO: 77773 - protein, 9 aa, Homo Sapiens
ADFMLKASS

SEQ ID NO: 77774 - protein, 9 aa, Homo Sapiens
NMLSNKEQL

SEQ ID NO: 77775 - protein, 9 aa, Homo Sapiens
TRQLVITTA

SEQ ID NO: 77776 - protein, 9 aa, Homo Sapiens
CEGQGLHRG

SEQ ID NO: 77777 - protein, 9 aa, Homo Sapiens
STTWATYLA

SEQ ID NO: 77778 - protein, 9 aa, Homo Sapiens
QGISLVTWT

SEQ ID NO: 77779 - protein, 9 aa, Homo Sapiens
HSNITVMFF

SEQ ID NO: 77780 - protein, 9 aa, Homo Sapiens
SYRKFALKY

SEQ ID NO: 77781 - protein, 9 aa, Homo Sapiens
DFMLKASSV

SEQ ID NO: 77782 - protein, 9 aa, Homo Sapiens
LLHTVVTAS

SEQ ID NO: 77783 - protein, 9 aa, Homo Sapiens
SMLSKSTVK

SEQ ID NO: 77784 - protein, 9 aa, Homo Sapiens
ANPNVTDMY

SEQ ID NO: 77785 - protein, 9 aa, Homo Sapiens
VSAVASLLK

SEQ ID NO: 77786 - protein, 9 aa, Homo Sapiens
RRRRAPLVA

SEQ ID NO: 77787 - protein, 9 aa, Homo Sapiens
IFLFCFPTI

SEQ ID NO: 77788 - protein, 9 aa, Homo Sapiens
ERTSVARTV

SEQ ID NO: 77789 - protein, 9 aa, Homo Sapiens
SLKTACQGI

SEQ ID NO: 77790 - protein, 9 aa, Homo Sapiens
TDSLAPGVS

SEQ ID NO: 77791 - protein, 9 aa, Homo Sapiens
KLRTDALIN

SEQ ID NO: 77792 - protein, 9 aa, Homo Sapiens
LTRSPAISA

SEQ ID NO: 77793 - protein, 9 aa, Homo Sapiens
KDEKPEPKQ

SEQ ID NO: 77794 - protein, 9 aa, Homo Sapiens
AVSLTRSPA

SEQ ID NO: 77795 - protein, 9 aa, Homo Sapiens
MLSNKEQLR

SEQ ID NO: 77796 - protein, 9 aa, Homo Sapiens
LDKFLQDVR

SEQ ID NO: 77797 - protein, 9 aa, Homo Sapiens
KTVSAVASL

SEQ ID NO: 77798 - protein, 9 aa, Homo Sapiens
SGAGFNSLE

SEQ ID NO: 77799 - protein, 9 aa, Homo Sapiens
CKAYSWTEK

SEQ ID NO: 77800 - protein, 9 aa, Homo Sapiens
TRRTSSLGS

SEQ ID NO: 77801 - protein, 9 aa, Homo Sapiens
REKSTFIEE

SEQ ID NO: 77802 - protein, 9 aa, Homo Sapiens
ITTAVSLVR

SEQ ID NO: 77803 - protein, 9 aa, Homo Sapiens
LTEQKPDGL

SEQ ID NO: 77804 - protein, 9 aa, Homo Sapiens
GGVEEVLKT

SEQ ID NO: 77805 - protein, 9 aa, Homo Sapiens
LELDKFLQD

SEQ ID NO: 77806 - protein, 9 aa, Homo Sapiens
KVAKYTNKG

SEQ ID NO: 77807 - protein, 9 aa, Homo Sapiens
SVCYSGCFF

SEQ ID NO: 77808 - protein, 9 aa, Homo Sapiens
CEGCRKDLL

SEQ ID NO: 77809 - protein, 9 aa, Homo Sapiens
DIPCRAMFP

SEQ ID NO: 77810 - protein, 9 aa, Homo Sapiens
DEDNDPNDG

SEQ ID NO: 77811 - protein, 9 aa, Homo Sapiens
FDDEDNDPN

SEQ ID NO: 77812 - protein, 9 aa, Homo Sapiens
LSNKEQLRD

SEQ ID NO: 77813 - protein, 9 aa, Homo Sapiens
SLSGLSIHC

SEQ ID NO: 77814 - protein, 9 aa, Homo Sapiens
RTHQPAFLQ

SEQ ID NO: 77815 - protein, 9 aa, Homo Sapiens
LPAPPKGAT

SEQ ID NO: 77816 - protein, 9 aa, Homo Sapiens
EHGANPNVT

SEQ ID NO: 77817 - protein, 9 aa, Homo Sapiens
TAAVSLTRS

SEQ ID NO: 77818 - protein, 9 aa, Homo Sapiens
SRHIVLLFS

SEQ ID NO: 77819 - protein, 9 aa, Homo Sapiens
LSKSTVKRL

SEQ ID NO: 77820 - protein, 9 aa, Homo Sapiens
ECARNATCS

SEQ ID NO: 77821 - protein, 9 aa, Homo Sapiens
LREERKQQG

SEQ ID NO: 77822 - protein, 9 aa, Homo Sapiens
EYFLCEIDE

SEQ ID NO: 77823 - protein, 9 aa, Homo Sapiens
AADFMLKAS

SEQ ID NO: 77824 - protein, 9 aa, Homo Sapiens
FCVCVISKC

SEQ ID NO: 77825 - protein, 9 aa, Homo Sapiens
KTSSVSCVG

SEQ ID NO: 77826 - protein, 9 aa, Homo Sapiens
ARVIHVVTL

SEQ ID NO: 77827 - protein, 9 aa, Homo Sapiens
TQLSGAGFN

SEQ ID NO: 77828 - protein, 9 aa, Homo Sapiens
QELAEACEG

SEQ ID NO: 77829 - protein, 9 aa, Homo Sapiens
DKVAIPTDG

SEQ ID NO: 77830 - protein, 9 aa, Homo Sapiens
TEQKPDGLI

SEQ ID NO: 77831 - protein, 9 aa, Homo Sapiens
GAGFNSLEV

SEQ ID NO: 77832 - protein, 9 aa, Homo Sapiens
LLQKINQVL

SEQ ID NO: 77833 - protein, 9 aa, Homo Sapiens
LYRKQSSKH

SEQ ID NO: 77834 - protein, 9 aa, Homo Sapiens
SGIKPLGHP

SEQ ID NO: 77835 - protein, 9 aa, Homo Sapiens
ATVLTHMVS

SEQ ID NO: 77836 - protein, 9 aa, Homo Sapiens
SPPFFFFSG

SEQ ID NO: 77837 - protein, 9 aa, Homo Sapiens
PYKVAKYTN

SEQ ID NO: 77838 - protein, 9 aa, Homo Sapiens
KYQPRMHIV

SEQ ID NO: 77839 - protein, 9 aa, Homo Sapiens
LQDVRNGIY

SEQ ID NO: 77840 - protein, 9 aa, Homo Sapiens
NGQCSLKTA

SEQ ID NO: 77841 - protein, 9 aa, Homo Sapiens
IMYSENDIS

SEQ ID NO: 77842 - protein, 9 aa, Homo Sapiens
ELAEACEGC

SEQ ID NO: 77843 - protein, 9 aa, Homo Sapiens
DPCYVNVQN

SEQ ID NO: 77844 - protein, 9 aa, Homo Sapiens
RRRAPLVAN

SEQ ID NO: 77845 - protein, 9 aa, Homo Sapiens
GVHDMACDT

SEQ ID NO: 77846 - protein, 9 aa, Homo Sapiens
RHISMGYKT

SEQ ID NO: 77847 - protein, 9 aa, Homo Sapiens
YQPRMHIVE

SEQ ID NO: 77848 - protein, 9 aa, Homo Sapiens
SVETIQGFQ

SEQ ID NO: 77849 - protein, 9 aa, Homo Sapiens
SFAAQSRRT

SEQ ID NO: 77850 - protein, 9 aa, Homo Sapiens
RSNNIEDCK

SEQ ID NO: 77851 - protein, 9 aa, Homo Sapiens
KIHSNQLDN

SEQ ID NO: 77852 - protein, 9 aa, Homo Sapiens
PYDEKQDEF

SEQ ID NO: 77853 - protein, 9 aa, Homo Sapiens
SNLRKLVAS

SEQ ID NO: 77854 - protein, 9 aa, Homo Sapiens
IQCLYRKQS

SEQ ID NO: 77855 - protein, 9 aa, Homo Sapiens
HLTEQKPDG

SEQ ID NO: 77856 - protein, 9 aa, Homo Sapiens
PGLSCVQTA

SEQ ID NO: 77857 - protein, 9 aa, Homo Sapiens
DMRSNNIED

SEQ ID NO: 77858 - protein, 9 aa, Homo Sapiens
SWHIPYNED

SEQ ID NO: 77859 - protein, 9 aa, Homo Sapiens
GMQGGVEEV

SEQ ID NO: 77860 - protein, 9 aa, Homo Sapiens
LFQKTVSAV

SEQ ID NO: 77861 - protein, 9 aa, Homo Sapiens
LKFSGIPQR

SEQ ID NO: 77862 - protein, 9 aa, Homo Sapiens
GSTTWATYL

SEQ ID NO: 77863 - protein, 9 aa, Homo Sapiens
CSLKTACQG

SEQ ID NO: 77864 - protein, 9 aa, Homo Sapiens
KPLGHPFSQ

SEQ ID NO: 77865 - protein, 9 aa, Homo Sapiens
YGLKHLTEQ

SEQ ID NO: 77866 - protein, 9 aa, Homo Sapiens
KNMFSNLRK

SEQ ID NO: 77867 - protein, 9 aa, Homo Sapiens
YPSRAQPLS

SEQ ID NO: 77868 - protein, 9 aa, Homo Sapiens
ASFAAQSRR

SEQ ID NO: 77869 - protein, 9 aa, Homo Sapiens
LTTAQTSGS

SEQ ID NO: 77870 - protein, 9 aa, Homo Sapiens
IKPLGHPFS

SEQ ID NO: 77871 - protein, 9 aa, Homo Sapiens
PPGLTGLPG

SEQ ID NO: 77872 - protein, 9 aa, Homo Sapiens
ERKQQGELM

SEQ ID NO: 77873 - protein, 9 aa, Homo Sapiens
VCVISKCYM

SEQ ID NO: 77874 - protein, 9 aa, Homo Sapiens
ARASFAAQS

SEQ ID NO: 77875 - protein, 9 aa, Homo Sapiens
YKVAKYTNK

SEQ ID NO: 77876 - protein, 9 aa, Homo Sapiens
HGANPNVTD

SEQ ID NO: 77877 - protein, 9 aa, Homo Sapiens
TSIPPIPAN

SEQ ID NO: 77878 - protein, 9 aa, Homo Sapiens
QDVRNGIYP

SEQ ID NO: 77879 - protein, 9 aa, Homo Sapiens
AQELAEACE

SEQ ID NO: 77880 - protein, 9 aa, Homo Sapiens
RRTSIPPIP

SEQ ID NO: 77881 - protein, 9 aa, Homo Sapiens
VPTSIMYSE

SEQ ID NO: 77882 - protein, 9 aa, Homo Sapiens
IEESPLRIK

SEQ ID NO: 77883 - protein, 9 aa, Homo Sapiens
LEKMCRAVE

SEQ ID NO: 77884 - protein, 9 aa, Homo Sapiens
EQGRFGPNK

SEQ ID NO: 77885 - protein, 9 aa, Homo Sapiens
APSRKRRQQ

SEQ ID NO: 77886 - protein, 9 aa, Homo Sapiens
FASYTRLFL

SEQ ID NO: 77887 - protein, 9 aa, Homo Sapiens
AQGLSSKDK

SEQ ID NO: 77888 - protein, 9 aa, Homo Sapiens
AIQAKERLD

SEQ ID NO: 77889 - protein, 9 aa, Homo Sapiens
AKYYLDSLN

SEQ ID NO: 77890 - protein, 9 aa, Homo Sapiens
VKAIEQKNL

SEQ ID NO: 77891 - protein, 9 aa, Homo Sapiens
RNRGNTDRV

SEQ ID NO: 77892 - protein, 9 aa, Homo Sapiens
GKPESNLKE

SEQ ID NO: 77893 - protein, 9 aa, Homo Sapiens
RRQATDDAL

SEQ ID NO: 77894 - protein, 9 aa, Homo Sapiens
TVKTDNFSS

SEQ ID NO: 77895 - protein, 9 aa, Homo Sapiens
FVCTQFKVV

SEQ ID NO: 77896 - protein, 9 aa, Homo Sapiens
QARRQEKLQ

SEQ ID NO: 77897 - protein, 9 aa, Homo Sapiens
VNLFVINAP

SEQ ID NO: 77898 - protein, 9 aa, Homo Sapiens
SHSRRESRH

SEQ ID NO: 77899 - protein, 9 aa, Homo Sapiens
FFPHVLKKE

SEQ ID NO: 77900 - protein, 9 aa, Homo Sapiens
QLVIERLQE

SEQ ID NO: 77901 - protein, 9 aa, Homo Sapiens
LDGGRVKLI

SEQ ID NO: 77902 - protein, 9 aa, Homo Sapiens
HVEVVSQLL

SEQ ID NO: 77903 - protein, 9 aa, Homo Sapiens
NTCFMNCAL

SEQ ID NO: 77904 - protein, 9 aa, Homo Sapiens
LQLGLSHKV

SEQ ID NO: 77905 - protein, 9 aa, Homo Sapiens
QKPRKEKCI

SEQ ID NO: 77906 - protein, 9 aa, Homo Sapiens
YSRKDLHRN

SEQ ID NO: 77907 - protein, 9 aa, Homo Sapiens
AVEDQLSEI

SEQ ID NO: 77908 - protein, 9 aa, Homo Sapiens
EIAEGIVSH

SEQ ID NO: 77909 - protein, 9 aa, Homo Sapiens
ELEAEVAKM

SEQ ID NO: 77910 - protein, 9 aa, Homo Sapiens
SNENLLINE

SEQ ID NO: 77911 - protein, 9 aa, Homo Sapiens
GNINAKATQ

SEQ ID NO: 77912 - protein, 9 aa, Homo Sapiens
PSRKRRQQM

SEQ ID NO: 77913 - protein, 9 aa, Homo Sapiens
RFLTVMIKH

SEQ ID NO: 77914 - protein, 9 aa, Homo Sapiens
SLQLLPWRK

SEQ ID NO: 77915 - protein, 9 aa, Homo Sapiens
EMYEELNEM

SEQ ID NO: 77916 - protein, 9 aa, Homo Sapiens
HVGQMASVN

SEQ ID NO: 77917 - protein, 9 aa, Homo Sapiens
RWKPQLQKL

SEQ ID NO: 77918 - protein, 9 aa, Homo Sapiens
KMIQQEHKR

SEQ ID NO: 77919 - protein, 9 aa, Homo Sapiens
QSSLLSCLS

SEQ ID NO: 77920 - protein, 9 aa, Homo Sapiens
CLPHPKVPR

SEQ ID NO: 77921 - protein, 9 aa, Homo Sapiens
FFSEIEKTR

SEQ ID NO: 77922 - protein, 9 aa, Homo Sapiens
LKNNRCANC

SEQ ID NO: 77923 - protein, 9 aa, Homo Sapiens
YIMWVSVKE

SEQ ID NO: 77924 - protein, 9 aa, Homo Sapiens
RFAQDCEMK

SEQ ID NO: 77925 - protein, 9 aa, Homo Sapiens
QPIGGSFNS

SEQ ID NO: 77926 - protein, 9 aa, Homo Sapiens
QMLHQDELL

SEQ ID NO: 77927 - protein, 9 aa, Homo Sapiens
ILREMYEEL

SEQ ID NO: 77928 - protein, 9 aa, Homo Sapiens
EEILGSHDD

SEQ ID NO: 77929 - protein, 9 aa, Homo Sapiens
TIKPARSEL

SEQ ID NO: 77930 - protein, 9 aa, Homo Sapiens
SHDDEQEDP

SEQ ID NO: 77931 - protein, 9 aa, Homo Sapiens
FSEIEKTRL

SEQ ID NO: 77932 - protein, 9 aa, Homo Sapiens
IAYVLLYLF

SEQ ID NO: 77933 - protein, 9 aa, Homo Sapiens
TLNQEEEKK

SEQ ID NO: 77934 - protein, 9 aa, Homo Sapiens
LACKRDYLI

SEQ ID NO: 77935 - protein, 9 aa, Homo Sapiens
GLWPVKEVG

SEQ ID NO: 77936 - protein, 9 aa, Homo Sapiens
RKQQRVFFL

SEQ ID NO: 77937 - protein, 9 aa, Homo Sapiens
EDNMYSIDF

SEQ ID NO: 77938 - protein, 9 aa, Homo Sapiens
PFQRLAREI

SEQ ID NO: 77939 - protein, 9 aa, Homo Sapiens
PHTDTSEVN

SEQ ID NO: 77940 - protein, 9 aa, Homo Sapiens
LLQRITEIV

SEQ ID NO: 77941 - protein, 9 aa, Homo Sapiens
SAAASLRCL

SEQ ID NO: 77942 - protein, 9 aa, Homo Sapiens
CICRGWYPK

SEQ ID NO: 77943 - protein, 9 aa, Homo Sapiens
IQKAQGPIL

SEQ ID NO: 77944 - protein, 9 aa, Homo Sapiens
LASSNLSHL

SEQ ID NO: 77945 - protein, 9 aa, Homo Sapiens
SMWISPDFL

SEQ ID NO: 77946 - protein, 9 aa, Homo Sapiens
QDREGPSSS

SEQ ID NO: 77947 - protein, 9 aa, Homo Sapiens
QDLPFKRSW

SEQ ID NO: 77948 - protein, 9 aa, Homo Sapiens
PTTSMKIQQ

SEQ ID NO: 77949 - protein, 9 aa, Homo Sapiens
TTCGGGVQY

SEQ ID NO: 77950 - protein, 9 aa, Homo Sapiens
QELSYTKGL

SEQ ID NO: 77951 - protein, 8 aa, Homo Sapiens
GVQGFQEF

SEQ ID NO: 77952 - protein, 9 aa, Homo Sapiens
PPSTFHQAN

SEQ ID NO: 77953 - protein, 9 aa, Homo Sapiens
LLSPVLYVM

SEQ ID NO: 77954 - protein, 9 aa, Homo Sapiens
DFYNKKMDS

SEQ ID NO: 77955 - protein, 9 aa, Homo Sapiens
TCGHMASYP

SEQ ID NO: 77956 - protein, 9 aa, Homo Sapiens
CCFDSFKYV

SEQ ID NO: 77957 - protein, 9 aa, Homo Sapiens
PSRRVRSQK

SEQ ID NO: 77958 - protein, 9 aa, Homo Sapiens
KRQEREDEL

SEQ ID NO: 77959 - protein, 9 aa, Homo Sapiens
SKTSEAAPR

SEQ ID NO: 77960 - protein, 9 aa, Homo Sapiens
IQRTSKPLN

SEQ ID NO: 77961 - protein, 9 aa, Homo Sapiens
VEDQLSEIK

SEQ ID NO: 77962 - protein, 9 aa, Homo Sapiens
RGANDSTLA

SEQ ID NO: 77963 - protein, 9 aa, Homo Sapiens
DRDYFDYST

SEQ ID NO: 77964 - protein, 9 aa, Homo Sapiens
TSSTIRSRS

SEQ ID NO: 77965 - protein, 9 aa, Homo Sapiens
VIAFQGHQG

SEQ ID NO: 77966 - protein, 9 aa, Homo Sapiens
KFFLFLDPL

SEQ ID NO: 77967 - protein, 9 aa, Homo Sapiens
VELNYSFDK

SEQ ID NO: 77968 - protein, 9 aa, Homo Sapiens
SEEKEEKEY

SEQ ID NO: 77969 - protein, 9 aa, Homo Sapiens
NVKAKGYTM

SEQ ID NO: 77970 - protein, 9 aa, Homo Sapiens
KDLHRNKLY

SEQ ID NO: 77971 - protein, 9 aa, Homo Sapiens
SRECAVKAI

SEQ ID NO: 77972 - protein, 9 aa, Homo Sapiens
AQGGKVMEY

SEQ ID NO: 77973 - protein, 9 aa, Homo Sapiens
WASRPKATL

SEQ ID NO: 77974 - protein, 9 aa, Homo Sapiens
AAAGSPTST

SEQ ID NO: 77975 - protein, 9 aa, Homo Sapiens
KIQRGQLLA

SEQ ID NO: 77976 - protein, 9 aa, Homo Sapiens
EKFFPHVLK

SEQ ID NO: 77977 - protein, 9 aa, Homo Sapiens
QIRHMETQA

SEQ ID NO: 77978 - protein, 9 aa, Homo Sapiens
EFFSEIEKT

SEQ ID NO: 77979 - protein, 9 aa, Homo Sapiens
VKSTLEPKG

SEQ ID NO: 77980 - protein, 9 aa, Homo Sapiens
SCCGSVCCD

SEQ ID NO: 77981 - protein, 9 aa, Homo Sapiens
VQWLLDNYQ

SEQ ID NO: 77982 - protein, 9 aa, Homo Sapiens
DEEMWFNKD

SEQ ID NO: 77983 - protein, 9 aa, Homo Sapiens
LEQLCVSKW

SEQ ID NO: 77984 - protein, 9 aa, Homo Sapiens
KKHLDKLSS

SEQ ID NO: 77985 - protein, 9 aa, Homo Sapiens
SLLLYDVRA

SEQ ID NO: 77986 - protein, 9 aa, Homo Sapiens
EIVPQYVSA

SEQ ID NO: 77987 - protein, 9 aa, Homo Sapiens
ILGSHDDEQ

SEQ ID NO: 77988 - protein, 9 aa, Homo Sapiens
NEVPVPPPV

SEQ ID NO: 77989 - protein, 9 aa, Homo Sapiens
RAAYLKKML

SEQ ID NO: 77990 - protein, 9 aa, Homo Sapiens
LQEEKEQKE

SEQ ID NO: 77991 - protein, 9 aa, Homo Sapiens
SKDTDITLL

SEQ ID NO: 77992 - protein, 9 aa, Homo Sapiens
IDFTKEGLS

SEQ ID NO: 77993 - protein, 9 aa, Homo Sapiens
IKKILLNIS

SEQ ID NO: 77994 - protein, 9 aa, Homo Sapiens
IINLYYHPG

SEQ ID NO: 77995 - protein, 9 aa, Homo Sapiens
LLDKTGLRI

SEQ ID NO: 77996 - protein, 9 aa, Homo Sapiens
DINFKIQRG

SEQ ID NO: 77997 - protein, 9 aa, Homo Sapiens
NGQLIPYTS

SEQ ID NO: 77998 - protein, 9 aa, Homo Sapiens
QLLPWRKSS

SEQ ID NO: 77999 - protein, 9 aa, Homo Sapiens
LPFPLPQPA

SEQ ID NO: 78000 - protein, 9 aa, Homo Sapiens
PPPSTFHQA

SEQ ID NO: 78001 - protein, 9 aa, Homo Sapiens
NMYSIDFTR

SEQ ID NO: 78002 - protein, 9 aa, Homo Sapiens
PQLIVVATN

SEQ ID NO: 78003 - protein, 9 aa, Homo Sapiens
IRPQYSNPR

SEQ ID NO: 78004 - protein, 9 aa, Homo Sapiens
IDSADLNGK

SEQ ID NO: 78005 - protein, 9 aa, Homo Sapiens
AISIPEHDK

SEQ ID NO: 78006 - protein, 9 aa, Homo Sapiens
KLCSIQSQN

SEQ ID NO: 78007 - protein, 9 aa, Homo Sapiens
EKMIQQEHK

SEQ ID NO: 78008 - protein, 9 aa, Homo Sapiens
QEHKRQERE

SEQ ID NO: 78009 - protein, 9 aa, Homo Sapiens
VSPKTDEFL

SEQ ID NO: 78010 - protein, 9 aa, Homo Sapiens
VRVQFCPFQ

SEQ ID NO: 78011 - protein, 9 aa, Homo Sapiens
KLEQGRFGP

SEQ ID NO: 78012 - protein, 9 aa, Homo Sapiens
SSEKLSPSV

SEQ ID NO: 78013 - protein, 9 aa, Homo Sapiens
VSTCDENTQ

SEQ ID NO: 78014 - protein, 9 aa, Homo Sapiens
RRQEKLQRR

SEQ ID NO: 78015 - protein, 9 aa, Homo Sapiens
EDKEQMLIL

SEQ ID NO: 78016 - protein, 9 aa, Homo Sapiens
PFPLPQPAL

SEQ ID NO: 78017 - protein, 9 aa, Homo Sapiens
IFAIEKINS

SEQ ID NO: 78018 - protein, 9 aa, Homo Sapiens
SLRVMKVQD

SEQ ID NO: 78019 - protein, 9 aa, Homo Sapiens
LFIMKNLNV

SEQ ID NO: 78020 - protein, 9 aa, Homo Sapiens
LYQLILDCW

SEQ ID NO: 78021 - protein, 9 aa, Homo Sapiens
IKKRDGTPG

SEQ ID NO: 78022 - protein, 9 aa, Homo Sapiens
GNRLHLAFN

SEQ ID NO: 78023 - protein, 9 aa, Homo Sapiens
SEIEKTRLN

SEQ ID NO: 78024 - protein, 9 aa, Homo Sapiens
WIIRNGLVI

SEQ ID NO: 78025 - protein, 9 aa, Homo Sapiens
LDEEELLEQ

SEQ ID NO: 78026 - protein, 9 aa, Homo Sapiens
CFWNGQLIP

SEQ ID NO: 78027 - protein, 9 aa, Homo Sapiens
PYKMMGVLL

SEQ ID NO: 78028 - protein, 9 aa, Homo Sapiens
SKQRQGLDG

SEQ ID NO: 78029 - protein, 9 aa, Homo Sapiens
PKTDEFLDL

SEQ ID NO: 78030 - protein, 9 aa, Homo Sapiens
FSAAASLRC

SEQ ID NO: 78031 - protein, 9 aa, Homo Sapiens
SRIKKLDKL

SEQ ID NO: 78032 - protein, 9 aa, Homo Sapiens
IQFYYSESW

SEQ ID NO: 78033 - protein, 9 aa, Homo Sapiens
LPASHPLFG

SEQ ID NO: 78034 - protein, 9 aa, Homo Sapiens
WTVWLPSMR

SEQ ID NO: 78035 - protein, 9 aa, Homo Sapiens
GLLQVQLKT

SEQ ID NO: 78036 - protein, 9 aa, Homo Sapiens
EELGKDLFH

SEQ ID NO: 78037 - protein, 9 aa, Homo Sapiens
RFLLFMWVL

SEQ ID NO: 78038 - protein, 9 aa, Homo Sapiens
WFNKDEEEE

SEQ ID NO: 78039 - protein, 9 aa, Homo Sapiens
MKGTPEAIA

SEQ ID NO: 78040 - protein, 9 aa, Homo Sapiens
NPSMIPIQK

SEQ ID NO: 78041 - protein, 9 aa, Homo Sapiens
AKMRQMLQS

SEQ ID NO: 78042 - protein, 9 aa, Homo Sapiens
NTDRVARYF

SEQ ID NO: 78043 - protein, 9 aa, Homo Sapiens
MIKHGYIGE

SEQ ID NO: 78044 - protein, 9 aa, Homo Sapiens
LKKYMQKTC

SEQ ID NO: 78045 - protein, 9 aa, Homo Sapiens
LILDCWQKE

SEQ ID NO: 78046 - protein, 9 aa, Homo Sapiens
RAVEDQLSE

SEQ ID NO: 78047 - protein, 9 aa, Homo Sapiens
LQQPDSCLP

SEQ ID NO: 78048 - protein, 9 aa, Homo Sapiens
WQKKKKHRN

SEQ ID NO: 78049 - protein, 9 aa, Homo Sapiens
KEEGIKVFK

SEQ ID NO: 78050 - protein, 9 aa, Homo Sapiens
STLEPKGMD

SEQ ID NO: 78051 - protein, 9 aa, Homo Sapiens
QEKLQRRQE

SEQ ID NO: 78052 - protein, 9 aa, Homo Sapiens
IKHGYIGEF

SEQ ID NO: 78053 - protein, 9 aa, Homo Sapiens
VQLKTRKTC

SEQ ID NO: 78054 - protein, 9 aa, Homo Sapiens
HQDELLAST

SEQ ID NO: 78055 - protein, 9 aa, Homo Sapiens
FSNRSNFNK

SEQ ID NO: 78056 - protein, 9 aa, Homo Sapiens
AYVLLYLFA

SEQ ID NO: 78057 - protein, 9 aa, Homo Sapiens
LKKEKTRPE

SEQ ID NO: 78058 - protein, 9 aa, Homo Sapiens
MADHTEVIK

SEQ ID NO: 78059 - protein, 9 aa, Homo Sapiens
PPGEDKGEY

SEQ ID NO: 78060 - protein, 9 aa, Homo Sapiens
PMIQRTSKP

SEQ ID NO: 78061 - protein, 9 aa, Homo Sapiens
DILQRFLAC

SEQ ID NO: 78062 - protein, 9 aa, Homo Sapiens
KDQVKEVKK

SEQ ID NO: 78063 - protein, 9 aa, Homo Sapiens
ATNGGLPPL

SEQ ID NO: 78064 - protein, 9 aa, Homo Sapiens
QWLLDNYQT

SEQ ID NO: 78065 - protein, 9 aa, Homo Sapiens
KEEEDKNRK

SEQ ID NO: 78066 - protein, 9 aa, Homo Sapiens
NDSTLAMPE

SEQ ID NO: 78067 - protein, 9 aa, Homo Sapiens
PFQKNVEST

SEQ ID NO: 78068 - protein, 9 aa, Homo Sapiens
KKMLLVKAN

SEQ ID NO: 78069 - protein, 9 aa, Homo Sapiens
GEQQPKSAE

SEQ ID NO: 78070 - protein, 9 aa, Homo Sapiens
LDKLSSYHV

SEQ ID NO: 78071 - protein, 9 aa, Homo Sapiens
PSLSNENLL

SEQ ID NO: 78072 - protein, 9 aa, Homo Sapiens
DAHLDRIDS

SEQ ID NO: 78073 - protein, 9 aa, Homo Sapiens
RQFTSTEET

SEQ ID NO: 78074 - protein, 9 aa, Homo Sapiens
VEHHALFRL

SEQ ID NO: 78075 - protein, 9 aa, Homo Sapiens
VECLDDRNT

SEQ ID NO: 78076 - protein, 9 aa, Homo Sapiens
VELSKQCQM

SEQ ID NO: 78077 - protein, 9 aa, Homo Sapiens
AEAKLKNNR

SEQ ID NO: 78078 - protein, 9 aa, Homo Sapiens
KLDSIIDFT

SEQ ID NO: 78079 - protein, 9 aa, Homo Sapiens
SWLSYHVLK

SEQ ID NO: 78080 - protein, 9 aa, Homo Sapiens
RPPEGLVRV

SEQ ID NO: 78081 - protein, 9 aa, Homo Sapiens
ATQAGQTAL

SEQ ID NO: 78082 - protein, 9 aa, Homo Sapiens
DHTEVIKGI

SEQ ID NO: 78083 - protein, 9 aa, Homo Sapiens
IALPSVYQT

SEQ ID NO: 78084 - protein, 9 aa, Homo Sapiens
IQHTNSKKQ

SEQ ID NO: 78085 - protein, 9 aa, Homo Sapiens
KLPLHKKIN

SEQ ID NO: 78086 - protein, 9 aa, Homo Sapiens
PKATLQDFP

SEQ ID NO: 78087 - protein, 9 aa, Homo Sapiens
PKYLIQQEQ

SEQ ID NO: 78088 - protein, 9 aa, Homo Sapiens
KIALPSVYQ

SEQ ID NO: 78089 - protein, 9 aa, Homo Sapiens
RHNQALRLR

SEQ ID NO: 78090 - protein, 9 aa, Homo Sapiens
GFLTPCSNM

SEQ ID NO: 78091 - protein, 9 aa, Homo Sapiens
PVPENHLLL

SEQ ID NO: 78092 - protein, 9 aa, Homo Sapiens
VWLPSMRTC

SEQ ID NO: 78093 - protein, 9 aa, Homo Sapiens
TLEPKGMDK

SEQ ID NO: 78094 - protein, 9 aa, Homo Sapiens
PPPPSTFHQ

SEQ ID NO: 78095 - protein, 9 aa, Homo Sapiens
AFSNRSNFN

SEQ ID NO: 78096 - protein, 9 aa, Homo Sapiens
EVIKGIHQY

SEQ ID NO: 78097 - protein, 9 aa, Homo Sapiens
GMIDDDIFE

SEQ ID NO: 78098 - protein, 9 aa, Homo Sapiens
VNDSRLEEL

SEQ ID NO: 78099 - protein, 9 aa, Homo Sapiens
VVTAEGLWP

SEQ ID NO: 78100 - protein, 9 aa, Homo Sapiens
THVSHSDAE

SEQ ID NO: 78101 - protein, 9 aa, Homo Sapiens
FFRGFVNYV

SEQ ID NO: 78102 - protein, 9 aa, Homo Sapiens
ALCDLLAGM

SEQ ID NO: 78103 - protein, 9 aa, Homo Sapiens
KVQDREGPS

SEQ ID NO: 78104 - protein, 9 aa, Homo Sapiens
KLIVNLDCI

SEQ ID NO: 78105 - protein, 9 aa, Homo Sapiens
FSLFIMKNL

SEQ ID NO: 78106 - protein, 9 aa, Homo Sapiens
PSTFHQANT

SEQ ID NO: 78107 - protein, 9 aa, Homo Sapiens
TLRDFSNLN

SEQ ID NO: 78108 - protein, 9 aa, Homo Sapiens
NINAKATQA

SEQ ID NO: 78109 - protein, 9 aa, Homo Sapiens
LHQDELLAS

SEQ ID NO: 78110 - protein, 9 aa, Homo Sapiens
DEHYTVKTD

SEQ ID NO: 78111 - protein, 9 aa, Homo Sapiens
SVTWNPYKM

SEQ ID NO: 78112 - protein, 9 aa, Homo Sapiens
GQSSLLSCL

SEQ ID NO: 78113 - protein, 9 aa, Homo Sapiens
DSLNRIGAA

SEQ ID NO: 78114 - protein, 9 aa, Homo Sapiens
DPFARSSPT

SEQ ID NO: 78115 - protein, 9 aa, Homo Sapiens
QSDVDFYNK

SEQ ID NO: 78116 - protein, 9 aa, Homo Sapiens
NSWLSYHVL

SEQ ID NO: 78117 - protein, 9 aa, Homo Sapiens
EEKEYEPQP

SEQ ID NO: 78118 - protein, 9 aa, Homo Sapiens
GRVKLIVNL

SEQ ID NO: 78119 - protein, 9 aa, Homo Sapiens
PSVIDGVTV

SEQ ID NO: 78120 - protein, 9 aa, Homo Sapiens
IVSHSRRES

SEQ ID NO: 78121 - protein, 9 aa, Homo Sapiens
VSSYIMWVS

SEQ ID NO: 78122 - protein, 9 aa, Homo Sapiens
SEALPNNMT

SEQ ID NO: 78123 - protein, 9 aa, Homo Sapiens
SIIKKRDGT

SEQ ID NO: 78124 - protein, 9 aa, Homo Sapiens
ATDDALLLI

SEQ ID NO: 78125 - protein, 9 aa, Homo Sapiens
LEPKGMDKI

SEQ ID NO: 78126 - protein, 9 aa, Homo Sapiens
WLPSMRTCC

SEQ ID NO: 78127 - protein, 9 aa, Homo Sapiens
WLLDNYQTA

SEQ ID NO: 78128 - protein, 9 aa, Homo Sapiens
LKMRAIQAK

SEQ ID NO: 78129 - protein, 9 aa, Homo Sapiens
CHSDKFQCQ

SEQ ID NO: 78130 - protein, 9 aa, Homo Sapiens
TLGRIRFKF

SEQ ID NO: 78131 - protein, 9 aa, Homo Sapiens
EKINSSPAL

SEQ ID NO: 78132 - protein, 9 aa, Homo Sapiens
TCCQARTPT

SEQ ID NO: 78133 - protein, 9 aa, Homo Sapiens
EKYGAEVIL

SEQ ID NO: 78134 - protein, 9 aa, Homo Sapiens
DSYQHLQAE

SEQ ID NO: 78135 - protein, 9 aa, Homo Sapiens
EPKGMDKIL

SEQ ID NO: 78136 - protein, 9 aa, Homo Sapiens
SAQLSNEGV

SEQ ID NO: 78137 - protein, 9 aa, Homo Sapiens
KKHRNTNTD

SEQ ID NO: 78138 - protein, 9 aa, Homo Sapiens
KTLQESSFQ

SEQ ID NO: 78139 - protein, 9 aa, Homo Sapiens
NEERLQEEA

SEQ ID NO: 78140 - protein, 9 aa, Homo Sapiens
EVNLFVINA

SEQ ID NO: 78141 - protein, 9 aa, Homo Sapiens
QEEKEQKEN

SEQ ID NO: 78142 - protein, 9 aa, Homo Sapiens
SIQSQNMMM

SEQ ID NO: 78143 - protein, 9 aa, Homo Sapiens
REKSIIDKK

SEQ ID NO: 78144 - protein, 9 aa, Homo Sapiens
NAEASAQLS

SEQ ID NO: 78145 - protein, 9 aa, Homo Sapiens
PESRAHQVL

SEQ ID NO: 78146 - protein, 9 aa, Homo Sapiens
RVLGSSKRL

SEQ ID NO: 78147 - protein, 9 aa, Homo Sapiens
QQMQRNLGT

SEQ ID NO: 78148 - protein, 9 aa, Homo Sapiens
GPLPASHPL

SEQ ID NO: 78149 - protein, 9 aa, Homo Sapiens
NNRCANCFD

SEQ ID NO: 78150 - protein, 9 aa, Homo Sapiens
PFKRSWSVN

SEQ ID NO: 78151 - protein, 9 aa, Homo Sapiens
VSLELLEWI

SEQ ID NO: 78152 - protein, 9 aa, Homo Sapiens
KRLFQNKYF

SEQ ID NO: 78153 - protein, 9 aa, Homo Sapiens
DCEMKKCSD

SEQ ID NO: 78154 - protein, 9 aa, Homo Sapiens
FKDQVKEVK

SEQ ID NO: 78155 - protein, 9 aa, Homo Sapiens
PAKGASLTP

SEQ ID NO: 78156 - protein, 9 aa, Homo Sapiens
NSVTWNPYK

SEQ ID NO: 78157 - protein, 9 aa, Homo Sapiens
EASAQLSNE

SEQ ID NO: 78158 - protein, 9 aa, Homo Sapiens
IPIQKAQGP

SEQ ID NO: 78159 - protein, 9 aa, Homo Sapiens
SPSVIDGVT

SEQ ID NO: 78160 - protein, 9 aa, Homo Sapiens
DSFKYVKTI

SEQ ID NO: 78161 - protein, 9 aa, Homo Sapiens
MPSSSNTKP

SEQ ID NO: 78162 - protein, 9 aa, Homo Sapiens
GPAKGASLT

SEQ ID NO: 78163 - protein, 9 aa, Homo Sapiens
GHQGYLRLP

SEQ ID NO: 78164 - protein, 9 aa, Homo Sapiens
RQATDDALL

SEQ ID NO: 78165 - protein, 9 aa, Homo Sapiens
KTRLNIDKI

SEQ ID NO: 78166 - protein, 9 aa, Homo Sapiens
MIMHTGGRP

SEQ ID NO: 78167 - protein, 9 aa, Homo Sapiens
QRQGLDGLN

SEQ ID NO: 78168 - protein, 9 aa, Homo Sapiens
ALYQLILDC

SEQ ID NO: 78169 - protein, 9 aa, Homo Sapiens
VVATNGGLP

SEQ ID NO: 78170 - protein, 9 aa, Homo Sapiens
KHLDKLSSY

SEQ ID NO: 78171 - protein, 9 aa, Homo Sapiens
LPNNMTLAL

SEQ ID NO: 78172 - protein, 9 aa, Homo Sapiens
QGYLRLPGP

SEQ ID NO: 78173 - protein, 9 aa, Homo Sapiens
SYAFIVEAV

SEQ ID NO: 78174 - protein, 9 aa, Homo Sapiens
QDCQEKERE

SEQ ID NO: 78175 - protein, 9 aa, Homo Sapiens
FQGLMESIR

SEQ ID NO: 78176 - protein, 9 aa, Homo Sapiens
EVILVLQKY

SEQ ID NO: 78177 - protein, 9 aa, Homo Sapiens
LMFKTEDLV

SEQ ID NO: 78178 - protein, 9 aa, Homo Sapiens
IRHVGQMAS

SEQ ID NO: 78179 - protein, 9 aa, Homo Sapiens
LSGPAKGAS

SEQ ID NO: 78180 - protein, 9 aa, Homo Sapiens
EMKLPLHKK

SEQ ID NO: 78181 - protein, 9 aa, Homo Sapiens
QLTTGFEPS

SEQ ID NO: 78182 - protein, 9 aa, Homo Sapiens
SFPDEEIRK

SEQ ID NO: 78183 - protein, 9 aa, Homo Sapiens
GPEERLQRV

SEQ ID NO: 78184 - protein, 9 aa, Homo Sapiens
QGGKVMEYT

SEQ ID NO: 78185 - protein, 9 aa, Homo Sapiens
NRIGAADYQ

SEQ ID NO: 78186 - protein, 9 aa, Homo Sapiens
SGPLILGCG

SEQ ID NO: 78187 - protein, 9 aa, Homo Sapiens
HMIMHTGGR

SEQ ID NO: 78188 - protein, 9 aa, Homo Sapiens
SDVDFYNKK

SEQ ID NO: 78189 - protein, 9 aa, Homo Sapiens
HTGGRPYEC

SEQ ID NO: 78190 - protein, 9 aa, Homo Sapiens
AQIIGGHQV

SEQ ID NO: 78191 - protein, 9 aa, Homo Sapiens
EGLVRVVGR

SEQ ID NO: 78192 - protein, 9 aa, Homo Sapiens
LIRPQYSNP

SEQ ID NO: 78193 - protein, 9 aa, Homo Sapiens
TGFEPSLAS

SEQ ID NO: 78194 - protein, 9 aa, Homo Sapiens
NPRQARQPG

SEQ ID NO: 78195 - protein, 9 aa, Homo Sapiens
IQQEQCAEM

SEQ ID NO: 78196 - protein, 9 aa, Homo Sapiens
QQQQQDCQE

SEQ ID NO: 78197 - protein, 9 aa, Homo Sapiens
RVGMIDDDI

SEQ ID NO: 78198 - protein, 9 aa, Homo Sapiens
TSKPLNCDY

SEQ ID NO: 78199 - protein, 9 aa, Homo Sapiens
DISRECAVK

SEQ ID NO: 78200 - protein, 9 aa, Homo Sapiens
LQSANASVN

SEQ ID NO: 78201 - protein, 9 aa, Homo Sapiens
VCCDQGCGL

SEQ ID NO: 78202 - protein, 9 aa, Homo Sapiens
SHGETGNWH

SEQ ID NO: 78203 - protein, 9 aa, Homo Sapiens
EKLQRRQEQ

SEQ ID NO: 78204 - protein, 9 aa, Homo Sapiens
EGIVSHSRR

SEQ ID NO: 78205 - protein, 9 aa, Homo Sapiens
KLQFIIIEE

SEQ ID NO: 78206 - protein, 9 aa, Homo Sapiens
EEEKKCRYI

SEQ ID NO: 78207 - protein, 9 aa, Homo Sapiens
PEQTTEYLA

SEQ ID NO: 78208 - protein, 9 aa, Homo Sapiens
HLILVCLFA

SEQ ID NO: 78209 - protein, 9 aa, Homo Sapiens
LAFNRQVPR

SEQ ID NO: 78210 - protein, 9 aa, Homo Sapiens
VEAVLRIQS

SEQ ID NO: 78211 - protein, 9 aa, Homo Sapiens
IIDKKFFQL

SEQ ID NO: 78212 - protein, 9 aa, Homo Sapiens
HNIDCHSTD

SEQ ID NO: 78213 - protein, 9 aa, Homo Sapiens
QEEAVFGAD

SEQ ID NO: 78214 - protein, 9 aa, Homo Sapiens
VTLSTTCGH

SEQ ID NO: 78215 - protein, 9 aa, Homo Sapiens
PRAYFMFDT

SEQ ID NO: 78216 - protein, 9 aa, Homo Sapiens
LHLILVCLF

SEQ ID NO: 78217 - protein, 9 aa, Homo Sapiens
RLSLSVTQL

SEQ ID NO: 78218 - protein, 9 aa, Homo Sapiens
KWKEFVMER

SEQ ID NO: 78219 - protein, 9 aa, Homo Sapiens
KMKACYRRF

SEQ ID NO: 78220 - protein, 9 aa, Homo Sapiens
LCLGFLTPC

SEQ ID NO: 78221 - protein, 9 aa, Homo Sapiens
LRKSKQRQG

SEQ ID NO: 78222 - protein, 9 aa, Homo Sapiens
FHCTLYVLL

SEQ ID NO: 78223 - protein, 9 aa, Homo Sapiens
EQTTEYLAM

SEQ ID NO: 78224 - protein, 9 aa, Homo Sapiens
HVLKATDLG

SEQ ID NO: 78225 - protein, 9 aa, Homo Sapiens
RSSPTTSMK

SEQ ID NO: 78226 - protein, 9 aa, Homo Sapiens
ENNAEASAQ

SEQ ID NO: 78227 - protein, 9 aa, Homo Sapiens
ASVKELEKQ

SEQ ID NO: 78228 - protein, 9 aa, Homo Sapiens
KGYTMNVEI

SEQ ID NO: 78229 - protein, 9 aa, Homo Sapiens
RVDRLSLSV

SEQ ID NO: 78230 - protein, 9 aa, Homo Sapiens
TSSFPDEEI

SEQ ID NO: 78231 - protein, 9 aa, Homo Sapiens
LSKQCQMDD

SEQ ID NO: 78232 - protein, 9 aa, Homo Sapiens
GIQEVLMFK

SEQ ID NO: 78233 - protein, 9 aa, Homo Sapiens
WISPDFLCA

SEQ ID NO: 78234 - protein, 9 aa, Homo Sapiens
TNEVPVPPP

SEQ ID NO: 78235 - protein, 9 aa, Homo Sapiens
LGNINAKAT

SEQ ID NO: 78236 - protein, 9 aa, Homo Sapiens
ALLLIVNRY

SEQ ID NO: 78237 - protein, 9 aa, Homo Sapiens
GMCHSDKFQ

SEQ ID NO: 78238 - protein, 9 aa, Homo Sapiens
DLVKSTLEP

SEQ ID NO: 78239 - protein, 9 aa, Homo Sapiens
QERVDRLSL

SEQ ID NO: 78240 - protein, 9 aa, Homo Sapiens
KLKQQMLHQ

SEQ ID NO: 78241 - protein, 9 aa, Homo Sapiens
KERLDMEKR

SEQ ID NO: 78242 - protein, 9 aa, Homo Sapiens
YQHLQAEMQ

SEQ ID NO: 78243 - protein, 9 aa, Homo Sapiens
TIRSRSPPA

SEQ ID NO: 78244 - protein, 9 aa, Homo Sapiens
QRLAREIAQ

SEQ ID NO: 78245 - protein, 9 aa, Homo Sapiens
KNNRCANCF

SEQ ID NO: 78246 - protein, 9 aa, Homo Sapiens
IADFQTTAK

SEQ ID NO: 78247 - protein, 9 aa, Homo Sapiens
SYHVLKATD

SEQ ID NO: 78248 - protein, 9 aa, Homo Sapiens
FNSTTDSAL

SEQ ID NO: 78249 - protein, 9 aa, Homo Sapiens
LVLQKYSEW

SEQ ID NO: 78250 - protein, 9 aa, Homo Sapiens
VEDDVQRIV

SEQ ID NO: 78251 - protein, 9 aa, Homo Sapiens
TLKIALPSV

SEQ ID NO: 78252 - protein, 9 aa, Homo Sapiens
KMRQMLQSE

SEQ ID NO: 78253 - protein, 9 aa, Homo Sapiens
SGQGLDGAV

SEQ ID NO: 78254 - protein, 9 aa, Homo Sapiens
EKLCSIQSQ

SEQ ID NO: 78255 - protein, 9 aa, Homo Sapiens
PRMVSGHYI

SEQ ID NO: 78256 - protein, 9 aa, Homo Sapiens
REMYEELNE

SEQ ID NO: 78257 - protein, 9 aa, Homo Sapiens
KKYMQKTCS

SEQ ID NO: 78258 - protein, 9 aa, Homo Sapiens
QVVLEEGTR

SEQ ID NO: 78259 - protein, 9 aa, Homo Sapiens
YQPYGRKQQ

SEQ ID NO: 78260 - protein, 9 aa, Homo Sapiens
KEIRVGMID

SEQ ID NO: 78261 - protein, 9 aa, Homo Sapiens
MRTCCQART

SEQ ID NO: 78262 - protein, 9 aa, Homo Sapiens
VPENHLLLI

SEQ ID NO: 78263 - protein, 9 aa, Homo Sapiens
PRPSLSNEN

SEQ ID NO: 78264 - protein, 9 aa, Homo Sapiens
QLLLDRQCQ

SEQ ID NO: 78265 - protein, 9 aa, Homo Sapiens
YQSLLRGAD

SEQ ID NO: 78266 - protein, 9 aa, Homo Sapiens
AMALGNHQF

SEQ ID NO: 78267 - protein, 9 aa, Homo Sapiens
KEFVMERQR

SEQ ID NO: 78268 - protein, 9 aa, Homo Sapiens
KKCGIQHTN

SEQ ID NO: 78269 - protein, 9 aa, Homo Sapiens
YPHIESHPV

SEQ ID NO: 78270 - protein, 9 aa, Homo Sapiens
GRMSMKQVD

SEQ ID NO: 78271 - protein, 9 aa, Homo Sapiens
DQLSRNRGN

SEQ ID NO: 78272 - protein, 9 aa, Homo Sapiens
EKTRLNIDK

SEQ ID NO: 78273 - protein, 9 aa, Homo Sapiens
PTSYGGKYS

SEQ ID NO: 78274 - protein, 9 aa, Homo Sapiens
LALIALRIE

SEQ ID NO: 78275 - protein, 9 aa, Homo Sapiens
AVTNEERLQ

SEQ ID NO: 78276 - protein, 9 aa, Homo Sapiens
INFKIQRGQ

SEQ ID NO: 78277 - protein, 9 aa, Homo Sapiens
YYHPGCGGT

SEQ ID NO: 78278 - protein, 9 aa, Homo Sapiens
FVNYVKVRN

SEQ ID NO: 78279 - protein, 9 aa, Homo Sapiens
IVNLDCIRI

SEQ ID NO: 78280 - protein, 9 aa, Homo Sapiens
VLKATDLGL

SEQ ID NO: 78281 - protein, 9 aa, Homo Sapiens
PCSKTSEAA

SEQ ID NO: 78282 - protein, 9 aa, Homo Sapiens
IFECFWNGQ

SEQ ID NO: 78283 - protein, 9 aa, Homo Sapiens
ARMQLLHSG

SEQ ID NO: 78284 - protein, 9 aa, Homo Sapiens
AENIKCCKC

SEQ ID NO: 78285 - protein, 9 aa, Homo Sapiens
SSFPDEEIR

SEQ ID NO: 78286 - protein, 9 aa, Homo Sapiens
LREMYEELN

SEQ ID NO: 78287 - protein, 9 aa, Homo Sapiens
ALFRLRGPV

SEQ ID NO: 78288 - protein, 9 aa, Homo Sapiens
AVELSKQCQ

SEQ ID NO: 78289 - protein, 9 aa, Homo Sapiens
KRRLQKMDM

SEQ ID NO: 78290 - protein, 9 aa, Homo Sapiens
VQRIVDKAV

SEQ ID NO: 78291 - protein, 9 aa, Homo Sapiens
EKMCRAVED

SEQ ID NO: 78292 - protein, 9 aa, Homo Sapiens
TGQGSLLLY

SEQ ID NO: 78293 - protein, 9 aa, Homo Sapiens
FDFVELNYS

SEQ ID NO: 78294 - protein, 9 aa, Homo Sapiens
TIHNIDCHS

SEQ ID NO: 78295 - protein, 9 aa, Homo Sapiens
GILKSIIKK

SEQ ID NO: 78296 - protein, 9 aa, Homo Sapiens
KFQCQEDGI

SEQ ID NO: 78297 - protein, 9 aa, Homo Sapiens
LAMASLAGG

SEQ ID NO: 78298 - protein, 9 aa, Homo Sapiens
EEGSGPLIL

SEQ ID NO: 78299 - protein, 9 aa, Homo Sapiens
TEVIKGIHQ

SEQ ID NO: 78300 - protein, 9 aa, Homo Sapiens
TLMAVELSK

SEQ ID NO: 78301 - protein, 9 aa, Homo Sapiens
GSHDDEQED

SEQ ID NO: 78302 - protein, 9 aa, Homo Sapiens
GIRLECICR

SEQ ID NO: 78303 - protein, 9 aa, Homo Sapiens
LCAHALAAL

SEQ ID NO: 78304 - protein, 9 aa, Homo Sapiens
LSVSRLKRR

SEQ ID NO: 78305 - protein, 9 aa, Homo Sapiens
CGSVCCDQG

SEQ ID NO: 78306 - protein, 9 aa, Homo Sapiens
KDLFHCTLY

SEQ ID NO: 78307 - protein, 9 aa, Homo Sapiens
CLGFLTPCS

SEQ ID NO: 78308 - protein, 9 aa, Homo Sapiens
IERLQEEKE

SEQ ID NO: 78309 - protein, 9 aa, Homo Sapiens
WQELSYTKG

SEQ ID NO: 78310 - protein, 9 aa, Homo Sapiens
AHQVLPGHS

SEQ ID NO: 78311 - protein, 9 aa, Homo Sapiens
HTEVIKGIH

SEQ ID NO: 78312 - protein, 9 aa, Homo Sapiens
CDQGCGLEN

SEQ ID NO: 78313 - protein, 9 aa, Homo Sapiens
QLLQREANV

SEQ ID NO: 78314 - protein, 9 aa, Homo Sapiens
FLNILALIA

SEQ ID NO: 78315 - protein, 9 aa, Homo Sapiens
ECICRGWYP

SEQ ID NO: 78316 - protein, 9 aa, Homo Sapiens
REILREMYE

SEQ ID NO: 78317 - protein, 9 aa, Homo Sapiens
FYNKKMDSI

SEQ ID NO: 78318 - protein, 9 aa, Homo Sapiens
NRGFSLFIM

SEQ ID NO: 78319 - protein, 9 aa, Homo Sapiens
FLFLDPLRT

SEQ ID NO: 78320 - protein, 9 aa, Homo Sapiens
SVSRLKRRP

SEQ ID NO: 78321 - protein, 9 aa, Homo Sapiens
GNPPQRSKS

SEQ ID NO: 78322 - protein, 9 aa, Homo Sapiens
PGTLGRIRF

SEQ ID NO: 78323 - protein, 9 aa, Homo Sapiens
GCPLADNSL

SEQ ID NO: 78324 - protein, 9 aa, Homo Sapiens
LDSLNRIGA

SEQ ID NO: 78325 - protein, 9 aa, Homo Sapiens
SPFLNILAL

SEQ ID NO: 78326 - protein, 9 aa, Homo Sapiens
MIPIQKAQG

SEQ ID NO: 78327 - protein, 9 aa, Homo Sapiens
LEAEVAKMR

SEQ ID NO: 78328 - protein, 9 aa, Homo Sapiens
LFALSHHSP

SEQ ID NO: 78329 - protein, 9 aa, Homo Sapiens
LSYTKGLSL

SEQ ID NO: 78330 - protein, 9 aa, Homo Sapiens
RRFMSMNDL

SEQ ID NO: 78331 - protein, 9 aa, Homo Sapiens
PLADNSLRN

SEQ ID NO: 78332 - protein, 9 aa, Homo Sapiens
MLHQDELLA

SEQ ID NO: 78333 - protein, 9 aa, Homo Sapiens
IVEAVLRIQ

SEQ ID NO: 78334 - protein, 9 aa, Homo Sapiens
GETGNWHSD

SEQ ID NO: 78335 - protein, 9 aa, Homo Sapiens
MAVELSKQC

SEQ ID NO: 78336 - protein, 9 aa, Homo Sapiens
FLTSSTIRS

SEQ ID NO: 78337 - protein, 9 aa, Homo Sapiens
WKFQTCHST

SEQ ID NO: 78338 - protein, 9 aa, Homo Sapiens
TSYGGKYSV

SEQ ID NO: 78339 - protein, 9 aa, Homo Sapiens
SSTSFDFVE

SEQ ID NO: 78340 - protein, 9 aa, Homo Sapiens
IHEKWKEFV

SEQ ID NO: 78341 - protein, 9 aa, Homo Sapiens
QAASVKELE

SEQ ID NO: 78342 - protein, 9 aa, Homo Sapiens
LIVNLDCIR

SEQ ID NO: 78343 - protein, 9 aa, Homo Sapiens
CYRRFMSMN

SEQ ID NO: 78344 - protein, 9 aa, Homo Sapiens
NRGNTDRVA

SEQ ID NO: 78345 - protein, 9 aa, Homo Sapiens
SFKYVKTIR

SEQ ID NO: 78346 - protein, 9 aa, Homo Sapiens
ELSYTKGLS

SEQ ID NO: 78347 - protein, 9 aa, Homo Sapiens
VLKKEKTRP

SEQ ID NO: 78348 - protein, 9 aa, Homo Sapiens
EEMWFNKDE

SEQ ID NO: 78349 - protein, 9 aa, Homo Sapiens
PEERLQRVA

SEQ ID NO: 78350 - protein, 9 aa, Homo Sapiens
GSSLVSSSL

SEQ ID NO: 78351 - protein, 9 aa, Homo Sapiens
VMKVQDREG

SEQ ID NO: 78352 - protein, 9 aa, Homo Sapiens
SAEAKLKNN

SEQ ID NO: 78353 - protein, 9 aa, Homo Sapiens
TDITLLNTQ

SEQ ID NO: 78354 - protein, 9 aa, Homo Sapiens
RFMSMNDLV

SEQ ID NO: 78355 - protein, 9 aa, Homo Sapiens
AKERLDMEK

SEQ ID NO: 78356 - protein, 9 aa, Homo Sapiens
RDGKEPKPS

SEQ ID NO: 78357 - protein, 9 aa, Homo Sapiens
PEHDKADEI

SEQ ID NO: 78358 - protein, 9 aa, Homo Sapiens
LTTGFEPSL

SEQ ID NO: 78359 - protein, 9 aa, Homo Sapiens
LLQVQLKTR

SEQ ID NO: 78360 - protein, 9 aa, Homo Sapiens
FKFSNNAKY

SEQ ID NO: 78361 - protein, 9 aa, Homo Sapiens
CCDQGCGLE

SEQ ID NO: 78362 - protein, 9 aa, Homo Sapiens
AWSGCQVVL

SEQ ID NO: 78363 - protein, 9 aa, Homo Sapiens
NFDVKAVMK

SEQ ID NO: 78364 - protein, 9 aa, Homo Sapiens
PREKSIIDK

SEQ ID NO: 78365 - protein, 9 aa, Homo Sapiens
LLIWSVGAS

SEQ ID NO: 78366 - protein, 9 aa, Homo Sapiens
SGHYIPAIR

SEQ ID NO: 78367 - protein, 9 aa, Homo Sapiens
VTLGEQNRK

SEQ ID NO: 78368 - protein, 9 aa, Homo Sapiens
GKTEGDVHT

SEQ ID NO: 78369 - protein, 9 aa, Homo Sapiens
LHRFLLFMW

SEQ ID NO: 78370 - protein, 9 aa, Homo Sapiens
LYYHPGCGG

SEQ ID NO: 78371 - protein, 9 aa, Homo Sapiens
IIAYVLLYL

SEQ ID NO: 78372 - protein, 9 aa, Homo Sapiens
GKVMEYTTI

SEQ ID NO: 78373 - protein, 9 aa, Homo Sapiens
FPHVLKKEK

SEQ ID NO: 78374 - protein, 9 aa, Homo Sapiens
TSEVNLFVI

SEQ ID NO: 78375 - protein, 9 aa, Homo Sapiens
IRHMETQAK

SEQ ID NO: 78376 - protein, 9 aa, Homo Sapiens
ASAQLSNEG

SEQ ID NO: 78377 - protein, 9 aa, Homo Sapiens
TPSSCLQQP

SEQ ID NO: 78378 - protein, 9 aa, Homo Sapiens
KQCQMDDCG

SEQ ID NO: 78379 - protein, 9 aa, Homo Sapiens
QPYGRKQQR

SEQ ID NO: 78380 - protein, 9 aa, Homo Sapiens
VCLFALSHH

SEQ ID NO: 78381 - protein, 9 aa, Homo Sapiens
KSSLDGLGG

SEQ ID NO: 78382 - protein, 9 aa, Homo Sapiens
FQRLAREIA

SEQ ID NO: 78383 - protein, 9 aa, Homo Sapiens
SLTKGTNEV

SEQ ID NO: 78384 - protein, 9 aa, Homo Sapiens
ESDKEVAGK

SEQ ID NO: 78385 - protein, 9 aa, Homo Sapiens
MIDDDIFEE

SEQ ID NO: 78386 - protein, 9 aa, Homo Sapiens
MYSIDFTRF

SEQ ID NO: 78387 - protein, 9 aa, Homo Sapiens
MVAGKPESN

SEQ ID NO: 78388 - protein, 9 aa, Homo Sapiens
LELEAEVAK

SEQ ID NO: 78389 - protein, 9 aa, Homo Sapiens
HRREILREM

SEQ ID NO: 78390 - protein, 9 aa, Homo Sapiens
SQLDTLEDK

SEQ ID NO: 78391 - protein, 9 aa, Homo Sapiens
VCTQFKVVR

SEQ ID NO: 78392 - protein, 9 aa, Homo Sapiens
PSQLPLSVS

SEQ ID NO: 78393 - protein, 9 aa, Homo Sapiens
VKELEKQIE

SEQ ID NO: 78394 - protein, 9 aa, Homo Sapiens
EIEKTRLNI

SEQ ID NO: 78395 - protein, 9 aa, Homo Sapiens
RALSRFRHR

SEQ ID NO: 78396 - protein, 9 aa, Homo Sapiens
RLSTVRAAY

SEQ ID NO: 78397 - protein, 9 aa, Homo Sapiens
RKFFLFLDP

SEQ ID NO: 78398 - protein, 9 aa, Homo Sapiens
FKYVKTIRQ

SEQ ID NO: 78399 - protein, 9 aa, Homo Sapiens
HSRRESRHL

SEQ ID NO: 78400 - protein, 9 aa, Homo Sapiens
TLLNTQEPM

SEQ ID NO: 78401 - protein, 9 aa, Homo Sapiens
RGGGVYSAG

SEQ ID NO: 78402 - protein, 9 aa, Homo Sapiens
LSVLQRLKD

SEQ ID NO: 78403 - protein, 9 aa, Homo Sapiens
LILVCLFAL

SEQ ID NO: 78404 - protein, 9 aa, Homo Sapiens
NTKPVLSSL

SEQ ID NO: 78405 - protein, 9 aa, Homo Sapiens
LSSYHVKTA

SEQ ID NO: 78406 - protein, 9 aa, Homo Sapiens
QGDLLFFEK

SEQ ID NO: 78407 - protein, 9 aa, Homo Sapiens
STTCGGGVQ

SEQ ID NO: 78408 - protein, 9 aa, Homo Sapiens
KTGLRITVL

SEQ ID NO: 78409 - protein, 9 aa, Homo Sapiens
FAENIKCCK

SEQ ID NO: 78410 - protein, 9 aa, Homo Sapiens
LLTSSFPDE

SEQ ID NO: 78411 - protein, 9 aa, Homo Sapiens
RRLQKMDMM

SEQ ID NO: 78412 - protein, 9 aa, Homo Sapiens
LSCLSKLLG

SEQ ID NO: 78413 - protein, 9 aa, Homo Sapiens
IHNIDCHST

SEQ ID NO: 78414 - protein, 9 aa, Homo Sapiens
FLTPCSNMV

SEQ ID NO: 78415 - protein, 9 aa, Homo Sapiens
TEYLAMASL

SEQ ID NO: 78416 - protein, 9 aa, Homo Sapiens
KTDEHYTVK

SEQ ID NO: 78417 - protein, 9 aa, Homo Sapiens
KPQLQKLLK

SEQ ID NO: 78418 - protein, 9 aa, Homo Sapiens
LKPRPPEGL

SEQ ID NO: 78419 - protein, 9 aa, Homo Sapiens
SSPGIGKVS

SEQ ID NO: 78420 - protein, 9 aa, Homo Sapiens
LTSSFPDEE

SEQ ID NO: 78421 - protein, 9 aa, Homo Sapiens
NDLIDRALS

SEQ ID NO: 78422 - protein, 9 aa, Homo Sapiens
EEIRKVAVQ

SEQ ID NO: 78423 - protein, 9 aa, Homo Sapiens
IIGGHQVTP

SEQ ID NO: 78424 - protein, 9 aa, Homo Sapiens
GNTCFMNCA

SEQ ID NO: 78425 - protein, 9 aa, Homo Sapiens
SGPAKGASL

SEQ ID NO: 78426 - protein, 9 aa, Homo Sapiens
WGPWGDCST

SEQ ID NO: 78427 - protein, 9 aa, Homo Sapiens
ILVCLFALS

SEQ ID NO: 78428 - protein, 9 aa, Homo Sapiens
DKEQMLILE

SEQ ID NO: 78429 - protein, 9 aa, Homo Sapiens
SRPPLQGDL

SEQ ID NO: 78430 - protein, 9 aa, Homo Sapiens
ALPSVYQTL

SEQ ID NO: 78431 - protein, 9 aa, Homo Sapiens
PEDNMYSID

SEQ ID NO: 78432 - protein, 9 aa, Homo Sapiens
HMASYPLTL

SEQ ID NO: 78433 - protein, 9 aa, Homo Sapiens
FQDIMATRS

SEQ ID NO: 78434 - protein, 9 aa, Homo Sapiens
AEASAQLSN

SEQ ID NO: 78435 - protein, 9 aa, Homo Sapiens
AGSDNESDK

SEQ ID NO: 78436 - protein, 9 aa, Homo Sapiens
RKRRQQMQR

SEQ ID NO: 78437 - protein, 9 aa, Homo Sapiens
SDLLSPVLY

SEQ ID NO: 78438 - protein, 9 aa, Homo Sapiens
SRCWQGCAE

SEQ ID NO: 78439 - protein, 9 aa, Homo Sapiens
GDLVKSTLE

SEQ ID NO: 78440 - protein, 9 aa, Homo Sapiens
DLPFPLPQP

SEQ ID NO: 78441 - protein, 9 aa, Homo Sapiens
NNAEASAQL

SEQ ID NO: 78442 - protein, 9 aa, Homo Sapiens
HDKADEISD

SEQ ID NO: 78443 - protein, 9 aa, Homo Sapiens
PVIAFQGHQ

SEQ ID NO: 78444 - protein, 9 aa, Homo Sapiens
FMFDTREEK

SEQ ID NO: 78445 - protein, 9 aa, Homo Sapiens
LPGPLPASH

SEQ ID NO: 78446 - protein, 9 aa, Homo Sapiens
VNYVKVRNM

SEQ ID NO: 78447 - protein, 9 aa, Homo Sapiens
KFFPHVLKK

SEQ ID NO: 78448 - protein, 9 aa, Homo Sapiens
REPRPSLSN

SEQ ID NO: 78449 - protein, 9 aa, Homo Sapiens
IIKKRDGTP

SEQ ID NO: 78450 - protein, 9 aa, Homo Sapiens
DPQSVSQDS

SEQ ID NO: 78451 - protein, 9 aa, Homo Sapiens
GGGVYSAGK

SEQ ID NO: 78452 - protein, 9 aa, Homo Sapiens
TTGFEPSLA

SEQ ID NO: 78453 - protein, 9 aa, Homo Sapiens
PQLCAHALA

SEQ ID NO: 78454 - protein, 9 aa, Homo Sapiens
NFKIQRGQL

SEQ ID NO: 78455 - protein, 9 aa, Homo Sapiens
LSRFRHREV

SEQ ID NO: 78456 - protein, 9 aa, Homo Sapiens
GSSKRLFQN

SEQ ID NO: 78457 - protein, 9 aa, Homo Sapiens
EAEAAAGSP

SEQ ID NO: 78458 - protein, 9 aa, Homo Sapiens
KSSTSFDFV

SEQ ID NO: 78459 - protein, 9 aa, Homo Sapiens
GCQVVLEEG

SEQ ID NO: 78460 - protein, 9 aa, Homo Sapiens
KVRLSVLQR

SEQ ID NO: 78461 - protein, 9 aa, Homo Sapiens
DRALSRFRH

SEQ ID NO: 78462 - protein, 9 aa, Homo Sapiens
ERVDRLSLS

SEQ ID NO: 78463 - protein, 9 aa, Homo Sapiens
TQKEIRVGM

SEQ ID NO: 78464 - protein, 9 aa, Homo Sapiens
TGNWHSDSP

SEQ ID NO: 78465 - protein, 9 aa, Homo Sapiens
AYTIIGFEH

SEQ ID NO: 78466 - protein, 9 aa, Homo Sapiens
DSTLAMPEQ

SEQ ID NO: 78467 - protein, 9 aa, Homo Sapiens
LKKYRKEND

SEQ ID NO: 78468 - protein, 9 aa, Homo Sapiens
RAPSLFASY

SEQ ID NO: 78469 - protein, 9 aa, Homo Sapiens
KKFFQLSEM

SEQ ID NO: 78470 - protein, 9 aa, Homo Sapiens
SNMPSSSNT

SEQ ID NO: 78471 - protein, 9 aa, Homo Sapiens
QVDEQMLAI

SEQ ID NO: 78472 - protein, 9 aa, Homo Sapiens
QCAEMKSTE

SEQ ID NO: 78473 - protein, 9 aa, Homo Sapiens
NIDCHSTDN

SEQ ID NO: 78474 - protein, 9 aa, Homo Sapiens
EGEGEGKTE

SEQ ID NO: 78475 - protein, 9 aa, Homo Sapiens
GHATSVPVT

SEQ ID NO: 78476 - protein, 9 aa, Homo Sapiens
KVSGLDFEE

SEQ ID NO: 78477 - protein, 9 aa, Homo Sapiens
STFHQANTE

SEQ ID NO: 78478 - protein, 9 aa, Homo Sapiens
AKATQAGQT

SEQ ID NO: 78479 - protein, 9 aa, Homo Sapiens
SITHVSHSD

SEQ ID NO: 78480 - protein, 9 aa, Homo Sapiens
LAREIAQDF

SEQ ID NO: 78481 - protein, 9 aa, Homo Sapiens
HVLKKEKTR

SEQ ID NO: 78482 - protein, 9 aa, Homo Sapiens
SGCQVVLEE

SEQ ID NO: 78483 - protein, 9 aa, Homo Sapiens
NQEEEKKCR

SEQ ID NO: 78484 - protein, 9 aa, Homo Sapiens
QGSLLLYDV

SEQ ID NO: 78485 - protein, 9 aa, Homo Sapiens
QQEHKRQER

SEQ ID NO: 78486 - protein, 9 aa, Homo Sapiens
SLFIMKNLN

SEQ ID NO: 78487 - protein, 9 aa, Homo Sapiens
EEKEEKEYE

SEQ ID NO: 78488 - protein, 9 aa, Homo Sapiens
RSQKPTVGP

SEQ ID NO: 78489 - protein, 9 aa, Homo Sapiens
LKSIIKKRD

SEQ ID NO: 78490 - protein, 9 aa, Homo Sapiens
IVSSYIMWV

SEQ ID NO: 78491 - protein, 9 aa, Homo Sapiens
LLSCLSKLL

SEQ ID NO: 78492 - protein, 9 aa, Homo Sapiens
MHTGGRPYE

SEQ ID NO: 78493 - protein, 9 aa, Homo Sapiens
GLIRPQYSN

SEQ ID NO: 78494 - protein, 9 aa, Homo Sapiens
NYVKVRNMS

SEQ ID NO: 78495 - protein, 9 aa, Homo Sapiens
YGRKQQRVF

SEQ ID NO: 78496 - protein, 9 aa, Homo Sapiens
KRLKRRLQK

SEQ ID NO: 78497 - protein, 9 aa, Homo Sapiens
FPLPQPALA

SEQ ID NO: 78498 - protein, 9 aa, Homo Sapiens
SDKFQCQED

SEQ ID NO: 78499 - protein, 9 aa, Homo Sapiens
AFNRQVPRE

SEQ ID NO: 78500 - protein, 9 aa, Homo Sapiens
VRSRPPLQG

SEQ ID NO: 78501 - protein, 9 aa, Homo Sapiens
RGFVNYVKV

SEQ ID NO: 78502 - protein, 9 aa, Homo Sapiens
KHRNTNTDS

SEQ ID NO: 78503 - protein, 9 aa, Homo Sapiens
TFLHKDGGL

SEQ ID NO: 78504 - protein, 9 aa, Homo Sapiens
RGFSLFIMK

SEQ ID NO: 78505 - protein, 9 aa, Homo Sapiens
IKVFKDQVK

SEQ ID NO: 78506 - protein, 9 aa, Homo Sapiens
IGKVSGLDF

SEQ ID NO: 78507 - protein, 9 aa, Homo Sapiens
DFTKEGLSN

SEQ ID NO: 78508 - protein, 9 aa, Homo Sapiens
ESSFQDIMA

SEQ ID NO: 78509 - protein, 9 aa, Homo Sapiens
NLRVECLDD

SEQ ID NO: 78510 - protein, 9 aa, Homo Sapiens
SYIMWVSVK

SEQ ID NO: 78511 - protein, 9 aa, Homo Sapiens
AHQTPLPSK

SEQ ID NO: 78512 - protein, 9 aa, Homo Sapiens
IAEGIVSHS

SEQ ID NO: 78513 - protein, 9 aa, Homo Sapiens
RLQRVAERV

SEQ ID NO: 78514 - protein, 9 aa, Homo Sapiens
LDTLEDKEQ

SEQ ID NO: 78515 - protein, 9 aa, Homo Sapiens
LRAQGGKVM

SEQ ID NO: 78516 - protein, 9 aa, Homo Sapiens
VRGGGVYSA

SEQ ID NO: 78517 - protein, 9 aa, Homo Sapiens
QKISTQNRQ

SEQ ID NO: 78518 - protein, 9 aa, Homo Sapiens
SVDRPTFLH

SEQ ID NO: 78519 - protein, 9 aa, Homo Sapiens
SPEAALGVS

SEQ ID NO: 78520 - protein, 9 aa, Homo Sapiens
EVTLRDFSN

SEQ ID NO: 78521 - protein, 9 aa, Homo Sapiens
TNGGLPPLA

SEQ ID NO: 78522 - protein, 9 aa, Homo Sapiens
QLIPYTSVE

SEQ ID NO: 78523 - protein, 9 aa, Homo Sapiens
HDDEQEDPN

SEQ ID NO: 78524 - protein, 9 aa, Homo Sapiens
DEFFSEIEK

SEQ ID NO: 78525 - protein, 9 aa, Homo Sapiens
KRKLEQGRF

SEQ ID NO: 78526 - protein, 9 aa, Homo Sapiens
AEGIVSHSR

SEQ ID NO: 78527 - protein, 9 aa, Homo Sapiens
NQHAYPTSY

SEQ ID NO: 78528 - protein, 9 aa, Homo Sapiens
SRAPSLFAS

SEQ ID NO: 78529 - protein, 9 aa, Homo Sapiens
NLYYHPGCG

SEQ ID NO: 78530 - protein, 9 aa, Homo Sapiens
NLNKQDIRY

SEQ ID NO: 78531 - protein, 9 aa, Homo Sapiens
EQNRKKLQK

SEQ ID NO: 78532 - protein, 9 aa, Homo Sapiens
VKKCGIQHT

SEQ ID NO: 78533 - protein, 9 aa, Homo Sapiens
AAQPIGGSF

SEQ ID NO: 78534 - protein, 9 aa, Homo Sapiens
VTLNVKAKG

SEQ ID NO: 78535 - protein, 9 aa, Homo Sapiens
SNRSNFNKH

SEQ ID NO: 78536 - protein, 9 aa, Homo Sapiens
LQGDLLFFE

SEQ ID NO: 78537 - protein, 9 aa, Homo Sapiens
DLPFKRSWS

SEQ ID NO: 78538 - protein, 9 aa, Homo Sapiens
EGEGKTEGD

SEQ ID NO: 78539 - protein, 9 aa, Homo Sapiens
SRKRRQQMQ

SEQ ID NO: 78540 - protein, 9 aa, Homo Sapiens
LEGIFLFLL

SEQ ID NO: 78541 - protein, 9 aa, Homo Sapiens
STGHATSVP

SEQ ID NO: 78542 - protein, 9 aa, Homo Sapiens
KPRPPEGLV

SEQ ID NO: 78543 - protein, 9 aa, Homo Sapiens
RHVGQMASV

SEQ ID NO: 78544 - protein, 9 aa, Homo Sapiens
KYGAEVILV

SEQ ID NO: 78545 - protein, 9 aa, Homo Sapiens
TGHATSVPV

SEQ ID NO: 78546 - protein, 9 aa, Homo Sapiens
IGGSFNSTT

SEQ ID NO: 78547 - protein, 9 aa, Homo Sapiens
EDRFAQDCE

SEQ ID NO: 78548 - protein, 9 aa, Homo Sapiens
PEGLVRVVG

SEQ ID NO: 78549 - protein, 9 aa, Homo Sapiens
LIVVATNGG

SEQ ID NO: 78550 - protein, 9 aa, Homo Sapiens
QCQLNVLDN

SEQ ID NO: 78551 - protein, 9 aa, Homo Sapiens
LCSIQSQNM

SEQ ID NO: 78552 - protein, 9 aa, Homo Sapiens
DRIDSADLN

SEQ ID NO: 78553 - protein, 9 aa, Homo Sapiens
VDAHLDRID

SEQ ID NO: 78554 - protein, 9 aa, Homo Sapiens
RELKSQKVE

SEQ ID NO: 78555 - protein, 9 aa, Homo Sapiens
IIRNGLVIN

SEQ ID NO: 78556 - protein, 9 aa, Homo Sapiens
VDRPTFLHK

SEQ ID NO: 78557 - protein, 9 aa, Homo Sapiens
QKEIRVGMI

SEQ ID NO: 78558 - protein, 9 aa, Homo Sapiens
LSHKVTEAG

SEQ ID NO: 78559 - protein, 9 aa, Homo Sapiens
QQMLHQDEL

SEQ ID NO: 78560 - protein, 9 aa, Homo Sapiens
QSVSQDSTT

SEQ ID NO: 78561 - protein, 9 aa, Homo Sapiens
AEVAKMRQM

SEQ ID NO: 78562 - protein, 9 aa, Homo Sapiens
TEIVPQYVS

SEQ ID NO: 78563 - protein, 9 aa, Homo Sapiens
FTAHQTPLP

SEQ ID NO: 78564 - protein, 9 aa, Homo Sapiens
PQRSKSAPP

SEQ ID NO: 78565 - protein, 9 aa, Homo Sapiens
LIGNREWII

SEQ ID NO: 78566 - protein, 9 aa, Homo Sapiens
AKVLTGFFC

SEQ ID NO: 78567 - protein, 9 aa, Homo Sapiens
GTNEVPVPP

SEQ ID NO: 78568 - protein, 9 aa, Homo Sapiens
HQFDNGVEG

SEQ ID NO: 78569 - protein, 9 aa, Homo Sapiens
LDKLQFIII

SEQ ID NO: 78570 - protein, 9 aa, Homo Sapiens
WGDCSTTCG

SEQ ID NO: 78571 - protein, 9 aa, Homo Sapiens
LKQQMLHQD

SEQ ID NO: 78572 - protein, 9 aa, Homo Sapiens
ACKRDYLIL

SEQ ID NO: 78573 - protein, 9 aa, Homo Sapiens
LQKMDMMLR

SEQ ID NO: 78574 - protein, 9 aa, Homo Sapiens
MPMIQRTSK

SEQ ID NO: 78575 - protein, 9 aa, Homo Sapiens
ADFQTTAKE

SEQ ID NO: 78576 - protein, 9 aa, Homo Sapiens
CSTTCGGGV

SEQ ID NO: 78577 - protein, 9 aa, Homo Sapiens
HRVEDDVQR

SEQ ID NO: 78578 - protein, 9 aa, Homo Sapiens
RMSMKQVDE

SEQ ID NO: 78579 - protein, 9 aa, Homo Sapiens
EEEQKPRKE

SEQ ID NO: 78580 - protein, 9 aa, Homo Sapiens
QKPTVGPPE

SEQ ID NO: 78581 - protein, 9 aa, Homo Sapiens
YALLRKSKQ

SEQ ID NO: 78582 - protein, 9 aa, Homo Sapiens
KGEYVIKAS

SEQ ID NO: 78583 - protein, 9 aa, Homo Sapiens
YGAEVILVL

SEQ ID NO: 78584 - protein, 9 aa, Homo Sapiens
QFDNGVEGL

SEQ ID NO: 78585 - protein, 9 aa, Homo Sapiens
GKEPKPSAE

SEQ ID NO: 78586 - protein, 9 aa, Homo Sapiens
SSLVSSSLA

SEQ ID NO: 78587 - protein, 9 aa, Homo Sapiens
RVMKVQDRE

SEQ ID NO: 78588 - protein, 9 aa, Homo Sapiens
EAAQDLPFK

SEQ ID NO: 78589 - protein, 9 aa, Homo Sapiens
EQLCVSKWS

SEQ ID NO: 78590 - protein, 9 aa, Homo Sapiens
VSQLLQREA

SEQ ID NO: 78591 - protein, 9 aa, Homo Sapiens
LQGLLQVQL

SEQ ID NO: 78592 - protein, 9 aa, Homo Sapiens
RVHMIMHTG

SEQ ID NO: 78593 - protein, 9 aa, Homo Sapiens
MFDTREEKR

SEQ ID NO: 78594 - protein, 9 aa, Homo Sapiens
FPDEEIRKV

SEQ ID NO: 78595 - protein, 9 aa, Homo Sapiens
SVSDLPFPL

SEQ ID NO: 78596 - protein, 9 aa, Homo Sapiens
EPKPSAEAA

SEQ ID NO: 78597 - protein, 9 aa, Homo Sapiens
DGGVPESCN

SEQ ID NO: 78598 - protein, 9 aa, Homo Sapiens
QTAEGVSLP

SEQ ID NO: 78599 - protein, 9 aa, Homo Sapiens
PSKESCVAI

SEQ ID NO: 78600 - protein, 9 aa, Homo Sapiens
QVQLKTRKT

SEQ ID NO: 78601 - protein, 9 aa, Homo Sapiens
ISLTKGTNE

SEQ ID NO: 78602 - protein, 9 aa, Homo Sapiens
SNLNKQDIR

SEQ ID NO: 78603 - protein, 9 aa, Homo Sapiens
VPPGEDKGE

SEQ ID NO: 78604 - protein, 9 aa, Homo Sapiens
CNLRLCTLD

SEQ ID NO: 78605 - protein, 9 aa, Homo Sapiens
IQSQNMMMK

SEQ ID NO: 78606 - protein, 9 aa, Homo Sapiens
PLILGCGPL

SEQ ID NO: 78607 - protein, 9 aa, Homo Sapiens
NSLRNLMAA

SEQ ID NO: 78608 - protein, 9 aa, Homo Sapiens
FSNLNKQDI

SEQ ID NO: 78609 - protein, 9 aa, Homo Sapiens
RTSKPLNCD

SEQ ID NO: 78610 - protein, 9 aa, Homo Sapiens
STIRSRSPP

SEQ ID NO: 78611 - protein, 9 aa, Homo Sapiens
YVVTAEGLW

SEQ ID NO: 78612 - protein, 9 aa, Homo Sapiens
QHAYPTSYG

SEQ ID NO: 78613 - protein, 9 aa, Homo Sapiens
EQIRHMETQ

SEQ ID NO: 78614 - protein, 9 aa, Homo Sapiens
GIKVFKDQV

SEQ ID NO: 78615 - protein, 9 aa, Homo Sapiens
HEKWKEFVM

SEQ ID NO: 78616 - protein, 9 aa, Homo Sapiens
LLYLFASLT

SEQ ID NO: 78617 - protein, 9 aa, Homo Sapiens
VNPFPLSQL

SEQ ID NO: 78618 - protein, 9 aa, Homo Sapiens
PQLQKLLKL

SEQ ID NO: 78619 - protein, 9 aa, Homo Sapiens
QLGLSHKVT

SEQ ID NO: 78620 - protein, 9 aa, Homo Sapiens
IVVATNGGL

SEQ ID NO: 78621 - protein, 9 aa, Homo Sapiens
KACYRRFMS

SEQ ID NO: 78622 - protein, 9 aa, Homo Sapiens
IIQATIIRH

SEQ ID NO: 78623 - protein, 9 aa, Homo Sapiens
FVHRELKSQ

SEQ ID NO: 78624 - protein, 9 aa, Homo Sapiens
SRAHQVLPG

SEQ ID NO: 78625 - protein, 9 aa, Homo Sapiens
CPFQKNVES

SEQ ID NO: 78626 - protein, 9 aa, Homo Sapiens
AYLKKMLLV

SEQ ID NO: 78627 - protein, 9 aa, Homo Sapiens
AQPIGGSFN

SEQ ID NO: 78628 - protein, 9 aa, Homo Sapiens
QAMIFAIEK

SEQ ID NO: 78629 - protein, 9 aa, Homo Sapiens
DVKKCGIQH

SEQ ID NO: 78630 - protein, 9 aa, Homo Sapiens
KMDAYMKGT

SEQ ID NO: 78631 - protein, 9 aa, Homo Sapiens
QFQGLMESI

SEQ ID NO: 78632 - protein, 9 aa, Homo Sapiens
LGFLTPCSN

SEQ ID NO: 78633 - protein, 9 aa, Homo Sapiens
LGLSHKVTE

SEQ ID NO: 78634 - protein, 9 aa, Homo Sapiens
ASLRCLNSA

SEQ ID NO: 78635 - protein, 9 aa, Homo Sapiens
NCALQCLSN

SEQ ID NO: 78636 - protein, 9 aa, Homo Sapiens
LISYAFIVE

SEQ ID NO: 78637 - protein, 9 aa, Homo Sapiens
QNRQALDLV

SEQ ID NO: 78638 - protein, 9 aa, Homo Sapiens
LNVKAKGYT

SEQ ID NO: 78639 - protein, 9 aa, Homo Sapiens
IEIKPVNPF

SEQ ID NO: 78640 - protein, 9 aa, Homo Sapiens
LPLSVSRLK

SEQ ID NO: 78641 - protein, 9 aa, Homo Sapiens
QEEEKKCRY

SEQ ID NO: 78642 - protein, 9 aa, Homo Sapiens
FAKIINLYY

SEQ ID NO: 78643 - protein, 9 aa, Homo Sapiens
HYTVKTDNF

SEQ ID NO: 78644 - protein, 9 aa, Homo Sapiens
YYLDSLNRI

SEQ ID NO: 78645 - protein, 9 aa, Homo Sapiens
SSKEEEDKN

SEQ ID NO: 78646 - protein, 9 aa, Homo Sapiens
ERQHSLKKY

SEQ ID NO: 78647 - protein, 9 aa, Homo Sapiens
DFSNLNKQD

SEQ ID NO: 78648 - protein, 9 aa, Homo Sapiens
SLASSNLSH

SEQ ID NO: 78649 - protein, 9 aa, Homo Sapiens
GKDLFHCTL

SEQ ID NO: 78650 - protein, 9 aa, Homo Sapiens
GIGKVSGLD

SEQ ID NO: 78651 - protein, 9 aa, Homo Sapiens
FIMKNLNVT

SEQ ID NO: 78652 - protein, 9 aa, Homo Sapiens
PSSCLQQPD

SEQ ID NO: 78653 - protein, 9 aa, Homo Sapiens
LLAGMAYKV

SEQ ID NO: 78654 - protein, 9 aa, Homo Sapiens
SDNESDKEV

SEQ ID NO: 78655 - protein, 9 aa, Homo Sapiens
SLRCLNSAV

SEQ ID NO: 78656 - protein, 9 aa, Homo Sapiens
SLSVTQLDP

SEQ ID NO: 78657 - protein, 9 aa, Homo Sapiens
VGQMASVNM

SEQ ID NO: 78658 - protein, 9 aa, Homo Sapiens
YVKVRNMSE

SEQ ID NO: 78659 - protein, 9 aa, Homo Sapiens
HTNSKKQSD

SEQ ID NO: 78660 - protein, 9 aa, Homo Sapiens
TTSMKIQQN

SEQ ID NO: 78661 - protein, 9 aa, Homo Sapiens
KLQRRQEQA

SEQ ID NO: 78662 - protein, 9 aa, Homo Sapiens
KEPKPSAEA

SEQ ID NO: 78663 - protein, 9 aa, Homo Sapiens
CLLLWLLLL

SEQ ID NO: 78664 - protein, 9 aa, Homo Sapiens
SHSDAESKR

SEQ ID NO: 78665 - protein, 9 aa, Homo Sapiens
GNLRVECLD

SEQ ID NO: 78666 - protein, 9 aa, Homo Sapiens
RGNTDRVAR

SEQ ID NO: 78667 - protein, 9 aa, Homo Sapiens
RLKRRLQKM

SEQ ID NO: 78668 - protein, 9 aa, Homo Sapiens
IKKLDKLQF

SEQ ID NO: 78669 - protein, 9 aa, Homo Sapiens
IQRGQLLAV

SEQ ID NO: 78670 - protein, 9 aa, Homo Sapiens
PGEDKGEYV

SEQ ID NO: 78671 - protein, 9 aa, Homo Sapiens
QGCAEIGTL

SEQ ID NO: 78672 - protein, 9 aa, Homo Sapiens
KEIRHVGQM

SEQ ID NO: 78673 - protein, 9 aa, Homo Sapiens
NVSAKDAGE

SEQ ID NO: 78674 - protein, 9 aa, Homo Sapiens
AVEHHALFR

SEQ ID NO: 78675 - protein, 9 aa, Homo Sapiens
FAIEKINSS

SEQ ID NO: 78676 - protein, 9 aa, Homo Sapiens
YLRNVSAKD

SEQ ID NO: 78677 - protein, 9 aa, Homo Sapiens
FFLFLDPLR

SEQ ID NO: 78678 - protein, 9 aa, Homo Sapiens
LPWRKSSLD

SEQ ID NO: 78679 - protein, 9 aa, Homo Sapiens
VGMIDDDIF

SEQ ID NO: 78680 - protein, 9 aa, Homo Sapiens
AHLDRIDSA

SEQ ID NO: 78681 - protein, 9 aa, Homo Sapiens
AAYTIIGFE

SEQ ID NO: 78682 - protein, 9 aa, Homo Sapiens
RKLEQGRFG

SEQ ID NO: 78683 - protein, 9 aa, Homo Sapiens
DDETPQLCA

SEQ ID NO: 78684 - protein, 9 aa, Homo Sapiens
IKGIHQYPG

SEQ ID NO: 78685 - protein, 9 aa, Homo Sapiens
YVLLYLFAS

SEQ ID NO: 78686 - protein, 9 aa, Homo Sapiens
LMESIRQAD

SEQ ID NO: 78687 - protein, 9 aa, Homo Sapiens
ADNSLRNLM

SEQ ID NO: 78688 - protein, 9 aa, Homo Sapiens
RKLPFQRLA

SEQ ID NO: 78689 - protein, 9 aa, Homo Sapiens
DEEELLEQL

SEQ ID NO: 78690 - protein, 9 aa, Homo Sapiens
ELSGPAKGA

SEQ ID NO: 78691 - protein, 9 aa, Homo Sapiens
KYRKENDMA

SEQ ID NO: 78692 - protein, 9 aa, Homo Sapiens
KQRQGLDGL

SEQ ID NO: 78693 - protein, 9 aa, Homo Sapiens
STEETWVEC

SEQ ID NO: 78694 - protein, 9 aa, Homo Sapiens
IEKINSSPA

SEQ ID NO: 78695 - protein, 9 aa, Homo Sapiens
EGEQQPKSA

SEQ ID NO: 78696 - protein, 9 aa, Homo Sapiens
LTEMKLPLH

SEQ ID NO: 78697 - protein, 9 aa, Homo Sapiens
GQGLDGAVD

SEQ ID NO: 78698 - protein, 9 aa, Homo Sapiens
KATQAGQTA

SEQ ID NO: 78699 - protein, 9 aa, Homo Sapiens
KLIKKILLN

SEQ ID NO: 78700 - protein, 9 aa, Homo Sapiens
QLIVVATNG

SEQ ID NO: 78701 - protein, 9 aa, Homo Sapiens
PFPLSQLQR

SEQ ID NO: 78702 - protein, 9 aa, Homo Sapiens
NHQFDNGVE

SEQ ID NO: 78703 - protein, 9 aa, Homo Sapiens
SSSSSLADD

SEQ ID NO: 78704 - protein, 9 aa, Homo Sapiens
EPRPSLSNE

SEQ ID NO: 78705 - protein, 9 aa, Homo Sapiens
FTSTEETWV

SEQ ID NO: 78706 - protein, 9 aa, Homo Sapiens
MFKTEDLVL

SEQ ID NO: 78707 - protein, 9 aa, Homo Sapiens
FWNGQLIPY

SEQ ID NO: 78708 - protein, 9 aa, Homo Sapiens
FVMERQRQE

SEQ ID NO: 78709 - protein, 9 aa, Homo Sapiens
QDIMATRSS

SEQ ID NO: 78710 - protein, 9 aa, Homo Sapiens
RSLRVMKVQ

SEQ ID NO: 78711 - protein, 9 aa, Homo Sapiens
EEKEQKENS

SEQ ID NO: 78712 - protein, 9 aa, Homo Sapiens
KDAGEYTCL

SEQ ID NO: 78713 - protein, 9 aa, Homo Sapiens
RLECICRGW

SEQ ID NO: 78714 - protein, 9 aa, Homo Sapiens
LGVQCLLLW

SEQ ID NO: 78715 - protein, 9 aa, Homo Sapiens
LLDRQCQLN

SEQ ID NO: 78716 - protein, 9 aa, Homo Sapiens
GDLLFFEKA

SEQ ID NO: 78717 - protein, 9 aa, Homo Sapiens
EDEEMWFNK

SEQ ID NO: 78718 - protein, 9 aa, Homo Sapiens
EYKFDVSLE

SEQ ID NO: 78719 - protein, 9 aa, Homo Sapiens
EMWFNKDEE

SEQ ID NO: 78720 - protein, 9 aa, Homo Sapiens
VVLVGVKSQ

SEQ ID NO: 78721 - protein, 9 aa, Homo Sapiens
GFWQKKKKH

SEQ ID NO: 78722 - protein, 9 aa, Homo Sapiens
RVECLDDRN

SEQ ID NO: 78723 - protein, 9 aa, Homo Sapiens
ALGNHQFDN

SEQ ID NO: 78724 - protein, 9 aa, Homo Sapiens
DNYQTAEGV

SEQ ID NO: 78725 - protein, 9 aa, Homo Sapiens
NGGLPPLAS

SEQ ID NO: 78726 - protein, 9 aa, Homo Sapiens
QQPKSAEAT

SEQ ID NO: 78727 - protein, 9 aa, Homo Sapiens
MQLLHSGGR

SEQ ID NO: 78728 - protein, 9 aa, Homo Sapiens
TFLTSSTIR

SEQ ID NO: 78729 - protein, 9 aa, Homo Sapiens
SSKDTDITL

SEQ ID NO: 78730 - protein, 9 aa, Homo Sapiens
CKRDYLILR

SEQ ID NO: 78731 - protein, 9 aa, Homo Sapiens
RMQLLHSGG

SEQ ID NO: 78732 - protein, 9 aa, Homo Sapiens
LVIERLQEE

SEQ ID NO: 78733 - protein, 9 aa, Homo Sapiens
PQLTTGFEP

SEQ ID NO: 78734 - protein, 9 aa, Homo Sapiens
SSTIRSRSP

SEQ ID NO: 78735 - protein, 9 aa, Homo Sapiens
PDLASMWIS

SEQ ID NO: 78736 - protein, 9 aa, Homo Sapiens
LELLEWIWH

SEQ ID NO: 78737 - protein, 9 aa, Homo Sapiens
NESDKEVAG

SEQ ID NO: 78738 - protein, 9 aa, Homo Sapiens
DNMYSIDFT

SEQ ID NO: 78739 - protein, 9 aa, Homo Sapiens
PHPKVPRHL

SEQ ID NO: 78740 - protein, 9 aa, Homo Sapiens
DSIIDFTKE

SEQ ID NO: 78741 - protein, 9 aa, Homo Sapiens
NSRCWQGCA

SEQ ID NO: 78742 - protein, 9 aa, Homo Sapiens
LQRVAERVA

SEQ ID NO: 78743 - protein, 9 aa, Homo Sapiens
KKKHRNTNT

SEQ ID NO: 78744 - protein, 9 aa, Homo Sapiens
MIIAYVLLY

SEQ ID NO: 78745 - protein, 9 aa, Homo Sapiens
KKLDKLQFI

SEQ ID NO: 78746 - protein, 9 aa, Homo Sapiens
VLPGHSLSS

SEQ ID NO: 78747 - protein, 9 aa, Homo Sapiens
ETGNWHSDS

SEQ ID NO: 78748 - protein, 9 aa, Homo Sapiens
MNCALQCLS

SEQ ID NO: 78749 - protein, 9 aa, Homo Sapiens
FDVKAVMKT

SEQ ID NO: 78750 - protein, 9 aa, Homo Sapiens
TEDRFAQDC

SEQ ID NO: 78751 - protein, 9 aa, Homo Sapiens
NLFVINAPY

SEQ ID NO: 78752 - protein, 9 aa, Homo Sapiens
HRFLLFMWV

SEQ ID NO: 78753 - protein, 9 aa, Homo Sapiens
IMWVSVKEV

SEQ ID NO: 78754 - protein, 9 aa, Homo Sapiens
TLNVKAKGY

SEQ ID NO: 78755 - protein, 9 aa, Homo Sapiens
LYLRNVSAK

SEQ ID NO: 78756 - protein, 9 aa, Homo Sapiens
QQQDCQEKE

SEQ ID NO: 78757 - protein, 9 aa, Homo Sapiens
CLFALSHHS

SEQ ID NO: 78758 - protein, 9 aa, Homo Sapiens
PDEEIRKVA

SEQ ID NO: 78759 - protein, 9 aa, Homo Sapiens
PESCNLRLC

SEQ ID NO: 78760 - protein, 9 aa, Homo Sapiens
QRIVDKAVK

SEQ ID NO: 78761 - protein, 9 aa, Homo Sapiens
SPVLYVMEN

SEQ ID NO: 78762 - protein, 9 aa, Homo Sapiens
LWPVKEVGM

SEQ ID NO: 78763 - protein, 9 aa, Homo Sapiens
FYYSESWTV

SEQ ID NO: 78764 - protein, 9 aa, Homo Sapiens
HSHGETGNW

SEQ ID NO: 78765 - protein, 9 aa, Homo Sapiens
ASMWISPDF

SEQ ID NO: 78766 - protein, 9 aa, Homo Sapiens
LRCLNSAVE

SEQ ID NO: 78767 - protein, 9 aa, Homo Sapiens
IMHTGGRPY

SEQ ID NO: 78768 - protein, 9 aa, Homo Sapiens
IRHNQALRL

SEQ ID NO: 78769 - protein, 9 aa, Homo Sapiens
MIQRTSKPL

SEQ ID NO: 78770 - protein, 9 aa, Homo Sapiens
RVESKLIKK

SEQ ID NO: 78771 - protein, 9 aa, Homo Sapiens
VPDLASMWI

SEQ ID NO: 78772 - protein, 9 aa, Homo Sapiens
EEEILGSHD

SEQ ID NO: 78773 - protein, 9 aa, Homo Sapiens
KEQMLILEC

SEQ ID NO: 78774 - protein, 9 aa, Homo Sapiens
RKDLHRNKL

SEQ ID NO: 78775 - protein, 9 aa, Homo Sapiens
QSANASVND

SEQ ID NO: 78776 - protein, 9 aa, Homo Sapiens
DLASMWISP

SEQ ID NO: 78777 - protein, 9 aa, Homo Sapiens
HKRQEREDE

SEQ ID NO: 78778 - protein, 9 aa, Homo Sapiens
VPVVSPKTD

SEQ ID NO: 78779 - protein, 9 aa, Homo Sapiens
LPLHKKIND

SEQ ID NO: 78780 - protein, 9 aa, Homo Sapiens
SHPLFGRLV

SEQ ID NO: 78781 - protein, 9 aa, Homo Sapiens
LPSVYQTLC

SEQ ID NO: 78782 - protein, 9 aa, Homo Sapiens
HRNKLYVTF

SEQ ID NO: 78783 - protein, 9 aa, Homo Sapiens
DRPTFLHKD

SEQ ID NO: 78784 - protein, 9 aa, Homo Sapiens
DSADLNGKL

SEQ ID NO: 78785 - protein, 9 aa, Homo Sapiens
EILGSHDDE

SEQ ID NO: 78786 - protein, 9 aa, Homo Sapiens
EAKLKNNRC

SEQ ID NO: 78787 - protein, 9 aa, Homo Sapiens
EYLAMASLA

SEQ ID NO: 78788 - protein, 9 aa, Homo Sapiens
QKLLKLPAF

SEQ ID NO: 78789 - protein, 9 aa, Homo Sapiens
AEGLWPVKE

SEQ ID NO: 78790 - protein, 9 aa, Homo Sapiens
ECAVKAIEQ

SEQ ID NO: 78791 - protein, 9 aa, Homo Sapiens
QGKACYRWS

SEQ ID NO: 78792 - protein, 9 aa, Homo Sapiens
NSCCGSVCC

SEQ ID NO: 78793 - protein, 9 aa, Homo Sapiens
VDFYNKKMD

SEQ ID NO: 78794 - protein, 9 aa, Homo Sapiens
WVRGGGVYS

SEQ ID NO: 78795 - protein, 9 aa, Homo Sapiens
EERLQRVAE

SEQ ID NO: 78796 - protein, 9 aa, Homo Sapiens
KLKSWKFQT

SEQ ID NO: 78797 - protein, 9 aa, Homo Sapiens
DKFQCQEDG

SEQ ID NO: 78798 - protein, 9 aa, Homo Sapiens
GEQNRKKLQ

SEQ ID NO: 78799 - protein, 9 aa, Homo Sapiens
AKEIRHVGQ

SEQ ID NO: 78800 - protein, 9 aa, Homo Sapiens
GNWHSDSPR

SEQ ID NO: 78801 - protein, 9 aa, Homo Sapiens
QLKPRPPEG

SEQ ID NO: 78802 - protein, 9 aa, Homo Sapiens
LPSKESCVA

SEQ ID NO: 78803 - protein, 9 aa, Homo Sapiens
RLSVLQRLK

SEQ ID NO: 78804 - protein, 9 aa, Homo Sapiens
CAVKAIEQK

SEQ ID NO: 78805 - protein, 9 aa, Homo Sapiens
VQEFAENIK

SEQ ID NO: 78806 - protein, 9 aa, Homo Sapiens
LGSSKRLFQ

SEQ ID NO: 78807 - protein, 9 aa, Homo Sapiens
YKMMGVLLQ

SEQ ID NO: 78808 - protein, 9 aa, Homo Sapiens
EGSGPLILG

SEQ ID NO: 78809 - protein, 9 aa, Homo Sapiens
STSFDFVEL

SEQ ID NO: 78810 - protein, 9 aa, Homo Sapiens
LGEQNRKKL

SEQ ID NO: 78811 - protein, 9 aa, Homo Sapiens
LVSSSLASS

SEQ ID NO: 78812 - protein, 9 aa, Homo Sapiens
FSITHVSHS

SEQ ID NO: 78813 - protein, 9 aa, Homo Sapiens
ELSKQCQMD

SEQ ID NO: 78814 - protein, 9 aa, Homo Sapiens
GGKVMEYTT

SEQ ID NO: 78815 - protein, 9 aa, Homo Sapiens
IKPARSELF

SEQ ID NO: 78816 - protein, 9 aa, Homo Sapiens
LSPHTQVFL

SEQ ID NO: 78817 - protein, 9 aa, Homo Sapiens
ESNLKEVVT

SEQ ID NO: 78818 - protein, 9 aa, Homo Sapiens
TTAKELGLL

SEQ ID NO: 78819 - protein, 9 aa, Homo Sapiens
KVTEAGGNL

SEQ ID NO: 78820 - protein, 9 aa, Homo Sapiens
ITHVSHSDA

SEQ ID NO: 78821 - protein, 9 aa, Homo Sapiens
QFCPFQKNV

SEQ ID NO: 78822 - protein, 9 aa, Homo Sapiens
DVSLELLEW

SEQ ID NO: 78823 - protein, 9 aa, Homo Sapiens
LKIALPSVY

SEQ ID NO: 78824 - protein, 9 aa, Homo Sapiens
MSCSVALAV

SEQ ID NO: 78825 - protein, 9 aa, Homo Sapiens
KTDEFLDLL

SEQ ID NO: 78826 - protein, 9 aa, Homo Sapiens
WHSDSPRHG

SEQ ID NO: 78827 - protein, 9 aa, Homo Sapiens
RSRPPLQGD

SEQ ID NO: 78828 - protein, 9 aa, Homo Sapiens
IDRALSRFR

SEQ ID NO: 78829 - protein, 9 aa, Homo Sapiens
AVKAIEQKN

SEQ ID NO: 78830 - protein, 9 aa, Homo Sapiens
RMVSGHYIP

SEQ ID NO: 78831 - protein, 9 aa, Homo Sapiens
QGHQGYLRL

SEQ ID NO: 78832 - protein, 9 aa, Homo Sapiens
PAGILKSII

SEQ ID NO: 78833 - protein, 9 aa, Homo Sapiens
TKGTNEVPV

SEQ ID NO: 78834 - protein, 9 aa, Homo Sapiens
PVNPFPLSQ

SEQ ID NO: 78835 - protein, 9 aa, Homo Sapiens
RMPDPQSVS

SEQ ID NO: 78836 - protein, 9 aa, Homo Sapiens
MAYFVCTQF

SEQ ID NO: 78837 - protein, 9 aa, Homo Sapiens
VFKDQVKEV

SEQ ID NO: 78838 - protein, 9 aa, Homo Sapiens
SVKELEKQI

SEQ ID NO: 78839 - protein, 9 aa, Homo Sapiens
VKAEAEAAA

SEQ ID NO: 78840 - protein, 9 aa, Homo Sapiens
SETIHNIDC

SEQ ID NO: 78841 - protein, 9 aa, Homo Sapiens
GFSLFIMKN

SEQ ID NO: 78842 - protein, 9 aa, Homo Sapiens
LGKDLFHCT

SEQ ID NO: 78843 - protein, 9 aa, Homo Sapiens
HKVTEAGGN

SEQ ID NO: 78844 - protein, 9 aa, Homo Sapiens
YPTSYGGKY

SEQ ID NO: 78845 - protein, 9 aa, Homo Sapiens
SSSLADDHY

SEQ ID NO: 78846 - protein, 9 aa, Homo Sapiens
TTCGHMASY

SEQ ID NO: 78847 - protein, 9 aa, Homo Sapiens
QSLLRGADE

SEQ ID NO: 78848 - protein, 9 aa, Homo Sapiens
DKADEISDE

SEQ ID NO: 78849 - protein, 9 aa, Homo Sapiens
RLAREIAQD

SEQ ID NO: 78850 - protein, 9 aa, Homo Sapiens
IRVESKLIK

SEQ ID NO: 78851 - protein, 9 aa, Homo Sapiens
RFLACKRDY

SEQ ID NO: 78852 - protein, 9 aa, Homo Sapiens
RIHLLAAQG

SEQ ID NO: 78853 - protein, 9 aa, Homo Sapiens
TLQESSFQD

SEQ ID NO: 78854 - protein, 9 aa, Homo Sapiens
AFIVEAVLR

SEQ ID NO: 78855 - protein, 9 aa, Homo Sapiens
TSFDFVELN

SEQ ID NO: 78856 - protein, 9 aa, Homo Sapiens
LADNSLRNL

SEQ ID NO: 78857 - protein, 9 aa, Homo Sapiens
GMSDLLSPV

SEQ ID NO: 78858 - protein, 9 aa, Homo Sapiens
ETPQLCAHA

SEQ ID NO: 78859 - protein, 9 aa, Homo Sapiens
IQAKERLDM

SEQ ID NO: 78860 - protein, 9 aa, Homo Sapiens
GNREWIIRN

SEQ ID NO: 78861 - protein, 9 aa, Homo Sapiens
CLSKLLGKK

SEQ ID NO: 78862 - protein, 9 aa, Homo Sapiens
AKGYTMNVE

SEQ ID NO: 78863 - protein, 9 aa, Homo Sapiens
EKSIIDKKF

SEQ ID NO: 78864 - protein, 9 aa, Homo Sapiens
DNESDKEVA

SEQ ID NO: 78865 - protein, 9 aa, Homo Sapiens
FRGRMSMKQ

SEQ ID NO: 78866 - protein, 9 aa, Homo Sapiens
ADHTEVIKG

SEQ ID NO: 78867 - protein, 9 aa, Homo Sapiens
QGLSSKDKY

SEQ ID NO: 78868 - protein, 9 aa, Homo Sapiens
FLACKRDYL

SEQ ID NO: 78869 - protein, 9 aa, Homo Sapiens
YNRGFSLFI

SEQ ID NO: 78870 - protein, 9 aa, Homo Sapiens
RLQEEKEQK

SEQ ID NO: 78871 - protein, 9 aa, Homo Sapiens
GGIRLECIC

SEQ ID NO: 78872 - protein, 9 aa, Homo Sapiens
SWTVWLPSM

SEQ ID NO: 78873 - protein, 9 aa, Homo Sapiens
EDSYQHLQA

SEQ ID NO: 78874 - protein, 9 aa, Homo Sapiens
YEDSYQHLQ

SEQ ID NO: 78875 - protein, 9 aa, Homo Sapiens
SISLTKGTN

SEQ ID NO: 78876 - protein, 9 aa, Homo Sapiens
HAYPTSYGG

SEQ ID NO: 78877 - protein, 9 aa, Homo Sapiens
QLQKLLKLP

SEQ ID NO: 78878 - protein, 9 aa, Homo Sapiens
KKMDSIVQC

SEQ ID NO: 78879 - protein, 9 aa, Homo Sapiens
NENLLINEL

SEQ ID NO: 78880 - protein, 9 aa, Homo Sapiens
EVVSQLLQR

SEQ ID NO: 78881 - protein, 9 aa, Homo Sapiens
VLYVMENEV

SEQ ID NO: 78882 - protein, 9 aa, Homo Sapiens
YSNPRQARQ

SEQ ID NO: 78883 - protein, 9 aa, Homo Sapiens
SPTTSMKIQ

SEQ ID NO: 78884 - protein, 9 aa, Homo Sapiens
GSGPLILGC

SEQ ID NO: 78885 - protein, 9 aa, Homo Sapiens
CTAVRKFFL

SEQ ID NO: 78886 - protein, 9 aa, Homo Sapiens
NLRLCTLDP

SEQ ID NO: 78887 - protein, 9 aa, Homo Sapiens
TAHQTPLPS

SEQ ID NO: 78888 - protein, 9 aa, Homo Sapiens
QKAQGPILL

SEQ ID NO: 78889 - protein, 9 aa, Homo Sapiens
SEGEGEGKT

SEQ ID NO: 78890 - protein, 9 aa, Homo Sapiens
LSVTQLDPK

SEQ ID NO: 78891 - protein, 9 aa, Homo Sapiens
KGLSLVYMA

SEQ ID NO: 78892 - protein, 9 aa, Homo Sapiens
NREWIIRNG

SEQ ID NO: 78893 - protein, 9 aa, Homo Sapiens
VQDREGPSS

SEQ ID NO: 78894 - protein, 9 aa, Homo Sapiens
KQQRVFFLF

SEQ ID NO: 78895 - protein, 9 aa, Homo Sapiens
MSMKQVDEQ

SEQ ID NO: 78896 - protein, 9 aa, Homo Sapiens
FEAKVLTGF

SEQ ID NO: 78897 - protein, 9 aa, Homo Sapiens
TPQLCAHAL

SEQ ID NO: 78898 - protein, 9 aa, Homo Sapiens
IVPQYVSAF

SEQ ID NO: 78899 - protein, 9 aa, Homo Sapiens
KSWKFQTCH

SEQ ID NO: 78900 - protein, 9 aa, Homo Sapiens
AALCLGFLT

SEQ ID NO: 78901 - protein, 9 aa, Homo Sapiens
YTKGLSLVY

SEQ ID NO: 78902 - protein, 9 aa, Homo Sapiens
RCLNSAVEC

SEQ ID NO: 78903 - protein, 9 aa, Homo Sapiens
EAARMQLLH

SEQ ID NO: 78904 - protein, 9 aa, Homo Sapiens
TKGLSLVYM

SEQ ID NO: 78905 - protein, 9 aa, Homo Sapiens
TLEDKEQML

SEQ ID NO: 78906 - protein, 9 aa, Homo Sapiens
SYGGKYSVK

SEQ ID NO: 78907 - protein, 9 aa, Homo Sapiens
SSCLQQPDS

SEQ ID NO: 78908 - protein, 9 aa, Homo Sapiens
QQARRQEKL

SEQ ID NO: 78909 - protein, 9 aa, Homo Sapiens
CAHALAALQ

SEQ ID NO: 78910 - protein, 9 aa, Homo Sapiens
IFLFLLIWS

SEQ ID NO: 78911 - protein, 9 aa, Homo Sapiens
PSSSNTKPV

SEQ ID NO: 78912 - protein, 9 aa, Homo Sapiens
NCCGQGKAC

SEQ ID NO: 78913 - protein, 9 aa, Homo Sapiens
PGCLRVSTC

SEQ ID NO: 78914 - protein, 9 aa, Homo Sapiens
QGLMESIRQ

SEQ ID NO: 78915 - protein, 9 aa, Homo Sapiens
DNSLRNLMA

SEQ ID NO: 78916 - protein, 9 aa, Homo Sapiens
ARRQEKLQR

SEQ ID NO: 78917 - protein, 9 aa, Homo Sapiens
CLDDRNTFR

SEQ ID NO: 78918 - protein, 9 aa, Homo Sapiens
PIGGSFNST

SEQ ID NO: 78919 - protein, 9 aa, Homo Sapiens
ECQKLKSWK

SEQ ID NO: 78920 - protein, 9 aa, Homo Sapiens
PLHKKINDF

SEQ ID NO: 78921 - protein, 9 aa, Homo Sapiens
IGGHQVTPH

SEQ ID NO: 78922 - protein, 9 aa, Homo Sapiens
WKEFVMERQ

SEQ ID NO: 78923 - protein, 9 aa, Homo Sapiens
QRFLACKRD

SEQ ID NO: 78924 - protein, 9 aa, Homo Sapiens
NDSRLEELK

SEQ ID NO: 78925 - protein, 9 aa, Homo Sapiens
STSDYEHSR

SEQ ID NO: 78926 - protein, 9 aa, Homo Sapiens
AKVRLSVLQ

SEQ ID NO: 78927 - protein, 9 aa, Homo Sapiens
VLMFKTEDL

SEQ ID NO: 78928 - protein, 9 aa, Homo Sapiens
KRWKPQLQK

SEQ ID NO: 78929 - protein, 9 aa, Homo Sapiens
IVRFLTVMI

SEQ ID NO: 78930 - protein, 9 aa, Homo Sapiens
HSLKKYRKE

SEQ ID NO: 78931 - protein, 9 aa, Homo Sapiens
VLIGNREWI

SEQ ID NO: 78932 - protein, 9 aa, Homo Sapiens
EKWKEFVME

SEQ ID NO: 78933 - protein, 9 aa, Homo Sapiens
GEGEGKTEG

SEQ ID NO: 78934 - protein, 9 aa, Homo Sapiens
NKKMDSIVQ

SEQ ID NO: 78935 - protein, 9 aa, Homo Sapiens
HLHRFLLFM

SEQ ID NO: 78936 - protein, 9 aa, Homo Sapiens
LADDHYEFA

SEQ ID NO: 78937 - protein, 9 aa, Homo Sapiens
LDRQCQLNV

SEQ ID NO: 78938 - protein, 9 aa, Homo Sapiens
DFQTTAKEL

SEQ ID NO: 78939 - protein, 9 aa, Homo Sapiens
NASVNDSRL

SEQ ID NO: 78940 - protein, 9 aa, Homo Sapiens
PVVSPKTDE

SEQ ID NO: 78941 - protein, 9 aa, Homo Sapiens
SKLIKKILL

SEQ ID NO: 78942 - protein, 9 aa, Homo Sapiens
GGVPESCNL

SEQ ID NO: 78943 - protein, 9 aa, Homo Sapiens
VSRLKRRPD

SEQ ID NO: 78944 - protein, 9 aa, Homo Sapiens
FMSMNDLVQ

SEQ ID NO: 78945 - protein, 9 aa, Homo Sapiens
WQGCAEIGT

SEQ ID NO: 78946 - protein, 9 aa, Homo Sapiens
EKEYEPQPE

SEQ ID NO: 78947 - protein, 9 aa, Homo Sapiens
KPESNLKEV

SEQ ID NO: 78948 - protein, 9 aa, Homo Sapiens
RCWQGCAEI

SEQ ID NO: 78949 - protein, 9 aa, Homo Sapiens
STQNRQALD

SEQ ID NO: 78950 - protein, 9 aa, Homo Sapiens
GHYIPAIRA

SEQ ID NO: 78951 - protein, 9 aa, Homo Sapiens
ANDSTLAMP

SEQ ID NO: 78952 - protein, 9 aa, Homo Sapiens
PMQGNPPQR

SEQ ID NO: 78953 - protein, 9 aa, Homo Sapiens
LHKDGGLVE

SEQ ID NO: 78954 - protein, 9 aa, Homo Sapiens
MGRLRSGQG

SEQ ID NO: 78955 - protein, 9 aa, Homo Sapiens
CLCLPHPKV

SEQ ID NO: 78956 - protein, 9 aa, Homo Sapiens
KMCRAVEDQ

SEQ ID NO: 78957 - protein, 9 aa, Homo Sapiens
ISIPEHDKA

SEQ ID NO: 78958 - protein, 9 aa, Homo Sapiens
KKYRKENDM

SEQ ID NO: 78959 - protein, 9 aa, Homo Sapiens
KEYEPQPEP

SEQ ID NO: 78960 - protein, 9 aa, Homo Sapiens
CSIPLNELY

SEQ ID NO: 78961 - protein, 9 aa, Homo Sapiens
GRIRFKFSN

SEQ ID NO: 78962 - protein, 9 aa, Homo Sapiens
HKKINDFCR

SEQ ID NO: 78963 - protein, 9 aa, Homo Sapiens
YSTPSSCLQ

SEQ ID NO: 78964 - protein, 9 aa, Homo Sapiens
SRKDLHRNK

SEQ ID NO: 78965 - protein, 9 aa, Homo Sapiens
PGPPPPSTF

SEQ ID NO: 78966 - protein, 9 aa, Homo Sapiens
RIKKLDKLQ

SEQ ID NO: 78967 - protein, 9 aa, Homo Sapiens
LIYVFEAKV

SEQ ID NO: 78968 - protein, 9 aa, Homo Sapiens
KCGIQHTNS

SEQ ID NO: 78969 - protein, 9 aa, Homo Sapiens
QGRFGPNKM

SEQ ID NO: 78970 - protein, 9 aa, Homo Sapiens
MKACYRRFM

SEQ ID NO: 78971 - protein, 9 aa, Homo Sapiens
SSVPVVSPK

SEQ ID NO: 78972 - protein, 9 aa, Homo Sapiens
QKMDMMLRA

SEQ ID NO: 78973 - protein, 9 aa, Homo Sapiens
ESCNLRLCT

SEQ ID NO: 78974 - protein, 9 aa, Homo Sapiens
LHRNKLYVT

SEQ ID NO: 78975 - protein, 9 aa, Homo Sapiens
DAYMKGTPE

SEQ ID NO: 78976 - protein, 9 aa, Homo Sapiens
LHELSGPAK

SEQ ID NO: 78977 - protein, 9 aa, Homo Sapiens
GDQAASVKE

SEQ ID NO: 78978 - protein, 9 aa, Homo Sapiens
RLQKMDMML

SEQ ID NO: 78979 - protein, 9 aa, Homo Sapiens
EAAAGSPTS

SEQ ID NO: 78980 - protein, 9 aa, Homo Sapiens
RDYFDYSTS

SEQ ID NO: 78981 - protein, 9 aa, Homo Sapiens
DDVQRIVDK

SEQ ID NO: 78982 - protein, 9 aa, Homo Sapiens
MRAIQAKER

SEQ ID NO: 78983 - protein, 9 aa, Homo Sapiens
VTAEGLWPV

SEQ ID NO: 78984 - protein, 9 aa, Homo Sapiens
PVTLNVKAK

SEQ ID NO: 78985 - protein, 9 aa, Homo Sapiens
KDKKHLDKL

SEQ ID NO: 78986 - protein, 9 aa, Homo Sapiens
CTQFKVVRN

SEQ ID NO: 78987 - protein, 9 aa, Homo Sapiens
RSVSDLPFP

SEQ ID NO: 78988 - protein, 9 aa, Homo Sapiens
SCSVALAVL

SEQ ID NO: 78989 - protein, 9 aa, Homo Sapiens
KEEKEYEPQ

SEQ ID NO: 78990 - protein, 9 aa, Homo Sapiens
RLQGLLQVQ

SEQ ID NO: 78991 - protein, 9 aa, Homo Sapiens
PLPSKESCV

SEQ ID NO: 78992 - protein, 9 aa, Homo Sapiens
VFEAKVLTG

SEQ ID NO: 78993 - protein, 9 aa, Homo Sapiens
HPESRAHQV

SEQ ID NO: 78994 - protein, 9 aa, Homo Sapiens
LLSPEAALG

SEQ ID NO: 78995 - protein, 9 aa, Homo Sapiens
RAHQVLPGH

SEQ ID NO: 78996 - protein, 9 aa, Homo Sapiens
QRMPDPQSV

SEQ ID NO: 78997 - protein, 9 aa, Homo Sapiens
IRQFTSTEE

SEQ ID NO: 78998 - protein, 9 aa, Homo Sapiens
INAKATQAG

SEQ ID NO: 78999 - protein, 9 aa, Homo Sapiens
ASAGLLEQI

SEQ ID NO: 79000 - protein, 9 aa, Homo Sapiens
QGLDGAVDM

SEQ ID NO: 79001 - protein, 9 aa, Homo Sapiens
MQKTCSIPL

SEQ ID NO: 79002 - protein, 9 aa, Homo Sapiens
SSPTTSMKI

SEQ ID NO: 79003 - protein, 9 aa, Homo Sapiens
EKLKQQMLH

SEQ ID NO: 79004 - protein, 9 aa, Homo Sapiens
SVYQTLCFE

SEQ ID NO: 79005 - protein, 9 aa, Homo Sapiens
RPKATLQDF

SEQ ID NO: 79006 - protein, 9 aa, Homo Sapiens
QIIGGHQVT

SEQ ID NO: 79007 - protein, 9 aa, Homo Sapiens
PHVLKKEKT

SEQ ID NO: 79008 - protein, 9 aa, Homo Sapiens
LSYHVLKAT

SEQ ID NO: 79009 - protein, 9 aa, Homo Sapiens
KCAVEHHAL

SEQ ID NO: 79010 - protein, 9 aa, Homo Sapiens
VSTGHATSV

SEQ ID NO: 79011 - protein, 9 aa, Homo Sapiens
QTTAKELGL

SEQ ID NO: 79012 - protein, 9 aa, Homo Sapiens
QRAAYLKKM

SEQ ID NO: 79013 - protein, 9 aa, Homo Sapiens
SGCPLADNS

SEQ ID NO: 79014 - protein, 9 aa, Homo Sapiens
SVLQRLKDQ

SEQ ID NO: 79015 - protein, 9 aa, Homo Sapiens
SSFQDIMAT

SEQ ID NO: 79016 - protein, 9 aa, Homo Sapiens
WNGQLIPYT

SEQ ID NO: 79017 - protein, 9 aa, Homo Sapiens
MCHSDKFQC

SEQ ID NO: 79018 - protein, 9 aa, Homo Sapiens
QRITEIVPQ

SEQ ID NO: 79019 - protein, 9 aa, Homo Sapiens
GSVCCDQGC

SEQ ID NO: 79020 - protein, 9 aa, Homo Sapiens
NPFPLSQLQ

SEQ ID NO: 79021 - protein, 9 aa, Homo Sapiens
RGRMSMKQV

SEQ ID NO: 79022 - protein, 9 aa, Homo Sapiens
LKSQKVEQI

SEQ ID NO: 79023 - protein, 9 aa, Homo Sapiens
VHRELKSQK

SEQ ID NO: 79024 - protein, 9 aa, Homo Sapiens
APSQLPLSV

SEQ ID NO: 79025 - protein, 9 aa, Homo Sapiens
LEQGRFGPN

SEQ ID NO: 79026 - protein, 9 aa, Homo Sapiens
KRTHIKNTM

SEQ ID NO: 79027 - protein, 9 aa, Homo Sapiens
GVPESCNLR

SEQ ID NO: 79028 - protein, 9 aa, Homo Sapiens
GAQIIGGHQ

SEQ ID NO: 79029 - protein, 9 aa, Homo Sapiens
FMNCALQCL

SEQ ID NO: 79030 - protein, 9 aa, Homo Sapiens
LFLLIWSVG

SEQ ID NO: 79031 - protein, 9 aa, Homo Sapiens
FEPSLASSG

SEQ ID NO: 79032 - protein, 9 aa, Homo Sapiens
VSDLPFPLP

SEQ ID NO: 79033 - protein, 9 aa, Homo Sapiens
DSISSSSSL

SEQ ID NO: 79034 - protein, 9 aa, Homo Sapiens
AGLLEQIRH

SEQ ID NO: 79035 - protein, 9 aa, Homo Sapiens
LIDRALSRF

SEQ ID NO: 79036 - protein, 9 aa, Homo Sapiens
KPRKEKCIS

SEQ ID NO: 79037 - protein, 9 aa, Homo Sapiens
KADEISDEN

SEQ ID NO: 79038 - protein, 9 aa, Homo Sapiens
NYQTAEGVS

SEQ ID NO: 79039 - protein, 9 aa, Homo Sapiens
KLDKLQFII

SEQ ID NO: 79040 - protein, 9 aa, Homo Sapiens
AQGEAARMQ

SEQ ID NO: 79041 - protein, 9 aa, Homo Sapiens
AKIINLYYH

SEQ ID NO: 79042 - protein, 9 aa, Homo Sapiens
ARSSPTTSM

SEQ ID NO: 79043 - protein, 9 aa, Homo Sapiens
KRRQQMQRN

SEQ ID NO: 79044 - protein, 9 aa, Homo Sapiens
YYSESWTVW

SEQ ID NO: 79045 - protein, 9 aa, Homo Sapiens
DALLLIVNR

SEQ ID NO: 79046 - protein, 9 aa, Homo Sapiens
FFVTATYQS

SEQ ID NO: 79047 - protein, 9 aa, Homo Sapiens
FRVHMIMHT

SEQ ID NO: 79048 - protein, 9 aa, Homo Sapiens
PSLFASYTR

SEQ ID NO: 79049 - protein, 9 aa, Homo Sapiens
FALSHHSPR

SEQ ID NO: 79050 - protein, 9 aa, Homo Sapiens
GIQHTNSKK

SEQ ID NO: 79051 - protein, 9 aa, Homo Sapiens
QLSRNRGNT

SEQ ID NO: 79052 - protein, 9 aa, Homo Sapiens
QSQNMMMKS

SEQ ID NO: 79053 - protein, 9 aa, Homo Sapiens
NKDEEEEGK

SEQ ID NO: 79054 - protein, 9 aa, Homo Sapiens
IPLSPHTQV

SEQ ID NO: 79055 - protein, 9 aa, Homo Sapiens
WNPYKMMGV

SEQ ID NO: 79056 - protein, 9 aa, Homo Sapiens
QVFAKNFDV

SEQ ID NO: 79057 - protein, 9 aa, Homo Sapiens
NRQALDLVA

SEQ ID NO: 79058 - protein, 9 aa, Homo Sapiens
EVTLGEQNR

SEQ ID NO: 79059 - protein, 9 aa, Homo Sapiens
SNTKPVLSS

SEQ ID NO: 79060 - protein, 9 aa, Homo Sapiens
EEKKCRYIK

SEQ ID NO: 79061 - protein, 9 aa, Homo Sapiens
EQQARRQEK

SEQ ID NO: 79062 - protein, 9 aa, Homo Sapiens
LLAAQGLSS

SEQ ID NO: 79063 - protein, 9 aa, Homo Sapiens
PIQKAQGPI

SEQ ID NO: 79064 - protein, 9 aa, Homo Sapiens
IRIHLLAAQ

SEQ ID NO: 79065 - protein, 9 aa, Homo Sapiens
TDEHYTVKT

SEQ ID NO: 79066 - protein, 9 aa, Homo Sapiens
DDALLLIVN

SEQ ID NO: 79067 - protein, 9 aa, Homo Sapiens
QGEAARMQL

SEQ ID NO: 79068 - protein, 9 aa, Homo Sapiens
EVAKMRQML

SEQ ID NO: 79069 - protein, 9 aa, Homo Sapiens
VVLEEGTRY

SEQ ID NO: 79070 - protein, 9 aa, Homo Sapiens
VFAKNFDVK

SEQ ID NO: 79071 - protein, 9 aa, Homo Sapiens
FAKNFDVKA

SEQ ID NO: 79072 - protein, 9 aa, Homo Sapiens
GSEGEGEGK

SEQ ID NO: 79073 - protein, 9 aa, Homo Sapiens
SSSSLADDH

SEQ ID NO: 79074 - protein, 9 aa, Homo Sapiens
PGPLPASHP

SEQ ID NO: 79075 - protein, 9 aa, Homo Sapiens
AGKPESNLK

SEQ ID NO: 79076 - protein, 9 aa, Homo Sapiens
DTSEVNLFV

SEQ ID NO: 79077 - protein, 9 aa, Homo Sapiens
QLILDCWQK

SEQ ID NO: 79078 - protein, 9 aa, Homo Sapiens
LCDLLAGMA

SEQ ID NO: 79079 - protein, 9 aa, Homo Sapiens
TCDENTQET

SEQ ID NO: 79080 - protein, 9 aa, Homo Sapiens
ATIIRHNQA

SEQ ID NO: 79081 - protein, 9 aa, Homo Sapiens
DKLQFIIIE

SEQ ID NO: 79082 - protein, 9 aa, Homo Sapiens
IIRHNQALR

SEQ ID NO: 79083 - protein, 9 aa, Homo Sapiens
CGQGKACYR

SEQ ID NO: 79084 - protein, 9 aa, Homo Sapiens
SLLSCLSKL

SEQ ID NO: 79085 - protein, 9 aa, Homo Sapiens
ACYRRFMSM

SEQ ID NO: 79086 - protein, 9 aa, Homo Sapiens
GTLGRIRFK

SEQ ID NO: 79087 - protein, 9 aa, Homo Sapiens
VNLLSPEAA

SEQ ID NO: 79088 - protein, 9 aa, Homo Sapiens
LTVMIKHGY

SEQ ID NO: 79089 - protein, 9 aa, Homo Sapiens
LSGCPLADN

SEQ ID NO: 79090 - protein, 9 aa, Homo Sapiens
KATLQDFPG

SEQ ID NO: 79091 - protein, 9 aa, Homo Sapiens
KNFDVKAVM

SEQ ID NO: 79092 - protein, 9 aa, Homo Sapiens
EYEPQPEPV

SEQ ID NO: 79093 - protein, 9 aa, Homo Sapiens
LRDFSNLNK

SEQ ID NO: 79094 - protein, 9 aa, Homo Sapiens
RPSLSNENL

SEQ ID NO: 79095 - protein, 9 aa, Homo Sapiens
QAKERLDME

SEQ ID NO: 79096 - protein, 9 aa, Homo Sapiens
EHHALFRLR

SEQ ID NO: 79097 - protein, 9 aa, Homo Sapiens
STSCSRFIR

SEQ ID NO: 79098 - protein, 9 aa, Homo Sapiens
LQVQLKTRK

SEQ ID NO: 79099 - protein, 9 aa, Homo Sapiens
RDFSNLNKQ

SEQ ID NO: 79100 - protein, 9 aa, Homo Sapiens
SIPEHDKAD

SEQ ID NO: 79101 - protein, 9 aa, Homo Sapiens
CPAALYQLI

SEQ ID NO: 79102 - protein, 9 aa, Homo Sapiens
KDINFKIQR

SEQ ID NO: 79103 - protein, 9 aa, Homo Sapiens
CSVALAVLA

SEQ ID NO: 79104 - protein, 9 aa, Homo Sapiens
SSNTKPVLS

SEQ ID NO: 79105 - protein, 9 aa, Homo Sapiens
REYKFDVSL

SEQ ID NO: 79106 - protein, 9 aa, Homo Sapiens
SSSNTKPVL

SEQ ID NO: 79107 - protein, 9 aa, Homo Sapiens
KYYLDSLNR

SEQ ID NO: 79108 - protein, 9 aa, Homo Sapiens
QSSKEEEDK

SEQ ID NO: 79109 - protein, 9 aa, Homo Sapiens
KSIIKKRDG

SEQ ID NO: 79110 - protein, 9 aa, Homo Sapiens
QLKTRKTCF

SEQ ID NO: 79111 - protein, 9 aa, Homo Sapiens
LSPVLYVME

SEQ ID NO: 79112 - protein, 9 aa, Homo Sapiens
KLSPSVIDG

SEQ ID NO: 79113 - protein, 9 aa, Homo Sapiens
SKNGVQEFA

SEQ ID NO: 79114 - protein, 9 aa, Homo Sapiens
GFEPSLASS

SEQ ID NO: 79115 - protein, 9 aa, Homo Sapiens
MIQQEHKRQ

SEQ ID NO: 79116 - protein, 9 aa, Homo Sapiens
TPEAIAGLC

SEQ ID NO: 79117 - protein, 9 aa, Homo Sapiens
SLFASYTRL

SEQ ID NO: 79118 - protein, 9 aa, Homo Sapiens
KSTLEPKGM

SEQ ID NO: 79119 - protein, 9 aa, Homo Sapiens
VHMIMHTGG

SEQ ID NO: 79120 - protein, 9 aa, Homo Sapiens
ICCFDSFKY

SEQ ID NO: 79121 - protein, 9 aa, Homo Sapiens
KVFKDQVKE

SEQ ID NO: 79122 - protein, 9 aa, Homo Sapiens
IRQADLKNW

SEQ ID NO: 79123 - protein, 9 aa, Homo Sapiens
AYMKGTPEA

SEQ ID NO: 79124 - protein, 9 aa, Homo Sapiens
CEMKKCSDY

SEQ ID NO: 79125 - protein, 9 aa, Homo Sapiens
NESPFLNIL

SEQ ID NO: 79126 - protein, 9 aa, Homo Sapiens
ECLDDRNTF

SEQ ID NO: 79127 - protein, 9 aa, Homo Sapiens
QQPDSCLPY

SEQ ID NO: 79128 - protein, 9 aa, Homo Sapiens
GRKQQRVFF

SEQ ID NO: 79129 - protein, 9 aa, Homo Sapiens
LFASYTRLF

SEQ ID NO: 79130 - protein, 9 aa, Homo Sapiens
LCLPHPKVP

SEQ ID NO: 79131 - protein, 9 aa, Homo Sapiens
KNGVQEFAE

SEQ ID NO: 79132 - protein, 9 aa, Homo Sapiens
KKEKTRPEG

SEQ ID NO: 79133 - protein, 9 aa, Homo Sapiens
WIYQPYGRK

SEQ ID NO: 79134 - protein, 9 aa, Homo Sapiens
MKLPLHKKI

SEQ ID NO: 79135 - protein, 9 aa, Homo Sapiens
KTEDLVLRK

SEQ ID NO: 79136 - protein, 9 aa, Homo Sapiens
EFAENIKCC

SEQ ID NO: 79137 - protein, 9 aa, Homo Sapiens
ETIHNIDCH

SEQ ID NO: 79138 - protein, 9 aa, Homo Sapiens
SCLQQPDSC

SEQ ID NO: 79139 - protein, 9 aa, Homo Sapiens
TAEGLWPVK

SEQ ID NO: 79140 - protein, 9 aa, Homo Sapiens
TAKELGLLS

SEQ ID NO: 79141 - protein, 9 aa, Homo Sapiens
RTCCQARTP

SEQ ID NO: 79142 - protein, 9 aa, Homo Sapiens
PNNMTLALA

SEQ ID NO: 79143 - protein, 9 aa, Homo Sapiens
KSAEATVCA

SEQ ID NO: 79144 - protein, 9 aa, Homo Sapiens
QMADHTEVI

SEQ ID NO: 79145 - protein, 9 aa, Homo Sapiens
YMKGTPEAI

SEQ ID NO: 79146 - protein, 9 aa, Homo Sapiens
GPPPPSTFH

SEQ ID NO: 79147 - protein, 9 aa, Homo Sapiens
GPWGDCSTT

SEQ ID NO: 79148 - protein, 9 aa, Homo Sapiens
SRRVRSQKP

SEQ ID NO: 79149 - protein, 9 aa, Homo Sapiens
NRLHLAFNR

SEQ ID NO: 79150 - protein, 9 aa, Homo Sapiens
AKNFDVKAV

SEQ ID NO: 79151 - protein, 9 aa, Homo Sapiens
LSNENLLIN

SEQ ID NO: 79152 - protein, 9 aa, Homo Sapiens
LPSMRTCCQ

SEQ ID NO: 79153 - protein, 9 aa, Homo Sapiens
IIDFTKEGL

SEQ ID NO: 79154 - protein, 9 aa, Homo Sapiens
LSPEAALGV

SEQ ID NO: 79155 - protein, 9 aa, Homo Sapiens
YFDYSTSDY

SEQ ID NO: 79156 - protein, 9 aa, Homo Sapiens
LVCLFALSH

SEQ ID NO: 79157 - protein, 9 aa, Homo Sapiens
RQQQQQDCQ

SEQ ID NO: 79158 - protein, 9 aa, Homo Sapiens
LKKMLLVKA

SEQ ID NO: 79159 - protein, 9 aa, Homo Sapiens
EQQPKSAEA

SEQ ID NO: 79160 - protein, 9 aa, Homo Sapiens
STFLTSSTI

SEQ ID NO: 79161 - protein, 9 aa, Homo Sapiens
QRTSKPLNC

SEQ ID NO: 79162 - protein, 9 aa, Homo Sapiens
SKEEEDKNR

SEQ ID NO: 79163 - protein, 9 aa, Homo Sapiens
YLIQQEQCA

SEQ ID NO: 79164 - protein, 9 aa, Homo Sapiens
WAGPEERLQ

SEQ ID NO: 79165 - protein, 9 aa, Homo Sapiens
LGNHQFDNG

SEQ ID NO: 79166 - protein, 9 aa, Homo Sapiens
VKVRNMSES

SEQ ID NO: 79167 - protein, 9 aa, Homo Sapiens
ICRGWYPKP

SEQ ID NO: 79168 - protein, 9 aa, Homo Sapiens
QGLLQVQLK

SEQ ID NO: 79169 - protein, 9 aa, Homo Sapiens
KQVDEQMLA

SEQ ID NO: 79170 - protein, 9 aa, Homo Sapiens
QFYYSESWT

SEQ ID NO: 79171 - protein, 9 aa, Homo Sapiens
GSDNESDKE

SEQ ID NO: 79172 - protein, 9 aa, Homo Sapiens
GPLILGCGP

SEQ ID NO: 79173 - protein, 9 aa, Homo Sapiens
VTNEERLQE

SEQ ID NO: 79174 - protein, 9 aa, Homo Sapiens
MWISPDFLC

SEQ ID NO: 79175 - protein, 9 aa, Homo Sapiens
LNRIGAADY

SEQ ID NO: 79176 - protein, 9 aa, Homo Sapiens
MPDPQSVSQ

SEQ ID NO: 79177 - protein, 9 aa, Homo Sapiens
WPVKEVGMY

SEQ ID NO: 79178 - protein, 9 aa, Homo Sapiens
ISRECAVKA

SEQ ID NO: 79179 - protein, 9 aa, Homo Sapiens
LKVNLLSPE

SEQ ID NO: 79180 - protein, 9 aa, Homo Sapiens
LLEQIRHME

SEQ ID NO: 79181 - protein, 9 aa, Homo Sapiens
LRVSTCDEN

SEQ ID NO: 79182 - protein, 9 aa, Homo Sapiens
ISSSSSLAD

SEQ ID NO: 79183 - protein, 9 aa, Homo Sapiens
FNKDEEEEG

SEQ ID NO: 79184 - protein, 9 aa, Homo Sapiens
TEETWVECW

SEQ ID NO: 79185 - protein, 9 aa, Homo Sapiens
RAYFMFDTR

SEQ ID NO: 79186 - protein, 9 aa, Homo Sapiens
LILGCGPLN

SEQ ID NO: 79187 - protein, 9 aa, Homo Sapiens
MFRDGKEPK

SEQ ID NO: 79188 - protein, 9 aa, Homo Sapiens
EGLWPVKEV

SEQ ID NO: 79189 - protein, 9 aa, Homo Sapiens
VRKFFLFLD

SEQ ID NO: 79190 - protein, 9 aa, Homo Sapiens
RQEKLQRRQ

SEQ ID NO: 79191 - protein, 9 aa, Homo Sapiens
PLSVSRLKR

SEQ ID NO: 79192 - protein, 9 aa, Homo Sapiens
KIVSSYIMW

SEQ ID NO: 79193 - protein, 9 aa, Homo Sapiens
GGVYSAGKL

SEQ ID NO: 79194 - protein, 9 aa, Homo Sapiens
NLKEVVTAS

SEQ ID NO: 79195 - protein, 9 aa, Homo Sapiens
KPEQTTEYL

SEQ ID NO: 79196 - protein, 9 aa, Homo Sapiens
LKDINFKIQ

SEQ ID NO: 79197 - protein, 9 aa, Homo Sapiens
PSMIPIQKA

SEQ ID NO: 79198 - protein, 9 aa, Homo Sapiens
TTEYLAMAS

SEQ ID NO: 79199 - protein, 9 aa, Homo Sapiens
MWFNKDEEE

SEQ ID NO: 79200 - protein, 9 aa, Homo Sapiens
QHLQAEMQS

SEQ ID NO: 79201 - protein, 9 aa, Homo Sapiens
LDRIDSADL

SEQ ID NO: 79202 - protein, 9 aa, Homo Sapiens
THSRAPSLF

SEQ ID NO: 79203 - protein, 9 aa, Homo Sapiens
MALGNHQFD

SEQ ID NO: 79204 - protein, 9 aa, Homo Sapiens
QLLHSGGRV

SEQ ID NO: 79205 - protein, 9 aa, Homo Sapiens
TQNRQALDL

SEQ ID NO: 79206 - protein, 9 aa, Homo Sapiens
QVLPGHSLS

SEQ ID NO: 79207 - protein, 9 aa, Homo Sapiens
GAEVILVLQ

SEQ ID NO: 79208 - protein, 9 aa, Homo Sapiens
HQTPLPSKE

SEQ ID NO: 79209 - protein, 9 aa, Homo Sapiens
ERLQEEKEQ

SEQ ID NO: 79210 - protein, 9 aa, Homo Sapiens
PLPASHPLF

SEQ ID NO: 79211 - protein, 9 aa, Homo Sapiens
IQEVLMFKT

SEQ ID NO: 79212 - protein, 9 aa, Homo Sapiens
SLQRAAYLK

SEQ ID NO: 79213 - protein, 9 aa, Homo Sapiens
KPTVGPPEK

SEQ ID NO: 79214 - protein, 9 aa, Homo Sapiens
WKPQLQKLL

SEQ ID NO: 79215 - protein, 9 aa, Homo Sapiens
AAQGLSSKD

SEQ ID NO: 79216 - protein, 9 aa, Homo Sapiens
EDKGEYVIK

SEQ ID NO: 79217 - protein, 9 aa, Homo Sapiens
KINSSPALL

SEQ ID NO: 79218 - protein, 9 aa, Homo Sapiens
ESIRQADLK

SEQ ID NO: 79219 - protein, 9 aa, Homo Sapiens
FKVVRNDNQ

SEQ ID NO: 79220 - protein, 9 aa, Homo Sapiens
YLCKPEDNM

SEQ ID NO: 79221 - protein, 9 aa, Homo Sapiens
RFSITHVSH

SEQ ID NO: 79222 - protein, 9 aa, Homo Sapiens
PTFLHKDGG

SEQ ID NO: 79223 - protein, 9 aa, Homo Sapiens
VEVVSQLLQ

SEQ ID NO: 79224 - protein, 9 aa, Homo Sapiens
HPVPENHLL

SEQ ID NO: 79225 - protein, 9 aa, Homo Sapiens
VQLKPRPPE

SEQ ID NO: 79226 - protein, 9 aa, Homo Sapiens
AGPEERLQR

SEQ ID NO: 79227 - protein, 9 aa, Homo Sapiens
GQMASVNMD

SEQ ID NO: 79228 - protein, 9 aa, Homo Sapiens
VRLSVLQRL

SEQ ID NO: 79229 - protein, 9 aa, Homo Sapiens
SWKFQTCHS

SEQ ID NO: 79230 - protein, 9 aa, Homo Sapiens
GNHQFDNGV

SEQ ID NO: 79231 - protein, 9 aa, Homo Sapiens
EKEEKEYEP

SEQ ID NO: 79232 - protein, 9 aa, Homo Sapiens
IQATIIRHN

SEQ ID NO: 79233 - protein, 9 aa, Homo Sapiens
HRELKSQKV

SEQ ID NO: 79234 - protein, 9 aa, Homo Sapiens
AAASLRCLN

SEQ ID NO: 79235 - protein, 9 aa, Homo Sapiens
QNSWLSYHV

SEQ ID NO: 79236 - protein, 9 aa, Homo Sapiens
SPGIGKVSG

SEQ ID NO: 79237 - protein, 9 aa, Homo Sapiens
FKRSWSVNL

SEQ ID NO: 79238 - protein, 9 aa, Homo Sapiens
KVMEYTTIL

SEQ ID NO: 79239 - protein, 9 aa, Homo Sapiens
LFHCTLYVL

SEQ ID NO: 79240 - protein, 9 aa, Homo Sapiens
PAALYQLIL

SEQ ID NO: 79241 - protein, 9 aa, Homo Sapiens
KYMQKTCSI

SEQ ID NO: 79242 - protein, 9 aa, Homo Sapiens
ASEALPNNM

SEQ ID NO: 79243 - protein, 9 aa, Homo Sapiens
TSDYEHSRR

SEQ ID NO: 79244 - protein, 9 aa, Homo Sapiens
NLEKMCRAV

SEQ ID NO: 79245 - protein, 9 aa, Homo Sapiens
QLDTLEDKE

SEQ ID NO: 79246 - protein, 9 aa, Homo Sapiens
FLSCWVRGG

SEQ ID NO: 79247 - protein, 9 aa, Homo Sapiens
LPFKRSWSV

SEQ ID NO: 79248 - protein, 9 aa, Homo Sapiens
VLLYLFASL

SEQ ID NO: 79249 - protein, 9 aa, Homo Sapiens
DICCFDSFK

SEQ ID NO: 79250 - protein, 9 aa, Homo Sapiens
LRNVSAKDA

SEQ ID NO: 79251 - protein, 9 aa, Homo Sapiens
SFNSTTDSA

SEQ ID NO: 79252 - protein, 9 aa, Homo Sapiens
LDNYQTAEG

SEQ ID NO: 79253 - protein, 9 aa, Homo Sapiens
GTGQGSLLL

SEQ ID NO: 79254 - protein, 9 aa, Homo Sapiens
RAAYTIIGF

SEQ ID NO: 79255 - protein, 9 aa, Homo Sapiens
LVKAEAEAA

SEQ ID NO: 79256 - protein, 9 aa, Homo Sapiens
SAKDAGEYT

SEQ ID NO: 79257 - protein, 9 aa, Homo Sapiens
TWNPYKMMG

SEQ ID NO: 79258 - protein, 9 aa, Homo Sapiens
AFFVTATYQ

SEQ ID NO: 79259 - protein, 9 aa, Homo Sapiens
FCPFQKNVE

SEQ ID NO: 79260 - protein, 9 aa, Homo Sapiens
QRSKSAPPR

SEQ ID NO: 79261 - protein, 9 aa, Homo Sapiens
NRQVPREQA

SEQ ID NO: 79262 - protein, 9 aa, Homo Sapiens
CGHMASYPL

SEQ ID NO: 79263 - protein, 9 aa, Homo Sapiens
SQLPLSVSR

SEQ ID NO: 79264 - protein, 9 aa, Homo Sapiens
QDCEMKKCS

SEQ ID NO: 79265 - protein, 9 aa, Homo Sapiens
DKTGLRITV

SEQ ID NO: 79266 - protein, 9 aa, Homo Sapiens
EEELLEQLC

SEQ ID NO: 79267 - protein, 9 aa, Homo Sapiens
ASHPLFGRL

SEQ ID NO: 79268 - protein, 9 aa, Homo Sapiens
SLNRIGAAD

SEQ ID NO: 79269 - protein, 9 aa, Homo Sapiens
DKEVAGKKS

SEQ ID NO: 79270 - protein, 9 aa, Homo Sapiens
LNQEEEKKC

SEQ ID NO: 79271 - protein, 9 aa, Homo Sapiens
EEQKPRKEK

SEQ ID NO: 79272 - protein, 9 aa, Homo Sapiens
QQEQCAEMK

SEQ ID NO: 79273 - protein, 9 aa, Homo Sapiens
HLDKLSSYH

SEQ ID NO: 79274 - protein, 9 aa, Homo Sapiens
HSDAESKRG

SEQ ID NO: 79275 - protein, 9 aa, Homo Sapiens
QFTSTEETW

SEQ ID NO: 79276 - protein, 9 aa, Homo Sapiens
EEGIKVFKD

SEQ ID NO: 79277 - protein, 9 aa, Homo Sapiens
VRFLTVMIK

SEQ ID NO: 79278 - protein, 9 aa, Homo Sapiens
EDDETPQLC

SEQ ID NO: 79279 - protein, 9 aa, Homo Sapiens
DCSTTCGGG

SEQ ID NO: 79280 - protein, 9 aa, Homo Sapiens
STCDENTQE

SEQ ID NO: 79281 - protein, 9 aa, Homo Sapiens
LCKPEDNMY

SEQ ID NO: 79282 - protein, 9 aa, Homo Sapiens
KQSSKEEED

SEQ ID NO: 79283 - protein, 9 aa, Homo Sapiens
KGTNEVPVP

SEQ ID NO: 79284 - protein, 9 aa, Homo Sapiens
ILVLQKYSE

SEQ ID NO: 79285 - protein, 9 aa, Homo Sapiens
DETPQLCAH

SEQ ID NO: 79286 - protein, 9 aa, Homo Sapiens
SVSQDSTTP

SEQ ID NO: 79287 - protein, 9 aa, Homo Sapiens
LTSSTIRSR

SEQ ID NO: 79288 - protein, 9 aa, Homo Sapiens
RVKLIVNLD

SEQ ID NO: 79289 - protein, 9 aa, Homo Sapiens
FDVSLELLE

SEQ ID NO: 79290 - protein, 9 aa, Homo Sapiens
VAGKPESNL

SEQ ID NO: 79291 - protein, 9 aa, Homo Sapiens
LASEALPNN

SEQ ID NO: 79292 - protein, 9 aa, Homo Sapiens
HVSHSDAES

SEQ ID NO: 79293 - protein, 9 aa, Homo Sapiens
RRQQMQRNL

SEQ ID NO: 79294 - protein, 9 aa, Homo Sapiens
ELGKDLFHC

SEQ ID NO: 79295 - protein, 9 aa, Homo Sapiens
RVRSQKPTV

SEQ ID NO: 79296 - protein, 9 aa, Homo Sapiens
KVNLLSPEA

SEQ ID NO: 79297 - protein, 9 aa, Homo Sapiens
LRSGQGLDG

SEQ ID NO: 79298 - protein, 9 aa, Homo Sapiens
GEDKGEYVI

SEQ ID NO: 79299 - protein, 9 aa, Homo Sapiens
YLAMASLAG

SEQ ID NO: 79300 - protein, 9 aa, Homo Sapiens
AKELGLLSS

SEQ ID NO: 79301 - protein, 9 aa, Homo Sapiens
QFKVVRNDN

SEQ ID NO: 79302 - protein, 9 aa, Homo Sapiens
MQGNPPQRS

SEQ ID NO: 79303 - protein, 9 aa, Homo Sapiens
SANASVNDS

SEQ ID NO: 79304 - protein, 9 aa, Homo Sapiens
ILGCGPLNP

SEQ ID NO: 79305 - protein, 9 aa, Homo Sapiens
SVCCDQGCG

SEQ ID NO: 79306 - protein, 9 aa, Homo Sapiens
ATYQSLLRG

SEQ ID NO: 79307 - protein, 9 aa, Homo Sapiens
DQVFAKNFD

SEQ ID NO: 79308 - protein, 9 aa, Homo Sapiens
VTLRDFSNL

SEQ ID NO: 79309 - protein, 9 aa, Homo Sapiens
DKKFFQLSE

SEQ ID NO: 79310 - protein, 9 aa, Homo Sapiens
SDKEVAGKK

SEQ ID NO: 79311 - protein, 9 aa, Homo Sapiens
MKVQDREGP

SEQ ID NO: 79312 - protein, 9 aa, Homo Sapiens
LQRITEIVP

SEQ ID NO: 79313 - protein, 9 aa, Homo Sapiens
ITEIVPQYV

SEQ ID NO: 79314 - protein, 9 aa, Homo Sapiens
SQAPCSKTS

SEQ ID NO: 79315 - protein, 9 aa, Homo Sapiens
SYQHLQAEM

SEQ ID NO: 79316 - protein, 9 aa, Homo Sapiens
KPSAEAAAA

SEQ ID NO: 79317 - protein, 9 aa, Homo Sapiens
LEQIRHMET

SEQ ID NO: 79318 - protein, 9 aa, Homo Sapiens
VSGHYIPAI

SEQ ID NO: 79319 - protein, 9 aa, Homo Sapiens
ESHPVPENH

SEQ ID NO: 79320 - protein, 9 aa, Homo Sapiens
ANASVNDSR

SEQ ID NO: 79321 - protein, 9 aa, Homo Sapiens
RIRFKFSNN

SEQ ID NO: 79322 - protein, 9 aa, Homo Sapiens
IYVFEAKVL

SEQ ID NO: 79323 - protein, 9 aa, Homo Sapiens
CKPEDNMYS

SEQ ID NO: 79324 - protein, 9 aa, Homo Sapiens
HGETGNWHS

SEQ ID NO: 79325 - protein, 9 aa, Homo Sapiens
VESKLIKKI

SEQ ID NO: 79326 - protein, 9 aa, Homo Sapiens
VKLIVNLDC

SEQ ID NO: 79327 - protein, 9 aa, Homo Sapiens
YRKENDMAQ

SEQ ID NO: 79328 - protein, 9 aa, Homo Sapiens
QEVLMFKTE

SEQ ID NO: 79329 - protein, 9 aa, Homo Sapiens
DCHSTDNMS

SEQ ID NO: 79330 - protein, 9 aa, Homo Sapiens
KSQKVEQIK

SEQ ID NO: 79331 - protein, 9 aa, Homo Sapiens
PGMCHSDKF

SEQ ID NO: 79332 - protein, 9 aa, Homo Sapiens
VATNGGLPP

SEQ ID NO: 79333 - protein, 9 aa, Homo Sapiens
FAQDCEMKK

SEQ ID NO: 79334 - protein, 9 aa, Homo Sapiens
GFVNYVKVR

SEQ ID NO: 79335 - protein, 9 aa, Homo Sapiens
KPLNCDYSI

SEQ ID NO: 79336 - protein, 9 aa, Homo Sapiens
GLNCCGQGK

SEQ ID NO: 79337 - protein, 9 aa, Homo Sapiens
MKQVDEQML

SEQ ID NO: 79338 - protein, 9 aa, Homo Sapiens
YRRFMSMND

SEQ ID NO: 79339 - protein, 9 aa, Homo Sapiens
KTDNFSSVL

SEQ ID NO: 79340 - protein, 9 aa, Homo Sapiens
LQFIIIEEL

SEQ ID NO: 79341 - protein, 9 aa, Homo Sapiens
VSHSRRESR

SEQ ID NO: 79342 - protein, 9 aa, Homo Sapiens
PRPPEGLVR

SEQ ID NO: 79343 - protein, 9 aa, Homo Sapiens
LTPCSNMVQ

SEQ ID NO: 79344 - protein, 9 aa, Homo Sapiens
QEFAENIKC

SEQ ID NO: 79345 - protein, 9 aa, Homo Sapiens
FLHKDGGLV

SEQ ID NO: 79346 - protein, 9 aa, Homo Sapiens
IRFKFSNNA

SEQ ID NO: 79347 - protein, 9 aa, Homo Sapiens
RLQEEAVFG

SEQ ID NO: 79348 - protein, 9 aa, Homo Sapiens
AAQDLPFKR

SEQ ID NO: 79349 - protein, 9 aa, Homo Sapiens
CHSTDNMSK

SEQ ID NO: 79350 - protein, 9 aa, Homo Sapiens
RIDSADLNG

SEQ ID NO: 79351 - protein, 9 aa, Homo Sapiens
ATSVPVTSL

SEQ ID NO: 79352 - protein, 9 aa, Homo Sapiens
LDSIIDFTK

SEQ ID NO: 79353 - protein, 9 aa, Homo Sapiens
LRVECLDDR

SEQ ID NO: 79354 - protein, 9 aa, Homo Sapiens
KAEAEAAAG

SEQ ID NO: 79355 - protein, 9 aa, Homo Sapiens
AMIFAIEKI

SEQ ID NO: 79356 - protein, 9 aa, Homo Sapiens
EGIKVFKDQ

SEQ ID NO: 79357 - protein, 9 aa, Homo Sapiens
EIRVGMIDD

SEQ ID NO: 79358 - protein, 9 aa, Homo Sapiens
RECAVKAIE

SEQ ID NO: 79359 - protein, 9 aa, Homo Sapiens
LLYDVRAQK

SEQ ID NO: 79360 - protein, 9 aa, Homo Sapiens
FTKEGLSNC

SEQ ID NO: 79361 - protein, 9 aa, Homo Sapiens
SAEATVCAN

SEQ ID NO: 79362 - protein, 9 aa, Homo Sapiens
CQEKERELG

SEQ ID NO: 79363 - protein, 9 aa, Homo Sapiens
TLAMPEQMK

SEQ ID NO: 79364 - protein, 9 aa, Homo Sapiens
GRLRSGQGL

SEQ ID NO: 79365 - protein, 9 aa, Homo Sapiens
PFARSSPTT

SEQ ID NO: 79366 - protein, 9 aa, Homo Sapiens
QLSNEGVMN

SEQ ID NO: 79367 - protein, 9 aa, Homo Sapiens
EERLQEEAV

SEQ ID NO: 79368 - protein, 9 aa, Homo Sapiens
VPQYVSAFA

SEQ ID NO: 79369 - protein, 9 aa, Homo Sapiens
KSIIDKKFF

SEQ ID NO: 79370 - protein, 9 aa, Homo Sapiens
EFVMERQRQ

SEQ ID NO: 79371 - protein, 9 aa, Homo Sapiens
FDSFKYVKT

SEQ ID NO: 79372 - protein, 9 aa, Homo Sapiens
PESNLKEVV

SEQ ID NO: 79373 - protein, 9 aa, Homo Sapiens
GEGKTEGDV

SEQ ID NO: 79374 - protein, 9 aa, Homo Sapiens
MSDLLSPVL

SEQ ID NO: 79375 - protein, 9 aa, Homo Sapiens
LFQNKYFRN

SEQ ID NO: 79376 - protein, 9 aa, Homo Sapiens
IAFQGHQGY

SEQ ID NO: 79377 - protein, 9 aa, Homo Sapiens
DITLLNTQE

SEQ ID NO: 79378 - protein, 9 aa, Homo Sapiens
VPVTSLSSV

SEQ ID NO: 79379 - protein, 9 aa, Homo Sapiens
EEDKNRKCS

SEQ ID NO: 79380 - protein, 9 aa, Homo Sapiens
EGIFLFLLI

SEQ ID NO: 79381 - protein, 9 aa, Homo Sapiens
TPCSNMVQE

SEQ ID NO: 79382 - protein, 9 aa, Homo Sapiens
IRLECICRG

SEQ ID NO: 79383 - protein, 9 aa, Homo Sapiens
AARMQLLHS

SEQ ID NO: 79384 - protein, 9 aa, Homo Sapiens
GKACYRWSK

SEQ ID NO: 79385 - protein, 9 aa, Homo Sapiens
FVELNYSFD

SEQ ID NO: 79386 - protein, 9 aa, Homo Sapiens
KSKQRQGLD

SEQ ID NO: 79387 - protein, 9 aa, Homo Sapiens
TSVPVTSLS

SEQ ID NO: 79388 - protein, 9 aa, Homo Sapiens
KDTDITLLN

SEQ ID NO: 79389 - protein, 9 aa, Homo Sapiens
DTDITLLNT

SEQ ID NO: 79390 - protein, 9 aa, Homo Sapiens
CRAVEDQLS

SEQ ID NO: 79391 - protein, 9 aa, Homo Sapiens
FDYSTSDYE

SEQ ID NO: 79392 - protein, 9 aa, Homo Sapiens
APSLFASYT

SEQ ID NO: 79393 - protein, 9 aa, Homo Sapiens
LTKGTNEVP

SEQ ID NO: 79394 - protein, 9 aa, Homo Sapiens
YQLILDCWQ

SEQ ID NO: 79395 - protein, 9 aa, Homo Sapiens
TLSTTCGHM

SEQ ID NO: 79396 - protein, 9 aa, Homo Sapiens
RMGRLRSGQ

SEQ ID NO: 79397 - protein, 9 aa, Homo Sapiens
SISSSSSLA

SEQ ID NO: 79398 - protein, 9 aa, Homo Sapiens
HQGYLRLPG

SEQ ID NO: 79399 - protein, 9 aa, Homo Sapiens
TVWLPSMRT

SEQ ID NO: 79400 - protein, 9 aa, Homo Sapiens
KNPSMIPIQ

SEQ ID NO: 79401 - protein, 9 aa, Homo Sapiens
KRSWSVNLD

SEQ ID NO: 79402 - protein, 9 aa, Homo Sapiens
EAKVLTGFF

SEQ ID NO: 79403 - protein, 9 aa, Homo Sapiens
SPKTDEFLD

SEQ ID NO: 79404 - protein, 9 aa, Homo Sapiens
YSTSDYEHS

SEQ ID NO: 79405 - protein, 9 aa, Homo Sapiens
TGGRPYECK

SEQ ID NO: 79406 - protein, 9 aa, Homo Sapiens
RSGQGLDGA

SEQ ID NO: 79407 - protein, 9 aa, Homo Sapiens
QKKKKHRNT

SEQ ID NO: 79408 - protein, 9 aa, Homo Sapiens
KDEEEEGKA

SEQ ID NO: 79409 - protein, 9 aa, Homo Sapiens
MIFAIEKIN

SEQ ID NO: 79410 - protein, 9 aa, Homo Sapiens
FLLFMWVLP

SEQ ID NO: 79411 - protein, 9 aa, Homo Sapiens
ILKSIIKKR

SEQ ID NO: 79412 - protein, 9 aa, Homo Sapiens
TVMIKHGYI

SEQ ID NO: 79413 - protein, 9 aa, Homo Sapiens
SLSNENLLI

SEQ ID NO: 79414 - protein, 9 aa, Homo Sapiens
QTPLPSKES

SEQ ID NO: 79415 - protein, 9 aa, Homo Sapiens
AAYLKKMLL

SEQ ID NO: 79416 - protein, 9 aa, Homo Sapiens
FRDGKEPKP

SEQ ID NO: 79417 - protein, 9 aa, Homo Sapiens
IDKKFFQLS

SEQ ID NO: 79418 - protein, 9 aa, Homo Sapiens
NWHSDSPRH

SEQ ID NO: 79419 - protein, 9 aa, Homo Sapiens
SSLASSNLS

SEQ ID NO: 79420 - protein, 9 aa, Homo Sapiens
TPLPSKESC

SEQ ID NO: 79421 - protein, 9 aa, Homo Sapiens
STVRAAYTI

SEQ ID NO: 79422 - protein, 9 aa, Homo Sapiens
YSTFLTSST

SEQ ID NO: 79423 - protein, 9 aa, Homo Sapiens
YNQHAYPTS

SEQ ID NO: 79424 - protein, 9 aa, Homo Sapiens
HLLAAQGLS

SEQ ID NO: 79425 - protein, 9 aa, Homo Sapiens
LSTTCGHMA

SEQ ID NO: 79426 - protein, 9 aa, Homo Sapiens
AIEKINSSP

SEQ ID NO: 79427 - protein, 9 aa, Homo Sapiens
AALYQLILD

SEQ ID NO: 79428 - protein, 9 aa, Homo Sapiens
LLRKSKQRQ

SEQ ID NO: 79429 - protein, 9 aa, Homo Sapiens
MWVSVKEVS

SEQ ID NO: 79430 - protein, 9 aa, Homo Sapiens
FLLIWSVGA

SEQ ID NO: 79431 - protein, 9 aa, Homo Sapiens
SQKVEQIKL

SEQ ID NO: 79432 - protein, 9 aa, Homo Sapiens
EQKPRKEKC

SEQ ID NO: 79433 - protein, 9 aa, Homo Sapiens
IYQPYGRKQ

SEQ ID NO: 79434 - protein, 9 aa, Homo Sapiens
YMQKTCSIP

SEQ ID NO: 79435 - protein, 9 aa, Homo Sapiens
IPEHDKADE

SEQ ID NO: 79436 - protein, 9 aa, Homo Sapiens
DLFHCTLYV

SEQ ID NO: 79437 - protein, 9 aa, Homo Sapiens
AAGSPTSTP

SEQ ID NO: 79438 - protein, 9 aa, Homo Sapiens
EAVLRIQSA

SEQ ID NO: 79439 - protein, 9 aa, Homo Sapiens
SRPKATLQD

SEQ ID NO: 79440 - protein, 9 aa, Homo Sapiens
LIKKILLNI

SEQ ID NO: 79441 - protein, 9 aa, Homo Sapiens
PSQAPCSKT

SEQ ID NO: 79442 - protein, 9 aa, Homo Sapiens
RPQYSNPRQ

SEQ ID NO: 79443 - protein, 9 aa, Homo Sapiens
QLPLSVSRL

SEQ ID NO: 79444 - protein, 9 aa, Homo Sapiens
DVKAVMKTS

SEQ ID NO: 79445 - protein, 9 aa, Homo Sapiens
GIVSHSRRE

SEQ ID NO: 79446 - protein, 9 aa, Homo Sapiens
HLDRIDSAD

SEQ ID NO: 79447 - protein, 9 aa, Homo Sapiens
DLHRNKLYV

SEQ ID NO: 79448 - protein, 9 aa, Homo Sapiens
FARSSPTTS

SEQ ID NO: 79449 - protein, 9 aa, Homo Sapiens
GQGSLLLYD

SEQ ID NO: 79450 - protein, 9 aa, Homo Sapiens
PGIGKVSGL

SEQ ID NO: 79451 - protein, 9 aa, Homo Sapiens
PPGPPPPST

SEQ ID NO: 79452 - protein, 9 aa, Homo Sapiens
MWLLDKTGL

SEQ ID NO: 79453 - protein, 9 aa, Homo Sapiens
GHQVTPHSR

SEQ ID NO: 79454 - protein, 9 aa, Homo Sapiens
YQTAEGVSL

SEQ ID NO: 79455 - protein, 9 aa, Homo Sapiens
AYFVCTQFK

SEQ ID NO: 79456 - protein, 9 aa, Homo Sapiens
QTTEYLAMA

SEQ ID NO: 79457 - protein, 9 aa, Homo Sapiens
VIHEKWKEF

SEQ ID NO: 79458 - protein, 9 aa, Homo Sapiens
QHTNSKKQS

SEQ ID NO: 79459 - protein, 9 aa, Homo Sapiens
AGMAYKVNI

SEQ ID NO: 79460 - protein, 9 aa, Homo Sapiens
PDPQSVSQD

SEQ ID NO: 79461 - protein, 9 aa, Homo Sapiens
DYSTSDYEH

SEQ ID NO: 79462 - protein, 9 aa, Homo Sapiens
GCLRVSTCD

SEQ ID NO: 79463 - protein, 9 aa, Homo Sapiens
HKDGGLVEE

SEQ ID NO: 79464 - protein, 9 aa, Homo Sapiens
SLELLEWIW

SEQ ID NO: 79465 - protein, 9 aa, Homo Sapiens
SFQDIMATR

SEQ ID NO: 79466 - protein, 9 aa, Homo Sapiens
TQFKVVRND

SEQ ID NO: 79467 - protein, 9 aa, Homo Sapiens
PYGRKQQRV

SEQ ID NO: 79468 - protein, 9 aa, Homo Sapiens
MESIRQADL

SEQ ID NO: 79469 - protein, 9 aa, Homo Sapiens
HCLCLPHPK

SEQ ID NO: 79470 - protein, 9 aa, Homo Sapiens
QEEEQKPRK

SEQ ID NO: 79471 - protein, 9 aa, Homo Sapiens
LLPWRKSSL

SEQ ID NO: 79472 - protein, 9 aa, Homo Sapiens
HWQELSYTK

SEQ ID NO: 79473 - protein, 9 aa, Homo Sapiens
INLYYHPGC

SEQ ID NO: 79474 - protein, 9 aa, Homo Sapiens
QIQFYYSES

SEQ ID NO: 79475 - protein, 9 aa, Homo Sapiens
ILQRFLACK

SEQ ID NO: 79476 - protein, 9 aa, Homo Sapiens
SEKLSPSVI

SEQ ID NO: 79477 - protein, 9 aa, Homo Sapiens
HIESHPVPE

SEQ ID NO: 79478 - protein, 9 aa, Homo Sapiens
ALLRKSKQR

SEQ ID NO: 79479 - protein, 9 aa, Homo Sapiens
APQLTTGFE

SEQ ID NO: 79480 - protein, 9 aa, Homo Sapiens
CLNSAVECV

SEQ ID NO: 79481 - protein, 9 aa, Homo Sapiens
LPFQRLARE

SEQ ID NO: 79482 - protein, 9 aa, Homo Sapiens
LRVMKVQDR

SEQ ID NO: 79483 - protein, 9 aa, Homo Sapiens
ISPDFLCAL

SEQ ID NO: 79484 - protein, 9 aa, Homo Sapiens
GSLLLYDVR

SEQ ID NO: 79485 - protein, 9 aa, Homo Sapiens
PKSAEATVC

SEQ ID NO: 79486 - protein, 9 aa, Homo Sapiens
VYQTLCFED

SEQ ID NO: 79487 - protein, 9 aa, Homo Sapiens
FQKNVESTR

SEQ ID NO: 79488 - protein, 9 aa, Homo Sapiens
AQDLPFKRS

SEQ ID NO: 79489 - protein, 9 aa, Homo Sapiens
KIINLYYHP

SEQ ID NO: 79490 - protein, 9 aa, Homo Sapiens
DQAASVKEL

SEQ ID NO: 79491 - protein, 9 aa, Homo Sapiens
VKAKGYTMN

SEQ ID NO: 79492 - protein, 9 aa, Homo Sapiens
EGNLRVECL

SEQ ID NO: 79493 - protein, 9 aa, Homo Sapiens
DKNRKCSPE

SEQ ID NO: 79494 - protein, 9 aa, Homo Sapiens
PASHPLFGR

SEQ ID NO: 79495 - protein, 9 aa, Homo Sapiens
TEMKLPLHK

SEQ ID NO: 79496 - protein, 9 aa, Homo Sapiens
QLCAHALAA

SEQ ID NO: 79497 - protein, 9 aa, Homo Sapiens
QRLKDQADG

SEQ ID NO: 79498 - protein, 9 aa, Homo Sapiens
CSRFIRNTN

SEQ ID NO: 79499 - protein, 9 aa, Homo Sapiens
PVLYVMENE

SEQ ID NO: 79500 - protein, 9 aa, Homo Sapiens
LLLIVNRYW

SEQ ID NO: 79501 - protein, 9 aa, Homo Sapiens
TGLRITVLL

SEQ ID NO: 79502 - protein, 9 aa, Homo Sapiens
SVNDSRLEE

SEQ ID NO: 79503 - protein, 9 aa, Homo Sapiens
ESKLIKKIL

SEQ ID NO: 79504 - protein, 9 aa, Homo Sapiens
VSQDSTTPH

SEQ ID NO: 79505 - protein, 9 aa, Homo Sapiens
GTPEAIAGL

SEQ ID NO: 79506 - protein, 9 aa, Homo Sapiens
VGEVTLGEQ

SEQ ID NO: 79507 - protein, 9 aa, Homo Sapiens
QHSLKKYRK

SEQ ID NO: 79508 - protein, 9 aa, Homo Sapiens
LKSWKFQTC

SEQ ID NO: 79509 - protein, 9 aa, Homo Sapiens
KTSEAAPRE

SEQ ID NO: 79510 - protein, 9 aa, Homo Sapiens
AKGASLTPK

SEQ ID NO: 79511 - protein, 9 aa, Homo Sapiens
VGQSSLLSC

SEQ ID NO: 79512 - protein, 9 aa, Homo Sapiens
LSCWVRGGG

SEQ ID NO: 79513 - protein, 9 aa, Homo Sapiens
LSLSVTQLD

SEQ ID NO: 79514 - protein, 9 aa, Homo Sapiens
DAMALGNHQ

SEQ ID NO: 79515 - protein, 9 aa, Homo Sapiens
RQHSLKKYR

SEQ ID NO: 79516 - protein, 9 aa, Homo Sapiens
LKRRLQKMD

SEQ ID NO: 79517 - protein, 9 aa, Homo Sapiens
TAVRKFFLF

SEQ ID NO: 79518 - protein, 9 aa, Homo Sapiens
HHALFRLRG

SEQ ID NO: 79519 - protein, 9 aa, Homo Sapiens
ANSVTWNPY

SEQ ID NO: 79520 - protein, 9 aa, Homo Sapiens
AYPTSYGGK

SEQ ID NO: 79521 - protein, 9 aa, Homo Sapiens
QKNVESTRT

SEQ ID NO: 79522 - protein, 9 aa, Homo Sapiens
FLTVMIKHG

SEQ ID NO: 79523 - protein, 9 aa, Homo Sapiens
FQTTAKELG

SEQ ID NO: 79524 - protein, 9 aa, Homo Sapiens
SMIPIQKAQ

SEQ ID NO: 79525 - protein, 9 aa, Homo Sapiens
GQLIPYTSV

SEQ ID NO: 79526 - protein, 9 aa, Homo Sapiens
QMQRNLGTE

SEQ ID NO: 79527 - protein, 9 aa, Homo Sapiens
TLGEQNRKK

SEQ ID NO: 79528 - protein, 9 aa, Homo Sapiens
SVPVTSLSS

SEQ ID NO: 79529 - protein, 9 aa, Homo Sapiens
DVDFYNKKM

SEQ ID NO: 79530 - protein, 9 aa, Homo Sapiens
YTIIGFEHG

SEQ ID NO: 79531 - protein, 9 aa, Homo Sapiens
DTLEDKEQM

SEQ ID NO: 79532 - protein, 9 aa, Homo Sapiens
VSHSDAESK

SEQ ID NO: 79533 - protein, 9 aa, Homo Sapiens
SQKPTVGPP

SEQ ID NO: 79534 - protein, 9 aa, Homo Sapiens
FIVEAVLRI

SEQ ID NO: 79535 - protein, 9 aa, Homo Sapiens
GKRKLEQGR

SEQ ID NO: 79536 - protein, 9 aa, Homo Sapiens
ITLLNTQEP

SEQ ID NO: 79537 - protein, 9 aa, Homo Sapiens
DLIDRALSR

SEQ ID NO: 79538 - protein, 9 aa, Homo Sapiens
MVSGHYIPA

SEQ ID NO: 79539 - protein, 9 aa, Homo Sapiens
EDKNRKCSP

SEQ ID NO: 79540 - protein, 9 aa, Homo Sapiens
VLEEGTRYL

SEQ ID NO: 79541 - protein, 9 aa, Homo Sapiens
RAIQAKERL

SEQ ID NO: 79542 - protein, 9 aa, Homo Sapiens
QQQQDCQEK

SEQ ID NO: 79543 - protein, 9 aa, Homo Sapiens
VQLLLDRQC

SEQ ID NO: 79544 - protein, 9 aa, Homo Sapiens
AGILKSIIK

SEQ ID NO: 79545 - protein, 9 aa, Homo Sapiens
HQVLPGHSL

SEQ ID NO: 79546 - protein, 9 aa, Homo Sapiens
AQLSNEGVM

SEQ ID NO: 79547 - protein, 9 aa, Homo Sapiens
KYVKTIRQQ

SEQ ID NO: 79548 - protein, 9 aa, Homo Sapiens
AFQGHQGYL

SEQ ID NO: 79549 - protein, 9 aa, Homo Sapiens
CSIQSQNMM

SEQ ID NO: 79550 - protein, 9 aa, Homo Sapiens
HCTLYVLLK

SEQ ID NO: 79551 - protein, 9 aa, Homo Sapiens
RLHLAFNRQ

SEQ ID NO: 79552 - protein, 9 aa, Homo Sapiens
EGDQAASVK

SEQ ID NO: 79553 - protein, 9 aa, Homo Sapiens
PEGEQQPKS

SEQ ID NO: 79554 - protein, 9 aa, Homo Sapiens
FMWVLPPGT

SEQ ID NO: 79555 - protein, 9 aa, Homo Sapiens
QRVAERVAA

SEQ ID NO: 79556 - protein, 9 aa, Homo Sapiens
FECFWNGQL

SEQ ID NO: 79557 - protein, 9 aa, Homo Sapiens
NPYKMMGVL

SEQ ID NO: 79558 - protein, 9 aa, Homo Sapiens
EAALGVSGL

SEQ ID NO: 79559 - protein, 9 aa, Homo Sapiens
VQFCPFQKN

SEQ ID NO: 79560 - protein, 9 aa, Homo Sapiens
SSKRLFQNK

SEQ ID NO: 79561 - protein, 9 aa, Homo Sapiens
GLSHKVTEA

SEQ ID NO: 79562 - protein, 9 aa, Homo Sapiens
EHYTVKTDN

SEQ ID NO: 79563 - protein, 9 aa, Homo Sapiens
WSGCQVVLE

SEQ ID NO: 79564 - protein, 9 aa, Homo Sapiens
VPESCNLRL

SEQ ID NO: 79565 - protein, 9 aa, Homo Sapiens
RQALDLVAA

SEQ ID NO: 79566 - protein, 9 aa, Homo Sapiens
SRNRGNTDR

SEQ ID NO: 79567 - protein, 9 aa, Homo Sapiens
QESSFQDIM

SEQ ID NO: 79568 - protein, 9 aa, Homo Sapiens
KKKKHRNTN

SEQ ID NO: 79569 - protein, 9 aa, Homo Sapiens
KGASLTPKG

SEQ ID NO: 79570 - protein, 9 aa, Homo Sapiens
LAGMAYKVN

SEQ ID NO: 79571 - protein, 9 aa, Homo Sapiens
PSVYQTLCF

SEQ ID NO: 79572 - protein, 9 aa, Homo Sapiens
ALCLGFLTP

SEQ ID NO: 79573 - protein, 9 aa, Homo Sapiens
ILDCWQKER

SEQ ID NO: 79574 - protein, 9 aa, Homo Sapiens
GEPRAYFMF

SEQ ID NO: 79575 - protein, 9 aa, Homo Sapiens
YVFEAKVLT

SEQ ID NO: 79576 - protein, 9 aa, Homo Sapiens
GPRMVSGHY

SEQ ID NO: 79577 - protein, 9 aa, Homo Sapiens
VVSQLLQRE

SEQ ID NO: 79578 - protein, 9 aa, Homo Sapiens
FVTATYQSL

SEQ ID NO: 79579 - protein, 9 aa, Homo Sapiens
SFDFVELNY

SEQ ID NO: 79580 - protein, 9 aa, Homo Sapiens
RLRSGQGLD

SEQ ID NO: 79581 - protein, 9 aa, Homo Sapiens
YTVKTDNFS

SEQ ID NO: 79582 - protein, 9 aa, Homo Sapiens
ERLQRVAER

SEQ ID NO: 79583 - protein, 9 aa, Homo Sapiens
PPQRSKSAP

SEQ ID NO: 79584 - protein, 9 aa, Homo Sapiens
RAQGGKVME

SEQ ID NO: 79585 - protein, 9 aa, Homo Sapiens
LLDNYQTAE

SEQ ID NO: 79586 - protein, 9 aa, Homo Sapiens
SCNLRLCTL

SEQ ID NO: 79587 - protein, 9 aa, Homo Sapiens
HYEDSYQHL

SEQ ID NO: 79588 - protein, 9 aa, Homo Sapiens
LNDLIDRAL

SEQ ID NO: 79589 - protein, 9 aa, Homo Sapiens
LHKKINDFC

SEQ ID NO: 79590 - protein, 9 aa, Homo Sapiens
SDLPFPLPQ

SEQ ID NO: 79591 - protein, 9 aa, Homo Sapiens
VVSPKTDEF

SEQ ID NO: 79592 - protein, 9 aa, Homo Sapiens
FLFLLIWSV

SEQ ID NO: 79593 - protein, 9 aa, Homo Sapiens
WLSYHVLKA

SEQ ID NO: 79594 - protein, 9 aa, Homo Sapiens
TDDALLLIV

SEQ ID NO: 79595 - protein, 9 aa, Homo Sapiens
CCGQGKACY

SEQ ID NO: 79596 - protein, 9 aa, Homo Sapiens
KVLTGFFCQ

SEQ ID NO: 79597 - protein, 9 aa, Homo Sapiens
QALDLVAAK

SEQ ID NO: 79598 - protein, 9 aa, Homo Sapiens
SSLADDHYE

SEQ ID NO: 79599 - protein, 9 aa, Homo Sapiens
EAEVAKMRQ

SEQ ID NO: 79600 - protein, 9 aa, Homo Sapiens
KPEDNMYSI

SEQ ID NO: 79601 - protein, 9 aa, Homo Sapiens
VLQRLKDQA

SEQ ID NO: 79602 - protein, 9 aa, Homo Sapiens
STLAMPEQM

SEQ ID NO: 79603 - protein, 9 aa, Homo Sapiens
WRKSSLDGL

SEQ ID NO: 79604 - protein, 9 aa, Homo Sapiens
PFLNILALI

SEQ ID NO: 79605 - protein, 9 aa, Homo Sapiens
HLAFNRQVP

SEQ ID NO: 79606 - protein, 9 aa, Homo Sapiens
SESWTVWLP

SEQ ID NO: 79607 - protein, 9 aa, Homo Sapiens
AVRKFFLFL

SEQ ID NO: 79608 - protein, 9 aa, Homo Sapiens
PWGDCSTTC

SEQ ID NO: 79609 - protein, 9 aa, Homo Sapiens
AYFMFDTRE

SEQ ID NO: 79610 - protein, 9 aa, Homo Sapiens
GHVEVVSQL

SEQ ID NO: 79611 - protein, 9 aa, Homo Sapiens
EALPNNMTL

SEQ ID NO: 79612 - protein, 9 aa, Homo Sapiens
TQAGQTALM

SEQ ID NO: 79613 - protein, 9 aa, Homo Sapiens
NILALIALR

SEQ ID NO: 79614 - protein, 9 aa, Homo Sapiens
HPKVPRHLP

SEQ ID NO: 79615 - protein, 9 aa, Homo Sapiens
PQYSNPRQA

SEQ ID NO: 79616 - protein, 9 aa, Homo Sapiens
YSESWTVWL

SEQ ID NO: 79617 - protein, 9 aa, Homo Sapiens
KEVAGKKSF

SEQ ID NO: 79618 - protein, 9 aa, Homo Sapiens
PHIESHPVP

SEQ ID NO: 79619 - protein, 9 aa, Homo Sapiens
EVLMFKTED

SEQ ID NO: 79620 - protein, 9 aa, Homo Sapiens
ISYAFIVEA

SEQ ID NO: 79621 - protein, 9 aa, Homo Sapiens
GVPWASRPK

SEQ ID NO: 79622 - protein, 9 aa, Homo Sapiens
EYVIKASEG

SEQ ID NO: 79623 - protein, 9 aa, Homo Sapiens
DKGEYVIKA

SEQ ID NO: 79624 - protein, 9 aa, Homo Sapiens
VMIKHGYIG

SEQ ID NO: 79625 - protein, 9 aa, Homo Sapiens
KELGLLSSS

SEQ ID NO: 79626 - protein, 9 aa, Homo Sapiens
EELLEQLCV

SEQ ID NO: 79627 - protein, 9 aa, Homo Sapiens
SKPLNCDYS

SEQ ID NO: 79628 - protein, 9 aa, Homo Sapiens
ECFWNGQLI

SEQ ID NO: 79629 - protein, 9 aa, Homo Sapiens
PLSPHTQVF

SEQ ID NO: 79630 - protein, 9 aa, Homo Sapiens
HLRAQGGKV

SEQ ID NO: 79631 - protein, 9 aa, Homo Sapiens
GGRVKLIVN

SEQ ID NO: 79632 - protein, 9 aa, Homo Sapiens
QEEEILGSH

SEQ ID NO: 79633 - protein, 9 aa, Homo Sapiens
TATYQSLLR

SEQ ID NO: 79634 - protein, 9 aa, Homo Sapiens
GIFLFLLIW

SEQ ID NO: 79635 - protein, 9 aa, Homo Sapiens
KPARSELFN

SEQ ID NO: 79636 - protein, 9 aa, Homo Sapiens
LSPSVIDGV

SEQ ID NO: 79637 - protein, 9 aa, Homo Sapiens
AHRREILRE

SEQ ID NO: 79638 - protein, 9 aa, Homo Sapiens
IGKRKLEQG

SEQ ID NO: 79639 - protein, 9 aa, Homo Sapiens
KTEGDVHTS

SEQ ID NO: 79640 - protein, 9 aa, Homo Sapiens
GRFGPNKMM

SEQ ID NO: 79641 - protein, 9 aa, Homo Sapiens
DRLSLSVTQ

SEQ ID NO: 79642 - protein, 9 aa, Homo Sapiens
KACYRWSKR

SEQ ID NO: 79643 - protein, 9 aa, Homo Sapiens
GQGKACYRW

SEQ ID NO: 79644 - protein, 9 aa, Homo Sapiens
LYDVRAQKF

SEQ ID NO: 79645 - protein, 9 aa, Homo Sapiens
AEVILVLQK

SEQ ID NO: 79646 - protein, 9 aa, Homo Sapiens
IESHPVPEN

SEQ ID NO: 79647 - protein, 9 aa, Homo Sapiens
STTCGHMAS

SEQ ID NO: 79648 - protein, 9 aa, Homo Sapiens
CQKLKSWKF

SEQ ID NO: 79649 - protein, 9 aa, Homo Sapiens
AKLKNNRCA

SEQ ID NO: 79650 - protein, 9 aa, Homo Sapiens
LSTSCSRFI

SEQ ID NO: 79651 - protein, 9 aa, Homo Sapiens
EQCAEMKST

SEQ ID NO: 79652 - protein, 9 aa, Homo Sapiens
TCSIPLNEL

SEQ ID NO: 79653 - protein, 9 aa, Homo Sapiens
SCLSKLLGK

SEQ ID NO: 79654 - protein, 9 aa, Homo Sapiens
HSDKFQCQE

SEQ ID NO: 79655 - protein, 9 aa, Homo Sapiens
GVQCLLLWL

SEQ ID NO: 79656 - protein, 9 aa, Homo Sapiens
LFLDPLRTG

SEQ ID NO: 79657 - protein, 9 aa, Homo Sapiens
YLDSLNRIG

SEQ ID NO: 79658 - protein, 9 aa, Homo Sapiens
ALSRFRHRE

SEQ ID NO: 79659 - protein, 9 aa, Homo Sapiens
AQDCEMKKC

SEQ ID NO: 79660 - protein, 9 aa, Homo Sapiens
MDAYMKGTP

SEQ ID NO: 79661 - protein, 9 aa, Homo Sapiens
STPSSCLQQ

SEQ ID NO: 79662 - protein, 9 aa, Homo Sapiens
YNKKMDSIV

SEQ ID NO: 79663 - protein, 9 aa, Homo Sapiens
VRAAYTIIG

SEQ ID NO: 79664 - protein, 9 aa, Homo Sapiens
EIRHVGQMA

SEQ ID NO: 79665 - protein, 9 aa, Homo Sapiens
LPMQGNPPQ

SEQ ID NO: 79666 - protein, 9 aa, Homo Sapiens
AKRLKRRLQ

SEQ ID NO: 79667 - protein, 9 aa, Homo Sapiens
CGIQHTNSK

SEQ ID NO: 79668 - protein, 9 aa, Homo Sapiens
GYSRKDLHR

SEQ ID NO: 79669 - protein, 9 aa, Homo Sapiens
CALQCLSNT

SEQ ID NO: 79670 - protein, 9 aa, Homo Sapiens
KLLKLPAFM

SEQ ID NO: 79671 - protein, 9 aa, Homo Sapiens
CWQGCAEIG

SEQ ID NO: 79672 - protein, 9 aa, Homo Sapiens
RPPLQGDLL

SEQ ID NO: 79673 - protein, 9 aa, Homo Sapiens
CLQQPDSCL

SEQ ID NO: 79674 - protein, 9 aa, Homo Sapiens
SAGLLEQIR

SEQ ID NO: 79675 - protein, 9 aa, Homo Sapiens
LYNRGFSLF

SEQ ID NO: 79676 - protein, 9 aa, Homo Sapiens
EHKRQERED

SEQ ID NO: 79677 - protein, 9 aa, Homo Sapiens
HRNTNTDSI

SEQ ID NO: 79678 - protein, 9 aa, Homo Sapiens
EGHVEVVSQ

SEQ ID NO: 79679 - protein, 9 aa, Homo Sapiens
KTCSIPLNE

SEQ ID NO: 79680 - protein, 9 aa, Homo Sapiens
SNLKEVVTA

SEQ ID NO: 79681 - protein, 9 aa, Homo Sapiens
ELKSQKVEQ

SEQ ID NO: 79682 - protein, 9 aa, Homo Sapiens
ASRPKATLQ

SEQ ID NO: 79683 - protein, 9 aa, Homo Sapiens
EPSQAPCSK

SEQ ID NO: 79684 - protein, 9 aa, Homo Sapiens
DKKHLDKLS

SEQ ID NO: 79685 - protein, 9 aa, Homo Sapiens
SCSRFIRNT

SEQ ID NO: 79686 - protein, 9 aa, Homo Sapiens
SLQLGLSHK

SEQ ID NO: 79687 - protein, 9 aa, Homo Sapiens
LNILALIAL

SEQ ID NO: 79688 - protein, 9 aa, Homo Sapiens
LLPGPLPAS

SEQ ID NO: 79689 - protein, 9 aa, Homo Sapiens
KLKNNRCAN

SEQ ID NO: 79690 - protein, 9 aa, Homo Sapiens
SSSLASSNL

SEQ ID NO: 79691 - protein, 9 aa, Homo Sapiens
QEKERELGR

SEQ ID NO: 79692 - protein, 9 aa, Homo Sapiens
VSSSLASSN

SEQ ID NO: 79693 - protein, 9 aa, Homo Sapiens
ISTQNRQAL

SEQ ID NO: 79694 - protein, 9 aa, Homo Sapiens
DSSPGIGKV

SEQ ID NO: 79695 - protein, 9 aa, Homo Sapiens
VLGSSKRLF

SEQ ID NO: 79696 - protein, 9 aa, Homo Sapiens
DYFDYSTSD

SEQ ID NO: 79697 - protein, 9 aa, Homo Sapiens
YFVCTQFKV

SEQ ID NO: 79698 - protein, 9 aa, Homo Sapiens
RQQMQRNLG

SEQ ID NO: 79699 - protein, 9 aa, Homo Sapiens
NMIIAYVLL

SEQ ID NO: 79700 - protein, 9 aa, Homo Sapiens
VDRLSLSVT

SEQ ID NO: 79701 - protein, 9 aa, Homo Sapiens
FDTREEKRF

SEQ ID NO: 79702 - protein, 9 aa, Homo Sapiens
QMASVNMDP

SEQ ID NO: 79703 - protein, 9 aa, Homo Sapiens
QPKSAEATV

SEQ ID NO: 79704 - protein, 9 aa, Homo Sapiens
GANDSTLAM

SEQ ID NO: 79705 - protein, 9 aa, Homo Sapiens
IRVGMIDDD

SEQ ID NO: 79706 - protein, 9 aa, Homo Sapiens
EWIIRNGLV

SEQ ID NO: 79707 - protein, 9 aa, Homo Sapiens
DKLSSYHVK

SEQ ID NO: 79708 - protein, 9 aa, Homo Sapiens
CDLLAGMAY

SEQ ID NO: 79709 - protein, 9 aa, Homo Sapiens
AFMWLLDKT

SEQ ID NO: 79710 - protein, 9 aa, Homo Sapiens
DRFAQDCEM

SEQ ID NO: 79711 - protein, 9 aa, Homo Sapiens
TCFMNCALQ

SEQ ID NO: 79712 - protein, 9 aa, Homo Sapiens
LLFMWVLPP

SEQ ID NO: 79713 - protein, 9 aa, Homo Sapiens
FKTEDLVLR

SEQ ID NO: 79714 - protein, 9 aa, Homo Sapiens
GEAARMQLL

SEQ ID NO: 79715 - protein, 9 aa, Homo Sapiens
GEYVIKASE

SEQ ID NO: 79716 - protein, 9 aa, Homo Sapiens
SLADDHYEF

SEQ ID NO: 79717 - protein, 9 aa, Homo Sapiens
LHLAFNRQV

SEQ ID NO: 79718 - protein, 9 aa, Homo Sapiens
GHMASYPLT

SEQ ID NO: 79719 - protein, 9 aa, Homo Sapiens
HTIPLSPHT

SEQ ID NO: 79720 - protein, 9 aa, Homo Sapiens
VTWNPYKMM

SEQ ID NO: 79721 - protein, 9 aa, Homo Sapiens
NMTLALAYL

SEQ ID NO: 79722 - protein, 9 aa, Homo Sapiens
NLLSPEAAL

SEQ ID NO: 79723 - protein, 9 aa, Homo Sapiens
EHDKADEIS

SEQ ID NO: 79724 - protein, 9 aa, Homo Sapiens
VTATYQSLL

SEQ ID NO: 79725 - protein, 9 aa, Homo Sapiens
VIKGIHQYP

SEQ ID NO: 79726 - protein, 9 aa, Homo Sapiens
LDKTGLRIT

SEQ ID NO: 79727 - protein, 9 aa, Homo Sapiens
QAPCSKTSE

SEQ ID NO: 79728 - protein, 9 aa, Homo Sapiens
DVQRIVDKA

SEQ ID NO: 79729 - protein, 9 aa, Homo Sapiens
NAKATQAGQ

SEQ ID NO: 79730 - protein, 9 aa, Homo Sapiens
HNQALRLRA

SEQ ID NO: 79731 - protein, 9 aa, Homo Sapiens
AKDAGEYTC

SEQ ID NO: 79732 - protein, 9 aa, Homo Sapiens
RPSSEKLSP

SEQ ID NO: 79733 - protein, 9 aa, Homo Sapiens
LQLLPWRKS

SEQ ID NO: 79734 - protein, 9 aa, Homo Sapiens
HTQVFLCPS

SEQ ID NO: 79735 - protein, 9 aa, Homo Sapiens
RRVRSQKPT

SEQ ID NO: 79736 - protein, 9 aa, Homo Sapiens
ERLQEEAVF

SEQ ID NO: 79737 - protein, 9 aa, Homo Sapiens
VSGLDFEET

SEQ ID NO: 79738 - protein, 9 aa, Homo Sapiens
HATSVPVTS

SEQ ID NO: 79739 - protein, 9 aa, Homo Sapiens
SMRTCCQAR

SEQ ID NO: 79740 - protein, 9 aa, Homo Sapiens
LQESSFQDI

SEQ ID NO: 79741 - protein, 9 aa, Homo Sapiens
MCRAVEDQL

SEQ ID NO: 79742 - protein, 9 aa, Homo Sapiens
MAYKVNILM

SEQ ID NO: 79743 - protein, 9 aa, Homo Sapiens
SIIDFTKEG

SEQ ID NO: 79744 - protein, 9 aa, Homo Sapiens
TDTSEVNLF

SEQ ID NO: 79745 - protein, 9 aa, Homo Sapiens
EGKTEGDVH

SEQ ID NO: 79746 - protein, 9 aa, Homo Sapiens
SSLLSCLSK

SEQ ID NO: 79747 - protein, 9 aa, Homo Sapiens
QATIIRHNQ

SEQ ID NO: 79748 - protein, 9 aa, Homo Sapiens
CPLADNSLR

SEQ ID NO: 79749 - protein, 9 aa, Homo Sapiens
CQVVLEEGT

SEQ ID NO: 79750 - protein, 9 aa, Homo Sapiens
LFRLRGPVQ

SEQ ID NO: 79751 - protein, 9 aa, Homo Sapiens
SLVSSSLAS

SEQ ID NO: 79752 - protein, 9 aa, Homo Sapiens
KFQTCHSTV

SEQ ID NO: 79753 - protein, 9 aa, Homo Sapiens
SSYIMWVSV

SEQ ID NO: 79754 - protein, 9 aa, Homo Sapiens
LYLFASLTS

SEQ ID NO: 79755 - protein, 9 aa, Homo Sapiens
LGSHDDEQE

SEQ ID NO: 79756 - protein, 9 aa, Homo Sapiens
CWVRGGGVY

SEQ ID NO: 79757 - protein, 9 aa, Homo Sapiens
GEVTLGEQN

SEQ ID NO: 79758 - protein, 9 aa, Homo Sapiens
QCLLLWLLL

SEQ ID NO: 79759 - protein, 9 aa, Homo Sapiens
GLLEQIRHM

SEQ ID NO: 79760 - protein, 9 aa, Homo Sapiens
EPSLASSGM

SEQ ID NO: 79761 - protein, 9 aa, Homo Sapiens
CRHYEDSYQ

SEQ ID NO: 79762 - protein, 9 aa, Homo Sapiens
PEAALGVSG

SEQ ID NO: 79763 - protein, 9 aa, Homo Sapiens
HTDTSEVNL

SEQ ID NO: 79764 - protein, 9 aa, Homo Sapiens
CAVEHHALF

SEQ ID NO: 79765 - protein, 9 aa, Homo Sapiens
ALPNNMTLA

SEQ ID NO: 79766 - protein, 9 aa, Homo Sapiens
DGKEPKPSA

SEQ ID NO: 79767 - protein, 9 aa, Homo Sapiens
LMAVELSKQ

SEQ ID NO: 79768 - protein, 9 aa, Homo Sapiens
CSKTSEAAP

SEQ ID NO: 79769 - protein, 9 aa, Homo Sapiens
DEEIRKVAV

SEQ ID NO: 79770 - protein, 9 aa, Homo Sapiens
LSRNRGNTD

SEQ ID NO: 79771 - protein, 9 aa, Homo Sapiens
EIKPVNPFP

SEQ ID NO: 79772 - protein, 9 aa, Homo Sapiens
CFDSFKYVK

SEQ ID NO: 79773 - protein, 9 aa, Homo Sapiens
KMRAIQAKE

SEQ ID NO: 79774 - protein, 9 aa, Homo Sapiens
HYIPAIRAH

SEQ ID NO: 79775 - protein, 9 aa, Homo Sapiens
QLCVSKWSD

SEQ ID NO: 79776 - protein, 9 aa, Homo Sapiens
KKILLNISA

SEQ ID NO: 79777 - protein, 9 aa, Homo Sapiens
ESRAHQVLP

SEQ ID NO: 79778 - protein, 9 aa, Homo Sapiens
VVQLLLDRQ

SEQ ID NO: 79779 - protein, 9 aa, Homo Sapiens
PPLQGDLLF

SEQ ID NO: 79780 - protein, 9 aa, Homo Sapiens
LHTIPLSPH

SEQ ID NO: 79781 - protein, 9 aa, Homo Sapiens
KGTPEAIAG

SEQ ID NO: 79782 - protein, 9 aa, Homo Sapiens
SNPRQARQP

SEQ ID NO: 79783 - protein, 9 aa, Homo Sapiens
TIIRHNQAL

SEQ ID NO: 79784 - protein, 9 aa, Homo Sapiens
VSSKDTDIT

SEQ ID NO: 79785 - protein, 9 aa, Homo Sapiens
VPWASRPKA

SEQ ID NO: 79786 - protein, 9 aa, Homo Sapiens
RPTFLHKDG

SEQ ID NO: 79787 - protein, 9 aa, Homo Sapiens
TSTEETWVE

SEQ ID NO: 79788 - protein, 9 aa, Homo Sapiens
CFMNCALQC

SEQ ID NO: 79789 - protein, 9 aa, Homo Sapiens
KKLDSIIDF

SEQ ID NO: 79790 - protein, 9 aa, Homo Sapiens
KAFSNRSNF

SEQ ID NO: 79791 - protein, 9 aa, Homo Sapiens
LQRLKDQAD

SEQ ID NO: 79792 - protein, 9 aa, Homo Sapiens
ASVNDSRLE

SEQ ID NO: 79793 - protein, 9 aa, Homo Sapiens
QNMMMKSEH

SEQ ID NO: 79794 - protein, 9 aa, Homo Sapiens
NNMTLALAY

SEQ ID NO: 79795 - protein, 9 aa, Homo Sapiens
QKLKSWKFQ

SEQ ID NO: 79796 - protein, 9 aa, Homo Sapiens
PWASRPKAT

SEQ ID NO: 79797 - protein, 9 aa, Homo Sapiens
GVQEFAENI

SEQ ID NO: 79798 - protein, 9 aa, Homo Sapiens
QKTCSIPLN

SEQ ID NO: 79799 - protein, 9 aa, Homo Sapiens
TYQSLLRGA

SEQ ID NO: 79800 - protein, 9 aa, Homo Sapiens
SKRLFQNKY

SEQ ID NO: 79801 - protein, 9 aa, Homo Sapiens
LHRVEDDVQ

SEQ ID NO: 79802 - protein, 9 aa, Homo Sapiens
CRGWYPKPL

SEQ ID NO: 79803 - protein, 9 aa, Homo Sapiens
DCQEKEREL

SEQ ID NO: 79804 - protein, 9 aa, Homo Sapiens
LEDKEQMLI

SEQ ID NO: 79805 - protein, 9 aa, Homo Sapiens
SQNMMMKSE

SEQ ID NO: 79806 - protein, 9 aa, Homo Sapiens
AASLRCLNS

SEQ ID NO: 79807 - protein, 9 aa, Homo Sapiens
RKSSLDGLG

SEQ ID NO: 79808 - protein, 9 aa, Homo Sapiens
HALFRLRGP

SEQ ID NO: 79809 - protein, 9 aa, Homo Sapiens
PQSVSQDST

SEQ ID NO: 79810 - protein, 9 aa, Homo Sapiens
YAFIVEAVL

SEQ ID NO: 79811 - protein, 9 aa, Homo Sapiens
PPGMCHSDK

SEQ ID NO: 79812 - protein, 9 aa, Homo Sapiens
RKSKQRQGL

SEQ ID NO: 79813 - protein, 9 aa, Homo Sapiens
APCSKTSEA

SEQ ID NO: 79814 - protein, 9 aa, Homo Sapiens
GMAYKVNIL

SEQ ID NO: 79815 - protein, 9 aa, Homo Sapiens
QVTPHSRPY

SEQ ID NO: 79816 - protein, 9 aa, Homo Sapiens
EDDVQRIVD

SEQ ID NO: 79817 - protein, 9 aa, Homo Sapiens
QNRKKLQKI

SEQ ID NO: 79818 - protein, 9 aa, Homo Sapiens
VIERLQEEK

SEQ ID NO: 79819 - protein, 9 aa, Homo Sapiens
LLLYDVRAQ

SEQ ID NO: 79820 - protein, 9 aa, Homo Sapiens
PHTQVFLCP

SEQ ID NO: 79821 - protein, 9 aa, Homo Sapiens
KELEKQIEK

SEQ ID NO: 79822 - protein, 9 aa, Homo Sapiens
TNEERLQEE

SEQ ID NO: 79823 - protein, 9 aa, Homo Sapiens
PSMRTCCQA

SEQ ID NO: 79824 - protein, 9 aa, Homo Sapiens
SLKKYRKEN

SEQ ID NO: 79825 - protein, 9 aa, Homo Sapiens
LQRAAYLKK

SEQ ID NO: 79826 - protein, 9 aa, Homo Sapiens
LLEGIFLFL

SEQ ID NO: 79827 - protein, 9 aa, Homo Sapiens
RVEDDVQRI

SEQ ID NO: 79828 - protein, 9 aa, Homo Sapiens
FKIQRGQLL

SEQ ID NO: 79829 - protein, 9 aa, Homo Sapiens
FRGFVNYVK

SEQ ID NO: 79830 - protein, 9 aa, Homo Sapiens
KLIYVFEAK

SEQ ID NO: 79831 - protein, 9 aa, Homo Sapiens
NIRQFTSTE

SEQ ID NO: 79832 - protein, 9 aa, Homo Sapiens
SKQCQMDDC

SEQ ID NO: 79833 - protein, 9 aa, Homo Sapiens
PLQGDLLFF

SEQ ID NO: 79834 - protein, 9 aa, Homo Sapiens
RVSTCDENT

SEQ ID NO: 79835 - protein, 9 aa, Homo Sapiens
EPRAYFMFD

SEQ ID NO: 79836 - protein, 9 aa, Homo Sapiens
HSRAPSLFA

SEQ ID NO: 79837 - protein, 9 aa, Homo Sapiens
ILALIALRI

SEQ ID NO: 79838 - protein, 9 aa, Homo Sapiens
LFMWVLPPG

SEQ ID NO: 79839 - protein, 9 aa, Homo Sapiens
GGSFNSTTD

SEQ ID NO: 79840 - protein, 9 aa, Homo Sapiens
LPGCLRVST

SEQ ID NO: 79841 - protein, 9 aa, Homo Sapiens
LIQQEQCAE

SEQ ID NO: 79842 - protein, 9 aa, Homo Sapiens
GDCSTTCGG

SEQ ID NO: 79843 - protein, 9 aa, Homo Sapiens
LQEEAVFGA

SEQ ID NO: 79844 - protein, 9 aa, Homo Sapiens
IDCHSTDNM

SEQ ID NO: 79845 - protein, 9 aa, Homo Sapiens
SPHTQVFLC

SEQ ID NO: 79846 - protein, 9 aa, Homo Sapiens
KLPFQRLAR

SEQ ID NO: 79847 - protein, 9 aa, Homo Sapiens
GLMESIRQA

SEQ ID NO: 79848 - protein, 9 aa, Homo Sapiens
NGVQEFAEN

SEQ ID NO: 79849 - protein, 9 aa, Homo Sapiens
ESWTVWLPS

SEQ ID NO: 79850 - protein, 9 aa, Homo Sapiens
DGGRVKLIV

SEQ ID NO: 79851 - protein, 9 aa, Homo Sapiens
PSSEKLSPS

SEQ ID NO: 79852 - protein, 9 aa, Homo Sapiens
NPPQRSKSA

SEQ ID NO: 79853 - protein, 9 aa, Homo Sapiens
TSCSRFIRN

SEQ ID NO: 79854 - protein, 9 aa, Homo Sapiens
AEAAAGSPT

SEQ ID NO: 79855 - protein, 9 aa, Homo Sapiens
KPVNPFPLS

SEQ ID NO: 79856 - protein, 9 aa, Homo Sapiens
LAAQGLSSK

SEQ ID NO: 79857 - protein, 9 aa, Homo Sapiens
ANIRQFTST

SEQ ID NO: 79858 - protein, 9 aa, Homo Sapiens
IQQEHKRQE

SEQ ID NO: 79859 - protein, 9 aa, Homo Sapiens
YKFDVSLEL

SEQ ID NO: 79860 - protein, 9 aa, Homo Sapiens
QKVEQIKLA

SEQ ID NO: 79861 - protein, 9 aa, Homo Sapiens
RHYEDSYQH

SEQ ID NO: 79862 - protein, 9 aa, Homo Sapiens
QRGQLLAVA

SEQ ID NO: 79863 - protein, 9 aa, Homo Sapiens
MLSTSCSRF

SEQ ID NO: 79864 - protein, 9 aa, Homo Sapiens
RITEIVPQY

SEQ ID NO: 79865 - protein, 9 aa, Homo Sapiens
PWRKSSLDG

SEQ ID NO: 79866 - protein, 9 aa, Homo Sapiens
SHPVPENHL

SEQ ID NO: 79867 - protein, 9 aa, Homo Sapiens
FMWLLDKTG

SEQ ID NO: 79868 - protein, 9 aa, Homo Sapiens
YEPQPEPVA

SEQ ID NO: 79869 - protein, 9 aa, Homo Sapiens
ELLEQLCVS

SEQ ID NO: 79870 - protein, 9 aa, Homo Sapiens
GGHQVTPHS

SEQ ID NO: 79871 - protein, 9 aa, Homo Sapiens
EEEDKNRKC

SEQ ID NO: 79872 - protein, 9 aa, Homo Sapiens
VAKMRQMLQ

SEQ ID NO: 79873 - protein, 9 aa, Homo Sapiens
SEVNLFVIN

SEQ ID NO: 79874 - protein, 9 aa, Homo Sapiens
GRGANDSTL

SEQ ID NO: 79875 - protein, 9 aa, Homo Sapiens
VEGNLRVEC

SEQ ID NO: 79876 - protein, 9 aa, Homo Sapiens
FPLSQLQRM

SEQ ID NO: 79877 - protein, 9 aa, Homo Sapiens
RVQFCPFQK

SEQ ID NO: 79878 - protein, 9 aa, Homo Sapiens
GNTDRVARY

SEQ ID NO: 79879 - protein, 9 aa, Homo Sapiens
TVRAAYTII

SEQ ID NO: 79880 - protein, 9 aa, Homo Sapiens
KLSSYHVKT

SEQ ID NO: 79881 - protein, 9 aa, Homo Sapiens
GSFNSTTDS

SEQ ID NO: 79882 - protein, 9 aa, Homo Sapiens
QEQCAEMKS

SEQ ID NO: 79883 - protein, 9 aa, Homo Sapiens
HELSGPAKG

SEQ ID NO: 79884 - protein, 9 aa, Homo Sapiens
RREILREMY

SEQ ID NO: 79885 - protein, 9 aa, Homo Sapiens
KQQMLHQDE

SEQ ID NO: 79886 - protein, 9 aa, Homo Sapiens
SHLHRFLLF

SEQ ID NO: 79887 - protein, 9 aa, Homo Sapiens
LEEGTRYLS

SEQ ID NO: 79888 - protein, 9 aa, Homo Sapiens
IHLLAAQGL

SEQ ID NO: 79889 - protein, 9 aa, Homo Sapiens
LAMPEQMKF

SEQ ID NO: 79890 - protein, 9 aa, Homo Sapiens
TIPLSPHTQ

SEQ ID NO: 79891 - protein, 9 aa, Homo Sapiens
AHLRAQGGK

SEQ ID NO: 79892 - protein, 9 aa, Homo Sapiens
IKPVNPFPL

SEQ ID NO: 79893 - protein, 9 aa, Homo Sapiens
KFDVSLELL

SEQ ID NO: 79894 - protein, 9 aa, Homo Sapiens
ESPFLNILA

SEQ ID NO: 79895 - protein, 9 aa, Homo Sapiens
LGRIRFKFS

SEQ ID NO: 79896 - protein, 9 aa, Homo Sapiens
EILREMYEE

SEQ ID NO: 79897 - protein, 9 aa, Homo Sapiens
RNVSAKDAG

SEQ ID NO: 79898 - protein, 9 aa, Homo Sapiens
LSTVRAAYT

SEQ ID NO: 79899 - protein, 9 aa, Homo Sapiens
QATDDALLL

SEQ ID NO: 79900 - protein, 9 aa, Homo Sapiens
LPHPKVPRH

SEQ ID NO: 79901 - protein, 9 aa, Homo Sapiens
AASVKELEK

SEQ ID NO: 79902 - protein, 9 aa, Homo Sapiens
KDISRECAV

SEQ ID NO: 79903 - protein, 9 aa, Homo Sapiens
VRSQKPTVG

SEQ ID NO: 79904 - protein, 9 aa, Homo Sapiens
SIIDKKFFQ

SEQ ID NO: 79905 - protein, 9 aa, Homo Sapiens
MGYSRKDLH

SEQ ID NO: 79906 - protein, 9 aa, Homo Sapiens
FQGHQGYLR

SEQ ID NO: 79907 - protein, 9 aa, Homo Sapiens
SYTKGLSLV

SEQ ID NO: 79908 - protein, 9 aa, Homo Sapiens
SVPVVSPKT

SEQ ID NO: 79909 - protein, 9 aa, Homo Sapiens
VSAKDAGEY

SEQ ID NO: 79910 - protein, 9 aa, Homo Sapiens
PPEGLVRVV

SEQ ID NO: 79911 - protein, 9 aa, Homo Sapiens
DLLAGMAYK

SEQ ID NO: 79912 - protein, 9 aa, Homo Sapiens
CCGSVCCDQ

SEQ ID NO: 79913 - protein, 9 aa, Homo Sapiens
QYSNPRQAR

SEQ ID NO: 79914 - protein, 9 aa, Homo Sapiens
FWQKKKKHR

SEQ ID NO: 79915 - protein, 9 aa, Homo Sapiens
DFVELNYSF

SEQ ID NO: 79916 - protein, 9 aa, Homo Sapiens
SQLLQREAN

SEQ ID NO: 79917 - protein, 9 aa, Homo Sapiens
YLKKMLLVK

SEQ ID NO: 79918 - protein, 9 aa, Homo Sapiens
CLRVSTCDE

SEQ ID NO: 79919 - protein, 9 aa, Homo Sapiens
HQVTPHSRP

SEQ ID NO: 79920 - protein, 9 aa, Homo Sapiens
DRQCQLNVL

SEQ ID NO: 79921 - protein, 9 aa, Homo Sapiens
RLFQNKYFR

SEQ ID NO: 79922 - protein, 9 aa, Homo Sapiens
NMPSSSNTK

SEQ ID NO: 79923 - protein, 9 aa, Homo Sapiens
ASNMPSSSN

SEQ ID NO: 79924 - protein, 9 aa, Homo Sapiens
VQCLLLWLL

SEQ ID NO: 79925 - protein, 9 aa, Homo Sapiens
QQDCQEKER

SEQ ID NO: 79926 - protein, 9 aa, Homo Sapiens
YHPGCGGTT

SEQ ID NO: 79927 - protein, 9 aa, Homo Sapiens
GKVSGLDFE

SEQ ID NO: 79928 - protein, 9 aa, Homo Sapiens
IEKTRLNID

SEQ ID NO: 79929 - protein, 9 aa, Homo Sapiens
IKIVSSYIM

SEQ ID NO: 79930 - protein, 9 aa, Homo Sapiens
RQCQLNVLD

SEQ ID NO: 79931 - protein, 9 aa, Homo Sapiens
PSAEAKLKN

SEQ ID NO: 79932 - protein, 9 aa, Homo Sapiens
VKTDNFSSV

SEQ ID NO: 79933 - protein, 9 aa, Homo Sapiens
LECICRGWY

SEQ ID NO: 79934 - protein, 9 aa, Homo Sapiens
FNRQVPREQ

SEQ ID NO: 79935 - protein, 9 aa, Homo Sapiens
AEAEAAAGS

SEQ ID NO: 79936 - protein, 9 aa, Homo Sapiens
EKLSPSVID

SEQ ID NO: 79937 - protein, 9 aa, Homo Sapiens
KYLIQQEQC

SEQ ID NO: 79938 - protein, 9 aa, Homo Sapiens
QGNPPQRSK

SEQ ID NO: 79939 - protein, 9 aa, Homo Sapiens
LQKLLKLPA

SEQ ID NO: 79940 - protein, 9 aa, Homo Sapiens
LVKSTLEPK

SEQ ID NO: 79941 - protein, 9 aa, Homo Sapiens
YFMFDTREE

SEQ ID NO: 79942 - protein, 9 aa, Homo Sapiens
IGNREWIIR

SEQ ID NO: 79943 - protein, 9 aa, Homo Sapiens
AREIAQDFK

SEQ ID NO: 79944 - protein, 9 aa, Homo Sapiens
PKPSAEAAA

SEQ ID NO: 79945 - protein, 9 aa, Homo Sapiens
SCWVRGGGV

SEQ ID NO: 79946 - protein, 9 aa, Homo Sapiens
SMKQVDEQM

SEQ ID NO: 79947 - protein, 9 aa, Homo Sapiens
KAKGYTMNV

SEQ ID NO: 79948 - protein, 9 aa, Homo Sapiens
LASMWISPD

SEQ ID NO: 79949 - protein, 9 aa, Homo Sapiens
CCQARTPTQ

SEQ ID NO: 79950 - protein, 9 aa, Homo Sapiens
RFKFSNNAK

SEQ ID NO: 79951 - protein, 9 aa, Homo Sapiens
VILVLQKYS

SEQ ID NO: 79952 - protein, 9 aa, Homo Sapiens
LQRFLACKR

SEQ ID NO: 79953 - protein, 9 aa, Homo Sapiens
DLLSPVLYV

SEQ ID NO: 79954 - protein, 9 aa, Homo Sapiens
PPPGPPPPS

SEQ ID NO: 79955 - protein, 9 aa, Homo Sapiens
LNCCGQGKA

SEQ ID NO: 79956 - protein, 9 aa, Homo Sapiens
YIPAIRAHS

SEQ ID NO: 79957 - protein, 9 aa, Homo Sapiens
YHVLKATDL

SEQ ID NO: 79958 - protein, 9 aa, Homo Sapiens
SIRQADLKN

SEQ ID NO: 79959 - protein, 9 aa, Homo Sapiens
REWIIRNGL

SEQ ID NO: 79960 - protein, 9 aa, Homo Sapiens
KISTQNRQA

SEQ ID NO: 79961 - protein, 9 aa, Homo Sapiens
SHKVTEAGG

SEQ ID NO: 79962 - protein, 9 aa, Homo Sapiens
LLEQLCVSK

SEQ ID NO: 79963 - protein, 9 aa, Homo Sapiens
WLLDKTGLR

SEQ ID NO: 79964 - protein, 9 aa, Homo Sapiens
HRSVSDLPF

SEQ ID NO: 79965 - protein, 9 aa, Homo Sapiens
PNLECIQKA

SEQ ID NO: 79966 - protein, 9 aa, Homo Sapiens
VNHEPVKWP

SEQ ID NO: 79967 - protein, 9 aa, Homo Sapiens
LNLITHQKI

SEQ ID NO: 79968 - protein, 9 aa, Homo Sapiens
DLLRHQRTH

SEQ ID NO: 79969 - protein, 9 aa, Homo Sapiens
RHGEDKHQP

SEQ ID NO: 79970 - protein, 9 aa, Homo Sapiens
VPGVTAVEL

SEQ ID NO: 79971 - protein, 9 aa, Homo Sapiens
PTSESRFAW

SEQ ID NO: 79972 - protein, 9 aa, Homo Sapiens
AVLVLDMLC

SEQ ID NO: 79973 - protein, 9 aa, Homo Sapiens
FMPHSPQVP

SEQ ID NO: 79974 - protein, 9 aa, Homo Sapiens
SWSKEGMEK

SEQ ID NO: 79975 - protein, 9 aa, Homo Sapiens
PACSPSKAA

SEQ ID NO: 79976 - protein, 9 aa, Homo Sapiens
NYRFIHPGV

SEQ ID NO: 79977 - protein, 9 aa, Homo Sapiens
YLYPDFTRL

SEQ ID NO: 79978 - protein, 9 aa, Homo Sapiens
LRQVLKSEE

SEQ ID NO: 79979 - protein, 9 aa, Homo Sapiens
FSEDDLECR

SEQ ID NO: 79980 - protein, 9 aa, Homo Sapiens
GKSVDGIRS

SEQ ID NO: 79981 - protein, 9 aa, Homo Sapiens
HGEDKHQPP

SEQ ID NO: 79982 - protein, 9 aa, Homo Sapiens
DSDSENKGE

SEQ ID NO: 79983 - protein, 9 aa, Homo Sapiens
WSVNHEPVK

SEQ ID NO: 79984 - protein, 9 aa, Homo Sapiens
PSKAAVETQ

SEQ ID NO: 79985 - protein, 9 aa, Homo Sapiens
DANFNMDAD

SEQ ID NO: 79986 - protein, 9 aa, Homo Sapiens
ESRFAWSPL

SEQ ID NO: 79987 - protein, 9 aa, Homo Sapiens
YLHKFLSSA

SEQ ID NO: 79988 - protein, 9 aa, Homo Sapiens
NKSGDPSCV

SEQ ID NO: 79989 - protein, 9 aa, Homo Sapiens
LLQLQPPLP

SEQ ID NO: 79990 - protein, 9 aa, Homo Sapiens
ASAGARNAD

SEQ ID NO: 79991 - protein, 9 aa, Homo Sapiens
GLTWGSATI

SEQ ID NO: 79992 - protein, 9 aa, Homo Sapiens
LAKATYDWL

SEQ ID NO: 79993 - protein, 9 aa, Homo Sapiens
SSCMGGMNQ

SEQ ID NO: 79994 - protein, 9 aa, Homo Sapiens
KSEEPRHRA

SEQ ID NO: 79995 - protein, 9 aa, Homo Sapiens
WGMNYRFIH

SEQ ID NO: 79996 - protein, 9 aa, Homo Sapiens
VDGIRSSVI

SEQ ID NO: 79997 - protein, 9 aa, Homo Sapiens
LLKLLLQLQ

SEQ ID NO: 79998 - protein, 9 aa, Homo Sapiens
VLDMLCRQD

SEQ ID NO: 79999 - protein, 9 aa, Homo Sapiens
VELGEETCT

SEQ ID NO: 80000 - protein, 9 aa, Homo Sapiens
TSQRTRCPR

SEQ ID NO: 80001 - protein, 9 aa, Homo Sapiens
SAFSTSSDS

SEQ ID NO: 80002 - protein, 9 aa, Homo Sapiens
EEKKKILLN

SEQ ID NO: 80003 - protein, 9 aa, Homo Sapiens
TASSSSRIS

SEQ ID NO: 80004 - protein, 9 aa, Homo Sapiens
KSVDGIRSS

SEQ ID NO: 80005 - protein, 9 aa, Homo Sapiens
DKSDLLRHQ

SEQ ID NO: 80006 - protein, 9 aa, Homo Sapiens
KILLNLSCQ

SEQ ID NO: 80007 - protein, 9 aa, Homo Sapiens
HEPVKWPNP

SEQ ID NO: 80008 - protein, 9 aa, Homo Sapiens
PLPTSESRF

SEQ ID NO: 80009 - protein, 9 aa, Homo Sapiens
HVDTSPTPV

SEQ ID NO: 80010 - protein, 9 aa, Homo Sapiens
LLDTAGKKF

SEQ ID NO: 80011 - protein, 9 aa, Homo Sapiens
VLKSEEPRH

SEQ ID NO: 80012 - protein, 9 aa, Homo Sapiens
VEERFNKSG

SEQ ID NO: 80013 - protein, 9 aa, Homo Sapiens
TLKLNLITH

SEQ ID NO: 80014 - protein, 9 aa, Homo Sapiens
LQCQEAEQA

SEQ ID NO: 80015 - protein, 9 aa, Homo Sapiens
LKLLLQLQP

SEQ ID NO: 80016 - protein, 9 aa, Homo Sapiens
VLVLDMLCR

SEQ ID NO: 80017 - protein, 9 aa, Homo Sapiens
NMLLGNPKK

SEQ ID NO: 80018 - protein, 9 aa, Homo Sapiens
IEKLLNFAP

SEQ ID NO: 80019 - protein, 9 aa, Homo Sapiens
MLLGNPKKR

SEQ ID NO: 80020 - protein, 9 aa, Homo Sapiens
EQTPEVAPE

SEQ ID NO: 80021 - protein, 9 aa, Homo Sapiens
LKLNLITHQ

SEQ ID NO: 80022 - protein, 9 aa, Homo Sapiens
LAQFPNMLL

SEQ ID NO: 80023 - protein, 9 aa, Homo Sapiens
MLQLLQHKD

SEQ ID NO: 80024 - protein, 9 aa, Homo Sapiens
AARGRRSEP

SEQ ID NO: 80025 - protein, 9 aa, Homo Sapiens
QKANKGTHT

SEQ ID NO: 80026 - protein, 9 aa, Homo Sapiens
AFSTSSDSL

SEQ ID NO: 80027 - protein, 9 aa, Homo Sapiens
QHWLVDDAW

SEQ ID NO: 80028 - protein, 9 aa, Homo Sapiens
TCNLLRGDQ

SEQ ID NO: 80029 - protein, 9 aa, Homo Sapiens
WSKEGMEKH

SEQ ID NO: 80030 - protein, 9 aa, Homo Sapiens
LGLAELTVT

SEQ ID NO: 80031 - protein, 9 aa, Homo Sapiens
QLQPPLPRA

SEQ ID NO: 80032 - protein, 9 aa, Homo Sapiens
CNLLRGDQT

SEQ ID NO: 80033 - protein, 9 aa, Homo Sapiens
FVPLVQALG

SEQ ID NO: 80034 - protein, 9 aa, Homo Sapiens
HYQQSADSS

SEQ ID NO: 80035 - protein, 9 aa, Homo Sapiens
SIVRFMPHS

SEQ ID NO: 80036 - protein, 9 aa, Homo Sapiens
CKACNLYSW

SEQ ID NO: 80037 - protein, 9 aa, Homo Sapiens
QSLGLTWGS

SEQ ID NO: 80038 - protein, 9 aa, Homo Sapiens
LYSWSKEGM

SEQ ID NO: 80039 - protein, 9 aa, Homo Sapiens
KHQPPPTSE

SEQ ID NO: 80040 - protein, 9 aa, Homo Sapiens
DMLCRQDPS

SEQ ID NO: 80041 - protein, 9 aa, Homo Sapiens
FRHNFVPLV

SEQ ID NO: 80042 - protein, 9 aa, Homo Sapiens
QTLLDTAGK

SEQ ID NO: 80043 - protein, 9 aa, Homo Sapiens
PHSPQVPND

SEQ ID NO: 80044 - protein, 9 aa, Homo Sapiens
YSWSKEGME

SEQ ID NO: 80045 - protein, 9 aa, Homo Sapiens
ARGRRSEPQ

SEQ ID NO: 80046 - protein, 9 aa, Homo Sapiens
RDHMAQHFS

SEQ ID NO: 80047 - protein, 9 aa, Homo Sapiens
AQHFSGLLE

SEQ ID NO: 80048 - protein, 9 aa, Homo Sapiens
QDSSAFSTS

SEQ ID NO: 80049 - protein, 9 aa, Homo Sapiens
QEVEERFNK

SEQ ID NO: 80050 - protein, 9 aa, Homo Sapiens
WGSATIRFV

SEQ ID NO: 80051 - protein, 9 aa, Homo Sapiens
TLQSLGLTW

SEQ ID NO: 80052 - protein, 9 aa, Homo Sapiens
STSESRPPT

SEQ ID NO: 80053 - protein, 9 aa, Homo Sapiens
LTKNRRGGV

SEQ ID NO: 80054 - protein, 9 aa, Homo Sapiens
HRRRVQRKR

SEQ ID NO: 80055 - protein, 9 aa, Homo Sapiens
LLKHGASAG

SEQ ID NO: 80056 - protein, 9 aa, Homo Sapiens
RYLLQCQEA

SEQ ID NO: 80057 - protein, 9 aa, Homo Sapiens
ECIQKANKG

SEQ ID NO: 80058 - protein, 9 aa, Homo Sapiens
NLYSWSKEG

SEQ ID NO: 80059 - protein, 9 aa, Homo Sapiens
RGFRDKSDL

SEQ ID NO: 80060 - protein, 9 aa, Homo Sapiens
VPPLGNIDV

SEQ ID NO: 80061 - protein, 9 aa, Homo Sapiens
GSHYQQSAD

SEQ ID NO: 80062 - protein, 9 aa, Homo Sapiens
EEQHRRRVQ

SEQ ID NO: 80063 - protein, 9 aa, Homo Sapiens
QHRRRVQRK

SEQ ID NO: 80064 - protein, 9 aa, Homo Sapiens
LRKQHWLVD

SEQ ID NO: 80065 - protein, 9 aa, Homo Sapiens
NQWSVNHEP

SEQ ID NO: 80066 - protein, 9 aa, Homo Sapiens
AGERHGSHY

SEQ ID NO: 80067 - protein, 9 aa, Homo Sapiens
VDPEEKKKI

SEQ ID NO: 80068 - protein, 9 aa, Homo Sapiens
TIILEQLLK

SEQ ID NO: 80069 - protein, 9 aa, Homo Sapiens
HNFVPLVQA

SEQ ID NO: 80070 - protein, 9 aa, Homo Sapiens
YGTENYAGP

SEQ ID NO: 80071 - protein, 9 aa, Homo Sapiens
PLVQALGDA

SEQ ID NO: 80072 - protein, 9 aa, Homo Sapiens
LKHGASAGA

SEQ ID NO: 80073 - protein, 9 aa, Homo Sapiens
QQELHCEDA

SEQ ID NO: 80074 - protein, 9 aa, Homo Sapiens
LPTSESRFA

SEQ ID NO: 80075 - protein, 9 aa, Homo Sapiens
QFVRLRKQH

SEQ ID NO: 80076 - protein, 9 aa, Homo Sapiens
QLLQHKDTY

SEQ ID NO: 80077 - protein, 9 aa, Homo Sapiens
LDTAGKKFF

SEQ ID NO: 80078 - protein, 9 aa, Homo Sapiens
PKTSQRTRC

SEQ ID NO: 80079 - protein, 9 aa, Homo Sapiens
LQLQPPLPR

SEQ ID NO: 80080 - protein, 9 aa, Homo Sapiens
DFTRLEDPQ

SEQ ID NO: 80081 - protein, 9 aa, Homo Sapiens
NYAGPCDPE

SEQ ID NO: 80082 - protein, 9 aa, Homo Sapiens
GNCTWGMNY

SEQ ID NO: 80083 - protein, 9 aa, Homo Sapiens
CSFRHNFVP

SEQ ID NO: 80084 - protein, 9 aa, Homo Sapiens
LHKFLSSAQ

SEQ ID NO: 80085 - protein, 9 aa, Homo Sapiens
VTAVELGEE

SEQ ID NO: 80086 - protein, 9 aa, Homo Sapiens
RKADSDSEN

SEQ ID NO: 80087 - protein, 9 aa, Homo Sapiens
GKKFFTSKI

SEQ ID NO: 80088 - protein, 9 aa, Homo Sapiens
VEAVLVLDM

SEQ ID NO: 80089 - protein, 9 aa, Homo Sapiens
IILEQLLKI

SEQ ID NO: 80090 - protein, 9 aa, Homo Sapiens
NHVDTSPTP

SEQ ID NO: 80091 - protein, 9 aa, Homo Sapiens
VASVLGGSG

SEQ ID NO: 80092 - protein, 9 aa, Homo Sapiens
LSSAQAICL

SEQ ID NO: 80093 - protein, 9 aa, Homo Sapiens
SAQAICLAD

SEQ ID NO: 80094 - protein, 9 aa, Homo Sapiens
LECIQKANK

SEQ ID NO: 80095 - protein, 9 aa, Homo Sapiens
EPRHRALAW

SEQ ID NO: 80096 - protein, 9 aa, Homo Sapiens
HGASAGARN

SEQ ID NO: 80097 - protein, 9 aa, Homo Sapiens
SARYLLQCQ

SEQ ID NO: 80098 - protein, 9 aa, Homo Sapiens
MPHSPQVPN

SEQ ID NO: 80099 - protein, 9 aa, Homo Sapiens
KFYLYPDFT

SEQ ID NO: 80100 - protein, 9 aa, Homo Sapiens
RFMPHSPQV

SEQ ID NO: 80101 - protein, 9 aa, Homo Sapiens
LLNFAPLEK

SEQ ID NO: 80102 - protein, 9 aa, Homo Sapiens
ELSARYLLQ

SEQ ID NO: 80103 - protein, 9 aa, Homo Sapiens
TWGMNYRFI

SEQ ID NO: 80104 - protein, 9 aa, Homo Sapiens
AMLQLLQHK

SEQ ID NO: 80105 - protein, 9 aa, Homo Sapiens
GAGGSILYS

SEQ ID NO: 80106 - protein, 9 aa, Homo Sapiens
TENYAGPCD

SEQ ID NO: 80107 - protein, 9 aa, Homo Sapiens
RTRCPRPKT

SEQ ID NO: 80108 - protein, 9 aa, Homo Sapiens
LGAGGSILY

SEQ ID NO: 80109 - protein, 9 aa, Homo Sapiens
KTIILEQLL

SEQ ID NO: 80110 - protein, 9 aa, Homo Sapiens
EAVLVLDML

SEQ ID NO: 80111 - protein, 9 aa, Homo Sapiens
ASSSSRISS

SEQ ID NO: 80112 - protein, 9 aa, Homo Sapiens
LIEKLLNFA

SEQ ID NO: 80113 - protein, 9 aa, Homo Sapiens
EKIQRAQQT

SEQ ID NO: 80114 - protein, 9 aa, Homo Sapiens
ACSPSKAAV

SEQ ID NO: 80115 - protein, 9 aa, Homo Sapiens
FDYSSQQQL

SEQ ID NO: 80116 - protein, 9 aa, Homo Sapiens
KGKSVDGIR

SEQ ID NO: 80117 - protein, 9 aa, Homo Sapiens
YKGKSVDGI

SEQ ID NO: 80118 - protein, 9 aa, Homo Sapiens
TSESRPPTE

SEQ ID NO: 80119 - protein, 9 aa, Homo Sapiens
LQLLQHKDT

SEQ ID NO: 80120 - protein, 9 aa, Homo Sapiens
KKILLNLSC

SEQ ID NO: 80121 - protein, 9 aa, Homo Sapiens
SCMGGMNQR

SEQ ID NO: 80122 - protein, 9 aa, Homo Sapiens
GVTAVELGE

SEQ ID NO: 80123 - protein, 9 aa, Homo Sapiens
ILKTALGLA

SEQ ID NO: 80124 - protein, 9 aa, Homo Sapiens
LKGVNVIPF

SEQ ID NO: 80125 - protein, 9 aa, Homo Sapiens
ALAKATYDW

SEQ ID NO: 80126 - protein, 9 aa, Homo Sapiens
HMAQHFSGL

SEQ ID NO: 80127 - protein, 9 aa, Homo Sapiens
FTRLEDPQV

SEQ ID NO: 80128 - protein, 9 aa, Homo Sapiens
ARYLLQCQE

SEQ ID NO: 80129 - protein, 9 aa, Homo Sapiens
IQKANKGTH

SEQ ID NO: 80130 - protein, 9 aa, Homo Sapiens
AQFPNMLLG

SEQ ID NO: 80131 - protein, 9 aa, Homo Sapiens
QHFSGLLEI

SEQ ID NO: 80132 - protein, 9 aa, Homo Sapiens
VQTQPESTS

SEQ ID NO: 80133 - protein, 9 aa, Homo Sapiens
PEQTPEVAP

SEQ ID NO: 80134 - protein, 9 aa, Homo Sapiens
SVDGIRSSV

SEQ ID NO: 80135 - protein, 9 aa, Homo Sapiens
GFRDKSDLL

SEQ ID NO: 80136 - protein, 9 aa, Homo Sapiens
EEPRHRALA

SEQ ID NO: 80137 - protein, 9 aa, Homo Sapiens
SQPSQNQGL

SEQ ID NO: 80138 - protein, 9 aa, Homo Sapiens
KLLNFAPLE

SEQ ID NO: 80139 - protein, 9 aa, Homo Sapiens
SLGLTWGSA

SEQ ID NO: 80140 - protein, 9 aa, Homo Sapiens
QRTRCPRPK

SEQ ID NO: 80141 - protein, 9 aa, Homo Sapiens
ANFNMDADY

SEQ ID NO: 80142 - protein, 9 aa, Homo Sapiens
TRCPRPKTK

SEQ ID NO: 80143 - protein, 9 aa, Homo Sapiens
QRAQQTCEE

SEQ ID NO: 80144 - protein, 9 aa, Homo Sapiens
ESTSESRPP

SEQ ID NO: 80145 - protein, 9 aa, Homo Sapiens
PEPAPEQTP

SEQ ID NO: 80146 - protein, 9 aa, Homo Sapiens
SPSKAAVET

SEQ ID NO: 80147 - protein, 9 aa, Homo Sapiens
EEEQHRRRV

SEQ ID NO: 80148 - protein, 9 aa, Homo Sapiens
TWGSATIRF

SEQ ID NO: 80149 - protein, 9 aa, Homo Sapiens
SENKGEESK

SEQ ID NO: 80150 - protein, 9 aa, Homo Sapiens
LQHKDTYSW

SEQ ID NO: 80151 - protein, 9 aa, Homo Sapiens
LYPDFTRLE

SEQ ID NO: 80152 - protein, 9 aa, Homo Sapiens
QWSVNHEPV

SEQ ID NO: 80153 - protein, 9 aa, Homo Sapiens
VAKGQYVHT

SEQ ID NO: 80154 - protein, 9 aa, Homo Sapiens
SGLLEIARS

SEQ ID NO: 80155 - protein, 9 aa, Homo Sapiens
EEEEEEQHR

SEQ ID NO: 80156 - protein, 9 aa, Homo Sapiens
LSARYLLQC

SEQ ID NO: 80157 - protein, 9 aa, Homo Sapiens
INCEKIQRA

SEQ ID NO: 80158 - protein, 9 aa, Homo Sapiens
RAQQTCEEC

SEQ ID NO: 80159 - protein, 9 aa, Homo Sapiens
DSENKGEES

SEQ ID NO: 80160 - protein, 9 aa, Homo Sapiens
KSGDPSCVI

SEQ ID NO: 80161 - protein, 9 aa, Homo Sapiens
QELHCEDAN

SEQ ID NO: 80162 - protein, 9 aa, Homo Sapiens
RFAWSPLAG

SEQ ID NO: 80163 - protein, 9 aa, Homo Sapiens
YSSQQQLFQ

SEQ ID NO: 80164 - protein, 9 aa, Homo Sapiens
EDDLECRGI

SEQ ID NO: 80165 - protein, 9 aa, Homo Sapiens
VGLFDYSSQ

SEQ ID NO: 80166 - protein, 9 aa, Homo Sapiens
SRISSQPGQ

SEQ ID NO: 80167 - protein, 9 aa, Homo Sapiens
GVASVLGGS

SEQ ID NO: 80168 - protein, 9 aa, Homo Sapiens
VFTLKLNLI

SEQ ID NO: 80169 - protein, 9 aa, Homo Sapiens
LLLKHGASA

SEQ ID NO: 80170 - protein, 9 aa, Homo Sapiens
KADSDSENK

SEQ ID NO: 80171 - protein, 9 aa, Homo Sapiens
CNLYSWSKE

SEQ ID NO: 80172 - protein, 9 aa, Homo Sapiens
HLDMYNRNH

SEQ ID NO: 80173 - protein, 9 aa, Homo Sapiens
RHGSHYQQS

SEQ ID NO: 80174 - protein, 9 aa, Homo Sapiens
VTSNFSEDD

SEQ ID NO: 80175 - protein, 9 aa, Homo Sapiens
DMYNRNHVD

SEQ ID NO: 80176 - protein, 9 aa, Homo Sapiens
VPEPAPEQT

SEQ ID NO: 80177 - protein, 9 aa, Homo Sapiens
KIQRAQQTC

SEQ ID NO: 80178 - protein, 9 aa, Homo Sapiens
NCQVAKGQY

SEQ ID NO: 80179 - protein, 9 aa, Homo Sapiens
DTAGKKFFT

SEQ ID NO: 80180 - protein, 9 aa, Homo Sapiens
LFDYSSQQQ

SEQ ID NO: 80181 - protein, 9 aa, Homo Sapiens
STSSDSLLS

SEQ ID NO: 80182 - protein, 9 aa, Homo Sapiens
TDDYGTENY

SEQ ID NO: 80183 - protein, 9 aa, Homo Sapiens
LLNLSCQSC

SEQ ID NO: 80184 - protein, 9 aa, Homo Sapiens
ANCQVAKGQ

SEQ ID NO: 80185 - protein, 9 aa, Homo Sapiens
MGGMNQRPI

SEQ ID NO: 80186 - protein, 9 aa, Homo Sapiens
CEKIQRAQQ

SEQ ID NO: 80187 - protein, 9 aa, Homo Sapiens
LDMYNRNHV

SEQ ID NO: 80188 - protein, 9 aa, Homo Sapiens
LLQCQEAEQ

SEQ ID NO: 80189 - protein, 9 aa, Homo Sapiens
QVAKGQYVH

SEQ ID NO: 80190 - protein, 9 aa, Homo Sapiens
LKISLPLYS

SEQ ID NO: 80191 - protein, 9 aa, Homo Sapiens
KATYDWLFR

SEQ ID NO: 80192 - protein, 9 aa, Homo Sapiens
RGGVASVLG

SEQ ID NO: 80193 - protein, 9 aa, Homo Sapiens
AKATYDWLF

SEQ ID NO: 80194 - protein, 9 aa, Homo Sapiens
YQQSADSSR

SEQ ID NO: 80195 - protein, 9 aa, Homo Sapiens
GRGFRDKSD

SEQ ID NO: 80196 - protein, 9 aa, Homo Sapiens
SSAFSTSSD

SEQ ID NO: 80197 - protein, 9 aa, Homo Sapiens
DYVPPLGNI

SEQ ID NO: 80198 - protein, 9 aa, Homo Sapiens
SSRISSQPG

SEQ ID NO: 80199 - protein, 9 aa, Homo Sapiens
HKFLSSAQA

SEQ ID NO: 80200 - protein, 9 aa, Homo Sapiens
NCTWGMNYR

SEQ ID NO: 80201 - protein, 9 aa, Homo Sapiens
SRFAWSPLA

SEQ ID NO: 80202 - protein, 9 aa, Homo Sapiens
SSQPSQNQG

SEQ ID NO: 80203 - protein, 9 aa, Homo Sapiens
SEPQGREAP

SEQ ID NO: 80204 - protein, 9 aa, Homo Sapiens
FNKSGDPSC

SEQ ID NO: 80205 - protein, 9 aa, Homo Sapiens
EERFNKSGD

SEQ ID NO: 80206 - protein, 9 aa, Homo Sapiens
IPFLELIGL

SEQ ID NO: 80207 - protein, 9 aa, Homo Sapiens
HCEDANFNM

SEQ ID NO: 80208 - protein, 9 aa, Homo Sapiens
IDVETLDIT

SEQ ID NO: 80209 - protein, 9 aa, Homo Sapiens
RTCNLLRGD

SEQ ID NO: 80210 - protein, 9 aa, Homo Sapiens
SHYQQSADS

SEQ ID NO: 80211 - protein, 9 aa, Homo Sapiens
GEDKHQPPP

SEQ ID NO: 80212 - protein, 9 aa, Homo Sapiens
KSSQPSQNQ

SEQ ID NO: 80213 - protein, 9 aa, Homo Sapiens
TYDWLFRWL

SEQ ID NO: 80214 - protein, 9 aa, Homo Sapiens
TAVELGEET

SEQ ID NO: 80215 - protein, 9 aa, Homo Sapiens
KTLAQFPNM

SEQ ID NO: 80216 - protein, 9 aa, Homo Sapiens
DWLFRWLVS

SEQ ID NO: 80217 - protein, 9 aa, Homo Sapiens
PESTSESRP

SEQ ID NO: 80218 - protein, 9 aa, Homo Sapiens
SDLLRHQRT

SEQ ID NO: 80219 - protein, 9 aa, Homo Sapiens
CIQKANKGT

SEQ ID NO: 80220 - protein, 9 aa, Homo Sapiens
KNRRGGVAS

SEQ ID NO: 80221 - protein, 9 aa, Homo Sapiens
SAGARNADQ

SEQ ID NO: 80222 - protein, 9 aa, Homo Sapiens
KLLLQLQPP

SEQ ID NO: 80223 - protein, 9 aa, Homo Sapiens
EPVKWPNPE

SEQ ID NO: 80224 - protein, 9 aa, Homo Sapiens
KVFTLKLNL

SEQ ID NO: 80225 - protein, 9 aa, Homo Sapiens
TSSDSLLSS

SEQ ID NO: 80226 - protein, 9 aa, Homo Sapiens
KRAMANCQV

SEQ ID NO: 80227 - protein, 9 aa, Homo Sapiens
SDSENKGEE

SEQ ID NO: 80228 - protein, 9 aa, Homo Sapiens
NLSCQSCTF

SEQ ID NO: 80229 - protein, 9 aa, Homo Sapiens
RPRTCNLLR

SEQ ID NO: 80230 - protein, 9 aa, Homo Sapiens
ADSDSENKG

SEQ ID NO: 80231 - protein, 9 aa, Homo Sapiens
APEQTPEVA

SEQ ID NO: 80232 - protein, 9 aa, Homo Sapiens
PPLPTSESR

SEQ ID NO: 80233 - protein, 9 aa, Homo Sapiens
CGKVFTLKL

SEQ ID NO: 80234 - protein, 9 aa, Homo Sapiens
ERFNKSGDP

SEQ ID NO: 80235 - protein, 9 aa, Homo Sapiens
EEEEEEEQH

SEQ ID NO: 80236 - protein, 9 aa, Homo Sapiens
GGMNQRPIL

SEQ ID NO: 80237 - protein, 9 aa, Homo Sapiens
DKHQPPPTS

SEQ ID NO: 80238 - protein, 9 aa, Homo Sapiens
PPLGNIDVE

SEQ ID NO: 80239 - protein, 9 aa, Homo Sapiens
TLAQFPNML

SEQ ID NO: 80240 - protein, 9 aa, Homo Sapiens
PDLGAGGSI

SEQ ID NO: 80241 - protein, 9 aa, Homo Sapiens
TSNFSEDDL

SEQ ID NO: 80242 - protein, 9 aa, Homo Sapiens
WLFRWLVSR

SEQ ID NO: 80243 - protein, 9 aa, Homo Sapiens
ALKGVNVIP

SEQ ID NO: 80244 - protein, 9 aa, Homo Sapiens
DNIKSSQPS

SEQ ID NO: 80245 - protein, 9 aa, Homo Sapiens
SFRHNFVPL

SEQ ID NO: 80246 - protein, 9 aa, Homo Sapiens
LLLQLQPPL

SEQ ID NO: 80247 - protein, 9 aa, Homo Sapiens
SRHGEDKHQ

SEQ ID NO: 80248 - protein, 9 aa, Homo Sapiens
LHCEDANFN

SEQ ID NO: 80249 - protein, 9 aa, Homo Sapiens
LQLLKLLLQ

SEQ ID NO: 80250 - protein, 9 aa, Homo Sapiens
NQRPILTII

SEQ ID NO: 80251 - protein, 9 aa, Homo Sapiens
FPNMLLGNP

SEQ ID NO: 80252 - protein, 9 aa, Homo Sapiens
SKAAVETQL

SEQ ID NO: 80253 - protein, 9 aa, Homo Sapiens
SESRPPTEE

SEQ ID NO: 80254 - protein, 9 aa, Homo Sapiens
EEEEEQHRR

SEQ ID NO: 80255 - protein, 9 aa, Homo Sapiens
AMANCQVAK

SEQ ID NO: 80256 - protein, 9 aa, Homo Sapiens
QTPEVAPEL

SEQ ID NO: 80257 - protein, 9 aa, Homo Sapiens
YRFIHPGVN

SEQ ID NO: 80258 - protein, 9 aa, Homo Sapiens
RFNKSGDPS

SEQ ID NO: 80259 - protein, 9 aa, Homo Sapiens
RRGGVASVL

SEQ ID NO: 80260 - protein, 9 aa, Homo Sapiens
KSDLLRHQR

SEQ ID NO: 80261 - protein, 9 aa, Homo Sapiens
HRPRTCNLL

SEQ ID NO: 80262 - protein, 9 aa, Homo Sapiens
FVRLRKQHW

SEQ ID NO: 80263 - protein, 9 aa, Homo Sapiens
GTENYAGPC

SEQ ID NO: 80264 - protein, 9 aa, Homo Sapiens
QHKDTYSWL

SEQ ID NO: 80265 - protein, 9 aa, Homo Sapiens
SVNHEPVKW

SEQ ID NO: 80266 - protein, 9 aa, Homo Sapiens
YDWLFRWLV

SEQ ID NO: 80267 - protein, 9 aa, Homo Sapiens
SESRFAWSP

SEQ ID NO: 80268 - protein, 9 aa, Homo Sapiens
LGNIDVETL

SEQ ID NO: 80269 - protein, 9 aa, Homo Sapiens
LVLDMLCRQ

SEQ ID NO: 80270 - protein, 9 aa, Homo Sapiens
FTLKLNLIT

SEQ ID NO: 80271 - protein, 9 aa, Homo Sapiens
DLGAGGSIL

SEQ ID NO: 80272 - protein, 9 aa, Homo Sapiens
ENYAGPCDP

SEQ ID NO: 80273 - protein, 9 aa, Homo Sapiens
CQVAKGQYV

SEQ ID NO: 80274 - protein, 9 aa, Homo Sapiens
VIPFLELIG

SEQ ID NO: 80275 - protein, 9 aa, Homo Sapiens
GDPACSPSK

SEQ ID NO: 80276 - protein, 9 aa, Homo Sapiens
ILEQLLKIS

SEQ ID NO: 80277 - protein, 9 aa, Homo Sapiens
AGKKFFTSK

SEQ ID NO: 80278 - protein, 9 aa, Homo Sapiens
AALKGVNVI

SEQ ID NO: 80279 - protein, 9 aa, Homo Sapiens
YVPPLGNID

SEQ ID NO: 80280 - protein, 9 aa, Homo Sapiens
RKVPGVTAV

SEQ ID NO: 80281 - protein, 9 aa, Homo Sapiens
TVGLFDYSS

SEQ ID NO: 80282 - protein, 9 aa, Homo Sapiens
RAMANCQVA

SEQ ID NO: 80283 - protein, 9 aa, Homo Sapiens
SQDSSAFST

SEQ ID NO: 80284 - protein, 9 aa, Homo Sapiens
MAQHFSGLL

SEQ ID NO: 80285 - protein, 9 aa, Homo Sapiens
DGIRSSVIP

SEQ ID NO: 80286 - protein, 9 aa, Homo Sapiens
KQHWLVDDA

SEQ ID NO: 80287 - protein, 9 aa, Homo Sapiens
RGRRSEPQG

SEQ ID NO: 80288 - protein, 9 aa, Homo Sapiens
EEEEQHRRR

SEQ ID NO: 80289 - protein, 9 aa, Homo Sapiens
RLRKQHWLV

SEQ ID NO: 80290 - protein, 9 aa, Homo Sapiens
TAGKKFFTS

SEQ ID NO: 80291 - protein, 9 aa, Homo Sapiens
DPACSPSKA

SEQ ID NO: 80292 - protein, 9 aa, Homo Sapiens
SEDDLECRG

SEQ ID NO: 80293 - protein, 9 aa, Homo Sapiens
HFSGLLEIA

SEQ ID NO: 80294 - protein, 9 aa, Homo Sapiens
LLQHKDTYS

SEQ ID NO: 80295 - protein, 9 aa, Homo Sapiens
ERHGSHYQQ

SEQ ID NO: 80296 - protein, 9 aa, Homo Sapiens
RHNFVPLVQ

SEQ ID NO: 80297 - protein, 9 aa, Homo Sapiens
VNQWSVNHE

SEQ ID NO: 80298 - protein, 9 aa, Homo Sapiens
GSILYSFQP

SEQ ID NO: 80299 - protein, 9 aa, Homo Sapiens
ENKGEESKP

SEQ ID NO: 80300 - protein, 9 aa, Homo Sapiens
DHMAQHFSG

SEQ ID NO: 80301 - protein, 9 aa, Homo Sapiens
PSQNQGLGR

SEQ ID NO: 80302 - protein, 9 aa, Homo Sapiens
QLLKISLPL

SEQ ID NO: 80303 - protein, 9 aa, Homo Sapiens
NIDVETLDI

SEQ ID NO: 80304 - protein, 9 aa, Homo Sapiens
DDYGTENYA

SEQ ID NO: 80305 - protein, 9 aa, Homo Sapiens
EELSARYLL

SEQ ID NO: 80306 - protein, 9 aa, Homo Sapiens
CEDANFNMD

SEQ ID NO: 80307 - protein, 9 aa, Homo Sapiens
VRFMPHSPQ

SEQ ID NO: 80308 - protein, 9 aa, Homo Sapiens
DSRHGEDKH

SEQ ID NO: 80309 - protein, 9 aa, Homo Sapiens
FYLYPDFTR

SEQ ID NO: 80310 - protein, 9 aa, Homo Sapiens
NKGEESKPK

SEQ ID NO: 80311 - protein, 9 aa, Homo Sapiens
MAARGRRSE

SEQ ID NO: 80312 - protein, 9 aa, Homo Sapiens
RISSQPGQQ

SEQ ID NO: 80313 - protein, 9 aa, Homo Sapiens
CMGGMNQRP

SEQ ID NO: 80314 - protein, 9 aa, Homo Sapiens
PTDDYGTEN

SEQ ID NO: 80315 - protein, 9 aa, Homo Sapiens
QRPILTIIT

SEQ ID NO: 80316 - protein, 9 aa, Homo Sapiens
KACNLYSWS

SEQ ID NO: 80317 - protein, 9 aa, Homo Sapiens
GLAELTVTD

SEQ ID NO: 80318 - protein, 9 aa, Homo Sapiens
GGVASVLGG

SEQ ID NO: 80319 - protein, 9 aa, Homo Sapiens
DSSAFSTSS

SEQ ID NO: 80320 - protein, 9 aa, Homo Sapiens
QLLKLLLQL

SEQ ID NO: 80321 - protein, 9 aa, Homo Sapiens
SEEPRHRAL

SEQ ID NO: 80322 - protein, 9 aa, Homo Sapiens
GLFDYSSQQ

SEQ ID NO: 80323 - protein, 9 aa, Homo Sapiens
EKKKILLNL

SEQ ID NO: 80324 - protein, 9 aa, Homo Sapiens
NFSEDDLEC

SEQ ID NO: 80325 - protein, 9 aa, Homo Sapiens
QYLHKFLSS

SEQ ID NO: 80326 - protein, 9 aa, Homo Sapiens
DYSSQQQLF

SEQ ID NO: 80327 - protein, 9 aa, Homo Sapiens
EPAPEQTPE

SEQ ID NO: 80328 - protein, 9 aa, Homo Sapiens
GHRPRTCNL

SEQ ID NO: 80329 - protein, 9 aa, Homo Sapiens
LNLSCQSCT

SEQ ID NO: 80330 - protein, 9 aa, Homo Sapiens
NLECIQKAN

SEQ ID NO: 80331 - protein, 9 aa, Homo Sapiens
KYKGKSVDG

SEQ ID NO: 80332 - protein, 9 aa, Homo Sapiens
HSPQVPNDN

SEQ ID NO: 80333 - protein, 9 aa, Homo Sapiens
QPESTSESR

SEQ ID NO: 80334 - protein, 9 aa, Homo Sapiens
NRNHVDTSP

SEQ ID NO: 80335 - protein, 9 aa, Homo Sapiens
LGLTWGSAT

SEQ ID NO: 80336 - protein, 9 aa, Homo Sapiens
TKNRRGGVA

SEQ ID NO: 80337 - protein, 9 aa, Homo Sapiens
GNVTSNFSE

SEQ ID NO: 80338 - protein, 9 aa, Homo Sapiens
GVNVIPFLE

SEQ ID NO: 80339 - protein, 9 aa, Homo Sapiens
EQHRRRVQR

SEQ ID NO: 80340 - protein, 9 aa, Homo Sapiens
LTWGSATIR

SEQ ID NO: 80341 - protein, 9 aa, Homo Sapiens
GKVFTLKLN

SEQ ID NO: 80342 - protein, 9 aa, Homo Sapiens
MANCQVAKG

SEQ ID NO: 80343 - protein, 9 aa, Homo Sapiens
SQRTRCPRP

SEQ ID NO: 80344 - protein, 9 aa, Homo Sapiens
LQFVRLRKQ

SEQ ID NO: 80345 - protein, 9 aa, Homo Sapiens
TLLDTAGKK

SEQ ID NO: 80346 - protein, 9 aa, Homo Sapiens
NRRGGVASV

SEQ ID NO: 80347 - protein, 9 aa, Homo Sapiens
KHGASAGAR

SEQ ID NO: 80348 - protein, 9 aa, Homo Sapiens
NLLRGDQTT

SEQ ID NO: 80349 - protein, 9 aa, Homo Sapiens
KAAVETQLA

SEQ ID NO: 80350 - protein, 9 aa, Homo Sapiens
QPSQNQGLG

SEQ ID NO: 80351 - protein, 9 aa, Homo Sapiens
NVTSNFSED

SEQ ID NO: 80352 - protein, 9 aa, Homo Sapiens
VDNIKSSQP

SEQ ID NO: 80353 - protein, 9 aa, Homo Sapiens
TSESRFAWS

SEQ ID NO: 80354 - protein, 9 aa, Homo Sapiens
MNYRFIHPG

SEQ ID NO: 80355 - protein, 9 aa, Homo Sapiens
YPDFTRLED

SEQ ID NO: 80356 - protein, 9 aa, Homo Sapiens
FSGLLEIAR

SEQ ID NO: 80357 - protein, 9 aa, Homo Sapiens
LDMLCRQDP

SEQ ID NO: 80358 - protein, 9 aa, Homo Sapiens
AGGSILYSF

SEQ ID NO: 80359 - protein, 9 aa, Homo Sapiens
KKFFTSKIV

SEQ ID NO: 80360 - protein, 9 aa, Homo Sapiens
PNMLLGNPK

SEQ ID NO: 80361 - protein, 9 aa, Homo Sapiens
TALGLAELT

SEQ ID NO: 80362 - protein, 9 aa, Homo Sapiens
LLKISLPLY

SEQ ID NO: 80363 - protein, 9 aa, Homo Sapiens
ELHCEDANF

SEQ ID NO: 80364 - protein, 9 aa, Homo Sapiens
QVLKSEEPR

SEQ ID NO: 80365 - protein, 9 aa, Homo Sapiens
PEEKKKILL

SEQ ID NO: 80366 - protein, 9 aa, Homo Sapiens
RRSEPQGRE

SEQ ID NO: 80367 - protein, 9 aa, Homo Sapiens
ATYDWLFRW

SEQ ID NO: 80368 - protein, 9 aa, Homo Sapiens
KTALGLAEL

SEQ ID NO: 80369 - protein, 9 aa, Homo Sapiens
AVELGEETC

SEQ ID NO: 80370 - protein, 9 aa, Homo Sapiens
KANKGTHTS

SEQ ID NO: 80371 - protein, 9 aa, Homo Sapiens
VRLRKQHWL

SEQ ID NO: 80372 - protein, 9 aa, Homo Sapiens
NHEPVKWPN

SEQ ID NO: 80373 - protein, 9 aa, Homo Sapiens
TQPESTSES

SEQ ID NO: 80374 - protein, 9 aa, Homo Sapiens
PDFTRLEDP

SEQ ID NO: 80375 - protein, 9 aa, Homo Sapiens
SSAQAICLA

SEQ ID NO: 80376 - protein, 9 aa, Homo Sapiens
NFVPLVQAL

SEQ ID NO: 80377 - protein, 9 aa, Homo Sapiens
EKLLNFAPL

SEQ ID NO: 80378 - protein, 9 aa, Homo Sapiens
CTWGMNYRF

SEQ ID NO: 80379 - protein, 9 aa, Homo Sapiens
MNQRPILTI

SEQ ID NO: 80380 - protein, 9 aa, Homo Sapiens
MGHRPRTCN

SEQ ID NO: 80381 - protein, 9 aa, Homo Sapiens
CILKTALGL

SEQ ID NO: 80382 - protein, 9 aa, Homo Sapiens
DLIEKLLNF

SEQ ID NO: 80383 - protein, 9 aa, Homo Sapiens
NCEKIQRAQ

SEQ ID NO: 80384 - protein, 9 aa, Homo Sapiens
VNVIPFLEL

SEQ ID NO: 80385 - protein, 9 aa, Homo Sapiens
PLLLKHGAS

SEQ ID NO: 80386 - protein, 9 aa, Homo Sapiens
GNIDVETLD

SEQ ID NO: 80387 - protein, 9 aa, Homo Sapiens
SSQQQLFQR

SEQ ID NO: 80388 - protein, 9 aa, Homo Sapiens
IQRAQQTCE

SEQ ID NO: 80389 - protein, 9 aa, Homo Sapiens
GRRSEPQGR

SEQ ID NO: 80390 - protein, 9 aa, Homo Sapiens
RKQHWLVDD

SEQ ID NO: 80391 - protein, 9 aa, Homo Sapiens
SILYSFQPP

SEQ ID NO: 80392 - protein, 9 aa, Homo Sapiens
IKSSQPSQN

SEQ ID NO: 80393 - protein, 9 aa, Homo Sapiens
QTQPESTSE

SEQ ID NO: 80394 - protein, 9 aa, Homo Sapiens
GMNYRFIHP

SEQ ID NO: 80395 - protein, 9 aa, Homo Sapiens
SNFSEDDLE

SEQ ID NO: 80396 - protein, 9 aa, Homo Sapiens
PAPEQTPEV

SEQ ID NO: 80397 - protein, 9 aa, Homo Sapiens
PRTCNLLRG

SEQ ID NO: 80398 - protein, 9 aa, Homo Sapiens
IVRFMPHSP

SEQ ID NO: 80399 - protein, 9 aa, Homo Sapiens
HKDTYSWLL

SEQ ID NO: 80400 - protein, 9 aa, Homo Sapiens
LQSLGLTWG

SEQ ID NO: 80401 - protein, 9 aa, Homo Sapiens
EDKHQPPPT

SEQ ID NO: 80402 - protein, 9 aa, Homo Sapiens
DYGTENYAG

SEQ ID NO: 80403 - protein, 9 aa, Homo Sapiens
RSEPQGREA

SEQ ID NO: 80404 - protein, 9 aa, Homo Sapiens
ISSQPGQQD

SEQ ID NO: 80405 - protein, 9 aa, Homo Sapiens
EDANFNMDA

SEQ ID NO: 80406 - protein, 9 aa, Homo Sapiens
GGSILYSFQ

SEQ ID NO: 80407 - protein, 9 aa, Homo Sapiens
ILYSFQPPS

SEQ ID NO: 80408 - protein, 9 aa, Homo Sapiens
RDKSDLLRH

SEQ ID NO: 80409 - protein, 9 aa, Homo Sapiens
LAELTVTDL

SEQ ID NO: 80410 - protein, 9 aa, Homo Sapiens
KGVNVIPFL

SEQ ID NO: 80411 - protein, 9 aa, Homo Sapiens
SSSSRISSQ

SEQ ID NO: 80412 - protein, 9 aa, Homo Sapiens
KFLSSAQAI

SEQ ID NO: 80413 - protein, 9 aa, Homo Sapiens
SVPEPAPEQ

SEQ ID NO: 80414 - protein, 9 aa, Homo Sapiens
ILLNLSCQS

SEQ ID NO: 80415 - protein, 9 aa, Homo Sapiens
KVPGVTAVE

SEQ ID NO: 80416 - protein, 9 aa, Homo Sapiens
GERHGSHYQ

SEQ ID NO: 80417 - protein, 9 aa, Homo Sapiens
CPRPKTKTT

SEQ ID NO: 80418 - protein, 9 aa, Homo Sapiens
QFPNMLLGN

SEQ ID NO: 80419 - protein, 9 aa, Homo Sapiens
IKFYLYPDF

SEQ ID NO: 80420 - protein, 9 aa, Homo Sapiens
GASAGARNA

SEQ ID NO: 80421 - protein, 9 aa, Homo Sapiens
NVIPFLELI

SEQ ID NO: 80422 - protein, 9 aa, Homo Sapiens
PLGNIDVET

SEQ ID NO: 80423 - protein, 9 aa, Homo Sapiens
SSSRISSQP

SEQ ID NO: 80424 - protein, 9 aa, Homo Sapiens
GMNQRPILT

SEQ ID NO: 80425 - protein, 9 aa, Homo Sapiens
GTASSSSRI

SEQ ID NO: 80426 - protein, 9 aa, Homo Sapiens
LPNLECIQK

SEQ ID NO: 80427 - protein, 9 aa, Homo Sapiens
PGVTAVELG

SEQ ID NO: 80428 - protein, 9 aa, Homo Sapiens
CINCEKIQR

SEQ ID NO: 80429 - protein, 9 aa, Homo Sapiens
MLCRQDPSF

SEQ ID NO: 80430 - protein, 9 aa, Homo Sapiens
LKSEEPRHR

SEQ ID NO: 80431 - protein, 9 aa, Homo Sapiens
HGSHYQQSA

SEQ ID NO: 80432 - protein, 9 aa, Homo Sapiens
DPEEKKKIL

SEQ ID NO: 80433 - protein, 9 aa, Homo Sapiens
ALGLAELTV

SEQ ID NO: 80434 - protein, 9 aa, Homo Sapiens
YLLQCQEAE

SEQ ID NO: 80435 - protein, 9 aa, Homo Sapiens
LKTALGLAE

SEQ ID NO: 80436 - protein, 9 aa, Homo Sapiens
ACNLYSWSK

SEQ ID NO: 80437 - protein, 9 aa, Homo Sapiens
EVEERFNKS

SEQ ID NO: 80438 - protein, 9 aa, Homo Sapiens
RQVLKSEEP

SEQ ID NO: 80439 - protein, 9 aa, Homo Sapiens
FLSSAQAIC

SEQ ID NO: 80440 - protein, 9 aa, Homo Sapiens
FRDKSDLLR

SEQ ID NO: 80441 - protein, 9 aa, Homo Sapiens
PDSRHGEDK

SEQ ID NO: 80442 - protein, 9 aa, Homo Sapiens
KKKILLNLS

SEQ ID NO: 80443 - protein, 9 aa, Homo Sapiens
GIRSSVIPR

SEQ ID NO: 80444 - protein, 9 aa, Homo Sapiens
KTSQRTRCP

SEQ ID NO: 80445 - protein, 9 aa, Homo Sapiens
RNHVDTSPT

SEQ ID NO: 80446 - protein, 9 aa, Homo Sapiens
YNRNHVDTS

SEQ ID NO: 80447 - protein, 9 aa, Homo Sapiens
KLNLITHQK

SEQ ID NO: 80448 - protein, 9 aa, Homo Sapiens
KAMLQLLQH

SEQ ID NO: 80449 - protein, 9 aa, Homo Sapiens
RCPRPKTKT

SEQ ID NO: 80450 - protein, 9 aa, Homo Sapiens
LEQLLKISL

SEQ ID NO: 80451 - protein, 9 aa, Homo Sapiens
ATVGLFDYS

SEQ ID NO: 80452 - protein, 9 aa, Homo Sapiens
FSTSSDSLL

SEQ ID NO: 80453 - protein, 9 aa, Homo Sapiens
MYNRNHVDT

SEQ ID NO: 80454 - protein, 9 aa, Homo Sapiens
NIKSSQPSQ

SEQ ID NO: 80455 - protein, 9 aa, Homo Sapiens
GSIVRFMPH

SEQ ID NO: 80456 - protein, 9 aa, Homo Sapiens
CSPSKAAVE

SEQ ID NO: 80457 - protein, 9 aa, Homo Sapiens
EQLLKISLP

SEQ ID NO: 80458 - protein, 9 aa, Homo Sapiens
VPLVQALGD

SEQ ID NO: 80459 - protein, 9 aa, Homo Sapiens
VSRLFPSTV

SEQ ID NO: 80460 - protein, 9 aa, Homo Sapiens
TFPAAIQGV

SEQ ID NO: 80461 - protein, 9 aa, Homo Sapiens
QLFCPPPGA

SEQ ID NO: 80462 - protein, 9 aa, Homo Sapiens
STSFLILTE

SEQ ID NO: 80463 - protein, 9 aa, Homo Sapiens
QSEGSKGSL

SEQ ID NO: 80464 - protein, 9 aa, Homo Sapiens
STTPVDTSK

SEQ ID NO: 80465 - protein, 9 aa, Homo Sapiens
RKKKRNRPE

SEQ ID NO: 80466 - protein, 9 aa, Homo Sapiens
EAFSLDYIV

SEQ ID NO: 80467 - protein, 9 aa, Homo Sapiens
LCQLFCPPP

SEQ ID NO: 80468 - protein, 9 aa, Homo Sapiens
PPGPPHQDV

SEQ ID NO: 80469 - protein, 9 aa, Homo Sapiens
ISPTYTWKL

SEQ ID NO: 80470 - protein, 9 aa, Homo Sapiens
LFIHQKLHA

SEQ ID NO: 80471 - protein, 9 aa, Homo Sapiens
QKGSTDGLP

SEQ ID NO: 80472 - protein, 9 aa, Homo Sapiens
HWLCQLFCP

SEQ ID NO: 80473 - protein, 9 aa, Homo Sapiens
KGSTDGLPD

SEQ ID NO: 80474 - protein, 9 aa, Homo Sapiens
PDELCEARF

SEQ ID NO: 80475 - protein, 9 aa, Homo Sapiens
GVNSPPSVG

SEQ ID NO: 80476 - protein, 9 aa, Homo Sapiens
LHAQENPHK

SEQ ID NO: 80477 - protein, 9 aa, Homo Sapiens
GEMPAQLTS

SEQ ID NO: 80478 - protein, 9 aa, Homo Sapiens
LVSQLRGEA

SEQ ID NO: 80479 - protein, 9 aa, Homo Sapiens
LEELGIEGL

SEQ ID NO: 80480 - protein, 9 aa, Homo Sapiens
PPPGAWALQ

SEQ ID NO: 80481 - protein, 9 aa, Homo Sapiens
KLVSQLRGE

SEQ ID NO: 80482 - protein, 9 aa, Homo Sapiens
TWKLIFRLI

SEQ ID NO: 80483 - protein, 9 aa, Homo Sapiens
SGLFIHQKL

SEQ ID NO: 80484 - protein, 9 aa, Homo Sapiens
GPPHQDVLS

SEQ ID NO: 80485 - protein, 9 aa, Homo Sapiens
GLFIHQKLH

SEQ ID NO: 80486 - protein, 9 aa, Homo Sapiens
NKDGNITLN

SEQ ID NO: 80487 - protein, 9 aa, Homo Sapiens
MVVLCLNLR

SEQ ID NO: 80488 - protein, 9 aa, Homo Sapiens
WTEDSFLCN

SEQ ID NO: 80489 - protein, 9 aa, Homo Sapiens
TPVDTSKPV

SEQ ID NO: 80490 - protein, 9 aa, Homo Sapiens
LVKSKIERV

SEQ ID NO: 80491 - protein, 9 aa, Homo Sapiens
EMPAQLTSR

SEQ ID NO: 80492 - protein, 9 aa, Homo Sapiens
THALMVVLC

SEQ ID NO: 80493 - protein, 9 aa, Homo Sapiens
DTSKPVTNS

SEQ ID NO: 80494 - protein, 9 aa, Homo Sapiens
DVLSGPHWL

SEQ ID NO: 80495 - protein, 9 aa, Homo Sapiens
ALMVVLCLN

SEQ ID NO: 80496 - protein, 9 aa, Homo Sapiens
EEERKKKRN

SEQ ID NO: 80497 - protein, 9 aa, Homo Sapiens
PPSVGGGGG

SEQ ID NO: 80498 - protein, 9 aa, Homo Sapiens
PFVAGCHCP

SEQ ID NO: 80499 - protein, 9 aa, Homo Sapiens
PTYTWKLIF

SEQ ID NO: 80500 - protein, 9 aa, Homo Sapiens
GPCNKPFVA

SEQ ID NO: 80501 - protein, 9 aa, Homo Sapiens
PHQDVLSGP

SEQ ID NO: 80502 - protein, 9 aa, Homo Sapiens
MSHQKGSTD

SEQ ID NO: 80503 - protein, 9 aa, Homo Sapiens
RHDPLVKSK

SEQ ID NO: 80504 - protein, 9 aa, Homo Sapiens
CEARFAAGV

SEQ ID NO: 80505 - protein, 9 aa, Homo Sapiens
PLVKSKIER

SEQ ID NO: 80506 - protein, 9 aa, Homo Sapiens
CSCARRIRS

SEQ ID NO: 80507 - protein, 9 aa, Homo Sapiens
HQKGSTDGL

SEQ ID NO: 80508 - protein, 9 aa, Homo Sapiens
IPLSHAHKP

SEQ ID NO: 80509 - protein, 9 aa, Homo Sapiens
GSPPEREHA

SEQ ID NO: 80510 - protein, 9 aa, Homo Sapiens
EIELEMEKI

SEQ ID NO: 80511 - protein, 9 aa, Homo Sapiens
WLCQLFCPP

SEQ ID NO: 80512 - protein, 9 aa, Homo Sapiens
KEYMKNLLK

SEQ ID NO: 80513 - protein, 9 aa, Homo Sapiens
KPFVAGCHC

SEQ ID NO: 80514 - protein, 9 aa, Homo Sapiens
SPPEREHAP

SEQ ID NO: 80515 - protein, 9 aa, Homo Sapiens
WALQRGPSP

SEQ ID NO: 80516 - protein, 9 aa, Homo Sapiens
SEKLVSQLR

SEQ ID NO: 80517 - protein, 9 aa, Homo Sapiens
EMALDRFVA

SEQ ID NO: 80518 - protein, 9 aa, Homo Sapiens
GSCCSCARR

SEQ ID NO: 80519 - protein, 9 aa, Homo Sapiens
VQDPLGKGE

SEQ ID NO: 80520 - protein, 9 aa, Homo Sapiens
RKVNWLLPR

SEQ ID NO: 80521 - protein, 9 aa, Homo Sapiens
CPPPGAWAL

SEQ ID NO: 80522 - protein, 9 aa, Homo Sapiens
MPAQLTSRR

SEQ ID NO: 80523 - protein, 9 aa, Homo Sapiens
HAHKPYQLK

SEQ ID NO: 80524 - protein, 9 aa, Homo Sapiens
HDPLVKSKI

SEQ ID NO: 80525 - protein, 9 aa, Homo Sapiens
HTPPSSCIM

SEQ ID NO: 80526 - protein, 9 aa, Homo Sapiens
TTKGEMPAQ

SEQ ID NO: 80527 - protein, 9 aa, Homo Sapiens
PGVNSPPSV

SEQ ID NO: 80528 - protein, 9 aa, Homo Sapiens
RFQDGPHST

SEQ ID NO: 80529 - protein, 9 aa, Homo Sapiens
VMMTKAVKS

SEQ ID NO: 80530 - protein, 9 aa, Homo Sapiens
MMTKAVKSS

SEQ ID NO: 80531 - protein, 9 aa, Homo Sapiens
PGPPHQDVL

SEQ ID NO: 80532 - protein, 9 aa, Homo Sapiens
TKGEMPAQL

SEQ ID NO: 80533 - protein, 9 aa, Homo Sapiens
GTHALMVVL

SEQ ID NO: 80534 - protein, 9 aa, Homo Sapiens
VNSPPSVGG

SEQ ID NO: 80535 - protein, 9 aa, Homo Sapiens
EKLVSQLRG

SEQ ID NO: 80536 - protein, 9 aa, Homo Sapiens
RNRPEEGSC

SEQ ID NO: 80537 - protein, 9 aa, Homo Sapiens
FVAGCHCPA

SEQ ID NO: 80538 - protein, 9 aa, Homo Sapiens
VKEDLPHTP

SEQ ID NO: 80539 - protein, 9 aa, Homo Sapiens
FQDGPHSTP

SEQ ID NO: 80540 - protein, 9 aa, Homo Sapiens
SPPSVGGGG

SEQ ID NO: 80541 - protein, 9 aa, Homo Sapiens
AGVQKEHKE

SEQ ID NO: 80542 - protein, 9 aa, Homo Sapiens
SPTYTWKLI

SEQ ID NO: 80543 - protein, 9 aa, Homo Sapiens
LCNKDGNIT

SEQ ID NO: 80544 - protein, 9 aa, Homo Sapiens
KEEEEKEEE

SEQ ID NO: 80545 - protein, 9 aa, Homo Sapiens
LTEMALDRF

SEQ ID NO: 80546 - protein, 9 aa, Homo Sapiens
KRCLRKVNW

SEQ ID NO: 80547 - protein, 9 aa, Homo Sapiens
PAAIQGVIQ

SEQ ID NO: 80548 - protein, 9 aa, Homo Sapiens
NSPPSVGGG

SEQ ID NO: 80549 - protein, 9 aa, Homo Sapiens
MTKAVKSSK

SEQ ID NO: 80550 - protein, 9 aa, Homo Sapiens
NAIPLSHAH

SEQ ID NO: 80551 - protein, 9 aa, Homo Sapiens
WKLIFRLIQ

SEQ ID NO: 80552 - protein, 9 aa, Homo Sapiens
PCNKPFVAG

SEQ ID NO: 80553 - protein, 9 aa, Homo Sapiens
LILTEMALD

SEQ ID NO: 80554 - protein, 9 aa, Homo Sapiens
LKTFPAAIQ

SEQ ID NO: 80555 - protein, 9 aa, Homo Sapiens
RLFPSTVQD

SEQ ID NO: 80556 - protein, 9 aa, Homo Sapiens
HALMVVLCL

SEQ ID NO: 80557 - protein, 9 aa, Homo Sapiens
DSFLCNKDG

SEQ ID NO: 80558 - protein, 9 aa, Homo Sapiens
SGPHWLCQL

SEQ ID NO: 80559 - protein, 9 aa, Homo Sapiens
FLCNKDGNI

SEQ ID NO: 80560 - protein, 9 aa, Homo Sapiens
FLVAYLEEL

SEQ ID NO: 80561 - protein, 9 aa, Homo Sapiens
YCCLPDELC

SEQ ID NO: 80562 - protein, 9 aa, Homo Sapiens
SFLCNKDGN

SEQ ID NO: 80563 - protein, 9 aa, Homo Sapiens
SQLRGEAAA

SEQ ID NO: 80564 - protein, 9 aa, Homo Sapiens
KRNRPEEGS

SEQ ID NO: 80565 - protein, 9 aa, Homo Sapiens
DGTHALMVV

SEQ ID NO: 80566 - protein, 9 aa, Homo Sapiens
LFCPPPGAW

SEQ ID NO: 80567 - protein, 9 aa, Homo Sapiens
LTTKGEMPA

SEQ ID NO: 80568 - protein, 9 aa, Homo Sapiens
VLSGPHWLC

SEQ ID NO: 80569 - protein, 9 aa, Homo Sapiens
TEMALDRFV

SEQ ID NO: 80570 - protein, 9 aa, Homo Sapiens
LEMEKIQRL

SEQ ID NO: 80571 - protein, 9 aa, Homo Sapiens
KEDLPHTPP

SEQ ID NO: 80572 - protein, 9 aa, Homo Sapiens
HKEYMKNLL

SEQ ID NO: 80573 - protein, 9 aa, Homo Sapiens
PPEREHAPP

SEQ ID NO: 80574 - protein, 9 aa, Homo Sapiens
KEHKEYMKN

SEQ ID NO: 80575 - protein, 9 aa, Homo Sapiens
DGPHSTPQE

SEQ ID NO: 80576 - protein, 9 aa, Homo Sapiens
EMEKIQRLR

SEQ ID NO: 80577 - protein, 9 aa, Homo Sapiens
VFTVGSPPE

SEQ ID NO: 80578 - protein, 9 aa, Homo Sapiens
GNAIPLSHA

SEQ ID NO: 80579 - protein, 9 aa, Homo Sapiens
VKSSKEQAL

SEQ ID NO: 80580 - protein, 9 aa, Homo Sapiens
GVQKEHKEY

SEQ ID NO: 80581 - protein, 9 aa, Homo Sapiens
LPHTPPSSC

SEQ ID NO: 80582 - protein, 9 aa, Homo Sapiens
AAIQGVIQS

SEQ ID NO: 80583 - protein, 9 aa, Homo Sapiens
LCEARFAAG

SEQ ID NO: 80584 - protein, 9 aa, Homo Sapiens
DPLVKSKIE

SEQ ID NO: 80585 - protein, 9 aa, Homo Sapiens
AVKSSKEQA

SEQ ID NO: 80586 - protein, 9 aa, Homo Sapiens
AIQGVIQSE

SEQ ID NO: 80587 - protein, 9 aa, Homo Sapiens
LSGLEAFSL

SEQ ID NO: 80588 - protein, 9 aa, Homo Sapiens
ELGIEGLLG

SEQ ID NO: 80589 - protein, 9 aa, Homo Sapiens
EGSKGSLQG

SEQ ID NO: 80590 - protein, 9 aa, Homo Sapiens
IHQKLHAQE

SEQ ID NO: 80591 - protein, 9 aa, Homo Sapiens
IQGVIQSEL

SEQ ID NO: 80592 - protein, 9 aa, Homo Sapiens
RPEEGSCCS

SEQ ID NO: 80593 - protein, 9 aa, Homo Sapiens
GSLQGELQI

SEQ ID NO: 80594 - protein, 9 aa, Homo Sapiens
KKKRNRPEE

SEQ ID NO: 80595 - protein, 9 aa, Homo Sapiens
LMVVLCLNL

SEQ ID NO: 80596 - protein, 9 aa, Homo Sapiens
LDYIVKWPL

SEQ ID NO: 80597 - protein, 9 aa, Homo Sapiens
LRKVNWLLP

SEQ ID NO: 80598 - protein, 9 aa, Homo Sapiens
EHKEYMKNL

SEQ ID NO: 80599 - protein, 9 aa, Homo Sapiens
VLCLNLRNL

SEQ ID NO: 80600 - protein, 9 aa, Homo Sapiens
GLEAFSLDY

SEQ ID NO: 80601 - protein, 9 aa, Homo Sapiens
PAQLTSRRE

SEQ ID NO: 80602 - protein, 9 aa, Homo Sapiens
LPDELCEAR

SEQ ID NO: 80603 - protein, 9 aa, Homo Sapiens
TEDSFLCNK

SEQ ID NO: 80604 - protein, 9 aa, Homo Sapiens
KLHAQENPH

SEQ ID NO: 80605 - protein, 9 aa, Homo Sapiens
PPHQDVLSG

SEQ ID NO: 80606 - protein, 9 aa, Homo Sapiens
PHTPPSSCI

SEQ ID NO: 80607 - protein, 9 aa, Homo Sapiens
EERKKKRNR

SEQ ID NO: 80608 - protein, 9 aa, Homo Sapiens
AQLTSRREI

SEQ ID NO: 80609 - protein, 9 aa, Homo Sapiens
PGAWALQRG

SEQ ID NO: 80610 - protein, 9 aa, Homo Sapiens
AIPLSHAHK

SEQ ID NO: 80611 - protein, 9 aa, Homo Sapiens
SEGSKGSLQ

SEQ ID NO: 80612 - protein, 9 aa, Homo Sapiens
SKRCLRKVN

SEQ ID NO: 80613 - protein, 9 aa, Homo Sapiens
APPGPPHQD

SEQ ID NO: 80614 - protein, 9 aa, Homo Sapiens
FSLDYIVKW

SEQ ID NO: 80615 - protein, 9 aa, Homo Sapiens
VSQLRGEAA

SEQ ID NO: 80616 - protein, 9 aa, Homo Sapiens
SLDYIVKWP

SEQ ID NO: 80617 - protein, 9 aa, Homo Sapiens
EEGSCCSCA

SEQ ID NO: 80618 - protein, 9 aa, Homo Sapiens
LSGPHWLCQ

SEQ ID NO: 80619 - protein, 9 aa, Homo Sapiens
PVDTSKPVT

SEQ ID NO: 80620 - protein, 9 aa, Homo Sapiens
TPPSSCIMD

SEQ ID NO: 80621 - protein, 9 aa, Homo Sapiens
LVAYLEELG

SEQ ID NO: 80622 - protein, 9 aa, Homo Sapiens
SLQGELQIT

SEQ ID NO: 80623 - protein, 9 aa, Homo Sapiens
AWALQRGPS

SEQ ID NO: 80624 - protein, 9 aa, Homo Sapiens
SFLILTEMA

SEQ ID NO: 80625 - protein, 9 aa, Homo Sapiens
AHKPYQLKE

SEQ ID NO: 80626 - protein, 9 aa, Homo Sapiens
KGEMPAQLT

SEQ ID NO: 80627 - protein, 9 aa, Homo Sapiens
HQKLHAQEN

SEQ ID NO: 80628 - protein, 9 aa, Homo Sapiens
IELEMEKIQ

SEQ ID NO: 80629 - protein, 9 aa, Homo Sapiens
GSEKLVSQL

SEQ ID NO: 80630 - protein, 9 aa, Homo Sapiens
TSKPVTNST

SEQ ID NO: 80631 - protein, 9 aa, Homo Sapiens
NKPFVAGCH

SEQ ID NO: 80632 - protein, 9 aa, Homo Sapiens
QKLHAQENP

SEQ ID NO: 80633 - protein, 9 aa, Homo Sapiens
KAVKSSKEQ

SEQ ID NO: 80634 - protein, 9 aa, Homo Sapiens
SSKEQALLK

SEQ ID NO: 80635 - protein, 9 aa, Homo Sapiens
TYTWKLIFR

SEQ ID NO: 80636 - protein, 9 aa, Homo Sapiens
EDSFLCNKD

SEQ ID NO: 80637 - protein, 9 aa, Homo Sapiens
KVNWLLPRA

SEQ ID NO: 80638 - protein, 9 aa, Homo Sapiens
GPHWLCQLF

SEQ ID NO: 80639 - protein, 9 aa, Homo Sapiens
QDVLSGPHW

SEQ ID NO: 80640 - protein, 9 aa, Homo Sapiens
EHAPPGPPH

SEQ ID NO: 80641 - protein, 9 aa, Homo Sapiens
GTRFQDGPH

SEQ ID NO: 80642 - protein, 9 aa, Homo Sapiens
SGLEAFSLD

SEQ ID NO: 80643 - protein, 9 aa, Homo Sapiens
VKSKIERVN

SEQ ID NO: 80644 - protein, 9 aa, Homo Sapiens
REHAPPGPP

SEQ ID NO: 80645 - protein, 9 aa, Homo Sapiens
AYLEELGIE

SEQ ID NO: 80646 - protein, 9 aa, Homo Sapiens
TVGSPPERE

SEQ ID NO: 80647 - protein, 9 aa, Homo Sapiens
MEKIQRLRE

SEQ ID NO: 80648 - protein, 9 aa, Homo Sapiens
STVQDPLGK

SEQ ID NO: 80649 - protein, 9 aa, Homo Sapiens
CLRKVNWLL

SEQ ID NO: 80650 - protein, 9 aa, Homo Sapiens
TRHDPLVKS

SEQ ID NO: 80651 - protein, 9 aa, Homo Sapiens
PHWLCQLFC

SEQ ID NO: 80652 - protein, 9 aa, Homo Sapiens
ILTEMALDR

SEQ ID NO: 80653 - protein, 9 aa, Homo Sapiens
QKEHKEYMK

SEQ ID NO: 80654 - protein, 9 aa, Homo Sapiens
VGSPPEREH

SEQ ID NO: 80655 - protein, 9 aa, Homo Sapiens
CCLPDELCE

SEQ ID NO: 80656 - protein, 9 aa, Homo Sapiens
KPVTNSTEA

SEQ ID NO: 80657 - protein, 9 aa, Homo Sapiens
EGSCCSCAR

SEQ ID NO: 80658 - protein, 9 aa, Homo Sapiens
QLRGEAAAG

SEQ ID NO: 80659 - protein, 9 aa, Homo Sapiens
QGVIQSELN

SEQ ID NO: 80660 - protein, 9 aa, Homo Sapiens
DEEKEEEEK

SEQ ID NO: 80661 - protein, 9 aa, Homo Sapiens
CNKDGNITL

SEQ ID NO: 80662 - protein, 9 aa, Homo Sapiens
VNWLLPRAG

SEQ ID NO: 80663 - protein, 9 aa, Homo Sapiens
SKGSLQGEL

SEQ ID NO: 80664 - protein, 9 aa, Homo Sapiens
RGSEKLVSQ

SEQ ID NO: 80665 - protein, 9 aa, Homo Sapiens
AFSLDYIVK

SEQ ID NO: 80666 - protein, 9 aa, Homo Sapiens
VAYLEELGI

SEQ ID NO: 80667 - protein, 9 aa, Homo Sapiens
SKPVTNSTE

SEQ ID NO: 80668 - protein, 9 aa, Homo Sapiens
CLPDELCEA

SEQ ID NO: 80669 - protein, 9 aa, Homo Sapiens
FLILTEMAL

SEQ ID NO: 80670 - protein, 9 aa, Homo Sapiens
GPHSTPQEE

SEQ ID NO: 80671 - protein, 9 aa, Homo Sapiens
KKRNRPEEG

SEQ ID NO: 80672 - protein, 9 aa, Homo Sapiens
HSTPQEEGG

SEQ ID NO: 80673 - protein, 9 aa, Homo Sapiens
RKTRHDPLV

SEQ ID NO: 80674 - protein, 9 aa, Homo Sapiens
VGGGGGSSG

SEQ ID NO: 80675 - protein, 9 aa, Homo Sapiens
PLSHAHKPY

SEQ ID NO: 80676 - protein, 9 aa, Homo Sapiens
AISPTYTWK

SEQ ID NO: 80677 - protein, 9 aa, Homo Sapiens
YLEELGIEG

SEQ ID NO: 80678 - protein, 9 aa, Homo Sapiens
TVQDPLGKG

SEQ ID NO: 80679 - protein, 9 aa, Homo Sapiens
DELCEARFA

SEQ ID NO: 80680 - protein, 9 aa, Homo Sapiens
TRFQDGPHS

SEQ ID NO: 80681 - protein, 9 aa, Homo Sapiens
NWLLPRAGG

SEQ ID NO: 80682 - protein, 9 aa, Homo Sapiens
SCCSCARRI

SEQ ID NO: 80683 - protein, 9 aa, Homo Sapiens
PEEIELEME

SEQ ID NO: 80684 - protein, 9 aa, Homo Sapiens
LGIEGLLGN

SEQ ID NO: 80685 - protein, 9 aa, Homo Sapiens
PEEGSCCSC

SEQ ID NO: 80686 - protein, 9 aa, Homo Sapiens
KTRHDPLVK

SEQ ID NO: 80687 - protein, 9 aa, Homo Sapiens
PHSTPQEEG

SEQ ID NO: 80688 - protein, 9 aa, Homo Sapiens
PEREHAPPG

SEQ ID NO: 80689 - protein, 9 aa, Homo Sapiens
SRLFPSTVQ

SEQ ID NO: 80690 - protein, 9 aa, Homo Sapiens
LFPSTVQDP

SEQ ID NO: 80691 - protein, 9 aa, Homo Sapiens
TSFLILTEM

SEQ ID NO: 80692 - protein, 9 aa, Homo Sapiens
KGSLQGELQ

SEQ ID NO: 80693 - protein, 9 aa, Homo Sapiens
CNKPFVAGC

SEQ ID NO: 80694 - protein, 9 aa, Homo Sapiens
FCPPPGAWA

SEQ ID NO: 80695 - protein, 9 aa, Homo Sapiens
IGPCNKPFV

SEQ ID NO: 80696 - protein, 9 aa, Homo Sapiens
TTPVDTSKP

SEQ ID NO: 80697 - protein, 9 aa, Homo Sapiens
NRPEEGSCC

SEQ ID NO: 80698 - protein, 9 aa, Homo Sapiens
GAWALQRGP

SEQ ID NO: 80699 - protein, 9 aa, Homo Sapiens
RCLRKVNWL

SEQ ID NO: 80700 - protein, 9 aa, Homo Sapiens
EDLPHTPPS

SEQ ID NO: 80701 - protein, 9 aa, Homo Sapiens
EELGIEGLL

SEQ ID NO: 80702 - protein, 9 aa, Homo Sapiens
FPAAIQGVI

SEQ ID NO: 80703 - protein, 9 aa, Homo Sapiens
PPSSCIMDK

SEQ ID NO: 80704 - protein, 9 aa, Homo Sapiens
EREHAPPGP

SEQ ID NO: 80705 - protein, 9 aa, Homo Sapiens
KSSKEQALL

SEQ ID NO: 80706 - protein, 9 aa, Homo Sapiens
ELEMEKIQR

SEQ ID NO: 80707 - protein, 9 aa, Homo Sapiens
SHQKGSTDG

SEQ ID NO: 80708 - protein, 9 aa, Homo Sapiens
VVLCLNLRN

SEQ ID NO: 80709 - protein, 9 aa, Homo Sapiens
RQSEGSKGS

SEQ ID NO: 80710 - protein, 9 aa, Homo Sapiens
FTVGSPPER

SEQ ID NO: 80711 - protein, 9 aa, Homo Sapiens
CQLFCPPPG

SEQ ID NO: 80712 - protein, 9 aa, Homo Sapiens
LSHAHKPYQ

SEQ ID NO: 80713 - protein, 9 aa, Homo Sapiens
YTWKLIFRL

SEQ ID NO: 80714 - protein, 9 aa, Homo Sapiens
DLPHTPPSS

SEQ ID NO: 80715 - protein, 9 aa, Homo Sapiens
EIGPCNKPF

SEQ ID NO: 80716 - protein, 9 aa, Homo Sapiens
FIHQKLHAQ

SEQ ID NO: 80717 - protein, 9 aa, Homo Sapiens
KEEERKKKR

SEQ ID NO: 80718 - protein, 9 aa, Homo Sapiens
ERKKKRNRP

SEQ ID NO: 80719 - protein, 9 aa, Homo Sapiens
HQDVLSGPH

SEQ ID NO: 80720 - protein, 9 aa, Homo Sapiens
QDGPHSTPQ

SEQ ID NO: 80721 - protein, 9 aa, Homo Sapiens
PPGAWALQR

SEQ ID NO: 80722 - protein, 9 aa, Homo Sapiens
KLIFRLIQG

SEQ ID NO: 80723 - protein, 9 aa, Homo Sapiens
SHAHKPYQL

SEQ ID NO: 80724 - protein, 9 aa, Homo Sapiens
GSKGSLQGE

SEQ ID NO: 80725 - protein, 9 aa, Homo Sapiens
ELCEARFAA

SEQ ID NO: 80726 - protein, 9 aa, Homo Sapiens
FPSTVQDPL

SEQ ID NO: 80727 - protein, 9 aa, Homo Sapiens
EEIELEMEK

SEQ ID NO: 80728 - protein, 9 aa, Homo Sapiens
GAGVQKEHK

SEQ ID NO: 80729 - protein, 9 aa, Homo Sapiens
CCSCARRIR

SEQ ID NO: 80730 - protein, 9 aa, Homo Sapiens
EKIQRLREV

SEQ ID NO: 80731 - protein, 9 aa, Homo Sapiens
KTFPAAIQG

SEQ ID NO: 80732 - protein, 9 aa, Homo Sapiens
PSTVQDPLG

SEQ ID NO: 80733 - protein, 9 aa, Homo Sapiens
VQKEHKEYM

SEQ ID NO: 80734 - protein, 9 aa, Homo Sapiens
TKAVKSSKE

SEQ ID NO: 80735 - protein, 9 aa, Homo Sapiens
LEAFSLDYI

SEQ ID NO: 80736 - protein, 9 aa, Homo Sapiens
HAPPGPPHQ

SEQ ID NO: 80737 - protein, 9 aa, Homo Sapiens
VDTSKPVTN

SEQ ID NO: 80738 - protein, 9 aa, Homo Sapiens
PSVGGGGGS

SEQ ID NO: 80739 - protein, 9 aa, Homo Sapiens
AQPMTKKQK

SEQ ID NO: 80740 - protein, 9 aa, Homo Sapiens
VSANSKGLD

SEQ ID NO: 80741 - protein, 9 aa, Homo Sapiens
EADLDLAVE

SEQ ID NO: 80742 - protein, 9 aa, Homo Sapiens
NAEGIIEFH

SEQ ID NO: 80743 - protein, 9 aa, Homo Sapiens
GLPEDIVIE

SEQ ID NO: 80744 - protein, 9 aa, Homo Sapiens
HQCHRMEAQ

SEQ ID NO: 80745 - protein, 9 aa, Homo Sapiens
GGNPFAKPS

SEQ ID NO: 80746 - protein, 9 aa, Homo Sapiens
FLCSNPKIW

SEQ ID NO: 80747 - protein, 9 aa, Homo Sapiens
SANSKGLDT

SEQ ID NO: 80748 - protein, 9 aa, Homo Sapiens
DPPASKAPD

SEQ ID NO: 80749 - protein, 9 aa, Homo Sapiens
SGKLKSRVL

SEQ ID NO: 80750 - protein, 9 aa, Homo Sapiens
PTDPPASKA

SEQ ID NO: 80751 - protein, 9 aa, Homo Sapiens
KKNPDRGYG

SEQ ID NO: 80752 - protein, 9 aa, Homo Sapiens
FFFWWWLQV

SEQ ID NO: 80753 - protein, 9 aa, Homo Sapiens
AVSANSKGL

SEQ ID NO: 80754 - protein, 9 aa, Homo Sapiens
LCATSTSSE

SEQ ID NO: 80755 - protein, 9 aa, Homo Sapiens
SEEEIDFLC

SEQ ID NO: 80756 - protein, 9 aa, Homo Sapiens
AQVLEVECF

SEQ ID NO: 80757 - protein, 9 aa, Homo Sapiens
EDSLILENS

SEQ ID NO: 80758 - protein, 9 aa, Homo Sapiens
KSGEEQLSY

SEQ ID NO: 80759 - protein, 9 aa, Homo Sapiens
QCECRPKKR

SEQ ID NO: 80760 - protein, 9 aa, Homo Sapiens
SGKTTQVSQ

SEQ ID NO: 80761 - protein, 9 aa, Homo Sapiens
FGYQYKRLE

SEQ ID NO: 80762 - protein, 9 aa, Homo Sapiens
TNEQQKIIK

SEQ ID NO: 80763 - protein, 9 aa, Homo Sapiens
PLVLNSEQS

SEQ ID NO: 80764 - protein, 9 aa, Homo Sapiens
PSCSFPHNF

SEQ ID NO: 80765 - protein, 9 aa, Homo Sapiens
VTSGPGEEE

SEQ ID NO: 80766 - protein, 9 aa, Homo Sapiens
PGGQINPNF

SEQ ID NO: 80767 - protein, 9 aa, Homo Sapiens
PLSVGIAFF

SEQ ID NO: 80768 - protein, 9 aa, Homo Sapiens
VELPDCFSP

SEQ ID NO: 80769 - protein, 9 aa, Homo Sapiens
EVKTNEQQK

SEQ ID NO: 80770 - protein, 9 aa, Homo Sapiens
DKKGKTTQV

SEQ ID NO: 80771 - protein, 9 aa, Homo Sapiens
REESPQCLE

SEQ ID NO: 80772 - protein, 9 aa, Homo Sapiens
EGNLRVENL

SEQ ID NO: 80773 - protein, 9 aa, Homo Sapiens
FNVFVCYQK

SEQ ID NO: 80774 - protein, 9 aa, Homo Sapiens
LFCDKDGKA

SEQ ID NO: 80775 - protein, 9 aa, Homo Sapiens
ELPRVRPRF

SEQ ID NO: 80776 - protein, 9 aa, Homo Sapiens
LLLPAHRSP

SEQ ID NO: 80777 - protein, 9 aa, Homo Sapiens
LYWKDARTS

SEQ ID NO: 80778 - protein, 9 aa, Homo Sapiens
CECRPKKRT

SEQ ID NO: 80779 - protein, 9 aa, Homo Sapiens
VPKAKATRK

SEQ ID NO: 80780 - protein, 9 aa, Homo Sapiens
SQFLYEAGF

SEQ ID NO: 80781 - protein, 9 aa, Homo Sapiens
NAYRCTKRY

SEQ ID NO: 80782 - protein, 9 aa, Homo Sapiens
KDLMKELYQ

SEQ ID NO: 80783 - protein, 9 aa, Homo Sapiens
EVVHAIRGQ

SEQ ID NO: 80784 - protein, 9 aa, Homo Sapiens
LLPEDGYSF

SEQ ID NO: 80785 - protein, 9 aa, Homo Sapiens
AARQLTNAY

SEQ ID NO: 80786 - protein, 9 aa, Homo Sapiens
SVGIAFFLM

SEQ ID NO: 80787 - protein, 9 aa, Homo Sapiens
TDPPASKAP

SEQ ID NO: 80788 - protein, 9 aa, Homo Sapiens
HVNEDAELM

SEQ ID NO: 80789 - protein, 9 aa, Homo Sapiens
SSKDLMKEL

SEQ ID NO: 80790 - protein, 9 aa, Homo Sapiens
RNTPQKEDR

SEQ ID NO: 80791 - protein, 9 aa, Homo Sapiens
QLPLAIKPV

SEQ ID NO: 80792 - protein, 9 aa, Homo Sapiens
EVATYKDWI

SEQ ID NO: 80793 - protein, 9 aa, Homo Sapiens
HLLSVCGFR

SEQ ID NO: 80794 - protein, 9 aa, Homo Sapiens
VVIRTLGRL

SEQ ID NO: 80795 - protein, 9 aa, Homo Sapiens
WFNKAWLQG

SEQ ID NO: 80796 - protein, 9 aa, Homo Sapiens
CFSPELRSL

SEQ ID NO: 80797 - protein, 9 aa, Homo Sapiens
KAQVLEVEC

SEQ ID NO: 80798 - protein, 9 aa, Homo Sapiens
RPRFLRAWH

SEQ ID NO: 80799 - protein, 9 aa, Homo Sapiens
GERLHLFCD

SEQ ID NO: 80800 - protein, 9 aa, Homo Sapiens
RLSSPCRMK

SEQ ID NO: 80801 - protein, 9 aa, Homo Sapiens
AAGSSKDLM

SEQ ID NO: 80802 - protein, 9 aa, Homo Sapiens
QQTEALVHG

SEQ ID NO: 80803 - protein, 9 aa, Homo Sapiens
KAKATRKIW

SEQ ID NO: 80804 - protein, 9 aa, Homo Sapiens
ELMFVGVTS

SEQ ID NO: 80805 - protein, 9 aa, Homo Sapiens
NEQQKIIKD

SEQ ID NO: 80806 - protein, 9 aa, Homo Sapiens
QSANETGQD

SEQ ID NO: 80807 - protein, 9 aa, Homo Sapiens
ECRPKKRTV

SEQ ID NO: 80808 - protein, 9 aa, Homo Sapiens
PRVRPRFLR

SEQ ID NO: 80809 - protein, 9 aa, Homo Sapiens
VPGIRGNQG

SEQ ID NO: 80810 - protein, 9 aa, Homo Sapiens
KAKRLSKEE

SEQ ID NO: 80811 - protein, 9 aa, Homo Sapiens
SEQSDTLEQ

SEQ ID NO: 80812 - protein, 9 aa, Homo Sapiens
FRPDLIEEE

SEQ ID NO: 80813 - protein, 9 aa, Homo Sapiens
DSQLTKKMT

SEQ ID NO: 80814 - protein, 9 aa, Homo Sapiens
SAEELPRVR

SEQ ID NO: 80815 - protein, 9 aa, Homo Sapiens
AVELPDCFS

SEQ ID NO: 80816 - protein, 9 aa, Homo Sapiens
YQDLDWNPK

SEQ ID NO: 80817 - protein, 9 aa, Homo Sapiens
PTVSLCATS

SEQ ID NO: 80818 - protein, 9 aa, Homo Sapiens
ATCTLVNAY

SEQ ID NO: 80819 - protein, 9 aa, Homo Sapiens
SPQCLENQS

SEQ ID NO: 80820 - protein, 9 aa, Homo Sapiens
SCKGDTQGA

SEQ ID NO: 80821 - protein, 9 aa, Homo Sapiens
EDAELMFVG

SEQ ID NO: 80822 - protein, 9 aa, Homo Sapiens
GSVGPSGGG

SEQ ID NO: 80823 - protein, 9 aa, Homo Sapiens
QSSGHSRQG

SEQ ID NO: 80824 - protein, 9 aa, Homo Sapiens
FQSANETGQ

SEQ ID NO: 80825 - protein, 9 aa, Homo Sapiens
ARTSGVVFT

SEQ ID NO: 80826 - protein, 9 aa, Homo Sapiens
KRFNDGSDQ

SEQ ID NO: 80827 - protein, 9 aa, Homo Sapiens
DGYSFDVVR

SEQ ID NO: 80828 - protein, 9 aa, Homo Sapiens
DSCKGDTQG

SEQ ID NO: 80829 - protein, 9 aa, Homo Sapiens
GDLDGDCPA

SEQ ID NO: 80830 - protein, 9 aa, Homo Sapiens
VHGFYEVVD

SEQ ID NO: 80831 - protein, 9 aa, Homo Sapiens
THSSNKSEY

SEQ ID NO: 80832 - protein, 9 aa, Homo Sapiens
DGSDQKKKL

SEQ ID NO: 80833 - protein, 9 aa, Homo Sapiens
ILGSDQLCL

SEQ ID NO: 80834 - protein, 9 aa, Homo Sapiens
LPLSVGIAF

SEQ ID NO: 80835 - protein, 9 aa, Homo Sapiens
ITVQRQLPL

SEQ ID NO: 80836 - protein, 9 aa, Homo Sapiens
EIDFLCSNP

SEQ ID NO: 80837 - protein, 9 aa, Homo Sapiens
STILSHQCH

SEQ ID NO: 80838 - protein, 9 aa, Homo Sapiens
ASKAPDRPS

SEQ ID NO: 80839 - protein, 9 aa, Homo Sapiens
LRKKIRDLE

SEQ ID NO: 80840 - protein, 9 aa, Homo Sapiens
KEGVPKAKA

SEQ ID NO: 80841 - protein, 9 aa, Homo Sapiens
ANETGQDLV

SEQ ID NO: 80842 - protein, 9 aa, Homo Sapiens
VQRQLPLAI

SEQ ID NO: 80843 - protein, 9 aa, Homo Sapiens
DARTSGVVF

SEQ ID NO: 80844 - protein, 9 aa, Homo Sapiens
WAARRGLWW

SEQ ID NO: 80845 - protein, 9 aa, Homo Sapiens
EQSDTLEQR

SEQ ID NO: 80846 - protein, 9 aa, Homo Sapiens
ESQSKDELT

SEQ ID NO: 80847 - protein, 9 aa, Homo Sapiens
AYSLEDADD

SEQ ID NO: 80848 - protein, 9 aa, Homo Sapiens
IDFLCSNPK

SEQ ID NO: 80849 - protein, 9 aa, Homo Sapiens
DLLADTEYQ

SEQ ID NO: 80850 - protein, 9 aa, Homo Sapiens
VNAYRCTKR

SEQ ID NO: 80851 - protein, 9 aa, Homo Sapiens
NSQNWSSQK

SEQ ID NO: 80852 - protein, 9 aa, Homo Sapiens
RQLTNAYPD

SEQ ID NO: 80853 - protein, 9 aa, Homo Sapiens
GERIASHDN

SEQ ID NO: 80854 - protein, 9 aa, Homo Sapiens
WKDARTSGV

SEQ ID NO: 80855 - protein, 9 aa, Homo Sapiens
GNQGPSGLA

SEQ ID NO: 80856 - protein, 9 aa, Homo Sapiens
CFTSTTRVP

SEQ ID NO: 80857 - protein, 9 aa, Homo Sapiens
AEGIIEFHP

SEQ ID NO: 80858 - protein, 9 aa, Homo Sapiens
YAVSANSKG

SEQ ID NO: 80859 - protein, 9 aa, Homo Sapiens
CDKDGKALC

SEQ ID NO: 80860 - protein, 9 aa, Homo Sapiens
NPFAKPSEL

SEQ ID NO: 80861 - protein, 9 aa, Homo Sapiens
SSGHSRQGS

SEQ ID NO: 80862 - protein, 9 aa, Homo Sapiens
LADTEYQIS

SEQ ID NO: 80863 - protein, 9 aa, Homo Sapiens
QLTNAYPDL

SEQ ID NO: 80864 - protein, 9 aa, Homo Sapiens
STATMLPPI

SEQ ID NO: 80865 - protein, 9 aa, Homo Sapiens
PIPKPKEPS

SEQ ID NO: 80866 - protein, 9 aa, Homo Sapiens
FFVYTAEQP

SEQ ID NO: 80867 - protein, 9 aa, Homo Sapiens
AKRLSKEEA

SEQ ID NO: 80868 - protein, 9 aa, Homo Sapiens
NKSEYIFSS

SEQ ID NO: 80869 - protein, 9 aa, Homo Sapiens
DSTSGKLKS

SEQ ID NO: 80870 - protein, 9 aa, Homo Sapiens
RGAHSQGKS

SEQ ID NO: 80871 - protein, 9 aa, Homo Sapiens
KCLIDEELL

SEQ ID NO: 80872 - protein, 9 aa, Homo Sapiens
AELMFVGVT

SEQ ID NO: 80873 - protein, 9 aa, Homo Sapiens
TPQKEDRSA

SEQ ID NO: 80874 - protein, 9 aa, Homo Sapiens
LSLLLPAHR

SEQ ID NO: 80875 - protein, 9 aa, Homo Sapiens
HYVDKKGKT

SEQ ID NO: 80876 - protein, 9 aa, Homo Sapiens
PCIVCAEAD

SEQ ID NO: 80877 - protein, 9 aa, Homo Sapiens
TVHYVDKKG

SEQ ID NO: 80878 - protein, 9 aa, Homo Sapiens
VNILQENDE

SEQ ID NO: 80879 - protein, 9 aa, Homo Sapiens
LNSEQSDTL

SEQ ID NO: 80880 - protein, 9 aa, Homo Sapiens
EGYGLPEDI

SEQ ID NO: 80881 - protein, 9 aa, Homo Sapiens
TLVEREDVT

SEQ ID NO: 80882 - protein, 9 aa, Homo Sapiens
IRGNQGPSG

SEQ ID NO: 80883 - protein, 9 aa, Homo Sapiens
KDSCKGDTQ

SEQ ID NO: 80884 - protein, 9 aa, Homo Sapiens
VDKKGKTTQ

SEQ ID NO: 80885 - protein, 9 aa, Homo Sapiens
EKTDIGLPP

SEQ ID NO: 80886 - protein, 9 aa, Homo Sapiens
ARQLTNAYP

SEQ ID NO: 80887 - protein, 9 aa, Homo Sapiens
EPLRKKIRD

SEQ ID NO: 80888 - protein, 9 aa, Homo Sapiens
IVCAEADLD

SEQ ID NO: 80889 - protein, 9 aa, Homo Sapiens
LVNAYRCTK

SEQ ID NO: 80890 - protein, 9 aa, Homo Sapiens
ELAEKKLHD

SEQ ID NO: 80891 - protein, 9 aa, Homo Sapiens
QAAIKKVDQ

SEQ ID NO: 80892 - protein, 9 aa, Homo Sapiens
LPPTVSLCA

SEQ ID NO: 80893 - protein, 9 aa, Homo Sapiens
GRGSVGPSG

SEQ ID NO: 80894 - protein, 9 aa, Homo Sapiens
NSKGLDTVV

SEQ ID NO: 80895 - protein, 9 aa, Homo Sapiens
GSDQLCLLL

SEQ ID NO: 80896 - protein, 9 aa, Homo Sapiens
KLEDFFVYT

SEQ ID NO: 80897 - protein, 9 aa, Homo Sapiens
IEFHPKYTA

SEQ ID NO: 80898 - protein, 9 aa, Homo Sapiens
RVRPRFLRA

SEQ ID NO: 80899 - protein, 9 aa, Homo Sapiens
SAYSLEDAD

SEQ ID NO: 80900 - protein, 9 aa, Homo Sapiens
NDGSDQKKK

SEQ ID NO: 80901 - protein, 9 aa, Homo Sapiens
EGVPKAKAT

SEQ ID NO: 80902 - protein, 9 aa, Homo Sapiens
RECSEDWYG

SEQ ID NO: 80903 - protein, 9 aa, Homo Sapiens
VKGVEPGMP

SEQ ID NO: 80904 - protein, 9 aa, Homo Sapiens
VPKPEPIPK

SEQ ID NO: 80905 - protein, 9 aa, Homo Sapiens
SSNKSEYIF

SEQ ID NO: 80906 - protein, 9 aa, Homo Sapiens
LDTAQRLHL

SEQ ID NO: 80907 - protein, 9 aa, Homo Sapiens
CATSTSSEP

SEQ ID NO: 80908 - protein, 9 aa, Homo Sapiens
TLVNAYRCT

SEQ ID NO: 80909 - protein, 9 aa, Homo Sapiens
LIEEESEGI

SEQ ID NO: 80910 - protein, 9 aa, Homo Sapiens
IASHDNRFL

SEQ ID NO: 80911 - protein, 9 aa, Homo Sapiens
LHWAIQQGH

SEQ ID NO: 80912 - protein, 9 aa, Homo Sapiens
EPARPDIIY

SEQ ID NO: 80913 - protein, 9 aa, Homo Sapiens
GFRLYKPRM

SEQ ID NO: 80914 - protein, 9 aa, Homo Sapiens
LHLLAADAP

SEQ ID NO: 80915 - protein, 9 aa, Homo Sapiens
STHSSNKSE

SEQ ID NO: 80916 - protein, 9 aa, Homo Sapiens
AYRCTKRYG

SEQ ID NO: 80917 - protein, 9 aa, Homo Sapiens
QVLEVECFT

SEQ ID NO: 80918 - protein, 9 aa, Homo Sapiens
CSNPKIWNV

SEQ ID NO: 80919 - protein, 9 aa, Homo Sapiens
CAEADLDLA

SEQ ID NO: 80920 - protein, 9 aa, Homo Sapiens
EFHPKYTAF

SEQ ID NO: 80921 - protein, 9 aa, Homo Sapiens
FNKAWLQGI

SEQ ID NO: 80922 - protein, 9 aa, Homo Sapiens
EELPRVRPR

SEQ ID NO: 80923 - protein, 9 aa, Homo Sapiens
KGQGGPFVD

SEQ ID NO: 80924 - protein, 9 aa, Homo Sapiens
CSFPHNFVL

SEQ ID NO: 80925 - protein, 9 aa, Homo Sapiens
PEDIVIEKR

SEQ ID NO: 80926 - protein, 9 aa, Homo Sapiens
IDTLVERED

SEQ ID NO: 80927 - protein, 9 aa, Homo Sapiens
AMFESQSKD

SEQ ID NO: 80928 - protein, 9 aa, Homo Sapiens
HGFYEVVDS

SEQ ID NO: 80929 - protein, 9 aa, Homo Sapiens
KAMFESQSK

SEQ ID NO: 80930 - protein, 9 aa, Homo Sapiens
SDQKKKLYC

SEQ ID NO: 80931 - protein, 9 aa, Homo Sapiens
YGLPEDIVI

SEQ ID NO: 80932 - protein, 9 aa, Homo Sapiens
HIDTLVERE

SEQ ID NO: 80933 - protein, 9 aa, Homo Sapiens
FDVVRNIPN

SEQ ID NO: 80934 - protein, 9 aa, Homo Sapiens
PAHGRSAYS

SEQ ID NO: 80935 - protein, 9 aa, Homo Sapiens
SGRPSKRNL

SEQ ID NO: 80936 - protein, 9 aa, Homo Sapiens
IIEFHPKYT

SEQ ID NO: 80937 - protein, 9 aa, Homo Sapiens
SSKERNTPQ

SEQ ID NO: 80938 - protein, 9 aa, Homo Sapiens
EPKKAKRLS

SEQ ID NO: 80939 - protein, 9 aa, Homo Sapiens
EFRTCTADS

SEQ ID NO: 80940 - protein, 9 aa, Homo Sapiens
TMAVELPDC

SEQ ID NO: 80941 - protein, 9 aa, Homo Sapiens
PSKRNLYAD

SEQ ID NO: 80942 - protein, 9 aa, Homo Sapiens
QNPYKCNEC

SEQ ID NO: 80943 - protein, 9 aa, Homo Sapiens
GPSCSFPHN

SEQ ID NO: 80944 - protein, 9 aa, Homo Sapiens
TAQRLHLLA

SEQ ID NO: 80945 - protein, 9 aa, Homo Sapiens
VATYKDWIS

SEQ ID NO: 80946 - protein, 9 aa, Homo Sapiens
SWFNKAWLQ

SEQ ID NO: 80947 - protein, 9 aa, Homo Sapiens
QKVDGLSTE

SEQ ID NO: 80948 - protein, 9 aa, Homo Sapiens
TKKMTHEAS

SEQ ID NO: 80949 - protein, 9 aa, Homo Sapiens
STPLHWAIQ

SEQ ID NO: 80950 - protein, 9 aa, Homo Sapiens
TSGKLKSRV

SEQ ID NO: 80951 - protein, 9 aa, Homo Sapiens
SKAPDRPSK

SEQ ID NO: 80952 - protein, 9 aa, Homo Sapiens
KRLSKEEAE

SEQ ID NO: 80953 - protein, 9 aa, Homo Sapiens
SVGPSGGGS

SEQ ID NO: 80954 - protein, 9 aa, Homo Sapiens
EPMGTAREC

SEQ ID NO: 80955 - protein, 9 aa, Homo Sapiens
LILENSQNW

SEQ ID NO: 80956 - protein, 9 aa, Homo Sapiens
AEADLDLAV

SEQ ID NO: 80957 - protein, 9 aa, Homo Sapiens
FPVVIRTLG

SEQ ID NO: 80958 - protein, 9 aa, Homo Sapiens
GSSKDLMKE

SEQ ID NO: 80959 - protein, 9 aa, Homo Sapiens
VKTNEQQKI

SEQ ID NO: 80960 - protein, 9 aa, Homo Sapiens
PKREHLPLS

SEQ ID NO: 80961 - protein, 9 aa, Homo Sapiens
IYQDLDWNP

SEQ ID NO: 80962 - protein, 9 aa, Homo Sapiens
AQLELAEKK

SEQ ID NO: 80963 - protein, 9 aa, Homo Sapiens
VECFTSTTR

SEQ ID NO: 80964 - protein, 9 aa, Homo Sapiens
SGEEQLSYG

SEQ ID NO: 80965 - protein, 9 aa, Homo Sapiens
IIYQEPQGT

SEQ ID NO: 80966 - protein, 9 aa, Homo Sapiens
VTVTVNILQ

SEQ ID NO: 80967 - protein, 9 aa, Homo Sapiens
NLRVENLDD

SEQ ID NO: 80968 - protein, 9 aa, Homo Sapiens
AEPARPDII

SEQ ID NO: 80969 - protein, 9 aa, Homo Sapiens
ALVHGFYEV

SEQ ID NO: 80970 - protein, 9 aa, Homo Sapiens
AAQPMTKKQ

SEQ ID NO: 80971 - protein, 9 aa, Homo Sapiens
NSEQSDTLE

SEQ ID NO: 80972 - protein, 9 aa, Homo Sapiens
AARRGLWWR

SEQ ID NO: 80973 - protein, 9 aa, Homo Sapiens
FEDSTSGKL

SEQ ID NO: 80974 - protein, 9 aa, Homo Sapiens
HGRSAYSLE

SEQ ID NO: 80975 - protein, 9 aa, Homo Sapiens
GSRQSSGHS

SEQ ID NO: 80976 - protein, 9 aa, Homo Sapiens
LTFHRLSSP

SEQ ID NO: 80977 - protein, 9 aa, Homo Sapiens
FRPPELEPE

SEQ ID NO: 80978 - protein, 9 aa, Homo Sapiens
ECFTSTTRV

SEQ ID NO: 80979 - protein, 9 aa, Homo Sapiens
SVLDIYQDL

SEQ ID NO: 80980 - protein, 9 aa, Homo Sapiens
MAVELPDCF

SEQ ID NO: 80981 - protein, 9 aa, Homo Sapiens
SRLTFHRLS

SEQ ID NO: 80982 - protein, 9 aa, Homo Sapiens
TFHRLSSPC

SEQ ID NO: 80983 - protein, 9 aa, Homo Sapiens
RPDIIYQEP

SEQ ID NO: 80984 - protein, 9 aa, Homo Sapiens
PFFFWWWLQ

SEQ ID NO: 80985 - protein, 9 aa, Homo Sapiens
QRLHLLAAD

SEQ ID NO: 80986 - protein, 9 aa, Homo Sapiens
ATVQKDEFR

SEQ ID NO: 80987 - protein, 9 aa, Homo Sapiens
PDLIEEESE

SEQ ID NO: 80988 - protein, 9 aa, Homo Sapiens
LPEDIVIEK

SEQ ID NO: 80989 - protein, 9 aa, Homo Sapiens
SEVKTNEQQ

SEQ ID NO: 80990 - protein, 9 aa, Homo Sapiens
QPMTKKQKV

SEQ ID NO: 80991 - protein, 9 aa, Homo Sapiens
FFPFFFWWW

SEQ ID NO: 80992 - protein, 9 aa, Homo Sapiens
PSWFNKAWL

SEQ ID NO: 80993 - protein, 9 aa, Homo Sapiens
EKKLHDFQD

SEQ ID NO: 80994 - protein, 9 aa, Homo Sapiens
ADLLYWKDA

SEQ ID NO: 80995 - protein, 9 aa, Homo Sapiens
QCHRMEAQR

SEQ ID NO: 80996 - protein, 9 aa, Homo Sapiens
FNDGSDQKK

SEQ ID NO: 80997 - protein, 9 aa, Homo Sapiens
IDPSWFNKA

SEQ ID NO: 80998 - protein, 9 aa, Homo Sapiens
GASSGRPSK

SEQ ID NO: 80999 - protein, 9 aa, Homo Sapiens
RLHLLAADA

SEQ ID NO: 81000 - protein, 9 aa, Homo Sapiens
ECSEDWYGS

SEQ ID NO: 81001 - protein, 9 aa, Homo Sapiens
EEESEGIHE

SEQ ID NO: 81002 - protein, 9 aa, Homo Sapiens
NVFVCYQKC

SEQ ID NO: 81003 - protein, 9 aa, Homo Sapiens
GQGGPFVDG

SEQ ID NO: 81004 - protein, 9 aa, Homo Sapiens
MGTARECSE

SEQ ID NO: 81005 - protein, 9 aa, Homo Sapiens
LSVRDLLAD

SEQ ID NO: 81006 - protein, 9 aa, Homo Sapiens
PGIRGNQGP

SEQ ID NO: 81007 - protein, 9 aa, Homo Sapiens
KDWISKQWG

SEQ ID NO: 81008 - protein, 9 aa, Homo Sapiens
DFFVYTAEQ

SEQ ID NO: 81009 - protein, 9 aa, Homo Sapiens
NVHFLSLLL

SEQ ID NO: 81010 - protein, 9 aa, Homo Sapiens
GPAHGRSAY

SEQ ID NO: 81011 - protein, 9 aa, Homo Sapiens
LCLLLFDLR

SEQ ID NO: 81012 - protein, 9 aa, Homo Sapiens
KEPKKAKRL

SEQ ID NO: 81013 - protein, 9 aa, Homo Sapiens
RFNDGSDQK

SEQ ID NO: 81014 - protein, 9 aa, Homo Sapiens
EEIDFLCSN

SEQ ID NO: 81015 - protein, 9 aa, Homo Sapiens
PKKAKRLSK

SEQ ID NO: 81016 - protein, 9 aa, Homo Sapiens
PEPIPKPKE

SEQ ID NO: 81017 - protein, 9 aa, Homo Sapiens
GAPGCSGFR

SEQ ID NO: 81018 - protein, 9 aa, Homo Sapiens
ATMLPPINP

SEQ ID NO: 81019 - protein, 9 aa, Homo Sapiens
FPHNFVLLV

SEQ ID NO: 81020 - protein, 9 aa, Homo Sapiens
HSRQGSGSG

SEQ ID NO: 81021 - protein, 9 aa, Homo Sapiens
IDKAIDTGQ

SEQ ID NO: 81022 - protein, 9 aa, Homo Sapiens
LKAQLELAE

SEQ ID NO: 81023 - protein, 9 aa, Homo Sapiens
ILSHQCHRM

SEQ ID NO: 81024 - protein, 9 aa, Homo Sapiens
FHPKYTAFE

SEQ ID NO: 81025 - protein, 9 aa, Homo Sapiens
LEGYGLPED

SEQ ID NO: 81026 - protein, 9 aa, Homo Sapiens
APGCSGFRP

SEQ ID NO: 81027 - protein, 9 aa, Homo Sapiens
SATVQKDEF

SEQ ID NO: 81028 - protein, 9 aa, Homo Sapiens
QKDEFRTCT

SEQ ID NO: 81029 - protein, 9 aa, Homo Sapiens
ENSQNWSSQ

SEQ ID NO: 81030 - protein, 9 aa, Homo Sapiens
QQGHLPMVI

SEQ ID NO: 81031 - protein, 9 aa, Homo Sapiens
PPLVLNSEQ

SEQ ID NO: 81032 - protein, 9 aa, Homo Sapiens
HSQGKSSPC

SEQ ID NO: 81033 - protein, 9 aa, Homo Sapiens
VFVCYQKCN

SEQ ID NO: 81034 - protein, 9 aa, Homo Sapiens
ASSGRPSKR

SEQ ID NO: 81035 - protein, 9 aa, Homo Sapiens
SRQGSGSGH

SEQ ID NO: 81036 - protein, 9 aa, Homo Sapiens
VLNSEQSDT

SEQ ID NO: 81037 - protein, 9 aa, Homo Sapiens
EVDQLKGQG

SEQ ID NO: 81038 - protein, 9 aa, Homo Sapiens
LLYWKDART

SEQ ID NO: 81039 - protein, 9 aa, Homo Sapiens
PGCSGFRPP

SEQ ID NO: 81040 - protein, 9 aa, Homo Sapiens
QLCLLLFDL

SEQ ID NO: 81041 - protein, 9 aa, Homo Sapiens
KATRKIWMV

SEQ ID NO: 81042 - protein, 9 aa, Homo Sapiens
KSEYIFSSE

SEQ ID NO: 81043 - protein, 9 aa, Homo Sapiens
SNMEQGVKG

SEQ ID NO: 81044 - protein, 9 aa, Homo Sapiens
ISEVKTNEQ

SEQ ID NO: 81045 - protein, 9 aa, Homo Sapiens
KKGKTTQVV

SEQ ID NO: 81046 - protein, 9 aa, Homo Sapiens
FLSLLLPAH

SEQ ID NO: 81047 - protein, 9 aa, Homo Sapiens
AKPSELDNP

SEQ ID NO: 81048 - protein, 9 aa, Homo Sapiens
DFLCSNPKI

SEQ ID NO: 81049 - protein, 9 aa, Homo Sapiens
NETGQDLVN

SEQ ID NO: 81050 - protein, 9 aa, Homo Sapiens
SRQSSGHSR

SEQ ID NO: 81051 - protein, 9 aa, Homo Sapiens
VVFFPFFFW

SEQ ID NO: 81052 - protein, 9 aa, Homo Sapiens
DAELMFVGV

SEQ ID NO: 81053 - protein, 9 aa, Homo Sapiens
PKAKATRKI

SEQ ID NO: 81054 - protein, 9 aa, Homo Sapiens
QEFPVVIRT

SEQ ID NO: 81055 - protein, 9 aa, Homo Sapiens
AFNVFVCYQ

SEQ ID NO: 81056 - protein, 9 aa, Homo Sapiens
KDELTPFDM

SEQ ID NO: 81057 - protein, 9 aa, Homo Sapiens
PGVPGIRGN

SEQ ID NO: 81058 - protein, 9 aa, Homo Sapiens
VCAEADLDL

SEQ ID NO: 81059 - protein, 9 aa, Homo Sapiens
HSTATMLPP

SEQ ID NO: 81060 - protein, 9 aa, Homo Sapiens
GVPGIRGNQ

SEQ ID NO: 81061 - protein, 9 aa, Homo Sapiens
KGVEPGMPE

SEQ ID NO: 81062 - protein, 9 aa, Homo Sapiens
CKGDTQGAP

SEQ ID NO: 81063 - protein, 9 aa, Homo Sapiens
AGEVVHAIR

SEQ ID NO: 81064 - protein, 9 aa, Homo Sapiens
GVKGVEPGM

SEQ ID NO: 81065 - protein, 9 aa, Homo Sapiens
PNFGYQYKR

SEQ ID NO: 81066 - protein, 9 aa, Homo Sapiens
RLHLFCDKD

SEQ ID NO: 81067 - protein, 9 aa, Homo Sapiens
EEMVEPLRK

SEQ ID NO: 81068 - protein, 9 aa, Homo Sapiens
SNKSEYIFS

SEQ ID NO: 81069 - protein, 9 aa, Homo Sapiens
FPFFFWWWL

SEQ ID NO: 81070 - protein, 9 aa, Homo Sapiens
TMYAVSANS

SEQ ID NO: 81071 - protein, 9 aa, Homo Sapiens
VIRTLGRLQ

SEQ ID NO: 81072 - protein, 9 aa, Homo Sapiens
KDARTSGVV

SEQ ID NO: 81073 - protein, 9 aa, Homo Sapiens
TEALVHGFY

SEQ ID NO: 81074 - protein, 9 aa, Homo Sapiens
KREHLPLSV

SEQ ID NO: 81075 - protein, 9 aa, Homo Sapiens
VTDEVATYK

SEQ ID NO: 81076 - protein, 9 aa, Homo Sapiens
EELLSMANF

SEQ ID NO: 81077 - protein, 9 aa, Homo Sapiens
SSSHIDTLV

SEQ ID NO: 81078 - protein, 9 aa, Homo Sapiens
ERNTPQKED

SEQ ID NO: 81079 - protein, 9 aa, Homo Sapiens
PKEKTDIGL

SEQ ID NO: 81080 - protein, 9 aa, Homo Sapiens
IDTGQNPYK

SEQ ID NO: 81081 - protein, 9 aa, Homo Sapiens
FCDKDGKAL

SEQ ID NO: 81082 - protein, 9 aa, Homo Sapiens
DEVATYKDW

SEQ ID NO: 81083 - protein, 9 aa, Homo Sapiens
HAIRGQSGE

SEQ ID NO: 81084 - protein, 9 aa, Homo Sapiens
KNPCIVCAE

SEQ ID NO: 81085 - protein, 9 aa, Homo Sapiens
LENQSSPMG

SEQ ID NO: 81086 - protein, 9 aa, Homo Sapiens
GLFTAARQL

SEQ ID NO: 81087 - protein, 9 aa, Homo Sapiens
IRGQSGELA

SEQ ID NO: 81088 - protein, 9 aa, Homo Sapiens
PRMASTHVY

SEQ ID NO: 81089 - protein, 9 aa, Homo Sapiens
TAARQLTNA

SEQ ID NO: 81090 - protein, 9 aa, Homo Sapiens
SKRNLYADI

SEQ ID NO: 81091 - protein, 9 aa, Homo Sapiens
NKLQEFPVV

SEQ ID NO: 81092 - protein, 9 aa, Homo Sapiens
RLTFHRLSS

SEQ ID NO: 81093 - protein, 9 aa, Homo Sapiens
RFQSANETG

SEQ ID NO: 81094 - protein, 9 aa, Homo Sapiens
CLIDEELLS

SEQ ID NO: 81095 - protein, 9 aa, Homo Sapiens
NILQENDEK

SEQ ID NO: 81096 - protein, 9 aa, Homo Sapiens
FFWWWLQVT

SEQ ID NO: 81097 - protein, 9 aa, Homo Sapiens
SSGRPSKRN

SEQ ID NO: 81098 - protein, 9 aa, Homo Sapiens
CLLLFDLRS

SEQ ID NO: 81099 - protein, 9 aa, Homo Sapiens
KPKEPSPEK

SEQ ID NO: 81100 - protein, 9 aa, Homo Sapiens
DQLKGQGGP

SEQ ID NO: 81101 - protein, 9 aa, Homo Sapiens
RDLLADTEY

SEQ ID NO: 81102 - protein, 9 aa, Homo Sapiens
ARRGLWWRD

SEQ ID NO: 81103 - protein, 9 aa, Homo Sapiens
GKSSPCTYI

SEQ ID NO: 81104 - protein, 9 aa, Homo Sapiens
CNVHFLSLL

SEQ ID NO: 81105 - protein, 9 aa, Homo Sapiens
TDSTHSSNK

SEQ ID NO: 81106 - protein, 9 aa, Homo Sapiens
GTARECSED

SEQ ID NO: 81107 - protein, 9 aa, Homo Sapiens
DVFEDSTSG

SEQ ID NO: 81108 - protein, 9 aa, Homo Sapiens
PTPMGRGSV

SEQ ID NO: 81109 - protein, 9 aa, Homo Sapiens
SREESPQCL

SEQ ID NO: 81110 - protein, 9 aa, Homo Sapiens
NLDDRNTFR

SEQ ID NO: 81111 - protein, 9 aa, Homo Sapiens
DKDGKALCW

SEQ ID NO: 81112 - protein, 9 aa, Homo Sapiens
GIIEFHPKY

SEQ ID NO: 81113 - protein, 9 aa, Homo Sapiens
QENDEKPIC

SEQ ID NO: 81114 - protein, 9 aa, Homo Sapiens
LGSDQLCLL

SEQ ID NO: 81115 - protein, 9 aa, Homo Sapiens
LLPPTVSLC

SEQ ID NO: 81116 - protein, 9 aa, Homo Sapiens
GEVVHAIRG

SEQ ID NO: 81117 - protein, 9 aa, Homo Sapiens
QIDPSWFNK

SEQ ID NO: 81118 - protein, 9 aa, Homo Sapiens
LKKCLIDEE

SEQ ID NO: 81119 - protein, 9 aa, Homo Sapiens
DTLVEREDV

SEQ ID NO: 81120 - protein, 9 aa, Homo Sapiens
DLIEEESEG

SEQ ID NO: 81121 - protein, 9 aa, Homo Sapiens
KQKVDGLST

SEQ ID NO: 81122 - protein, 9 aa, Homo Sapiens
SDQLCLLLF

SEQ ID NO: 81123 - protein, 9 aa, Homo Sapiens
DGGNPFAKP

SEQ ID NO: 81124 - protein, 9 aa, Homo Sapiens
HPKYTAFEV

SEQ ID NO: 81125 - protein, 9 aa, Homo Sapiens
KTDIGLPPP

SEQ ID NO: 81126 - protein, 9 aa, Homo Sapiens
AIQQGHLPM

SEQ ID NO: 81127 - protein, 9 aa, Homo Sapiens
RQLPLAIKP

SEQ ID NO: 81128 - protein, 9 aa, Homo Sapiens
ADSQLTKKM

SEQ ID NO: 81129 - protein, 9 aa, Homo Sapiens
ARPDIIYQE

SEQ ID NO: 81130 - protein, 9 aa, Homo Sapiens
ENLDDRNTF

SEQ ID NO: 81131 - protein, 9 aa, Homo Sapiens
TATMLPPIN

SEQ ID NO: 81132 - protein, 9 aa, Homo Sapiens
FAKPSELDN

SEQ ID NO: 81133 - protein, 9 aa, Homo Sapiens
RLSKEEAEM

SEQ ID NO: 81134 - protein, 9 aa, Homo Sapiens
GRSAYSLED

SEQ ID NO: 81135 - protein, 9 aa, Homo Sapiens
KEKTDIGLP

SEQ ID NO: 81136 - protein, 9 aa, Homo Sapiens
LFRPDLIEE

SEQ ID NO: 81137 - protein, 9 aa, Homo Sapiens
RLDTAQRLH

SEQ ID NO: 81138 - protein, 9 aa, Homo Sapiens
LPDCFSPEL

SEQ ID NO: 81139 - protein, 9 aa, Homo Sapiens
ELEGYGLPE

SEQ ID NO: 81140 - protein, 9 aa, Homo Sapiens
DLLYWKDAR

SEQ ID NO: 81141 - protein, 9 aa, Homo Sapiens
NEDSLILEN

SEQ ID NO: 81142 - protein, 9 aa, Homo Sapiens
SHIDTLVER

SEQ ID NO: 81143 - protein, 9 aa, Homo Sapiens
GQNPYKCNE

SEQ ID NO: 81144 - protein, 9 aa, Homo Sapiens
KNPDRGYGA

SEQ ID NO: 81145 - protein, 9 aa, Homo Sapiens
EQQKIIKDN

SEQ ID NO: 81146 - protein, 9 aa, Homo Sapiens
QKDSCKGDT

SEQ ID NO: 81147 - protein, 9 aa, Homo Sapiens
VRDLLADTE

SEQ ID NO: 81148 - protein, 9 aa, Homo Sapiens
CSEDWYGSA

SEQ ID NO: 81149 - protein, 9 aa, Homo Sapiens
VHFLSLLLP

SEQ ID NO: 81150 - protein, 9 aa, Homo Sapiens
DISVLDIYQ

SEQ ID NO: 81151 - protein, 9 aa, Homo Sapiens
EDIVIEKRG

SEQ ID NO: 81152 - protein, 9 aa, Homo Sapiens
MFESQSKDE

SEQ ID NO: 81153 - protein, 9 aa, Homo Sapiens
RQSSGHSRQ

SEQ ID NO: 81154 - protein, 9 aa, Homo Sapiens
VQKDEFRTC

SEQ ID NO: 81155 - protein, 9 aa, Homo Sapiens
SSRLTFHRL

SEQ ID NO: 81156 - protein, 9 aa, Homo Sapiens
TARECSEDW

SEQ ID NO: 81157 - protein, 9 aa, Homo Sapiens
DSLILENSQ

SEQ ID NO: 81158 - protein, 9 aa, Homo Sapiens
LAEKKLHDF

SEQ ID NO: 81159 - protein, 9 aa, Homo Sapiens
EEEIDFLCS

SEQ ID NO: 81160 - protein, 9 aa, Homo Sapiens
LTNAYPDLR

SEQ ID NO: 81161 - protein, 9 aa, Homo Sapiens
MEQGVKGVE

SEQ ID NO: 81162 - protein, 9 aa, Homo Sapiens
CDISVLDIY

SEQ ID NO: 81163 - protein, 9 aa, Homo Sapiens
DDRFQSANE

SEQ ID NO: 81164 - protein, 9 aa, Homo Sapiens
NKAWLQGIS

SEQ ID NO: 81165 - protein, 9 aa, Homo Sapiens
HRMEAQRSE

SEQ ID NO: 81166 - protein, 9 aa, Homo Sapiens
QKEDRSASS

SEQ ID NO: 81167 - protein, 9 aa, Homo Sapiens
QGVKGVEPG

SEQ ID NO: 81168 - protein, 9 aa, Homo Sapiens
VDQLKGQGG

SEQ ID NO: 81169 - protein, 9 aa, Homo Sapiens
FWWWLQVTS

SEQ ID NO: 81170 - protein, 9 aa, Homo Sapiens
LVLNSEQSD

SEQ ID NO: 81171 - protein, 9 aa, Homo Sapiens
AEELPRVRP

SEQ ID NO: 81172 - protein, 9 aa, Homo Sapiens
GDCPAPMLQ

SEQ ID NO: 81173 - protein, 9 aa, Homo Sapiens
IEEESEGIH

SEQ ID NO: 81174 - protein, 9 aa, Homo Sapiens
PMTKKQKVD

SEQ ID NO: 81175 - protein, 9 aa, Homo Sapiens
EDGYSFDVV

SEQ ID NO: 81176 - protein, 9 aa, Homo Sapiens
AAAGSSKDL

SEQ ID NO: 81177 - protein, 9 aa, Homo Sapiens
CTLVNAYRC

SEQ ID NO: 81178 - protein, 9 aa, Homo Sapiens
NPNFGYQYK

SEQ ID NO: 81179 - protein, 9 aa, Homo Sapiens
VLEVECFTS

SEQ ID NO: 81180 - protein, 9 aa, Homo Sapiens
RSAYSLEDA

SEQ ID NO: 81181 - protein, 9 aa, Homo Sapiens
GGAAAGSSK

SEQ ID NO: 81182 - protein, 9 aa, Homo Sapiens
LVEREDVTL

SEQ ID NO: 81183 - protein, 9 aa, Homo Sapiens
YSFDVVRNI

SEQ ID NO: 81184 - protein, 9 aa, Homo Sapiens
LQEFPVVIR

SEQ ID NO: 81185 - protein, 9 aa, Homo Sapiens
EMVEPLRKK

SEQ ID NO: 81186 - protein, 9 aa, Homo Sapiens
MASTHVYQI

SEQ ID NO: 81187 - protein, 9 aa, Homo Sapiens
EDSTSGKLK

SEQ ID NO: 81188 - protein, 9 aa, Homo Sapiens
TPLHWAIQQ

SEQ ID NO: 81189 - protein, 9 aa, Homo Sapiens
PASKAPDRP

SEQ ID NO: 81190 - protein, 9 aa, Homo Sapiens
TTMYAVSAN

SEQ ID NO: 81191 - protein, 9 aa, Homo Sapiens
GSDQKKKLY

SEQ ID NO: 81192 - protein, 9 aa, Homo Sapiens
GPGEEEDLA

SEQ ID NO: 81193 - protein, 9 aa, Homo Sapiens
FAQEYKKNP

SEQ ID NO: 81194 - protein, 9 aa, Homo Sapiens
DQKKKLYCI

SEQ ID NO: 81195 - protein, 9 aa, Homo Sapiens
GTVHYVDKK

SEQ ID NO: 81196 - protein, 9 aa, Homo Sapiens
LYKPRMAST

SEQ ID NO: 81197 - protein, 9 aa, Homo Sapiens
SKERNTPQK

SEQ ID NO: 81198 - protein, 9 aa, Homo Sapiens
KRNLYADID

SEQ ID NO: 81199 - protein, 9 aa, Homo Sapiens
RKKIRDLEK

SEQ ID NO: 81200 - protein, 9 aa, Homo Sapiens
MGRGSVGPS

SEQ ID NO: 81201 - protein, 9 aa, Homo Sapiens
LHLFCDKDG

SEQ ID NO: 81202 - protein, 9 aa, Homo Sapiens
FRLYKPRMA

SEQ ID NO: 81203 - protein, 9 aa, Homo Sapiens
VRPRFLRAW

SEQ ID NO: 81204 - protein, 9 aa, Homo Sapiens
TLSVRDLLA

SEQ ID NO: 81205 - protein, 9 aa, Homo Sapiens
GAHSQGKSS

SEQ ID NO: 81206 - protein, 9 aa, Homo Sapiens
LSHQCHRME

SEQ ID NO: 81207 - protein, 9 aa, Homo Sapiens
DEFRTCTAD

SEQ ID NO: 81208 - protein, 9 aa, Homo Sapiens
NGDLDGDCP

SEQ ID NO: 81209 - protein, 9 aa, Homo Sapiens
PMGTARECS

SEQ ID NO: 81210 - protein, 9 aa, Homo Sapiens
RAVTSGPGE

SEQ ID NO: 81211 - protein, 9 aa, Homo Sapiens
AVTSGPGEE

SEQ ID NO: 81212 - protein, 9 aa, Homo Sapiens
YKKNPDRGY

SEQ ID NO: 81213 - protein, 9 aa, Homo Sapiens
GKTTQVSQF

SEQ ID NO: 81214 - protein, 9 aa, Homo Sapiens
QLSYGEEKA

SEQ ID NO: 81215 - protein, 9 aa, Homo Sapiens
EPIPKPKEP

SEQ ID NO: 81216 - protein, 9 aa, Homo Sapiens
VRGAHSQGK

SEQ ID NO: 81217 - protein, 9 aa, Homo Sapiens
AIKKVDQGK

SEQ ID NO: 81218 - protein, 9 aa, Homo Sapiens
TVSLCATST

SEQ ID NO: 81219 - protein, 9 aa, Homo Sapiens
KPSELDNPF

SEQ ID NO: 81220 - protein, 9 aa, Homo Sapiens
DTAQRLHLL

SEQ ID NO: 81221 - protein, 9 aa, Homo Sapiens
FTAARQLTN

SEQ ID NO: 81222 - protein, 9 aa, Homo Sapiens
TGAPGCSGF

SEQ ID NO: 81223 - protein, 9 aa, Homo Sapiens
TVQRQLPLA

SEQ ID NO: 81224 - protein, 9 aa, Homo Sapiens
LWWRDQPSK

SEQ ID NO: 81225 - protein, 9 aa, Homo Sapiens
SLILENSQN

SEQ ID NO: 81226 - protein, 9 aa, Homo Sapiens
TVQKDEFRT

SEQ ID NO: 81227 - protein, 9 aa, Homo Sapiens
LDGDCPAPM

SEQ ID NO: 81228 - protein, 9 aa, Homo Sapiens
EESPQCLEN

SEQ ID NO: 81229 - protein, 9 aa, Homo Sapiens
LQENDEKPI

SEQ ID NO: 81230 - protein, 9 aa, Homo Sapiens
KKIRDLEKS

SEQ ID NO: 81231 - protein, 9 aa, Homo Sapiens
AHSQGKSSP

SEQ ID NO: 81232 - protein, 9 aa, Homo Sapiens
PPPLVLNSE

SEQ ID NO: 81233 - protein, 9 aa, Homo Sapiens
SGFRPPELE

SEQ ID NO: 81234 - protein, 9 aa, Homo Sapiens
TGQNPYKCN

SEQ ID NO: 81235 - protein, 9 aa, Homo Sapiens
RKSGEEQLS

SEQ ID NO: 81236 - protein, 9 aa, Homo Sapiens
TDIGLPPPK

SEQ ID NO: 81237 - protein, 9 aa, Homo Sapiens
EVECFTSTT

SEQ ID NO: 81238 - protein, 9 aa, Homo Sapiens
NTPQKEDRS

SEQ ID NO: 81239 - protein, 9 aa, Homo Sapiens
WRDQPSKGL

SEQ ID NO: 81240 - protein, 9 aa, Homo Sapiens
LVHGFYEVV

SEQ ID NO: 81241 - protein, 9 aa, Homo Sapiens
AQRLHLLAA

SEQ ID NO: 81242 - protein, 9 aa, Homo Sapiens
HLFCDKDGK

SEQ ID NO: 81243 - protein, 9 aa, Homo Sapiens
PLAIKPVTY

SEQ ID NO: 81244 - protein, 9 aa, Homo Sapiens
SQGKSSPCT

SEQ ID NO: 81245 - protein, 9 aa, Homo Sapiens
AEKKLHDFQ

SEQ ID NO: 81246 - protein, 9 aa, Homo Sapiens
DNRFLLHLA

SEQ ID NO: 81247 - protein, 9 aa, Homo Sapiens
REHLPLSVG

SEQ ID NO: 81248 - protein, 9 aa, Homo Sapiens
QLKGQGGPF

SEQ ID NO: 81249 - protein, 9 aa, Homo Sapiens
CIVCAEADL

SEQ ID NO: 81250 - protein, 9 aa, Homo Sapiens
SFPHNFVLL

SEQ ID NO: 81251 - protein, 9 aa, Homo Sapiens
TCTLVNAYR

SEQ ID NO: 81252 - protein, 9 aa, Homo Sapiens
KKCLIDEEL

SEQ ID NO: 81253 - protein, 9 aa, Homo Sapiens
PARPDIIYQ

SEQ ID NO: 81254 - protein, 9 aa, Homo Sapiens
GQINPNFGY

SEQ ID NO: 81255 - protein, 9 aa, Homo Sapiens
VFFPFFFWW

SEQ ID NO: 81256 - protein, 9 aa, Homo Sapiens
GAAAGSSKD

SEQ ID NO: 81257 - protein, 9 aa, Homo Sapiens
VSQFLYEAG

SEQ ID NO: 81258 - protein, 9 aa, Homo Sapiens
QGKSSPCTY

SEQ ID NO: 81259 - protein, 9 aa, Homo Sapiens
EQLSYGEEK

SEQ ID NO: 81260 - protein, 9 aa, Homo Sapiens
LMFVGVTSN

SEQ ID NO: 81261 - protein, 9 aa, Homo Sapiens
KLQEFPVVI

SEQ ID NO: 81262 - protein, 9 aa, Homo Sapiens
SHQCHRMEA

SEQ ID NO: 81263 - protein, 9 aa, Homo Sapiens
KTDPKEKTD

SEQ ID NO: 81264 - protein, 9 aa, Homo Sapiens
SLLLPAHRS

SEQ ID NO: 81265 - protein, 9 aa, Homo Sapiens
ASHDNRFLL

SEQ ID NO: 81266 - protein, 9 aa, Homo Sapiens
GSGKTTQVS

SEQ ID NO: 81267 - protein, 9 aa, Homo Sapiens
SFDVVRNIP

SEQ ID NO: 81268 - protein, 9 aa, Homo Sapiens
ILQENDEKP

SEQ ID NO: 81269 - protein, 9 aa, Homo Sapiens
TQVSQFLYE

SEQ ID NO: 81270 - protein, 9 aa, Homo Sapiens
SKDELTPFD

SEQ ID NO: 81271 - protein, 9 aa, Homo Sapiens
RDGGNPFAK

SEQ ID NO: 81272 - protein, 9 aa, Homo Sapiens
VYTAEQPQI

SEQ ID NO: 81273 - protein, 9 aa, Homo Sapiens
HRLSSPCRM

SEQ ID NO: 81274 - protein, 9 aa, Homo Sapiens
QTEALVHGF

SEQ ID NO: 81275 - protein, 9 aa, Homo Sapiens
KAQLELAEK

SEQ ID NO: 81276 - protein, 9 aa, Homo Sapiens
PQKEDRSAS

SEQ ID NO: 81277 - protein, 9 aa, Homo Sapiens
QQKIIKDNQ

SEQ ID NO: 81278 - protein, 9 aa, Homo Sapiens
GIRGNQGPS

SEQ ID NO: 81279 - protein, 9 aa, Homo Sapiens
AHGRSAYSL

SEQ ID NO: 81280 - protein, 9 aa, Homo Sapiens
SCSFPHNFV

SEQ ID NO: 81281 - protein, 9 aa, Homo Sapiens
RRGLWWRDQ

SEQ ID NO: 81282 - protein, 9 aa, Homo Sapiens
KKVDQGKVK

SEQ ID NO: 81283 - protein, 9 aa, Homo Sapiens
DGTVHYVDK

SEQ ID NO: 81284 - protein, 9 aa, Homo Sapiens
HSSNKSEYI

SEQ ID NO: 81285 - protein, 9 aa, Homo Sapiens
YVDKKGKTT

SEQ ID NO: 81286 - protein, 9 aa, Homo Sapiens
LIDEELLSM

SEQ ID NO: 81287 - protein, 9 aa, Homo Sapiens
WWRDQPSKG

SEQ ID NO: 81288 - protein, 9 aa, Homo Sapiens
IDEELLSMA

SEQ ID NO: 81289 - protein, 9 aa, Homo Sapiens
TMLPPINPI

SEQ ID NO: 81290 - protein, 9 aa, Homo Sapiens
YTAEQPQIG

SEQ ID NO: 81291 - protein, 9 aa, Homo Sapiens
ILENSQNWS

SEQ ID NO: 81292 - protein, 9 aa, Homo Sapiens
QVSQFLYEA

SEQ ID NO: 81293 - protein, 9 aa, Homo Sapiens
GVPKAKATR

SEQ ID NO: 81294 - protein, 9 aa, Homo Sapiens
VNEDAELMF

SEQ ID NO: 81295 - protein, 9 aa, Homo Sapiens
SGHSRQGSG

SEQ ID NO: 81296 - protein, 9 aa, Homo Sapiens
ERIASHDNR

SEQ ID NO: 81297 - protein, 9 aa, Homo Sapiens
TDPKEKTDI

SEQ ID NO: 81298 - protein, 9 aa, Homo Sapiens
ATYKDWISK

SEQ ID NO: 81299 - protein, 9 aa, Homo Sapiens
CSGFRPPEL

SEQ ID NO: 81300 - protein, 9 aa, Homo Sapiens
VCYQKCNIA

SEQ ID NO: 81301 - protein, 9 aa, Homo Sapiens
KPRMASTHV

SEQ ID NO: 81302 - protein, 9 aa, Homo Sapiens
SSSRLTFHR

SEQ ID NO: 81303 - protein, 9 aa, Homo Sapiens
RPSKRNLYA

SEQ ID NO: 81304 - protein, 9 aa, Homo Sapiens
LPEDGYSFD

SEQ ID NO: 81305 - protein, 9 aa, Homo Sapiens
FRLDTAQRL

SEQ ID NO: 81306 - protein, 9 aa, Homo Sapiens
SQSKDELTP

SEQ ID NO: 81307 - protein, 9 aa, Homo Sapiens
AIDTGQNPY

SEQ ID NO: 81308 - protein, 9 aa, Homo Sapiens
ARECSEDWY

SEQ ID NO: 81309 - protein, 9 aa, Homo Sapiens
TTLSVRDLL

SEQ ID NO: 81310 - protein, 9 aa, Homo Sapiens
VLDIYQDLD

SEQ ID NO: 81311 - protein, 9 aa, Homo Sapiens
PKPKEPSPE

SEQ ID NO: 81312 - protein, 9 aa, Homo Sapiens
TKKQKVDGL

SEQ ID NO: 81313 - protein, 9 aa, Homo Sapiens
QSKDELTPF

SEQ ID NO: 81314 - protein, 9 aa, Homo Sapiens
PHNFVLLVQ

SEQ ID NO: 81315 - protein, 9 aa, Homo Sapiens
LRVENLDDR

SEQ ID NO: 81316 - protein, 9 aa, Homo Sapiens
NPCIVCAEA

SEQ ID NO: 81317 - protein, 9 aa, Homo Sapiens
QCLENQSSP

SEQ ID NO: 81318 - protein, 9 aa, Homo Sapiens
GYGLPEDIV

SEQ ID NO: 81319 - protein, 9 aa, Homo Sapiens
KAIDTGQNP

SEQ ID NO: 81320 - protein, 9 aa, Homo Sapiens
EKTDPKEKT

SEQ ID NO: 81321 - protein, 9 aa, Homo Sapiens
TTQVSQFLY

SEQ ID NO: 81322 - protein, 9 aa, Homo Sapiens
CRPKKRTVL

SEQ ID NO: 81323 - protein, 9 aa, Homo Sapiens
YDDRFQSAN

SEQ ID NO: 81324 - protein, 9 aa, Homo Sapiens
YKDWISKQW

SEQ ID NO: 81325 - protein, 9 aa, Homo Sapiens
LRKSGEEQL

SEQ ID NO: 81326 - protein, 9 aa, Homo Sapiens
PEADSQLTK

SEQ ID NO: 81327 - protein, 9 aa, Homo Sapiens
VEPLRKKIR

SEQ ID NO: 81328 - protein, 9 aa, Homo Sapiens
ESPQCLENQ

SEQ ID NO: 81329 - protein, 9 aa, Homo Sapiens
SANETGQDL

SEQ ID NO: 81330 - protein, 9 aa, Homo Sapiens
EALVHGFYE

SEQ ID NO: 81331 - protein, 9 aa, Homo Sapiens
HQGPSCSFP

SEQ ID NO: 81332 - protein, 9 aa, Homo Sapiens
PKPEPIPKP

SEQ ID NO: 81333 - protein, 9 aa, Homo Sapiens
ANSKGLDTV

SEQ ID NO: 81334 - protein, 9 aa, Homo Sapiens
RGNQGPSGL

SEQ ID NO: 81335 - protein, 9 aa, Homo Sapiens
PEDGYSFDV

SEQ ID NO: 81336 - protein, 9 aa, Homo Sapiens
LPPINPILA

SEQ ID NO: 81337 - protein, 9 aa, Homo Sapiens
KTTQVSQFL

SEQ ID NO: 81338 - protein, 9 aa, Homo Sapiens
TYKDWISKQ

SEQ ID NO: 81339 - protein, 9 aa, Homo Sapiens
SSHIDTLVE

SEQ ID NO: 81340 - protein, 9 aa, Homo Sapiens
VSLCATSTS

SEQ ID NO: 81341 - protein, 9 aa, Homo Sapiens
DEELLSMAN

SEQ ID NO: 81342 - protein, 9 aa, Homo Sapiens
PDIIYQEPQ

SEQ ID NO: 81343 - protein, 9 aa, Homo Sapiens
PVVIRTLGR

SEQ ID NO: 81344 - protein, 9 aa, Homo Sapiens
DQLCLLLFD

SEQ ID NO: 81345 - protein, 9 aa, Homo Sapiens
KKQKVDGLS

SEQ ID NO: 81346 - protein, 9 aa, Homo Sapiens
IQAAIKKVD

SEQ ID NO: 81347 - protein, 9 aa, Homo Sapiens
LCSNPKIWN

SEQ ID NO: 81348 - protein, 9 aa, Homo Sapiens
HFLSLLLPA

SEQ ID NO: 81349 - protein, 9 aa, Homo Sapiens
DKAIDTGQN

SEQ ID NO: 81350 - protein, 9 aa, Homo Sapiens
TVNILQEND

SEQ ID NO: 81351 - protein, 9 aa, Homo Sapiens
EEQLSYGEE

SEQ ID NO: 81352 - protein, 9 aa, Homo Sapiens
VHYVDKKGK

SEQ ID NO: 81353 - protein, 9 aa, Homo Sapiens
RVENLDDRN

SEQ ID NO: 81354 - protein, 9 aa, Homo Sapiens
LELAEKKLH

SEQ ID NO: 81355 - protein, 9 aa, Homo Sapiens
SKDLMKELY

SEQ ID NO: 81356 - protein, 9 aa, Homo Sapiens
QLELAEKKL

SEQ ID NO: 81357 - protein, 9 aa, Homo Sapiens
HDNRFLLHL

SEQ ID NO: 81358 - protein, 9 aa, Homo Sapiens
TILSHQCHR

SEQ ID NO: 81359 - protein, 9 aa, Homo Sapiens
ELPDCFSPE

SEQ ID NO: 81360 - protein, 9 aa, Homo Sapiens
MTKKQKVDG

SEQ ID NO: 81361 - protein, 9 aa, Homo Sapiens
EPTPMGRGS

SEQ ID NO: 81362 - protein, 9 aa, Homo Sapiens
DIIYQEPQG

SEQ ID NO: 81363 - protein, 9 aa, Homo Sapiens
LSKEEAEMA

SEQ ID NO: 81364 - protein, 9 aa, Homo Sapiens
HLPLSVGIA

SEQ ID NO: 81365 - protein, 9 aa, Homo Sapiens
QGGPFVDGV

SEQ ID NO: 81366 - protein, 9 aa, Homo Sapiens
QPTDPPASK

SEQ ID NO: 81367 - protein, 9 aa, Homo Sapiens
FVYTAEQPQ

SEQ ID NO: 81368 - protein, 9 aa, Homo Sapiens
IPKPKEPSP

SEQ ID NO: 81369 - protein, 9 aa, Homo Sapiens
STSGKLKSR

SEQ ID NO: 81370 - protein, 9 aa, Homo Sapiens
IKKVDQGKV

SEQ ID NO: 81371 - protein, 9 aa, Homo Sapiens
CHRMEAQRS

SEQ ID NO: 81372 - protein, 9 aa, Homo Sapiens
GYSFDVVRN

SEQ ID NO: 81373 - protein, 9 aa, Homo Sapiens
LAIKPVTYT

SEQ ID NO: 81374 - protein, 9 aa, Homo Sapiens
YLKKCLIDE

SEQ ID NO: 81375 - protein, 9 aa, Homo Sapiens
GHSRQGSGS

SEQ ID NO: 81376 - protein, 9 aa, Homo Sapiens
PPASKAPDR

SEQ ID NO: 81377 - protein, 9 aa, Homo Sapiens
NQGPSGLAG

SEQ ID NO: 81378 - protein, 9 aa, Homo Sapiens
SAGEVVHAI

SEQ ID NO: 81379 - protein, 9 aa, Homo Sapiens
INPNFGYQY

SEQ ID NO: 81380 - protein, 9 aa, Homo Sapiens
GRPSKRNLY

SEQ ID NO: 81381 - protein, 9 aa, Homo Sapiens
GGQINPNFG

SEQ ID NO: 81382 - protein, 9 aa, Homo Sapiens
PLHWAIQQG

SEQ ID NO: 81383 - protein, 9 aa, Homo Sapiens
VEGNLRVEN

SEQ ID NO: 81384 - protein, 9 aa, Homo Sapiens
YKPRMASTH

SEQ ID NO: 81385 - protein, 9 aa, Homo Sapiens
YWKDARTSG

SEQ ID NO: 81386 - protein, 9 aa, Homo Sapiens
RGSVGPSGG

SEQ ID NO: 81387 - protein, 9 aa, Homo Sapiens
EKEGVPKAK

SEQ ID NO: 81388 - protein, 9 aa, Homo Sapiens
KAPDRPSKP

SEQ ID NO: 81389 - protein, 9 aa, Homo Sapiens
ACNVHFLSL

SEQ ID NO: 81390 - protein, 9 aa, Homo Sapiens
KKMTHEAST

SEQ ID NO: 81391 - protein, 9 aa, Homo Sapiens
LLADTEYQI

SEQ ID NO: 81392 - protein, 9 aa, Homo Sapiens
VQQTEALVH

SEQ ID NO: 81393 - protein, 9 aa, Homo Sapiens
CYQKCNIAD

SEQ ID NO: 81394 - protein, 9 aa, Homo Sapiens
EHLPLSVGI

SEQ ID NO: 81395 - protein, 9 aa, Homo Sapiens
DIYQDLDWN

SEQ ID NO: 81396 - protein, 9 aa, Homo Sapiens
MLPPINPIL

SEQ ID NO: 81397 - protein, 9 aa, Homo Sapiens
DCPAPMLQK

SEQ ID NO: 81398 - protein, 9 aa, Homo Sapiens
MVEPLRKKI

SEQ ID NO: 81399 - protein, 9 aa, Homo Sapiens
FRTCTADSK

SEQ ID NO: 81400 - protein, 9 aa, Homo Sapiens
VTVNILQEN

SEQ ID NO: 81401 - protein, 9 aa, Homo Sapiens
IYQEPQGTQ

SEQ ID NO: 81402 - protein, 9 aa, Homo Sapiens
PGEEEDLAA

SEQ ID NO: 81403 - protein, 9 aa, Homo Sapiens
TDEVATYKD

SEQ ID NO: 81404 - protein, 9 aa, Homo Sapiens
VFEDSTSGK

SEQ ID NO: 81405 - protein, 9 aa, Homo Sapiens
PLRKKIRDL

SEQ ID NO: 81406 - protein, 9 aa, Homo Sapiens
FESQSKDEL

SEQ ID NO: 81407 - protein, 9 aa, Homo Sapiens
QGPSCSFPH

SEQ ID NO: 81408 - protein, 9 aa, Homo Sapiens
VENLDDRNT

SEQ ID NO: 81409 - protein, 9 aa, Homo Sapiens
LENSQNWSS

SEQ ID NO: 81410 - protein, 9 aa, Homo Sapiens
LTKKMTHEA

SEQ ID NO: 81411 - protein, 9 aa, Homo Sapiens
QRQLPLAIK

SEQ ID NO: 81412 - protein, 9 aa, Homo Sapiens
YSLEDADDQ

SEQ ID NO: 81413 - protein, 9 aa, Homo Sapiens
KKAKRLSKE

SEQ ID NO: 81414 - protein, 9 aa, Homo Sapiens
NMEQGVKGV

SEQ ID NO: 81415 - protein, 9 aa, Homo Sapiens
RFAQEYKKN

SEQ ID NO: 81416 - protein, 9 aa, Homo Sapiens
RIASHDNRF

SEQ ID NO: 81417 - protein, 9 aa, Homo Sapiens
LPRVRPRFL

SEQ ID NO: 81418 - protein, 9 aa, Homo Sapiens
FVCYQKCNI

SEQ ID NO: 81419 - protein, 9 aa, Homo Sapiens
KAWLQGISE

SEQ ID NO: 81420 - protein, 9 aa, Homo Sapiens
QLTKKMTHE

SEQ ID NO: 81421 - protein, 9 aa, Homo Sapiens
IQQGHLPMV

SEQ ID NO: 81422 - protein, 9 aa, Homo Sapiens
EGIIEFHPK

SEQ ID NO: 81423 - protein, 9 aa, Homo Sapiens
FHRLSSPCR

SEQ ID NO: 81424 - protein, 9 aa, Homo Sapiens
LLFRPDLIE

SEQ ID NO: 81425 - protein, 9 aa, Homo Sapiens
VHAIRGQSG

SEQ ID NO: 81426 - protein, 9 aa, Homo Sapiens
DRFQSANET

SEQ ID NO: 81427 - protein, 9 aa, Homo Sapiens
AGSSKDLMK

SEQ ID NO: 81428 - protein, 9 aa, Homo Sapiens
GEEEDLAAA

SEQ ID NO: 81429 - protein, 9 aa, Homo Sapiens
RPDLIEEES

SEQ ID NO: 81430 - protein, 9 aa, Homo Sapiens
TSGPGEEED

SEQ ID NO: 81431 - protein, 9 aa, Homo Sapiens
TPMGRGSVG

SEQ ID NO: 81432 - protein, 9 aa, Homo Sapiens
TVTVNILQE

SEQ ID NO: 81433 - protein, 9 aa, Homo Sapiens
SGPGEEEDL

SEQ ID NO: 81434 - protein, 9 aa, Homo Sapiens
VEREDVTLK

SEQ ID NO: 81435 - protein, 9 aa, Homo Sapiens
EQGVKGVEP

SEQ ID NO: 81436 - protein, 9 aa, Homo Sapiens
TAEQPQIGE

SEQ ID NO: 81437 - protein, 9 aa, Homo Sapiens
GEEQLSYGE

SEQ ID NO: 81438 - protein, 9 aa, Homo Sapiens
DPSWFNKAW

SEQ ID NO: 81439 - protein, 9 aa, Homo Sapiens
KERNTPQKE

SEQ ID NO: 81440 - protein, 9 aa, Homo Sapiens
RGLWWRDQP

SEQ ID NO: 81441 - protein, 9 aa, Homo Sapiens
EADSQLTKK

SEQ ID NO: 81442 - protein, 9 aa, Homo Sapiens
DILGSDQLC

SEQ ID NO: 81443 - protein, 9 aa, Homo Sapiens
WNGDLDGDC

SEQ ID NO: 81444 - protein, 9 aa, Homo Sapiens
ISVLDIYQD

SEQ ID NO: 81445 - protein, 9 aa, Homo Sapiens
LSVGIAFFL

SEQ ID NO: 81446 - protein, 9 aa, Homo Sapiens
PPTVSLCAT

SEQ ID NO: 81447 - protein, 9 aa, Homo Sapiens
QEVDQLKGQ

SEQ ID NO: 81448 - protein, 9 aa, Homo Sapiens
PDCFSPELR

SEQ ID NO: 81449 - protein, 9 aa, Homo Sapiens
QKKKLYCIY

SEQ ID NO: 81450 - protein, 9 aa, Homo Sapiens
EEEDLAAAT

SEQ ID NO: 81451 - protein, 9 aa, Homo Sapiens
NEDAELMFV

SEQ ID NO: 81452 - protein, 9 aa, Homo Sapiens
GCSGFRPPE

SEQ ID NO: 81453 - protein, 9 aa, Homo Sapiens
LFTAARQLT

SEQ ID NO: 81454 - protein, 9 aa, Homo Sapiens
DPKEKTDIG

SEQ ID NO: 81455 - protein, 9 aa, Homo Sapiens
NPDRGYGAG

SEQ ID NO: 81456 - protein, 9 aa, Homo Sapiens
DSNMEQGVK

SEQ ID NO: 81457 - protein, 9 aa, Homo Sapiens
THSTATMLP

SEQ ID NO: 81458 - protein, 9 aa, Homo Sapiens
DGDCPAPML

SEQ ID NO: 81459 - protein, 9 aa, Homo Sapiens
CLENQSSPM

SEQ ID NO: 81460 - protein, 9 aa, Homo Sapiens
AIRGQSGEL

SEQ ID NO: 81461 - protein, 9 aa, Homo Sapiens
HWAIQQGHL

SEQ ID NO: 81462 - protein, 9 aa, Homo Sapiens
CPAPMLQKP

SEQ ID NO: 81463 - protein, 9 aa, Homo Sapiens
SLCATSTSS

SEQ ID NO: 81464 - protein, 9 aa, Homo Sapiens
EYKKNPDRG

SEQ ID NO: 81465 - protein, 9 aa, Homo Sapiens
ERLHLFCDK

SEQ ID NO: 81466 - protein, 9 aa, Homo Sapiens
LEVECFTST

SEQ ID NO: 81467 - protein, 9 aa, Homo Sapiens
MYAVSANSK

SEQ ID NO: 81468 - protein, 9 aa, Homo Sapiens
NRFLLHLAD

SEQ ID NO: 81469 - protein, 9 aa, Homo Sapiens
LDIYQDLDW

SEQ ID NO: 81470 - protein, 9 aa, Homo Sapiens
KTHSTATML

SEQ ID NO: 81471 - protein, 9 aa, Homo Sapiens
QEYKKNPDR

SEQ ID NO: 81472 - protein, 9 aa, Homo Sapiens
WWWLQVTSK

SEQ ID NO: 81473 - protein, 9 aa, Homo Sapiens
KTNEQQKII

SEQ ID NO: 81474 - protein, 9 aa, Homo Sapiens
LPLAIKPVT

SEQ ID NO: 81475 - protein, 9 aa, Homo Sapiens
GLWWRDQPS

SEQ ID NO: 81476 - protein, 9 aa, Homo Sapiens
RLYKPRMAS

SEQ ID NO: 81477 - protein, 9 aa, Homo Sapiens
KPEPIPKPK

SEQ ID NO: 81478 - protein, 9 aa, Homo Sapiens
PFAKPSELD

SEQ ID NO: 81479 - protein, 9 aa, Homo Sapiens
DSTHSSNKS

SEQ ID NO: 81480 - protein, 9 aa, Homo Sapiens
KSSPCTYIT

SEQ ID NO: 81481 - protein, 9 aa, Homo Sapiens
RMASTHVYQ

SEQ ID NO: 81482 - protein, 9 aa, Homo Sapiens
MFVGVTSNS

SEQ ID NO: 81483 - protein, 9 aa, Homo Sapiens
AKATRKIWM

SEQ ID NO: 81484 - protein, 9 aa, Homo Sapiens
NAFNVFVCY

SEQ ID NO: 81485 - protein, 9 aa, Homo Sapiens
RHLLSVCGF

SEQ ID NO: 81486 - protein, 9 aa, Homo Sapiens
WAIQQGHLP

SEQ ID NO: 81487 - protein, 9 aa, Homo Sapiens
PMGRGSVGP

SEQ ID NO: 81488 - protein, 9 aa, Homo Sapiens
EDFFVYTAE

SEQ ID NO: 81489 - protein, 9 aa, Homo Sapiens
PQCLENQSS

SEQ ID NO: 81490 - protein, 9 aa, Homo Sapiens
KVDQGKVKQ

SEQ ID NO: 81491 - protein, 9 aa, Homo Sapiens
AQEYKKNPD

SEQ ID NO: 81492 - protein, 9 aa, Homo Sapiens
GFRPPELEP

SEQ ID NO: 81493 - protein, 9 aa, Homo Sapiens
VDQGKVKQA

SEQ ID NO: 81494 - protein, 9 aa, Homo Sapiens
YQKCNIADI

SEQ ID NO: 81495 - protein, 9 aa, Homo Sapiens
GNPFAKPSE

SEQ ID NO: 81496 - protein, 9 aa, Homo Sapiens
SVRDLLADT

SEQ ID NO: 81497 - protein, 9 aa, Homo Sapiens
SQLTKKMTH

SEQ ID NO: 81498 - protein, 9 aa, Homo Sapiens
AAIKKVDQG

SEQ ID NO: 81499 - protein, 9 aa, Homo Sapiens
LKGQGGPFV

SEQ ID NO: 81500 - protein, 9 aa, Homo Sapiens
DTGQNPYKC

SEQ ID NO: 81501 - protein, 9 aa, Homo Sapiens
DCFSPELRS

SEQ ID NO: 81502 - protein, 9 aa, Homo Sapiens
LSYGEEKAV

SEQ ID NO: 81503 - protein, 9 aa, Homo Sapiens
GKLKSRVLR

SEQ ID NO: 81504 - protein, 9 aa, Homo Sapiens
SHDNRFLLH

SEQ ID NO: 81505 - protein, 9 aa, Homo Sapiens
GNLRVENLD

SEQ ID NO: 81506 - protein, 9 aa, Homo Sapiens
DLDGDCPAP

SEQ ID NO: 81507 - protein, 9 aa, Homo Sapiens
KDEFRTCTA

SEQ ID NO: 81508 - protein, 9 aa, Homo Sapiens
NFGYQYKRL

SEQ ID NO: 81509 - protein, 9 aa, Homo Sapiens
EFPVVIRTL

SEQ ID NO: 81510 - protein, 9 aa, Homo Sapiens
QINPNFGYQ

SEQ ID NO: 81511 - protein, 9 aa, Homo Sapiens
YRCTKRYGR

SEQ ID NO: 81512 - protein, 9 aa, Homo Sapiens
LEDFFVYTA

SEQ ID NO: 81513 - protein, 9 aa, Homo Sapiens
VVHAIRGQS

SEQ ID NO: 81514 - protein, 9 aa, Homo Sapiens
FGIWRYKEK

SEQ ID NO: 81515 - protein, 9 aa, Homo Sapiens
DYLYKDPNQ

SEQ ID NO: 81516 - protein, 9 aa, Homo Sapiens
MQETVAQLL

SEQ ID NO: 81517 - protein, 9 aa, Homo Sapiens
GKIQQEYII

SEQ ID NO: 81518 - protein, 9 aa, Homo Sapiens
TAEVPFRGI

SEQ ID NO: 81519 - protein, 9 aa, Homo Sapiens
DKFVLPKTH

SEQ ID NO: 81520 - protein, 9 aa, Homo Sapiens
NIYLKQINY

SEQ ID NO: 81521 - protein, 9 aa, Homo Sapiens
FDFLVVILS

SEQ ID NO: 81522 - protein, 9 aa, Homo Sapiens
KEAILEEKP

SEQ ID NO: 81523 - protein, 9 aa, Homo Sapiens
KEEKTTKNE

SEQ ID NO: 81524 - protein, 9 aa, Homo Sapiens
TCATRSSSG

SEQ ID NO: 81525 - protein, 9 aa, Homo Sapiens
LVGLIYKDM

SEQ ID NO: 81526 - protein, 9 aa, Homo Sapiens
DKNDIPRTD

SEQ ID NO: 81527 - protein, 9 aa, Homo Sapiens
KDFSCKGAE

SEQ ID NO: 81528 - protein, 9 aa, Homo Sapiens
CCQIKHKKQ

SEQ ID NO: 81529 - protein, 9 aa, Homo Sapiens
NSAYRQKKT

SEQ ID NO: 81530 - protein, 9 aa, Homo Sapiens
NAQLDNKKN

SEQ ID NO: 81531 - protein, 9 aa, Homo Sapiens
YTAYKNYYY

SEQ ID NO: 81532 - protein, 9 aa, Homo Sapiens
EEKPYLFSL

SEQ ID NO: 81533 - protein, 9 aa, Homo Sapiens
PFVHLPLST

SEQ ID NO: 81534 - protein, 9 aa, Homo Sapiens
AEAMCANLN

SEQ ID NO: 81535 - protein, 9 aa, Homo Sapiens
VSQPIDLIK

SEQ ID NO: 81536 - protein, 9 aa, Homo Sapiens
TISWFLAAG

SEQ ID NO: 81537 - protein, 9 aa, Homo Sapiens
DGTVIVEAD

SEQ ID NO: 81538 - protein, 9 aa, Homo Sapiens
AMHILTQPF

SEQ ID NO: 81539 - protein, 9 aa, Homo Sapiens
WMMGLTIST

SEQ ID NO: 81540 - protein, 9 aa, Homo Sapiens
INRLRQKIK

SEQ ID NO: 81541 - protein, 9 aa, Homo Sapiens
PLELWMMGL

SEQ ID NO: 81542 - protein, 9 aa, Homo Sapiens
EFSKHLKEE

SEQ ID NO: 81543 - protein, 9 aa, Homo Sapiens
ENSMEDIMF

SEQ ID NO: 81544 - protein, 9 aa, Homo Sapiens
KNLYNTILS

SEQ ID NO: 81545 - protein, 9 aa, Homo Sapiens
EKNELVSDE

SEQ ID NO: 81546 - protein, 9 aa, Homo Sapiens
ISECTEQTL

SEQ ID NO: 81547 - protein, 9 aa, Homo Sapiens
EQIKRCQEI

SEQ ID NO: 81548 - protein, 9 aa, Homo Sapiens
ETRIQFPKL

SEQ ID NO: 81549 - protein, 9 aa, Homo Sapiens
EEAQEEAQG

SEQ ID NO: 81550 - protein, 9 aa, Homo Sapiens
TQPLFSGKK

SEQ ID NO: 81551 - protein, 9 aa, Homo Sapiens
FWSLKPENL

SEQ ID NO: 81552 - protein, 9 aa, Homo Sapiens
NICPWLNYL

SEQ ID NO: 81553 - protein, 9 aa, Homo Sapiens
VKAMINAGQ

SEQ ID NO: 81554 - protein, 9 aa, Homo Sapiens
ILEEKPYLF

SEQ ID NO: 81555 - protein, 9 aa, Homo Sapiens
QPTNVKVVV

SEQ ID NO: 81556 - protein, 9 aa, Homo Sapiens
GKTVQALSR

SEQ ID NO: 81557 - protein, 9 aa, Homo Sapiens
NFNYKQRGA

SEQ ID NO: 81558 - protein, 9 aa, Homo Sapiens
FNEEFKIFL

SEQ ID NO: 81559 - protein, 9 aa, Homo Sapiens
ENFRTQKLS

SEQ ID NO: 81560 - protein, 9 aa, Homo Sapiens
SSDGPVREP

SEQ ID NO: 81561 - protein, 9 aa, Homo Sapiens
ETVAPSDIM

SEQ ID NO: 81562 - protein, 9 aa, Homo Sapiens
KTKKRKSLG

SEQ ID NO: 81563 - protein, 9 aa, Homo Sapiens
DNPEMRRVR

SEQ ID NO: 81564 - protein, 9 aa, Homo Sapiens
RRGSHRIFT

SEQ ID NO: 81565 - protein, 9 aa, Homo Sapiens
EQLMRDKIQ

SEQ ID NO: 81566 - protein, 9 aa, Homo Sapiens
PCQKHSLRN

SEQ ID NO: 81567 - protein, 9 aa, Homo Sapiens
NVKVVVPAA

SEQ ID NO: 81568 - protein, 9 aa, Homo Sapiens
PVDISTCLK

SEQ ID NO: 81569 - protein, 9 aa, Homo Sapiens
GDSETDRCI

SEQ ID NO: 81570 - protein, 9 aa, Homo Sapiens
IMPKQVTTS

SEQ ID NO: 81571 - protein, 9 aa, Homo Sapiens
DIKNVAELL

SEQ ID NO: 81572 - protein, 9 aa, Homo Sapiens
RKDYQPKYF

SEQ ID NO: 81573 - protein, 9 aa, Homo Sapiens
LITVMAYDH

SEQ ID NO: 81574 - protein, 9 aa, Homo Sapiens
KFVLPKTHK

SEQ ID NO: 81575 - protein, 9 aa, Homo Sapiens
PYTLPPGSA

SEQ ID NO: 81576 - protein, 9 aa, Homo Sapiens
RYKGQVGNS

SEQ ID NO: 81577 - protein, 9 aa, Homo Sapiens
KQLSAQFYG

SEQ ID NO: 81578 - protein, 9 aa, Homo Sapiens
SPNHTSLSI

SEQ ID NO: 81579 - protein, 9 aa, Homo Sapiens
TCLKEANEV

SEQ ID NO: 81580 - protein, 9 aa, Homo Sapiens
LDMKLVGIN

SEQ ID NO: 81581 - protein, 9 aa, Homo Sapiens
GTQMTGLTA

SEQ ID NO: 81582 - protein, 9 aa, Homo Sapiens
GACVNAVDL

SEQ ID NO: 81583 - protein, 9 aa, Homo Sapiens
GKAFSHAEY

SEQ ID NO: 81584 - protein, 9 aa, Homo Sapiens
TVFSHSVWS

SEQ ID NO: 81585 - protein, 9 aa, Homo Sapiens
QEVKNLYNT

SEQ ID NO: 81586 - protein, 9 aa, Homo Sapiens
WNIFDFLVV

SEQ ID NO: 81587 - protein, 9 aa, Homo Sapiens
MLGYKFKGR

SEQ ID NO: 81588 - protein, 9 aa, Homo Sapiens
QREGRLREQ

SEQ ID NO: 81589 - protein, 9 aa, Homo Sapiens
SKSLIAQWS

SEQ ID NO: 81590 - protein, 9 aa, Homo Sapiens
NQRVRVLDK

SEQ ID NO: 81591 - protein, 9 aa, Homo Sapiens
AQRKRLQQH

SEQ ID NO: 81592 - protein, 9 aa, Homo Sapiens
NDIFVSTSE

SEQ ID NO: 81593 - protein, 9 aa, Homo Sapiens
MGISAMYFY

SEQ ID NO: 81594 - protein, 9 aa, Homo Sapiens
LPLSTREKQ

SEQ ID NO: 81595 - protein, 9 aa, Homo Sapiens
LKNKAIIRH

SEQ ID NO: 81596 - protein, 9 aa, Homo Sapiens
LSLENYSIL

SEQ ID NO: 81597 - protein, 9 aa, Homo Sapiens
IKLNQKQDM

SEQ ID NO: 81598 - protein, 9 aa, Homo Sapiens
VGNSEAAMK

SEQ ID NO: 81599 - protein, 9 aa, Homo Sapiens
YGKKKKKRI

SEQ ID NO: 81600 - protein, 9 aa, Homo Sapiens
KEDNIKAVG

SEQ ID NO: 81601 - protein, 9 aa, Homo Sapiens
GLGRHVGVV

SEQ ID NO: 81602 - protein, 9 aa, Homo Sapiens
ETLGCCNLI

SEQ ID NO: 81603 - protein, 9 aa, Homo Sapiens
LLWELLTAE

SEQ ID NO: 81604 - protein, 9 aa, Homo Sapiens
RLKKPIVGI

SEQ ID NO: 81605 - protein, 9 aa, Homo Sapiens
PRAFSSCSY

SEQ ID NO: 81606 - protein, 9 aa, Homo Sapiens
ARALDNKLL

SEQ ID NO: 81607 - protein, 9 aa, Homo Sapiens
SHNSVVIIR

SEQ ID NO: 81608 - protein, 9 aa, Homo Sapiens
LQPESGRKR

SEQ ID NO: 81609 - protein, 9 aa, Homo Sapiens
TTNSKAPFG

SEQ ID NO: 81610 - protein, 9 aa, Homo Sapiens
DFEPFKEKE

SEQ ID NO: 81611 - protein, 9 aa, Homo Sapiens
YKQRGAFRG

SEQ ID NO: 81612 - protein, 9 aa, Homo Sapiens
AREVVRAEI

SEQ ID NO: 81613 - protein, 9 aa, Homo Sapiens
VYGSMVLNK

SEQ ID NO: 81614 - protein, 9 aa, Homo Sapiens
ALRLTDSSS

SEQ ID NO: 81615 - protein, 9 aa, Homo Sapiens
LGRHVGVVI

SEQ ID NO: 81616 - protein, 9 aa, Homo Sapiens
WKQSIGQYY

SEQ ID NO: 81617 - protein, 9 aa, Homo Sapiens
RYKEKCYYL

SEQ ID NO: 81618 - protein, 9 aa, Homo Sapiens
KKKFYIGGV

SEQ ID NO: 81619 - protein, 9 aa, Homo Sapiens
VVKEDNIKA

SEQ ID NO: 81620 - protein, 9 aa, Homo Sapiens
VPERYNVGT

SEQ ID NO: 81621 - protein, 9 aa, Homo Sapiens
RTVLISKKL

SEQ ID NO: 81622 - protein, 9 aa, Homo Sapiens
RNQNFIILS

SEQ ID NO: 81623 - protein, 9 aa, Homo Sapiens
SLPTRINKM

SEQ ID NO: 81624 - protein, 9 aa, Homo Sapiens
KMVKVYIKT

SEQ ID NO: 81625 - protein, 9 aa, Homo Sapiens
SRAPETIES

SEQ ID NO: 81626 - protein, 9 aa, Homo Sapiens
LDNPEMRRV

SEQ ID NO: 81627 - protein, 9 aa, Homo Sapiens
VAELKQTGR

SEQ ID NO: 81628 - protein, 9 aa, Homo Sapiens
LQQHMQQKE

SEQ ID NO: 81629 - protein, 9 aa, Homo Sapiens
EMISECTEQ

SEQ ID NO: 81630 - protein, 9 aa, Homo Sapiens
TRTWPPTIM

SEQ ID NO: 81631 - protein, 9 aa, Homo Sapiens
NFIILSLEN

SEQ ID NO: 81632 - protein, 9 aa, Homo Sapiens
EFKIFLTAQ

SEQ ID NO: 81633 - protein, 9 aa, Homo Sapiens
FMEYQGASS

SEQ ID NO: 81634 - protein, 9 aa, Homo Sapiens
SYASLITSA

SEQ ID NO: 81635 - protein, 9 aa, Homo Sapiens
DNLFTGAQN

SEQ ID NO: 81636 - protein, 9 aa, Homo Sapiens
CSTQVSMTM

SEQ ID NO: 81637 - protein, 9 aa, Homo Sapiens
TNSKAPFGL

SEQ ID NO: 81638 - protein, 9 aa, Homo Sapiens
KKLLKRTPR

SEQ ID NO: 81639 - protein, 9 aa, Homo Sapiens
PPTIMPKQV

SEQ ID NO: 81640 - protein, 9 aa, Homo Sapiens
DLFNGKKPI

SEQ ID NO: 81641 - protein, 9 aa, Homo Sapiens
LVGINFYDP

SEQ ID NO: 81642 - protein, 9 aa, Homo Sapiens
IILFCVRGH

SEQ ID NO: 81643 - protein, 9 aa, Homo Sapiens
WYFGRSFVL

SEQ ID NO: 81644 - protein, 9 aa, Homo Sapiens
PKYFLSIPI

SEQ ID NO: 81645 - protein, 9 aa, Homo Sapiens
HSSSLRDYP

SEQ ID NO: 81646 - protein, 9 aa, Homo Sapiens
CNLICSDKT

SEQ ID NO: 81647 - protein, 9 aa, Homo Sapiens
RKSLEVVTP

SEQ ID NO: 81648 - protein, 9 aa, Homo Sapiens
NPVPCQKHS

SEQ ID NO: 81649 - protein, 9 aa, Homo Sapiens
QKQDMEIAE

SEQ ID NO: 81650 - protein, 9 aa, Homo Sapiens
DVVQRFGHG

SEQ ID NO: 81651 - protein, 9 aa, Homo Sapiens
REGRLREQE

SEQ ID NO: 81652 - protein, 9 aa, Homo Sapiens
GRMGISAMY

SEQ ID NO: 81653 - protein, 9 aa, Homo Sapiens
RINKMNLCE

SEQ ID NO: 81654 - protein, 9 aa, Homo Sapiens
GEAFGNKWC

SEQ ID NO: 81655 - protein, 9 aa, Homo Sapiens
NNIDFDKND

SEQ ID NO: 81656 - protein, 9 aa, Homo Sapiens
VRRHAIHRN

SEQ ID NO: 81657 - protein, 9 aa, Homo Sapiens
LELARALDN

SEQ ID NO: 81658 - protein, 9 aa, Homo Sapiens
QKDGRWFPD

SEQ ID NO: 81659 - protein, 9 aa, Homo Sapiens
YLCQEFASA

SEQ ID NO: 81660 - protein, 9 aa, Homo Sapiens
LLIVVNIIT

SEQ ID NO: 81661 - protein, 9 aa, Homo Sapiens
RGSHRIFTS

SEQ ID NO: 81662 - protein, 9 aa, Homo Sapiens
KRQQGSKEE

SEQ ID NO: 81663 - protein, 9 aa, Homo Sapiens
PTTISVELE

SEQ ID NO: 81664 - protein, 9 aa, Homo Sapiens
HTTLMDEKI

SEQ ID NO: 81665 - protein, 9 aa, Homo Sapiens
YIILFCVRG

SEQ ID NO: 81666 - protein, 9 aa, Homo Sapiens
SLITSAINS

SEQ ID NO: 81667 - protein, 9 aa, Homo Sapiens
TELIPRPIE

SEQ ID NO: 81668 - protein, 9 aa, Homo Sapiens
ELLTAEVPF

SEQ ID NO: 81669 - protein, 9 aa, Homo Sapiens
PPVFKKKFY

SEQ ID NO: 81670 - protein, 9 aa, Homo Sapiens
NLEGLDLLF

SEQ ID NO: 81671 - protein, 9 aa, Homo Sapiens
QQNCSIPCF

SEQ ID NO: 81672 - protein, 9 aa, Homo Sapiens
KEDIDSQEI

SEQ ID NO: 81673 - protein, 9 aa, Homo Sapiens
PSCTAVLCS

SEQ ID NO: 81674 - protein, 9 aa, Homo Sapiens
SSISSIDKN

SEQ ID NO: 81675 - protein, 9 aa, Homo Sapiens
QQHMQQHVQ

SEQ ID NO: 81676 - protein, 9 aa, Homo Sapiens
KELQNKFTP

SEQ ID NO: 81677 - protein, 9 aa, Homo Sapiens
PPSVIRRLV

SEQ ID NO: 81678 - protein, 9 aa, Homo Sapiens
REKQLQQLL

SEQ ID NO: 81679 - protein, 9 aa, Homo Sapiens
MSRERAESE

SEQ ID NO: 81680 - protein, 9 aa, Homo Sapiens
FLLLFSLLF

SEQ ID NO: 81681 - protein, 9 aa, Homo Sapiens
FPKLLETLR

SEQ ID NO: 81682 - protein, 9 aa, Homo Sapiens
KRKMVKVYI

SEQ ID NO: 81683 - protein, 9 aa, Homo Sapiens
PIYIILFCV

SEQ ID NO: 81684 - protein, 9 aa, Homo Sapiens
KNPVPCQKH

SEQ ID NO: 81685 - protein, 9 aa, Homo Sapiens
IEILTEMIS

SEQ ID NO: 81686 - protein, 9 aa, Homo Sapiens
PRKNKKMIY

SEQ ID NO: 81687 - protein, 9 aa, Homo Sapiens
KNPLYPITV

SEQ ID NO: 81688 - protein, 9 aa, Homo Sapiens
QSPLQISQS

SEQ ID NO: 81689 - protein, 9 aa, Homo Sapiens
VADLENMFQ

SEQ ID NO: 81690 - protein, 9 aa, Homo Sapiens
IAVFLICFV

SEQ ID NO: 81691 - protein, 9 aa, Homo Sapiens
SFPGIPYTL

SEQ ID NO: 81692 - protein, 9 aa, Homo Sapiens
VYAEVKHVG

SEQ ID NO: 81693 - protein, 9 aa, Homo Sapiens
LSKTKKRKS

SEQ ID NO: 81694 - protein, 9 aa, Homo Sapiens
KEEEAQEEA

SEQ ID NO: 81695 - protein, 9 aa, Homo Sapiens
KQPHDTTKT

SEQ ID NO: 81696 - protein, 9 aa, Homo Sapiens
MLTGHDGGD

SEQ ID NO: 81697 - protein, 9 aa, Homo Sapiens
VLGRMGISA

SEQ ID NO: 81698 - protein, 9 aa, Homo Sapiens
LEIEPQIYG

SEQ ID NO: 81699 - protein, 9 aa, Homo Sapiens
KAFSHAEYF

SEQ ID NO: 81700 - protein, 9 aa, Homo Sapiens
RDYPPASRS

SEQ ID NO: 81701 - protein, 9 aa, Homo Sapiens
ETVFSHSVW

SEQ ID NO: 81702 - protein, 9 aa, Homo Sapiens
PCSSDGPVR

SEQ ID NO: 81703 - protein, 9 aa, Homo Sapiens
SIPLHILDS

SEQ ID NO: 81704 - protein, 9 aa, Homo Sapiens
IRITPQDSR

SEQ ID NO: 81705 - protein, 9 aa, Homo Sapiens
TISTRTWPP

SEQ ID NO: 81706 - protein, 9 aa, Homo Sapiens
IPGPIILGF

SEQ ID NO: 81707 - protein, 9 aa, Homo Sapiens
ACTTTPCML

SEQ ID NO: 81708 - protein, 9 aa, Homo Sapiens
PTIMPKQVT

SEQ ID NO: 81709 - protein, 9 aa, Homo Sapiens
ILDSRAPET

SEQ ID NO: 81710 - protein, 9 aa, Homo Sapiens
ETFGDIFLH

SEQ ID NO: 81711 - protein, 9 aa, Homo Sapiens
LAVLSERFP

SEQ ID NO: 81712 - protein, 9 aa, Homo Sapiens
TGRTDISPR

SEQ ID NO: 81713 - protein, 9 aa, Homo Sapiens
SEQMSKTNY

SEQ ID NO: 81714 - protein, 9 aa, Homo Sapiens
GLTATGPDV

SEQ ID NO: 81715 - protein, 9 aa, Homo Sapiens
DTDGDGRGN

SEQ ID NO: 81716 - protein, 9 aa, Homo Sapiens
LSRVTDLFN

SEQ ID NO: 81717 - protein, 9 aa, Homo Sapiens
SKFCQSYSE

SEQ ID NO: 81718 - protein, 9 aa, Homo Sapiens
SQSSPESDD

SEQ ID NO: 81719 - protein, 9 aa, Homo Sapiens
HLPTKIYEK

SEQ ID NO: 81720 - protein, 9 aa, Homo Sapiens
KSLGLGPGE

SEQ ID NO: 81721 - protein, 9 aa, Homo Sapiens
TVAPSDIMG

SEQ ID NO: 81722 - protein, 9 aa, Homo Sapiens
TRINKMNLC

SEQ ID NO: 81723 - protein, 9 aa, Homo Sapiens
QLMRDKIQI

SEQ ID NO: 81724 - protein, 9 aa, Homo Sapiens
MVKVYIKTD

SEQ ID NO: 81725 - protein, 9 aa, Homo Sapiens
PSDIMGAGV

SEQ ID NO: 81726 - protein, 9 aa, Homo Sapiens
LVTDRLTEN

SEQ ID NO: 81727 - protein, 9 aa, Homo Sapiens
SEILEAISH

SEQ ID NO: 81728 - protein, 9 aa, Homo Sapiens
MMEKNELVS

SEQ ID NO: 81729 - protein, 9 aa, Homo Sapiens
CDPECNHML

SEQ ID NO: 81730 - protein, 9 aa, Homo Sapiens
KFLKNKAII

SEQ ID NO: 81731 - protein, 9 aa, Homo Sapiens
IQQEYIISD

SEQ ID NO: 81732 - protein, 9 aa, Homo Sapiens
DALSYMNIQ

SEQ ID NO: 81733 - protein, 9 aa, Homo Sapiens
QDMEIAELK

SEQ ID NO: 81734 - protein, 9 aa, Homo Sapiens
VPCQKHSLR

SEQ ID NO: 81735 - protein, 9 aa, Homo Sapiens
LVYGSMVLN

SEQ ID NO: 81736 - protein, 9 aa, Homo Sapiens
TNVKVVVPA

SEQ ID NO: 81737 - protein, 9 aa, Homo Sapiens
DGENKDTIQ

SEQ ID NO: 81738 - protein, 9 aa, Homo Sapiens
VLPKTHKTS

SEQ ID NO: 81739 - protein, 9 aa, Homo Sapiens
QRQADFLRP

SEQ ID NO: 81740 - protein, 9 aa, Homo Sapiens
SLRDYPPAS

SEQ ID NO: 81741 - protein, 9 aa, Homo Sapiens
VCQIFIENK

SEQ ID NO: 81742 - protein, 9 aa, Homo Sapiens
SSPSTGTLR

SEQ ID NO: 81743 - protein, 9 aa, Homo Sapiens
WTVDYVHSF

SEQ ID NO: 81744 - protein, 9 aa, Homo Sapiens
TMHKDVSKT

SEQ ID NO: 81745 - protein, 9 aa, Homo Sapiens
DLIDPFYVD

SEQ ID NO: 81746 - protein, 9 aa, Homo Sapiens
GKAAYVLDN

SEQ ID NO: 81747 - protein, 9 aa, Homo Sapiens
PSFSKVIHL

SEQ ID NO: 81748 - protein, 9 aa, Homo Sapiens
RMGISAMYF

SEQ ID NO: 81749 - protein, 9 aa, Homo Sapiens
PLILKKLLK

SEQ ID NO: 81750 - protein, 9 aa, Homo Sapiens
KETLGRYGS

SEQ ID NO: 81751 - protein, 9 aa, Homo Sapiens
SCEGGSKNR

SEQ ID NO: 81752 - protein, 9 aa, Homo Sapiens
GRMPNLKKR

SEQ ID NO: 81753 - protein, 9 aa, Homo Sapiens
LFRTSDLSS

SEQ ID NO: 81754 - protein, 9 aa, Homo Sapiens
WRYFTELIP

SEQ ID NO: 81755 - protein, 9 aa, Homo Sapiens
YGSMVLNKR

SEQ ID NO: 81756 - protein, 9 aa, Homo Sapiens
HVGVVIGIL

SEQ ID NO: 81757 - protein, 9 aa, Homo Sapiens
RQADFLRPP

SEQ ID NO: 81758 - protein, 9 aa, Homo Sapiens
SDMYCLVGL

SEQ ID NO: 81759 - protein, 9 aa, Homo Sapiens
SCTAVLCST

SEQ ID NO: 81760 - protein, 9 aa, Homo Sapiens
RESVIEKPY

SEQ ID NO: 81761 - protein, 9 aa, Homo Sapiens
TYLDKHNIY

SEQ ID NO: 81762 - protein, 9 aa, Homo Sapiens
ISSIDKNSK

SEQ ID NO: 81763 - protein, 9 aa, Homo Sapiens
SYFCCAIEN

SEQ ID NO: 81764 - protein, 9 aa, Homo Sapiens
NIITSQSLR

SEQ ID NO: 81765 - protein, 9 aa, Homo Sapiens
RKKVTSDKD

SEQ ID NO: 81766 - protein, 9 aa, Homo Sapiens
EIDIKNVAE

SEQ ID NO: 81767 - protein, 9 aa, Homo Sapiens
PVVQPLPTP

SEQ ID NO: 81768 - protein, 9 aa, Homo Sapiens
YQGASSPGI

SEQ ID NO: 81769 - protein, 9 aa, Homo Sapiens
CSSCDCPNC

SEQ ID NO: 81770 - protein, 9 aa, Homo Sapiens
DKGTAEELQ

SEQ ID NO: 81771 - protein, 9 aa, Homo Sapiens
QRKRLQQHM

SEQ ID NO: 81772 - protein, 9 aa, Homo Sapiens
HGFIQELVR

SEQ ID NO: 81773 - protein, 9 aa, Homo Sapiens
SICKRRFRV

SEQ ID NO: 81774 - protein, 9 aa, Homo Sapiens
GENSKNQNK

SEQ ID NO: 81775 - protein, 9 aa, Homo Sapiens
CQEFASACP

SEQ ID NO: 81776 - protein, 9 aa, Homo Sapiens
EMLNLEEKF

SEQ ID NO: 81777 - protein, 9 aa, Homo Sapiens
LKQTGRTDI

SEQ ID NO: 81778 - protein, 9 aa, Homo Sapiens
IVVNIITSQ

SEQ ID NO: 81779 - protein, 9 aa, Homo Sapiens
RKNKKMIYL

SEQ ID NO: 81780 - protein, 9 aa, Homo Sapiens
EEFKIFLTA

SEQ ID NO: 81781 - protein, 9 aa, Homo Sapiens
KDPNQQKIY

SEQ ID NO: 81782 - protein, 9 aa, Homo Sapiens
EDNIKAVGK

SEQ ID NO: 81783 - protein, 9 aa, Homo Sapiens
ISTRTWPPT

SEQ ID NO: 81784 - protein, 9 aa, Homo Sapiens
TTKNELSAI

SEQ ID NO: 81785 - protein, 9 aa, Homo Sapiens
ETEQDTEKL

SEQ ID NO: 81786 - protein, 9 aa, Homo Sapiens
TAVEQKAQV

SEQ ID NO: 81787 - protein, 9 aa, Homo Sapiens
DRISCSPKK

SEQ ID NO: 81788 - protein, 9 aa, Homo Sapiens
SGENSKNQN

SEQ ID NO: 81789 - protein, 9 aa, Homo Sapiens
FREDSLVIN

SEQ ID NO: 81790 - protein, 9 aa, Homo Sapiens
MISECTEQT

SEQ ID NO: 81791 - protein, 9 aa, Homo Sapiens
NIKLQFCHQ

SEQ ID NO: 81792 - protein, 9 aa, Homo Sapiens
ILEDLIERD

SEQ ID NO: 81793 - protein, 9 aa, Homo Sapiens
NSCEGGSKN

SEQ ID NO: 81794 - protein, 9 aa, Homo Sapiens
RFQEFQKKY

SEQ ID NO: 81795 - protein, 9 aa, Homo Sapiens
ERTTDLKQQ

SEQ ID NO: 81796 - protein, 9 aa, Homo Sapiens
WKCLFTLKE

SEQ ID NO: 81797 - protein, 9 aa, Homo Sapiens
LFSGKKVIA

SEQ ID NO: 81798 - protein, 9 aa, Homo Sapiens
LRESVIEKP

SEQ ID NO: 81799 - protein, 9 aa, Homo Sapiens
YNTILSDKN

SEQ ID NO: 81800 - protein, 9 aa, Homo Sapiens
LAEIDIKNV

SEQ ID NO: 81801 - protein, 9 aa, Homo Sapiens
IVEADGESL

SEQ ID NO: 81802 - protein, 9 aa, Homo Sapiens
SSGPLSSAS

SEQ ID NO: 81803 - protein, 9 aa, Homo Sapiens
TCASSPSTG

SEQ ID NO: 81804 - protein, 9 aa, Homo Sapiens
FTQYIFTEI

SEQ ID NO: 81805 - protein, 9 aa, Homo Sapiens
FCRYMIEIF

SEQ ID NO: 81806 - protein, 9 aa, Homo Sapiens
HAIHRNSLE

SEQ ID NO: 81807 - protein, 9 aa, Homo Sapiens
DIDSQEIEA

SEQ ID NO: 81808 - protein, 9 aa, Homo Sapiens
LQTQPLFSG

SEQ ID NO: 81809 - protein, 9 aa, Homo Sapiens
TGHKMKILQ

SEQ ID NO: 81810 - protein, 9 aa, Homo Sapiens
DTNGNHQVR

SEQ ID NO: 81811 - protein, 9 aa, Homo Sapiens
YFGRSFVLS

SEQ ID NO: 81812 - protein, 9 aa, Homo Sapiens
TAGDFEPFK

SEQ ID NO: 81813 - protein, 9 aa, Homo Sapiens
QSIGQYYSN

SEQ ID NO: 81814 - protein, 9 aa, Homo Sapiens
SLEVVSKHF

SEQ ID NO: 81815 - protein, 9 aa, Homo Sapiens
RQSGSLAIH

SEQ ID NO: 81816 - protein, 9 aa, Homo Sapiens
TSSSGHKRH

SEQ ID NO: 81817 - protein, 9 aa, Homo Sapiens
NYKQRGAFR

SEQ ID NO: 81818 - protein, 9 aa, Homo Sapiens
VKVVVPAAG

SEQ ID NO: 81819 - protein, 9 aa, Homo Sapiens
EEFALRDQK

SEQ ID NO: 81820 - protein, 9 aa, Homo Sapiens
PDVQEKFLL

SEQ ID NO: 81821 - protein, 9 aa, Homo Sapiens
SSLNGENFR

SEQ ID NO: 81822 - protein, 9 aa, Homo Sapiens
ANLNAGGHV

SEQ ID NO: 81823 - protein, 9 aa, Homo Sapiens
CRTPPLQQP

SEQ ID NO: 81824 - protein, 9 aa, Homo Sapiens
FFFKCTICN

SEQ ID NO: 81825 - protein, 9 aa, Homo Sapiens
DENSMEDIM

SEQ ID NO: 81826 - protein, 9 aa, Homo Sapiens
RALRGQLEK

SEQ ID NO: 81827 - protein, 9 aa, Homo Sapiens
TDSSSSSTS

SEQ ID NO: 81828 - protein, 9 aa, Homo Sapiens
KVVVPAAGL

SEQ ID NO: 81829 - protein, 9 aa, Homo Sapiens
HNSVVIIRG

SEQ ID NO: 81830 - protein, 9 aa, Homo Sapiens
FLPVVQPLP

SEQ ID NO: 81831 - protein, 9 aa, Homo Sapiens
DSICKRRFR

SEQ ID NO: 81832 - protein, 9 aa, Homo Sapiens
DFLVVILSI

SEQ ID NO: 81833 - protein, 9 aa, Homo Sapiens
TWPPTIMPK

SEQ ID NO: 81834 - protein, 9 aa, Homo Sapiens
RSSPGRMPN

SEQ ID NO: 81835 - protein, 9 aa, Homo Sapiens
DTDKLITPF

SEQ ID NO: 81836 - protein, 9 aa, Homo Sapiens
RRQREGRLR

SEQ ID NO: 81837 - protein, 9 aa, Homo Sapiens
ELFRTSDLS

SEQ ID NO: 81838 - protein, 9 aa, Homo Sapiens
MGKDPSPQA

SEQ ID NO: 81839 - protein, 9 aa, Homo Sapiens
SPRAPGTAG

SEQ ID NO: 81840 - protein, 9 aa, Homo Sapiens
NYMTKFLND

SEQ ID NO: 81841 - protein, 9 aa, Homo Sapiens
NNMIQQKNM

SEQ ID NO: 81842 - protein, 9 aa, Homo Sapiens
SYVSLEVVS

SEQ ID NO: 81843 - protein, 9 aa, Homo Sapiens
GNFNYKQRG

SEQ ID NO: 81844 - protein, 9 aa, Homo Sapiens
LWELLTAEV

SEQ ID NO: 81845 - protein, 9 aa, Homo Sapiens
MIQQKNMAM

SEQ ID NO: 81846 - protein, 9 aa, Homo Sapiens
KILLHFKFN

SEQ ID NO: 81847 - protein, 9 aa, Homo Sapiens
LISKKLTNP

SEQ ID NO: 81848 - protein, 9 aa, Homo Sapiens
VKMQPPGKL

SEQ ID NO: 81849 - protein, 9 aa, Homo Sapiens
ALHDKAQKR

SEQ ID NO: 81850 - protein, 9 aa, Homo Sapiens
RCLLNVQSR

SEQ ID NO: 81851 - protein, 9 aa, Homo Sapiens
SSPYLCQEF

SEQ ID NO: 81852 - protein, 9 aa, Homo Sapiens
KFGRNINLE

SEQ ID NO: 81853 - protein, 9 aa, Homo Sapiens
RTDISPREN

SEQ ID NO: 81854 - protein, 9 aa, Homo Sapiens
EYFQKHVRS

SEQ ID NO: 81855 - protein, 9 aa, Homo Sapiens
QEFQKKYDV

SEQ ID NO: 81856 - protein, 9 aa, Homo Sapiens
CLCTDGNEI

SEQ ID NO: 81857 - protein, 9 aa, Homo Sapiens
QFSANPVLA

SEQ ID NO: 81858 - protein, 9 aa, Homo Sapiens
VDYVHSFIR

SEQ ID NO: 81859 - protein, 9 aa, Homo Sapiens
GVKADEVLH

SEQ ID NO: 81860 - protein, 9 aa, Homo Sapiens
VTDLFNGKK

SEQ ID NO: 81861 - protein, 9 aa, Homo Sapiens
VETFGDIFL

SEQ ID NO: 81862 - protein, 9 aa, Homo Sapiens
KAAYVLDNP

SEQ ID NO: 81863 - protein, 9 aa, Homo Sapiens
TEMISECTE

SEQ ID NO: 81864 - protein, 9 aa, Homo Sapiens
FTCASSPST

SEQ ID NO: 81865 - protein, 9 aa, Homo Sapiens
EFQNLKSHL

SEQ ID NO: 81866 - protein, 9 aa, Homo Sapiens
QMNMENLFV

SEQ ID NO: 81867 - protein, 9 aa, Homo Sapiens
SANPVLASD

SEQ ID NO: 81868 - protein, 9 aa, Homo Sapiens
FNFLHWIFA

SEQ ID NO: 81869 - protein, 9 aa, Homo Sapiens
INAGQLKNG

SEQ ID NO: 81870 - protein, 9 aa, Homo Sapiens
EGVSPRKSL

SEQ ID NO: 81871 - protein, 9 aa, Homo Sapiens
QVGNSEAAM

SEQ ID NO: 81872 - protein, 9 aa, Homo Sapiens
VGVVIGILV

SEQ ID NO: 81873 - protein, 9 aa, Homo Sapiens
LTPTGHKMK

SEQ ID NO: 81874 - protein, 9 aa, Homo Sapiens
GPRAFSSCS

SEQ ID NO: 81875 - protein, 9 aa, Homo Sapiens
IQIREPVDL

SEQ ID NO: 81876 - protein, 9 aa, Homo Sapiens
ANTCATRSS

SEQ ID NO: 81877 - protein, 9 aa, Homo Sapiens
EGNMLGYKF

SEQ ID NO: 81878 - protein, 9 aa, Homo Sapiens
AVEQKAQVE

SEQ ID NO: 81879 - protein, 9 aa, Homo Sapiens
SSPRAPGTA

SEQ ID NO: 81880 - protein, 9 aa, Homo Sapiens
VPTNYFHIC

SEQ ID NO: 81881 - protein, 9 aa, Homo Sapiens
ESVSSSSST

SEQ ID NO: 81882 - protein, 9 aa, Homo Sapiens
NMIQQKNMA

SEQ ID NO: 81883 - protein, 9 aa, Homo Sapiens
ELEQFMEYQ

SEQ ID NO: 81884 - protein, 9 aa, Homo Sapiens
THSMGSRRT

SEQ ID NO: 81885 - protein, 9 aa, Homo Sapiens
KHSLRNSSN

SEQ ID NO: 81886 - protein, 9 aa, Homo Sapiens
PSTEEKLKT

SEQ ID NO: 81887 - protein, 9 aa, Homo Sapiens
AVCYMMVSF

SEQ ID NO: 81888 - protein, 9 aa, Homo Sapiens
CVFGIWRYK

SEQ ID NO: 81889 - protein, 9 aa, Homo Sapiens
EILKQDKGS

SEQ ID NO: 81890 - protein, 9 aa, Homo Sapiens
KTYQPWGNV

SEQ ID NO: 81891 - protein, 9 aa, Homo Sapiens
CSVSNESND

SEQ ID NO: 81892 - protein, 9 aa, Homo Sapiens
EEETRIQFP

SEQ ID NO: 81893 - protein, 9 aa, Homo Sapiens
DGRWFPDRI

SEQ ID NO: 81894 - protein, 9 aa, Homo Sapiens
LEALELQKT

SEQ ID NO: 81895 - protein, 9 aa, Homo Sapiens
DSETDRCIL

SEQ ID NO: 81896 - protein, 9 aa, Homo Sapiens
TKASLLSVA

SEQ ID NO: 81897 - protein, 9 aa, Homo Sapiens
LTLRAASSP

SEQ ID NO: 81898 - protein, 9 aa, Homo Sapiens
RGQLEKSIQ

SEQ ID NO: 81899 - protein, 9 aa, Homo Sapiens
IFDFLVVIL

SEQ ID NO: 81900 - protein, 9 aa, Homo Sapiens
SLVLQTQPL

SEQ ID NO: 81901 - protein, 9 aa, Homo Sapiens
IWRYKEKCY

SEQ ID NO: 81902 - protein, 9 aa, Homo Sapiens
KFCQSYSED

SEQ ID NO: 81903 - protein, 9 aa, Homo Sapiens
CPWLNYLPF

SEQ ID NO: 81904 - protein, 9 aa, Homo Sapiens
SPTTNSKAP

SEQ ID NO: 81905 - protein, 9 aa, Homo Sapiens
VDSICKRRF

SEQ ID NO: 81906 - protein, 9 aa, Homo Sapiens
PTNPMKFLK

SEQ ID NO: 81907 - protein, 9 aa, Homo Sapiens
KNLEGLDLL

SEQ ID NO: 81908 - protein, 9 aa, Homo Sapiens
PSYLERKHL

SEQ ID NO: 81909 - protein, 9 aa, Homo Sapiens
CASSPSTGT

SEQ ID NO: 81910 - protein, 9 aa, Homo Sapiens
AATTPILTL

SEQ ID NO: 81911 - protein, 9 aa, Homo Sapiens
YMTKFLNDR

SEQ ID NO: 81912 - protein, 9 aa, Homo Sapiens
EPEAEKSFI

SEQ ID NO: 81913 - protein, 9 aa, Homo Sapiens
EEDYEREKQ

SEQ ID NO: 81914 - protein, 9 aa, Homo Sapiens
PSRSEFSKH

SEQ ID NO: 81915 - protein, 9 aa, Homo Sapiens
QLQVIVKKA

SEQ ID NO: 81916 - protein, 9 aa, Homo Sapiens
PWQAKPHVL

SEQ ID NO: 81917 - protein, 9 aa, Homo Sapiens
RNNMIQQKN

SEQ ID NO: 81918 - protein, 9 aa, Homo Sapiens
HKIIHTEKK

SEQ ID NO: 81919 - protein, 9 aa, Homo Sapiens
TDLDVPSEA

SEQ ID NO: 81920 - protein, 9 aa, Homo Sapiens
KKRIGRPPG

SEQ ID NO: 81921 - protein, 9 aa, Homo Sapiens
NLNIKLQFC

SEQ ID NO: 81922 - protein, 9 aa, Homo Sapiens
TIKRQQGSK

SEQ ID NO: 81923 - protein, 9 aa, Homo Sapiens
VFFSTVMSI

SEQ ID NO: 81924 - protein, 9 aa, Homo Sapiens
CTGIKVVIP

SEQ ID NO: 81925 - protein, 9 aa, Homo Sapiens
KVADKVINE

SEQ ID NO: 81926 - protein, 9 aa, Homo Sapiens
DKYVFLMQK

SEQ ID NO: 81927 - protein, 9 aa, Homo Sapiens
LARALDNKL

SEQ ID NO: 81928 - protein, 9 aa, Homo Sapiens
GAKKKDFSC

SEQ ID NO: 81929 - protein, 9 aa, Homo Sapiens
AKFGRNINL

SEQ ID NO: 81930 - protein, 9 aa, Homo Sapiens
DDGEAFGNK

SEQ ID NO: 81931 - protein, 9 aa, Homo Sapiens
NDCDKYVFL

SEQ ID NO: 81932 - protein, 9 aa, Homo Sapiens
EKKYSSCAR

SEQ ID NO: 81933 - protein, 9 aa, Homo Sapiens
HANVPERYN

SEQ ID NO: 81934 - protein, 9 aa, Homo Sapiens
IAMSTMHKD

SEQ ID NO: 81935 - protein, 9 aa, Homo Sapiens
LKSDIGKYT

SEQ ID NO: 81936 - protein, 9 aa, Homo Sapiens
IFTSPLNHI

SEQ ID NO: 81937 - protein, 9 aa, Homo Sapiens
SIKNPLYPI

SEQ ID NO: 81938 - protein, 9 aa, Homo Sapiens
LIVVNIITS

SEQ ID NO: 81939 - protein, 9 aa, Homo Sapiens
EQKAQVETS

SEQ ID NO: 81940 - protein, 9 aa, Homo Sapiens
NPEMRRVRE

SEQ ID NO: 81941 - protein, 9 aa, Homo Sapiens
LPVVQPLPT

SEQ ID NO: 81942 - protein, 9 aa, Homo Sapiens
SGLTTKQML

SEQ ID NO: 81943 - protein, 9 aa, Homo Sapiens
VLHSFLQSQ

SEQ ID NO: 81944 - protein, 9 aa, Homo Sapiens
QDTEKLKKI

SEQ ID NO: 81945 - protein, 9 aa, Homo Sapiens
IIIAVFLIC

SEQ ID NO: 81946 - protein, 9 aa, Homo Sapiens
YMMVSFNFL

SEQ ID NO: 81947 - protein, 9 aa, Homo Sapiens
AFGNKWCSL

SEQ ID NO: 81948 - protein, 9 aa, Homo Sapiens
MVSFNFLHW

SEQ ID NO: 81949 - protein, 9 aa, Homo Sapiens
LYPTHRTTK

SEQ ID NO: 81950 - protein, 9 aa, Homo Sapiens
PKQVTTSAA

SEQ ID NO: 81951 - protein, 9 aa, Homo Sapiens
QPLFSGKKV

SEQ ID NO: 81952 - protein, 9 aa, Homo Sapiens
PERYNVGTS

SEQ ID NO: 81953 - protein, 9 aa, Homo Sapiens
QKKYLYRYP

SEQ ID NO: 81954 - protein, 9 aa, Homo Sapiens
YLYKDPNQQ

SEQ ID NO: 81955 - protein, 9 aa, Homo Sapiens
PMKFLKNKA

SEQ ID NO: 81956 - protein, 9 aa, Homo Sapiens
KKKKKRIGR

SEQ ID NO: 81957 - protein, 9 aa, Homo Sapiens
KSIQGNNCL

SEQ ID NO: 81958 - protein, 9 aa, Homo Sapiens
SHSLAVTSY

SEQ ID NO: 81959 - protein, 9 aa, Homo Sapiens
FGRSFVLST

SEQ ID NO: 81960 - protein, 9 aa, Homo Sapiens
GNACDDDMD

SEQ ID NO: 81961 - protein, 9 aa, Homo Sapiens
RNLPHGFIQ

SEQ ID NO: 81962 - protein, 9 aa, Homo Sapiens
SWFLAAGRK

SEQ ID NO: 81963 - protein, 9 aa, Homo Sapiens
GDGRGNACD

SEQ ID NO: 81964 - protein, 9 aa, Homo Sapiens
IPEDLIDPF

SEQ ID NO: 81965 - protein, 9 aa, Homo Sapiens
VDLWQFTPL

SEQ ID NO: 81966 - protein, 9 aa, Homo Sapiens
IANYPIYII

SEQ ID NO: 81967 - protein, 9 aa, Homo Sapiens
LGKLLTVLL

SEQ ID NO: 81968 - protein, 9 aa, Homo Sapiens
GRWFPDRIS

SEQ ID NO: 81969 - protein, 9 aa, Homo Sapiens
LQSCFIYEE

SEQ ID NO: 81970 - protein, 9 aa, Homo Sapiens
LTDSSSSST

SEQ ID NO: 81971 - protein, 9 aa, Homo Sapiens
LPTTKASLL

SEQ ID NO: 81972 - protein, 9 aa, Homo Sapiens
KLNPSHNAA

SEQ ID NO: 81973 - protein, 9 aa, Homo Sapiens
TGIKVVIPR

SEQ ID NO: 81974 - protein, 9 aa, Homo Sapiens
NDILVYGSM

SEQ ID NO: 81975 - protein, 9 aa, Homo Sapiens
QNLKSHLEN

SEQ ID NO: 81976 - protein, 9 aa, Homo Sapiens
LGFTIDSTC

SEQ ID NO: 81977 - protein, 9 aa, Homo Sapiens
CYMMVSFNF

SEQ ID NO: 81978 - protein, 9 aa, Homo Sapiens
NKDTIQNGN

SEQ ID NO: 81979 - protein, 9 aa, Homo Sapiens
FTELIPRPI

SEQ ID NO: 81980 - protein, 9 aa, Homo Sapiens
DFSTSTYSN

SEQ ID NO: 81981 - protein, 9 aa, Homo Sapiens
THYYGKKKK

SEQ ID NO: 81982 - protein, 9 aa, Homo Sapiens
AISHNSVVI

SEQ ID NO: 81983 - protein, 9 aa, Homo Sapiens
VSPTTNSKA

SEQ ID NO: 81984 - protein, 9 aa, Homo Sapiens
EKSIQGNNC

SEQ ID NO: 81985 - protein, 9 aa, Homo Sapiens
SYMNIQQKE

SEQ ID NO: 81986 - protein, 9 aa, Homo Sapiens
MHLNRLEIE

SEQ ID NO: 81987 - protein, 9 aa, Homo Sapiens
MPYSHSLAV

SEQ ID NO: 81988 - protein, 9 aa, Homo Sapiens
SRLKKPIVG

SEQ ID NO: 81989 - protein, 9 aa, Homo Sapiens
PTNVKVVVP

SEQ ID NO: 81990 - protein, 9 aa, Homo Sapiens
LYNTILSDK

SEQ ID NO: 81991 - protein, 9 aa, Homo Sapiens
RKHTTLMDE

SEQ ID NO: 81992 - protein, 9 aa, Homo Sapiens
SKILLHFKF

SEQ ID NO: 81993 - protein, 9 aa, Homo Sapiens
DKRKALIPC

SEQ ID NO: 81994 - protein, 9 aa, Homo Sapiens
QTHSMGSRR

SEQ ID NO: 81995 - protein, 9 aa, Homo Sapiens
SLETVFSHS

SEQ ID NO: 81996 - protein, 9 aa, Homo Sapiens
SPLQISQSS

SEQ ID NO: 81997 - protein, 9 aa, Homo Sapiens
KHTTLMDEK

SEQ ID NO: 81998 - protein, 9 aa, Homo Sapiens
YNVGTSVIQ

SEQ ID NO: 81999 - protein, 9 aa, Homo Sapiens
ALNAWKEKF

SEQ ID NO: 82000 - protein, 9 aa, Homo Sapiens
NLICSDKTG

SEQ ID NO: 82001 - protein, 9 aa, Homo Sapiens
AHFLPVVQP

SEQ ID NO: 82002 - protein, 9 aa, Homo Sapiens
YYSEPGRNN

SEQ ID NO: 82003 - protein, 9 aa, Homo Sapiens
FLKNKAIIR

SEQ ID NO: 82004 - protein, 9 aa, Homo Sapiens
MCANLNAGG

SEQ ID NO: 82005 - protein, 9 aa, Homo Sapiens
LVETFGDIF

SEQ ID NO: 82006 - protein, 9 aa, Homo Sapiens
NQQKIYDLF

SEQ ID NO: 82007 - protein, 9 aa, Homo Sapiens
IKLQFCHQR

SEQ ID NO: 82008 - protein, 9 aa, Homo Sapiens
VSYVSLEVV

SEQ ID NO: 82009 - protein, 9 aa, Homo Sapiens
PRPIEMSDE

SEQ ID NO: 82010 - protein, 9 aa, Homo Sapiens
PQSGLGRHV

SEQ ID NO: 82011 - protein, 9 aa, Homo Sapiens
FGHLTNVTF

SEQ ID NO: 82012 - protein, 9 aa, Homo Sapiens
DFDKNDIPR

SEQ ID NO: 82013 - protein, 9 aa, Homo Sapiens
TQMTGLTAT

SEQ ID NO: 82014 - protein, 9 aa, Homo Sapiens
AQKREKPSQ

SEQ ID NO: 82015 - protein, 9 aa, Homo Sapiens
NKLLSLKTV

SEQ ID NO: 82016 - protein, 9 aa, Homo Sapiens
GQYYSNVIA

SEQ ID NO: 82017 - protein, 9 aa, Homo Sapiens
EAILEEKPY

SEQ ID NO: 82018 - protein, 9 aa, Homo Sapiens
LPHGFIQEL

SEQ ID NO: 82019 - protein, 9 aa, Homo Sapiens
LNYLPFGPF

SEQ ID NO: 82020 - protein, 9 aa, Homo Sapiens
LCSTQVSMT

SEQ ID NO: 82021 - protein, 9 aa, Homo Sapiens
AVMWHFVTL

SEQ ID NO: 82022 - protein, 9 aa, Homo Sapiens
FTSPLNHIY

SEQ ID NO: 82023 - protein, 9 aa, Homo Sapiens
DGEAFGNKW

SEQ ID NO: 82024 - protein, 9 aa, Homo Sapiens
NSKAPFGLK

SEQ ID NO: 82025 - protein, 9 aa, Homo Sapiens
LLTPWSILP

SEQ ID NO: 82026 - protein, 9 aa, Homo Sapiens
TGKRARHTI

SEQ ID NO: 82027 - protein, 9 aa, Homo Sapiens
EKQLQQLLT

SEQ ID NO: 82028 - protein, 9 aa, Homo Sapiens
GRGNACDDD

SEQ ID NO: 82029 - protein, 9 aa, Homo Sapiens
TPTGHKMKI

SEQ ID NO: 82030 - protein, 9 aa, Homo Sapiens
TREEVLQLS

SEQ ID NO: 82031 - protein, 9 aa, Homo Sapiens
PEDLIDPFY

SEQ ID NO: 82032 - protein, 9 aa, Homo Sapiens
RAFRQSGSL

SEQ ID NO: 82033 - protein, 9 aa, Homo Sapiens
TIRITPQDS

SEQ ID NO: 82034 - protein, 9 aa, Homo Sapiens
GPIILGFTI

SEQ ID NO: 82035 - protein, 9 aa, Homo Sapiens
LTEKGNQSI

SEQ ID NO: 82036 - protein, 9 aa, Homo Sapiens
KNELSAISR

SEQ ID NO: 82037 - protein, 9 aa, Homo Sapiens
KSDIGKYTC

SEQ ID NO: 82038 - protein, 9 aa, Homo Sapiens
AQRQADFLR

SEQ ID NO: 82039 - protein, 9 aa, Homo Sapiens
YASLITSAI

SEQ ID NO: 82040 - protein, 9 aa, Homo Sapiens
GTEIFLITV

SEQ ID NO: 82041 - protein, 9 aa, Homo Sapiens
RNTWVTGRE

SEQ ID NO: 82042 - protein, 9 aa, Homo Sapiens
FICKTGESL

SEQ ID NO: 82043 - protein, 9 aa, Homo Sapiens
HKMKILQPH

SEQ ID NO: 82044 - protein, 9 aa, Homo Sapiens
STSTYSNSV

SEQ ID NO: 82045 - protein, 9 aa, Homo Sapiens
PGSCPSCTA

SEQ ID NO: 82046 - protein, 9 aa, Homo Sapiens
GDFEPFKEK

SEQ ID NO: 82047 - protein, 9 aa, Homo Sapiens
SEVQGMQEA

SEQ ID NO: 82048 - protein, 9 aa, Homo Sapiens
TQVSMTMGW

SEQ ID NO: 82049 - protein, 9 aa, Homo Sapiens
LSRSKSRSR

SEQ ID NO: 82050 - protein, 9 aa, Homo Sapiens
NNNERTTDL

SEQ ID NO: 82051 - protein, 9 aa, Homo Sapiens
LQEKYKELT

SEQ ID NO: 82052 - protein, 9 aa, Homo Sapiens
KTNYQSFHF

SEQ ID NO: 82053 - protein, 9 aa, Homo Sapiens
SVSNESNDL

SEQ ID NO: 82054 - protein, 9 aa, Homo Sapiens
NLGNFNYKQ

SEQ ID NO: 82055 - protein, 9 aa, Homo Sapiens
FNGKKPIEL

SEQ ID NO: 82056 - protein, 9 aa, Homo Sapiens
PCDDTTSWE

SEQ ID NO: 82057 - protein, 9 aa, Homo Sapiens
LLTHGDSVH

SEQ ID NO: 82058 - protein, 9 aa, Homo Sapiens
GTIPGPIIL

SEQ ID NO: 82059 - protein, 9 aa, Homo Sapiens
SSSSTSTSN

SEQ ID NO: 82060 - protein, 9 aa, Homo Sapiens
IDFDKNDIP

SEQ ID NO: 82061 - protein, 9 aa, Homo Sapiens
NGGKTTTIL

SEQ ID NO: 82062 - protein, 9 aa, Homo Sapiens
GLTTKQMLR

SEQ ID NO: 82063 - protein, 9 aa, Homo Sapiens
DFSKFCQSY

SEQ ID NO: 82064 - protein, 9 aa, Homo Sapiens
GRHVGVVIG

SEQ ID NO: 82065 - protein, 9 aa, Homo Sapiens
KSRSPQSPP

SEQ ID NO: 82066 - protein, 8 aa, Homo Sapiens
RAQEDLEG

SEQ ID NO: 82067 - protein, 9 aa, Homo Sapiens
GKRARHTIK

SEQ ID NO: 82068 - protein, 9 aa, Homo Sapiens
QVKPSPESP

SEQ ID NO: 82069 - protein, 9 aa, Homo Sapiens
RGNACDDDM

SEQ ID NO: 82070 - protein, 9 aa, Homo Sapiens
HSLETVFSH

SEQ ID NO: 82071 - protein, 9 aa, Homo Sapiens
EEKEEEAQE

SEQ ID NO: 82072 - protein, 9 aa, Homo Sapiens
RQKIKAEHA

SEQ ID NO: 82073 - protein, 9 aa, Homo Sapiens
FEPFKEKEC

SEQ ID NO: 82074 - protein, 9 aa, Homo Sapiens
SFNFLHWIF

SEQ ID NO: 82075 - protein, 9 aa, Homo Sapiens
DLIERDSGV

SEQ ID NO: 82076 - protein, 9 aa, Homo Sapiens
RRGRRKNLE

SEQ ID NO: 82077 - protein, 9 aa, Homo Sapiens
EGKIQQEYI

SEQ ID NO: 82078 - protein, 9 aa, Homo Sapiens
DINNIDFDK

SEQ ID NO: 82079 - protein, 9 aa, Homo Sapiens
AWKEKFMTV

SEQ ID NO: 82080 - protein, 9 aa, Homo Sapiens
DLSSSTSLS

SEQ ID NO: 82081 - protein, 9 aa, Homo Sapiens
KQDMLKERQ

SEQ ID NO: 82082 - protein, 9 aa, Homo Sapiens
MPAITGCRE

SEQ ID NO: 82083 - protein, 9 aa, Homo Sapiens
CDKYVFLMQ

SEQ ID NO: 82084 - protein, 9 aa, Homo Sapiens
PLQQPPSVI

SEQ ID NO: 82085 - protein, 9 aa, Homo Sapiens
RKIRAEGLQ

SEQ ID NO: 82086 - protein, 9 aa, Homo Sapiens
LGCTAPFGY

SEQ ID NO: 82087 - protein, 9 aa, Homo Sapiens
LTPWSILPS

SEQ ID NO: 82088 - protein, 9 aa, Homo Sapiens
KNELVSDEM

SEQ ID NO: 82089 - protein, 9 aa, Homo Sapiens
MGSRRTLML

SEQ ID NO: 82090 - protein, 9 aa, Homo Sapiens
GIQDSFKKE

SEQ ID NO: 82091 - protein, 9 aa, Homo Sapiens
VLISKKLTN

SEQ ID NO: 82092 - protein, 9 aa, Homo Sapiens
RRAVGWWKC

SEQ ID NO: 82093 - protein, 9 aa, Homo Sapiens
TPILTLGTQ

SEQ ID NO: 82094 - protein, 9 aa, Homo Sapiens
KDPSPQAGC

SEQ ID NO: 82095 - protein, 9 aa, Homo Sapiens
YKCLCTDGN

SEQ ID NO: 82096 - protein, 9 aa, Homo Sapiens
TVLISKKLT

SEQ ID NO: 82097 - protein, 9 aa, Homo Sapiens
TAEELQEKY

SEQ ID NO: 82098 - protein, 9 aa, Homo Sapiens
RTPPLQQPP

SEQ ID NO: 82099 - protein, 9 aa, Homo Sapiens
GKYHIQACT

SEQ ID NO: 82100 - protein, 9 aa, Homo Sapiens
VLLLSIKNP

SEQ ID NO: 82101 - protein, 9 aa, Homo Sapiens
YEDLRRQGL

SEQ ID NO: 82102 - protein, 9 aa, Homo Sapiens
VQPLPTPLL

SEQ ID NO: 82103 - protein, 9 aa, Homo Sapiens
QNPVSYVSL

SEQ ID NO: 82104 - protein, 9 aa, Homo Sapiens
DVKMQPPGK

SEQ ID NO: 82105 - protein, 9 aa, Homo Sapiens
HGACVNAVD

SEQ ID NO: 82106 - protein, 9 aa, Homo Sapiens
AFSSCSYTS

SEQ ID NO: 82107 - protein, 9 aa, Homo Sapiens
TFDLQDWTQ

SEQ ID NO: 82108 - protein, 9 aa, Homo Sapiens
DLRTFHLMH

SEQ ID NO: 82109 - protein, 9 aa, Homo Sapiens
DVCQIFIEN

SEQ ID NO: 82110 - protein, 9 aa, Homo Sapiens
IYEKTEKPC

SEQ ID NO: 82111 - protein, 9 aa, Homo Sapiens
KLKKILEVV

SEQ ID NO: 82112 - protein, 9 aa, Homo Sapiens
FSSCSYTSG

SEQ ID NO: 82113 - protein, 9 aa, Homo Sapiens
SKNGGKTTT

SEQ ID NO: 82114 - protein, 9 aa, Homo Sapiens
FQEFQKKYD

SEQ ID NO: 82115 - protein, 9 aa, Homo Sapiens
NVPERYNVG

SEQ ID NO: 82116 - protein, 9 aa, Homo Sapiens
TLRAASSPR

SEQ ID NO: 82117 - protein, 9 aa, Homo Sapiens
HMLTGHDGG

SEQ ID NO: 82118 - protein, 9 aa, Homo Sapiens
PYLCQEFAS

SEQ ID NO: 82119 - protein, 9 aa, Homo Sapiens
ALDNKLLSL

SEQ ID NO: 82120 - protein, 9 aa, Homo Sapiens
SEQLMRDKI

SEQ ID NO: 82121 - protein, 9 aa, Homo Sapiens
GVSPRKSLE

SEQ ID NO: 82122 - protein, 9 aa, Homo Sapiens
LEQPSRSEF

SEQ ID NO: 82123 - protein, 9 aa, Homo Sapiens
MFQYRRNEH

SEQ ID NO: 82124 - protein, 9 aa, Homo Sapiens
SHLPQELPP

SEQ ID NO: 82125 - protein, 9 aa, Homo Sapiens
PILTLGTQM

SEQ ID NO: 82126 - protein, 9 aa, Homo Sapiens
TPQDSRWVG

SEQ ID NO: 82127 - protein, 9 aa, Homo Sapiens
ILTISWFLA

SEQ ID NO: 82128 - protein, 9 aa, Homo Sapiens
ISHNSVVII

SEQ ID NO: 82129 - protein, 9 aa, Homo Sapiens
CKRRFRVLH

SEQ ID NO: 82130 - protein, 9 aa, Homo Sapiens
LYPDMNVIT

SEQ ID NO: 82131 - protein, 9 aa, Homo Sapiens
QGGGLAVLS

SEQ ID NO: 82132 - protein, 9 aa, Homo Sapiens
SESDFSKFC

SEQ ID NO: 82133 - protein, 9 aa, Homo Sapiens
LTFNEEFKI

SEQ ID NO: 82134 - protein, 9 aa, Homo Sapiens
QLEKSIQGN

SEQ ID NO: 82135 - protein, 9 aa, Homo Sapiens
IKHKKQPHD

SEQ ID NO: 82136 - protein, 9 aa, Homo Sapiens
FILEDLIER

SEQ ID NO: 82137 - protein, 9 aa, Homo Sapiens
KNDIPRTDT

SEQ ID NO: 82138 - protein, 9 aa, Homo Sapiens
DYQPKYFLS

SEQ ID NO: 82139 - protein, 9 aa, Homo Sapiens
LQQHMQQHV

SEQ ID NO: 82140 - protein, 9 aa, Homo Sapiens
RVLDKRKAL

SEQ ID NO: 82141 - protein, 9 aa, Homo Sapiens
NVTKIAEKK

SEQ ID NO: 82142 - protein, 9 aa, Homo Sapiens
IKAEHASHG

SEQ ID NO: 82143 - protein, 9 aa, Homo Sapiens
HKVADGFKV

SEQ ID NO: 82144 - protein, 9 aa, Homo Sapiens
QEFASACPG

SEQ ID NO: 82145 - protein, 9 aa, Homo Sapiens
IKRQQGSKE

SEQ ID NO: 82146 - protein, 9 aa, Homo Sapiens
CFIYEEKGL

SEQ ID NO: 82147 - protein, 9 aa, Homo Sapiens
SQVKVFGKT

SEQ ID NO: 82148 - protein, 9 aa, Homo Sapiens
GPSFSKVIH

SEQ ID NO: 82149 - protein, 9 aa, Homo Sapiens
TDLFNGKKP

SEQ ID NO: 82150 - protein, 9 aa, Homo Sapiens
CRNLPHGFI

SEQ ID NO: 82151 - protein, 9 aa, Homo Sapiens
LGTLYPTHR

SEQ ID NO: 82152 - protein, 9 aa, Homo Sapiens
PLDTSHLPQ

SEQ ID NO: 82153 - protein, 9 aa, Homo Sapiens
MPKQVTTSA

SEQ ID NO: 82154 - protein, 9 aa, Homo Sapiens
QIFIENKIN

SEQ ID NO: 82155 - protein, 9 aa, Homo Sapiens
KHVGDTLLG

SEQ ID NO: 82156 - protein, 9 aa, Homo Sapiens
DSLLCSMSH

SEQ ID NO: 82157 - protein, 9 aa, Homo Sapiens
YVADLENMF

SEQ ID NO: 82158 - protein, 9 aa, Homo Sapiens
FTEILKQDK

SEQ ID NO: 82159 - protein, 9 aa, Homo Sapiens
WDDGENKDT

SEQ ID NO: 82160 - protein, 9 aa, Homo Sapiens
RLEIEPQIY

SEQ ID NO: 82161 - protein, 9 aa, Homo Sapiens
TTKASLLSV

SEQ ID NO: 82162 - protein, 9 aa, Homo Sapiens
LSEDLYPDM

SEQ ID NO: 82163 - protein, 9 aa, Homo Sapiens
PYIAPSYLE

SEQ ID NO: 82164 - protein, 9 aa, Homo Sapiens
RCQEIHNKL

SEQ ID NO: 82165 - protein, 9 aa, Homo Sapiens
EYQGASSPG

SEQ ID NO: 82166 - protein, 9 aa, Homo Sapiens
VQRFGHGTE

SEQ ID NO: 82167 - protein, 9 aa, Homo Sapiens
WSKILLHFK

SEQ ID NO: 82168 - protein, 9 aa, Homo Sapiens
RDKIQIREP

SEQ ID NO: 82169 - protein, 9 aa, Homo Sapiens
SMEDIMFST

SEQ ID NO: 82170 - protein, 9 aa, Homo Sapiens
VAFLETYLD

SEQ ID NO: 82171 - protein, 9 aa, Homo Sapiens
RYQNPWQAK

SEQ ID NO: 82172 - protein, 9 aa, Homo Sapiens
FAVLFGRKE

SEQ ID NO: 82173 - protein, 9 aa, Homo Sapiens
SRKHTTLMD

SEQ ID NO: 82174 - protein, 9 aa, Homo Sapiens
QLLKTVSSL

SEQ ID NO: 82175 - protein, 9 aa, Homo Sapiens
DPQFSANPV

SEQ ID NO: 82176 - protein, 9 aa, Homo Sapiens
NLEEKFDGV

SEQ ID NO: 82177 - protein, 9 aa, Homo Sapiens
HCTGIKVVI

SEQ ID NO: 82178 - protein, 9 aa, Homo Sapiens
LQVIVKKAQ

SEQ ID NO: 82179 - protein, 9 aa, Homo Sapiens
YIFTEILKQ

SEQ ID NO: 82180 - protein, 9 aa, Homo Sapiens
LSSEQMSKT

SEQ ID NO: 82181 - protein, 9 aa, Homo Sapiens
SEDLYPDMN

SEQ ID NO: 82182 - protein, 9 aa, Homo Sapiens
VLDKRKALI

SEQ ID NO: 82183 - protein, 9 aa, Homo Sapiens
NHDNLFTGA

SEQ ID NO: 82184 - protein, 9 aa, Homo Sapiens
YEKTEKPCL

SEQ ID NO: 82185 - protein, 9 aa, Homo Sapiens
DEVLHSFLQ

SEQ ID NO: 82186 - protein, 9 aa, Homo Sapiens
CFFLFAVLF

SEQ ID NO: 82187 - protein, 9 aa, Homo Sapiens
AASSPRAPG

SEQ ID NO: 82188 - protein, 9 aa, Homo Sapiens
QTVIVGKAP

SEQ ID NO: 82189 - protein, 9 aa, Homo Sapiens
DSEGDSETD

SEQ ID NO: 82190 - protein, 9 aa, Homo Sapiens
QFPKLLETL

SEQ ID NO: 82191 - protein, 9 aa, Homo Sapiens
IYEEKGLIS

SEQ ID NO: 82192 - protein, 9 aa, Homo Sapiens
LLGSSGPLS

SEQ ID NO: 82193 - protein, 9 aa, Homo Sapiens
KEKCYYLPF

SEQ ID NO: 82194 - protein, 9 aa, Homo Sapiens
TDRLTENMA

SEQ ID NO: 82195 - protein, 9 aa, Homo Sapiens
INKMNLCEA

SEQ ID NO: 82196 - protein, 9 aa, Homo Sapiens
GKVADKVIN

SEQ ID NO: 82197 - protein, 9 aa, Homo Sapiens
QPKYFLSIP

SEQ ID NO: 82198 - protein, 9 aa, Homo Sapiens
FSLLFAGAL

SEQ ID NO: 82199 - protein, 9 aa, Homo Sapiens
DNIPEDLID

SEQ ID NO: 82200 - protein, 9 aa, Homo Sapiens
QACTTTPCM

SEQ ID NO: 82201 - protein, 9 aa, Homo Sapiens
ENEQALYEL

SEQ ID NO: 82202 - protein, 9 aa, Homo Sapiens
IKEFNETSS

SEQ ID NO: 82203 - protein, 9 aa, Homo Sapiens
LHDKAQKRE

SEQ ID NO: 82204 - protein, 9 aa, Homo Sapiens
EKREVFERK

SEQ ID NO: 82205 - protein, 9 aa, Homo Sapiens
EETRIQFPK

SEQ ID NO: 82206 - protein, 9 aa, Homo Sapiens
FGGTEIFLI

SEQ ID NO: 82207 - protein, 9 aa, Homo Sapiens
LEKSIQGNN

SEQ ID NO: 82208 - protein, 9 aa, Homo Sapiens
RSFVLSTPA

SEQ ID NO: 82209 - protein, 9 aa, Homo Sapiens
VSFNFLHWI

SEQ ID NO: 82210 - protein, 9 aa, Homo Sapiens
YMIEIFVHG

SEQ ID NO: 82211 - protein, 9 aa, Homo Sapiens
WLNYLPFGP

SEQ ID NO: 82212 - protein, 9 aa, Homo Sapiens
QGDKSRSPQ

SEQ ID NO: 82213 - protein, 9 aa, Homo Sapiens
KKTYEDLRR

SEQ ID NO: 82214 - protein, 9 aa, Homo Sapiens
NIQQKEDIT

SEQ ID NO: 82215 - protein, 9 aa, Homo Sapiens
QKREKPSQG

SEQ ID NO: 82216 - protein, 9 aa, Homo Sapiens
VGKYHIQAC

SEQ ID NO: 82217 - protein, 9 aa, Homo Sapiens
PYSHSLAVT

SEQ ID NO: 82218 - protein, 9 aa, Homo Sapiens
RRRGRRKNL

SEQ ID NO: 82219 - protein, 9 aa, Homo Sapiens
DNIKAVGKK

SEQ ID NO: 82220 - protein, 9 aa, Homo Sapiens
EKSFICKTG

SEQ ID NO: 82221 - protein, 9 aa, Homo Sapiens
QQHMQQKEL

SEQ ID NO: 82222 - protein, 9 aa, Homo Sapiens
SSYFCCAIE

SEQ ID NO: 82223 - protein, 9 aa, Homo Sapiens
RIKSENLRI

SEQ ID NO: 82224 - protein, 9 aa, Homo Sapiens
MYCLVGLIY

SEQ ID NO: 82225 - protein, 9 aa, Homo Sapiens
IKEEKTTKN

SEQ ID NO: 82226 - protein, 9 aa, Homo Sapiens
KPYIAPSYL

SEQ ID NO: 82227 - protein, 9 aa, Homo Sapiens
FRGAEYNRN

SEQ ID NO: 82228 - protein, 9 aa, Homo Sapiens
DFSCKGAED

SEQ ID NO: 82229 - protein, 9 aa, Homo Sapiens
GSSGPLSSA

SEQ ID NO: 82230 - protein, 9 aa, Homo Sapiens
QSRKQQLPA

SEQ ID NO: 82231 - protein, 9 aa, Homo Sapiens
FQKKYDVNA

SEQ ID NO: 82232 - protein, 9 aa, Homo Sapiens
SPYLCQEFA

SEQ ID NO: 82233 - protein, 9 aa, Homo Sapiens
ESDFSKFCQ

SEQ ID NO: 82234 - protein, 9 aa, Homo Sapiens
LTATGPDVQ

SEQ ID NO: 82235 - protein, 9 aa, Homo Sapiens
ALKSDIGKY

SEQ ID NO: 82236 - protein, 9 aa, Homo Sapiens
TSAINSSPK

SEQ ID NO: 82237 - protein, 9 aa, Homo Sapiens
DQTVIVGKA

SEQ ID NO: 82238 - protein, 9 aa, Homo Sapiens
DIQKWTVDY

SEQ ID NO: 82239 - protein, 9 aa, Homo Sapiens
STGTLRLLT

SEQ ID NO: 82240 - protein, 9 aa, Homo Sapiens
TVIVEADGE

SEQ ID NO: 82241 - protein, 9 aa, Homo Sapiens
GSGAGCSSC

SEQ ID NO: 82242 - protein, 9 aa, Homo Sapiens
FERKIRAEG

SEQ ID NO: 82243 - protein, 9 aa, Homo Sapiens
NEIQPDNPN

SEQ ID NO: 82244 - protein, 9 aa, Homo Sapiens
TTKRMLTSP

SEQ ID NO: 82245 - protein, 9 aa, Homo Sapiens
HCCQIKHKK

SEQ ID NO: 82246 - protein, 9 aa, Homo Sapiens
LGCCNLICS

SEQ ID NO: 82247 - protein, 9 aa, Homo Sapiens
GVLGRMGIS

SEQ ID NO: 82248 - protein, 9 aa, Homo Sapiens
REEVLQLSS

SEQ ID NO: 82249 - protein, 9 aa, Homo Sapiens
QIKRCQEIH

SEQ ID NO: 82250 - protein, 9 aa, Homo Sapiens
DLYPDMNVI

SEQ ID NO: 82251 - protein, 9 aa, Homo Sapiens
LYDGQVKPS

SEQ ID NO: 82252 - protein, 9 aa, Homo Sapiens
CGKAFSHAE

SEQ ID NO: 82253 - protein, 9 aa, Homo Sapiens
KELYHLTEK

SEQ ID NO: 82254 - protein, 9 aa, Homo Sapiens
GMIYPQNKD

SEQ ID NO: 82255 - protein, 9 aa, Homo Sapiens
TGLTATGPD

SEQ ID NO: 82256 - protein, 9 aa, Homo Sapiens
AMINAGQLK

SEQ ID NO: 82257 - protein, 9 aa, Homo Sapiens
FLMQKYHKS

SEQ ID NO: 82258 - protein, 9 aa, Homo Sapiens
TIMPKQVTT

SEQ ID NO: 82259 - protein, 9 aa, Homo Sapiens
RKMVKVYIK

SEQ ID NO: 82260 - protein, 9 aa, Homo Sapiens
RGAEYNRNT

SEQ ID NO: 82261 - protein, 9 aa, Homo Sapiens
NKFTPGRRE

SEQ ID NO: 82262 - protein, 9 aa, Homo Sapiens
VQLYAKFGR

SEQ ID NO: 82263 - protein, 9 aa, Homo Sapiens
LNRLEIEPQ

SEQ ID NO: 82264 - protein, 9 aa, Homo Sapiens
ADFLRPPGA

SEQ ID NO: 82265 - protein, 9 aa, Homo Sapiens
KFLLPPTTI

SEQ ID NO: 82266 - protein, 9 aa, Homo Sapiens
YMPAITGCR

SEQ ID NO: 82267 - protein, 9 aa, Homo Sapiens
PRKSLEVVT

SEQ ID NO: 82268 - protein, 9 aa, Homo Sapiens
DTPCDDTTS

SEQ ID NO: 82269 - protein, 9 aa, Homo Sapiens
LFGRKELFA

SEQ ID NO: 82270 - protein, 9 aa, Homo Sapiens
IDIKNVAEL

SEQ ID NO: 82271 - protein, 9 aa, Homo Sapiens
NCDPECNHM

SEQ ID NO: 82272 - protein, 9 aa, Homo Sapiens
YEREKQLQQ

SEQ ID NO: 82273 - protein, 9 aa, Homo Sapiens
HLIKLNQKQ

SEQ ID NO: 82274 - protein, 9 aa, Homo Sapiens
LETYLDKHN

SEQ ID NO: 82275 - protein, 9 aa, Homo Sapiens
EDVVQRFGH

SEQ ID NO: 82276 - protein, 9 aa, Homo Sapiens
KFMTVDQDG

SEQ ID NO: 82277 - protein, 9 aa, Homo Sapiens
EAAKEKVFQ

SEQ ID NO: 82278 - protein, 9 aa, Homo Sapiens
VKPSPESPK

SEQ ID NO: 82279 - protein, 9 aa, Homo Sapiens
RLTENMATV

SEQ ID NO: 82280 - protein, 9 aa, Homo Sapiens
AFRQSGSLA

SEQ ID NO: 82281 - protein, 9 aa, Homo Sapiens
SSLPTRINK

SEQ ID NO: 82282 - protein, 9 aa, Homo Sapiens
FIENKINPN

SEQ ID NO: 82283 - protein, 9 aa, Homo Sapiens
DCGRAFRQS

SEQ ID NO: 82284 - protein, 9 aa, Homo Sapiens
VNAVDLWQF

SEQ ID NO: 82285 - protein, 9 aa, Homo Sapiens
ATFEDGSRE

SEQ ID NO: 82286 - protein, 9 aa, Homo Sapiens
NLYNTILSD

SEQ ID NO: 82287 - protein, 9 aa, Homo Sapiens
YKDPNQQKI

SEQ ID NO: 82288 - protein, 9 aa, Homo Sapiens
LTLPTDTNG

SEQ ID NO: 82289 - protein, 9 aa, Homo Sapiens
AQLEALELQ

SEQ ID NO: 82290 - protein, 9 aa, Homo Sapiens
FLICFVPFH

SEQ ID NO: 82291 - protein, 9 aa, Homo Sapiens
YFTELIPRP

SEQ ID NO: 82292 - protein, 9 aa, Homo Sapiens
WHFVTLLSF

SEQ ID NO: 82293 - protein, 9 aa, Homo Sapiens
KFTPGRREE

SEQ ID NO: 82294 - protein, 9 aa, Homo Sapiens
EFASACPGS

SEQ ID NO: 82295 - protein, 9 aa, Homo Sapiens
VIVEADGES

SEQ ID NO: 82296 - protein, 9 aa, Homo Sapiens
LKSHLENTF

SEQ ID NO: 82297 - protein, 9 aa, Homo Sapiens
RVTDLFNGK

SEQ ID NO: 82298 - protein, 9 aa, Homo Sapiens
PGIPYTLPP

SEQ ID NO: 82299 - protein, 9 aa, Homo Sapiens
RPRKNKKMI

SEQ ID NO: 82300 - protein, 9 aa, Homo Sapiens
LMDEKIKSQ

SEQ ID NO: 82301 - protein, 9 aa, Homo Sapiens
KRIKSENLR

SEQ ID NO: 82302 - protein, 9 aa, Homo Sapiens
DKSRSPQSP

SEQ ID NO: 82303 - protein, 9 aa, Homo Sapiens
SVHKVADGF

SEQ ID NO: 82304 - protein, 9 aa, Homo Sapiens
WELLTAEVP

SEQ ID NO: 82305 - protein, 9 aa, Homo Sapiens
WKEKFMTVD

SEQ ID NO: 82306 - protein, 9 aa, Homo Sapiens
WFPDRISCS

SEQ ID NO: 82307 - protein, 9 aa, Homo Sapiens
NVQSRKQQL

SEQ ID NO: 82308 - protein, 9 aa, Homo Sapiens
SFVLSTPAV

SEQ ID NO: 82309 - protein, 9 aa, Homo Sapiens
EKLKTYQPW

SEQ ID NO: 82310 - protein, 9 aa, Homo Sapiens
NTCATRSSS

SEQ ID NO: 82311 - protein, 9 aa, Homo Sapiens
LKKILEVVN

SEQ ID NO: 82312 - protein, 9 aa, Homo Sapiens
RKHKIIHTE

SEQ ID NO: 82313 - protein, 9 aa, Homo Sapiens
ITPQDSRWV

SEQ ID NO: 82314 - protein, 9 aa, Homo Sapiens
KNKKMIYLQ

SEQ ID NO: 82315 - protein, 9 aa, Homo Sapiens
AVSPTTNSK

SEQ ID NO: 82316 - protein, 9 aa, Homo Sapiens
TTSAATTPI

SEQ ID NO: 82317 - protein, 9 aa, Homo Sapiens
MLTSPNHTS

SEQ ID NO: 82318 - protein, 9 aa, Homo Sapiens
KQKKTQSNT

SEQ ID NO: 82319 - protein, 9 aa, Homo Sapiens
RENSCEGGS

SEQ ID NO: 82320 - protein, 9 aa, Homo Sapiens
SESHSLSRS

SEQ ID NO: 82321 - protein, 9 aa, Homo Sapiens
AEELQEKYK

SEQ ID NO: 82322 - protein, 9 aa, Homo Sapiens
MSKTNYQSF

SEQ ID NO: 82323 - protein, 9 aa, Homo Sapiens
KAQKREKPS

SEQ ID NO: 82324 - protein, 9 aa, Homo Sapiens
AFFAHCTGI

SEQ ID NO: 82325 - protein, 9 aa, Homo Sapiens
GKDPSPQAG

SEQ ID NO: 82326 - protein, 9 aa, Homo Sapiens
LELWMMGLT

SEQ ID NO: 82327 - protein, 9 aa, Homo Sapiens
RSPQSPPGK

SEQ ID NO: 82328 - protein, 9 aa, Homo Sapiens
RFGHGTEFN

SEQ ID NO: 82329 - protein, 9 aa, Homo Sapiens
KIKAEHASH

SEQ ID NO: 82330 - protein, 9 aa, Homo Sapiens
LFAGALATA

SEQ ID NO: 82331 - protein, 9 aa, Homo Sapiens
VSGLTTKQM

SEQ ID NO: 82332 - protein, 9 aa, Homo Sapiens
DLPQTHSMG

SEQ ID NO: 82333 - protein, 9 aa, Homo Sapiens
REVFERKIR

SEQ ID NO: 82334 - protein, 9 aa, Homo Sapiens
MHRIKRIKS

SEQ ID NO: 82335 - protein, 9 aa, Homo Sapiens
PSEAVTCQP

SEQ ID NO: 82336 - protein, 9 aa, Homo Sapiens
KNHDNLFTG

SEQ ID NO: 82337 - protein, 9 aa, Homo Sapiens
NRLEIEPQI

SEQ ID NO: 82338 - protein, 9 aa, Homo Sapiens
ASSYFCCAI

SEQ ID NO: 82339 - protein, 9 aa, Homo Sapiens
ERYNVGTSV

SEQ ID NO: 82340 - protein, 9 aa, Homo Sapiens
YDVNAIIHY

SEQ ID NO: 82341 - protein, 9 aa, Homo Sapiens
TVAQLLKTV

SEQ ID NO: 82342 - protein, 9 aa, Homo Sapiens
QEERQMSRE

SEQ ID NO: 82343 - protein, 9 aa, Homo Sapiens
EIFLITVMA

SEQ ID NO: 82344 - protein, 9 aa, Homo Sapiens
IHRTLGFQK

SEQ ID NO: 82345 - protein, 9 aa, Homo Sapiens
NLFTGAQNE

SEQ ID NO: 82346 - protein, 9 aa, Homo Sapiens
PTLTFNEEF

SEQ ID NO: 82347 - protein, 9 aa, Homo Sapiens
NERTTDLKQ

SEQ ID NO: 82348 - protein, 9 aa, Homo Sapiens
QKKTFDLQD

SEQ ID NO: 82349 - protein, 9 aa, Homo Sapiens
CWYFGRSFV

SEQ ID NO: 82350 - protein, 9 aa, Homo Sapiens
NEPEAEKSF

SEQ ID NO: 82351 - protein, 9 aa, Homo Sapiens
IHRNSLEGG

SEQ ID NO: 82352 - protein, 9 aa, Homo Sapiens
LKFILEDLI

SEQ ID NO: 82353 - protein, 9 aa, Homo Sapiens
VANEDKMSL

SEQ ID NO: 82354 - protein, 9 aa, Homo Sapiens
RAASSPRAP

SEQ ID NO: 82355 - protein, 9 aa, Homo Sapiens
QTMYEHLGK

SEQ ID NO: 82356 - protein, 9 aa, Homo Sapiens
LICSDKTGT

SEQ ID NO: 82357 - protein, 9 aa, Homo Sapiens
LAQRQADFL

SEQ ID NO: 82358 - protein, 9 aa, Homo Sapiens
ILPSSPYLC

SEQ ID NO: 82359 - protein, 9 aa, Homo Sapiens
QEKFLLPPT

SEQ ID NO: 82360 - protein, 9 aa, Homo Sapiens
HLMHTVPAL

SEQ ID NO: 82361 - protein, 9 aa, Homo Sapiens
HSLRNSSNV

SEQ ID NO: 82362 - protein, 9 aa, Homo Sapiens
TDKLITPFV

SEQ ID NO: 82363 - protein, 9 aa, Homo Sapiens
DLVLLKTRE

SEQ ID NO: 82364 - protein, 9 aa, Homo Sapiens
HNAAGTSRS

SEQ ID NO: 82365 - protein, 9 aa, Homo Sapiens
KGTAEELQE

SEQ ID NO: 82366 - protein, 9 aa, Homo Sapiens
GTLYPTHRT

SEQ ID NO: 82367 - protein, 9 aa, Homo Sapiens
CANLNAGGH

SEQ ID NO: 82368 - protein, 9 aa, Homo Sapiens
HPPVFKKKF

SEQ ID NO: 82369 - protein, 9 aa, Homo Sapiens
FAHCTGIKV

SEQ ID NO: 82370 - protein, 9 aa, Homo Sapiens
GSHRIFTSP

SEQ ID NO: 82371 - protein, 9 aa, Homo Sapiens
FAGALATAL

SEQ ID NO: 82372 - protein, 9 aa, Homo Sapiens
LAVTSYATS

SEQ ID NO: 82373 - protein, 9 aa, Homo Sapiens
LCSMSHVHP

SEQ ID NO: 82374 - protein, 9 aa, Homo Sapiens
EQLELFRTS

SEQ ID NO: 82375 - protein, 9 aa, Homo Sapiens
GTLRLLTPW

SEQ ID NO: 82376 - protein, 9 aa, Homo Sapiens
QFYGVTSST

SEQ ID NO: 82377 - protein, 9 aa, Homo Sapiens
CDDTTSWED

SEQ ID NO: 82378 - protein, 9 aa, Homo Sapiens
CRYMIEIFV

SEQ ID NO: 82379 - protein, 9 aa, Homo Sapiens
LSYSSLKTV

SEQ ID NO: 82380 - protein, 9 aa, Homo Sapiens
YPIYIILFC

SEQ ID NO: 82381 - protein, 9 aa, Homo Sapiens
KVLLLSIKN

SEQ ID NO: 82382 - protein, 9 aa, Homo Sapiens
ETSHPKQKK

SEQ ID NO: 82383 - protein, 9 aa, Homo Sapiens
TMMEKNELV

SEQ ID NO: 82384 - protein, 9 aa, Homo Sapiens
KTYEDLRRQ

SEQ ID NO: 82385 - protein, 9 aa, Homo Sapiens
LLFAGALAT

SEQ ID NO: 82386 - protein, 9 aa, Homo Sapiens
LYAKFGRNI

SEQ ID NO: 82387 - protein, 9 aa, Homo Sapiens
KSHLENTFK

SEQ ID NO: 82388 - protein, 9 aa, Homo Sapiens
GFVKAMINA

SEQ ID NO: 82389 - protein, 9 aa, Homo Sapiens
TLMDEKIKS

SEQ ID NO: 82390 - protein, 9 aa, Homo Sapiens
SHNAAGTSR

SEQ ID NO: 82391 - protein, 9 aa, Homo Sapiens
DKSSLNSLE

SEQ ID NO: 82392 - protein, 9 aa, Homo Sapiens
FPDRISCSP

SEQ ID NO: 82393 - protein, 9 aa, Homo Sapiens
MGLTISTRT

SEQ ID NO: 82394 - protein, 9 aa, Homo Sapiens
HVGDTLLGM

SEQ ID NO: 82395 - protein, 9 aa, Homo Sapiens
EDKMSLLKS

SEQ ID NO: 82396 - protein, 9 aa, Homo Sapiens
QQEALQPES

SEQ ID NO: 82397 - protein, 9 aa, Homo Sapiens
AVGWWKCLF

SEQ ID NO: 82398 - protein, 9 aa, Homo Sapiens
LELFRTSDL

SEQ ID NO: 82399 - protein, 9 aa, Homo Sapiens
FGKTVQALS

SEQ ID NO: 82400 - protein, 9 aa, Homo Sapiens
VQWSDNYIS

SEQ ID NO: 82401 - protein, 9 aa, Homo Sapiens
VGKAPPETR

SEQ ID NO: 82402 - protein, 9 aa, Homo Sapiens
FGLARDIYD

SEQ ID NO: 82403 - protein, 9 aa, Homo Sapiens
TQEAAKEKV

SEQ ID NO: 82404 - protein, 9 aa, Homo Sapiens
WRYKEKCYY

SEQ ID NO: 82405 - protein, 9 aa, Homo Sapiens
NYLPFGPFK

SEQ ID NO: 82406 - protein, 9 aa, Homo Sapiens
TDGDGRGNA

SEQ ID NO: 82407 - protein, 9 aa, Homo Sapiens
PSPNSVHGI

SEQ ID NO: 82408 - protein, 9 aa, Homo Sapiens
VSLEVVSKH

SEQ ID NO: 82409 - protein, 9 aa, Homo Sapiens
VTTSAATTP

SEQ ID NO: 82410 - protein, 9 aa, Homo Sapiens
RDQKKYLYR

SEQ ID NO: 82411 - protein, 9 aa, Homo Sapiens
PSKSLIAQW

SEQ ID NO: 82412 - protein, 9 aa, Homo Sapiens
AGDFEPFKE

SEQ ID NO: 82413 - protein, 9 aa, Homo Sapiens
IFTEILKQD

SEQ ID NO: 82414 - protein, 9 aa, Homo Sapiens
LHILDSRAP

SEQ ID NO: 82415 - protein, 9 aa, Homo Sapiens
TKIAEKKKV

SEQ ID NO: 82416 - protein, 9 aa, Homo Sapiens
EEEKEEEAQ

SEQ ID NO: 82417 - protein, 9 aa, Homo Sapiens
FPCEDTPCD

SEQ ID NO: 82418 - protein, 9 aa, Homo Sapiens
ELIPRPIEM

SEQ ID NO: 82419 - protein, 9 aa, Homo Sapiens
GCSSCDCPN

SEQ ID NO: 82420 - protein, 9 aa, Homo Sapiens
TSPNHTSLS

SEQ ID NO: 82421 - protein, 9 aa, Homo Sapiens
GDKSRSPQS

SEQ ID NO: 82422 - protein, 9 aa, Homo Sapiens
KRETSHPKQ

SEQ ID NO: 82423 - protein, 9 aa, Homo Sapiens
LTLGTQMTG

SEQ ID NO: 82424 - protein, 9 aa, Homo Sapiens
ALSSEQMSK

SEQ ID NO: 82425 - protein, 9 aa, Homo Sapiens
STGMTTRSE

SEQ ID NO: 82426 - protein, 9 aa, Homo Sapiens
DLENMFQYR

SEQ ID NO: 82427 - protein, 9 aa, Homo Sapiens
YLDKHNIYS

SEQ ID NO: 82428 - protein, 9 aa, Homo Sapiens
LDKQDMLKE

SEQ ID NO: 82429 - protein, 9 aa, Homo Sapiens
LNQKQDMEI

SEQ ID NO: 82430 - protein, 9 aa, Homo Sapiens
QKAQVETSP

SEQ ID NO: 82431 - protein, 9 aa, Homo Sapiens
FTGAQNEFK

SEQ ID NO: 82432 - protein, 9 aa, Homo Sapiens
LICFVPFHF

SEQ ID NO: 82433 - protein, 9 aa, Homo Sapiens
PVPCQKHSL

SEQ ID NO: 82434 - protein, 9 aa, Homo Sapiens
CVNAVDLWQ

SEQ ID NO: 82435 - protein, 9 aa, Homo Sapiens
QQGSKEEEK

SEQ ID NO: 82436 - protein, 9 aa, Homo Sapiens
LEKNHDNLF

SEQ ID NO: 82437 - protein, 9 aa, Homo Sapiens
VILTISWFL

SEQ ID NO: 82438 - protein, 9 aa, Homo Sapiens
WSDNYISVL

SEQ ID NO: 82439 - protein, 9 aa, Homo Sapiens
RGPFPLPQL

SEQ ID NO: 82440 - protein, 9 aa, Homo Sapiens
STMHKDVSK

SEQ ID NO: 82441 - protein, 9 aa, Homo Sapiens
DAKEIQDAI

SEQ ID NO: 82442 - protein, 9 aa, Homo Sapiens
LLKKVPTNY

SEQ ID NO: 82443 - protein, 9 aa, Homo Sapiens
TSTYSNSVA

SEQ ID NO: 82444 - protein, 9 aa, Homo Sapiens
VGWWKCLFT

SEQ ID NO: 82445 - protein, 9 aa, Homo Sapiens
QPESGRKRI

SEQ ID NO: 82446 - protein, 9 aa, Homo Sapiens
VVNIITSQS

SEQ ID NO: 82447 - protein, 9 aa, Homo Sapiens
ILKQDKGSD

SEQ ID NO: 82448 - protein, 9 aa, Homo Sapiens
PVREPLAGT

SEQ ID NO: 82449 - protein, 9 aa, Homo Sapiens
FVTLLSFTC

SEQ ID NO: 82450 - protein, 9 aa, Homo Sapiens
PSSPYLCQE

SEQ ID NO: 82451 - protein, 9 aa, Homo Sapiens
KKETLGRYG

SEQ ID NO: 82452 - protein, 9 aa, Homo Sapiens
YVFLMQKYH

SEQ ID NO: 82453 - protein, 9 aa, Homo Sapiens
HLTNVTFPT

SEQ ID NO: 82454 - protein, 9 aa, Homo Sapiens
GDVANEDKM

SEQ ID NO: 82455 - protein, 9 aa, Homo Sapiens
NSKEAITAL

SEQ ID NO: 82456 - protein, 9 aa, Homo Sapiens
PEAEKSFIC

SEQ ID NO: 82457 - protein, 9 aa, Homo Sapiens
FVKAMINAG

SEQ ID NO: 82458 - protein, 9 aa, Homo Sapiens
KSENLRIQN

SEQ ID NO: 82459 - protein, 9 aa, Homo Sapiens
MMVSFNFLH

SEQ ID NO: 82460 - protein, 9 aa, Homo Sapiens
PARENSCEG

SEQ ID NO: 82461 - protein, 9 aa, Homo Sapiens
TSHLPQELP

SEQ ID NO: 82462 - protein, 9 aa, Homo Sapiens
FRTSDLSSS

SEQ ID NO: 82463 - protein, 9 aa, Homo Sapiens
VCYMMVSFN

SEQ ID NO: 82464 - protein, 9 aa, Homo Sapiens
ALEDVVQRF

SEQ ID NO: 82465 - protein, 9 aa, Homo Sapiens
PSTGMTTRS

SEQ ID NO: 82466 - protein, 9 aa, Homo Sapiens
KVFQSVPAG

SEQ ID NO: 82467 - protein, 9 aa, Homo Sapiens
RNINLEADE

SEQ ID NO: 82468 - protein, 9 aa, Homo Sapiens
NKKMIYLQV

SEQ ID NO: 82469 - protein, 9 aa, Homo Sapiens
EVKHVGDTL

SEQ ID NO: 82470 - protein, 9 aa, Homo Sapiens
TFHLMHTVP

SEQ ID NO: 82471 - protein, 9 aa, Homo Sapiens
LTQPFYFLF

SEQ ID NO: 82472 - protein, 9 aa, Homo Sapiens
PTTKASLLS

SEQ ID NO: 82473 - protein, 9 aa, Homo Sapiens
LSIKNPLYP

SEQ ID NO: 82474 - protein, 9 aa, Homo Sapiens
LPTRINKMN

SEQ ID NO: 82475 - protein, 9 aa, Homo Sapiens
MDRKDAATI

SEQ ID NO: 82476 - protein, 9 aa, Homo Sapiens
HLTEKGNQS

SEQ ID NO: 82477 - protein, 9 aa, Homo Sapiens
RQKKTFDLQ

SEQ ID NO: 82478 - protein, 9 aa, Homo Sapiens
VFGKTVQAL

SEQ ID NO: 82479 - protein, 9 aa, Homo Sapiens
DPEIILQVL

SEQ ID NO: 82480 - protein, 9 aa, Homo Sapiens
IDPFYVDQY

SEQ ID NO: 82481 - protein, 9 aa, Homo Sapiens
TAATFEDGS

SEQ ID NO: 82482 - protein, 9 aa, Homo Sapiens
PQFSANPVL

SEQ ID NO: 82483 - protein, 9 aa, Homo Sapiens
STPAVMWHF

SEQ ID NO: 82484 - protein, 9 aa, Homo Sapiens
VGSQGSRLK

SEQ ID NO: 82485 - protein, 9 aa, Homo Sapiens
NLVPDSMTA

SEQ ID NO: 82486 - protein, 9 aa, Homo Sapiens
LTISWFLAA

SEQ ID NO: 82487 - protein, 9 aa, Homo Sapiens
DKVINENTR

SEQ ID NO: 82488 - protein, 9 aa, Homo Sapiens
NSVHGIYCS

SEQ ID NO: 82489 - protein, 9 aa, Homo Sapiens
FPVAFLETY

SEQ ID NO: 82490 - protein, 9 aa, Homo Sapiens
DRKDAATIK

SEQ ID NO: 82491 - protein, 9 aa, Homo Sapiens
TLTFNEEFK

SEQ ID NO: 82492 - protein, 9 aa, Homo Sapiens
ERKIRAEGL

SEQ ID NO: 82493 - protein, 9 aa, Homo Sapiens
EAQEEAQGV

SEQ ID NO: 82494 - protein, 9 aa, Homo Sapiens
KIKEFNETS

SEQ ID NO: 82495 - protein, 9 aa, Homo Sapiens
EEGNMLGYK

SEQ ID NO: 82496 - protein, 9 aa, Homo Sapiens
TPAVMWHFV

SEQ ID NO: 82497 - protein, 9 aa, Homo Sapiens
EAMCANLNA

SEQ ID NO: 82498 - protein, 9 aa, Homo Sapiens
TLGTQMTGL

SEQ ID NO: 82499 - protein, 9 aa, Homo Sapiens
PTTKRMLTS

SEQ ID NO: 82500 - protein, 9 aa, Homo Sapiens
YLERKHLDL

SEQ ID NO: 82501 - protein, 9 aa, Homo Sapiens
DMNVITGIL

SEQ ID NO: 82502 - protein, 9 aa, Homo Sapiens
GSQGSRLKK

SEQ ID NO: 82503 - protein, 9 aa, Homo Sapiens
DIEKEDIDS

SEQ ID NO: 82504 - protein, 9 aa, Homo Sapiens
LEQFMEYQG

SEQ ID NO: 82505 - protein, 9 aa, Homo Sapiens
VQEERQMSR

SEQ ID NO: 82506 - protein, 9 aa, Homo Sapiens
EADGESLSI

SEQ ID NO: 82507 - protein, 9 aa, Homo Sapiens
GRLREQEME

SEQ ID NO: 82508 - protein, 9 aa, Homo Sapiens
NHPPVFKKK

SEQ ID NO: 82509 - protein, 9 aa, Homo Sapiens
ANEDKMSLL

SEQ ID NO: 82510 - protein, 9 aa, Homo Sapiens
ISTCLKEAN

SEQ ID NO: 82511 - protein, 9 aa, Homo Sapiens
IKRIKSENL

SEQ ID NO: 82512 - protein, 9 aa, Homo Sapiens
FTETAATFE

SEQ ID NO: 82513 - protein, 9 aa, Homo Sapiens
NGRNNMIQQ

SEQ ID NO: 82514 - protein, 9 aa, Homo Sapiens
LPTDTNGNH

SEQ ID NO: 82515 - protein, 9 aa, Homo Sapiens
PCFWETQPL

SEQ ID NO: 82516 - protein, 9 aa, Homo Sapiens
DVANEDKMS

SEQ ID NO: 82517 - protein, 9 aa, Homo Sapiens
NQNFIILSL

SEQ ID NO: 82518 - protein, 9 aa, Homo Sapiens
LKDQTVIVG

SEQ ID NO: 82519 - protein, 9 aa, Homo Sapiens
FCSVSNESN

SEQ ID NO: 82520 - protein, 9 aa, Homo Sapiens
TDDGEAFGN

SEQ ID NO: 82521 - protein, 9 aa, Homo Sapiens
RQMNMENLF

SEQ ID NO: 82522 - protein, 9 aa, Homo Sapiens
CFTLIVGEL

SEQ ID NO: 82523 - protein, 9 aa, Homo Sapiens
PFPLPQLRL

SEQ ID NO: 82524 - protein, 9 aa, Homo Sapiens
VLGCTAPFG

SEQ ID NO: 82525 - protein, 9 aa, Homo Sapiens
LVPDSMTAT

SEQ ID NO: 82526 - protein, 9 aa, Homo Sapiens
NQGTVERGP

SEQ ID NO: 82527 - protein, 9 aa, Homo Sapiens
EALQPESGR

SEQ ID NO: 82528 - protein, 9 aa, Homo Sapiens
RYMIEIFVH

SEQ ID NO: 82529 - protein, 9 aa, Homo Sapiens
QKHSLRNSS

SEQ ID NO: 82530 - protein, 9 aa, Homo Sapiens
VVSQPIDLI

SEQ ID NO: 82531 - protein, 9 aa, Homo Sapiens
MKSSLNGEN

SEQ ID NO: 82532 - protein, 9 aa, Homo Sapiens
DVAENLNIK

SEQ ID NO: 82533 - protein, 9 aa, Homo Sapiens
HRTVLISKK

SEQ ID NO: 82534 - protein, 9 aa, Homo Sapiens
PPASRSENQ

SEQ ID NO: 82535 - protein, 9 aa, Homo Sapiens
LFNGKKPIE

SEQ ID NO: 82536 - protein, 9 aa, Homo Sapiens
GQVKPSPES

SEQ ID NO: 82537 - protein, 9 aa, Homo Sapiens
HLENTFKCN

SEQ ID NO: 82538 - protein, 9 aa, Homo Sapiens
LPSSPYLCQ

SEQ ID NO: 82539 - protein, 9 aa, Homo Sapiens
TKFLNDRWM

SEQ ID NO: 82540 - protein, 9 aa, Homo Sapiens
RITPQDSRW

SEQ ID NO: 82541 - protein, 9 aa, Homo Sapiens
EEKFDGVLR

SEQ ID NO: 82542 - protein, 9 aa, Homo Sapiens
FDKNDIPRT

SEQ ID NO: 82543 - protein, 9 aa, Homo Sapiens
EGDSETDRC

SEQ ID NO: 82544 - protein, 9 aa, Homo Sapiens
IKSENLRIQ

SEQ ID NO: 82545 - protein, 9 aa, Homo Sapiens
TEKLKKILE

SEQ ID NO: 82546 - protein, 9 aa, Homo Sapiens
DYYMPAITG

SEQ ID NO: 82547 - protein, 9 aa, Homo Sapiens
HRYQNPWQA

SEQ ID NO: 82548 - protein, 9 aa, Homo Sapiens
HRTLGFQKL

SEQ ID NO: 82549 - protein, 9 aa, Homo Sapiens
PVYAEVKHV

SEQ ID NO: 82550 - protein, 9 aa, Homo Sapiens
IIAVFLICF

SEQ ID NO: 82551 - protein, 9 aa, Homo Sapiens
KSSLNGENF

SEQ ID NO: 82552 - protein, 9 aa, Homo Sapiens
RLQQHMQQH

SEQ ID NO: 82553 - protein, 9 aa, Homo Sapiens
TYHNLVPDS

SEQ ID NO: 82554 - protein, 9 aa, Homo Sapiens
FFKCTICNN

SEQ ID NO: 82555 - protein, 9 aa, Homo Sapiens
RPRANTCAT

SEQ ID NO: 82556 - protein, 9 aa, Homo Sapiens
EKEEEAQEE

SEQ ID NO: 82557 - protein, 9 aa, Homo Sapiens
LEEKPYLFS

SEQ ID NO: 82558 - protein, 9 aa, Homo Sapiens
LTISTRTWP

SEQ ID NO: 82559 - protein, 9 aa, Homo Sapiens
LSELQPSPN

SEQ ID NO: 82560 - protein, 9 aa, Homo Sapiens
CEDTPCDDT

SEQ ID NO: 82561 - protein, 9 aa, Homo Sapiens
EDLIDPFYV

SEQ ID NO: 82562 - protein, 9 aa, Homo Sapiens
SCPSCTAVL

SEQ ID NO: 82563 - protein, 9 aa, Homo Sapiens
YVLDNPEMR

SEQ ID NO: 82564 - protein, 9 aa, Homo Sapiens
LKQINYSKA

SEQ ID NO: 82565 - protein, 9 aa, Homo Sapiens
ADVCQIFIE

SEQ ID NO: 82566 - protein, 9 aa, Homo Sapiens
SSCSYTSGP

SEQ ID NO: 82567 - protein, 9 aa, Homo Sapiens
AEYNRNTWV

SEQ ID NO: 82568 - protein, 9 aa, Homo Sapiens
FSKFCQSYS

SEQ ID NO: 82569 - protein, 9 aa, Homo Sapiens
MASILKGYK

SEQ ID NO: 82570 - protein, 9 aa, Homo Sapiens
VASKVQSEE

SEQ ID NO: 82571 - protein, 9 aa, Homo Sapiens
KKYSSCARE

SEQ ID NO: 82572 - protein, 9 aa, Homo Sapiens
LCQEFASAC

SEQ ID NO: 82573 - protein, 9 aa, Homo Sapiens
HPKQKKTQS

SEQ ID NO: 82574 - protein, 9 aa, Homo Sapiens
SILPSSPYL

SEQ ID NO: 82575 - protein, 9 aa, Homo Sapiens
LNSLEALMK

SEQ ID NO: 82576 - protein, 9 aa, Homo Sapiens
SVLYDGQVK

SEQ ID NO: 82577 - protein, 9 aa, Homo Sapiens
VIVKKAQEE

SEQ ID NO: 82578 - protein, 9 aa, Homo Sapiens
EFALRDQKK

SEQ ID NO: 82579 - protein, 9 aa, Homo Sapiens
VRVLDKRKA

SEQ ID NO: 82580 - protein, 9 aa, Homo Sapiens
LNDRWMLQK

SEQ ID NO: 82581 - protein, 9 aa, Homo Sapiens
PTKIYEKTE

SEQ ID NO: 82582 - protein, 9 aa, Homo Sapiens
QSGLGRHVG

SEQ ID NO: 82583 - protein, 9 aa, Homo Sapiens
RQREGRLRE

SEQ ID NO: 82584 - protein, 9 aa, Homo Sapiens
LVQGGGLAV

SEQ ID NO: 82585 - protein, 9 aa, Homo Sapiens
ESVIEKPYQ

SEQ ID NO: 82586 - protein, 9 aa, Homo Sapiens
IYDKEYYSV

SEQ ID NO: 82587 - protein, 9 aa, Homo Sapiens
FLLPPTTIS

SEQ ID NO: 82588 - protein, 9 aa, Homo Sapiens
SRKLNPSHN

SEQ ID NO: 82589 - protein, 9 aa, Homo Sapiens
EQDTEKLKK

SEQ ID NO: 82590 - protein, 9 aa, Homo Sapiens
RKLNPSHNA

SEQ ID NO: 82591 - protein, 9 aa, Homo Sapiens
CLLGTLYPT

SEQ ID NO: 82592 - protein, 9 aa, Homo Sapiens
KVLPLELWM

SEQ ID NO: 82593 - protein, 9 aa, Homo Sapiens
GDSVHKVAD

SEQ ID NO: 82594 - protein, 9 aa, Homo Sapiens
DSTDLDVPS

SEQ ID NO: 82595 - protein, 9 aa, Homo Sapiens
VFFFKCTIC

SEQ ID NO: 82596 - protein, 9 aa, Homo Sapiens
LNLEEKFDG

SEQ ID NO: 82597 - protein, 9 aa, Homo Sapiens
FDVSGLTTK

SEQ ID NO: 82598 - protein, 9 aa, Homo Sapiens
DQDEEGKIQ

SEQ ID NO: 82599 - protein, 9 aa, Homo Sapiens
YHIQACTTT

SEQ ID NO: 82600 - protein, 9 aa, Homo Sapiens
VERGPFPLP

SEQ ID NO: 82601 - protein, 9 aa, Homo Sapiens
FASACPGSC

SEQ ID NO: 82602 - protein, 9 aa, Homo Sapiens
FLVVILSIV

SEQ ID NO: 82603 - protein, 9 aa, Homo Sapiens
VLYDGQVKP

SEQ ID NO: 82604 - protein, 9 aa, Homo Sapiens
GPVDISTCL

SEQ ID NO: 82605 - protein, 9 aa, Homo Sapiens
RRKNLEGLD

SEQ ID NO: 82606 - protein, 9 aa, Homo Sapiens
FLRPPGAAE

SEQ ID NO: 82607 - protein, 9 aa, Homo Sapiens
KWKEAILEE

SEQ ID NO: 82608 - protein, 9 aa, Homo Sapiens
VRLTPTGHK

SEQ ID NO: 82609 - protein, 9 aa, Homo Sapiens
TLLSFTCAS

SEQ ID NO: 82610 - protein, 9 aa, Homo Sapiens
EMQQNCSIP

SEQ ID NO: 82611 - protein, 9 aa, Homo Sapiens
LETVFSHSV

SEQ ID NO: 82612 - protein, 9 aa, Homo Sapiens
RDLVLLKTR

SEQ ID NO: 82613 - protein, 9 aa, Homo Sapiens
LPCLLGTLY

SEQ ID NO: 82614 - protein, 9 aa, Homo Sapiens
IAEKKKVRK

SEQ ID NO: 82615 - protein, 9 aa, Homo Sapiens
LERQMNMEN

SEQ ID NO: 82616 - protein, 9 aa, Homo Sapiens
PLSTREKQI

SEQ ID NO: 82617 - protein, 9 aa, Homo Sapiens
GIWRYKEKC

SEQ ID NO: 82618 - protein, 9 aa, Homo Sapiens
QWILDKQDM

SEQ ID NO: 82619 - protein, 9 aa, Homo Sapiens
PWLNYLPFG

SEQ ID NO: 82620 - protein, 9 aa, Homo Sapiens
KFDGVLREE

SEQ ID NO: 82621 - protein, 9 aa, Homo Sapiens
KGQVGNSEA

SEQ ID NO: 82622 - protein, 9 aa, Homo Sapiens
RRHAIHRNS

SEQ ID NO: 82623 - protein, 9 aa, Homo Sapiens
LVKELQNKF

SEQ ID NO: 82624 - protein, 9 aa, Homo Sapiens
DDGTVIVEA

SEQ ID NO: 82625 - protein, 9 aa, Homo Sapiens
VYIKTDGLV

SEQ ID NO: 82626 - protein, 9 aa, Homo Sapiens
ALRGQLEKS

SEQ ID NO: 82627 - protein, 9 aa, Homo Sapiens
MINAGQLKN

SEQ ID NO: 82628 - protein, 9 aa, Homo Sapiens
EQMSKTNYQ

SEQ ID NO: 82629 - protein, 9 aa, Homo Sapiens
KIPARENSC

SEQ ID NO: 82630 - protein, 9 aa, Homo Sapiens
LSTREKQIL

SEQ ID NO: 82631 - protein, 9 aa, Homo Sapiens
ILEAISHNS

SEQ ID NO: 82632 - protein, 9 aa, Homo Sapiens
RHAIHRNSL

SEQ ID NO: 82633 - protein, 9 aa, Homo Sapiens
FTLIVGELK

SEQ ID NO: 82634 - protein, 9 aa, Homo Sapiens
VEADGESLS

SEQ ID NO: 82635 - protein, 9 aa, Homo Sapiens
ENSKNQNKS

SEQ ID NO: 82636 - protein, 9 aa, Homo Sapiens
EDSEGDSET

SEQ ID NO: 82637 - protein, 9 aa, Homo Sapiens
KWTVDYVHS

SEQ ID NO: 82638 - protein, 9 aa, Homo Sapiens
KKKRIGRPP

SEQ ID NO: 82639 - protein, 9 aa, Homo Sapiens
HTRENEQAL

SEQ ID NO: 82640 - protein, 9 aa, Homo Sapiens
LPLLKKVPT

SEQ ID NO: 82641 - protein, 9 aa, Homo Sapiens
RLIHRTLGF

SEQ ID NO: 82642 - protein, 9 aa, Homo Sapiens
LVLQTQPLF

SEQ ID NO: 82643 - protein, 9 aa, Homo Sapiens
REVVRAEIM

SEQ ID NO: 82644 - protein, 9 aa, Homo Sapiens
GLSYSSLKT

SEQ ID NO: 82645 - protein, 9 aa, Homo Sapiens
LFSLLFAGA

SEQ ID NO: 82646 - protein, 9 aa, Homo Sapiens
LLCSMSHVH

SEQ ID NO: 82647 - protein, 9 aa, Homo Sapiens
ECNHMLTGH

SEQ ID NO: 82648 - protein, 9 aa, Homo Sapiens
PEETILTFS

SEQ ID NO: 82649 - protein, 9 aa, Homo Sapiens
THGDSVHKV

SEQ ID NO: 82650 - protein, 9 aa, Homo Sapiens
YYSNVIANL

SEQ ID NO: 82651 - protein, 9 aa, Homo Sapiens
AMPYSHSLA

SEQ ID NO: 82652 - protein, 9 aa, Homo Sapiens
ETILTFSEV

SEQ ID NO: 82653 - protein, 9 aa, Homo Sapiens
HAMPYSHSL

SEQ ID NO: 82654 - protein, 9 aa, Homo Sapiens
SELQPSPNS

SEQ ID NO: 82655 - protein, 9 aa, Homo Sapiens
TGMIYPQNK

SEQ ID NO: 82656 - protein, 9 aa, Homo Sapiens
GLARDIYDK

SEQ ID NO: 82657 - protein, 9 aa, Homo Sapiens
LILKKLLKR

SEQ ID NO: 82658 - protein, 9 aa, Homo Sapiens
SHLENTFKC

SEQ ID NO: 82659 - protein, 9 aa, Homo Sapiens
GDFSTSTYS

SEQ ID NO: 82660 - protein, 9 aa, Homo Sapiens
IKNVAELLV

SEQ ID NO: 82661 - protein, 9 aa, Homo Sapiens
KDYQPKYFL

SEQ ID NO: 82662 - protein, 9 aa, Homo Sapiens
KADEVLHSF

SEQ ID NO: 82663 - protein, 9 aa, Homo Sapiens
HNLVPDSMT

SEQ ID NO: 82664 - protein, 9 aa, Homo Sapiens
TSLVPVLGC

SEQ ID NO: 82665 - protein, 9 aa, Homo Sapiens
PKQKKTQSN

SEQ ID NO: 82666 - protein, 9 aa, Homo Sapiens
DIGKYTCDC

SEQ ID NO: 82667 - protein, 9 aa, Homo Sapiens
SCSYTSGPG

SEQ ID NO: 82668 - protein, 9 aa, Homo Sapiens
SFICKTGES

SEQ ID NO: 82669 - protein, 9 aa, Homo Sapiens
IAPSYLERK

SEQ ID NO: 82670 - protein, 9 aa, Homo Sapiens
RHTIKRQQG

SEQ ID NO: 82671 - protein, 9 aa, Homo Sapiens
KGVLGRMGI

SEQ ID NO: 82672 - protein, 9 aa, Homo Sapiens
HRIFTSPLN

SEQ ID NO: 82673 - protein, 9 aa, Homo Sapiens
GIPYTLPPG

SEQ ID NO: 82674 - protein, 9 aa, Homo Sapiens
CSMSHVHPN

SEQ ID NO: 82675 - protein, 9 aa, Homo Sapiens
PGQRYKGQV

SEQ ID NO: 82676 - protein, 9 aa, Homo Sapiens
QPNKSDATI

SEQ ID NO: 82677 - protein, 9 aa, Homo Sapiens
DPECNHMLT

SEQ ID NO: 82678 - protein, 9 aa, Homo Sapiens
EVKNLYNTI

SEQ ID NO: 82679 - protein, 9 aa, Homo Sapiens
NAVDLWQFT

SEQ ID NO: 82680 - protein, 9 aa, Homo Sapiens
KCLFTLKEE

SEQ ID NO: 82681 - protein, 9 aa, Homo Sapiens
QKKYDVNAI

SEQ ID NO: 82682 - protein, 9 aa, Homo Sapiens
EFTETAATF

SEQ ID NO: 82683 - protein, 9 aa, Homo Sapiens
GNMLGYKFK

SEQ ID NO: 82684 - protein, 9 aa, Homo Sapiens
LSHSLETVF

SEQ ID NO: 82685 - protein, 9 aa, Homo Sapiens
VTSFPGIPY

SEQ ID NO: 82686 - protein, 9 aa, Homo Sapiens
KEEEKEEEA

SEQ ID NO: 82687 - protein, 9 aa, Homo Sapiens
LCTDGNEIQ

SEQ ID NO: 82688 - protein, 9 aa, Homo Sapiens
YHANVPERY

SEQ ID NO: 82689 - protein, 9 aa, Homo Sapiens
FIYEEKGLI

SEQ ID NO: 82690 - protein, 9 aa, Homo Sapiens
KTTKNELSA

SEQ ID NO: 82691 - protein, 9 aa, Homo Sapiens
GKTTTILRC

SEQ ID NO: 82692 - protein, 9 aa, Homo Sapiens
QGSKEEEKE

SEQ ID NO: 82693 - protein, 9 aa, Homo Sapiens
HLPLSTREK

SEQ ID NO: 82694 - protein, 9 aa, Homo Sapiens
LRAASSPRA

SEQ ID NO: 82695 - protein, 9 aa, Homo Sapiens
TGPDVQEKF

SEQ ID NO: 82696 - protein, 9 aa, Homo Sapiens
VIEKPYQKS

SEQ ID NO: 82697 - protein, 9 aa, Homo Sapiens
ERGPFPLPQ

SEQ ID NO: 82698 - protein, 9 aa, Homo Sapiens
LPTKIYEKT

SEQ ID NO: 82699 - protein, 9 aa, Homo Sapiens
GTHTRENEQ

SEQ ID NO: 82700 - protein, 9 aa, Homo Sapiens
IKTDGLVAV

SEQ ID NO: 82701 - protein, 9 aa, Homo Sapiens
EDLYPDMNV

SEQ ID NO: 82702 - protein, 9 aa, Homo Sapiens
GGLAVLSER

SEQ ID NO: 82703 - protein, 9 aa, Homo Sapiens
RYNVGTSVI

SEQ ID NO: 82704 - protein, 9 aa, Homo Sapiens
GNEIQPDNP

SEQ ID NO: 82705 - protein, 9 aa, Homo Sapiens
TAYKNYYYS

SEQ ID NO: 82706 - protein, 9 aa, Homo Sapiens
KKKVRKNWL

SEQ ID NO: 82707 - protein, 9 aa, Homo Sapiens
MEYQGASSP

SEQ ID NO: 82708 - protein, 9 aa, Homo Sapiens
PQDSRWVGA

SEQ ID NO: 82709 - protein, 9 aa, Homo Sapiens
LRDYPPASR

SEQ ID NO: 82710 - protein, 9 aa, Homo Sapiens
RSESDFSKF

SEQ ID NO: 82711 - protein, 9 aa, Homo Sapiens
LKIKEFNET

SEQ ID NO: 82712 - protein, 9 aa, Homo Sapiens
HSLSRSKSR

SEQ ID NO: 82713 - protein, 9 aa, Homo Sapiens
TLTLRAASS

SEQ ID NO: 82714 - protein, 9 aa, Homo Sapiens
VFERKIRAE

SEQ ID NO: 82715 - protein, 9 aa, Homo Sapiens
YPLILKKLL

SEQ ID NO: 82716 - protein, 9 aa, Homo Sapiens
PPIVASKVQ

SEQ ID NO: 82717 - protein, 9 aa, Homo Sapiens
WSILPSSPY

SEQ ID NO: 82718 - protein, 9 aa, Homo Sapiens
LDVPSEAVT

SEQ ID NO: 82719 - protein, 9 aa, Homo Sapiens
QNKFTPGRR

SEQ ID NO: 82720 - protein, 9 aa, Homo Sapiens
STSEDEPES

SEQ ID NO: 82721 - protein, 9 aa, Homo Sapiens
DLDVPSEAV

SEQ ID NO: 82722 - protein, 9 aa, Homo Sapiens
SLVPVLGCT

SEQ ID NO: 82723 - protein, 9 aa, Homo Sapiens
LDNKLLSLK

SEQ ID NO: 82724 - protein, 9 aa, Homo Sapiens
EIHNKLLSR

SEQ ID NO: 82725 - protein, 9 aa, Homo Sapiens
DVSGLTTKQ

SEQ ID NO: 82726 - protein, 9 aa, Homo Sapiens
QKTYVLNPL

SEQ ID NO: 82727 - protein, 9 aa, Homo Sapiens
TIIRPLESY

SEQ ID NO: 82728 - protein, 9 aa, Homo Sapiens
EIANYPIYI

SEQ ID NO: 82729 - protein, 9 aa, Homo Sapiens
LTFSEVQGM

SEQ ID NO: 82730 - protein, 9 aa, Homo Sapiens
HKDVSKTSL

SEQ ID NO: 82731 - protein, 9 aa, Homo Sapiens
KKDFSCKGA

SEQ ID NO: 82732 - protein, 9 aa, Homo Sapiens
TEIFLITVM

SEQ ID NO: 82733 - protein, 9 aa, Homo Sapiens
TQPFYFLFF

SEQ ID NO: 82734 - protein, 9 aa, Homo Sapiens
KKYDVNAII

SEQ ID NO: 82735 - protein, 9 aa, Homo Sapiens
QEIHNKLLS

SEQ ID NO: 82736 - protein, 9 aa, Homo Sapiens
EAFGNKWCS

SEQ ID NO: 82737 - protein, 9 aa, Homo Sapiens
TLIVGELKK

SEQ ID NO: 82738 - protein, 9 aa, Homo Sapiens
VDSLLCSMS

SEQ ID NO: 82739 - protein, 9 aa, Homo Sapiens
REQLELFRT

SEQ ID NO: 82740 - protein, 9 aa, Homo Sapiens
LGSSGPLSS

SEQ ID NO: 82741 - protein, 9 aa, Homo Sapiens
VIHLPLLNQ

SEQ ID NO: 82742 - protein, 9 aa, Homo Sapiens
TSDLSSSTS

SEQ ID NO: 82743 - protein, 9 aa, Homo Sapiens
SPGRMPNLK

SEQ ID NO: 82744 - protein, 9 aa, Homo Sapiens
DFLRPPGAA

SEQ ID NO: 82745 - protein, 9 aa, Homo Sapiens
WDLRTFHLM

SEQ ID NO: 82746 - protein, 9 aa, Homo Sapiens
IKAVGKKLH

SEQ ID NO: 82747 - protein, 9 aa, Homo Sapiens
VKADEVLHS

SEQ ID NO: 82748 - protein, 9 aa, Homo Sapiens
SLNSLEALM

SEQ ID NO: 82749 - protein, 9 aa, Homo Sapiens
PDPSKSLIA

SEQ ID NO: 82750 - protein, 9 aa, Homo Sapiens
REGVSPRKS

SEQ ID NO: 82751 - protein, 9 aa, Homo Sapiens
CSIPCFWET

SEQ ID NO: 82752 - protein, 9 aa, Homo Sapiens
DIFVSTSED

SEQ ID NO: 82753 - protein, 9 aa, Homo Sapiens
KDVSKTSLK

SEQ ID NO: 82754 - protein, 9 aa, Homo Sapiens
LKGYKTYLR

SEQ ID NO: 82755 - protein, 9 aa, Homo Sapiens
STREKQILS

SEQ ID NO: 82756 - protein, 9 aa, Homo Sapiens
LPTYHNLVP

SEQ ID NO: 82757 - protein, 9 aa, Homo Sapiens
CEEETRIQF

SEQ ID NO: 82758 - protein, 9 aa, Homo Sapiens
PLPTYHNLV

SEQ ID NO: 82759 - protein, 9 aa, Homo Sapiens
CQKHSLRNS

SEQ ID NO: 82760 - protein, 9 aa, Homo Sapiens
IVGKAPPET

SEQ ID NO: 82761 - protein, 9 aa, Homo Sapiens
CIYAKVTYM

SEQ ID NO: 82762 - protein, 9 aa, Homo Sapiens
NLLTRLLKR

SEQ ID NO: 82763 - protein, 9 aa, Homo Sapiens
PLLKKVPTN

SEQ ID NO: 82764 - protein, 9 aa, Homo Sapiens
YKRYASSYF

SEQ ID NO: 82765 - protein, 9 aa, Homo Sapiens
SSTSSSGHK

SEQ ID NO: 82766 - protein, 9 aa, Homo Sapiens
MGNIYLKQI

SEQ ID NO: 82767 - protein, 9 aa, Homo Sapiens
SLNGENFRT

SEQ ID NO: 82768 - protein, 9 aa, Homo Sapiens
IKIQQKLKM

SEQ ID NO: 82769 - protein, 9 aa, Homo Sapiens
LMKSSLNGE

SEQ ID NO: 82770 - protein, 9 aa, Homo Sapiens
KGYKTYLRP

SEQ ID NO: 82771 - protein, 9 aa, Homo Sapiens
GENFRTQKL

SEQ ID NO: 82772 - protein, 9 aa, Homo Sapiens
PQSPPGKPQ

SEQ ID NO: 82773 - protein, 9 aa, Homo Sapiens
PGQKINQQE

SEQ ID NO: 82774 - protein, 9 aa, Homo Sapiens
NWSKILLHF

SEQ ID NO: 82775 - protein, 9 aa, Homo Sapiens
KAVGKKLHE

SEQ ID NO: 82776 - protein, 9 aa, Homo Sapiens
LLSIKNPLY

SEQ ID NO: 82777 - protein, 9 aa, Homo Sapiens
EALELQKTY

SEQ ID NO: 82778 - protein, 9 aa, Homo Sapiens
MDEKIKSQS

SEQ ID NO: 82779 - protein, 9 aa, Homo Sapiens
EQPSRSEFS

SEQ ID NO: 82780 - protein, 9 aa, Homo Sapiens
IILGFTIDS

SEQ ID NO: 82781 - protein, 9 aa, Homo Sapiens
LEEGNMLGY

SEQ ID NO: 82782 - protein, 9 aa, Homo Sapiens
CKGAEDNMV

SEQ ID NO: 82783 - protein, 9 aa, Homo Sapiens
TGCREAIKR

SEQ ID NO: 82784 - protein, 9 aa, Homo Sapiens
SDFSKFCQS

SEQ ID NO: 82785 - protein, 9 aa, Homo Sapiens
TKKRKSLGL

SEQ ID NO: 82786 - protein, 9 aa, Homo Sapiens
DKMSLLKSV

SEQ ID NO: 82787 - protein, 9 aa, Homo Sapiens
DSQSPLQIS

SEQ ID NO: 82788 - protein, 9 aa, Homo Sapiens
DILVYGSMV

SEQ ID NO: 82789 - protein, 9 aa, Homo Sapiens
KIQQEYIIS

SEQ ID NO: 82790 - protein, 9 aa, Homo Sapiens
KALKSDIGK

SEQ ID NO: 82791 - protein, 9 aa, Homo Sapiens
SEAVTCQPQ

SEQ ID NO: 82792 - protein, 9 aa, Homo Sapiens
VLSTPAVMW

SEQ ID NO: 82793 - protein, 9 aa, Homo Sapiens
MQQNCSIPC

SEQ ID NO: 82794 - protein, 9 aa, Homo Sapiens
LYKDPNQQK

SEQ ID NO: 82795 - protein, 9 aa, Homo Sapiens
SFKKETLGR

SEQ ID NO: 82796 - protein, 9 aa, Homo Sapiens
QQPPSVIRR

SEQ ID NO: 82797 - protein, 9 aa, Homo Sapiens
EVFERKIRA

SEQ ID NO: 82798 - protein, 9 aa, Homo Sapiens
PVFKKKFYI

SEQ ID NO: 82799 - protein, 9 aa, Homo Sapiens
AMCANLNAG

SEQ ID NO: 82800 - protein, 9 aa, Homo Sapiens
AQFYGVTSS

SEQ ID NO: 82801 - protein, 9 aa, Homo Sapiens
CCNLICSDK

SEQ ID NO: 82802 - protein, 9 aa, Homo Sapiens
NYYYSEPGR

SEQ ID NO: 82803 - protein, 9 aa, Homo Sapiens
KLVGINFYD

SEQ ID NO: 82804 - protein, 9 aa, Homo Sapiens
QNFIILSLE

SEQ ID NO: 82805 - protein, 9 aa, Homo Sapiens
EKKKVRKNW

SEQ ID NO: 82806 - protein, 9 aa, Homo Sapiens
SQSPLQISQ

SEQ ID NO: 82807 - protein, 9 aa, Homo Sapiens
DEEGKIQQE

SEQ ID NO: 82808 - protein, 9 aa, Homo Sapiens
NIPEDLIDP

SEQ ID NO: 82809 - protein, 9 aa, Homo Sapiens
NPSHNAAGT

SEQ ID NO: 82810 - protein, 9 aa, Homo Sapiens
QGSRLKKPI

SEQ ID NO: 82811 - protein, 9 aa, Homo Sapiens
WILDKQDML

SEQ ID NO: 82812 - protein, 9 aa, Homo Sapiens
MSLLKSVLQ

SEQ ID NO: 82813 - protein, 9 aa, Homo Sapiens
IDSQEIEAQ

SEQ ID NO: 82814 - protein, 9 aa, Homo Sapiens
NTILSDKNS

SEQ ID NO: 82815 - protein, 9 aa, Homo Sapiens
FDYYMPAIT

SEQ ID NO: 82816 - protein, 9 aa, Homo Sapiens
HMQQHVQLL

SEQ ID NO: 82817 - protein, 9 aa, Homo Sapiens
IFIENKINP

SEQ ID NO: 82818 - protein, 9 aa, Homo Sapiens
ANPVLASDV

SEQ ID NO: 82819 - protein, 9 aa, Homo Sapiens
PIVASKVQS

SEQ ID NO: 82820 - protein, 9 aa, Homo Sapiens
ALELQKTYV

SEQ ID NO: 82821 - protein, 9 aa, Homo Sapiens
QTQPLFSGK

SEQ ID NO: 82822 - protein, 9 aa, Homo Sapiens
VGELKKPRT

SEQ ID NO: 82823 - protein, 9 aa, Homo Sapiens
SKEEEKEEE

SEQ ID NO: 82824 - protein, 9 aa, Homo Sapiens
EINGRNNMI

SEQ ID NO: 82825 - protein, 9 aa, Homo Sapiens
AIPGQKINQ

SEQ ID NO: 82826 - protein, 9 aa, Homo Sapiens
CPSCTAVLC

SEQ ID NO: 82827 - protein, 9 aa, Homo Sapiens
PAITGCREA

SEQ ID NO: 82828 - protein, 9 aa, Homo Sapiens
LDNKKNNLI

SEQ ID NO: 82829 - protein, 9 aa, Homo Sapiens
NPVLASDVI

SEQ ID NO: 82830 - protein, 9 aa, Homo Sapiens
KEFTETAAT

SEQ ID NO: 82831 - protein, 9 aa, Homo Sapiens
YSSCAREVV

SEQ ID NO: 82832 - protein, 9 aa, Homo Sapiens
PNSVHGIYC

SEQ ID NO: 82833 - protein, 9 aa, Homo Sapiens
QIKHKKQPH

SEQ ID NO: 82834 - protein, 9 aa, Homo Sapiens
ISWFLAAGR

SEQ ID NO: 82835 - protein, 9 aa, Homo Sapiens
SHRIFTSPL

SEQ ID NO: 82836 - protein, 9 aa, Homo Sapiens
YRQKKTFDL

SEQ ID NO: 82837 - protein, 9 aa, Homo Sapiens
SAATTPILT

SEQ ID NO: 82838 - protein, 9 aa, Homo Sapiens
KTVQALSRI

SEQ ID NO: 82839 - protein, 9 aa, Homo Sapiens
ARIWYLLDV

SEQ ID NO: 82840 - protein, 9 aa, Homo Sapiens
KLVQGGGLA

SEQ ID NO: 82841 - protein, 9 aa, Homo Sapiens
YHLTEKGNQ

SEQ ID NO: 82842 - protein, 9 aa, Homo Sapiens
LRTFHLMHT

SEQ ID NO: 82843 - protein, 9 aa, Homo Sapiens
VTYMFDNGG

SEQ ID NO: 82844 - protein, 9 aa, Homo Sapiens
KPYQKSEQG

SEQ ID NO: 82845 - protein, 9 aa, Homo Sapiens
KFILEDLIE

SEQ ID NO: 82846 - protein, 9 aa, Homo Sapiens
PESGRKRIP

SEQ ID NO: 82847 - protein, 9 aa, Homo Sapiens
KIYEKTEKP

SEQ ID NO: 82848 - protein, 9 aa, Homo Sapiens
KDKELYHLT

SEQ ID NO: 82849 - protein, 9 aa, Homo Sapiens
SYLERKHLD

SEQ ID NO: 82850 - protein, 9 aa, Homo Sapiens
ENDIFVSTS

SEQ ID NO: 82851 - protein, 9 aa, Homo Sapiens
RLTDSSSSS

SEQ ID NO: 82852 - protein, 9 aa, Homo Sapiens
YAFCRYMIE

SEQ ID NO: 82853 - protein, 9 aa, Homo Sapiens
ADEVLHSFL

SEQ ID NO: 82854 - protein, 9 aa, Homo Sapiens
DKLITPFVG

SEQ ID NO: 82855 - protein, 9 aa, Homo Sapiens
LLHFKFNNR

SEQ ID NO: 82856 - protein, 9 aa, Homo Sapiens
RIQFPKLLE

SEQ ID NO: 82857 - protein, 9 aa, Homo Sapiens
TTILRCLDR

SEQ ID NO: 82858 - protein, 9 aa, Homo Sapiens
KRCQEIHNK

SEQ ID NO: 82859 - protein, 9 aa, Homo Sapiens
QMSRERAES

SEQ ID NO: 82860 - protein, 9 aa, Homo Sapiens
NDRWMLQKG

SEQ ID NO: 82861 - protein, 9 aa, Homo Sapiens
NQSGGSDIE

SEQ ID NO: 82862 - protein, 9 aa, Homo Sapiens
AFSHAEYFQ

SEQ ID NO: 82863 - protein, 9 aa, Homo Sapiens
PLFSGDFST

SEQ ID NO: 82864 - protein, 9 aa, Homo Sapiens
KKNNLIYQV

SEQ ID NO: 82865 - protein, 9 aa, Homo Sapiens
QNLVTDRLT

SEQ ID NO: 82866 - protein, 9 aa, Homo Sapiens
TLPTDTNGN

SEQ ID NO: 82867 - protein, 9 aa, Homo Sapiens
KHKIIHTEK

SEQ ID NO: 82868 - protein, 9 aa, Homo Sapiens
VYKRYASSY

SEQ ID NO: 82869 - protein, 9 aa, Homo Sapiens
YMNIQQKED

SEQ ID NO: 82870 - protein, 9 aa, Homo Sapiens
INGRNNMIQ

SEQ ID NO: 82871 - protein, 9 aa, Homo Sapiens
TGMTTRSEM

SEQ ID NO: 82872 - protein, 9 aa, Homo Sapiens
HAEYFQKHV

SEQ ID NO: 82873 - protein, 9 aa, Homo Sapiens
STEEKLKTY

SEQ ID NO: 82874 - protein, 9 aa, Homo Sapiens
KKKDFSCKG

SEQ ID NO: 82875 - protein, 9 aa, Homo Sapiens
TILRCLDRD

SEQ ID NO: 82876 - protein, 9 aa, Homo Sapiens
FGNKWCSLT

SEQ ID NO: 82877 - protein, 9 aa, Homo Sapiens
TKQMLRKDQ

SEQ ID NO: 82878 - protein, 9 aa, Homo Sapiens
HPTLTFNEE

SEQ ID NO: 82879 - protein, 9 aa, Homo Sapiens
KYDVNAIIH

SEQ ID NO: 82880 - protein, 9 aa, Homo Sapiens
QLSAQFYGV

SEQ ID NO: 82881 - protein, 9 aa, Homo Sapiens
LYHLTEKGN

SEQ ID NO: 82882 - protein, 9 aa, Homo Sapiens
SFTCASSPS

SEQ ID NO: 82883 - protein, 9 aa, Homo Sapiens
ADLENMFQY

SEQ ID NO: 82884 - protein, 9 aa, Homo Sapiens
TTTILRCLD

SEQ ID NO: 82885 - protein, 9 aa, Homo Sapiens
QVSMTMGWR

SEQ ID NO: 82886 - protein, 9 aa, Homo Sapiens
KRYASSYFC

SEQ ID NO: 82887 - protein, 9 aa, Homo Sapiens
CLVGLIYKD

SEQ ID NO: 82888 - protein, 9 aa, Homo Sapiens
WRKKVTSDK

SEQ ID NO: 82889 - protein, 9 aa, Homo Sapiens
VQLQVIVKK

SEQ ID NO: 82890 - protein, 9 aa, Homo Sapiens
NEEFKIFLT

SEQ ID NO: 82891 - protein, 9 aa, Homo Sapiens
LRPPGAAEP

SEQ ID NO: 82892 - protein, 9 aa, Homo Sapiens
ETYLDKHNI

SEQ ID NO: 82893 - protein, 9 aa, Homo Sapiens
GRSFVLSTP

SEQ ID NO: 82894 - protein, 9 aa, Homo Sapiens
TVDYVHSFI

SEQ ID NO: 82895 - protein, 9 aa, Homo Sapiens
FLETYLDKH

SEQ ID NO: 82896 - protein, 9 aa, Homo Sapiens
LLGTLYPTH

SEQ ID NO: 82897 - protein, 9 aa, Homo Sapiens
GQKINQQEE

SEQ ID NO: 82898 - protein, 9 aa, Homo Sapiens
PVAFLETYL

SEQ ID NO: 82899 - protein, 9 aa, Homo Sapiens
DKNSKEAIT

SEQ ID NO: 82900 - protein, 9 aa, Homo Sapiens
PCLIDTDKL

SEQ ID NO: 82901 - protein, 9 aa, Homo Sapiens
MEKNELVSD

SEQ ID NO: 82902 - protein, 9 aa, Homo Sapiens
RAFSSCSYT

SEQ ID NO: 82903 - protein, 9 aa, Homo Sapiens
IQACTTTPC

SEQ ID NO: 82904 - protein, 9 aa, Homo Sapiens
TTRSEMPYP

SEQ ID NO: 82905 - protein, 9 aa, Homo Sapiens
LIDTDKLIT

SEQ ID NO: 82906 - protein, 9 aa, Homo Sapiens
RDVAENLNI

SEQ ID NO: 82907 - protein, 9 aa, Homo Sapiens
MPPFILAPQ

SEQ ID NO: 82908 - protein, 9 aa, Homo Sapiens
EKPYQKSEQ

SEQ ID NO: 82909 - protein, 9 aa, Homo Sapiens
TREKQILSS

SEQ ID NO: 82910 - protein, 9 aa, Homo Sapiens
EKVFQSVPA

SEQ ID NO: 82911 - protein, 9 aa, Homo Sapiens
FGRKELFAA

SEQ ID NO: 82912 - protein, 9 aa, Homo Sapiens
VMSILYYLG

SEQ ID NO: 82913 - protein, 9 aa, Homo Sapiens
PDMNVITGI

SEQ ID NO: 82914 - protein, 9 aa, Homo Sapiens
AGGHPLDTS

SEQ ID NO: 82915 - protein, 9 aa, Homo Sapiens
KPSPESPKP

SEQ ID NO: 82916 - protein, 9 aa, Homo Sapiens
RTFHLMHTV

SEQ ID NO: 82917 - protein, 9 aa, Homo Sapiens
QKWTVDYVH

SEQ ID NO: 82918 - protein, 9 aa, Homo Sapiens
QHMQQHVQL

SEQ ID NO: 82919 - protein, 9 aa, Homo Sapiens
ITGMIYPQN

SEQ ID NO: 82920 - protein, 9 aa, Homo Sapiens
GTVIVEADG

SEQ ID NO: 82921 - protein, 9 aa, Homo Sapiens
SKVQSEEPA

SEQ ID NO: 82922 - protein, 9 aa, Homo Sapiens
IDKNSKEAI

SEQ ID NO: 82923 - protein, 9 aa, Homo Sapiens
ADKVINENT

SEQ ID NO: 82924 - protein, 9 aa, Homo Sapiens
YMFDNGGTV

SEQ ID NO: 82925 - protein, 9 aa, Homo Sapiens
NKSDATILC

SEQ ID NO: 82926 - protein, 9 aa, Homo Sapiens
QDAISGIGT

SEQ ID NO: 82927 - protein, 9 aa, Homo Sapiens
AEIDIKNVA

SEQ ID NO: 82928 - protein, 9 aa, Homo Sapiens
QKGNNNERT

SEQ ID NO: 82929 - protein, 9 aa, Homo Sapiens
KREVQLQVI

SEQ ID NO: 82930 - protein, 9 aa, Homo Sapiens
TTPILTLGT

SEQ ID NO: 82931 - protein, 9 aa, Homo Sapiens
VFSHSVWSF

SEQ ID NO: 82932 - protein, 9 aa, Homo Sapiens
LRLLTPWSI

SEQ ID NO: 82933 - protein, 9 aa, Homo Sapiens
WVILTISWF

SEQ ID NO: 82934 - protein, 9 aa, Homo Sapiens
KMNLCEAGL

SEQ ID NO: 82935 - protein, 9 aa, Homo Sapiens
KAKQLSAQF

SEQ ID NO: 82936 - protein, 9 aa, Homo Sapiens
ILSLENYSI

SEQ ID NO: 82937 - protein, 9 aa, Homo Sapiens
NAWKEKFMT

SEQ ID NO: 82938 - protein, 9 aa, Homo Sapiens
PCEDTPCDD

SEQ ID NO: 82939 - protein, 9 aa, Homo Sapiens
FRQSGSLAI

SEQ ID NO: 82940 - protein, 9 aa, Homo Sapiens
KMSLLKSVL

SEQ ID NO: 82941 - protein, 9 aa, Homo Sapiens
LITSAINSS

SEQ ID NO: 82942 - protein, 9 aa, Homo Sapiens
LTEMISECT

SEQ ID NO: 82943 - protein, 9 aa, Homo Sapiens
QLDNKKNNL

SEQ ID NO: 82944 - protein, 9 aa, Homo Sapiens
HIQACTTTP

SEQ ID NO: 82945 - protein, 9 aa, Homo Sapiens
SMSHVHPNY

SEQ ID NO: 82946 - protein, 9 aa, Homo Sapiens
NTWVTGREP

SEQ ID NO: 82947 - protein, 9 aa, Homo Sapiens
GRAFRQSGS

SEQ ID NO: 82948 - protein, 9 aa, Homo Sapiens
LNVTKIAEK

SEQ ID NO: 82949 - protein, 9 aa, Homo Sapiens
NYPIYIILF

SEQ ID NO: 82950 - protein, 9 aa, Homo Sapiens
FKFNNRTSV

SEQ ID NO: 82951 - protein, 9 aa, Homo Sapiens
KQVTTSAAT

SEQ ID NO: 82952 - protein, 9 aa, Homo Sapiens
LEINGRNNM

SEQ ID NO: 82953 - protein, 9 aa, Homo Sapiens
CLLNVQSRK

SEQ ID NO: 82954 - protein, 9 aa, Homo Sapiens
PGPIILGFT

SEQ ID NO: 82955 - protein, 9 aa, Homo Sapiens
SGAHFLPVV

SEQ ID NO: 82956 - protein, 9 aa, Homo Sapiens
DTEKLKKIL

SEQ ID NO: 82957 - protein, 9 aa, Homo Sapiens
NPVSYVSLE

SEQ ID NO: 82958 - protein, 9 aa, Homo Sapiens
SAQFYGVTS

SEQ ID NO: 82959 - protein, 9 aa, Homo Sapiens
TLGCCNLIC

SEQ ID NO: 82960 - protein, 9 aa, Homo Sapiens
SYTAYKNYY

SEQ ID NO: 82961 - protein, 9 aa, Homo Sapiens
STDLDVPSE

SEQ ID NO: 82962 - protein, 9 aa, Homo Sapiens
YASSYFCCA

SEQ ID NO: 82963 - protein, 9 aa, Homo Sapiens
VLQTQPLFS

SEQ ID NO: 82964 - protein, 9 aa, Homo Sapiens
QPSRSEFSK

SEQ ID NO: 82965 - protein, 9 aa, Homo Sapiens
RIKRIKSEN

SEQ ID NO: 82966 - protein, 9 aa, Homo Sapiens
MQALKIKEF

SEQ ID NO: 82967 - protein, 9 aa, Homo Sapiens
ILDKQDMLK

SEQ ID NO: 82968 - protein, 9 aa, Homo Sapiens
EFREDSLVI

SEQ ID NO: 82969 - protein, 9 aa, Homo Sapiens
TEKGNQSIE

SEQ ID NO: 82970 - protein, 9 aa, Homo Sapiens
INNIDFDKN

SEQ ID NO: 82971 - protein, 9 aa, Homo Sapiens
KNQNKSGGL

SEQ ID NO: 82972 - protein, 9 aa, Homo Sapiens
VAQLLKTVS

SEQ ID NO: 82973 - protein, 9 aa, Homo Sapiens
TLRLLTPWS

SEQ ID NO: 82974 - protein, 9 aa, Homo Sapiens
SHAEYFQKH

SEQ ID NO: 82975 - protein, 9 aa, Homo Sapiens
FIIIAVFLI

SEQ ID NO: 82976 - protein, 9 aa, Homo Sapiens
ENEPEAEKS

SEQ ID NO: 82977 - protein, 9 aa, Homo Sapiens
FSKVIHLPL

SEQ ID NO: 82978 - protein, 9 aa, Homo Sapiens
LLDMKLVGI

SEQ ID NO: 82979 - protein, 9 aa, Homo Sapiens
FIILSLENY

SEQ ID NO: 82980 - protein, 9 aa, Homo Sapiens
HRRQREGRL

SEQ ID NO: 82981 - protein, 9 aa, Homo Sapiens
TRSEMPYPD

SEQ ID NO: 82982 - protein, 9 aa, Homo Sapiens
GGHPLDTSH

SEQ ID NO: 82983 - protein, 9 aa, Homo Sapiens
KEKVFQSVP

SEQ ID NO: 82984 - protein, 9 aa, Homo Sapiens
KRLQQHMQQ

SEQ ID NO: 82985 - protein, 9 aa, Homo Sapiens
MTGLTATGP

SEQ ID NO: 82986 - protein, 9 aa, Homo Sapiens
PSHNAAGTS

SEQ ID NO: 82987 - protein, 9 aa, Homo Sapiens
FVSTSEDEP

SEQ ID NO: 82988 - protein, 9 aa, Homo Sapiens
KRKALIPCK

SEQ ID NO: 82989 - protein, 9 aa, Homo Sapiens
FGRNINLEA

SEQ ID NO: 82990 - protein, 9 aa, Homo Sapiens
PTNYFHICS

SEQ ID NO: 82991 - protein, 9 aa, Homo Sapiens
TDGNEIQPD

SEQ ID NO: 82992 - protein, 9 aa, Homo Sapiens
MSHVHPNYF

SEQ ID NO: 82993 - protein, 9 aa, Homo Sapiens
NSKNQNKSG

SEQ ID NO: 82994 - protein, 9 aa, Homo Sapiens
AKEKVFQSV

SEQ ID NO: 82995 - protein, 9 aa, Homo Sapiens
LLTAEVPFR

SEQ ID NO: 82996 - protein, 9 aa, Homo Sapiens
RLTPTGHKM

SEQ ID NO: 82997 - protein, 9 aa, Homo Sapiens
WGPVDISTC

SEQ ID NO: 82998 - protein, 9 aa, Homo Sapiens
SPRKSLEVV

SEQ ID NO: 82999 - protein, 9 aa, Homo Sapiens
RIWYLLDVK

SEQ ID NO: 83000 - protein, 9 aa, Homo Sapiens
DSQEIEAQE

SEQ ID NO: 83001 - protein, 9 aa, Homo Sapiens
KREVFERKI

SEQ ID NO: 83002 - protein, 9 aa, Homo Sapiens
CLIDTDKLI

SEQ ID NO: 83003 - protein, 9 aa, Homo Sapiens
AYVLDNPEM

SEQ ID NO: 83004 - protein, 9 aa, Homo Sapiens
NKMNLCEAG

SEQ ID NO: 83005 - protein, 9 aa, Homo Sapiens
IFLITVMAY

SEQ ID NO: 83006 - protein, 9 aa, Homo Sapiens
INYSKAIKF

SEQ ID NO: 83007 - protein, 9 aa, Homo Sapiens
HSFLQSQVV

SEQ ID NO: 83008 - protein, 9 aa, Homo Sapiens
AENLNIKLQ

SEQ ID NO: 83009 - protein, 9 aa, Homo Sapiens
IWYLLDVKM

SEQ ID NO: 83010 - protein, 9 aa, Homo Sapiens
IPRPIEMSD

SEQ ID NO: 83011 - protein, 9 aa, Homo Sapiens
VNIITSQSL

SEQ ID NO: 83012 - protein, 9 aa, Homo Sapiens
GPFPLPQLR

SEQ ID NO: 83013 - protein, 9 aa, Homo Sapiens
ELPTTKASL

SEQ ID NO: 83014 - protein, 9 aa, Homo Sapiens
SDLSSSTSL

SEQ ID NO: 83015 - protein, 9 aa, Homo Sapiens
QKIKAEHAS

SEQ ID NO: 83016 - protein, 9 aa, Homo Sapiens
RDNIPEDLI

SEQ ID NO: 83017 - protein, 9 aa, Homo Sapiens
SAINSSPKK

SEQ ID NO: 83018 - protein, 9 aa, Homo Sapiens
SHSLSRSKS

SEQ ID NO: 83019 - protein, 9 aa, Homo Sapiens
YKTYLRPIT

SEQ ID NO: 83020 - protein, 9 aa, Homo Sapiens
VVQPLPTPL

SEQ ID NO: 83021 - protein, 9 aa, Homo Sapiens
WQAKPHVLD

SEQ ID NO: 83022 - protein, 9 aa, Homo Sapiens
RAGPSFSKV

SEQ ID NO: 83023 - protein, 9 aa, Homo Sapiens
KVPTNYFHI

SEQ ID NO: 83024 - protein, 9 aa, Homo Sapiens
SNLGNFNYK

SEQ ID NO: 83025 - protein, 9 aa, Homo Sapiens
KAEHASHGD

SEQ ID NO: 83026 - protein, 9 aa, Homo Sapiens
KNYYYSEPG

SEQ ID NO: 83027 - protein, 9 aa, Homo Sapiens
LFSGDFSTS

SEQ ID NO: 83028 - protein, 9 aa, Homo Sapiens
QDSFKKETL

SEQ ID NO: 83029 - protein, 9 aa, Homo Sapiens
KEIQDAISG

SEQ ID NO: 83030 - protein, 9 aa, Homo Sapiens
QETVAQLLK

SEQ ID NO: 83031 - protein, 9 aa, Homo Sapiens
ILKKLLKRT

SEQ ID NO: 83032 - protein, 9 aa, Homo Sapiens
GGTEIFLIT

SEQ ID NO: 83033 - protein, 9 aa, Homo Sapiens
SPCSSDGPV

SEQ ID NO: 83034 - protein, 9 aa, Homo Sapiens
LIKIQQKLK

SEQ ID NO: 83035 - protein, 9 aa, Homo Sapiens
EKFMTVDQD

SEQ ID NO: 83036 - protein, 9 aa, Homo Sapiens
SGAGCSSCD

SEQ ID NO: 83037 - protein, 9 aa, Homo Sapiens
HFVTLLSFT

SEQ ID NO: 83038 - protein, 9 aa, Homo Sapiens
LLKTVSSLS

SEQ ID NO: 83039 - protein, 9 aa, Homo Sapiens
VQSRKQQLP

SEQ ID NO: 83040 - protein, 9 aa, Homo Sapiens
LMHTVPALD

SEQ ID NO: 83041 - protein, 9 aa, Homo Sapiens
YNRNTWVTG

SEQ ID NO: 83042 - protein, 9 aa, Homo Sapiens
SGPRAFSSC

SEQ ID NO: 83043 - protein, 9 aa, Homo Sapiens
QVIVKKAQE

SEQ ID NO: 83044 - protein, 9 aa, Homo Sapiens
EENDIFVST

SEQ ID NO: 83045 - protein, 9 aa, Homo Sapiens
AHCTGIKVV

SEQ ID NO: 83046 - protein, 9 aa, Homo Sapiens
RSDDKSSLN

SEQ ID NO: 83047 - protein, 9 aa, Homo Sapiens
IPGQKINQQ

SEQ ID NO: 83048 - protein, 9 aa, Homo Sapiens
ENSCEGGSK

SEQ ID NO: 83049 - protein, 9 aa, Homo Sapiens
VQSEEPAGK

SEQ ID NO: 83050 - protein, 9 aa, Homo Sapiens
GPVREPLAG

SEQ ID NO: 83051 - protein, 9 aa, Homo Sapiens
HLGKLLTVL

SEQ ID NO: 83052 - protein, 9 aa, Homo Sapiens
AELKQTGRT

SEQ ID NO: 83053 - protein, 9 aa, Homo Sapiens
RANTCATRS

SEQ ID NO: 83054 - protein, 9 aa, Homo Sapiens
KTTTILRCL

SEQ ID NO: 83055 - protein, 9 aa, Homo Sapiens
YKGQVGNSE

SEQ ID NO: 83056 - protein, 9 aa, Homo Sapiens
DVPSEAVTC

SEQ ID NO: 83057 - protein, 9 aa, Homo Sapiens
FHLMHTVPA

SEQ ID NO: 83058 - protein, 9 aa, Homo Sapiens
YKEKCYYLP

SEQ ID NO: 83059 - protein, 9 aa, Homo Sapiens
FLFAVLFGR

SEQ ID NO: 83060 - protein, 9 aa, Homo Sapiens
KYHIQACTT

SEQ ID NO: 83061 - protein, 9 aa, Homo Sapiens
YVHSFIRSL

SEQ ID NO: 83062 - protein, 9 aa, Homo Sapiens
DRLTENMAT

SEQ ID NO: 83063 - protein, 9 aa, Homo Sapiens
EIQDAISGI

SEQ ID NO: 83064 - protein, 9 aa, Homo Sapiens
ENLLTRLLK

SEQ ID NO: 83065 - protein, 9 aa, Homo Sapiens
ELQKTYVLN

SEQ ID NO: 83066 - protein, 9 aa, Homo Sapiens
KSLIAQWSP

SEQ ID NO: 83067 - protein, 9 aa, Homo Sapiens
ELWMMGLTI

SEQ ID NO: 83068 - protein, 9 aa, Homo Sapiens
KSLEVVTPE

SEQ ID NO: 83069 - protein, 9 aa, Homo Sapiens
AEYFQKHVR

SEQ ID NO: 83070 - protein, 9 aa, Homo Sapiens
GENKDTIQN

SEQ ID NO: 83071 - protein, 9 aa, Homo Sapiens
LIVGELKKP

SEQ ID NO: 83072 - protein, 9 aa, Homo Sapiens
LQVLKQLFY

SEQ ID NO: 83073 - protein, 9 aa, Homo Sapiens
HDNLFTGAQ

SEQ ID NO: 83074 - protein, 9 aa, Homo Sapiens
ENLLIVVNI

SEQ ID NO: 83075 - protein, 9 aa, Homo Sapiens
MNMENLFVT

SEQ ID NO: 83076 - protein, 9 aa, Homo Sapiens
KKYLYRYPG

SEQ ID NO: 83077 - protein, 9 aa, Homo Sapiens
KLLKRTPRK

SEQ ID NO: 83078 - protein, 9 aa, Homo Sapiens
LKQLFYMIN

SEQ ID NO: 83079 - protein, 9 aa, Homo Sapiens
AGCSSCDCP

SEQ ID NO: 83080 - protein, 9 aa, Homo Sapiens
TQYIFTEIL

SEQ ID NO: 83081 - protein, 9 aa, Homo Sapiens
LCRNLPHGF

SEQ ID NO: 83082 - protein, 9 aa, Homo Sapiens
SSSSTSSSG

SEQ ID NO: 83083 - protein, 9 aa, Homo Sapiens
CQIKHKKQP

SEQ ID NO: 83084 - protein, 9 aa, Homo Sapiens
QWSDNYISV

SEQ ID NO: 83085 - protein, 9 aa, Homo Sapiens
VLKQLFYMI

SEQ ID NO: 83086 - protein, 9 aa, Homo Sapiens
HGDSVHKVA

SEQ ID NO: 83087 - protein, 9 aa, Homo Sapiens
GKKKKKRIG

SEQ ID NO: 83088 - protein, 9 aa, Homo Sapiens
IGWNIFDFL

SEQ ID NO: 83089 - protein, 9 aa, Homo Sapiens
LENMFQYRR

SEQ ID NO: 83090 - protein, 9 aa, Homo Sapiens
ASSPRAPGT

SEQ ID NO: 83091 - protein, 9 aa, Homo Sapiens
SEMLNLEEK

SEQ ID NO: 83092 - protein, 9 aa, Homo Sapiens
MHKDVSKTS

SEQ ID NO: 83093 - protein, 9 aa, Homo Sapiens
TYEDLRRQG

SEQ ID NO: 83094 - protein, 9 aa, Homo Sapiens
GRSVVDSIC

SEQ ID NO: 83095 - protein, 9 aa, Homo Sapiens
GLTISTRTW

SEQ ID NO: 83096 - protein, 9 aa, Homo Sapiens
LEDLIERDS

SEQ ID NO: 83097 - protein, 9 aa, Homo Sapiens
KKMIYLQVQ

SEQ ID NO: 83098 - protein, 9 aa, Homo Sapiens
VIVGKAPPE

SEQ ID NO: 83099 - protein, 9 aa, Homo Sapiens
LGNFNYKQR

SEQ ID NO: 83100 - protein, 9 aa, Homo Sapiens
PCLLGTLYP

SEQ ID NO: 83101 - protein, 9 aa, Homo Sapiens
ALRDQKKYL

SEQ ID NO: 83102 - protein, 9 aa, Homo Sapiens
SKKLTNPRG

SEQ ID NO: 83103 - protein, 9 aa, Homo Sapiens
GVFFFKCTI

SEQ ID NO: 83104 - protein, 9 aa, Homo Sapiens
SDTNQSGGS

SEQ ID NO: 83105 - protein, 9 aa, Homo Sapiens
MMGLTISTR

SEQ ID NO: 83106 - protein, 9 aa, Homo Sapiens
LGYKFKGRS

SEQ ID NO: 83107 - protein, 9 aa, Homo Sapiens
IPLHILDSR

SEQ ID NO: 83108 - protein, 9 aa, Homo Sapiens
QINYSKAIK

SEQ ID NO: 83109 - protein, 9 aa, Homo Sapiens
SCFIYEEKG

SEQ ID NO: 83110 - protein, 9 aa, Homo Sapiens
KSFICKTGE

SEQ ID NO: 83111 - protein, 9 aa, Homo Sapiens
AIHRNSLEG

SEQ ID NO: 83112 - protein, 9 aa, Homo Sapiens
VVQRFGHGT

SEQ ID NO: 83113 - protein, 9 aa, Homo Sapiens
RELERQMNM

SEQ ID NO: 83114 - protein, 9 aa, Homo Sapiens
PNQQKIYDL

SEQ ID NO: 83115 - protein, 9 aa, Homo Sapiens
LVVILSIVG

SEQ ID NO: 83116 - protein, 9 aa, Homo Sapiens
VPVLGCTAP

SEQ ID NO: 83117 - protein, 9 aa, Homo Sapiens
YCLVGLIYK

SEQ ID NO: 83118 - protein, 9 aa, Homo Sapiens
SMGSRRTLM

SEQ ID NO: 83119 - protein, 9 aa, Homo Sapiens
ICPWLNYLP

SEQ ID NO: 83120 - protein, 9 aa, Homo Sapiens
TPCDDTTSW

SEQ ID NO: 83121 - protein, 9 aa, Homo Sapiens
TEILKQDKG

SEQ ID NO: 83122 - protein, 9 aa, Homo Sapiens
SFSKVIHLP

SEQ ID NO: 83123 - protein, 9 aa, Homo Sapiens
LSTIRITPQ

SEQ ID NO: 83124 - protein, 9 aa, Homo Sapiens
INENTRDST

SEQ ID NO: 83125 - protein, 9 aa, Homo Sapiens
LTAGDFEPF

SEQ ID NO: 83126 - protein, 9 aa, Homo Sapiens
EAEAMCANL

SEQ ID NO: 83127 - protein, 9 aa, Homo Sapiens
PTYHNLVPD

SEQ ID NO: 83128 - protein, 9 aa, Homo Sapiens
NKKNNLIYQ

SEQ ID NO: 83129 - protein, 9 aa, Homo Sapiens
SIPCFWETQ

SEQ ID NO: 83130 - protein, 9 aa, Homo Sapiens
KQDMEIAEL

SEQ ID NO: 83131 - protein, 9 aa, Homo Sapiens
DDGENKDTI

SEQ ID NO: 83132 - protein, 9 aa, Homo Sapiens
RQQGSKEEE

SEQ ID NO: 83133 - protein, 9 aa, Homo Sapiens
ETVAQLLKT

SEQ ID NO: 83134 - protein, 9 aa, Homo Sapiens
GNKWCSLTK

SEQ ID NO: 83135 - protein, 9 aa, Homo Sapiens
YQNPWQAKP

SEQ ID NO: 83136 - protein, 9 aa, Homo Sapiens
INAGVFFFK

SEQ ID NO: 83137 - protein, 9 aa, Homo Sapiens
DGDGRGNAC

SEQ ID NO: 83138 - protein, 9 aa, Homo Sapiens
YDGQVKPSP

SEQ ID NO: 83139 - protein, 9 aa, Homo Sapiens
SQGSRLKKP

SEQ ID NO: 83140 - protein, 9 aa, Homo Sapiens
IHNKLLSRT

SEQ ID NO: 83141 - protein, 9 aa, Homo Sapiens
TSHPKQKKT

SEQ ID NO: 83142 - protein, 9 aa, Homo Sapiens
SPSTGTLRL

SEQ ID NO: 83143 - protein, 9 aa, Homo Sapiens
AVLFGRKEL

SEQ ID NO: 83144 - protein, 9 aa, Homo Sapiens
TAVLCSTQV

SEQ ID NO: 83145 - protein, 9 aa, Homo Sapiens
HMQQKELGT

SEQ ID NO: 83146 - protein, 9 aa, Homo Sapiens
VFLICFVPF

SEQ ID NO: 83147 - protein, 9 aa, Homo Sapiens
RMPNLKKRK

SEQ ID NO: 83148 - protein, 9 aa, Homo Sapiens
CKYPLILKK

SEQ ID NO: 83149 - protein, 9 aa, Homo Sapiens
QQEYIISDP

SEQ ID NO: 83150 - protein, 9 aa, Homo Sapiens
DKELYHLTE

SEQ ID NO: 83151 - protein, 9 aa, Homo Sapiens
YGGSGAGCS

SEQ ID NO: 83152 - protein, 9 aa, Homo Sapiens
EAISHNSVV

SEQ ID NO: 83153 - protein, 9 aa, Homo Sapiens
DYHRRQREG

SEQ ID NO: 83154 - protein, 9 aa, Homo Sapiens
VHKVADGFK

SEQ ID NO: 83155 - protein, 9 aa, Homo Sapiens
VFLMQKYHK

SEQ ID NO: 83156 - protein, 9 aa, Homo Sapiens
GAGCSSCDC

SEQ ID NO: 83157 - protein, 9 aa, Homo Sapiens
KSLKFILED

SEQ ID NO: 83158 - protein, 9 aa, Homo Sapiens
VHLPLSTRE

SEQ ID NO: 83159 - protein, 9 aa, Homo Sapiens
ACPGSCPSC

SEQ ID NO: 83160 - protein, 9 aa, Homo Sapiens
TDYLYKDPN

SEQ ID NO: 83161 - protein, 9 aa, Homo Sapiens
MTTRSEMPY

SEQ ID NO: 83162 - protein, 9 aa, Homo Sapiens
VPAAGLSAA

SEQ ID NO: 83163 - protein, 9 aa, Homo Sapiens
AKVTYMFDN

SEQ ID NO: 83164 - protein, 9 aa, Homo Sapiens
GYKTYLRPI

SEQ ID NO: 83165 - protein, 9 aa, Homo Sapiens
LARDIYDKE

SEQ ID NO: 83166 - protein, 9 aa, Homo Sapiens
SLKFILEDL

SEQ ID NO: 83167 - protein, 9 aa, Homo Sapiens
PPTTISVEL

SEQ ID NO: 83168 - protein, 9 aa, Homo Sapiens
VVVPAAGLS

SEQ ID NO: 83169 - protein, 9 aa, Homo Sapiens
NESNDLLYQ

SEQ ID NO: 83170 - protein, 9 aa, Homo Sapiens
MFSTRKFLD

SEQ ID NO: 83171 - protein, 9 aa, Homo Sapiens
EDSLVINSK

SEQ ID NO: 83172 - protein, 9 aa, Homo Sapiens
TVQALSRIS

SEQ ID NO: 83173 - protein, 9 aa, Homo Sapiens
QDMLKERQK

SEQ ID NO: 83174 - protein, 9 aa, Homo Sapiens
DKQDMLKER

SEQ ID NO: 83175 - protein, 9 aa, Homo Sapiens
ITSAINSSP

SEQ ID NO: 83176 - protein, 9 aa, Homo Sapiens
KQMLRKDQK

SEQ ID NO: 83177 - protein, 9 aa, Homo Sapiens
REDSLVINS

SEQ ID NO: 83178 - protein, 9 aa, Homo Sapiens
PIILGFTID

SEQ ID NO: 83179 - protein, 9 aa, Homo Sapiens
TNQSGGSDI

SEQ ID NO: 83180 - protein, 9 aa, Homo Sapiens
IQKWTVDYV

SEQ ID NO: 83181 - protein, 9 aa, Homo Sapiens
RDPQFSANP

SEQ ID NO: 83182 - protein, 9 aa, Homo Sapiens
EKLKKILEV

SEQ ID NO: 83183 - protein, 9 aa, Homo Sapiens
EKEDIDSQE

SEQ ID NO: 83184 - protein, 9 aa, Homo Sapiens
HYYGKKKKK

SEQ ID NO: 83185 - protein, 9 aa, Homo Sapiens
RNYMTKFLN

SEQ ID NO: 83186 - protein, 9 aa, Homo Sapiens
RKSLGLGPG

SEQ ID NO: 83187 - protein, 9 aa, Homo Sapiens
PTTNSKAPF

SEQ ID NO: 83188 - protein, 9 aa, Homo Sapiens
DFFWDDGEN

SEQ ID NO: 83189 - protein, 9 aa, Homo Sapiens
CQIFIENKI

SEQ ID NO: 83190 - protein, 9 aa, Homo Sapiens
HFKFNNRTS

SEQ ID NO: 83191 - protein, 9 aa, Homo Sapiens
ARHTIKRQQ

SEQ ID NO: 83192 - protein, 9 aa, Homo Sapiens
KLTNPRGLA

SEQ ID NO: 83193 - protein, 9 aa, Homo Sapiens
YVSLEVVSK

SEQ ID NO: 83194 - protein, 9 aa, Homo Sapiens
DISTCLKEA

SEQ ID NO: 83195 - protein, 9 aa, Homo Sapiens
RKNLEGLDL

SEQ ID NO: 83196 - protein, 9 aa, Homo Sapiens
LSFTCASSP

SEQ ID NO: 83197 - protein, 9 aa, Homo Sapiens
ILYYLGLMQ

SEQ ID NO: 83198 - protein, 9 aa, Homo Sapiens
NNERTTDLK

SEQ ID NO: 83199 - protein, 9 aa, Homo Sapiens
QTGRTDISP

SEQ ID NO: 83200 - protein, 9 aa, Homo Sapiens
IDLIKIQQK

SEQ ID NO: 83201 - protein, 9 aa, Homo Sapiens
TFSEVQGMQ

SEQ ID NO: 83202 - protein, 9 aa, Homo Sapiens
LKTVSSLSE

SEQ ID NO: 83203 - protein, 9 aa, Homo Sapiens
YIKTDGLVA

SEQ ID NO: 83204 - protein, 9 aa, Homo Sapiens
YLLDVKMQP

SEQ ID NO: 83205 - protein, 9 aa, Homo Sapiens
PTGHKMKIL

SEQ ID NO: 83206 - protein, 9 aa, Homo Sapiens
EAFFAHCTG

SEQ ID NO: 83207 - protein, 9 aa, Homo Sapiens
ERQMSRERA

SEQ ID NO: 83208 - protein, 9 aa, Homo Sapiens
QSGSLAIHR

SEQ ID NO: 83209 - protein, 9 aa, Homo Sapiens
AKPHVLDMQ

SEQ ID NO: 83210 - protein, 9 aa, Homo Sapiens
YAKFGRNIN

SEQ ID NO: 83211 - protein, 9 aa, Homo Sapiens
LRQKIKAEH

SEQ ID NO: 83212 - protein, 9 aa, Homo Sapiens
NMFQYRRNE

SEQ ID NO: 83213 - protein, 9 aa, Homo Sapiens
LITGMIYPQ

SEQ ID NO: 83214 - protein, 9 aa, Homo Sapiens
QVLKQLFYM

SEQ ID NO: 83215 - protein, 9 aa, Homo Sapiens
DSFKKETLG

SEQ ID NO: 83216 - protein, 9 aa, Homo Sapiens
KKLITGMIY

SEQ ID NO: 83217 - protein, 9 aa, Homo Sapiens
LKKPIVGIP

SEQ ID NO: 83218 - protein, 9 aa, Homo Sapiens
LQPSPNSVH

SEQ ID NO: 83219 - protein, 9 aa, Homo Sapiens
ALKIKEFNE

SEQ ID NO: 83220 - protein, 9 aa, Homo Sapiens
PVLGCTAPF

SEQ ID NO: 83221 - protein, 9 aa, Homo Sapiens
QKIPARENS

SEQ ID NO: 83222 - protein, 9 aa, Homo Sapiens
SCKGAEDNM

SEQ ID NO: 83223 - protein, 9 aa, Homo Sapiens
PLQSCFIYE

SEQ ID NO: 83224 - protein, 9 aa, Homo Sapiens
FLSDAIPGQ

SEQ ID NO: 83225 - protein, 9 aa, Homo Sapiens
FQYRRNEHG

SEQ ID NO: 83226 - protein, 9 aa, Homo Sapiens
SSLRDYPPA

SEQ ID NO: 83227 - protein, 9 aa, Homo Sapiens
KYFLSIPIT

SEQ ID NO: 83228 - protein, 9 aa, Homo Sapiens
MLCRNLPHG

SEQ ID NO: 83229 - protein, 9 aa, Homo Sapiens
LIKEEKTTK

SEQ ID NO: 83230 - protein, 9 aa, Homo Sapiens
PECNHMLTG

SEQ ID NO: 83231 - protein, 9 aa, Homo Sapiens
NGGQYRCYS

SEQ ID NO: 83232 - protein, 9 aa, Homo Sapiens
VKELQNKFT

SEQ ID NO: 83233 - protein, 9 aa, Homo Sapiens
MWHFVTLLS

SEQ ID NO: 83234 - protein, 9 aa, Homo Sapiens
GTVERGPFP

SEQ ID NO: 83235 - protein, 9 aa, Homo Sapiens
LQNKFTPGR

SEQ ID NO: 83236 - protein, 9 aa, Homo Sapiens
KWKQSIGQY

SEQ ID NO: 83237 - protein, 9 aa, Homo Sapiens
TVMSILYYL

SEQ ID NO: 83238 - protein, 9 aa, Homo Sapiens
MGWRNYLMP

SEQ ID NO: 83239 - protein, 9 aa, Homo Sapiens
DYVHSFIRS

SEQ ID NO: 83240 - protein, 9 aa, Homo Sapiens
NKWCSLTKN

SEQ ID NO: 83241 - protein, 9 aa, Homo Sapiens
GQRYKGQVG

SEQ ID NO: 83242 - protein, 9 aa, Homo Sapiens
AALNAWKEK

SEQ ID NO: 83243 - protein, 9 aa, Homo Sapiens
IEIFVHGDL

SEQ ID NO: 83244 - protein, 9 aa, Homo Sapiens
LQKTYVLNP

SEQ ID NO: 83245 - protein, 9 aa, Homo Sapiens
ASACPGSCP

SEQ ID NO: 83246 - protein, 9 aa, Homo Sapiens
ILVYGSMVL

SEQ ID NO: 83247 - protein, 9 aa, Homo Sapiens
DNYISVLTG

SEQ ID NO: 83248 - protein, 9 aa, Homo Sapiens
NIFDFLVVI

SEQ ID NO: 83249 - protein, 9 aa, Homo Sapiens
EDLRRQGLL

SEQ ID NO: 83250 - protein, 9 aa, Homo Sapiens
KLSKTKKRK

SEQ ID NO: 83251 - protein, 9 aa, Homo Sapiens
FPGIPYTLP

SEQ ID NO: 83252 - protein, 9 aa, Homo Sapiens
FGHGTEFNK

SEQ ID NO: 83253 - protein, 9 aa, Homo Sapiens
RSEMPYPDE

SEQ ID NO: 83254 - protein, 9 aa, Homo Sapiens
VDKGVLGRM

SEQ ID NO: 83255 - protein, 9 aa, Homo Sapiens
RFCSVSNES

SEQ ID NO: 83256 - protein, 9 aa, Homo Sapiens
QPSPNSVHG

SEQ ID NO: 83257 - protein, 9 aa, Homo Sapiens
DNKKNNLIY

SEQ ID NO: 83258 - protein, 9 aa, Homo Sapiens
HPLDTSHLP

SEQ ID NO: 83259 - protein, 9 aa, Homo Sapiens
EYDSFGHLT

SEQ ID NO: 83260 - protein, 9 aa, Homo Sapiens
TRIQFPKLL

SEQ ID NO: 83261 - protein, 9 aa, Homo Sapiens
QVVKEDNIK

SEQ ID NO: 83262 - protein, 9 aa, Homo Sapiens
LDKRKALIP

SEQ ID NO: 83263 - protein, 9 aa, Homo Sapiens
KHGACVNAV

SEQ ID NO: 83264 - protein, 9 aa, Homo Sapiens
PWSILPSSP

SEQ ID NO: 83265 - protein, 9 aa, Homo Sapiens
NLPHGFIQE

SEQ ID NO: 83266 - protein, 9 aa, Homo Sapiens
QSCFIYEEK

SEQ ID NO: 83267 - protein, 9 aa, Homo Sapiens
PPLQQPPSV

SEQ ID NO: 83268 - protein, 9 aa, Homo Sapiens
KKPIVGIPG

SEQ ID NO: 83269 - protein, 9 aa, Homo Sapiens
KDQTVIVGK

SEQ ID NO: 83270 - protein, 9 aa, Homo Sapiens
RRELERQMN

SEQ ID NO: 83271 - protein, 9 aa, Homo Sapiens
RARHTIKRQ

SEQ ID NO: 83272 - protein, 9 aa, Homo Sapiens
AAYVLDNPE

SEQ ID NO: 83273 - protein, 9 aa, Homo Sapiens
STSSSGHKR

SEQ ID NO: 83274 - protein, 9 aa, Homo Sapiens
SSCAREVVR

SEQ ID NO: 83275 - protein, 9 aa, Homo Sapiens
ISAGTHTRE

SEQ ID NO: 83276 - protein, 9 aa, Homo Sapiens
GWWKCLFTL

SEQ ID NO: 83277 - protein, 9 aa, Homo Sapiens
YEEKGLISA

SEQ ID NO: 83278 - protein, 9 aa, Homo Sapiens
LDTSHLPQE

SEQ ID NO: 83279 - protein, 9 aa, Homo Sapiens
VPSEAVTCQ

SEQ ID NO: 83280 - protein, 9 aa, Homo Sapiens
AITGCREAI

SEQ ID NO: 83281 - protein, 9 aa, Homo Sapiens
KKKKRIGRP

SEQ ID NO: 83282 - protein, 9 aa, Homo Sapiens
GNNNERTTD

SEQ ID NO: 83283 - protein, 9 aa, Homo Sapiens
LNGENFRTQ

SEQ ID NO: 83284 - protein, 9 aa, Homo Sapiens
NENTRDSTF

SEQ ID NO: 83285 - protein, 9 aa, Homo Sapiens
VPDSMTATQ

SEQ ID NO: 83286 - protein, 9 aa, Homo Sapiens
ALQPESGRK

SEQ ID NO: 83287 - protein, 9 aa, Homo Sapiens
FYEYDSFGH

SEQ ID NO: 83288 - protein, 9 aa, Homo Sapiens
PQTHSMGSR

SEQ ID NO: 83289 - protein, 9 aa, Homo Sapiens
EIILQVLKQ

SEQ ID NO: 83290 - protein, 9 aa, Homo Sapiens
MHILTQPFY

SEQ ID NO: 83291 - protein, 9 aa, Homo Sapiens
HILDSRAPE

SEQ ID NO: 83292 - protein, 9 aa, Homo Sapiens
NIKAVGKKL

SEQ ID NO: 83293 - protein, 9 aa, Homo Sapiens
ASILKGYKT

SEQ ID NO: 83294 - protein, 9 aa, Homo Sapiens
EFQKKYDVN

SEQ ID NO: 83295 - protein, 9 aa, Homo Sapiens
YLKQINYSK

SEQ ID NO: 83296 - protein, 9 aa, Homo Sapiens
MEDSEGDSE

SEQ ID NO: 83297 - protein, 9 aa, Homo Sapiens
TNYFHICSA

SEQ ID NO: 83298 - protein, 9 aa, Homo Sapiens
FTPGRREEA

SEQ ID NO: 83299 - protein, 9 aa, Homo Sapiens
LEEKFDGVL

SEQ ID NO: 83300 - protein, 9 aa, Homo Sapiens
FKKETLGRY

SEQ ID NO: 83301 - protein, 9 aa, Homo Sapiens
HILTQPFYF

SEQ ID NO: 83302 - protein, 9 aa, Homo Sapiens
KLNQKQDME

SEQ ID NO: 83303 - protein, 9 aa, Homo Sapiens
YQPKYFLSI

SEQ ID NO: 83304 - protein, 9 aa, Homo Sapiens
IYLKQINYS

SEQ ID NO: 83305 - protein, 9 aa, Homo Sapiens
PGRMPNLKK

SEQ ID NO: 83306 - protein, 9 aa, Homo Sapiens
FKCTICNNS

SEQ ID NO: 83307 - protein, 9 aa, Homo Sapiens
WWKCLFTLK

SEQ ID NO: 83308 - protein, 9 aa, Homo Sapiens
KQRGAFRGS

SEQ ID NO: 83309 - protein, 9 aa, Homo Sapiens
MKFLKNKAI

SEQ ID NO: 83310 - protein, 9 aa, Homo Sapiens
VGINFYDPT

SEQ ID NO: 83311 - protein, 9 aa, Homo Sapiens
CTAPFGYRK

SEQ ID NO: 83312 - protein, 9 aa, Homo Sapiens
QEKYKELTE

SEQ ID NO: 83313 - protein, 9 aa, Homo Sapiens
VSPRKSLEV

SEQ ID NO: 83314 - protein, 9 aa, Homo Sapiens
ILQVLKQLF

SEQ ID NO: 83315 - protein, 9 aa, Homo Sapiens
NNHPPVFKK

SEQ ID NO: 83316 - protein, 9 aa, Homo Sapiens
ACVNAVDLW

SEQ ID NO: 83317 - protein, 9 aa, Homo Sapiens
KRKSLGLGP

SEQ ID NO: 83318 - protein, 9 aa, Homo Sapiens
IPARENSCE

SEQ ID NO: 83319 - protein, 9 aa, Homo Sapiens
FFWDDGENK

SEQ ID NO: 83320 - protein, 9 aa, Homo Sapiens
QMSKTNYQS

SEQ ID NO: 83321 - protein, 9 aa, Homo Sapiens
VREPLAGTS

SEQ ID NO: 83322 - protein, 9 aa, Homo Sapiens
LHSFLQSQV

SEQ ID NO: 83323 - protein, 9 aa, Homo Sapiens
AEKSFICKT

SEQ ID NO: 83324 - protein, 9 aa, Homo Sapiens
WSLKPENLL

SEQ ID NO: 83325 - protein, 9 aa, Homo Sapiens
SLLFAGALA

SEQ ID NO: 83326 - protein, 9 aa, Homo Sapiens
PHGFIQELV

SEQ ID NO: 83327 - protein, 9 aa, Homo Sapiens
SHSLETVFS

SEQ ID NO: 83328 - protein, 9 aa, Homo Sapiens
GGSGAGCSS

SEQ ID NO: 83329 - protein, 9 aa, Homo Sapiens
NMENLFVTW

SEQ ID NO: 83330 - protein, 9 aa, Homo Sapiens
GLAVLSERF

SEQ ID NO: 83331 - protein, 9 aa, Homo Sapiens
DKPYIAPSY

SEQ ID NO: 83332 - protein, 9 aa, Homo Sapiens
LLLFSLLFA

SEQ ID NO: 83333 - protein, 9 aa, Homo Sapiens
GGKTTTILR

SEQ ID NO: 83334 - protein, 9 aa, Homo Sapiens
WPPTIMPKQ

SEQ ID NO: 83335 - protein, 9 aa, Homo Sapiens
REVQLQVIV

SEQ ID NO: 83336 - protein, 9 aa, Homo Sapiens
QPPSVIRRL

SEQ ID NO: 83337 - protein, 9 aa, Homo Sapiens
CDAKEIQDA

SEQ ID NO: 83338 - protein, 9 aa, Homo Sapiens
NYISVLTGP

SEQ ID NO: 83339 - protein, 9 aa, Homo Sapiens
LQQPPSVIR

SEQ ID NO: 83340 - protein, 9 aa, Homo Sapiens
EYNRNTWVT

SEQ ID NO: 83341 - protein, 9 aa, Homo Sapiens
NRNTWVTGR

SEQ ID NO: 83342 - protein, 9 aa, Homo Sapiens
KVIHLPLLN

SEQ ID NO: 83343 - protein, 9 aa, Homo Sapiens
MTMGWRNYL

SEQ ID NO: 83344 - protein, 9 aa, Homo Sapiens
PLQISQSSP

SEQ ID NO: 83345 - protein, 9 aa, Homo Sapiens
DSRAPETIE

SEQ ID NO: 83346 - protein, 9 aa, Homo Sapiens
TFEDGSRED

SEQ ID NO: 83347 - protein, 9 aa, Homo Sapiens
CQEIHNKLL

SEQ ID NO: 83348 - protein, 9 aa, Homo Sapiens
TVERGPFPL

SEQ ID NO: 83349 - protein, 9 aa, Homo Sapiens
VFKKKFYIG

SEQ ID NO: 83350 - protein, 9 aa, Homo Sapiens
TKIYEKTEK

SEQ ID NO: 83351 - protein, 9 aa, Homo Sapiens
KCLCTDGNE

SEQ ID NO: 83352 - protein, 9 aa, Homo Sapiens
RMLTSPNHT

SEQ ID NO: 83353 - protein, 9 aa, Homo Sapiens
KLITGMIYP

SEQ ID NO: 83354 - protein, 9 aa, Homo Sapiens
IDTAVEQKA

SEQ ID NO: 83355 - protein, 9 aa, Homo Sapiens
DMKLVGINF

SEQ ID NO: 83356 - protein, 9 aa, Homo Sapiens
SKHSESHSL

SEQ ID NO: 83357 - protein, 9 aa, Homo Sapiens
SGRKRIPLT

SEQ ID NO: 83358 - protein, 9 aa, Homo Sapiens
KYPLILKKL

SEQ ID NO: 83359 - protein, 9 aa, Homo Sapiens
LKTYQPWGN

SEQ ID NO: 83360 - protein, 9 aa, Homo Sapiens
RIFTSPLNH

SEQ ID NO: 83361 - protein, 9 aa, Homo Sapiens
VGLIYKDMF

SEQ ID NO: 83362 - protein, 9 aa, Homo Sapiens
GKYTCDCGT

SEQ ID NO: 83363 - protein, 9 aa, Homo Sapiens
NCSIPCFWE

SEQ ID NO: 83364 - protein, 9 aa, Homo Sapiens
LTAEVPFRG

SEQ ID NO: 83365 - protein, 9 aa, Homo Sapiens
GLVETFGDI

SEQ ID NO: 83366 - protein, 9 aa, Homo Sapiens
GLIYKDMFL

SEQ ID NO: 83367 - protein, 9 aa, Homo Sapiens
EPQIYGLRW

SEQ ID NO: 83368 - protein, 9 aa, Homo Sapiens
AVDLWQFTP

SEQ ID NO: 83369 - protein, 9 aa, Homo Sapiens
LENLLIVVN

SEQ ID NO: 83370 - protein, 9 aa, Homo Sapiens
TNGNHQVRA

SEQ ID NO: 83371 - protein, 9 aa, Homo Sapiens
YSYASLITS

SEQ ID NO: 83372 - protein, 9 aa, Homo Sapiens
NIDFDKNDI

SEQ ID NO: 83373 - protein, 9 aa, Homo Sapiens
DSFGHLTNV

SEQ ID NO: 83374 - protein, 9 aa, Homo Sapiens
DGPVREPLA

SEQ ID NO: 83375 - protein, 9 aa, Homo Sapiens
TTKQMLRKD

SEQ ID NO: 83376 - protein, 9 aa, Homo Sapiens
EETILTFSE

SEQ ID NO: 83377 - protein, 9 aa, Homo Sapiens
KQINYSKAI

SEQ ID NO: 83378 - protein, 9 aa, Homo Sapiens
YDSFGHLTN

SEQ ID NO: 83379 - protein, 9 aa, Homo Sapiens
AVLCSTQVS

SEQ ID NO: 83380 - protein, 9 aa, Homo Sapiens
PIDLIKIQQ

SEQ ID NO: 83381 - protein, 9 aa, Homo Sapiens
LGRMGISAM

SEQ ID NO: 83382 - protein, 9 aa, Homo Sapiens
NQKQDMEIA

SEQ ID NO: 83383 - protein, 9 aa, Homo Sapiens
GYTGKVLPL

SEQ ID NO: 83384 - protein, 9 aa, Homo Sapiens
PEIILQVLK

SEQ ID NO: 83385 - protein, 9 aa, Homo Sapiens
EPFKEKECL

SEQ ID NO: 83386 - protein, 9 aa, Homo Sapiens
IVGELKKPR

SEQ ID NO: 83387 - protein, 9 aa, Homo Sapiens
MNVITGILK

SEQ ID NO: 83388 - protein, 9 aa, Homo Sapiens
CSYTSGPGS

SEQ ID NO: 83389 - protein, 9 aa, Homo Sapiens
GSMVLNKRK

SEQ ID NO: 83390 - protein, 9 aa, Homo Sapiens
EKWKEAILE

SEQ ID NO: 83391 - protein, 9 aa, Homo Sapiens
SLIAQWSPH

SEQ ID NO: 83392 - protein, 9 aa, Homo Sapiens
SSSTSSSGH

SEQ ID NO: 83393 - protein, 9 aa, Homo Sapiens
SMQRPRANT

SEQ ID NO: 83394 - protein, 9 aa, Homo Sapiens
FSHAEYFQK

SEQ ID NO: 83395 - protein, 9 aa, Homo Sapiens
ELKQTGRTD

SEQ ID NO: 83396 - protein, 9 aa, Homo Sapiens
RYASSYFCC

SEQ ID NO: 83397 - protein, 9 aa, Homo Sapiens
ANYPIYIIL

SEQ ID NO: 83398 - protein, 9 aa, Homo Sapiens
ELGYTGKVL

SEQ ID NO: 83399 - protein, 9 aa, Homo Sapiens
VDLIDKFVL

SEQ ID NO: 83400 - protein, 9 aa, Homo Sapiens
WWVILTISW

SEQ ID NO: 83401 - protein, 9 aa, Homo Sapiens
LNIKLQFCH

SEQ ID NO: 83402 - protein, 9 aa, Homo Sapiens
AEKKKVRKN

SEQ ID NO: 83403 - protein, 9 aa, Homo Sapiens
NAGQLKNGD

SEQ ID NO: 83404 - protein, 9 aa, Homo Sapiens
ELVQWSDNY

SEQ ID NO: 83405 - protein, 9 aa, Homo Sapiens
YYYSEPGRN

SEQ ID NO: 83406 - protein, 9 aa, Homo Sapiens
VNICPWLNY

SEQ ID NO: 83407 - protein, 9 aa, Homo Sapiens
QLYAKFGRN

SEQ ID NO: 83408 - protein, 9 aa, Homo Sapiens
GTAEELQEK

SEQ ID NO: 83409 - protein, 9 aa, Homo Sapiens
VTLLSFTCA

SEQ ID NO: 83410 - protein, 9 aa, Homo Sapiens
GYGGSGAGC

SEQ ID NO: 83411 - protein, 9 aa, Homo Sapiens
ANVPERYNV

SEQ ID NO: 83412 - protein, 9 aa, Homo Sapiens
QHMQQKELG

SEQ ID NO: 83413 - protein, 9 aa, Homo Sapiens
NLLIVVNII

SEQ ID NO: 83414 - protein, 9 aa, Homo Sapiens
EMHRIKRIK

SEQ ID NO: 83415 - protein, 9 aa, Homo Sapiens
NKVLLLSIK

SEQ ID NO: 83416 - protein, 9 aa, Homo Sapiens
TMGWRNYLM

SEQ ID NO: 83417 - protein, 9 aa, Homo Sapiens
FWDDGENKD

SEQ ID NO: 83418 - protein, 9 aa, Homo Sapiens
NGKKPIELR

SEQ ID NO: 83419 - protein, 9 aa, Homo Sapiens
VETLGCCNL

SEQ ID NO: 83420 - protein, 9 aa, Homo Sapiens
SQPIDLIKI

SEQ ID NO: 83421 - protein, 9 aa, Homo Sapiens
VQEKFLLPP

SEQ ID NO: 83422 - protein, 9 aa, Homo Sapiens
LRGQLEKSI

SEQ ID NO: 83423 - protein, 9 aa, Homo Sapiens
PLFSGKKVI

SEQ ID NO: 83424 - protein, 9 aa, Homo Sapiens
FSTSTYSNS

SEQ ID NO: 83425 - protein, 9 aa, Homo Sapiens
IDKFVLPKT

SEQ ID NO: 83426 - protein, 9 aa, Homo Sapiens
VLFGRKELF

SEQ ID NO: 83427 - protein, 9 aa, Homo Sapiens
EILEAISHN

SEQ ID NO: 83428 - protein, 9 aa, Homo Sapiens
LMQKYHKSN

SEQ ID NO: 83429 - protein, 9 aa, Homo Sapiens
DQKKYLYRY

SEQ ID NO: 83430 - protein, 9 aa, Homo Sapiens
EKTEKPCLL

SEQ ID NO: 83431 - protein, 9 aa, Homo Sapiens
GRTDISPRE

SEQ ID NO: 83432 - protein, 9 aa, Homo Sapiens
FYGVTSSTA

SEQ ID NO: 83433 - protein, 9 aa, Homo Sapiens
SPQSPPGKP

SEQ ID NO: 83434 - protein, 9 aa, Homo Sapiens
KIIHTEKKP

SEQ ID NO: 83435 - protein, 9 aa, Homo Sapiens
LLSFTCASS

SEQ ID NO: 83436 - protein, 9 aa, Homo Sapiens
SVVDSICKR

SEQ ID NO: 83437 - protein, 9 aa, Homo Sapiens
TMGKDPSPQ

SEQ ID NO: 83438 - protein, 9 aa, Homo Sapiens
NLKSHLENT

SEQ ID NO: 83439 - protein, 9 aa, Homo Sapiens
QMTGLTATG

SEQ ID NO: 83440 - protein, 9 aa, Homo Sapiens
CPGSCPSCT

SEQ ID NO: 83441 - protein, 9 aa, Homo Sapiens
KKLTNPRGL

SEQ ID NO: 83442 - protein, 9 aa, Homo Sapiens
TDTNGNHQV

SEQ ID NO: 83443 - protein, 9 aa, Homo Sapiens
NKKTYEDLR

SEQ ID NO: 83444 - protein, 9 aa, Homo Sapiens
DTNQSGGSD

SEQ ID NO: 83445 - protein, 9 aa, Homo Sapiens
VTKIAEKKK

SEQ ID NO: 83446 - protein, 9 aa, Homo Sapiens
SIDKNSKEA

SEQ ID NO: 83447 - protein, 9 aa, Homo Sapiens
SSLNSLEAL

SEQ ID NO: 83448 - protein, 9 aa, Homo Sapiens
ILTFSEVQG

SEQ ID NO: 83449 - protein, 9 aa, Homo Sapiens
EFNETSSSQ

SEQ ID NO: 83450 - protein, 9 aa, Homo Sapiens
GAHFLPVVQ

SEQ ID NO: 83451 - protein, 9 aa, Homo Sapiens
SISSIDKNS

SEQ ID NO: 83452 - protein, 9 aa, Homo Sapiens
SCAREVVRA

SEQ ID NO: 83453 - protein, 9 aa, Homo Sapiens
YGFVKAMIN

SEQ ID NO: 83454 - protein, 9 aa, Homo Sapiens
EREKQLQQL

SEQ ID NO: 83455 - protein, 9 aa, Homo Sapiens
TGTLRLLTP

SEQ ID NO: 83456 - protein, 9 aa, Homo Sapiens
ELERQMNME

SEQ ID NO: 83457 - protein, 9 aa, Homo Sapiens
LNPSHNAAG

SEQ ID NO: 83458 - protein, 9 aa, Homo Sapiens
MTKFLNDRW

SEQ ID NO: 83459 - protein, 9 aa, Homo Sapiens
MVLNKRKYR

SEQ ID NO: 83460 - protein, 9 aa, Homo Sapiens
VLCSTQVSM

SEQ ID NO: 83461 - protein, 9 aa, Homo Sapiens
ELQNKFTPG

SEQ ID NO: 83462 - protein, 9 aa, Homo Sapiens
KNGGKTTTI

SEQ ID NO: 83463 - protein, 9 aa, Homo Sapiens
QRYKGQVGN

SEQ ID NO: 83464 - protein, 9 aa, Homo Sapiens
FCQSYSEDF

SEQ ID NO: 83465 - protein, 9 aa, Homo Sapiens
KFLNDRWML

SEQ ID NO: 83466 - protein, 9 aa, Homo Sapiens
ENMFQYRRN

SEQ ID NO: 83467 - protein, 9 aa, Homo Sapiens
GEAEAMCAN

SEQ ID NO: 83468 - protein, 9 aa, Homo Sapiens
NHMLTGHDG

SEQ ID NO: 83469 - protein, 9 aa, Homo Sapiens
KHKKQPHDT

SEQ ID NO: 83470 - protein, 9 aa, Homo Sapiens
NGENFRTQK

SEQ ID NO: 83471 - protein, 9 aa, Homo Sapiens
EKFLLPPTT

SEQ ID NO: 83472 - protein, 9 aa, Homo Sapiens
INFYDPTSA

SEQ ID NO: 83473 - protein, 9 aa, Homo Sapiens
KDGRWFPDR

SEQ ID NO: 83474 - protein, 9 aa, Homo Sapiens
ICKTGESLL

SEQ ID NO: 83475 - protein, 9 aa, Homo Sapiens
PQNLVTDRL

SEQ ID NO: 83476 - protein, 9 aa, Homo Sapiens
KKTFDLQDW

SEQ ID NO: 83477 - protein, 9 aa, Homo Sapiens
LLTLPTDTN

SEQ ID NO: 83478 - protein, 9 aa, Homo Sapiens
HTIKRQQGS

SEQ ID NO: 83479 - protein, 9 aa, Homo Sapiens
VVPAAGLSA

SEQ ID NO: 83480 - protein, 9 aa, Homo Sapiens
SFGHLTNVT

SEQ ID NO: 83481 - protein, 9 aa, Homo Sapiens
EQFMEYQGA

SEQ ID NO: 83482 - protein, 9 aa, Homo Sapiens
QSSDNSDTN

SEQ ID NO: 83483 - protein, 9 aa, Homo Sapiens
MFDNGGTVF

SEQ ID NO: 83484 - protein, 9 aa, Homo Sapiens
IMFSTRKFL

SEQ ID NO: 83485 - protein, 9 aa, Homo Sapiens
NAGVFFFKC

SEQ ID NO: 83486 - protein, 9 aa, Homo Sapiens
TIPGPIILG

SEQ ID NO: 83487 - protein, 9 aa, Homo Sapiens
GGGLAVLSE

SEQ ID NO: 83488 - protein, 9 aa, Homo Sapiens
KGNNNERTT

SEQ ID NO: 83489 - protein, 9 aa, Homo Sapiens
EELQEKYKE

SEQ ID NO: 83490 - protein, 9 aa, Homo Sapiens
KAMINAGQL

SEQ ID NO: 83491 - protein, 9 aa, Homo Sapiens
ETLGRYGSC

SEQ ID NO: 83492 - protein, 9 aa, Homo Sapiens
PFVRRHAIH

SEQ ID NO: 83493 - protein, 9 aa, Homo Sapiens
QRPRANTCA

SEQ ID NO: 83494 - protein, 9 aa, Homo Sapiens
AEVKHVGDT

SEQ ID NO: 83495 - protein, 9 aa, Homo Sapiens
EDLIERDSG

SEQ ID NO: 83496 - protein, 9 aa, Homo Sapiens
SSSTSTSNS

SEQ ID NO: 83497 - protein, 9 aa, Homo Sapiens
VLLKTREEV

SEQ ID NO: 83498 - protein, 9 aa, Homo Sapiens
YMLCRNLPH

SEQ ID NO: 83499 - protein, 9 aa, Homo Sapiens
TVIVGKAPP

SEQ ID NO: 83500 - protein, 9 aa, Homo Sapiens
QADFLRPPG

SEQ ID NO: 83501 - protein, 9 aa, Homo Sapiens
SLAVTSYAT

SEQ ID NO: 83502 - protein, 9 aa, Homo Sapiens
RSVVDSICK

SEQ ID NO: 83503 - protein, 9 aa, Homo Sapiens
NSLEALMKK

SEQ ID NO: 83504 - protein, 9 aa, Homo Sapiens
VKRETSHPK

SEQ ID NO: 83505 - protein, 9 aa, Homo Sapiens
IQDSFKKET

SEQ ID NO: 83506 - protein, 9 aa, Homo Sapiens
SGDFSTSTY

SEQ ID NO: 83507 - protein, 9 aa, Homo Sapiens
ASKVQSEEP

SEQ ID NO: 83508 - protein, 9 aa, Homo Sapiens
LNAWKEKFM

SEQ ID NO: 83509 - protein, 9 aa, Homo Sapiens
YAEVKHVGD

SEQ ID NO: 83510 - protein, 9 aa, Homo Sapiens
IIRPLESYL

SEQ ID NO: 83511 - protein, 9 aa, Homo Sapiens
PSTGTLRLL

SEQ ID NO: 83512 - protein, 9 aa, Homo Sapiens
QRFGHGTEF

SEQ ID NO: 83513 - protein, 9 aa, Homo Sapiens
GSRLKKPIV

SEQ ID NO: 83514 - protein, 9 aa, Homo Sapiens
QDSRWVGAW

SEQ ID NO: 83515 - protein, 9 aa, Homo Sapiens
EKFDGVLRE

SEQ ID NO: 83516 - protein, 9 aa, Homo Sapiens
VPDPSKSLI

SEQ ID NO: 83517 - protein, 9 aa, Homo Sapiens
ARENSCEGG

SEQ ID NO: 83518 - protein, 9 aa, Homo Sapiens
FKREVQLQV

SEQ ID NO: 83519 - protein, 9 aa, Homo Sapiens
GLDAPLFGV

SEQ ID NO: 83520 - protein, 9 aa, Homo Sapiens
QYYSNVIAN

SEQ ID NO: 83521 - protein, 9 aa, Homo Sapiens
STVMSILYY

SEQ ID NO: 83522 - protein, 9 aa, Homo Sapiens
SLKPENLLT

SEQ ID NO: 83523 - protein, 9 aa, Homo Sapiens
LVSDEMVSL

SEQ ID NO: 83524 - protein, 9 aa, Homo Sapiens
YRFCSVSNE

SEQ ID NO: 83525 - protein, 9 aa, Homo Sapiens
LLLSIKNPL

SEQ ID NO: 83526 - protein, 9 aa, Homo Sapiens
LIPRPIEMS

SEQ ID NO: 83527 - protein, 9 aa, Homo Sapiens
SNESNDLLY

SEQ ID NO: 83528 - protein, 9 aa, Homo Sapiens
CGRAFRQSG

SEQ ID NO: 83529 - protein, 9 aa, Homo Sapiens
LLPPTTISV

SEQ ID NO: 83530 - protein, 9 aa, Homo Sapiens
FVHLPLSTR

SEQ ID NO: 83531 - protein, 9 aa, Homo Sapiens
KLKTYQPWG

SEQ ID NO: 83532 - protein, 9 aa, Homo Sapiens
LLNVQSRKQ

SEQ ID NO: 83533 - protein, 9 aa, Homo Sapiens
LTTKQMLRK

SEQ ID NO: 83534 - protein, 9 aa, Homo Sapiens
NPMKFLKNK

SEQ ID NO: 83535 - protein, 9 aa, Homo Sapiens
VKVFGKTVQ

SEQ ID NO: 83536 - protein, 9 aa, Homo Sapiens
KHSESHSLS

SEQ ID NO: 83537 - protein, 9 aa, Homo Sapiens
VYRFCSVSN

SEQ ID NO: 83538 - protein, 9 aa, Homo Sapiens
SHVHPNYFS

SEQ ID NO: 83539 - protein, 9 aa, Homo Sapiens
EKNHDNLFT

SEQ ID NO: 83540 - protein, 9 aa, Homo Sapiens
HSLAVTSYA

SEQ ID NO: 83541 - protein, 9 aa, Homo Sapiens
DVQEKFLLP

SEQ ID NO: 83542 - protein, 9 aa, Homo Sapiens
FSHSVWSFR

SEQ ID NO: 83543 - protein, 9 aa, Homo Sapiens
LPQTHSMGS

SEQ ID NO: 83544 - protein, 9 aa, Homo Sapiens
EDIDSQEIE

SEQ ID NO: 83545 - protein, 9 aa, Homo Sapiens
VKEDNIKAV

SEQ ID NO: 83546 - protein, 9 aa, Homo Sapiens
CTAVLCSTQ

SEQ ID NO: 83547 - protein, 9 aa, Homo Sapiens
STQVSMTMG

SEQ ID NO: 83548 - protein, 9 aa, Homo Sapiens
STRTWPPTI

SEQ ID NO: 83549 - protein, 9 aa, Homo Sapiens
RGRRKNLEG

SEQ ID NO: 83550 - protein, 9 aa, Homo Sapiens
RKRLQQHMQ

SEQ ID NO: 83551 - protein, 9 aa, Homo Sapiens
KEFNETSSS

SEQ ID NO: 83552 - protein, 9 aa, Homo Sapiens
GSKEEEKEE

SEQ ID NO: 83553 - protein, 9 aa, Homo Sapiens
QLEALELQK

SEQ ID NO: 83554 - protein, 9 aa, Homo Sapiens
FSEVQGMQE

SEQ ID NO: 83555 - protein, 9 aa, Homo Sapiens
ILLHFKFNN

SEQ ID NO: 83556 - protein, 9 aa, Homo Sapiens
SKNQNKSGG

SEQ ID NO: 83557 - protein, 9 aa, Homo Sapiens
GKVLPLELW

SEQ ID NO: 83558 - protein, 9 aa, Homo Sapiens
DELEQFMEY

SEQ ID NO: 83559 - protein, 9 aa, Homo Sapiens
LRDPQFSAN

SEQ ID NO: 83560 - protein, 9 aa, Homo Sapiens
PTDTNGNHQ

SEQ ID NO: 83561 - protein, 9 aa, Homo Sapiens
FQNLKSHLE

SEQ ID NO: 83562 - protein, 9 aa, Homo Sapiens
CALHDKAQK

SEQ ID NO: 83563 - protein, 9 aa, Homo Sapiens
DKGVLGRMG

SEQ ID NO: 83564 - protein, 9 aa, Homo Sapiens
SDNSDTNQS

SEQ ID NO: 83565 - protein, 9 aa, Homo Sapiens
ITGCREAIK

SEQ ID NO: 83566 - protein, 9 aa, Homo Sapiens
KVTYMFDNG

SEQ ID NO: 83567 - protein, 9 aa, Homo Sapiens
LSTPAVMWH

SEQ ID NO: 83568 - protein, 9 aa, Homo Sapiens
GYKFKGRSI

SEQ ID NO: 83569 - protein, 9 aa, Homo Sapiens
AVLSERFPP

SEQ ID NO: 83570 - protein, 9 aa, Homo Sapiens
LFAVLFGRK

SEQ ID NO: 83571 - protein, 9 aa, Homo Sapiens
EKTTKNELS

SEQ ID NO: 83572 - protein, 9 aa, Homo Sapiens
VQGGGLAVL

SEQ ID NO: 83573 - protein, 9 aa, Homo Sapiens
RALDNKLLS

SEQ ID NO: 83574 - protein, 9 aa, Homo Sapiens
QVKVFGKTV

SEQ ID NO: 83575 - protein, 9 aa, Homo Sapiens
QAKPHVLDM

SEQ ID NO: 83576 - protein, 9 aa, Homo Sapiens
THTRENEQA

SEQ ID NO: 83577 - protein, 9 aa, Homo Sapiens
LGYTGKVLP

SEQ ID NO: 83578 - protein, 9 aa, Homo Sapiens
VLLWELLTA

SEQ ID NO: 83579 - protein, 9 aa, Homo Sapiens
LKPENLLTR

SEQ ID NO: 83580 - protein, 9 aa, Homo Sapiens
FFAHCTGIK

SEQ ID NO: 83581 - protein, 9 aa, Homo Sapiens
MPNLKKRKG

SEQ ID NO: 83582 - protein, 9 aa, Homo Sapiens
FNYKQRGAF

SEQ ID NO: 83583 - protein, 9 aa, Homo Sapiens
LQISQSSPE

SEQ ID NO: 83584 - protein, 9 aa, Homo Sapiens
LPPIVASKV

SEQ ID NO: 83585 - protein, 9 aa, Homo Sapiens
IDTDKLITP

SEQ ID NO: 83586 - protein, 9 aa, Homo Sapiens
GRNINLEAD

SEQ ID NO: 83587 - protein, 9 aa, Homo Sapiens
AKKKDFSCK

SEQ ID NO: 83588 - protein, 9 aa, Homo Sapiens
EEKLKTYQP

SEQ ID NO: 83589 - protein, 9 aa, Homo Sapiens
HFLPVVQPL

SEQ ID NO: 83590 - protein, 9 aa, Homo Sapiens
CDLPQTHSM

SEQ ID NO: 83591 - protein, 9 aa, Homo Sapiens
VLDNPEMRR

SEQ ID NO: 83592 - protein, 9 aa, Homo Sapiens
GHKMKILQP

SEQ ID NO: 83593 - protein, 9 aa, Homo Sapiens
GELVQWSDN

SEQ ID NO: 83594 - protein, 9 aa, Homo Sapiens
YYMPAITGC

SEQ ID NO: 83595 - protein, 9 aa, Homo Sapiens
LFWSLKPEN

SEQ ID NO: 83596 - protein, 9 aa, Homo Sapiens
NQNKSGGLK

SEQ ID NO: 83597 - protein, 9 aa, Homo Sapiens
NMLGYKFKG

SEQ ID NO: 83598 - protein, 9 aa, Homo Sapiens
MQRPRANTC

SEQ ID NO: 83599 - protein, 9 aa, Homo Sapiens
QDEEGKIQQ

SEQ ID NO: 83600 - protein, 9 aa, Homo Sapiens
IPCFWETQP

SEQ ID NO: 83601 - protein, 9 aa, Homo Sapiens
VSNAQLDNK

SEQ ID NO: 83602 - protein, 9 aa, Homo Sapiens
SPNSVHGIY

SEQ ID NO: 83603 - protein, 9 aa, Homo Sapiens
AFCRYMIEI

SEQ ID NO: 83604 - protein, 9 aa, Homo Sapiens
RDIYDKEYY

SEQ ID NO: 83605 - protein, 9 aa, Homo Sapiens
DTSHLPQEL

SEQ ID NO: 83606 - protein, 9 aa, Homo Sapiens
TEQDTEKLK

SEQ ID NO: 83607 - protein, 9 aa, Homo Sapiens
HDKAQKREK

SEQ ID NO: 83608 - protein, 9 aa, Homo Sapiens
SKAPFGLKP

SEQ ID NO: 83609 - protein, 9 aa, Homo Sapiens
GQNPVSYVS

SEQ ID NO: 83610 - protein, 9 aa, Homo Sapiens
YPPASRSEN

SEQ ID NO: 83611 - protein, 9 aa, Homo Sapiens
EVLHSFLQS

SEQ ID NO: 83612 - protein, 9 aa, Homo Sapiens
KEKFMTVDQ

SEQ ID NO: 83613 - protein, 9 aa, Homo Sapiens
FLITVMAYD

SEQ ID NO: 83614 - protein, 9 aa, Homo Sapiens
ELQEKYKEL

SEQ ID NO: 83615 - protein, 9 aa, Homo Sapiens
QVTTSAATT

SEQ ID NO: 83616 - protein, 9 aa, Homo Sapiens
SHPKQKKTQ

SEQ ID NO: 83617 - protein, 9 aa, Homo Sapiens
SMVLNKRKY

SEQ ID NO: 83618 - protein, 9 aa, Homo Sapiens
PNKSDATIL

SEQ ID NO: 83619 - protein, 9 aa, Homo Sapiens
AYRQKKTFD

SEQ ID NO: 83620 - protein, 9 aa, Homo Sapiens
YTGKVLPLE

SEQ ID NO: 83621 - protein, 9 aa, Homo Sapiens
TGKVLPLEL

SEQ ID NO: 83622 - protein, 9 aa, Homo Sapiens
AQLDNKKNN

SEQ ID NO: 83623 - protein, 9 aa, Homo Sapiens
MIEIFVHGD

SEQ ID NO: 83624 - protein, 9 aa, Homo Sapiens
KVQSEEPAG

SEQ ID NO: 83625 - protein, 9 aa, Homo Sapiens
KKQPHDTTK

SEQ ID NO: 83626 - protein, 9 aa, Homo Sapiens
TSAATTPIL

SEQ ID NO: 83627 - protein, 9 aa, Homo Sapiens
LSRKLNPSH

SEQ ID NO: 83628 - protein, 9 aa, Homo Sapiens
IQKGNNNER

SEQ ID NO: 83629 - protein, 9 aa, Homo Sapiens
GNADVCQIF

SEQ ID NO: 83630 - protein, 9 aa, Homo Sapiens
SKVIHLPLL

SEQ ID NO: 83631 - protein, 9 aa, Homo Sapiens
SNAQLDNKK

SEQ ID NO: 83632 - protein, 9 aa, Homo Sapiens
LLDVKMQPP

SEQ ID NO: 83633 - protein, 9 aa, Homo Sapiens
TETAATFED

SEQ ID NO: 83634 - protein, 9 aa, Homo Sapiens
VMWHFVTLL

SEQ ID NO: 83635 - protein, 9 aa, Homo Sapiens
RLQQHMQQK

SEQ ID NO: 83636 - protein, 9 aa, Homo Sapiens
DMYCLVGLI

SEQ ID NO: 83637 - protein, 9 aa, Homo Sapiens
PVSYVSLEV

SEQ ID NO: 83638 - protein, 9 aa, Homo Sapiens
KQTGRTDIS

SEQ ID NO: 83639 - protein, 9 aa, Homo Sapiens
KYVFLMQKY

SEQ ID NO: 83640 - protein, 9 aa, Homo Sapiens
KVYIKTDGL

SEQ ID NO: 83641 - protein, 9 aa, Homo Sapiens
LPLELWMMG

SEQ ID NO: 83642 - protein, 9 aa, Homo Sapiens
WELGYTGKV

SEQ ID NO: 83643 - protein, 9 aa, Homo Sapiens
APSYLERKH

SEQ ID NO: 83644 - protein, 9 aa, Homo Sapiens
IGKYTCDCG

SEQ ID NO: 83645 - protein, 9 aa, Homo Sapiens
QPIDLIKIQ

SEQ ID NO: 83646 - protein, 9 aa, Homo Sapiens
FSANPVLAS

SEQ ID NO: 83647 - protein, 9 aa, Homo Sapiens
GPDVQEKFL

SEQ ID NO: 83648 - protein, 9 aa, Homo Sapiens
SEGDSETDR

SEQ ID NO: 83649 - protein, 9 aa, Homo Sapiens
PFKEKECLE

SEQ ID NO: 83650 - protein, 9 aa, Homo Sapiens
PRNQNFIIL

SEQ ID NO: 83651 - protein, 9 aa, Homo Sapiens
KAQVETSPE

SEQ ID NO: 83652 - protein, 9 aa, Homo Sapiens
SLSRSKSRS

SEQ ID NO: 83653 - protein, 9 aa, Homo Sapiens
EHLGKLLTV

SEQ ID NO: 83654 - protein, 9 aa, Homo Sapiens
DSLVINSKN

SEQ ID NO: 83655 - protein, 9 aa, Homo Sapiens
ENKDTIQNG

SEQ ID NO: 83656 - protein, 9 aa, Homo Sapiens
SILYYLGLM

SEQ ID NO: 83657 - protein, 9 aa, Homo Sapiens
SDAIPGQKI

SEQ ID NO: 83658 - protein, 9 aa, Homo Sapiens
LKKVPTNYF

SEQ ID NO: 83659 - protein, 9 aa, Homo Sapiens
NEDKMSLLK

SEQ ID NO: 83660 - protein, 9 aa, Homo Sapiens
LVPVLGCTA

SEQ ID NO: 83661 - protein, 9 aa, Homo Sapiens
GQVGNSEAA

SEQ ID NO: 83662 - protein, 9 aa, Homo Sapiens
AYKNYYYSE

SEQ ID NO: 83663 - protein, 9 aa, Homo Sapiens
LIDPFYVDQ

SEQ ID NO: 83664 - protein, 9 aa, Homo Sapiens
SAGTHTREN

SEQ ID NO: 83665 - protein, 9 aa, Homo Sapiens
HPFVRRHAI

SEQ ID NO: 83666 - protein, 9 aa, Homo Sapiens
TTLMDEKIK

SEQ ID NO: 83667 - protein, 9 aa, Homo Sapiens
FFSTVMSIL

SEQ ID NO: 83668 - protein, 9 aa, Homo Sapiens
LSDAIPGQK

SEQ ID NO: 83669 - protein, 9 aa, Homo Sapiens
SDIGKYTCD

SEQ ID NO: 83670 - protein, 9 aa, Homo Sapiens
AVFLICFVP

SEQ ID NO: 83671 - protein, 9 aa, Homo Sapiens
ARDIYDKEY

SEQ ID NO: 83672 - protein, 9 aa, Homo Sapiens
SVIEKPYQK

SEQ ID NO: 83673 - protein, 9 aa, Homo Sapiens
YAKVTYMFD

SEQ ID NO: 83674 - protein, 9 aa, Homo Sapiens
MSTMHKDVS

SEQ ID NO: 83675 - protein, 9 aa, Homo Sapiens
SAYRQKKTF

SEQ ID NO: 83676 - protein, 9 aa, Homo Sapiens
QYIFTEILK

SEQ ID NO: 83677 - protein, 9 aa, Homo Sapiens
LNVQSRKQQ

SEQ ID NO: 83678 - protein, 9 aa, Homo Sapiens
LFTGAQNEF

SEQ ID NO: 83679 - protein, 9 aa, Homo Sapiens
LPKTHKTSH

SEQ ID NO: 83680 - protein, 9 aa, Homo Sapiens
SSSLRDYPP

SEQ ID NO: 83681 - protein, 9 aa, Homo Sapiens
LKKLLKRTP

SEQ ID NO: 83682 - protein, 9 aa, Homo Sapiens
IKRCQEIHN

SEQ ID NO: 83683 - protein, 9 aa, Homo Sapiens
RTWPPTIMP

SEQ ID NO: 83684 - protein, 9 aa, Homo Sapiens
YKNYYYSEP

SEQ ID NO: 83685 - protein, 9 aa, Homo Sapiens
TILTFSEVQ

SEQ ID NO: 83686 - protein, 9 aa, Homo Sapiens
YEHLGKLLT

SEQ ID NO: 83687 - protein, 9 aa, Homo Sapiens
SIGQYYSNV

SEQ ID NO: 83688 - protein, 9 aa, Homo Sapiens
QFMEYQGAS

SEQ ID NO: 83689 - protein, 9 aa, Homo Sapiens
FFLFAVLFG

SEQ ID NO: 83690 - protein, 9 aa, Homo Sapiens
MGIEFREDS

SEQ ID NO: 83691 - protein, 9 aa, Homo Sapiens
NSDTNQSGG

SEQ ID NO: 83692 - protein, 9 aa, Homo Sapiens
ILGFTIDST

SEQ ID NO: 83693 - protein, 9 aa, Homo Sapiens
SKTKKRKSL

SEQ ID NO: 83694 - protein, 9 aa, Homo Sapiens
MQRPRKNKK

SEQ ID NO: 83695 - protein, 9 aa, Homo Sapiens
LRLTDSSSS

SEQ ID NO: 83696 - protein, 9 aa, Homo Sapiens
DPLQSCFIY

SEQ ID NO: 83697 - protein, 9 aa, Homo Sapiens
ELYHLTEKG

SEQ ID NO: 83698 - protein, 9 aa, Homo Sapiens
TPWSILPSS

SEQ ID NO: 83699 - protein, 9 aa, Homo Sapiens
AAKEKVFQS

SEQ ID NO: 83700 - protein, 9 aa, Homo Sapiens
MSILYYLGL

SEQ ID NO: 83701 - protein, 9 aa, Homo Sapiens
AVQEERQMS

SEQ ID NO: 83702 - protein, 9 aa, Homo Sapiens
FALRDQKKY

SEQ ID NO: 83703 - protein, 9 aa, Homo Sapiens
SKTNYQSFH

SEQ ID NO: 83704 - protein, 9 aa, Homo Sapiens
PLHILDSRA

SEQ ID NO: 83705 - protein, 9 aa, Homo Sapiens
ISQSSPESD

SEQ ID NO: 83706 - protein, 9 aa, Homo Sapiens
EDYEREKQL

SEQ ID NO: 83707 - protein, 9 aa, Homo Sapiens
RQMSRERAE

SEQ ID NO: 83708 - protein, 9 aa, Homo Sapiens
FVRRHAIHR

SEQ ID NO: 83709 - protein, 9 aa, Homo Sapiens
ASLITSAIN

SEQ ID NO: 83710 - protein, 9 aa, Homo Sapiens
EVQLQVIVK

SEQ ID NO: 83711 - protein, 9 aa, Homo Sapiens
KNSKEAITA

SEQ ID NO: 83712 - protein, 9 aa, Homo Sapiens
KRARHTIKR

SEQ ID NO: 83713 - protein, 9 aa, Homo Sapiens
YIAPSYLER

SEQ ID NO: 83714 - protein, 9 aa, Homo Sapiens
MYEHLGKLL

SEQ ID NO: 83715 - protein, 9 aa, Homo Sapiens
MNIQQKEDI

SEQ ID NO: 83716 - protein, 9 aa, Homo Sapiens
NKSGGLKSS

SEQ ID NO: 83717 - protein, 9 aa, Homo Sapiens
FVLPKTHKT

SEQ ID NO: 83718 - protein, 9 aa, Homo Sapiens
AGVFFFKCT

SEQ ID NO: 83719 - protein, 9 aa, Homo Sapiens
QNPWQAKPH

SEQ ID NO: 83720 - protein, 9 aa, Homo Sapiens
LMRDKIQIR

SEQ ID NO: 83721 - protein, 9 aa, Homo Sapiens
EAEKSFICK

SEQ ID NO: 83722 - protein, 9 aa, Homo Sapiens
KREKPSQGI

SEQ ID NO: 83723 - protein, 9 aa, Homo Sapiens
YCDAKEIQD

SEQ ID NO: 83724 - protein, 9 aa, Homo Sapiens
CKTGESLLS

SEQ ID NO: 83725 - protein, 9 aa, Homo Sapiens
IVASKVQSE

SEQ ID NO: 83726 - protein, 9 aa, Homo Sapiens
ILTLGTQMT

SEQ ID NO: 83727 - protein, 9 aa, Homo Sapiens
PHLPTKIYE

SEQ ID NO: 83728 - protein, 9 aa, Homo Sapiens
KNKAIIRHR

SEQ ID NO: 83729 - protein, 9 aa, Homo Sapiens
DKIQIREPV

SEQ ID NO: 83730 - protein, 9 aa, Homo Sapiens
KNVAELLVD

SEQ ID NO: 83731 - protein, 9 aa, Homo Sapiens
HSMGSRRTL

SEQ ID NO: 83732 - protein, 9 aa, Homo Sapiens
QLELFRTSD

SEQ ID NO: 83733 - protein, 9 aa, Homo Sapiens
NACDDDMDG

SEQ ID NO: 83734 - protein, 9 aa, Homo Sapiens
ASSPSTGTL

SEQ ID NO: 83735 - protein, 9 aa, Homo Sapiens
DAIPGQKIN

SEQ ID NO: 83736 - protein, 9 aa, Homo Sapiens
APSDIMGAG

SEQ ID NO: 83737 - protein, 9 aa, Homo Sapiens
IKNPLYPIT

SEQ ID NO: 83738 - protein, 9 aa, Homo Sapiens
SDDKSSLNS

SEQ ID NO: 83739 - protein, 9 aa, Homo Sapiens
RTSDLSSST

SEQ ID NO: 83740 - protein, 9 aa, Homo Sapiens
KKVPTNYFH

SEQ ID NO: 83741 - protein, 9 aa, Homo Sapiens
SACPGSCPS

SEQ ID NO: 83742 - protein, 9 aa, Homo Sapiens
VVDSICKRR

SEQ ID NO: 83743 - protein, 9 aa, Homo Sapiens
RHVGVVIGI

SEQ ID NO: 83744 - protein, 9 aa, Homo Sapiens
IEFREDSLV

SEQ ID NO: 83745 - protein, 9 aa, Homo Sapiens
WKEAILEEK

SEQ ID NO: 83746 - protein, 9 aa, Homo Sapiens
LRDQKKYLY

SEQ ID NO: 83747 - protein, 9 aa, Homo Sapiens
ENNHPPVFK

SEQ ID NO: 83748 - protein, 9 aa, Homo Sapiens
VDISTCLKE

SEQ ID NO: 83749 - protein, 9 aa, Homo Sapiens
SRKQQLPAI

SEQ ID NO: 83750 - protein, 9 aa, Homo Sapiens
AYCDAKEIQ

SEQ ID NO: 83751 - protein, 9 aa, Homo Sapiens
SDGPVREPL

SEQ ID NO: 83752 - protein, 9 aa, Homo Sapiens
KIRAEGLQM

SEQ ID NO: 83753 - protein, 9 aa, Homo Sapiens
FKKKFYIGG

SEQ ID NO: 83754 - protein, 9 aa, Homo Sapiens
TMYEHLGKL

SEQ ID NO: 83755 - protein, 9 aa, Homo Sapiens
RAVGWWKCL

SEQ ID NO: 83756 - protein, 9 aa, Homo Sapiens
NLVTDRLTE

SEQ ID NO: 83757 - protein, 9 aa, Homo Sapiens
IILQVLKQL

SEQ ID NO: 83758 - protein, 9 aa, Homo Sapiens
LTSPNHTSL

SEQ ID NO: 83759 - protein, 9 aa, Homo Sapiens
LDSRAPETI

SEQ ID NO: 83760 - protein, 9 aa, Homo Sapiens
GINFYDPTS

SEQ ID NO: 83761 - protein, 9 aa, Homo Sapiens
ILTEMISEC

SEQ ID NO: 83762 - protein, 9 aa, Homo Sapiens
GHLTNVTFP

SEQ ID NO: 83763 - protein, 9 aa, Homo Sapiens
SGLGRHVGV

SEQ ID NO: 83764 - protein, 9 aa, Homo Sapiens
AMSTMHKDV

SEQ ID NO: 83765 - protein, 9 aa, Homo Sapiens
QISQSSPES

SEQ ID NO: 83766 - protein, 9 aa, Homo Sapiens
NELVSDEMV

SEQ ID NO: 83767 - protein, 9 aa, Homo Sapiens
VFQSVPAGP

SEQ ID NO: 83768 - protein, 9 aa, Homo Sapiens
KKRKDYQPK

SEQ ID NO: 83769 - protein, 9 aa, Homo Sapiens
YYGKKKKKR

SEQ ID NO: 83770 - protein, 9 aa, Homo Sapiens
NRLRQKIKA

SEQ ID NO: 83771 - protein, 9 aa, Homo Sapiens
LIAQWSPHT

SEQ ID NO: 83772 - protein, 9 aa, Homo Sapiens
DLIKIQQKL

SEQ ID NO: 83773 - protein, 9 aa, Homo Sapiens
GACFTLIVG

SEQ ID NO: 83774 - protein, 9 aa, Homo Sapiens
TLYPTHRTT

SEQ ID NO: 83775 - protein, 9 aa, Homo Sapiens
MIYPQNKDG

SEQ ID NO: 83776 - protein, 9 aa, Homo Sapiens
ATGPDVQEK

SEQ ID NO: 83777 - protein, 9 aa, Homo Sapiens
LIHRTLGFQ

SEQ ID NO: 83778 - protein, 9 aa, Homo Sapiens
DTAVEQKAQ

SEQ ID NO: 83779 - protein, 9 aa, Homo Sapiens
SPLAEIDIK

SEQ ID NO: 83780 - protein, 9 aa, Homo Sapiens
GMTTRSEMP

SEQ ID NO: 83781 - protein, 9 aa, Homo Sapiens
DGRGNACDD

SEQ ID NO: 83782 - protein, 9 aa, Homo Sapiens
PDRISCSPK

SEQ ID NO: 83783 - protein, 9 aa, Homo Sapiens
LLFSLLFAG

SEQ ID NO: 83784 - protein, 9 aa, Homo Sapiens
PRANTCATR

SEQ ID NO: 83785 - protein, 9 aa, Homo Sapiens
TIAMSTMHK

SEQ ID NO: 83786 - protein, 9 aa, Homo Sapiens
LREQLELFR

SEQ ID NO: 83787 - protein, 9 aa, Homo Sapiens
IPYTLPPGS

SEQ ID NO: 83788 - protein, 9 aa, Homo Sapiens
AGPSFSKVI

SEQ ID NO: 83789 - protein, 9 aa, Homo Sapiens
EEKTTKNEL

SEQ ID NO: 83790 - protein, 9 aa, Homo Sapiens
DLIDKFVLP

SEQ ID NO: 83791 - protein, 9 aa, Homo Sapiens
PTDALSYMN

SEQ ID NO: 83792 - protein, 9 aa, Homo Sapiens
YLEQPSRSE

SEQ ID NO: 83793 - protein, 9 aa, Homo Sapiens
SILKGYKTY

SEQ ID NO: 83794 - protein, 9 aa, Homo Sapiens
LVNICPWLN

SEQ ID NO: 83795 - protein, 9 aa, Homo Sapiens
QEAAKEKVF

SEQ ID NO: 83796 - protein, 9 aa, Homo Sapiens
TFNEEFKIF

SEQ ID NO: 83797 - protein, 9 aa, Homo Sapiens
LGTQMTGLT

SEQ ID NO: 83798 - protein, 9 aa, Homo Sapiens
KQLQQLLTD

SEQ ID NO: 83799 - protein, 9 aa, Homo Sapiens
RSEFSKHLK

SEQ ID NO: 83800 - protein, 9 aa, Homo Sapiens
TKNELSAIS

SEQ ID NO: 83801 - protein, 9 aa, Homo Sapiens
FVLSTPAVM

SEQ ID NO: 83802 - protein, 9 aa, Homo Sapiens
ESGRKRIPL

SEQ ID NO: 83803 - protein, 9 aa, Homo Sapiens
GGACFTLIV

SEQ ID NO: 83804 - protein, 9 aa, Homo Sapiens
YEYDSFGHL

SEQ ID NO: 83805 - protein, 9 aa, Homo Sapiens
EERQMSRER

SEQ ID NO: 83806 - protein, 9 aa, Homo Sapiens
LTENMATVS

SEQ ID NO: 83807 - protein, 9 aa, Homo Sapiens
CLFTLKEEK

SEQ ID NO: 83808 - protein, 9 aa, Homo Sapiens
NGNHQVRAG

SEQ ID NO: 83809 - protein, 9 aa, Homo Sapiens
DDTTSWEDA

SEQ ID NO: 83810 - protein, 9 aa, Homo Sapiens
IEPQIYGLR

SEQ ID NO: 83811 - protein, 9 aa, Homo Sapiens
KPENLLTRL

SEQ ID NO: 83812 - protein, 9 aa, Homo Sapiens
DYPPASRSE

SEQ ID NO: 83813 - protein, 9 aa, Homo Sapiens
LVYKRYASS

SEQ ID NO: 83814 - protein, 9 aa, Homo Sapiens
KTYLRPITE

SEQ ID NO: 83815 - protein, 9 aa, Homo Sapiens
DDKSSLNSL

SEQ ID NO: 83816 - protein, 9 aa, Homo Sapiens
SEENDIFVS

SEQ ID NO: 83817 - protein, 9 aa, Homo Sapiens
QEALQPESG

SEQ ID NO: 83818 - protein, 9 aa, Homo Sapiens
DNKLLSLKT

SEQ ID NO: 83819 - protein, 9 aa, Homo Sapiens
MKLVGINFY

SEQ ID NO: 83820 - protein, 9 aa, Homo Sapiens
TFGDIFLHL

SEQ ID NO: 83821 - protein, 9 aa, Homo Sapiens
SSIDKNSKE

SEQ ID NO: 83822 - protein, 9 aa, Homo Sapiens
PLAEIDIKN

SEQ ID NO: 83823 - protein, 9 aa, Homo Sapiens
EEEAQEEAQ

SEQ ID NO: 83824 - protein, 9 aa, Homo Sapiens
GSCPSCTAV

SEQ ID NO: 83825 - protein, 9 aa, Homo Sapiens
TPSTGMTTR

SEQ ID NO: 83826 - protein, 9 aa, Homo Sapiens
RVRVLDKRK

SEQ ID NO: 83827 - protein, 9 aa, Homo Sapiens
TSFPGIPYT

SEQ ID NO: 83828 - protein, 9 aa, Homo Sapiens
VINENTRDS

SEQ ID NO: 83829 - protein, 9 aa, Homo Sapiens
YPDMNVITG

SEQ ID NO: 83830 - protein, 9 aa, Homo Sapiens
TILSDKNSS

SEQ ID NO: 83831 - protein, 9 aa, Homo Sapiens
PPFILAPQP

SEQ ID NO: 83832 - protein, 9 aa, Homo Sapiens
NADVCQIFI

SEQ ID NO: 83833 - protein, 9 aa, Homo Sapiens
RLLTPWSIL

SEQ ID NO: 83834 - protein, 9 aa, Homo Sapiens
VAPSDIMGA

SEQ ID NO: 83835 - protein, 9 aa, Homo Sapiens
RWFPDRISC

SEQ ID NO: 83836 - protein, 9 aa, Homo Sapiens
GWNIFDFLV

SEQ ID NO: 83837 - protein, 9 aa, Homo Sapiens
LVLLKTREE

SEQ ID NO: 83838 - protein, 9 aa, Homo Sapiens
RETSHPKQK

SEQ ID NO: 83839 - protein, 9 aa, Homo Sapiens
YHNLVPDSM

SEQ ID NO: 83840 - protein, 9 aa, Homo Sapiens
AGTHTRENE

SEQ ID NO: 83841 - protein, 9 aa, Homo Sapiens
NLNAGGHVD

SEQ ID NO: 83842 - protein, 9 aa, Homo Sapiens
KLLTVLLTL

SEQ ID NO: 83843 - protein, 9 aa, Homo Sapiens
SEFSKHLKE

SEQ ID NO: 83844 - protein, 9 aa, Homo Sapiens
SECTEQTLF

SEQ ID NO: 83845 - protein, 9 aa, Homo Sapiens
LELQKTYVL

SEQ ID NO: 83846 - protein, 9 aa, Homo Sapiens
QNCSIPCFW

SEQ ID NO: 83847 - protein, 9 aa, Homo Sapiens
KYSSCAREV

SEQ ID NO: 83848 - protein, 9 aa, Homo Sapiens
LEGLDLLFM

SEQ ID NO: 83849 - protein, 9 aa, Homo Sapiens
KTREEVLQL

SEQ ID NO: 83850 - protein, 9 aa, Homo Sapiens
AATFEDGSR

SEQ ID NO: 83851 - protein, 9 aa, Homo Sapiens
YKFKGRSIL

SEQ ID NO: 83852 - protein, 9 aa, Homo Sapiens
HRIKRIKSE

SEQ ID NO: 83853 - protein, 9 aa, Homo Sapiens
DGQVKPSPE

SEQ ID NO: 83854 - protein, 9 aa, Homo Sapiens
PIQKGNNNE

SEQ ID NO: 83855 - protein, 9 aa, Homo Sapiens
QGTVERGPF

SEQ ID NO: 83856 - protein, 9 aa, Homo Sapiens
IILSLENYS

SEQ ID NO: 83857 - protein, 9 aa, Homo Sapiens
TEEKLKTYQ

SEQ ID NO: 83858 - protein, 9 aa, Homo Sapiens
HSESHSLSR

SEQ ID NO: 83859 - protein, 9 aa, Homo Sapiens
QRVRVLDKR

SEQ ID NO: 83860 - protein, 9 aa, Homo Sapiens
QREGVSPRK

SEQ ID NO: 83861 - protein, 9 aa, Homo Sapiens
AEVPFRGID

SEQ ID NO: 83862 - protein, 9 aa, Homo Sapiens
DKAQKREKP

SEQ ID NO: 83863 - protein, 9 aa, Homo Sapiens
FSGDFSTST

SEQ ID NO: 83864 - protein, 9 aa, Homo Sapiens
EEGKIQQEY

SEQ ID NO: 83865 - protein, 9 aa, Homo Sapiens
VLPLELWMM

SEQ ID NO: 83866 - protein, 9 aa, Homo Sapiens
SRSPQSPPG

SEQ ID NO: 83867 - protein, 9 aa, Homo Sapiens
DPSKSLIAQ

SEQ ID NO: 83868 - protein, 9 aa, Homo Sapiens
AILEEKPYL

SEQ ID NO: 83869 - protein, 9 aa, Homo Sapiens
GQLEKSIQG

SEQ ID NO: 83870 - protein, 9 aa, Homo Sapiens
QRPRKNKKM

SEQ ID NO: 83871 - protein, 9 aa, Homo Sapiens
GCCNLICSD

SEQ ID NO: 83872 - protein, 9 aa, Homo Sapiens
ILTQPFYFL

SEQ ID NO: 83873 - protein, 9 aa, Homo Sapiens
PEAFFAHCT

SEQ ID NO: 83874 - protein, 9 aa, Homo Sapiens
KSSLNSLEA

SEQ ID NO: 83875 - protein, 9 aa, Homo Sapiens
GIEFREDSL

SEQ ID NO: 83876 - protein, 9 aa, Homo Sapiens
YHRRQREGR

SEQ ID NO: 83877 - protein, 9 aa, Homo Sapiens
STCLKEANE

SEQ ID NO: 83878 - protein, 9 aa, Homo Sapiens
ARRSSPGRM

SEQ ID NO: 83879 - protein, 9 aa, Homo Sapiens
TYQPWGNVP

SEQ ID NO: 83880 - protein, 9 aa, Homo Sapiens
KIQIREPVD

SEQ ID NO: 83881 - protein, 9 aa, Homo Sapiens
MLNLEEKFD

SEQ ID NO: 83882 - protein, 9 aa, Homo Sapiens
LSYMNIQQK

SEQ ID NO: 83883 - protein, 9 aa, Homo Sapiens
IEKPYQKSE

SEQ ID NO: 83884 - protein, 9 aa, Homo Sapiens
FNKKLITGM

SEQ ID NO: 83885 - protein, 9 aa, Homo Sapiens
GCTAPFGYR

SEQ ID NO: 83886 - protein, 9 aa, Homo Sapiens
PTRINKMNL

SEQ ID NO: 83887 - protein, 9 aa, Homo Sapiens
ETAATFEDG

SEQ ID NO: 83888 - protein, 9 aa, Homo Sapiens
GNIYLKQIN

SEQ ID NO: 83889 - protein, 9 aa, Homo Sapiens
AKQLSAQFY

SEQ ID NO: 83890 - protein, 9 aa, Homo Sapiens
TPPLQQPPS

SEQ ID NO: 83891 - protein, 9 aa, Homo Sapiens
QKINQQEEP

SEQ ID NO: 83892 - protein, 9 aa, Homo Sapiens
VEQKAQVET

SEQ ID NO: 83893 - protein, 9 aa, Homo Sapiens
LEDVVQRFG

SEQ ID NO: 83894 - protein, 9 aa, Homo Sapiens
ELQPSPNSV

SEQ ID NO: 83895 - protein, 9 aa, Homo Sapiens
LHFKFNNRT

SEQ ID NO: 83896 - protein, 9 aa, Homo Sapiens
IFVSTSEDE

SEQ ID NO: 83897 - protein, 9 aa, Homo Sapiens
LPPTTISVE

SEQ ID NO: 83898 - protein, 9 aa, Homo Sapiens
ALSYMNIQQ

SEQ ID NO: 83899 - protein, 9 aa, Homo Sapiens
DYEREKQLQ

SEQ ID NO: 83900 - protein, 9 aa, Homo Sapiens
EDIMFSTRK

SEQ ID NO: 83901 - protein, 9 aa, Homo Sapiens
WYLLDVKMQ

SEQ ID NO: 83902 - protein, 9 aa, Homo Sapiens
AKEIQDAIS

SEQ ID NO: 83903 - protein, 9 aa, Homo Sapiens
ESHSLSRSK

SEQ ID NO: 83904 - protein, 9 aa, Homo Sapiens
QMEDSEGDS

SEQ ID NO: 83905 - protein, 9 aa, Homo Sapiens
KAPFGLKPR

SEQ ID NO: 83906 - protein, 9 aa, Homo Sapiens
RRSSPGRMP

SEQ ID NO: 83907 - protein, 9 aa, Homo Sapiens
SRVTDLFNG

SEQ ID NO: 83908 - protein, 9 aa, Homo Sapiens
TNPMKFLKN

SEQ ID NO: 83909 - protein, 9 aa, Homo Sapiens
PVGKYHIQA

SEQ ID NO: 83910 - protein, 9 aa, Homo Sapiens
DSSSSSTST

SEQ ID NO: 83911 - protein, 9 aa, Homo Sapiens
VSTSEDEPE

SEQ ID NO: 83912 - protein, 9 aa, Homo Sapiens
LDVKMQPPG

SEQ ID NO: 83913 - protein, 9 aa, Homo Sapiens
RKQQLPAIN

SEQ ID NO: 83914 - protein, 9 aa, Homo Sapiens
TSRKHTTLM

SEQ ID NO: 83915 - protein, 9 aa, Homo Sapiens
NPWQAKPHV

SEQ ID NO: 83916 - protein, 9 aa, Homo Sapiens
SSEQMSKTN

SEQ ID NO: 83917 - protein, 9 aa, Homo Sapiens
AFLETYLDK

SEQ ID NO: 83918 - protein, 9 aa, Homo Sapiens
QALKIKEFN

SEQ ID NO: 83919 - protein, 9 aa, Homo Sapiens
LTHGDSVHK

SEQ ID NO: 83920 - protein, 9 aa, Homo Sapiens
FKEKECLEG

SEQ ID NO: 83921 - protein, 9 aa, Homo Sapiens
QLQQLLTDL

SEQ ID NO: 83922 - protein, 9 aa, Homo Sapiens
GKAPPETRL

SEQ ID NO: 83923 - protein, 9 aa, Homo Sapiens
LWMMGLTIS

SEQ ID NO: 83924 - protein, 9 aa, Homo Sapiens
SMTMGWRNY

SEQ ID NO: 83925 - protein, 9 aa, Homo Sapiens
DIYDKEYYS

SEQ ID NO: 83926 - protein, 9 aa, Homo Sapiens
MRDKIQIRE

SEQ ID NO: 83927 - protein, 9 aa, Homo Sapiens
VAENLNIKL

SEQ ID NO: 83928 - protein, 9 aa, Homo Sapiens
NVPDPSKSL

SEQ ID NO: 83929 - protein, 9 aa, Homo Sapiens
KKRKSLGLG

SEQ ID NO: 83930 - protein, 9 aa, Homo Sapiens
EDIEKEDID

SEQ ID NO: 83931 - protein, 9 aa, Homo Sapiens
EAVQEERQM

SEQ ID NO: 83932 - protein, 9 aa, Homo Sapiens
GRRKNLEGL

SEQ ID NO: 83933 - protein, 9 aa, Homo Sapiens
DGNEIQPDN

SEQ ID NO: 83934 - protein, 9 aa, Homo Sapiens
FSCKGAEDN

SEQ ID NO: 83935 - protein, 9 aa, Homo Sapiens
LIKLNQKQD

SEQ ID NO: 83936 - protein, 9 aa, Homo Sapiens
DSVHKVADG

SEQ ID NO: 83937 - protein, 9 aa, Homo Sapiens
LENTFKCND

SEQ ID NO: 83938 - protein, 9 aa, Homo Sapiens
AQLLKTVSS

SEQ ID NO: 83939 - protein, 9 aa, Homo Sapiens
GKLLTVLLT

SEQ ID NO: 83940 - protein, 9 aa, Homo Sapiens
VKHVGDTLL

SEQ ID NO: 83941 - protein, 9 aa, Homo Sapiens
SRSEFSKHL

SEQ ID NO: 83942 - protein, 9 aa, Homo Sapiens
EDTPCDDTT

SEQ ID NO: 83943 - protein, 9 aa, Homo Sapiens
VKVYIKTDG

SEQ ID NO: 83944 - protein, 9 aa, Homo Sapiens
SSDNSDTNQ

SEQ ID NO: 83945 - protein, 9 aa, Homo Sapiens
VSNESNDLL

SEQ ID NO: 83946 - protein, 9 aa, Homo Sapiens
VWWVILTIS

SEQ ID NO: 83947 - protein, 9 aa, Homo Sapiens
VADKVINEN

SEQ ID NO: 83948 - protein, 9 aa, Homo Sapiens
VSMTMGWRN

SEQ ID NO: 83949 - protein, 9 aa, Homo Sapiens
YTLPPGSAP

SEQ ID NO: 83950 - protein, 9 aa, Homo Sapiens
KIAEKKKVR

SEQ ID NO: 83951 - protein, 9 aa, Homo Sapiens
EIEPQIYGL

SEQ ID NO: 83952 - protein, 9 aa, Homo Sapiens
LEAISHNSV

SEQ ID NO: 83953 - protein, 9 aa, Homo Sapiens
DPNQQKIYD

SEQ ID NO: 83954 - protein, 9 aa, Homo Sapiens
EGRLREQEM

SEQ ID NO: 83955 - protein, 9 aa, Homo Sapiens
KTMMEKNEL

SEQ ID NO: 83956 - protein, 9 aa, Homo Sapiens
TPVYAEVKH

SEQ ID NO: 83957 - protein, 9 aa, Homo Sapiens
DNSDTNQSG

SEQ ID NO: 83958 - protein, 9 aa, Homo Sapiens
LVQWSDNYI

SEQ ID NO: 83959 - protein, 9 aa, Homo Sapiens
RLRQKIKAE

SEQ ID NO: 83960 - protein, 9 aa, Homo Sapiens
IYAKVTYMF

SEQ ID NO: 83961 - protein, 9 aa, Homo Sapiens
IYIILFCVR

SEQ ID NO: 83962 - protein, 9 aa, Homo Sapiens
VTDRLTENM

SEQ ID NO: 83963 - protein, 9 aa, Homo Sapiens
TATGPDVQE

SEQ ID NO: 83964 - protein, 9 aa, Homo Sapiens
VKNLYNTIL

SEQ ID NO: 83965 - protein, 9 aa, Homo Sapiens
MEDIMFSTR

SEQ ID NO: 83966 - protein, 9 aa, Homo Sapiens
LLKTREEVL

SEQ ID NO: 83967 - protein, 9 aa, Homo Sapiens
FLNDRWMLQ

SEQ ID NO: 83968 - protein, 9 aa, Homo Sapiens
MHTVPALDQ

SEQ ID NO: 83969 - protein, 9 aa, Homo Sapiens
GHPLDTSHL

SEQ ID NO: 83970 - protein, 9 aa, Homo Sapiens
TYMFDNGGT

SEQ ID NO: 83971 - protein, 9 aa, Homo Sapiens
KQSIGQYYS

SEQ ID NO: 83972 - protein, 9 aa, Homo Sapiens
LIDKFVLPK

SEQ ID NO: 83973 - protein, 9 aa, Homo Sapiens
LIYKDMFLD

SEQ ID NO: 83974 - protein, 9 aa, Homo Sapiens
FSTVMSILY

SEQ ID NO: 83975 - protein, 9 aa, Homo Sapiens
PDCGRAFRQ

SEQ ID NO: 83976 - protein, 9 aa, Homo Sapiens
SDNYISVLT

SEQ ID NO: 83977 - protein, 9 aa, Homo Sapiens
TSPLNHIYL

SEQ ID NO: 83978 - protein, 9 aa, Homo Sapiens
ATTPILTLG

SEQ ID NO: 83979 - protein, 9 aa, Homo Sapiens
IQDAISGIG

SEQ ID NO: 83980 - protein, 9 aa, Homo Sapiens
CAREVVRAE

SEQ ID NO: 83981 - protein, 9 aa, Homo Sapiens
CTDGNEIQP

SEQ ID NO: 83982 - protein, 9 aa, Homo Sapiens
KCTICNNSD

SEQ ID NO: 83983 - protein, 9 aa, Homo Sapiens
FNETSSSQL

SEQ ID NO: 83984 - protein, 9 aa, Homo Sapiens
YSHSLAVTS

SEQ ID NO: 83985 - protein, 9 aa, Homo Sapiens
MLKERQKDL

SEQ ID NO: 83986 - protein, 9 aa, Homo Sapiens
PENLLTRLL

SEQ ID NO: 83987 - protein, 9 aa, Homo Sapiens
ACFTLIVGE

SEQ ID NO: 83988 - protein, 9 aa, Homo Sapiens
DIMFSTRKF

SEQ ID NO: 83989 - protein, 9 aa, Homo Sapiens
EILTEMISE

SEQ ID NO: 83990 - protein, 9 aa, Homo Sapiens
DCDKYVFLM

SEQ ID NO: 83991 - protein, 9 aa, Homo Sapiens
KVINENTRD

SEQ ID NO: 83992 - protein, 9 aa, Homo Sapiens
CNHMLTGHD

SEQ ID NO: 83993 - protein, 9 aa, Homo Sapiens
AIDTAVEQK

SEQ ID NO: 83994 - protein, 9 aa, Homo Sapiens
GAEYNRNTW

SEQ ID NO: 83995 - protein, 9 aa, Homo Sapiens
IQFPKLLET

SEQ ID NO: 83996 - protein, 9 aa, Homo Sapiens
STIRITPQD

SEQ ID NO: 83997 - protein, 9 aa, Homo Sapiens
IGQYYSNVI

SEQ ID NO: 83998 - protein, 9 aa, Homo Sapiens
ISKKLTNPR

SEQ ID NO: 83999 - protein, 9 aa, Homo Sapiens
RYFTELIPR

SEQ ID NO: 84000 - protein, 9 aa, Homo Sapiens
TDALSYMNI

SEQ ID NO: 84001 - protein, 9 aa, Homo Sapiens
CSSDGPVRE

SEQ ID NO: 84002 - protein, 9 aa, Homo Sapiens
GMGIEFRED

SEQ ID NO: 84003 - protein, 9 aa, Homo Sapiens
VPCLIDTDK

SEQ ID NO: 84004 - protein, 9 aa, Homo Sapiens
ELVSDEMVS

SEQ ID NO: 84005 - protein, 9 aa, Homo Sapiens
IRPLESYLL

SEQ ID NO: 84006 - protein, 9 aa, Homo Sapiens
ELARALDNK

SEQ ID NO: 84007 - protein, 9 aa, Homo Sapiens
ICKRRFRVL

SEQ ID NO: 84008 - protein, 9 aa, Homo Sapiens
NSMEDIMFS

SEQ ID NO: 84009 - protein, 9 aa, Homo Sapiens
DMLKERQKD

SEQ ID NO: 84010 - protein, 9 aa, Homo Sapiens
RENEQALYE

SEQ ID NO: 84011 - protein, 9 aa, Homo Sapiens
ERQMNMENL

SEQ ID NO: 84012 - protein, 9 aa, Homo Sapiens
ITVMAYDHY

SEQ ID NO: 84013 - protein, 9 aa, Homo Sapiens
TKRMLTSPN

SEQ ID NO: 84014 - protein, 9 aa, Homo Sapiens
VFIIIAVFL

SEQ ID NO: 84015 - protein, 9 aa, Homo Sapiens
SLRESVIEK

SEQ ID NO: 84016 - protein, 9 aa, Homo Sapiens
HLNRLEIEP

SEQ ID NO: 84017 - protein, 9 aa, Homo Sapiens
NKKLITGMI

SEQ ID NO: 84018 - protein, 9 aa, Homo Sapiens
VFGIWRYKE

SEQ ID NO: 84019 - protein, 9 aa, Homo Sapiens
HKKQPHDTT

SEQ ID NO: 84020 - protein, 9 aa, Homo Sapiens
KMKILQPHV

SEQ ID NO: 84021 - protein, 9 aa, Homo Sapiens
TRENEQALY

SEQ ID NO: 84022 - protein, 9 aa, Homo Sapiens
KYTCDCGTD

SEQ ID NO: 84023 - protein, 9 aa, Homo Sapiens
KVFGKTVQA

SEQ ID NO: 84024 - protein, 9 aa, Homo Sapiens
SSPGRMPNL

SEQ ID NO: 84025 - protein, 9 aa, Homo Sapiens
GRNNMIQQK

SEQ ID NO: 84026 - protein, 9 aa, Homo Sapiens
RPLESYLLD

SEQ ID NO: 84027 - protein, 9 aa, Homo Sapiens
KRMLTSPNH

SEQ ID NO: 84028 - protein, 9 aa, Homo Sapiens
KTFDLQDWT

SEQ ID NO: 84029 - protein, 9 aa, Homo Sapiens
ILKGYKTYL

SEQ ID NO: 84030 - protein, 9 aa, Homo Sapiens
PAVMWHFVT

SEQ ID NO: 84031 - protein, 9 aa, Homo Sapiens
LSAQFYGVT

SEQ ID NO: 84032 - protein, 9 aa, Homo Sapiens
YWGPVDIST

SEQ ID NO: 84033 - protein, 9 aa, Homo Sapiens
EQMEDSEGD

SEQ ID NO: 84034 - protein, 9 aa, Homo Sapiens
SLLCSMSHV

SEQ ID NO: 84035 - protein, 9 aa, Homo Sapiens
KRKDYQPKY

SEQ ID NO: 84036 - protein, 9 aa, Homo Sapiens
IEKEDIDSQ

SEQ ID NO: 84037 - protein, 9 aa, Homo Sapiens
ENLNIKLQF

SEQ ID NO: 84038 - protein, 9 aa, Homo Sapiens
LKTREEVLQ

SEQ ID NO: 84039 - protein, 9 aa, Homo Sapiens
KLITPFVGL

SEQ ID NO: 84040 - protein, 9 aa, Homo Sapiens
QNKSGGLKS

SEQ ID NO: 84041 - protein, 9 aa, Homo Sapiens
LWTTPPLQH

SEQ ID NO: 84042 - protein, 9 aa, Homo Sapiens
LTKHSRVHL

SEQ ID NO: 84043 - protein, 9 aa, Homo Sapiens
ARYVGTLNN

SEQ ID NO: 84044 - protein, 9 aa, Homo Sapiens
ITRTWPVSG

SEQ ID NO: 84045 - protein, 9 aa, Homo Sapiens
LAADGKPGR

SEQ ID NO: 84046 - protein, 9 aa, Homo Sapiens
GTGCGGESI

SEQ ID NO: 84047 - protein, 9 aa, Homo Sapiens
QRPLDEPSA

SEQ ID NO: 84048 - protein, 9 aa, Homo Sapiens
RAIQTLVYF

SEQ ID NO: 84049 - protein, 9 aa, Homo Sapiens
GCGGESIFG

SEQ ID NO: 84050 - protein, 9 aa, Homo Sapiens
IIMQEVVCC

SEQ ID NO: 84051 - protein, 9 aa, Homo Sapiens
SRHNVLPEP

SEQ ID NO: 84052 - protein, 9 aa, Homo Sapiens
RPLDEPSAG

SEQ ID NO: 84053 - protein, 9 aa, Homo Sapiens
AFSGSYKLD

SEQ ID NO: 84054 - protein, 9 aa, Homo Sapiens
QLDKSASGV

SEQ ID NO: 84055 - protein, 9 aa, Homo Sapiens
DDNDCKTAI

SEQ ID NO: 84056 - protein, 9 aa, Homo Sapiens
FDSKSYDKT

SEQ ID NO: 84057 - protein, 9 aa, Homo Sapiens
CRTGVLLSS

SEQ ID NO: 84058 - protein, 9 aa, Homo Sapiens
RVKFTERSR

SEQ ID NO: 84059 - protein, 9 aa, Homo Sapiens
KFRDRRVKF

SEQ ID NO: 84060 - protein, 9 aa, Homo Sapiens
WTTPPLQHG

SEQ ID NO: 84061 - protein, 9 aa, Homo Sapiens
LGERPFHCN

SEQ ID NO: 84062 - protein, 9 aa, Homo Sapiens
GDPTGTGCG

SEQ ID NO: 84063 - protein, 9 aa, Homo Sapiens
AQEAMAGKG

SEQ ID NO: 84064 - protein, 9 aa, Homo Sapiens
HDVAPTSVT

SEQ ID NO: 84065 - protein, 9 aa, Homo Sapiens
TGDPTGTGC

SEQ ID NO: 84066 - protein, 9 aa, Homo Sapiens
RTWPVSGRF

SEQ ID NO: 84067 - protein, 9 aa, Homo Sapiens
VLWTTPPLQ

SEQ ID NO: 84068 - protein, 9 aa, Homo Sapiens
VHLGERPFH

SEQ ID NO: 84069 - protein, 9 aa, Homo Sapiens
LQPHADHAH

SEQ ID NO: 84070 - protein, 9 aa, Homo Sapiens
QQVLAADGK

SEQ ID NO: 84071 - protein, 9 aa, Homo Sapiens
YVRDVLSAT

SEQ ID NO: 84072 - protein, 9 aa, Homo Sapiens
PHDVAPTSV

SEQ ID NO: 84073 - protein, 9 aa, Homo Sapiens
SATFCTGFL

SEQ ID NO: 84074 - protein, 9 aa, Homo Sapiens
VLAPVPTLV

SEQ ID NO: 84075 - protein, 9 aa, Homo Sapiens
LSRHNVLPE

SEQ ID NO: 84076 - protein, 9 aa, Homo Sapiens
SREGLIRRG

SEQ ID NO: 84077 - protein, 9 aa, Homo Sapiens
EEMQVLQCT

SEQ ID NO: 84078 - protein, 9 aa, Homo Sapiens
LRDTDMNKK

SEQ ID NO: 84079 - protein, 9 aa, Homo Sapiens
EMQVLQCTA

SEQ ID NO: 84080 - protein, 9 aa, Homo Sapiens
PLDEPSAGL

SEQ ID NO: 84081 - protein, 9 aa, Homo Sapiens
QDDNDCKTA

SEQ ID NO: 84082 - protein, 9 aa, Homo Sapiens
TGCGGESIF

SEQ ID NO: 84083 - protein, 9 aa, Homo Sapiens
GFCWCMDPD

SEQ ID NO: 84084 - protein, 9 aa, Homo Sapiens
MNMFEAPTL

SEQ ID NO: 84085 - protein, 9 aa, Homo Sapiens
SAINFDSKS

SEQ ID NO: 84086 - protein, 9 aa, Homo Sapiens
ERAIQTLVY

SEQ ID NO: 84087 - protein, 9 aa, Homo Sapiens
RDRRVKFTE

SEQ ID NO: 84088 - protein, 9 aa, Homo Sapiens
VLQCTAGGN

SEQ ID NO: 84089 - protein, 9 aa, Homo Sapiens
RVTGGWGGR

SEQ ID NO: 84090 - protein, 9 aa, Homo Sapiens
AHADAPAIQ

SEQ ID NO: 84091 - protein, 9 aa, Homo Sapiens
GGWGGRQGP

SEQ ID NO: 84092 - protein, 9 aa, Homo Sapiens
AIQTLVYFP

SEQ ID NO: 84093 - protein, 9 aa, Homo Sapiens
PVSGRFTAP

SEQ ID NO: 84094 - protein, 9 aa, Homo Sapiens
APAIQPVLW

SEQ ID NO: 84095 - protein, 9 aa, Homo Sapiens
LQPLQPHAD

SEQ ID NO: 84096 - protein, 9 aa, Homo Sapiens
NFDSKSYDK

SEQ ID NO: 84097 - protein, 9 aa, Homo Sapiens
HAHADAPAI

SEQ ID NO: 84098 - protein, 9 aa, Homo Sapiens
RERWEQQVL

SEQ ID NO: 84099 - protein, 9 aa, Homo Sapiens
APSAINFDS

SEQ ID NO: 84100 - protein, 9 aa, Homo Sapiens
CCSAPYAML

SEQ ID NO: 84101 - protein, 9 aa, Homo Sapiens
AAARYVGTL

SEQ ID NO: 84102 - protein, 9 aa, Homo Sapiens
GSYKLDDGK

SEQ ID NO: 84103 - protein, 9 aa, Homo Sapiens
VCCSAPYAM

SEQ ID NO: 84104 - protein, 9 aa, Homo Sapiens
QPHADHAHA

SEQ ID NO: 84105 - protein, 9 aa, Homo Sapiens
KDAPPVEKI

SEQ ID NO: 84106 - protein, 9 aa, Homo Sapiens
NIPAKDAPP

SEQ ID NO: 84107 - protein, 9 aa, Homo Sapiens
GWGGRQGPS

SEQ ID NO: 84108 - protein, 9 aa, Homo Sapiens
TNIPAKDAP

SEQ ID NO: 84109 - protein, 9 aa, Homo Sapiens
PEPHLALQP

SEQ ID NO: 84110 - protein, 9 aa, Homo Sapiens
WSELLAFDH

SEQ ID NO: 84111 - protein, 9 aa, Homo Sapiens
RDVLSATFC

SEQ ID NO: 84112 - protein, 9 aa, Homo Sapiens
HLALQPLQP

SEQ ID NO: 84113 - protein, 9 aa, Homo Sapiens
QPLQPHADH

SEQ ID NO: 84114 - protein, 9 aa, Homo Sapiens
LPEPHLALQ

SEQ ID NO: 84115 - protein, 9 aa, Homo Sapiens
TGVLLSSSP

SEQ ID NO: 84116 - protein, 9 aa, Homo Sapiens
TGGWGGRQG

SEQ ID NO: 84117 - protein, 9 aa, Homo Sapiens
NMFEAPTLP

SEQ ID NO: 84118 - protein, 9 aa, Homo Sapiens
PPVEKIDTM

SEQ ID NO: 84119 - protein, 9 aa, Homo Sapiens
SGSYKLDDG

SEQ ID NO: 84120 - protein, 9 aa, Homo Sapiens
EPHLALQPL

SEQ ID NO: 84121 - protein, 9 aa, Homo Sapiens
VPTLVLAPM

SEQ ID NO: 84122 - protein, 9 aa, Homo Sapiens
VIQTLQAPH

SEQ ID NO: 84123 - protein, 9 aa, Homo Sapiens
AKRTAAQEA

SEQ ID NO: 84124 - protein, 9 aa, Homo Sapiens
SELLAFDHI

SEQ ID NO: 84125 - protein, 9 aa, Homo Sapiens
CGGESIFGQ

SEQ ID NO: 84126 - protein, 9 aa, Homo Sapiens
DPSQRPLDE

SEQ ID NO: 84127 - protein, 9 aa, Homo Sapiens
AFDHIYRQV

SEQ ID NO: 84128 - protein, 9 aa, Homo Sapiens
RHNVLPEPH

SEQ ID NO: 84129 - protein, 9 aa, Homo Sapiens
FSGSYKLDD

SEQ ID NO: 84130 - protein, 9 aa, Homo Sapiens
QSREGLIRR

SEQ ID NO: 84131 - protein, 9 aa, Homo Sapiens
IPAKDAPPV

SEQ ID NO: 84132 - protein, 9 aa, Homo Sapiens
VLPEPHLAL

SEQ ID NO: 84133 - protein, 9 aa, Homo Sapiens
REGLIRRGV

SEQ ID NO: 84134 - protein, 9 aa, Homo Sapiens
VGTLNNVVC

SEQ ID NO: 84135 - protein, 9 aa, Homo Sapiens
LSATFCTGF

SEQ ID NO: 84136 - protein, 9 aa, Homo Sapiens
FRDRRVKFT

SEQ ID NO: 84137 - protein, 9 aa, Homo Sapiens
ERWEQQVLA

SEQ ID NO: 84138 - protein, 9 aa, Homo Sapiens
TPPLQHGHR

SEQ ID NO: 84139 - protein, 9 aa, Homo Sapiens
LLSSSPEAE

SEQ ID NO: 84140 - protein, 9 aa, Homo Sapiens
EDLQLDKSA

SEQ ID NO: 84141 - protein, 9 aa, Homo Sapiens
RYVGTLNNV

SEQ ID NO: 84142 - protein, 9 aa, Homo Sapiens
TTPPLQHGH

SEQ ID NO: 84143 - protein, 9 aa, Homo Sapiens
QCTAGGNVN

SEQ ID NO: 84144 - protein, 9 aa, Homo Sapiens
PVPTLVLAP

SEQ ID NO: 84145 - protein, 9 aa, Homo Sapiens
RTAAQEAMA

SEQ ID NO: 84146 - protein, 9 aa, Homo Sapiens
GAPSAINFD

SEQ ID NO: 84147 - protein, 9 aa, Homo Sapiens
EVVCCSAPY

SEQ ID NO: 84148 - protein, 9 aa, Homo Sapiens
RRVKFTERS

SEQ ID NO: 84149 - protein, 9 aa, Homo Sapiens
AIQPVLWTT

SEQ ID NO: 84150 - protein, 9 aa, Homo Sapiens
RDTDMNKKD

SEQ ID NO: 84151 - protein, 9 aa, Homo Sapiens
DEPSAGLGE

SEQ ID NO: 84152 - protein, 9 aa, Homo Sapiens
CTAGGNVNV

SEQ ID NO: 84153 - protein, 9 aa, Homo Sapiens
TAAQEAMAG

SEQ ID NO: 84154 - protein, 9 aa, Homo Sapiens
RWEQQVLAA

SEQ ID NO: 84155 - protein, 9 aa, Homo Sapiens
ATFCTGFLF

SEQ ID NO: 84156 - protein, 9 aa, Homo Sapiens
TFCTGFLFS

SEQ ID NO: 84157 - protein, 9 aa, Homo Sapiens
DHAHADAPA

SEQ ID NO: 84158 - protein, 9 aa, Homo Sapiens
KGSVHGLRN

SEQ ID NO: 84159 - protein, 9 aa, Homo Sapiens
SSSPEAEVP

SEQ ID NO: 84160 - protein, 9 aa, Homo Sapiens
WPVSGRFTA

SEQ ID NO: 84161 - protein, 9 aa, Homo Sapiens
GVLLSSSPE

SEQ ID NO: 84162 - protein, 9 aa, Homo Sapiens
KRVTGGWGG

SEQ ID NO: 84163 - protein, 9 aa, Homo Sapiens
VYFPVGDGD

SEQ ID NO: 84164 - protein, 9 aa, Homo Sapiens
PGAPSAINF

SEQ ID NO: 84165 - protein, 9 aa, Homo Sapiens
TRTWPVSGR

SEQ ID NO: 84166 - protein, 9 aa, Homo Sapiens
NCWSELLAF

SEQ ID NO: 84167 - protein, 9 aa, Homo Sapiens
QVLAADGKP

SEQ ID NO: 84168 - protein, 9 aa, Homo Sapiens
DVLSATFCT

SEQ ID NO: 84169 - protein, 9 aa, Homo Sapiens
LVLAPMPAS

SEQ ID NO: 84170 - protein, 9 aa, Homo Sapiens
PDPSQRPLD

SEQ ID NO: 84171 - protein, 9 aa, Homo Sapiens
LCRTGVLLS

SEQ ID NO: 84172 - protein, 9 aa, Homo Sapiens
LQHGHRHGL

SEQ ID NO: 84173 - protein, 9 aa, Homo Sapiens
VLSATFCTG

SEQ ID NO: 84174 - protein, 9 aa, Homo Sapiens
CWCMDPDGH

SEQ ID NO: 84175 - protein, 9 aa, Homo Sapiens
AARYVGTLN

SEQ ID NO: 84176 - protein, 9 aa, Homo Sapiens
LDEPSAGLG

SEQ ID NO: 84177 - protein, 9 aa, Homo Sapiens
KHSRVHLGE

SEQ ID NO: 84178 - protein, 9 aa, Homo Sapiens
PSQRPLDEP

SEQ ID NO: 84179 - protein, 9 aa, Homo Sapiens
SQRPLDEPS

SEQ ID NO: 84180 - protein, 9 aa, Homo Sapiens
FCWCMDPDG

SEQ ID NO: 84181 - protein, 9 aa, Homo Sapiens
VRDVLSATF

SEQ ID NO: 84182 - protein, 9 aa, Homo Sapiens
RVHLGERPF

SEQ ID NO: 84183 - protein, 9 aa, Homo Sapiens
ADHAHADAP

SEQ ID NO: 84184 - protein, 9 aa, Homo Sapiens
IQTLQAPHD

SEQ ID NO: 84185 - protein, 9 aa, Homo Sapiens
STGFCWCMD

SEQ ID NO: 84186 - protein, 9 aa, Homo Sapiens
QTLVYFPVG

SEQ ID NO: 84187 - protein, 9 aa, Homo Sapiens
LQCTAGGNV

SEQ ID NO: 84188 - protein, 9 aa, Homo Sapiens
DAKRTAAQE

SEQ ID NO: 84189 - protein, 9 aa, Homo Sapiens
CWSELLAFD

SEQ ID NO: 84190 - protein, 9 aa, Homo Sapiens
HLGERPFHC

SEQ ID NO: 84191 - protein, 9 aa, Homo Sapiens
GSVHGLRNG

SEQ ID NO: 84192 - protein, 9 aa, Homo Sapiens
GLIRRGVLK

SEQ ID NO: 84193 - protein, 9 aa, Homo Sapiens
MQEVVCCSA

SEQ ID NO: 84194 - protein, 9 aa, Homo Sapiens
ALSRHNVLP

SEQ ID NO: 84195 - protein, 9 aa, Homo Sapiens
LVLAPVPTL

SEQ ID NO: 84196 - protein, 9 aa, Homo Sapiens
VHGLRNGVL

SEQ ID NO: 84197 - protein, 9 aa, Homo Sapiens
DITRTWPVS

SEQ ID NO: 84198 - protein, 9 aa, Homo Sapiens
QEAMAGKGR

SEQ ID NO: 84199 - protein, 9 aa, Homo Sapiens
QPVLWTTPP

SEQ ID NO: 84200 - protein, 9 aa, Homo Sapiens
GSTGFCWCM

SEQ ID NO: 84201 - protein, 9 aa, Homo Sapiens
TMKFRDRRV

SEQ ID NO: 84202 - protein, 9 aa, Homo Sapiens
PTGTGCGGE

SEQ ID NO: 84203 - protein, 9 aa, Homo Sapiens
NVLPEPHLA

SEQ ID NO: 84204 - protein, 9 aa, Homo Sapiens
MAFSGSYKL

SEQ ID NO: 84205 - protein, 9 aa, Homo Sapiens
LGFIMNMFE

SEQ ID NO: 84206 - protein, 9 aa, Homo Sapiens
PVLWTTPPL

SEQ ID NO: 84207 - protein, 9 aa, Homo Sapiens
HADHAHADA

SEQ ID NO: 84208 - protein, 9 aa, Homo Sapiens
DAPAIQPVL

SEQ ID NO: 84209 - protein, 9 aa, Homo Sapiens
PAIQPVLWT

SEQ ID NO: 84210 - protein, 9 aa, Homo Sapiens
HADAPAIQP

SEQ ID NO: 84211 - protein, 9 aa, Homo Sapiens
KRTAAQEAM

SEQ ID NO: 84212 - protein, 9 aa, Homo Sapiens
VVCCSAPYA

SEQ ID NO: 84213 - protein, 9 aa, Homo Sapiens
RPQAAARYV

SEQ ID NO: 84214 - protein, 9 aa, Homo Sapiens
QTLQAPHDV

SEQ ID NO: 84215 - protein, 9 aa, Homo Sapiens
KAKRVTGGW

SEQ ID NO: 84216 - protein, 9 aa, Homo Sapiens
KERAIQTLV

SEQ ID NO: 84217 - protein, 9 aa, Homo Sapiens
LLAFDHIYR

SEQ ID NO: 84218 - protein, 9 aa, Homo Sapiens
VSGRFTAPQ

SEQ ID NO: 84219 - protein, 9 aa, Homo Sapiens
DLQLDKSAS

SEQ ID NO: 84220 - protein, 9 aa, Homo Sapiens
ADAPAIQPV

SEQ ID NO: 84221 - protein, 9 aa, Homo Sapiens
MQVLQCTAG

SEQ ID NO: 84222 - protein, 9 aa, Homo Sapiens
IQTLVYFPV

SEQ ID NO: 84223 - protein, 9 aa, Homo Sapiens
MKFRDRRVK

SEQ ID NO: 84224 - protein, 9 aa, Homo Sapiens
PQAAARYVG

SEQ ID NO: 84225 - protein, 9 aa, Homo Sapiens
PSAINFDSK

SEQ ID NO: 84226 - protein, 9 aa, Homo Sapiens
AKDAPPVEK

SEQ ID NO: 84227 - protein, 9 aa, Homo Sapiens
IMNMFEAPT

SEQ ID NO: 84228 - protein, 9 aa, Homo Sapiens
LQLDKSASG

SEQ ID NO: 84229 - protein, 9 aa, Homo Sapiens
RQSREGLIR

SEQ ID NO: 84230 - protein, 9 aa, Homo Sapiens
INFDSKSYD

SEQ ID NO: 84231 - protein, 9 aa, Homo Sapiens
SASGVKEEW

SEQ ID NO: 84232 - protein, 9 aa, Homo Sapiens
RTGVLLSSS

SEQ ID NO: 84233 - protein, 9 aa, Homo Sapiens
IQPVLWTTP

SEQ ID NO: 84234 - protein, 9 aa, Homo Sapiens
EAPTLPDIS

SEQ ID NO: 84235 - protein, 9 aa, Homo Sapiens
ISTRQSREG

SEQ ID NO: 84236 - protein, 9 aa, Homo Sapiens
QNCWSELLA

SEQ ID NO: 84237 - protein, 9 aa, Homo Sapiens
FIMNMFEAP

SEQ ID NO: 84238 - protein, 9 aa, Homo Sapiens
TDAKRTAAQ

SEQ ID NO: 84239 - protein, 9 aa, Homo Sapiens
HSRVHLGER

SEQ ID NO: 84240 - protein, 9 aa, Homo Sapiens
APPVEKIDT

SEQ ID NO: 84241 - protein, 9 aa, Homo Sapiens
QVLQCTAGG

SEQ ID NO: 84242 - protein, 9 aa, Homo Sapiens
ELLAFDHIY

SEQ ID NO: 84243 - protein, 9 aa, Homo Sapiens
DQDDNDCKT

SEQ ID NO: 84244 - protein, 9 aa, Homo Sapiens
VLAADGKPG

SEQ ID NO: 84245 - protein, 9 aa, Homo Sapiens
PTLVLAPMP

SEQ ID NO: 84246 - protein, 9 aa, Homo Sapiens
TKHSRVHLG

SEQ ID NO: 84247 - protein, 9 aa, Homo Sapiens
DRRVKFTER

SEQ ID NO: 84248 - protein, 9 aa, Homo Sapiens
KTMKFRDRR

SEQ ID NO: 84249 - protein, 9 aa, Homo Sapiens
LYKGSVHGL

SEQ ID NO: 84250 - protein, 9 aa, Homo Sapiens
AAQEAMAGK

SEQ ID NO: 84251 - protein, 9 aa, Homo Sapiens
YVGTLNNVV

SEQ ID NO: 84252 - protein, 9 aa, Homo Sapiens
KSASGVKEE

SEQ ID NO: 84253 - protein, 9 aa, Homo Sapiens
NPAALSRHN

SEQ ID NO: 84254 - protein, 9 aa, Homo Sapiens
TRQSREGLI

SEQ ID NO: 84255 - protein, 9 aa, Homo Sapiens
AKRVTGGWG

SEQ ID NO: 84256 - protein, 9 aa, Homo Sapiens
CSAPYAMLE

SEQ ID NO: 84257 - protein, 9 aa, Homo Sapiens
REDLQLDKS

SEQ ID NO: 84258 - protein, 9 aa, Homo Sapiens
YKGSVHGLR

SEQ ID NO: 84259 - protein, 9 aa, Homo Sapiens
CMDPDGHEV

SEQ ID NO: 84260 - protein, 9 aa, Homo Sapiens
LRNGVLLDR

SEQ ID NO: 84261 - protein, 9 aa, Homo Sapiens
GFIMNMFEA

SEQ ID NO: 84262 - protein, 9 aa, Homo Sapiens
TWPVSGRFT

SEQ ID NO: 84263 - protein, 9 aa, Homo Sapiens
ALQPLQPHA

SEQ ID NO: 84264 - protein, 9 aa, Homo Sapiens
PAALSRHNV

SEQ ID NO: 84265 - protein, 9 aa, Homo Sapiens
HGLRNGVLL

SEQ ID NO: 84266 - protein, 9 aa, Homo Sapiens
DPTGTGCGG

SEQ ID NO: 84267 - protein, 9 aa, Homo Sapiens
LAPVPTLVL

SEQ ID NO: 84268 - protein, 9 aa, Homo Sapiens
IMQEVVCCS

SEQ ID NO: 84269 - protein, 9 aa, Homo Sapiens
VTGGWGGRQ

SEQ ID NO: 84270 - protein, 9 aa, Homo Sapiens
PLQPHADHA

SEQ ID NO: 84271 - protein, 9 aa, Homo Sapiens
GLRNGVLLD

SEQ ID NO: 84272 - protein, 9 aa, Homo Sapiens
DKSASGVKE

SEQ ID NO: 84273 - protein, 9 aa, Homo Sapiens
LALQPLQPH

SEQ ID NO: 84274 - protein, 9 aa, Homo Sapiens
HNVLPEPHL

SEQ ID NO: 84275 - protein, 9 aa, Homo Sapiens
PHLALQPLQ

SEQ ID NO: 84276 - protein, 9 aa, Homo Sapiens
PLQHGHRHG

SEQ ID NO: 84277 - protein, 9 aa, Homo Sapiens
PAKDAPPVE

SEQ ID NO: 84278 - protein, 9 aa, Homo Sapiens
TLQAPHDVA

SEQ ID NO: 84279 - protein, 9 aa, Homo Sapiens
AALSRHNVL

SEQ ID NO: 84280 - protein, 9 aa, Homo Sapiens
STRQSREGL

SEQ ID NO: 84281 - protein, 9 aa, Homo Sapiens
TGFCWCMDP

SEQ ID NO: 84282 - protein, 9 aa, Homo Sapiens
WGGRQGPSP

SEQ ID NO: 84283 - protein, 9 aa, Homo Sapiens
FEAPTLPDI

SEQ ID NO: 84284 - protein, 9 aa, Homo Sapiens
QAPHDVAPT

SEQ ID NO: 84285 - protein, 9 aa, Homo Sapiens
TLVYFPVGD

SEQ ID NO: 84286 - protein, 9 aa, Homo Sapiens
VLLSSSPEA

SEQ ID NO: 84287 - protein, 9 aa, Homo Sapiens
SGRFTAPQA

SEQ ID NO: 84288 - protein, 9 aa, Homo Sapiens
MDPDGHEVP

SEQ ID NO: 84289 - protein, 9 aa, Homo Sapiens
LAFDHIYRQ

SEQ ID NO: 84290 - protein, 9 aa, Homo Sapiens
EQQVLAADG

SEQ ID NO: 84291 - protein, 9 aa, Homo Sapiens
LSSSPEAEV

SEQ ID NO: 84292 - protein, 9 aa, Homo Sapiens
SRVHLGERP

SEQ ID NO: 84293 - protein, 9 aa, Homo Sapiens
APVPTLVLA

SEQ ID NO: 84294 - protein, 9 aa, Homo Sapiens
EGLIRRGVL

SEQ ID NO: 84295 - protein, 9 aa, Homo Sapiens
DAPPVEKID

SEQ ID NO: 84296 - protein, 9 aa, Homo Sapiens
TGTGCGGES

SEQ ID NO: 84297 - protein, 9 aa, Homo Sapiens
TLVLAPMPA

SEQ ID NO: 84298 - protein, 9 aa, Homo Sapiens
AINFDSKSY

SEQ ID NO: 84299 - protein, 9 aa, Homo Sapiens
PHADHAHAD

SEQ ID NO: 84300 - protein, 9 aa, Homo Sapiens
LDKSASGVK

SEQ ID NO: 84301 - protein, 9 aa, Homo Sapiens
GDQDDNDCK

SEQ ID NO: 84302 - protein, 9 aa, Homo Sapiens
WCMDPDGHE

SEQ ID NO: 84303 - protein, 9 aa, Homo Sapiens
APHDVAPTS

SEQ ID NO: 84304 - protein, 9 aa, Homo Sapiens
QAAARYVGT

SEQ ID NO: 84305 - protein, 9 aa, Homo Sapiens
PPLQHGHRH

SEQ ID NO: 84306 - protein, 9 aa, Homo Sapiens
SVHGLRNGV

SEQ ID NO: 84307 - protein, 9 aa, Homo Sapiens
WEQQVLAAD

SEQ ID NO: 84308 - protein, 9 aa, Homo Sapiens
SYKLDDGKP

SEQ ID NO: 84309 - protein, 9 aa, Homo Sapiens
MFEAPTLPD

SEQ ID NO: 84310 - protein, 9 aa, Homo Sapiens
LVYFPVGDG

SEQ ID NO: 84311 - protein, 9 aa, Homo Sapiens
QEVVCCSAP

SEQ ID NO: 84312 - protein, 9 aa, Homo Sapiens
LQAPHDVAP

SEQ ID NO: 84313 - protein, 9 aa, Homo Sapiens
KVKSMQMLH

SEQ ID NO: 84314 - protein, 9 aa, Homo Sapiens
PCDCYPVGY

SEQ ID NO: 84315 - protein, 9 aa, Homo Sapiens
SCISHLTTH

SEQ ID NO: 84316 - protein, 9 aa, Homo Sapiens
KPNPIILTD

SEQ ID NO: 84317 - protein, 9 aa, Homo Sapiens
SQNEGVNER

SEQ ID NO: 84318 - protein, 9 aa, Homo Sapiens
KCLQTFCGS

SEQ ID NO: 84319 - protein, 9 aa, Homo Sapiens
KAHYVLSSS

SEQ ID NO: 84320 - protein, 9 aa, Homo Sapiens
ISKPMNFST

SEQ ID NO: 84321 - protein, 9 aa, Homo Sapiens
LHSHCPRHC

SEQ ID NO: 84322 - protein, 9 aa, Homo Sapiens
DDDDENKPK

SEQ ID NO: 84323 - protein, 9 aa, Homo Sapiens
YYKRIEPTD

SEQ ID NO: 84324 - protein, 9 aa, Homo Sapiens
AAALGPQDP

SEQ ID NO: 84325 - protein, 9 aa, Homo Sapiens
PWGRLHSHC

SEQ ID NO: 84326 - protein, 9 aa, Homo Sapiens
LSSLLEENQ

SEQ ID NO: 84327 - protein, 9 aa, Homo Sapiens
YVLSSSWDE

SEQ ID NO: 84328 - protein, 9 aa, Homo Sapiens
NAGSSVGRR

SEQ ID NO: 84329 - protein, 9 aa, Homo Sapiens
RFLMGFIDS

SEQ ID NO: 84330 - protein, 9 aa, Homo Sapiens
AENFFYVIL

SEQ ID NO: 84331 - protein, 9 aa, Homo Sapiens
NLYQKDKCL

SEQ ID NO: 84332 - protein, 9 aa, Homo Sapiens
SHAPVSREE

SEQ ID NO: 84333 - protein, 9 aa, Homo Sapiens
LSSSWDEQM

SEQ ID NO: 84334 - protein, 9 aa, Homo Sapiens
LKRLLINAH

SEQ ID NO: 84335 - protein, 9 aa, Homo Sapiens
GWDAAGQLW

SEQ ID NO: 84336 - protein, 9 aa, Homo Sapiens
EESNAGSSV

SEQ ID NO: 84337 - protein, 9 aa, Homo Sapiens
DCYPVGYTS

SEQ ID NO: 84338 - protein, 9 aa, Homo Sapiens
KRIEPTDAH

SEQ ID NO: 84339 - protein, 9 aa, Homo Sapiens
SQGQEQEVC

SEQ ID NO: 84340 - protein, 9 aa, Homo Sapiens
CPHACPPPY

SEQ ID NO: 84341 - protein, 9 aa, Homo Sapiens
IQCDRRQCK

SEQ ID NO: 84342 - protein, 9 aa, Homo Sapiens
HNFILFRFL

SEQ ID NO: 84343 - protein, 9 aa, Homo Sapiens
CSQGQEQEV

SEQ ID NO: 84344 - protein, 9 aa, Homo Sapiens
PCSKMVKIM

SEQ ID NO: 84345 - protein, 9 aa, Homo Sapiens
KPHKCNQCC

SEQ ID NO: 84346 - protein, 9 aa, Homo Sapiens
PAMQVDRFI

SEQ ID NO: 84347 - protein, 9 aa, Homo Sapiens
LLEKCSQGQ

SEQ ID NO: 84348 - protein, 9 aa, Homo Sapiens
PTDAHVLQK

SEQ ID NO: 84349 - protein, 9 aa, Homo Sapiens
LLKGNSPAA

SEQ ID NO: 84350 - protein, 9 aa, Homo Sapiens
SVPYRMAVV

SEQ ID NO: 84351 - protein, 9 aa, Homo Sapiens
AMIRKFQKK

SEQ ID NO: 84352 - protein, 9 aa, Homo Sapiens
PMGWDAAGQ

SEQ ID NO: 84353 - protein, 9 aa, Homo Sapiens
RQINKKGFC

SEQ ID NO: 84354 - protein, 9 aa, Homo Sapiens
WFAPCSKMV

SEQ ID NO: 84355 - protein, 9 aa, Homo Sapiens
DKCLQTFCG

SEQ ID NO: 84356 - protein, 9 aa, Homo Sapiens
QDHYNSCYL

SEQ ID NO: 84357 - protein, 9 aa, Homo Sapiens
EEEKEEESN

SEQ ID NO: 84358 - protein, 9 aa, Homo Sapiens
RYALLACLQ

SEQ ID NO: 84359 - protein, 9 aa, Homo Sapiens
KEQDDDDEN

SEQ ID NO: 84360 - protein, 9 aa, Homo Sapiens
LEFISKPMN

SEQ ID NO: 84361 - protein, 9 aa, Homo Sapiens
VLSSSWDEQ

SEQ ID NO: 84362 - protein, 9 aa, Homo Sapiens
FQKKKDALK

SEQ ID NO: 84363 - protein, 9 aa, Homo Sapiens
PPWGRLHSH

SEQ ID NO: 84364 - protein, 9 aa, Homo Sapiens
WNQGSTLSS

SEQ ID NO: 84365 - protein, 9 aa, Homo Sapiens
RRNVIQCDR

SEQ ID NO: 84366 - protein, 9 aa, Homo Sapiens
FVYKKDRNF

SEQ ID NO: 84367 - protein, 9 aa, Homo Sapiens
KNQQVQLMR

SEQ ID NO: 84368 - protein, 9 aa, Homo Sapiens
YTSRSCAPH

SEQ ID NO: 84369 - protein, 9 aa, Homo Sapiens
MKNQQVQLM

SEQ ID NO: 84370 - protein, 9 aa, Homo Sapiens
MQMLHMPIT

SEQ ID NO: 84371 - protein, 9 aa, Homo Sapiens
AMQVDRFIQ

SEQ ID NO: 84372 - protein, 9 aa, Homo Sapiens
KYTPMGWDA

SEQ ID NO: 84373 - protein, 9 aa, Homo Sapiens
FMQKHLKNH

SEQ ID NO: 84374 - protein, 9 aa, Homo Sapiens
FCSYGPVIL

SEQ ID NO: 84375 - protein, 9 aa, Homo Sapiens
SANPAMQVD

SEQ ID NO: 84376 - protein, 9 aa, Homo Sapiens
FYVILYLMV

SEQ ID NO: 84377 - protein, 9 aa, Homo Sapiens
PHKCNQCCK

SEQ ID NO: 84378 - protein, 9 aa, Homo Sapiens
RWKYTPMGW

SEQ ID NO: 84379 - protein, 9 aa, Homo Sapiens
GKKKGIQDH

SEQ ID NO: 84380 - protein, 9 aa, Homo Sapiens
TPMGWDAAG

SEQ ID NO: 84381 - protein, 9 aa, Homo Sapiens
RSQEMNLWS

SEQ ID NO: 84382 - protein, 9 aa, Homo Sapiens
DLRTAVKPN

SEQ ID NO: 84383 - protein, 9 aa, Homo Sapiens
SSWDEQMEC

SEQ ID NO: 84384 - protein, 9 aa, Homo Sapiens
TGPPMARVP

SEQ ID NO: 84385 - protein, 9 aa, Homo Sapiens
CDCYPVGYT

SEQ ID NO: 84386 - protein, 9 aa, Homo Sapiens
VLKTHGLLL

SEQ ID NO: 84387 - protein, 9 aa, Homo Sapiens
KKGIQDHYN

SEQ ID NO: 84388 - protein, 9 aa, Homo Sapiens
HCPRHCPPW

SEQ ID NO: 84389 - protein, 9 aa, Homo Sapiens
EQLSSLLEE

SEQ ID NO: 84390 - protein, 9 aa, Homo Sapiens
MMKNQQVQL

SEQ ID NO: 84391 - protein, 9 aa, Homo Sapiens
FSVVGSFLF

SEQ ID NO: 84392 - protein, 9 aa, Homo Sapiens
SEKESQNEG

SEQ ID NO: 84393 - protein, 9 aa, Homo Sapiens
HYVLSSSWD

SEQ ID NO: 84394 - protein, 9 aa, Homo Sapiens
CLQTFCGSP

SEQ ID NO: 84395 - protein, 9 aa, Homo Sapiens
HASSHAPVS

SEQ ID NO: 84396 - protein, 9 aa, Homo Sapiens
PNPIILTDQ

SEQ ID NO: 84397 - protein, 9 aa, Homo Sapiens
SFVYKKDRN

SEQ ID NO: 84398 - protein, 9 aa, Homo Sapiens
FSCISHLTT

SEQ ID NO: 84399 - protein, 9 aa, Homo Sapiens
KIADFGAAA

SEQ ID NO: 84400 - protein, 9 aa, Homo Sapiens
CDRRQCKSD

SEQ ID NO: 84401 - protein, 9 aa, Homo Sapiens
YYIYTSLPD

SEQ ID NO: 84402 - protein, 9 aa, Homo Sapiens
ESQNEGVNE

SEQ ID NO: 84403 - protein, 9 aa, Homo Sapiens
SSLMDSKAC

SEQ ID NO: 84404 - protein, 9 aa, Homo Sapiens
PGRYALLAC

SEQ ID NO: 84405 - protein, 9 aa, Homo Sapiens
LEENQALAT

SEQ ID NO: 84406 - protein, 9 aa, Homo Sapiens
GHRSQEMNL

SEQ ID NO: 84407 - protein, 9 aa, Homo Sapiens
VIQCDRRQC

SEQ ID NO: 84408 - protein, 9 aa, Homo Sapiens
EECGKAFSC

SEQ ID NO: 84409 - protein, 9 aa, Homo Sapiens
VGKILDTID

SEQ ID NO: 84410 - protein, 9 aa, Homo Sapiens
QRLKIADFG

SEQ ID NO: 84411 - protein, 9 aa, Homo Sapiens
AMWRISPPS

SEQ ID NO: 84412 - protein, 9 aa, Homo Sapiens
SSSWDEQME

SEQ ID NO: 84413 - protein, 9 aa, Homo Sapiens
FRHASSHAP

SEQ ID NO: 84414 - protein, 9 aa, Homo Sapiens
KFQKKKDAL

SEQ ID NO: 84415 - protein, 9 aa, Homo Sapiens
NFFYVILYL

SEQ ID NO: 84416 - protein, 9 aa, Homo Sapiens
QAKAQEKLT

SEQ ID NO: 84417 - protein, 9 aa, Homo Sapiens
QDDDDENKP

SEQ ID NO: 84418 - protein, 9 aa, Homo Sapiens
LKIADFGAA

SEQ ID NO: 84419 - protein, 9 aa, Homo Sapiens
QKDKCLQTF

SEQ ID NO: 84420 - protein, 9 aa, Homo Sapiens
NVIQCDRRQ

SEQ ID NO: 84421 - protein, 9 aa, Homo Sapiens
SMVGKILDT

SEQ ID NO: 84422 - protein, 9 aa, Homo Sapiens
IEPTDAHVL

SEQ ID NO: 84423 - protein, 9 aa, Homo Sapiens
GYTSRSCAP

SEQ ID NO: 84424 - protein, 9 aa, Homo Sapiens
ASSHAPVSR

SEQ ID NO: 84425 - protein, 9 aa, Homo Sapiens
GLPQSENNQ

SEQ ID NO: 84426 - protein, 9 aa, Homo Sapiens
GPPMAPVPT

SEQ ID NO: 84427 - protein, 9 aa, Homo Sapiens
IAYYIYTSL

SEQ ID NO: 84428 - protein, 9 aa, Homo Sapiens
AVKPNPIIL

SEQ ID NO: 84429 - protein, 9 aa, Homo Sapiens
RLLINAHEQ

SEQ ID NO: 84430 - protein, 9 aa, Homo Sapiens
IYTSLPDNV

SEQ ID NO: 84431 - protein, 9 aa, Homo Sapiens
EFISKPMNF

SEQ ID NO: 84432 - protein, 9 aa, Homo Sapiens
HRSQEMNLW

SEQ ID NO: 84433 - protein, 9 aa, Homo Sapiens
KRLLINAHE

SEQ ID NO: 84434 - protein, 9 aa, Homo Sapiens
SNLYQKDKC

SEQ ID NO: 84435 - protein, 9 aa, Homo Sapiens
QQCELLKRL

SEQ ID NO: 84436 - protein, 9 aa, Homo Sapiens
FFYVILYLM

SEQ ID NO: 84437 - protein, 9 aa, Homo Sapiens
KPKKEQDDD

SEQ ID NO: 84438 - protein, 9 aa, Homo Sapiens
CSKMVKIMR

SEQ ID NO: 84439 - protein, 9 aa, Homo Sapiens
FISKPMNFS

SEQ ID NO: 84440 - protein, 9 aa, Homo Sapiens
IRKFQKKKD

SEQ ID NO: 84441 - protein, 9 aa, Homo Sapiens
ILFRFLMGF

SEQ ID NO: 84442 - protein, 9 aa, Homo Sapiens
VGIGLPQSE

SEQ ID NO: 84443 - protein, 9 aa, Homo Sapiens
NPIILTDQG

SEQ ID NO: 84444 - protein, 9 aa, Homo Sapiens
EKLTLLKAL

SEQ ID NO: 84445 - protein, 9 aa, Homo Sapiens
KKVKSMQML

SEQ ID NO: 84446 - protein, 9 aa, Homo Sapiens
IQDHYNSCY

SEQ ID NO: 84447 - protein, 9 aa, Homo Sapiens
IWFYFSVVG

SEQ ID NO: 84448 - protein, 9 aa, Homo Sapiens
VSTVHITKK

SEQ ID NO: 84449 - protein, 9 aa, Homo Sapiens
VDRFIQVCT

SEQ ID NO: 84450 - protein, 9 aa, Homo Sapiens
QKKKDALKK

SEQ ID NO: 84451 - protein, 9 aa, Homo Sapiens
WKYTPMGWD

SEQ ID NO: 84452 - protein, 9 aa, Homo Sapiens
KAQEKLTLL

SEQ ID NO: 84453 - protein, 9 aa, Homo Sapiens
SNAGSSVGR

SEQ ID NO: 84454 - protein, 9 aa, Homo Sapiens
LLEENQALA

SEQ ID NO: 84455 - protein, 9 aa, Homo Sapiens
RMAVVVRSP

SEQ ID NO: 84456 - protein, 9 aa, Homo Sapiens
RHASSHAPV

SEQ ID NO: 84457 - protein, 9 aa, Homo Sapiens
CKAFNRSST

SEQ ID NO: 84458 - protein, 9 aa, Homo Sapiens
DTIDDFGLR

SEQ ID NO: 84459 - protein, 9 aa, Homo Sapiens
STGQRLKIA

SEQ ID NO: 84460 - protein, 9 aa, Homo Sapiens
PYRMAVVVR

SEQ ID NO: 84461 - protein, 9 aa, Homo Sapiens
FILFRFLMG

SEQ ID NO: 84462 - protein, 9 aa, Homo Sapiens
SQEMNLWST

SEQ ID NO: 84463 - protein, 9 aa, Homo Sapiens
SKMVKIMRG

SEQ ID NO: 84464 - protein, 9 aa, Homo Sapiens
LYQKDKCLQ

SEQ ID NO: 84465 - protein, 9 aa, Homo Sapiens
AHYVLSSSW

SEQ ID NO: 84466 - protein, 9 aa, Homo Sapiens
RGFMQKHLK

SEQ ID NO: 84467 - protein, 9 aa, Homo Sapiens
MLHMPITSA

SEQ ID NO: 84468 - protein, 9 aa, Homo Sapiens
RKFQKKKDA

SEQ ID NO: 84469 - protein, 9 aa, Homo Sapiens
VQEQLSSLL

SEQ ID NO: 84470 - protein, 9 aa, Homo Sapiens
LKGNSPAAA

SEQ ID NO: 84471 - protein, 9 aa, Homo Sapiens
QSFVYKKDR

SEQ ID NO: 84472 - protein, 9 aa, Homo Sapiens
AYYIYTSLP

SEQ ID NO: 84473 - protein, 9 aa, Homo Sapiens
RTAVKPNPI

SEQ ID NO: 84474 - protein, 9 aa, Homo Sapiens
NSPAAALGP

SEQ ID NO: 84475 - protein, 9 aa, Homo Sapiens
CELLKRLLI

SEQ ID NO: 84476 - protein, 9 aa, Homo Sapiens
YIYTSLPDN

SEQ ID NO: 84477 - protein, 9 aa, Homo Sapiens
LHMPITSAM

SEQ ID NO: 84478 - protein, 9 aa, Homo Sapiens
EKEEESNAG

SEQ ID NO: 84479 - protein, 9 aa, Homo Sapiens
DRRQCKSDE

SEQ ID NO: 84480 - protein, 9 aa, Homo Sapiens
RNVIQCDRR

SEQ ID NO: 84481 - protein, 9 aa, Homo Sapiens
LAPGRYALL

SEQ ID NO: 84482 - protein, 9 aa, Homo Sapiens
TLSSLMDSK

SEQ ID NO: 84483 - protein, 9 aa, Homo Sapiens
TLLKALSHK

SEQ ID NO: 84484 - protein, 9 aa, Homo Sapiens
KKGFCSYGP

SEQ ID NO: 84485 - protein, 9 aa, Homo Sapiens
DHYNSCYLD

SEQ ID NO: 84486 - protein, 9 aa, Homo Sapiens
SVVGSFLFI

SEQ ID NO: 84487 - protein, 9 aa, Homo Sapiens
AKAQEKLTL

SEQ ID NO: 84488 - protein, 9 aa, Homo Sapiens
SLPDNVEEP

SEQ ID NO: 84489 - protein, 9 aa, Homo Sapiens
NFRHASSHA

SEQ ID NO: 84490 - protein, 9 aa, Homo Sapiens
LTLLKALSH

SEQ ID NO: 84491 - protein, 9 aa, Homo Sapiens
KKPKKEQDD

SEQ ID NO: 84492 - protein, 9 aa, Homo Sapiens
LWNQGSTLS

SEQ ID NO: 84493 - protein, 9 aa, Homo Sapiens
NRGFMQKHL

SEQ ID NO: 84494 - protein, 9 aa, Homo Sapiens
YALLACLQD

SEQ ID NO: 84495 - protein, 9 aa, Homo Sapiens
RQSVPYRMA

SEQ ID NO: 84496 - protein, 9 aa, Homo Sapiens
SGAMWRISP

SEQ ID NO: 84497 - protein, 9 aa, Homo Sapiens
FRNRGFMQK

SEQ ID NO: 84498 - protein, 9 aa, Homo Sapiens
GVRQSVPYR

SEQ ID NO: 84499 - protein, 9 aa, Homo Sapiens
MNLWSTATY

SEQ ID NO: 84500 - protein, 9 aa, Homo Sapiens
GIGLPQSEN

SEQ ID NO: 84501 - protein, 9 aa, Homo Sapiens
YKRIEPTDA

SEQ ID NO: 84502 - protein, 9 aa, Homo Sapiens
KSMQMLHMP

SEQ ID NO: 84503 - protein, 9 aa, Homo Sapiens
TAVKPNPII

SEQ ID NO: 84504 - protein, 9 aa, Homo Sapiens
DRNFLKLPD

SEQ ID NO: 84505 - protein, 9 aa, Homo Sapiens
GKAHYVLSS

SEQ ID NO: 84506 - protein, 9 aa, Homo Sapiens
QCDRRQCKS

SEQ ID NO: 84507 - protein, 9 aa, Homo Sapiens
YFSVVGSFL

SEQ ID NO: 84508 - protein, 9 aa, Homo Sapiens
KKDALKKES

SEQ ID NO: 84509 - protein, 9 aa, Homo Sapiens
SLLEENQAL

SEQ ID NO: 84510 - protein, 9 aa, Homo Sapiens
KLTLLKALS

SEQ ID NO: 84511 - protein, 9 aa, Homo Sapiens
CNQCCKAFN

SEQ ID NO: 84512 - protein, 9 aa, Homo Sapiens
PVGIGLPQS

SEQ ID NO: 84513 - protein, 9 aa, Homo Sapiens
INKKGFCSY

SEQ ID NO: 84514 - protein, 9 aa, Homo Sapiens
FLMGFIDSI

SEQ ID NO: 84515 - protein, 9 aa, Homo Sapiens
MNFSTMRRK

SEQ ID NO: 84516 - protein, 9 aa, Homo Sapiens
KKKDALKKE

SEQ ID NO: 84517 - protein, 9 aa, Homo Sapiens
GRKFRNRGF

SEQ ID NO: 84518 - protein, 9 aa, Homo Sapiens
VGYTSRSCA

SEQ ID NO: 84519 - protein, 9 aa, Homo Sapiens
LSEKESQNE

SEQ ID NO: 84520 - protein, 9 aa, Homo Sapiens
KILDTIDDF

SEQ ID NO: 84521 - protein, 9 aa, Homo Sapiens
YPVGYTSRS

SEQ ID NO: 84522 - protein, 9 aa, Homo Sapiens
HRRTHTGQK

SEQ ID NO: 84523 - protein, 9 aa, Homo Sapiens
EEESNAGSS

SEQ ID NO: 84524 - protein, 9 aa, Homo Sapiens
KKDRNFLKL

SEQ ID NO: 84525 - protein, 9 aa, Homo Sapiens
WGRLHSHCP

SEQ ID NO: 84526 - protein, 9 aa, Homo Sapiens
EGSSGAMWR

SEQ ID NO: 84527 - protein, 9 aa, Homo Sapiens
RSANPAMQV

SEQ ID NO: 84528 - protein, 9 aa, Homo Sapiens
GIQDHYNSC

SEQ ID NO: 84529 - protein, 9 aa, Homo Sapiens
RLKIADFGA

SEQ ID NO: 84530 - protein, 9 aa, Homo Sapiens
EIWMMKNQQ

SEQ ID NO: 84531 - protein, 9 aa, Homo Sapiens
SPAAALGPQ

SEQ ID NO: 84532 - protein, 9 aa, Homo Sapiens
GQRLKIADF

SEQ ID NO: 84533 - protein, 9 aa, Homo Sapiens
CISHLTTHK

SEQ ID NO: 84534 - protein, 9 aa, Homo Sapiens
AKVDAENFF

SEQ ID NO: 84535 - protein, 9 aa, Homo Sapiens
KPVGIGLPQ

SEQ ID NO: 84536 - protein, 9 aa, Homo Sapiens
YTSLPDNVE

SEQ ID NO: 84537 - protein, 9 aa, Homo Sapiens
QEQLSSLLE

SEQ ID NO: 84538 - protein, 9 aa, Homo Sapiens
KVDAENFFY

SEQ ID NO: 84539 - protein, 9 aa, Homo Sapiens
DSTGQRLKI

SEQ ID NO: 84540 - protein, 9 aa, Homo Sapiens
TDAHVLQKN

SEQ ID NO: 84541 - protein, 9 aa, Homo Sapiens
RASLSEKES

SEQ ID NO: 84542 - protein, 9 aa, Homo Sapiens
NQCCKAFNR

SEQ ID NO: 84543 - protein, 9 aa, Homo Sapiens
WMMKNQQVQ

SEQ ID NO: 84544 - protein, 9 aa, Homo Sapiens
FYFSVVGSF

SEQ ID NO: 84545 - protein, 9 aa, Homo Sapiens
QVQLMRQMK

SEQ ID NO: 84546 - protein, 9 aa, Homo Sapiens
EKCSQGQEQ

SEQ ID NO: 84547 - protein, 9 aa, Homo Sapiens
STLSSLMDS

SEQ ID NO: 84548 - protein, 9 aa, Homo Sapiens
LSSLMDSKA

SEQ ID NO: 84549 - protein, 9 aa, Homo Sapiens
PHACPPPYP

SEQ ID NO: 84550 - protein, 9 aa, Homo Sapiens
LPLAPGRYA

SEQ ID NO: 84551 - protein, 9 aa, Homo Sapiens
EMNLWSTAT

SEQ ID NO: 84552 - protein, 9 aa, Homo Sapiens
ESNAGSSVG

SEQ ID NO: 84553 - protein, 9 aa, Homo Sapiens
GRYALLACL

SEQ ID NO: 84554 - protein, 9 aa, Homo Sapiens
RRTHTGQKP

SEQ ID NO: 84555 - protein, 9 aa, Homo Sapiens
YQKDKCLQT

SEQ ID NO: 84556 - protein, 9 aa, Homo Sapiens
WFYFSVVGS

SEQ ID NO: 84557 - protein, 9 aa, Homo Sapiens
FAPCSKMVK

SEQ ID NO: 84558 - protein, 9 aa, Homo Sapiens
PLPLAPGRY

SEQ ID NO: 84559 - protein, 9 aa, Homo Sapiens
VYKKDRNFL

SEQ ID NO: 84560 - protein, 9 aa, Homo Sapiens
KEEESNAGS

SEQ ID NO: 84561 - protein, 9 aa, Homo Sapiens
GFCSYGPVI

SEQ ID NO: 84562 - protein, 9 aa, Homo Sapiens
HAPVSREEL

SEQ ID NO: 84563 - protein, 9 aa, Homo Sapiens
VKIMRGPFM

SEQ ID NO: 84564 - protein, 9 aa, Homo Sapiens
SLSEKESQN

SEQ ID NO: 84565 - protein, 9 aa, Homo Sapiens
QHRRTHTGQ

SEQ ID NO: 84566 - protein, 9 aa, Homo Sapiens
NPAMQVDRF

SEQ ID NO: 84567 - protein, 9 aa, Homo Sapiens
HKCNQCCKA

SEQ ID NO: 84568 - protein, 9 aa, Homo Sapiens
RRQCKSDEE

SEQ ID NO: 84569 - protein, 9 aa, Homo Sapiens
GNSPAAALG

SEQ ID NO: 84570 - protein, 9 aa, Homo Sapiens
QIEGSSGAM

SEQ ID NO: 84571 - protein, 9 aa, Homo Sapiens
PKKEQDDDD

SEQ ID NO: 84572 - protein, 9 aa, Homo Sapiens
PVGYTSRSC

SEQ ID NO: 84573 - protein, 9 aa, Homo Sapiens
RIEPTDAHV

SEQ ID NO: 84574 - protein, 9 aa, Homo Sapiens
SSGAMWRIS

SEQ ID NO: 84575 - protein, 9 aa, Homo Sapiens
VGHRSQEMN

SEQ ID NO: 84576 - protein, 9 aa, Homo Sapiens
QQVQLMRQM

SEQ ID NO: 84577 - protein, 9 aa, Homo Sapiens
KCNQCCKAF

SEQ ID NO: 84578 - protein, 9 aa, Homo Sapiens
NQGSTLSSL

SEQ ID NO: 84579 - protein, 9 aa, Homo Sapiens
QVDRFIQVC

SEQ ID NO: 84580 - protein, 9 aa, Homo Sapiens
KKEQDDDDE

SEQ ID NO: 84581 - protein, 9 aa, Homo Sapiens
QEKLTLLKA

SEQ ID NO: 84582 - protein, 9 aa, Homo Sapiens
KFRNRGFMQ

SEQ ID NO: 84583 - protein, 9 aa, Homo Sapiens
EKESQNEGV

SEQ ID NO: 84584 - protein, 9 aa, Homo Sapiens
KGNSPAAAL

SEQ ID NO: 84585 - protein, 9 aa, Homo Sapiens
LEKCSQGQE

SEQ ID NO: 84586 - protein, 9 aa, Homo Sapiens
LLKRLLINA

SEQ ID NO: 84587 - protein, 9 aa, Homo Sapiens
RKFRNRGFM

SEQ ID NO: 84588 - protein, 9 aa, Homo Sapiens
LIAYYIYTS

SEQ ID NO: 84589 - protein, 9 aa, Homo Sapiens
YTPMGWDAA

SEQ ID NO: 84590 - protein, 9 aa, Homo Sapiens
IGLPQSENN

SEQ ID NO: 84591 - protein, 9 aa, Homo Sapiens
VKPNPIILT

SEQ ID NO: 84592 - protein, 9 aa, Homo Sapiens
CYPVGYTSR

SEQ ID NO: 84593 - protein, 9 aa, Homo Sapiens
ECGKAFSCI

SEQ ID NO: 84594 - protein, 9 aa, Homo Sapiens
NKKGFCSYG

SEQ ID NO: 84595 - protein, 9 aa, Homo Sapiens
GFMQKHLKN

SEQ ID NO: 84596 - protein, 9 aa, Homo Sapiens
GKAFSCISH

SEQ ID NO: 84597 - protein, 9 aa, Homo Sapiens
SSLLEENQA

SEQ ID NO: 84598 - protein, 9 aa, Homo Sapiens
DAENFFYVI

SEQ ID NO: 84599 - protein, 9 aa, Homo Sapiens
APCSKMVKI

SEQ ID NO: 84600 - protein, 9 aa, Homo Sapiens
VDAENFFYV

SEQ ID NO: 84601 - protein, 9 aa, Homo Sapiens
LPQSENNQD

SEQ ID NO: 84602 - protein, 9 aa, Homo Sapiens
KCSQGQEQE

SEQ ID NO: 84603 - protein, 9 aa, Homo Sapiens
EPTDAHVLQ

SEQ ID NO: 84604 - protein, 9 aa, Homo Sapiens
VPTGPPMAR

SEQ ID NO: 84605 - protein, 9 aa, Homo Sapiens
NQQVQLMRQ

SEQ ID NO: 84606 - protein, 9 aa, Homo Sapiens
WDAAGQLWY

SEQ ID NO: 84607 - protein, 9 aa, Homo Sapiens
NFILFRFLM

SEQ ID NO: 84608 - protein, 9 aa, Homo Sapiens
SKPMNFSTM

SEQ ID NO: 84609 - protein, 9 aa, Homo Sapiens
LDTIDDFGL

SEQ ID NO: 84610 - protein, 9 aa, Homo Sapiens
CPPPYPPPE

SEQ ID NO: 84611 - protein, 9 aa, Homo Sapiens
PAAALGPQD

SEQ ID NO: 84612 - protein, 9 aa, Homo Sapiens
VKSMQMLHM

SEQ ID NO: 84613 - protein, 9 aa, Homo Sapiens
QCCKAFNRS

SEQ ID NO: 84614 - protein, 9 aa, Homo Sapiens
MGWDAAGQL

SEQ ID NO: 84615 - protein, 9 aa, Homo Sapiens
GAMWRISPP

SEQ ID NO: 84616 - protein, 9 aa, Homo Sapiens
MIRKFQKKK

SEQ ID NO: 84617 - protein, 9 aa, Homo Sapiens
NYYKRIEPT

SEQ ID NO: 84618 - protein, 9 aa, Homo Sapiens
EQDDDDENK

SEQ ID NO: 84619 - protein, 9 aa, Homo Sapiens
LMGFIDSII

SEQ ID NO: 84620 - protein, 9 aa, Homo Sapiens
GKILDTIDD

SEQ ID NO: 84621 - protein, 9 aa, Homo Sapiens
ANPAMQVDR

SEQ ID NO: 84622 - protein, 9 aa, Homo Sapiens
NFSTMRRKL

SEQ ID NO: 84623 - protein, 9 aa, Homo Sapiens
PTGPPMARV

SEQ ID NO: 84624 - protein, 9 aa, Homo Sapiens
KDKCLQTFC

SEQ ID NO: 84625 - protein, 9 aa, Homo Sapiens
DDDENKPKP

SEQ ID NO: 84626 - protein, 9 aa, Homo Sapiens
FTNIWFYFS

SEQ ID NO: 84627 - protein, 9 aa, Homo Sapiens
GSSGAMWRI

SEQ ID NO: 84628 - protein, 9 aa, Homo Sapiens
AFSCISHLT

SEQ ID NO: 84629 - protein, 9 aa, Homo Sapiens
PQSENNQDK

SEQ ID NO: 84630 - protein, 9 aa, Homo Sapiens
HSHCPRHCP

SEQ ID NO: 84631 - protein, 9 aa, Homo Sapiens
MVKIMRGPF

SEQ ID NO: 84632 - protein, 9 aa, Homo Sapiens
TIDDFGLRN

SEQ ID NO: 84633 - protein, 9 aa, Homo Sapiens
CCKAFNRSS

SEQ ID NO: 84634 - protein, 9 aa, Homo Sapiens
APGRYALLA

SEQ ID NO: 84635 - protein, 9 aa, Homo Sapiens
CSYGPVILV

SEQ ID NO: 84636 - protein, 9 aa, Homo Sapiens
NLWSTATYT

SEQ ID NO: 84637 - protein, 9 aa, Homo Sapiens
QEMNLWSTA

SEQ ID NO: 84638 - protein, 9 aa, Homo Sapiens
NIWFYFSVV

SEQ ID NO: 84639 - protein, 9 aa, Homo Sapiens
ELLKRLLIN

SEQ ID NO: 84640 - protein, 9 aa, Homo Sapiens
SSHAPVSRE

SEQ ID NO: 84641 - protein, 9 aa, Homo Sapiens
KPMNFSTMR

SEQ ID NO: 84642 - protein, 9 aa, Homo Sapiens
TNIWFYFSV

SEQ ID NO: 84643 - protein, 9 aa, Homo Sapiens
IEGSSGAMW

SEQ ID NO: 84644 - protein, 9 aa, Homo Sapiens
SMQMLHMPI

SEQ ID NO: 84645 - protein, 9 aa, Homo Sapiens
QSENNQDKG

SEQ ID NO: 84646 - protein, 9 aa, Homo Sapiens
PLAPGRYAL

SEQ ID NO: 84647 - protein, 9 aa, Homo Sapiens
KKKGIQDHY

SEQ ID NO: 84648 - protein, 9 aa, Homo Sapiens
YRMAVVVRS

SEQ ID NO: 84649 - protein, 9 aa, Homo Sapiens
LRTAVKPNP

SEQ ID NO: 84650 - protein, 9 aa, Homo Sapiens
FRFLMGFID

SEQ ID NO: 84651 - protein, 9 aa, Homo Sapiens
KDRNFLKLP

SEQ ID NO: 84652 - protein, 9 aa, Homo Sapiens
LFRFLMGFI

SEQ ID NO: 84653 - protein, 9 aa, Homo Sapiens
RNRGFMQKH

SEQ ID NO: 84654 - protein, 9 aa, Homo Sapiens
KESQNEGVN

SEQ ID NO: 84655 - protein, 9 aa, Homo Sapiens
AQEKLTLLK

SEQ ID NO: 84656 - protein, 9 aa, Homo Sapiens
FIECGIATV

SEQ ID NO: 84657 - protein, 9 aa, Homo Sapiens
QGSTLSSLM

SEQ ID NO: 84658 - protein, 9 aa, Homo Sapiens
ACPPPYPPP

SEQ ID NO: 84659 - protein, 9 aa, Homo Sapiens
GNFRHASSH

SEQ ID NO: 84660 - protein, 9 aa, Homo Sapiens
KAFSCISHL

SEQ ID NO: 84661 - protein, 9 aa, Homo Sapiens
IGKKKGIQD

SEQ ID NO: 84662 - protein, 9 aa, Homo Sapiens
YKKDRNFLK

SEQ ID NO: 84663 - protein, 9 aa, Homo Sapiens
IWMMKNQQV

SEQ ID NO: 84664 - protein, 9 aa, Homo Sapiens
ILDTIDDFG

SEQ ID NO: 84665 - protein, 9 aa, Homo Sapiens
RLHSHCPRH

SEQ ID NO: 84666 - protein, 9 aa, Homo Sapiens
MQVDRFIQV

SEQ ID NO: 84667 - protein, 9 aa, Homo Sapiens
KMVKIMRGP

SEQ ID NO: 84668 - protein, 9 aa, Homo Sapiens
VPYRMAVVV

SEQ ID NO: 84669 - protein, 9 aa, Homo Sapiens
ASLSEKESQ

SEQ ID NO: 84670 - protein, 9 aa, Homo Sapiens
GSTLSSLMD

SEQ ID NO: 84671 - protein, 9 aa, Homo Sapiens
QMLHMPITS

SEQ ID NO: 84672 - protein, 9 aa, Homo Sapiens
MWRISPPSR

SEQ ID NO: 84673 - protein, 9 aa, Homo Sapiens
GLLEKCSQG

SEQ ID NO: 84674 - protein, 9 aa, Homo Sapiens
ENFFYVILY

SEQ ID NO: 84675 - protein, 9 aa, Homo Sapiens
EEKEEESNA

SEQ ID NO: 84676 - protein, 9 aa, Homo Sapiens
FSGLLEKCS

SEQ ID NO: 84677 - protein, 9 aa, Homo Sapiens
QSVPYRMAV

SEQ ID NO: 84678 - protein, 9 aa, Homo Sapiens
GRLHSHCPR

SEQ ID NO: 84679 - protein, 9 aa, Homo Sapiens
TGQRLKIAD

SEQ ID NO: 84680 - protein, 9 aa, Homo Sapiens
QINKKGFCS

SEQ ID NO: 84681 - protein, 9 aa, Homo Sapiens
QCELLKRLL

SEQ ID NO: 84682 - protein, 9 aa, Homo Sapiens
RNFLKLPDT

SEQ ID NO: 84683 - protein, 9 aa, Homo Sapiens
SQQCELLKR

SEQ ID NO: 84684 - protein, 9 aa, Homo Sapiens
MVGKILDTI

SEQ ID NO: 84685 - protein, 9 aa, Homo Sapiens
KGFCSYGPV

SEQ ID NO: 84686 - protein, 9 aa, Homo Sapiens
IDSTGQRLK

SEQ ID NO: 84687 - protein, 9 aa, Homo Sapiens
SHCPRHCPP

SEQ ID NO: 84688 - protein, 9 aa, Homo Sapiens
QLSSLLEEN

SEQ ID NO: 84689 - protein, 9 aa, Homo Sapiens
KGIQDHYNS

SEQ ID NO: 84690 - protein, 9 aa, Homo Sapiens
RLLKGNSPA

SEQ ID NO: 84691 - protein, 9 aa, Homo Sapiens
SGLLEKCSQ

SEQ ID NO: 84692 - protein, 9 aa, Homo Sapiens
TSLPDNVEE

SEQ ID NO: 84693 - protein, 9 aa, Homo Sapiens
YEEKRKKKM

SEQ ID NO: 84694 - protein, 9 aa, Homo Sapiens
HACPPPYPP

SEQ ID NO: 84695 - protein, 9 aa, Homo Sapiens
VRQSVPYRM

SEQ ID NO: 84696 - protein, 9 aa, Homo Sapiens
PMNFSTMRR

SEQ ID NO: 84697 - protein, 9 aa, Homo Sapiens
ALLSIYMEW

SEQ ID NO: 84698 - protein, 9 aa, Homo Sapiens
WNLNPVFGG

SEQ ID NO: 84699 - protein, 9 aa, Homo Sapiens
QEPLRFKDV

SEQ ID NO: 84700 - protein, 9 aa, Homo Sapiens
IWLLILSYV

SEQ ID NO: 84701 - protein, 9 aa, Homo Sapiens
GPYASPGVA

SEQ ID NO: 84702 - protein, 9 aa, Homo Sapiens
CLHRKSQYL

SEQ ID NO: 84703 - protein, 9 aa, Homo Sapiens
YGSRVKDIE

SEQ ID NO: 84704 - protein, 9 aa, Homo Sapiens
YCLHRKSQY

SEQ ID NO: 84705 - protein, 9 aa, Homo Sapiens
WLLILSYVG

SEQ ID NO: 84706 - protein, 9 aa, Homo Sapiens
LGAVVAVIG

SEQ ID NO: 84707 - protein, 9 aa, Homo Sapiens
KIMSQEPLR

SEQ ID NO: 84708 - protein, 9 aa, Homo Sapiens
TVLEGGEVR

SEQ ID NO: 84709 - protein, 9 aa, Homo Sapiens
FAMRNVCPP

SEQ ID NO: 84710 - protein, 9 aa, Homo Sapiens
DDDKAHIII

SEQ ID NO: 84711 - protein, 9 aa, Homo Sapiens
LDDLEEQAM

SEQ ID NO: 84712 - protein, 9 aa, Homo Sapiens
SQYCLHRKS

SEQ ID NO: 84713 - protein, 9 aa, Homo Sapiens
GLCIWLLIL

SEQ ID NO: 84714 - protein, 9 aa, Homo Sapiens
QIWNLNPVF

SEQ ID NO: 84715 - protein, 9 aa, Homo Sapiens
PLRFKDVAV

SEQ ID NO: 84716 - protein, 9 aa, Homo Sapiens
KDIEPQEAE

SEQ ID NO: 84717 - protein, 9 aa, Homo Sapiens
RLSASQIWN

SEQ ID NO: 84718 - protein, 9 aa, Homo Sapiens
LRFKDVAVV

SEQ ID NO: 84719 - protein, 9 aa, Homo Sapiens
RGPFGGPLR

SEQ ID NO: 84720 - protein, 9 aa, Homo Sapiens
MRIKYDLKG

SEQ ID NO: 84721 - protein, 9 aa, Homo Sapiens
RNVCPPRGF

SEQ ID NO: 84722 - protein, 9 aa, Homo Sapiens
ASQIWNLNP

SEQ ID NO: 84723 - protein, 9 aa, Homo Sapiens
KSTVLEGGE

SEQ ID NO: 84724 - protein, 9 aa, Homo Sapiens
PFGGPLRQG

SEQ ID NO: 84725 - protein, 9 aa, Homo Sapiens
AMELYRRLR

SEQ ID NO: 84726 - protein, 9 aa, Homo Sapiens
SRLSASQIW

SEQ ID NO: 84727 - protein, 9 aa, Homo Sapiens
RVKDIEPQE

SEQ ID NO: 84728 - protein, 9 aa, Homo Sapiens
LDSHPTTVS

SEQ ID NO: 84729 - protein, 9 aa, Homo Sapiens
SSQYCLHRK

SEQ ID NO: 84730 - protein, 9 aa, Homo Sapiens
MRNVCPPRG

SEQ ID NO: 84731 - protein, 9 aa, Homo Sapiens
CIWLLILSY

SEQ ID NO: 84732 - protein, 9 aa, Homo Sapiens
CPPRGFPPY

SEQ ID NO: 84733 - protein, 9 aa, Homo Sapiens
MEQILRATG

SEQ ID NO: 84734 - protein, 9 aa, Homo Sapiens
IWNLNPVFG

SEQ ID NO: 84735 - protein, 9 aa, Homo Sapiens
ALDSHPTTV

SEQ ID NO: 84736 - protein, 9 aa, Homo Sapiens
VFFSSQYCL

SEQ ID NO: 84737 - protein, 9 aa, Homo Sapiens
SIYMEWAED

SEQ ID NO: 84738 - protein, 9 aa, Homo Sapiens
EWAEDLPLR

SEQ ID NO: 84739 - protein, 9 aa, Homo Sapiens
DIEPQEAEE

SEQ ID NO: 84740 - protein, 9 aa, Homo Sapiens
TTVSLHHQR

SEQ ID NO: 84741 - protein, 9 aa, Homo Sapiens
TTAVDTSTP

SEQ ID NO: 84742 - protein, 9 aa, Homo Sapiens
ADSEKSTVL

SEQ ID NO: 84743 - protein, 9 aa, Homo Sapiens
VKMRIKYDL

SEQ ID NO: 84744 - protein, 9 aa, Homo Sapiens
KAHIIIRSL

SEQ ID NO: 84745 - protein, 9 aa, Homo Sapiens
LRQGCQPLE

SEQ ID NO: 84746 - protein, 9 aa, Homo Sapiens
DSHPTTVSL

SEQ ID NO: 84747 - protein, 9 aa, Homo Sapiens
SKVDDDKAH

SEQ ID NO: 84748 - protein, 9 aa, Homo Sapiens
STTAVDTST

SEQ ID NO: 84749 - protein, 9 aa, Homo Sapiens
PTTSPVGPY

SEQ ID NO: 84750 - protein, 9 aa, Homo Sapiens
LSTTAVDTS

SEQ ID NO: 84751 - protein, 9 aa, Homo Sapiens
LSASQIWNL

SEQ ID NO: 84752 - protein, 9 aa, Homo Sapiens
LSIYMEWAE

SEQ ID NO: 84753 - protein, 9 aa, Homo Sapiens
MELYRRLRE

SEQ ID NO: 84754 - protein, 9 aa, Homo Sapiens
IGDGVNDSP

SEQ ID NO: 84755 - protein, 9 aa, Homo Sapiens
SPVGPYASP

SEQ ID NO: 84756 - protein, 9 aa, Homo Sapiens
PRSVKMRIK

SEQ ID NO: 84757 - protein, 9 aa, Homo Sapiens
RLGAVVAVI

SEQ ID NO: 84758 - protein, 9 aa, Homo Sapiens
GPFGGPLRQ

SEQ ID NO: 84759 - protein, 9 aa, Homo Sapiens
QYCLHRKSQ

SEQ ID NO: 84760 - protein, 9 aa, Homo Sapiens
MVFFSSQYC

SEQ ID NO: 84761 - protein, 9 aa, Homo Sapiens
SVKMRIKYD

SEQ ID NO: 84762 - protein, 9 aa, Homo Sapiens
PYASPGVAG

SEQ ID NO: 84763 - protein, 9 aa, Homo Sapiens
AVDTSTPVT

SEQ ID NO: 84764 - protein, 9 aa, Homo Sapiens
KVDDDKAHI

SEQ ID NO: 84765 - protein, 9 aa, Homo Sapiens
PVGPYASPG

SEQ ID NO: 84766 - protein, 9 aa, Homo Sapiens
VAVIGDGVN

SEQ ID NO: 84767 - protein, 9 aa, Homo Sapiens
EQAMELYRR

SEQ ID NO: 84768 - protein, 9 aa, Homo Sapiens
IEPQEAEEF

SEQ ID NO: 84769 - protein, 9 aa, Homo Sapiens
PIMEQILRA

SEQ ID NO: 84770 - protein, 9 aa, Homo Sapiens
RSVKMRIKY

SEQ ID NO: 84771 - protein, 9 aa, Homo Sapiens
HPTTVSLHH

SEQ ID NO: 84772 - protein, 9 aa, Homo Sapiens
TSPVGPYAS

SEQ ID NO: 84773 - protein, 9 aa, Homo Sapiens
GSRVKDIEP

SEQ ID NO: 84774 - protein, 9 aa, Homo Sapiens
SRGPFGGPL

SEQ ID NO: 84775 - protein, 9 aa, Homo Sapiens
CSKPIMEQI

SEQ ID NO: 84776 - protein, 9 aa, Homo Sapiens
GAVVAVIGD

SEQ ID NO: 84777 - protein, 9 aa, Homo Sapiens
VVAVIGDGV

SEQ ID NO: 84778 - protein, 9 aa, Homo Sapiens
TTSPVGPYA

SEQ ID NO: 84779 - protein, 9 aa, Homo Sapiens
SRVKDIEPQ

SEQ ID NO: 84780 - protein, 9 aa, Homo Sapiens
LLSIYMEWA

SEQ ID NO: 84781 - protein, 9 aa, Homo Sapiens
SKPIMEQIL

SEQ ID NO: 84782 - protein, 9 aa, Homo Sapiens
EEQAMELYR

SEQ ID NO: 84783 - protein, 9 aa, Homo Sapiens
AMRNVCPPR

SEQ ID NO: 84784 - protein, 9 aa, Homo Sapiens
STLSTTAVD

SEQ ID NO: 84785 - protein, 9 aa, Homo Sapiens
ASTLSTTAV

SEQ ID NO: 84786 - protein, 9 aa, Homo Sapiens
VIGDGVNDS

SEQ ID NO: 84787 - protein, 9 aa, Homo Sapiens
FSSQYCLHR

SEQ ID NO: 84788 - protein, 9 aa, Homo Sapiens
NVCPPRGFP

SEQ ID NO: 84789 - protein, 9 aa, Homo Sapiens
FFSSQYCLH

SEQ ID NO: 84790 - protein, 9 aa, Homo Sapiens
QILRATGKA

SEQ ID NO: 84791 - protein, 9 aa, Homo Sapiens
IMEQILRAT

SEQ ID NO: 84792 - protein, 9 aa, Homo Sapiens
EKSTVLEGG

SEQ ID NO: 84793 - protein, 9 aa, Homo Sapiens
EASTLSTTA

SEQ ID NO: 84794 - protein, 9 aa, Homo Sapiens
SASQIWNLN

SEQ ID NO: 84795 - protein, 9 aa, Homo Sapiens
SHPTTVSLH

SEQ ID NO: 84796 - protein, 9 aa, Homo Sapiens
LLPRSVKMR

SEQ ID NO: 84797 - protein, 9 aa, Homo Sapiens
RFKDVAVVF

SEQ ID NO: 84798 - protein, 9 aa, Homo Sapiens
IMSQEPLRF

SEQ ID NO: 84799 - protein, 9 aa, Homo Sapiens
VLEGGEVRF

SEQ ID NO: 84800 - protein, 9 aa, Homo Sapiens
WAEDLPLRK

SEQ ID NO: 84801 - protein, 9 aa, Homo Sapiens
AVIGDGVND

SEQ ID NO: 84802 - protein, 9 aa, Homo Sapiens
DDKAHIIIR

SEQ ID NO: 84803 - protein, 9 aa, Homo Sapiens
EPQEAEEFC

SEQ ID NO: 84804 - protein, 9 aa, Homo Sapiens
YASPGVAGF

SEQ ID NO: 84805 - protein, 9 aa, Homo Sapiens
STVLEGGEV

SEQ ID NO: 84806 - protein, 9 aa, Homo Sapiens
TLSTTAVDT

SEQ ID NO: 84807 - protein, 9 aa, Homo Sapiens
QAMELYRRL

SEQ ID NO: 84808 - protein, 9 aa, Homo Sapiens
DLEEQAMEL

SEQ ID NO: 84809 - protein, 9 aa, Homo Sapiens
VDDDKAHII

SEQ ID NO: 84810 - protein, 9 aa, Homo Sapiens
MSQEPLRFK

SEQ ID NO: 84811 - protein, 9 aa, Homo Sapiens
HIIIRSLLD

SEQ ID NO: 84812 - protein, 9 aa, Homo Sapiens
PTTVSLHHQ

SEQ ID NO: 84813 - protein, 9 aa, Homo Sapiens
AVVAVIGDG

SEQ ID NO: 84814 - protein, 9 aa, Homo Sapiens
TNGLCIWLL

SEQ ID NO: 84815 - protein, 9 aa, Homo Sapiens
YMEWAEDLP

SEQ ID NO: 84816 - protein, 9 aa, Homo Sapiens
GGPLRQGCQ

SEQ ID NO: 84817 - protein, 9 aa, Homo Sapiens
DSEKSTVLE

SEQ ID NO: 84818 - protein, 9 aa, Homo Sapiens
LPRSVKMRI

SEQ ID NO: 84819 - protein, 9 aa, Homo Sapiens
MEWAEDLPL

SEQ ID NO: 84820 - protein, 9 aa, Homo Sapiens
VCPPRGFPP

SEQ ID NO: 84821 - protein, 9 aa, Homo Sapiens
AHIIIRSLL

SEQ ID NO: 84822 - protein, 9 aa, Homo Sapiens
FGGPLRQGC

SEQ ID NO: 84823 - protein, 9 aa, Homo Sapiens
NGLCIWLLI

SEQ ID NO: 84824 - protein, 9 aa, Homo Sapiens
KPIMEQILR

SEQ ID NO: 84825 - protein, 9 aa, Homo Sapiens
RIKYDLKGS

SEQ ID NO: 84826 - protein, 9 aa, Homo Sapiens
LCIWLLILS

SEQ ID NO: 84827 - protein, 9 aa, Homo Sapiens
VGPYASPGV

SEQ ID NO: 84828 - protein, 9 aa, Homo Sapiens
SEKSTVLEG

SEQ ID NO: 84829 - protein, 9 aa, Homo Sapiens
KMRIKYDLK

SEQ ID NO: 84830 - protein, 9 aa, Homo Sapiens
EPLRFKDVA

SEQ ID NO: 84831 - protein, 9 aa, Homo Sapiens
TVSLHHQRP

SEQ ID NO: 84832 - protein, 9 aa, Homo Sapiens
VCSKPIMEQ

SEQ ID NO: 84833 - protein, 9 aa, Homo Sapiens
TAVDTSTPV

SEQ ID NO: 84834 - protein, 9 aa, Homo Sapiens
LEEQAMELY

SEQ ID NO: 84835 - protein, 9 aa, Homo Sapiens
EQILRATGK

SEQ ID NO: 84836 - protein, 9 aa, Homo Sapiens
GPLRQGCQP

SEQ ID NO: 84837 - protein, 9 aa, Homo Sapiens
MTNGLCIWL

SEQ ID NO: 84838 - protein, 9 aa, Homo Sapiens
DKAHIIIRS

SEQ ID NO: 84839 - protein, 9 aa, Homo Sapiens
SQEPLRFKD

SEQ ID NO: 84840 - protein, 9 aa, Homo Sapiens
VKDIEPQEA

SEQ ID NO: 84841 - protein, 9 aa, Homo Sapiens
PLRQGCQPL

SEQ ID NO: 84842 - protein, 9 aa, Homo Sapiens
LEGGEVRFN

SEQ ID NO: 84843 - protein, 9 aa, Homo Sapiens
IYMEWAEDL

SEQ ID NO: 84844 - protein, 9 aa, Homo Sapiens
IMTNGLCIW

SEQ ID NO: 84845 - protein, 9 aa, Homo Sapiens
DDLEEQAME

SEQ ID NO: 84846 - protein, 9 aa, Homo Sapiens
IALDSHPTT

SEQ ID NO: 84847 - protein, 9 aa, Homo Sapiens
SQIWNLNPV

SEQ ID NO: 84848 - protein, 9 aa, Homo Sapiens
PSSGARGQQ

SEQ ID NO: 84849 - protein, 9 aa, Homo Sapiens
RLFRILDSL

SEQ ID NO: 84850 - protein, 9 aa, Homo Sapiens
QRGAALLFL

SEQ ID NO: 84851 - protein, 9 aa, Homo Sapiens
HQLFYNACQ

SEQ ID NO: 84852 - protein, 9 aa, Homo Sapiens
GFEDCLVFH

SEQ ID NO: 84853 - protein, 9 aa, Homo Sapiens
LQRGAALLF

SEQ ID NO: 84854 - protein, 9 aa, Homo Sapiens
GPVLWDMAF

SEQ ID NO: 84855 - protein, 9 aa, Homo Sapiens
RLINTCNVL

SEQ ID NO: 84856 - protein, 9 aa, Homo Sapiens
LGGARITVF

SEQ ID NO: 84857 - protein, 9 aa, Homo Sapiens
LAKGFPLGG

SEQ ID NO: 84858 - protein, 9 aa, Homo Sapiens
HELMDKFSN

SEQ ID NO: 84859 - protein, 9 aa, Homo Sapiens
HRIKVTFKD

SEQ ID NO: 84860 - protein, 9 aa, Homo Sapiens
GESGDKEEE

SEQ ID NO: 84861 - protein, 9 aa, Homo Sapiens
FYNACQLDN

SEQ ID NO: 84862 - protein, 9 aa, Homo Sapiens
TECFLLAYM

SEQ ID NO: 84863 - protein, 9 aa, Homo Sapiens
VNYRRLINT

SEQ ID NO: 84864 - protein, 9 aa, Homo Sapiens
AKGFPLGGR

SEQ ID NO: 84865 - protein, 9 aa, Homo Sapiens
GPQRTEYVS

SEQ ID NO: 84866 - protein, 9 aa, Homo Sapiens
SVPFHRTPI

SEQ ID NO: 84867 - protein, 9 aa, Homo Sapiens
PLSSTAPPP

SEQ ID NO: 84868 - protein, 9 aa, Homo Sapiens
LSLAPSHRR

SEQ ID NO: 84869 - protein, 9 aa, Homo Sapiens
VWAVDALGL

SEQ ID NO: 84870 - protein, 9 aa, Homo Sapiens
TNRAFLQDG

SEQ ID NO: 84871 - protein, 9 aa, Homo Sapiens
NLCLSTGIL

SEQ ID NO: 84872 - protein, 9 aa, Homo Sapiens
ECFLLAYMA

SEQ ID NO: 84873 - protein, 9 aa, Homo Sapiens
FRGNKRNYI

SEQ ID NO: 84874 - protein, 9 aa, Homo Sapiens
YQEHKEENH

SEQ ID NO: 84875 - protein, 9 aa, Homo Sapiens
GETLLASDN

SEQ ID NO: 84876 - protein, 9 aa, Homo Sapiens
PKIFLGPQR

SEQ ID NO: 84877 - protein, 9 aa, Homo Sapiens
CLSTGILLV

SEQ ID NO: 84878 - protein, 9 aa, Homo Sapiens
FTVNYTRLR

SEQ ID NO: 84879 - protein, 9 aa, Homo Sapiens
NILEENLWR

SEQ ID NO: 84880 - protein, 9 aa, Homo Sapiens
DLQRGAALL

SEQ ID NO: 84881 - protein, 9 aa, Homo Sapiens
VLILNAAKT

SEQ ID NO: 84882 - protein, 9 aa, Homo Sapiens
FSCIIAECL

SEQ ID NO: 84883 - protein, 9 aa, Homo Sapiens
PLGPWRHVE

SEQ ID NO: 84884 - protein, 9 aa, Homo Sapiens
KEEDDEEED

SEQ ID NO: 84885 - protein, 9 aa, Homo Sapiens
PGEDRLFRI

SEQ ID NO: 84886 - protein, 9 aa, Homo Sapiens
GMFLPKHSL

SEQ ID NO: 84887 - protein, 9 aa, Homo Sapiens
WNLCLSTGI

SEQ ID NO: 84888 - protein, 9 aa, Homo Sapiens
VLWDMAFSK

SEQ ID NO: 84889 - protein, 9 aa, Homo Sapiens
ALLFLRQGW

SEQ ID NO: 84890 - protein, 9 aa, Homo Sapiens
YPAFPADGS

SEQ ID NO: 84891 - protein, 9 aa, Homo Sapiens
SKEEDDEEE

SEQ ID NO: 84892 - protein, 9 aa, Homo Sapiens
ILNAAKTCP

SEQ ID NO: 84893 - protein, 9 aa, Homo Sapiens
AVFTVNYTR

SEQ ID NO: 84894 - protein, 9 aa, Homo Sapiens
KLEHQLFYN

SEQ ID NO: 84895 - protein, 9 aa, Homo Sapiens
KTNMGASSS

SEQ ID NO: 84896 - protein, 9 aa, Homo Sapiens
VSSLHAESP

SEQ ID NO: 84897 - protein, 9 aa, Homo Sapiens
HVEGVEDWE

SEQ ID NO: 84898 - protein, 9 aa, Homo Sapiens
SSSLSLAPS

SEQ ID NO: 84899 - protein, 9 aa, Homo Sapiens
SSSSLSLAP

SEQ ID NO: 84900 - protein, 9 aa, Homo Sapiens
APSHRRPQD

SEQ ID NO: 84901 - protein, 9 aa, Homo Sapiens
DAVFTVNYT

SEQ ID NO: 84902 - protein, 9 aa, Homo Sapiens
LVNYRRLIN

SEQ ID NO: 84903 - protein, 9 aa, Homo Sapiens
AHNEDVTTR

SEQ ID NO: 84904 - protein, 9 aa, Homo Sapiens
RITVFASKT

SEQ ID NO: 84905 - protein, 9 aa, Homo Sapiens
GCTEPQPGA

SEQ ID NO: 84906 - protein, 9 aa, Homo Sapiens
ALFIKVQVG

SEQ ID NO: 84907 - protein, 9 aa, Homo Sapiens
PPPVLPPPP

SEQ ID NO: 84908 - protein, 9 aa, Homo Sapiens
NKRNYIVMI

SEQ ID NO: 84909 - protein, 9 aa, Homo Sapiens
NLWRSDKEL

SEQ ID NO: 84910 - protein, 9 aa, Homo Sapiens
VSLPELEDR

SEQ ID NO: 84911 - protein, 9 aa, Homo Sapiens
FPADGSTGV

SEQ ID NO: 84912 - protein, 9 aa, Homo Sapiens
LAYMAYDCY

SEQ ID NO: 84913 - protein, 9 aa, Homo Sapiens
ESPESRVSH

SEQ ID NO: 84914 - protein, 9 aa, Homo Sapiens
QVSLPELED

SEQ ID NO: 84915 - protein, 9 aa, Homo Sapiens
EDVTTRETC

SEQ ID NO: 84916 - protein, 9 aa, Homo Sapiens
IFSCIIAEC

SEQ ID NO: 84917 - protein, 9 aa, Homo Sapiens
RIKVTFKDE

SEQ ID NO: 84918 - protein, 9 aa, Homo Sapiens
VFTVNYTRL

SEQ ID NO: 84919 - protein, 9 aa, Homo Sapiens
MAWQVSLPE

SEQ ID NO: 84920 - protein, 9 aa, Homo Sapiens
WMFFILLGV

SEQ ID NO: 84921 - protein, 9 aa, Homo Sapiens
KYEQDDVNL

SEQ ID NO: 84922 - protein, 9 aa, Homo Sapiens
ITVFASKTS

SEQ ID NO: 84923 - protein, 9 aa, Homo Sapiens
NWSSARNSA

SEQ ID NO: 84924 - protein, 9 aa, Homo Sapiens
GAVAKQGFH

SEQ ID NO: 84925 - protein, 9 aa, Homo Sapiens
LHAESPESR

SEQ ID NO: 84926 - protein, 9 aa, Homo Sapiens
QEHKEENHE

SEQ ID NO: 84927 - protein, 9 aa, Homo Sapiens
VLDYLFRRF

SEQ ID NO: 84928 - protein, 9 aa, Homo Sapiens
KKLEHQLFY

SEQ ID NO: 84929 - protein, 9 aa, Homo Sapiens
VTTRETCKA

SEQ ID NO: 84930 - protein, 9 aa, Homo Sapiens
NTNRAFLQD

SEQ ID NO: 84931 - protein, 9 aa, Homo Sapiens
GFHFLCMPV

SEQ ID NO: 84932 - protein, 9 aa, Homo Sapiens
PMAVHRIKV

SEQ ID NO: 84933 - protein, 9 aa, Homo Sapiens
QRIHTREKL

SEQ ID NO: 84934 - protein, 9 aa, Homo Sapiens
QSSKQAFRG

SEQ ID NO: 84935 - protein, 9 aa, Homo Sapiens
LLWRANTNR

SEQ ID NO: 84936 - protein, 9 aa, Homo Sapiens
VLQSSKQAF

SEQ ID NO: 84937 - protein, 9 aa, Homo Sapiens
KYKGRYCVD

SEQ ID NO: 84938 - protein, 9 aa, Homo Sapiens
QGWRASWGW

SEQ ID NO: 84939 - protein, 9 aa, Homo Sapiens
SSLHAESPE

SEQ ID NO: 84940 - protein, 9 aa, Homo Sapiens
IAVLVLILN

SEQ ID NO: 84941 - protein, 9 aa, Homo Sapiens
PDEDLPSSG

SEQ ID NO: 84942 - protein, 9 aa, Homo Sapiens
SRLHDELLR

SEQ ID NO: 84943 - protein, 9 aa, Homo Sapiens
EQGCTEPQP

SEQ ID NO: 84944 - protein, 9 aa, Homo Sapiens
CVDERKRFR

SEQ ID NO: 84945 - protein, 9 aa, Homo Sapiens
QKLELNIKE

SEQ ID NO: 84946 - protein, 9 aa, Homo Sapiens
VPNKVLPPA

SEQ ID NO: 84947 - protein, 9 aa, Homo Sapiens
RPQDLQRGA

SEQ ID NO: 84948 - protein, 9 aa, Homo Sapiens
RDQTKKSPM

SEQ ID NO: 84949 - protein, 9 aa, Homo Sapiens
PPGTRFRAM

SEQ ID NO: 84950 - protein, 9 aa, Homo Sapiens
PWRHVEGVE

SEQ ID NO: 84951 - protein, 9 aa, Homo Sapiens
FLGPQRTEY

SEQ ID NO: 84952 - protein, 9 aa, Homo Sapiens
LINTCNVLQ

SEQ ID NO: 84953 - protein, 9 aa, Homo Sapiens
YCVDERKRF

SEQ ID NO: 84954 - protein, 9 aa, Homo Sapiens
RRQRSGKTN

SEQ ID NO: 84955 - protein, 9 aa, Homo Sapiens
VPFHRTPIS

SEQ ID NO: 84956 - protein, 9 aa, Homo Sapiens
FFVTHLAIT

SEQ ID NO: 84957 - protein, 9 aa, Homo Sapiens
SKGALFIKV

SEQ ID NO: 84958 - protein, 9 aa, Homo Sapiens
DSDSKEEDD

SEQ ID NO: 84959 - protein, 9 aa, Homo Sapiens
SLQKMFGNG

SEQ ID NO: 84960 - protein, 9 aa, Homo Sapiens
EDCLVFHEL

SEQ ID NO: 84961 - protein, 9 aa, Homo Sapiens
LGPQRTEYV

SEQ ID NO: 84962 - protein, 9 aa, Homo Sapiens
DSKEEDDEE

SEQ ID NO: 84963 - protein, 9 aa, Homo Sapiens
LQKMFGNGR

SEQ ID NO: 84964 - protein, 9 aa, Homo Sapiens
FQKLELNIK

SEQ ID NO: 84965 - protein, 9 aa, Homo Sapiens
NKVLPPAYL

SEQ ID NO: 84966 - protein, 9 aa, Homo Sapiens
VLVLILNAA

SEQ ID NO: 84967 - protein, 9 aa, Homo Sapiens
ILEENLWRS

SEQ ID NO: 84968 - protein, 9 aa, Homo Sapiens
TNMGASSSS

SEQ ID NO: 84969 - protein, 9 aa, Homo Sapiens
PGPVLWDMA

SEQ ID NO: 84970 - protein, 9 aa, Homo Sapiens
GWRASWGWN

SEQ ID NO: 84971 - protein, 9 aa, Homo Sapiens
YLFRRFADD

SEQ ID NO: 84972 - protein, 9 aa, Homo Sapiens
PYQEKSLQK

SEQ ID NO: 84973 - protein, 9 aa, Homo Sapiens
WQVSLPELE

SEQ ID NO: 84974 - protein, 9 aa, Homo Sapiens
NDQIYWSDF

SEQ ID NO: 84975 - protein, 9 aa, Homo Sapiens
ARVSEEKKV

SEQ ID NO: 84976 - protein, 9 aa, Homo Sapiens
KVTEERLKA

SEQ ID NO: 84977 - protein, 9 aa, Homo Sapiens
ASDNCGEAI

SEQ ID NO: 84978 - protein, 9 aa, Homo Sapiens
QKMFGNGRA

SEQ ID NO: 84979 - protein, 9 aa, Homo Sapiens
MFFILLGVT

SEQ ID NO: 84980 - protein, 9 aa, Homo Sapiens
FIKVQVGST

SEQ ID NO: 84981 - protein, 9 aa, Homo Sapiens
RQTVPIKHK

SEQ ID NO: 84982 - protein, 9 aa, Homo Sapiens
SHRRPQDLQ

SEQ ID NO: 84983 - protein, 9 aa, Homo Sapiens
VHRIKVTFK

SEQ ID NO: 84984 - protein, 9 aa, Homo Sapiens
QIFSCIIAE

SEQ ID NO: 84985 - protein, 9 aa, Homo Sapiens
QPSIFQKLE

SEQ ID NO: 84986 - protein, 9 aa, Homo Sapiens
KQAFRGNKR

SEQ ID NO: 84987 - protein, 9 aa, Homo Sapiens
LGGRCSSSG

SEQ ID NO: 84988 - protein, 9 aa, Homo Sapiens
FGESGDKEE

SEQ ID NO: 84989 - protein, 9 aa, Homo Sapiens
IFQKLELNI

SEQ ID NO: 84990 - protein, 9 aa, Homo Sapiens
GARITVFAS

SEQ ID NO: 84991 - protein, 9 aa, Homo Sapiens
DQIYWSDFK

SEQ ID NO: 84992 - protein, 9 aa, Homo Sapiens
SLAPSHRRP

SEQ ID NO: 84993 - protein, 9 aa, Homo Sapiens
REKLYKCKS

SEQ ID NO: 84994 - protein, 9 aa, Homo Sapiens
PQDLQRGAA

SEQ ID NO: 84995 - protein, 9 aa, Homo Sapiens
ENLWRSDKE

SEQ ID NO: 84996 - protein, 9 aa, Homo Sapiens
EDLPSSGAR

SEQ ID NO: 84997 - protein, 9 aa, Homo Sapiens
SSRLHDELL

SEQ ID NO: 84998 - protein, 9 aa, Homo Sapiens
ARITVFASK

SEQ ID NO: 84999 - protein, 9 aa, Homo Sapiens
KSLQKMFGN

SEQ ID NO: 85000 - protein, 9 aa, Homo Sapiens
CLVFHELMD

SEQ ID NO: 85001 - protein, 9 aa, Homo Sapiens
VEVPNKVLP

SEQ ID NO: 85002 - protein, 9 aa, Homo Sapiens
WSSARNSAS

SEQ ID NO: 85003 - protein, 9 aa, Homo Sapiens
FEDCLVFHE

SEQ ID NO: 85004 - protein, 9 aa, Homo Sapiens
LRRQRSGKT

SEQ ID NO: 85005 - protein, 9 aa, Homo Sapiens
LGVTERKFS

SEQ ID NO: 85006 - protein, 9 aa, Homo Sapiens
LRAHNEDVT

SEQ ID NO: 85007 - protein, 9 aa, Homo Sapiens
QGSSNGVEV

SEQ ID NO: 85008 - protein, 9 aa, Homo Sapiens
ITRWIQRRQ

SEQ ID NO: 85009 - protein, 9 aa, Homo Sapiens
GTRFRAMAI

SEQ ID NO: 85010 - protein, 9 aa, Homo Sapiens
SPMGPLDRE

SEQ ID NO: 85011 - protein, 9 aa, Homo Sapiens
QGCTEPQPG

SEQ ID NO: 85012 - protein, 9 aa, Homo Sapiens
NDNVAALRR

SEQ ID NO: 85013 - protein, 9 aa, Homo Sapiens
LFYNACQLD

SEQ ID NO: 85014 - protein, 9 aa, Homo Sapiens
RRFADDYKI

SEQ ID NO: 85015 - protein, 9 aa, Homo Sapiens
RRLINTCNV

SEQ ID NO: 85016 - protein, 9 aa, Homo Sapiens
LARVSEEKK

SEQ ID NO: 85017 - protein, 9 aa, Homo Sapiens
PSHRRPQDL

SEQ ID NO: 85018 - protein, 9 aa, Homo Sapiens
QIYWSDFKE

SEQ ID NO: 85019 - protein, 9 aa, Homo Sapiens
NNDQIYWSD

SEQ ID NO: 85020 - protein, 9 aa, Homo Sapiens
PPPGTRFRA

SEQ ID NO: 85021 - protein, 9 aa, Homo Sapiens
SSSGMFLPK

SEQ ID NO: 85022 - protein, 9 aa, Homo Sapiens
LPKHSLPKI

SEQ ID NO: 85023 - protein, 9 aa, Homo Sapiens
KGALFIKVQ

SEQ ID NO: 85024 - protein, 9 aa, Homo Sapiens
DDVNLEGVG

SEQ ID NO: 85025 - protein, 9 aa, Homo Sapiens
FHFLCMPVF

SEQ ID NO: 85026 - protein, 9 aa, Homo Sapiens
VAALRRQRS

SEQ ID NO: 85027 - protein, 9 aa, Homo Sapiens
MFLPKHSLP

SEQ ID NO: 85028 - protein, 9 aa, Homo Sapiens
FRILDSLQH

SEQ ID NO: 85029 - protein, 9 aa, Homo Sapiens
AECLQRAVH

SEQ ID NO: 85030 - protein, 9 aa, Homo Sapiens
GWNLCLSTG

SEQ ID NO: 85031 - protein, 9 aa, Homo Sapiens
LLAYMAYDC

SEQ ID NO: 85032 - protein, 9 aa, Homo Sapiens
MGPLDREAL

SEQ ID NO: 85033 - protein, 9 aa, Homo Sapiens
RVSEEKKVT

SEQ ID NO: 85034 - protein, 9 aa, Homo Sapiens
LRRILRSPM

SEQ ID NO: 85035 - protein, 9 aa, Homo Sapiens
SLFQGSSNG

SEQ ID NO: 85036 - protein, 9 aa, Homo Sapiens
RQGWRASWG

SEQ ID NO: 85037 - protein, 9 aa, Homo Sapiens
KSPMGPLDR

SEQ ID NO: 85038 - protein, 9 aa, Homo Sapiens
LGKYKEQGC

SEQ ID NO: 85039 - protein, 9 aa, Homo Sapiens
TRWIQRRQT

SEQ ID NO: 85040 - protein, 9 aa, Homo Sapiens
VKQPSIFQK

SEQ ID NO: 85041 - protein, 9 aa, Homo Sapiens
QDDVNLEGV

SEQ ID NO: 85042 - protein, 9 aa, Homo Sapiens
KAVLYSPLN

SEQ ID NO: 85043 - protein, 9 aa, Homo Sapiens
KIFLGPQRT

SEQ ID NO: 85044 - protein, 9 aa, Homo Sapiens
AVHRIKVTF

SEQ ID NO: 85045 - protein, 9 aa, Homo Sapiens
STPPPGTRF

SEQ ID NO: 85046 - protein, 9 aa, Homo Sapiens
KLELNIKEK

SEQ ID NO: 85047 - protein, 9 aa, Homo Sapiens
ARNSASAAE

SEQ ID NO: 85048 - protein, 9 aa, Homo Sapiens
YIVMITKSK

SEQ ID NO: 85049 - protein, 9 aa, Homo Sapiens
GAALLFLRQ

SEQ ID NO: 85050 - protein, 9 aa, Homo Sapiens
TRFRAMAIY

SEQ ID NO: 85051 - protein, 9 aa, Homo Sapiens
YSVPFHRTP

SEQ ID NO: 85052 - protein, 9 aa, Homo Sapiens
VLYSPLNRF

SEQ ID NO: 85053 - protein, 9 aa, Homo Sapiens
KGFPLGGRC

SEQ ID NO: 85054 - protein, 9 aa, Homo Sapiens
RWIQRRQTV

SEQ ID NO: 85055 - protein, 9 aa, Homo Sapiens
WRANTNRAF

SEQ ID NO: 85056 - protein, 9 aa, Homo Sapiens
LFLRQGWRA

SEQ ID NO: 85057 - protein, 9 aa, Homo Sapiens
SIDYLNNDQ

SEQ ID NO: 85058 - protein, 9 aa, Homo Sapiens
QRRQTVPIK

SEQ ID NO: 85059 - protein, 9 aa, Homo Sapiens
NRAFLQDGF

SEQ ID NO: 85060 - protein, 9 aa, Homo Sapiens
DALGLPSRF

SEQ ID NO: 85061 - protein, 9 aa, Homo Sapiens
ETLLASDNC

SEQ ID NO: 85062 - protein, 9 aa, Homo Sapiens
YQEKSLQKM

SEQ ID NO: 85063 - protein, 9 aa, Homo Sapiens
LFRILDSLQ

SEQ ID NO: 85064 - protein, 9 aa, Homo Sapiens
VDPGPVLWD

SEQ ID NO: 85065 - protein, 9 aa, Homo Sapiens
LASDNCGEA

SEQ ID NO: 85066 - protein, 9 aa, Homo Sapiens
AWQVSLPEL

SEQ ID NO: 85067 - protein, 9 aa, Homo Sapiens
RHVEGVEDW

SEQ ID NO: 85068 - protein, 9 aa, Homo Sapiens
RGAALLFLR

SEQ ID NO: 85069 - protein, 9 aa, Homo Sapiens
ITECFLLAY

SEQ ID NO: 85070 - protein, 9 aa, Homo Sapiens
LVLILNAAK

SEQ ID NO: 85071 - protein, 9 aa, Homo Sapiens
TVFASKTSQ

SEQ ID NO: 85072 - protein, 9 aa, Homo Sapiens
SSNGVEVRY

SEQ ID NO: 85073 - protein, 9 aa, Homo Sapiens
QDLQRGAAL

SEQ ID NO: 85074 - protein, 9 aa, Homo Sapiens
RNYIVMITK

SEQ ID NO: 85075 - protein, 9 aa, Homo Sapiens
NSVTDLVNY

SEQ ID NO: 85076 - protein, 9 aa, Homo Sapiens
GNKRNYIVM

SEQ ID NO: 85077 - protein, 9 aa, Homo Sapiens
SPESRVSHL

SEQ ID NO: 85078 - protein, 9 aa, Homo Sapiens
SLPKIFLGP

SEQ ID NO: 85079 - protein, 9 aa, Homo Sapiens
EAKVNSVTD

SEQ ID NO: 85080 - protein, 9 aa, Homo Sapiens
EDRLFRILD

SEQ ID NO: 85081 - protein, 9 aa, Homo Sapiens
RYCVDERKR

SEQ ID NO: 85082 - protein, 9 aa, Homo Sapiens
LLASDNCGE

SEQ ID NO: 85083 - protein, 9 aa, Homo Sapiens
RANTNRAFL

SEQ ID NO: 85084 - protein, 9 aa, Homo Sapiens
GASSSSLSL

SEQ ID NO: 85085 - protein, 9 aa, Homo Sapiens
DRLFRILDS

SEQ ID NO: 85086 - protein, 9 aa, Homo Sapiens
SLHAESPES

SEQ ID NO: 85087 - protein, 9 aa, Homo Sapiens
SCIIAECLQ

SEQ ID NO: 85088 - protein, 9 aa, Homo Sapiens
IIAECLQRA

SEQ ID NO: 85089 - protein, 9 aa, Homo Sapiens
NRYQEHKEE

SEQ ID NO: 85090 - protein, 9 aa, Homo Sapiens
GALFIKVQV

SEQ ID NO: 85091 - protein, 9 aa, Homo Sapiens
QAFRGNKRN

SEQ ID NO: 85092 - protein, 9 aa, Homo Sapiens
RSGKTNMGA

SEQ ID NO: 85093 - protein, 9 aa, Homo Sapiens
LLGVTERKF

SEQ ID NO: 85094 - protein, 9 aa, Homo Sapiens
DPGPVLWDM

SEQ ID NO: 85095 - protein, 9 aa, Homo Sapiens
GEDSDSDSK

SEQ ID NO: 85096 - protein, 9 aa, Homo Sapiens
YLNNDQIYW

SEQ ID NO: 85097 - protein, 9 aa, Homo Sapiens
HNEDVTTRE

SEQ ID NO: 85098 - protein, 9 aa, Homo Sapiens
LLFLRQGWR

SEQ ID NO: 85099 - protein, 9 aa, Homo Sapiens
TVNYTRLRK

SEQ ID NO: 85100 - protein, 9 aa, Homo Sapiens
SSGARGQQE

SEQ ID NO: 85101 - protein, 9 aa, Homo Sapiens
IKVTFKDEP

SEQ ID NO: 85102 - protein, 9 aa, Homo Sapiens
HSLPKIFLG

SEQ ID NO: 85103 - protein, 9 aa, Homo Sapiens
ILYPAFPAD

SEQ ID NO: 85104 - protein, 9 aa, Homo Sapiens
LASKGALFI

SEQ ID NO: 85105 - protein, 9 aa, Homo Sapiens
LPSSGARGQ

SEQ ID NO: 85106 - protein, 9 aa, Homo Sapiens
RNSASAAEA

SEQ ID NO: 85107 - protein, 9 aa, Homo Sapiens
EHKEENHEK

SEQ ID NO: 85108 - protein, 9 aa, Homo Sapiens
MVLDYLFRR

SEQ ID NO: 85109 - protein, 9 aa, Homo Sapiens
WRHVEGVED

SEQ ID NO: 85110 - protein, 9 aa, Homo Sapiens
THLAITDSF

SEQ ID NO: 85111 - protein, 9 aa, Homo Sapiens
LPELEDRLQ

SEQ ID NO: 85112 - protein, 9 aa, Homo Sapiens
AFPADGSTG

SEQ ID NO: 85113 - protein, 9 aa, Homo Sapiens
GSSNGVEVR

SEQ ID NO: 85114 - protein, 9 aa, Homo Sapiens
TLLASDNCG

SEQ ID NO: 85115 - protein, 9 aa, Homo Sapiens
LNNDQIYWS

SEQ ID NO: 85116 - protein, 9 aa, Homo Sapiens
SARNSASAA

SEQ ID NO: 85117 - protein, 9 aa, Homo Sapiens
NYRRLINTC

SEQ ID NO: 85118 - protein, 9 aa, Homo Sapiens
RHSDAVFTV

SEQ ID NO: 85119 - protein, 9 aa, Homo Sapiens
EKSLQKMFG

SEQ ID NO: 85120 - protein, 9 aa, Homo Sapiens
GRCSSSGMF

SEQ ID NO: 85121 - protein, 9 aa, Homo Sapiens
SDNCGEAIR

SEQ ID NO: 85122 - protein, 9 aa, Homo Sapiens
SGDKEEEEF

SEQ ID NO: 85123 - protein, 9 aa, Homo Sapiens
VFHELMDKF

SEQ ID NO: 85124 - protein, 9 aa, Homo Sapiens
TCNVLQSSK

SEQ ID NO: 85125 - protein, 9 aa, Homo Sapiens
KQGFHFLCM

SEQ ID NO: 85126 - protein, 9 aa, Homo Sapiens
KHSLPKIFL

SEQ ID NO: 85127 - protein, 9 aa, Homo Sapiens
WIQRRQTVP

SEQ ID NO: 85128 - protein, 9 aa, Homo Sapiens
FWMFFILLG

SEQ ID NO: 85129 - protein, 9 aa, Homo Sapiens
PFHRTPISS

SEQ ID NO: 85130 - protein, 9 aa, Homo Sapiens
ILLGVTERK

SEQ ID NO: 85131 - protein, 9 aa, Homo Sapiens
PLGGRCSSS

SEQ ID NO: 85132 - protein, 9 aa, Homo Sapiens
PAFPADGST

SEQ ID NO: 85133 - protein, 9 aa, Homo Sapiens
SDSDSKEED

SEQ ID NO: 85134 - protein, 9 aa, Homo Sapiens
NVLQSSKQA

SEQ ID NO: 85135 - protein, 9 aa, Homo Sapiens
NVAALRRQR

SEQ ID NO: 85136 - protein, 9 aa, Homo Sapiens
LRQGWRASW

SEQ ID NO: 85137 - protein, 9 aa, Homo Sapiens
IKKLEHQLF

SEQ ID NO: 85138 - protein, 9 aa, Homo Sapiens
SLSLAPSHR

SEQ ID NO: 85139 - protein, 9 aa, Homo Sapiens
SDSKEEDDE

SEQ ID NO: 85140 - protein, 9 aa, Homo Sapiens
QEKSLQKMF

SEQ ID NO: 85141 - protein, 9 aa, Homo Sapiens
LAPSHRRPQ

SEQ ID NO: 85142 - protein, 9 aa, Homo Sapiens
AVLYSPLNR

SEQ ID NO: 85143 - protein, 9 aa, Homo Sapiens
LILNAAKTC

SEQ ID NO: 85144 - protein, 9 aa, Homo Sapiens
RIHTREKLY

SEQ ID NO: 85145 - protein, 9 aa, Homo Sapiens
RCSSSGMFL

SEQ ID NO: 85146 - protein, 9 aa, Homo Sapiens
NTCNVLQSS

SEQ ID NO: 85147 - protein, 9 aa, Homo Sapiens
FLLAYMAYD

SEQ ID NO: 85148 - protein, 9 aa, Homo Sapiens
SASAAEARS

SEQ ID NO: 85149 - protein, 9 aa, Homo Sapiens
EHQLFYNAC

SEQ ID NO: 85150 - protein, 9 aa, Homo Sapiens
KRNYIVMIT

SEQ ID NO: 85151 - protein, 9 aa, Homo Sapiens
LQSSKQAFR

SEQ ID NO: 85152 - protein, 9 aa, Homo Sapiens
DLPSSGARG

SEQ ID NO: 85153 - protein, 9 aa, Homo Sapiens
FVTHLAITD

SEQ ID NO: 85154 - protein, 9 aa, Homo Sapiens
ALGWNLCLS

SEQ ID NO: 85155 - protein, 9 aa, Homo Sapiens
FRAMAIYKQ

SEQ ID NO: 85156 - protein, 9 aa, Homo Sapiens
SSGMFLPKH

SEQ ID NO: 85157 - protein, 9 aa, Homo Sapiens
RVSSLHAES

SEQ ID NO: 85158 - protein, 9 aa, Homo Sapiens
FHELMDKFS

SEQ ID NO: 85159 - protein, 9 aa, Homo Sapiens
VFASKTSQR

SEQ ID NO: 85160 - protein, 9 aa, Homo Sapiens
QTKKSPMGP

SEQ ID NO: 85161 - protein, 9 aa, Homo Sapiens
RYQEHKEEN

SEQ ID NO: 85162 - protein, 9 aa, Homo Sapiens
YIAVLVLIL

SEQ ID NO: 85163 - protein, 9 aa, Homo Sapiens
PVEVPNKVL

SEQ ID NO: 85164 - protein, 9 aa, Homo Sapiens
CFLLAYMAY

SEQ ID NO: 85165 - protein, 9 aa, Homo Sapiens
RRPQDLQRG

SEQ ID NO: 85166 - protein, 9 aa, Homo Sapiens
DVTTRETCK

SEQ ID NO: 85167 - protein, 9 aa, Homo Sapiens
DYLFRRFAD

SEQ ID NO: 85168 - protein, 9 aa, Homo Sapiens
SSARNSASA

SEQ ID NO: 85169 - protein, 9 aa, Homo Sapiens
LYSPLNRFG

SEQ ID NO: 85170 - protein, 9 aa, Homo Sapiens
LFRRFADDY

SEQ ID NO: 85171 - protein, 9 aa, Homo Sapiens
SIFQKLELN

SEQ ID NO: 85172 - protein, 9 aa, Homo Sapiens
HKEENHEKD

SEQ ID NO: 85173 - protein, 9 aa, Homo Sapiens
VEGVEDWEK

SEQ ID NO: 85174 - protein, 9 aa, Homo Sapiens
KEQGCTEPQ

SEQ ID NO: 85175 - protein, 9 aa, Homo Sapiens
RRQTVPIKH

SEQ ID NO: 85176 - protein, 9 aa, Homo Sapiens
EDSDSDSKE

SEQ ID NO: 85177 - protein, 9 aa, Homo Sapiens
PELEDRLQC

SEQ ID NO: 85178 - protein, 9 aa, Homo Sapiens
IKVQVGSTP

SEQ ID NO: 85179 - protein, 9 aa, Homo Sapiens
CSNRYQEHK

SEQ ID NO: 85180 - protein, 9 aa, Homo Sapiens
GQVWAVDAL

SEQ ID NO: 85181 - protein, 9 aa, Homo Sapiens
YSPLNRFGN

SEQ ID NO: 85182 - protein, 9 aa, Homo Sapiens
PADGSTGVE

SEQ ID NO: 85183 - protein, 9 aa, Homo Sapiens
YKGRYCVDE

SEQ ID NO: 85184 - protein, 9 aa, Homo Sapiens
KKSPMGPLD

SEQ ID NO: 85185 - protein, 9 aa, Homo Sapiens
SDAVFTVNY

SEQ ID NO: 85186 - protein, 9 aa, Homo Sapiens
KVNSVTDLV

SEQ ID NO: 85187 - protein, 9 aa, Homo Sapiens
LFIKVQVGS

SEQ ID NO: 85188 - protein, 9 aa, Homo Sapiens
GGRCSSSGM

SEQ ID NO: 85189 - protein, 9 aa, Homo Sapiens
VAKQGFHFL

SEQ ID NO: 85190 - protein, 9 aa, Homo Sapiens
CCSNRYQEH

SEQ ID NO: 85191 - protein, 9 aa, Homo Sapiens
TDLVNYRRL

SEQ ID NO: 85192 - protein, 9 aa, Homo Sapiens
LKAVLYSPL

SEQ ID NO: 85193 - protein, 9 aa, Homo Sapiens
VNYTRLRKQ

SEQ ID NO: 85194 - protein, 9 aa, Homo Sapiens
ASSSSLSLA

SEQ ID NO: 85195 - protein, 9 aa, Homo Sapiens
AVDALGLPS

SEQ ID NO: 85196 - protein, 9 aa, Homo Sapiens
IDYLNNDQI

SEQ ID NO: 85197 - protein, 9 aa, Homo Sapiens
LWRSDKELE

SEQ ID NO: 85198 - protein, 9 aa, Homo Sapiens
DNCGEAIRS

SEQ ID NO: 85199 - protein, 9 aa, Homo Sapiens
FASKTSQRY

SEQ ID NO: 85200 - protein, 9 aa, Homo Sapiens
VDALGLPSR

SEQ ID NO: 85201 - protein, 9 aa, Homo Sapiens
RGNKRNYIV

SEQ ID NO: 85202 - protein, 9 aa, Homo Sapiens
DSDSDSKEE

SEQ ID NO: 85203 - protein, 9 aa, Homo Sapiens
VSEEKKVTE

SEQ ID NO: 85204 - protein, 9 aa, Homo Sapiens
SPLNRFGNL

SEQ ID NO: 85205 - protein, 9 aa, Homo Sapiens
LEHQLFYNA

SEQ ID NO: 85206 - protein, 9 aa, Homo Sapiens
EPLGPWRHV

SEQ ID NO: 85207 - protein, 9 aa, Homo Sapiens
LPKIFLGPQ

SEQ ID NO: 85208 - protein, 9 aa, Homo Sapiens
DNVAALRRQ

SEQ ID NO: 85209 - protein, 9 aa, Homo Sapiens
HDELLRRIL

SEQ ID NO: 85210 - protein, 9 aa, Homo Sapiens
INTCNVLQS

SEQ ID NO: 85211 - protein, 9 aa, Homo Sapiens
TKKSPMGPL

SEQ ID NO: 85212 - protein, 9 aa, Homo Sapiens
SNRYQEHKE

SEQ ID NO: 85213 - protein, 9 aa, Homo Sapiens
AQIFSCIIA

SEQ ID NO: 85214 - protein, 9 aa, Homo Sapiens
GKTNMGASS

SEQ ID NO: 85215 - protein, 9 aa, Homo Sapiens
DVNLEGVGN

SEQ ID NO: 85216 - protein, 9 aa, Homo Sapiens
VTHLAITDS

SEQ ID NO: 85217 - protein, 9 aa, Homo Sapiens
DKYEQDDVN

SEQ ID NO: 85218 - protein, 9 aa, Homo Sapiens
FRRFADDYK

SEQ ID NO: 85219 - protein, 9 aa, Homo Sapiens
CIIAECLQR

SEQ ID NO: 85220 - protein, 9 aa, Homo Sapiens
PTPVEVPNK

SEQ ID NO: 85221 - protein, 9 aa, Homo Sapiens
DEDLPSSGA

SEQ ID NO: 85222 - protein, 9 aa, Homo Sapiens
VLPPPPLSS

SEQ ID NO: 85223 - protein, 9 aa, Homo Sapiens
RPYQEKSLQ

SEQ ID NO: 85224 - protein, 9 aa, Homo Sapiens
KLKAVLYSP

SEQ ID NO: 85225 - protein, 9 aa, Homo Sapiens
RTPISSMSS

SEQ ID NO: 85226 - protein, 9 aa, Homo Sapiens
GFPLGGRCS

SEQ ID NO: 85227 - protein, 9 aa, Homo Sapiens
ILDSLQHSP

SEQ ID NO: 85228 - protein, 9 aa, Homo Sapiens
VNSVTDLVN

SEQ ID NO: 85229 - protein, 9 aa, Homo Sapiens
TREKLYKCK

SEQ ID NO: 85230 - protein, 9 aa, Homo Sapiens
QVWAVDALG

SEQ ID NO: 85231 - protein, 9 aa, Homo Sapiens
PSIFQKLEL

SEQ ID NO: 85232 - protein, 9 aa, Homo Sapiens
YMAYDCYVA

SEQ ID NO: 85233 - protein, 9 aa, Homo Sapiens
LWDMAFSKD

SEQ ID NO: 85234 - protein, 9 aa, Homo Sapiens
GDKEEEEFT

SEQ ID NO: 85235 - protein, 9 aa, Homo Sapiens
SSLSLAPSH

SEQ ID NO: 85236 - protein, 9 aa, Homo Sapiens
KHQRIHTRE

SEQ ID NO: 85237 - protein, 9 aa, Homo Sapiens
RNILEENLW

SEQ ID NO: 85238 - protein, 9 aa, Homo Sapiens
MTFFVTHLA

SEQ ID NO: 85239 - protein, 9 aa, Homo Sapiens
AYMAYDCYV

SEQ ID NO: 85240 - protein, 9 aa, Homo Sapiens
SEEKKVTEE

SEQ ID NO: 85241 - protein, 9 aa, Homo Sapiens
KKVTEERLK

SEQ ID NO: 85242 - protein, 9 aa, Homo Sapiens
DIFGESGDK

SEQ ID NO: 85243 - protein, 9 aa, Homo Sapiens
WAVDALGLP

SEQ ID NO: 85244 - protein, 9 aa, Homo Sapiens
FLRQGWRAS

SEQ ID NO: 85245 - protein, 9 aa, Homo Sapiens
SSKQAFRGN

SEQ ID NO: 85246 - protein, 9 aa, Homo Sapiens
DELLRRILR

SEQ ID NO: 85247 - protein, 9 aa, Homo Sapiens
EQDDVNLEG

SEQ ID NO: 85248 - protein, 9 aa, Homo Sapiens
ASKGALFIK

SEQ ID NO: 85249 - protein, 9 aa, Homo Sapiens
DCLVFHELM

SEQ ID NO: 85250 - protein, 9 aa, Homo Sapiens
NSASAAEAR

SEQ ID NO: 85251 - protein, 9 aa, Homo Sapiens
AALLFLRQG

SEQ ID NO: 85252 - protein, 9 aa, Homo Sapiens
LGPWRHVEG

SEQ ID NO: 85253 - protein, 9 aa, Homo Sapiens
IAECLQRAV

SEQ ID NO: 85254 - protein, 9 aa, Homo Sapiens
TTPMAVHRI

SEQ ID NO: 85255 - protein, 9 aa, Homo Sapiens
ALRAHNEDV

SEQ ID NO: 85256 - protein, 9 aa, Homo Sapiens
EPTPVEVPN

SEQ ID NO: 85257 - protein, 9 aa, Homo Sapiens
NGVEVRYDL

SEQ ID NO: 85258 - protein, 9 aa, Homo Sapiens
TDYSVPFHR

SEQ ID NO: 85259 - protein, 9 aa, Homo Sapiens
LDYLFRRFA

SEQ ID NO: 85260 - protein, 9 aa, Homo Sapiens
HSDAVFTVN

SEQ ID NO: 85261 - protein, 9 aa, Homo Sapiens
LGLPSRFGS

SEQ ID NO: 85262 - protein, 9 aa, Homo Sapiens
PMGPLDREA

SEQ ID NO: 85263 - protein, 9 aa, Homo Sapiens
GRYCVDERK

SEQ ID NO: 85264 - protein, 9 aa, Homo Sapiens
LWRANTNRA

SEQ ID NO: 85265 - protein, 9 aa, Homo Sapiens
ALRRQRSGK

SEQ ID NO: 85266 - protein, 9 aa, Homo Sapiens
ALGLPSRFG

SEQ ID NO: 85267 - protein, 9 aa, Homo Sapiens
GGARITVFA

SEQ ID NO: 85268 - protein, 9 aa, Homo Sapiens
GKYKEQGCT

SEQ ID NO: 85269 - protein, 9 aa, Homo Sapiens
NCGEAIRSL

SEQ ID NO: 85270 - protein, 9 aa, Homo Sapiens
SGMFLPKHS

SEQ ID NO: 85271 - protein, 9 aa, Homo Sapiens
EEKKVTEER

SEQ ID NO: 85272 - protein, 9 aa, Homo Sapiens
GEDRLFRIL

SEQ ID NO: 85273 - protein, 9 aa, Homo Sapiens
RLHDELLRR

SEQ ID NO: 85274 - protein, 9 aa, Homo Sapiens
LYPAFPADG

SEQ ID NO: 85275 - protein, 9 aa, Homo Sapiens
FHRTPISSM

SEQ ID NO: 85276 - protein, 9 aa, Homo Sapiens
KITRWIQRR

SEQ ID NO: 85277 - protein, 9 aa, Homo Sapiens
QRSGKTNMG

SEQ ID NO: 85278 - protein, 9 aa, Homo Sapiens
LPPPPLSST

SEQ ID NO: 85279 - protein, 9 aa, Homo Sapiens
SLLWRANTN

SEQ ID NO: 85280 - protein, 9 aa, Homo Sapiens
LNDNVAALR

SEQ ID NO: 85281 - protein, 9 aa, Homo Sapiens
WDMAFSKDH

SEQ ID NO: 85282 - protein, 9 aa, Homo Sapiens
SDKYEQDDV

SEQ ID NO: 85283 - protein, 9 aa, Homo Sapiens
TFFVTHLAI

SEQ ID NO: 85284 - protein, 9 aa, Homo Sapiens
ASAAEARSM

SEQ ID NO: 85285 - protein, 9 aa, Homo Sapiens
VNLEGVGNN

SEQ ID NO: 85286 - protein, 9 aa, Homo Sapiens
FQGSSNGVE

SEQ ID NO: 85287 - protein, 9 aa, Homo Sapiens
PVLPPPPLS

SEQ ID NO: 85288 - protein, 9 aa, Homo Sapiens
HRRPQDLQR

SEQ ID NO: 85289 - protein, 9 aa, Homo Sapiens
SNGVEVRYD

SEQ ID NO: 85290 - protein, 9 aa, Homo Sapiens
PPVLPPPPL

SEQ ID NO: 85291 - protein, 9 aa, Homo Sapiens
RILDSLQHS

SEQ ID NO: 85292 - protein, 9 aa, Homo Sapiens
AVLVLILNA

SEQ ID NO: 85293 - protein, 9 aa, Homo Sapiens
LVFHELMDK

SEQ ID NO: 85294 - protein, 9 aa, Homo Sapiens
SGARGQQEQ

SEQ ID NO: 85295 - protein, 9 aa, Homo Sapiens
QLFYNACQL

SEQ ID NO: 85296 - protein, 9 aa, Homo Sapiens
GPWRHVEGV

SEQ ID NO: 85297 - protein, 9 aa, Homo Sapiens
VDERKRFRL

SEQ ID NO: 85298 - protein, 9 aa, Homo Sapiens
KQPSIFQKL

SEQ ID NO: 85299 - protein, 9 aa, Homo Sapiens
CTEPQPGAR

SEQ ID NO: 85300 - protein, 9 aa, Homo Sapiens
LEENLWRSD

SEQ ID NO: 85301 - protein, 9 aa, Homo Sapiens
EVPNKVLPP

SEQ ID NO: 85302 - protein, 9 aa, Homo Sapiens
RFRAMAIYK

SEQ ID NO: 85303 - protein, 9 aa, Homo Sapiens
PPPLSSTAP

SEQ ID NO: 85304 - protein, 9 aa, Homo Sapiens
DKEEEEFTG

SEQ ID NO: 85305 - protein, 9 aa, Homo Sapiens
VTDLVNYRR

SEQ ID NO: 85306 - protein, 9 aa, Homo Sapiens
KYKEQGCTE

SEQ ID NO: 85307 - protein, 9 aa, Homo Sapiens
AKVNSVTDL

SEQ ID NO: 85308 - protein, 9 aa, Homo Sapiens
TPMAVHRIK

SEQ ID NO: 85309 - protein, 9 aa, Homo Sapiens
EILYPAFPA

SEQ ID NO: 85310 - protein, 9 aa, Homo Sapiens
DERKRFRLC

SEQ ID NO: 85311 - protein, 9 aa, Homo Sapiens
QGFHFLCMP

SEQ ID NO: 85312 - protein, 9 aa, Homo Sapiens
IQRRQTVPI

SEQ ID NO: 85313 - protein, 9 aa, Homo Sapiens
HFWMFFILL

SEQ ID NO: 85314 - protein, 9 aa, Homo Sapiens
SRMTFFVTH

SEQ ID NO: 85315 - protein, 9 aa, Homo Sapiens
NEDVTTRET

SEQ ID NO: 85316 - protein, 9 aa, Homo Sapiens
ESGDKEEEE

SEQ ID NO: 85317 - protein, 9 aa, Homo Sapiens
PNKVLPPAY

SEQ ID NO: 85318 - protein, 9 aa, Homo Sapiens
LSLFQGSSN

SEQ ID NO: 85319 - protein, 9 aa, Homo Sapiens
CSSSGMFLP

SEQ ID NO: 85320 - protein, 9 aa, Homo Sapiens
PLNRFGNLT

SEQ ID NO: 85321 - protein, 9 aa, Homo Sapiens
ANTNRAFLQ

SEQ ID NO: 85322 - protein, 9 aa, Homo Sapiens
SGKTNMGAS

SEQ ID NO: 85323 - protein, 9 aa, Homo Sapiens
HRTPISSMS

SEQ ID NO: 85324 - protein, 9 aa, Homo Sapiens
MALGWNLCL

SEQ ID NO: 85325 - protein, 9 aa, Homo Sapiens
KEEEEFTGF

SEQ ID NO: 85326 - protein, 9 aa, Homo Sapiens
PKHSLPKIF

SEQ ID NO: 85327 - protein, 9 aa, Homo Sapiens
LNAAKTCPT

SEQ ID NO: 85328 - protein, 9 aa, Homo Sapiens
RMTFFVTHL

SEQ ID NO: 85329 - protein, 9 aa, Homo Sapiens
DYLNNDQIY

SEQ ID NO: 85330 - protein, 9 aa, Homo Sapiens
FPLGGRCSS

SEQ ID NO: 85331 - protein, 9 aa, Homo Sapiens
FLPKHSLPK

SEQ ID NO: 85332 - protein, 9 aa, Homo Sapiens
HAESPESRV

SEQ ID NO: 85333 - protein, 9 aa, Homo Sapiens
RAHNEDVTT

SEQ ID NO: 85334 - protein, 9 aa, Homo Sapiens
KGRYCVDER

SEQ ID NO: 85335 - protein, 9 aa, Homo Sapiens
NMGASSSSL

SEQ ID NO: 85336 - protein, 9 aa, Homo Sapiens
PGTRFRAMA

SEQ ID NO: 85337 - protein, 9 aa, Homo Sapiens
NYIVMITKS

SEQ ID NO: 85338 - protein, 9 aa, Homo Sapiens
SVTDLVNYR

SEQ ID NO: 85339 - protein, 9 aa, Homo Sapiens
PPPPLSSTA

SEQ ID NO: 85340 - protein, 9 aa, Homo Sapiens
IFLGPQRTE

SEQ ID NO: 85341 - protein, 9 aa, Homo Sapiens
DLVNYRRLI

SEQ ID NO: 85342 - protein, 9 aa, Homo Sapiens
KPDEDLPSS

SEQ ID NO: 85343 - protein, 9 aa, Homo Sapiens
LFQGSSNGV

SEQ ID NO: 85344 - protein, 9 aa, Homo Sapiens
DQTKKSPMG

SEQ ID NO: 85345 - protein, 9 aa, Homo Sapiens
SLPELEDRL

SEQ ID NO: 85346 - protein, 9 aa, Homo Sapiens
PVLWDMAFS

SEQ ID NO: 85347 - protein, 9 aa, Homo Sapiens
RQRSGKTNM

SEQ ID NO: 85348 - protein, 9 aa, Homo Sapiens
MAVHRIKVT

SEQ ID NO: 85349 - protein, 9 aa, Homo Sapiens
TPPPGTRFR

SEQ ID NO: 85350 - protein, 9 aa, Homo Sapiens
ELLRRILRS

SEQ ID NO: 85351 - protein, 9 aa, Homo Sapiens
EKKVTEERL

SEQ ID NO: 85352 - protein, 9 aa, Homo Sapiens
SKQAFRGNK

SEQ ID NO: 85353 - protein, 9 aa, Homo Sapiens
ADGSTGVEL

SEQ ID NO: 85354 - protein, 9 aa, Homo Sapiens
AALRRQRSG

SEQ ID NO: 85355 - protein, 9 aa, Homo Sapiens
HLAITDSFT

SEQ ID NO: 85356 - protein, 9 aa, Homo Sapiens
YEQDDVNLE

SEQ ID NO: 85357 - protein, 9 aa, Homo Sapiens
YRRLINTCN

SEQ ID NO: 85358 - protein, 9 aa, Homo Sapiens
AKQGFHFLC

SEQ ID NO: 85359 - protein, 9 aa, Homo Sapiens
WRSDKELEK

SEQ ID NO: 85360 - protein, 9 aa, Homo Sapiens
IFGESGDKE

SEQ ID NO: 85361 - protein, 9 aa, Homo Sapiens
FILLGVTER

SEQ ID NO: 85362 - protein, 9 aa, Homo Sapiens
AESPESRVS

SEQ ID NO: 85363 - protein, 9 aa, Homo Sapiens
AFRGNKRNY

SEQ ID NO: 85364 - protein, 9 aa, Homo Sapiens
PPLSSTAPP

SEQ ID NO: 85365 - protein, 9 aa, Homo Sapiens
TPVEVPNKV

SEQ ID NO: 85366 - protein, 9 aa, Homo Sapiens
MGASSSSLS

SEQ ID NO: 85367 - protein, 9 aa, Homo Sapiens
CNVLQSSKQ

SEQ ID NO: 85368 - protein, 9 aa, Homo Sapiens
LHDELLRRI

SEQ ID NO: 85369 - protein, 9 aa, Homo Sapiens
WRASWGWNR

SEQ ID NO: 85370 - protein, 9 aa, Homo Sapiens
DYSVPFHRT

SEQ ID NO: 85371 - protein, 9 aa, Homo Sapiens
LGWNLCLST

SEQ ID NO: 85372 - protein, 9 aa, Homo Sapiens
AVAKQGFHF

SEQ ID NO: 85373 - protein, 9 aa, Homo Sapiens
QMALGWNLC

SEQ ID NO: 85374 - protein, 9 aa, Homo Sapiens
EENLWRSDK

SEQ ID NO: 85375 - protein, 9 aa, Homo Sapiens
LLRRILRSP

SEQ ID NO: 85376 - protein, 9 aa, Homo Sapiens
HFLCMPVFH

SEQ ID NO: 85377 - protein, 9 aa, Homo Sapiens
YKEQGCTEP

SEQ ID NO: 85378 - protein, 9 aa, Homo Sapiens
LCLSTGILL

SEQ ID NO: 85379 - protein, 9 aa, Homo Sapiens
VVDPGPVLW

SEQ ID NO: 85380 - protein, 9 aa, Homo Sapiens
YSHVKDEVR

SEQ ID NO: 85381 - protein, 9 aa, Homo Sapiens
CIVNPARKG

SEQ ID NO: 85382 - protein, 9 aa, Homo Sapiens
VLARFTAEM

SEQ ID NO: 85383 - protein, 9 aa, Homo Sapiens
GLLVFGMAF

SEQ ID NO: 85384 - protein, 9 aa, Homo Sapiens
GEETWQALL

SEQ ID NO: 85385 - protein, 9 aa, Homo Sapiens
TAGRQLASL

SEQ ID NO: 85386 - protein, 9 aa, Homo Sapiens
QPVIFSTSP

SEQ ID NO: 85387 - protein, 9 aa, Homo Sapiens
TAFIGLYIG

SEQ ID NO: 85388 - protein, 9 aa, Homo Sapiens
ALQCVPNTT

SEQ ID NO: 85389 - protein, 9 aa, Homo Sapiens
DIFVSTSED

SEQ ID NO: 85390 - protein, 9 aa, Homo Sapiens
SHVKDEVRY

SEQ ID NO: 85391 - protein, 9 aa, Homo Sapiens
GRQLASLLE

SEQ ID NO: 85392 - protein, 9 aa, Homo Sapiens
LDKNGQFAL

SEQ ID NO: 85393 - protein, 9 aa, Homo Sapiens
ISSLTAFIG

SEQ ID NO: 85394 - protein, 9 aa, Homo Sapiens
KVKRSKKAP

SEQ ID NO: 85395 - protein, 9 aa, Homo Sapiens
DHLDKNGQF

SEQ ID NO: 85396 - protein, 9 aa, Homo Sapiens
EDNVELPPA

SEQ ID NO: 85397 - protein, 9 aa, Homo Sapiens
VAINKIVLT

SEQ ID NO: 85398 - protein, 9 aa, Homo Sapiens
FNEEGETPA

SEQ ID NO: 85399 - protein, 9 aa, Homo Sapiens
NLVKAVKTA

SEQ ID NO: 85400 - protein, 9 aa, Homo Sapiens
RWGPEEDNV

SEQ ID NO: 85401 - protein, 9 aa, Homo Sapiens
VTTTMLRWI

SEQ ID NO: 85402 - protein, 9 aa, Homo Sapiens
FPYTRQDKK

SEQ ID NO: 85403 - protein, 9 aa, Homo Sapiens
NAGQLKNGD

SEQ ID NO: 85404 - protein, 9 aa, Homo Sapiens
DPFTHHDLD

SEQ ID NO: 85405 - protein, 9 aa, Homo Sapiens
GQFALVHAA

SEQ ID NO: 85406 - protein, 9 aa, Homo Sapiens
KKKLAKNGI

SEQ ID NO: 85407 - protein, 9 aa, Homo Sapiens
RKIFGLSIL

SEQ ID NO: 85408 - protein, 9 aa, Homo Sapiens
KIAEQEFLD

SEQ ID NO: 85409 - protein, 9 aa, Homo Sapiens
LGPSFCQRA

SEQ ID NO: 85410 - protein, 9 aa, Homo Sapiens
PKLNLKKAR

SEQ ID NO: 85411 - protein, 9 aa, Homo Sapiens
GSWAGITAV

SEQ ID NO: 85412 - protein, 9 aa, Homo Sapiens
KEGKKELLF

SEQ ID NO: 85413 - protein, 9 aa, Homo Sapiens
CVPNTTTLI

SEQ ID NO: 85414 - protein, 9 aa, Homo Sapiens
ETQMEQLRG

SEQ ID NO: 85415 - protein, 9 aa, Homo Sapiens
HLDLQQYSF

SEQ ID NO: 85416 - protein, 9 aa, Homo Sapiens
DFLVRDSMS

SEQ ID NO: 85417 - protein, 9 aa, Homo Sapiens
NVELPPAEL

SEQ ID NO: 85418 - protein, 9 aa, Homo Sapiens
MSSPGNFVL

SEQ ID NO: 85419 - protein, 9 aa, Homo Sapiens
IQISVSINK

SEQ ID NO: 85420 - protein, 9 aa, Homo Sapiens
LNPTYKEQD

SEQ ID NO: 85421 - protein, 9 aa, Homo Sapiens
QFALVHAAL

SEQ ID NO: 85422 - protein, 9 aa, Homo Sapiens
VKAMINAGQ

SEQ ID NO: 85423 - protein, 9 aa, Homo Sapiens
ELTRQVKKK

SEQ ID NO: 85424 - protein, 9 aa, Homo Sapiens
METQMEQLR

SEQ ID NO: 85425 - protein, 9 aa, Homo Sapiens
ARFTAEMSD

SEQ ID NO: 85426 - protein, 9 aa, Homo Sapiens
DKAGSWAGI

SEQ ID NO: 85427 - protein, 9 aa, Homo Sapiens
MLQIGHHLE

SEQ ID NO: 85428 - protein, 9 aa, Homo Sapiens
AFSATMLIF

SEQ ID NO: 85429 - protein, 9 aa, Homo Sapiens
MGRLNPTYK

SEQ ID NO: 85430 - protein, 9 aa, Homo Sapiens
SAGRGRASR

SEQ ID NO: 85431 - protein, 9 aa, Homo Sapiens
PLSAGRGRA

SEQ ID NO: 85432 - protein, 9 aa, Homo Sapiens
FIGLYIGLS

SEQ ID NO: 85433 - protein, 9 aa, Homo Sapiens
EKAPTKEGK

SEQ ID NO: 85434 - protein, 9 aa, Homo Sapiens
LERMQVHSP

SEQ ID NO: 85435 - protein, 9 aa, Homo Sapiens
GLKTHLDLQ

SEQ ID NO: 85436 - protein, 9 aa, Homo Sapiens
EMKGLKTHL

SEQ ID NO: 85437 - protein, 9 aa, Homo Sapiens
EDRTADYHS

SEQ ID NO: 85438 - protein, 9 aa, Homo Sapiens
ERYKCLEQL

SEQ ID NO: 85439 - protein, 9 aa, Homo Sapiens
HPDNKHKNL

SEQ ID NO: 85440 - protein, 9 aa, Homo Sapiens
PNKQNQNAI

SEQ ID NO: 85441 - protein, 9 aa, Homo Sapiens
RALIDSVIR

SEQ ID NO: 85442 - protein, 9 aa, Homo Sapiens
IKLEQNTLN

SEQ ID NO: 85443 - protein, 9 aa, Homo Sapiens
KFRKTPIVK

SEQ ID NO: 85444 - protein, 9 aa, Homo Sapiens
INKIVLTDP

SEQ ID NO: 85445 - protein, 9 aa, Homo Sapiens
KDLPVLARF

SEQ ID NO: 85446 - protein, 9 aa, Homo Sapiens
EDVDKNALQ

SEQ ID NO: 85447 - protein, 9 aa, Homo Sapiens
QLLAAPREL

SEQ ID NO: 85448 - protein, 9 aa, Homo Sapiens
SPVNLVKAV

SEQ ID NO: 85449 - protein, 9 aa, Homo Sapiens
QSLGKRLNA

SEQ ID NO: 85450 - protein, 9 aa, Homo Sapiens
GRSLSTARV

SEQ ID NO: 85451 - protein, 9 aa, Homo Sapiens
SGQLIDKAG

SEQ ID NO: 85452 - protein, 9 aa, Homo Sapiens
TFGDGCHGK

SEQ ID NO: 85453 - protein, 9 aa, Homo Sapiens
RYKCLEQLA

SEQ ID NO: 85454 - protein, 9 aa, Homo Sapiens
LRALGAAAG

SEQ ID NO: 85455 - protein, 9 aa, Homo Sapiens
VSTQQIGQL

SEQ ID NO: 85456 - protein, 9 aa, Homo Sapiens
QPGMAGGDG

SEQ ID NO: 85457 - protein, 9 aa, Homo Sapiens
MAGGDGPPG

SEQ ID NO: 85458 - protein, 9 aa, Homo Sapiens
SLSTARVVQ

SEQ ID NO: 85459 - protein, 9 aa, Homo Sapiens
TTIKQRSRC

SEQ ID NO: 85460 - protein, 9 aa, Homo Sapiens
FKHNTDHIR

SEQ ID NO: 85461 - protein, 9 aa, Homo Sapiens
MYTFGDGCH

SEQ ID NO: 85462 - protein, 9 aa, Homo Sapiens
LVTFQSLGK

SEQ ID NO: 85463 - protein, 9 aa, Homo Sapiens
ETLLGGLLV

SEQ ID NO: 85464 - protein, 9 aa, Homo Sapiens
LSILVPPHI

SEQ ID NO: 85465 - protein, 9 aa, Homo Sapiens
GGQGRIRAR

SEQ ID NO: 85466 - protein, 9 aa, Homo Sapiens
VAKGIGRMA

SEQ ID NO: 85467 - protein, 9 aa, Homo Sapiens
IAEQEFLDA

SEQ ID NO: 85468 - protein, 9 aa, Homo Sapiens
IPCFPYTRQ

SEQ ID NO: 85469 - protein, 9 aa, Homo Sapiens
IFSTSPAVS

SEQ ID NO: 85470 - protein, 9 aa, Homo Sapiens
LTAFIGLYI

SEQ ID NO: 85471 - protein, 9 aa, Homo Sapiens
NASLSVHSE

SEQ ID NO: 85472 - protein, 9 aa, Homo Sapiens
IGLYIGLSV

SEQ ID NO: 85473 - protein, 9 aa, Homo Sapiens
ALAPNSTAG

SEQ ID NO: 85474 - protein, 9 aa, Homo Sapiens
STARVVQPL

SEQ ID NO: 85475 - protein, 9 aa, Homo Sapiens
GCHGKLGLG

SEQ ID NO: 85476 - protein, 9 aa, Homo Sapiens
TTCLRFPGR

SEQ ID NO: 85477 - protein, 9 aa, Homo Sapiens
TWQALLSPR

SEQ ID NO: 85478 - protein, 9 aa, Homo Sapiens
VEDRTADYH

SEQ ID NO: 85479 - protein, 9 aa, Homo Sapiens
RLPLSAGRG

SEQ ID NO: 85480 - protein, 9 aa, Homo Sapiens
LVVGPGARS

SEQ ID NO: 85481 - protein, 9 aa, Homo Sapiens
KYAGEEGII

SEQ ID NO: 85482 - protein, 9 aa, Homo Sapiens
KNGQFALVH

SEQ ID NO: 85483 - protein, 9 aa, Homo Sapiens
STAGRQLAS

SEQ ID NO: 85484 - protein, 9 aa, Homo Sapiens
GGPSALTSR

SEQ ID NO: 85485 - protein, 9 aa, Homo Sapiens
AGGDGPPGP

SEQ ID NO: 85486 - protein, 9 aa, Homo Sapiens
KCLEQLAAE

SEQ ID NO: 85487 - protein, 9 aa, Homo Sapiens
DINSNSSET

SEQ ID NO: 85488 - protein, 9 aa, Homo Sapiens
DKNALQYIH

SEQ ID NO: 85489 - protein, 9 aa, Homo Sapiens
TFQSLGKRL

SEQ ID NO: 85490 - protein, 9 aa, Homo Sapiens
GQGRIRARL

SEQ ID NO: 85491 - protein, 9 aa, Homo Sapiens
EASDIKLEQ

SEQ ID NO: 85492 - protein, 9 aa, Homo Sapiens
ETTTTAQKT

SEQ ID NO: 85493 - protein, 9 aa, Homo Sapiens
SDANPEVTT

SEQ ID NO: 85494 - protein, 9 aa, Homo Sapiens
KAMINAGQL

SEQ ID NO: 85495 - protein, 9 aa, Homo Sapiens
DWQVSTQQI

SEQ ID NO: 85496 - protein, 9 aa, Homo Sapiens
PGMAGGDGP

SEQ ID NO: 85497 - protein, 9 aa, Homo Sapiens
SRQHELRHF

SEQ ID NO: 85498 - protein, 9 aa, Homo Sapiens
YGFVKAMIN

SEQ ID NO: 85499 - protein, 9 aa, Homo Sapiens
LQIGHHLEK

SEQ ID NO: 85500 - protein, 9 aa, Homo Sapiens
QEDSRTASE

SEQ ID NO: 85501 - protein, 9 aa, Homo Sapiens
FRSAAAQRL

SEQ ID NO: 85502 - protein, 9 aa, Homo Sapiens
VFTTIKQRS

SEQ ID NO: 85503 - protein, 9 aa, Homo Sapiens
IDKAGSWAG

SEQ ID NO: 85504 - protein, 9 aa, Homo Sapiens
FSRQHELRH

SEQ ID NO: 85505 - protein, 9 aa, Homo Sapiens
FFVQRKPDF

SEQ ID NO: 85506 - protein, 9 aa, Homo Sapiens
RIVMGEETW

SEQ ID NO: 85507 - protein, 9 aa, Homo Sapiens
WPFFVQRKP

SEQ ID NO: 85508 - protein, 9 aa, Homo Sapiens
AMINAGQLK

SEQ ID NO: 85509 - protein, 9 aa, Homo Sapiens
TFREPFVLT

SEQ ID NO: 85510 - protein, 9 aa, Homo Sapiens
RSAAAQRLH

SEQ ID NO: 85511 - protein, 9 aa, Homo Sapiens
WIDQAVTLI

SEQ ID NO: 85512 - protein, 9 aa, Homo Sapiens
KAPTKEGKK

SEQ ID NO: 85513 - protein, 9 aa, Homo Sapiens
FALVHAALR

SEQ ID NO: 85514 - protein, 9 aa, Homo Sapiens
WQALLSPRA

SEQ ID NO: 85515 - protein, 9 aa, Homo Sapiens
TTTTAQKTS

SEQ ID NO: 85516 - protein, 9 aa, Homo Sapiens
PDNKHKNLY

SEQ ID NO: 85517 - protein, 9 aa, Homo Sapiens
GDFLVRDSM

SEQ ID NO: 85518 - protein, 9 aa, Homo Sapiens
GGLLVFGMA

SEQ ID NO: 85519 - protein, 9 aa, Homo Sapiens
FVKAMINAG

SEQ ID NO: 85520 - protein, 9 aa, Homo Sapiens
KARALIDSV

SEQ ID NO: 85521 - protein, 9 aa, Homo Sapiens
VFGMAFAVV

SEQ ID NO: 85522 - protein, 9 aa, Homo Sapiens
NPTYKEQDC

SEQ ID NO: 85523 - protein, 9 aa, Homo Sapiens
MNFSRQHEL

SEQ ID NO: 85524 - protein, 9 aa, Homo Sapiens
LGKRLNAVV

SEQ ID NO: 85525 - protein, 9 aa, Homo Sapiens
PWYFVEMVE

SEQ ID NO: 85526 - protein, 9 aa, Homo Sapiens
DFRSAAAQR

SEQ ID NO: 85527 - protein, 9 aa, Homo Sapiens
FIKFRKTPI

SEQ ID NO: 85528 - protein, 9 aa, Homo Sapiens
PTKEGKKEL

SEQ ID NO: 85529 - protein, 9 aa, Homo Sapiens
LHLERMQVH

SEQ ID NO: 85530 - protein, 9 aa, Homo Sapiens
AGRGRASRA

SEQ ID NO: 85531 - protein, 9 aa, Homo Sapiens
CGRIFKHNT

SEQ ID NO: 85532 - protein, 9 aa, Homo Sapiens
GDNIQISVS

SEQ ID NO: 85533 - protein, 9 aa, Homo Sapiens
TIYAVAPVP

SEQ ID NO: 85534 - protein, 9 aa, Homo Sapiens
SFCQRAFEH

SEQ ID NO: 85535 - protein, 9 aa, Homo Sapiens
HIMETQMEQ

SEQ ID NO: 85536 - protein, 9 aa, Homo Sapiens
PVLARFTAE

SEQ ID NO: 85537 - protein, 9 aa, Homo Sapiens
SRTASEPME

SEQ ID NO: 85538 - protein, 9 aa, Homo Sapiens
MMNFSRQHE

SEQ ID NO: 85539 - protein, 9 aa, Homo Sapiens
FTHHDLDMG

SEQ ID NO: 85540 - protein, 9 aa, Homo Sapiens
KTPIVKATN

SEQ ID NO: 85541 - protein, 9 aa, Homo Sapiens
LIDKAGSWA

SEQ ID NO: 85542 - protein, 9 aa, Homo Sapiens
PETTTTAQK

SEQ ID NO: 85543 - protein, 9 aa, Homo Sapiens
FTYEDVDKN

SEQ ID NO: 85544 - protein, 9 aa, Homo Sapiens
RKIAEQEFL

SEQ ID NO: 85545 - protein, 9 aa, Homo Sapiens
FQSLGKRLN

SEQ ID NO: 85546 - protein, 9 aa, Homo Sapiens
GRIFKHNTD

SEQ ID NO: 85547 - protein, 9 aa, Homo Sapiens
NDLCIVNPA

SEQ ID NO: 85548 - protein, 9 aa, Homo Sapiens
STSPAVSGW

SEQ ID NO: 85549 - protein, 9 aa, Homo Sapiens
RSALIQHWP

SEQ ID NO: 85550 - protein, 9 aa, Homo Sapiens
QHWPVHTGE

SEQ ID NO: 85551 - protein, 9 aa, Homo Sapiens
RDSMSSPGN

SEQ ID NO: 85552 - protein, 9 aa, Homo Sapiens
FGLSILVPP

SEQ ID NO: 85553 - protein, 9 aa, Homo Sapiens
GGDGPPGPK

SEQ ID NO: 85554 - protein, 9 aa, Homo Sapiens
LNASLSVHS

SEQ ID NO: 85555 - protein, 9 aa, Homo Sapiens
EHSAVPTSG

SEQ ID NO: 85556 - protein, 9 aa, Homo Sapiens
LNLKKARAY

SEQ ID NO: 85557 - protein, 9 aa, Homo Sapiens
KTIYAVAPV

SEQ ID NO: 85558 - protein, 9 aa, Homo Sapiens
EAPNKQNQN

SEQ ID NO: 85559 - protein, 9 aa, Homo Sapiens
EEDNVELPP

SEQ ID NO: 85560 - protein, 9 aa, Homo Sapiens
FSTSPAVSG

SEQ ID NO: 85561 - protein, 9 aa, Homo Sapiens
FREPFVLTE

SEQ ID NO: 85562 - protein, 9 aa, Homo Sapiens
RSGGQGRIR

SEQ ID NO: 85563 - protein, 9 aa, Homo Sapiens
GSPCNDLCI

SEQ ID NO: 85564 - protein, 9 aa, Homo Sapiens
GMAGGDGPP

SEQ ID NO: 85565 - protein, 9 aa, Homo Sapiens
ASPRDWQVS

SEQ ID NO: 85566 - protein, 9 aa, Homo Sapiens
FISSLTAFI

SEQ ID NO: 85567 - protein, 9 aa, Homo Sapiens
DFDVVYATM

SEQ ID NO: 85568 - protein, 9 aa, Homo Sapiens
SMSSPGNFV

SEQ ID NO: 85569 - protein, 9 aa, Homo Sapiens
RLNADLRKL

SEQ ID NO: 85570 - protein, 9 aa, Homo Sapiens
EETWQALLS

SEQ ID NO: 85571 - protein, 9 aa, Homo Sapiens
DQAVTLIFK

SEQ ID NO: 85572 - protein, 9 aa, Homo Sapiens
VNLVKAVKT

SEQ ID NO: 85573 - protein, 9 aa, Homo Sapiens
QRSRCDRWM

SEQ ID NO: 85574 - protein, 9 aa, Homo Sapiens
QLIDKAGSW

SEQ ID NO: 85575 - protein, 9 aa, Homo Sapiens
VHSEKDELI

SEQ ID NO: 85576 - protein, 9 aa, Homo Sapiens
ARVDPFTHH

SEQ ID NO: 85577 - protein, 9 aa, Homo Sapiens
ALTSRTGQL

SEQ ID NO: 85578 - protein, 9 aa, Homo Sapiens
SAVPTSGCA

SEQ ID NO: 85579 - protein, 9 aa, Homo Sapiens
GRLNADLRK

SEQ ID NO: 85580 - protein, 9 aa, Homo Sapiens
IIEDMKLMF

SEQ ID NO: 85581 - protein, 9 aa, Homo Sapiens
YKEQDCGPP

SEQ ID NO: 85582 - protein, 9 aa, Homo Sapiens
KRLNAVVRR

SEQ ID NO: 85583 - protein, 9 aa, Homo Sapiens
THSVWPFFV

SEQ ID NO: 85584 - protein, 9 aa, Homo Sapiens
LRFPGRLNA

SEQ ID NO: 85585 - protein, 9 aa, Homo Sapiens
NKIVLTDPQ

SEQ ID NO: 85586 - protein, 9 aa, Homo Sapiens
ALIQHWPVH

SEQ ID NO: 85587 - protein, 9 aa, Homo Sapiens
YFVEMVEAD

SEQ ID NO: 85588 - protein, 9 aa, Homo Sapiens
TLLGGLLVF

SEQ ID NO: 85589 - protein, 9 aa, Homo Sapiens
NSTAGRQLA

SEQ ID NO: 85590 - protein, 9 aa, Homo Sapiens
VGPGARSGL

SEQ ID NO: 85591 - protein, 9 aa, Homo Sapiens
IFGLSILVP

SEQ ID NO: 85592 - protein, 9 aa, Homo Sapiens
RFPGRLNAD

SEQ ID NO: 85593 - protein, 9 aa, Homo Sapiens
ERKIFGLSI

SEQ ID NO: 85594 - protein, 9 aa, Homo Sapiens
WGPEEDNVE

SEQ ID NO: 85595 - protein, 9 aa, Homo Sapiens
TTTMLRWIY

SEQ ID NO: 85596 - protein, 9 aa, Homo Sapiens
NGQFALVHA

SEQ ID NO: 85597 - protein, 9 aa, Homo Sapiens
TTTAQKTSA

SEQ ID NO: 85598 - protein, 9 aa, Homo Sapiens
VMDKARALI

SEQ ID NO: 85599 - protein, 9 aa, Homo Sapiens
AARSGGQGR

SEQ ID NO: 85600 - protein, 9 aa, Homo Sapiens
IFKHNTDHI

SEQ ID NO: 85601 - protein, 9 aa, Homo Sapiens
SGLGAPVRL

SEQ ID NO: 85602 - protein, 9 aa, Homo Sapiens
GDLGPSFCQ

SEQ ID NO: 85603 - protein, 9 aa, Homo Sapiens
AAPRELHKF

SEQ ID NO: 85604 - protein, 9 aa, Homo Sapiens
AGLPGELGH

SEQ ID NO: 85605 - protein, 9 aa, Homo Sapiens
WRLPLSAGR

SEQ ID NO: 85606 - protein, 9 aa, Homo Sapiens
DPWYFVEMV

SEQ ID NO: 85607 - protein, 9 aa, Homo Sapiens
EDSRTASEP

SEQ ID NO: 85608 - protein, 9 aa, Homo Sapiens
RVAINKIVL

SEQ ID NO: 85609 - protein, 9 aa, Homo Sapiens
TAVWRLPLS

SEQ ID NO: 85610 - protein, 9 aa, Homo Sapiens
DSIFNEEGE

SEQ ID NO: 85611 - protein, 9 aa, Homo Sapiens
FVSTSEDEP

SEQ ID NO: 85612 - protein, 9 aa, Homo Sapiens
YKCLEQLAA

SEQ ID NO: 85613 - protein, 9 aa, Homo Sapiens
GQLIDKAGS

SEQ ID NO: 85614 - protein, 9 aa, Homo Sapiens
LSAGRGRAS

SEQ ID NO: 85615 - protein, 9 aa, Homo Sapiens
EQEFLDASE

SEQ ID NO: 85616 - protein, 9 aa, Homo Sapiens
RYSHVKDEV

SEQ ID NO: 85617 - protein, 9 aa, Homo Sapiens
DSRTASEPM

SEQ ID NO: 85618 - protein, 9 aa, Homo Sapiens
REPFVLTEK

SEQ ID NO: 85619 - protein, 9 aa, Homo Sapiens
RSRCDRWMV

SEQ ID NO: 85620 - protein, 9 aa, Homo Sapiens
ETWQALLSP

SEQ ID NO: 85621 - protein, 9 aa, Homo Sapiens
SIFNEEGET

SEQ ID NO: 85622 - protein, 9 aa, Homo Sapiens
DGCHGKLGL

SEQ ID NO: 85623 - protein, 9 aa, Homo Sapiens
HSSPVNLVK

SEQ ID NO: 85624 - protein, 9 aa, Homo Sapiens
DRTADYHSN

SEQ ID NO: 85625 - protein, 9 aa, Homo Sapiens
FQWIDQAVT

SEQ ID NO: 85626 - protein, 9 aa, Homo Sapiens
PVNLVKAVK

SEQ ID NO: 85627 - protein, 9 aa, Homo Sapiens
HLHSSPVNL

SEQ ID NO: 85628 - protein, 9 aa, Homo Sapiens
ASDIKLEQN

SEQ ID NO: 85629 - protein, 9 aa, Homo Sapiens
KQNQNAISE

SEQ ID NO: 85630 - protein, 9 aa, Homo Sapiens
ELRHFYNRR

SEQ ID NO: 85631 - protein, 9 aa, Homo Sapiens
EEGIIEDMK

SEQ ID NO: 85632 - protein, 9 aa, Homo Sapiens
PTYKEQDCG

SEQ ID NO: 85633 - protein, 9 aa, Homo Sapiens
AQERQLRAL

SEQ ID NO: 85634 - protein, 9 aa, Homo Sapiens
ITFREPFVL

SEQ ID NO: 85635 - protein, 9 aa, Homo Sapiens
HEKAPTKEG

SEQ ID NO: 85636 - protein, 9 aa, Homo Sapiens
NSNSSETTD

SEQ ID NO: 85637 - protein, 9 aa, Homo Sapiens
EPFVLTEKG

SEQ ID NO: 85638 - protein, 9 aa, Homo Sapiens
RALGAAAGC

SEQ ID NO: 85639 - protein, 9 aa, Homo Sapiens
KRSKKAPNS

SEQ ID NO: 85640 - protein, 9 aa, Homo Sapiens
FLDASERVQ

SEQ ID NO: 85641 - protein, 9 aa, Homo Sapiens
DTFTYEDVD

SEQ ID NO: 85642 - protein, 9 aa, Homo Sapiens
KTHSVWPFF

SEQ ID NO: 85643 - protein, 9 aa, Homo Sapiens
FLVRDSMSS

SEQ ID NO: 85644 - protein, 9 aa, Homo Sapiens
KKLAKNGIC

SEQ ID NO: 85645 - protein, 9 aa, Homo Sapiens
IQHWPVHTG

SEQ ID NO: 85646 - protein, 9 aa, Homo Sapiens
PGQPGMAGG

SEQ ID NO: 85647 - protein, 9 aa, Homo Sapiens
KAGSWAGIT

SEQ ID NO: 85648 - protein, 9 aa, Homo Sapiens
LDKTIYAVA

SEQ ID NO: 85649 - protein, 9 aa, Homo Sapiens
LVRDSMSSP

SEQ ID NO: 85650 - protein, 9 aa, Homo Sapiens
FVPINLHLE

SEQ ID NO: 85651 - protein, 9 aa, Homo Sapiens
CDKRVAINK

SEQ ID NO: 85652 - protein, 9 aa, Homo Sapiens
TYEDVDKNA

SEQ ID NO: 85653 - protein, 9 aa, Homo Sapiens
ARALIDSVI

SEQ ID NO: 85654 - protein, 9 aa, Homo Sapiens
TRQVKKKLA

SEQ ID NO: 85655 - protein, 9 aa, Homo Sapiens
IFGFIGAFS

SEQ ID NO: 85656 - protein, 9 aa, Homo Sapiens
RQVKKKLAK

SEQ ID NO: 85657 - protein, 9 aa, Homo Sapiens
KLEQNTLNG

SEQ ID NO: 85658 - protein, 9 aa, Homo Sapiens
NQNAISEAH

SEQ ID NO: 85659 - protein, 9 aa, Homo Sapiens
DLGPSFCQR

SEQ ID NO: 85660 - protein, 9 aa, Homo Sapiens
LSTARVVQP

SEQ ID NO: 85661 - protein, 9 aa, Homo Sapiens
PYTRQDKKD

SEQ ID NO: 85662 - protein, 9 aa, Homo Sapiens
DVVYATMHG

SEQ ID NO: 85663 - protein, 9 aa, Homo Sapiens
LDPWYFVEM

SEQ ID NO: 85664 - protein, 9 aa, Homo Sapiens
TASEPMEEE

SEQ ID NO: 85665 - protein, 9 aa, Homo Sapiens
GIIEDMKLM

SEQ ID NO: 85666 - protein, 9 aa, Homo Sapiens
AKHAVSEGS

SEQ ID NO: 85667 - protein, 9 aa, Homo Sapiens
PRELHKFFS

SEQ ID NO: 85668 - protein, 9 aa, Homo Sapiens
AAQRLHLEI

SEQ ID NO: 85669 - protein, 9 aa, Homo Sapiens
VDKNALQYI

SEQ ID NO: 85670 - protein, 9 aa, Homo Sapiens
HHDLDMGTI

SEQ ID NO: 85671 - protein, 9 aa, Homo Sapiens
AEQEFLDAS

SEQ ID NO: 85672 - protein, 9 aa, Homo Sapiens
TYKEQDCGP

SEQ ID NO: 85673 - protein, 9 aa, Homo Sapiens
LTSRTGQLP

SEQ ID NO: 85674 - protein, 9 aa, Homo Sapiens
AGRQLASLL

SEQ ID NO: 85675 - protein, 9 aa, Homo Sapiens
SRKIAEQEF

SEQ ID NO: 85676 - protein, 9 aa, Homo Sapiens
RTGQLPPEG

SEQ ID NO: 85677 - protein, 9 aa, Homo Sapiens
NTDHIRHQR

SEQ ID NO: 85678 - protein, 9 aa, Homo Sapiens
MDKARALID

SEQ ID NO: 85679 - protein, 9 aa, Homo Sapiens
VDPFTHHDL

SEQ ID NO: 85680 - protein, 9 aa, Homo Sapiens
LAAPRELHK

SEQ ID NO: 85681 - protein, 9 aa, Homo Sapiens
SRTGQLPPE

SEQ ID NO: 85682 - protein, 9 aa, Homo Sapiens
LRSALIQHW

SEQ ID NO: 85683 - protein, 9 aa, Homo Sapiens
DKRVAINKI

SEQ ID NO: 85684 - protein, 9 aa, Homo Sapiens
EVENVEDRT

SEQ ID NO: 85685 - protein, 9 aa, Homo Sapiens
LPVLARFTA

SEQ ID NO: 85686 - protein, 9 aa, Homo Sapiens
KADSIFNEE

SEQ ID NO: 85687 - protein, 9 aa, Homo Sapiens
KHAVSEGSK

SEQ ID NO: 85688 - protein, 9 aa, Homo Sapiens
SVHSEKDEL

SEQ ID NO: 85689 - protein, 9 aa, Homo Sapiens
LLVFGMAFA

SEQ ID NO: 85690 - protein, 9 aa, Homo Sapiens
LVFGMAFAV

SEQ ID NO: 85691 - protein, 9 aa, Homo Sapiens
GGVGEALQC

SEQ ID NO: 85692 - protein, 9 aa, Homo Sapiens
PEVTTTMLR

SEQ ID NO: 85693 - protein, 9 aa, Homo Sapiens
GFSQPVIFS

SEQ ID NO: 85694 - protein, 9 aa, Homo Sapiens
LLGIDVSRA

SEQ ID NO: 85695 - protein, 9 aa, Homo Sapiens
PTEEKRQED

SEQ ID NO: 85696 - protein, 9 aa, Homo Sapiens
FTDGSEERV

SEQ ID NO: 85697 - protein, 9 aa, Homo Sapiens
EMHIMETQM

SEQ ID NO: 85698 - protein, 9 aa, Homo Sapiens
IKFRKTPIV

SEQ ID NO: 85699 - protein, 9 aa, Homo Sapiens
VRDSMSSPG

SEQ ID NO: 85700 - protein, 9 aa, Homo Sapiens
NVEDRTADY

SEQ ID NO: 85701 - protein, 9 aa, Homo Sapiens
FRKTPIVKA

SEQ ID NO: 85702 - protein, 9 aa, Homo Sapiens
TFTYEDVDK

SEQ ID NO: 85703 - protein, 9 aa, Homo Sapiens
EFLDASERV

SEQ ID NO: 85704 - protein, 9 aa, Homo Sapiens
VWPFFVQRK

SEQ ID NO: 85705 - protein, 9 aa, Homo Sapiens
QHEKAPTKE

SEQ ID NO: 85706 - protein, 9 aa, Homo Sapiens
YAVAPVPAL

SEQ ID NO: 85707 - protein, 9 aa, Homo Sapiens
ADSIFNEEG

SEQ ID NO: 85708 - protein, 9 aa, Homo Sapiens
APNKQNQNA

SEQ ID NO: 85709 - protein, 9 aa, Homo Sapiens
DNIQISVSI

SEQ ID NO: 85710 - protein, 9 aa, Homo Sapiens
PFTHHDLDM

SEQ ID NO: 85711 - protein, 9 aa, Homo Sapiens
YPLKFQWID

SEQ ID NO: 85712 - protein, 9 aa, Homo Sapiens
NLKKARAYG

SEQ ID NO: 85713 - protein, 9 aa, Homo Sapiens
MDDFDVVYA

SEQ ID NO: 85714 - protein, 9 aa, Homo Sapiens
GGSPCNDLC

SEQ ID NO: 85715 - protein, 9 aa, Homo Sapiens
ARSGGQGRI

SEQ ID NO: 85716 - protein, 9 aa, Homo Sapiens
VVGPGARSG

SEQ ID NO: 85717 - protein, 9 aa, Homo Sapiens
DLPVLARFT

SEQ ID NO: 85718 - protein, 9 aa, Homo Sapiens
VVRWSVAKG

SEQ ID NO: 85719 - protein, 9 aa, Homo Sapiens
DANPEVTTT

SEQ ID NO: 85720 - protein, 9 aa, Homo Sapiens
IFNEEGETP

SEQ ID NO: 85721 - protein, 9 aa, Homo Sapiens
VFTDGSEER

SEQ ID NO: 85722 - protein, 9 aa, Homo Sapiens
NIQISVSIN

SEQ ID NO: 85723 - protein, 9 aa, Homo Sapiens
LKTHLDLQQ

SEQ ID NO: 85724 - protein, 9 aa, Homo Sapiens
ALIDSVIRK

SEQ ID NO: 85725 - protein, 9 aa, Homo Sapiens
QVKKKLAKN

SEQ ID NO: 85726 - protein, 9 aa, Homo Sapiens
EERYKCLEQ

SEQ ID NO: 85727 - protein, 9 aa, Homo Sapiens
GFVKAMINA

SEQ ID NO: 85728 - protein, 9 aa, Homo Sapiens
GELGHVGPV

SEQ ID NO: 85729 - protein, 9 aa, Homo Sapiens
LYINIVAYD

SEQ ID NO: 85730 - protein, 9 aa, Homo Sapiens
PFVRNRYSH

SEQ ID NO: 85731 - protein, 9 aa, Homo Sapiens
INLHLERMQ

SEQ ID NO: 85732 - protein, 9 aa, Homo Sapiens
FSATMLIFI

SEQ ID NO: 85733 - protein, 9 aa, Homo Sapiens
GRGRASRAP

SEQ ID NO: 85734 - protein, 9 aa, Homo Sapiens
VKRSKKAPN

SEQ ID NO: 85735 - protein, 9 aa, Homo Sapiens
RTADYHSNG

SEQ ID NO: 85736 - protein, 9 aa, Homo Sapiens
EALQCVPNT

SEQ ID NO: 85737 - protein, 9 aa, Homo Sapiens
SGGQGRIRA

SEQ ID NO: 85738 - protein, 9 aa, Homo Sapiens
RGRASRAPM

SEQ ID NO: 85739 - protein, 9 aa, Homo Sapiens
PRVFTDGSE

SEQ ID NO: 85740 - protein, 9 aa, Homo Sapiens
ITAVWRLPL

SEQ ID NO: 85741 - protein, 9 aa, Homo Sapiens
APNSTAGRQ

SEQ ID NO: 85742 - protein, 9 aa, Homo Sapiens
FGFIGAFSA

SEQ ID NO: 85743 - protein, 9 aa, Homo Sapiens
HHLEKYLSQ

SEQ ID NO: 85744 - protein, 9 aa, Homo Sapiens
QISVSINKK

SEQ ID NO: 85745 - protein, 9 aa, Homo Sapiens
NRYSHVKDE

SEQ ID NO: 85746 - protein, 9 aa, Homo Sapiens
PLKFQWIDQ

SEQ ID NO: 85747 - protein, 9 aa, Homo Sapiens
PGRLNADLR

SEQ ID NO: 85748 - protein, 9 aa, Homo Sapiens
LGHVGPVGD

SEQ ID NO: 85749 - protein, 9 aa, Homo Sapiens
AREERYKCL

SEQ ID NO: 85750 - protein, 9 aa, Homo Sapiens
LPGELGHVG

SEQ ID NO: 85751 - protein, 9 aa, Homo Sapiens
RVFTDGSEE

SEQ ID NO: 85752 - protein, 9 aa, Homo Sapiens
VMGEETWQA

SEQ ID NO: 85753 - protein, 9 aa, Homo Sapiens
DVDKNALQY

SEQ ID NO: 85754 - protein, 9 aa, Homo Sapiens
SRWGPEEDN

SEQ ID NO: 85755 - protein, 9 aa, Homo Sapiens
HLDKNGQFA

SEQ ID NO: 85756 - protein, 9 aa, Homo Sapiens
FVLTEKGMR

SEQ ID NO: 85757 - protein, 9 aa, Homo Sapiens
LSVHSEKDE

SEQ ID NO: 85758 - protein, 9 aa, Homo Sapiens
APTKEGKKE

SEQ ID NO: 85759 - protein, 9 aa, Homo Sapiens
PVIFSTSPA

SEQ ID NO: 85760 - protein, 9 aa, Homo Sapiens
ARSGLGAPV

SEQ ID NO: 85761 - protein, 9 aa, Homo Sapiens
HWPVHTGEK

SEQ ID NO: 85762 - protein, 9 aa, Homo Sapiens
SVWPFFVQR

SEQ ID NO: 85763 - protein, 9 aa, Homo Sapiens
TEEKRQEDE

SEQ ID NO: 85764 - protein, 9 aa, Homo Sapiens
QNAISEAHG

SEQ ID NO: 85765 - protein, 9 aa, Homo Sapiens
SDIKLEQNT

SEQ ID NO: 85766 - protein, 9 aa, Homo Sapiens
SEKDELILF

SEQ ID NO: 85767 - protein, 9 aa, Homo Sapiens
INAGQLKNG

SEQ ID NO: 85768 - protein, 9 aa, Homo Sapiens
GPEEDNVEL

SEQ ID NO: 85769 - protein, 9 aa, Homo Sapiens
QVSTQQIGQ

SEQ ID NO: 85770 - protein, 9 aa, Homo Sapiens
AQKTSAAAV

SEQ ID NO: 85771 - protein, 9 aa, Homo Sapiens
WPVHTGEKR

SEQ ID NO: 85772 - protein, 9 aa, Homo Sapiens
RVVQPLSIQ

SEQ ID NO: 85773 - protein, 9 aa, Homo Sapiens
FDVVYATMH

SEQ ID NO: 85774 - protein, 9 aa, Homo Sapiens
YGDNIQISV

SEQ ID NO: 85775 - protein, 9 aa, Homo Sapiens
NVFTTIKQR

SEQ ID NO: 85776 - protein, 9 aa, Homo Sapiens
YIFGFIGAF

SEQ ID NO: 85777 - protein, 9 aa, Homo Sapiens
RIRARLRPI

SEQ ID NO: 85778 - protein, 9 aa, Homo Sapiens
DLCIVNPAR

SEQ ID NO: 85779 - protein, 9 aa, Homo Sapiens
LHSSPVNLV

SEQ ID NO: 85780 - protein, 9 aa, Homo Sapiens
LPLSAGRGR

SEQ ID NO: 85781 - protein, 9 aa, Homo Sapiens
LTRQVKKKL

SEQ ID NO: 85782 - protein, 9 aa, Homo Sapiens
KHKNLYINI

SEQ ID NO: 85783 - protein, 9 aa, Homo Sapiens
SVSINKKLG

SEQ ID NO: 85784 - protein, 9 aa, Homo Sapiens
THHDLDMGT

SEQ ID NO: 85785 - protein, 9 aa, Homo Sapiens
PINLHLERM

SEQ ID NO: 85786 - protein, 9 aa, Homo Sapiens
CLEQLAAEE

SEQ ID NO: 85787 - protein, 9 aa, Homo Sapiens
PNSTAGRQL

SEQ ID NO: 85788 - protein, 9 aa, Homo Sapiens
DGSEERVTC

SEQ ID NO: 85789 - protein, 9 aa, Homo Sapiens
QKTSAAAVQ

SEQ ID NO: 85790 - protein, 9 aa, Homo Sapiens
PEMHIMETQ

SEQ ID NO: 85791 - protein, 9 aa, Homo Sapiens
QNTLNGYKS

SEQ ID NO: 85792 - protein, 9 aa, Homo Sapiens
HLDKTIYAV

SEQ ID NO: 85793 - protein, 9 aa, Homo Sapiens
GQPGMAGGD

SEQ ID NO: 85794 - protein, 9 aa, Homo Sapiens
QNQNAISEA

SEQ ID NO: 85795 - protein, 9 aa, Homo Sapiens
NKHKNLYIN

SEQ ID NO: 85796 - protein, 9 aa, Homo Sapiens
KHLDKTIYA

SEQ ID NO: 85797 - protein, 9 aa, Homo Sapiens
DKYAGEEGI

SEQ ID NO: 85798 - protein, 9 aa, Homo Sapiens
GPSFCQRAF

SEQ ID NO: 85799 - protein, 9 aa, Homo Sapiens
RSLSTARVV

SEQ ID NO: 85800 - protein, 9 aa, Homo Sapiens
EMVEADPLI

SEQ ID NO: 85801 - protein, 9 aa, Homo Sapiens
AAAQRLHLE

SEQ ID NO: 85802 - protein, 9 aa, Homo Sapiens
HELRHFYNR

SEQ ID NO: 85803 - protein, 9 aa, Homo Sapiens
IGAFSATML

SEQ ID NO: 85804 - protein, 9 aa, Homo Sapiens
QEDEPPTDN

SEQ ID NO: 85805 - protein, 9 aa, Homo Sapiens
LQHEKAPTK

SEQ ID NO: 85806 - protein, 9 aa, Homo Sapiens
MINAGQLKN

SEQ ID NO: 85807 - protein, 9 aa, Homo Sapiens
VKKKLAKNG

SEQ ID NO: 85808 - protein, 9 aa, Homo Sapiens
KNLYINIVA

SEQ ID NO: 85809 - protein, 9 aa, Homo Sapiens
VSINKKLGL

SEQ ID NO: 85810 - protein, 9 aa, Homo Sapiens
SEPMEEEPA

SEQ ID NO: 85811 - protein, 9 aa, Homo Sapiens
ENVEDRTAD

SEQ ID NO: 85812 - protein, 9 aa, Homo Sapiens
HKNLYINIV

SEQ ID NO: 85813 - protein, 9 aa, Homo Sapiens
FPGRLNADL

SEQ ID NO: 85814 - protein, 9 aa, Homo Sapiens
EGIIEDMKL

SEQ ID NO: 85815 - protein, 9 aa, Homo Sapiens
LGDLGPSFC

SEQ ID NO: 85816 - protein, 9 aa, Homo Sapiens
QAREERYKC

SEQ ID NO: 85817 - protein, 9 aa, Homo Sapiens
LARFTAEMS

SEQ ID NO: 85818 - protein, 9 aa, Homo Sapiens
DIKLEQNTL

SEQ ID NO: 85819 - protein, 9 aa, Homo Sapiens
DNKHKNLYI

SEQ ID NO: 85820 - protein, 9 aa, Homo Sapiens
LLGGLLVFG

SEQ ID NO: 85821 - protein, 9 aa, Homo Sapiens
PSFCQRAFE

SEQ ID NO: 85822 - protein, 9 aa, Homo Sapiens
THLDLQQYS

SEQ ID NO: 85823 - protein, 9 aa, Homo Sapiens
GEEGIIEDM

SEQ ID NO: 85824 - protein, 9 aa, Homo Sapiens
DEPPTDNQG

SEQ ID NO: 85825 - protein, 9 aa, Homo Sapiens
ERQLRALGA

SEQ ID NO: 85826 - protein, 9 aa, Homo Sapiens
GPSALTSRT

SEQ ID NO: 85827 - protein, 9 aa, Homo Sapiens
GHVGPVGDP

SEQ ID NO: 85828 - protein, 9 aa, Homo Sapiens
WAGITAVWR

SEQ ID NO: 85829 - protein, 9 aa, Homo Sapiens
IGHHLEKYL

SEQ ID NO: 85830 - protein, 9 aa, Homo Sapiens
ARVVQPLSI

SEQ ID NO: 85831 - protein, 9 aa, Homo Sapiens
FDINSNSSE

SEQ ID NO: 85832 - protein, 9 aa, Homo Sapiens
QLRALGAAA

SEQ ID NO: 85833 - protein, 9 aa, Homo Sapiens
DSMSSPGNF

SEQ ID NO: 85834 - protein, 9 aa, Homo Sapiens
PCNDLCIVN

SEQ ID NO: 85835 - protein, 9 aa, Homo Sapiens
CARVDPFTH

SEQ ID NO: 85836 - protein, 9 aa, Homo Sapiens
FTTIKQRSR

SEQ ID NO: 85837 - protein, 9 aa, Homo Sapiens
TVVRWSVAK

SEQ ID NO: 85838 - protein, 9 aa, Homo Sapiens
LIDSVIRKG

SEQ ID NO: 85839 - protein, 9 aa, Homo Sapiens
SEENDIFVS

SEQ ID NO: 85840 - protein, 9 aa, Homo Sapiens
PSALTSRTG

SEQ ID NO: 85841 - protein, 9 aa, Homo Sapiens
LEQNTLNGY

SEQ ID NO: 85842 - protein, 9 aa, Homo Sapiens
QEFLDASER

SEQ ID NO: 85843 - protein, 9 aa, Homo Sapiens
TAQKTSAAA

SEQ ID NO: 85844 - protein, 9 aa, Homo Sapiens
KHNTDHIRH

SEQ ID NO: 85845 - protein, 9 aa, Homo Sapiens
FVEMVEADP

SEQ ID NO: 85846 - protein, 9 aa, Homo Sapiens
RDWQVSTQQ

SEQ ID NO: 85847 - protein, 9 aa, Homo Sapiens
EEKRQEDEP

SEQ ID NO: 85848 - protein, 9 aa, Homo Sapiens
NAISEAHGK

SEQ ID NO: 85849 - protein, 9 aa, Homo Sapiens
REERYKCLE

SEQ ID NO: 85850 - protein, 9 aa, Homo Sapiens
KQRSRCDRW

SEQ ID NO: 85851 - protein, 9 aa, Homo Sapiens
IDQAVTLIF

SEQ ID NO: 85852 - protein, 9 aa, Homo Sapiens
GRIRARLRP

SEQ ID NO: 85853 - protein, 9 aa, Homo Sapiens
RFTAEMSDW

SEQ ID NO: 85854 - protein, 9 aa, Homo Sapiens
QCVPNTTTL

SEQ ID NO: 85855 - protein, 9 aa, Homo Sapiens
SWAGITAVW

SEQ ID NO: 85856 - protein, 9 aa, Homo Sapiens
SPEMHIMET

SEQ ID NO: 85857 - protein, 9 aa, Homo Sapiens
HNTDHIRHQ

SEQ ID NO: 85858 - protein, 9 aa, Homo Sapiens
TDGSEERVT

SEQ ID NO: 85859 - protein, 9 aa, Homo Sapiens
TRAQLLAAP

SEQ ID NO: 85860 - protein, 9 aa, Homo Sapiens
DDFDVVYAT

SEQ ID NO: 85861 - protein, 9 aa, Homo Sapiens
EVTTTMLRW

SEQ ID NO: 85862 - protein, 9 aa, Homo Sapiens
ERRGEHSAV

SEQ ID NO: 85863 - protein, 9 aa, Homo Sapiens
GNMLQIGHH

SEQ ID NO: 85864 - protein, 9 aa, Homo Sapiens
VPINLHLER

SEQ ID NO: 85865 - protein, 9 aa, Homo Sapiens
GVFIKFRKT

SEQ ID NO: 85866 - protein, 9 aa, Homo Sapiens
SAAAQRLHL

SEQ ID NO: 85867 - protein, 9 aa, Homo Sapiens
RQEDEPPTD

SEQ ID NO: 85868 - protein, 9 aa, Homo Sapiens
SPCNDLCIV

SEQ ID NO: 85869 - protein, 9 aa, Homo Sapiens
GRLNPTYKE

SEQ ID NO: 85870 - protein, 9 aa, Homo Sapiens
VIPCFPYTR

SEQ ID NO: 85871 - protein, 9 aa, Homo Sapiens
PGELGHVGP

SEQ ID NO: 85872 - protein, 9 aa, Homo Sapiens
APRELHKFF

SEQ ID NO: 85873 - protein, 9 aa, Homo Sapiens
DTVVRWSVA

SEQ ID NO: 85874 - protein, 9 aa, Homo Sapiens
SVAKGIGRM

SEQ ID NO: 85875 - protein, 9 aa, Homo Sapiens
SSPVNLVKA

SEQ ID NO: 85876 - protein, 9 aa, Homo Sapiens
CFPYTRQDK

SEQ ID NO: 85877 - protein, 9 aa, Homo Sapiens
LLAAPRELH

SEQ ID NO: 85878 - protein, 9 aa, Homo Sapiens
IDSVIRKGA

SEQ ID NO: 85879 - protein, 9 aa, Homo Sapiens
AQRLHLEID

SEQ ID NO: 85880 - protein, 9 aa, Homo Sapiens
AGEEGIIED

SEQ ID NO: 85881 - protein, 9 aa, Homo Sapiens
NPEVTTTML

SEQ ID NO: 85882 - protein, 9 aa, Homo Sapiens
APLRPKLNL

SEQ ID NO: 85883 - protein, 9 aa, Homo Sapiens
RNRYSHVKD

SEQ ID NO: 85884 - protein, 9 aa, Homo Sapiens
LFEPRVFTD

SEQ ID NO: 85885 - protein, 9 aa, Homo Sapiens
IKQRSRCDR

SEQ ID NO: 85886 - protein, 9 aa, Homo Sapiens
YTFGDGCHG

SEQ ID NO: 85887 - protein, 9 aa, Homo Sapiens
YEDVDKNAL

SEQ ID NO: 85888 - protein, 9 aa, Homo Sapiens
AVIPCFPYT

SEQ ID NO: 85889 - protein, 9 aa, Homo Sapiens
ECGRIFKHN

SEQ ID NO: 85890 - protein, 9 aa, Homo Sapiens
VRWSVAKGI

SEQ ID NO: 85891 - protein, 9 aa, Homo Sapiens
FIGAFSATM

SEQ ID NO: 85892 - protein, 9 aa, Homo Sapiens
EKRQEDEPP

SEQ ID NO: 85893 - protein, 9 aa, Homo Sapiens
AQLLAAPRE

SEQ ID NO: 85894 - protein, 9 aa, Homo Sapiens
HSVWPFFVQ

SEQ ID NO: 85895 - protein, 9 aa, Homo Sapiens
NMLQIGHHL

SEQ ID NO: 85896 - protein, 9 aa, Homo Sapiens
KTHLDLQQY

SEQ ID NO: 85897 - protein, 9 aa, Homo Sapiens
FCQRAFEHA

SEQ ID NO: 85898 - protein, 9 aa, Homo Sapiens
PKVKRSKKA

SEQ ID NO: 85899 - protein, 9 aa, Homo Sapiens
NEEGETPAW

SEQ ID NO: 85900 - protein, 9 aa, Homo Sapiens
NLYINIVAY

SEQ ID NO: 85901 - protein, 9 aa, Homo Sapiens
RKADSIFNE

SEQ ID NO: 85902 - protein, 9 aa, Homo Sapiens
GITAVWRLP

SEQ ID NO: 85903 - protein, 9 aa, Homo Sapiens
PGARSGLGA

SEQ ID NO: 85904 - protein, 9 aa, Homo Sapiens
TIKQRSRCD

SEQ ID NO: 85905 - protein, 9 aa, Homo Sapiens
GARSGLGAP

SEQ ID NO: 85906 - protein, 9 aa, Homo Sapiens
VFIKFRKTP

SEQ ID NO: 85907 - protein, 9 aa, Homo Sapiens
NDIFVSTSE

SEQ ID NO: 85908 - protein, 9 aa, Homo Sapiens
SPFVRNRYS

SEQ ID NO: 85909 - protein, 9 aa, Homo Sapiens
GLPGELGHV

SEQ ID NO: 85910 - protein, 9 aa, Homo Sapiens
SLTAFIGLY

SEQ ID NO: 85911 - protein, 9 aa, Homo Sapiens
LGVFIKFRK

SEQ ID NO: 85912 - protein, 9 aa, Homo Sapiens
HSAVPTSGC

SEQ ID NO: 85913 - protein, 9 aa, Homo Sapiens
LMYTFGDGC

SEQ ID NO: 85914 - protein, 9 aa, Homo Sapiens
EENDIFVST

SEQ ID NO: 85915 - protein, 9 aa, Homo Sapiens
RGEHSAVPT

SEQ ID NO: 85916 - protein, 9 aa, Homo Sapiens
RVDPFTHHD

SEQ ID NO: 85917 - protein, 9 aa, Homo Sapiens
VENVEDRTA

SEQ ID NO: 85918 - protein, 9 aa, Homo Sapiens
IHLHSSPVN

SEQ ID NO: 85919 - protein, 9 aa, Homo Sapiens
LKKARAYGP

SEQ ID NO: 85920 - protein, 9 aa, Homo Sapiens
IELTRQVKK

SEQ ID NO: 85921 - protein, 9 aa, Homo Sapiens
MHIMETQME

SEQ ID NO: 85922 - protein, 9 aa, Homo Sapiens
RWSVAKGIG

SEQ ID NO: 85923 - protein, 9 aa, Homo Sapiens
SILVPPHIV

SEQ ID NO: 85924 - protein, 9 aa, Homo Sapiens
IFVSTSEDE

SEQ ID NO: 85925 - protein, 9 aa, Homo Sapiens
SNSSETTDL

SEQ ID NO: 85926 - protein, 9 aa, Homo Sapiens
GLSILVPPH

SEQ ID NO: 85927 - protein, 9 aa, Homo Sapiens
TARVVQPLS

SEQ ID NO: 85928 - protein, 9 aa, Homo Sapiens
ASGQLIDKA

SEQ ID NO: 85929 - protein, 9 aa, Homo Sapiens
EQNTLNGYK

SEQ ID NO: 85930 - protein, 9 aa, Homo Sapiens
KEQDCGPPG

SEQ ID NO: 85931 - protein, 9 aa, Homo Sapiens
KFQWIDQAV

SEQ ID NO: 85932 - protein, 9 aa, Homo Sapiens
QASPRDWQV

SEQ ID NO: 85933 - protein, 9 aa, Homo Sapiens
SQPVIFSTS

SEQ ID NO: 85934 - protein, 9 aa, Homo Sapiens
IMETQMEQL

SEQ ID NO: 85935 - protein, 9 aa, Homo Sapiens
VEMVEADPL

SEQ ID NO: 85936 - protein, 9 aa, Homo Sapiens
VITFREPFV

SEQ ID NO: 85937 - protein, 9 aa, Homo Sapiens
VSTSEDEPE

SEQ ID NO: 85938 - protein, 9 aa, Homo Sapiens
LKFQWIDQA

SEQ ID NO: 85939 - protein, 9 aa, Homo Sapiens
DKDLPVLAR

SEQ ID NO: 85940 - protein, 9 aa, Homo Sapiens
AGITAVWRL

SEQ ID NO: 85941 - protein, 9 aa, Homo Sapiens
TTMLRWIYT

SEQ ID NO: 85942 - protein, 9 aa, Homo Sapiens
RSGLGAPVR

SEQ ID NO: 85943 - protein, 9 aa, Homo Sapiens
AINKIVLTD

SEQ ID NO: 85944 - protein, 9 aa, Homo Sapiens
AVPTSGCAT

SEQ ID NO: 85945 - protein, 9 aa, Homo Sapiens
SLSVHSEKD

SEQ ID NO: 85946 - protein, 9 aa, Homo Sapiens
PFVLTEKGM

SEQ ID NO: 85947 - protein, 9 aa, Homo Sapiens
VLTEKGMRC

SEQ ID NO: 85948 - protein, 9 aa, Homo Sapiens
SLGKRLNAV

SEQ ID NO: 85949 - protein, 9 aa, Homo Sapiens
GEHSAVPTS

SEQ ID NO: 85950 - protein, 9 aa, Homo Sapiens
PFFVQRKPD

SEQ ID NO: 85951 - protein, 9 aa, Homo Sapiens
DNVELPPAE

SEQ ID NO: 85952 - protein, 9 aa, Homo Sapiens
NFSRQHELR

SEQ ID NO: 85953 - protein, 9 aa, Homo Sapiens
QWIDQAVTL

SEQ ID NO: 85954 - protein, 9 aa, Homo Sapiens
LAPNSTAGR

SEQ ID NO: 85955 - protein, 9 aa, Homo Sapiens
GDGPPGPKG

SEQ ID NO: 85956 - protein, 9 aa, Homo Sapiens
PCFPYTRQD

SEQ ID NO: 85957 - protein, 9 aa, Homo Sapiens
GFIGAFSAT

SEQ ID NO: 85958 - protein, 9 aa, Homo Sapiens
RRGEHSAVP

SEQ ID NO: 85959 - protein, 9 aa, Homo Sapiens
QGNMLQIGH

SEQ ID NO: 85960 - protein, 9 aa, Homo Sapiens
RIFKHNTDH

SEQ ID NO: 85961 - protein, 9 aa, Homo Sapiens
HVGPVGDPG

SEQ ID NO: 85962 - protein, 9 aa, Homo Sapiens
VGEALQCVP

SEQ ID NO: 85963 - protein, 9 aa, Homo Sapiens
TQMEQLRGS

SEQ ID NO: 85964 - protein, 9 aa, Homo Sapiens
VEMKGLKTH

SEQ ID NO: 85965 - protein, 9 aa, Homo Sapiens
GAFSATMLI

SEQ ID NO: 85966 - protein, 9 aa, Homo Sapiens
VPTSGCATS

SEQ ID NO: 85967 - protein, 9 aa, Homo Sapiens
YATMHGNAA

SEQ ID NO: 85968 - protein, 9 aa, Homo Sapiens
RLNPTYKEQ

SEQ ID NO: 85969 - protein, 9 aa, Homo Sapiens
MEVENVEDR

SEQ ID NO: 85970 - protein, 9 aa, Homo Sapiens
AQEDSRTAS

SEQ ID NO: 85971 - protein, 9 aa, Homo Sapiens
VYATMHGNA

SEQ ID NO: 85972 - protein, 9 aa, Homo Sapiens
FEFDINSNS

SEQ ID NO: 85973 - protein, 9 aa, Homo Sapiens
PEEDNVELP

SEQ ID NO: 85974 - protein, 9 aa, Homo Sapiens
IYAVAPVPA

SEQ ID NO: 85975 - protein, 9 aa, Homo Sapiens
QERQLRALG

SEQ ID NO: 85976 - protein, 9 aa, Homo Sapiens
VVYATMHGN

SEQ ID NO: 85977 - protein, 9 aa, Homo Sapiens
MKGLKTHLD

SEQ ID NO: 85978 - protein, 9 aa, Homo Sapiens
EFDINSNSS

SEQ ID NO: 85979 - protein, 9 aa, Homo Sapiens
IVMGEETWQ

SEQ ID NO: 85980 - protein, 9 aa, Homo Sapiens
TKEGKKELL

SEQ ID NO: 85981 - protein, 9 aa, Homo Sapiens
YAGEEGIIE

SEQ ID NO: 85982 - protein, 9 aa, Homo Sapiens
NKQNQNAIS

SEQ ID NO: 85983 - protein, 9 aa, Homo Sapiens
MGEETWQAL

SEQ ID NO: 85984 - protein, 9 aa, Homo Sapiens
KRVAINKIV

SEQ ID NO: 85985 - protein, 9 aa, Homo Sapiens
KDTVVRWSV

SEQ ID NO: 85986 - protein, 9 aa, Homo Sapiens
INSNSSETT

SEQ ID NO: 85987 - protein, 9 aa, Homo Sapiens
RLHLEIDSY

SEQ ID NO: 85988 - protein, 9 aa, Homo Sapiens
QGRSLSTAR

SEQ ID NO: 85989 - protein, 9 aa, Homo Sapiens
HLERMQVHS

SEQ ID NO: 85990 - protein, 9 aa, Homo Sapiens
SALTSRTGQ

SEQ ID NO: 85991 - protein, 9 aa, Homo Sapiens
VKHLDKTIY

SEQ ID NO: 85992 - protein, 9 aa, Homo Sapiens
TSRTGQLPP

SEQ ID NO: 85993 - protein, 9 aa, Homo Sapiens
EPRVFTDGS

SEQ ID NO: 85994 - protein, 9 aa, Homo Sapiens
RAQLLAAPR

SEQ ID NO: 85995 - protein, 9 aa, Homo Sapiens
GDGCHGKLG

SEQ ID NO: 85996 - protein, 9 aa, Homo Sapiens
DKTIYAVAP

SEQ ID NO: 85997 - protein, 9 aa, Homo Sapiens
LCIVNPARK

SEQ ID NO: 85998 - protein, 9 aa, Homo Sapiens
LRPKLNLKK

SEQ ID NO: 85999 - protein, 9 aa, Homo Sapiens
RKTPIVKAT

SEQ ID NO: 86000 - protein, 9 aa, Homo Sapiens
ILVPPHIVG

SEQ ID NO: 86001 - protein, 9 aa, Homo Sapiens
NLHLERMQV

SEQ ID NO: 86002 - protein, 9 aa, Homo Sapiens
DCDKRVAIN

SEQ ID NO: 86003 - protein, 9 aa, Homo Sapiens
CHGKLGLGL

SEQ ID NO: 86004 - protein, 9 aa, Homo Sapiens
KGLKTHLDL

SEQ ID NO: 86005 - protein, 9 aa, Homo Sapiens
GPGARSGLG

SEQ ID NO: 86006 - protein, 9 aa, Homo Sapiens
PRKADSIFN

SEQ ID NO: 86007 - protein, 9 aa, Homo Sapiens
PLRPKLNLK

SEQ ID NO: 86008 - protein, 9 aa, Homo Sapiens
EDEPPTDNQ

SEQ ID NO: 86009 - protein, 9 aa, Homo Sapiens
TRQDKKDKV

SEQ ID NO: 86010 - protein, 9 aa, Homo Sapiens
NSSETTDLL

SEQ ID NO: 86011 - protein, 9 aa, Homo Sapiens
AGSWAGITA

SEQ ID NO: 86012 - protein, 9 aa, Homo Sapiens
MVEADPLIR

SEQ ID NO: 86013 - protein, 9 aa, Homo Sapiens
VWRLPLSAG

SEQ ID NO: 86014 - protein, 9 aa, Homo Sapiens
KTSAAAVQG

SEQ ID NO: 86015 - protein, 9 aa, Homo Sapiens
FGDGCHGKL

SEQ ID NO: 86016 - protein, 9 aa, Homo Sapiens
GKRLNAVVR

SEQ ID NO: 86017 - protein, 9 aa, Homo Sapiens
VIFSTSPAV

SEQ ID NO: 86018 - protein, 9 aa, Homo Sapiens
VRNRYSHVK

SEQ ID NO: 86019 - protein, 9 aa, Homo Sapiens
LIQHWPVHT

SEQ ID NO: 86020 - protein, 9 aa, Homo Sapiens
SPRDWQVST

SEQ ID NO: 86021 - protein, 9 aa, Homo Sapiens
YTRQDKKDK

SEQ ID NO: 86022 - protein, 9 aa, Homo Sapiens
RQLRALGAA

SEQ ID NO: 86023 - protein, 9 aa, Homo Sapiens
GHHLEKYLS

SEQ ID NO: 86024 - protein, 9 aa, Homo Sapiens
ANPEVTTTM

SEQ ID NO: 86025 - protein, 9 aa, Homo Sapiens
RQHELRHFY

SEQ ID NO: 86026 - protein, 9 aa, Homo Sapiens
ASEPMEEEP

SEQ ID NO: 86027 - protein, 9 aa, Homo Sapiens
KRQEDEPPT

SEQ ID NO: 86028 - protein, 9 aa, Homo Sapiens
HSEKDELIL

SEQ ID NO: 86029 - protein, 9 aa, Homo Sapiens
ENDIFVSTS

SEQ ID NO: 86030 - protein, 9 aa, Homo Sapiens
QHELRHFYN

SEQ ID NO: 86031 - protein, 9 aa, Homo Sapiens
ELGHVGPVG

SEQ ID NO: 86032 - protein, 9 aa, Homo Sapiens
GVGEALQCV

SEQ ID NO: 86033 - protein, 9 aa, Homo Sapiens
ERMQVHSPH

SEQ ID NO: 86034 - protein, 9 aa, Homo Sapiens
WSVAKGIGR

SEQ ID NO: 86035 - protein, 9 aa, Homo Sapiens
RTASEPMEE

SEQ ID NO: 86036 - protein, 9 aa, Homo Sapiens
RMDDFDVVY

SEQ ID NO: 86037 - protein, 9 aa, Homo Sapiens
TCLRFPGRL

SEQ ID NO: 86038 - protein, 9 aa, Homo Sapiens
DKARALIDS

SEQ ID NO: 86039 - protein, 9 aa, Homo Sapiens
LQCVPNTTT

SEQ ID NO: 86040 - protein, 9 aa, Homo Sapiens
PRDWQVSTQ

SEQ ID NO: 86041 - protein, 9 aa, Homo Sapiens
FEPRVFTDG

SEQ ID NO: 86042 - protein, 9 aa, Homo Sapiens
KIFGLSILV

SEQ ID NO: 86043 - protein, 9 aa, Homo Sapiens
GEALQCVPN

SEQ ID NO: 86044 - protein, 9 aa, Homo Sapiens
CLRFPGRLN

SEQ ID NO: 86045 - protein, 9 aa, Homo Sapiens
ISVSINKKL

SEQ ID NO: 86046 - protein, 9 aa, Homo Sapiens
RPKLNLKKA

SEQ ID NO: 86047 - protein, 9 aa, Homo Sapiens
AFEFDINSN

SEQ ID NO: 86048 - protein, 9 aa, Homo Sapiens
FVRNRYSHV

SEQ ID NO: 86049 - protein, 9 aa, Homo Sapiens
SSLTAFIGL

SEQ ID NO: 86050 - protein, 9 aa, Homo Sapiens
VTFQSLGKR

SEQ ID NO: 86051 - protein, 9 aa, Homo Sapiens
QRLHLEIDS

SEQ ID NO: 86052 - protein, 9 aa, Homo Sapiens
QGRIRARLR

SEQ ID NO: 86053 - protein, 9 aa, Homo Sapiens
WYFVEMVEA

SEQ ID NO: 86054 - protein, 9 aa, Homo Sapiens
STSEDEPES

SEQ ID NO: 86055 - protein, 9 aa, Homo Sapiens
AFIGLYIGL

SEQ ID NO: 86056 - protein, 9 aa, Homo Sapiens
AVWRLPLSA

SEQ ID NO: 86057 - protein, 9 aa, Homo Sapiens
KLNLKKARA

SEQ ID NO: 86058 - protein, 9 aa, Homo Sapiens
FVQRKPDFR

SEQ ID NO: 86059 - protein, 9 aa, Homo Sapiens
WQVSTQQIG

SEQ ID NO: 86060 - protein, 9 aa, Homo Sapiens
FSQPVIFST

SEQ ID NO: 86061 - protein, 9 aa, Homo Sapiens
SALIQHWPV

SEQ ID NO: 86062 - protein, 9 aa, Homo Sapiens
LGGLLVFGM

SEQ ID NO: 86063 - protein, 9 aa, Homo Sapiens
TTAQKTSAA

SEQ ID NO: 86064 - protein, 9 aa, Homo Sapiens
CNDLCIVNP

SEQ ID NO: 86065 - protein, 9 aa, Homo Sapiens
DKNGQFALV

SEQ ID NO: 86066 - protein, 9 aa, Homo Sapiens
CQRAFEHAV

SEQ ID NO: 86067 - protein, 9 aa, Homo Sapiens
QIGHHLEKY

SEQ ID NO: 86068 - protein, 9 aa, Homo Sapiens
ASLSVHSEK

SEQ ID NO: 86069 - protein, 9 aa, Homo Sapiens
VEHDFLTKV

SEQ ID NO: 86070 - protein, 9 aa, Homo Sapiens
GVKIPDAKH

SEQ ID NO: 86071 - protein, 9 aa, Homo Sapiens
RQNMVQHLD

SEQ ID NO: 86072 - protein, 9 aa, Homo Sapiens
TFDLRNLTY

SEQ ID NO: 86073 - protein, 9 aa, Homo Sapiens
YQDRVTQCK

SEQ ID NO: 86074 - protein, 9 aa, Homo Sapiens
NIMSMGRFV

SEQ ID NO: 86075 - protein, 9 aa, Homo Sapiens
ETPYNFEEV

SEQ ID NO: 86076 - protein, 9 aa, Homo Sapiens
VETVDNFLL

SEQ ID NO: 86077 - protein, 9 aa, Homo Sapiens
PNHFDQFYC

SEQ ID NO: 86078 - protein, 9 aa, Homo Sapiens
AEDEKTQRE

SEQ ID NO: 86079 - protein, 9 aa, Homo Sapiens
TVPNLLRGA

SEQ ID NO: 86080 - protein, 9 aa, Homo Sapiens
ELEELKQFL

SEQ ID NO: 86081 - protein, 9 aa, Homo Sapiens
EELKQFLLQ

SEQ ID NO: 86082 - protein, 9 aa, Homo Sapiens
YKLPFPTSP

SEQ ID NO: 86083 - protein, 9 aa, Homo Sapiens
GDRLITELL

SEQ ID NO: 86084 - protein, 9 aa, Homo Sapiens
SHFYLPLSA

SEQ ID NO: 86085 - protein, 9 aa, Homo Sapiens
PYNFEEVWP

SEQ ID NO: 86086 - protein, 9 aa, Homo Sapiens
RKAKEKYEV

SEQ ID NO: 86087 - protein, 9 aa, Homo Sapiens
LKQFLLQNE

SEQ ID NO: 86088 - protein, 9 aa, Homo Sapiens
DAEDEKTQR

SEQ ID NO: 86089 - protein, 9 aa, Homo Sapiens
NFEEVWPKF

SEQ ID NO: 86090 - protein, 9 aa, Homo Sapiens
KYPEKEREP

SEQ ID NO: 86091 - protein, 9 aa, Homo Sapiens
MSMGRFVWK

SEQ ID NO: 86092 - protein, 9 aa, Homo Sapiens
LGTVQHFFD

SEQ ID NO: 86093 - protein, 9 aa, Homo Sapiens
MHRDSFPLD

SEQ ID NO: 86094 - protein, 9 aa, Homo Sapiens
NLSGLKLGF

SEQ ID NO: 86095 - protein, 9 aa, Homo Sapiens
FPTSPLSPH

SEQ ID NO: 86096 - protein, 9 aa, Homo Sapiens
NEVVPKNIP

SEQ ID NO: 86097 - protein, 9 aa, Homo Sapiens
NGPGDRLEL

SEQ ID NO: 86098 - protein, 9 aa, Homo Sapiens
LPHLPHTQW

SEQ ID NO: 86099 - protein, 9 aa, Homo Sapiens
DRLITELLP

SEQ ID NO: 86100 - protein, 9 aa, Homo Sapiens
RNLTYVHTC

SEQ ID NO: 86101 - protein, 9 aa, Homo Sapiens
EQGPAGSTG

SEQ ID NO: 86102 - protein, 9 aa, Homo Sapiens
PNLSGLKLG

SEQ ID NO: 86103 - protein, 9 aa, Homo Sapiens
PCACFLFGS

SEQ ID NO: 86104 - protein, 9 aa, Homo Sapiens
RDSFPLDCK

SEQ ID NO: 86105 - protein, 9 aa, Homo Sapiens
IEQKARIIY

SEQ ID NO: 86106 - protein, 9 aa, Homo Sapiens
TPYNFEEVW

SEQ ID NO: 86107 - protein, 9 aa, Homo Sapiens
VIRDVLPNH

SEQ ID NO: 86108 - protein, 9 aa, Homo Sapiens
GLVEHDFLT

SEQ ID NO: 86109 - protein, 9 aa, Homo Sapiens
ILSSDDDND

SEQ ID NO: 86110 - protein, 9 aa, Homo Sapiens
EDEKTQRES

SEQ ID NO: 86111 - protein, 9 aa, Homo Sapiens
ACFLFGSSF

SEQ ID NO: 86112 - protein, 9 aa, Homo Sapiens
TLLSFGKAV

SEQ ID NO: 86113 - protein, 9 aa, Homo Sapiens
GVLRRQNMV

SEQ ID NO: 86114 - protein, 9 aa, Homo Sapiens
CGPNHFDQF

SEQ ID NO: 86115 - protein, 9 aa, Homo Sapiens
VVKLDVVCT

SEQ ID NO: 86116 - protein, 9 aa, Homo Sapiens
FDQFYCDFM

SEQ ID NO: 86117 - protein, 9 aa, Homo Sapiens
KHTLVSITE

SEQ ID NO: 86118 - protein, 9 aa, Homo Sapiens
ICITGFVYN

SEQ ID NO: 86119 - protein, 9 aa, Homo Sapiens
RGFMLESKI

SEQ ID NO: 86120 - protein, 9 aa, Homo Sapiens
MDHRGFLSH

SEQ ID NO: 86121 - protein, 9 aa, Homo Sapiens
VKYPEKERE

SEQ ID NO: 86122 - protein, 9 aa, Homo Sapiens
TCSKWNGNV

SEQ ID NO: 86123 - protein, 9 aa, Homo Sapiens
PTDLAFILD

SEQ ID NO: 86124 - protein, 9 aa, Homo Sapiens
TVFHQNGVK

SEQ ID NO: 86125 - protein, 9 aa, Homo Sapiens
NSSKDSEPI

SEQ ID NO: 86126 - protein, 9 aa, Homo Sapiens
ERHQKEEYQ

SEQ ID NO: 86127 - protein, 9 aa, Homo Sapiens
WKMIMNDSK

SEQ ID NO: 86128 - protein, 9 aa, Homo Sapiens
KWNGNVGKT

SEQ ID NO: 86129 - protein, 9 aa, Homo Sapiens
YRQNRFASS

SEQ ID NO: 86130 - protein, 9 aa, Homo Sapiens
PMTVPNLLR

SEQ ID NO: 86131 - protein, 9 aa, Homo Sapiens
CSKWNGNVG

SEQ ID NO: 86132 - protein, 9 aa, Homo Sapiens
DEKTQRESL

SEQ ID NO: 86133 - protein, 9 aa, Homo Sapiens
TLVSITEFI

SEQ ID NO: 86134 - protein, 9 aa, Homo Sapiens
FFDIRGFML

SEQ ID NO: 86135 - protein, 9 aa, Homo Sapiens
PLGTVQHFF

SEQ ID NO: 86136 - protein, 9 aa, Homo Sapiens
SSQKKPSLE

SEQ ID NO: 86137 - protein, 9 aa, Homo Sapiens
VFHQNGVKI

SEQ ID NO: 86138 - protein, 9 aa, Homo Sapiens
IMSMGRFVW

SEQ ID NO: 86139 - protein, 9 aa, Homo Sapiens
EKTKRVSSQ

SEQ ID NO: 86140 - protein, 9 aa, Homo Sapiens
IYNEFISVH

SEQ ID NO: 86141 - protein, 9 aa, Homo Sapiens
GPGDRLELP

SEQ ID NO: 86142 - protein, 9 aa, Homo Sapiens
SANKHTLVS

SEQ ID NO: 86143 - protein, 9 aa, Homo Sapiens
LDVGNPLGT

SEQ ID NO: 86144 - protein, 9 aa, Homo Sapiens
KNIIEQKAR

SEQ ID NO: 86145 - protein, 9 aa, Homo Sapiens
GVPFSKPSN

SEQ ID NO: 86146 - protein, 9 aa, Homo Sapiens
CPSQFPSLG

SEQ ID NO: 86147 - protein, 9 aa, Homo Sapiens
FAEKNGPGD

SEQ ID NO: 86148 - protein, 9 aa, Homo Sapiens
KMIMNDSKR

SEQ ID NO: 86149 - protein, 9 aa, Homo Sapiens
DLAFILDGS

SEQ ID NO: 86150 - protein, 9 aa, Homo Sapiens
HRSIKYSMW

SEQ ID NO: 86151 - protein, 9 aa, Homo Sapiens
VVCTKCRVP

SEQ ID NO: 86152 - protein, 9 aa, Homo Sapiens
GFLSHFYLP

SEQ ID NO: 86153 - protein, 9 aa, Homo Sapiens
TSADYKLPF

SEQ ID NO: 86154 - protein, 9 aa, Homo Sapiens
PLIKLSEHA

SEQ ID NO: 86155 - protein, 9 aa, Homo Sapiens
KDDCWICIT

SEQ ID NO: 86156 - protein, 9 aa, Homo Sapiens
DPPLIKLSE

SEQ ID NO: 86157 - protein, 9 aa, Homo Sapiens
FMLESKIWN

SEQ ID NO: 86158 - protein, 9 aa, Homo Sapiens
GSTGFQGLP

SEQ ID NO: 86159 - protein, 9 aa, Homo Sapiens
WNIMSMGRF

SEQ ID NO: 86160 - protein, 9 aa, Homo Sapiens
LALSVETVD

SEQ ID NO: 86161 - protein, 9 aa, Homo Sapiens
LDINNEVVP

SEQ ID NO: 86162 - protein, 9 aa, Homo Sapiens
YSMWCSTEH

SEQ ID NO: 86163 - protein, 9 aa, Homo Sapiens
QKEEYQDRV

SEQ ID NO: 86164 - protein, 9 aa, Homo Sapiens
PPLIKLSEH

SEQ ID NO: 86165 - protein, 9 aa, Homo Sapiens
SQKKPSLEA

SEQ ID NO: 86166 - protein, 9 aa, Homo Sapiens
YQGRHLEDT

SEQ ID NO: 86167 - protein, 9 aa, Homo Sapiens
SITEFILEK

SEQ ID NO: 86168 - protein, 9 aa, Homo Sapiens
NAKYAIFMA

SEQ ID NO: 86169 - protein, 9 aa, Homo Sapiens
LSSDDDNDD

SEQ ID NO: 86170 - protein, 9 aa, Homo Sapiens
KGELYRQNR

SEQ ID NO: 86171 - protein, 9 aa, Homo Sapiens
QFLLQNERS

SEQ ID NO: 86172 - protein, 9 aa, Homo Sapiens
TPMTVPNLL

SEQ ID NO: 86173 - protein, 9 aa, Homo Sapiens
SKIWNIMSM

SEQ ID NO: 86174 - protein, 9 aa, Homo Sapiens
KLPFPTSPL

SEQ ID NO: 86175 - protein, 9 aa, Homo Sapiens
DDCWICITG

SEQ ID NO: 86176 - protein, 9 aa, Homo Sapiens
ESKIWNIMS

SEQ ID NO: 86177 - protein, 9 aa, Homo Sapiens
SEPIVKNGR

SEQ ID NO: 86178 - protein, 9 aa, Homo Sapiens
IMNDSKRKA

SEQ ID NO: 86179 - protein, 9 aa, Homo Sapiens
RGLVEHDFL

SEQ ID NO: 86180 - protein, 9 aa, Homo Sapiens
YKVEKREGY

SEQ ID NO: 86181 - protein, 9 aa, Homo Sapiens
NLTYVHTCC

SEQ ID NO: 86182 - protein, 9 aa, Homo Sapiens
TKEIQRKAK

SEQ ID NO: 86183 - protein, 9 aa, Homo Sapiens
MTFDLRNLT

SEQ ID NO: 86184 - protein, 9 aa, Homo Sapiens
GFMLESKIW

SEQ ID NO: 86185 - protein, 9 aa, Homo Sapiens
ANKNIIEQK

SEQ ID NO: 86186 - protein, 9 aa, Homo Sapiens
GELYRQNRF

SEQ ID NO: 86187 - protein, 9 aa, Homo Sapiens
RSIKYSMWC

SEQ ID NO: 86188 - protein, 9 aa, Homo Sapiens
ELPHLPHTQ

SEQ ID NO: 86189 - protein, 9 aa, Homo Sapiens
VPCACFLFG

SEQ ID NO: 86190 - protein, 9 aa, Homo Sapiens
EITKQEKDF

SEQ ID NO: 86191 - protein, 9 aa, Homo Sapiens
APTDLAFIL

SEQ ID NO: 86192 - protein, 9 aa, Homo Sapiens
EKEREPSEK

SEQ ID NO: 86193 - protein, 9 aa, Homo Sapiens
IQRKAKEKY

SEQ ID NO: 86194 - protein, 9 aa, Homo Sapiens
RCSYCERGF

SEQ ID NO: 86195 - protein, 9 aa, Homo Sapiens
FHQNGVKIP

SEQ ID NO: 86196 - protein, 9 aa, Homo Sapiens
NIPQGYKVE

SEQ ID NO: 86197 - protein, 9 aa, Homo Sapiens
QHFFDIRGF

SEQ ID NO: 86198 - protein, 9 aa, Homo Sapiens
TGFVYNVSP

SEQ ID NO: 86199 - protein, 9 aa, Homo Sapiens
HWEPSKATY

SEQ ID NO: 86200 - protein, 9 aa, Homo Sapiens
RPEEYDFLT

SEQ ID NO: 86201 - protein, 9 aa, Homo Sapiens
RFVWKHLFF

SEQ ID NO: 86202 - protein, 9 aa, Homo Sapiens
RQNRFASSK

SEQ ID NO: 86203 - protein, 9 aa, Homo Sapiens
CWICITGFV

SEQ ID NO: 86204 - protein, 9 aa, Homo Sapiens
SMWCSTEHG

SEQ ID NO: 86205 - protein, 9 aa, Homo Sapiens
TKQEKDFLW

SEQ ID NO: 86206 - protein, 9 aa, Homo Sapiens
KCPSQFPSL

SEQ ID NO: 86207 - protein, 9 aa, Homo Sapiens
IPQGYKVEK

SEQ ID NO: 86208 - protein, 9 aa, Homo Sapiens
VKKLSANKH

SEQ ID NO: 86209 - protein, 9 aa, Homo Sapiens
NNEVVPKNI

SEQ ID NO: 86210 - protein, 9 aa, Homo Sapiens
RGFLSHFYL

SEQ ID NO: 86211 - protein, 9 aa, Homo Sapiens
WICITGFVY

SEQ ID NO: 86212 - protein, 9 aa, Homo Sapiens
NGVKIPDAK

SEQ ID NO: 86213 - protein, 9 aa, Homo Sapiens
MWCSTEHGN

SEQ ID NO: 86214 - protein, 9 aa, Homo Sapiens
SFPLDCKVY

SEQ ID NO: 86215 - protein, 9 aa, Homo Sapiens
LEKNLMSVL

SEQ ID NO: 86216 - protein, 9 aa, Homo Sapiens
EEVWPKFQQ

SEQ ID NO: 86217 - protein, 9 aa, Homo Sapiens
ADYKLPFPT

SEQ ID NO: 86218 - protein, 9 aa, Homo Sapiens
RVVKLDVVC

SEQ ID NO: 86219 - protein, 9 aa, Homo Sapiens
EHDFLTKVL

SEQ ID NO: 86220 - protein, 9 aa, Homo Sapiens
DVGNPLGTV

SEQ ID NO: 86221 - protein, 9 aa, Homo Sapiens
SSKDSEPIV

SEQ ID NO: 86222 - protein, 9 aa, Homo Sapiens
TIETLLSFG

SEQ ID NO: 86223 - protein, 9 aa, Homo Sapiens
NEFISVHAT

SEQ ID NO: 86224 - protein, 9 aa, Homo Sapiens
ITELLPELQ

SEQ ID NO: 86225 - protein, 9 aa, Homo Sapiens
TYYQGRHLE

SEQ ID NO: 86226 - protein, 9 aa, Homo Sapiens
SPNLSGLKL

SEQ ID NO: 86227 - protein, 9 aa, Homo Sapiens
MVQHLDVKL

SEQ ID NO: 86228 - protein, 9 aa, Homo Sapiens
DIRGFMLES

SEQ ID NO: 86229 - protein, 9 aa, Homo Sapiens
YSSVSIHWE

SEQ ID NO: 86230 - protein, 9 aa, Homo Sapiens
LGQRGLVEH

SEQ ID NO: 86231 - protein, 9 aa, Homo Sapiens
QNGVKIPDA

SEQ ID NO: 86232 - protein, 9 aa, Homo Sapiens
KDSEPIVKN

SEQ ID NO: 86233 - protein, 9 aa, Homo Sapiens
CRTAPTDLA

SEQ ID NO: 86234 - protein, 9 aa, Homo Sapiens
SKDSEPIVK

SEQ ID NO: 86235 - protein, 9 aa, Homo Sapiens
YPEKEREPS

SEQ ID NO: 86236 - protein, 9 aa, Homo Sapiens
MTVPNLLRG

SEQ ID NO: 86237 - protein, 9 aa, Homo Sapiens
FDLRNLTYV

SEQ ID NO: 86238 - protein, 9 aa, Homo Sapiens
RFCGPNHFD

SEQ ID NO: 86239 - protein, 9 aa, Homo Sapiens
VVIIAVVWC

SEQ ID NO: 86240 - protein, 9 aa, Homo Sapiens
VPFSKPSNT

SEQ ID NO: 86241 - protein, 9 aa, Homo Sapiens
LSHFYLPLS

SEQ ID NO: 86242 - protein, 9 aa, Homo Sapiens
VHATKEVNL

SEQ ID NO: 86243 - protein, 9 aa, Homo Sapiens
HFDQFYCDF

SEQ ID NO: 86244 - protein, 9 aa, Homo Sapiens
LKCPSQFPS

SEQ ID NO: 86245 - protein, 9 aa, Homo Sapiens
VSITEFILE

SEQ ID NO: 86246 - protein, 9 aa, Homo Sapiens
IVKYPEKER

SEQ ID NO: 86247 - protein, 9 aa, Homo Sapiens
DYKLPFPTS

SEQ ID NO: 86248 - protein, 9 aa, Homo Sapiens
SVETVDNFL

SEQ ID NO: 86249 - protein, 9 aa, Homo Sapiens
RLELPHLPH

SEQ ID NO: 86250 - protein, 9 aa, Homo Sapiens
NKNIIEQKA

SEQ ID NO: 86251 - protein, 9 aa, Homo Sapiens
KVEKREGYP

SEQ ID NO: 86252 - protein, 9 aa, Homo Sapiens
LIKLSEHAM

SEQ ID NO: 86253 - protein, 9 aa, Homo Sapiens
EITPMLCGL

SEQ ID NO: 86254 - protein, 9 aa, Homo Sapiens
IAVVWCVVG

SEQ ID NO: 86255 - protein, 9 aa, Homo Sapiens
IIAVVWCVV

SEQ ID NO: 86256 - protein, 9 aa, Homo Sapiens
EEDLKCPSQ

SEQ ID NO: 86257 - protein, 9 aa, Homo Sapiens
HKEITPMLC

SEQ ID NO: 86258 - protein, 9 aa, Homo Sapiens
PGEKKSQAS

SEQ ID NO: 86259 - protein, 9 aa, Homo Sapiens
SSDDDNDDI

SEQ ID NO: 86260 - protein, 9 aa, Homo Sapiens
VSRLQKKIQ

SEQ ID NO: 86261 - protein, 9 aa, Homo Sapiens
EEYQDRVTQ

SEQ ID NO: 86262 - protein, 9 aa, Homo Sapiens
GEKLVSVKK

SEQ ID NO: 86263 - protein, 9 aa, Homo Sapiens
KTKRVSSQK

SEQ ID NO: 86264 - protein, 9 aa, Homo Sapiens
HREVVSRLQ

SEQ ID NO: 86265 - protein, 9 aa, Homo Sapiens
EIVASSPNL

SEQ ID NO: 86266 - protein, 9 aa, Homo Sapiens
KELDINNEV

SEQ ID NO: 86267 - protein, 9 aa, Homo Sapiens
WNGNVGKTV

SEQ ID NO: 86268 - protein, 9 aa, Homo Sapiens
LEDTFGEDW

SEQ ID NO: 86269 - protein, 9 aa, Homo Sapiens
QDAEDEKTQ

SEQ ID NO: 86270 - protein, 9 aa, Homo Sapiens
IWNIMSMGR

SEQ ID NO: 86271 - protein, 9 aa, Homo Sapiens
QKKPSLEAT

SEQ ID NO: 86272 - protein, 9 aa, Homo Sapiens
ILEKNLMSV

SEQ ID NO: 86273 - protein, 9 aa, Homo Sapiens
LMSVLDVGN

SEQ ID NO: 86274 - protein, 9 aa, Homo Sapiens
VASSPNLSG

SEQ ID NO: 86275 - protein, 9 aa, Homo Sapiens
AELEELKQF

SEQ ID NO: 86276 - protein, 9 aa, Homo Sapiens
MSVLDVGNP

SEQ ID NO: 86277 - protein, 9 aa, Homo Sapiens
KPYRCSYCE

SEQ ID NO: 86278 - protein, 9 aa, Homo Sapiens
DRLELPHLP

SEQ ID NO: 86279 - protein, 9 aa, Homo Sapiens
KVFAEKNGP

SEQ ID NO: 86280 - protein, 9 aa, Homo Sapiens
VLALSVETV

SEQ ID NO: 86281 - protein, 9 aa, Homo Sapiens
YNFEEVWPK

SEQ ID NO: 86282 - protein, 9 aa, Homo Sapiens
NLMSVLDVG

SEQ ID NO: 86283 - protein, 9 aa, Homo Sapiens
VAAVNVQTT

SEQ ID NO: 86284 - protein, 9 aa, Homo Sapiens
RTAPTDLAF

SEQ ID NO: 86285 - protein, 9 aa, Homo Sapiens
RTHTGEKLV

SEQ ID NO: 86286 - protein, 9 aa, Homo Sapiens
SADYKLPFP

SEQ ID NO: 86287 - protein, 9 aa, Homo Sapiens
VKLDVVCTK

SEQ ID NO: 86288 - protein, 9 aa, Homo Sapiens
EANKNIIEQ

SEQ ID NO: 86289 - protein, 9 aa, Homo Sapiens
ANKHTLVSI

SEQ ID NO: 86290 - protein, 9 aa, Homo Sapiens
PAGSTGFQG

SEQ ID NO: 86291 - protein, 9 aa, Homo Sapiens
VWKHLFFLL

SEQ ID NO: 86292 - protein, 9 aa, Homo Sapiens
ELDINNEVV

SEQ ID NO: 86293 - protein, 9 aa, Homo Sapiens
KLVSVKKLS

SEQ ID NO: 86294 - protein, 9 aa, Homo Sapiens
LQDTCSKWN

SEQ ID NO: 86295 - protein, 9 aa, Homo Sapiens
LTYVHTCCN

SEQ ID NO: 86296 - protein, 9 aa, Homo Sapiens
VQHLDVKLV

SEQ ID NO: 86297 - protein, 9 aa, Homo Sapiens
KLDVVCTKC

SEQ ID NO: 86298 - protein, 9 aa, Homo Sapiens
SSPNLSGLK

SEQ ID NO: 86299 - protein, 9 aa, Homo Sapiens
NDSKRKAKS

SEQ ID NO: 86300 - protein, 9 aa, Homo Sapiens
AFILDGSYS

SEQ ID NO: 86301 - protein, 9 aa, Homo Sapiens
KKLSANKHT

SEQ ID NO: 86302 - protein, 9 aa, Homo Sapiens
LERHQKEEY

SEQ ID NO: 86303 - protein, 9 aa, Homo Sapiens
ITKQEKDFL

SEQ ID NO: 86304 - protein, 9 aa, Homo Sapiens
ELYRQNRFA

SEQ ID NO: 86305 - protein, 9 aa, Homo Sapiens
SVSIHWEPS

SEQ ID NO: 86306 - protein, 9 aa, Homo Sapiens
KQEKDFLWS

SEQ ID NO: 86307 - protein, 9 aa, Homo Sapiens
NMVQHLDVK

SEQ ID NO: 86308 - protein, 9 aa, Homo Sapiens
LSFGKAVDW

SEQ ID NO: 86309 - protein, 9 aa, Homo Sapiens
KEEYQDRVT

SEQ ID NO: 86310 - protein, 9 aa, Homo Sapiens
FIFHEYLLG

SEQ ID NO: 86311 - protein, 9 aa, Homo Sapiens
PEKEREPSE

SEQ ID NO: 86312 - protein, 9 aa, Homo Sapiens
GQRGLVEHD

SEQ ID NO: 86313 - protein, 9 aa, Homo Sapiens
LEELKQFLL

SEQ ID NO: 86314 - protein, 9 aa, Homo Sapiens
SVCLGVPFS

SEQ ID NO: 86315 - protein, 9 aa, Homo Sapiens
RDVLPNHLT

SEQ ID NO: 86316 - protein, 9 aa, Homo Sapiens
KEITPMLCG

SEQ ID NO: 86317 - protein, 9 aa, Homo Sapiens
ASSPNLSGL

SEQ ID NO: 86318 - protein, 9 aa, Homo Sapiens
FYNIPQGYK

SEQ ID NO: 86319 - protein, 9 aa, Homo Sapiens
LDVVCTKCR

SEQ ID NO: 86320 - protein, 9 aa, Homo Sapiens
DHRGFLSHF

SEQ ID NO: 86321 - protein, 9 aa, Homo Sapiens
VIIAVVWCV

SEQ ID NO: 86322 - protein, 9 aa, Homo Sapiens
VDNFLLAEK

SEQ ID NO: 86323 - protein, 9 aa, Homo Sapiens
AVVWCVVGT

SEQ ID NO: 86324 - protein, 9 aa, Homo Sapiens
RPATWQRCN

SEQ ID NO: 86325 - protein, 9 aa, Homo Sapiens
LSVETVDNF

SEQ ID NO: 86326 - protein, 9 aa, Homo Sapiens
VCTKCRVPS

SEQ ID NO: 86327 - protein, 9 aa, Homo Sapiens
STGFQGLPG

SEQ ID NO: 86328 - protein, 9 aa, Homo Sapiens
STVFHQNGV

SEQ ID NO: 86329 - protein, 9 aa, Homo Sapiens
EQKARIIYE

SEQ ID NO: 86330 - protein, 9 aa, Homo Sapiens
KHLFFLLNS

SEQ ID NO: 86331 - protein, 9 aa, Homo Sapiens
RRQNMVQHL

SEQ ID NO: 86332 - protein, 9 aa, Homo Sapiens
MIMNDSKRK

SEQ ID NO: 86333 - protein, 9 aa, Homo Sapiens
ALQPGEKKS

SEQ ID NO: 86334 - protein, 9 aa, Homo Sapiens
LYSSVSIHW

SEQ ID NO: 86335 - protein, 9 aa, Homo Sapiens
VFAEKNGPG

SEQ ID NO: 86336 - protein, 9 aa, Homo Sapiens
KQFLLQNER

SEQ ID NO: 86337 - protein, 9 aa, Homo Sapiens
LVSITEFIL

SEQ ID NO: 86338 - protein, 9 aa, Homo Sapiens
CLGVPFSKP

SEQ ID NO: 86339 - protein, 9 aa, Homo Sapiens
HTLVSITEF

SEQ ID NO: 86340 - protein, 9 aa, Homo Sapiens
FMARKIGAR

SEQ ID NO: 86341 - protein, 9 aa, Homo Sapiens
FPLDCKVYV

SEQ ID NO: 86342 - protein, 9 aa, Homo Sapiens
LRFCGPNHF

SEQ ID NO: 86343 - protein, 9 aa, Homo Sapiens
DRVVKLDVV

SEQ ID NO: 86344 - protein, 9 aa, Homo Sapiens
YNEFISVHA

SEQ ID NO: 86345 - protein, 9 aa, Homo Sapiens
QGPAGSTGF

SEQ ID NO: 86346 - protein, 9 aa, Homo Sapiens
IVASSPNLS

SEQ ID NO: 86347 - protein, 9 aa, Homo Sapiens
QGRHLEDTF

SEQ ID NO: 86348 - protein, 9 aa, Homo Sapiens
SWGPRPATW

SEQ ID NO: 86349 - protein, 9 aa, Homo Sapiens
DSFPLDCKV

SEQ ID NO: 86350 - protein, 9 aa, Homo Sapiens
DSEPIVKNG

SEQ ID NO: 86351 - protein, 9 aa, Homo Sapiens
VQHFFDIRG

SEQ ID NO: 86352 - protein, 9 aa, Homo Sapiens
ATWQRCNIT

SEQ ID NO: 86353 - protein, 9 aa, Homo Sapiens
LELPHLPHT

SEQ ID NO: 86354 - protein, 9 aa, Homo Sapiens
NKHTLVSIT

SEQ ID NO: 86355 - protein, 9 aa, Homo Sapiens
PYRCSYCER

SEQ ID NO: 86356 - protein, 9 aa, Homo Sapiens
HRDSFPLDC

SEQ ID NO: 86357 - protein, 9 aa, Homo Sapiens
GPNHFDQFY

SEQ ID NO: 86358 - protein, 9 aa, Homo Sapiens
TDLAFILDG

SEQ ID NO: 86359 - protein, 9 aa, Homo Sapiens
DLKCPSQFP

SEQ ID NO: 86360 - protein, 9 aa, Homo Sapiens
RLITELLPE

SEQ ID NO: 86361 - protein, 9 aa, Homo Sapiens
SYCERGFTK

SEQ ID NO: 86362 - protein, 9 aa, Homo Sapiens
HFYLPLSAK

SEQ ID NO: 86363 - protein, 9 aa, Homo Sapiens
TVDNFLLAE

SEQ ID NO: 86364 - protein, 9 aa, Homo Sapiens
DPLSEITKQ

SEQ ID NO: 86365 - protein, 9 aa, Homo Sapiens
DCWICITGF

SEQ ID NO: 86366 - protein, 9 aa, Homo Sapiens
WKHLFFLLN

SEQ ID NO: 86367 - protein, 9 aa, Homo Sapiens
ALSVETVDN

SEQ ID NO: 86368 - protein, 9 aa, Homo Sapiens
SIKYSMWCS

SEQ ID NO: 86369 - protein, 9 aa, Homo Sapiens
WEPSKATYP

SEQ ID NO: 86370 - protein, 9 aa, Homo Sapiens
LLPELQLVE

SEQ ID NO: 86371 - protein, 9 aa, Homo Sapiens
WCVVGTSLV

SEQ ID NO: 86372 - protein, 9 aa, Homo Sapiens
FLLQNERSF

SEQ ID NO: 86373 - protein, 9 aa, Homo Sapiens
KLSANKHTL

SEQ ID NO: 86374 - protein, 9 aa, Homo Sapiens
GTVQHFFDI

SEQ ID NO: 86375 - protein, 9 aa, Homo Sapiens
KEIQRKAKE

SEQ ID NO: 86376 - protein, 9 aa, Homo Sapiens
EFISVHATK

SEQ ID NO: 86377 - protein, 9 aa, Homo Sapiens
TVQHFFDIR

SEQ ID NO: 86378 - protein, 9 aa, Homo Sapiens
CFLFGSSFP

SEQ ID NO: 86379 - protein, 9 aa, Homo Sapiens
GEQGPAGST

SEQ ID NO: 86380 - protein, 9 aa, Homo Sapiens
GPRPATWQR

SEQ ID NO: 86381 - protein, 9 aa, Homo Sapiens
IETLLSFGK

SEQ ID NO: 86382 - protein, 9 aa, Homo Sapiens
NTIETLLSF

SEQ ID NO: 86383 - protein, 9 aa, Homo Sapiens
FDIRGFMLE

SEQ ID NO: 86384 - protein, 9 aa, Homo Sapiens
EEYDFLTPV

SEQ ID NO: 86385 - protein, 9 aa, Homo Sapiens
VLQDTCSKW

SEQ ID NO: 86386 - protein, 9 aa, Homo Sapiens
YCERGFTKN

SEQ ID NO: 86387 - protein, 9 aa, Homo Sapiens
AAVNVQTTQ

SEQ ID NO: 86388 - protein, 9 aa, Homo Sapiens
LQPGEKKSQ

SEQ ID NO: 86389 - protein, 9 aa, Homo Sapiens
SVLDVGNPL

SEQ ID NO: 86390 - protein, 9 aa, Homo Sapiens
KHREVVSRL

SEQ ID NO: 86391 - protein, 9 aa, Homo Sapiens
CITGFVYNV

SEQ ID NO: 86392 - protein, 9 aa, Homo Sapiens
QNRFASSKE

SEQ ID NO: 86393 - protein, 9 aa, Homo Sapiens
HTGEKLVSV

SEQ ID NO: 86394 - protein, 9 aa, Homo Sapiens
FLSHFYLPL

SEQ ID NO: 86395 - protein, 9 aa, Homo Sapiens
RDPLSEITK

SEQ ID NO: 86396 - protein, 9 aa, Homo Sapiens
QGYKVEKRE

SEQ ID NO: 86397 - protein, 9 aa, Homo Sapiens
TGEKLVSVK

SEQ ID NO: 86398 - protein, 9 aa, Homo Sapiens
VWCVVGTSL

SEQ ID NO: 86399 - protein, 9 aa, Homo Sapiens
PFPTSPLSP

SEQ ID NO: 86400 - protein, 9 aa, Homo Sapiens
FVWKHLFFL

SEQ ID NO: 86401 - protein, 9 aa, Homo Sapiens
LVSVKKLSA

SEQ ID NO: 86402 - protein, 9 aa, Homo Sapiens
NPLGTVQHF

SEQ ID NO: 86403 - protein, 9 aa, Homo Sapiens
SRLQKKIQE

SEQ ID NO: 86404 - protein, 9 aa, Homo Sapiens
DINNEVVPK

SEQ ID NO: 86405 - protein, 9 aa, Homo Sapiens
HATKEVNLD

SEQ ID NO: 86406 - protein, 9 aa, Homo Sapiens
SEITKQEKD

SEQ ID NO: 86407 - protein, 9 aa, Homo Sapiens
EYQDRVTQC

SEQ ID NO: 86408 - protein, 9 aa, Homo Sapiens
EVVPKNIPK

SEQ ID NO: 86409 - protein, 9 aa, Homo Sapiens
GFSFIFHEY

SEQ ID NO: 86410 - protein, 9 aa, Homo Sapiens
KEKYEVLEN

SEQ ID NO: 86411 - protein, 9 aa, Homo Sapiens
DLRNLTYVH

SEQ ID NO: 86412 - protein, 9 aa, Homo Sapiens
LITELLPEL

SEQ ID NO: 86413 - protein, 9 aa, Homo Sapiens
LLSQDAEDE

SEQ ID NO: 86414 - protein, 9 aa, Homo Sapiens
TGYVPCACF

SEQ ID NO: 86415 - protein, 9 aa, Homo Sapiens
YNIPQGYKV

SEQ ID NO: 86416 - protein, 9 aa, Homo Sapiens
DPNTIETLL

SEQ ID NO: 86417 - protein, 9 aa, Homo Sapiens
PNHLTEVLT

SEQ ID NO: 86418 - protein, 9 aa, Homo Sapiens
DWKMIMNDS

SEQ ID NO: 86419 - protein, 9 aa, Homo Sapiens
GYVPCACFL

SEQ ID NO: 86420 - protein, 9 aa, Homo Sapiens
CGLQNNRVE

SEQ ID NO: 86421 - protein, 9 aa, Homo Sapiens
FSFIFHEYL

SEQ ID NO: 86422 - protein, 9 aa, Homo Sapiens
VLDVGNPLG

SEQ ID NO: 86423 - protein, 9 aa, Homo Sapiens
PNLLRGAVF

SEQ ID NO: 86424 - protein, 9 aa, Homo Sapiens
LCGLQNNRV

SEQ ID NO: 86425 - protein, 9 aa, Homo Sapiens
EDTFGEDWQ

SEQ ID NO: 86426 - protein, 9 aa, Homo Sapiens
YYQGRHLED

SEQ ID NO: 86427 - protein, 9 aa, Homo Sapiens
VLPNHLTEV

SEQ ID NO: 86428 - protein, 9 aa, Homo Sapiens
PRPATWQRC

SEQ ID NO: 86429 - protein, 9 aa, Homo Sapiens
GPRPEEYDF

SEQ ID NO: 86430 - protein, 9 aa, Homo Sapiens
PATWQRCNI

SEQ ID NO: 86431 - protein, 9 aa, Homo Sapiens
QDTCSKWNG

SEQ ID NO: 86432 - protein, 9 aa, Homo Sapiens
IKYSMWCST

SEQ ID NO: 86433 - protein, 9 aa, Homo Sapiens
IFMARKIGA

SEQ ID NO: 86434 - protein, 9 aa, Homo Sapiens
ITEFILEKN

SEQ ID NO: 86435 - protein, 9 aa, Homo Sapiens
TPMLCGLQN

SEQ ID NO: 86436 - protein, 9 aa, Homo Sapiens
GEKPYRCSY

SEQ ID NO: 86437 - protein, 9 aa, Homo Sapiens
EVWPKFQQI

SEQ ID NO: 86438 - protein, 9 aa, Homo Sapiens
FSKPSNTSE

SEQ ID NO: 86439 - protein, 9 aa, Homo Sapiens
GVVIIAVVW

SEQ ID NO: 86440 - protein, 9 aa, Homo Sapiens
IKLSEHAMF

SEQ ID NO: 86441 - protein, 9 aa, Homo Sapiens
KYAIFMARK

SEQ ID NO: 86442 - protein, 9 aa, Homo Sapiens
LVEHDFLTK

SEQ ID NO: 86443 - protein, 9 aa, Homo Sapiens
KSKVFAEKN

SEQ ID NO: 86444 - protein, 9 aa, Homo Sapiens
QKARIIYED

SEQ ID NO: 86445 - protein, 9 aa, Homo Sapiens
VCLGVPFSK

SEQ ID NO: 86446 - protein, 9 aa, Homo Sapiens
PMLCGLQNN

SEQ ID NO: 86447 - protein, 9 aa, Homo Sapiens
KNGPGDRLE

SEQ ID NO: 86448 - protein, 9 aa, Homo Sapiens
LLEEDLKCP

SEQ ID NO: 86449 - protein, 9 aa, Homo Sapiens
KEREPSEKI

SEQ ID NO: 86450 - protein, 9 aa, Homo Sapiens
REVVSRLQK

SEQ ID NO: 86451 - protein, 9 aa, Homo Sapiens
TWQRCNITP

SEQ ID NO: 86452 - protein, 9 aa, Homo Sapiens
DVLPNHLTE

SEQ ID NO: 86453 - protein, 9 aa, Homo Sapiens
QEIVASSPN

SEQ ID NO: 86454 - protein, 9 aa, Homo Sapiens
LEEDLKCPS

SEQ ID NO: 86455 - protein, 9 aa, Homo Sapiens
GNPLGTVQH

SEQ ID NO: 86456 - protein, 9 aa, Homo Sapiens
ETVDNFLLA

SEQ ID NO: 86457 - protein, 9 aa, Homo Sapiens
LYRQNRFAS

SEQ ID NO: 86458 - protein, 9 aa, Homo Sapiens
ITPMLCGLQ

SEQ ID NO: 86459 - protein, 9 aa, Homo Sapiens
FTPMTVPNL

SEQ ID NO: 86460 - protein, 9 aa, Homo Sapiens
EYDFLTPVE

SEQ ID NO: 86461 - protein, 9 aa, Homo Sapiens
PEEYDFLTP

SEQ ID NO: 86462 - protein, 9 aa, Homo Sapiens
NNAKYAIFM

SEQ ID NO: 86463 - protein, 9 aa, Homo Sapiens
NSVCLGVPF

SEQ ID NO: 86464 - protein, 9 aa, Homo Sapiens
GFTPMTVPN

SEQ ID NO: 86465 - protein, 9 aa, Homo Sapiens
HQNGVKIPD

SEQ ID NO: 86466 - protein, 9 aa, Homo Sapiens
DFLTPVEEA

SEQ ID NO: 86467 - protein, 9 aa, Homo Sapiens
FTGYVPCAC

SEQ ID NO: 86468 - protein, 9 aa, Homo Sapiens
TAPTDLAFI

SEQ ID NO: 86469 - protein, 9 aa, Homo Sapiens
LPFPTSPLS

SEQ ID NO: 86470 - protein, 9 aa, Homo Sapiens
SKVFAEKNG

SEQ ID NO: 86471 - protein, 9 aa, Homo Sapiens
EREPSEKIQ

SEQ ID NO: 86472 - protein, 9 aa, Homo Sapiens
MLESKIWNI

SEQ ID NO: 86473 - protein, 9 aa, Homo Sapiens
TEFILEKNL

SEQ ID NO: 86474 - protein, 9 aa, Homo Sapiens
IRGFMLESK

SEQ ID NO: 86475 - protein, 9 aa, Homo Sapiens
ELKQFLLQN

SEQ ID NO: 86476 - protein, 9 aa, Homo Sapiens
LLSFGKAVD

SEQ ID NO: 86477 - protein, 9 aa, Homo Sapiens
QRKAKEKYE

SEQ ID NO: 86478 - protein, 9 aa, Homo Sapiens
ENSSKDSEP

SEQ ID NO: 86479 - protein, 9 aa, Homo Sapiens
LAFILDGSY

SEQ ID NO: 86480 - protein, 9 aa, Homo Sapiens
GVIRDVLPN

SEQ ID NO: 86481 - protein, 9 aa, Homo Sapiens
LRNLTYVHT

SEQ ID NO: 86482 - protein, 9 aa, Homo Sapiens
CSYCERGFT

SEQ ID NO: 86483 - protein, 9 aa, Homo Sapiens
VWPKFQQIM

SEQ ID NO: 86484 - protein, 9 aa, Homo Sapiens
LSEHAMFIS

SEQ ID NO: 86485 - protein, 9 aa, Homo Sapiens
SMGRFVWKH

SEQ ID NO: 86486 - protein, 9 aa, Homo Sapiens
RVSSQKKPS

SEQ ID NO: 86487 - protein, 9 aa, Homo Sapiens
EKPYRCSYC

SEQ ID NO: 86488 - protein, 9 aa, Homo Sapiens
MWKGELYRQ

SEQ ID NO: 86489 - protein, 9 aa, Homo Sapiens
LGVPFSKPS

SEQ ID NO: 86490 - protein, 9 aa, Homo Sapiens
IEENSSKDS

SEQ ID NO: 86491 - protein, 9 aa, Homo Sapiens
SEHAMFISA

SEQ ID NO: 86492 - protein, 9 aa, Homo Sapiens
IHWEPSKAT

SEQ ID NO: 86493 - protein, 9 aa, Homo Sapiens
SFIFHEYLL

SEQ ID NO: 86494 - protein, 9 aa, Homo Sapiens
REPSEKIQK

SEQ ID NO: 86495 - protein, 9 aa, Homo Sapiens
PNTIETLLS

SEQ ID NO: 86496 - protein, 9 aa, Homo Sapiens
SQDAEDEKT

SEQ ID NO: 86497 - protein, 9 aa, Homo Sapiens
YRCSYCERG

SEQ ID NO: 86498 - protein, 9 aa, Homo Sapiens
AIFMARKIG

SEQ ID NO: 86499 - protein, 9 aa, Homo Sapiens
QRGLVEHDF

SEQ ID NO: 86500 - protein, 9 aa, Homo Sapiens
YLLGACGNF

SEQ ID NO: 86501 - protein, 9 aa, Homo Sapiens
HDFLTKVLS

SEQ ID NO: 86502 - protein, 9 aa, Homo Sapiens
VGNPLGTVQ

SEQ ID NO: 86503 - protein, 9 aa, Homo Sapiens
EDLKCPSQF

SEQ ID NO: 86504 - protein, 9 aa, Homo Sapiens
EYLLGACGN

SEQ ID NO: 86505 - protein, 9 aa, Homo Sapiens
MGRFVWKHL

SEQ ID NO: 86506 - protein, 9 aa, Homo Sapiens
YDFLTPVEE

SEQ ID NO: 86507 - protein, 9 aa, Homo Sapiens
NIIEQKARI

SEQ ID NO: 86508 - protein, 9 aa, Homo Sapiens
KYSMWCSTE

SEQ ID NO: 86509 - protein, 9 aa, Homo Sapiens
RHQKEEYQD

SEQ ID NO: 86510 - protein, 9 aa, Homo Sapiens
SVHATKEVN

SEQ ID NO: 86511 - protein, 9 aa, Homo Sapiens
SDWKMIMND

SEQ ID NO: 86512 - protein, 9 aa, Homo Sapiens
PFSKPSNTS

SEQ ID NO: 86513 - protein, 9 aa, Homo Sapiens
HFFDIRGFM

SEQ ID NO: 86514 - protein, 9 aa, Homo Sapiens
YVPCACFLF

SEQ ID NO: 86515 - protein, 9 aa, Homo Sapiens
VPNLLRGAV

SEQ ID NO: 86516 - protein, 9 aa, Homo Sapiens
RLQKKIQEA

SEQ ID NO: 86517 - protein, 9 aa, Homo Sapiens
LESKIWNIM

SEQ ID NO: 86518 - protein, 9 aa, Homo Sapiens
MNDSKRKAK

SEQ ID NO: 86519 - protein, 9 aa, Homo Sapiens
AGSTGFQGL

SEQ ID NO: 86520 - protein, 9 aa, Homo Sapiens
QNMVQHLDV

SEQ ID NO: 86521 - protein, 9 aa, Homo Sapiens
KRVSSQKKP

SEQ ID NO: 86522 - protein, 9 aa, Homo Sapiens
FILEKNLMS

SEQ ID NO: 86523 - protein, 9 aa, Homo Sapiens
IHRSIKYSM

SEQ ID NO: 86524 - protein, 9 aa, Homo Sapiens
HRGFLSHFY

SEQ ID NO: 86525 - protein, 9 aa, Homo Sapiens
LSEITKQEK

SEQ ID NO: 86526 - protein, 9 aa, Homo Sapiens
ISVHATKEV

SEQ ID NO: 86527 - protein, 9 aa, Homo Sapiens
GPAGSTGFQ

SEQ ID NO: 86528 - protein, 9 aa, Homo Sapiens
AKHREVVSR

SEQ ID NO: 86529 - protein, 9 aa, Homo Sapiens
GSDWKMIMN

SEQ ID NO: 86530 - protein, 9 aa, Homo Sapiens
EENSSKDSE

SEQ ID NO: 86531 - protein, 9 aa, Homo Sapiens
GKELDINNE

SEQ ID NO: 86532 - protein, 9 aa, Homo Sapiens
KIWNIMSMG

SEQ ID NO: 86533 - protein, 9 aa, Homo Sapiens
DTCSKWNGN

SEQ ID NO: 86534 - protein, 9 aa, Homo Sapiens
GRFVWKHLF

SEQ ID NO: 86535 - protein, 9 aa, Homo Sapiens
SIHWEPSKA

SEQ ID NO: 86536 - protein, 9 aa, Homo Sapiens
WKGELYRQN

SEQ ID NO: 86537 - protein, 9 aa, Homo Sapiens
KLSEHAMFI

SEQ ID NO: 86538 - protein, 9 aa, Homo Sapiens
THTGEKLVS

SEQ ID NO: 86539 - protein, 9 aa, Homo Sapiens
ETLLSFGKA

SEQ ID NO: 86540 - protein, 9 aa, Homo Sapiens
AKEKYEVLE

SEQ ID NO: 86541 - protein, 9 aa, Homo Sapiens
NHFDQFYCD

SEQ ID NO: 86542 - protein, 9 aa, Homo Sapiens
QPGEKKSQA

SEQ ID NO: 86543 - protein, 9 aa, Homo Sapiens
FEEVWPKFQ

SEQ ID NO: 86544 - protein, 9 aa, Homo Sapiens
GYKVEKREG

SEQ ID NO: 86545 - protein, 9 aa, Homo Sapiens
HQKEEYQDR

SEQ ID NO: 86546 - protein, 9 aa, Homo Sapiens
EKTQRESLE

SEQ ID NO: 86547 - protein, 9 aa, Homo Sapiens
MLCGLQNNR

SEQ ID NO: 86548 - protein, 9 aa, Homo Sapiens
YAIFMARKI

SEQ ID NO: 86549 - protein, 9 aa, Homo Sapiens
DMTFDLRNL

SEQ ID NO: 86550 - protein, 9 aa, Homo Sapiens
TSTVFHQNG

SEQ ID NO: 86551 - protein, 9 aa, Homo Sapiens
SSVSIHWEP

SEQ ID NO: 86552 - protein, 9 aa, Homo Sapiens
PVAAVNVQT

SEQ ID NO: 86553 - protein, 9 aa, Homo Sapiens
EKNLMSVLD

SEQ ID NO: 86554 - protein, 9 aa, Homo Sapiens
DVVCTKCRV

SEQ ID NO: 86555 - protein, 9 aa, Homo Sapiens
EVVSRLQKK

SEQ ID NO: 86556 - protein, 9 aa, Homo Sapiens
DGDRLITEL

SEQ ID NO: 86557 - protein, 9 aa, Homo Sapiens
CSWGPRPAT

SEQ ID NO: 86558 - protein, 9 aa, Homo Sapiens
VLRRQNMVQ

SEQ ID NO: 86559 - protein, 9 aa, Homo Sapiens
LPNHLTEVL

SEQ ID NO: 86560 - protein, 9 aa, Homo Sapiens
HEYLLGACG

SEQ ID NO: 86561 - protein, 9 aa, Homo Sapiens
NLLRGAVFE

SEQ ID NO: 86562 - protein, 9 aa, Homo Sapiens
CACFLFGSS

SEQ ID NO: 86563 - protein, 9 aa, Homo Sapiens
AKYAIFMAR

SEQ ID NO: 86564 - protein, 9 aa, Homo Sapiens
PLSEITKQE

SEQ ID NO: 86565 - protein, 9 aa, Homo Sapiens
TKRVSSQKK

SEQ ID NO: 86566 - protein, 9 aa, Homo Sapiens
KNLMSVLDV

SEQ ID NO: 86567 - protein, 9 aa, Homo Sapiens
SKWNGNVGK

SEQ ID NO: 86568 - protein, 9 aa, Homo Sapiens
VSSQKKPSL

SEQ ID NO: 86569 - protein, 9 aa, Homo Sapiens
WGPRPATWQ

SEQ ID NO: 86570 - protein, 9 aa, Homo Sapiens
KAKEKYEVL

SEQ ID NO: 86571 - protein, 9 aa, Homo Sapiens
FISVHATKE

SEQ ID NO: 86572 - protein, 9 aa, Homo Sapiens
LSQDAEDEK

SEQ ID NO: 86573 - protein, 9 aa, Homo Sapiens
GDRLELPHL

SEQ ID NO: 86574 - protein, 9 aa, Homo Sapiens
VVSRLQKKI

SEQ ID NO: 86575 - protein, 9 aa, Homo Sapiens
TELLPELQL

SEQ ID NO: 86576 - protein, 9 aa, Homo Sapiens
SVKKLSANK

SEQ ID NO: 86577 - protein, 9 aa, Homo Sapiens
YGPRPEEYD

SEQ ID NO: 86578 - protein, 9 aa, Homo Sapiens
EFILEKNLM

SEQ ID NO: 86579 - protein, 9 aa, Homo Sapiens
ITGFVYNVS

SEQ ID NO: 86580 - protein, 9 aa, Homo Sapiens
IFHEYLLGA

SEQ ID NO: 86581 - protein, 9 aa, Homo Sapiens
IIEQKARII

SEQ ID NO: 86582 - protein, 9 aa, Homo Sapiens
RHLEDTFGE

SEQ ID NO: 86583 - protein, 9 aa, Homo Sapiens
YGVIRDVLP

SEQ ID NO: 86584 - protein, 9 aa, Homo Sapiens
VVWCVVGTS

SEQ ID NO: 86585 - protein, 9 aa, Homo Sapiens
FILSSDDDN

SEQ ID NO: 86586 - protein, 9 aa, Homo Sapiens
IRDVLPNHL

SEQ ID NO: 86587 - protein, 9 aa, Homo Sapiens
INNEVVPKN

SEQ ID NO: 86588 - protein, 9 aa, Homo Sapiens
VSIHWEPSK

SEQ ID NO: 86589 - protein, 9 aa, Homo Sapiens
ELLPELQLV

SEQ ID NO: 86590 - protein, 9 aa, Homo Sapiens
AEKNGPGDR

SEQ ID NO: 86591 - protein, 9 aa, Homo Sapiens
PSQFPSLGY

SEQ ID NO: 86592 - protein, 9 aa, Homo Sapiens
PRPEEYDFL

SEQ ID NO: 86593 - protein, 9 aa, Homo Sapiens
FHEYLLGAC

SEQ ID NO: 86594 - protein, 9 aa, Homo Sapiens
GRHLEDTFG

SEQ ID NO: 86595 - protein, 9 aa, Homo Sapiens
FCGPNHFDQ

SEQ ID NO: 86596 - protein, 9 aa, Homo Sapiens
HLEDTFGED

SEQ ID NO: 86597 - protein, 9 aa, Homo Sapiens
EIQRKAKEK

SEQ ID NO: 86598 - protein, 9 aa, Homo Sapiens
LSANKHTLV

SEQ ID NO: 86599 - protein, 9 aa, Homo Sapiens
EKLVSVKKL

SEQ ID NO: 86600 - protein, 9 aa, Homo Sapiens
LNNAKYAIF

SEQ ID NO: 86601 - protein, 9 aa, Homo Sapiens
PQGYKVEKR

SEQ ID NO: 86602 - protein, 9 aa, Homo Sapiens
LRRQNMVQH

SEQ ID NO: 86603 - protein, 9 aa, Homo Sapiens
VSVKKLSAN

SEQ ID NO: 86604 - protein, 9 aa, Homo Sapiens
EKNGPGDRL

SEQ ID NO: 86605 - protein, 9 aa, Homo Sapiens
PGDRLELPH

SEQ ID NO: 86606 - protein, 9 aa, Homo Sapiens
PPASSRPTL

SEQ ID NO: 86607 - protein, 9 aa, Homo Sapiens
AQPMPLRPP

SEQ ID NO: 86608 - protein, 9 aa, Homo Sapiens
DSSSTSSSE

SEQ ID NO: 86609 - protein, 9 aa, Homo Sapiens
PQKYQRGNL

SEQ ID NO: 86610 - protein, 9 aa, Homo Sapiens
IQDYSKYPF

SEQ ID NO: 86611 - protein, 9 aa, Homo Sapiens
PVNLPQGGP

SEQ ID NO: 86612 - protein, 9 aa, Homo Sapiens
VCTARAPPA

SEQ ID NO: 86613 - protein, 9 aa, Homo Sapiens
RPTLTPVPR

SEQ ID NO: 86614 - protein, 9 aa, Homo Sapiens
KDWSNLSGK

SEQ ID NO: 86615 - protein, 9 aa, Homo Sapiens
IPDCEPILE

SEQ ID NO: 86616 - protein, 9 aa, Homo Sapiens
GGMQHGYGV

SEQ ID NO: 86617 - protein, 9 aa, Homo Sapiens
RRSVWPAQP

SEQ ID NO: 86618 - protein, 9 aa, Homo Sapiens
GPTCRRRRR

SEQ ID NO: 86619 - protein, 9 aa, Homo Sapiens
AWVPVPAPA

SEQ ID NO: 86620 - protein, 9 aa, Homo Sapiens
GMQHGYGVR

SEQ ID NO: 86621 - protein, 9 aa, Homo Sapiens
LLICTAELQ

SEQ ID NO: 86622 - protein, 9 aa, Homo Sapiens
LTHVIHQDE

SEQ ID NO: 86623 - protein, 9 aa, Homo Sapiens
SHGLPVGVI

SEQ ID NO: 86624 - protein, 9 aa, Homo Sapiens
AAPTRPRRV

SEQ ID NO: 86625 - protein, 9 aa, Homo Sapiens
AELTQKIFD

SEQ ID NO: 86626 - protein, 9 aa, Homo Sapiens
AFTFAALCY

SEQ ID NO: 86627 - protein, 9 aa, Homo Sapiens
CDEIPDCEP

SEQ ID NO: 86628 - protein, 9 aa, Homo Sapiens
RTVCTARAP

SEQ ID NO: 86629 - protein, 9 aa, Homo Sapiens
VVLLLGSVV

SEQ ID NO: 86630 - protein, 9 aa, Homo Sapiens
RTAAVSLTW

SEQ ID NO: 86631 - protein, 9 aa, Homo Sapiens
ENPETDVYI

SEQ ID NO: 86632 - protein, 9 aa, Homo Sapiens
PLSSYVLVH

SEQ ID NO: 86633 - protein, 9 aa, Homo Sapiens
PEKRLRRVA

SEQ ID NO: 86634 - protein, 9 aa, Homo Sapiens
KKESCVTEF

SEQ ID NO: 86635 - protein, 9 aa, Homo Sapiens
AVSLTWSQT

SEQ ID NO: 86636 - protein, 9 aa, Homo Sapiens
SLTFHAKMS

SEQ ID NO: 86637 - protein, 9 aa, Homo Sapiens
TGRRARWSR

SEQ ID NO: 86638 - protein, 9 aa, Homo Sapiens
PTCRRRRRP

SEQ ID NO: 86639 - protein, 9 aa, Homo Sapiens
WVPVPAPAP

SEQ ID NO: 86640 - protein, 9 aa, Homo Sapiens
ISPTSPGRA

SEQ ID NO: 86641 - protein, 9 aa, Homo Sapiens
AFFRELISW

SEQ ID NO: 86642 - protein, 9 aa, Homo Sapiens
GVISPTSPG

SEQ ID NO: 86643 - protein, 9 aa, Homo Sapiens
ALPGLAFFR

SEQ ID NO: 86644 - protein, 9 aa, Homo Sapiens
ISYEHLKRH

SEQ ID NO: 86645 - protein, 9 aa, Homo Sapiens
PTTMCGCYC

SEQ ID NO: 86646 - protein, 9 aa, Homo Sapiens
QPMPLRPPT

SEQ ID NO: 86647 - protein, 9 aa, Homo Sapiens
TMCKHPLMC

SEQ ID NO: 86648 - protein, 9 aa, Homo Sapiens
SVWPAQPMP

SEQ ID NO: 86649 - protein, 9 aa, Homo Sapiens
ICTAELQMA

SEQ ID NO: 86650 - protein, 9 aa, Homo Sapiens
TVFISYEHL

SEQ ID NO: 86651 - protein, 9 aa, Homo Sapiens
KENPETDVY

SEQ ID NO: 86652 - protein, 9 aa, Homo Sapiens
TLTPVPRRR

SEQ ID NO: 86653 - protein, 9 aa, Homo Sapiens
DQKTMEKPH

SEQ ID NO: 86654 - protein, 9 aa, Homo Sapiens
ATRSTAAAK

SEQ ID NO: 86655 - protein, 9 aa, Homo Sapiens
PSHPAWVPV

SEQ ID NO: 86656 - protein, 9 aa, Homo Sapiens
PMAETHAWA

SEQ ID NO: 86657 - protein, 9 aa, Homo Sapiens
ICKDWSNLS

SEQ ID NO: 86658 - protein, 9 aa, Homo Sapiens
TAAAKSCPS

SEQ ID NO: 86659 - protein, 9 aa, Homo Sapiens
RKKESCVTE

SEQ ID NO: 86660 - protein, 9 aa, Homo Sapiens
VLEIVHPGQ

SEQ ID NO: 86661 - protein, 9 aa, Homo Sapiens
TVCTARAPP

SEQ ID NO: 86662 - protein, 9 aa, Homo Sapiens
IKREGQQLM

SEQ ID NO: 86663 - protein, 9 aa, Homo Sapiens
STRLRASTR

SEQ ID NO: 86664 - protein, 9 aa, Homo Sapiens
AASAWAACT

SEQ ID NO: 86665 - protein, 9 aa, Homo Sapiens
KHIRNRYTI

SEQ ID NO: 86666 - protein, 9 aa, Homo Sapiens
HKFIIHNAL

SEQ ID NO: 86667 - protein, 9 aa, Homo Sapiens
QKKKDSRSS

SEQ ID NO: 86668 - protein, 9 aa, Homo Sapiens
ALGDRSYSD

SEQ ID NO: 86669 - protein, 9 aa, Homo Sapiens
APSPQHSPQ

SEQ ID NO: 86670 - protein, 9 aa, Homo Sapiens
RRRRPPTAW

SEQ ID NO: 86671 - protein, 9 aa, Homo Sapiens
TCTPCAVLR

SEQ ID NO: 86672 - protein, 9 aa, Homo Sapiens
EWLEKIKRE

SEQ ID NO: 86673 - protein, 9 aa, Homo Sapiens
VVLTVLGIH

SEQ ID NO: 86674 - protein, 9 aa, Homo Sapiens
TPTMCKHPL

SEQ ID NO: 86675 - protein, 9 aa, Homo Sapiens
PRGPTCRRR

SEQ ID NO: 86676 - protein, 9 aa, Homo Sapiens
VCQRRDSAA

SEQ ID NO: 86677 - protein, 9 aa, Homo Sapiens
ERPLSSYVL

SEQ ID NO: 86678 - protein, 9 aa, Homo Sapiens
ATRTVCTAR

SEQ ID NO: 86679 - protein, 9 aa, Homo Sapiens
TRPTPTRRP

SEQ ID NO: 86680 - protein, 9 aa, Homo Sapiens
TFHAKMSLI

SEQ ID NO: 86681 - protein, 9 aa, Homo Sapiens
IAELTQKIF

SEQ ID NO: 86682 - protein, 9 aa, Homo Sapiens
PTMCKHPLM

SEQ ID NO: 86683 - protein, 9 aa, Homo Sapiens
CTARAPPAS

SEQ ID NO: 86684 - protein, 9 aa, Homo Sapiens
AAIICPHIS

SEQ ID NO: 86685 - protein, 9 aa, Homo Sapiens
VSLTWSQTP

SEQ ID NO: 86686 - protein, 9 aa, Homo Sapiens
RQFVILQKK

SEQ ID NO: 86687 - protein, 9 aa, Homo Sapiens
LATLSDQKT

SEQ ID NO: 86688 - protein, 9 aa, Homo Sapiens
EIQDHAIQD

SEQ ID NO: 86689 - protein, 9 aa, Homo Sapiens
SQSKGNKLY

SEQ ID NO: 86690 - protein, 9 aa, Homo Sapiens
TRPPRGPTC

SEQ ID NO: 86691 - protein, 9 aa, Homo Sapiens
QAAIICPHI

SEQ ID NO: 86692 - protein, 9 aa, Homo Sapiens
TARSRAASA

SEQ ID NO: 86693 - protein, 9 aa, Homo Sapiens
QRRDSAAEE

SEQ ID NO: 86694 - protein, 9 aa, Homo Sapiens
YTIALDTQD

SEQ ID NO: 86695 - protein, 9 aa, Homo Sapiens
VSPVWAHKS

SEQ ID NO: 86696 - protein, 9 aa, Homo Sapiens
FHAGVSPVW

SEQ ID NO: 86697 - protein, 9 aa, Homo Sapiens
KMVPLGDIN

SEQ ID NO: 86698 - protein, 9 aa, Homo Sapiens
TPCAVLRRR

SEQ ID NO: 86699 - protein, 9 aa, Homo Sapiens
IQDHAIQDY

SEQ ID NO: 86700 - protein, 9 aa, Homo Sapiens
ETDVYIKDL

SEQ ID NO: 86701 - protein, 9 aa, Homo Sapiens
PTPTRRPRR

SEQ ID NO: 86702 - protein, 9 aa, Homo Sapiens
SYEHLKRHK

SEQ ID NO: 86703 - protein, 9 aa, Homo Sapiens
FLDQKRGVF

SEQ ID NO: 86704 - protein, 9 aa, Homo Sapiens
AKIRTVEMT

SEQ ID NO: 86705 - protein, 9 aa, Homo Sapiens
KGNKLYLEG

SEQ ID NO: 86706 - protein, 9 aa, Homo Sapiens
VLRWAGPEK

SEQ ID NO: 86707 - protein, 9 aa, Homo Sapiens
VASAGVISP

SEQ ID NO: 86708 - protein, 9 aa, Homo Sapiens
EPTCTPCAV

SEQ ID NO: 86709 - protein, 9 aa, Homo Sapiens
GVILTTGQD

SEQ ID NO: 86710 - protein, 9 aa, Homo Sapiens
YKEPSAKSH

SEQ ID NO: 86711 - protein, 9 aa, Homo Sapiens
GAYFHAGVS

SEQ ID NO: 86712 - protein, 9 aa, Homo Sapiens
NKEWLEKIK

SEQ ID NO: 86713 - protein, 9 aa, Homo Sapiens
SRAASAWAA

SEQ ID NO: 86714 - protein, 9 aa, Homo Sapiens
KCDEIPDCE

SEQ ID NO: 86715 - protein, 9 aa, Homo Sapiens
PKEVDRTRL

SEQ ID NO: 86716 - protein, 9 aa, Homo Sapiens
WAGGMQHGY

SEQ ID NO: 86717 - protein, 9 aa, Homo Sapiens
FTFAALCYM

SEQ ID NO: 86718 - protein, 9 aa, Homo Sapiens
SSLSGNTAI

SEQ ID NO: 86719 - protein, 9 aa, Homo Sapiens
ARSRAASAW

SEQ ID NO: 86720 - protein, 9 aa, Homo Sapiens
TRTVCTARA

SEQ ID NO: 86721 - protein, 9 aa, Homo Sapiens
ARAPPASSR

SEQ ID NO: 86722 - protein, 9 aa, Homo Sapiens
PTLTPVPRR

SEQ ID NO: 86723 - protein, 9 aa, Homo Sapiens
RQGTVFISY

SEQ ID NO: 86724 - protein, 9 aa, Homo Sapiens
KIKREGQQL

SEQ ID NO: 86725 - protein, 9 aa, Homo Sapiens
EMQRKKESC

SEQ ID NO: 86726 - protein, 9 aa, Homo Sapiens
HAGVSPVWA

SEQ ID NO: 86727 - protein, 9 aa, Homo Sapiens
QHGYGVRQS

SEQ ID NO: 86728 - protein, 9 aa, Homo Sapiens
TAWTAATRT

SEQ ID NO: 86729 - protein, 9 aa, Homo Sapiens
PTCRCAAPT

SEQ ID NO: 86730 - protein, 9 aa, Homo Sapiens
TEIAELTQK

SEQ ID NO: 86731 - protein, 9 aa, Homo Sapiens
AGGMQHGYG

SEQ ID NO: 86732 - protein, 9 aa, Homo Sapiens
PVPAPAPAP

SEQ ID NO: 86733 - protein, 9 aa, Homo Sapiens
DINSHSLKK

SEQ ID NO: 86734 - protein, 9 aa, Homo Sapiens
IRNRYTIAL

SEQ ID NO: 86735 - protein, 9 aa, Homo Sapiens
LMCREPTCT

SEQ ID NO: 86736 - protein, 9 aa, Homo Sapiens
LSRELQLSV

SEQ ID NO: 86737 - protein, 9 aa, Homo Sapiens
RTVEMTFVI

SEQ ID NO: 86738 - protein, 9 aa, Homo Sapiens
STRPPRGPT

SEQ ID NO: 86739 - protein, 9 aa, Homo Sapiens
SAWAACTGP

SEQ ID NO: 86740 - protein, 9 aa, Homo Sapiens
TCRRRRRPP

SEQ ID NO: 86741 - protein, 9 aa, Homo Sapiens
RELQLSVLE

SEQ ID NO: 86742 - protein, 9 aa, Homo Sapiens
TREIQDHAI

SEQ ID NO: 86743 - protein, 9 aa, Homo Sapiens
LSDQKTMEK

SEQ ID NO: 86744 - protein, 9 aa, Homo Sapiens
TARAPPASS

SEQ ID NO: 86745 - protein, 9 aa, Homo Sapiens
ERQGTVFIS

SEQ ID NO: 86746 - protein, 9 aa, Homo Sapiens
EFLDQKRGV

SEQ ID NO: 86747 - protein, 9 aa, Homo Sapiens
GPTRTAAVS

SEQ ID NO: 86748 - protein, 9 aa, Homo Sapiens
PLMCREPTC

SEQ ID NO: 86749 - protein, 9 aa, Homo Sapiens
RRVGSGTAR

SEQ ID NO: 86750 - protein, 9 aa, Homo Sapiens
LSVLEIVHP

SEQ ID NO: 86751 - protein, 9 aa, Homo Sapiens
FFRELISWG

SEQ ID NO: 86752 - protein, 9 aa, Homo Sapiens
THVIHQDES

SEQ ID NO: 86753 - protein, 9 aa, Homo Sapiens
LTWSQTPTM

SEQ ID NO: 86754 - protein, 9 aa, Homo Sapiens
SCVTEFISR

SEQ ID NO: 86755 - protein, 9 aa, Homo Sapiens
QGQWAGGMQ

SEQ ID NO: 86756 - protein, 9 aa, Homo Sapiens
TDVYIKDLS

SEQ ID NO: 86757 - protein, 9 aa, Homo Sapiens
PTRTAAVSL

SEQ ID NO: 86758 - protein, 9 aa, Homo Sapiens
MCGCYCASP

SEQ ID NO: 86759 - protein, 9 aa, Homo Sapiens
MQRKKESCV

SEQ ID NO: 86760 - protein, 9 aa, Homo Sapiens
RPRRVGSGT

SEQ ID NO: 86761 - protein, 9 aa, Homo Sapiens
RPLSSYVLV

SEQ ID NO: 86762 - protein, 9 aa, Homo Sapiens
RASTRPPRG

SEQ ID NO: 86763 - protein, 9 aa, Homo Sapiens
NLSGKNYII

SEQ ID NO: 86764 - protein, 9 aa, Homo Sapiens
RWSRPTCRC

SEQ ID NO: 86765 - protein, 9 aa, Homo Sapiens
LPQGGPSSG

SEQ ID NO: 86766 - protein, 9 aa, Homo Sapiens
GSGTARSRA

SEQ ID NO: 86767 - protein, 9 aa, Homo Sapiens
VNLPQGGPS

SEQ ID NO: 86768 - protein, 9 aa, Homo Sapiens
SPTSPGRAT

SEQ ID NO: 86769 - protein, 9 aa, Homo Sapiens
RRARWSRPT

SEQ ID NO: 86770 - protein, 9 aa, Homo Sapiens
SDSSSTSSS

SEQ ID NO: 86771 - protein, 9 aa, Homo Sapiens
TFAALCYML

SEQ ID NO: 86772 - protein, 9 aa, Homo Sapiens
INSHSLKKD

SEQ ID NO: 86773 - protein, 9 aa, Homo Sapiens
AYFHAGVSP

SEQ ID NO: 86774 - protein, 9 aa, Homo Sapiens
RPTCRCAAP

SEQ ID NO: 86775 - protein, 9 aa, Homo Sapiens
LVHAESGKV

SEQ ID NO: 86776 - protein, 9 aa, Homo Sapiens
RAKIRTVEM

SEQ ID NO: 86777 - protein, 9 aa, Homo Sapiens
PRRTGRRAR

SEQ ID NO: 86778 - protein, 9 aa, Homo Sapiens
VPVPAPAPA

SEQ ID NO: 86779 - protein, 9 aa, Homo Sapiens
MCREPTCTP

SEQ ID NO: 86780 - protein, 9 aa, Homo Sapiens
RDSAAEEKA

SEQ ID NO: 86781 - protein, 9 aa, Homo Sapiens
GPEKRLRRV

SEQ ID NO: 86782 - protein, 9 aa, Homo Sapiens
APTRPRRVG

SEQ ID NO: 86783 - protein, 9 aa, Homo Sapiens
KESCVTEFI

SEQ ID NO: 86784 - protein, 9 aa, Homo Sapiens
AAAKSCPST

SEQ ID NO: 86785 - protein, 9 aa, Homo Sapiens
AKSCPSTRL

SEQ ID NO: 86786 - protein, 9 aa, Homo Sapiens
YFHAGVSPV

SEQ ID NO: 86787 - protein, 9 aa, Homo Sapiens
RGPTCRRRR

SEQ ID NO: 86788 - protein, 9 aa, Homo Sapiens
FISYEHLKR

SEQ ID NO: 86789 - protein, 9 aa, Homo Sapiens
SNLSGKNYI

SEQ ID NO: 86790 - protein, 9 aa, Homo Sapiens
VVCQRRDSA

SEQ ID NO: 86791 - protein, 9 aa, Homo Sapiens
CREPTCTPC

SEQ ID NO: 86792 - protein, 9 aa, Homo Sapiens
NLPQGGPSS

SEQ ID NO: 86793 - protein, 9 aa, Homo Sapiens
RPPRGPTCR

SEQ ID NO: 86794 - protein, 9 aa, Homo Sapiens
TPTRRPRRT

SEQ ID NO: 86795 - protein, 9 aa, Homo Sapiens
RIRVKLPKE

SEQ ID NO: 86796 - protein, 9 aa, Homo Sapiens
SQTPTMCKH

SEQ ID NO: 86797 - protein, 9 aa, Homo Sapiens
QKTMEKPHG

SEQ ID NO: 86798 - protein, 9 aa, Homo Sapiens
LPVGVILTT

SEQ ID NO: 86799 - protein, 9 aa, Homo Sapiens
LTPVPRRRR

SEQ ID NO: 86800 - protein, 9 aa, Homo Sapiens
VFPQKYQRG

SEQ ID NO: 86801 - protein, 9 aa, Homo Sapiens
VISSELLRP

SEQ ID NO: 86802 - protein, 9 aa, Homo Sapiens
TVEMTFVIV

SEQ ID NO: 86803 - protein, 9 aa, Homo Sapiens
LRRRSVWPA

SEQ ID NO: 86804 - protein, 9 aa, Homo Sapiens
REPTCTPCA

SEQ ID NO: 86805 - protein, 9 aa, Homo Sapiens
MAFTFAALC

SEQ ID NO: 86806 - protein, 9 aa, Homo Sapiens
VILTTGQDS

SEQ ID NO: 86807 - protein, 9 aa, Homo Sapiens
LGDRSYSDS

SEQ ID NO: 86808 - protein, 9 aa, Homo Sapiens
SDQKTMEKP

SEQ ID NO: 86809 - protein, 9 aa, Homo Sapiens
IRTVEMTFV

SEQ ID NO: 86810 - protein, 9 aa, Homo Sapiens
LLTHVIHQD

SEQ ID NO: 86811 - protein, 9 aa, Homo Sapiens
MCKHPLMCR

SEQ ID NO: 86812 - protein, 9 aa, Homo Sapiens
WPAQPMPLR

SEQ ID NO: 86813 - protein, 9 aa, Homo Sapiens
FAALCYMLA

SEQ ID NO: 86814 - protein, 9 aa, Homo Sapiens
WLEKIKREG

SEQ ID NO: 86815 - protein, 9 aa, Homo Sapiens
ASAWAACTG

SEQ ID NO: 86816 - protein, 9 aa, Homo Sapiens
NITEIAELT

SEQ ID NO: 86817 - protein, 9 aa, Homo Sapiens
GLAFFRELI

SEQ ID NO: 86818 - protein, 9 aa, Homo Sapiens
LRQFVILQK

SEQ ID NO: 86819 - protein, 9 aa, Homo Sapiens
IRVKLPKEV

SEQ ID NO: 86820 - protein, 9 aa, Homo Sapiens
SSQSKGNKL

SEQ ID NO: 86821 - protein, 9 aa, Homo Sapiens
RPPTTMCGC

SEQ ID NO: 86822 - protein, 9 aa, Homo Sapiens
LDQKRGVFP

SEQ ID NO: 86823 - protein, 9 aa, Homo Sapiens
QSKGNKLYL

SEQ ID NO: 86824 - protein, 9 aa, Homo Sapiens
AAKSCPSTR

SEQ ID NO: 86825 - protein, 9 aa, Homo Sapiens
TAAVSLTWS

SEQ ID NO: 86826 - protein, 9 aa, Homo Sapiens
MVPLGDINS

SEQ ID NO: 86827 - protein, 9 aa, Homo Sapiens
CVTEFISRE

SEQ ID NO: 86828 - protein, 9 aa, Homo Sapiens
ACTGPTRTA

SEQ ID NO: 86829 - protein, 9 aa, Homo Sapiens
AWTAATRTV

SEQ ID NO: 86830 - protein, 9 aa, Homo Sapiens
CKHPLMCRE

SEQ ID NO: 86831 - protein, 9 aa, Homo Sapiens
QKRGVFPQK

SEQ ID NO: 86832 - protein, 9 aa, Homo Sapiens
SALSKPVIS

SEQ ID NO: 86833 - protein, 9 aa, Homo Sapiens
GTVFISYEH

SEQ ID NO: 86834 - protein, 9 aa, Homo Sapiens
ARWSRPTCR

SEQ ID NO: 86835 - protein, 9 aa, Homo Sapiens
ASAGVISPT

SEQ ID NO: 86836 - protein, 9 aa, Homo Sapiens
CKDWSNLSG

SEQ ID NO: 86837 - protein, 9 aa, Homo Sapiens
RLAPSPQHS

SEQ ID NO: 86838 - protein, 9 aa, Homo Sapiens
RRPRRTGRR

SEQ ID NO: 86839 - protein, 9 aa, Homo Sapiens
ASSRPTLTP

SEQ ID NO: 86840 - protein, 9 aa, Homo Sapiens
PLGDINSHS

SEQ ID NO: 86841 - protein, 9 aa, Homo Sapiens
RRRPMAETH

SEQ ID NO: 86842 - protein, 9 aa, Homo Sapiens
KRLRRVAER

SEQ ID NO: 86843 - protein, 9 aa, Homo Sapiens
HQDESDAPW

SEQ ID NO: 86844 - protein, 9 aa, Homo Sapiens
VISPTSPGR

SEQ ID NO: 86845 - protein, 9 aa, Homo Sapiens
VKLPKEVDR

SEQ ID NO: 86846 - protein, 9 aa, Homo Sapiens
QDHAIQDYS

SEQ ID NO: 86847 - protein, 9 aa, Homo Sapiens
CQRRDSAAE

SEQ ID NO: 86848 - protein, 9 aa, Homo Sapiens
LALPGLAFF

SEQ ID NO: 86849 - protein, 9 aa, Homo Sapiens
SAKSHKFII

SEQ ID NO: 86850 - protein, 9 aa, Homo Sapiens
KLRQFVILQ

SEQ ID NO: 86851 - protein, 9 aa, Homo Sapiens
RSVWPAQPM

SEQ ID NO: 86852 - protein, 9 aa, Homo Sapiens
RRPMAETHA

SEQ ID NO: 86853 - protein, 9 aa, Homo Sapiens
LLGSVVLTV

SEQ ID NO: 86854 - protein, 9 aa, Homo Sapiens
QGTVFISYE

SEQ ID NO: 86855 - protein, 9 aa, Homo Sapiens
PVISSELLR

SEQ ID NO: 86856 - protein, 9 aa, Homo Sapiens
PRRRRPMAE

SEQ ID NO: 86857 - protein, 9 aa, Homo Sapiens
RVGSGTARS

SEQ ID NO: 86858 - protein, 9 aa, Homo Sapiens
PMQAAIICP

SEQ ID NO: 86859 - protein, 9 aa, Homo Sapiens
HVIHQDESD

SEQ ID NO: 86860 - protein, 9 aa, Homo Sapiens
LASSLSGNT

SEQ ID NO: 86861 - protein, 9 aa, Homo Sapiens
VLRRRSVWP

SEQ ID NO: 86862 - protein, 9 aa, Homo Sapiens
LPGLAFFRE

SEQ ID NO: 86863 - protein, 9 aa, Homo Sapiens
FVILQKKKD

SEQ ID NO: 86864 - protein, 9 aa, Homo Sapiens
LRASTRPPR

SEQ ID NO: 86865 - protein, 9 aa, Homo Sapiens
PPRGPTCRR

SEQ ID NO: 86866 - protein, 9 aa, Homo Sapiens
PMPLRPPTT

SEQ ID NO: 86867 - protein, 9 aa, Homo Sapiens
SPGRATRST

SEQ ID NO: 86868 - protein, 9 aa, Homo Sapiens
TAATRTVCT

SEQ ID NO: 86869 - protein, 9 aa, Homo Sapiens
AALCYMLAL

SEQ ID NO: 86870 - protein, 9 aa, Homo Sapiens
LTFHAKMSL

SEQ ID NO: 86871 - protein, 9 aa, Homo Sapiens
VEKHIRNRY

SEQ ID NO: 86872 - protein, 9 aa, Homo Sapiens
AETHAWAGT

SEQ ID NO: 86873 - protein, 9 aa, Homo Sapiens
GDINSHSLK

SEQ ID NO: 86874 - protein, 9 aa, Homo Sapiens
GCYCASPSA

SEQ ID NO: 86875 - protein, 9 aa, Homo Sapiens
GNTAIITDH

SEQ ID NO: 86876 - protein, 9 aa, Homo Sapiens
WAACTGPTR

SEQ ID NO: 86877 - protein, 9 aa, Homo Sapiens
TRRPRRTGR

SEQ ID NO: 86878 - protein, 9 aa, Homo Sapiens
EPSAKSHKF

SEQ ID NO: 86879 - protein, 9 aa, Homo Sapiens
LRLAPSPQH

SEQ ID NO: 86880 - protein, 9 aa, Homo Sapiens
DPVNLPQGG

SEQ ID NO: 86881 - protein, 9 aa, Homo Sapiens
KNITEIAEL

SEQ ID NO: 86882 - protein, 9 aa, Homo Sapiens
LRWAGPEKR

SEQ ID NO: 86883 - protein, 9 aa, Homo Sapiens
MPLRPPTTM

SEQ ID NO: 86884 - protein, 9 aa, Homo Sapiens
RNRYTIALD

SEQ ID NO: 86885 - protein, 9 aa, Homo Sapiens
PGLAFFREL

SEQ ID NO: 86886 - protein, 9 aa, Homo Sapiens
AGTRPTPTR

SEQ ID NO: 86887 - protein, 9 aa, Homo Sapiens
RSYSDSSST

SEQ ID NO: 86888 - protein, 9 aa, Homo Sapiens
NLLDSLTFH

SEQ ID NO: 86889 - protein, 9 aa, Homo Sapiens
PPTAWTAAT

SEQ ID NO: 86890 - protein, 9 aa, Homo Sapiens
CAVLRRRSV

SEQ ID NO: 86891 - protein, 9 aa, Homo Sapiens
HAIQDYSKY

SEQ ID NO: 86892 - protein, 9 aa, Homo Sapiens
RSRAASAWA

SEQ ID NO: 86893 - protein, 9 aa, Homo Sapiens
SVVCQRRDS

SEQ ID NO: 86894 - protein, 9 aa, Homo Sapiens
NRYTIALDT

SEQ ID NO: 86895 - protein, 9 aa, Homo Sapiens
RRRPPTAWT

SEQ ID NO: 86896 - protein, 9 aa, Homo Sapiens
TRPRRVGSG

SEQ ID NO: 86897 - protein, 9 aa, Homo Sapiens
ELKENPETD

SEQ ID NO: 86898 - protein, 9 aa, Homo Sapiens
PSTRLRAST

SEQ ID NO: 86899 - protein, 9 aa, Homo Sapiens
VLTVLGIHL

SEQ ID NO: 86900 - protein, 9 aa, Homo Sapiens
NTAIITDHP

SEQ ID NO: 86901 - protein, 9 aa, Homo Sapiens
YVLVHAESG

SEQ ID NO: 86902 - protein, 9 aa, Homo Sapiens
QTPTMCKHP

SEQ ID NO: 86903 - protein, 9 aa, Homo Sapiens
KREGQQLMQ

SEQ ID NO: 86904 - protein, 9 aa, Homo Sapiens
LLDSLTFHA

SEQ ID NO: 86905 - protein, 9 aa, Homo Sapiens
HDPVNLPQG

SEQ ID NO: 86906 - protein, 9 aa, Homo Sapiens
SRPTLTPVP

SEQ ID NO: 86907 - protein, 9 aa, Homo Sapiens
VPRRRRPMA

SEQ ID NO: 86908 - protein, 9 aa, Homo Sapiens
ASTRPPRGP

SEQ ID NO: 86909 - protein, 9 aa, Homo Sapiens
ELTQKIFDL

SEQ ID NO: 86910 - protein, 9 aa, Homo Sapiens
KLYLEGSSD

SEQ ID NO: 86911 - protein, 9 aa, Homo Sapiens
EKIKREGQQ

SEQ ID NO: 86912 - protein, 9 aa, Homo Sapiens
ILQKKKDSR

SEQ ID NO: 86913 - protein, 9 aa, Homo Sapiens
SPQHSPQMM

SEQ ID NO: 86914 - protein, 9 aa, Homo Sapiens
PETDVYIKD

SEQ ID NO: 86915 - protein, 9 aa, Homo Sapiens
FHAKMSLIH

SEQ ID NO: 86916 - protein, 9 aa, Homo Sapiens
QDLLTHVIH

SEQ ID NO: 86917 - protein, 9 aa, Homo Sapiens
RTGRRARWS

SEQ ID NO: 86918 - protein, 9 aa, Homo Sapiens
SVVLTVLGI

SEQ ID NO: 86919 - protein, 9 aa, Homo Sapiens
PPTTMCGCY

SEQ ID NO: 86920 - protein, 9 aa, Homo Sapiens
QRKKESCVT

SEQ ID NO: 86921 - protein, 9 aa, Homo Sapiens
PEEFLDQKR

SEQ ID NO: 86922 - protein, 9 aa, Homo Sapiens
LSKPVISSE

SEQ ID NO: 86923 - protein, 9 aa, Homo Sapiens
RWAGPEKRL

SEQ ID NO: 86924 - protein, 9 aa, Homo Sapiens
PTRPRRVGS

SEQ ID NO: 86925 - protein, 9 aa, Homo Sapiens
QPMQAAIIC

SEQ ID NO: 86926 - protein, 9 aa, Homo Sapiens
CEPILEFNR

SEQ ID NO: 86927 - protein, 9 aa, Homo Sapiens
ELQMALTSP

SEQ ID NO: 86928 - protein, 9 aa, Homo Sapiens
PCAVLRRRS

SEQ ID NO: 86929 - protein, 9 aa, Homo Sapiens
PLRPPTTMC

SEQ ID NO: 86930 - protein, 9 aa, Homo Sapiens
EKCDEIPDC

SEQ ID NO: 86931 - protein, 9 aa, Homo Sapiens
TLSDQKTME

SEQ ID NO: 86932 - protein, 9 aa, Homo Sapiens
AGVSPVWAH

SEQ ID NO: 86933 - protein, 9 aa, Homo Sapiens
TPVPRRRRP

SEQ ID NO: 86934 - protein, 9 aa, Homo Sapiens
ALSKPVISS

SEQ ID NO: 86935 - protein, 9 aa, Homo Sapiens
WAGPEKRLR

SEQ ID NO: 86936 - protein, 9 aa, Homo Sapiens
ASSLSGNTA

SEQ ID NO: 86937 - protein, 9 aa, Homo Sapiens
SGTARSRAA

SEQ ID NO: 86938 - protein, 9 aa, Homo Sapiens
SHKFIIHNA

SEQ ID NO: 86939 - protein, 9 aa, Homo Sapiens
VLVHAESGK

SEQ ID NO: 86940 - protein, 9 aa, Homo Sapiens
SRAKIRTVE

SEQ ID NO: 86941 - protein, 9 aa, Homo Sapiens
LSSYVLVHA

SEQ ID NO: 86942 - protein, 9 aa, Homo Sapiens
HPLMCREPT

SEQ ID NO: 86943 - protein, 9 aa, Homo Sapiens
ILTTGQDSQ

SEQ ID NO: 86944 - protein, 9 aa, Homo Sapiens
IICPHISEA

SEQ ID NO: 86945 - protein, 9 aa, Homo Sapiens
RPPTAWTAA

SEQ ID NO: 86946 - protein, 9 aa, Homo Sapiens
LQLSVLEIV

SEQ ID NO: 86947 - protein, 9 aa, Homo Sapiens
AACTGPTRT

SEQ ID NO: 86948 - protein, 9 aa, Homo Sapiens
GRRARWSRP

SEQ ID NO: 86949 - protein, 9 aa, Homo Sapiens
LAPSPQHSP

SEQ ID NO: 86950 - protein, 9 aa, Homo Sapiens
SHPAWVPVP

SEQ ID NO: 86951 - protein, 9 aa, Homo Sapiens
LAFFRELIS

SEQ ID NO: 86952 - protein, 9 aa, Homo Sapiens
ATLSDQKTM

SEQ ID NO: 86953 - protein, 9 aa, Homo Sapiens
DLLTHVIHQ

SEQ ID NO: 86954 - protein, 9 aa, Homo Sapiens
CAAPTRPRR

SEQ ID NO: 86955 - protein, 9 aa, Homo Sapiens
WTAATRTVC

SEQ ID NO: 86956 - protein, 9 aa, Homo Sapiens
QLSVLEIVH

SEQ ID NO: 86957 - protein, 9 aa, Homo Sapiens
DVYIKDLSS

SEQ ID NO: 86958 - protein, 9 aa, Homo Sapiens
VEMTFVIVT

SEQ ID NO: 86959 - protein, 9 aa, Homo Sapiens
PTCTPCAVL

SEQ ID NO: 86960 - protein, 9 aa, Homo Sapiens
PGRATRSTA

SEQ ID NO: 86961 - protein, 9 aa, Homo Sapiens
VGSGTARSR

SEQ ID NO: 86962 - protein, 9 aa, Homo Sapiens
TRLRASTRP

SEQ ID NO: 86963 - protein, 9 aa, Homo Sapiens
MQAAIICPH

SEQ ID NO: 86964 - protein, 9 aa, Homo Sapiens
NPETDVYIK

SEQ ID NO: 86965 - protein, 9 aa, Homo Sapiens
KHPLMCREP

SEQ ID NO: 86966 - protein, 9 aa, Homo Sapiens
SKPVISSEL

SEQ ID NO: 86967 - protein, 9 aa, Homo Sapiens
RRPPTAWTA

SEQ ID NO: 86968 - protein, 9 aa, Homo Sapiens
KSHKFIIHN

SEQ ID NO: 86969 - protein, 9 aa, Homo Sapiens
RGVFPQKYQ

SEQ ID NO: 86970 - protein, 9 aa, Homo Sapiens
CTAELQMAL

SEQ ID NO: 86971 - protein, 9 aa, Homo Sapiens
VFSALSKPV

SEQ ID NO: 86972 - protein, 9 aa, Homo Sapiens
ELQLSVLEI

SEQ ID NO: 86973 - protein, 9 aa, Homo Sapiens
PTSPGRATR

SEQ ID NO: 86974 - protein, 9 aa, Homo Sapiens
RARWSRPTC

SEQ ID NO: 86975 - protein, 9 aa, Homo Sapiens
EMTFVIVTA

SEQ ID NO: 86976 - protein, 9 aa, Homo Sapiens
KLPKEVDRT

SEQ ID NO: 86977 - protein, 9 aa, Homo Sapiens
LCYMLALLL

SEQ ID NO: 86978 - protein, 9 aa, Homo Sapiens
AIICPHISE

SEQ ID NO: 86979 - protein, 9 aa, Homo Sapiens
APPASSRPT

SEQ ID NO: 86980 - protein, 9 aa, Homo Sapiens
CRRRRRPPT

SEQ ID NO: 86981 - protein, 9 aa, Homo Sapiens
GQWAGGMQH

SEQ ID NO: 86982 - protein, 9 aa, Homo Sapiens
RPMAETHAW

SEQ ID NO: 86983 - protein, 9 aa, Homo Sapiens
NKLYLEGSS

SEQ ID NO: 86984 - protein, 9 aa, Homo Sapiens
ETHAWAGTR

SEQ ID NO: 86985 - protein, 9 aa, Homo Sapiens
KSCPSTRLR

SEQ ID NO: 86986 - protein, 9 aa, Homo Sapiens
TGPTRTAAV

SEQ ID NO: 86987 - protein, 9 aa, Homo Sapiens
DRSYSDSSS

SEQ ID NO: 86988 - protein, 9 aa, Homo Sapiens
RAASAWAAC

SEQ ID NO: 86989 - protein, 9 aa, Homo Sapiens
LSGNTAIIT

SEQ ID NO: 86990 - protein, 9 aa, Homo Sapiens
VWPAQPMPL

SEQ ID NO: 86991 - protein, 9 aa, Homo Sapiens
PSAKSHKFI

SEQ ID NO: 86992 - protein, 9 aa, Homo Sapiens
SAGVISPTS

SEQ ID NO: 86993 - protein, 9 aa, Homo Sapiens
SVLEIVHPG

SEQ ID NO: 86994 - protein, 9 aa, Homo Sapiens
LGDINSHSL

SEQ ID NO: 86995 - protein, 9 aa, Homo Sapiens
DEIPDCEPI

SEQ ID NO: 86996 - protein, 9 aa, Homo Sapiens
LSGKNYIIL

SEQ ID NO: 86997 - protein, 9 aa, Homo Sapiens
VPLGDINSH

SEQ ID NO: 86998 - protein, 9 aa, Homo Sapiens
LYLEGSSDN

SEQ ID NO: 86999 - protein, 9 aa, Homo Sapiens
WSQTPTMCK

SEQ ID NO: 87000 - protein, 9 aa, Homo Sapiens
HAWAGTRPT

SEQ ID NO: 87001 - protein, 9 aa, Homo Sapiens
KPVISSELL

SEQ ID NO: 87002 - protein, 9 aa, Homo Sapiens
ESCVTEFIS

SEQ ID NO: 87003 - protein, 9 aa, Homo Sapiens
SCPSTRLRA

SEQ ID NO: 87004 - protein, 9 aa, Homo Sapiens
VILQKKKDS

SEQ ID NO: 87005 - protein, 9 aa, Homo Sapiens
PAWVPVPAP

SEQ ID NO: 87006 - protein, 9 aa, Homo Sapiens
TMCGCYCAS

SEQ ID NO: 87007 - protein, 9 aa, Homo Sapiens
SRELQLSVL

SEQ ID NO: 87008 - protein, 9 aa, Homo Sapiens
DSLTFHAKM

SEQ ID NO: 87009 - protein, 9 aa, Homo Sapiens
DSAAEEKAL

SEQ ID NO: 87010 - protein, 9 aa, Homo Sapiens
PQHSPQMME

SEQ ID NO: 87011 - protein, 9 aa, Homo Sapiens
SGNTAIITD

SEQ ID NO: 87012 - protein, 9 aa, Homo Sapiens
EIAELTQKI

SEQ ID NO: 87013 - protein, 9 aa, Homo Sapiens
AGVISPTSP

SEQ ID NO: 87014 - protein, 9 aa, Homo Sapiens
CTGPTRTAA

SEQ ID NO: 87015 - protein, 9 aa, Homo Sapiens
AAVSLTWSQ

SEQ ID NO: 87016 - protein, 9 aa, Homo Sapiens
IHQDESDAP

SEQ ID NO: 87017 - protein, 9 aa, Homo Sapiens
LDSLTFHAK

SEQ ID NO: 87018 - protein, 9 aa, Homo Sapiens
AHDPVNLPQ

SEQ ID NO: 87019 - protein, 9 aa, Homo Sapiens
GVSPVWAHK

SEQ ID NO: 87020 - protein, 9 aa, Homo Sapiens
RPTPTRRPR

SEQ ID NO: 87021 - protein, 9 aa, Homo Sapiens
QWAGGMQHG

SEQ ID NO: 87022 - protein, 9 aa, Homo Sapiens
CGCYCASPS

SEQ ID NO: 87023 - protein, 9 aa, Homo Sapiens
CRCAAPTRP

SEQ ID NO: 87024 - protein, 9 aa, Homo Sapiens
CPSTRLRAS

SEQ ID NO: 87025 - protein, 9 aa, Homo Sapiens
MAETHAWAG

SEQ ID NO: 87026 - protein, 9 aa, Homo Sapiens
GGAYFHAGV

SEQ ID NO: 87027 - protein, 9 aa, Homo Sapiens
AVLRRRSVW

SEQ ID NO: 87028 - protein, 9 aa, Homo Sapiens
GRATRSTAA

SEQ ID NO: 87029 - protein, 9 aa, Homo Sapiens
EKHIRNRYT

SEQ ID NO: 87030 - protein, 9 aa, Homo Sapiens
STAAAKSCP

SEQ ID NO: 87031 - protein, 9 aa, Homo Sapiens
KEWLEKIKR

SEQ ID NO: 87032 - protein, 9 aa, Homo Sapiens
GLPVGVILT

SEQ ID NO: 87033 - protein, 9 aa, Homo Sapiens
TTMCGCYCA

SEQ ID NO: 87034 - protein, 9 aa, Homo Sapiens
QKMVPLGDI

SEQ ID NO: 87035 - protein, 9 aa, Homo Sapiens
PTRRPRRTG

SEQ ID NO: 87036 - protein, 9 aa, Homo Sapiens
WSRPTCRCA

SEQ ID NO: 87037 - protein, 9 aa, Homo Sapiens
RPRRTGRRA

SEQ ID NO: 87038 - protein, 9 aa, Homo Sapiens
TSPGRATRS

SEQ ID NO: 87039 - protein, 9 aa, Homo Sapiens
THAWAGTRP

SEQ ID NO: 87040 - protein, 9 aa, Homo Sapiens
AELQMALTS

SEQ ID NO: 87041 - protein, 9 aa, Homo Sapiens
GVFPQKYQR

SEQ ID NO: 87042 - protein, 9 aa, Homo Sapiens
GDRSYSDSS

SEQ ID NO: 87043 - protein, 9 aa, Homo Sapiens
GTARSRAAS

SEQ ID NO: 87044 - protein, 9 aa, Homo Sapiens
KRGVFPQKY

SEQ ID NO: 87045 - protein, 9 aa, Homo Sapiens
TKNITEIAE

SEQ ID NO: 87046 - protein, 9 aa, Homo Sapiens
DCEPILEFN

SEQ ID NO: 87047 - protein, 9 aa, Homo Sapiens
PASSRPTLT

SEQ ID NO: 87048 - protein, 9 aa, Homo Sapiens
CTPCAVLRR

SEQ ID NO: 87049 - protein, 9 aa, Homo Sapiens
RRRSVWPAQ

SEQ ID NO: 87050 - protein, 9 aa, Homo Sapiens
CLATLSDQK

SEQ ID NO: 87051 - protein, 9 aa, Homo Sapiens
RSTAAAKSC

SEQ ID NO: 87052 - protein, 9 aa, Homo Sapiens
YSDSSSTSS

SEQ ID NO: 87053 - protein, 9 aa, Homo Sapiens
LPEEFLDQK

SEQ ID NO: 87054 - protein, 9 aa, Homo Sapiens
QHSPQMMED

SEQ ID NO: 87055 - protein, 9 aa, Homo Sapiens
PQGGPSSGK

SEQ ID NO: 87056 - protein, 9 aa, Homo Sapiens
RLRASTRPP

SEQ ID NO: 87057 - protein, 9 aa, Homo Sapiens
VIHQDESDA

SEQ ID NO: 87058 - protein, 9 aa, Homo Sapiens
PSPQHSPQM

SEQ ID NO: 87059 - protein, 9 aa, Homo Sapiens
RAPPASSRP

SEQ ID NO: 87060 - protein, 9 aa, Homo Sapiens
RCAAPTRPR

SEQ ID NO: 87061 - protein, 9 aa, Homo Sapiens
HGLPVGVIL

SEQ ID NO: 87062 - protein, 9 aa, Homo Sapiens
EEFLDQKRG

SEQ ID NO: 87063 - protein, 9 aa, Homo Sapiens
EIPDCEPIL

SEQ ID NO: 87064 - protein, 9 aa, Homo Sapiens
RYTIALDTQ

SEQ ID NO: 87065 - protein, 9 aa, Homo Sapiens
TWSQTPTMC

SEQ ID NO: 87066 - protein, 9 aa, Homo Sapiens
TCRCAAPTR

SEQ ID NO: 87067 - protein, 9 aa, Homo Sapiens
DWSNLSGKN

SEQ ID NO: 87068 - protein, 9 aa, Homo Sapiens
PLASSLSGN

SEQ ID NO: 87069 - protein, 9 aa, Homo Sapiens
LICTAELQM

SEQ ID NO: 87070 - protein, 9 aa, Homo Sapiens
TAELQMALT

SEQ ID NO: 87071 - protein, 9 aa, Homo Sapiens
RRRRRPPTA

SEQ ID NO: 87072 - protein, 9 aa, Homo Sapiens
SSRPTLTPV

SEQ ID NO: 87073 - protein, 9 aa, Homo Sapiens
GSVVLTVLG

SEQ ID NO: 87074 - protein, 9 aa, Homo Sapiens
TRTAAVSLT

SEQ ID NO: 87075 - protein, 9 aa, Homo Sapiens
ALCYMLALL

SEQ ID NO: 87076 - protein, 9 aa, Homo Sapiens
SGKNYIILN

SEQ ID NO: 87077 - protein, 9 aa, Homo Sapiens
LRPPTTMCG

SEQ ID NO: 87078 - protein, 9 aa, Homo Sapiens
REIQDHAIQ

SEQ ID NO: 87079 - protein, 9 aa, Homo Sapiens
RATRSTAAA

SEQ ID NO: 87080 - protein, 9 aa, Homo Sapiens
PVGVILTTG

SEQ ID NO: 87081 - protein, 9 aa, Homo Sapiens
RSVVCQRRD

SEQ ID NO: 87082 - protein, 9 aa, Homo Sapiens
SLTWSQTPT

SEQ ID NO: 87083 - protein, 9 aa, Homo Sapiens
AVASAGVIS

SEQ ID NO: 87084 - protein, 9 aa, Homo Sapiens
KEVDRTRLE

SEQ ID NO: 87085 - protein, 9 aa, Homo Sapiens
SYVLVHAES

SEQ ID NO: 87086 - protein, 9 aa, Homo Sapiens
PDCEPILEF

SEQ ID NO: 87087 - protein, 9 aa, Homo Sapiens
AKSHKFIIH

SEQ ID NO: 87088 - protein, 9 aa, Homo Sapiens
FSALSKPVI

SEQ ID NO: 87089 - protein, 9 aa, Homo Sapiens
GNKLYLEGS

SEQ ID NO: 87090 - protein, 9 aa, Homo Sapiens
SRPTCRCAA

SEQ ID NO: 87091 - protein, 9 aa, Homo Sapiens
RRDSAAEEK

SEQ ID NO: 87092 - protein, 9 aa, Homo Sapiens
PTAWTAATR

SEQ ID NO: 87093 - protein, 9 aa, Homo Sapiens
QCLATLSDQ

SEQ ID NO: 87094 - protein, 9 aa, Homo Sapiens
SKGNKLYLE

SEQ ID NO: 87095 - protein, 9 aa, Homo Sapiens
WAGTRPTPT

SEQ ID NO: 87096 - protein, 9 aa, Homo Sapiens
ICPHISEAE

SEQ ID NO: 87097 - protein, 9 aa, Homo Sapiens
WSNLSGKNY

SEQ ID NO: 87098 - protein, 9 aa, Homo Sapiens
KIRTVEMTF

SEQ ID NO: 87099 - protein, 9 aa, Homo Sapiens
PRRVGSGTA

SEQ ID NO: 87100 - protein, 9 aa, Homo Sapiens
LLLGSVVLT

SEQ ID NO: 87101 - protein, 9 aa, Homo Sapiens
LEKIKREGQ

SEQ ID NO: 87102 - protein, 9 aa, Homo Sapiens
GLALPGLAF

SEQ ID NO: 87103 - protein, 9 aa, Homo Sapiens
LQKKKDSRS

SEQ ID NO: 87104 - protein, 9 aa, Homo Sapiens
LKENPETDV

SEQ ID NO: 87105 - protein, 9 aa, Homo Sapiens
QFVILQKKK

SEQ ID NO: 87106 - protein, 9 aa, Homo Sapiens
PVPRRRRPM

SEQ ID NO: 87107 - protein, 9 aa, Homo Sapiens
AWAACTGPT

SEQ ID NO: 87108 - protein, 9 aa, Homo Sapiens
RRRRPMAET

SEQ ID NO: 87109 - protein, 9 aa, Homo Sapiens
AWAGTRPTP

SEQ ID NO: 87110 - protein, 9 aa, Homo Sapiens
GTRPTPTRR

SEQ ID NO: 87111 - protein, 9 aa, Homo Sapiens
TRSTAAAKS

SEQ ID NO: 87112 - protein, 9 aa, Homo Sapiens
FPQKYQRGN

SEQ ID NO: 87113 - protein, 9 aa, Homo Sapiens
NQPMQAAII

SEQ ID NO: 87114 - protein, 9 aa, Homo Sapiens
VFISYEHLK

SEQ ID NO: 87115 - protein, 9 aa, Homo Sapiens
SLSGNTAII

SEQ ID NO: 87116 - protein, 9 aa, Homo Sapiens
ITEIAELTQ

SEQ ID NO: 87117 - protein, 9 aa, Homo Sapiens
KEPSAKSHK

SEQ ID NO: 87118 - protein, 9 aa, Homo Sapiens
DHAIQDYSK

SEQ ID NO: 87119 - protein, 9 aa, Homo Sapiens
LLRLAPSPQ

SEQ ID NO: 87120 - protein, 9 aa, Homo Sapiens
QGGPSSGKV

SEQ ID NO: 87121 - protein, 9 aa, Homo Sapiens
AGPEKRLRR

SEQ ID NO: 87122 - protein, 9 aa, Homo Sapiens
DQKRGVFPQ

SEQ ID NO: 87123 - protein, 9 aa, Homo Sapiens
MQHGYGVRQ

SEQ ID NO: 87124 - protein, 9 aa, Homo Sapiens
PAQPMPLRP

SEQ ID NO: 87125 - protein, 9 aa, Homo Sapiens
EKRLRRVAE

SEQ ID NO: 87126 - protein, 9 aa, Homo Sapiens
SYSDSSSTS

SEQ ID NO: 87127 - protein, 9 aa, Homo Sapiens
HPAWVPVPA

SEQ ID NO: 87128 - protein, 9 aa, Homo Sapiens
RRTGRRARW

SEQ ID NO: 87129 - protein, 9 aa, Homo Sapiens
MNLLDSLTF

SEQ ID NO: 87130 - protein, 9 aa, Homo Sapiens
LPKEVDRTR

SEQ ID NO: 87131 - protein, 9 aa, Homo Sapiens
VLLLGSVVL

SEQ ID NO: 87132 - protein, 9 aa, Homo Sapiens
VGVILTTGQ

SEQ ID NO: 87133 - protein, 9 aa, Homo Sapiens
SSYVLVHAE

SEQ ID NO: 87134 - protein, 9 aa, Homo Sapiens
AATRTVCTA

SEQ ID NO: 87135 - protein, 9 aa, Homo Sapiens
AIQDYSKYP

SEQ ID NO: 87136 - protein, 9 aa, Homo Sapiens
HIRNRYTIA

SEQ ID NO: 87137 - protein, 9 aa, Homo Sapiens
RVKLPKEVD

SEQ ID NO: 87138 - protein, 9 aa, Homo Sapiens
LGSVVLTVL

SEQ ID NO: 87139 - protein, 9 aa, Homo Sapiens
VLEMPSGTR

SEQ ID NO: 87140 - protein, 9 aa, Homo Sapiens
NLKRLWVLP

SEQ ID NO: 87141 - protein, 9 aa, Homo Sapiens
YIINKCGLE

SEQ ID NO: 87142 - protein, 9 aa, Homo Sapiens
PPSSLSRGL

SEQ ID NO: 87143 - protein, 9 aa, Homo Sapiens
LDLCEDEHV

SEQ ID NO: 87144 - protein, 9 aa, Homo Sapiens
ARAFVVVAS

SEQ ID NO: 87145 - protein, 9 aa, Homo Sapiens
VFHRAVCCV

SEQ ID NO: 87146 - protein, 9 aa, Homo Sapiens
DPQLTEKLR

SEQ ID NO: 87147 - protein, 9 aa, Homo Sapiens
PVPTIRPLS

SEQ ID NO: 87148 - protein, 9 aa, Homo Sapiens
DDEDEMHPN

SEQ ID NO: 87149 - protein, 9 aa, Homo Sapiens
HYQCNAGSG

SEQ ID NO: 87150 - protein, 9 aa, Homo Sapiens
WCGEALREK

SEQ ID NO: 87151 - protein, 9 aa, Homo Sapiens
LEVEDKAIV

SEQ ID NO: 87152 - protein, 9 aa, Homo Sapiens
HICDPNCSI

SEQ ID NO: 87153 - protein, 9 aa, Homo Sapiens
HISTPNKYK

SEQ ID NO: 87154 - protein, 9 aa, Homo Sapiens
LWVLPANKQ

SEQ ID NO: 87155 - protein, 9 aa, Homo Sapiens
AKVQRVKQE

SEQ ID NO: 87156 - protein, 9 aa, Homo Sapiens
DRCFRLKRR

SEQ ID NO: 87157 - protein, 9 aa, Homo Sapiens
GNNNMTTEN

SEQ ID NO: 87158 - protein, 9 aa, Homo Sapiens
LVVCEVDPQ

SEQ ID NO: 87159 - protein, 9 aa, Homo Sapiens
STPNKYKFQ

SEQ ID NO: 87160 - protein, 9 aa, Homo Sapiens
TAQTILKKE

SEQ ID NO: 87161 - protein, 9 aa, Homo Sapiens
ITFCAQGEQ

SEQ ID NO: 87162 - protein, 9 aa, Homo Sapiens
GERTLMGIV

SEQ ID NO: 87163 - protein, 9 aa, Homo Sapiens
GGYQPQGPP

SEQ ID NO: 87164 - protein, 9 aa, Homo Sapiens
GTRKTVSLL

SEQ ID NO: 87165 - protein, 9 aa, Homo Sapiens
SQKDAKQII

SEQ ID NO: 87166 - protein, 9 aa, Homo Sapiens
KARREHSRE

SEQ ID NO: 87167 - protein, 9 aa, Homo Sapiens
CELRNKLQP

SEQ ID NO: 87168 - protein, 9 aa, Homo Sapiens
VSITYFNEW

SEQ ID NO: 87169 - protein, 9 aa, Homo Sapiens
TEWKIEGWL

SEQ ID NO: 87170 - protein, 9 aa, Homo Sapiens
TEKAISVHS

SEQ ID NO: 87171 - protein, 9 aa, Homo Sapiens
QRVKQEKGI

SEQ ID NO: 87172 - protein, 9 aa, Homo Sapiens
SDDEDEMHP

SEQ ID NO: 87173 - protein, 9 aa, Homo Sapiens
KNYIINKCG

SEQ ID NO: 87174 - protein, 9 aa, Homo Sapiens
KLASFLKHF

SEQ ID NO: 87175 - protein, 9 aa, Homo Sapiens
NTTARAFVV

SEQ ID NO: 87176 - protein, 9 aa, Homo Sapiens
STSTPRGAE

SEQ ID NO: 87177 - protein, 9 aa, Homo Sapiens
PTIRPLSRT

SEQ ID NO: 87178 - protein, 9 aa, Homo Sapiens
FIKDCDLKN

SEQ ID NO: 87179 - protein, 9 aa, Homo Sapiens
LPFHRKNNP

SEQ ID NO: 87180 - protein, 9 aa, Homo Sapiens
IRGRACFCA

SEQ ID NO: 87181 - protein, 9 aa, Homo Sapiens
ETEAAKVQR

SEQ ID NO: 87182 - protein, 9 aa, Homo Sapiens
HRKENAGAT

SEQ ID NO: 87183 - protein, 9 aa, Homo Sapiens
NESKARREH

SEQ ID NO: 87184 - protein, 9 aa, Homo Sapiens
SISLLNHIC

SEQ ID NO: 87185 - protein, 9 aa, Homo Sapiens
LKRLWVLPA

SEQ ID NO: 87186 - protein, 9 aa, Homo Sapiens
APQENLQVL

SEQ ID NO: 87187 - protein, 9 aa, Homo Sapiens
DLCEDEHVS

SEQ ID NO: 87188 - protein, 9 aa, Homo Sapiens
HIQASVYPP

SEQ ID NO: 87189 - protein, 9 aa, Homo Sapiens
FVTTQAPSI

SEQ ID NO: 87190 - protein, 9 aa, Homo Sapiens
VLGLGVFHR

SEQ ID NO: 87191 - protein, 9 aa, Homo Sapiens
QGPPPQGGY

SEQ ID NO: 87192 - protein, 9 aa, Homo Sapiens
VVVASALGI

SEQ ID NO: 87193 - protein, 9 aa, Homo Sapiens
YMHWQGELI

SEQ ID NO: 87194 - protein, 9 aa, Homo Sapiens
NAGSGSDSE

SEQ ID NO: 87195 - protein, 9 aa, Homo Sapiens
ITYFNEWHE

SEQ ID NO: 87196 - protein, 9 aa, Homo Sapiens
SPAGSLPSA

SEQ ID NO: 87197 - protein, 9 aa, Homo Sapiens
TPNKYKFQY

SEQ ID NO: 87198 - protein, 9 aa, Homo Sapiens
FYSCDPDGL

SEQ ID NO: 87199 - protein, 9 aa, Homo Sapiens
SAEPSAAEG

SEQ ID NO: 87200 - protein, 9 aa, Homo Sapiens
EGWLPVARS

SEQ ID NO: 87201 - protein, 9 aa, Homo Sapiens
QCNAGSGSD

SEQ ID NO: 87202 - protein, 9 aa, Homo Sapiens
TQCRDKKHQ

SEQ ID NO: 87203 - protein, 9 aa, Homo Sapiens
GPPPSSLSR

SEQ ID NO: 87204 - protein, 9 aa, Homo Sapiens
IKDCDLKNK

SEQ ID NO: 87205 - protein, 9 aa, Homo Sapiens
RTLMGIVID

SEQ ID NO: 87206 - protein, 9 aa, Homo Sapiens
TRRTDICLP

SEQ ID NO: 87207 - protein, 9 aa, Homo Sapiens
YHNHIQASV

SEQ ID NO: 87208 - protein, 9 aa, Homo Sapiens
ICLICGDCM

SEQ ID NO: 87209 - protein, 9 aa, Homo Sapiens
RMKVHLTQH

SEQ ID NO: 87210 - protein, 9 aa, Homo Sapiens
QGPPPSSLS

SEQ ID NO: 87211 - protein, 9 aa, Homo Sapiens
VEDKAIVIH

SEQ ID NO: 87212 - protein, 9 aa, Homo Sapiens
TILKKEAED

SEQ ID NO: 87213 - protein, 9 aa, Homo Sapiens
CEDEHVSIR

SEQ ID NO: 87214 - protein, 9 aa, Homo Sapiens
RLKRRMKVH

SEQ ID NO: 87215 - protein, 9 aa, Homo Sapiens
PPEVHLEVE

SEQ ID NO: 87216 - protein, 9 aa, Homo Sapiens
SGTRKTVSL

SEQ ID NO: 87217 - protein, 9 aa, Homo Sapiens
TSELKVIKN

SEQ ID NO: 87218 - protein, 9 aa, Homo Sapiens
VGFVIITFC

SEQ ID NO: 87219 - protein, 9 aa, Homo Sapiens
SKARREHSR

SEQ ID NO: 87220 - protein, 9 aa, Homo Sapiens
EVHLEVEDK

SEQ ID NO: 87221 - protein, 9 aa, Homo Sapiens
SLSRGLSRA

SEQ ID NO: 87222 - protein, 9 aa, Homo Sapiens
PDIRGRACF

SEQ ID NO: 87223 - protein, 9 aa, Homo Sapiens
LKHFDREVE

SEQ ID NO: 87224 - protein, 9 aa, Homo Sapiens
HFDREVEIR

SEQ ID NO: 87225 - protein, 9 aa, Homo Sapiens
ISTPNKYKF

SEQ ID NO: 87226 - protein, 9 aa, Homo Sapiens
ELCEFYSCD

SEQ ID NO: 87227 - protein, 9 aa, Homo Sapiens
HVSIRRQAI

SEQ ID NO: 87228 - protein, 9 aa, Homo Sapiens
KWMITQCRD

SEQ ID NO: 87229 - protein, 9 aa, Homo Sapiens
RKTVSLLAL

SEQ ID NO: 87230 - protein, 9 aa, Homo Sapiens
KYKFQYVQR

SEQ ID NO: 87231 - protein, 9 aa, Homo Sapiens
IINKCGLEF

SEQ ID NO: 87232 - protein, 9 aa, Homo Sapiens
QVGERTLMG

SEQ ID NO: 87233 - protein, 9 aa, Homo Sapiens
LTSELKVIK

SEQ ID NO: 87234 - protein, 9 aa, Homo Sapiens
HPAPQENLQ

SEQ ID NO: 87235 - protein, 9 aa, Homo Sapiens
VHIMDEHWC

SEQ ID NO: 87236 - protein, 9 aa, Homo Sapiens
VIITFCAQG

SEQ ID NO: 87237 - protein, 9 aa, Homo Sapiens
GELIVGGTV

SEQ ID NO: 87238 - protein, 9 aa, Homo Sapiens
TITRRTDIC

SEQ ID NO: 87239 - protein, 9 aa, Homo Sapiens
MPSGTRKTV

SEQ ID NO: 87240 - protein, 9 aa, Homo Sapiens
RACFCALLN

SEQ ID NO: 87241 - protein, 9 aa, Homo Sapiens
DYHNHIQAS

SEQ ID NO: 87242 - protein, 9 aa, Homo Sapiens
GDCMDLEEP

SEQ ID NO: 87243 - protein, 9 aa, Homo Sapiens
GVFHRAVCC

SEQ ID NO: 87244 - protein, 9 aa, Homo Sapiens
ICDPNCSIV

SEQ ID NO: 87245 - protein, 9 aa, Homo Sapiens
TTARAFVVV

SEQ ID NO: 87246 - protein, 9 aa, Homo Sapiens
SQLTSELKV

SEQ ID NO: 87247 - protein, 9 aa, Homo Sapiens
EMPSGTRKT

SEQ ID NO: 87248 - protein, 9 aa, Homo Sapiens
CMDLEEPEK

SEQ ID NO: 87249 - protein, 9 aa, Homo Sapiens
VVGFPFLDN

SEQ ID NO: 87250 - protein, 9 aa, Homo Sapiens
YQCNAGSGS

SEQ ID NO: 87251 - protein, 9 aa, Homo Sapiens
EIVSITYFN

SEQ ID NO: 87252 - protein, 9 aa, Homo Sapiens
LRNKLQPGS

SEQ ID NO: 87253 - protein, 9 aa, Homo Sapiens
MHWQGELIV

SEQ ID NO: 87254 - protein, 9 aa, Homo Sapiens
SRSWIEKPD

SEQ ID NO: 87255 - protein, 9 aa, Homo Sapiens
IITFCAQGE

SEQ ID NO: 87256 - protein, 9 aa, Homo Sapiens
SLLLLNGNN

SEQ ID NO: 87257 - protein, 9 aa, Homo Sapiens
AGSLPSAEP

SEQ ID NO: 87258 - protein, 9 aa, Homo Sapiens
QLDLCEDEH

SEQ ID NO: 87259 - protein, 9 aa, Homo Sapiens
PSAEPSAAE

SEQ ID NO: 87260 - protein, 9 aa, Homo Sapiens
KNNPKQFYK

SEQ ID NO: 87261 - protein, 9 aa, Homo Sapiens
SYLRVSEDD

SEQ ID NO: 87262 - protein, 9 aa, Homo Sapiens
GSLLLLNGN

SEQ ID NO: 87263 - protein, 9 aa, Homo Sapiens
VKNYIINKC

SEQ ID NO: 87264 - protein, 9 aa, Homo Sapiens
CGEALREKL

SEQ ID NO: 87265 - protein, 9 aa, Homo Sapiens
FNTRFTLNS

SEQ ID NO: 87266 - protein, 9 aa, Homo Sapiens
MATSPYGGG

SEQ ID NO: 87267 - protein, 9 aa, Homo Sapiens
ARREHSREL

SEQ ID NO: 87268 - protein, 9 aa, Homo Sapiens
GPTITRRTD

SEQ ID NO: 87269 - protein, 9 aa, Homo Sapiens
AELCEFYSC

SEQ ID NO: 87270 - protein, 9 aa, Homo Sapiens
LDYHNHIQA

SEQ ID NO: 87271 - protein, 9 aa, Homo Sapiens
LGLGVFHRA

SEQ ID NO: 87272 - protein, 9 aa, Homo Sapiens
LLNHICDPN

SEQ ID NO: 87273 - protein, 9 aa, Homo Sapiens
WIEKPDSVC

SEQ ID NO: 87274 - protein, 9 aa, Homo Sapiens
LMGIVIDSG

SEQ ID NO: 87275 - protein, 9 aa, Homo Sapiens
LGVFHRAVC

SEQ ID NO: 87276 - protein, 9 aa, Homo Sapiens
LSGYRMQLG

SEQ ID NO: 87277 - protein, 9 aa, Homo Sapiens
GEQPLSPTM

SEQ ID NO: 87278 - protein, 9 aa, Homo Sapiens
AFVVVASAL

SEQ ID NO: 87279 - protein, 9 aa, Homo Sapiens
FCAQGEQEY

SEQ ID NO: 87280 - protein, 9 aa, Homo Sapiens
AEPSAAEGT

SEQ ID NO: 87281 - protein, 9 aa, Homo Sapiens
LAMKWMITQ

SEQ ID NO: 87282 - protein, 9 aa, Homo Sapiens
HLEVEDKAI

SEQ ID NO: 87283 - protein, 9 aa, Homo Sapiens
LLLLNGNNN

SEQ ID NO: 87284 - protein, 9 aa, Homo Sapiens
TYFNEWHEG

SEQ ID NO: 87285 - protein, 9 aa, Homo Sapiens
SLPSAEPSA

SEQ ID NO: 87286 - protein, 9 aa, Homo Sapiens
DLSTSTPRG

SEQ ID NO: 87287 - protein, 9 aa, Homo Sapiens
NKYKFQYVQ

SEQ ID NO: 87288 - protein, 9 aa, Homo Sapiens
RRRHYQCNA

SEQ ID NO: 87289 - protein, 9 aa, Homo Sapiens
EEVSQKDAK

SEQ ID NO: 87290 - protein, 9 aa, Homo Sapiens
SFLKHFDRE

SEQ ID NO: 87291 - protein, 9 aa, Homo Sapiens
LVVPVPTIR

SEQ ID NO: 87292 - protein, 9 aa, Homo Sapiens
SWIEKPDSV

SEQ ID NO: 87293 - protein, 9 aa, Homo Sapiens
LCEDEHVSI

SEQ ID NO: 87294 - protein, 9 aa, Homo Sapiens
ATEKAISVH

SEQ ID NO: 87295 - protein, 9 aa, Homo Sapiens
VPVPTIRPL

SEQ ID NO: 87296 - protein, 9 aa, Homo Sapiens
QGELIVGGT

SEQ ID NO: 87297 - protein, 9 aa, Homo Sapiens
GLGVFHRAV

SEQ ID NO: 87298 - protein, 9 aa, Homo Sapiens
DCDLKNKPR

SEQ ID NO: 87299 - protein, 9 aa, Homo Sapiens
PSSLSRGLS

SEQ ID NO: 87300 - protein, 9 aa, Homo Sapiens
REHSRELLR

SEQ ID NO: 87301 - protein, 9 aa, Homo Sapiens
PFHRKNNPK

SEQ ID NO: 87302 - protein, 9 aa, Homo Sapiens
CRSRSWIEK

SEQ ID NO: 87303 - protein, 9 aa, Homo Sapiens
PNSEEVSQK

SEQ ID NO: 87304 - protein, 9 aa, Homo Sapiens
PNKYKFQYV

SEQ ID NO: 87305 - protein, 9 aa, Homo Sapiens
TEAAKVQRV

SEQ ID NO: 87306 - protein, 9 aa, Homo Sapiens
AAKVQRVKQ

SEQ ID NO: 87307 - protein, 9 aa, Homo Sapiens
RTAQTILKK

SEQ ID NO: 87308 - protein, 9 aa, Homo Sapiens
RRHYQCNAG

SEQ ID NO: 87309 - protein, 9 aa, Homo Sapiens
RCFRLKRRM

SEQ ID NO: 87310 - protein, 9 aa, Homo Sapiens
YKFQYVQRP

SEQ ID NO: 87311 - protein, 9 aa, Homo Sapiens
ITRRTDICL

SEQ ID NO: 87312 - protein, 9 aa, Homo Sapiens
NAGATEKAI

SEQ ID NO: 87313 - protein, 9 aa, Homo Sapiens
RKLASFLKH

SEQ ID NO: 87314 - protein, 9 aa, Homo Sapiens
PLSPTMATS

SEQ ID NO: 87315 - protein, 9 aa, Homo Sapiens
KVQRVKQEK

SEQ ID NO: 87316 - protein, 9 aa, Homo Sapiens
DEDEMHPNI

SEQ ID NO: 87317 - protein, 9 aa, Homo Sapiens
GSLPSAEPS

SEQ ID NO: 87318 - protein, 9 aa, Homo Sapiens
RRMKVHLTQ

SEQ ID NO: 87319 - protein, 9 aa, Homo Sapiens
YLSGYRMQL

SEQ ID NO: 87320 - protein, 9 aa, Homo Sapiens
RKNNPKQFY

SEQ ID NO: 87321 - protein, 9 aa, Homo Sapiens
HHPAPQENL

SEQ ID NO: 87322 - protein, 9 aa, Homo Sapiens
TFCAQGEQE

SEQ ID NO: 87323 - protein, 9 aa, Homo Sapiens
GFVIITFCA

SEQ ID NO: 87324 - protein, 9 aa, Homo Sapiens
DEMHPNIDT

SEQ ID NO: 87325 - protein, 9 aa, Homo Sapiens
LSPTMATSP

SEQ ID NO: 87326 - protein, 9 aa, Homo Sapiens
SLLNHICDP

SEQ ID NO: 87327 - protein, 9 aa, Homo Sapiens
GHHPAPQEN

SEQ ID NO: 87328 - protein, 9 aa, Homo Sapiens
ARFFNTRFT

SEQ ID NO: 87329 - protein, 9 aa, Homo Sapiens
QKDAKQIIE

SEQ ID NO: 87330 - protein, 9 aa, Homo Sapiens
CATLIAWEL

SEQ ID NO: 87331 - protein, 9 aa, Homo Sapiens
LEMPSGTRK

SEQ ID NO: 87332 - protein, 9 aa, Homo Sapiens
CDPDGLPCN

SEQ ID NO: 87333 - protein, 9 aa, Homo Sapiens
IHGHHPAPQ

SEQ ID NO: 87334 - protein, 9 aa, Homo Sapiens
GIILCELRN

SEQ ID NO: 87335 - protein, 9 aa, Homo Sapiens
DETEAAKVQ

SEQ ID NO: 87336 - protein, 9 aa, Homo Sapiens
DCMDLEEPE

SEQ ID NO: 87337 - protein, 9 aa, Homo Sapiens
KHFDREVEI

SEQ ID NO: 87338 - protein, 9 aa, Homo Sapiens
RREHSRELL

SEQ ID NO: 87339 - protein, 9 aa, Homo Sapiens
WMITQCRDK

SEQ ID NO: 87340 - protein, 9 aa, Homo Sapiens
CDLKNKPRK

SEQ ID NO: 87341 - protein, 9 aa, Homo Sapiens
VCEVDPQLT

SEQ ID NO: 87342 - protein, 9 aa, Homo Sapiens
EDDPTVYPN

SEQ ID NO: 87343 - protein, 9 aa, Homo Sapiens
EVSQKDAKQ

SEQ ID NO: 87344 - protein, 9 aa, Homo Sapiens
RHGPTITRR

SEQ ID NO: 87345 - protein, 9 aa, Homo Sapiens
GYRMQLGSS

SEQ ID NO: 87346 - protein, 9 aa, Homo Sapiens
LKKEAEDVI

SEQ ID NO: 87347 - protein, 9 aa, Homo Sapiens
VGERTLMGI

SEQ ID NO: 87348 - protein, 9 aa, Homo Sapiens
DGIILCELR

SEQ ID NO: 87349 - protein, 9 aa, Homo Sapiens
QGGYQPQGP

SEQ ID NO: 87350 - protein, 9 aa, Homo Sapiens
PEVHLEVED

SEQ ID NO: 87351 - protein, 9 aa, Homo Sapiens
ICGDCMDLE

SEQ ID NO: 87352 - protein, 9 aa, Homo Sapiens
LPSAEPSAA

SEQ ID NO: 87353 - protein, 9 aa, Homo Sapiens
NGNNNMTTE

SEQ ID NO: 87354 - protein, 9 aa, Homo Sapiens
ISLLNHICD

SEQ ID NO: 87355 - protein, 9 aa, Homo Sapiens
FSYLRVSED

SEQ ID NO: 87356 - protein, 9 aa, Homo Sapiens
EKPDSVCSL

SEQ ID NO: 87357 - protein, 9 aa, Homo Sapiens
ASFLKHFDR

SEQ ID NO: 87358 - protein, 9 aa, Homo Sapiens
CLLTTIYMF

SEQ ID NO: 87359 - protein, 9 aa, Homo Sapiens
PQLTEKLRK

SEQ ID NO: 87360 - protein, 9 aa, Homo Sapiens
KENAGATEK

SEQ ID NO: 87361 - protein, 9 aa, Homo Sapiens
RPEIVSITY

SEQ ID NO: 87362 - protein, 9 aa, Homo Sapiens
TIRPLSRTE

SEQ ID NO: 87363 - protein, 9 aa, Homo Sapiens
IMDEHWCGE

SEQ ID NO: 87364 - protein, 9 aa, Homo Sapiens
EDEMHPNID

SEQ ID NO: 87365 - protein, 9 aa, Homo Sapiens
RCRSRSWIE

SEQ ID NO: 87366 - protein, 9 aa, Homo Sapiens
RSRSWIEKP

SEQ ID NO: 87367 - protein, 9 aa, Homo Sapiens
ENAGATEKA

SEQ ID NO: 87368 - protein, 9 aa, Homo Sapiens
TSTPRGAEE

SEQ ID NO: 87369 - protein, 9 aa, Homo Sapiens
GFARFFNTR

SEQ ID NO: 87370 - protein, 9 aa, Homo Sapiens
WTEWKIEGW

SEQ ID NO: 87371 - protein, 9 aa, Homo Sapiens
LDNRYRKIV

SEQ ID NO: 87372 - protein, 9 aa, Homo Sapiens
PAPQENLQV

SEQ ID NO: 87373 - protein, 9 aa, Homo Sapiens
NHIQASVYP

SEQ ID NO: 87374 - protein, 9 aa, Homo Sapiens
GPPEVHLEV

SEQ ID NO: 87375 - protein, 9 aa, Homo Sapiens
HRRPCATLI

SEQ ID NO: 87376 - protein, 9 aa, Homo Sapiens
QLTSELKVI

SEQ ID NO: 87377 - protein, 9 aa, Homo Sapiens
VPTIRPLSR

SEQ ID NO: 87378 - protein, 9 aa, Homo Sapiens
HNHIQASVY

SEQ ID NO: 87379 - protein, 9 aa, Homo Sapiens
YSCDPDGLP

SEQ ID NO: 87380 - protein, 9 aa, Homo Sapiens
TARAFVVVA

SEQ ID NO: 87381 - protein, 9 aa, Homo Sapiens
IYMFLIVPE

SEQ ID NO: 87382 - protein, 9 aa, Homo Sapiens
LLNGNNNMT

SEQ ID NO: 87383 - protein, 9 aa, Homo Sapiens
EDEHVSIRR

SEQ ID NO: 87384 - protein, 9 aa, Homo Sapiens
VSDDEDEMH

SEQ ID NO: 87385 - protein, 9 aa, Homo Sapiens
IEKPDSVCS

SEQ ID NO: 87386 - protein, 9 aa, Homo Sapiens
PAGSLPSAE

SEQ ID NO: 87387 - protein, 9 aa, Homo Sapiens
PPPQGGYQP

SEQ ID NO: 87388 - protein, 9 aa, Homo Sapiens
RHYQCNAGS

SEQ ID NO: 87389 - protein, 9 aa, Homo Sapiens
PPPSSLSRG

SEQ ID NO: 87390 - protein, 9 aa, Homo Sapiens
NKPRKGKNV

SEQ ID NO: 87391 - protein, 9 aa, Homo Sapiens
QTILKKEAE

SEQ ID NO: 87392 - protein, 9 aa, Homo Sapiens
GRACFCALL

SEQ ID NO: 87393 - protein, 9 aa, Homo Sapiens
DIRGRACFC

SEQ ID NO: 87394 - protein, 9 aa, Homo Sapiens
LCELRNKLQ

SEQ ID NO: 87395 - protein, 9 aa, Homo Sapiens
QLGSSTDKK

SEQ ID NO: 87396 - protein, 9 aa, Homo Sapiens
RLWVLPANK

SEQ ID NO: 87397 - protein, 9 aa, Homo Sapiens
LLTTIYMFL

SEQ ID NO: 87398 - protein, 9 aa, Homo Sapiens
RSWIEKPDS

SEQ ID NO: 87399 - protein, 9 aa, Homo Sapiens
TRKTVSLLA

SEQ ID NO: 87400 - protein, 9 aa, Homo Sapiens
RQVGERTLM

SEQ ID NO: 87401 - protein, 9 aa, Homo Sapiens
EVSDDEDEM

SEQ ID NO: 87402 - protein, 9 aa, Homo Sapiens
MITQCRDKK

SEQ ID NO: 87403 - protein, 9 aa, Homo Sapiens
SGYRMQLGS

SEQ ID NO: 87404 - protein, 9 aa, Homo Sapiens
ILCELRNKL

SEQ ID NO: 87405 - protein, 9 aa, Homo Sapiens
SPTMATSPY

SEQ ID NO: 87406 - protein, 9 aa, Homo Sapiens
AICLICGDC

SEQ ID NO: 87407 - protein, 9 aa, Homo Sapiens
HWCGEALRE

SEQ ID NO: 87408 - protein, 9 aa, Homo Sapiens
RPCATLIAW

SEQ ID NO: 87409 - protein, 9 aa, Homo Sapiens
LNGNNNMTT

SEQ ID NO: 87410 - protein, 9 aa, Homo Sapiens
IRPLSRTEP

SEQ ID NO: 87411 - protein, 9 aa, Homo Sapiens
IRHGPTITR

SEQ ID NO: 87412 - protein, 9 aa, Homo Sapiens
NNPKQFYKE

SEQ ID NO: 87413 - protein, 9 aa, Homo Sapiens
MQLGSSTDK

SEQ ID NO: 87414 - protein, 9 aa, Homo Sapiens
RKYMHWQGE

SEQ ID NO: 87415 - protein, 9 aa, Homo Sapiens
HRKNNPKQF

SEQ ID NO: 87416 - protein, 9 aa, Homo Sapiens
ICLLTTIYM

SEQ ID NO: 87417 - protein, 9 aa, Homo Sapiens
WKIEGWLPV

SEQ ID NO: 87418 - protein, 9 aa, Homo Sapiens
DLKNKPRKG

SEQ ID NO: 87419 - protein, 9 aa, Homo Sapiens
INKCGLEFK

SEQ ID NO: 87420 - protein, 9 aa, Homo Sapiens
EMHPNIDTA

SEQ ID NO: 87421 - protein, 9 aa, Homo Sapiens
VSQKDAKQI

SEQ ID NO: 87422 - protein, 9 aa, Homo Sapiens
PEIVSITYF

SEQ ID NO: 87423 - protein, 9 aa, Homo Sapiens
WVLPANKQI

SEQ ID NO: 87424 - protein, 9 aa, Homo Sapiens
VQRVKQEKG

SEQ ID NO: 87425 - protein, 9 aa, Homo Sapiens
YRDGFARFF

SEQ ID NO: 87426 - protein, 9 aa, Homo Sapiens
FVVVASALG

SEQ ID NO: 87427 - protein, 9 aa, Homo Sapiens
FLKHFDREV

SEQ ID NO: 87428 - protein, 9 aa, Homo Sapiens
FRLKRRMKV

SEQ ID NO: 87429 - protein, 9 aa, Homo Sapiens
IVSITYFNE

SEQ ID NO: 87430 - protein, 9 aa, Homo Sapiens
DPNSEEVSQ

SEQ ID NO: 87431 - protein, 9 aa, Homo Sapiens
HGPTITRRT

SEQ ID NO: 87432 - protein, 9 aa, Homo Sapiens
CNAGSGSDS

SEQ ID NO: 87433 - protein, 9 aa, Homo Sapiens
KYMHWQGEL

SEQ ID NO: 87434 - protein, 9 aa, Homo Sapiens
KRRMKVHLT

SEQ ID NO: 87435 - protein, 9 aa, Homo Sapiens
ASTHRRPCA

SEQ ID NO: 87436 - protein, 9 aa, Homo Sapiens
STHRRPCAT

SEQ ID NO: 87437 - protein, 9 aa, Homo Sapiens
HVLGLGVFH

SEQ ID NO: 87438 - protein, 9 aa, Homo Sapiens
PQGGYQPQG

SEQ ID NO: 87439 - protein, 9 aa, Homo Sapiens
KRLWVLPAN

SEQ ID NO: 87440 - protein, 9 aa, Homo Sapiens
YFNEWHEGT

SEQ ID NO: 87441 - protein, 9 aa, Homo Sapiens
EAAKVQRVK

SEQ ID NO: 87442 - protein, 9 aa, Homo Sapiens
NPKQFYKEL

SEQ ID NO: 87443 - protein, 9 aa, Homo Sapiens
KKEAEDVIW

SEQ ID NO: 87444 - protein, 9 aa, Homo Sapiens
YMFLIVPET

SEQ ID NO: 87445 - protein, 9 aa, Homo Sapiens
LNHICDPNC

SEQ ID NO: 87446 - protein, 9 aa, Homo Sapiens
KVIKNAVAG

SEQ ID NO: 87447 - protein, 9 aa, Homo Sapiens
VHLEVEDKA

SEQ ID NO: 87448 - protein, 9 aa, Homo Sapiens
AMKWMITQC

SEQ ID NO: 87449 - protein, 9 aa, Homo Sapiens
QAPSILLFI

SEQ ID NO: 87450 - protein, 9 aa, Homo Sapiens
RFFNTRFTL

SEQ ID NO: 87451 - protein, 9 aa, Homo Sapiens
AQTILKKEA

SEQ ID NO: 87452 - protein, 9 aa, Homo Sapiens
ELKVIKNAV

SEQ ID NO: 87453 - protein, 9 aa, Homo Sapiens
MHPNIDTAS

SEQ ID NO: 87454 - protein, 9 aa, Homo Sapiens
VVCEVDPQL

SEQ ID NO: 87455 - protein, 9 aa, Homo Sapiens
YLRVSEDDP

SEQ ID NO: 87456 - protein, 9 aa, Homo Sapiens
TLMGIVIDS

SEQ ID NO: 87457 - protein, 9 aa, Homo Sapiens
LLDYHNHIQ

SEQ ID NO: 87458 - protein, 9 aa, Homo Sapiens
CGDCMDLEE

SEQ ID NO: 87459 - protein, 9 aa, Homo Sapiens
PSGTRKTVS

SEQ ID NO: 87460 - protein, 9 aa, Homo Sapiens
FVIITFCAQ

SEQ ID NO: 87461 - protein, 9 aa, Homo Sapiens
DNRYRKIVD

SEQ ID NO: 87462 - protein, 9 aa, Homo Sapiens
VVPVPTIRP

SEQ ID NO: 87463 - protein, 9 aa, Homo Sapiens
PRGAEEEPL

SEQ ID NO: 87464 - protein, 9 aa, Homo Sapiens
EQPLSPTMA

SEQ ID NO: 87465 - protein, 9 aa, Homo Sapiens
PSILLFINS

SEQ ID NO: 87466 - protein, 9 aa, Homo Sapiens
KNKPRKGKN

SEQ ID NO: 87467 - protein, 9 aa, Homo Sapiens
MKWMITQCR

SEQ ID NO: 87468 - protein, 9 aa, Homo Sapiens
RVSEDDPTV

SEQ ID NO: 87469 - protein, 9 aa, Homo Sapiens
MDEHWCGEA

SEQ ID NO: 87470 - protein, 9 aa, Homo Sapiens
RDGFARFFN

SEQ ID NO: 87471 - protein, 9 aa, Homo Sapiens
RAFVVVASA

SEQ ID NO: 87472 - protein, 9 aa, Homo Sapiens
MFLIVPETK

SEQ ID NO: 87473 - protein, 9 aa, Homo Sapiens
VSEDDPTVY

SEQ ID NO: 87474 - protein, 9 aa, Homo Sapiens
PSISLLNHI

SEQ ID NO: 87475 - protein, 9 aa, Homo Sapiens
FFSYLRVSE

SEQ ID NO: 87476 - protein, 9 aa, Homo Sapiens
SSLSRGLSR

SEQ ID NO: 87477 - protein, 9 aa, Homo Sapiens
EVDPQLTEK

SEQ ID NO: 87478 - protein, 9 aa, Homo Sapiens
CAQGEQEYQ

SEQ ID NO: 87479 - protein, 9 aa, Homo Sapiens
THRRPCATL

SEQ ID NO: 87480 - protein, 9 aa, Homo Sapiens
FIRHGPTIT

SEQ ID NO: 87481 - protein, 9 aa, Homo Sapiens
QENLQVLAA

SEQ ID NO: 87482 - protein, 9 aa, Homo Sapiens
FARFFNTRF

SEQ ID NO: 87483 - protein, 9 aa, Homo Sapiens
TTIYMFLIV

SEQ ID NO: 87484 - protein, 9 aa, Homo Sapiens
STPRGAEEE

SEQ ID NO: 87485 - protein, 9 aa, Homo Sapiens
QPLSPTMAT

SEQ ID NO: 87486 - protein, 9 aa, Homo Sapiens
RGRACFCAL

SEQ ID NO: 87487 - protein, 9 aa, Homo Sapiens
RRPCATLIA

SEQ ID NO: 87488 - protein, 9 aa, Homo Sapiens
EAVKNYIIN

SEQ ID NO: 87489 - protein, 9 aa, Homo Sapiens
SRKYMHWQG

SEQ ID NO: 87490 - protein, 9 aa, Homo Sapiens
PFLDNRYRK

SEQ ID NO: 87491 - protein, 9 aa, Homo Sapiens
RMQLGSSTD

SEQ ID NO: 87492 - protein, 9 aa, Homo Sapiens
PQENLQVLA

SEQ ID NO: 87493 - protein, 9 aa, Homo Sapiens
LPANKQINS

SEQ ID NO: 87494 - protein, 9 aa, Homo Sapiens
PCATLIAWE

SEQ ID NO: 87495 - protein, 9 aa, Homo Sapiens
AVKNYIINK

SEQ ID NO: 87496 - protein, 9 aa, Homo Sapiens
PTMATSPYG

SEQ ID NO: 87497 - protein, 9 aa, Homo Sapiens
QCRDKKHQR

SEQ ID NO: 87498 - protein, 9 aa, Homo Sapiens
GLVVPVPTI

SEQ ID NO: 87499 - protein, 9 aa, Homo Sapiens
YRMQLGSST

SEQ ID NO: 87500 - protein, 9 aa, Homo Sapiens
YQPQGPPPP

SEQ ID NO: 87501 - protein, 9 aa, Homo Sapiens
QLNESKARR

SEQ ID NO: 87502 - protein, 9 aa, Homo Sapiens
SEDDPTVYP

SEQ ID NO: 87503 - protein, 9 aa, Homo Sapiens
DEHVSIRRQ

SEQ ID NO: 87504 - protein, 9 aa, Homo Sapiens
LKRRMKVHL

SEQ ID NO: 87505 - protein, 9 aa, Homo Sapiens
ELRNKLQPG

SEQ ID NO: 87506 - protein, 9 aa, Homo Sapiens
RQGPPPSSL

SEQ ID NO: 87507 - protein, 9 aa, Homo Sapiens
EHWCGEALR

SEQ ID NO: 87508 - protein, 9 aa, Homo Sapiens
VTTQAPSIL

SEQ ID NO: 87509 - protein, 9 aa, Homo Sapiens
LKVIKNAVA

SEQ ID NO: 87510 - protein, 9 aa, Homo Sapiens
LCEFYSCDP

SEQ ID NO: 87511 - protein, 9 aa, Homo Sapiens
VIKNAVAGV

SEQ ID NO: 87512 - protein, 9 aa, Homo Sapiens
RKENAGATE

SEQ ID NO: 87513 - protein, 9 aa, Homo Sapiens
NHICDPNCS

SEQ ID NO: 87514 - protein, 9 aa, Homo Sapiens
ITQCRDKKH

SEQ ID NO: 87515 - protein, 9 aa, Homo Sapiens
KFQYVQRPL

SEQ ID NO: 87516 - protein, 9 aa, Homo Sapiens
LRVSEDDPT

SEQ ID NO: 87517 - protein, 9 aa, Homo Sapiens
PPDIRGRAC

SEQ ID NO: 87518 - protein, 9 aa, Homo Sapiens
APSILLFIN

SEQ ID NO: 87519 - protein, 9 aa, Homo Sapiens
IYLSGYRMQ

SEQ ID NO: 87520 - protein, 9 aa, Homo Sapiens
GATEKAISV

SEQ ID NO: 87521 - protein, 9 aa, Homo Sapiens
WLPVARSAH

SEQ ID NO: 87522 - protein, 9 aa, Homo Sapiens
RNKLQPGSV

SEQ ID NO: 87523 - protein, 9 aa, Homo Sapiens
GYQPQGPPP

SEQ ID NO: 87524 - protein, 9 aa, Homo Sapiens
LNESKARRE

SEQ ID NO: 87525 - protein, 9 aa, Homo Sapiens
ILLFINSSS

SEQ ID NO: 87526 - protein, 9 aa, Homo Sapiens
EHVSIRRQA

SEQ ID NO: 87527 - protein, 9 aa, Homo Sapiens
NSEEVSQKD

SEQ ID NO: 87528 - protein, 9 aa, Homo Sapiens
CLICGDCMD

SEQ ID NO: 87529 - protein, 9 aa, Homo Sapiens
LLLNGNNNM

SEQ ID NO: 87530 - protein, 9 aa, Homo Sapiens
AGATEKAIS

SEQ ID NO: 87531 - protein, 9 aa, Homo Sapiens
SEEVSQKDA

SEQ ID NO: 87532 - protein, 9 aa, Homo Sapiens
SASTHRRPC

SEQ ID NO: 87533 - protein, 9 aa, Homo Sapiens
PPQGGYQPQ

SEQ ID NO: 87534 - protein, 9 aa, Homo Sapiens
VDPQLTEKL

SEQ ID NO: 87535 - protein, 9 aa, Homo Sapiens
WQGELIVGG

SEQ ID NO: 87536 - protein, 9 aa, Homo Sapiens
HIMDEHWCG

SEQ ID NO: 87537 - protein, 9 aa, Homo Sapiens
HGHHPAPQE

SEQ ID NO: 87538 - protein, 9 aa, Homo Sapiens
FHRKNNPKQ

SEQ ID NO: 87539 - protein, 9 aa, Homo Sapiens
LASFLKHFD

SEQ ID NO: 87540 - protein, 9 aa, Homo Sapiens
MGIVIDSGD

SEQ ID NO: 87541 - protein, 9 aa, Homo Sapiens
IEGWLPVAR

SEQ ID NO: 87542 - protein, 9 aa, Homo Sapiens
IQASVYPPA

SEQ ID NO: 87543 - protein, 9 aa, Homo Sapiens
EWKIEGWLP

SEQ ID NO: 87544 - protein, 9 aa, Homo Sapiens
PKQFYKELA

SEQ ID NO: 87545 - protein, 9 aa, Homo Sapiens
CEVDPQLTE

SEQ ID NO: 87546 - protein, 9 aa, Homo Sapiens
PTITRRTDI

SEQ ID NO: 87547 - protein, 9 aa, Homo Sapiens
YEAVKNYII

SEQ ID NO: 87548 - protein, 9 aa, Homo Sapiens
RNTTARAFV

SEQ ID NO: 87549 - protein, 9 aa, Homo Sapiens
TGSLLLLNG

SEQ ID NO: 87550 - protein, 9 aa, Homo Sapiens
NYIINKCGL

SEQ ID NO: 87551 - protein, 9 aa, Homo Sapiens
NRYRKIVDV

SEQ ID NO: 87552 - protein, 9 aa, Homo Sapiens
TMATSPYGG

SEQ ID NO: 87553 - protein, 9 aa, Homo Sapiens
LSRGLSRAV

SEQ ID NO: 87554 - protein, 9 aa, Homo Sapiens
ILKKEAEDV

SEQ ID NO: 87555 - protein, 9 aa, Homo Sapiens
RGAEEEPLV

SEQ ID NO: 87556 - protein, 9 aa, Homo Sapiens
GFPFLDNRY

SEQ ID NO: 87557 - protein, 9 aa, Homo Sapiens
FHRAVCCVG

SEQ ID NO: 87558 - protein, 9 aa, Homo Sapiens
GPPPQGGYQ

SEQ ID NO: 87559 - protein, 9 aa, Homo Sapiens
EFYSCDPDG

SEQ ID NO: 87560 - protein, 9 aa, Homo Sapiens
DGFARFFNT

SEQ ID NO: 87561 - protein, 9 aa, Homo Sapiens
CFRLKRRMK

SEQ ID NO: 87562 - protein, 9 aa, Homo Sapiens
HRAVCCVGF

SEQ ID NO: 87563 - protein, 9 aa, Homo Sapiens
TPRGAEEEP

SEQ ID NO: 87564 - protein, 9 aa, Homo Sapiens
ESKARREHS

SEQ ID NO: 87565 - protein, 9 aa, Homo Sapiens
VGFPFLDNR

SEQ ID NO: 87566 - protein, 9 aa, Homo Sapiens
DEHWCGEAL

SEQ ID NO: 87567 - protein, 9 aa, Homo Sapiens
GWLPVARSA

SEQ ID NO: 87568 - protein, 9 aa, Homo Sapiens
SRRRHYQCN

SEQ ID NO: 87569 - protein, 9 aa, Homo Sapiens
LICGDCMDL

SEQ ID NO: 87570 - protein, 9 aa, Homo Sapiens
SCDPDGLPC

SEQ ID NO: 87571 - protein, 9 aa, Homo Sapiens
KIEGWLPVA

SEQ ID NO: 87572 - protein, 9 aa, Homo Sapiens
KDCDLKNKP

SEQ ID NO: 87573 - protein, 9 aa, Homo Sapiens
FFNTRFTLN

SEQ ID NO: 87574 - protein, 9 aa, Homo Sapiens
VLPANKQIN

SEQ ID NO: 87575 - protein, 9 aa, Homo Sapiens
HWQGELIVG

SEQ ID NO: 87576 - protein, 9 aa, Homo Sapiens
FPFLDNRYR

SEQ ID NO: 87577 - protein, 9 aa, Homo Sapiens
SELKVIKNA

SEQ ID NO: 87578 - protein, 9 aa, Homo Sapiens
CEFYSCDPD

SEQ ID NO: 87579 - protein, 9 aa, Homo Sapiens
GAEEEPLVP

SEQ ID NO: 87580 - protein, 9 aa, Homo Sapiens
WRTAQTILK

SEQ ID NO: 87581 - protein, 9 aa, Homo Sapiens
QNLKRLWVL

SEQ ID NO: 87582 - protein, 9 aa, Homo Sapiens
IILCELRNK

SEQ ID NO: 87583 - protein, 9 aa, Homo Sapiens
QLTEKLRKF

SEQ ID NO: 87584 - protein, 9 aa, Homo Sapiens
TTQAPSILL

SEQ ID NO: 87585 - protein, 9 aa, Homo Sapiens
LSTSTPRGA

SEQ ID NO: 87586 - protein, 9 aa, Homo Sapiens
ERTLMGIVI

SEQ ID NO: 87587 - protein, 9 aa, Homo Sapiens
TQAPSILLF

SEQ ID NO: 87588 - protein, 9 aa, Homo Sapiens
FLDNRYRKI

SEQ ID NO: 87589 - protein, 9 aa, Homo Sapiens
LKNKPRKGK

SEQ ID NO: 87590 - protein, 9 aa, Homo Sapiens
SILLFINSS

SEQ ID NO: 87591 - protein, 9 aa, Homo Sapiens
LTTIYMFLI

SEQ ID NO: 87592 - protein, 9 aa, Homo Sapiens
TIYMFLIVP

SEQ ID NO: 87593 - protein, 9 aa, Homo Sapiens
EVEDKAIVI

SEQ ID NO: 87594 - protein, 9 aa, Homo Sapiens
SITYFNEWH

SEQ ID NO: 87595 - protein, 9 aa, Homo Sapiens
QASVYPPAA

SEQ ID NO: 87596 - protein, 9 aa, Homo Sapiens
CFHILMIMR

SEQ ID NO: 87597 - protein, 9 aa, Homo Sapiens
PRRDVGAAA

SEQ ID NO: 87598 - protein, 9 aa, Homo Sapiens
ETLRDGSRY

SEQ ID NO: 87599 - protein, 9 aa, Homo Sapiens
MPHADGVAS

SEQ ID NO: 87600 - protein, 9 aa, Homo Sapiens
LSAMNVDKF

SEQ ID NO: 87601 - protein, 9 aa, Homo Sapiens
VRTGCVRSP

SEQ ID NO: 87602 - protein, 9 aa, Homo Sapiens
CRPAEQSTA

SEQ ID NO: 87603 - protein, 9 aa, Homo Sapiens
QPPKWGPEP

SEQ ID NO: 87604 - protein, 9 aa, Homo Sapiens
SSPNVALHC

SEQ ID NO: 87605 - protein, 9 aa, Homo Sapiens
EFSHVIAWQ

SEQ ID NO: 87606 - protein, 9 aa, Homo Sapiens
DKAQELATL

SEQ ID NO: 87607 - protein, 9 aa, Homo Sapiens
VGAAAAGPR

SEQ ID NO: 87608 - protein, 9 aa, Homo Sapiens
DNICVLNEE

SEQ ID NO: 87609 - protein, 9 aa, Homo Sapiens
LSQLMEKKL

SEQ ID NO: 87610 - protein, 9 aa, Homo Sapiens
NVTSRLALA

SEQ ID NO: 87611 - protein, 9 aa, Homo Sapiens
GISRGVEAP

SEQ ID NO: 87612 - protein, 9 aa, Homo Sapiens
RAAVQPAQT

SEQ ID NO: 87613 - protein, 9 aa, Homo Sapiens
TFRNKEVKE

SEQ ID NO: 87614 - protein, 9 aa, Homo Sapiens
TAEEFTYIR

SEQ ID NO: 87615 - protein, 9 aa, Homo Sapiens
SRIQFGFLT

SEQ ID NO: 87616 - protein, 9 aa, Homo Sapiens
DPQADVSID

SEQ ID NO: 87617 - protein, 9 aa, Homo Sapiens
RKRLGRALV

SEQ ID NO: 87618 - protein, 9 aa, Homo Sapiens
KPERRPPQG

SEQ ID NO: 87619 - protein, 9 aa, Homo Sapiens
SPASASREA

SEQ ID NO: 87620 - protein, 9 aa, Homo Sapiens
VCNSLSIKV

SEQ ID NO: 87621 - protein, 9 aa, Homo Sapiens
DKNNVMLQW

SEQ ID NO: 87622 - protein, 9 aa, Homo Sapiens
KVMPKQTRK

SEQ ID NO: 87623 - protein, 9 aa, Homo Sapiens
SSDNICVLN

SEQ ID NO: 87624 - protein, 9 aa, Homo Sapiens
EFTYIRKRL

SEQ ID NO: 87625 - protein, 9 aa, Homo Sapiens
MRVSVPGPT

SEQ ID NO: 87626 - protein, 9 aa, Homo Sapiens
QYVHNVCNS

SEQ ID NO: 87627 - protein, 9 aa, Homo Sapiens
NIQSKKRNN

SEQ ID NO: 87628 - protein, 9 aa, Homo Sapiens
WMEACHRTG

SEQ ID NO: 87629 - protein, 9 aa, Homo Sapiens
GLYNHMPWQ

SEQ ID NO: 87630 - protein, 9 aa, Homo Sapiens
SYAQYVHNV

SEQ ID NO: 87631 - protein, 9 aa, Homo Sapiens
EQEIHYAVL

SEQ ID NO: 87632 - protein, 9 aa, Homo Sapiens
PPTLNGHLK

SEQ ID NO: 87633 - protein, 9 aa, Homo Sapiens
PTAAAAPAA

SEQ ID NO: 87634 - protein, 9 aa, Homo Sapiens
QADVSIDLL

SEQ ID NO: 87635 - protein, 9 aa, Homo Sapiens
KPTSEKSAA

SEQ ID NO: 87636 - protein, 9 aa, Homo Sapiens
AAAAANQCG

SEQ ID NO: 87637 - protein, 9 aa, Homo Sapiens
WAGSELPPG

SEQ ID NO: 87638 - protein, 9 aa, Homo Sapiens
GSPFLSYKN

SEQ ID NO: 87639 - protein, 9 aa, Homo Sapiens
PGKPLSRAD

SEQ ID NO: 87640 - protein, 9 aa, Homo Sapiens
AKRWMEACH

SEQ ID NO: 87641 - protein, 9 aa, Homo Sapiens
VKLTTYTQT

SEQ ID NO: 87642 - protein, 9 aa, Homo Sapiens
NDLQEPQEP

SEQ ID NO: 87643 - protein, 9 aa, Homo Sapiens
LLQKEEFSH

SEQ ID NO: 87644 - protein, 9 aa, Homo Sapiens
GSHQHQEAL

SEQ ID NO: 87645 - protein, 9 aa, Homo Sapiens
LFFGEPLPQ

SEQ ID NO: 87646 - protein, 9 aa, Homo Sapiens
RLSASQIWN

SEQ ID NO: 87647 - protein, 9 aa, Homo Sapiens
TPGHTMATS

SEQ ID NO: 87648 - protein, 9 aa, Homo Sapiens
EVIFLMPCF

SEQ ID NO: 87649 - protein, 9 aa, Homo Sapiens
GAPVVDSSI

SEQ ID NO: 87650 - protein, 9 aa, Homo Sapiens
MCPDNGAQI

SEQ ID NO: 87651 - protein, 9 aa, Homo Sapiens
LCEDVPWKQ

SEQ ID NO: 87652 - protein, 9 aa, Homo Sapiens
RVSLFIQKN

SEQ ID NO: 87653 - protein, 9 aa, Homo Sapiens
APIAGHSVW

SEQ ID NO: 87654 - protein, 9 aa, Homo Sapiens
YKNVGPGLQ

SEQ ID NO: 87655 - protein, 9 aa, Homo Sapiens
FHILMIMRE

SEQ ID NO: 87656 - protein, 9 aa, Homo Sapiens
KALPNCISH

SEQ ID NO: 87657 - protein, 9 aa, Homo Sapiens
AKSLENSDE

SEQ ID NO: 87658 - protein, 9 aa, Homo Sapiens
EDLCHALRR

SEQ ID NO: 87659 - protein, 9 aa, Homo Sapiens
LITISKLFT

SEQ ID NO: 87660 - protein, 9 aa, Homo Sapiens
LKRGCRGVE

SEQ ID NO: 87661 - protein, 9 aa, Homo Sapiens
SEATASALR

SEQ ID NO: 87662 - protein, 9 aa, Homo Sapiens
LSLNQPPKW

SEQ ID NO: 87663 - protein, 9 aa, Homo Sapiens
YHLVLFLVK

SEQ ID NO: 87664 - protein, 9 aa, Homo Sapiens
ALKRGCRGV

SEQ ID NO: 87665 - protein, 9 aa, Homo Sapiens
LVCCFHILM

SEQ ID NO: 87666 - protein, 9 aa, Homo Sapiens
ILNQLGADT

SEQ ID NO: 87667 - protein, 9 aa, Homo Sapiens
MYDMPLRLN

SEQ ID NO: 87668 - protein, 9 aa, Homo Sapiens
QLCEDVPWK

SEQ ID NO: 87669 - protein, 9 aa, Homo Sapiens
TAAAAPAAG

SEQ ID NO: 87670 - protein, 9 aa, Homo Sapiens
DPKNMFGIW

SEQ ID NO: 87671 - protein, 9 aa, Homo Sapiens
DGSRYSLKQ

SEQ ID NO: 87672 - protein, 9 aa, Homo Sapiens
AANQCGNLM

SEQ ID NO: 87673 - protein, 9 aa, Homo Sapiens
RRAGALGCR

SEQ ID NO: 87674 - protein, 9 aa, Homo Sapiens
VSASSSAAV

SEQ ID NO: 87675 - protein, 9 aa, Homo Sapiens
ESPWYLQVH

SEQ ID NO: 87676 - protein, 9 aa, Homo Sapiens
TKNQEDDVK

SEQ ID NO: 87677 - protein, 9 aa, Homo Sapiens
RVSVPGPTA

SEQ ID NO: 87678 - protein, 9 aa, Homo Sapiens
EDNFMVCPQ

SEQ ID NO: 87679 - protein, 9 aa, Homo Sapiens
YDMPLRLNL

SEQ ID NO: 87680 - protein, 9 aa, Homo Sapiens
LNGHLKPTS

SEQ ID NO: 87681 - protein, 9 aa, Homo Sapiens
YAQYVHNVC

SEQ ID NO: 87682 - protein, 9 aa, Homo Sapiens
YKVSLDNNV

SEQ ID NO: 87683 - protein, 9 aa, Homo Sapiens
ESKFNPVAI

SEQ ID NO: 87684 - protein, 9 aa, Homo Sapiens
QLGADTLTS

SEQ ID NO: 87685 - protein, 9 aa, Homo Sapiens
PQQKPQEES

SEQ ID NO: 87686 - protein, 9 aa, Homo Sapiens
HNGAINFNN

SEQ ID NO: 87687 - protein, 9 aa, Homo Sapiens
GAQSTVSCR

SEQ ID NO: 87688 - protein, 9 aa, Homo Sapiens
EQDVFYKVS

SEQ ID NO: 87689 - protein, 9 aa, Homo Sapiens
RDTYYHLVL

SEQ ID NO: 87690 - protein, 9 aa, Homo Sapiens
EIPLEEMPH

SEQ ID NO: 87691 - protein, 9 aa, Homo Sapiens
FMVCPQLPM

SEQ ID NO: 87692 - protein, 9 aa, Homo Sapiens
MGRTSTVSA

SEQ ID NO: 87693 - protein, 9 aa, Homo Sapiens
IRRACEHMP

SEQ ID NO: 87694 - protein, 9 aa, Homo Sapiens
ASQIWNLNP

SEQ ID NO: 87695 - protein, 9 aa, Homo Sapiens
LQWRSPPGS

SEQ ID NO: 87696 - protein, 9 aa, Homo Sapiens
ACEHMPSLM

SEQ ID NO: 87697 - protein, 9 aa, Homo Sapiens
PCLLTGSPF

SEQ ID NO: 87698 - protein, 9 aa, Homo Sapiens
MREVIFLMP

SEQ ID NO: 87699 - protein, 9 aa, Homo Sapiens
VKEESINEN

SEQ ID NO: 87700 - protein, 9 aa, Homo Sapiens
RIHPQQKPQ

SEQ ID NO: 87701 - protein, 9 aa, Homo Sapiens
DPGPRPRLL

SEQ ID NO: 87702 - protein, 9 aa, Homo Sapiens
GSWAGSELP

SEQ ID NO: 87703 - protein, 9 aa, Homo Sapiens
KRQTPERLA

SEQ ID NO: 87704 - protein, 9 aa, Homo Sapiens
AQSTVSCRT

SEQ ID NO: 87705 - protein, 9 aa, Homo Sapiens
AQYVHNVCN

SEQ ID NO: 87706 - protein, 9 aa, Homo Sapiens
VIFLMPCFR

SEQ ID NO: 87707 - protein, 9 aa, Homo Sapiens
EKDSRIQFG

SEQ ID NO: 87708 - protein, 9 aa, Homo Sapiens
LSSIGCWHG

SEQ ID NO: 87709 - protein, 9 aa, Homo Sapiens
FLCFAAGNV

SEQ ID NO: 87710 - protein, 9 aa, Homo Sapiens
LVPLVRTGC

SEQ ID NO: 87711 - protein, 9 aa, Homo Sapiens
TCGKSNNDC

SEQ ID NO: 87712 - protein, 9 aa, Homo Sapiens
SWAGSELPP

SEQ ID NO: 87713 - protein, 9 aa, Homo Sapiens
LTTYTQTTI

SEQ ID NO: 87714 - protein, 9 aa, Homo Sapiens
EATASALRK

SEQ ID NO: 87715 - protein, 9 aa, Homo Sapiens
YTSCMLVQA

SEQ ID NO: 87716 - protein, 9 aa, Homo Sapiens
LSRWILQQA

SEQ ID NO: 87717 - protein, 9 aa, Homo Sapiens
AVTEAAHAL

SEQ ID NO: 87718 - protein, 9 aa, Homo Sapiens
DNGRVLLDN

SEQ ID NO: 87719 - protein, 9 aa, Homo Sapiens
SKFNPVAIY

SEQ ID NO: 87720 - protein, 9 aa, Homo Sapiens
GKPERRPPQ

SEQ ID NO: 87721 - protein, 9 aa, Homo Sapiens
LYNHMPWQY

SEQ ID NO: 87722 - protein, 9 aa, Homo Sapiens
HGAQSTVSC

SEQ ID NO: 87723 - protein, 9 aa, Homo Sapiens
ALRGSPVIS

SEQ ID NO: 87724 - protein, 9 aa, Homo Sapiens
RKKHFLNSM

SEQ ID NO: 87725 - protein, 9 aa, Homo Sapiens
CMHLYTAVL

SEQ ID NO: 87726 - protein, 9 aa, Homo Sapiens
VLPDLKDVE

SEQ ID NO: 87727 - protein, 9 aa, Homo Sapiens
MEEEDEEDE

SEQ ID NO: 87728 - protein, 9 aa, Homo Sapiens
LGQPCNCLP

SEQ ID NO: 87729 - protein, 9 aa, Homo Sapiens
PASASREAG

SEQ ID NO: 87730 - protein, 9 aa, Homo Sapiens
ISQHPFCGP

SEQ ID NO: 87731 - protein, 9 aa, Homo Sapiens
HLKPTSEKS

SEQ ID NO: 87732 - protein, 9 aa, Homo Sapiens
GSSPNVALH

SEQ ID NO: 87733 - protein, 9 aa, Homo Sapiens
KPQEESSPQ

SEQ ID NO: 87734 - protein, 9 aa, Homo Sapiens
PNVALHCVD

SEQ ID NO: 87735 - protein, 9 aa, Homo Sapiens
ELSRSSYVY

SEQ ID NO: 87736 - protein, 9 aa, Homo Sapiens
VVMQWSCQE

SEQ ID NO: 87737 - protein, 9 aa, Homo Sapiens
AQAVYELSR

SEQ ID NO: 87738 - protein, 9 aa, Homo Sapiens
RYHGAQSTV

SEQ ID NO: 87739 - protein, 9 aa, Homo Sapiens
ARRSRATGR

SEQ ID NO: 87740 - protein, 9 aa, Homo Sapiens
RCHNKQHSD

SEQ ID NO: 87741 - protein, 9 aa, Homo Sapiens
DPGAPVVDS

SEQ ID NO: 87742 - protein, 9 aa, Homo Sapiens
EDDVKQPFN

SEQ ID NO: 87743 - protein, 9 aa, Homo Sapiens
KVSLDNNVE

SEQ ID NO: 87744 - protein, 9 aa, Homo Sapiens
NSIADSDYL

SEQ ID NO: 87745 - protein, 9 aa, Homo Sapiens
LLPRKVSQL

SEQ ID NO: 87746 - protein, 9 aa, Homo Sapiens
VNVTSRLAL

SEQ ID NO: 87747 - protein, 9 aa, Homo Sapiens
QDVFYKVSL

SEQ ID NO: 87748 - protein, 9 aa, Homo Sapiens
ENSDENKIV

SEQ ID NO: 87749 - protein, 9 aa, Homo Sapiens
HSQLLDDAH

SEQ ID NO: 87750 - protein, 9 aa, Homo Sapiens
IKDNYGLNE

SEQ ID NO: 87751 - protein, 9 aa, Homo Sapiens
LPSEAATGG

SEQ ID NO: 87752 - protein, 9 aa, Homo Sapiens
MHSTCGDCV

SEQ ID NO: 87753 - protein, 9 aa, Homo Sapiens
EIRDTYYHL

SEQ ID NO: 87754 - protein, 9 aa, Homo Sapiens
STVSCRTGY

SEQ ID NO: 87755 - protein, 9 aa, Homo Sapiens
VSVPGPTAA

SEQ ID NO: 87756 - protein, 9 aa, Homo Sapiens
RHGISRGVE

SEQ ID NO: 87757 - protein, 9 aa, Homo Sapiens
DSRIQFGFL

SEQ ID NO: 87758 - protein, 9 aa, Homo Sapiens
KFNPVAIYE

SEQ ID NO: 87759 - protein, 9 aa, Homo Sapiens
GVEVDVWDG

SEQ ID NO: 87760 - protein, 9 aa, Homo Sapiens
LASIRRACE

SEQ ID NO: 87761 - protein, 9 aa, Homo Sapiens
VVLPDLKDV

SEQ ID NO: 87762 - protein, 9 aa, Homo Sapiens
LTWVAERGI

SEQ ID NO: 87763 - protein, 9 aa, Homo Sapiens
KLTTYTQTT

SEQ ID NO: 87764 - protein, 9 aa, Homo Sapiens
FIQKNQEGF

SEQ ID NO: 87765 - protein, 9 aa, Homo Sapiens
GHLKPTSEK

SEQ ID NO: 87766 - protein, 9 aa, Homo Sapiens
AETTEACHP

SEQ ID NO: 87767 - protein, 9 aa, Homo Sapiens
MAKSLENSD

SEQ ID NO: 87768 - protein, 9 aa, Homo Sapiens
ANAVTEAAH

SEQ ID NO: 87769 - protein, 9 aa, Homo Sapiens
LIEIMFSDE

SEQ ID NO: 87770 - protein, 9 aa, Homo Sapiens
VPCLLTGSP

SEQ ID NO: 87771 - protein, 9 aa, Homo Sapiens
QLMEKKLKE

SEQ ID NO: 87772 - protein, 9 aa, Homo Sapiens
SPMGRTSTV

SEQ ID NO: 87773 - protein, 9 aa, Homo Sapiens
RVHSGEKAF

SEQ ID NO: 87774 - protein, 9 aa, Homo Sapiens
KVLNHLSPE

SEQ ID NO: 87775 - protein, 9 aa, Homo Sapiens
EEAVMEEED

SEQ ID NO: 87776 - protein, 9 aa, Homo Sapiens
PGPTAAAAP

SEQ ID NO: 87777 - protein, 9 aa, Homo Sapiens
ECRAAVQPA

SEQ ID NO: 87778 - protein, 9 aa, Homo Sapiens
ADSVPANSE

SEQ ID NO: 87779 - protein, 9 aa, Homo Sapiens
ASASREAGI

SEQ ID NO: 87780 - protein, 9 aa, Homo Sapiens
WREWYYEVI

SEQ ID NO: 87781 - protein, 9 aa, Homo Sapiens
ITISKLFTA

SEQ ID NO: 87782 - protein, 9 aa, Homo Sapiens
PGLILTSQH

SEQ ID NO: 87783 - protein, 9 aa, Homo Sapiens
TLEGEVRSL

SEQ ID NO: 87784 - protein, 9 aa, Homo Sapiens
PIFYISQHP

SEQ ID NO: 87785 - protein, 9 aa, Homo Sapiens
FLSYKNVGP

SEQ ID NO: 87786 - protein, 9 aa, Homo Sapiens
NGRVLLDNH

SEQ ID NO: 87787 - protein, 9 aa, Homo Sapiens
VKQPFNDSG

SEQ ID NO: 87788 - protein, 9 aa, Homo Sapiens
IQSKKRNNV

SEQ ID NO: 87789 - protein, 9 aa, Homo Sapiens
SHEEVMDVI

SEQ ID NO: 87790 - protein, 9 aa, Homo Sapiens
PRRPGSSPN

SEQ ID NO: 87791 - protein, 9 aa, Homo Sapiens
FSHVIAWQQ

SEQ ID NO: 87792 - protein, 9 aa, Homo Sapiens
LYQVLNMWT

SEQ ID NO: 87793 - protein, 9 aa, Homo Sapiens
VVIIDSSKH

SEQ ID NO: 87794 - protein, 9 aa, Homo Sapiens
PDLKDVEIS

SEQ ID NO: 87795 - protein, 9 aa, Homo Sapiens
NILIDPLEL

SEQ ID NO: 87796 - protein, 9 aa, Homo Sapiens
ARIRATSLA

SEQ ID NO: 87797 - protein, 9 aa, Homo Sapiens
QGLLASEKW

SEQ ID NO: 87798 - protein, 9 aa, Homo Sapiens
VVEDPQADV

SEQ ID NO: 87799 - protein, 9 aa, Homo Sapiens
KSVPCLLTG

SEQ ID NO: 87800 - protein, 9 aa, Homo Sapiens
WILLLETFL

SEQ ID NO: 87801 - protein, 9 aa, Homo Sapiens
SSLEDIMYV

SEQ ID NO: 87802 - protein, 9 aa, Homo Sapiens
VADLTWVAE

SEQ ID NO: 87803 - protein, 9 aa, Homo Sapiens
LEMIKMCPD

SEQ ID NO: 87804 - protein, 9 aa, Homo Sapiens
AEEFTYIRK

SEQ ID NO: 87805 - protein, 9 aa, Homo Sapiens
VAGLCAHRE

SEQ ID NO: 87806 - protein, 9 aa, Homo Sapiens
DLASKANIL

SEQ ID NO: 87807 - protein, 9 aa, Homo Sapiens
EAPGLYNHM

SEQ ID NO: 87808 - protein, 9 aa, Homo Sapiens
CTERFVSSH

SEQ ID NO: 87809 - protein, 9 aa, Homo Sapiens
PFLSYKNVG

SEQ ID NO: 87810 - protein, 9 aa, Homo Sapiens
ISKLFTAIG

SEQ ID NO: 87811 - protein, 9 aa, Homo Sapiens
GFSWHSQLV

SEQ ID NO: 87812 - protein, 9 aa, Homo Sapiens
VAGKERGWR

SEQ ID NO: 87813 - protein, 9 aa, Homo Sapiens
IEIMFSDEC

SEQ ID NO: 87814 - protein, 9 aa, Homo Sapiens
SKKRNNVEI

SEQ ID NO: 87815 - protein, 9 aa, Homo Sapiens
SLRCHNKQH

SEQ ID NO: 87816 - protein, 9 aa, Homo Sapiens
SQEEWACLD

SEQ ID NO: 87817 - protein, 9 aa, Homo Sapiens
SILPGKPLS

SEQ ID NO: 87818 - protein, 9 aa, Homo Sapiens
LWYTPIWRE

SEQ ID NO: 87819 - protein, 9 aa, Homo Sapiens
IKLHTTGDL

SEQ ID NO: 87820 - protein, 9 aa, Homo Sapiens
VPFESPWYL

SEQ ID NO: 87821 - protein, 9 aa, Homo Sapiens
AHENYDKNN

SEQ ID NO: 87822 - protein, 9 aa, Homo Sapiens
LCQGEKSWV

SEQ ID NO: 87823 - protein, 9 aa, Homo Sapiens
ENFALLSSI

SEQ ID NO: 87824 - protein, 9 aa, Homo Sapiens
LRDGSRYSL

SEQ ID NO: 87825 - protein, 9 aa, Homo Sapiens
YSKRTMTGN

SEQ ID NO: 87826 - protein, 9 aa, Homo Sapiens
GQLTSSDEA

SEQ ID NO: 87827 - protein, 9 aa, Homo Sapiens
SDRYHGAQS

SEQ ID NO: 87828 - protein, 9 aa, Homo Sapiens
LLETFLCFA

SEQ ID NO: 87829 - protein, 9 aa, Homo Sapiens
SALRKKHVD

SEQ ID NO: 87830 - protein, 9 aa, Homo Sapiens
FGRGFMYDM

SEQ ID NO: 87831 - protein, 9 aa, Homo Sapiens
EERHKALPN

SEQ ID NO: 87832 - protein, 9 aa, Homo Sapiens
ADTLTSLRR

SEQ ID NO: 87833 - protein, 9 aa, Homo Sapiens
STQMEGVRT

SEQ ID NO: 87834 - protein, 9 aa, Homo Sapiens
DMPLRLNLL

SEQ ID NO: 87835 - protein, 9 aa, Homo Sapiens
IYTLRNQEI

SEQ ID NO: 87836 - protein, 9 aa, Homo Sapiens
WSCQEAWNS

SEQ ID NO: 87837 - protein, 9 aa, Homo Sapiens
VHGPPALRG

SEQ ID NO: 87838 - protein, 9 aa, Homo Sapiens
NVDKFEKGP

SEQ ID NO: 87839 - protein, 9 aa, Homo Sapiens
NENHTYCIA

SEQ ID NO: 87840 - protein, 9 aa, Homo Sapiens
SAEMGNLLT

SEQ ID NO: 87841 - protein, 9 aa, Homo Sapiens
EECRAAVQP

SEQ ID NO: 87842 - protein, 9 aa, Homo Sapiens
KRTMTGNWS

SEQ ID NO: 87843 - protein, 9 aa, Homo Sapiens
QLQCEFCSV

SEQ ID NO: 87844 - protein, 9 aa, Homo Sapiens
PIAGHSVWL

SEQ ID NO: 87845 - protein, 9 aa, Homo Sapiens
RPRRDVGAA

SEQ ID NO: 87846 - protein, 9 aa, Homo Sapiens
VSTPTKSVP

SEQ ID NO: 87847 - protein, 9 aa, Homo Sapiens
WYTPIWREW

SEQ ID NO: 87848 - protein, 9 aa, Homo Sapiens
ETHSSSPSG

SEQ ID NO: 87849 - protein, 9 aa, Homo Sapiens
LTSQHCNEG

SEQ ID NO: 87850 - protein, 9 aa, Homo Sapiens
KNMFGIWRV

SEQ ID NO: 87851 - protein, 9 aa, Homo Sapiens
SGFLVLRPI

SEQ ID NO: 87852 - protein, 9 aa, Homo Sapiens
NCAKEVAGL

SEQ ID NO: 87853 - protein, 9 aa, Homo Sapiens
LRPEKCRCF

SEQ ID NO: 87854 - protein, 9 aa, Homo Sapiens
KAADFIEVL

SEQ ID NO: 87855 - protein, 9 aa, Homo Sapiens
REVIFLMPC

SEQ ID NO: 87856 - protein, 9 aa, Homo Sapiens
SRSCTDSAR

SEQ ID NO: 87857 - protein, 9 aa, Homo Sapiens
LVQLGQPCN

SEQ ID NO: 87858 - protein, 9 aa, Homo Sapiens
LVPFESPWY

SEQ ID NO: 87859 - protein, 9 aa, Homo Sapiens
PERRPPQGG

SEQ ID NO: 87860 - protein, 9 aa, Homo Sapiens
SSNCNHIFW

SEQ ID NO: 87861 - protein, 9 aa, Homo Sapiens
PKNMFGIWR

SEQ ID NO: 87862 - protein, 9 aa, Homo Sapiens
DLTWVAERG

SEQ ID NO: 87863 - protein, 9 aa, Homo Sapiens
YSSLCQGEK

SEQ ID NO: 87864 - protein, 9 aa, Homo Sapiens
NAVTEAAHA

SEQ ID NO: 87865 - protein, 9 aa, Homo Sapiens
AVQPAQTLT

SEQ ID NO: 87866 - protein, 9 aa, Homo Sapiens
GRVLLDNHK

SEQ ID NO: 87867 - protein, 9 aa, Homo Sapiens
GFMYDMPLR

SEQ ID NO: 87868 - protein, 9 aa, Homo Sapiens
ELYFKEPLA

SEQ ID NO: 87869 - protein, 9 aa, Homo Sapiens
DSVPANSEN

SEQ ID NO: 87870 - protein, 9 aa, Homo Sapiens
VLDGLYKEN

SEQ ID NO: 87871 - protein, 9 aa, Homo Sapiens
EIHYAVLHF

SEQ ID NO: 87872 - protein, 9 aa, Homo Sapiens
LEDIMYVLK

SEQ ID NO: 87873 - protein, 9 aa, Homo Sapiens
SNNDCDEEF

SEQ ID NO: 87874 - protein, 9 aa, Homo Sapiens
KMCPDNGAQ

SEQ ID NO: 87875 - protein, 9 aa, Homo Sapiens
ALLSSIGCW

SEQ ID NO: 87876 - protein, 9 aa, Homo Sapiens
NKAADFIEV

SEQ ID NO: 87877 - protein, 9 aa, Homo Sapiens
QVLNMWTLG

SEQ ID NO: 87878 - protein, 9 aa, Homo Sapiens
NFMVCPQLP

SEQ ID NO: 87879 - protein, 9 aa, Homo Sapiens
LYKENDLDP

SEQ ID NO: 87880 - protein, 9 aa, Homo Sapiens
VIIDSSKHS

SEQ ID NO: 87881 - protein, 9 aa, Homo Sapiens
CCINYSSLC

SEQ ID NO: 87882 - protein, 9 aa, Homo Sapiens
RRSRATGRR

SEQ ID NO: 87883 - protein, 9 aa, Homo Sapiens
NICVLNEET

SEQ ID NO: 87884 - protein, 9 aa, Homo Sapiens
GSLWYTPIW

SEQ ID NO: 87885 - protein, 9 aa, Homo Sapiens
SVPGPTAAA

SEQ ID NO: 87886 - protein, 9 aa, Homo Sapiens
CRGVEVDVW

SEQ ID NO: 87887 - protein, 9 aa, Homo Sapiens
KKRNNVEIM

SEQ ID NO: 87888 - protein, 9 aa, Homo Sapiens
VHSGEKAFK

SEQ ID NO: 87889 - protein, 9 aa, Homo Sapiens
MNVDKFEKG

SEQ ID NO: 87890 - protein, 9 aa, Homo Sapiens
QSTAFHLDS

SEQ ID NO: 87891 - protein, 9 aa, Homo Sapiens
QSTVSCRTG

SEQ ID NO: 87892 - protein, 9 aa, Homo Sapiens
ERGNNQESS

SEQ ID NO: 87893 - protein, 9 aa, Homo Sapiens
CYETCGKSN

SEQ ID NO: 87894 - protein, 9 aa, Homo Sapiens
KPLSRADLR

SEQ ID NO: 87895 - protein, 9 aa, Homo Sapiens
NGHLKPTSE

SEQ ID NO: 87896 - protein, 9 aa, Homo Sapiens
PGKPERRPP

SEQ ID NO: 87897 - protein, 9 aa, Homo Sapiens
QEDDVKQPF

SEQ ID NO: 87898 - protein, 9 aa, Homo Sapiens
QSSERGNNQ

SEQ ID NO: 87899 - protein, 9 aa, Homo Sapiens
PIWREWYYE

SEQ ID NO: 87900 - protein, 9 aa, Homo Sapiens
NEDLCHALR

SEQ ID NO: 87901 - protein, 9 aa, Homo Sapiens
FALLSSIGC

SEQ ID NO: 87902 - protein, 9 aa, Homo Sapiens
DSLRCHNKQ

SEQ ID NO: 87903 - protein, 9 aa, Homo Sapiens
DSGFLVLRP

SEQ ID NO: 87904 - protein, 9 aa, Homo Sapiens
GVRTLTDVR

SEQ ID NO: 87905 - protein, 9 aa, Homo Sapiens
KIKLHTTGD

SEQ ID NO: 87906 - protein, 9 aa, Homo Sapiens
VPANSENEV

SEQ ID NO: 87907 - protein, 9 aa, Homo Sapiens
CLIEIMFSD

SEQ ID NO: 87908 - protein, 9 aa, Homo Sapiens
TMAALVCCF

SEQ ID NO: 87909 - protein, 9 aa, Homo Sapiens
EACHRTGGG

SEQ ID NO: 87910 - protein, 9 aa, Homo Sapiens
IWREWYYEV

SEQ ID NO: 87911 - protein, 9 aa, Homo Sapiens
LDGLYKEND

SEQ ID NO: 87912 - protein, 9 aa, Homo Sapiens
QCGNLMAHP

SEQ ID NO: 87913 - protein, 9 aa, Homo Sapiens
NYGLNEDLE

SEQ ID NO: 87914 - protein, 9 aa, Homo Sapiens
TKSVPCLLT

SEQ ID NO: 87915 - protein, 9 aa, Homo Sapiens
LASKANILI

SEQ ID NO: 87916 - protein, 9 aa, Homo Sapiens
VSLFIQKNQ

SEQ ID NO: 87917 - protein, 9 aa, Homo Sapiens
TMATSRTTA

SEQ ID NO: 87918 - protein, 9 aa, Homo Sapiens
ADLTWVAER

SEQ ID NO: 87919 - protein, 9 aa, Homo Sapiens
LRLCTVKFC

SEQ ID NO: 87920 - protein, 9 aa, Homo Sapiens
QEKPCECKE

SEQ ID NO: 87921 - protein, 9 aa, Homo Sapiens
RLALAVSSR

SEQ ID NO: 87922 - protein, 9 aa, Homo Sapiens
RSRATGRRQ

SEQ ID NO: 87923 - protein, 9 aa, Homo Sapiens
PKVSILPGK

SEQ ID NO: 87924 - protein, 9 aa, Homo Sapiens
ELPLAVTAN

SEQ ID NO: 87925 - protein, 9 aa, Homo Sapiens
ELLSVAGKE

SEQ ID NO: 87926 - protein, 9 aa, Homo Sapiens
MYVLKPTFT

SEQ ID NO: 87927 - protein, 9 aa, Homo Sapiens
PLVRTGCVR

SEQ ID NO: 87928 - protein, 9 aa, Homo Sapiens
NQLGADTLT

SEQ ID NO: 87929 - protein, 9 aa, Homo Sapiens
DVGAAAAGP

SEQ ID NO: 87930 - protein, 9 aa, Homo Sapiens
NNQESSQPV

SEQ ID NO: 87931 - protein, 9 aa, Homo Sapiens
GLQWRSPPG

SEQ ID NO: 87932 - protein, 9 aa, Homo Sapiens
NDSGFLVLR

SEQ ID NO: 87933 - protein, 9 aa, Homo Sapiens
LEKFKIKLH

SEQ ID NO: 87934 - protein, 9 aa, Homo Sapiens
PDNGAQIDP

SEQ ID NO: 87935 - protein, 9 aa, Homo Sapiens
LASEKWTLG

SEQ ID NO: 87936 - protein, 9 aa, Homo Sapiens
RAGALGCRP

SEQ ID NO: 87937 - protein, 9 aa, Homo Sapiens
ATASALRKK

SEQ ID NO: 87938 - protein, 9 aa, Homo Sapiens
VCPQLPMPF

SEQ ID NO: 87939 - protein, 9 aa, Homo Sapiens
LEQLCEDVP

SEQ ID NO: 87940 - protein, 9 aa, Homo Sapiens
CEHMPSLMS

SEQ ID NO: 87941 - protein, 9 aa, Homo Sapiens
TSCMLVQAF

SEQ ID NO: 87942 - protein, 9 aa, Homo Sapiens
IAGHSVWLS

SEQ ID NO: 87943 - protein, 9 aa, Homo Sapiens
GSALRSELQ

SEQ ID NO: 87944 - protein, 9 aa, Homo Sapiens
RHKALPNCI

SEQ ID NO: 87945 - protein, 9 aa, Homo Sapiens
ILSAMNVDK

SEQ ID NO: 87946 - protein, 9 aa, Homo Sapiens
CAHREVAQF

SEQ ID NO: 87947 - protein, 9 aa, Homo Sapiens
LDNHKDMIV

SEQ ID NO: 87948 - protein, 9 aa, Homo Sapiens
VAIYENTRE

SEQ ID NO: 87949 - protein, 9 aa, Homo Sapiens
MATSRTTAT

SEQ ID NO: 87950 - protein, 9 aa, Homo Sapiens
VMPKQTRKK

SEQ ID NO: 87951 - protein, 9 aa, Homo Sapiens
HNKQHSDQS

SEQ ID NO: 87952 - protein, 9 aa, Homo Sapiens
LLDDAHKKA

SEQ ID NO: 87953 - protein, 9 aa, Homo Sapiens
KEIRDTYYH

SEQ ID NO: 87954 - protein, 9 aa, Homo Sapiens
QHCNEGVQL

SEQ ID NO: 87955 - protein, 9 aa, Homo Sapiens
NEDLESESV

SEQ ID NO: 87956 - protein, 9 aa, Homo Sapiens
KNEDLCHAL

SEQ ID NO: 87957 - protein, 9 aa, Homo Sapiens
VAACNMHST

SEQ ID NO: 87958 - protein, 9 aa, Homo Sapiens
LCSEGSGFV

SEQ ID NO: 87959 - protein, 9 aa, Homo Sapiens
HKALPNCIS

SEQ ID NO: 87960 - protein, 9 aa, Homo Sapiens
KAFKCEECG

SEQ ID NO: 87961 - protein, 9 aa, Homo Sapiens
TTGKELYFK

SEQ ID NO: 87962 - protein, 9 aa, Homo Sapiens
LLLETFLCF

SEQ ID NO: 87963 - protein, 9 aa, Homo Sapiens
VVESVALSP

SEQ ID NO: 87964 - protein, 9 aa, Homo Sapiens
DNDSGFLVL

SEQ ID NO: 87965 - protein, 9 aa, Homo Sapiens
DVFYKVSLD

SEQ ID NO: 87966 - protein, 9 aa, Homo Sapiens
EAAHALAAA

SEQ ID NO: 87967 - protein, 9 aa, Homo Sapiens
GERSRRAGA

SEQ ID NO: 87968 - protein, 9 aa, Homo Sapiens
RNQEIKSAM

SEQ ID NO: 87969 - protein, 9 aa, Homo Sapiens
QTPERLAQR

SEQ ID NO: 87970 - protein, 9 aa, Homo Sapiens
KGSHQHQEA

SEQ ID NO: 87971 - protein, 9 aa, Homo Sapiens
FLMPCFRSP

SEQ ID NO: 87972 - protein, 9 aa, Homo Sapiens
AALVCCFHI

SEQ ID NO: 87973 - protein, 9 aa, Homo Sapiens
AEWRWVAPI

SEQ ID NO: 87974 - protein, 9 aa, Homo Sapiens
GNWSTQGCR

SEQ ID NO: 87975 - protein, 9 aa, Homo Sapiens
VCCFHILMI

SEQ ID NO: 87976 - protein, 9 aa, Homo Sapiens
PHVVYKRQT

SEQ ID NO: 87977 - protein, 9 aa, Homo Sapiens
YYHLVLFLV

SEQ ID NO: 87978 - protein, 9 aa, Homo Sapiens
YKRQTPERL

SEQ ID NO: 87979 - protein, 9 aa, Homo Sapiens
ALPNCISHI

SEQ ID NO: 87980 - protein, 9 aa, Homo Sapiens
TVKFCPDSE

SEQ ID NO: 87981 - protein, 9 aa, Homo Sapiens
IWNLNPVFG

SEQ ID NO: 87982 - protein, 9 aa, Homo Sapiens
RSCTDSARP

SEQ ID NO: 87983 - protein, 9 aa, Homo Sapiens
MPKQTRKKH

SEQ ID NO: 87984 - protein, 9 aa, Homo Sapiens
TSQHCNEGV

SEQ ID NO: 87985 - protein, 9 aa, Homo Sapiens
PWLLPVQME

SEQ ID NO: 87986 - protein, 9 aa, Homo Sapiens
EHSQLLDDA

SEQ ID NO: 87987 - protein, 9 aa, Homo Sapiens
VKFCPDSER

SEQ ID NO: 87988 - protein, 9 aa, Homo Sapiens
SSTIKDQFH

SEQ ID NO: 87989 - protein, 9 aa, Homo Sapiens
CQEAWNSLL

SEQ ID NO: 87990 - protein, 9 aa, Homo Sapiens
AMNVDKFEK

SEQ ID NO: 87991 - protein, 9 aa, Homo Sapiens
HSPEDEQKG

SEQ ID NO: 87992 - protein, 9 aa, Homo Sapiens
DFIEVLSSL

SEQ ID NO: 87993 - protein, 9 aa, Homo Sapiens
PMGRTSTVS

SEQ ID NO: 87994 - protein, 9 aa, Homo Sapiens
DPDREKEAA

SEQ ID NO: 87995 - protein, 9 aa, Homo Sapiens
YDKNNVMLQ

SEQ ID NO: 87996 - protein, 9 aa, Homo Sapiens
KLNDLQEPQ

SEQ ID NO: 87997 - protein, 9 aa, Homo Sapiens
ETCGKSNND

SEQ ID NO: 87998 - protein, 9 aa, Homo Sapiens
IHYAVLHFH

SEQ ID NO: 87999 - protein, 9 aa, Homo Sapiens
SDENKIVSL

SEQ ID NO: 88000 - protein, 9 aa, Homo Sapiens
EDPDVVIID

SEQ ID NO: 88001 - protein, 9 aa, Homo Sapiens
PPGRCPGRS

SEQ ID NO: 88002 - protein, 9 aa, Homo Sapiens
HPQQKPQEE

SEQ ID NO: 88003 - protein, 9 aa, Homo Sapiens
SDNICVLNE

SEQ ID NO: 88004 - protein, 9 aa, Homo Sapiens
LSPELPLAV

SEQ ID NO: 88005 - protein, 9 aa, Homo Sapiens
CRCFVHPQW

SEQ ID NO: 88006 - protein, 9 aa, Homo Sapiens
KHYMCTECG

SEQ ID NO: 88007 - protein, 9 aa, Homo Sapiens
NQEIKSAMR

SEQ ID NO: 88008 - protein, 9 aa, Homo Sapiens
TGSPFLSYK

SEQ ID NO: 88009 - protein, 9 aa, Homo Sapiens
DTYYHLVLF

SEQ ID NO: 88010 - protein, 9 aa, Homo Sapiens
LVRTGCVRS

SEQ ID NO: 88011 - protein, 9 aa, Homo Sapiens
WNSIADSDY

SEQ ID NO: 88012 - protein, 9 aa, Homo Sapiens
EHMPSLMSS

SEQ ID NO: 88013 - protein, 9 aa, Homo Sapiens
DRYHGAQST

SEQ ID NO: 88014 - protein, 9 aa, Homo Sapiens
NVGPGLQWR

SEQ ID NO: 88015 - protein, 9 aa, Homo Sapiens
RTGCVRSPR

SEQ ID NO: 88016 - protein, 9 aa, Homo Sapiens
YLEKFKIKL

SEQ ID NO: 88017 - protein, 9 aa, Homo Sapiens
KDQFHSAAK

SEQ ID NO: 88018 - protein, 9 aa, Homo Sapiens
SARRSRATG

SEQ ID NO: 88019 - protein, 9 aa, Homo Sapiens
SREAGITGN

SEQ ID NO: 88020 - protein, 9 aa, Homo Sapiens
LELLSVAGK

SEQ ID NO: 88021 - protein, 9 aa, Homo Sapiens
TVLDGLYKE

SEQ ID NO: 88022 - protein, 9 aa, Homo Sapiens
AALYQVLNM

SEQ ID NO: 88023 - protein, 9 aa, Homo Sapiens
DLRLCTVKF

SEQ ID NO: 88024 - protein, 9 aa, Homo Sapiens
WSNENHTYC

SEQ ID NO: 88025 - protein, 9 aa, Homo Sapiens
LPQINHYFC

SEQ ID NO: 88026 - protein, 9 aa, Homo Sapiens
FNNIGYAWI

SEQ ID NO: 88027 - protein, 9 aa, Homo Sapiens
AGEQDVFYK

SEQ ID NO: 88028 - protein, 9 aa, Homo Sapiens
AASAECQNC

SEQ ID NO: 88029 - protein, 9 aa, Homo Sapiens
EMIKMCPDN

SEQ ID NO: 88030 - protein, 9 aa, Homo Sapiens
EFCSVTRWK

SEQ ID NO: 88031 - protein, 9 aa, Homo Sapiens
LVQDSQCMH

SEQ ID NO: 88032 - protein, 9 aa, Homo Sapiens
RIQFGFLTV

SEQ ID NO: 88033 - protein, 9 aa, Homo Sapiens
FVSSHEEVM

SEQ ID NO: 88034 - protein, 9 aa, Homo Sapiens
NMWTLGQVT

SEQ ID NO: 88035 - protein, 9 aa, Homo Sapiens
TIERNAIDD

SEQ ID NO: 88036 - protein, 9 aa, Homo Sapiens
VPLVRTGCV

SEQ ID NO: 88037 - protein, 9 aa, Homo Sapiens
VATIERNAI

SEQ ID NO: 88038 - protein, 9 aa, Homo Sapiens
SQLLDDAHK

SEQ ID NO: 88039 - protein, 9 aa, Homo Sapiens
KSNNDCDEE

SEQ ID NO: 88040 - protein, 9 aa, Homo Sapiens
GLMSGVVES

SEQ ID NO: 88041 - protein, 9 aa, Homo Sapiens
SENEVEPVD

SEQ ID NO: 88042 - protein, 9 aa, Homo Sapiens
RVTVEDPDR

SEQ ID NO: 88043 - protein, 9 aa, Homo Sapiens
ELATLEGEV

SEQ ID NO: 88044 - protein, 9 aa, Homo Sapiens
KELYFKEPL

SEQ ID NO: 88045 - protein, 9 aa, Homo Sapiens
QDPKHWNSI

SEQ ID NO: 88046 - protein, 9 aa, Homo Sapiens
YRHGISRGV

SEQ ID NO: 88047 - protein, 9 aa, Homo Sapiens
RWILQQARQ

SEQ ID NO: 88048 - protein, 9 aa, Homo Sapiens
RPAEQSTAF

SEQ ID NO: 88049 - protein, 9 aa, Homo Sapiens
PPPGKPERR

SEQ ID NO: 88050 - protein, 9 aa, Homo Sapiens
SGVVESVAL

SEQ ID NO: 88051 - protein, 9 aa, Homo Sapiens
EKEEVKEES

SEQ ID NO: 88052 - protein, 9 aa, Homo Sapiens
DCRPAEQST

SEQ ID NO: 88053 - protein, 9 aa, Homo Sapiens
VVKPDILFF

SEQ ID NO: 88054 - protein, 9 aa, Homo Sapiens
LLTGSPFLS

SEQ ID NO: 88055 - protein, 9 aa, Homo Sapiens
REAGITGNS

SEQ ID NO: 88056 - protein, 9 aa, Homo Sapiens
SSHEEVMDV

SEQ ID NO: 88057 - protein, 9 aa, Homo Sapiens
EQKGSHQHQ

SEQ ID NO: 88058 - protein, 9 aa, Homo Sapiens
GADSVPANS

SEQ ID NO: 88059 - protein, 9 aa, Homo Sapiens
ASIRRACEH

SEQ ID NO: 88060 - protein, 9 aa, Homo Sapiens
LQKEEFSHV

SEQ ID NO: 88061 - protein, 9 aa, Homo Sapiens
RFVSSHEEV

SEQ ID NO: 88062 - protein, 9 aa, Homo Sapiens
EDEQKGSHQ

SEQ ID NO: 88063 - protein, 9 aa, Homo Sapiens
HWNSIADSD

SEQ ID NO: 88064 - protein, 9 aa, Homo Sapiens
ERCRPRRDV

SEQ ID NO: 88065 - protein, 9 aa, Homo Sapiens
WNLNPVFGG

SEQ ID NO: 88066 - protein, 9 aa, Homo Sapiens
VLSSLFKSH

SEQ ID NO: 88067 - protein, 9 aa, Homo Sapiens
MFGIWRVPA

SEQ ID NO: 88068 - protein, 9 aa, Homo Sapiens
PSLVVAGLC

SEQ ID NO: 88069 - protein, 9 aa, Homo Sapiens
KEESINENE

SEQ ID NO: 88070 - protein, 9 aa, Homo Sapiens
CTVKFCPDS

SEQ ID NO: 88071 - protein, 9 aa, Homo Sapiens
WRSPPGSWA

SEQ ID NO: 88072 - protein, 9 aa, Homo Sapiens
SRLALAVSS

SEQ ID NO: 88073 - protein, 9 aa, Homo Sapiens
IFLMPCFRS

SEQ ID NO: 88074 - protein, 9 aa, Homo Sapiens
EAGITGNSK

SEQ ID NO: 88075 - protein, 9 aa, Homo Sapiens
LPGLILTSQ

SEQ ID NO: 88076 - protein, 9 aa, Homo Sapiens
CNMHSTCGD

SEQ ID NO: 88077 - protein, 9 aa, Homo Sapiens
GNLMAHPAP

SEQ ID NO: 88078 - protein, 9 aa, Homo Sapiens
PEDEQKGSH

SEQ ID NO: 88079 - protein, 9 aa, Homo Sapiens
ICVLNEETK

SEQ ID NO: 88080 - protein, 9 aa, Homo Sapiens
TGKELYFKE

SEQ ID NO: 88081 - protein, 9 aa, Homo Sapiens
SQSSERGNN

SEQ ID NO: 88082 - protein, 9 aa, Homo Sapiens
QDLPSEAAT

SEQ ID NO: 88083 - protein, 9 aa, Homo Sapiens
MIMREVIFL

SEQ ID NO: 88084 - protein, 9 aa, Homo Sapiens
FMYDMPLRL

SEQ ID NO: 88085 - protein, 9 aa, Homo Sapiens
KHWNSIADS

SEQ ID NO: 88086 - protein, 9 aa, Homo Sapiens
YVHNVCNSL

SEQ ID NO: 88087 - protein, 9 aa, Homo Sapiens
SIADSDYLW

SEQ ID NO: 88088 - protein, 9 aa, Homo Sapiens
SQLVTHRRT

SEQ ID NO: 88089 - protein, 9 aa, Homo Sapiens
QLVTHRRTH

SEQ ID NO: 88090 - protein, 9 aa, Homo Sapiens
TSSTIKDQF

SEQ ID NO: 88091 - protein, 9 aa, Homo Sapiens
ERRPPQGGN

SEQ ID NO: 88092 - protein, 9 aa, Homo Sapiens
PTLNGHLKP

SEQ ID NO: 88093 - protein, 9 aa, Homo Sapiens
SARPAWRSR

SEQ ID NO: 88094 - protein, 9 aa, Homo Sapiens
NNIGYAWIA

SEQ ID NO: 88095 - protein, 9 aa, Homo Sapiens
PTTGKELYF

SEQ ID NO: 88096 - protein, 9 aa, Homo Sapiens
KQGLLASEK

SEQ ID NO: 88097 - protein, 9 aa, Homo Sapiens
AERGILVAS

SEQ ID NO: 88098 - protein, 9 aa, Homo Sapiens
LEHRVSLFI

SEQ ID NO: 88099 - protein, 9 aa, Homo Sapiens
PISEDEQEI

SEQ ID NO: 88100 - protein, 9 aa, Homo Sapiens
ANILIDPLE

SEQ ID NO: 88101 - protein, 9 aa, Homo Sapiens
PGSWAGSEL

SEQ ID NO: 88102 - protein, 9 aa, Homo Sapiens
RQLQCEFCS

SEQ ID NO: 88103 - protein, 9 aa, Homo Sapiens
ILRLITISK

SEQ ID NO: 88104 - protein, 9 aa, Homo Sapiens
GKNISFADC

SEQ ID NO: 88105 - protein, 9 aa, Homo Sapiens
SPFLSYKNV

SEQ ID NO: 88106 - protein, 9 aa, Homo Sapiens
PGSSPNVAL

SEQ ID NO: 88107 - protein, 9 aa, Homo Sapiens
VLNHLSPEL

SEQ ID NO: 88108 - protein, 9 aa, Homo Sapiens
SVPCLLTGS

SEQ ID NO: 88109 - protein, 9 aa, Homo Sapiens
EVNVTSRLA

SEQ ID NO: 88110 - protein, 9 aa, Homo Sapiens
MTGNWSTQG

SEQ ID NO: 88111 - protein, 9 aa, Homo Sapiens
EPSARRSRA

SEQ ID NO: 88112 - protein, 9 aa, Homo Sapiens
LDDAHKKAR

SEQ ID NO: 88113 - protein, 9 aa, Homo Sapiens
SASQIWNLN

SEQ ID NO: 88114 - protein, 9 aa, Homo Sapiens
SQHPFCGPN

SEQ ID NO: 88115 - protein, 9 aa, Homo Sapiens
HLSPELPLA

SEQ ID NO: 88116 - protein, 9 aa, Homo Sapiens
ISFADCLSQ

SEQ ID NO: 88117 - protein, 9 aa, Homo Sapiens
AIDDLKSLE

SEQ ID NO: 88118 - protein, 9 aa, Homo Sapiens
PFESPWYLQ

SEQ ID NO: 88119 - protein, 9 aa, Homo Sapiens
EKTSSTIKD

SEQ ID NO: 88120 - protein, 9 aa, Homo Sapiens
IQFGFLTVT

SEQ ID NO: 88121 - protein, 9 aa, Homo Sapiens
SQHCNEGVQ

SEQ ID NO: 88122 - protein, 9 aa, Homo Sapiens
QWRSPPGSW

SEQ ID NO: 88123 - protein, 9 aa, Homo Sapiens
SELQSSDLF

SEQ ID NO: 88124 - protein, 9 aa, Homo Sapiens
ASAECQNCA

SEQ ID NO: 88125 - protein, 9 aa, Homo Sapiens
EGSGFVPVE

SEQ ID NO: 88126 - protein, 9 aa, Homo Sapiens
QMEGVRTLT

SEQ ID NO: 88127 - protein, 9 aa, Homo Sapiens
ELPPGRCPG

SEQ ID NO: 88128 - protein, 9 aa, Homo Sapiens
LRGDPGAPV

SEQ ID NO: 88129 - protein, 9 aa, Homo Sapiens
QKGSHQHQE

SEQ ID NO: 88130 - protein, 9 aa, Homo Sapiens
RGSPVISDI

SEQ ID NO: 88131 - protein, 9 aa, Homo Sapiens
LRIHPQQKP

SEQ ID NO: 88132 - protein, 9 aa, Homo Sapiens
LHTGEKHYM

SEQ ID NO: 88133 - protein, 9 aa, Homo Sapiens
AVVALTQDL

SEQ ID NO: 88134 - protein, 9 aa, Homo Sapiens
SVALSPFER

SEQ ID NO: 88135 - protein, 9 aa, Homo Sapiens
QLLDDAHKK

SEQ ID NO: 88136 - protein, 9 aa, Homo Sapiens
FNPVAIYEN

SEQ ID NO: 88137 - protein, 9 aa, Homo Sapiens
RLLPRKVSQ

SEQ ID NO: 88138 - protein, 9 aa, Homo Sapiens
TGNWSTQGC

SEQ ID NO: 88139 - protein, 9 aa, Homo Sapiens
MPLRLNLLD

SEQ ID NO: 88140 - protein, 9 aa, Homo Sapiens
PEECRAAVQ

SEQ ID NO: 88141 - protein, 9 aa, Homo Sapiens
RSELQSSDL

SEQ ID NO: 88142 - protein, 9 aa, Homo Sapiens
QEDPDVVII

SEQ ID NO: 88143 - protein, 9 aa, Homo Sapiens
QYHSSAEMG

SEQ ID NO: 88144 - protein, 9 aa, Homo Sapiens
CKAQAVYEL

SEQ ID NO: 88145 - protein, 9 aa, Homo Sapiens
RNAIDDLKS

SEQ ID NO: 88146 - protein, 9 aa, Homo Sapiens
QEIKSAMRR

SEQ ID NO: 88147 - protein, 9 aa, Homo Sapiens
YEIINSSNC

SEQ ID NO: 88148 - protein, 9 aa, Homo Sapiens
VKKLNDLQE

SEQ ID NO: 88149 - protein, 9 aa, Homo Sapiens
KWTLGQNDR

SEQ ID NO: 88150 - protein, 9 aa, Homo Sapiens
IPLEEMPHA

SEQ ID NO: 88151 - protein, 9 aa, Homo Sapiens
EMPHADGVA

SEQ ID NO: 88152 - protein, 9 aa, Homo Sapiens
PHADGVAST

SEQ ID NO: 88153 - protein, 9 aa, Homo Sapiens
INSSNCNHI

SEQ ID NO: 88154 - protein, 9 aa, Homo Sapiens
IMYVLKPTF

SEQ ID NO: 88155 - protein, 9 aa, Homo Sapiens
SPNVALHCV

SEQ ID NO: 88156 - protein, 9 aa, Homo Sapiens
LMSGVVESV

SEQ ID NO: 88157 - protein, 9 aa, Homo Sapiens
YCIAKEIEF

SEQ ID NO: 88158 - protein, 9 aa, Homo Sapiens
PDREKEAAF

SEQ ID NO: 88159 - protein, 9 aa, Homo Sapiens
ERSRRAGAL

SEQ ID NO: 88160 - protein, 9 aa, Homo Sapiens
NLRPEKCRC

SEQ ID NO: 88161 - protein, 9 aa, Homo Sapiens
QEEWACLDS

SEQ ID NO: 88162 - protein, 9 aa, Homo Sapiens
PPGKPERRP

SEQ ID NO: 88163 - protein, 9 aa, Homo Sapiens
SLFIQKNQE

SEQ ID NO: 88164 - protein, 9 aa, Homo Sapiens
LFLNEACLI

SEQ ID NO: 88165 - protein, 9 aa, Homo Sapiens
EACLIEIMF

SEQ ID NO: 88166 - protein, 9 aa, Homo Sapiens
RALKRGCRG

SEQ ID NO: 88167 - protein, 9 aa, Homo Sapiens
LFIQKNQEG

SEQ ID NO: 88168 - protein, 9 aa, Homo Sapiens
RVLLDNHKD

SEQ ID NO: 88169 - protein, 9 aa, Homo Sapiens
SERGNNQES

SEQ ID NO: 88170 - protein, 9 aa, Homo Sapiens
LPDLKDVEI

SEQ ID NO: 88171 - protein, 9 aa, Homo Sapiens
NVALHCVDT

SEQ ID NO: 88172 - protein, 9 aa, Homo Sapiens
DIMYVLKPT

SEQ ID NO: 88173 - protein, 9 aa, Homo Sapiens
GYRVTVEDP

SEQ ID NO: 88174 - protein, 9 aa, Homo Sapiens
AACNMHSTC

SEQ ID NO: 88175 - protein, 9 aa, Homo Sapiens
LSYKNVGPG

SEQ ID NO: 88176 - protein, 9 aa, Homo Sapiens
FLVLRPISA

SEQ ID NO: 88177 - protein, 9 aa, Homo Sapiens
FWSNENHTY

SEQ ID NO: 88178 - protein, 9 aa, Homo Sapiens
REQPWLLPV

SEQ ID NO: 88179 - protein, 9 aa, Homo Sapiens
RQTPERLAQ

SEQ ID NO: 88180 - protein, 9 aa, Homo Sapiens
VLNEETKEL

SEQ ID NO: 88181 - protein, 9 aa, Homo Sapiens
ENGTWVVLP

SEQ ID NO: 88182 - protein, 9 aa, Homo Sapiens
HLVLFLVKA

SEQ ID NO: 88183 - protein, 9 aa, Homo Sapiens
RWMEACHRT

SEQ ID NO: 88184 - protein, 9 aa, Homo Sapiens
GGKNISFAD

SEQ ID NO: 88185 - protein, 9 aa, Homo Sapiens
NGTWVVLPD

SEQ ID NO: 88186 - protein, 9 aa, Homo Sapiens
VLSQLMEKK

SEQ ID NO: 88187 - protein, 9 aa, Homo Sapiens
DVKQPFNDS

SEQ ID NO: 88188 - protein, 9 aa, Homo Sapiens
ESYTSCMLV

SEQ ID NO: 88189 - protein, 9 aa, Homo Sapiens
SFADCLSQL

SEQ ID NO: 88190 - protein, 9 aa, Homo Sapiens
AEMGNLLTV

SEQ ID NO: 88191 - protein, 9 aa, Homo Sapiens
GPRLSRWIL

SEQ ID NO: 88192 - protein, 9 aa, Homo Sapiens
CHALRRMEN

SEQ ID NO: 88193 - protein, 9 aa, Homo Sapiens
GIWRVPAPF

SEQ ID NO: 88194 - protein, 9 aa, Homo Sapiens
SCQEAWNSL

SEQ ID NO: 88195 - protein, 9 aa, Homo Sapiens
LMPEECRAA

SEQ ID NO: 88196 - protein, 9 aa, Homo Sapiens
PVVDSSIEG

SEQ ID NO: 88197 - protein, 9 aa, Homo Sapiens
TLRDGSRYS

SEQ ID NO: 88198 - protein, 9 aa, Homo Sapiens
EEPSARRSR

SEQ ID NO: 88199 - protein, 9 aa, Homo Sapiens
VLNMWTLGQ

SEQ ID NO: 88200 - protein, 9 aa, Homo Sapiens
VALTQDLPS

SEQ ID NO: 88201 - protein, 9 aa, Homo Sapiens
LYFKEPLAL

SEQ ID NO: 88202 - protein, 9 aa, Homo Sapiens
EHRVSLFIQ

SEQ ID NO: 88203 - protein, 9 aa, Homo Sapiens
HNVCNSLSI

SEQ ID NO: 88204 - protein, 9 aa, Homo Sapiens
EKWTLGQND

SEQ ID NO: 88205 - protein, 9 aa, Homo Sapiens
QIWNLNPVF

SEQ ID NO: 88206 - protein, 9 aa, Homo Sapiens
LVLRPISAD

SEQ ID NO: 88207 - protein, 9 aa, Homo Sapiens
RRPGSSPNV

SEQ ID NO: 88208 - protein, 9 aa, Homo Sapiens
GLCAHREVA

SEQ ID NO: 88209 - protein, 9 aa, Homo Sapiens
NVCNSLSIK

SEQ ID NO: 88210 - protein, 9 aa, Homo Sapiens
KTSSTIKDQ

SEQ ID NO: 88211 - protein, 9 aa, Homo Sapiens
CRAAVQPAQ

SEQ ID NO: 88212 - protein, 9 aa, Homo Sapiens
PKQTRKKHF

SEQ ID NO: 88213 - protein, 9 aa, Homo Sapiens
TWVVLPDLK

SEQ ID NO: 88214 - protein, 9 aa, Homo Sapiens
QDSQCMHLY

SEQ ID NO: 88215 - protein, 9 aa, Homo Sapiens
NFNNIGYAW

SEQ ID NO: 88216 - protein, 9 aa, Homo Sapiens
LTQDLPSEA

SEQ ID NO: 88217 - protein, 9 aa, Homo Sapiens
LLDNHKDMI

SEQ ID NO: 88218 - protein, 9 aa, Homo Sapiens
RWVAPIAGH

SEQ ID NO: 88219 - protein, 9 aa, Homo Sapiens
TMTGNWSTQ

SEQ ID NO: 88220 - protein, 9 aa, Homo Sapiens
MDPKNMFGI

SEQ ID NO: 88221 - protein, 9 aa, Homo Sapiens
QNCAKEVAG

SEQ ID NO: 88222 - protein, 9 aa, Homo Sapiens
TYCIAKEIE

SEQ ID NO: 88223 - protein, 9 aa, Homo Sapiens
ILCSEGSGF

SEQ ID NO: 88224 - protein, 9 aa, Homo Sapiens
PETLRDGSR

SEQ ID NO: 88225 - protein, 9 aa, Homo Sapiens
LNEACLIEI

SEQ ID NO: 88226 - protein, 9 aa, Homo Sapiens
PGLYNHMPW

SEQ ID NO: 88227 - protein, 9 aa, Homo Sapiens
PDILFFGEP

SEQ ID NO: 88228 - protein, 9 aa, Homo Sapiens
SDNDSGFLV

SEQ ID NO: 88229 - protein, 9 aa, Homo Sapiens
LEEMPHADG

SEQ ID NO: 88230 - protein, 9 aa, Homo Sapiens
SSAEMGNLL

SEQ ID NO: 88231 - protein, 9 aa, Homo Sapiens
QEIHYAVLH

SEQ ID NO: 88232 - protein, 9 aa, Homo Sapiens
WLYLEKFKI

SEQ ID NO: 88233 - protein, 9 aa, Homo Sapiens
MPCFRSPLS

SEQ ID NO: 88234 - protein, 9 aa, Homo Sapiens
PEKCRCFVH

SEQ ID NO: 88235 - protein, 9 aa, Homo Sapiens
LILTSQHCN

SEQ ID NO: 88236 - protein, 9 aa, Homo Sapiens
ASREAGITG

SEQ ID NO: 88237 - protein, 9 aa, Homo Sapiens
GLLASEKWT

SEQ ID NO: 88238 - protein, 9 aa, Homo Sapiens
VKPDILFFG

SEQ ID NO: 88239 - protein, 9 aa, Homo Sapiens
IQDPKHWNS

SEQ ID NO: 88240 - protein, 9 aa, Homo Sapiens
SALRSELQS

SEQ ID NO: 88241 - protein, 9 aa, Homo Sapiens
FTYIRKRLG

SEQ ID NO: 88242 - protein, 9 aa, Homo Sapiens
EEVKEESIN

SEQ ID NO: 88243 - protein, 9 aa, Homo Sapiens
YKENDLDPR

SEQ ID NO: 88244 - protein, 9 aa, Homo Sapiens
LPPGRCPGR

SEQ ID NO: 88245 - protein, 9 aa, Homo Sapiens
STPTKSVPC

SEQ ID NO: 88246 - protein, 9 aa, Homo Sapiens
AAANQCGNL

SEQ ID NO: 88247 - protein, 9 aa, Homo Sapiens
GEKHYMCTE

SEQ ID NO: 88248 - protein, 9 aa, Homo Sapiens
CGNLMAHPA

SEQ ID NO: 88249 - protein, 9 aa, Homo Sapiens
IKMCPDNGA

SEQ ID NO: 88250 - protein, 9 aa, Homo Sapiens
HSGEKAFKC

SEQ ID NO: 88251 - protein, 9 aa, Homo Sapiens
ACLIEIMFS

SEQ ID NO: 88252 - protein, 9 aa, Homo Sapiens
TIKDQFHSA

SEQ ID NO: 88253 - protein, 9 aa, Homo Sapiens
KTMAALVCC

SEQ ID NO: 88254 - protein, 9 aa, Homo Sapiens
PCSRSCTDS

SEQ ID NO: 88255 - protein, 9 aa, Homo Sapiens
LNQPPKWGP

SEQ ID NO: 88256 - protein, 9 aa, Homo Sapiens
PGPRPRLLP

SEQ ID NO: 88257 - protein, 9 aa, Homo Sapiens
NSENEVEPV

SEQ ID NO: 88258 - protein, 9 aa, Homo Sapiens
TYTQTTIRK

SEQ ID NO: 88259 - protein, 9 aa, Homo Sapiens
SQIWNLNPV

SEQ ID NO: 88260 - protein, 9 aa, Homo Sapiens
VGPRLSRWI

SEQ ID NO: 88261 - protein, 9 aa, Homo Sapiens
VVYKRQTPE

SEQ ID NO: 88262 - protein, 9 aa, Homo Sapiens
SLWYTPIWR

SEQ ID NO: 88263 - protein, 9 aa, Homo Sapiens
RGCRGVEVD

SEQ ID NO: 88264 - protein, 9 aa, Homo Sapiens
CPDNGAQID

SEQ ID NO: 88265 - protein, 9 aa, Homo Sapiens
RCFVHPQWQ

SEQ ID NO: 88266 - protein, 9 aa, Homo Sapiens
KAQAVYELS

SEQ ID NO: 88267 - protein, 9 aa, Homo Sapiens
SPEDEQKGS

SEQ ID NO: 88268 - protein, 9 aa, Homo Sapiens
RLSRWILQQ

SEQ ID NO: 88269 - protein, 9 aa, Homo Sapiens
CRPRRDVGA

SEQ ID NO: 88270 - protein, 9 aa, Homo Sapiens
NHMPWQYHA

SEQ ID NO: 88271 - protein, 9 aa, Homo Sapiens
PPGSWAGSE

SEQ ID NO: 88272 - protein, 9 aa, Homo Sapiens
MSGVVESVA

SEQ ID NO: 88273 - protein, 9 aa, Homo Sapiens
YGLNEDLES

SEQ ID NO: 88274 - protein, 9 aa, Homo Sapiens
WGPEPRSSG

SEQ ID NO: 88275 - protein, 9 aa, Homo Sapiens
SAMNVDKFE

SEQ ID NO: 88276 - protein, 9 aa, Homo Sapiens
KAQELATLE

SEQ ID NO: 88277 - protein, 9 aa, Homo Sapiens
VVAGLCAHR

SEQ ID NO: 88278 - protein, 9 aa, Homo Sapiens
IPIFYISQH

SEQ ID NO: 88279 - protein, 9 aa, Homo Sapiens
ERFVSSHEE

SEQ ID NO: 88280 - protein, 9 aa, Homo Sapiens
WVAPIAGHS

SEQ ID NO: 88281 - protein, 9 aa, Homo Sapiens
CNHIFWPMG

SEQ ID NO: 88282 - protein, 9 aa, Homo Sapiens
IPSETHSSS

SEQ ID NO: 88283 - protein, 9 aa, Homo Sapiens
DNILCSEGS

SEQ ID NO: 88284 - protein, 9 aa, Homo Sapiens
IHSQEKPCE

SEQ ID NO: 88285 - protein, 9 aa, Homo Sapiens
GTWVVLPDL

SEQ ID NO: 88286 - protein, 9 aa, Homo Sapiens
VKVAACNMH

SEQ ID NO: 88287 - protein, 9 aa, Homo Sapiens
NKQHSDQSE

SEQ ID NO: 88288 - protein, 9 aa, Homo Sapiens
KKVMPKQTR

SEQ ID NO: 88289 - protein, 9 aa, Homo Sapiens
SSLCQGEKS

SEQ ID NO: 88290 - protein, 9 aa, Homo Sapiens
PAEQSTAFH

SEQ ID NO: 88291 - protein, 9 aa, Homo Sapiens
ATLEGEVRS

SEQ ID NO: 88292 - protein, 9 aa, Homo Sapiens
LNQLGADTL

SEQ ID NO: 88293 - protein, 9 aa, Homo Sapiens
LRNQEIKSA

SEQ ID NO: 88294 - protein, 9 aa, Homo Sapiens
ILEQLCEDV

SEQ ID NO: 88295 - protein, 9 aa, Homo Sapiens
SPWYLQVHI

SEQ ID NO: 88296 - protein, 9 aa, Homo Sapiens
YNHMPWQYH

SEQ ID NO: 88297 - protein, 9 aa, Homo Sapiens
ALVLSQLME

SEQ ID NO: 88298 - protein, 9 aa, Homo Sapiens
FESPWYLQV

SEQ ID NO: 88299 - protein, 9 aa, Homo Sapiens
AAHALAAAR

SEQ ID NO: 88300 - protein, 9 aa, Homo Sapiens
RPEKCRCFV

SEQ ID NO: 88301 - protein, 9 aa, Homo Sapiens
YKTMAALVC

SEQ ID NO: 88302 - protein, 9 aa, Homo Sapiens
EKAFKCEEC

SEQ ID NO: 88303 - protein, 9 aa, Homo Sapiens
SRLSASQIW

SEQ ID NO: 88304 - protein, 9 aa, Homo Sapiens
EESINENEK

SEQ ID NO: 88305 - protein, 9 aa, Homo Sapiens
ENHTYCIAK

SEQ ID NO: 88306 - protein, 9 aa, Homo Sapiens
WILEQLCED

SEQ ID NO: 88307 - protein, 9 aa, Homo Sapiens
LCTVKFCPD

SEQ ID NO: 88308 - protein, 9 aa, Homo Sapiens
VAERGILVA

SEQ ID NO: 88309 - protein, 9 aa, Homo Sapiens
SPPGSWAGS

SEQ ID NO: 88310 - protein, 9 aa, Homo Sapiens
PTRLIFVFS

SEQ ID NO: 88311 - protein, 9 aa, Homo Sapiens
VTVEDPDRE

SEQ ID NO: 88312 - protein, 9 aa, Homo Sapiens
CLLTGSPFL

SEQ ID NO: 88313 - protein, 9 aa, Homo Sapiens
MAALVCCFH

SEQ ID NO: 88314 - protein, 9 aa, Homo Sapiens
CAKEVAGLR

SEQ ID NO: 88315 - protein, 9 aa, Homo Sapiens
RNNVEIMWL

SEQ ID NO: 88316 - protein, 9 aa, Homo Sapiens
APVVDSSIE

SEQ ID NO: 88317 - protein, 9 aa, Homo Sapiens
YKIFRILLP

SEQ ID NO: 88318 - protein, 9 aa, Homo Sapiens
IERNAIDDL

SEQ ID NO: 88319 - protein, 9 aa, Homo Sapiens
VLLDNHKDM

SEQ ID NO: 88320 - protein, 9 aa, Homo Sapiens
PQEDPDVVI

SEQ ID NO: 88321 - protein, 9 aa, Homo Sapiens
SRYSLKQDG

SEQ ID NO: 88322 - protein, 9 aa, Homo Sapiens
NEETKELFC

SEQ ID NO: 88323 - protein, 9 aa, Homo Sapiens
ALVCCFHIL

SEQ ID NO: 88324 - protein, 9 aa, Homo Sapiens
RDVGAAAAG

SEQ ID NO: 88325 - protein, 9 aa, Homo Sapiens
KVAACNMHS

SEQ ID NO: 88326 - protein, 9 aa, Homo Sapiens
ILTSQHCNE

SEQ ID NO: 88327 - protein, 9 aa, Homo Sapiens
EQPWLLPVQ

SEQ ID NO: 88328 - protein, 9 aa, Homo Sapiens
SINENEKGK

SEQ ID NO: 88329 - protein, 9 aa, Homo Sapiens
IKDQFHSAA

SEQ ID NO: 88330 - protein, 9 aa, Homo Sapiens
SASREAGIT

SEQ ID NO: 88331 - protein, 9 aa, Homo Sapiens
VESVALSPF

SEQ ID NO: 88332 - protein, 9 aa, Homo Sapiens
QKEEFSHVI

SEQ ID NO: 88333 - protein, 9 aa, Homo Sapiens
QCEFCSVTR

SEQ ID NO: 88334 - protein, 9 aa, Homo Sapiens
DNHKDMIVE

SEQ ID NO: 88335 - protein, 9 aa, Homo Sapiens
TGVVKPDIL

SEQ ID NO: 88336 - protein, 9 aa, Homo Sapiens
VGPGLQWRS

SEQ ID NO: 88337 - protein, 9 aa, Homo Sapiens
GKPLSRADL

SEQ ID NO: 88338 - protein, 9 aa, Homo Sapiens
STIKDQFHS

SEQ ID NO: 88339 - protein, 9 aa, Homo Sapiens
TPERLAQRG

SEQ ID NO: 88340 - protein, 9 aa, Homo Sapiens
RRACEHMPS

SEQ ID NO: 88341 - protein, 9 aa, Homo Sapiens
ALREQPWLL

SEQ ID NO: 88342 - protein, 9 aa, Homo Sapiens
TPIWREWYY

SEQ ID NO: 88343 - protein, 9 aa, Homo Sapiens
TRKKHFLNS

SEQ ID NO: 88344 - protein, 9 aa, Homo Sapiens
KPDILFFGE

SEQ ID NO: 88345 - protein, 9 aa, Homo Sapiens
VFYKVSLDN

SEQ ID NO: 88346 - protein, 9 aa, Homo Sapiens
LNHLSPELP

SEQ ID NO: 88347 - protein, 9 aa, Homo Sapiens
PRPRLLPRK

SEQ ID NO: 88348 - protein, 9 aa, Homo Sapiens
LVLSQLMEK

SEQ ID NO: 88349 - protein, 9 aa, Homo Sapiens
TQTTIRKYV

SEQ ID NO: 88350 - protein, 9 aa, Homo Sapiens
HENYDKNNV

SEQ ID NO: 88351 - protein, 9 aa, Homo Sapiens
CEFCSVTRW

SEQ ID NO: 88352 - protein, 9 aa, Homo Sapiens
SNCNHIFWP

SEQ ID NO: 88353 - protein, 9 aa, Homo Sapiens
SEGSGFVPV

SEQ ID NO: 88354 - protein, 9 aa, Homo Sapiens
AHKKARNAY

SEQ ID NO: 88355 - protein, 9 aa, Homo Sapiens
RGDPGAPVV

SEQ ID NO: 88356 - protein, 9 aa, Homo Sapiens
NILCSEGSG

SEQ ID NO: 88357 - protein, 9 aa, Homo Sapiens
SQCMHLYTA

SEQ ID NO: 88358 - protein, 9 aa, Homo Sapiens
KVSILPGKP

SEQ ID NO: 88359 - protein, 9 aa, Homo Sapiens
LSASQIWNL

SEQ ID NO: 88360 - protein, 9 aa, Homo Sapiens
RPRLLPRKV

SEQ ID NO: 88361 - protein, 9 aa, Homo Sapiens
LLPVQMELG

SEQ ID NO: 88362 - protein, 9 aa, Homo Sapiens
QCMHLYTAV

SEQ ID NO: 88363 - protein, 9 aa, Homo Sapiens
HSQLVTHRR

SEQ ID NO: 88364 - protein, 9 aa, Homo Sapiens
VSILPGKPL

SEQ ID NO: 88365 - protein, 9 aa, Homo Sapiens
KILRLITIS

SEQ ID NO: 88366 - protein, 9 aa, Homo Sapiens
RGVEAPLLD

SEQ ID NO: 88367 - protein, 9 aa, Homo Sapiens
ASKANILID

SEQ ID NO: 88368 - protein, 9 aa, Homo Sapiens
KWGPEPRSS

SEQ ID NO: 88369 - protein, 9 aa, Homo Sapiens
VYELSRSSY

SEQ ID NO: 88370 - protein, 9 aa, Homo Sapiens
INFNNIGYA

SEQ ID NO: 88371 - protein, 9 aa, Homo Sapiens
IGCWHGAKD

SEQ ID NO: 88372 - protein, 9 aa, Homo Sapiens
TSTVSASSS

SEQ ID NO: 88373 - protein, 9 aa, Homo Sapiens
VMQWSCQEA

SEQ ID NO: 88374 - protein, 9 aa, Homo Sapiens
TLNGHLKPT

SEQ ID NO: 88375 - protein, 9 aa, Homo Sapiens
RRDVGAAAA

SEQ ID NO: 88376 - protein, 9 aa, Homo Sapiens
NQEDDVKQP

SEQ ID NO: 88377 - protein, 9 aa, Homo Sapiens
VVDSSIEGP

SEQ ID NO: 88378 - protein, 9 aa, Homo Sapiens
EEMPHADGV

SEQ ID NO: 88379 - protein, 9 aa, Homo Sapiens
GLYKENDLD

SEQ ID NO: 88380 - protein, 9 aa, Homo Sapiens
EAVMEEEDE

SEQ ID NO: 88381 - protein, 9 aa, Homo Sapiens
HALAAARPA

SEQ ID NO: 88382 - protein, 9 aa, Homo Sapiens
SLEDIMYVL

SEQ ID NO: 88383 - protein, 9 aa, Homo Sapiens
PRLSRWILQ

SEQ ID NO: 88384 - protein, 9 aa, Homo Sapiens
RVKVAACNM

SEQ ID NO: 88385 - protein, 9 aa, Homo Sapiens
SLNQPPKWG

SEQ ID NO: 88386 - protein, 9 aa, Homo Sapiens
FRSPLSQER

SEQ ID NO: 88387 - protein, 9 aa, Homo Sapiens
QSEATASAL

SEQ ID NO: 88388 - protein, 9 aa, Homo Sapiens
RCRPRRDVG

SEQ ID NO: 88389 - protein, 9 aa, Homo Sapiens
KGFSWHSQL

SEQ ID NO: 88390 - protein, 9 aa, Homo Sapiens
SHVIAWQQG

SEQ ID NO: 88391 - protein, 9 aa, Homo Sapiens
EDKAQELAT

SEQ ID NO: 88392 - protein, 9 aa, Homo Sapiens
HSQEKPCEC

SEQ ID NO: 88393 - protein, 9 aa, Homo Sapiens
SYTSCMLVQ

SEQ ID NO: 88394 - protein, 9 aa, Homo Sapiens
TDSARPAWR

SEQ ID NO: 88395 - protein, 9 aa, Homo Sapiens
RDDSLRCHN

SEQ ID NO: 88396 - protein, 9 aa, Homo Sapiens
EIKSAMRRL

SEQ ID NO: 88397 - protein, 9 aa, Homo Sapiens
ILMIMREVI

SEQ ID NO: 88398 - protein, 9 aa, Homo Sapiens
NEACLIEIM

SEQ ID NO: 88399 - protein, 9 aa, Homo Sapiens
DSARPAWRS

SEQ ID NO: 88400 - protein, 9 aa, Homo Sapiens
ANQCGNLMA

SEQ ID NO: 88401 - protein, 9 aa, Homo Sapiens
YQVLNMWTL

SEQ ID NO: 88402 - protein, 9 aa, Homo Sapiens
LGADTLTSL

SEQ ID NO: 88403 - protein, 9 aa, Homo Sapiens
DEQKGSHQH

SEQ ID NO: 88404 - protein, 9 aa, Homo Sapiens
TVSASSSAA

SEQ ID NO: 88405 - protein, 9 aa, Homo Sapiens
IDDLKSLEE

SEQ ID NO: 88406 - protein, 9 aa, Homo Sapiens
GCVRSPRQR

SEQ ID NO: 88407 - protein, 9 aa, Homo Sapiens
EALREQPWL

SEQ ID NO: 88408 - protein, 9 aa, Homo Sapiens
PPGNYSARI

SEQ ID NO: 88409 - protein, 9 aa, Homo Sapiens
CCFHILMIM

SEQ ID NO: 88410 - protein, 9 aa, Homo Sapiens
DPDVVIIDS

SEQ ID NO: 88411 - protein, 9 aa, Homo Sapiens
GHTMATSRT

SEQ ID NO: 88412 - protein, 9 aa, Homo Sapiens
LMEKKLKEG

SEQ ID NO: 88413 - protein, 9 aa, Homo Sapiens
GVVKPDILF

SEQ ID NO: 88414 - protein, 9 aa, Homo Sapiens
TEACHPTRL

SEQ ID NO: 88415 - protein, 9 aa, Homo Sapiens
LYLEKFKIK

SEQ ID NO: 88416 - protein, 9 aa, Homo Sapiens
GSRYSLKQD

SEQ ID NO: 88417 - protein, 9 aa, Homo Sapiens
FYKVSLDNN

SEQ ID NO: 88418 - protein, 9 aa, Homo Sapiens
DSPASASRE

SEQ ID NO: 88419 - protein, 9 aa, Homo Sapiens
EVLSSLFKS

SEQ ID NO: 88420 - protein, 9 aa, Homo Sapiens
YPFSTQMEG

SEQ ID NO: 88421 - protein, 9 aa, Homo Sapiens
DPKHWNSIA

SEQ ID NO: 88422 - protein, 9 aa, Homo Sapiens
CSRSCTDSA

SEQ ID NO: 88423 - protein, 9 aa, Homo Sapiens
CGKSNNDCD

SEQ ID NO: 88424 - protein, 9 aa, Homo Sapiens
EEFSHVIAW

SEQ ID NO: 88425 - protein, 9 aa, Homo Sapiens
HILMIMREV

SEQ ID NO: 88426 - protein, 9 aa, Homo Sapiens
SNENHTYCI

SEQ ID NO: 88427 - protein, 9 aa, Homo Sapiens
ALRSELQSS

SEQ ID NO: 88428 - protein, 9 aa, Homo Sapiens
GSELPPGRC

SEQ ID NO: 88429 - protein, 9 aa, Homo Sapiens
QWSCQEAWN

SEQ ID NO: 88430 - protein, 9 aa, Homo Sapiens
IDSSLEDIM

SEQ ID NO: 88431 - protein, 9 aa, Homo Sapiens
THSSSPSGA

SEQ ID NO: 88432 - protein, 9 aa, Homo Sapiens
TTYTQTTIR

SEQ ID NO: 88433 - protein, 9 aa, Homo Sapiens
KSLENSDEN

SEQ ID NO: 88434 - protein, 9 aa, Homo Sapiens
NQCGNLMAH

SEQ ID NO: 88435 - protein, 9 aa, Homo Sapiens
ACHRTGGGA

SEQ ID NO: 88436 - protein, 9 aa, Homo Sapiens
YIRKRLGRA

SEQ ID NO: 88437 - protein, 9 aa, Homo Sapiens
VQYHSSAEM

SEQ ID NO: 88438 - protein, 9 aa, Homo Sapiens
ILIDPLELQ

SEQ ID NO: 88439 - protein, 9 aa, Homo Sapiens
KVVMQWSCQ

SEQ ID NO: 88440 - protein, 9 aa, Homo Sapiens
DGGKNISFA

SEQ ID NO: 88441 - protein, 9 aa, Homo Sapiens
PLEKDSRIQ

SEQ ID NO: 88442 - protein, 9 aa, Homo Sapiens
WHSQLVTHR

SEQ ID NO: 88443 - protein, 9 aa, Homo Sapiens
MLVQAFQKA

SEQ ID NO: 88444 - protein, 9 aa, Homo Sapiens
MQWSCQEAW

SEQ ID NO: 88445 - protein, 9 aa, Homo Sapiens
TFLCFAAGN

SEQ ID NO: 88446 - protein, 9 aa, Homo Sapiens
KANILIDPL

SEQ ID NO: 88447 - protein, 9 aa, Homo Sapiens
DLPSEAATG

SEQ ID NO: 88448 - protein, 9 aa, Homo Sapiens
QNIQSKKRN

SEQ ID NO: 88449 - protein, 9 aa, Homo Sapiens
LPGNTDSTE

SEQ ID NO: 88450 - protein, 9 aa, Homo Sapiens
ERNAIDDLK

SEQ ID NO: 88451 - protein, 9 aa, Homo Sapiens
SCTDSARPA

SEQ ID NO: 88452 - protein, 9 aa, Homo Sapiens
PLEEMPHAD

SEQ ID NO: 88453 - protein, 9 aa, Homo Sapiens
NSDENKIVS

SEQ ID NO: 88454 - protein, 9 aa, Homo Sapiens
VVALTQDLP

SEQ ID NO: 88455 - protein, 9 aa, Homo Sapiens
SSIGCWHGA

SEQ ID NO: 88456 - protein, 9 aa, Homo Sapiens
EWRWVAPIA

SEQ ID NO: 88457 - protein, 9 aa, Homo Sapiens
TGCVRSPRQ

SEQ ID NO: 88458 - protein, 9 aa, Homo Sapiens
GPPALRGSP

SEQ ID NO: 88459 - protein, 9 aa, Homo Sapiens
ASEKWTLGQ

SEQ ID NO: 88460 - protein, 9 aa, Homo Sapiens
TAHENYDKN

SEQ ID NO: 88461 - protein, 9 aa, Homo Sapiens
LSRSSYVYL

SEQ ID NO: 88462 - protein, 9 aa, Homo Sapiens
FIEVLSSLF

SEQ ID NO: 88463 - protein, 9 aa, Homo Sapiens
TLRNQEIKS

SEQ ID NO: 88464 - protein, 9 aa, Homo Sapiens
SLCQGEKSW

SEQ ID NO: 88465 - protein, 9 aa, Homo Sapiens
AVMEEEDEE

SEQ ID NO: 88466 - protein, 9 aa, Homo Sapiens
IFYISQHPF

SEQ ID NO: 88467 - protein, 9 aa, Homo Sapiens
SRGVEAPLL

SEQ ID NO: 88468 - protein, 9 aa, Homo Sapiens
QHPFCGPNI

SEQ ID NO: 88469 - protein, 9 aa, Homo Sapiens
FSTQMEGVR

SEQ ID NO: 88470 - protein, 9 aa, Homo Sapiens
GFLVLRPIS

SEQ ID NO: 88471 - protein, 9 aa, Homo Sapiens
EKCRCFVHP

SEQ ID NO: 88472 - protein, 9 aa, Homo Sapiens
GVHGPPALR

SEQ ID NO: 88473 - protein, 9 aa, Homo Sapiens
RGNNQESSQ

SEQ ID NO: 88474 - protein, 9 aa, Homo Sapiens
PNCISHIIV

SEQ ID NO: 88475 - protein, 9 aa, Homo Sapiens
KNQEDDVKQ

SEQ ID NO: 88476 - protein, 9 aa, Homo Sapiens
LTVLDGLYK

SEQ ID NO: 88477 - protein, 9 aa, Homo Sapiens
CPQLPMPFF

SEQ ID NO: 88478 - protein, 9 aa, Homo Sapiens
LWILLLETF

SEQ ID NO: 88479 - protein, 9 aa, Homo Sapiens
FCSVTRWKM

SEQ ID NO: 88480 - protein, 9 aa, Homo Sapiens
MGNLLTVEE

SEQ ID NO: 88481 - protein, 9 aa, Homo Sapiens
AHALAAARP

SEQ ID NO: 88482 - protein, 9 aa, Homo Sapiens
NQESSQPVG

SEQ ID NO: 88483 - protein, 9 aa, Homo Sapiens
AADFIEVLS

SEQ ID NO: 88484 - protein, 9 aa, Homo Sapiens
YSARIRATS

SEQ ID NO: 88485 - protein, 9 aa, Homo Sapiens
PGERSRRAG

SEQ ID NO: 88486 - protein, 9 aa, Homo Sapiens
SIGCWHGAK

SEQ ID NO: 88487 - protein, 9 aa, Homo Sapiens
NISFADCLS

SEQ ID NO: 88488 - protein, 9 aa, Homo Sapiens
RLCTVKFCP

SEQ ID NO: 88489 - protein, 9 aa, Homo Sapiens
ATIERNAID

SEQ ID NO: 88490 - protein, 9 aa, Homo Sapiens
TGEKHYMCT

SEQ ID NO: 88491 - protein, 9 aa, Homo Sapiens
LPNCISHII

SEQ ID NO: 88492 - protein, 9 aa, Homo Sapiens
VEDPDREKE

SEQ ID NO: 88493 - protein, 9 aa, Homo Sapiens
RTSTVSASS

SEQ ID NO: 88494 - protein, 9 aa, Homo Sapiens
HVVYKRQTP

SEQ ID NO: 88495 - protein, 9 aa, Homo Sapiens
TASALRKKH

SEQ ID NO: 88496 - protein, 9 aa, Homo Sapiens
AGSELPPGR

SEQ ID NO: 88497 - protein, 9 aa, Homo Sapiens
DNYGLNEDL

SEQ ID NO: 88498 - protein, 9 aa, Homo Sapiens
VSSHEEVMD

SEQ ID NO: 88499 - protein, 9 aa, Homo Sapiens
FYISQHPFC

SEQ ID NO: 88500 - protein, 9 aa, Homo Sapiens
TEAAHALAA

SEQ ID NO: 88501 - protein, 9 aa, Homo Sapiens
VVSTPTKSV

SEQ ID NO: 88502 - protein, 9 aa, Homo Sapiens
GPGLQWRSP

SEQ ID NO: 88503 - protein, 9 aa, Homo Sapiens
HPFCGPNII

SEQ ID NO: 88504 - protein, 9 aa, Homo Sapiens
QLGQPCNCL

SEQ ID NO: 88505 - protein, 9 aa, Homo Sapiens
GPTAAAAPA

SEQ ID NO: 88506 - protein, 9 aa, Homo Sapiens
HTYCIAKEI

SEQ ID NO: 88507 - protein, 9 aa, Homo Sapiens
ALTQDLPSE

SEQ ID NO: 88508 - protein, 9 aa, Homo Sapiens
WLLPVQMEL

SEQ ID NO: 88509 - protein, 9 aa, Homo Sapiens
LRSELQSSD

SEQ ID NO: 88510 - protein, 9 aa, Homo Sapiens
RDGSRYSLK

SEQ ID NO: 88511 - protein, 9 aa, Homo Sapiens
LQCEFCSVT

SEQ ID NO: 88512 - protein, 9 aa, Homo Sapiens
PGNYSARIR

SEQ ID NO: 88513 - protein, 9 aa, Homo Sapiens
RILLPGNTD

SEQ ID NO: 88514 - protein, 9 aa, Homo Sapiens
AAVQPAQTL

SEQ ID NO: 88515 - protein, 9 aa, Homo Sapiens
MLNPLIYTF

SEQ ID NO: 88516 - protein, 9 aa, Homo Sapiens
HGISRGVEA

SEQ ID NO: 88517 - protein, 9 aa, Homo Sapiens
QTRKKHFLN

SEQ ID NO: 88518 - protein, 9 aa, Homo Sapiens
TQDLPSEAA

SEQ ID NO: 88519 - protein, 9 aa, Homo Sapiens
ESINENEKG

SEQ ID NO: 88520 - protein, 9 aa, Homo Sapiens
RIHSQEKPC

SEQ ID NO: 88521 - protein, 9 aa, Homo Sapiens
YRVTVEDPD

SEQ ID NO: 88522 - protein, 9 aa, Homo Sapiens
NGAINFNNI

SEQ ID NO: 88523 - protein, 9 aa, Homo Sapiens
PKWGPEPRS

SEQ ID NO: 88524 - protein, 9 aa, Homo Sapiens
YCGLPQINH

SEQ ID NO: 88525 - protein, 9 aa, Homo Sapiens
KIFRILLPG

SEQ ID NO: 88526 - protein, 9 aa, Homo Sapiens
TDPGPRPRL

SEQ ID NO: 88527 - protein, 9 aa, Homo Sapiens
HYCGLPQIN

SEQ ID NO: 88528 - protein, 9 aa, Homo Sapiens
LSVAGKERG

SEQ ID NO: 88529 - protein, 9 aa, Homo Sapiens
DDSLRCHNK

SEQ ID NO: 88530 - protein, 9 aa, Homo Sapiens
LENSDENKI

SEQ ID NO: 88531 - protein, 9 aa, Homo Sapiens
SRWILQQAR

SEQ ID NO: 88532 - protein, 9 aa, Homo Sapiens
AQLHYCGLP

SEQ ID NO: 88533 - protein, 9 aa, Homo Sapiens
DAHKKARNA

SEQ ID NO: 88534 - protein, 9 aa, Homo Sapiens
ADFIEVLSS

SEQ ID NO: 88535 - protein, 9 aa, Homo Sapiens
PALRGSPVI

SEQ ID NO: 88536 - protein, 9 aa, Homo Sapiens
IEVLSSLFK

SEQ ID NO: 88537 - protein, 9 aa, Homo Sapiens
LRGSPVISD

SEQ ID NO: 88538 - protein, 9 aa, Homo Sapiens
VLRPISADP

SEQ ID NO: 88539 - protein, 9 aa, Homo Sapiens
LQSEATASA

SEQ ID NO: 88540 - protein, 9 aa, Homo Sapiens
NHTYCIAKE

SEQ ID NO: 88541 - protein, 9 aa, Homo Sapiens
YTQTTIRKY

SEQ ID NO: 88542 - protein, 9 aa, Homo Sapiens
KGSALRSEL

SEQ ID NO: 88543 - protein, 9 aa, Homo Sapiens
LVQAFQKAA

SEQ ID NO: 88544 - protein, 9 aa, Homo Sapiens
GVVESVALS

SEQ ID NO: 88545 - protein, 9 aa, Homo Sapiens
RVPSLPPQP

SEQ ID NO: 88546 - protein, 9 aa, Homo Sapiens
AKVVMQWSC

SEQ ID NO: 88547 - protein, 9 aa, Homo Sapiens
GKSNNDCDE

SEQ ID NO: 88548 - protein, 9 aa, Homo Sapiens
YFESKFNPV

SEQ ID NO: 88549 - protein, 9 aa, Homo Sapiens
DENKIVSLD

SEQ ID NO: 88550 - protein, 9 aa, Homo Sapiens
RSPPGSWAG

SEQ ID NO: 88551 - protein, 9 aa, Homo Sapiens
NFALLSSIG

SEQ ID NO: 88552 - protein, 9 aa, Homo Sapiens
GVEAPLLDD

SEQ ID NO: 88553 - protein, 9 aa, Homo Sapiens
VDGGKNISF

SEQ ID NO: 88554 - protein, 9 aa, Homo Sapiens
QSKKRNNVE

SEQ ID NO: 88555 - protein, 9 aa, Homo Sapiens
KFCPDSERR

SEQ ID NO: 88556 - protein, 9 aa, Homo Sapiens
GALGCRPGL

SEQ ID NO: 88557 - protein, 9 aa, Homo Sapiens
SARIRATSL

SEQ ID NO: 88558 - protein, 9 aa, Homo Sapiens
WVVLPDLKD

SEQ ID NO: 88559 - protein, 9 aa, Homo Sapiens
SMDPKNMFG

SEQ ID NO: 88560 - protein, 9 aa, Homo Sapiens
ESVALSPFE

SEQ ID NO: 88561 - protein, 9 aa, Homo Sapiens
MVCPQLPMP

SEQ ID NO: 88562 - protein, 9 aa, Homo Sapiens
CQNCAKEVA

SEQ ID NO: 88563 - protein, 9 aa, Homo Sapiens
SVAGKERGW

SEQ ID NO: 88564 - protein, 9 aa, Homo Sapiens
CHNKQHSDQ

SEQ ID NO: 88565 - protein, 9 aa, Homo Sapiens
LPGKPLSRA

SEQ ID NO: 88566 - protein, 9 aa, Homo Sapiens
NYSARIRAT

SEQ ID NO: 88567 - protein, 9 aa, Homo Sapiens
WVAERGILV

SEQ ID NO: 88568 - protein, 9 aa, Homo Sapiens
QEKTSSTIK

SEQ ID NO: 88569 - protein, 9 aa, Homo Sapiens
KFKIKLHTT

SEQ ID NO: 88570 - protein, 9 aa, Homo Sapiens
QAVYELSRS

SEQ ID NO: 88571 - protein, 9 aa, Homo Sapiens
RRPPQGGNQ

SEQ ID NO: 88572 - protein, 9 aa, Homo Sapiens
KNVGPGLQW

SEQ ID NO: 88573 - protein, 9 aa, Homo Sapiens
IKSAMRRLK

SEQ ID NO: 88574 - protein, 9 aa, Homo Sapiens
PKHWNSIAD

SEQ ID NO: 88575 - protein, 9 aa, Homo Sapiens
YELSRSSYV

SEQ ID NO: 88576 - protein, 9 aa, Homo Sapiens
LALAVSSRG

SEQ ID NO: 88577 - protein, 9 aa, Homo Sapiens
KDNYGLNED

SEQ ID NO: 88578 - protein, 9 aa, Homo Sapiens
ALYQVLNMW

SEQ ID NO: 88579 - protein, 9 aa, Homo Sapiens
NMFGIWRVP

SEQ ID NO: 88580 - protein, 9 aa, Homo Sapiens
KPTTGKELY

SEQ ID NO: 88581 - protein, 9 aa, Homo Sapiens
PGRCPGRSA

SEQ ID NO: 88582 - protein, 9 aa, Homo Sapiens
ANSENEVEP

SEQ ID NO: 88583 - protein, 9 aa, Homo Sapiens
QPWLLPVQM

SEQ ID NO: 88584 - protein, 9 aa, Homo Sapiens
SPELPLAVT

SEQ ID NO: 88585 - protein, 9 aa, Homo Sapiens
LMIMREVIF

SEQ ID NO: 88586 - protein, 9 aa, Homo Sapiens
SQEKPCECK

SEQ ID NO: 88587 - protein, 9 aa, Homo Sapiens
AECQNCAKE

SEQ ID NO: 88588 - protein, 9 aa, Homo Sapiens
YTLRNQEIK

SEQ ID NO: 88589 - protein, 9 aa, Homo Sapiens
LVVAGLCAH

SEQ ID NO: 88590 - protein, 9 aa, Homo Sapiens
NHLSPELPL

SEQ ID NO: 88591 - protein, 9 aa, Homo Sapiens
VHNVCNSLS

SEQ ID NO: 88592 - protein, 9 aa, Homo Sapiens
MRRVPSLPP

SEQ ID NO: 88593 - protein, 9 aa, Homo Sapiens
GEQDVFYKV

SEQ ID NO: 88594 - protein, 9 aa, Homo Sapiens
FESKFNPVA

SEQ ID NO: 88595 - protein, 9 aa, Homo Sapiens
EQLCEDVPW

SEQ ID NO: 88596 - protein, 9 aa, Homo Sapiens
VTEAAHALA

SEQ ID NO: 88597 - protein, 9 aa, Homo Sapiens
EMGNLLTVE

SEQ ID NO: 88598 - protein, 9 aa, Homo Sapiens
YETCGKSNN

SEQ ID NO: 88599 - protein, 9 aa, Homo Sapiens
IRDTYYHLV

SEQ ID NO: 88600 - protein, 9 aa, Homo Sapiens
GRTSTVSAS

SEQ ID NO: 88601 - protein, 9 aa, Homo Sapiens
HGPPALRGS

SEQ ID NO: 88602 - protein, 9 aa, Homo Sapiens
MEGVRTLTD

SEQ ID NO: 88603 - protein, 9 aa, Homo Sapiens
TSRLALAVS

SEQ ID NO: 88604 - protein, 9 aa, Homo Sapiens
LHYCGLPQI

SEQ ID NO: 88605 - protein, 9 aa, Homo Sapiens
RACEHMPSL

SEQ ID NO: 88606 - protein, 9 aa, Homo Sapiens
LETFLCFAA

SEQ ID NO: 88607 - protein, 9 aa, Homo Sapiens
NSSNCNHIF

SEQ ID NO: 88608 - protein, 9 aa, Homo Sapiens
VQDSQCMHL

SEQ ID NO: 88609 - protein, 9 aa, Homo Sapiens
IESYTSCML

SEQ ID NO: 88610 - protein, 9 aa, Homo Sapiens
PQADVSIDL

SEQ ID NO: 88611 - protein, 9 aa, Homo Sapiens
QLHYCGLPQ

SEQ ID NO: 88612 - protein, 9 aa, Homo Sapiens
SRIPSETHS

SEQ ID NO: 88613 - protein, 9 aa, Homo Sapiens
RIPSETHSS

SEQ ID NO: 88614 - protein, 9 aa, Homo Sapiens
LREEPSARR

SEQ ID NO: 88615 - protein, 9 aa, Homo Sapiens
CEDVPWKQR

SEQ ID NO: 88616 - protein, 9 aa, Homo Sapiens
AQELATLEG

SEQ ID NO: 88617 - protein, 9 aa, Homo Sapiens
TPTKSVPCL

SEQ ID NO: 88618 - protein, 9 aa, Homo Sapiens
RPGSSPNVA

SEQ ID NO: 88619 - protein, 9 aa, Homo Sapiens
GSGFVPVEK

SEQ ID NO: 88620 - protein, 9 aa, Homo Sapiens
LCAHREVAQ

SEQ ID NO: 88621 - protein, 9 aa, Homo Sapiens
SAECQNCAK

SEQ ID NO: 88622 - protein, 9 aa, Homo Sapiens
VEAPLLDDF

SEQ ID NO: 88623 - protein, 9 aa, Homo Sapiens
PTVKLTTYT

SEQ ID NO: 88624 - protein, 9 aa, Homo Sapiens
ETFLCFAAG

SEQ ID NO: 88625 - protein, 9 aa, Homo Sapiens
TTPGHTMAT

SEQ ID NO: 88626 - protein, 9 aa, Homo Sapiens
KKLNDLQEP

SEQ ID NO: 88627 - protein, 9 aa, Homo Sapiens
GPRPRLLPR

SEQ ID NO: 88628 - protein, 9 aa, Homo Sapiens
GKGFSWHSQ

SEQ ID NO: 88629 - protein, 9 aa, Homo Sapiens
YFKEPLALQ

SEQ ID NO: 88630 - protein, 9 aa, Homo Sapiens
HSSAEMGNL

SEQ ID NO: 88631 - protein, 9 aa, Homo Sapiens
NCISHIIVV

SEQ ID NO: 88632 - protein, 9 aa, Homo Sapiens
GKELYFKEP

SEQ ID NO: 88633 - protein, 9 aa, Homo Sapiens
GNYSARIRA

SEQ ID NO: 88634 - protein, 9 aa, Homo Sapiens
VYKRQTPER

SEQ ID NO: 88635 - protein, 9 aa, Homo Sapiens
PGLQWRSPP

SEQ ID NO: 88636 - protein, 9 aa, Homo Sapiens
VQLGQPCNC

SEQ ID NO: 88637 - protein, 9 aa, Homo Sapiens
TYYHLVLFL

SEQ ID NO: 88638 - protein, 9 aa, Homo Sapiens
ISEDEQEIH

SEQ ID NO: 88639 - protein, 9 aa, Homo Sapiens
NHKDMIVEE

SEQ ID NO: 88640 - protein, 9 aa, Homo Sapiens
DLCHALRRM

SEQ ID NO: 88641 - protein, 9 aa, Homo Sapiens
GNNQESSQP

SEQ ID NO: 88642 - protein, 9 aa, Homo Sapiens
DYKTMAALV

SEQ ID NO: 88643 - protein, 9 aa, Homo Sapiens
ILPGKPLSR

SEQ ID NO: 88644 - protein, 9 aa, Homo Sapiens
DDAHKKARN

SEQ ID NO: 88645 - protein, 9 aa, Homo Sapiens
VEDNFMVCP

SEQ ID NO: 88646 - protein, 9 aa, Homo Sapiens
HADGVASTP

SEQ ID NO: 88647 - protein, 9 aa, Homo Sapiens
GADTLTSLR

SEQ ID NO: 88648 - protein, 9 aa, Homo Sapiens
KENDLDPRY

SEQ ID NO: 88649 - protein, 9 aa, Homo Sapiens
RTMTGNWST

SEQ ID NO: 88650 - protein, 9 aa, Homo Sapiens
LSRKNEDLC

SEQ ID NO: 88651 - protein, 9 aa, Homo Sapiens
PFSTQMEGV

SEQ ID NO: 88652 - protein, 9 aa, Homo Sapiens
CTDSARPAW

SEQ ID NO: 88653 - protein, 9 aa, Homo Sapiens
PGHTMATSR

SEQ ID NO: 88654 - protein, 9 aa, Homo Sapiens
KQPFNDSGC

SEQ ID NO: 88655 - protein, 9 aa, Homo Sapiens
ADVSIDLLA

SEQ ID NO: 88656 - protein, 9 aa, Homo Sapiens
MEACHRTGG

SEQ ID NO: 88657 - protein, 9 aa, Homo Sapiens
GDPGAPVVD

SEQ ID NO: 88658 - protein, 9 aa, Homo Sapiens
SGEKAFKCE

SEQ ID NO: 88659 - protein, 9 aa, Homo Sapiens
AAAANQCGN

SEQ ID NO: 88660 - protein, 9 aa, Homo Sapiens
SWHSQLVTH

SEQ ID NO: 88661 - protein, 9 aa, Homo Sapiens
PPKWGPEPR

SEQ ID NO: 88662 - protein, 9 aa, Homo Sapiens
YTPIWREWY

SEQ ID NO: 88663 - protein, 9 aa, Homo Sapiens
GRGFMYDMP

SEQ ID NO: 88664 - protein, 9 aa, Homo Sapiens
SIRRACEHM

SEQ ID NO: 88665 - protein, 9 aa, Homo Sapiens
NAIDDLKSL

SEQ ID NO: 88666 - protein, 9 aa, Homo Sapiens
NWSTQGCRL

SEQ ID NO: 88667 - protein, 9 aa, Homo Sapiens
DTLTSLRRL

SEQ ID NO: 88668 - protein, 9 aa, Homo Sapiens
RGFMYDMPL

SEQ ID NO: 88669 - protein, 9 aa, Homo Sapiens
IFRILLPGN

SEQ ID NO: 88670 - protein, 9 aa, Homo Sapiens
QELATLEGE

SEQ ID NO: 88671 - protein, 9 aa, Homo Sapiens
AINFNNIGY

SEQ ID NO: 88672 - protein, 9 aa, Homo Sapiens
CFVHPQWQL

SEQ ID NO: 88673 - protein, 9 aa, Homo Sapiens
FVEDNFMVC

SEQ ID NO: 88674 - protein, 9 aa, Homo Sapiens
REEPSARRS

SEQ ID NO: 88675 - protein, 9 aa, Homo Sapiens
WRWVAPIAG

SEQ ID NO: 88676 - protein, 9 aa, Homo Sapiens
AEQSTAFHL

SEQ ID NO: 88677 - protein, 9 aa, Homo Sapiens
LCHALRRME

SEQ ID NO: 88678 - protein, 9 aa, Homo Sapiens
MEKKLKEGP

SEQ ID NO: 88679 - protein, 9 aa, Homo Sapiens
QKPQEESSP

SEQ ID NO: 88680 - protein, 9 aa, Homo Sapiens
VEDPQADVS

SEQ ID NO: 88681 - protein, 9 aa, Homo Sapiens
ELVPFESPW

SEQ ID NO: 88682 - protein, 9 aa, Homo Sapiens
TYIRKRLGR

SEQ ID NO: 88683 - protein, 9 aa, Homo Sapiens
SETHSSSPS

SEQ ID NO: 88684 - protein, 9 aa, Homo Sapiens
CVLNEETKE

SEQ ID NO: 88685 - protein, 9 aa, Homo Sapiens
ILLLETFLC

SEQ ID NO: 88686 - protein, 9 aa, Homo Sapiens
CFRSPLSQE

SEQ ID NO: 88687 - protein, 9 aa, Homo Sapiens
AVYELSRSS

SEQ ID NO: 88688 - protein, 9 aa, Homo Sapiens
HEEVMDVID

SEQ ID NO: 88689 - protein, 9 aa, Homo Sapiens
INYSSLCQG

SEQ ID NO: 88690 - protein, 9 aa, Homo Sapiens
ERHKALPNC

SEQ ID NO: 88691 - protein, 9 aa, Homo Sapiens
LIDPLELQS

SEQ ID NO: 88692 - protein, 9 aa, Homo Sapiens
ASALRKKHV

SEQ ID NO: 88693 - protein, 9 aa, Homo Sapiens
RLITISKLF

SEQ ID NO: 88694 - protein, 9 aa, Homo Sapiens
VDCRPAEQS

SEQ ID NO: 88695 - protein, 9 aa, Homo Sapiens
YHGAQSTVS

SEQ ID NO: 88696 - protein, 9 aa, Homo Sapiens
MPWQYHAGQ

SEQ ID NO: 88697 - protein, 9 aa, Homo Sapiens
EIINSSNCN

SEQ ID NO: 88698 - protein, 9 aa, Homo Sapiens
TVKLTTYTQ

SEQ ID NO: 88699 - protein, 9 aa, Homo Sapiens
NPTAHENYD

SEQ ID NO: 88700 - protein, 9 aa, Homo Sapiens
ACHPTRLIF

SEQ ID NO: 88701 - protein, 9 aa, Homo Sapiens
CSEGSGFVP

SEQ ID NO: 88702 - protein, 9 aa, Homo Sapiens
AEVNVTSRL

SEQ ID NO: 88703 - protein, 9 aa, Homo Sapiens
LNEDLESES

SEQ ID NO: 88704 - protein, 9 aa, Homo Sapiens
CSVTRWKMA

SEQ ID NO: 88705 - protein, 9 aa, Homo Sapiens
QQKPQEESS

SEQ ID NO: 88706 - protein, 9 aa, Homo Sapiens
DNFMVCPQL

SEQ ID NO: 88707 - protein, 9 aa, Homo Sapiens
CMLVQAFQK

SEQ ID NO: 88708 - protein, 9 aa, Homo Sapiens
WYLQVHILH

SEQ ID NO: 88709 - protein, 9 aa, Homo Sapiens
GLNEDLESE

SEQ ID NO: 88710 - protein, 9 aa, Homo Sapiens
KRWMEACHR

SEQ ID NO: 88711 - protein, 9 aa, Homo Sapiens
SQLMEKKLK

SEQ ID NO: 88712 - protein, 9 aa, Homo Sapiens
ESVKKLNDL

SEQ ID NO: 88713 - protein, 9 aa, Homo Sapiens
TTTPGHTMA

SEQ ID NO: 88714 - protein, 9 aa, Homo Sapiens
FLNEACLIE

SEQ ID NO: 88715 - protein, 9 aa, Homo Sapiens
ELLQKEEFS

SEQ ID NO: 88716 - protein, 9 aa, Homo Sapiens
DDVKQPFND

SEQ ID NO: 88717 - protein, 9 aa, Homo Sapiens
SLENSDENK

SEQ ID NO: 88718 - protein, 9 aa, Homo Sapiens
VPSLPPQPG

SEQ ID NO: 88719 - protein, 9 aa, Homo Sapiens
QRIHSQEKP

SEQ ID NO: 88720 - protein, 9 aa, Homo Sapiens
IKGSALRSE

SEQ ID NO: 88721 - protein, 9 aa, Homo Sapiens
SEKWTLGQN

SEQ ID NO: 88722 - protein, 9 aa, Homo Sapiens
GVADLTWVA

SEQ ID NO: 88723 - protein, 9 aa, Homo Sapiens
KEEVKEESI

SEQ ID NO: 88724 - protein, 9 aa, Homo Sapiens
EVKEESINE

SEQ ID NO: 88725 - protein, 9 aa, Homo Sapiens
DCCINYSSL

SEQ ID NO: 88726 - protein, 9 aa, Homo Sapiens
FRNKEVKEA

SEQ ID NO: 88727 - protein, 9 aa, Homo Sapiens
LIKGSALRS

SEQ ID NO: 88728 - protein, 9 aa, Homo Sapiens
VDKFEKGPR

SEQ ID NO: 88729 - protein, 9 aa, Homo Sapiens
MHLYTAVLR

SEQ ID NO: 88730 - protein, 9 aa, Homo Sapiens
IHPQQKPQE

SEQ ID NO: 88731 - protein, 9 aa, Homo Sapiens
HRVSLFIQK

SEQ ID NO: 88732 - protein, 9 aa, Homo Sapiens
HQRIHSQEK

SEQ ID NO: 88733 - protein, 9 aa, Homo Sapiens
VTSRLALAV

SEQ ID NO: 88734 - protein, 9 aa, Homo Sapiens
ILLPGNTDS

SEQ ID NO: 88735 - protein, 9 aa, Homo Sapiens
PCNCLPPLR

SEQ ID NO: 88736 - protein, 9 aa, Homo Sapiens
LMPCFRSPL

SEQ ID NO: 88737 - protein, 9 aa, Homo Sapiens
SCMLVQAFQ

SEQ ID NO: 88738 - protein, 9 aa, Homo Sapiens
EDEQEIHYA

SEQ ID NO: 88739 - protein, 9 aa, Homo Sapiens
WLVQDSQCM

SEQ ID NO: 88740 - protein, 9 aa, Homo Sapiens
FADCLSQLF

SEQ ID NO: 88741 - protein, 9 aa, Homo Sapiens
CHPTRLIFV

SEQ ID NO: 88742 - protein, 9 aa, Homo Sapiens
HYMCTECGK

SEQ ID NO: 88743 - protein, 9 aa, Homo Sapiens
FGIWRVPAP

SEQ ID NO: 88744 - protein, 9 aa, Homo Sapiens
SELPPGRCP

SEQ ID NO: 88745 - protein, 9 aa, Homo Sapiens
LTGSPFLSY

SEQ ID NO: 88746 - protein, 9 aa, Homo Sapiens
SVPANSENE

SEQ ID NO: 88747 - protein, 9 aa, Homo Sapiens
LATLEGEVR

SEQ ID NO: 88748 - protein, 9 aa, Homo Sapiens
PWYLQVHIL

SEQ ID NO: 88749 - protein, 9 aa, Homo Sapiens
PGAPVVDSS

SEQ ID NO: 88750 - protein, 9 aa, Homo Sapiens
DVSIDLLAE

SEQ ID NO: 88751 - protein, 9 aa, Homo Sapiens
SILSAMNVD

SEQ ID NO: 88752 - protein, 9 aa, Homo Sapiens
YVGPRLSRW

SEQ ID NO: 88753 - protein, 9 aa, Homo Sapiens
CGLPQINHY

SEQ ID NO: 88754 - protein, 9 aa, Homo Sapiens
KSILSAMNV

SEQ ID NO: 88755 - protein, 9 aa, Homo Sapiens
ELRIHPQQK

SEQ ID NO: 88756 - protein, 9 aa, Homo Sapiens
DGLYKENDL

SEQ ID NO: 88757 - protein, 9 aa, Homo Sapiens
VMEEEDEED

SEQ ID NO: 88758 - protein, 9 aa, Homo Sapiens
NLELLSVAG

SEQ ID NO: 88759 - protein, 9 aa, Homo Sapiens
APGLYNHMP

SEQ ID NO: 88760 - protein, 9 aa, Homo Sapiens
VAPIAGHSV

SEQ ID NO: 88761 - protein, 9 aa, Homo Sapiens
LEKDSRIQF

SEQ ID NO: 88762 - protein, 9 aa, Homo Sapiens
LREQPWLLP

SEQ ID NO: 88763 - protein, 9 aa, Homo Sapiens
EDVPWKQRT

SEQ ID NO: 88764 - protein, 9 aa, Homo Sapiens
EDPDREKEA

SEQ ID NO: 88765 - protein, 9 aa, Homo Sapiens
LNEETKELF

SEQ ID NO: 88766 - protein, 9 aa, Homo Sapiens
SKANILIDP

SEQ ID NO: 88767 - protein, 9 aa, Homo Sapiens
LLSVAGKER

SEQ ID NO: 88768 - protein, 9 aa, Homo Sapiens
NCNHIFWPM

SEQ ID NO: 88769 - protein, 9 aa, Homo Sapiens
SLESVKKLN

SEQ ID NO: 88770 - protein, 9 aa, Homo Sapiens
LLPGNTDST

SEQ ID NO: 88771 - protein, 9 aa, Homo Sapiens
RSRRAGALG

SEQ ID NO: 88772 - protein, 9 aa, Homo Sapiens
LRLITISKL

SEQ ID NO: 88773 - protein, 9 aa, Homo Sapiens
AGLCAHREV

SEQ ID NO: 88774 - protein, 9 aa, Homo Sapiens
KQTRKKHFL

SEQ ID NO: 88775 - protein, 9 aa, Homo Sapiens
GLILTSQHC

SEQ ID NO: 88776 - protein, 9 aa, Homo Sapiens
VSRIPSETH

SEQ ID NO: 88777 - protein, 9 aa, Homo Sapiens
KRNNVEIMW

SEQ ID NO: 88778 - protein, 9 aa, Homo Sapiens
SRKNEDLCH

SEQ ID NO: 88779 - protein, 9 aa, Homo Sapiens
TERFVSSHE

SEQ ID NO: 88780 - protein, 9 aa, Homo Sapiens
RSPLSQERL

SEQ ID NO: 88781 - protein, 9 aa, Homo Sapiens
DEQEIHYAV

SEQ ID NO: 88782 - protein, 9 aa, Homo Sapiens
PVAIYENTR

SEQ ID NO: 88783 - protein, 9 aa, Homo Sapiens
LRCHNKQHS

SEQ ID NO: 88784 - protein, 9 aa, Homo Sapiens
STVSASSSA

SEQ ID NO: 88785 - protein, 9 aa, Homo Sapiens
ENYDKNNVM

SEQ ID NO: 88786 - protein, 9 aa, Homo Sapiens
DSSLEDIMY

SEQ ID NO: 88787 - protein, 9 aa, Homo Sapiens
PPALRGSPV

SEQ ID NO: 88788 - protein, 9 aa, Homo Sapiens
AGKERGWRT

SEQ ID NO: 88789 - protein, 9 aa, Homo Sapiens
NYSSLCQGE

SEQ ID NO: 88790 - protein, 9 aa, Homo Sapiens
MIKMCPDNG

SEQ ID NO: 88791 - protein, 9 aa, Homo Sapiens
HTMATSRTT

SEQ ID NO: 88792 - protein, 9 aa, Homo Sapiens
NQPPKWGPE

SEQ ID NO: 88793 - protein, 9 aa, Homo Sapiens
EEFTYIRKR

SEQ ID NO: 88794 - protein, 9 aa, Homo Sapiens
EACHPTRLI

SEQ ID NO: 88795 - protein, 9 aa, Homo Sapiens
NNVEIMWLA

SEQ ID NO: 88796 - protein, 9 aa, Homo Sapiens
TLTSLRRLA

SEQ ID NO: 88797 - protein, 9 aa, Homo Sapiens
VYKIFRILL

SEQ ID NO: 88798 - protein, 9 aa, Homo Sapiens
KNISFADCL

SEQ ID NO: 88799 - protein, 9 aa, Homo Sapiens
RKNEDLCHA

SEQ ID NO: 88800 - protein, 9 aa, Homo Sapiens
LNDLQEPQE

SEQ ID NO: 88801 - protein, 9 aa, Homo Sapiens
PCFRSPLSQ

SEQ ID NO: 88802 - protein, 9 aa, Homo Sapiens
PTAHENYDK

SEQ ID NO: 88803 - protein, 9 aa, Homo Sapiens
IMREVIFLM

SEQ ID NO: 88804 - protein, 9 aa, Homo Sapiens
PANSENEVE

SEQ ID NO: 88805 - protein, 9 aa, Homo Sapiens
LNMWTLGQV

SEQ ID NO: 88806 - protein, 9 aa, Homo Sapiens
KRGCRGVEV

SEQ ID NO: 88807 - protein, 9 aa, Homo Sapiens
FSWHSQLVT

SEQ ID NO: 88808 - protein, 9 aa, Homo Sapiens
SKLFTAIGV

SEQ ID NO: 88809 - protein, 9 aa, Homo Sapiens
FRILLPGNT

SEQ ID NO: 88810 - protein, 9 aa, Homo Sapiens
GKERGWRTV

SEQ ID NO: 88811 - protein, 9 aa, Homo Sapiens
TTEACHPTR

SEQ ID NO: 88812 - protein, 9 aa, Homo Sapiens
KEEFSHVIA

SEQ ID NO: 88813 - protein, 9 aa, Homo Sapiens
LLSSIGCWH

SEQ ID NO: 88814 - protein, 9 aa, Homo Sapiens
QPCNCLPPL

SEQ ID NO: 88815 - protein, 9 aa, Homo Sapiens
GAINFNNIG

SEQ ID NO: 88816 - protein, 9 aa, Homo Sapiens
RRVPSLPPQ

SEQ ID NO: 88817 - protein, 9 aa, Homo Sapiens
SYKNVGPGL

SEQ ID NO: 88818 - protein, 9 aa, Homo Sapiens
GLPQINHYF

SEQ ID NO: 88819 - protein, 9 aa, Homo Sapiens
YHSSAEMGN

SEQ ID NO: 88820 - protein, 9 aa, Homo Sapiens
RGVEVDVWD

SEQ ID NO: 88821 - protein, 9 aa, Homo Sapiens
SVKKLNDLQ

SEQ ID NO: 88822 - protein, 9 aa, Homo Sapiens
EKFKIKLHT

SEQ ID NO: 88823 - protein, 9 aa, Homo Sapiens
PSETHSSSP

SEQ ID NO: 88824 - protein, 9 aa, Homo Sapiens
MPEECRAAV

SEQ ID NO: 88825 - protein, 9 aa, Homo Sapiens
SSERGNNQE

SEQ ID NO: 88826 - protein, 9 aa, Homo Sapiens
GTTTPGHTM

SEQ ID NO: 88827 - protein, 9 aa, Homo Sapiens
WILQQARQQ

SEQ ID NO: 88828 - protein, 9 aa, Homo Sapiens
PRLLPRKVS

SEQ ID NO: 88829 - protein, 9 aa, Homo Sapiens
NNDCDEEFQ

SEQ ID NO: 88830 - protein, 9 aa, Homo Sapiens
VPGPTAAAA

SEQ ID NO: 88831 - protein, 9 aa, Homo Sapiens
ECQNCAKEV

SEQ ID NO: 88832 - protein, 9 aa, Homo Sapiens
GQPCNCLPP

SEQ ID NO: 88833 - protein, 9 aa, Homo Sapiens
NYDKNNVML

SEQ ID NO: 88834 - protein, 9 aa, Homo Sapiens
GCRGVEVDV

SEQ ID NO: 88835 - protein, 9 aa, Homo Sapiens
CNCLPPLRA

SEQ ID NO: 88836 - protein, 9 aa, Homo Sapiens
ETTEACHPT

SEQ ID NO: 88837 - protein, 9 aa, Homo Sapiens
HSSSPSGAG

SEQ ID NO: 88838 - protein, 9 aa, Homo Sapiens
PDVVIIDSS

SEQ ID NO: 88839 - protein, 9 aa, Homo Sapiens
TQMEGVRTL

SEQ ID NO: 88840 - protein, 9 aa, Homo Sapiens
TISKLFTAI

SEQ ID NO: 88841 - protein, 9 aa, Homo Sapiens
LLASEKWTL

SEQ ID NO: 88842 - protein, 9 aa, Homo Sapiens
YISQHPFCG

SEQ ID NO: 88843 - protein, 9 aa, Homo Sapiens
FCPDSERRF

SEQ ID NO: 88844 - protein, 9 aa, Homo Sapiens
FKIKLHTTG

SEQ ID NO: 88845 - protein, 9 aa, Homo Sapiens
GPETLRDGS

SEQ ID NO: 88846 - protein, 9 aa, Homo Sapiens
HTGEKHYMC

SEQ ID NO: 88847 - protein, 9 aa, Homo Sapiens
DWILEQLCE

SEQ ID NO: 88848 - protein, 9 aa, Homo Sapiens
PHNGAINFN

SEQ ID NO: 88849 - protein, 9 aa, Homo Sapiens
LESVKKLND

SEQ ID NO: 88850 - protein, 9 aa, Homo Sapiens
EDPQADVSI

SEQ ID NO: 88851 - protein, 9 aa, Homo Sapiens
SDNILCSEG

SEQ ID NO: 88852 - protein, 9 aa, Homo Sapiens
DSQCMHLYT

SEQ ID NO: 88853 - protein, 9 aa, Homo Sapiens
QRVHSGEKA

SEQ ID NO: 88854 - protein, 9 aa, Homo Sapiens
EDIMYVLKP

SEQ ID NO: 88855 - protein, 9 aa, Homo Sapiens
DILFFGEPL

SEQ ID NO: 88856 - protein, 9 aa, Homo Sapiens
IRKRLGRAL

SEQ ID NO: 88857 - protein, 9 aa, Homo Sapiens
SEDEQEIHY

SEQ ID NO: 88858 - protein, 9 aa, Homo Sapiens
HPTRLIFVF

SEQ ID NO: 88859 - protein, 9 aa, Homo Sapiens
EQSTAFHLD

SEQ ID NO: 88860 - protein, 9 aa, Homo Sapiens
EGVRTLTDV

SEQ ID NO: 88861 - protein, 9 aa, Homo Sapiens
MWTLGQVTC

SEQ ID NO: 88862 - protein, 9 aa, Homo Sapiens
EKHYMCTEC

SEQ ID NO: 88863 - protein, 9 aa, Homo Sapiens
ALRKKHVDS

SEQ ID NO: 88864 - protein, 9 aa, Homo Sapiens
NMHSTCGDC

SEQ ID NO: 88865 - protein, 9 aa, Homo Sapiens
IIDSSKHSD

SEQ ID NO: 88866 - protein, 9 aa, Homo Sapiens
EDLESESVN

SEQ ID NO: 88867 - protein, 9 aa, Homo Sapiens
KCRCFVHPQ

SEQ ID NO: 88868 - protein, 9 aa, Homo Sapiens
LKPTSEKSA

SEQ ID NO: 88869 - protein, 9 aa, Homo Sapiens
PSARRSRAT

SEQ ID NO: 88870 - protein, 9 aa, Homo Sapiens
TWVAERGIL

SEQ ID NO: 88871 - protein, 9 aa, Homo Sapiens
SVTRWKMAI

SEQ ID NO: 88872 - protein, 9 aa, Homo Sapiens
ISRGVEAPL

SEQ ID NO: 88873 - protein, 9 aa, Homo Sapiens
IQKNQEGFT

SEQ ID NO: 88874 - protein, 9 aa, Homo Sapiens
ACNMHSTCG

SEQ ID NO: 88875 - protein, 9 aa, Homo Sapiens
CINYSSLCQ

SEQ ID NO: 88876 - protein, 9 aa, Homo Sapiens
KDSRIQFGF

SEQ ID NO: 88877 - protein, 9 aa, Homo Sapiens
DLEMIKMCP

SEQ ID NO: 88878 - protein, 9 aa, Homo Sapiens
SLVVAGLCA

SEQ ID NO: 88879 - protein, 9 aa, Homo Sapiens
PELPLAVTA

SEQ ID NO: 88880 - protein, 9 aa, Homo Sapiens
IAQLHYCGL

SEQ ID NO: 88881 - protein, 9 aa, Homo Sapiens
HMPWQYHAG

SEQ ID NO: 88882 - protein, 9 aa, Homo Sapiens
GEKAFKCEE

SEQ ID NO: 88883 - protein, 9 aa, Homo Sapiens
QFGFLTVTN

SEQ ID NO: 88884 - protein, 9 aa, Homo Sapiens
KLVPLVRTG

SEQ ID NO: 88885 - protein, 9 aa, Homo Sapiens
DVVIIDSSK

SEQ ID NO: 88886 - protein, 9 aa, Homo Sapiens
PTKSVPCLL

SEQ ID NO: 88887 - protein, 9 aa, Homo Sapiens
SRRAGALGC

SEQ ID NO: 88888 - protein, 9 aa, Homo Sapiens
TVEDPDREK

SEQ ID NO: 88889 - protein, 9 aa, Homo Sapiens
ILFFGEPLP

SEQ ID NO: 88890 - protein, 9 aa, Homo Sapiens
SKRTMTGNW

SEQ ID NO: 88891 - protein, 9 aa, Homo Sapiens
KVVEDPQAD

SEQ ID NO: 88892 - protein, 9 aa, Homo Sapiens
IINSSNCNH

SEQ ID NO: 88893 - protein, 9 aa, Homo Sapiens
AGALGCRPG

SEQ ID NO: 88894 - protein, 9 aa, Homo Sapiens
NCLPPLRAA

SEQ ID NO: 88895 - protein, 9 aa, Homo Sapiens
NPVAIYENT

SEQ ID NO: 88896 - protein, 9 aa, Homo Sapiens
QVSKLNKNF

SEQ ID NO: 88897 - protein, 9 aa, Homo Sapiens
AKDGGLVTS

SEQ ID NO: 88898 - protein, 9 aa, Homo Sapiens
VSYRKAISQ

SEQ ID NO: 88899 - protein, 9 aa, Homo Sapiens
YVMESGDPS

SEQ ID NO: 88900 - protein, 9 aa, Homo Sapiens
SGQQNTIRT

SEQ ID NO: 88901 - protein, 9 aa, Homo Sapiens
QISQALLEP

SEQ ID NO: 88902 - protein, 9 aa, Homo Sapiens
QGLREALLT

SEQ ID NO: 88903 - protein, 9 aa, Homo Sapiens
DTVEKLPKH

SEQ ID NO: 88904 - protein, 9 aa, Homo Sapiens
NKNFKNKGK

SEQ ID NO: 88905 - protein, 9 aa, Homo Sapiens
YYQIGEKGP

SEQ ID NO: 88906 - protein, 9 aa, Homo Sapiens
MPGTVHSLW

SEQ ID NO: 88907 - protein, 9 aa, Homo Sapiens
FEVYYQIGE

SEQ ID NO: 88908 - protein, 9 aa, Homo Sapiens
KLNKNFKNK

SEQ ID NO: 88909 - protein, 9 aa, Homo Sapiens
HEPSLCAHV

SEQ ID NO: 88910 - protein, 9 aa, Homo Sapiens
TVAENPLNF

SEQ ID NO: 88911 - protein, 9 aa, Homo Sapiens
QDFAKDGGL

SEQ ID NO: 88912 - protein, 9 aa, Homo Sapiens
NDSPPAETE

SEQ ID NO: 88913 - protein, 9 aa, Homo Sapiens
DIDTVEKLP

SEQ ID NO: 88914 - protein, 9 aa, Homo Sapiens
PRKPAADQD

SEQ ID NO: 88915 - protein, 9 aa, Homo Sapiens
QEERLKFKD

SEQ ID NO: 88916 - protein, 9 aa, Homo Sapiens
EKQVSKLNK

SEQ ID NO: 88917 - protein, 9 aa, Homo Sapiens
QCPFDQELL

SEQ ID NO: 88918 - protein, 9 aa, Homo Sapiens
SIPEPRKPA

SEQ ID NO: 88919 - protein, 9 aa, Homo Sapiens
SSISFYKDR

SEQ ID NO: 88920 - protein, 9 aa, Homo Sapiens
SISFYKDRN

SEQ ID NO: 88921 - protein, 9 aa, Homo Sapiens
EERLKFKDE

SEQ ID NO: 88922 - protein, 9 aa, Homo Sapiens
TYIILEDSQ

SEQ ID NO: 88923 - protein, 9 aa, Homo Sapiens
RKGISGKRP

SEQ ID NO: 88924 - protein, 9 aa, Homo Sapiens
GLVTSQESG

SEQ ID NO: 88925 - protein, 9 aa, Homo Sapiens
TPGIGWLKK

SEQ ID NO: 88926 - protein, 9 aa, Homo Sapiens
EMDIDTVEK

SEQ ID NO: 88927 - protein, 9 aa, Homo Sapiens
KYVMESGDP

SEQ ID NO: 88928 - protein, 9 aa, Homo Sapiens
NPVSASRSH

SEQ ID NO: 88929 - protein, 9 aa, Homo Sapiens
LCAHVECPP

SEQ ID NO: 88930 - protein, 9 aa, Homo Sapiens
RRRTPGIGW

SEQ ID NO: 88931 - protein, 9 aa, Homo Sapiens
KQVSKLNKN

SEQ ID NO: 88932 - protein, 9 aa, Homo Sapiens
VHSLWHSVK

SEQ ID NO: 88933 - protein, 9 aa, Homo Sapiens
TLQEQLKKH

SEQ ID NO: 88934 - protein, 9 aa, Homo Sapiens
VSKLNKNFK

SEQ ID NO: 88935 - protein, 9 aa, Homo Sapiens
EPSIPEPRK

SEQ ID NO: 88936 - protein, 9 aa, Homo Sapiens
FETVAENPL

SEQ ID NO: 88937 - protein, 9 aa, Homo Sapiens
EEMDIDTVE

SEQ ID NO: 88938 - protein, 9 aa, Homo Sapiens
ISQALLEPS

SEQ ID NO: 88939 - protein, 9 aa, Homo Sapiens
NGQRQGLRE

SEQ ID NO: 88940 - protein, 9 aa, Homo Sapiens
PSIPEPRKP

SEQ ID NO: 88941 - protein, 9 aa, Homo Sapiens
LLEPSTLVP

SEQ ID NO: 88942 - protein, 9 aa, Homo Sapiens
YIILEDSQE

SEQ ID NO: 88943 - protein, 9 aa, Homo Sapiens
SNDSPPAET

SEQ ID NO: 88944 - protein, 9 aa, Homo Sapiens
LFAKSHYNE

SEQ ID NO: 88945 - protein, 9 aa, Homo Sapiens
MDIDTVEKL

SEQ ID NO: 88946 - protein, 9 aa, Homo Sapiens
PRRRTPGIG

SEQ ID NO: 88947 - protein, 9 aa, Homo Sapiens
RTPGIGWLK

SEQ ID NO: 88948 - protein, 9 aa, Homo Sapiens
NFKNKGKVQ

SEQ ID NO: 88949 - protein, 9 aa, Homo Sapiens
SASRSHPFT

SEQ ID NO: 88950 - protein, 9 aa, Homo Sapiens
SSSISFYKD

SEQ ID NO: 88951 - protein, 9 aa, Homo Sapiens
ATPRRRTPG

SEQ ID NO: 88952 - protein, 9 aa, Homo Sapiens
DQELLRRQQ

SEQ ID NO: 88953 - protein, 9 aa, Homo Sapiens
EVQISQALL

SEQ ID NO: 88954 - protein, 9 aa, Homo Sapiens
HSLWHSVKQ

SEQ ID NO: 88955 - protein, 9 aa, Homo Sapiens
VQISQALLE

SEQ ID NO: 88956 - protein, 9 aa, Homo Sapiens
RRKGISGKR

SEQ ID NO: 88957 - protein, 9 aa, Homo Sapiens
NDSVPAQYS

SEQ ID NO: 88958 - protein, 9 aa, Homo Sapiens
PEPRKPAAD

SEQ ID NO: 88959 - protein, 9 aa, Homo Sapiens
EKLPKHYAN

SEQ ID NO: 88960 - protein, 9 aa, Homo Sapiens
EPSLCAHVE

SEQ ID NO: 88961 - protein, 9 aa, Homo Sapiens
VPAQYSNWL

SEQ ID NO: 88962 - protein, 9 aa, Homo Sapiens
QALLEPSTL

SEQ ID NO: 88963 - protein, 9 aa, Homo Sapiens
PPAETEPGE

SEQ ID NO: 88964 - protein, 9 aa, Homo Sapiens
NKGKVQLKS

SEQ ID NO: 88965 - protein, 9 aa, Homo Sapiens
ISFYKDRNE

SEQ ID NO: 88966 - protein, 9 aa, Homo Sapiens
RSHPFTLNL

SEQ ID NO: 88967 - protein, 9 aa, Homo Sapiens
ACALEFETV

SEQ ID NO: 88968 - protein, 9 aa, Homo Sapiens
MHEPSLCAH

SEQ ID NO: 88969 - protein, 9 aa, Homo Sapiens
PDSSGQQNT

SEQ ID NO: 88970 - protein, 9 aa, Homo Sapiens
SEVQISQAL

SEQ ID NO: 88971 - protein, 9 aa, Homo Sapiens
PSLCAHVEC

SEQ ID NO: 88972 - protein, 9 aa, Homo Sapiens
QAGLQHLAP

SEQ ID NO: 88973 - protein, 9 aa, Homo Sapiens
DFAKDGGLV

SEQ ID NO: 88974 - protein, 9 aa, Homo Sapiens
TVEKLPKHY

SEQ ID NO: 88975 - protein, 9 aa, Homo Sapiens
RKPAADQDG

SEQ ID NO: 88976 - protein, 9 aa, Homo Sapiens
LEKQVSKLN

SEQ ID NO: 88977 - protein, 9 aa, Homo Sapiens
LWHSVKQTI

SEQ ID NO: 88978 - protein, 9 aa, Homo Sapiens
DSPPAETEP

SEQ ID NO: 88979 - protein, 9 aa, Homo Sapiens
KNFKNKGKV

SEQ ID NO: 88980 - protein, 9 aa, Homo Sapiens
QEQLKKHKG

SEQ ID NO: 88981 - protein, 9 aa, Homo Sapiens
RQGLREALL

SEQ ID NO: 88982 - protein, 9 aa, Homo Sapiens
LQCPFDQEL

SEQ ID NO: 88983 - protein, 9 aa, Homo Sapiens
FAKDGGLVT

SEQ ID NO: 88984 - protein, 9 aa, Homo Sapiens
PACALEFET

SEQ ID NO: 88985 - protein, 9 aa, Homo Sapiens
SSGQQNTIR

SEQ ID NO: 88986 - protein, 9 aa, Homo Sapiens
ILEDSQEGR

SEQ ID NO: 88987 - protein, 9 aa, Homo Sapiens
SQAGLQHLA

SEQ ID NO: 88988 - protein, 9 aa, Homo Sapiens
IPEPRKPAA

SEQ ID NO: 88989 - protein, 9 aa, Homo Sapiens
GATPRRRTP

SEQ ID NO: 88990 - protein, 9 aa, Homo Sapiens
PLNDSVPAQ

SEQ ID NO: 88991 - protein, 9 aa, Homo Sapiens
IDQEERLKF

SEQ ID NO: 88992 - protein, 9 aa, Homo Sapiens
VWIDPFEVY

SEQ ID NO: 88993 - protein, 9 aa, Homo Sapiens
DGGLVTSQE

SEQ ID NO: 88994 - protein, 9 aa, Homo Sapiens
EEEDLWISA

SEQ ID NO: 88995 - protein, 9 aa, Homo Sapiens
YRKAISQAG

SEQ ID NO: 88996 - protein, 9 aa, Homo Sapiens
MESGDPSTN

SEQ ID NO: 88997 - protein, 9 aa, Homo Sapiens
DLSVNGQRQ

SEQ ID NO: 88998 - protein, 9 aa, Homo Sapiens
RLKFKDEVL

SEQ ID NO: 88999 - protein, 9 aa, Homo Sapiens
QNTIRTADS

SEQ ID NO: 89000 - protein, 9 aa, Homo Sapiens
YKYVMESGD

SEQ ID NO: 89001 - protein, 9 aa, Homo Sapiens
KAISQAGLQ

SEQ ID NO: 89002 - protein, 9 aa, Homo Sapiens
GQRQGLREA

SEQ ID NO: 89003 - protein, 9 aa, Homo Sapiens
LLLSSSISF

SEQ ID NO: 89004 - protein, 9 aa, Homo Sapiens
KKKEEEDLW

SEQ ID NO: 89005 - protein, 9 aa, Homo Sapiens
RPGAGEGPG

SEQ ID NO: 89006 - protein, 9 aa, Homo Sapiens
RMPGTVHSL

SEQ ID NO: 89007 - protein, 9 aa, Homo Sapiens
PFEVYYQIG

SEQ ID NO: 89008 - protein, 9 aa, Homo Sapiens
YNEAYKWCI

SEQ ID NO: 89009 - protein, 9 aa, Homo Sapiens
IDTVEKLPK

SEQ ID NO: 89010 - protein, 9 aa, Homo Sapiens
ISGKRPGAG

SEQ ID NO: 89011 - protein, 9 aa, Homo Sapiens
VYYQIGEKG

SEQ ID NO: 89012 - protein, 9 aa, Homo Sapiens
LKFKDEVLD

SEQ ID NO: 89013 - protein, 9 aa, Homo Sapiens
ISQAGLQHL

SEQ ID NO: 89014 - protein, 9 aa, Homo Sapiens
SHYNEAYKW

SEQ ID NO: 89015 - protein, 9 aa, Homo Sapiens
DPFEVYYQI

SEQ ID NO: 89016 - protein, 9 aa, Homo Sapiens
LVTSQESGQ

SEQ ID NO: 89017 - protein, 9 aa, Homo Sapiens
SLCAHVECP

SEQ ID NO: 89018 - protein, 9 aa, Homo Sapiens
SYRKAISQA

SEQ ID NO: 89019 - protein, 9 aa, Homo Sapiens
LNKNFKNKG

SEQ ID NO: 89020 - protein, 9 aa, Homo Sapiens
EDSQEGRIR

SEQ ID NO: 89021 - protein, 9 aa, Homo Sapiens
SVPAQYSNW

SEQ ID NO: 89022 - protein, 9 aa, Homo Sapiens
QLKKHKGFR

SEQ ID NO: 89023 - protein, 9 aa, Homo Sapiens
GISGKRPGA

SEQ ID NO: 89024 - protein, 9 aa, Homo Sapiens
YKPLNDSVP

SEQ ID NO: 89025 - protein, 9 aa, Homo Sapiens
QQNTIRTAD

SEQ ID NO: 89026 - protein, 9 aa, Homo Sapiens
SGKRPGAGE

SEQ ID NO: 89027 - protein, 9 aa, Homo Sapiens
SRSHPFTLN

SEQ ID NO: 89028 - protein, 9 aa, Homo Sapiens
AISQAGLQH

SEQ ID NO: 89029 - protein, 9 aa, Homo Sapiens
SHPFTLNLL

SEQ ID NO: 89030 - protein, 9 aa, Homo Sapiens
HPFTLNLLP

SEQ ID NO: 89031 - protein, 9 aa, Homo Sapiens
TIRTADSLE

SEQ ID NO: 89032 - protein, 9 aa, Homo Sapiens
VEKLPKHYA

SEQ ID NO: 89033 - protein, 9 aa, Homo Sapiens
LSSSISFYK

SEQ ID NO: 89034 - protein, 9 aa, Homo Sapiens
IDPFEVYYQ

SEQ ID NO: 89035 - protein, 9 aa, Homo Sapiens
LLSSSISFY

SEQ ID NO: 89036 - protein, 9 aa, Homo Sapiens
FDQELLRRQ

SEQ ID NO: 89037 - protein, 9 aa, Homo Sapiens
GDPSTNVIL

SEQ ID NO: 89038 - protein, 9 aa, Homo Sapiens
EQLKKHKGF

SEQ ID NO: 89039 - protein, 9 aa, Homo Sapiens
GGLVTSQES

SEQ ID NO: 89040 - protein, 9 aa, Homo Sapiens
HKGFRRFVR

SEQ ID NO: 89041 - protein, 9 aa, Homo Sapiens
KGISGKRPG

SEQ ID NO: 89042 - protein, 9 aa, Homo Sapiens
ETEPGEVVD

SEQ ID NO: 89043 - protein, 9 aa, Homo Sapiens
GQQNTIRTA

SEQ ID NO: 89044 - protein, 9 aa, Homo Sapiens
NGATPRRRT

SEQ ID NO: 89045 - protein, 9 aa, Homo Sapiens
FAKSHYNEA

SEQ ID NO: 89046 - protein, 9 aa, Homo Sapiens
SGDPSTNVI

SEQ ID NO: 89047 - protein, 9 aa, Homo Sapiens
SQALLEPST

SEQ ID NO: 89048 - protein, 9 aa, Homo Sapiens
LNDSVPAQY

SEQ ID NO: 89049 - protein, 9 aa, Homo Sapiens
KKEEEDLWI

SEQ ID NO: 89050 - protein, 9 aa, Homo Sapiens
NTIRTADSL

SEQ ID NO: 89051 - protein, 9 aa, Homo Sapiens
PVSASRSHP

SEQ ID NO: 89052 - protein, 9 aa, Homo Sapiens
IILEDSQEG

SEQ ID NO: 89053 - protein, 9 aa, Homo Sapiens
NEAYKWCIE

SEQ ID NO: 89054 - protein, 9 aa, Homo Sapiens
TVHSLWHSV

SEQ ID NO: 89055 - protein, 9 aa, Homo Sapiens
KFKDEVLDM

SEQ ID NO: 89056 - protein, 9 aa, Homo Sapiens
VNGQRQGLR

SEQ ID NO: 89057 - protein, 9 aa, Homo Sapiens
TEPGEVVDS

SEQ ID NO: 89058 - protein, 9 aa, Homo Sapiens
LSVNGQRQG

SEQ ID NO: 89059 - protein, 9 aa, Homo Sapiens
QEGRIRALI

SEQ ID NO: 89060 - protein, 9 aa, Homo Sapiens
FYKYVMESG

SEQ ID NO: 89061 - protein, 9 aa, Homo Sapiens
VMESGDPST

SEQ ID NO: 89062 - protein, 9 aa, Homo Sapiens
FKDEVLDMY

SEQ ID NO: 89063 - protein, 9 aa, Homo Sapiens
HYNEAYKWC

SEQ ID NO: 89064 - protein, 9 aa, Homo Sapiens
SVNGQRQGL

SEQ ID NO: 89065 - protein, 9 aa, Homo Sapiens
SPPAETEPG

SEQ ID NO: 89066 - protein, 9 aa, Homo Sapiens
EPRKPAADQ

SEQ ID NO: 89067 - protein, 9 aa, Homo Sapiens
VSASRSHPF

SEQ ID NO: 89068 - protein, 9 aa, Homo Sapiens
DSSGQQNTI

SEQ ID NO: 89069 - protein, 9 aa, Homo Sapiens
ETVAENPLN

SEQ ID NO: 89070 - protein, 9 aa, Homo Sapiens
KKHKGFRRF

SEQ ID NO: 89071 - protein, 9 aa, Homo Sapiens
ALLEPSTLV

SEQ ID NO: 89072 - protein, 9 aa, Homo Sapiens
FYKDRNEAR

SEQ ID NO: 89073 - protein, 9 aa, Homo Sapiens
KSHYNEAYK

SEQ ID NO: 89074 - protein, 9 aa, Homo Sapiens
WIDPFEVYY

SEQ ID NO: 89075 - protein, 9 aa, Homo Sapiens
KDGGLVTSQ

SEQ ID NO: 89076 - protein, 9 aa, Homo Sapiens
LQEQLKKHK

SEQ ID NO: 89077 - protein, 9 aa, Homo Sapiens
RRTPGIGWL

SEQ ID NO: 89078 - protein, 9 aa, Homo Sapiens
CPFDQELLR

SEQ ID NO: 89079 - protein, 9 aa, Homo Sapiens
LLFAKSHYN

SEQ ID NO: 89080 - protein, 9 aa, Homo Sapiens
PAQYSNWLL

SEQ ID NO: 89081 - protein, 9 aa, Homo Sapiens
SFYKDRNEA

SEQ ID NO: 89082 - protein, 9 aa, Homo Sapiens
SQEGRIRAL

SEQ ID NO: 89083 - protein, 9 aa, Homo Sapiens
KPLNDSVPA

SEQ ID NO: 89084 - protein, 9 aa, Homo Sapiens
RLQCPFDQE

SEQ ID NO: 89085 - protein, 9 aa, Homo Sapiens
EEPSIPEPR

SEQ ID NO: 89086 - protein, 9 aa, Homo Sapiens
PAETEPGEV

SEQ ID NO: 89087 - protein, 9 aa, Homo Sapiens
AKRLQCPFD

SEQ ID NO: 89088 - protein, 9 aa, Homo Sapiens
KKKKEEEDL

SEQ ID NO: 89089 - protein, 9 aa, Homo Sapiens
TPRRRTPGI

SEQ ID NO: 89090 - protein, 9 aa, Homo Sapiens
DSVPAQYSN

SEQ ID NO: 89091 - protein, 9 aa, Homo Sapiens
LKKHKGFRR

SEQ ID NO: 89092 - protein, 9 aa, Homo Sapiens
SLWHSVKQT

SEQ ID NO: 89093 - protein, 9 aa, Homo Sapiens
GTVHSLWHS

SEQ ID NO: 89094 - protein, 9 aa, Homo Sapiens
ERLKFKDEV

SEQ ID NO: 89095 - protein, 9 aa, Homo Sapiens
KRLQCPFDQ

SEQ ID NO: 89096 - protein, 9 aa, Homo Sapiens
QRQGLREAL

SEQ ID NO: 89097 - protein, 9 aa, Homo Sapiens
LEDSQEGRI

SEQ ID NO: 89098 - protein, 9 aa, Homo Sapiens
RKAISQAGL

SEQ ID NO: 89099 - protein, 9 aa, Homo Sapiens
KEEEDLWIS

SEQ ID NO: 89100 - protein, 9 aa, Homo Sapiens
KRPGAGEGP

SEQ ID NO: 89101 - protein, 9 aa, Homo Sapiens
PFDQELLRR

SEQ ID NO: 89102 - protein, 9 aa, Homo Sapiens
EVYYQIGEK

SEQ ID NO: 89103 - protein, 9 aa, Homo Sapiens
KNKGKVQLK

SEQ ID NO: 89104 - protein, 9 aa, Homo Sapiens
DQEERLKFK

SEQ ID NO: 89105 - protein, 9 aa, Homo Sapiens
PGTVHSLWH

SEQ ID NO: 89106 - protein, 9 aa, Homo Sapiens
AKSHYNEAY

SEQ ID NO: 89107 - protein, 9 aa, Homo Sapiens
ESGDPSTNV

SEQ ID NO: 89108 - protein, 9 aa, Homo Sapiens
AETEPGEVV

SEQ ID NO: 89109 - protein, 9 aa, Homo Sapiens
KHKGFRRFV

SEQ ID NO: 89110 - protein, 9 aa, Homo Sapiens
KKKKKEEED

SEQ ID NO: 89111 - protein, 9 aa, Homo Sapiens
DSQEGRIRA

SEQ ID NO: 89112 - protein, 9 aa, Homo Sapiens
ASRSHPFTL

SEQ ID NO: 89113 - protein, 9 aa, Homo Sapiens
SKLNKNFKN

SEQ ID NO: 89114 - protein, 9 aa, Homo Sapiens
GKRPGAGEG

SEQ ID NO: 89115 - protein, 9 aa, Homo Sapiens
FKNKGKVQL

SEQ ID NO: 89116 - protein, 9 aa, Homo Sapiens
APTKSQKLP

SEQ ID NO: 89117 - protein, 9 aa, Homo Sapiens
AVGASLTRS

SEQ ID NO: 89118 - protein, 9 aa, Homo Sapiens
QVLLNTFDK

SEQ ID NO: 89119 - protein, 9 aa, Homo Sapiens
VEEYESLIE

SEQ ID NO: 89120 - protein, 9 aa, Homo Sapiens
NGELKITSV

SEQ ID NO: 89121 - protein, 9 aa, Homo Sapiens
AILWHNYEL

SEQ ID NO: 89122 - protein, 9 aa, Homo Sapiens
EKGTVREDA

SEQ ID NO: 89123 - protein, 9 aa, Homo Sapiens
MTTTLLDTV

SEQ ID NO: 89124 - protein, 9 aa, Homo Sapiens
LVEEYESLI

SEQ ID NO: 89125 - protein, 9 aa, Homo Sapiens
EELKMTNPA

SEQ ID NO: 89126 - protein, 9 aa, Homo Sapiens
EQLLREERK

SEQ ID NO: 89127 - protein, 9 aa, Homo Sapiens
CQARDGGRL

SEQ ID NO: 89128 - protein, 9 aa, Homo Sapiens
AHYGRPKIN

SEQ ID NO: 89129 - protein, 9 aa, Homo Sapiens
WHNYELLVE

SEQ ID NO: 89130 - protein, 9 aa, Homo Sapiens
ATNYSLRVH

SEQ ID NO: 89131 - protein, 9 aa, Homo Sapiens
DEDPCPSVL

SEQ ID NO: 89132 - protein, 9 aa, Homo Sapiens
MVIQTELSW

SEQ ID NO: 89133 - protein, 9 aa, Homo Sapiens
EHYIKLIGF

SEQ ID NO: 89134 - protein, 9 aa, Homo Sapiens
DDESHWRYG

SEQ ID NO: 89135 - protein, 9 aa, Homo Sapiens
LRFEELKMT

SEQ ID NO: 89136 - protein, 9 aa, Homo Sapiens
TITNLLQGA

SEQ ID NO: 89137 - protein, 9 aa, Homo Sapiens
VITTFIEIF

SEQ ID NO: 89138 - protein, 9 aa, Homo Sapiens
NFYSNLMLQ

SEQ ID NO: 89139 - protein, 9 aa, Homo Sapiens
WALASQHGR

SEQ ID NO: 89140 - protein, 9 aa, Homo Sapiens
LENFYSNLM

SEQ ID NO: 89141 - protein, 9 aa, Homo Sapiens
KVSCSDTWV

SEQ ID NO: 89142 - protein, 9 aa, Homo Sapiens
TFIEIFITG

SEQ ID NO: 89143 - protein, 9 aa, Homo Sapiens
YESLIEKMS

SEQ ID NO: 89144 - protein, 9 aa, Homo Sapiens
ATQSNALSS

SEQ ID NO: 89145 - protein, 9 aa, Homo Sapiens
LCEEELAAM

SEQ ID NO: 89146 - protein, 9 aa, Homo Sapiens
EAQRQKIQC

SEQ ID NO: 89147 - protein, 9 aa, Homo Sapiens
LLQGAVAFM

SEQ ID NO: 89148 - protein, 9 aa, Homo Sapiens
QRQKIQCTA

SEQ ID NO: 89149 - protein, 9 aa, Homo Sapiens
NVVDINSAG

SEQ ID NO: 89150 - protein, 9 aa, Homo Sapiens
ACGFSSRIL

SEQ ID NO: 89151 - protein, 9 aa, Homo Sapiens
GRVWALASQ

SEQ ID NO: 89152 - protein, 9 aa, Homo Sapiens
RMCAKQCDS

SEQ ID NO: 89153 - protein, 9 aa, Homo Sapiens
GCPGGAGAG

SEQ ID NO: 89154 - protein, 9 aa, Homo Sapiens
LLQLLGSVQ

SEQ ID NO: 89155 - protein, 9 aa, Homo Sapiens
ILLQKVASM

SEQ ID NO: 89156 - protein, 9 aa, Homo Sapiens
FYSNLMLQH

SEQ ID NO: 89157 - protein, 9 aa, Homo Sapiens
VQGGGFNER

SEQ ID NO: 89158 - protein, 9 aa, Homo Sapiens
RDSAVGASL

SEQ ID NO: 89159 - protein, 9 aa, Homo Sapiens
GGAGAGQPA

SEQ ID NO: 89160 - protein, 9 aa, Homo Sapiens
LEKILLQKV

SEQ ID NO: 89161 - protein, 9 aa, Homo Sapiens
LWHNYELLV

SEQ ID NO: 89162 - protein, 9 aa, Homo Sapiens
DPLFRWLVS

SEQ ID NO: 89163 - protein, 9 aa, Homo Sapiens
GKAFGSTNS

SEQ ID NO: 89164 - protein, 9 aa, Homo Sapiens
HNYELLVEY

SEQ ID NO: 89165 - protein, 9 aa, Homo Sapiens
GRLAFRRRG

SEQ ID NO: 89166 - protein, 9 aa, Homo Sapiens
LSINDGFHI

SEQ ID NO: 89167 - protein, 9 aa, Homo Sapiens
KGTVREDAP

SEQ ID NO: 89168 - protein, 9 aa, Homo Sapiens
QSIAPTKSQ

SEQ ID NO: 89169 - protein, 9 aa, Homo Sapiens
NALSSVSCM

SEQ ID NO: 89170 - protein, 9 aa, Homo Sapiens
YGRLAFRRR

SEQ ID NO: 89171 - protein, 9 aa, Homo Sapiens
RRDSAVGAS

SEQ ID NO: 89172 - protein, 9 aa, Homo Sapiens
TLRFEELKM

SEQ ID NO: 89173 - protein, 9 aa, Homo Sapiens
LHFTLRFEE

SEQ ID NO: 89174 - protein, 9 aa, Homo Sapiens
ECGMTFSRK

SEQ ID NO: 89175 - protein, 9 aa, Homo Sapiens
QVGACGFSS

SEQ ID NO: 89176 - protein, 9 aa, Homo Sapiens
NLMLQHEER

SEQ ID NO: 89177 - protein, 9 aa, Homo Sapiens
HIYQKGCFQ

SEQ ID NO: 89178 - protein, 9 aa, Homo Sapiens
PLLKVSCSD

SEQ ID NO: 89179 - protein, 9 aa, Homo Sapiens
EEYESLIEK

SEQ ID NO: 89180 - protein, 9 aa, Homo Sapiens
FVEKGTVRE

SEQ ID NO: 89181 - protein, 9 aa, Homo Sapiens
GGRGDGQPL

SEQ ID NO: 89182 - protein, 9 aa, Homo Sapiens
PDIAWFQVL

SEQ ID NO: 89183 - protein, 9 aa, Homo Sapiens
ERPYLQVKA

SEQ ID NO: 89184 - protein, 9 aa, Homo Sapiens
KTHMNARAV

SEQ ID NO: 89185 - protein, 9 aa, Homo Sapiens
AWFQVLLNT

SEQ ID NO: 89186 - protein, 9 aa, Homo Sapiens
VEKGTVRED

SEQ ID NO: 89187 - protein, 9 aa, Homo Sapiens
MLQHEERET

SEQ ID NO: 89188 - protein, 9 aa, Homo Sapiens
FILVVSQEM

SEQ ID NO: 89189 - protein, 9 aa, Homo Sapiens
RPYLQVKAE

SEQ ID NO: 89190 - protein, 9 aa, Homo Sapiens
TNLLQGAVA

SEQ ID NO: 89191 - protein, 9 aa, Homo Sapiens
CVMWNVVDI

SEQ ID NO: 89192 - protein, 9 aa, Homo Sapiens
WSLLGKLVS

SEQ ID NO: 89193 - protein, 9 aa, Homo Sapiens
RRTVGIFYE

SEQ ID NO: 89194 - protein, 9 aa, Homo Sapiens
GSTNSLYEH

SEQ ID NO: 89195 - protein, 9 aa, Homo Sapiens
HTTALPDST

SEQ ID NO: 89196 - protein, 9 aa, Homo Sapiens
SSCSRMCAK

SEQ ID NO: 89197 - protein, 9 aa, Homo Sapiens
RGDGQPLPH

SEQ ID NO: 89198 - protein, 9 aa, Homo Sapiens
CLGAVPVRA

SEQ ID NO: 89199 - protein, 9 aa, Homo Sapiens
VLGAKARNS

SEQ ID NO: 89200 - protein, 9 aa, Homo Sapiens
NYELLVEYD

SEQ ID NO: 89201 - protein, 9 aa, Homo Sapiens
RDGGRLSGC

SEQ ID NO: 89202 - protein, 9 aa, Homo Sapiens
GRLSGCPGG

SEQ ID NO: 89203 - protein, 9 aa, Homo Sapiens
QLVITTFIE

SEQ ID NO: 89204 - protein, 9 aa, Homo Sapiens
IAWFQVLLN

SEQ ID NO: 89205 - protein, 9 aa, Homo Sapiens
NDGFHIYQK

SEQ ID NO: 89206 - protein, 9 aa, Homo Sapiens
PAVPGGHEA

SEQ ID NO: 89207 - protein, 9 aa, Homo Sapiens
EAAGGRGDG

SEQ ID NO: 89208 - protein, 9 aa, Homo Sapiens
QSNALSSVS

SEQ ID NO: 89209 - protein, 9 aa, Homo Sapiens
IEHYIKLIG

SEQ ID NO: 89210 - protein, 9 aa, Homo Sapiens
GLGRVWALA

SEQ ID NO: 89211 - protein, 9 aa, Homo Sapiens
GMRYAFLGP

SEQ ID NO: 89212 - protein, 9 aa, Homo Sapiens
ERSFLLDLL

SEQ ID NO: 89213 - protein, 9 aa, Homo Sapiens
LKLAGWQCP

SEQ ID NO: 89214 - protein, 9 aa, Homo Sapiens
THTTALPDS

SEQ ID NO: 89215 - protein, 9 aa, Homo Sapiens
EPALQMLRH

SEQ ID NO: 89216 - protein, 9 aa, Homo Sapiens
MAQTLEKIL

SEQ ID NO: 89217 - protein, 9 aa, Homo Sapiens
HEAAGGRGD

SEQ ID NO: 89218 - protein, 9 aa, Homo Sapiens
LILPQHTCL

SEQ ID NO: 89219 - protein, 9 aa, Homo Sapiens
LDTVFHHVS

SEQ ID NO: 89220 - protein, 9 aa, Homo Sapiens
AFRRRGLPT

SEQ ID NO: 89221 - protein, 9 aa, Homo Sapiens
RKGAILCEE

SEQ ID NO: 89222 - protein, 9 aa, Homo Sapiens
ILWHNYELL

SEQ ID NO: 89223 - protein, 9 aa, Homo Sapiens
ILVEEYESL

SEQ ID NO: 89224 - protein, 9 aa, Homo Sapiens
DKEGDDESH

SEQ ID NO: 89225 - protein, 9 aa, Homo Sapiens
INGELKITS

SEQ ID NO: 89226 - protein, 9 aa, Homo Sapiens
DPCPSVLGA

SEQ ID NO: 89227 - protein, 9 aa, Homo Sapiens
FEELKMTNP

SEQ ID NO: 89228 - protein, 9 aa, Homo Sapiens
LVSFSPAHP

SEQ ID NO: 89229 - protein, 9 aa, Homo Sapiens
IFYEVAYTV

SEQ ID NO: 89230 - protein, 9 aa, Homo Sapiens
FRRRGLPTI

SEQ ID NO: 89231 - protein, 9 aa, Homo Sapiens
TEEPALQML

SEQ ID NO: 89232 - protein, 9 aa, Homo Sapiens
LASQHGRIS

SEQ ID NO: 89233 - protein, 9 aa, Homo Sapiens
LILVEEYES

SEQ ID NO: 89234 - protein, 9 aa, Homo Sapiens
FSPAHPGLW

SEQ ID NO: 89235 - protein, 9 aa, Homo Sapiens
PVLKSNKGE

SEQ ID NO: 89236 - protein, 9 aa, Homo Sapiens
PKINGELKI

SEQ ID NO: 89237 - protein, 9 aa, Homo Sapiens
KNLGKLVFS

SEQ ID NO: 89238 - protein, 9 aa, Homo Sapiens
KINGELKIT

SEQ ID NO: 89239 - protein, 9 aa, Homo Sapiens
HTCLRTNRF

SEQ ID NO: 89240 - protein, 9 aa, Homo Sapiens
PQLCQARDG

SEQ ID NO: 89241 - protein, 9 aa, Homo Sapiens
IYQKGCFQV

SEQ ID NO: 89242 - protein, 9 aa, Homo Sapiens
KLILPQHTC

SEQ ID NO: 89243 - protein, 9 aa, Homo Sapiens
VSCSDTWVI

SEQ ID NO: 89244 - protein, 9 aa, Homo Sapiens
LGLTEEPAL

SEQ ID NO: 89245 - protein, 9 aa, Homo Sapiens
QTLEKILLQ

SEQ ID NO: 89246 - protein, 9 aa, Homo Sapiens
LDIRPKVWS

SEQ ID NO: 89247 - protein, 9 aa, Homo Sapiens
PGSTHTTAL

SEQ ID NO: 89248 - protein, 9 aa, Homo Sapiens
AKKEKEKNE

SEQ ID NO: 89249 - protein, 9 aa, Homo Sapiens
GSLGLLVSF

SEQ ID NO: 89250 - protein, 9 aa, Homo Sapiens
IRPKVWSLL

SEQ ID NO: 89251 - protein, 9 aa, Homo Sapiens
PKVWSLLGK

SEQ ID NO: 89252 - protein, 9 aa, Homo Sapiens
TPCSSLGLS

SEQ ID NO: 89253 - protein, 9 aa, Homo Sapiens
IQCTARKLF

SEQ ID NO: 89254 - protein, 9 aa, Homo Sapiens
LREERKKRR

SEQ ID NO: 89255 - protein, 9 aa, Homo Sapiens
YFILVVSQE

SEQ ID NO: 89256 - protein, 9 aa, Homo Sapiens
HFTLRFEEL

SEQ ID NO: 89257 - protein, 9 aa, Homo Sapiens
AVPGGHEAA

SEQ ID NO: 89258 - protein, 9 aa, Homo Sapiens
SNALSSVSC

SEQ ID NO: 89259 - protein, 9 aa, Homo Sapiens
LGMRYAFLG

SEQ ID NO: 89260 - protein, 9 aa, Homo Sapiens
LAFRRRGLP

SEQ ID NO: 89261 - protein, 9 aa, Homo Sapiens
REDAPVGSL

SEQ ID NO: 89262 - protein, 9 aa, Homo Sapiens
EKRVVSGSQ

SEQ ID NO: 89263 - protein, 9 aa, Homo Sapiens
KVWSLLGKL

SEQ ID NO: 89264 - protein, 9 aa, Homo Sapiens
EMKNLGKLV

SEQ ID NO: 89265 - protein, 9 aa, Homo Sapiens
LMLQHEERE

SEQ ID NO: 89266 - protein, 9 aa, Homo Sapiens
VPVLKSNKG

SEQ ID NO: 89267 - protein, 9 aa, Homo Sapiens
ITTFIEIFI

SEQ ID NO: 89268 - protein, 9 aa, Homo Sapiens
PYLQVKAEP

SEQ ID NO: 89269 - protein, 9 aa, Homo Sapiens
DINSAGERS

SEQ ID NO: 89270 - protein, 9 aa, Homo Sapiens
PLFRWLVSR

SEQ ID NO: 89271 - protein, 9 aa, Homo Sapiens
LAKATYDPL

SEQ ID NO: 89272 - protein, 9 aa, Homo Sapiens
INDGFHIYQ

SEQ ID NO: 89273 - protein, 9 aa, Homo Sapiens
CGKAFGSTN

SEQ ID NO: 89274 - protein, 9 aa, Homo Sapiens
RSVLTRHQI

SEQ ID NO: 89275 - protein, 9 aa, Homo Sapiens
MKNLGKLVF

SEQ ID NO: 89276 - protein, 9 aa, Homo Sapiens
SLGLLVSFS

SEQ ID NO: 89277 - protein, 9 aa, Homo Sapiens
KSQKLPRAD

SEQ ID NO: 89278 - protein, 9 aa, Homo Sapiens
KPDIAWFQV

SEQ ID NO: 89279 - protein, 9 aa, Homo Sapiens
VGACGFSSR

SEQ ID NO: 89280 - protein, 9 aa, Homo Sapiens
IFRASVQGG

SEQ ID NO: 89281 - protein, 9 aa, Homo Sapiens
QARDGGRLS

SEQ ID NO: 89282 - protein, 9 aa, Homo Sapiens
EIPERRDSA

SEQ ID NO: 89283 - protein, 9 aa, Homo Sapiens
FHIYQKGCF

SEQ ID NO: 89284 - protein, 9 aa, Homo Sapiens
IAPTKSQKL

SEQ ID NO: 89285 - protein, 9 aa, Homo Sapiens
ILCEEELAA

SEQ ID NO: 89286 - protein, 9 aa, Homo Sapiens
LLREERKKR

SEQ ID NO: 89287 - protein, 9 aa, Homo Sapiens
ALAKATYDP

SEQ ID NO: 89288 - protein, 9 aa, Homo Sapiens
DGFHIYQKG

SEQ ID NO: 89289 - protein, 9 aa, Homo Sapiens
QLLGSVQPQ

SEQ ID NO: 89290 - protein, 9 aa, Homo Sapiens
QGAVAFMPE

SEQ ID NO: 89291 - protein, 9 aa, Homo Sapiens
LQGAVAFMP

SEQ ID NO: 89292 - protein, 9 aa, Homo Sapiens
LLVSFSPAH

SEQ ID NO: 89293 - protein, 9 aa, Homo Sapiens
SGCPGGAGA

SEQ ID NO: 89294 - protein, 9 aa, Homo Sapiens
HGCLGAVPV

SEQ ID NO: 89295 - protein, 9 aa, Homo Sapiens
TTALPDSTT

SEQ ID NO: 89296 - protein, 9 aa, Homo Sapiens
LGLLVSFSP

SEQ ID NO: 89297 - protein, 9 aa, Homo Sapiens
FSSRILSFV

SEQ ID NO: 89298 - protein, 9 aa, Homo Sapiens
LIFRASVQG

SEQ ID NO: 89299 - protein, 9 aa, Homo Sapiens
RVWALASQH

SEQ ID NO: 89300 - protein, 9 aa, Homo Sapiens
ACGKTFYHR

SEQ ID NO: 89301 - protein, 9 aa, Homo Sapiens
CEEELAAMS

SEQ ID NO: 89302 - protein, 9 aa, Homo Sapiens
FRDGYFILV

SEQ ID NO: 89303 - protein, 9 aa, Homo Sapiens
GDEDPCPSV

SEQ ID NO: 89304 - protein, 9 aa, Homo Sapiens
LVITTFIEI

SEQ ID NO: 89305 - protein, 9 aa, Homo Sapiens
VVDINSAGE

SEQ ID NO: 89306 - protein, 9 aa, Homo Sapiens
KGAILCEEE

SEQ ID NO: 89307 - protein, 9 aa, Homo Sapiens
FRASVQGGG

SEQ ID NO: 89308 - protein, 9 aa, Homo Sapiens
CPSVLGAKA

SEQ ID NO: 89309 - protein, 9 aa, Homo Sapiens
ENFYSNLML

SEQ ID NO: 89310 - protein, 9 aa, Homo Sapiens
LLDTVFHHV

SEQ ID NO: 89311 - protein, 9 aa, Homo Sapiens
ASVQGGGFN

SEQ ID NO: 89312 - protein, 9 aa, Homo Sapiens
REERKKRRR

SEQ ID NO: 89313 - protein, 9 aa, Homo Sapiens
GSTHTTALP

SEQ ID NO: 89314 - protein, 9 aa, Homo Sapiens
QTELSWGLY

SEQ ID NO: 89315 - protein, 9 aa, Homo Sapiens
MHYGRLAFR

SEQ ID NO: 89316 - protein, 9 aa, Homo Sapiens
LRVHCANAL

SEQ ID NO: 89317 - protein, 9 aa, Homo Sapiens
ALSSVSCMP

SEQ ID NO: 89318 - protein, 9 aa, Homo Sapiens
KRVVSGSQD

SEQ ID NO: 89319 - protein, 9 aa, Homo Sapiens
GLTEEPALQ

SEQ ID NO: 89320 - protein, 9 aa, Homo Sapiens
AFGSTNSLY

SEQ ID NO: 89321 - protein, 9 aa, Homo Sapiens
YAFLGPLET

SEQ ID NO: 89322 - protein, 9 aa, Homo Sapiens
YKCNECGMT

SEQ ID NO: 89323 - protein, 9 aa, Homo Sapiens
PGGAGAGQP

SEQ ID NO: 89324 - protein, 9 aa, Homo Sapiens
VDINSAGER

SEQ ID NO: 89325 - protein, 9 aa, Homo Sapiens
ILPQHTCLR

SEQ ID NO: 89326 - protein, 9 aa, Homo Sapiens
KSSCSRMCA

SEQ ID NO: 89327 - protein, 9 aa, Homo Sapiens
YEVAYTVGL

SEQ ID NO: 89328 - protein, 9 aa, Homo Sapiens
ALQMLRHPT

SEQ ID NO: 89329 - protein, 9 aa, Homo Sapiens
ASVPVLKSN

SEQ ID NO: 89330 - protein, 9 aa, Homo Sapiens
LTITNLLQG

SEQ ID NO: 89331 - protein, 9 aa, Homo Sapiens
VWSLLGKLV

SEQ ID NO: 89332 - protein, 9 aa, Homo Sapiens
ILHFTLRFE

SEQ ID NO: 89333 - protein, 9 aa, Homo Sapiens
PHGCLGAVP

SEQ ID NO: 89334 - protein, 9 aa, Homo Sapiens
AQLVITTFI

SEQ ID NO: 89335 - protein, 9 aa, Homo Sapiens
WNVVDINSA

SEQ ID NO: 89336 - protein, 9 aa, Homo Sapiens
TPLKLAGWQ

SEQ ID NO: 89337 - protein, 9 aa, Homo Sapiens
CVAAILWHN

SEQ ID NO: 89338 - protein, 9 aa, Homo Sapiens
QGGGFNERC

SEQ ID NO: 89339 - protein, 9 aa, Homo Sapiens
LSGCPGGAG

SEQ ID NO: 89340 - protein, 9 aa, Homo Sapiens
SVQGGGFNE

SEQ ID NO: 89341 - protein, 9 aa, Homo Sapiens
GAGQPAVPG

SEQ ID NO: 89342 - protein, 9 aa, Homo Sapiens
GGHEAAGGR

SEQ ID NO: 89343 - protein, 9 aa, Homo Sapiens
YSLRVHCAN

SEQ ID NO: 89344 - protein, 9 aa, Homo Sapiens
KEMKNLGKL

SEQ ID NO: 89345 - protein, 9 aa, Homo Sapiens
ELDIRPKVW

SEQ ID NO: 89346 - protein, 9 aa, Homo Sapiens
SLRVHCANA

SEQ ID NO: 89347 - protein, 9 aa, Homo Sapiens
CDAGPLLKV

SEQ ID NO: 89348 - protein, 9 aa, Homo Sapiens
SGSQDATLR

SEQ ID NO: 89349 - protein, 9 aa, Homo Sapiens
QHTCLRTNR

SEQ ID NO: 89350 - protein, 9 aa, Homo Sapiens
KQKAKKEKE

SEQ ID NO: 89351 - protein, 9 aa, Homo Sapiens
VVMVIQTEL

SEQ ID NO: 89352 - protein, 9 aa, Homo Sapiens
RVVSGSQDA

SEQ ID NO: 89353 - protein, 9 aa, Homo Sapiens
RYAFLGPLE

SEQ ID NO: 89354 - protein, 9 aa, Homo Sapiens
IVVMVIQTE

SEQ ID NO: 89355 - protein, 9 aa, Homo Sapiens
INSAGERSR

SEQ ID NO: 89356 - protein, 9 aa, Homo Sapiens
TLLDTVFHH

SEQ ID NO: 89357 - protein, 9 aa, Homo Sapiens
EEPALQMLR

SEQ ID NO: 89358 - protein, 9 aa, Homo Sapiens
YLKEMKNLG

SEQ ID NO: 89359 - protein, 9 aa, Homo Sapiens
GGRLSGCPG

SEQ ID NO: 89360 - protein, 9 aa, Homo Sapiens
AAILWHNYE

SEQ ID NO: 89361 - protein, 9 aa, Homo Sapiens
ARDGGRLSG

SEQ ID NO: 89362 - protein, 9 aa, Homo Sapiens
LGAVPVRAL

SEQ ID NO: 89363 - protein, 9 aa, Homo Sapiens
AQTLEKILL

SEQ ID NO: 89364 - protein, 9 aa, Homo Sapiens
LGKLVFSRC

SEQ ID NO: 89365 - protein, 9 aa, Homo Sapiens
QPLPHGCLG

SEQ ID NO: 89366 - protein, 9 aa, Homo Sapiens
MCAKQCDSY

SEQ ID NO: 89367 - protein, 9 aa, Homo Sapiens
GNCQASVPV

SEQ ID NO: 89368 - protein, 9 aa, Homo Sapiens
SVQPQLCQA

SEQ ID NO: 89369 - protein, 9 aa, Homo Sapiens
LLQKVASMP

SEQ ID NO: 89370 - protein, 9 aa, Homo Sapiens
SSRILSFVY

SEQ ID NO: 89371 - protein, 9 aa, Homo Sapiens
DESHWRYGG

SEQ ID NO: 89372 - protein, 9 aa, Homo Sapiens
QCTARKLFG

SEQ ID NO: 89373 - protein, 9 aa, Homo Sapiens
FIEIFITGT

SEQ ID NO: 89374 - protein, 9 aa, Homo Sapiens
HFERPYLQV

SEQ ID NO: 89375 - protein, 9 aa, Homo Sapiens
LDPQGERSF

SEQ ID NO: 89376 - protein, 9 aa, Homo Sapiens
QPAVPGGHE

SEQ ID NO: 89377 - protein, 9 aa, Homo Sapiens
KAKKEKEKN

SEQ ID NO: 89378 - protein, 9 aa, Homo Sapiens
GSQDATLRV

SEQ ID NO: 89379 - protein, 9 aa, Homo Sapiens
TTTLLDTVF

SEQ ID NO: 89380 - protein, 9 aa, Homo Sapiens
TTFIEIFIT

SEQ ID NO: 89381 - protein, 9 aa, Homo Sapiens
RKKRRRQEL

SEQ ID NO: 89382 - protein, 9 aa, Homo Sapiens
TKRKGAILC

SEQ ID NO: 89383 - protein, 9 aa, Homo Sapiens
GFSSRILSF

SEQ ID NO: 89384 - protein, 9 aa, Homo Sapiens
DAGPLLKVS

SEQ ID NO: 89385 - protein, 9 aa, Homo Sapiens
VAAILWHNY

SEQ ID NO: 89386 - protein, 9 aa, Homo Sapiens
GIFYEVAYT

SEQ ID NO: 89387 - protein, 9 aa, Homo Sapiens
PLKLAGWQC

SEQ ID NO: 89388 - protein, 9 aa, Homo Sapiens
LLGSVQPQL

SEQ ID NO: 89389 - protein, 9 aa, Homo Sapiens
GKTFYHRSV

SEQ ID NO: 89390 - protein, 9 aa, Homo Sapiens
GERSFLLDL

SEQ ID NO: 89391 - protein, 9 aa, Homo Sapiens
SRMCAKQCD

SEQ ID NO: 89392 - protein, 9 aa, Homo Sapiens
TFYHRSVLT

SEQ ID NO: 89393 - protein, 9 aa, Homo Sapiens
VKSSCSRMC

SEQ ID NO: 89394 - protein, 9 aa, Homo Sapiens
VREDAPVGS

SEQ ID NO: 89395 - protein, 9 aa, Homo Sapiens
FLIFRASVQ

SEQ ID NO: 89396 - protein, 9 aa, Homo Sapiens
DSAVGASLT

SEQ ID NO: 89397 - protein, 9 aa, Homo Sapiens
CNECGMTFS

SEQ ID NO: 89398 - protein, 9 aa, Homo Sapiens
IQTELSWGL

SEQ ID NO: 89399 - protein, 9 aa, Homo Sapiens
RDKEGDDES

SEQ ID NO: 89400 - protein, 9 aa, Homo Sapiens
AQRQKIQCT

SEQ ID NO: 89401 - protein, 9 aa, Homo Sapiens
DGGRLSGCP

SEQ ID NO: 89402 - protein, 9 aa, Homo Sapiens
YHRSVLTRH

SEQ ID NO: 89403 - protein, 9 aa, Homo Sapiens
ERKKRRRQE

SEQ ID NO: 89404 - protein, 9 aa, Homo Sapiens
VTPLKLAGW

SEQ ID NO: 89405 - protein, 9 aa, Homo Sapiens
EYESLIEKM

SEQ ID NO: 89406 - protein, 9 aa, Homo Sapiens
GMGLDPQGE

SEQ ID NO: 89407 - protein, 9 aa, Homo Sapiens
PLPHGCLGA

SEQ ID NO: 89408 - protein, 9 aa, Homo Sapiens
ECGKAFGST

SEQ ID NO: 89409 - protein, 9 aa, Homo Sapiens
PERRDSAVG

SEQ ID NO: 89410 - protein, 9 aa, Homo Sapiens
RLSGCPGGA

SEQ ID NO: 89411 - protein, 9 aa, Homo Sapiens
CQASVPVLK

SEQ ID NO: 89412 - protein, 9 aa, Homo Sapiens
TNSLYEHRR

SEQ ID NO: 89413 - protein, 9 aa, Homo Sapiens
SDTPCSSLG

SEQ ID NO: 89414 - protein, 9 aa, Homo Sapiens
QKAKKEKEK

SEQ ID NO: 89415 - protein, 9 aa, Homo Sapiens
GDDESHWRY

SEQ ID NO: 89416 - protein, 9 aa, Homo Sapiens
FQVLLNTFD

SEQ ID NO: 89417 - protein, 9 aa, Homo Sapiens
DTPCSSLGL

SEQ ID NO: 89418 - protein, 9 aa, Homo Sapiens
EERKKRRRQ

SEQ ID NO: 89419 - protein, 9 aa, Homo Sapiens
QGERSFLLD

SEQ ID NO: 89420 - protein, 9 aa, Homo Sapiens
VGIFYEVAY

SEQ ID NO: 89421 - protein, 9 aa, Homo Sapiens
IQSIAPTKS

SEQ ID NO: 89422 - protein, 9 aa, Homo Sapiens
AGPLLKVSC

SEQ ID NO: 89423 - protein, 9 aa, Homo Sapiens
GKLVFSRCH

SEQ ID NO: 89424 - protein, 9 aa, Homo Sapiens
IAVTPLKLA

SEQ ID NO: 89425 - protein, 9 aa, Homo Sapiens
LPHGCLGAV

SEQ ID NO: 89426 - protein, 9 aa, Homo Sapiens
LPQHTCLRT

SEQ ID NO: 89427 - protein, 9 aa, Homo Sapiens
LGPLETMHL

SEQ ID NO: 89428 - protein, 9 aa, Homo Sapiens
GYFILVVSQ

SEQ ID NO: 89429 - protein, 9 aa, Homo Sapiens
LAGWQCPEC

SEQ ID NO: 89430 - protein, 9 aa, Homo Sapiens
HYIKLIGFF

SEQ ID NO: 89431 - protein, 9 aa, Homo Sapiens
GFHIYQKGC

SEQ ID NO: 89432 - protein, 9 aa, Homo Sapiens
GMTTTLLDT

SEQ ID NO: 89433 - protein, 9 aa, Homo Sapiens
AVTPLKLAG

SEQ ID NO: 89434 - protein, 9 aa, Homo Sapiens
LKVSCSDTW

SEQ ID NO: 89435 - protein, 9 aa, Homo Sapiens
LTEEPALQM

SEQ ID NO: 89436 - protein, 9 aa, Homo Sapiens
TYDPLFRWL

SEQ ID NO: 89437 - protein, 9 aa, Homo Sapiens
CFRDGYFIL

SEQ ID NO: 89438 - protein, 9 aa, Homo Sapiens
DESDTPCSS

SEQ ID NO: 89439 - protein, 9 aa, Homo Sapiens
AGGRGDGQP

SEQ ID NO: 89440 - protein, 9 aa, Homo Sapiens
DGYFILVVS

SEQ ID NO: 89441 - protein, 9 aa, Homo Sapiens
PYKCNECGM

SEQ ID NO: 89442 - protein, 9 aa, Homo Sapiens
SVLGAKARN

SEQ ID NO: 89443 - protein, 9 aa, Homo Sapiens
LQLLGSVQP

SEQ ID NO: 89444 - protein, 9 aa, Homo Sapiens
NLGKLVFSR

SEQ ID NO: 89445 - protein, 9 aa, Homo Sapiens
RPTEDVQAS

SEQ ID NO: 89446 - protein, 9 aa, Homo Sapiens
WFQVLLNTF

SEQ ID NO: 89447 - protein, 9 aa, Homo Sapiens
VIQTELSWG

SEQ ID NO: 89448 - protein, 9 aa, Homo Sapiens
TVREDAPVG

SEQ ID NO: 89449 - protein, 9 aa, Homo Sapiens
SQVGACGFS

SEQ ID NO: 89450 - protein, 9 aa, Homo Sapiens
KEGDDESHW

SEQ ID NO: 89451 - protein, 9 aa, Homo Sapiens
IPERRDSAV

SEQ ID NO: 89452 - protein, 9 aa, Homo Sapiens
WLKTHMNAR

SEQ ID NO: 89453 - protein, 9 aa, Homo Sapiens
VLKSNKGEE

SEQ ID NO: 89454 - protein, 9 aa, Homo Sapiens
PSATQSNAL

SEQ ID NO: 89455 - protein, 9 aa, Homo Sapiens
RVHCANALG

SEQ ID NO: 89456 - protein, 9 aa, Homo Sapiens
GRPKINGEL

SEQ ID NO: 89457 - protein, 9 aa, Homo Sapiens
GMTFSRKSY

SEQ ID NO: 89458 - protein, 9 aa, Homo Sapiens
CAKQCDSYP

SEQ ID NO: 89459 - protein, 9 aa, Homo Sapiens
VMVIQTELS

SEQ ID NO: 89460 - protein, 9 aa, Homo Sapiens
DGQPLPHGC

SEQ ID NO: 89461 - protein, 9 aa, Homo Sapiens
FERIEHYIK

SEQ ID NO: 89462 - protein, 9 aa, Homo Sapiens
VMWNVVDIN

SEQ ID NO: 89463 - protein, 9 aa, Homo Sapiens
QQKDDESDT

SEQ ID NO: 89464 - protein, 9 aa, Homo Sapiens
GLDPQGERS

SEQ ID NO: 89465 - protein, 9 aa, Homo Sapiens
KCNECGMTF

SEQ ID NO: 89466 - protein, 9 aa, Homo Sapiens
MWNVVDINS

SEQ ID NO: 89467 - protein, 9 aa, Homo Sapiens
RPKVWSLLG

SEQ ID NO: 89468 - protein, 9 aa, Homo Sapiens
PSVLGAKAR

SEQ ID NO: 89469 - protein, 9 aa, Homo Sapiens
MGLDPQGER

SEQ ID NO: 89470 - protein, 9 aa, Homo Sapiens
HRSVLTRHQ

SEQ ID NO: 89471 - protein, 9 aa, Homo Sapiens
GACGFSSRI

SEQ ID NO: 89472 - protein, 9 aa, Homo Sapiens
KDDESDTPC

SEQ ID NO: 89473 - protein, 9 aa, Homo Sapiens
QKIQCTARK

SEQ ID NO: 89474 - protein, 9 aa, Homo Sapiens
DLTITNLLQ

SEQ ID NO: 89475 - protein, 9 aa, Homo Sapiens
LQVKAEPPL

SEQ ID NO: 89476 - protein, 9 aa, Homo Sapiens
EGKLILPQH

SEQ ID NO: 89477 - protein, 9 aa, Homo Sapiens
TQSNALSSV

SEQ ID NO: 89478 - protein, 9 aa, Homo Sapiens
SAVGASLTR

SEQ ID NO: 89479 - protein, 9 aa, Homo Sapiens
QVKAEPPLT

SEQ ID NO: 89480 - protein, 9 aa, Homo Sapiens
CGMTFSRKS

SEQ ID NO: 89481 - protein, 9 aa, Homo Sapiens
GDGQPLPHG

SEQ ID NO: 89482 - protein, 9 aa, Homo Sapiens
PGGHEAAGG

SEQ ID NO: 89483 - protein, 9 aa, Homo Sapiens
AFERIEHYI

SEQ ID NO: 89484 - protein, 9 aa, Homo Sapiens
HCANALGPS

SEQ ID NO: 89485 - protein, 9 aa, Homo Sapiens
NYSLRVHCA

SEQ ID NO: 89486 - protein, 9 aa, Homo Sapiens
PALQMLRHP

SEQ ID NO: 89487 - protein, 9 aa, Homo Sapiens
RLAFRRRGL

SEQ ID NO: 89488 - protein, 9 aa, Homo Sapiens
AAGGRGDGQ

SEQ ID NO: 89489 - protein, 9 aa, Homo Sapiens
KKRRRQELE

SEQ ID NO: 89490 - protein, 9 aa, Homo Sapiens
FGSTNSLYE

SEQ ID NO: 89491 - protein, 9 aa, Homo Sapiens
CSRMCAKQC

SEQ ID NO: 89492 - protein, 9 aa, Homo Sapiens
MRYAFLGPL

SEQ ID NO: 89493 - protein, 9 aa, Homo Sapiens
ESLIEKMSN

SEQ ID NO: 89494 - protein, 9 aa, Homo Sapiens
ALASQHGRI

SEQ ID NO: 89495 - protein, 9 aa, Homo Sapiens
NECGMTFSR

SEQ ID NO: 89496 - protein, 9 aa, Homo Sapiens
SFVEKGTVR

SEQ ID NO: 89497 - protein, 9 aa, Homo Sapiens
LGSVQPQLC

SEQ ID NO: 89498 - protein, 9 aa, Homo Sapiens
RRRGLPTIT

SEQ ID NO: 89499 - protein, 9 aa, Homo Sapiens
PCPSVLGAK

SEQ ID NO: 89500 - protein, 9 aa, Homo Sapiens
QCFRDGYFI

SEQ ID NO: 89501 - protein, 9 aa, Homo Sapiens
GAILCEEEL

SEQ ID NO: 89502 - protein, 9 aa, Homo Sapiens
ATYDPLFRW

SEQ ID NO: 89503 - protein, 9 aa, Homo Sapiens
STHTTALPD

SEQ ID NO: 89504 - protein, 9 aa, Homo Sapiens
QWLKTHMNA

SEQ ID NO: 89505 - protein, 9 aa, Homo Sapiens
ERIEHYIKL

SEQ ID NO: 89506 - protein, 9 aa, Homo Sapiens
TKSQKLPRA

SEQ ID NO: 89507 - protein, 9 aa, Homo Sapiens
DIAWFQVLL

SEQ ID NO: 89508 - protein, 9 aa, Homo Sapiens
AKATYDPLF

SEQ ID NO: 89509 - protein, 9 aa, Homo Sapiens
QDATLRVWD

SEQ ID NO: 89510 - protein, 9 aa, Homo Sapiens
CTARKLFGL

SEQ ID NO: 89511 - protein, 9 aa, Homo Sapiens
KRKGAILCE

SEQ ID NO: 89512 - protein, 9 aa, Homo Sapiens
GQPAVPGGH

SEQ ID NO: 89513 - protein, 9 aa, Homo Sapiens
VKAEPPLTS

SEQ ID NO: 89514 - protein, 9 aa, Homo Sapiens
FYEVAYTVG

SEQ ID NO: 89515 - protein, 9 aa, Homo Sapiens
SVPVLKSNK

SEQ ID NO: 89516 - protein, 9 aa, Homo Sapiens
DDESDTPCS

SEQ ID NO: 89517 - protein, 9 aa, Homo Sapiens
TLEKILLQK

SEQ ID NO: 89518 - protein, 9 aa, Homo Sapiens
VQAFERIEH

SEQ ID NO: 89519 - protein, 9 aa, Homo Sapiens
NCQASVPVL

SEQ ID NO: 89520 - protein, 9 aa, Homo Sapiens
YLQVKAEPP

SEQ ID NO: 89521 - protein, 9 aa, Homo Sapiens
YDPLFRWLV

SEQ ID NO: 89522 - protein, 9 aa, Homo Sapiens
SCSRMCAKQ

SEQ ID NO: 89523 - protein, 9 aa, Homo Sapiens
VLLNTFDKS

SEQ ID NO: 89524 - protein, 9 aa, Homo Sapiens
EGDDESHWR

SEQ ID NO: 89525 - protein, 9 aa, Homo Sapiens
SQDATLRVW

SEQ ID NO: 89526 - protein, 9 aa, Homo Sapiens
SNLMLQHEE

SEQ ID NO: 89527 - protein, 9 aa, Homo Sapiens
PQHTCLRTN

SEQ ID NO: 89528 - protein, 9 aa, Homo Sapiens
NLLQGAVAF

SEQ ID NO: 89529 - protein, 9 aa, Homo Sapiens
EDPCPSVLG

SEQ ID NO: 89530 - protein, 9 aa, Homo Sapiens
QLLREERKK

SEQ ID NO: 89531 - protein, 9 aa, Homo Sapiens
ERRDSAVGA

SEQ ID NO: 89532 - protein, 9 aa, Homo Sapiens
LCQARDGGR

SEQ ID NO: 89533 - protein, 9 aa, Homo Sapiens
AGQPAVPGG

SEQ ID NO: 89534 - protein, 9 aa, Homo Sapiens
LKEMKNLGK

SEQ ID NO: 89535 - protein, 9 aa, Homo Sapiens
KTFYHRSVL

SEQ ID NO: 89536 - protein, 9 aa, Homo Sapiens
VVSGSQDAT

SEQ ID NO: 89537 - protein, 9 aa, Homo Sapiens
FERPYLQVK

SEQ ID NO: 89538 - protein, 9 aa, Homo Sapiens
KATYDPLFR

SEQ ID NO: 89539 - protein, 9 aa, Homo Sapiens
GSVQPQLCQ

SEQ ID NO: 89540 - protein, 9 aa, Homo Sapiens
DLILVEEYE

SEQ ID NO: 89541 - protein, 9 aa, Homo Sapiens
RASVQGGGF

SEQ ID NO: 89542 - protein, 9 aa, Homo Sapiens
GLGMRYAFL

SEQ ID NO: 89543 - protein, 9 aa, Homo Sapiens
SFSPAHPGL

SEQ ID NO: 89544 - protein, 9 aa, Homo Sapiens
TALPDSTTT

SEQ ID NO: 89545 - protein, 9 aa, Homo Sapiens
HRDKEGDDE

SEQ ID NO: 89546 - protein, 9 aa, Homo Sapiens
SINDGFHIY

SEQ ID NO: 89547 - protein, 9 aa, Homo Sapiens
VQPQLCQAR

SEQ ID NO: 89548 - protein, 9 aa, Homo Sapiens
ITNLLQGAV

SEQ ID NO: 89549 - protein, 9 aa, Homo Sapiens
TNYSLRVHC

SEQ ID NO: 89550 - protein, 9 aa, Homo Sapiens
GQPLPHGCL

SEQ ID NO: 89551 - protein, 9 aa, Homo Sapiens
GTVREDAPV

SEQ ID NO: 89552 - protein, 9 aa, Homo Sapiens
LPSATQSNA

SEQ ID NO: 89553 - protein, 9 aa, Homo Sapiens
GRGDGQPLP

SEQ ID NO: 89554 - protein, 9 aa, Homo Sapiens
RDGYFILVV

SEQ ID NO: 89555 - protein, 9 aa, Homo Sapiens
LPDSTTTSG

SEQ ID NO: 89556 - protein, 9 aa, Homo Sapiens
LKTHMNARA

SEQ ID NO: 89557 - protein, 9 aa, Homo Sapiens
KLAGWQCPE

SEQ ID NO: 89558 - protein, 9 aa, Homo Sapiens
HYGRLAFRR

SEQ ID NO: 89559 - protein, 9 aa, Homo Sapiens
EKILLQKVA

SEQ ID NO: 89560 - protein, 9 aa, Homo Sapiens
AILCEEELA

SEQ ID NO: 89561 - protein, 9 aa, Homo Sapiens
SIAPTKSQK

SEQ ID NO: 89562 - protein, 9 aa, Homo Sapiens
SQKLPRADV

SEQ ID NO: 89563 - protein, 9 aa, Homo Sapiens
RQKIQCTAR

SEQ ID NO: 89564 - protein, 9 aa, Homo Sapiens
QKDDESDTP

SEQ ID NO: 89565 - protein, 9 aa, Homo Sapiens
HRPTEDVQA

SEQ ID NO: 89566 - protein, 9 aa, Homo Sapiens
KILLQKVAS

SEQ ID NO: 89567 - protein, 9 aa, Homo Sapiens
YGRPKINGE

SEQ ID NO: 89568 - protein, 9 aa, Homo Sapiens
TTLLDTVFH

SEQ ID NO: 89569 - protein, 9 aa, Homo Sapiens
GKLILPQHT

SEQ ID NO: 89570 - protein, 9 aa, Homo Sapiens
HYGRPKING

SEQ ID NO: 89571 - protein, 9 aa, Homo Sapiens
GIVVMVIQT

SEQ ID NO: 89572 - protein, 9 aa, Homo Sapiens
GGLGRVWAL

SEQ ID NO: 89573 - protein, 9 aa, Homo Sapiens
DIAVTPLKL

SEQ ID NO: 89574 - protein, 9 aa, Homo Sapiens
MTFSRKSYF

SEQ ID NO: 89575 - protein, 9 aa, Homo Sapiens
VSGSQDATL

SEQ ID NO: 89576 - protein, 9 aa, Homo Sapiens
AGAGQPAVP

SEQ ID NO: 89577 - protein, 9 aa, Homo Sapiens
RTVGIFYEV

SEQ ID NO: 89578 - protein, 9 aa, Homo Sapiens
CPGGAGAGQ

SEQ ID NO: 89579 - protein, 9 aa, Homo Sapiens
QPQLCQARD

SEQ ID NO: 89580 - protein, 9 aa, Homo Sapiens
YSNLMLQHE

SEQ ID NO: 89581 - protein, 9 aa, Homo Sapiens
VWALASQHG

SEQ ID NO: 89582 - protein, 9 aa, Homo Sapiens
VHCANALGP

SEQ ID NO: 89583 - protein, 9 aa, Homo Sapiens
CGKTFYHRS

SEQ ID NO: 89584 - protein, 9 aa, Homo Sapiens
LLKVSCSDT

SEQ ID NO: 89585 - protein, 9 aa, Homo Sapiens
DIRPKVWSL

SEQ ID NO: 89586 - protein, 9 aa, Homo Sapiens
GAGAGQPAV

SEQ ID NO: 89587 - protein, 9 aa, Homo Sapiens
PQGERSFLL

SEQ ID NO: 89588 - protein, 9 aa, Homo Sapiens
VSFSPAHPG

SEQ ID NO: 89589 - protein, 9 aa, Homo Sapiens
ILVVSQEMA

SEQ ID NO: 89590 - protein, 9 aa, Homo Sapiens
RPKINGELK

SEQ ID NO: 89591 - protein, 9 aa, Homo Sapiens
DPQGERSFL

SEQ ID NO: 89592 - protein, 9 aa, Homo Sapiens
QLCQARDGG

SEQ ID NO: 89593 - protein, 9 aa, Homo Sapiens
QAFERIEHY

SEQ ID NO: 89594 - protein, 9 aa, Homo Sapiens
ESHWRYGGD

SEQ ID NO: 89595 - protein, 9 aa, Homo Sapiens
FTLRFEELK

SEQ ID NO: 89596 - protein, 9 aa, Homo Sapiens
FGIVVMVIQ

SEQ ID NO: 89597 - protein, 9 aa, Homo Sapiens
ESDTPCSSL

SEQ ID NO: 89598 - protein, 9 aa, Homo Sapiens
SATQSNALS

SEQ ID NO: 89599 - protein, 9 aa, Homo Sapiens
RFEELKMTN

SEQ ID NO: 89600 - protein, 9 aa, Homo Sapiens
QASVPVLKS

SEQ ID NO: 89601 - protein, 9 aa, Homo Sapiens
FLGPLETMH

SEQ ID NO: 89602 - protein, 9 aa, Homo Sapiens
GPLLKVSCS

SEQ ID NO: 89603 - protein, 9 aa, Homo Sapiens
EVAYTVGLL

SEQ ID NO: 89604 - protein, 9 aa, Homo Sapiens
CGFSSRILS

SEQ ID NO: 89605 - protein, 9 aa, Homo Sapiens
GHEAAGGRG

SEQ ID NO: 89606 - protein, 9 aa, Homo Sapiens
AFLGPLETM

SEQ ID NO: 89607 - protein, 9 aa, Homo Sapiens
PGMTTTLLD

SEQ ID NO: 89608 - protein, 9 aa, Homo Sapiens
KIQCTARKL

SEQ ID NO: 89609 - protein, 9 aa, Homo Sapiens
ALPDSTTTS

SEQ ID NO: 89610 - protein, 9 aa, Homo Sapiens
FYHRSVLTR

SEQ ID NO: 89611 - protein, 9 aa, Homo Sapiens
VAQLVITTF

SEQ ID NO: 89612 - protein, 9 aa, Homo Sapiens
PTKSQKLPR

SEQ ID NO: 89613 - protein, 9 aa, Homo Sapiens
VPGGHEAAG

SEQ ID NO: 89614 - protein, 9 aa, Homo Sapiens
GLLVSFSPA

SEQ ID NO: 89615 - protein, 9 aa, Homo Sapiens
TVGIFYEVA

SEQ ID NO: 89616 - protein, 9 aa, Homo Sapiens
GCLGAVPVR

SEQ ID NO: 89617 - protein, 9 aa, Homo Sapiens
KAFGSTNSL

SEQ ID NO: 89618 - protein, 9 aa, Homo Sapiens
RIEHYIKLI

SEQ ID NO: 89619 - protein, 9 aa, Homo Sapiens
LGRVWALAS

SEQ ID NO: 89620 - protein, 9 aa, Homo Sapiens
DTVFHHVSQ

SEQ ID NO: 89621 - protein, 9 aa, Homo Sapiens
STNSLYEHR

SEQ ID NO: 89622 - protein, 9 aa, Homo Sapiens
WCIFTNDFW

SEQ ID NO: 89623 - protein, 9 aa, Homo Sapiens
PEDTACTRS

SEQ ID NO: 89624 - protein, 9 aa, Homo Sapiens
ISFLEKQLG

SEQ ID NO: 89625 - protein, 9 aa, Homo Sapiens
GQQFSKDIQ

SEQ ID NO: 89626 - protein, 9 aa, Homo Sapiens
LRHKCCFSL

SEQ ID NO: 89627 - protein, 9 aa, Homo Sapiens
DDITDHSEM

SEQ ID NO: 89628 - protein, 9 aa, Homo Sapiens
KPKALAVYT

SEQ ID NO: 89629 - protein, 9 aa, Homo Sapiens
SMLCVFHSK

SEQ ID NO: 89630 - protein, 9 aa, Homo Sapiens
RSLNKLQNR

SEQ ID NO: 89631 - protein, 9 aa, Homo Sapiens
HGVAQQKVE

SEQ ID NO: 89632 - protein, 9 aa, Homo Sapiens
LNSESNFAQ

SEQ ID NO: 89633 - protein, 9 aa, Homo Sapiens
GMEIPLRTR

SEQ ID NO: 89634 - protein, 9 aa, Homo Sapiens
GSESIEITR

SEQ ID NO: 89635 - protein, 9 aa, Homo Sapiens
APGTQNMIN

SEQ ID NO: 89636 - protein, 9 aa, Homo Sapiens
AKSHDKANS

SEQ ID NO: 89637 - protein, 9 aa, Homo Sapiens
VFVSLLGVI

SEQ ID NO: 89638 - protein, 9 aa, Homo Sapiens
PPHSSENNS

SEQ ID NO: 89639 - protein, 9 aa, Homo Sapiens
LPGASNKGC

SEQ ID NO: 89640 - protein, 9 aa, Homo Sapiens
MINSRSYDE

SEQ ID NO: 89641 - protein, 9 aa, Homo Sapiens
KQGLVCFSE

SEQ ID NO: 89642 - protein, 9 aa, Homo Sapiens
FQATTYARR

SEQ ID NO: 89643 - protein, 9 aa, Homo Sapiens
SSSCNCIQY

SEQ ID NO: 89644 - protein, 9 aa, Homo Sapiens
EGDCAHEEK

SEQ ID NO: 89645 - protein, 9 aa, Homo Sapiens
KHQMEKASE

SEQ ID NO: 89646 - protein, 9 aa, Homo Sapiens
SQKSLCDSR

SEQ ID NO: 89647 - protein, 9 aa, Homo Sapiens
AYFIHNLSV

SEQ ID NO: 89648 - protein, 9 aa, Homo Sapiens
CNSCCMGGM

SEQ ID NO: 89649 - protein, 9 aa, Homo Sapiens
DLTRQEIRL

SEQ ID NO: 89650 - protein, 9 aa, Homo Sapiens
GGAGERGHL

SEQ ID NO: 89651 - protein, 9 aa, Homo Sapiens
MEKHMVELG

SEQ ID NO: 89652 - protein, 9 aa, Homo Sapiens
CDSREPTEK

SEQ ID NO: 89653 - protein, 9 aa, Homo Sapiens
QGGTSLDGK

SEQ ID NO: 89654 - protein, 9 aa, Homo Sapiens
RSYCYYFIE

SEQ ID NO: 89655 - protein, 9 aa, Homo Sapiens
RFKQFNIDF

SEQ ID NO: 89656 - protein, 9 aa, Homo Sapiens
YCYYFIEDR

SEQ ID NO: 89657 - protein, 9 aa, Homo Sapiens
QKQKPLDFS

SEQ ID NO: 89658 - protein, 9 aa, Homo Sapiens
PFDLRALKL

SEQ ID NO: 89659 - protein, 9 aa, Homo Sapiens
VFEEVDTYE

SEQ ID NO: 89660 - protein, 9 aa, Homo Sapiens
QKSLCDSRE

SEQ ID NO: 89661 - protein, 9 aa, Homo Sapiens
IYRKYTLDN

SEQ ID NO: 89662 - protein, 9 aa, Homo Sapiens
HQMEKASEN

SEQ ID NO: 89663 - protein, 9 aa, Homo Sapiens
QMEKASENI

SEQ ID NO: 89664 - protein, 9 aa, Homo Sapiens
NMINGTRFI

SEQ ID NO: 89665 - protein, 9 aa, Homo Sapiens
VAGEIESDN

SEQ ID NO: 89666 - protein, 9 aa, Homo Sapiens
YESSATAKP

SEQ ID NO: 89667 - protein, 9 aa, Homo Sapiens
GDRFKQFNI

SEQ ID NO: 89668 - protein, 9 aa, Homo Sapiens
QPPPHSSEN

SEQ ID NO: 89669 - protein, 9 aa, Homo Sapiens
WQELSLETS

SEQ ID NO: 89670 - protein, 9 aa, Homo Sapiens
ELSLETSGK

SEQ ID NO: 89671 - protein, 9 aa, Homo Sapiens
HQPPPHSSE

SEQ ID NO: 89672 - protein, 9 aa, Homo Sapiens
CTRSSFTVQ

SEQ ID NO: 89673 - protein, 9 aa, Homo Sapiens
HRPYSEICF

SEQ ID NO: 89674 - protein, 9 aa, Homo Sapiens
KHMVELGKL

SEQ ID NO: 89675 - protein, 9 aa, Homo Sapiens
ALCAQCLLC

SEQ ID NO: 89676 - protein, 9 aa, Homo Sapiens
HLIHLDWKC

SEQ ID NO: 89677 - protein, 9 aa, Homo Sapiens
VAWVDLMIA

SEQ ID NO: 89678 - protein, 9 aa, Homo Sapiens
AHEEKIWEE

SEQ ID NO: 89679 - protein, 9 aa, Homo Sapiens
LHADMLCSL

SEQ ID NO: 89680 - protein, 9 aa, Homo Sapiens
QETTPEVNF

SEQ ID NO: 89681 - protein, 9 aa, Homo Sapiens
LIHLDWKCL

SEQ ID NO: 89682 - protein, 9 aa, Homo Sapiens
KENLNLSQK

SEQ ID NO: 89683 - protein, 9 aa, Homo Sapiens
FCIIVGLWI

SEQ ID NO: 89684 - protein, 9 aa, Homo Sapiens
SYCYYFIED

SEQ ID NO: 89685 - protein, 9 aa, Homo Sapiens
SQGGTSLDG

SEQ ID NO: 89686 - protein, 9 aa, Homo Sapiens
VSMLCVFHS

SEQ ID NO: 89687 - protein, 9 aa, Homo Sapiens
GTHGQYGME

SEQ ID NO: 89688 - protein, 9 aa, Homo Sapiens
LQNRERSCR

SEQ ID NO: 89689 - protein, 9 aa, Homo Sapiens
FNILLSPII

SEQ ID NO: 89690 - protein, 9 aa, Homo Sapiens
YIIIDGDRF

SEQ ID NO: 89691 - protein, 9 aa, Homo Sapiens
VYRASQGVV

SEQ ID NO: 89692 - protein, 9 aa, Homo Sapiens
IKRNIQKCN

SEQ ID NO: 89693 - protein, 9 aa, Homo Sapiens
DKAAVFEEV

SEQ ID NO: 89694 - protein, 9 aa, Homo Sapiens
FAQAYAQGI

SEQ ID NO: 89695 - protein, 9 aa, Homo Sapiens
GLSGHPGPA

SEQ ID NO: 89696 - protein, 9 aa, Homo Sapiens
ENLNLSQKQ

SEQ ID NO: 89697 - protein, 9 aa, Homo Sapiens
ILLSPIIFH

SEQ ID NO: 89698 - protein, 9 aa, Homo Sapiens
YTLDNNGIV

SEQ ID NO: 89699 - protein, 9 aa, Homo Sapiens
NFAQAYAQG

SEQ ID NO: 89700 - protein, 9 aa, Homo Sapiens
FIHNLSVME

SEQ ID NO: 89701 - protein, 9 aa, Homo Sapiens
RPGQQGGAG

SEQ ID NO: 89702 - protein, 9 aa, Homo Sapiens
HANRNKHRR

SEQ ID NO: 89703 - protein, 9 aa, Homo Sapiens
KRPVAWVDL

SEQ ID NO: 89704 - protein, 9 aa, Homo Sapiens
LRALKLPSI

SEQ ID NO: 89705 - protein, 9 aa, Homo Sapiens
QEIRLCSVK

SEQ ID NO: 89706 - protein, 9 aa, Homo Sapiens
QCLLCGEPE

SEQ ID NO: 89707 - protein, 9 aa, Homo Sapiens
NLSVMESGV

SEQ ID NO: 89708 - protein, 9 aa, Homo Sapiens
FTPQNGAQH

SEQ ID NO: 89709 - protein, 9 aa, Homo Sapiens
STGQETTPE

SEQ ID NO: 89710 - protein, 9 aa, Homo Sapiens
KALAVYTQL

SEQ ID NO: 89711 - protein, 9 aa, Homo Sapiens
ENLSKYQDS

SEQ ID NO: 89712 - protein, 9 aa, Homo Sapiens
RNKHRRKKS

SEQ ID NO: 89713 - protein, 9 aa, Homo Sapiens
FSEVPQNVG

SEQ ID NO: 89714 - protein, 9 aa, Homo Sapiens
SLETSGKRK

SEQ ID NO: 89715 - protein, 9 aa, Homo Sapiens
THMEKHMVE

SEQ ID NO: 89716 - protein, 9 aa, Homo Sapiens
VKPKALAVY

SEQ ID NO: 89717 - protein, 9 aa, Homo Sapiens
EPEKHVCLP

SEQ ID NO: 89718 - protein, 9 aa, Homo Sapiens
EPSKFPGSL

SEQ ID NO: 89719 - protein, 9 aa, Homo Sapiens
YNNSTLYWK

SEQ ID NO: 89720 - protein, 9 aa, Homo Sapiens
ASNKGCVLS

SEQ ID NO: 89721 - protein, 9 aa, Homo Sapiens
QNMINGTRF

SEQ ID NO: 89722 - protein, 9 aa, Homo Sapiens
CCFSLSGTT

SEQ ID NO: 89723 - protein, 9 aa, Homo Sapiens
CLLCGEPEK

SEQ ID NO: 89724 - protein, 9 aa, Homo Sapiens
QYELKIGSE

SEQ ID NO: 89725 - protein, 9 aa, Homo Sapiens
SSCNCIQYE

SEQ ID NO: 89726 - protein, 9 aa, Homo Sapiens
NCIQYELKI

SEQ ID NO: 89727 - protein, 9 aa, Homo Sapiens
HADMLCSLG

SEQ ID NO: 89728 - protein, 9 aa, Homo Sapiens
NKGCVLSSA

SEQ ID NO: 89729 - protein, 9 aa, Homo Sapiens
YGMEIPLRT

SEQ ID NO: 89730 - protein, 9 aa, Homo Sapiens
KEGDCAHEE

SEQ ID NO: 89731 - protein, 9 aa, Homo Sapiens
ITDHSEMKK

SEQ ID NO: 89732 - protein, 9 aa, Homo Sapiens
STSSASSGD

SEQ ID NO: 89733 - protein, 9 aa, Homo Sapiens
LIQKDDITD

SEQ ID NO: 89734 - protein, 9 aa, Homo Sapiens
GPALCAQCL

SEQ ID NO: 89735 - protein, 9 aa, Homo Sapiens
QKYESSATA

SEQ ID NO: 89736 - protein, 9 aa, Homo Sapiens
TYYTLKPAN

SEQ ID NO: 89737 - protein, 9 aa, Homo Sapiens
EEVDTYERR

SEQ ID NO: 89738 - protein, 9 aa, Homo Sapiens
AYDFIMEFR

SEQ ID NO: 89739 - protein, 9 aa, Homo Sapiens
CAHEEKIWE

SEQ ID NO: 89740 - protein, 9 aa, Homo Sapiens
YRKYTLDNN

SEQ ID NO: 89741 - protein, 9 aa, Homo Sapiens
DKQGLVCFS

SEQ ID NO: 89742 - protein, 9 aa, Homo Sapiens
IIIDGDRFK

SEQ ID NO: 89743 - protein, 9 aa, Homo Sapiens
YTLKPANVK

SEQ ID NO: 89744 - protein, 9 aa, Homo Sapiens
TSSASSGDT

SEQ ID NO: 89745 - protein, 9 aa, Homo Sapiens
KPSVHLIHL

SEQ ID NO: 89746 - protein, 9 aa, Homo Sapiens
PGQQGGAGE

SEQ ID NO: 89747 - protein, 9 aa, Homo Sapiens
DGDRFKQFN

SEQ ID NO: 89748 - protein, 9 aa, Homo Sapiens
SPHANRNKH

SEQ ID NO: 89749 - protein, 9 aa, Homo Sapiens
LVCFSEVPQ

SEQ ID NO: 89750 - protein, 9 aa, Homo Sapiens
KIKRPVAWV

SEQ ID NO: 89751 - protein, 9 aa, Homo Sapiens
KKWQELSLE

SEQ ID NO: 89752 - protein, 9 aa, Homo Sapiens
FDLRALKLP

SEQ ID NO: 89753 - protein, 9 aa, Homo Sapiens
RKPPRNPNG

SEQ ID NO: 89754 - protein, 9 aa, Homo Sapiens
TLDNNGIVS

SEQ ID NO: 89755 - protein, 9 aa, Homo Sapiens
LLSLNETIK

SEQ ID NO: 89756 - protein, 9 aa, Homo Sapiens
IAVIRDQSS

SEQ ID NO: 89757 - protein, 9 aa, Homo Sapiens
LCEEVAGEI

SEQ ID NO: 89758 - protein, 9 aa, Homo Sapiens
SGDTTPLPG

SEQ ID NO: 89759 - protein, 9 aa, Homo Sapiens
PVFVSLLGV

SEQ ID NO: 89760 - protein, 9 aa, Homo Sapiens
KGKAPQKGS

SEQ ID NO: 89761 - protein, 9 aa, Homo Sapiens
INSRSYDEK

SEQ ID NO: 89762 - protein, 9 aa, Homo Sapiens
YPSTGQETT

SEQ ID NO: 89763 - protein, 9 aa, Homo Sapiens
PGPSHQPPP

SEQ ID NO: 89764 - protein, 9 aa, Homo Sapiens
QELSLETSG

SEQ ID NO: 89765 - protein, 9 aa, Homo Sapiens
AVIRDQSSG

SEQ ID NO: 89766 - protein, 9 aa, Homo Sapiens
LTLCKGKTA

SEQ ID NO: 89767 - protein, 9 aa, Homo Sapiens
SRTEPSKFP

SEQ ID NO: 89768 - protein, 9 aa, Homo Sapiens
LNLSQKQKP

SEQ ID NO: 89769 - protein, 9 aa, Homo Sapiens
VHLIHLDWK

SEQ ID NO: 89770 - protein, 9 aa, Homo Sapiens
NLSKYQDSE

SEQ ID NO: 89771 - protein, 9 aa, Homo Sapiens
DDYSQGGTS

SEQ ID NO: 89772 - protein, 9 aa, Homo Sapiens
CFSEVPQNV

SEQ ID NO: 89773 - protein, 9 aa, Homo Sapiens
QQFSKDIQA

SEQ ID NO: 89774 - protein, 9 aa, Homo Sapiens
GFQATTYAR

SEQ ID NO: 89775 - protein, 9 aa, Homo Sapiens
RHKCCFSLS

SEQ ID NO: 89776 - protein, 9 aa, Homo Sapiens
MLCSLGPKE

SEQ ID NO: 89777 - protein, 9 aa, Homo Sapiens
IQKCNSRGE

SEQ ID NO: 89778 - protein, 9 aa, Homo Sapiens
TGQETTPEV

SEQ ID NO: 89779 - protein, 9 aa, Homo Sapiens
GVAQQKVEK

SEQ ID NO: 89780 - protein, 9 aa, Homo Sapiens
CIQYELKIG

SEQ ID NO: 89781 - protein, 9 aa, Homo Sapiens
YRSYCYYFI

SEQ ID NO: 89782 - protein, 9 aa, Homo Sapiens
MEKASENIV

SEQ ID NO: 89783 - protein, 9 aa, Homo Sapiens
PGTQNMING

SEQ ID NO: 89784 - protein, 9 aa, Homo Sapiens
CGEPEKHVC

SEQ ID NO: 89785 - protein, 9 aa, Homo Sapiens
VDTYERRSG

SEQ ID NO: 89786 - protein, 9 aa, Homo Sapiens
CIFTNDFWG

SEQ ID NO: 89787 - protein, 9 aa, Homo Sapiens
KANSGSRPD

SEQ ID NO: 89788 - protein, 9 aa, Homo Sapiens
GGTSLDGKN

SEQ ID NO: 89789 - protein, 9 aa, Homo Sapiens
QVTSDYHGV

SEQ ID NO: 89790 - protein, 9 aa, Homo Sapiens
DTGMSVYAE

SEQ ID NO: 89791 - protein, 9 aa, Homo Sapiens
KSHDKANSG

SEQ ID NO: 89792 - protein, 9 aa, Homo Sapiens
FCRCHRPYS

SEQ ID NO: 89793 - protein, 9 aa, Homo Sapiens
LNKLQNRER

SEQ ID NO: 89794 - protein, 9 aa, Homo Sapiens
AIAVIRDQS

SEQ ID NO: 89795 - protein, 9 aa, Homo Sapiens
VVWGTVSPF

SEQ ID NO: 89796 - protein, 9 aa, Homo Sapiens
IEDRETWVD

SEQ ID NO: 89797 - protein, 9 aa, Homo Sapiens
RVMSLANLI

SEQ ID NO: 89798 - protein, 9 aa, Homo Sapiens
YTYYTLKPA

SEQ ID NO: 89799 - protein, 9 aa, Homo Sapiens
NLKTHMEKH

SEQ ID NO: 89800 - protein, 9 aa, Homo Sapiens
RPGAPLRWC

SEQ ID NO: 89801 - protein, 9 aa, Homo Sapiens
LAPGTQNMI

SEQ ID NO: 89802 - protein, 9 aa, Homo Sapiens
NILLSPIIF

SEQ ID NO: 89803 - protein, 9 aa, Homo Sapiens
VCFSEVPQN

SEQ ID NO: 89804 - protein, 9 aa, Homo Sapiens
NSTLYWKNR

SEQ ID NO: 89805 - protein, 9 aa, Homo Sapiens
SFLEKQLGS

SEQ ID NO: 89806 - protein, 9 aa, Homo Sapiens
LCGEPEKHV

SEQ ID NO: 89807 - protein, 9 aa, Homo Sapiens
PPPHSSENN

SEQ ID NO: 89808 - protein, 9 aa, Homo Sapiens
SCNCIQYEL

SEQ ID NO: 89809 - protein, 9 aa, Homo Sapiens
DLRALKLPS

SEQ ID NO: 89810 - protein, 9 aa, Homo Sapiens
PQNGAQHGG

SEQ ID NO: 89811 - protein, 9 aa, Homo Sapiens
YSEICFQSS

SEQ ID NO: 89812 - protein, 9 aa, Homo Sapiens
QDQKHQMEK

SEQ ID NO: 89813 - protein, 9 aa, Homo Sapiens
ATTYARRSY

SEQ ID NO: 89814 - protein, 9 aa, Homo Sapiens
KYTLDNNGI

SEQ ID NO: 89815 - protein, 9 aa, Homo Sapiens
EVFFNILLS

SEQ ID NO: 89816 - protein, 9 aa, Homo Sapiens
ALKLPSISC

SEQ ID NO: 89817 - protein, 9 aa, Homo Sapiens
APQKGSSLQ

SEQ ID NO: 89818 - protein, 9 aa, Homo Sapiens
CAQCLLCGE

SEQ ID NO: 89819 - protein, 9 aa, Homo Sapiens
CDVVWGTVS

SEQ ID NO: 89820 - protein, 9 aa, Homo Sapiens
QLCEEVAGE

SEQ ID NO: 89821 - protein, 9 aa, Homo Sapiens
NLNLSQKQK

SEQ ID NO: 89822 - protein, 9 aa, Homo Sapiens
IRDQSSGKS

SEQ ID NO: 89823 - protein, 9 aa, Homo Sapiens
DCAHEEKIW

SEQ ID NO: 89824 - protein, 9 aa, Homo Sapiens
GPFDLRALK

SEQ ID NO: 89825 - protein, 9 aa, Homo Sapiens
IVGLWISVP

SEQ ID NO: 89826 - protein, 9 aa, Homo Sapiens
STLYWKNRG

SEQ ID NO: 89827 - protein, 9 aa, Homo Sapiens
FFNILLSPI

SEQ ID NO: 89828 - protein, 9 aa, Homo Sapiens
KAQLLSLNE

SEQ ID NO: 89829 - protein, 9 aa, Homo Sapiens
NQPQFQQMK

SEQ ID NO: 89830 - protein, 9 aa, Homo Sapiens
PQFQQMKQI

SEQ ID NO: 89831 - protein, 9 aa, Homo Sapiens
RPGPSHQPP

SEQ ID NO: 89832 - protein, 9 aa, Homo Sapiens
LCKGKTARC

SEQ ID NO: 89833 - protein, 9 aa, Homo Sapiens
AIYRKYTLD

SEQ ID NO: 89834 - protein, 9 aa, Homo Sapiens
RRSYTGLAP

SEQ ID NO: 89835 - protein, 9 aa, Homo Sapiens
GGQQFSKDI

SEQ ID NO: 89836 - protein, 9 aa, Homo Sapiens
VRPLARVMS

SEQ ID NO: 89837 - protein, 9 aa, Homo Sapiens
QFQQMKQII

SEQ ID NO: 89838 - protein, 9 aa, Homo Sapiens
CYYFIEDRE

SEQ ID NO: 89839 - protein, 9 aa, Homo Sapiens
LSGTTSFKC

SEQ ID NO: 89840 - protein, 9 aa, Homo Sapiens
SQKQKPLDF

SEQ ID NO: 89841 - protein, 9 aa, Homo Sapiens
SPQKYESSA

SEQ ID NO: 89842 - protein, 9 aa, Homo Sapiens
NSRGELQVS

SEQ ID NO: 89843 - protein, 9 aa, Homo Sapiens
PALCAQCLL

SEQ ID NO: 89844 - protein, 9 aa, Homo Sapiens
DTACTRSSF

SEQ ID NO: 89845 - protein, 9 aa, Homo Sapiens
AEPWGPPVT

SEQ ID NO: 89846 - protein, 9 aa, Homo Sapiens
RAIYRKYTL

SEQ ID NO: 89847 - protein, 9 aa, Homo Sapiens
DFIMEFRNK

SEQ ID NO: 89848 - protein, 9 aa, Homo Sapiens
VVQLFCIIV

SEQ ID NO: 89849 - protein, 9 aa, Homo Sapiens
PEKHVCLPG

SEQ ID NO: 89850 - protein, 9 aa, Homo Sapiens
GKTARCFGL

SEQ ID NO: 89851 - protein, 9 aa, Homo Sapiens
EDTGMSVYA

SEQ ID NO: 89852 - protein, 9 aa, Homo Sapiens
NKHRRKKST

SEQ ID NO: 89853 - protein, 9 aa, Homo Sapiens
VAQQKVEKI

SEQ ID NO: 89854 - protein, 9 aa, Homo Sapiens
CFSLSGTTS

SEQ ID NO: 89855 - protein, 9 aa, Homo Sapiens
LCDSREPTE

SEQ ID NO: 89856 - protein, 9 aa, Homo Sapiens
TRKPPRNPN

SEQ ID NO: 89857 - protein, 9 aa, Homo Sapiens
KYESSATAK

SEQ ID NO: 89858 - protein, 9 aa, Homo Sapiens
LSQKQKPLD

SEQ ID NO: 89859 - protein, 9 aa, Homo Sapiens
QMKQIIQQN

SEQ ID NO: 89860 - protein, 9 aa, Homo Sapiens
YMCNSCCMG

SEQ ID NO: 89861 - protein, 9 aa, Homo Sapiens
TLCKGKTAR

SEQ ID NO: 89862 - protein, 9 aa, Homo Sapiens
IEITRKPPR

SEQ ID NO: 89863 - protein, 9 aa, Homo Sapiens
KQIIQQNPS

SEQ ID NO: 89864 - protein, 9 aa, Homo Sapiens
SKDIQALNP

SEQ ID NO: 89865 - protein, 9 aa, Homo Sapiens
PLARVMSLA

SEQ ID NO: 89866 - protein, 9 aa, Homo Sapiens
EEENLSKYQ

SEQ ID NO: 89867 - protein, 9 aa, Homo Sapiens
GSLLYVSML

SEQ ID NO: 89868 - protein, 9 aa, Homo Sapiens
ESNFAQAYA

SEQ ID NO: 89869 - protein, 9 aa, Homo Sapiens
DIQALNPMK

SEQ ID NO: 89870 - protein, 9 aa, Homo Sapiens
IYIIIDGDR

SEQ ID NO: 89871 - protein, 9 aa, Homo Sapiens
GQYGMEIPL

SEQ ID NO: 89872 - protein, 9 aa, Homo Sapiens
PGASNKGCV

SEQ ID NO: 89873 - protein, 9 aa, Homo Sapiens
CRCHRPYSE

SEQ ID NO: 89874 - protein, 9 aa, Homo Sapiens
LGVIDEVMV

SEQ ID NO: 89875 - protein, 9 aa, Homo Sapiens
GTVSPFTPQ

SEQ ID NO: 89876 - protein, 9 aa, Homo Sapiens
LQLCEEVAG

SEQ ID NO: 89877 - protein, 9 aa, Homo Sapiens
VSPFTPQNG

SEQ ID NO: 89878 - protein, 9 aa, Homo Sapiens
EENLSKYQD

SEQ ID NO: 89879 - protein, 9 aa, Homo Sapiens
KGKTARCFG

SEQ ID NO: 89880 - protein, 9 aa, Homo Sapiens
TSLDGKNLV

SEQ ID NO: 89881 - protein, 9 aa, Homo Sapiens
LKTHMEKHM

SEQ ID NO: 89882 - protein, 9 aa, Homo Sapiens
SHQPPPHSS

SEQ ID NO: 89883 - protein, 9 aa, Homo Sapiens
VFFNILLSP

SEQ ID NO: 89884 - protein, 9 aa, Homo Sapiens
NYMCNSCCM

SEQ ID NO: 89885 - protein, 9 aa, Homo Sapiens
NKLQNRERS

SEQ ID NO: 89886 - protein, 9 aa, Homo Sapiens
PANVKPPKM

SEQ ID NO: 89887 - protein, 9 aa, Homo Sapiens
TPLAPGTQN

SEQ ID NO: 89888 - protein, 9 aa, Homo Sapiens
LSSAPRDIL

SEQ ID NO: 89889 - protein, 9 aa, Homo Sapiens
GAPLRWCIF

SEQ ID NO: 89890 - protein, 9 aa, Homo Sapiens
ASQGVVISI

SEQ ID NO: 89891 - protein, 9 aa, Homo Sapiens
RIEDLTRQE

SEQ ID NO: 89892 - protein, 9 aa, Homo Sapiens
EITRKPPRN

SEQ ID NO: 89893 - protein, 9 aa, Homo Sapiens
SSGDTTPLP

SEQ ID NO: 89894 - protein, 9 aa, Homo Sapiens
KAAVFEEVD

SEQ ID NO: 89895 - protein, 9 aa, Homo Sapiens
SRSYDEKVD

SEQ ID NO: 89896 - protein, 9 aa, Homo Sapiens
LSGHPGPAL

SEQ ID NO: 89897 - protein, 9 aa, Homo Sapiens
RALKLPSIS

SEQ ID NO: 89898 - protein, 9 aa, Homo Sapiens
LLSPIIFHA

SEQ ID NO: 89899 - protein, 9 aa, Homo Sapiens
CNCIQYELK

SEQ ID NO: 89900 - protein, 9 aa, Homo Sapiens
DKSQKSLCD

SEQ ID NO: 89901 - protein, 9 aa, Homo Sapiens
PSHQPPPHS

SEQ ID NO: 89902 - protein, 9 aa, Homo Sapiens
TQNMINGTR

SEQ ID NO: 89903 - protein, 9 aa, Homo Sapiens
CIIVGLWIS

SEQ ID NO: 89904 - protein, 9 aa, Homo Sapiens
CHRPYSEIC

SEQ ID NO: 89905 - protein, 9 aa, Homo Sapiens
QQGGAGERG

SEQ ID NO: 89906 - protein, 9 aa, Homo Sapiens
SVHLIHLDW

SEQ ID NO: 89907 - protein, 9 aa, Homo Sapiens
YTQLPQDTS

SEQ ID NO: 89908 - protein, 9 aa, Homo Sapiens
APEMINSRS

SEQ ID NO: 89909 - protein, 9 aa, Homo Sapiens
CCLHADMLC

SEQ ID NO: 89910 - protein, 9 aa, Homo Sapiens
NIQKCNSRG

SEQ ID NO: 89911 - protein, 9 aa, Homo Sapiens
IIVGLWISV

SEQ ID NO: 89912 - protein, 9 aa, Homo Sapiens
ARRSYTGLA

SEQ ID NO: 89913 - protein, 9 aa, Homo Sapiens
DVYRASQGV

SEQ ID NO: 89914 - protein, 9 aa, Homo Sapiens
EMINSRSYD

SEQ ID NO: 89915 - protein, 9 aa, Homo Sapiens
YYTLKPANV

SEQ ID NO: 89916 - protein, 9 aa, Homo Sapiens
QKDDITDHS

SEQ ID NO: 89917 - protein, 9 aa, Homo Sapiens
CLPGASNKG

SEQ ID NO: 89918 - protein, 9 aa, Homo Sapiens
LSLETSGKR

SEQ ID NO: 89919 - protein, 9 aa, Homo Sapiens
VWGTVSPFT

SEQ ID NO: 89920 - protein, 9 aa, Homo Sapiens
ALAVYTQLP

SEQ ID NO: 89921 - protein, 9 aa, Homo Sapiens
SIKPSVHLI

SEQ ID NO: 89922 - protein, 9 aa, Homo Sapiens
SKFPGSLRY

SEQ ID NO: 89923 - protein, 9 aa, Homo Sapiens
KAPQKGSSL

SEQ ID NO: 89924 - protein, 9 aa, Homo Sapiens
DMLCSLGPK

SEQ ID NO: 89925 - protein, 9 aa, Homo Sapiens
MEFRNKFNT

SEQ ID NO: 89926 - protein, 9 aa, Homo Sapiens
KDIQALNPM

SEQ ID NO: 89927 - protein, 9 aa, Homo Sapiens
HNLSVMESG

SEQ ID NO: 89928 - protein, 9 aa, Homo Sapiens
SPFTPQNGA

SEQ ID NO: 89929 - protein, 9 aa, Homo Sapiens
PGRPGQQGG

SEQ ID NO: 89930 - protein, 9 aa, Homo Sapiens
QFKIKRPVA

SEQ ID NO: 89931 - protein, 9 aa, Homo Sapiens
GEPEKHVCL

SEQ ID NO: 89932 - protein, 9 aa, Homo Sapiens
QYGMEIPLR

SEQ ID NO: 89933 - protein, 9 aa, Homo Sapiens
PGPALCAQC

SEQ ID NO: 89934 - protein, 9 aa, Homo Sapiens
VVISITISS

SEQ ID NO: 89935 - protein, 9 aa, Homo Sapiens
QLFCIIVGL

SEQ ID NO: 89936 - protein, 9 aa, Homo Sapiens
GLVCFSEVP

SEQ ID NO: 89937 - protein, 9 aa, Homo Sapiens
KSQKSLCDS

SEQ ID NO: 89938 - protein, 9 aa, Homo Sapiens
RTEPSKFPG

SEQ ID NO: 89939 - protein, 9 aa, Homo Sapiens
KNIRRERSG

SEQ ID NO: 89940 - protein, 9 aa, Homo Sapiens
RWCIFTNDF

SEQ ID NO: 89941 - protein, 9 aa, Homo Sapiens
NGAQHGGLS

SEQ ID NO: 89942 - protein, 9 aa, Homo Sapiens
EDTACTRSS

SEQ ID NO: 89943 - protein, 9 aa, Homo Sapiens
FRNKFNTLV

SEQ ID NO: 89944 - protein, 9 aa, Homo Sapiens
GTSLDGKNL

SEQ ID NO: 89945 - protein, 9 aa, Homo Sapiens
IHNLSVMES

SEQ ID NO: 89946 - protein, 9 aa, Homo Sapiens
LSPIIFHAG

SEQ ID NO: 89947 - protein, 9 aa, Homo Sapiens
PQKYESSAT

SEQ ID NO: 89948 - protein, 9 aa, Homo Sapiens
WKAQLLSLN

SEQ ID NO: 89949 - protein, 9 aa, Homo Sapiens
AVFEEVDTY

SEQ ID NO: 89950 - protein, 9 aa, Homo Sapiens
SESNFAQAY

SEQ ID NO: 89951 - protein, 9 aa, Homo Sapiens
IHLDWKCLF

SEQ ID NO: 89952 - protein, 9 aa, Homo Sapiens
YRASQGVVI

SEQ ID NO: 89953 - protein, 9 aa, Homo Sapiens
FKNIRRERS

SEQ ID NO: 89954 - protein, 9 aa, Homo Sapiens
SVYAEPWGP

SEQ ID NO: 89955 - protein, 9 aa, Homo Sapiens
IQYELKIGS

SEQ ID NO: 89956 - protein, 9 aa, Homo Sapiens
PSTGQETTP

SEQ ID NO: 89957 - protein, 9 aa, Homo Sapiens
IDGDRFKQF

SEQ ID NO: 89958 - protein, 9 aa, Homo Sapiens
MAPEMINSR

SEQ ID NO: 89959 - protein, 9 aa, Homo Sapiens
TPEVNFTFE

SEQ ID NO: 89960 - protein, 9 aa, Homo Sapiens
QPQFQQMKQ

SEQ ID NO: 89961 - protein, 9 aa, Homo Sapiens
KYQDSETRL

SEQ ID NO: 89962 - protein, 9 aa, Homo Sapiens
ACTRSSFTV

SEQ ID NO: 89963 - protein, 9 aa, Homo Sapiens
TARCFGLTG

SEQ ID NO: 89964 - protein, 9 aa, Homo Sapiens
DYHGVAQQK

SEQ ID NO: 89965 - protein, 9 aa, Homo Sapiens
GFKNIRRER

SEQ ID NO: 89966 - protein, 9 aa, Homo Sapiens
SQAYFIHNL

SEQ ID NO: 89967 - protein, 9 aa, Homo Sapiens
MLCVFHSKY

SEQ ID NO: 89968 - protein, 9 aa, Homo Sapiens
TSDYHGVAQ

SEQ ID NO: 89969 - protein, 9 aa, Homo Sapiens
SLCDSREPT

SEQ ID NO: 89970 - protein, 9 aa, Homo Sapiens
SLSGTTSFK

SEQ ID NO: 89971 - protein, 9 aa, Homo Sapiens
DGTHGQYGM

SEQ ID NO: 89972 - protein, 9 aa, Homo Sapiens
TSTSSASSG

SEQ ID NO: 89973 - protein, 9 aa, Homo Sapiens
LCVFHSKYA

SEQ ID NO: 89974 - protein, 9 aa, Homo Sapiens
KTARCFGLT

SEQ ID NO: 89975 - protein, 9 aa, Homo Sapiens
MSLANLISP

SEQ ID NO: 89976 - protein, 9 aa, Homo Sapiens
SKYQDSETR

SEQ ID NO: 89977 - protein, 9 aa, Homo Sapiens
GKAPQKGSS

SEQ ID NO: 89978 - protein, 9 aa, Homo Sapiens
SQGVVISIT

SEQ ID NO: 89979 - protein, 9 aa, Homo Sapiens
FLEKQLGSC

SEQ ID NO: 89980 - protein, 9 aa, Homo Sapiens
HGGLSGHPG

SEQ ID NO: 89981 - protein, 9 aa, Homo Sapiens
FQQMKQIIQ

SEQ ID NO: 89982 - protein, 9 aa, Homo Sapiens
SQDQKHQME

SEQ ID NO: 89983 - protein, 9 aa, Homo Sapiens
ARAIYRKYT

SEQ ID NO: 89984 - protein, 9 aa, Homo Sapiens
LLGVIDEVM

SEQ ID NO: 89985 - protein, 9 aa, Homo Sapiens
PSKFPGSLR

SEQ ID NO: 89986 - protein, 9 aa, Homo Sapiens
HDKANSGSR

SEQ ID NO: 89987 - protein, 9 aa, Homo Sapiens
IPPEDTACT

SEQ ID NO: 89988 - protein, 9 aa, Homo Sapiens
LCSLGPKEA

SEQ ID NO: 89989 - protein, 9 aa, Homo Sapiens
LAVYTQLPQ

SEQ ID NO: 89990 - protein, 9 aa, Homo Sapiens
GHPGPALCA

SEQ ID NO: 89991 - protein, 9 aa, Homo Sapiens
PSVHLIHLD

SEQ ID NO: 89992 - protein, 9 aa, Homo Sapiens
SGSRPDRRE

SEQ ID NO: 89993 - protein, 9 aa, Homo Sapiens
GTQNMINGT

SEQ ID NO: 89994 - protein, 9 aa, Homo Sapiens
QISFLEKQL

SEQ ID NO: 89995 - protein, 9 aa, Homo Sapiens
FSLSGTTSF

SEQ ID NO: 89996 - protein, 9 aa, Homo Sapiens
WMAPEMINS

SEQ ID NO: 89997 - protein, 9 aa, Homo Sapiens
HVCLPGASN

SEQ ID NO: 89998 - protein, 9 aa, Homo Sapiens
TEPSKFPGS

SEQ ID NO: 89999 - protein, 9 aa, Homo Sapiens
WGTVSPFTP

SEQ ID NO: 90000 - protein, 9 aa, Homo Sapiens
VQLFCIIVG

SEQ ID NO: 90001 - protein, 9 aa, Homo Sapiens
MYTYYTLKP

SEQ ID NO: 90002 - protein, 9 aa, Homo Sapiens
VMSLANLIS

SEQ ID NO: 90003 - protein, 9 aa, Homo Sapiens
GCVLSSAPR

SEQ ID NO: 90004 - protein, 9 aa, Homo Sapiens
AQAYAQGIS

SEQ ID NO: 90005 - protein, 9 aa, Homo Sapiens
TGMSVYAEP

SEQ ID NO: 90006 - protein, 9 aa, Homo Sapiens
GVIDEVMVL

SEQ ID NO: 90007 - protein, 9 aa, Homo Sapiens
NSCCMGGMN

SEQ ID NO: 90008 - protein, 9 aa, Homo Sapiens
RDQSSGKSS

SEQ ID NO: 90009 - protein, 9 aa, Homo Sapiens
KCNSRGELQ

SEQ ID NO: 90010 - protein, 9 aa, Homo Sapiens
LETSGKRKK

SEQ ID NO: 90011 - protein, 9 aa, Homo Sapiens
TACTRSSFT

SEQ ID NO: 90012 - protein, 9 aa, Homo Sapiens
RNIQKCNSR

SEQ ID NO: 90013 - protein, 9 aa, Homo Sapiens
EKGKAPQKG

SEQ ID NO: 90014 - protein, 9 aa, Homo Sapiens
IRRERSGGA

SEQ ID NO: 90015 - protein, 9 aa, Homo Sapiens
AKEGDCAHE

SEQ ID NO: 90016 - protein, 9 aa, Homo Sapiens
GQETTPEVN

SEQ ID NO: 90017 - protein, 9 aa, Homo Sapiens
LPAIAVIRD

SEQ ID NO: 90018 - protein, 9 aa, Homo Sapiens
IAKEGDCAH

SEQ ID NO: 90019 - protein, 9 aa, Homo Sapiens
KCCFSLSGT

SEQ ID NO: 90020 - protein, 9 aa, Homo Sapiens
FPGSLRYSY

SEQ ID NO: 90021 - protein, 9 aa, Homo Sapiens
DITDHSEMK

SEQ ID NO: 90022 - protein, 9 aa, Homo Sapiens
QKCNSRGEL

SEQ ID NO: 90023 - protein, 9 aa, Homo Sapiens
YHGVAQQKV

SEQ ID NO: 90024 - protein, 9 aa, Homo Sapiens
GGLSGHPGP

SEQ ID NO: 90025 - protein, 9 aa, Homo Sapiens
MSVYAEPWG

SEQ ID NO: 90026 - protein, 9 aa, Homo Sapiens
QGVVISITI

SEQ ID NO: 90027 - protein, 9 aa, Homo Sapiens
DQKHQMEKA

SEQ ID NO: 90028 - protein, 9 aa, Homo Sapiens
YFIEDRETW

SEQ ID NO: 90029 - protein, 9 aa, Homo Sapiens
NSESNFAQA

SEQ ID NO: 90030 - protein, 9 aa, Homo Sapiens
VYAEPWGPP

SEQ ID NO: 90031 - protein, 9 aa, Homo Sapiens
AAVFEEVDT

SEQ ID NO: 90032 - protein, 9 aa, Homo Sapiens
SLLGVIDEV

SEQ ID NO: 90033 - protein, 9 aa, Homo Sapiens
MKQIIQQNP

SEQ ID NO: 90034 - protein, 9 aa, Homo Sapiens
FSQDQKHQM

SEQ ID NO: 90035 - protein, 9 aa, Homo Sapiens
RSWKAQLLS

SEQ ID NO: 90036 - protein, 9 aa, Homo Sapiens
EEPLSPQKY

SEQ ID NO: 90037 - protein, 9 aa, Homo Sapiens
KWQELSLET

SEQ ID NO: 90038 - protein, 9 aa, Homo Sapiens
AQCLLCGEP

SEQ ID NO: 90039 - protein, 9 aa, Homo Sapiens
ILQLCEEVA

SEQ ID NO: 90040 - protein, 9 aa, Homo Sapiens
ETTPEVNFT

SEQ ID NO: 90041 - protein, 9 aa, Homo Sapiens
ADMLCSLGP

SEQ ID NO: 90042 - protein, 9 aa, Homo Sapiens
ARVMSLANL

SEQ ID NO: 90043 - protein, 9 aa, Homo Sapiens
EQFKIKRPV

SEQ ID NO: 90044 - protein, 9 aa, Homo Sapiens
DKANSGSRP

SEQ ID NO: 90045 - protein, 9 aa, Homo Sapiens
GASNKGCVL

SEQ ID NO: 90046 - protein, 9 aa, Homo Sapiens
DVVWGTVSP

SEQ ID NO: 90047 - protein, 9 aa, Homo Sapiens
MEIPLRTRL

SEQ ID NO: 90048 - protein, 9 aa, Homo Sapiens
HEEKIWEEL

SEQ ID NO: 90049 - protein, 9 aa, Homo Sapiens
YARRSYTGL

SEQ ID NO: 90050 - protein, 9 aa, Homo Sapiens
CLHADMLCS

SEQ ID NO: 90051 - protein, 9 aa, Homo Sapiens
NIRRERSGG

SEQ ID NO: 90052 - protein, 9 aa, Homo Sapiens
MCNSCCMGG

SEQ ID NO: 90053 - protein, 9 aa, Homo Sapiens
WGFKNIRRE

SEQ ID NO: 90054 - protein, 9 aa, Homo Sapiens
PYSEICFQS

SEQ ID NO: 90055 - protein, 9 aa, Homo Sapiens
SIEITRKPP

SEQ ID NO: 90056 - protein, 9 aa, Homo Sapiens
SPIIFHAGY

SEQ ID NO: 90057 - protein, 9 aa, Homo Sapiens
QQMKQIIQQ

SEQ ID NO: 90058 - protein, 9 aa, Homo Sapiens
GPSHQPPPH

SEQ ID NO: 90059 - protein, 9 aa, Homo Sapiens
FIEDRETWV

SEQ ID NO: 90060 - protein, 9 aa, Homo Sapiens
CSLGPKEAK

SEQ ID NO: 90061 - protein, 9 aa, Homo Sapiens
LSPQKYESS

SEQ ID NO: 90062 - protein, 9 aa, Homo Sapiens
VLSSAPRDI

SEQ ID NO: 90063 - protein, 9 aa, Homo Sapiens
HMVELGKLQ

SEQ ID NO: 90064 - protein, 9 aa, Homo Sapiens
EFRNKFNTL

SEQ ID NO: 90065 - protein, 9 aa, Homo Sapiens
SNKGCVLSS

SEQ ID NO: 90066 - protein, 9 aa, Homo Sapiens
KSLCDSREP

SEQ ID NO: 90067 - protein, 9 aa, Homo Sapiens
TVSPFTPQN

SEQ ID NO: 90068 - protein, 9 aa, Homo Sapiens
CCMGGMNRR

SEQ ID NO: 90069 - protein, 9 aa, Homo Sapiens
LTRQEIRLC

SEQ ID NO: 90070 - protein, 9 aa, Homo Sapiens
YNYMCNSCC

SEQ ID NO: 90071 - protein, 9 aa, Homo Sapiens
FSKDIQALN

SEQ ID NO: 90072 - protein, 9 aa, Homo Sapiens
LCAQCLLCG

SEQ ID NO: 90073 - protein, 9 aa, Homo Sapiens
EVDTYERRS

SEQ ID NO: 90074 - protein, 9 aa, Homo Sapiens
HGQYGMEIP

SEQ ID NO: 90075 - protein, 9 aa, Homo Sapiens
QIPPEDTAC

SEQ ID NO: 90076 - protein, 9 aa, Homo Sapiens
DRFKQFNID

SEQ ID NO: 90077 - protein, 9 aa, Homo Sapiens
VSLLGVIDE

SEQ ID NO: 90078 - protein, 9 aa, Homo Sapiens
HMEKHMVEL

SEQ ID NO: 90079 - protein, 9 aa, Homo Sapiens
THGQYGMEI

SEQ ID NO: 90080 - protein, 9 aa, Homo Sapiens
RKYTLDNNG

SEQ ID NO: 90081 - protein, 9 aa, Homo Sapiens
SCCMGGMNR

SEQ ID NO: 90082 - protein, 9 aa, Homo Sapiens
EVAGEIESD

SEQ ID NO: 90083 - protein, 9 aa, Homo Sapiens
LSKYQDSET

SEQ ID NO: 90084 - protein, 9 aa, Homo Sapiens
EPLSPQKYE

SEQ ID NO: 90085 - protein, 9 aa, Homo Sapiens
PFTPQNGAQ

SEQ ID NO: 90086 - protein, 9 aa, Homo Sapiens
RNKFNTLVG

SEQ ID NO: 90087 - protein, 9 aa, Homo Sapiens
YQDSETRLV

SEQ ID NO: 90088 - protein, 9 aa, Homo Sapiens
PLRWCIFTN

SEQ ID NO: 90089 - protein, 9 aa, Homo Sapiens
PPEDTACTR

SEQ ID NO: 90090 - protein, 9 aa, Homo Sapiens
SLNKLQNRE

SEQ ID NO: 90091 - protein, 9 aa, Homo Sapiens
EEVAGEIES

SEQ ID NO: 90092 - protein, 9 aa, Homo Sapiens
EIRLCSVKQ

SEQ ID NO: 90093 - protein, 9 aa, Homo Sapiens
CNSRGELQV

SEQ ID NO: 90094 - protein, 9 aa, Homo Sapiens
SLLYVSMLC

SEQ ID NO: 90095 - protein, 9 aa, Homo Sapiens
NSGSRPDRR

SEQ ID NO: 90096 - protein, 9 aa, Homo Sapiens
ITRKPPRNP

SEQ ID NO: 90097 - protein, 9 aa, Homo Sapiens
SSAPRDILQ

SEQ ID NO: 90098 - protein, 9 aa, Homo Sapiens
YVSMLCVFH

SEQ ID NO: 90099 - protein, 9 aa, Homo Sapiens
HKCCFSLSG

SEQ ID NO: 90100 - protein, 9 aa, Homo Sapiens
VIDEVMVLL

SEQ ID NO: 90101 - protein, 9 aa, Homo Sapiens
PVAWVDLMI

SEQ ID NO: 90102 - protein, 9 aa, Homo Sapiens
SWKAQLLSL

SEQ ID NO: 90103 - protein, 9 aa, Homo Sapiens
KPANVKPPK

SEQ ID NO: 90104 - protein, 9 aa, Homo Sapiens
SYNNSTLYW

SEQ ID NO: 90105 - protein, 9 aa, Homo Sapiens
RPVAWVDLM

SEQ ID NO: 90106 - protein, 9 aa, Homo Sapiens
FGPFDLRAL

SEQ ID NO: 90107 - protein, 9 aa, Homo Sapiens
IKKWQELSL

SEQ ID NO: 90108 - protein, 9 aa, Homo Sapiens
CEEVAGEIE

SEQ ID NO: 90109 - protein, 9 aa, Homo Sapiens
FIMEFRNKF

SEQ ID NO: 90110 - protein, 9 aa, Homo Sapiens
IMEFRNKFN

SEQ ID NO: 90111 - protein, 9 aa, Homo Sapiens
NNSTLYWKN

SEQ ID NO: 90112 - protein, 9 aa, Homo Sapiens
RQEIRLCSV

SEQ ID NO: 90113 - protein, 9 aa, Homo Sapiens
NRERSCRAY

SEQ ID NO: 90114 - protein, 9 aa, Homo Sapiens
YSQGGTSLD

SEQ ID NO: 90115 - protein, 9 aa, Homo Sapiens
SEICFQSSS

SEQ ID NO: 90116 - protein, 9 aa, Homo Sapiens
QGGAGERGH

SEQ ID NO: 90117 - protein, 9 aa, Homo Sapiens
YELKIGSEE

SEQ ID NO: 90118 - protein, 9 aa, Homo Sapiens
NLSQKQKPL

SEQ ID NO: 90119 - protein, 9 aa, Homo Sapiens
LRWCIFTND

SEQ ID NO: 90120 - protein, 9 aa, Homo Sapiens
NSRSYDEKV

SEQ ID NO: 90121 - protein, 9 aa, Homo Sapiens
HYNYMCNSC

SEQ ID NO: 90122 - protein, 9 aa, Homo Sapiens
YAEPWGPPV

SEQ ID NO: 90123 - protein, 9 aa, Homo Sapiens
RASQGVVIS

SEQ ID NO: 90124 - protein, 9 aa, Homo Sapiens
KFPGSLRYS

SEQ ID NO: 90125 - protein, 9 aa, Homo Sapiens
ESIEITRKP

SEQ ID NO: 90126 - protein, 9 aa, Homo Sapiens
PQKGSSLQR

SEQ ID NO: 90127 - protein, 9 aa, Homo Sapiens
LKPANVKPP

SEQ ID NO: 90128 - protein, 9 aa, Homo Sapiens
QDSETRLVE

SEQ ID NO: 90129 - protein, 9 aa, Homo Sapiens
EKHVCLPGA

SEQ ID NO: 90130 - protein, 9 aa, Homo Sapiens
FVSLLGVID

SEQ ID NO: 90131 - protein, 9 aa, Homo Sapiens
EDLTRQEIR

SEQ ID NO: 90132 - protein, 9 aa, Homo Sapiens
TRQEIRLCS

SEQ ID NO: 90133 - protein, 9 aa, Homo Sapiens
ARSLNKLQN

SEQ ID NO: 90134 - protein, 9 aa, Homo Sapiens
IKPSVHLIH

SEQ ID NO: 90135 - protein, 9 aa, Homo Sapiens
EDKQGLVCF

SEQ ID NO: 90136 - protein, 9 aa, Homo Sapiens
KRNIQKCNS

SEQ ID NO: 90137 - protein, 9 aa, Homo Sapiens
SNFAQAYAQ

SEQ ID NO: 90138 - protein, 9 aa, Homo Sapiens
QAYFIHNLS

SEQ ID NO: 90139 - protein, 9 aa, Homo Sapiens
ARCFGLTGC

SEQ ID NO: 90140 - protein, 9 aa, Homo Sapiens
SEKGKAPQK

SEQ ID NO: 90141 - protein, 9 aa, Homo Sapiens
DRSWKAQLL

SEQ ID NO: 90142 - protein, 9 aa, Homo Sapiens
IIDGDRFKQ

SEQ ID NO: 90143 - protein, 9 aa, Homo Sapiens
SSASSGDTT

SEQ ID NO: 90144 - protein, 9 aa, Homo Sapiens
EKQLGSCSC

SEQ ID NO: 90145 - protein, 9 aa, Homo Sapiens
RPYSEICFQ

SEQ ID NO: 90146 - protein, 9 aa, Homo Sapiens
SEQISFLEK

SEQ ID NO: 90147 - protein, 9 aa, Homo Sapiens
VCLPGASNK

SEQ ID NO: 90148 - protein, 9 aa, Homo Sapiens
TSRTEPSKF

SEQ ID NO: 90149 - protein, 9 aa, Homo Sapiens
DYSQGGTSL

SEQ ID NO: 90150 - protein, 9 aa, Homo Sapiens
LSLNETIKN

SEQ ID NO: 90151 - protein, 9 aa, Homo Sapiens
EKHMVELGK

SEQ ID NO: 90152 - protein, 9 aa, Homo Sapiens
PPSPHANRN

SEQ ID NO: 90153 - protein, 9 aa, Homo Sapiens
NRNKHRRKK

SEQ ID NO: 90154 - protein, 9 aa, Homo Sapiens
QNGAQHGGL

SEQ ID NO: 90155 - protein, 9 aa, Homo Sapiens
HPGPALCAQ

SEQ ID NO: 90156 - protein, 9 aa, Homo Sapiens
GAQHGGLSG

SEQ ID NO: 90157 - protein, 9 aa, Homo Sapiens
VIRDQSSGK

SEQ ID NO: 90158 - protein, 9 aa, Homo Sapiens
GAGERGHLG

SEQ ID NO: 90159 - protein, 9 aa, Homo Sapiens
RCHRPYSEI

SEQ ID NO: 90160 - protein, 9 aa, Homo Sapiens
IQKDDITDH

SEQ ID NO: 90161 - protein, 9 aa, Homo Sapiens
TYARRSYTG

SEQ ID NO: 90162 - protein, 9 aa, Homo Sapiens
PEMINSRSY

SEQ ID NO: 90163 - protein, 9 aa, Homo Sapiens
GMSVYAEPW

SEQ ID NO: 90164 - protein, 9 aa, Homo Sapiens
QHGGLSGHP

SEQ ID NO: 90165 - protein, 9 aa, Homo Sapiens
CVLSSAPRD

SEQ ID NO: 90166 - protein, 9 aa, Homo Sapiens
PLSPQKYES

SEQ ID NO: 90167 - protein, 9 aa, Homo Sapiens
LEKQLGSCS

SEQ ID NO: 90168 - protein, 9 aa, Homo Sapiens
IKRPVAWVD

SEQ ID NO: 90169 - protein, 9 aa, Homo Sapiens
PHANRNKHR

SEQ ID NO: 90170 - protein, 9 aa, Homo Sapiens
PSPHANRNK

SEQ ID NO: 90171 - protein, 9 aa, Homo Sapiens
SDYHGVAQQ

SEQ ID NO: 90172 - protein, 9 aa, Homo Sapiens
FDKSQKSLC

SEQ ID NO: 90173 - protein, 9 aa, Homo Sapiens
SHDKANSGS

SEQ ID NO: 90174 - protein, 9 aa, Homo Sapiens
QLLSLNETI

SEQ ID NO: 90175 - protein, 9 aa, Homo Sapiens
EQISFLEKQ

SEQ ID NO: 90176 - protein, 9 aa, Homo Sapiens
SLDGKNLVQ

SEQ ID NO: 90177 - protein, 9 aa, Homo Sapiens
FEEVDTYER

SEQ ID NO: 90178 - protein, 9 aa, Homo Sapiens
FSQAYFIHN

SEQ ID NO: 90179 - protein, 9 aa, Homo Sapiens
YDFIMEFRN

SEQ ID NO: 90180 - protein, 9 aa, Homo Sapiens
TLKPANVKP

SEQ ID NO: 90181 - protein, 9 aa, Homo Sapiens
ASSGDTTPL

SEQ ID NO: 90182 - protein, 9 aa, Homo Sapiens
RPLARVMSL

SEQ ID NO: 90183 - protein, 9 aa, Homo Sapiens
FKIKRPVAW

SEQ ID NO: 90184 - protein, 9 aa, Homo Sapiens
LFCIIVGLW

SEQ ID NO: 90185 - protein, 9 aa, Homo Sapiens
ANRNKHRRK

SEQ ID NO: 90186 - protein, 9 aa, Homo Sapiens
QFSKDIQAL

SEQ ID NO: 90187 - protein, 9 aa, Homo Sapiens
APLRWCIFT

SEQ ID NO: 90188 - protein, 9 aa, Homo Sapiens
TPQNGAQHG

SEQ ID NO: 90189 - protein, 9 aa, Homo Sapiens
VTSDYHGVA

SEQ ID NO: 90190 - protein, 9 aa, Homo Sapiens
LLYVSMLCV

SEQ ID NO: 90191 - protein, 9 aa, Homo Sapiens
LYVSMLCVF

SEQ ID NO: 90192 - protein, 9 aa, Homo Sapiens
IEDLTRQEI

SEQ ID NO: 90193 - protein, 9 aa, Homo Sapiens
DVVQLFCII

SEQ ID NO: 90194 - protein, 9 aa, Homo Sapiens
AQHGGLSGH

SEQ ID NO: 90195 - protein, 9 aa, Homo Sapiens
ALPAIAVIR

SEQ ID NO: 90196 - protein, 9 aa, Homo Sapiens
LARVMSLAN

SEQ ID NO: 90197 - protein, 9 aa, Homo Sapiens
KHVCLPGAS

SEQ ID NO: 90198 - protein, 9 aa, Homo Sapiens
AQLLSLNET

SEQ ID NO: 90199 - protein, 9 aa, Homo Sapiens
QNRERSCRA

SEQ ID NO: 90200 - protein, 9 aa, Homo Sapiens
AVYTQLPQD

SEQ ID NO: 90201 - protein, 9 aa, Homo Sapiens
TTPEVNFTF

SEQ ID NO: 90202 - protein, 9 aa, Homo Sapiens
QAYAQGISR

SEQ ID NO: 90203 - protein, 9 aa, Homo Sapiens
KDDITDHSE

SEQ ID NO: 90204 - protein, 9 aa, Homo Sapiens
VYTQLPQDT

SEQ ID NO: 90205 - protein, 9 aa, Homo Sapiens
KQLGSCSCK

SEQ ID NO: 90206 - protein, 9 aa, Homo Sapiens
CKGKTARCF

SEQ ID NO: 90207 - protein, 9 aa, Homo Sapiens
SASSGDTTP

SEQ ID NO: 90208 - protein, 9 aa, Homo Sapiens
SESIEITRK

SEQ ID NO: 90209 - protein, 9 aa, Homo Sapiens
GVVISITIS

SEQ ID NO: 90210 - protein, 9 aa, Homo Sapiens
RVRPLARVM

SEQ ID NO: 90211 - protein, 9 aa, Homo Sapiens
KGCVLSSAP

SEQ ID NO: 90212 - protein, 9 aa, Homo Sapiens
QGLVCFSEV

SEQ ID NO: 90213 - protein, 9 aa, Homo Sapiens
PAIAVIRDQ

SEQ ID NO: 90214 - protein, 9 aa, Homo Sapiens
IQALNPMKQ

SEQ ID NO: 90215 - protein, 9 aa, Homo Sapiens
TTYARRSYT

SEQ ID NO: 90216 - protein, 9 aa, Homo Sapiens
LKLPSISCP

SEQ ID NO: 90217 - protein, 9 aa, Homo Sapiens
GDCAHEEKI

SEQ ID NO: 90218 - protein, 9 aa, Homo Sapiens
QATTYARRS

SEQ ID NO: 90219 - protein, 9 aa, Homo Sapiens
PLAPGTQNM

SEQ ID NO: 90220 - protein, 9 aa, Homo Sapiens
PKALAVYTQ

SEQ ID NO: 90221 - protein, 9 aa, Homo Sapiens
ASEKGKAPQ

SEQ ID NO: 90222 - protein, 9 aa, Homo Sapiens
QKGSSLQRS

SEQ ID NO: 90223 - protein, 9 aa, Homo Sapiens
KLQNRERSC

SEQ ID NO: 90224 - protein, 9 aa, Homo Sapiens
QKHQMEKAS

SEQ ID NO: 90225 - protein, 9 aa, Homo Sapiens
KTHMEKHMV

SEQ ID NO: 90226 - protein, 9 aa, Homo Sapiens
GQQGGAGER

SEQ ID NO: 90227 - protein, 9 aa, Homo Sapiens
TSYNNSTLY

SEQ ID NO: 90228 - protein, 9 aa, Homo Sapiens
ANSGSRPDR

SEQ ID NO: 90229 - protein, 9 aa, Homo Sapiens
LLCGEPEKH

SEQ ID NO: 90230 - protein, 9 aa, Homo Sapiens
TLYWKNRGT

SEQ ID NO: 90231 - protein, 9 aa, Homo Sapiens
SILQLCEEV

SEQ ID NO: 90232 - protein, 9 aa, Homo Sapiens
GRPGQQGGA

SEQ ID NO: 90233 - protein, 9 aa, Homo Sapiens
SGHPGPALC

SEQ ID NO: 90234 - protein, 9 aa, Homo Sapiens
PGAPLRWCI

SEQ ID NO: 90235 - protein, 9 aa, Homo Sapiens
AKENLNLSQ

SEQ ID NO: 90236 - protein, 9 aa, Homo Sapiens
YYFIEDRET

SEQ ID NO: 90237 - protein, 9 aa, Homo Sapiens
YFIHNLSVM

SEQ ID NO: 90238 - protein, 9 aa, Homo Sapiens
TRDSISRLH

SEQ ID NO: 90239 - protein, 9 aa, Homo Sapiens
KTAKAGGVT

SEQ ID NO: 90240 - protein, 9 aa, Homo Sapiens
EYIEKYCLG

SEQ ID NO: 90241 - protein, 9 aa, Homo Sapiens
PKKVYKPIL

SEQ ID NO: 90242 - protein, 9 aa, Homo Sapiens
FVAFSPAFA

SEQ ID NO: 90243 - protein, 9 aa, Homo Sapiens
KAGECVEDI

SEQ ID NO: 90244 - protein, 9 aa, Homo Sapiens
GKETLSDLF

SEQ ID NO: 90245 - protein, 9 aa, Homo Sapiens
PIVVAKASR

SEQ ID NO: 90246 - protein, 9 aa, Homo Sapiens
EKRAVLMRP

SEQ ID NO: 90247 - protein, 9 aa, Homo Sapiens
AMDLEKPPL

SEQ ID NO: 90248 - protein, 9 aa, Homo Sapiens
PQDLTRPLF

SEQ ID NO: 90249 - protein, 9 aa, Homo Sapiens
LCIFLDYFQ

SEQ ID NO: 90250 - protein, 9 aa, Homo Sapiens
SRKSSYASA

SEQ ID NO: 90251 - protein, 9 aa, Homo Sapiens
LEQQKEEDE

SEQ ID NO: 90252 - protein, 9 aa, Homo Sapiens
ERDELQRRL

SEQ ID NO: 90253 - protein, 9 aa, Homo Sapiens
TLLQTSLKY

SEQ ID NO: 90254 - protein, 9 aa, Homo Sapiens
HLRVYEGFV

SEQ ID NO: 90255 - protein, 9 aa, Homo Sapiens
IIKKELQCN

SEQ ID NO: 90256 - protein, 9 aa, Homo Sapiens
VLMRPMDPP

SEQ ID NO: 90257 - protein, 9 aa, Homo Sapiens
FRHSVVVPC

SEQ ID NO: 90258 - protein, 9 aa, Homo Sapiens
PGNIPVKED

SEQ ID NO: 90259 - protein, 9 aa, Homo Sapiens
ENKIAMKNI

SEQ ID NO: 90260 - protein, 9 aa, Homo Sapiens
GHYAQNVSM

SEQ ID NO: 90261 - protein, 9 aa, Homo Sapiens
LADYYIKCF

SEQ ID NO: 90262 - protein, 9 aa, Homo Sapiens
MSGDKSSQL

SEQ ID NO: 90263 - protein, 9 aa, Homo Sapiens
EDTHTEEYK

SEQ ID NO: 90264 - protein, 9 aa, Homo Sapiens
ATFKSQLNS

SEQ ID NO: 90265 - protein, 9 aa, Homo Sapiens
NTTVISENN

SEQ ID NO: 90266 - protein, 9 aa, Homo Sapiens
QLKKMHSSV

SEQ ID NO: 90267 - protein, 9 aa, Homo Sapiens
EFSKHLKEE

SEQ ID NO: 90268 - protein, 9 aa, Homo Sapiens
AKATISTCM

SEQ ID NO: 90269 - protein, 9 aa, Homo Sapiens
TIGDVSLVK

SEQ ID NO: 90270 - protein, 9 aa, Homo Sapiens
QKTATKKRN

SEQ ID NO: 90271 - protein, 9 aa, Homo Sapiens
KDPREKGDV

SEQ ID NO: 90272 - protein, 9 aa, Homo Sapiens
SSKRSKGRS

SEQ ID NO: 90273 - protein, 9 aa, Homo Sapiens
EKNELVSDE

SEQ ID NO: 90274 - protein, 9 aa, Homo Sapiens
KKMHSSVIL

SEQ ID NO: 90275 - protein, 9 aa, Homo Sapiens
SLKTRMVNQ

SEQ ID NO: 90276 - protein, 9 aa, Homo Sapiens
HLFPTMSAD

SEQ ID NO: 90277 - protein, 9 aa, Homo Sapiens
LHRGHTRLA

SEQ ID NO: 90278 - protein, 9 aa, Homo Sapiens
CRPGYLGKM

SEQ ID NO: 90279 - protein, 9 aa, Homo Sapiens
DVSERTHWT

SEQ ID NO: 90280 - protein, 9 aa, Homo Sapiens
ERTHWTPFL

SEQ ID NO: 90281 - protein, 9 aa, Homo Sapiens
KAHSKKCVE

SEQ ID NO: 90282 - protein, 9 aa, Homo Sapiens
DHAMVSPLK

SEQ ID NO: 90283 - protein, 9 aa, Homo Sapiens
LATFKSQLN

SEQ ID NO: 90284 - protein, 9 aa, Homo Sapiens
RTASSFQWL

SEQ ID NO: 90285 - protein, 9 aa, Homo Sapiens
KAIEFVYVK

SEQ ID NO: 90286 - protein, 9 aa, Homo Sapiens
AQQAPSETP

SEQ ID NO: 90287 - protein, 9 aa, Homo Sapiens
NFNPVWDEI

SEQ ID NO: 90288 - protein, 9 aa, Homo Sapiens
DEEEKTAKE

SEQ ID NO: 90289 - protein, 9 aa, Homo Sapiens
EDAPAESQY

SEQ ID NO: 90290 - protein, 9 aa, Homo Sapiens
QKKEVTIPF

SEQ ID NO: 90291 - protein, 9 aa, Homo Sapiens
QQKVKKTAK

SEQ ID NO: 90292 - protein, 9 aa, Homo Sapiens
QLQQITYSL

SEQ ID NO: 90293 - protein, 9 aa, Homo Sapiens
PREKGDVKK

SEQ ID NO: 90294 - protein, 9 aa, Homo Sapiens
FNEKNDILK

SEQ ID NO: 90295 - protein, 9 aa, Homo Sapiens
CSGPALKRS

SEQ ID NO: 90296 - protein, 9 aa, Homo Sapiens
IYKNFNPVW

SEQ ID NO: 90297 - protein, 9 aa, Homo Sapiens
DAPAESQYC

SEQ ID NO: 90298 - protein, 9 aa, Homo Sapiens
TQESDLSKQ

SEQ ID NO: 90299 - protein, 9 aa, Homo Sapiens
DIKNVAELL

SEQ ID NO: 90300 - protein, 9 aa, Homo Sapiens
KSKPIFWNF

SEQ ID NO: 90301 - protein, 9 aa, Homo Sapiens
FGAGATPGN

SEQ ID NO: 90302 - protein, 9 aa, Homo Sapiens
LATKDIRVN

SEQ ID NO: 90303 - protein, 9 aa, Homo Sapiens
ETQESDLSK

SEQ ID NO: 90304 - protein, 9 aa, Homo Sapiens
NSSEEPRNK

SEQ ID NO: 90305 - protein, 9 aa, Homo Sapiens
LSPPPSLCT

SEQ ID NO: 90306 - protein, 9 aa, Homo Sapiens
IFIENKINP

SEQ ID NO: 90307 - protein, 9 aa, Homo Sapiens
LGNTSQQLQ

SEQ ID NO: 90308 - protein, 9 aa, Homo Sapiens
EEIMQTLNK

SEQ ID NO: 90309 - protein, 9 aa, Homo Sapiens
TIACACIYF

SEQ ID NO: 90310 - protein, 9 aa, Homo Sapiens
HWAEYIEKY

SEQ ID NO: 90311 - protein, 9 aa, Homo Sapiens
LIVRHSREE

SEQ ID NO: 90312 - protein, 9 aa, Homo Sapiens
ASADEIIYK

SEQ ID NO: 90313 - protein, 9 aa, Homo Sapiens
YVFEAIHKA

SEQ ID NO: 90314 - protein, 9 aa, Homo Sapiens
KNRNNLIPI

SEQ ID NO: 90315 - protein, 9 aa, Homo Sapiens
DDLSQHQVQ

SEQ ID NO: 90316 - protein, 9 aa, Homo Sapiens
QEWFCPESQ

SEQ ID NO: 90317 - protein, 9 aa, Homo Sapiens
QRRLERFEK

SEQ ID NO: 90318 - protein, 9 aa, Homo Sapiens
EDSTMCVVC

SEQ ID NO: 90319 - protein, 9 aa, Homo Sapiens
LKGYKTYLR

SEQ ID NO: 90320 - protein, 9 aa, Homo Sapiens
FPLTSLFPY

SEQ ID NO: 90321 - protein, 9 aa, Homo Sapiens
PFALMMALL

SEQ ID NO: 90322 - protein, 9 aa, Homo Sapiens
HFEMPHDIV

SEQ ID NO: 90323 - protein, 9 aa, Homo Sapiens
DQELDDKKI

SEQ ID NO: 90324 - protein, 9 aa, Homo Sapiens
SPASTTKRV

SEQ ID NO: 90325 - protein, 9 aa, Homo Sapiens
SQGSFKGNH

SEQ ID NO: 90326 - protein, 9 aa, Homo Sapiens
AKAGGVTGK

SEQ ID NO: 90327 - protein, 9 aa, Homo Sapiens
LPSPTYRHL

SEQ ID NO: 90328 - protein, 9 aa, Homo Sapiens
SILEIRTIN

SEQ ID NO: 90329 - protein, 9 aa, Homo Sapiens
KEKTFTLIN

SEQ ID NO: 90330 - protein, 9 aa, Homo Sapiens
TASSFQWLL

SEQ ID NO: 90331 - protein, 9 aa, Homo Sapiens
TPGNIPVKE

SEQ ID NO: 90332 - protein, 9 aa, Homo Sapiens
ISFDLYESA

SEQ ID NO: 90333 - protein, 9 aa, Homo Sapiens
AQRCDGIND

SEQ ID NO: 90334 - protein, 9 aa, Homo Sapiens
TILEDQQDP

SEQ ID NO: 90335 - protein, 9 aa, Homo Sapiens
RRKAVATCS

SEQ ID NO: 90336 - protein, 9 aa, Homo Sapiens
VIERTFHLD

SEQ ID NO: 90337 - protein, 9 aa, Homo Sapiens
HRGHTRLAF

SEQ ID NO: 90338 - protein, 9 aa, Homo Sapiens
IGEKDFQKL

SEQ ID NO: 90339 - protein, 9 aa, Homo Sapiens
FLAAVSTLN

SEQ ID NO: 90340 - protein, 9 aa, Homo Sapiens
ALFLQKQLA

SEQ ID NO: 90341 - protein, 9 aa, Homo Sapiens
LSTNLFFIV

SEQ ID NO: 90342 - protein, 9 aa, Homo Sapiens
GEDSKGLAA

SEQ ID NO: 90343 - protein, 9 aa, Homo Sapiens
ETLGCCNLI

SEQ ID NO: 90344 - protein, 9 aa, Homo Sapiens
AVCMELYKP

SEQ ID NO: 90345 - protein, 9 aa, Homo Sapiens
EQAKATILE

SEQ ID NO: 90346 - protein, 9 aa, Homo Sapiens
PTYRHLLGF

SEQ ID NO: 90347 - protein, 9 aa, Homo Sapiens
NRAHGSWAT

SEQ ID NO: 90348 - protein, 9 aa, Homo Sapiens
GELFRCFSG

SEQ ID NO: 90349 - protein, 9 aa, Homo Sapiens
EFVDKEEKY

SEQ ID NO: 90350 - protein, 9 aa, Homo Sapiens
TTNSKAPFG

SEQ ID NO: 90351 - protein, 9 aa, Homo Sapiens
QQKEEDELK

SEQ ID NO: 90352 - protein, 9 aa, Homo Sapiens
LVWAINVTM

SEQ ID NO: 90353 - protein, 9 aa, Homo Sapiens
YRTLMCISV

SEQ ID NO: 90354 - protein, 9 aa, Homo Sapiens
SKAPFGLKP

SEQ ID NO: 90355 - protein, 9 aa, Homo Sapiens
QEERLRREE

SEQ ID NO: 90356 - protein, 9 aa, Homo Sapiens
NNTARNNSH

SEQ ID NO: 90357 - protein, 9 aa, Homo Sapiens
SSYASACSS

SEQ ID NO: 90358 - protein, 9 aa, Homo Sapiens
WKQSIGQYY

SEQ ID NO: 90359 - protein, 9 aa, Homo Sapiens
TDGMRTVRA

SEQ ID NO: 90360 - protein, 9 aa, Homo Sapiens
ELQRRLERF

SEQ ID NO: 90361 - protein, 9 aa, Homo Sapiens
KAGDKLTPR

SEQ ID NO: 90362 - protein, 9 aa, Homo Sapiens
TATKKRNTF

SEQ ID NO: 90363 - protein, 9 aa, Homo Sapiens
YYLSVNGYY

SEQ ID NO: 90364 - protein, 9 aa, Homo Sapiens
LEDAPAESQ

SEQ ID NO: 90365 - protein, 9 aa, Homo Sapiens
HAAKAKFFC

SEQ ID NO: 90366 - protein, 9 aa, Homo Sapiens
SVKESLDAK

SEQ ID NO: 90367 - protein, 9 aa, Homo Sapiens
NVTMIGVVL

SEQ ID NO: 90368 - protein, 9 aa, Homo Sapiens
KTPPPPTLS

SEQ ID NO: 90369 - protein, 9 aa, Homo Sapiens
FMAHPSQGN

SEQ ID NO: 90370 - protein, 9 aa, Homo Sapiens
QNGISEDSH

SEQ ID NO: 90371 - protein, 9 aa, Homo Sapiens
TAQNIRVLL

SEQ ID NO: 90372 - protein, 9 aa, Homo Sapiens
SCIVNLAVC

SEQ ID NO: 90373 - protein, 9 aa, Homo Sapiens
NLLMAYQIS

SEQ ID NO: 90374 - protein, 9 aa, Homo Sapiens
EMISECTEQ

SEQ ID NO: 90375 - protein, 9 aa, Homo Sapiens
GPEKGAMDL

SEQ ID NO: 90376 - protein, 9 aa, Homo Sapiens
RLRTIVLKM

SEQ ID NO: 90377 - protein, 9 aa, Homo Sapiens
NRATVLANS

SEQ ID NO: 90378 - protein, 9 aa, Homo Sapiens
YFAARALQI

SEQ ID NO: 90379 - protein, 9 aa, Homo Sapiens
LKDANDVPS

SEQ ID NO: 90380 - protein, 9 aa, Homo Sapiens
NLSHVMLQI

SEQ ID NO: 90381 - protein, 9 aa, Homo Sapiens
LICSDKTGT

SEQ ID NO: 90382 - protein, 9 aa, Homo Sapiens
LGKMFSISC

SEQ ID NO: 90383 - protein, 9 aa, Homo Sapiens
TNSKAPFGL

SEQ ID NO: 90384 - protein, 9 aa, Homo Sapiens
QRALHIRKL

SEQ ID NO: 90385 - protein, 9 aa, Homo Sapiens
SYASACSSS

SEQ ID NO: 90386 - protein, 9 aa, Homo Sapiens
NLPTTAQFM

SEQ ID NO: 90387 - protein, 9 aa, Homo Sapiens
QNTIHVGSI

SEQ ID NO: 90388 - protein, 9 aa, Homo Sapiens
CDEISMNLS

SEQ ID NO: 90389 - protein, 9 aa, Homo Sapiens
PFGMPGTSN

SEQ ID NO: 90390 - protein, 9 aa, Homo Sapiens
YNNGVDVTE

SEQ ID NO: 90391 - protein, 9 aa, Homo Sapiens
RNTFDSSRQ

SEQ ID NO: 90392 - protein, 9 aa, Homo Sapiens
CNLICSDKT

SEQ ID NO: 90393 - protein, 9 aa, Homo Sapiens
AHKNGMKNA

SEQ ID NO: 90394 - protein, 9 aa, Homo Sapiens
EQYHKILDL

SEQ ID NO: 90395 - protein, 9 aa, Homo Sapiens
SSHLNSQAR

SEQ ID NO: 90396 - protein, 9 aa, Homo Sapiens
FIGHYAQNV

SEQ ID NO: 90397 - protein, 9 aa, Homo Sapiens
YEGFVPGKK

SEQ ID NO: 90398 - protein, 9 aa, Homo Sapiens
GSWKYNQSI

SEQ ID NO: 90399 - protein, 9 aa, Homo Sapiens
VQRLIQMLA

SEQ ID NO: 90400 - protein, 9 aa, Homo Sapiens
IFLAAVSTL

SEQ ID NO: 90401 - protein, 9 aa, Homo Sapiens
PDNKHKNLY

SEQ ID NO: 90402 - protein, 9 aa, Homo Sapiens
AINVTMIGV

SEQ ID NO: 90403 - protein, 9 aa, Homo Sapiens
TLLHAIHNH

SEQ ID NO: 90404 - protein, 9 aa, Homo Sapiens
HTSVYFFLK

SEQ ID NO: 90405 - protein, 9 aa, Homo Sapiens
SCSKLATSF

SEQ ID NO: 90406 - protein, 9 aa, Homo Sapiens
TNKEFQFIL

SEQ ID NO: 90407 - protein, 9 aa, Homo Sapiens
KNGSWKYNQ

SEQ ID NO: 90408 - protein, 9 aa, Homo Sapiens
MWRLFVNIY

SEQ ID NO: 90409 - protein, 9 aa, Homo Sapiens
LRFPAESDS

SEQ ID NO: 90410 - protein, 9 aa, Homo Sapiens
LVNSQVDFQ

SEQ ID NO: 90411 - protein, 9 aa, Homo Sapiens
KDVLNVLQA

SEQ ID NO: 90412 - protein, 9 aa, Homo Sapiens
TVISENNKL

SEQ ID NO: 90413 - protein, 9 aa, Homo Sapiens
DHDLPTMLP

SEQ ID NO: 90414 - protein, 9 aa, Homo Sapiens
GKRSLRKQR

SEQ ID NO: 90415 - protein, 9 aa, Homo Sapiens
GEIFDFRGM

SEQ ID NO: 90416 - protein, 9 aa, Homo Sapiens
DKSSQLTKM

SEQ ID NO: 90417 - protein, 9 aa, Homo Sapiens
LNWQDIPLL

SEQ ID NO: 90418 - protein, 9 aa, Homo Sapiens
SKVIYKNFN

SEQ ID NO: 90419 - protein, 9 aa, Homo Sapiens
SYKISPGGK

SEQ ID NO: 90420 - protein, 9 aa, Homo Sapiens
PEELQPEQL

SEQ ID NO: 90421 - protein, 9 aa, Homo Sapiens
KGVHGKALF

SEQ ID NO: 90422 - protein, 9 aa, Homo Sapiens
PILYFIVSQ

SEQ ID NO: 90423 - protein, 9 aa, Homo Sapiens
ICWGTHSKP

SEQ ID NO: 90424 - protein, 9 aa, Homo Sapiens
DIPLLVQCS

SEQ ID NO: 90425 - protein, 9 aa, Homo Sapiens
EEEYRFLIC

SEQ ID NO: 90426 - protein, 9 aa, Homo Sapiens
QKLIETEER

SEQ ID NO: 90427 - protein, 9 aa, Homo Sapiens
ELHVEDTSF

SEQ ID NO: 90428 - protein, 9 aa, Homo Sapiens
IISLKCKTM

SEQ ID NO: 90429 - protein, 9 aa, Homo Sapiens
QNGDRFIED

SEQ ID NO: 90430 - protein, 9 aa, Homo Sapiens
PDSDCQGRG

SEQ ID NO: 90431 - protein, 9 aa, Homo Sapiens
NMETVSKSK

SEQ ID NO: 90432 - protein, 9 aa, Homo Sapiens
NDRYPWWMN

SEQ ID NO: 90433 - protein, 9 aa, Homo Sapiens
IKIREEPGC

SEQ ID NO: 90434 - protein, 9 aa, Homo Sapiens
IEILTEMIS

SEQ ID NO: 90435 - protein, 9 aa, Homo Sapiens
QELDDKKIK

SEQ ID NO: 90436 - protein, 9 aa, Homo Sapiens
FLVSRFIHM

SEQ ID NO: 90437 - protein, 9 aa, Homo Sapiens
QLYRTEKNN

SEQ ID NO: 90438 - protein, 9 aa, Homo Sapiens
ACIYFAARA

SEQ ID NO: 90439 - protein, 9 aa, Homo Sapiens
IKKKTHKVK

SEQ ID NO: 90440 - protein, 9 aa, Homo Sapiens
EWFNYPSLR

SEQ ID NO: 90441 - protein, 9 aa, Homo Sapiens
FHRFPNVYH

SEQ ID NO: 90442 - protein, 9 aa, Homo Sapiens
ARKSSYASA

SEQ ID NO: 90443 - protein, 9 aa, Homo Sapiens
ATVLANSYD

SEQ ID NO: 90444 - protein, 9 aa, Homo Sapiens
KKIKKKTHK

SEQ ID NO: 90445 - protein, 9 aa, Homo Sapiens
EGQKNKILE

SEQ ID NO: 90446 - protein, 9 aa, Homo Sapiens
NYKAECDED

SEQ ID NO: 90447 - protein, 9 aa, Homo Sapiens
KLKVIPETS

SEQ ID NO: 90448 - protein, 9 aa, Homo Sapiens
NAWQLYKTY

SEQ ID NO: 90449 - protein, 9 aa, Homo Sapiens
SELHVEDTS

SEQ ID NO: 90450 - protein, 9 aa, Homo Sapiens
SIKELYGLP

SEQ ID NO: 90451 - protein, 9 aa, Homo Sapiens
VLCIFLDYF

SEQ ID NO: 90452 - protein, 9 aa, Homo Sapiens
SSAGSLKRD

SEQ ID NO: 90453 - protein, 9 aa, Homo Sapiens
KKVYKPILL

SEQ ID NO: 90454 - protein, 9 aa, Homo Sapiens
IPGPIILGF

SEQ ID NO: 90455 - protein, 9 aa, Homo Sapiens
NDDHDLPTM

SEQ ID NO: 90456 - protein, 9 aa, Homo Sapiens
SVEKTLQCS

SEQ ID NO: 90457 - protein, 9 aa, Homo Sapiens
TKDIRVNKI

SEQ ID NO: 90458 - protein, 9 aa, Homo Sapiens
SKHKFLDRM

SEQ ID NO: 90459 - protein, 9 aa, Homo Sapiens
EKGESSTKT

SEQ ID NO: 90460 - protein, 9 aa, Homo Sapiens
GPNTTAVPV

SEQ ID NO: 90461 - protein, 9 aa, Homo Sapiens
HLEEPDDCF

SEQ ID NO: 90462 - protein, 9 aa, Homo Sapiens
SSEQFQRIS

SEQ ID NO: 90463 - protein, 9 aa, Homo Sapiens
GSLETSKAT

SEQ ID NO: 90464 - protein, 9 aa, Homo Sapiens
TERKDPATS

SEQ ID NO: 90465 - protein, 9 aa, Homo Sapiens
QKLLRTDQL

SEQ ID NO: 90466 - protein, 9 aa, Homo Sapiens
GRDLSHSSK

SEQ ID NO: 90467 - protein, 9 aa, Homo Sapiens
QVQLKKMHS

SEQ ID NO: 90468 - protein, 9 aa, Homo Sapiens
TMSADTMEL

SEQ ID NO: 90469 - protein, 9 aa, Homo Sapiens
IHNHRTILY

SEQ ID NO: 90470 - protein, 9 aa, Homo Sapiens
AQNTGQDTC

SEQ ID NO: 90471 - protein, 9 aa, Homo Sapiens
KPIFWNFMF

SEQ ID NO: 90472 - protein, 9 aa, Homo Sapiens
DLLNIFFGG

SEQ ID NO: 90473 - protein, 9 aa, Homo Sapiens
ENSVYLGKY

SEQ ID NO: 90474 - protein, 9 aa, Homo Sapiens
FALMMALLV

SEQ ID NO: 90475 - protein, 9 aa, Homo Sapiens
SISRLHVSC

SEQ ID NO: 90476 - protein, 9 aa, Homo Sapiens
ETSLTNNSR

SEQ ID NO: 90477 - protein, 9 aa, Homo Sapiens
MMEKNELVS

SEQ ID NO: 90478 - protein, 9 aa, Homo Sapiens
SLHSSLYHL

SEQ ID NO: 90479 - protein, 9 aa, Homo Sapiens
MDKTPPPPT

SEQ ID NO: 90480 - protein, 9 aa, Homo Sapiens
VSVSCIVNL

SEQ ID NO: 90481 - protein, 9 aa, Homo Sapiens
DWIHWDPEL

SEQ ID NO: 90482 - protein, 9 aa, Homo Sapiens
FKRQSFHTS

SEQ ID NO: 90483 - protein, 9 aa, Homo Sapiens
LQLEPILYF

SEQ ID NO: 90484 - protein, 9 aa, Homo Sapiens
SIHRLIEQE

SEQ ID NO: 90485 - protein, 9 aa, Homo Sapiens
SSNSFQNNP

SEQ ID NO: 90486 - protein, 9 aa, Homo Sapiens
VISENNKLE

SEQ ID NO: 90487 - protein, 9 aa, Homo Sapiens
RKNICWGTH

SEQ ID NO: 90488 - protein, 9 aa, Homo Sapiens
EEQKYKEQM

SEQ ID NO: 90489 - protein, 9 aa, Homo Sapiens
INDCFDESD

SEQ ID NO: 90490 - protein, 9 aa, Homo Sapiens
GTEFFLLTV

SEQ ID NO: 90491 - protein, 9 aa, Homo Sapiens
QQPVCGPAP

SEQ ID NO: 90492 - protein, 9 aa, Homo Sapiens
WTMLAKDIN

SEQ ID NO: 90493 - protein, 9 aa, Homo Sapiens
EQGWKLIPP

SEQ ID NO: 90494 - protein, 9 aa, Homo Sapiens
PAYGFPKRM

SEQ ID NO: 90495 - protein, 9 aa, Homo Sapiens
PKQRCSIIR

SEQ ID NO: 90496 - protein, 9 aa, Homo Sapiens
LSCSKLATS

SEQ ID NO: 90497 - protein, 9 aa, Homo Sapiens
EGRRKAVAT

SEQ ID NO: 90498 - protein, 9 aa, Homo Sapiens
VCQIFIENK

SEQ ID NO: 90499 - protein, 9 aa, Homo Sapiens
DYPTYTIVG

SEQ ID NO: 90500 - protein, 9 aa, Homo Sapiens
GYLNSLQSN

SEQ ID NO: 90501 - protein, 9 aa, Homo Sapiens
SKLNEHFSQ

SEQ ID NO: 90502 - protein, 9 aa, Homo Sapiens
ERKDPATSL

SEQ ID NO: 90503 - protein, 9 aa, Homo Sapiens
IVSIKELYG

SEQ ID NO: 90504 - protein, 9 aa, Homo Sapiens
KLSRDGSGS

SEQ ID NO: 90505 - protein, 9 aa, Homo Sapiens
LGRKGGEAS

SEQ ID NO: 90506 - protein, 9 aa, Homo Sapiens
DGTMKIRIL

SEQ ID NO: 90507 - protein, 9 aa, Homo Sapiens
EAEGRRKAV

SEQ ID NO: 90508 - protein, 9 aa, Homo Sapiens
EHFSQFGTL

SEQ ID NO: 90509 - protein, 9 aa, Homo Sapiens
WLLEIFLAA

SEQ ID NO: 90510 - protein, 9 aa, Homo Sapiens
DGFYVFEAI

SEQ ID NO: 90511 - protein, 9 aa, Homo Sapiens
EEEKTAKES

SEQ ID NO: 90512 - protein, 9 aa, Homo Sapiens
RFRLIVRHS

SEQ ID NO: 90513 - protein, 9 aa, Homo Sapiens
LRLEEAKSR

SEQ ID NO: 90514 - protein, 9 aa, Homo Sapiens
SFSKTSSGQ

SEQ ID NO: 90515 - protein, 9 aa, Homo Sapiens
VLSTNLFFI

SEQ ID NO: 90516 - protein, 9 aa, Homo Sapiens
TSLFPYQSL

SEQ ID NO: 90517 - protein, 9 aa, Homo Sapiens
KAYYRRGAA

SEQ ID NO: 90518 - protein, 9 aa, Homo Sapiens
SVFLQACFL

SEQ ID NO: 90519 - protein, 9 aa, Homo Sapiens
LSNDNETNS

SEQ ID NO: 90520 - protein, 9 aa, Homo Sapiens
TSQQLQSLQ

SEQ ID NO: 90521 - protein, 9 aa, Homo Sapiens
ISSSPNHSL

SEQ ID NO: 90522 - protein, 9 aa, Homo Sapiens
RESVIEKPY

SEQ ID NO: 90523 - protein, 9 aa, Homo Sapiens
LRCPCKIIK

SEQ ID NO: 90524 - protein, 9 aa, Homo Sapiens
PYQSLLQFP

SEQ ID NO: 90525 - protein, 9 aa, Homo Sapiens
EKTTNTELS

SEQ ID NO: 90526 - protein, 9 aa, Homo Sapiens
LYKTYDEKP

SEQ ID NO: 90527 - protein, 9 aa, Homo Sapiens
MLLLEKESA

SEQ ID NO: 90528 - protein, 9 aa, Homo Sapiens
LSHNDVMMT

SEQ ID NO: 90529 - protein, 9 aa, Homo Sapiens
WSRHRWMLT

SEQ ID NO: 90530 - protein, 9 aa, Homo Sapiens
VKFCPFGQW

SEQ ID NO: 90531 - protein, 9 aa, Homo Sapiens
LLQQKPRKA

SEQ ID NO: 90532 - protein, 9 aa, Homo Sapiens
EECGKGFKQ

SEQ ID NO: 90533 - protein, 9 aa, Homo Sapiens
VSVFLQACF

SEQ ID NO: 90534 - protein, 9 aa, Homo Sapiens
EIDIKNVAE

SEQ ID NO: 90535 - protein, 9 aa, Homo Sapiens
SLVKIKIRE

SEQ ID NO: 90536 - protein, 9 aa, Homo Sapiens
LSIIRLSHS

SEQ ID NO: 90537 - protein, 9 aa, Homo Sapiens
VKAMINAGQ

SEQ ID NO: 90538 - protein, 9 aa, Homo Sapiens
KHHPQTVKQ

SEQ ID NO: 90539 - protein, 9 aa, Homo Sapiens
LVLSQGSFK

SEQ ID NO: 90540 - protein, 9 aa, Homo Sapiens
SCSVEKTLQ

SEQ ID NO: 90541 - protein, 9 aa, Homo Sapiens
QDLTRPLFP

SEQ ID NO: 90542 - protein, 9 aa, Homo Sapiens
STLKFIAQY

SEQ ID NO: 90543 - protein, 9 aa, Homo Sapiens
PLLYRLFVY

SEQ ID NO: 90544 - protein, 9 aa, Homo Sapiens
MPNTSVFLD

SEQ ID NO: 90545 - protein, 9 aa, Homo Sapiens
QRLIQMLAC

SEQ ID NO: 90546 - protein, 9 aa, Homo Sapiens
EEKTAKEST

SEQ ID NO: 90547 - protein, 9 aa, Homo Sapiens
MPGTSNPGP

SEQ ID NO: 90548 - protein, 9 aa, Homo Sapiens
RHRWMLTPA

SEQ ID NO: 90549 - protein, 9 aa, Homo Sapiens
IIKNTNLGD

SEQ ID NO: 90550 - protein, 9 aa, Homo Sapiens
TEMISECTE

SEQ ID NO: 90551 - protein, 9 aa, Homo Sapiens
HLDTPEERE

SEQ ID NO: 90552 - protein, 9 aa, Homo Sapiens
WQDIPLLVQ

SEQ ID NO: 90553 - protein, 9 aa, Homo Sapiens
EEPKKAVPE

SEQ ID NO: 90554 - protein, 9 aa, Homo Sapiens
HPQITKDEV

SEQ ID NO: 90555 - protein, 9 aa, Homo Sapiens
HPDPSQVEL

SEQ ID NO: 90556 - protein, 9 aa, Homo Sapiens
VYFLTVHPE

SEQ ID NO: 90557 - protein, 9 aa, Homo Sapiens
EQMLLLEKE

SEQ ID NO: 90558 - protein, 9 aa, Homo Sapiens
RSLRKQRFM

SEQ ID NO: 90559 - protein, 9 aa, Homo Sapiens
ARLFLDNDK

SEQ ID NO: 90560 - protein, 9 aa, Homo Sapiens
NHQKMIKQF

SEQ ID NO: 90561 - protein, 9 aa, Homo Sapiens
MISECTEQT

SEQ ID NO: 90562 - protein, 9 aa, Homo Sapiens
SSSPNHSLY

SEQ ID NO: 90563 - protein, 9 aa, Homo Sapiens
AQNVSMWIF

SEQ ID NO: 90564 - protein, 9 aa, Homo Sapiens
DTHTEEYKN

SEQ ID NO: 90565 - protein, 9 aa, Homo Sapiens
LESVAEKHE

SEQ ID NO: 90566 - protein, 9 aa, Homo Sapiens
SKRSKGRSR

SEQ ID NO: 90567 - protein, 9 aa, Homo Sapiens
FPRLRTIVL

SEQ ID NO: 90568 - protein, 9 aa, Homo Sapiens
TVIERTFHL

SEQ ID NO: 90569 - protein, 9 aa, Homo Sapiens
KEEKTTNTE

SEQ ID NO: 90570 - protein, 9 aa, Homo Sapiens
ERTTDLKQQ

SEQ ID NO: 90571 - protein, 9 aa, Homo Sapiens
KQSFSFSKT

SEQ ID NO: 90572 - protein, 9 aa, Homo Sapiens
ELLNETQEE

SEQ ID NO: 90573 - protein, 9 aa, Homo Sapiens
EDMSEYSDD

SEQ ID NO: 90574 - protein, 9 aa, Homo Sapiens
NGISEDSHL

SEQ ID NO: 90575 - protein, 9 aa, Homo Sapiens
ATSLPMSLA

SEQ ID NO: 90576 - protein, 9 aa, Homo Sapiens
SFQWLLSTF

SEQ ID NO: 90577 - protein, 9 aa, Homo Sapiens
SLSNDNETN

SEQ ID NO: 90578 - protein, 9 aa, Homo Sapiens
AIEFVYVKE

SEQ ID NO: 90579 - protein, 9 aa, Homo Sapiens
QEIEHFQQA

SEQ ID NO: 90580 - protein, 9 aa, Homo Sapiens
LHAIHNHRT

SEQ ID NO: 90581 - protein, 9 aa, Homo Sapiens
KETLSDLFT

SEQ ID NO: 90582 - protein, 9 aa, Homo Sapiens
QKGNNNERT

SEQ ID NO: 90583 - protein, 9 aa, Homo Sapiens
LQVQALTKQ

SEQ ID NO: 90584 - protein, 9 aa, Homo Sapiens
IRILPDQFS

SEQ ID NO: 90585 - protein, 9 aa, Homo Sapiens
THEKLRQEI

SEQ ID NO: 90586 - protein, 9 aa, Homo Sapiens
FEAIHKAKI

SEQ ID NO: 90587 - protein, 9 aa, Homo Sapiens
AQFMIEAQP

SEQ ID NO: 90588 - protein, 9 aa, Homo Sapiens
ALMMALLVL

SEQ ID NO: 90589 - protein, 9 aa, Homo Sapiens
KTRMVNQNT

SEQ ID NO: 90590 - protein, 9 aa, Homo Sapiens
GGDGKASSQ

SEQ ID NO: 90591 - protein, 9 aa, Homo Sapiens
DKVDYELKN

SEQ ID NO: 90592 - protein, 9 aa, Homo Sapiens
ENLYNNGVD

SEQ ID NO: 90593 - protein, 9 aa, Homo Sapiens
KYKPMQKVD

SEQ ID NO: 90594 - protein, 9 aa, Homo Sapiens
IERTFHLDT

SEQ ID NO: 90595 - protein, 9 aa, Homo Sapiens
QSIGQYYSN

SEQ ID NO: 90596 - protein, 9 aa, Homo Sapiens
ARRPIERES

SEQ ID NO: 90597 - protein, 9 aa, Homo Sapiens
VVAKASRDV

SEQ ID NO: 90598 - protein, 9 aa, Homo Sapiens
ALKIIHQAN

SEQ ID NO: 90599 - protein, 9 aa, Homo Sapiens
HTPHKPISL

SEQ ID NO: 90600 - protein, 9 aa, Homo Sapiens
ESLDAKATI

SEQ ID NO: 90601 - protein, 9 aa, Homo Sapiens
TAGPNWLLD

SEQ ID NO: 90602 - protein, 9 aa, Homo Sapiens
MCVMLVSNF

SEQ ID NO: 90603 - protein, 9 aa, Homo Sapiens
RLRLEEAKS

SEQ ID NO: 90604 - protein, 9 aa, Homo Sapiens
RESDRLEDK

SEQ ID NO: 90605 - protein, 9 aa, Homo Sapiens
LDFLWHPEV

SEQ ID NO: 90606 - protein, 9 aa, Homo Sapiens
RERDELQRR

SEQ ID NO: 90607 - protein, 9 aa, Homo Sapiens
EEVQELYIR

SEQ ID NO: 90608 - protein, 9 aa, Homo Sapiens
YFNEKNDIL

SEQ ID NO: 90609 - protein, 9 aa, Homo Sapiens
QFPQYPMNS

SEQ ID NO: 90610 - protein, 9 aa, Homo Sapiens
RTLMCISVA

SEQ ID NO: 90611 - protein, 9 aa, Homo Sapiens
NLCLRFPAE

SEQ ID NO: 90612 - protein, 9 aa, Homo Sapiens
KEDEKKEDV

SEQ ID NO: 90613 - protein, 9 aa, Homo Sapiens
MFTAILNKS

SEQ ID NO: 90614 - protein, 9 aa, Homo Sapiens
KVYKPILLQ

SEQ ID NO: 90615 - protein, 9 aa, Homo Sapiens
GFVKAMINA

SEQ ID NO: 90616 - protein, 9 aa, Homo Sapiens
CLENLYNNG

SEQ ID NO: 90617 - protein, 9 aa, Homo Sapiens
KMYLVETKV

SEQ ID NO: 90618 - protein, 9 aa, Homo Sapiens
LSRDGSGSP

SEQ ID NO: 90619 - protein, 9 aa, Homo Sapiens
PRLRTIVLK

SEQ ID NO: 90620 - protein, 9 aa, Homo Sapiens
DLPTMLPDE

SEQ ID NO: 90621 - protein, 9 aa, Homo Sapiens
EEKYAIEEL

SEQ ID NO: 90622 - protein, 9 aa, Homo Sapiens
NNMIQQKNM

SEQ ID NO: 90623 - protein, 9 aa, Homo Sapiens
AGSLETSKA

SEQ ID NO: 90624 - protein, 9 aa, Homo Sapiens
INSHNLLKM

SEQ ID NO: 90625 - protein, 9 aa, Homo Sapiens
LYRTEKNNA

SEQ ID NO: 90626 - protein, 9 aa, Homo Sapiens
MIQQKNMAM

SEQ ID NO: 90627 - protein, 9 aa, Homo Sapiens
VRMDKTPPP

SEQ ID NO: 90628 - protein, 9 aa, Homo Sapiens
TQVQLKKMH

SEQ ID NO: 90629 - protein, 9 aa, Homo Sapiens
VNSQVDFQA

SEQ ID NO: 90630 - protein, 9 aa, Homo Sapiens
CVDQGGNKR

SEQ ID NO: 90631 - protein, 9 aa, Homo Sapiens
HPDNKHKNL

SEQ ID NO: 90632 - protein, 9 aa, Homo Sapiens
CDGINDCFD

SEQ ID NO: 90633 - protein, 9 aa, Homo Sapiens
ALINGYLNS

SEQ ID NO: 90634 - protein, 9 aa, Homo Sapiens
LKRDSTEVE

SEQ ID NO: 90635 - protein, 9 aa, Homo Sapiens
SLLQFPQYP

SEQ ID NO: 90636 - protein, 9 aa, Homo Sapiens
FHQAIFCIS

SEQ ID NO: 90637 - protein, 9 aa, Homo Sapiens
YIGKRSLRK

SEQ ID NO: 90638 - protein, 9 aa, Homo Sapiens
KRSLRKQRF

SEQ ID NO: 90639 - protein, 9 aa, Homo Sapiens
WSMFTAILN

SEQ ID NO: 90640 - protein, 9 aa, Homo Sapiens
AYQISFDLY

SEQ ID NO: 90641 - protein, 9 aa, Homo Sapiens
PYKCNDCHK

SEQ ID NO: 90642 - protein, 9 aa, Homo Sapiens
RIDNLYQRA

SEQ ID NO: 90643 - protein, 9 aa, Homo Sapiens
VSFHQAIFC

SEQ ID NO: 90644 - protein, 9 aa, Homo Sapiens
LLMAYQISF

SEQ ID NO: 90645 - protein, 9 aa, Homo Sapiens
QNTTVISEN

SEQ ID NO: 90646 - protein, 9 aa, Homo Sapiens
LGLHMKRHI

SEQ ID NO: 90647 - protein, 9 aa, Homo Sapiens
KISEQLYAF

SEQ ID NO: 90648 - protein, 9 aa, Homo Sapiens
ICQDSKPVQ

SEQ ID NO: 90649 - protein, 9 aa, Homo Sapiens
FPWVLLCSK

SEQ ID NO: 90650 - protein, 9 aa, Homo Sapiens
RKDPATSLP

SEQ ID NO: 90651 - protein, 9 aa, Homo Sapiens
SFDLYESAS

SEQ ID NO: 90652 - protein, 9 aa, Homo Sapiens
GGDLFTENE

SEQ ID NO: 90653 - protein, 9 aa, Homo Sapiens
LCIKSFDQW

SEQ ID NO: 90654 - protein, 9 aa, Homo Sapiens
HFFGGTEFF

SEQ ID NO: 90655 - protein, 9 aa, Homo Sapiens
ESLSNDNET

SEQ ID NO: 90656 - protein, 9 aa, Homo Sapiens
IGDKDNAKK

SEQ ID NO: 90657 - protein, 9 aa, Homo Sapiens
DDSQRLTAM

SEQ ID NO: 90658 - protein, 9 aa, Homo Sapiens
VSQLWAFLH

SEQ ID NO: 90659 - protein, 9 aa, Homo Sapiens
MFPLTSLFP

SEQ ID NO: 90660 - protein, 9 aa, Homo Sapiens
VSCIVNLAV

SEQ ID NO: 90661 - protein, 9 aa, Homo Sapiens
ELYGLPPIA

SEQ ID NO: 90662 - protein, 9 aa, Homo Sapiens
PAESQYCLL

SEQ ID NO: 90663 - protein, 9 aa, Homo Sapiens
MSLASLTAS

SEQ ID NO: 90664 - protein, 9 aa, Homo Sapiens
KKYNRLTLS

SEQ ID NO: 90665 - protein, 9 aa, Homo Sapiens
RRKEANSSE

SEQ ID NO: 90666 - protein, 9 aa, Homo Sapiens
RTVRAFHFD

SEQ ID NO: 90667 - protein, 9 aa, Homo Sapiens
RRKLVWAIN

SEQ ID NO: 90668 - protein, 9 aa, Homo Sapiens
ARMAHGSTA

SEQ ID NO: 90669 - protein, 9 aa, Homo Sapiens
GSLKRDSTE

SEQ ID NO: 90670 - protein, 9 aa, Homo Sapiens
KLPHKFHTL

SEQ ID NO: 90671 - protein, 9 aa, Homo Sapiens
GKGFKQCSH

SEQ ID NO: 90672 - protein, 9 aa, Homo Sapiens
LRIQSKQNI

SEQ ID NO: 90673 - protein, 9 aa, Homo Sapiens
DQYRTLMCI

SEQ ID NO: 90674 - protein, 9 aa, Homo Sapiens
DAQLQARRP

SEQ ID NO: 90675 - protein, 9 aa, Homo Sapiens
NMIQQKNMA

SEQ ID NO: 90676 - protein, 9 aa, Homo Sapiens
VLFLVSRFI

SEQ ID NO: 90677 - protein, 9 aa, Homo Sapiens
SRSDHLGLH

SEQ ID NO: 90678 - protein, 9 aa, Homo Sapiens
DLDARMAHG

SEQ ID NO: 90679 - protein, 9 aa, Homo Sapiens
LSRKSSYAS

SEQ ID NO: 90680 - protein, 9 aa, Homo Sapiens
LITDGMRTV

SEQ ID NO: 90681 - protein, 9 aa, Homo Sapiens
GSVTRDSIS

SEQ ID NO: 90682 - protein, 9 aa, Homo Sapiens
IEKLIKQVT

SEQ ID NO: 90683 - protein, 9 aa, Homo Sapiens
KEEIMQTLN

SEQ ID NO: 90684 - protein, 9 aa, Homo Sapiens
WLPLEGKEF

SEQ ID NO: 90685 - protein, 9 aa, Homo Sapiens
EAYVNENQA

SEQ ID NO: 90686 - protein, 9 aa, Homo Sapiens
QVEDGEIFD

SEQ ID NO: 90687 - protein, 9 aa, Homo Sapiens
ALTKQQQSP

SEQ ID NO: 90688 - protein, 9 aa, Homo Sapiens
LEKFTASIH

SEQ ID NO: 90689 - protein, 9 aa, Homo Sapiens
VQKSIEVPQ

SEQ ID NO: 90690 - protein, 9 aa, Homo Sapiens
QSSEQFQRI

SEQ ID NO: 90691 - protein, 9 aa, Homo Sapiens
VNQNTIHVG

SEQ ID NO: 90692 - protein, 9 aa, Homo Sapiens
KDLCIKSFD

SEQ ID NO: 90693 - protein, 9 aa, Homo Sapiens
KLKKQGEIP

SEQ ID NO: 90694 - protein, 9 aa, Homo Sapiens
DSTMCVVCS

SEQ ID NO: 90695 - protein, 9 aa, Homo Sapiens
AQAGSLETS

SEQ ID NO: 90696 - protein, 9 aa, Homo Sapiens
REYGHTYVE

SEQ ID NO: 90697 - protein, 9 aa, Homo Sapiens
AKIADFVLS

SEQ ID NO: 90698 - protein, 9 aa, Homo Sapiens
DELQRRLER

SEQ ID NO: 90699 - protein, 9 aa, Homo Sapiens
PCKIIKKEL

SEQ ID NO: 90700 - protein, 9 aa, Homo Sapiens
WKLIPPQEW

SEQ ID NO: 90701 - protein, 9 aa, Homo Sapiens
IKQVTESSH

SEQ ID NO: 90702 - protein, 9 aa, Homo Sapiens
SPTTNSKAP

SEQ ID NO: 90703 - protein, 9 aa, Homo Sapiens
LGEEQKYKE

SEQ ID NO: 90704 - protein, 9 aa, Homo Sapiens
YPSLRDKVT

SEQ ID NO: 90705 - protein, 9 aa, Homo Sapiens
KNLYINIVA

SEQ ID NO: 90706 - protein, 9 aa, Homo Sapiens
QRCDGINDC

SEQ ID NO: 90707 - protein, 9 aa, Homo Sapiens
LCSKDVTFH

SEQ ID NO: 90708 - protein, 9 aa, Homo Sapiens
CGKRSLFRI

SEQ ID NO: 90709 - protein, 9 aa, Homo Sapiens
DLQLEPILY

SEQ ID NO: 90710 - protein, 9 aa, Homo Sapiens
KMLREKKER

SEQ ID NO: 90711 - protein, 9 aa, Homo Sapiens
QQKQKYKPM

SEQ ID NO: 90712 - protein, 9 aa, Homo Sapiens
GEEQKYKEQ

SEQ ID NO: 90713 - protein, 9 aa, Homo Sapiens
VEKEIQKSK

SEQ ID NO: 90714 - protein, 9 aa, Homo Sapiens
SASPKQRCS

SEQ ID NO: 90715 - protein, 9 aa, Homo Sapiens
LNSSCSVEK

SEQ ID NO: 90716 - protein, 9 aa, Homo Sapiens
KPYVCTRCG

SEQ ID NO: 90717 - protein, 9 aa, Homo Sapiens
GSQETQESD

SEQ ID NO: 90718 - protein, 9 aa, Homo Sapiens
KDIRVNKIY

SEQ ID NO: 90719 - protein, 9 aa, Homo Sapiens
VNYGLQEKI

SEQ ID NO: 90720 - protein, 9 aa, Homo Sapiens
NYTEEEYRF

SEQ ID NO: 90721 - protein, 9 aa, Homo Sapiens
GFVYFLTVH

SEQ ID NO: 90722 - protein, 9 aa, Homo Sapiens
WVQKHHPQT

SEQ ID NO: 90723 - protein, 9 aa, Homo Sapiens
LENLYNNGV

SEQ ID NO: 90724 - protein, 9 aa, Homo Sapiens
IHMSGTQKS

SEQ ID NO: 90725 - protein, 9 aa, Homo Sapiens
NMPNTSVFL

SEQ ID NO: 90726 - protein, 9 aa, Homo Sapiens
ELFRCFSGQ

SEQ ID NO: 90727 - protein, 9 aa, Homo Sapiens
MSKIAEARK

SEQ ID NO: 90728 - protein, 9 aa, Homo Sapiens
IRIDNLYQR

SEQ ID NO: 90729 - protein, 9 aa, Homo Sapiens
HVESDFDDA

SEQ ID NO: 90730 - protein, 9 aa, Homo Sapiens
MRTASSFQW

SEQ ID NO: 90731 - protein, 9 aa, Homo Sapiens
LEEERHLPL

SEQ ID NO: 90732 - protein, 9 aa, Homo Sapiens
EDGEIFDFR

SEQ ID NO: 90733 - protein, 9 aa, Homo Sapiens
KFIAQYGNG

SEQ ID NO: 90734 - protein, 9 aa, Homo Sapiens
CSVEKTLQC

SEQ ID NO: 90735 - protein, 9 aa, Homo Sapiens
SESKAKAIE

SEQ ID NO: 90736 - protein, 9 aa, Homo Sapiens
IISFDSLHV

SEQ ID NO: 90737 - protein, 9 aa, Homo Sapiens
KRQSFHTSI

SEQ ID NO: 90738 - protein, 9 aa, Homo Sapiens
IPNEVCMFS

SEQ ID NO: 90739 - protein, 9 aa, Homo Sapiens
RQEIEVQHK

SEQ ID NO: 90740 - protein, 9 aa, Homo Sapiens
DEIIYKITQ

SEQ ID NO: 90741 - protein, 9 aa, Homo Sapiens
HHQNEKNRN

SEQ ID NO: 90742 - protein, 9 aa, Homo Sapiens
RTFHLDTPE

SEQ ID NO: 90743 - protein, 9 aa, Homo Sapiens
GGLAVLSER

SEQ ID NO: 90744 - protein, 9 aa, Homo Sapiens
DPPIGAQQS

SEQ ID NO: 90745 - protein, 9 aa, Homo Sapiens
NNGVDVTEL

SEQ ID NO: 90746 - protein, 9 aa, Homo Sapiens
FNPVWDEIV

SEQ ID NO: 90747 - protein, 9 aa, Homo Sapiens
DNDEFEKKR

SEQ ID NO: 90748 - protein, 9 aa, Homo Sapiens
MSARKSSYA

SEQ ID NO: 90749 - protein, 9 aa, Homo Sapiens
RTIVLKMPM

SEQ ID NO: 90750 - protein, 9 aa, Homo Sapiens
EKNRNNLIP

SEQ ID NO: 90751 - protein, 9 aa, Homo Sapiens
WVNNKMYLV

SEQ ID NO: 90752 - protein, 9 aa, Homo Sapiens
KKQGEIPNE

SEQ ID NO: 90753 - protein, 9 aa, Homo Sapiens
NSYDTAWKK

SEQ ID NO: 90754 - protein, 9 aa, Homo Sapiens
KAKFFCIMC

SEQ ID NO: 90755 - protein, 9 aa, Homo Sapiens
YSEGGDGKA

SEQ ID NO: 90756 - protein, 9 aa, Homo Sapiens
DAENEQILN

SEQ ID NO: 90757 - protein, 9 aa, Homo Sapiens
RKLVWAINV

SEQ ID NO: 90758 - protein, 9 aa, Homo Sapiens
LLTETKYIN

SEQ ID NO: 90759 - protein, 9 aa, Homo Sapiens
QQEMEPNLS

SEQ ID NO: 90760 - protein, 9 aa, Homo Sapiens
SSKDERQEN

SEQ ID NO: 90761 - protein, 9 aa, Homo Sapiens
EIAQTQNGI

SEQ ID NO: 90762 - protein, 9 aa, Homo Sapiens
YYRRGAARF

SEQ ID NO: 90763 - protein, 9 aa, Homo Sapiens
HDLPTMLPD

SEQ ID NO: 90764 - protein, 9 aa, Homo Sapiens
ADGTMKIRI

SEQ ID NO: 90765 - protein, 9 aa, Homo Sapiens
LTAQPLWNN

SEQ ID NO: 90766 - protein, 9 aa, Homo Sapiens
GDRKINRYF

SEQ ID NO: 90767 - protein, 9 aa, Homo Sapiens
LNSQARTSS

SEQ ID NO: 90768 - protein, 9 aa, Homo Sapiens
RAVLGRKGG

SEQ ID NO: 90769 - protein, 9 aa, Homo Sapiens
FTTVRMKPD

SEQ ID NO: 90770 - protein, 9 aa, Homo Sapiens
LILLTSLLS

SEQ ID NO: 90771 - protein, 9 aa, Homo Sapiens
TAQFMIEAQ

SEQ ID NO: 90772 - protein, 9 aa, Homo Sapiens
VLSQGSFKG

SEQ ID NO: 90773 - protein, 9 aa, Homo Sapiens
HKFHTLVGE

SEQ ID NO: 90774 - protein, 9 aa, Homo Sapiens
KKCSHRNSL

SEQ ID NO: 90775 - protein, 9 aa, Homo Sapiens
LEKLDVNCQ

SEQ ID NO: 90776 - protein, 9 aa, Homo Sapiens
IEVPQAKAQ

SEQ ID NO: 90777 - protein, 9 aa, Homo Sapiens
LLHTPHKPI

SEQ ID NO: 90778 - protein, 9 aa, Homo Sapiens
CSIIRDRGP

SEQ ID NO: 90779 - protein, 9 aa, Homo Sapiens
DSLSHNDVM

SEQ ID NO: 90780 - protein, 9 aa, Homo Sapiens
EKGDVKKTD

SEQ ID NO: 90781 - protein, 9 aa, Homo Sapiens
EKKEDVEEL

SEQ ID NO: 90782 - protein, 9 aa, Homo Sapiens
QPGPEKGAM

SEQ ID NO: 90783 - protein, 9 aa, Homo Sapiens
NLYINIVAY

SEQ ID NO: 90784 - protein, 9 aa, Homo Sapiens
SEYKEERIL

SEQ ID NO: 90785 - protein, 9 aa, Homo Sapiens
EPKKAVPEK

SEQ ID NO: 90786 - protein, 9 aa, Homo Sapiens
FPQYPMNSS

SEQ ID NO: 90787 - protein, 9 aa, Homo Sapiens
GVHGKALFL

SEQ ID NO: 90788 - protein, 9 aa, Homo Sapiens
KLTPRKLST

SEQ ID NO: 90789 - protein, 9 aa, Homo Sapiens
WAINVTMIG

SEQ ID NO: 90790 - protein, 9 aa, Homo Sapiens
LGFTIDSTC

SEQ ID NO: 90791 - protein, 9 aa, Homo Sapiens
PDPSQVELL

SEQ ID NO: 90792 - protein, 9 aa, Homo Sapiens
KEEIEKLIK

SEQ ID NO: 90793 - protein, 9 aa, Homo Sapiens
IQKSKGQEN

SEQ ID NO: 90794 - protein, 9 aa, Homo Sapiens
VLGRKGGEA

SEQ ID NO: 90795 - protein, 9 aa, Homo Sapiens
INGKHTFSE

SEQ ID NO: 90796 - protein, 9 aa, Homo Sapiens
VSPTTNSKA

SEQ ID NO: 90797 - protein, 9 aa, Homo Sapiens
KRNTFDSSR

SEQ ID NO: 90798 - protein, 9 aa, Homo Sapiens
FCIMCCSNI

SEQ ID NO: 90799 - protein, 9 aa, Homo Sapiens
KESAAYSQV

SEQ ID NO: 90800 - protein, 9 aa, Homo Sapiens
KSQRTERKD

SEQ ID NO: 90801 - protein, 9 aa, Homo Sapiens
TFHLDTPEE

SEQ ID NO: 90802 - protein, 9 aa, Homo Sapiens
VNEGQKNKI

SEQ ID NO: 90803 - protein, 9 aa, Homo Sapiens
AGPNWLLDV

SEQ ID NO: 90804 - protein, 9 aa, Homo Sapiens
QLEPILYFI

SEQ ID NO: 90805 - protein, 9 aa, Homo Sapiens
SKLTIVHHP

SEQ ID NO: 90806 - protein, 9 aa, Homo Sapiens
LKKMHSSVI

SEQ ID NO: 90807 - protein, 9 aa, Homo Sapiens
EAPGASADE

SEQ ID NO: 90808 - protein, 9 aa, Homo Sapiens
SPKQRCSII

SEQ ID NO: 90809 - protein, 9 aa, Homo Sapiens
TSFEASKHK

SEQ ID NO: 90810 - protein, 9 aa, Homo Sapiens
IKGVHGKAL

SEQ ID NO: 90811 - protein, 9 aa, Homo Sapiens
SQARTSSSK

SEQ ID NO: 90812 - protein, 9 aa, Homo Sapiens
VAKASRDVI

SEQ ID NO: 90813 - protein, 9 aa, Homo Sapiens
KLLEWFNYP

SEQ ID NO: 90814 - protein, 9 aa, Homo Sapiens
IMNSPMGKS

SEQ ID NO: 90815 - protein, 9 aa, Homo Sapiens
HYAQNVSMW

SEQ ID NO: 90816 - protein, 9 aa, Homo Sapiens
SNSSETTDL

SEQ ID NO: 90817 - protein, 9 aa, Homo Sapiens
AIFCISGDR

SEQ ID NO: 90818 - protein, 9 aa, Homo Sapiens
AGECVEDIT

SEQ ID NO: 90819 - protein, 9 aa, Homo Sapiens
ASASPKQRC

SEQ ID NO: 90820 - protein, 9 aa, Homo Sapiens
HSSLYHLIL

SEQ ID NO: 90821 - protein, 9 aa, Homo Sapiens
AFWTMLAKD

SEQ ID NO: 90822 - protein, 9 aa, Homo Sapiens
PHKPISLAM

SEQ ID NO: 90823 - protein, 9 aa, Homo Sapiens
SQETQESDL

SEQ ID NO: 90824 - protein, 9 aa, Homo Sapiens
TDQLEVCRE

SEQ ID NO: 90825 - protein, 9 aa, Homo Sapiens
NLICSDKTG

SEQ ID NO: 90826 - protein, 9 aa, Homo Sapiens
IEFVYVKEP

SEQ ID NO: 90827 - protein, 9 aa, Homo Sapiens
KIKIREEPG

SEQ ID NO: 90828 - protein, 9 aa, Homo Sapiens
TTVRMKPDP

SEQ ID NO: 90829 - protein, 9 aa, Homo Sapiens
LREKKERLE

SEQ ID NO: 90830 - protein, 9 aa, Homo Sapiens
DEFEKKRTA

SEQ ID NO: 90831 - protein, 9 aa, Homo Sapiens
TDGDSFHPQ

SEQ ID NO: 90832 - protein, 9 aa, Homo Sapiens
SLPMSLASL

SEQ ID NO: 90833 - protein, 9 aa, Homo Sapiens
ELATFKSQL

SEQ ID NO: 90834 - protein, 9 aa, Homo Sapiens
RIQSKQNIQ

SEQ ID NO: 90835 - protein, 9 aa, Homo Sapiens
KDVTFHPDP

SEQ ID NO: 90836 - protein, 9 aa, Homo Sapiens
RMRTASSFQ

SEQ ID NO: 90837 - protein, 9 aa, Homo Sapiens
YPQDLTRPL

SEQ ID NO: 90838 - protein, 9 aa, Homo Sapiens
HQNEKNRNN

SEQ ID NO: 90839 - protein, 9 aa, Homo Sapiens
LKCKTMQSD

SEQ ID NO: 90840 - protein, 9 aa, Homo Sapiens
NEKHMYPSI

SEQ ID NO: 90841 - protein, 9 aa, Homo Sapiens
VLTAGPNWL

SEQ ID NO: 90842 - protein, 9 aa, Homo Sapiens
PSQCEISPL

SEQ ID NO: 90843 - protein, 9 aa, Homo Sapiens
KRMRTASSF

SEQ ID NO: 90844 - protein, 9 aa, Homo Sapiens
QAQRCDGIN

SEQ ID NO: 90845 - protein, 9 aa, Homo Sapiens
GQYYSNVIA

SEQ ID NO: 90846 - protein, 9 aa, Homo Sapiens
KIIKKELQC

SEQ ID NO: 90847 - protein, 9 aa, Homo Sapiens
TINFIFRTK

SEQ ID NO: 90848 - protein, 9 aa, Homo Sapiens
LLVQCSECT

SEQ ID NO: 90849 - protein, 9 aa, Homo Sapiens
FVNIYFLQK

SEQ ID NO: 90850 - protein, 9 aa, Homo Sapiens
CDECGKILS

SEQ ID NO: 90851 - protein, 9 aa, Homo Sapiens
SIGQYYSNV

SEQ ID NO: 90852 - protein, 9 aa, Homo Sapiens
KLDVNCQKY

SEQ ID NO: 90853 - protein, 9 aa, Homo Sapiens
IADFVLSNM

SEQ ID NO: 90854 - protein, 9 aa, Homo Sapiens
RKLSRDGSG

SEQ ID NO: 90855 - protein, 9 aa, Homo Sapiens
EDTSFFLTL

SEQ ID NO: 90856 - protein, 9 aa, Homo Sapiens
KYNRLTLSK

SEQ ID NO: 90857 - protein, 9 aa, Homo Sapiens
WDPELSYEF

SEQ ID NO: 90858 - protein, 9 aa, Homo Sapiens
PATSLPMSL

SEQ ID NO: 90859 - protein, 9 aa, Homo Sapiens
NSKAPFGLK

SEQ ID NO: 90860 - protein, 9 aa, Homo Sapiens
QNTGQDTCI

SEQ ID NO: 90861 - protein, 9 aa, Homo Sapiens
HEAESTTEE

SEQ ID NO: 90862 - protein, 9 aa, Homo Sapiens
RILKHSSQN

SEQ ID NO: 90863 - protein, 9 aa, Homo Sapiens
NWQDIPLLV

SEQ ID NO: 90864 - protein, 9 aa, Homo Sapiens
RLYESNPMR

SEQ ID NO: 90865 - protein, 9 aa, Homo Sapiens
GDLFTENEN

SEQ ID NO: 90866 - protein, 9 aa, Homo Sapiens
LFTLIAGCK

SEQ ID NO: 90867 - protein, 9 aa, Homo Sapiens
WGLEDMSEY

SEQ ID NO: 90868 - protein, 9 aa, Homo Sapiens
EKTAKESTA

SEQ ID NO: 90869 - protein, 9 aa, Homo Sapiens
IKLKAGECV

SEQ ID NO: 90870 - protein, 9 aa, Homo Sapiens
GDVKKTDEL

SEQ ID NO: 90871 - protein, 9 aa, Homo Sapiens
KDNAKKVYE

SEQ ID NO: 90872 - protein, 9 aa, Homo Sapiens
GPIILGFTI

SEQ ID NO: 90873 - protein, 9 aa, Homo Sapiens
PDHAMVSPL

SEQ ID NO: 90874 - protein, 9 aa, Homo Sapiens
TSSGQSSKT

SEQ ID NO: 90875 - protein, 9 aa, Homo Sapiens
EKKERLEQD

SEQ ID NO: 90876 - protein, 9 aa, Homo Sapiens
TGQDTCILL

SEQ ID NO: 90877 - protein, 9 aa, Homo Sapiens
GKEDEKKED

SEQ ID NO: 90878 - protein, 9 aa, Homo Sapiens
LAMIISIYY

SEQ ID NO: 90879 - protein, 9 aa, Homo Sapiens
ECGKGFKQC

SEQ ID NO: 90880 - protein, 9 aa, Homo Sapiens
LSQSSALIL

SEQ ID NO: 90881 - protein, 9 aa, Homo Sapiens
QSLLQFPQY

SEQ ID NO: 90882 - protein, 9 aa, Homo Sapiens
DVRGQEGTL

SEQ ID NO: 90883 - protein, 9 aa, Homo Sapiens
SFHQAIFCI

SEQ ID NO: 90884 - protein, 9 aa, Homo Sapiens
ELCWLKHKA

SEQ ID NO: 90885 - protein, 9 aa, Homo Sapiens
LADHLEEPD

SEQ ID NO: 90886 - protein, 9 aa, Homo Sapiens
DCHKTFSHR

SEQ ID NO: 90887 - protein, 9 aa, Homo Sapiens
KNKRIEMLE

SEQ ID NO: 90888 - protein, 9 aa, Homo Sapiens
NNNERTTDL

SEQ ID NO: 90889 - protein, 9 aa, Homo Sapiens
HNDVMMTQS

SEQ ID NO: 90890 - protein, 9 aa, Homo Sapiens
KRTAAIAEV

SEQ ID NO: 90891 - protein, 9 aa, Homo Sapiens
KCNDCHKTF

SEQ ID NO: 90892 - protein, 9 aa, Homo Sapiens
SDTEKHEGG

SEQ ID NO: 90893 - protein, 9 aa, Homo Sapiens
GFKAGDKLT

SEQ ID NO: 90894 - protein, 9 aa, Homo Sapiens
SGPNRAHGS

SEQ ID NO: 90895 - protein, 9 aa, Homo Sapiens
ETLSDLFTL

SEQ ID NO: 90896 - protein, 9 aa, Homo Sapiens
VPCEPPEVG

SEQ ID NO: 90897 - protein, 9 aa, Homo Sapiens
GDEEEKWAA

SEQ ID NO: 90898 - protein, 9 aa, Homo Sapiens
TMCVVCSHH

SEQ ID NO: 90899 - protein, 9 aa, Homo Sapiens
TGPNGCGKR

SEQ ID NO: 90900 - protein, 9 aa, Homo Sapiens
STPDDLYVS

SEQ ID NO: 90901 - protein, 9 aa, Homo Sapiens
GTIPGPIIL

SEQ ID NO: 90902 - protein, 9 aa, Homo Sapiens
DLCIKSFDQ

SEQ ID NO: 90903 - protein, 9 aa, Homo Sapiens
NDEFEKKRT

SEQ ID NO: 90904 - protein, 9 aa, Homo Sapiens
TQNGISEDS

SEQ ID NO: 90905 - protein, 9 aa, Homo Sapiens
GKAQQAPSE

SEQ ID NO: 90906 - protein, 9 aa, Homo Sapiens
SKSKANFEK

SEQ ID NO: 90907 - protein, 9 aa, Homo Sapiens
DPEGEEWDE

SEQ ID NO: 90908 - protein, 9 aa, Homo Sapiens
SVFLDTDAE

SEQ ID NO: 90909 - protein, 9 aa, Homo Sapiens
TQKLLRTDQ

SEQ ID NO: 90910 - protein, 9 aa, Homo Sapiens
LCTIQHDHV

SEQ ID NO: 90911 - protein, 9 aa, Homo Sapiens
LQNAWQLYK

SEQ ID NO: 90912 - protein, 9 aa, Homo Sapiens
KGTKRKRDV

SEQ ID NO: 90913 - protein, 9 aa, Homo Sapiens
HHHQNEKNR

SEQ ID NO: 90914 - protein, 9 aa, Homo Sapiens
RNYFNEKND

SEQ ID NO: 90915 - protein, 9 aa, Homo Sapiens
LASFREMVF

SEQ ID NO: 90916 - protein, 9 aa, Homo Sapiens
KGDVKKTDE

SEQ ID NO: 90917 - protein, 9 aa, Homo Sapiens
EPNLSCPKR

SEQ ID NO: 90918 - protein, 9 aa, Homo Sapiens
WEPGKEDEK

SEQ ID NO: 90919 - protein, 9 aa, Homo Sapiens
SPAFALFLI

SEQ ID NO: 90920 - protein, 9 aa, Homo Sapiens
QGTIERYTY

SEQ ID NO: 90921 - protein, 9 aa, Homo Sapiens
QLTLVKNVL

SEQ ID NO: 90922 - protein, 9 aa, Homo Sapiens
SGRPNSGSG

SEQ ID NO: 90923 - protein, 9 aa, Homo Sapiens
IVSSAGSLK

SEQ ID NO: 90924 - protein, 9 aa, Homo Sapiens
FSPAFALFL

SEQ ID NO: 90925 - protein, 9 aa, Homo Sapiens
NKILEEMEK

SEQ ID NO: 90926 - protein, 9 aa, Homo Sapiens
QKNGSWKYN

SEQ ID NO: 90927 - protein, 9 aa, Homo Sapiens
LFSLTAQPL

SEQ ID NO: 90928 - protein, 9 aa, Homo Sapiens
KALFLQKQL

SEQ ID NO: 90929 - protein, 9 aa, Homo Sapiens
RFIHMSGTQ

SEQ ID NO: 90930 - protein, 9 aa, Homo Sapiens
INVTMIGVV

SEQ ID NO: 90931 - protein, 9 aa, Homo Sapiens
KVFCYRSGL

SEQ ID NO: 90932 - protein, 9 aa, Homo Sapiens
VSRFIHMSG

SEQ ID NO: 90933 - protein, 9 aa, Homo Sapiens
DDLYVSSSN

SEQ ID NO: 90934 - protein, 9 aa, Homo Sapiens
NNTARCVDQ

SEQ ID NO: 90935 - protein, 9 aa, Homo Sapiens
IFIGHYAQN

SEQ ID NO: 90936 - protein, 9 aa, Homo Sapiens
HHNFPPPSS

SEQ ID NO: 90937 - protein, 9 aa, Homo Sapiens
TYICKPDSD

SEQ ID NO: 90938 - protein, 9 aa, Homo Sapiens
PWMFPLTSL

SEQ ID NO: 90939 - protein, 9 aa, Homo Sapiens
SFFLTLLPL

SEQ ID NO: 90940 - protein, 9 aa, Homo Sapiens
GKVNEGQKN

SEQ ID NO: 90941 - protein, 9 aa, Homo Sapiens
LVVLGSQET

SEQ ID NO: 90942 - protein, 9 aa, Homo Sapiens
KFFCIMCCS

SEQ ID NO: 90943 - protein, 9 aa, Homo Sapiens
RKLESVAEK

SEQ ID NO: 90944 - protein, 9 aa, Homo Sapiens
CPESQLQGP

SEQ ID NO: 90945 - protein, 9 aa, Homo Sapiens
DAKATISTC

SEQ ID NO: 90946 - protein, 9 aa, Homo Sapiens
NTARCVDQG

SEQ ID NO: 90947 - protein, 9 aa, Homo Sapiens
CISVADPMV

SEQ ID NO: 90948 - protein, 9 aa, Homo Sapiens
IHWDPELSY

SEQ ID NO: 90949 - protein, 9 aa, Homo Sapiens
TSDSLSHND

SEQ ID NO: 90950 - protein, 9 aa, Homo Sapiens
SLVKELLDS

SEQ ID NO: 90951 - protein, 9 aa, Homo Sapiens
KTLLHAIHN

SEQ ID NO: 90952 - protein, 9 aa, Homo Sapiens
FPYQSLLQF

SEQ ID NO: 90953 - protein, 9 aa, Homo Sapiens
LRHRLRLEE

SEQ ID NO: 90954 - protein, 9 aa, Homo Sapiens
GRSENEKKS

SEQ ID NO: 90955 - protein, 9 aa, Homo Sapiens
ISEQLYAFC

SEQ ID NO: 90956 - protein, 9 aa, Homo Sapiens
RVENWNADH

SEQ ID NO: 90957 - protein, 9 aa, Homo Sapiens
AVLGRKGGE

SEQ ID NO: 90958 - protein, 9 aa, Homo Sapiens
VKELLDSGI

SEQ ID NO: 90959 - protein, 9 aa, Homo Sapiens
EVINDYNML

SEQ ID NO: 90960 - protein, 9 aa, Homo Sapiens
ECQEYGKTI

SEQ ID NO: 90961 - protein, 9 aa, Homo Sapiens
PNSGSGEDS

SEQ ID NO: 90962 - protein, 9 aa, Homo Sapiens
MLREKKERL

SEQ ID NO: 90963 - protein, 9 aa, Homo Sapiens
HNLLKMIRH

SEQ ID NO: 90964 - protein, 9 aa, Homo Sapiens
DVCQIFIEN

SEQ ID NO: 90965 - protein, 9 aa, Homo Sapiens
QAIFCISGD

SEQ ID NO: 90966 - protein, 9 aa, Homo Sapiens
IHQANKSKT

SEQ ID NO: 90967 - protein, 9 aa, Homo Sapiens
FVPGKKLIA

SEQ ID NO: 90968 - protein, 9 aa, Homo Sapiens
NPGPPGPKG

SEQ ID NO: 90969 - protein, 9 aa, Homo Sapiens
DNLYQRALH

SEQ ID NO: 90970 - protein, 9 aa, Homo Sapiens
TIPGPIILG

SEQ ID NO: 90971 - protein, 9 aa, Homo Sapiens
AQYGNGLKS

SEQ ID NO: 90972 - protein, 9 aa, Homo Sapiens
NPMRQRRPP

SEQ ID NO: 90973 - protein, 9 aa, Homo Sapiens
VPEEPKKAV

SEQ ID NO: 90974 - protein, 9 aa, Homo Sapiens
ASLTASGFP

SEQ ID NO: 90975 - protein, 9 aa, Homo Sapiens
IMKMSGDKS

SEQ ID NO: 90976 - protein, 9 aa, Homo Sapiens
GEIPNEVCM

SEQ ID NO: 90977 - protein, 9 aa, Homo Sapiens
VCGPAPPSR

SEQ ID NO: 90978 - protein, 9 aa, Homo Sapiens
VNMFIGEKD

SEQ ID NO: 90979 - protein, 9 aa, Homo Sapiens
FKPVRKHFE

SEQ ID NO: 90980 - protein, 9 aa, Homo Sapiens
HKNGMKNAE

SEQ ID NO: 90981 - protein, 9 aa, Homo Sapiens
LEQPSRSEF

SEQ ID NO: 90982 - protein, 9 aa, Homo Sapiens
KPILLQQKP

SEQ ID NO: 90983 - protein, 9 aa, Homo Sapiens
HEVMPLLYR

SEQ ID NO: 90984 - protein, 9 aa, Homo Sapiens
SHLPQELPP

SEQ ID NO: 90985 - protein, 9 aa, Homo Sapiens
KKKYNRLTL

SEQ ID NO: 90986 - protein, 9 aa, Homo Sapiens
ARCVDQGGN

SEQ ID NO: 90987 - protein, 9 aa, Homo Sapiens
FFCIMCCSN

SEQ ID NO: 90988 - protein, 9 aa, Homo Sapiens
LWAGDQILG

SEQ ID NO: 90989 - protein, 9 aa, Homo Sapiens
KKEDVEELL

SEQ ID NO: 90990 - protein, 9 aa, Homo Sapiens
IHRLIEQEE

SEQ ID NO: 90991 - protein, 9 aa, Homo Sapiens
PASTTKRVP

SEQ ID NO: 90992 - protein, 9 aa, Homo Sapiens
NSVNQEIEH

SEQ ID NO: 90993 - protein, 9 aa, Homo Sapiens
KELRKAAHK

SEQ ID NO: 90994 - protein, 9 aa, Homo Sapiens
LKRKRRKMT

SEQ ID NO: 90995 - protein, 9 aa, Homo Sapiens
KSIEVPQAK

SEQ ID NO: 90996 - protein, 9 aa, Homo Sapiens
TPEDLLNIF

SEQ ID NO: 90997 - protein, 9 aa, Homo Sapiens
DYYIKCFDT

SEQ ID NO: 90998 - protein, 9 aa, Homo Sapiens
SKLATSFQS

SEQ ID NO: 90999 - protein, 9 aa, Homo Sapiens
THSKPLYET

SEQ ID NO: 91000 - protein, 9 aa, Homo Sapiens
QIDKEQYHK

SEQ ID NO: 91001 - protein, 9 aa, Homo Sapiens
SIYYFKQLH

SEQ ID NO: 91002 - protein, 9 aa, Homo Sapiens
PLLVQCSEC

SEQ ID NO: 91003 - protein, 9 aa, Homo Sapiens
EGFKAGDKL

SEQ ID NO: 91004 - protein, 9 aa, Homo Sapiens
LSLVKIKIR

SEQ ID NO: 91005 - protein, 9 aa, Homo Sapiens
NDENEYVEE

SEQ ID NO: 91006 - protein, 9 aa, Homo Sapiens
EFVYVKEPP

SEQ ID NO: 91007 - protein, 9 aa, Homo Sapiens
NNSHCPRVV

SEQ ID NO: 91008 - protein, 9 aa, Homo Sapiens
DARLFLDND

SEQ ID NO: 91009 - protein, 9 aa, Homo Sapiens
GIIYIGKRS

SEQ ID NO: 91010 - protein, 9 aa, Homo Sapiens
EEEKWAAES

SEQ ID NO: 91011 - protein, 9 aa, Homo Sapiens
KRSKGRSRH

SEQ ID NO: 91012 - protein, 9 aa, Homo Sapiens
SDECVRMDK

SEQ ID NO: 91013 - protein, 9 aa, Homo Sapiens
TKKRNTFDS

SEQ ID NO: 91014 - protein, 9 aa, Homo Sapiens
DITPEDLLN

SEQ ID NO: 91015 - protein, 9 aa, Homo Sapiens
LLLEKESAA

SEQ ID NO: 91016 - protein, 9 aa, Homo Sapiens
HNHRTILYP

SEQ ID NO: 91017 - protein, 9 aa, Homo Sapiens
HGKALFLQK

SEQ ID NO: 91018 - protein, 9 aa, Homo Sapiens
KKRNTFDSS

SEQ ID NO: 91019 - protein, 9 aa, Homo Sapiens
SFSFSKTSS

SEQ ID NO: 91020 - protein, 9 aa, Homo Sapiens
LEWFNYPSL

SEQ ID NO: 91021 - protein, 9 aa, Homo Sapiens
SLETSKATA

SEQ ID NO: 91022 - protein, 9 aa, Homo Sapiens
DKLTPRKLS

SEQ ID NO: 91023 - protein, 9 aa, Homo Sapiens
QIFIENKIN

SEQ ID NO: 91024 - protein, 9 aa, Homo Sapiens
LKNKRIEML

SEQ ID NO: 91025 - protein, 9 aa, Homo Sapiens
NEHFSQFGT

SEQ ID NO: 91026 - protein, 9 aa, Homo Sapiens
FTLINVYCP

SEQ ID NO: 91027 - protein, 9 aa, Homo Sapiens
GTMKIRILP

SEQ ID NO: 91028 - protein, 9 aa, Homo Sapiens
EGCGELFRC

SEQ ID NO: 91029 - protein, 9 aa, Homo Sapiens
DFVLSNMMS

SEQ ID NO: 91030 - protein, 9 aa, Homo Sapiens
TAKAGGVTG

SEQ ID NO: 91031 - protein, 9 aa, Homo Sapiens
LWAFLHIKQ

SEQ ID NO: 91032 - protein, 9 aa, Homo Sapiens
ECRPGYLGK

SEQ ID NO: 91033 - protein, 9 aa, Homo Sapiens
GDKLTPRKL

SEQ ID NO: 91034 - protein, 9 aa, Homo Sapiens
YASACSSSE

SEQ ID NO: 91035 - protein, 9 aa, Homo Sapiens
REMVFRKTK

SEQ ID NO: 91036 - protein, 9 aa, Homo Sapiens
RHSREEETK

SEQ ID NO: 91037 - protein, 9 aa, Homo Sapiens
GPTAQNIRV

SEQ ID NO: 91038 - protein, 9 aa, Homo Sapiens
TTKRVPMGP

SEQ ID NO: 91039 - protein, 9 aa, Homo Sapiens
VMPLLYRLF

SEQ ID NO: 91040 - protein, 9 aa, Homo Sapiens
ILTEMISEC

SEQ ID NO: 91041 - protein, 9 aa, Homo Sapiens
YTIVGQNQY

SEQ ID NO: 91042 - protein, 9 aa, Homo Sapiens
YFLTVHPET

SEQ ID NO: 91043 - protein, 9 aa, Homo Sapiens
WNFMFFICL

SEQ ID NO: 91044 - protein, 9 aa, Homo Sapiens
TTVISENNK

SEQ ID NO: 91045 - protein, 9 aa, Homo Sapiens
LHKKTSCNL

SEQ ID NO: 91046 - protein, 9 aa, Homo Sapiens
TIPFLFTPF

SEQ ID NO: 91047 - protein, 9 aa, Homo Sapiens
VSSPDHAMV

SEQ ID NO: 91048 - protein, 9 aa, Homo Sapiens
VNQEIEHFQ

SEQ ID NO: 91049 - protein, 9 aa, Homo Sapiens
FKAGDKLTP

SEQ ID NO: 91050 - protein, 9 aa, Homo Sapiens
TIVGQNQYQ

SEQ ID NO: 91051 - protein, 9 aa, Homo Sapiens
FMIEAQPPK

SEQ ID NO: 91052 - protein, 9 aa, Homo Sapiens
ADTLSIIRL

SEQ ID NO: 91053 - protein, 9 aa, Homo Sapiens
KADTLSIIR

SEQ ID NO: 91054 - protein, 9 aa, Homo Sapiens
LFLDNDKTL

SEQ ID NO: 91055 - protein, 9 aa, Homo Sapiens
LVLSTNLFF

SEQ ID NO: 91056 - protein, 9 aa, Homo Sapiens
HWDPELSYE

SEQ ID NO: 91057 - protein, 9 aa, Homo Sapiens
NEIIKNTNL

SEQ ID NO: 91058 - protein, 9 aa, Homo Sapiens
LAVLSERFP

SEQ ID NO: 91059 - protein, 9 aa, Homo Sapiens
TTAVPVDSG

SEQ ID NO: 91060 - protein, 9 aa, Homo Sapiens
RLEDKGSLT

SEQ ID NO: 91061 - protein, 9 aa, Homo Sapiens
NSQARTSSS

SEQ ID NO: 91062 - protein, 9 aa, Homo Sapiens
EYRFLICML

SEQ ID NO: 91063 - protein, 9 aa, Homo Sapiens
GTQKSQRTE

SEQ ID NO: 91064 - protein, 9 aa, Homo Sapiens
QGPWMFPLT

SEQ ID NO: 91065 - protein, 9 aa, Homo Sapiens
LKTRMVNQN

SEQ ID NO: 91066 - protein, 9 aa, Homo Sapiens
RSDHLGLHM

SEQ ID NO: 91067 - protein, 9 aa, Homo Sapiens
VSNFPNKGY

SEQ ID NO: 91068 - protein, 9 aa, Homo Sapiens
RFPAESDSS

SEQ ID NO: 91069 - protein, 9 aa, Homo Sapiens
RLGNTSQQL

SEQ ID NO: 91070 - protein, 9 aa, Homo Sapiens
SKDVTFHPD

SEQ ID NO: 91071 - protein, 9 aa, Homo Sapiens
EVQELYIRD

SEQ ID NO: 91072 - protein, 9 aa, Homo Sapiens
EVMPLLYRL

SEQ ID NO: 91073 - protein, 9 aa, Homo Sapiens
LGDCSGPAL

SEQ ID NO: 91074 - protein, 9 aa, Homo Sapiens
NHSSPASTT

SEQ ID NO: 91075 - protein, 9 aa, Homo Sapiens
YTYPHKYKK

SEQ ID NO: 91076 - protein, 9 aa, Homo Sapiens
SHRGRSRMQ

SEQ ID NO: 91077 - protein, 9 aa, Homo Sapiens
WQLYKTYDE

SEQ ID NO: 91078 - protein, 9 aa, Homo Sapiens
PEEPKKAVP

SEQ ID NO: 91079 - protein, 9 aa, Homo Sapiens
MSSHLNSQA

SEQ ID NO: 91080 - protein, 9 aa, Homo Sapiens
NWNADHSKS

SEQ ID NO: 91081 - protein, 9 aa, Homo Sapiens
HCPRVVLPE

SEQ ID NO: 91082 - protein, 9 aa, Homo Sapiens
ASQQPVCGP

SEQ ID NO: 91083 - protein, 9 aa, Homo Sapiens
VGQNQYQAC

SEQ ID NO: 91084 - protein, 9 aa, Homo Sapiens
IYIGKRSLR

SEQ ID NO: 91085 - protein, 9 aa, Homo Sapiens
TYTIVGQNQ

SEQ ID NO: 91086 - protein, 9 aa, Homo Sapiens
MWLLEIFLA

SEQ ID NO: 91087 - protein, 9 aa, Homo Sapiens
NQNTIHVGS

SEQ ID NO: 91088 - protein, 9 aa, Homo Sapiens
KMSGDKSSQ

SEQ ID NO: 91089 - protein, 9 aa, Homo Sapiens
NEYVEEDGY

SEQ ID NO: 91090 - protein, 9 aa, Homo Sapiens
VHGKALFLQ

SEQ ID NO: 91091 - protein, 9 aa, Homo Sapiens
AAKAKFFCI

SEQ ID NO: 91092 - protein, 9 aa, Homo Sapiens
YGRDLSHSS

SEQ ID NO: 91093 - protein, 9 aa, Homo Sapiens
SFTTVRMKP

SEQ ID NO: 91094 - protein, 9 aa, Homo Sapiens
HPLDTSHLP

SEQ ID NO: 91095 - protein, 9 aa, Homo Sapiens
GDSCAVCME

SEQ ID NO: 91096 - protein, 9 aa, Homo Sapiens
SKKRRKEAN

SEQ ID NO: 91097 - protein, 9 aa, Homo Sapiens
ILRATKLKV

SEQ ID NO: 91098 - protein, 9 aa, Homo Sapiens
RISSSPNHS

SEQ ID NO: 91099 - protein, 9 aa, Homo Sapiens
NVPSTPQAM

SEQ ID NO: 91100 - protein, 9 aa, Homo Sapiens
LPGQGKAQQ

SEQ ID NO: 91101 - protein, 9 aa, Homo Sapiens
EKDFQKLMA

SEQ ID NO: 91102 - protein, 9 aa, Homo Sapiens
SATFDVPME

SEQ ID NO: 91103 - protein, 9 aa, Homo Sapiens
RLIVRHSRE

SEQ ID NO: 91104 - protein, 9 aa, Homo Sapiens
GEKPYVCTR

SEQ ID NO: 91105 - protein, 9 aa, Homo Sapiens
NFPPPSSNS

SEQ ID NO: 91106 - protein, 9 aa, Homo Sapiens
EKLIKQVTE

SEQ ID NO: 91107 - protein, 9 aa, Homo Sapiens
AIYAGEKPY

SEQ ID NO: 91108 - protein, 9 aa, Homo Sapiens
PEQLAELWG

SEQ ID NO: 91109 - protein, 9 aa, Homo Sapiens
LLNETQEEI

SEQ ID NO: 91110 - protein, 9 aa, Homo Sapiens
GINDCFDES

SEQ ID NO: 91111 - protein, 9 aa, Homo Sapiens
GGTEFFLLT

SEQ ID NO: 91112 - protein, 9 aa, Homo Sapiens
NQEIEHFQQ

SEQ ID NO: 91113 - protein, 9 aa, Homo Sapiens
NTARNNSHC

SEQ ID NO: 91114 - protein, 9 aa, Homo Sapiens
PEEVQELYI

SEQ ID NO: 91115 - protein, 9 aa, Homo Sapiens
YLSVNGYYI

SEQ ID NO: 91116 - protein, 9 aa, Homo Sapiens
ISRLHVSCS

SEQ ID NO: 91117 - protein, 9 aa, Homo Sapiens
EGKEKTFTL

SEQ ID NO: 91118 - protein, 9 aa, Homo Sapiens
FREMVFRKT

SEQ ID NO: 91119 - protein, 9 aa, Homo Sapiens
KKAVPEKKV

SEQ ID NO: 91120 - protein, 9 aa, Homo Sapiens
YKTYDEKPV

SEQ ID NO: 91121 - protein, 9 aa, Homo Sapiens
KTICQDSKP

SEQ ID NO: 91122 - protein, 9 aa, Homo Sapiens
HQVQEEQEL

SEQ ID NO: 91123 - protein, 9 aa, Homo Sapiens
WLKHKAKQI

SEQ ID NO: 91124 - protein, 9 aa, Homo Sapiens
HTLVGERGA

SEQ ID NO: 91125 - protein, 9 aa, Homo Sapiens
YLNFQSAIS

SEQ ID NO: 91126 - protein, 9 aa, Homo Sapiens
PLQSEKRLQ

SEQ ID NO: 91127 - protein, 9 aa, Homo Sapiens
LDTPEEREE

SEQ ID NO: 91128 - protein, 9 aa, Homo Sapiens
KNFNPVWDE

SEQ ID NO: 91129 - protein, 9 aa, Homo Sapiens
AMINAGQLK

SEQ ID NO: 91130 - protein, 9 aa, Homo Sapiens
HTRLAFPSP

SEQ ID NO: 91131 - protein, 9 aa, Homo Sapiens
SEDEDTHTE

SEQ ID NO: 91132 - protein, 9 aa, Homo Sapiens
PWKRLRIQS

SEQ ID NO: 91133 - protein, 9 aa, Homo Sapiens
YIFNFRDFA

SEQ ID NO: 91134 - protein, 9 aa, Homo Sapiens
YSKLTIVHH

SEQ ID NO: 91135 - protein, 9 aa, Homo Sapiens
IGGIPALLR

SEQ ID NO: 91136 - protein, 9 aa, Homo Sapiens
SCCPNVPST

SEQ ID NO: 91137 - protein, 9 aa, Homo Sapiens
CSHRNSLKH

SEQ ID NO: 91138 - protein, 9 aa, Homo Sapiens
VQGGGLAVL

SEQ ID NO: 91139 - protein, 9 aa, Homo Sapiens
SHLNSQART

SEQ ID NO: 91140 - protein, 9 aa, Homo Sapiens
METVSKSKA

SEQ ID NO: 91141 - protein, 9 aa, Homo Sapiens
GKVFCYRSG

SEQ ID NO: 91142 - protein, 9 aa, Homo Sapiens
HLGLHMKRH

SEQ ID NO: 91143 - protein, 9 aa, Homo Sapiens
ENEYVEEDG

SEQ ID NO: 91144 - protein, 9 aa, Homo Sapiens
AQLQARRPI

SEQ ID NO: 91145 - protein, 9 aa, Homo Sapiens
PEKGAMDLE

SEQ ID NO: 91146 - protein, 9 aa, Homo Sapiens
NDVPSQCEI

SEQ ID NO: 91147 - protein, 9 aa, Homo Sapiens
TKLKVEAKK

SEQ ID NO: 91148 - protein, 9 aa, Homo Sapiens
FGCTFVAFS

SEQ ID NO: 91149 - protein, 9 aa, Homo Sapiens
IQKGNNNER

SEQ ID NO: 91150 - protein, 9 aa, Homo Sapiens
HGGDLFTEN

SEQ ID NO: 91151 - protein, 9 aa, Homo Sapiens
EERHLPLQS

SEQ ID NO: 91152 - protein, 9 aa, Homo Sapiens
IDIKNVAEL

SEQ ID NO: 91153 - protein, 9 aa, Homo Sapiens
KLRQEIEVQ

SEQ ID NO: 91154 - protein, 9 aa, Homo Sapiens
NRQKNGSWK

SEQ ID NO: 91155 - protein, 9 aa, Homo Sapiens
LSQHQVQEE

SEQ ID NO: 91156 - protein, 9 aa, Homo Sapiens
PTALINGYL

SEQ ID NO: 91157 - protein, 9 aa, Homo Sapiens
NTELSAISR

SEQ ID NO: 91158 - protein, 9 aa, Homo Sapiens
HGSTALILA

SEQ ID NO: 91159 - protein, 9 aa, Homo Sapiens
LYYLSVNGY

SEQ ID NO: 91160 - protein, 9 aa, Homo Sapiens
KHKAKQIAQ

SEQ ID NO: 91161 - protein, 9 aa, Homo Sapiens
ARVENWNAD

SEQ ID NO: 91162 - protein, 9 aa, Homo Sapiens
TEEGKKIKK

SEQ ID NO: 91163 - protein, 9 aa, Homo Sapiens
ECGKILSQS

SEQ ID NO: 91164 - protein, 9 aa, Homo Sapiens
GTHSKPLYE

SEQ ID NO: 91165 - protein, 9 aa, Homo Sapiens
ILQSSEQFQ

SEQ ID NO: 91166 - protein, 9 aa, Homo Sapiens
KNDILKESN

SEQ ID NO: 91167 - protein, 9 aa, Homo Sapiens
SRKNYQSFH

SEQ ID NO: 91168 - protein, 9 aa, Homo Sapiens
KELLDSGIS

SEQ ID NO: 91169 - protein, 9 aa, Homo Sapiens
HSKCGPCNY

SEQ ID NO: 91170 - protein, 9 aa, Homo Sapiens
ENNKLESDY

SEQ ID NO: 91171 - protein, 9 aa, Homo Sapiens
TICQDSKPV

SEQ ID NO: 91172 - protein, 9 aa, Homo Sapiens
STSFEASKH

SEQ ID NO: 91173 - protein, 9 aa, Homo Sapiens
FHTLVGERG

SEQ ID NO: 91174 - protein, 9 aa, Homo Sapiens
YKCNDCHKT

SEQ ID NO: 91175 - protein, 9 aa, Homo Sapiens
KLDRFEKAG

SEQ ID NO: 91176 - protein, 9 aa, Homo Sapiens
TSKATASSP

SEQ ID NO: 91177 - protein, 9 aa, Homo Sapiens
TSLTNNSRI

SEQ ID NO: 91178 - protein, 9 aa, Homo Sapiens
KEQMAYLQQ

SEQ ID NO: 91179 - protein, 9 aa, Homo Sapiens
ALDPFRVNA

SEQ ID NO: 91180 - protein, 9 aa, Homo Sapiens
GGSLHSSLY

SEQ ID NO: 91181 - protein, 9 aa, Homo Sapiens
EILQSSEQF

SEQ ID NO: 91182 - protein, 9 aa, Homo Sapiens
LKYTNEPPQ

SEQ ID NO: 91183 - protein, 9 aa, Homo Sapiens
KMHSSVILL

SEQ ID NO: 91184 - protein, 9 aa, Homo Sapiens
KTTNTELSA

SEQ ID NO: 91185 - protein, 9 aa, Homo Sapiens
ITGIISLKT

SEQ ID NO: 91186 - protein, 9 aa, Homo Sapiens
PSSVSSPDH

SEQ ID NO: 91187 - protein, 9 aa, Homo Sapiens
KHEILTKSY

SEQ ID NO: 91188 - protein, 9 aa, Homo Sapiens
RQKNGSWKY

SEQ ID NO: 91189 - protein, 9 aa, Homo Sapiens
KQVEDGEIF

SEQ ID NO: 91190 - protein, 9 aa, Homo Sapiens
KATILEDQQ

SEQ ID NO: 91191 - protein, 9 aa, Homo Sapiens
VVWLPLEGK

SEQ ID NO: 91192 - protein, 9 aa, Homo Sapiens
INQKLIETE

SEQ ID NO: 91193 - protein, 9 aa, Homo Sapiens
DGDSCAVCM

SEQ ID NO: 91194 - protein, 9 aa, Homo Sapiens
CSSSKRSKG

SEQ ID NO: 91195 - protein, 9 aa, Homo Sapiens
DLSQHQVQE

SEQ ID NO: 91196 - protein, 9 aa, Homo Sapiens
KGAMDLEKP

SEQ ID NO: 91197 - protein, 9 aa, Homo Sapiens
FPTNKEFQF

SEQ ID NO: 91198 - protein, 9 aa, Homo Sapiens
LTRPLFPST

SEQ ID NO: 91199 - protein, 9 aa, Homo Sapiens
GCGKRSLFR

SEQ ID NO: 91200 - protein, 9 aa, Homo Sapiens
MSNNMSKIA

SEQ ID NO: 91201 - protein, 9 aa, Homo Sapiens
NLAVCLLCY

SEQ ID NO: 91202 - protein, 9 aa, Homo Sapiens
PQEWFCPES

SEQ ID NO: 91203 - protein, 9 aa, Homo Sapiens
YESNPMRQR

SEQ ID NO: 91204 - protein, 9 aa, Homo Sapiens
KVNEGQKNK

SEQ ID NO: 91205 - protein, 9 aa, Homo Sapiens
RDGPGVLCI

SEQ ID NO: 91206 - protein, 9 aa, Homo Sapiens
AVSPTTNSK

SEQ ID NO: 91207 - protein, 9 aa, Homo Sapiens
TLKFIAQYG

SEQ ID NO: 91208 - protein, 9 aa, Homo Sapiens
VFLQACFLT

SEQ ID NO: 91209 - protein, 9 aa, Homo Sapiens
ILEDQQDPS

SEQ ID NO: 91210 - protein, 9 aa, Homo Sapiens
PQAQRCDGI

SEQ ID NO: 91211 - protein, 9 aa, Homo Sapiens
VQALTKQQQ

SEQ ID NO: 91212 - protein, 9 aa, Homo Sapiens
QQSFHLALL

SEQ ID NO: 91213 - protein, 9 aa, Homo Sapiens
QGEIPNEVC

SEQ ID NO: 91214 - protein, 9 aa, Homo Sapiens
GKRSLFRIL

SEQ ID NO: 91215 - protein, 9 aa, Homo Sapiens
GTIERYTYP

SEQ ID NO: 91216 - protein, 9 aa, Homo Sapiens
GHLLTETKY

SEQ ID NO: 91217 - protein, 9 aa, Homo Sapiens
YECRPGYLG

SEQ ID NO: 91218 - protein, 9 aa, Homo Sapiens
LHVEDTSFF

SEQ ID NO: 91219 - protein, 9 aa, Homo Sapiens
PHKFHTLVG

SEQ ID NO: 91220 - protein, 9 aa, Homo Sapiens
AEPGPTAQN

SEQ ID NO: 91221 - protein, 9 aa, Homo Sapiens
HTEEYKNAK

SEQ ID NO: 91222 - protein, 9 aa, Homo Sapiens
HSVVVPCEP

SEQ ID NO: 91223 - protein, 9 aa, Homo Sapiens
GRWVHWNEI

SEQ ID NO: 91224 - protein, 9 aa, Homo Sapiens
ECGKVFCYR

SEQ ID NO: 91225 - protein, 9 aa, Homo Sapiens
GYLGKMFSI

SEQ ID NO: 91226 - protein, 9 aa, Homo Sapiens
GVRNRQKNG

SEQ ID NO: 91227 - protein, 9 aa, Homo Sapiens
AEKHEILTK

SEQ ID NO: 91228 - protein, 9 aa, Homo Sapiens
AKFFCIMCC

SEQ ID NO: 91229 - protein, 9 aa, Homo Sapiens
DLYVSSSNF

SEQ ID NO: 91230 - protein, 9 aa, Homo Sapiens
TIMNSPMGK

SEQ ID NO: 91231 - protein, 9 aa, Homo Sapiens
EKLFSLTAQ

SEQ ID NO: 91232 - protein, 9 aa, Homo Sapiens
YSRISSSPN

SEQ ID NO: 91233 - protein, 9 aa, Homo Sapiens
GFKQCSHLT

SEQ ID NO: 91234 - protein, 9 aa, Homo Sapiens
AKDINGTAV

SEQ ID NO: 91235 - protein, 9 aa, Homo Sapiens
FRLIVRHSR

SEQ ID NO: 91236 - protein, 9 aa, Homo Sapiens
SLHVYGQEE

SEQ ID NO: 91237 - protein, 9 aa, Homo Sapiens
NDNDEFEKK

SEQ ID NO: 91238 - protein, 9 aa, Homo Sapiens
ASGFPWVLL

SEQ ID NO: 91239 - protein, 9 aa, Homo Sapiens
MALLVLSCK

SEQ ID NO: 91240 - protein, 9 aa, Homo Sapiens
PQIDKEQYH

SEQ ID NO: 91241 - protein, 9 aa, Homo Sapiens
EEGCGELFR

SEQ ID NO: 91242 - protein, 9 aa, Homo Sapiens
EQLTLVKNV

SEQ ID NO: 91243 - protein, 9 aa, Homo Sapiens
LRKAAHKNG

SEQ ID NO: 91244 - protein, 9 aa, Homo Sapiens
GKASSQIRV

SEQ ID NO: 91245 - protein, 9 aa, Homo Sapiens
NERTTDLKQ

SEQ ID NO: 91246 - protein, 9 aa, Homo Sapiens
LDPFRVNAE

SEQ ID NO: 91247 - protein, 9 aa, Homo Sapiens
ISMNLSHVM

SEQ ID NO: 91248 - protein, 9 aa, Homo Sapiens
THTEEYKNA

SEQ ID NO: 91249 - protein, 9 aa, Homo Sapiens
PPPSSNSFQ

SEQ ID NO: 91250 - protein, 9 aa, Homo Sapiens
VSKSKANFE

SEQ ID NO: 91251 - protein, 9 aa, Homo Sapiens
TTNTELSAI

SEQ ID NO: 91252 - protein, 9 aa, Homo Sapiens
VANEDKMSL

SEQ ID NO: 91253 - protein, 9 aa, Homo Sapiens
KYTNEPPQG

SEQ ID NO: 91254 - protein, 9 aa, Homo Sapiens
MVKIILRHL

SEQ ID NO: 91255 - protein, 9 aa, Homo Sapiens
YGLPPIASL

SEQ ID NO: 91256 - protein, 9 aa, Homo Sapiens
GVLCIFLDY

SEQ ID NO: 91257 - protein, 9 aa, Homo Sapiens
NWLLDVTWQ

SEQ ID NO: 91258 - protein, 9 aa, Homo Sapiens
NRNNLIPIV

SEQ ID NO: 91259 - protein, 9 aa, Homo Sapiens
LSHVMLQII

SEQ ID NO: 91260 - protein, 9 aa, Homo Sapiens
KEQLTLVKN

SEQ ID NO: 91261 - protein, 9 aa, Homo Sapiens
CAVCMELYK

SEQ ID NO: 91262 - protein, 9 aa, Homo Sapiens
LFRCFSGQC

SEQ ID NO: 91263 - protein, 9 aa, Homo Sapiens
RKSSYASAC

SEQ ID NO: 91264 - protein, 9 aa, Homo Sapiens
EYGKTICQD

SEQ ID NO: 91265 - protein, 9 aa, Homo Sapiens
CTPPPKIIN

SEQ ID NO: 91266 - protein, 9 aa, Homo Sapiens
NSGPNRAHG

SEQ ID NO: 91267 - protein, 9 aa, Homo Sapiens
VKIILRHLI

SEQ ID NO: 91268 - protein, 9 aa, Homo Sapiens
LFTENENKD

SEQ ID NO: 91269 - protein, 9 aa, Homo Sapiens
CPCKIIKKE

SEQ ID NO: 91270 - protein, 9 aa, Homo Sapiens
LQRRLERFE

SEQ ID NO: 91271 - protein, 9 aa, Homo Sapiens
VKLATKDIR

SEQ ID NO: 91272 - protein, 9 aa, Homo Sapiens
SLTASGFPW

SEQ ID NO: 91273 - protein, 9 aa, Homo Sapiens
SIISFDSLH

SEQ ID NO: 91274 - protein, 9 aa, Homo Sapiens
LEIFLAAVS

SEQ ID NO: 91275 - protein, 9 aa, Homo Sapiens
GIFIGHYAQ

SEQ ID NO: 91276 - protein, 9 aa, Homo Sapiens
FWNFMFFIC

SEQ ID NO: 91277 - protein, 9 aa, Homo Sapiens
MKLPHKFHT

SEQ ID NO: 91278 - protein, 9 aa, Homo Sapiens
VWAINVTMI

SEQ ID NO: 91279 - protein, 9 aa, Homo Sapiens
GLHRGHTRL

SEQ ID NO: 91280 - protein, 9 aa, Homo Sapiens
TQKSQRTER

SEQ ID NO: 91281 - protein, 9 aa, Homo Sapiens
LNIFFGGGF

SEQ ID NO: 91282 - protein, 9 aa, Homo Sapiens
SRFIHMSGT

SEQ ID NO: 91283 - protein, 9 aa, Homo Sapiens
SFDQWSESD

SEQ ID NO: 91284 - protein, 9 aa, Homo Sapiens
WSATFDVPM

SEQ ID NO: 91285 - protein, 9 aa, Homo Sapiens
KEEKYAIEE

SEQ ID NO: 91286 - protein, 9 aa, Homo Sapiens
GMRTVRAFH

SEQ ID NO: 91287 - protein, 9 aa, Homo Sapiens
MEPNLSCPK

SEQ ID NO: 91288 - protein, 9 aa, Homo Sapiens
VETLGCCNL

SEQ ID NO: 91289 - protein, 9 aa, Homo Sapiens
SRLHVSCSY

SEQ ID NO: 91290 - protein, 9 aa, Homo Sapiens
LRESVIEKP

SEQ ID NO: 91291 - protein, 9 aa, Homo Sapiens
SERTHWTPF

SEQ ID NO: 91292 - protein, 9 aa, Homo Sapiens
ASFREMVFR

SEQ ID NO: 91293 - protein, 9 aa, Homo Sapiens
SPSDKVDYE

SEQ ID NO: 91294 - protein, 9 aa, Homo Sapiens
RSSVEKEIQ

SEQ ID NO: 91295 - protein, 9 aa, Homo Sapiens
TMMEKNELV

SEQ ID NO: 91296 - protein, 9 aa, Homo Sapiens
HFQQAIEKD

SEQ ID NO: 91297 - protein, 9 aa, Homo Sapiens
NKLKKQGEI

SEQ ID NO: 91298 - protein, 9 aa, Homo Sapiens
TKAYYRRGA

SEQ ID NO: 91299 - protein, 9 aa, Homo Sapiens
AYGFPKRMV

SEQ ID NO: 91300 - protein, 9 aa, Homo Sapiens
MNLSHVMLQ

SEQ ID NO: 91301 - protein, 9 aa, Homo Sapiens
ESQLQGPWM

SEQ ID NO: 91302 - protein, 9 aa, Homo Sapiens
ILEIRTINF

SEQ ID NO: 91303 - protein, 9 aa, Homo Sapiens
SQFGTLVNL

SEQ ID NO: 91304 - protein, 9 aa, Homo Sapiens
QQGVELPSV

SEQ ID NO: 91305 - protein, 9 aa, Homo Sapiens
SEDDIGRSE

SEQ ID NO: 91306 - protein, 9 aa, Homo Sapiens
VKESLDAKA

SEQ ID NO: 91307 - protein, 9 aa, Homo Sapiens
ECVRMDKTP

SEQ ID NO: 91308 - protein, 9 aa, Homo Sapiens
EDKMSLLKS

SEQ ID NO: 91309 - protein, 9 aa, Homo Sapiens
GKFHDVSER

SEQ ID NO: 91310 - protein, 9 aa, Homo Sapiens
RWMLTPAFH

SEQ ID NO: 91311 - protein, 9 aa, Homo Sapiens
NHRTILYPF

SEQ ID NO: 91312 - protein, 9 aa, Homo Sapiens
FQSAISVSA

SEQ ID NO: 91313 - protein, 9 aa, Homo Sapiens
HRLRLEEAK

SEQ ID NO: 91314 - protein, 9 aa, Homo Sapiens
TKRKRDVRG

SEQ ID NO: 91315 - protein, 9 aa, Homo Sapiens
ELEEERHLP

SEQ ID NO: 91316 - protein, 9 aa, Homo Sapiens
TNKMLREKK

SEQ ID NO: 91317 - protein, 9 aa, Homo Sapiens
MAHGSTALI

SEQ ID NO: 91318 - protein, 9 aa, Homo Sapiens
AEFVLLTVK

SEQ ID NO: 91319 - protein, 9 aa, Homo Sapiens
HLILLTSLL

SEQ ID NO: 91320 - protein, 9 aa, Homo Sapiens
PAHLFAMTI

SEQ ID NO: 91321 - protein, 9 aa, Homo Sapiens
PGVLCIFLD

SEQ ID NO: 91322 - protein, 9 aa, Homo Sapiens
KYKEQMAYL

SEQ ID NO: 91323 - protein, 9 aa, Homo Sapiens
LSDLFTLIA

SEQ ID NO: 91324 - protein, 9 aa, Homo Sapiens
FGLARDIYD

SEQ ID NO: 91325 - protein, 9 aa, Homo Sapiens
EFQQEMEPN

SEQ ID NO: 91326 - protein, 9 aa, Homo Sapiens
LTAGPNWLL

SEQ ID NO: 91327 - protein, 9 aa, Homo Sapiens
LNETQEEIN

SEQ ID NO: 91328 - protein, 9 aa, Homo Sapiens
EIPNEVCMF

SEQ ID NO: 91329 - protein, 9 aa, Homo Sapiens
STAAPAYGF

SEQ ID NO: 91330 - protein, 9 aa, Homo Sapiens
RDELQRRLE

SEQ ID NO: 91331 - protein, 9 aa, Homo Sapiens
LGVTTKFHR

SEQ ID NO: 91332 - protein, 9 aa, Homo Sapiens
DKTPPPPTL

SEQ ID NO: 91333 - protein, 9 aa, Homo Sapiens
DECVRMDKT

SEQ ID NO: 91334 - protein, 9 aa, Homo Sapiens
KTQEKEEIM

SEQ ID NO: 91335 - protein, 9 aa, Homo Sapiens
LFAMTIMNS

SEQ ID NO: 91336 - protein, 9 aa, Homo Sapiens
TSFQSMEVR

SEQ ID NO: 91337 - protein, 9 aa, Homo Sapiens
SQRTERKDP

SEQ ID NO: 91338 - protein, 9 aa, Homo Sapiens
KVPEEPKKA

SEQ ID NO: 91339 - protein, 9 aa, Homo Sapiens
EANHVQRLI

SEQ ID NO: 91340 - protein, 9 aa, Homo Sapiens
RPNSGSGED

SEQ ID NO: 91341 - protein, 9 aa, Homo Sapiens
QFILDVSVK

SEQ ID NO: 91342 - protein, 9 aa, Homo Sapiens
SGSPSKISP

SEQ ID NO: 91343 - protein, 9 aa, Homo Sapiens
RCVDQGGNK

SEQ ID NO: 91344 - protein, 9 aa, Homo Sapiens
KAIYAGEKP

SEQ ID NO: 91345 - protein, 9 aa, Homo Sapiens
IAMKNIGGI

SEQ ID NO: 91346 - protein, 9 aa, Homo Sapiens
GIISLKTRM

SEQ ID NO: 91347 - protein, 9 aa, Homo Sapiens
NSVYLGKYR

SEQ ID NO: 91348 - protein, 9 aa, Homo Sapiens
TDLDARMAH

SEQ ID NO: 91349 - protein, 9 aa, Homo Sapiens
EKEEIMQTL

SEQ ID NO: 91350 - protein, 9 aa, Homo Sapiens
PSDKVDYEL

SEQ ID NO: 91351 - protein, 9 aa, Homo Sapiens
KEINSHNLL

SEQ ID NO: 91352 - protein, 9 aa, Homo Sapiens
RLKQICREY

SEQ ID NO: 91353 - protein, 9 aa, Homo Sapiens
NIGGIPALL

SEQ ID NO: 91354 - protein, 9 aa, Homo Sapiens
AKTQEKEEI

SEQ ID NO: 91355 - protein, 9 aa, Homo Sapiens
TDEEEKTAK

SEQ ID NO: 91356 - protein, 9 aa, Homo Sapiens
VMLVSNFPN

SEQ ID NO: 91357 - protein, 9 aa, Homo Sapiens
KNYTEEEYR

SEQ ID NO: 91358 - protein, 9 aa, Homo Sapiens
MNRATVLAN

SEQ ID NO: 91359 - protein, 9 aa, Homo Sapiens
HQKMIKQFK

SEQ ID NO: 91360 - protein, 9 aa, Homo Sapiens
ENHQKMIKQ

SEQ ID NO: 91361 - protein, 9 aa, Homo Sapiens
TSVYFFLKN

SEQ ID NO: 91362 - protein, 9 aa, Homo Sapiens
QKQKYKPMQ

SEQ ID NO: 91363 - protein, 9 aa, Homo Sapiens
TFVAFSPAF

SEQ ID NO: 91364 - protein, 9 aa, Homo Sapiens
KELYGLPPI

SEQ ID NO: 91365 - protein, 9 aa, Homo Sapiens
VSSAGSLKR

SEQ ID NO: 91366 - protein, 9 aa, Homo Sapiens
QKVKKTAKA

SEQ ID NO: 91367 - protein, 9 aa, Homo Sapiens
GVEKLFSLT

SEQ ID NO: 91368 - protein, 9 aa, Homo Sapiens
PGTSNPGPP

SEQ ID NO: 91369 - protein, 9 aa, Homo Sapiens
VEDTSFFLT

SEQ ID NO: 91370 - protein, 9 aa, Homo Sapiens
ILLQQKPRK

SEQ ID NO: 91371 - protein, 9 aa, Homo Sapiens
AGDQILGLM

SEQ ID NO: 91372 - protein, 9 aa, Homo Sapiens
YRRGAARFA

SEQ ID NO: 91373 - protein, 9 aa, Homo Sapiens
KKEQLTLVK

SEQ ID NO: 91374 - protein, 9 aa, Homo Sapiens
PTYTIVGQN

SEQ ID NO: 91375 - protein, 9 aa, Homo Sapiens
NTSQQLQSL

SEQ ID NO: 91376 - protein, 9 aa, Homo Sapiens
NQKLIETEE

SEQ ID NO: 91377 - protein, 9 aa, Homo Sapiens
CWLKHKAKQ

SEQ ID NO: 91378 - protein, 9 aa, Homo Sapiens
GKALFLQKQ

SEQ ID NO: 91379 - protein, 9 aa, Homo Sapiens
LKHSSQNSN

SEQ ID NO: 91380 - protein, 9 aa, Homo Sapiens
LQPEQLAEL

SEQ ID NO: 91381 - protein, 9 aa, Homo Sapiens
EMVFRKTKG

SEQ ID NO: 91382 - protein, 9 aa, Homo Sapiens
KRAVLMRPM

SEQ ID NO: 91383 - protein, 9 aa, Homo Sapiens
GYYISEIPV

SEQ ID NO: 91384 - protein, 9 aa, Homo Sapiens
SDPEGEEWD

SEQ ID NO: 91385 - protein, 9 aa, Homo Sapiens
GDVANEDKM

SEQ ID NO: 91386 - protein, 9 aa, Homo Sapiens
FVKAMINAG

SEQ ID NO: 91387 - protein, 9 aa, Homo Sapiens
EERERLKEL

SEQ ID NO: 91388 - protein, 9 aa, Homo Sapiens
PGTNDENEY

SEQ ID NO: 91389 - protein, 9 aa, Homo Sapiens
RMWLLEIFL

SEQ ID NO: 91390 - protein, 9 aa, Homo Sapiens
QMLLLEKES

SEQ ID NO: 91391 - protein, 9 aa, Homo Sapiens
VLSNMMSDG

SEQ ID NO: 91392 - protein, 9 aa, Homo Sapiens
FRDFANIFQ

SEQ ID NO: 91393 - protein, 9 aa, Homo Sapiens
LIKQVTESS

SEQ ID NO: 91394 - protein, 9 aa, Homo Sapiens
GADGTMKIR

SEQ ID NO: 91395 - protein, 9 aa, Homo Sapiens
TSHLPQELP

SEQ ID NO: 91396 - protein, 9 aa, Homo Sapiens
TTEEGKKIK

SEQ ID NO: 91397 - protein, 9 aa, Homo Sapiens
VSIKELYGL

SEQ ID NO: 91398 - protein, 9 aa, Homo Sapiens
CIYFAARAL

SEQ ID NO: 91399 - protein, 9 aa, Homo Sapiens
TAAPAYGFP

SEQ ID NO: 91400 - protein, 9 aa, Homo Sapiens
CPFGQWWAS

SEQ ID NO: 91401 - protein, 9 aa, Homo Sapiens
QSAISVSAA

SEQ ID NO: 91402 - protein, 9 aa, Homo Sapiens
KPISLAMTL

SEQ ID NO: 91403 - protein, 9 aa, Homo Sapiens
PQTVKQALV

SEQ ID NO: 91404 - protein, 9 aa, Homo Sapiens
DEILQSSEQ

SEQ ID NO: 91405 - protein, 9 aa, Homo Sapiens
STNLFFIVT

SEQ ID NO: 91406 - protein, 9 aa, Homo Sapiens
GFVKAIEFV

SEQ ID NO: 91407 - protein, 9 aa, Homo Sapiens
PTEEGCGEL

SEQ ID NO: 91408 - protein, 9 aa, Homo Sapiens
DGINDCFDE

SEQ ID NO: 91409 - protein, 9 aa, Homo Sapiens
RLSYGRDLS

SEQ ID NO: 91410 - protein, 9 aa, Homo Sapiens
DGKASSQIR

SEQ ID NO: 91411 - protein, 9 aa, Homo Sapiens
QKHHPQTVK

SEQ ID NO: 91412 - protein, 9 aa, Homo Sapiens
KLATSFQSM

SEQ ID NO: 91413 - protein, 9 aa, Homo Sapiens
TLVKNVLKL

SEQ ID NO: 91414 - protein, 9 aa, Homo Sapiens
GGNDRYPWW

SEQ ID NO: 91415 - protein, 9 aa, Homo Sapiens
RVYEGFVPG

SEQ ID NO: 91416 - protein, 9 aa, Homo Sapiens
NTTAVPVDS

SEQ ID NO: 91417 - protein, 9 aa, Homo Sapiens
LYESNPMRQ

SEQ ID NO: 91418 - protein, 9 aa, Homo Sapiens
ENPYGPQTK

SEQ ID NO: 91419 - protein, 9 aa, Homo Sapiens
QKYKEQMAY

SEQ ID NO: 91420 - protein, 9 aa, Homo Sapiens
SQYCLLASH

SEQ ID NO: 91421 - protein, 9 aa, Homo Sapiens
NDCHKTFSH

SEQ ID NO: 91422 - protein, 9 aa, Homo Sapiens
KRSLFRILS

SEQ ID NO: 91423 - protein, 9 aa, Homo Sapiens
LDARLFLDN

SEQ ID NO: 91424 - protein, 9 aa, Homo Sapiens
DTCILLCSS

SEQ ID NO: 91425 - protein, 9 aa, Homo Sapiens
GDVSLVKEL

SEQ ID NO: 91426 - protein, 9 aa, Homo Sapiens
MKPDPKKVQ

SEQ ID NO: 91427 - protein, 9 aa, Homo Sapiens
HLPLQSEKR

SEQ ID NO: 91428 - protein, 9 aa, Homo Sapiens
SNFPNKGYS

SEQ ID NO: 91429 - protein, 9 aa, Homo Sapiens
TPGNIPPPP

SEQ ID NO: 91430 - protein, 9 aa, Homo Sapiens
DGEIFDFRG

SEQ ID NO: 91431 - protein, 9 aa, Homo Sapiens
MDLEKPPLP

SEQ ID NO: 91432 - protein, 9 aa, Homo Sapiens
NTIYFTCRA

SEQ ID NO: 91433 - protein, 9 aa, Homo Sapiens
ILYFIVSQP

SEQ ID NO: 91434 - protein, 9 aa, Homo Sapiens
NKHKNLYIN

SEQ ID NO: 91435 - protein, 9 aa, Homo Sapiens
CKTMQSDGI

SEQ ID NO: 91436 - protein, 9 aa, Homo Sapiens
GRRKAVATC

SEQ ID NO: 91437 - protein, 9 aa, Homo Sapiens
PSQGNAAYL

SEQ ID NO: 91438 - protein, 9 aa, Homo Sapiens
QEYGKTICQ

SEQ ID NO: 91439 - protein, 9 aa, Homo Sapiens
DDHDLPTML

SEQ ID NO: 91440 - protein, 9 aa, Homo Sapiens
AKAKRLKKY

SEQ ID NO: 91441 - protein, 9 aa, Homo Sapiens
DENEYVEED

SEQ ID NO: 91442 - protein, 9 aa, Homo Sapiens
SARKSSYAS

SEQ ID NO: 91443 - protein, 9 aa, Homo Sapiens
ANEDKMSLL

SEQ ID NO: 91444 - protein, 9 aa, Homo Sapiens
PNWLLDVTW

SEQ ID NO: 91445 - protein, 9 aa, Homo Sapiens
AVPVDSGPK

SEQ ID NO: 91446 - protein, 9 aa, Homo Sapiens
KTATKKRNT

SEQ ID NO: 91447 - protein, 9 aa, Homo Sapiens
VGGHLLTET

SEQ ID NO: 91448 - protein, 9 aa, Homo Sapiens
LNFQSAISV

SEQ ID NO: 91449 - protein, 9 aa, Homo Sapiens
YAIEELVKY

SEQ ID NO: 91450 - protein, 9 aa, Homo Sapiens
NGRNNMIQQ

SEQ ID NO: 91451 - protein, 9 aa, Homo Sapiens
LQQITYSLI

SEQ ID NO: 91452 - protein, 9 aa, Homo Sapiens
CEPPEVGSD

SEQ ID NO: 91453 - protein, 9 aa, Homo Sapiens
SHNLLKMIR

SEQ ID NO: 91454 - protein, 9 aa, Homo Sapiens
QVQEEQELE

SEQ ID NO: 91455 - protein, 9 aa, Homo Sapiens
HKNLYINIV

SEQ ID NO: 91456 - protein, 9 aa, Homo Sapiens
CNYKAECDE

SEQ ID NO: 91457 - protein, 9 aa, Homo Sapiens
LRSADDSQR

SEQ ID NO: 91458 - protein, 9 aa, Homo Sapiens
FPNKGYSVE

SEQ ID NO: 91459 - protein, 9 aa, Homo Sapiens
HVQRLIQML

SEQ ID NO: 91460 - protein, 9 aa, Homo Sapiens
RQENPYGPQ

SEQ ID NO: 91461 - protein, 9 aa, Homo Sapiens
RATKLKVEA

SEQ ID NO: 91462 - protein, 9 aa, Homo Sapiens
YLKKHNSSK

SEQ ID NO: 91463 - protein, 9 aa, Homo Sapiens
DQLEVCREF

SEQ ID NO: 91464 - protein, 9 aa, Homo Sapiens
DNKHKNLYI

SEQ ID NO: 91465 - protein, 9 aa, Homo Sapiens
DECGKILSQ

SEQ ID NO: 91466 - protein, 9 aa, Homo Sapiens
TRMVNQNTI

SEQ ID NO: 91467 - protein, 9 aa, Homo Sapiens
QGWKLIPPQ

SEQ ID NO: 91468 - protein, 9 aa, Homo Sapiens
SVTRDSISR

SEQ ID NO: 91469 - protein, 9 aa, Homo Sapiens
DGSGSPSKI

SEQ ID NO: 91470 - protein, 9 aa, Homo Sapiens
QGKAQQAPS

SEQ ID NO: 91471 - protein, 9 aa, Homo Sapiens
EGFVPGKKL

SEQ ID NO: 91472 - protein, 9 aa, Homo Sapiens
HQANKSKTN

SEQ ID NO: 91473 - protein, 9 aa, Homo Sapiens
RHLPLQSEK

SEQ ID NO: 91474 - protein, 9 aa, Homo Sapiens
LSLDLKNKR

SEQ ID NO: 91475 - protein, 9 aa, Homo Sapiens
DEKKEDVEE

SEQ ID NO: 91476 - protein, 9 aa, Homo Sapiens
SKPIFWNFM

SEQ ID NO: 91477 - protein, 9 aa, Homo Sapiens
VWLPLEGKE

SEQ ID NO: 91478 - protein, 9 aa, Homo Sapiens
AIVSIKELY

SEQ ID NO: 91479 - protein, 9 aa, Homo Sapiens
TVEEMPSES

SEQ ID NO: 91480 - protein, 9 aa, Homo Sapiens
KAKADTLSI

SEQ ID NO: 91481 - protein, 9 aa, Homo Sapiens
CKKCSHRNS

SEQ ID NO: 91482 - protein, 9 aa, Homo Sapiens
LFRQLQQIT

SEQ ID NO: 91483 - protein, 9 aa, Homo Sapiens
WYSEDEDTH

SEQ ID NO: 91484 - protein, 9 aa, Homo Sapiens
LEVFGGSLH

SEQ ID NO: 91485 - protein, 9 aa, Homo Sapiens
ELQPEQLAE

SEQ ID NO: 91486 - protein, 9 aa, Homo Sapiens
PCKKCSHRN

SEQ ID NO: 91487 - protein, 9 aa, Homo Sapiens
HRWMLTPAF

SEQ ID NO: 91488 - protein, 9 aa, Homo Sapiens
DLHKKTSCN

SEQ ID NO: 91489 - protein, 9 aa, Homo Sapiens
STMCVVCSH

SEQ ID NO: 91490 - protein, 9 aa, Homo Sapiens
SLVLSTNLF

SEQ ID NO: 91491 - protein, 9 aa, Homo Sapiens
NYPSLRDKV

SEQ ID NO: 91492 - protein, 9 aa, Homo Sapiens
TSVFLDTDA

SEQ ID NO: 91493 - protein, 9 aa, Homo Sapiens
ETSKATASS

SEQ ID NO: 91494 - protein, 9 aa, Homo Sapiens
KELLNETQE

SEQ ID NO: 91495 - protein, 9 aa, Homo Sapiens
EEKRRREQE

SEQ ID NO: 91496 - protein, 9 aa, Homo Sapiens
NIRVLLGKM

SEQ ID NO: 91497 - protein, 9 aa, Homo Sapiens
LKKHNSSKE

SEQ ID NO: 91498 - protein, 9 aa, Homo Sapiens
PLPSPTYRH

SEQ ID NO: 91499 - protein, 9 aa, Homo Sapiens
NGSWKYNQS

SEQ ID NO: 91500 - protein, 9 aa, Homo Sapiens
NSGSGEDSK

SEQ ID NO: 91501 - protein, 9 aa, Homo Sapiens
VLNVLQAVG

SEQ ID NO: 91502 - protein, 9 aa, Homo Sapiens
LKQELATFK

SEQ ID NO: 91503 - protein, 9 aa, Homo Sapiens
EYKEERILK

SEQ ID NO: 91504 - protein, 9 aa, Homo Sapiens
ADVCQIFIE

SEQ ID NO: 91505 - protein, 9 aa, Homo Sapiens
TKTKKGQVP

SEQ ID NO: 91506 - protein, 9 aa, Homo Sapiens
KDSSEDDIG

SEQ ID NO: 91507 - protein, 9 aa, Homo Sapiens
EKPYQKSEQ

SEQ ID NO: 91508 - protein, 9 aa, Homo Sapiens
VLLCSKDVT

SEQ ID NO: 91509 - protein, 9 aa, Homo Sapiens
MASILKGYK

SEQ ID NO: 91510 - protein, 9 aa, Homo Sapiens
LLYRLFVYL

SEQ ID NO: 91511 - protein, 9 aa, Homo Sapiens
KNELVSDEM

SEQ ID NO: 91512 - protein, 9 aa, Homo Sapiens
PMRQRRPPL

SEQ ID NO: 91513 - protein, 9 aa, Homo Sapiens
EEMPSESKA

SEQ ID NO: 91514 - protein, 9 aa, Homo Sapiens
ATFDVPMET

SEQ ID NO: 91515 - protein, 9 aa, Homo Sapiens
VPSGNTIYF

SEQ ID NO: 91516 - protein, 9 aa, Homo Sapiens
QGVELPSVL

SEQ ID NO: 91517 - protein, 9 aa, Homo Sapiens
PPPKIINGK

SEQ ID NO: 91518 - protein, 9 aa, Homo Sapiens
KVIPETSLT

SEQ ID NO: 91519 - protein, 9 aa, Homo Sapiens
EHFQQAIEK

SEQ ID NO: 91520 - protein, 9 aa, Homo Sapiens
NSLKHQERL

SEQ ID NO: 91521 - protein, 9 aa, Homo Sapiens
HKAIYAGEK

SEQ ID NO: 91522 - protein, 9 aa, Homo Sapiens
RLSPPPSLC

SEQ ID NO: 91523 - protein, 9 aa, Homo Sapiens
IPPQEWFCP

SEQ ID NO: 91524 - protein, 9 aa, Homo Sapiens
ESVIEKPYQ

SEQ ID NO: 91525 - protein, 9 aa, Homo Sapiens
IYDKEYYSV

SEQ ID NO: 91526 - protein, 9 aa, Homo Sapiens
VVVPCEPPE

SEQ ID NO: 91527 - protein, 9 aa, Homo Sapiens
CNDCHKTFS

SEQ ID NO: 91528 - protein, 9 aa, Homo Sapiens
TLSDLFTLI

SEQ ID NO: 91529 - protein, 9 aa, Homo Sapiens
GISTPDDLY

SEQ ID NO: 91530 - protein, 9 aa, Homo Sapiens
PELADHLEE

SEQ ID NO: 91531 - protein, 9 aa, Homo Sapiens
VFMAHPSQG

SEQ ID NO: 91532 - protein, 9 aa, Homo Sapiens
LINGYLNSL

SEQ ID NO: 91533 - protein, 9 aa, Homo Sapiens
QNAWQLYKT

SEQ ID NO: 91534 - protein, 9 aa, Homo Sapiens
SAWTVNYGL

SEQ ID NO: 91535 - protein, 9 aa, Homo Sapiens
IKFHYIFNF

SEQ ID NO: 91536 - protein, 9 aa, Homo Sapiens
ISLKCKTMQ

SEQ ID NO: 91537 - protein, 9 aa, Homo Sapiens
SLSHNDVMM

SEQ ID NO: 91538 - protein, 9 aa, Homo Sapiens
VKIKIREEP

SEQ ID NO: 91539 - protein, 9 aa, Homo Sapiens
LSVNGYYIS

SEQ ID NO: 91540 - protein, 9 aa, Homo Sapiens
CVEDITNKF

SEQ ID NO: 91541 - protein, 9 aa, Homo Sapiens
PDDLYVSSS

SEQ ID NO: 91542 - protein, 9 aa, Homo Sapiens
AKADTLSII

SEQ ID NO: 91543 - protein, 9 aa, Homo Sapiens
KAQQAPSET

SEQ ID NO: 91544 - protein, 9 aa, Homo Sapiens
LDAKATIST

SEQ ID NO: 91545 - protein, 9 aa, Homo Sapiens
LRTDQLEVC

SEQ ID NO: 91546 - protein, 9 aa, Homo Sapiens
IFWNFMFFI

SEQ ID NO: 91547 - protein, 9 aa, Homo Sapiens
FAMTIMNSP

SEQ ID NO: 91548 - protein, 9 aa, Homo Sapiens
PNTSVFLDT

SEQ ID NO: 91549 - protein, 9 aa, Homo Sapiens
AEYIEKYCL

SEQ ID NO: 91550 - protein, 9 aa, Homo Sapiens
PEKRAVLMR

SEQ ID NO: 91551 - protein, 9 aa, Homo Sapiens
GKNYTEEEY

SEQ ID NO: 91552 - protein, 9 aa, Homo Sapiens
RSRMQERDK

SEQ ID NO: 91553 - protein, 9 aa, Homo Sapiens
DSCAVCMEL

SEQ ID NO: 91554 - protein, 9 aa, Homo Sapiens
PTTNSKAPF

SEQ ID NO: 91555 - protein, 9 aa, Homo Sapiens
LSQGSFKGN

SEQ ID NO: 91556 - protein, 9 aa, Homo Sapiens
AELRHRLRL

SEQ ID NO: 91557 - protein, 9 aa, Homo Sapiens
NICWGTHSK

SEQ ID NO: 91558 - protein, 9 aa, Homo Sapiens
LRATKLKVE

SEQ ID NO: 91559 - protein, 9 aa, Homo Sapiens
RVGDIVRIT

SEQ ID NO: 91560 - protein, 9 aa, Homo Sapiens
SQQLQSLQV

SEQ ID NO: 91561 - protein, 9 aa, Homo Sapiens
RRLERFEKY

SEQ ID NO: 91562 - protein, 9 aa, Homo Sapiens
VQLKKMHSS

SEQ ID NO: 91563 - protein, 9 aa, Homo Sapiens
ENWNADHSK

SEQ ID NO: 91564 - protein, 9 aa, Homo Sapiens
KQRCSIIRD

SEQ ID NO: 91565 - protein, 9 aa, Homo Sapiens
KKLQQELEQ

SEQ ID NO: 91566 - protein, 9 aa, Homo Sapiens
AGSLKRDST

SEQ ID NO: 91567 - protein, 9 aa, Homo Sapiens
QEMEPNLSC

SEQ ID NO: 91568 - protein, 9 aa, Homo Sapiens
DRFEKAGPG

SEQ ID NO: 91569 - protein, 9 aa, Homo Sapiens
SPDHAMVSP

SEQ ID NO: 91570 - protein, 9 aa, Homo Sapiens
NYFNEKNDI

SEQ ID NO: 91571 - protein, 9 aa, Homo Sapiens
SGQDGFYVF

SEQ ID NO: 91572 - protein, 9 aa, Homo Sapiens
ARNNSHCPR

SEQ ID NO: 91573 - protein, 9 aa, Homo Sapiens
SVEKEIQKS

SEQ ID NO: 91574 - protein, 9 aa, Homo Sapiens
PASQQPVCG

SEQ ID NO: 91575 - protein, 9 aa, Homo Sapiens
AKISEQLYA

SEQ ID NO: 91576 - protein, 9 aa, Homo Sapiens
YKISPGGKS

SEQ ID NO: 91577 - protein, 9 aa, Homo Sapiens
QAGSLETSK

SEQ ID NO: 91578 - protein, 9 aa, Homo Sapiens
KRRKEANSS

SEQ ID NO: 91579 - protein, 9 aa, Homo Sapiens
EKYCLGTKK

SEQ ID NO: 91580 - protein, 9 aa, Homo Sapiens
MINAGQLKN

SEQ ID NO: 91581 - protein, 9 aa, Homo Sapiens
EGGNDRYPW

SEQ ID NO: 91582 - protein, 9 aa, Homo Sapiens
KLRCPCKII

SEQ ID NO: 91583 - protein, 9 aa, Homo Sapiens
NAEFVLLTV

SEQ ID NO: 91584 - protein, 9 aa, Homo Sapiens
QITKDEVLY

SEQ ID NO: 91585 - protein, 9 aa, Homo Sapiens
QYFLLSCGE

SEQ ID NO: 91586 - protein, 9 aa, Homo Sapiens
VKNVLKLST

SEQ ID NO: 91587 - protein, 9 aa, Homo Sapiens
AFEFDINSN

SEQ ID NO: 91588 - protein, 9 aa, Homo Sapiens
PYVCTRCGK

SEQ ID NO: 91589 - protein, 9 aa, Homo Sapiens
EQLYAFCYC

SEQ ID NO: 91590 - protein, 9 aa, Homo Sapiens
RRPIERESA

SEQ ID NO: 91591 - protein, 9 aa, Homo Sapiens
ATKLKVEAK

SEQ ID NO: 91592 - protein, 9 aa, Homo Sapiens
LVIAVVSVF

SEQ ID NO: 91593 - protein, 9 aa, Homo Sapiens
DVANEDKMS

SEQ ID NO: 91594 - protein, 9 aa, Homo Sapiens
YVCTRCGKA

SEQ ID NO: 91595 - protein, 9 aa, Homo Sapiens
FFIVTPTSR

SEQ ID NO: 91596 - protein, 9 aa, Homo Sapiens
YSEDEDTHT

SEQ ID NO: 91597 - protein, 9 aa, Homo Sapiens
RSLFRILSG

SEQ ID NO: 91598 - protein, 9 aa, Homo Sapiens
LMELFPTNK

SEQ ID NO: 91599 - protein, 9 aa, Homo Sapiens
EINSHNLLK

SEQ ID NO: 91600 - protein, 9 aa, Homo Sapiens
SRHRWMLTP

SEQ ID NO: 91601 - protein, 9 aa, Homo Sapiens
EEERHLPLQ

SEQ ID NO: 91602 - protein, 9 aa, Homo Sapiens
KLFSLTAQP

SEQ ID NO: 91603 - protein, 9 aa, Homo Sapiens
YYSNVIANL

SEQ ID NO: 91604 - protein, 9 aa, Homo Sapiens
TFDVPMETT

SEQ ID NO: 91605 - protein, 9 aa, Homo Sapiens
VNAEFVLLT

SEQ ID NO: 91606 - protein, 9 aa, Homo Sapiens
NKMLREKKE

SEQ ID NO: 91607 - protein, 9 aa, Homo Sapiens
KNYQSFHFN

SEQ ID NO: 91608 - protein, 9 aa, Homo Sapiens
QKSIEVPQA

SEQ ID NO: 91609 - protein, 9 aa, Homo Sapiens
RMDKTPPPP

SEQ ID NO: 91610 - protein, 9 aa, Homo Sapiens
HKPISLAMT

SEQ ID NO: 91611 - protein, 9 aa, Homo Sapiens
GLARDIYDK

SEQ ID NO: 91612 - protein, 9 aa, Homo Sapiens
GEEWDEEAE

SEQ ID NO: 91613 - protein, 9 aa, Homo Sapiens
LFPTNKQSV

SEQ ID NO: 91614 - protein, 9 aa, Homo Sapiens
LHVYGQEES

SEQ ID NO: 91615 - protein, 9 aa, Homo Sapiens
DGMRTVRAF

SEQ ID NO: 91616 - protein, 9 aa, Homo Sapiens
IKNVAELLV

SEQ ID NO: 91617 - protein, 9 aa, Homo Sapiens
KVKKTAKAG

SEQ ID NO: 91618 - protein, 9 aa, Homo Sapiens
QRTERKDPA

SEQ ID NO: 91619 - protein, 9 aa, Homo Sapiens
CIFLDYFQT

SEQ ID NO: 91620 - protein, 9 aa, Homo Sapiens
SKKKYNRLT

SEQ ID NO: 91621 - protein, 9 aa, Homo Sapiens
SLKPENLLT

SEQ ID NO: 91622 - protein, 9 aa, Homo Sapiens
LTASGFPWV

SEQ ID NO: 91623 - protein, 9 aa, Homo Sapiens
SYGRDLSHS

SEQ ID NO: 91624 - protein, 9 aa, Homo Sapiens
SVSCIVNLA

SEQ ID NO: 91625 - protein, 9 aa, Homo Sapiens
VFPTNKEFQ

SEQ ID NO: 91626 - protein, 9 aa, Homo Sapiens
MNAKIADFV

SEQ ID NO: 91627 - protein, 9 aa, Homo Sapiens
LYQRALHIR

SEQ ID NO: 91628 - protein, 9 aa, Homo Sapiens
REKGDVKKT

SEQ ID NO: 91629 - protein, 9 aa, Homo Sapiens
EIQKSKGQE

SEQ ID NO: 91630 - protein, 9 aa, Homo Sapiens
EKDLCIKSF

SEQ ID NO: 91631 - protein, 9 aa, Homo Sapiens
ERQENPYGP

SEQ ID NO: 91632 - protein, 9 aa, Homo Sapiens
SVNGYYISE

SEQ ID NO: 91633 - protein, 9 aa, Homo Sapiens
ISENNKLES

SEQ ID NO: 91634 - protein, 9 aa, Homo Sapiens
NNKLESDYM

SEQ ID NO: 91635 - protein, 9 aa, Homo Sapiens
EYVEEDGYI

SEQ ID NO: 91636 - protein, 9 aa, Homo Sapiens
TALINGYLN

SEQ ID NO: 91637 - protein, 9 aa, Homo Sapiens
TASGFPWVL

SEQ ID NO: 91638 - protein, 9 aa, Homo Sapiens
RDLSHSSKI

SEQ ID NO: 91639 - protein, 9 aa, Homo Sapiens
GAMDLEKPP

SEQ ID NO: 91640 - protein, 9 aa, Homo Sapiens
SFKGNHLCG

SEQ ID NO: 91641 - protein, 9 aa, Homo Sapiens
RMKPDPKKV

SEQ ID NO: 91642 - protein, 9 aa, Homo Sapiens
LIQMLACPP

SEQ ID NO: 91643 - protein, 9 aa, Homo Sapiens
KWSRHRWML

SEQ ID NO: 91644 - protein, 9 aa, Homo Sapiens
EPWKRLRIQ

SEQ ID NO: 91645 - protein, 9 aa, Homo Sapiens
DLTRPLFPS

SEQ ID NO: 91646 - protein, 9 aa, Homo Sapiens
NRSYTKAYY

SEQ ID NO: 91647 - protein, 9 aa, Homo Sapiens
LEPWKRLRI

SEQ ID NO: 91648 - protein, 9 aa, Homo Sapiens
GPNWLLDVT

SEQ ID NO: 91649 - protein, 9 aa, Homo Sapiens
TSSDPEGEE

SEQ ID NO: 91650 - protein, 9 aa, Homo Sapiens
TLMCISVAD

SEQ ID NO: 91651 - protein, 9 aa, Homo Sapiens
EDEDTHTEE

SEQ ID NO: 91652 - protein, 9 aa, Homo Sapiens
TINEKHMYP

SEQ ID NO: 91653 - protein, 9 aa, Homo Sapiens
CGPCNYKAE

SEQ ID NO: 91654 - protein, 9 aa, Homo Sapiens
KHGGDLFTE

SEQ ID NO: 91655 - protein, 9 aa, Homo Sapiens
GRKGGEASR

SEQ ID NO: 91656 - protein, 9 aa, Homo Sapiens
AMKNIGGIP

SEQ ID NO: 91657 - protein, 9 aa, Homo Sapiens
VLPWPFRNK

SEQ ID NO: 91658 - protein, 9 aa, Homo Sapiens
QGNAAYLPD

SEQ ID NO: 91659 - protein, 9 aa, Homo Sapiens
NTIHVGSIW

SEQ ID NO: 91660 - protein, 9 aa, Homo Sapiens
KRRKMTQRS

SEQ ID NO: 91661 - protein, 9 aa, Homo Sapiens
EIMQTLNKM

SEQ ID NO: 91662 - protein, 9 aa, Homo Sapiens
GDKSSQLTK

SEQ ID NO: 91663 - protein, 9 aa, Homo Sapiens
PSILEIRTI

SEQ ID NO: 91664 - protein, 9 aa, Homo Sapiens
WSFTTVRMK

SEQ ID NO: 91665 - protein, 9 aa, Homo Sapiens
CVELGVSVG

SEQ ID NO: 91666 - protein, 9 aa, Homo Sapiens
KFHTLVGER

SEQ ID NO: 91667 - protein, 9 aa, Homo Sapiens
SNMETVSKS

SEQ ID NO: 91668 - protein, 9 aa, Homo Sapiens
KLQQELEQQ

SEQ ID NO: 91669 - protein, 9 aa, Homo Sapiens
DMEIAQTQN

SEQ ID NO: 91670 - protein, 9 aa, Homo Sapiens
RLGEEQKYK

SEQ ID NO: 91671 - protein, 9 aa, Homo Sapiens
LVSRFIHMS

SEQ ID NO: 91672 - protein, 9 aa, Homo Sapiens
NLYQRALHI

SEQ ID NO: 91673 - protein, 9 aa, Homo Sapiens
RWVHWNEII

SEQ ID NO: 91674 - protein, 9 aa, Homo Sapiens
GLSRKSSYA

SEQ ID NO: 91675 - protein, 9 aa, Homo Sapiens
KHFEMPHDI

SEQ ID NO: 91676 - protein, 9 aa, Homo Sapiens
RVYNNTARC

SEQ ID NO: 91677 - protein, 9 aa, Homo Sapiens
FQFILDVSV

SEQ ID NO: 91678 - protein, 9 aa, Homo Sapiens
QAPSETPRG

SEQ ID NO: 91679 - protein, 9 aa, Homo Sapiens
AWTVNYGLQ

SEQ ID NO: 91680 - protein, 9 aa, Homo Sapiens
SDLFTLIAG

SEQ ID NO: 91681 - protein, 9 aa, Homo Sapiens
KCVELGVSV

SEQ ID NO: 91682 - protein, 9 aa, Homo Sapiens
ELFPTNKQS

SEQ ID NO: 91683 - protein, 9 aa, Homo Sapiens
EASKHKFLD

SEQ ID NO: 91684 - protein, 9 aa, Homo Sapiens
KKLITGIIS

SEQ ID NO: 91685 - protein, 9 aa, Homo Sapiens
RGEYDAVLP

SEQ ID NO: 91686 - protein, 9 aa, Homo Sapiens
TVSKSKANF

SEQ ID NO: 91687 - protein, 9 aa, Homo Sapiens
MPLLYRLFV

SEQ ID NO: 91688 - protein, 9 aa, Homo Sapiens
ESAAYSQVL

SEQ ID NO: 91689 - protein, 9 aa, Homo Sapiens
VQEEQELEA

SEQ ID NO: 91690 - protein, 9 aa, Homo Sapiens
GDEILQSSE

SEQ ID NO: 91691 - protein, 9 aa, Homo Sapiens
VRHSREEET

SEQ ID NO: 91692 - protein, 9 aa, Homo Sapiens
GGHLLTETK

SEQ ID NO: 91693 - protein, 9 aa, Homo Sapiens
EGKKIKKRN

SEQ ID NO: 91694 - protein, 9 aa, Homo Sapiens
GNDRYPWWM

SEQ ID NO: 91695 - protein, 9 aa, Homo Sapiens
LVKNVLKLS

SEQ ID NO: 91696 - protein, 9 aa, Homo Sapiens
QLQVQALTK

SEQ ID NO: 91697 - protein, 9 aa, Homo Sapiens
FIEDKTLLL

SEQ ID NO: 91698 - protein, 9 aa, Homo Sapiens
QLYKTYDEK

SEQ ID NO: 91699 - protein, 9 aa, Homo Sapiens
GRSRMQERD

SEQ ID NO: 91700 - protein, 9 aa, Homo Sapiens
EEIEKLIKQ

SEQ ID NO: 91701 - protein, 9 aa, Homo Sapiens
EWDEEAEDD

SEQ ID NO: 91702 - protein, 9 aa, Homo Sapiens
LLSCGEVVF

SEQ ID NO: 91703 - protein, 9 aa, Homo Sapiens
RLLHTPHKP

SEQ ID NO: 91704 - protein, 9 aa, Homo Sapiens
KNICWGTHS

SEQ ID NO: 91705 - protein, 9 aa, Homo Sapiens
TASVKLDFL

SEQ ID NO: 91706 - protein, 9 aa, Homo Sapiens
PMSLASLTA

SEQ ID NO: 91707 - protein, 9 aa, Homo Sapiens
ARARVENWN

SEQ ID NO: 91708 - protein, 9 aa, Homo Sapiens
YDAVLPWPF

SEQ ID NO: 91709 - protein, 9 aa, Homo Sapiens
QFGTLVNLQ

SEQ ID NO: 91710 - protein, 9 aa, Homo Sapiens
TLGCCNLIC

SEQ ID NO: 91711 - protein, 9 aa, Homo Sapiens
SQCEISPLI

SEQ ID NO: 91712 - protein, 9 aa, Homo Sapiens
RTDQLEVCR

SEQ ID NO: 91713 - protein, 9 aa, Homo Sapiens
DANDVPSQC

SEQ ID NO: 91714 - protein, 9 aa, Homo Sapiens
VSLVKELLD

SEQ ID NO: 91715 - protein, 9 aa, Homo Sapiens
LFLVSRFIH

SEQ ID NO: 91716 - protein, 9 aa, Homo Sapiens
KNIGGIPAL

SEQ ID NO: 91717 - protein, 9 aa, Homo Sapiens
RLGDCSGPA

SEQ ID NO: 91718 - protein, 9 aa, Homo Sapiens
HGIIYIGKR

SEQ ID NO: 91719 - protein, 9 aa, Homo Sapiens
FVLSNMMSD

SEQ ID NO: 91720 - protein, 9 aa, Homo Sapiens
DVASAWTVN

SEQ ID NO: 91721 - protein, 9 aa, Homo Sapiens
IPELADHLE

SEQ ID NO: 91722 - protein, 9 aa, Homo Sapiens
LLEIFLAAV

SEQ ID NO: 91723 - protein, 9 aa, Homo Sapiens
ELSYEFKHS

SEQ ID NO: 91724 - protein, 9 aa, Homo Sapiens
RKRRKMTQR

SEQ ID NO: 91725 - protein, 9 aa, Homo Sapiens
VAFSPAFAL

SEQ ID NO: 91726 - protein, 9 aa, Homo Sapiens
ATPGNIPPP

SEQ ID NO: 91727 - protein, 9 aa, Homo Sapiens
CGKILSQSS

SEQ ID NO: 91728 - protein, 9 aa, Homo Sapiens
IQMLACPPH

SEQ ID NO: 91729 - protein, 9 aa, Homo Sapiens
VEDGEIFDF

SEQ ID NO: 91730 - protein, 9 aa, Homo Sapiens
FDINSNSSE

SEQ ID NO: 91731 - protein, 9 aa, Homo Sapiens
PNVPSTPQA

SEQ ID NO: 91732 - protein, 9 aa, Homo Sapiens
MTQKKEVTI

SEQ ID NO: 91733 - protein, 9 aa, Homo Sapiens
HLNSQARTS

SEQ ID NO: 91734 - protein, 9 aa, Homo Sapiens
GLVIAVVSV

SEQ ID NO: 91735 - protein, 9 aa, Homo Sapiens
FFLLTVMAY

SEQ ID NO: 91736 - protein, 9 aa, Homo Sapiens
DEDTHTEEY

SEQ ID NO: 91737 - protein, 9 aa, Homo Sapiens
SLPASQQPV

SEQ ID NO: 91738 - protein, 9 aa, Homo Sapiens
VINDYNMLK

SEQ ID NO: 91739 - protein, 9 aa, Homo Sapiens
TAVPVDSGP

SEQ ID NO: 91740 - protein, 9 aa, Homo Sapiens
AFHHGDLLR

SEQ ID NO: 91741 - protein, 9 aa, Homo Sapiens
ENQARVSPS

SEQ ID NO: 91742 - protein, 9 aa, Homo Sapiens
ANSSEEPRN

SEQ ID NO: 91743 - protein, 9 aa, Homo Sapiens
PPQEWFCPE

SEQ ID NO: 91744 - protein, 9 aa, Homo Sapiens
NLLTRLLKR

SEQ ID NO: 91745 - protein, 9 aa, Homo Sapiens
HRNSLKHQE

SEQ ID NO: 91746 - protein, 9 aa, Homo Sapiens
HQAIFCISG

SEQ ID NO: 91747 - protein, 9 aa, Homo Sapiens
CIKSFDQWS

SEQ ID NO: 91748 - protein, 9 aa, Homo Sapiens
KDERQENPY

SEQ ID NO: 91749 - protein, 9 aa, Homo Sapiens
LSSEQMSRK

SEQ ID NO: 91750 - protein, 9 aa, Homo Sapiens
EQLAELWGR

SEQ ID NO: 91751 - protein, 9 aa, Homo Sapiens
TRESDRLED

SEQ ID NO: 91752 - protein, 9 aa, Homo Sapiens
NETQEEINK

SEQ ID NO: 91753 - protein, 9 aa, Homo Sapiens
IKDIISLKC

SEQ ID NO: 91754 - protein, 9 aa, Homo Sapiens
SSKEKVLQL

SEQ ID NO: 91755 - protein, 9 aa, Homo Sapiens
FEKKRTAAI

SEQ ID NO: 91756 - protein, 9 aa, Homo Sapiens
SKKCVELGV

SEQ ID NO: 91757 - protein, 9 aa, Homo Sapiens
EFFLLTVMA

SEQ ID NO: 91758 - protein, 9 aa, Homo Sapiens
KGYKTYLRP

SEQ ID NO: 91759 - protein, 9 aa, Homo Sapiens
LLEKESAAY

SEQ ID NO: 91760 - protein, 9 aa, Homo Sapiens
SLFPYQSLL

SEQ ID NO: 91761 - protein, 9 aa, Homo Sapiens
FKSQLNSQS

SEQ ID NO: 91762 - protein, 9 aa, Homo Sapiens
VVPCEPPEV

SEQ ID NO: 91763 - protein, 9 aa, Homo Sapiens
TMTINEKHM

SEQ ID NO: 91764 - protein, 9 aa, Homo Sapiens
SVAEKHEIL

SEQ ID NO: 91765 - protein, 9 aa, Homo Sapiens
KRDVRGQEG

SEQ ID NO: 91766 - protein, 9 aa, Homo Sapiens
AMIISIYYF

SEQ ID NO: 91767 - protein, 9 aa, Homo Sapiens
YYISEIPVD

SEQ ID NO: 91768 - protein, 9 aa, Homo Sapiens
GESSTKTKK

SEQ ID NO: 91769 - protein, 9 aa, Homo Sapiens
SNPMRQRRP

SEQ ID NO: 91770 - protein, 9 aa, Homo Sapiens
KDANDVPSQ

SEQ ID NO: 91771 - protein, 9 aa, Homo Sapiens
SLKYTNEPP

SEQ ID NO: 91772 - protein, 9 aa, Homo Sapiens
SDAIPIVVA

SEQ ID NO: 91773 - protein, 9 aa, Homo Sapiens
EQPSRSEFS

SEQ ID NO: 91774 - protein, 9 aa, Homo Sapiens
IILGFTIDS

SEQ ID NO: 91775 - protein, 9 aa, Homo Sapiens
LTLVKNVLK

SEQ ID NO: 91776 - protein, 9 aa, Homo Sapiens
TNTELSAIS

SEQ ID NO: 91777 - protein, 9 aa, Homo Sapiens
MVFRKTKGK

SEQ ID NO: 91778 - protein, 9 aa, Homo Sapiens
DKMSLLKSV

SEQ ID NO: 91779 - protein, 9 aa, Homo Sapiens
KEFQFILDV

SEQ ID NO: 91780 - protein, 9 aa, Homo Sapiens
GLEDMSEYS

SEQ ID NO: 91781 - protein, 9 aa, Homo Sapiens
GKDWGLEDM

SEQ ID NO: 91782 - protein, 9 aa, Homo Sapiens
NVYSKLTIV

SEQ ID NO: 91783 - protein, 9 aa, Homo Sapiens
VVSVFLQAC

SEQ ID NO: 91784 - protein, 9 aa, Homo Sapiens
LEDSTMCVV

SEQ ID NO: 91785 - protein, 9 aa, Homo Sapiens
LTTHKAIYA

SEQ ID NO: 91786 - protein, 9 aa, Homo Sapiens
SPNHSLYVF

SEQ ID NO: 91787 - protein, 9 aa, Homo Sapiens
DQILGLMGL

SEQ ID NO: 91788 - protein, 9 aa, Homo Sapiens
QHQVQEEQE

SEQ ID NO: 91789 - protein, 9 aa, Homo Sapiens
DDKKIKKKT

SEQ ID NO: 91790 - protein, 9 aa, Homo Sapiens
SVSSPDHAM

SEQ ID NO: 91791 - protein, 9 aa, Homo Sapiens
CQEYGKTIC

SEQ ID NO: 91792 - protein, 9 aa, Homo Sapiens
TELSAISRK

SEQ ID NO: 91793 - protein, 9 aa, Homo Sapiens
KDWGLEDMS

SEQ ID NO: 91794 - protein, 9 aa, Homo Sapiens
CCNLICSDK

SEQ ID NO: 91795 - protein, 9 aa, Homo Sapiens
KFCPFGQWW

SEQ ID NO: 91796 - protein, 9 aa, Homo Sapiens
SENNKLESD

SEQ ID NO: 91797 - protein, 9 aa, Homo Sapiens
TLSIIRLSH

SEQ ID NO: 91798 - protein, 9 aa, Homo Sapiens
EWFCPESQL

SEQ ID NO: 91799 - protein, 9 aa, Homo Sapiens
RKRDVRGQE

SEQ ID NO: 91800 - protein, 9 aa, Homo Sapiens
ETKYINLSL

SEQ ID NO: 91801 - protein, 9 aa, Homo Sapiens
EGEEWDEEA

SEQ ID NO: 91802 - protein, 9 aa, Homo Sapiens
MSLLKSVLQ

SEQ ID NO: 91803 - protein, 9 aa, Homo Sapiens
ESNPMRQRR

SEQ ID NO: 91804 - protein, 9 aa, Homo Sapiens
INEKHMYPS

SEQ ID NO: 91805 - protein, 9 aa, Homo Sapiens
AKAKFFCIM

SEQ ID NO: 91806 - protein, 9 aa, Homo Sapiens
EVPSGNTIY

SEQ ID NO: 91807 - protein, 9 aa, Homo Sapiens
PRNDDHDLP

SEQ ID NO: 91808 - protein, 9 aa, Homo Sapiens
FCYRSGLAR

SEQ ID NO: 91809 - protein, 9 aa, Homo Sapiens
DCQGRGIFI

SEQ ID NO: 91810 - protein, 9 aa, Homo Sapiens
EAESTTEEG

SEQ ID NO: 91811 - protein, 9 aa, Homo Sapiens
IKELYGLPP

SEQ ID NO: 91812 - protein, 9 aa, Homo Sapiens
LAAVSTLNI

SEQ ID NO: 91813 - protein, 9 aa, Homo Sapiens
EINGRNNMI

SEQ ID NO: 91814 - protein, 9 aa, Homo Sapiens
ADTMELKWV

SEQ ID NO: 91815 - protein, 9 aa, Homo Sapiens
VNNKMYLVE

SEQ ID NO: 91816 - protein, 9 aa, Homo Sapiens
TVRMKPDPK

SEQ ID NO: 91817 - protein, 9 aa, Homo Sapiens
TARCVDQGG

SEQ ID NO: 91818 - protein, 9 aa, Homo Sapiens
HHLHTSVYF

SEQ ID NO: 91819 - protein, 9 aa, Homo Sapiens
DRKINRYFI

SEQ ID NO: 91820 - protein, 9 aa, Homo Sapiens
ERLGNTSQQ

SEQ ID NO: 91821 - protein, 9 aa, Homo Sapiens
RRREQEERL

SEQ ID NO: 91822 - protein, 9 aa, Homo Sapiens
KHMYPSIQA

SEQ ID NO: 91823 - protein, 9 aa, Homo Sapiens
NLFFIVTPT

SEQ ID NO: 91824 - protein, 9 aa, Homo Sapiens
DQLYRTEKN

SEQ ID NO: 91825 - protein, 9 aa, Homo Sapiens
ESVAEKHEI

SEQ ID NO: 91826 - protein, 9 aa, Homo Sapiens
HMSGTQKSQ

SEQ ID NO: 91827 - protein, 9 aa, Homo Sapiens
LQSSEQFQR

SEQ ID NO: 91828 - protein, 9 aa, Homo Sapiens
KQQQSPTKA

SEQ ID NO: 91829 - protein, 9 aa, Homo Sapiens
MLAKDINGT

SEQ ID NO: 91830 - protein, 9 aa, Homo Sapiens
YNNTARCVD

SEQ ID NO: 91831 - protein, 9 aa, Homo Sapiens
KIIHQANKS

SEQ ID NO: 91832 - protein, 9 aa, Homo Sapiens
NHVQRLIQM

SEQ ID NO: 91833 - protein, 9 aa, Homo Sapiens
SEPPNWSAT

SEQ ID NO: 91834 - protein, 9 aa, Homo Sapiens
KPYQKSEQG

SEQ ID NO: 91835 - protein, 9 aa, Homo Sapiens
LLQFPQYPM

SEQ ID NO: 91836 - protein, 9 aa, Homo Sapiens
HLESQYFKR

SEQ ID NO: 91837 - protein, 9 aa, Homo Sapiens
APRFRLIVR

SEQ ID NO: 91838 - protein, 9 aa, Homo Sapiens
IRTINFIFR

SEQ ID NO: 91839 - protein, 9 aa, Homo Sapiens
LHTSVYFFL

SEQ ID NO: 91840 - protein, 9 aa, Homo Sapiens
TMKIRILPD

SEQ ID NO: 91841 - protein, 9 aa, Homo Sapiens
EKPYVCTRC

SEQ ID NO: 91842 - protein, 9 aa, Homo Sapiens
HEGGNDRYP

SEQ ID NO: 91843 - protein, 9 aa, Homo Sapiens
MELFPTNKQ

SEQ ID NO: 91844 - protein, 9 aa, Homo Sapiens
SEEKDVLNV

SEQ ID NO: 91845 - protein, 9 aa, Homo Sapiens
IDKEQYHKI

SEQ ID NO: 91846 - protein, 9 aa, Homo Sapiens
DKKIKKKTH

SEQ ID NO: 91847 - protein, 9 aa, Homo Sapiens
PSPTYRHLL

SEQ ID NO: 91848 - protein, 9 aa, Homo Sapiens
YVNENQARV

SEQ ID NO: 91849 - protein, 9 aa, Homo Sapiens
SLYHLILLT

SEQ ID NO: 91850 - protein, 9 aa, Homo Sapiens
QMSRKNYQS

SEQ ID NO: 91851 - protein, 9 aa, Homo Sapiens
IKSFDQWSE

SEQ ID NO: 91852 - protein, 9 aa, Homo Sapiens
SGSGEDSKG

SEQ ID NO: 91853 - protein, 9 aa, Homo Sapiens
SCGEVVFSV

SEQ ID NO: 91854 - protein, 9 aa, Homo Sapiens
KNGMKNAED

SEQ ID NO: 91855 - protein, 9 aa, Homo Sapiens
SVKLDFLWH

SEQ ID NO: 91856 - protein, 9 aa, Homo Sapiens
VELLEVFGG

SEQ ID NO: 91857 - protein, 9 aa, Homo Sapiens
SLEDSTMCV

SEQ ID NO: 91858 - protein, 9 aa, Homo Sapiens
FAARALQIP

SEQ ID NO: 91859 - protein, 9 aa, Homo Sapiens
NQSGGSDIE

SEQ ID NO: 91860 - protein, 9 aa, Homo Sapiens
EISMNLSHV

SEQ ID NO: 91861 - protein, 9 aa, Homo Sapiens
NKARARVEN

SEQ ID NO: 91862 - protein, 9 aa, Homo Sapiens
NNKMYLVET

SEQ ID NO: 91863 - protein, 9 aa, Homo Sapiens
TEKNNAALA

SEQ ID NO: 91864 - protein, 9 aa, Homo Sapiens
MHYLKKHNS

SEQ ID NO: 91865 - protein, 9 aa, Homo Sapiens
IGRSENEKK

SEQ ID NO: 91866 - protein, 9 aa, Homo Sapiens
QLEVCREFQ

SEQ ID NO: 91867 - protein, 9 aa, Homo Sapiens
SIEVPQAKA

SEQ ID NO: 91868 - protein, 9 aa, Homo Sapiens
VAEKHEILT

SEQ ID NO: 91869 - protein, 9 aa, Homo Sapiens
PGPTAQNIR

SEQ ID NO: 91870 - protein, 9 aa, Homo Sapiens
VGFVKAIEF

SEQ ID NO: 91871 - protein, 9 aa, Homo Sapiens
LFFIVTPTS

SEQ ID NO: 91872 - protein, 9 aa, Homo Sapiens
INGRNNMIQ

SEQ ID NO: 91873 - protein, 9 aa, Homo Sapiens
INGYLNSLQ

SEQ ID NO: 91874 - protein, 9 aa, Homo Sapiens
GRLRRLGDC

SEQ ID NO: 91875 - protein, 9 aa, Homo Sapiens
KLIPPQEWF

SEQ ID NO: 91876 - protein, 9 aa, Homo Sapiens
SKGRSRHQY

SEQ ID NO: 91877 - protein, 9 aa, Homo Sapiens
RLFLDNDKT

SEQ ID NO: 91878 - protein, 9 aa, Homo Sapiens
QVELLEVFG

SEQ ID NO: 91879 - protein, 9 aa, Homo Sapiens
SPGGKSQIL

SEQ ID NO: 91880 - protein, 9 aa, Homo Sapiens
FEASKHKFL

SEQ ID NO: 91881 - protein, 9 aa, Homo Sapiens
VDWVNNKMY

SEQ ID NO: 91882 - protein, 9 aa, Homo Sapiens
FGMPGTSNP

SEQ ID NO: 91883 - protein, 9 aa, Homo Sapiens
LIETEERER

SEQ ID NO: 91884 - protein, 9 aa, Homo Sapiens
VKHGGDLFT

SEQ ID NO: 91885 - protein, 9 aa, Homo Sapiens
FQQEMEPNL

SEQ ID NO: 91886 - protein, 9 aa, Homo Sapiens
YFKRQSFHT

SEQ ID NO: 91887 - protein, 9 aa, Homo Sapiens
DSDCQGRGI

SEQ ID NO: 91888 - protein, 9 aa, Homo Sapiens
CREYGHTYV

SEQ ID NO: 91889 - protein, 9 aa, Homo Sapiens
ESTTEEGKK

SEQ ID NO: 91890 - protein, 9 aa, Homo Sapiens
TTHKAIYAG

SEQ ID NO: 91891 - protein, 9 aa, Homo Sapiens
TLFRQLQQI

SEQ ID NO: 91892 - protein, 9 aa, Homo Sapiens
KFHDVSERT

SEQ ID NO: 91893 - protein, 9 aa, Homo Sapiens
KLKAGECVE

SEQ ID NO: 91894 - protein, 9 aa, Homo Sapiens
WKRLRIQSK

SEQ ID NO: 91895 - protein, 9 aa, Homo Sapiens
NAGQLKNGD

SEQ ID NO: 91896 - protein, 9 aa, Homo Sapiens
RFIEDKTLL

SEQ ID NO: 91897 - protein, 9 aa, Homo Sapiens
KEQYHKILD

SEQ ID NO: 91898 - protein, 9 aa, Homo Sapiens
VIAVVSVFL

SEQ ID NO: 91899 - protein, 9 aa, Homo Sapiens
LGSQETQES

SEQ ID NO: 91900 - protein, 9 aa, Homo Sapiens
YYFKQLHTP

SEQ ID NO: 91901 - protein, 9 aa, Homo Sapiens
HMYPSIQAK

SEQ ID NO: 91902 - protein, 9 aa, Homo Sapiens
QQITYSLIE

SEQ ID NO: 91903 - protein, 9 aa, Homo Sapiens
KTLEKLDVN

SEQ ID NO: 91904 - protein, 9 aa, Homo Sapiens
HLFAMTIMN

SEQ ID NO: 91905 - protein, 9 aa, Homo Sapiens
KKRTAAIAE

SEQ ID NO: 91906 - protein, 9 aa, Homo Sapiens
LHSSLYHLI

SEQ ID NO: 91907 - protein, 9 aa, Homo Sapiens
TENSVYLGK

SEQ ID NO: 91908 - protein, 9 aa, Homo Sapiens
TKQQQSPTK

SEQ ID NO: 91909 - protein, 9 aa, Homo Sapiens
MEKNELVSD

SEQ ID NO: 91910 - protein, 9 aa, Homo Sapiens
VILSVKFCP

SEQ ID NO: 91911 - protein, 9 aa, Homo Sapiens
ASTSFEASK

SEQ ID NO: 91912 - protein, 9 aa, Homo Sapiens
QTQNGISED

SEQ ID NO: 91913 - protein, 9 aa, Homo Sapiens
IPIVVAKAS

SEQ ID NO: 91914 - protein, 9 aa, Homo Sapiens
PRLRSADDS

SEQ ID NO: 91915 - protein, 9 aa, Homo Sapiens
MRTVRAFHF

SEQ ID NO: 91916 - protein, 9 aa, Homo Sapiens
GPNRAHGSW

SEQ ID NO: 91917 - protein, 9 aa, Homo Sapiens
PSKKKYNRL

SEQ ID NO: 91918 - protein, 9 aa, Homo Sapiens
NKRIEMLEH

SEQ ID NO: 91919 - protein, 9 aa, Homo Sapiens
SAGSLKRDS

SEQ ID NO: 91920 - protein, 9 aa, Homo Sapiens
ITKDEIFPA

SEQ ID NO: 91921 - protein, 9 aa, Homo Sapiens
KILSQSSAL

SEQ ID NO: 91922 - protein, 9 aa, Homo Sapiens
YLLIGDKDN

SEQ ID NO: 91923 - protein, 9 aa, Homo Sapiens
PEDLLNIFF

SEQ ID NO: 91924 - protein, 9 aa, Homo Sapiens
TNTEMEEVI

SEQ ID NO: 91925 - protein, 9 aa, Homo Sapiens
LTSLFPYQS

SEQ ID NO: 91926 - protein, 9 aa, Homo Sapiens
TAMWRLFVN

SEQ ID NO: 91927 - protein, 9 aa, Homo Sapiens
AGGHPLDTS

SEQ ID NO: 91928 - protein, 9 aa, Homo Sapiens
LGCCNLICS

SEQ ID NO: 91929 - protein, 9 aa, Homo Sapiens
NEKNDILKE

SEQ ID NO: 91930 - protein, 9 aa, Homo Sapiens
TDVASAWTV

SEQ ID NO: 91931 - protein, 9 aa, Homo Sapiens
SRISSSPNH

SEQ ID NO: 91932 - protein, 9 aa, Homo Sapiens
FVKAIEFVY

SEQ ID NO: 91933 - protein, 9 aa, Homo Sapiens
SYTKAYYRR

SEQ ID NO: 91934 - protein, 9 aa, Homo Sapiens
KSFDQWSES

SEQ ID NO: 91935 - protein, 9 aa, Homo Sapiens
RKVQKSIEV

SEQ ID NO: 91936 - protein, 9 aa, Homo Sapiens
IVRHSREEE

SEQ ID NO: 91937 - protein, 9 aa, Homo Sapiens
GSGSPSKIS

SEQ ID NO: 91938 - protein, 9 aa, Homo Sapiens
DSLHVYGQE

SEQ ID NO: 91939 - protein, 9 aa, Homo Sapiens
CFSRSDHLG

SEQ ID NO: 91940 - protein, 9 aa, Homo Sapiens
EQEERLRRE

SEQ ID NO: 91941 - protein, 9 aa, Homo Sapiens
HHPQTVKQA

SEQ ID NO: 91942 - protein, 9 aa, Homo Sapiens
TPHKPISLA

SEQ ID NO: 91943 - protein, 9 aa, Homo Sapiens
SSTKTKKGQ

SEQ ID NO: 91944 - protein, 9 aa, Homo Sapiens
IIHQANKSK

SEQ ID NO: 91945 - protein, 9 aa, Homo Sapiens
AEIDIKNVA

SEQ ID NO: 91946 - protein, 9 aa, Homo Sapiens
SLDAKATIS

SEQ ID NO: 91947 - protein, 9 aa, Homo Sapiens
VEDITNKFK

SEQ ID NO: 91948 - protein, 9 aa, Homo Sapiens
LESQYFKRQ

SEQ ID NO: 91949 - protein, 9 aa, Homo Sapiens
LMRPMDPPR

SEQ ID NO: 91950 - protein, 9 aa, Homo Sapiens
SSVEKEIQK

SEQ ID NO: 91951 - protein, 9 aa, Homo Sapiens
SVNQEIEHF

SEQ ID NO: 91952 - protein, 9 aa, Homo Sapiens
LEDKGSLTE

SEQ ID NO: 91953 - protein, 9 aa, Homo Sapiens
EKYAIEELV

SEQ ID NO: 91954 - protein, 9 aa, Homo Sapiens
KGESSTKTK

SEQ ID NO: 91955 - protein, 9 aa, Homo Sapiens
DKEINSHNL

SEQ ID NO: 91956 - protein, 9 aa, Homo Sapiens
TPPPKIING

SEQ ID NO: 91957 - protein, 9 aa, Homo Sapiens
ADYYIKCFD

SEQ ID NO: 91958 - protein, 9 aa, Homo Sapiens
TSNPGPPGP

SEQ ID NO: 91959 - protein, 9 aa, Homo Sapiens
EEWDEEAED

SEQ ID NO: 91960 - protein, 9 aa, Homo Sapiens
KMSLLKSVL

SEQ ID NO: 91961 - protein, 9 aa, Homo Sapiens
QVSFHQAIF

SEQ ID NO: 91962 - protein, 9 aa, Homo Sapiens
DVSLVKELL

SEQ ID NO: 91963 - protein, 9 aa, Homo Sapiens
LTEMISECT

SEQ ID NO: 91964 - protein, 9 aa, Homo Sapiens
EYGHTYVEV

SEQ ID NO: 91965 - protein, 9 aa, Homo Sapiens
PNLSCPKRL

SEQ ID NO: 91966 - protein, 9 aa, Homo Sapiens
VTIPFLFTP

SEQ ID NO: 91967 - protein, 9 aa, Homo Sapiens
IAKALVNSQ

SEQ ID NO: 91968 - protein, 9 aa, Homo Sapiens
KSQILDLVK

SEQ ID NO: 91969 - protein, 9 aa, Homo Sapiens
LEINGRNNM

SEQ ID NO: 91970 - protein, 9 aa, Homo Sapiens
KAGPGRKDS

SEQ ID NO: 91971 - protein, 9 aa, Homo Sapiens
PGPIILGFT

SEQ ID NO: 91972 - protein, 9 aa, Homo Sapiens
EEVINDYNM

SEQ ID NO: 91973 - protein, 9 aa, Homo Sapiens
DAIPIVVAK

SEQ ID NO: 91974 - protein, 9 aa, Homo Sapiens
NKSIRNLQV

SEQ ID NO: 91975 - protein, 9 aa, Homo Sapiens
YQSLLQFPQ

SEQ ID NO: 91976 - protein, 9 aa, Homo Sapiens
SCAVCMELY

SEQ ID NO: 91977 - protein, 9 aa, Homo Sapiens
DKDNAKKVY

SEQ ID NO: 91978 - protein, 9 aa, Homo Sapiens
EDKEINSHN

SEQ ID NO: 91979 - protein, 9 aa, Homo Sapiens
LASLTASGF

SEQ ID NO: 91980 - protein, 9 aa, Homo Sapiens
VGDIVRITK

SEQ ID NO: 91981 - protein, 9 aa, Homo Sapiens
VHPETPEGV

SEQ ID NO: 91982 - protein, 9 aa, Homo Sapiens
GPGVLCIFL

SEQ ID NO: 91983 - protein, 9 aa, Homo Sapiens
QPSRSEFSK

SEQ ID NO: 91984 - protein, 9 aa, Homo Sapiens
FRQLQQITY

SEQ ID NO: 91985 - protein, 9 aa, Homo Sapiens
HPSQGNAAY

SEQ ID NO: 91986 - protein, 9 aa, Homo Sapiens
FEVNLCLRF
